United States Patent 7,655,785 (BIOINFORMATICALLY DETECTABLE GROUP OF NOVEL REGULATORY OLIGONUCLEOTIDES AND USES THEREOF) - sequence listing, part 20

SEQ ID NO: 796492 - RNA, 13 nt, Homo sapiens
ucaacuaugauau

SEQ ID NO: 796493 - RNA, 15 nt, Homo sapiens
ucaacucaaccugga

SEQ ID NO: 796494 - RNA, 20 nt, Homo sapiens
ucaacucuuaaagacaucuu

SEQ ID NO: 796495 - RNA, 18 nt, Homo sapiens
ucaacucuucauugagcu

SEQ ID NO: 796496 - RNA, 16 nt, Homo sapiens
ucaacucuucccugaa

SEQ ID NO: 796497 - RNA, 11 nt, Homo sapiens
ucaacugccua

SEQ ID NO: 796498 - RNA, 22 nt, Homo sapiens
ucaacugcuuugaaacuugccu

SEQ ID NO: 796499 - RNA, 12 nt, Homo sapiens
ucaacuuccaaa

SEQ ID NO: 796500 - RNA, 12 nt, Homo sapiens
ucaacuuugaca

SEQ ID NO: 796501 - RNA, 18 nt, Homo sapiens
ucaacuuuuccuuucaua

SEQ ID NO: 796502 - RNA, 17 nt, Homo sapiens
ucaacuuuucuaagaaa

SEQ ID NO: 796503 - RNA, 15 nt, Homo sapiens
ucaagaaacugagga

SEQ ID NO: 796504 - RNA, 17 nt, Homo sapiens
ucaagaacaaacacugc

SEQ ID NO: 796505 - RNA, 13 nt, Homo sapiens
ucaagaacacaug

SEQ ID NO: 796506 - RNA, 16 nt, Homo sapiens
ucaagaacucugggcu

SEQ ID NO: 796507 - RNA, 12 nt, Homo sapiens
ucaagaagucuu

SEQ ID NO: 796508 - RNA, 22 nt, Homo sapiens
ucaagaaucuagaagaugugua

SEQ ID NO: 796509 - RNA, 13 nt, Homo sapiens
ucaagaaugcaau

SEQ ID NO: 796510 - RNA, 15 nt, Homo sapiens
ucaagaaugcaauau

SEQ ID NO: 796511 - RNA, 13 nt, Homo sapiens
ucaagacauuucu

SEQ ID NO: 796512 - RNA, 20 nt, Homo sapiens
ucaagaccauccuggacuga

SEQ ID NO: 796513 - RNA, 15 nt, Homo sapiens
ucaagacucaccuca

SEQ ID NO: 796514 - RNA, 17 nt, Homo sapiens
ucaagacuuagcuccug

SEQ ID NO: 796515 - RNA, 21 nt, Homo sapiens
ucaagagauagagaccaucuu

SEQ ID NO: 796516 - RNA, 20 nt, Homo sapiens
ucaagaucucauccaagcaa

SEQ ID NO: 796517 - RNA, 17 nt, Homo sapiens
ucaagaugacagcucuu

SEQ ID NO: 796518 - RNA, 22 nt, Homo sapiens
ucaagcaaaaugcuuacagggc

SEQ ID NO: 796519 - RNA, 14 nt, Homo sapiens
ucaagcacauguaa

SEQ ID NO: 796520 - RNA, 22 nt, Homo sapiens
ucaagcagacauagaagagcca

SEQ ID NO: 796521 - RNA, 16 nt, Homo sapiens
ucaagcagucgugccu

SEQ ID NO: 796522 - RNA, 15 nt, Homo sapiens
ucaagccccauuucc

SEQ ID NO: 796523 - RNA, 18 nt, Homo sapiens
ucaagcccuuuacuugac

SEQ ID NO: 796524 - RNA, 22 nt, Homo sapiens
ucaagcgauucuccugucucag

SEQ ID NO: 796525 - RNA, 15 nt, Homo sapiens
ucaagcuauucucau

SEQ ID NO: 796526 - RNA, 19 nt, Homo sapiens
ucaagcuauucucaugccu

SEQ ID NO: 796527 - RNA, 17 nt, Homo sapiens
ucaagcucaucuguuau

SEQ ID NO: 796528 - RNA, 20 nt, Homo sapiens
ucaagcuuucaaauccuccc

SEQ ID NO: 796529 - RNA, 14 nt, Homo sapiens
ucaaggaacagcca

SEQ ID NO: 796530 - RNA, 20 nt, Homo sapiens
ucaaggagaauguacuggcg

SEQ ID NO: 796531 - RNA, 12 nt, Homo sapiens
ucaaggcauuua

SEQ ID NO: 796532 - RNA, 17 nt, Homo sapiens
ucaaggccuucaguuua

SEQ ID NO: 796533 - RNA, 18 nt, Homo sapiens
ucaaggccuucaguuuau

SEQ ID NO: 796534 - RNA, 21 nt, Homo sapiens
ucaagggaauguaacugcuga

SEQ ID NO: 796535 - RNA, 16 nt, Homo sapiens
ucaagggacaaguauu

SEQ ID NO: 796536 - RNA, 21 nt, Homo sapiens
ucaagggcuagcaucccugag

SEQ ID NO: 796537 - RNA, 13 nt, Homo sapiens
ucaaggugggccu

SEQ ID NO: 796538 - RNA, 16 nt, Homo sapiens
ucaagguuuaaccuua

SEQ ID NO: 796539 - RNA, 16 nt, Homo sapiens
ucaaguaauugugaaa

SEQ ID NO: 796540 - RNA, 20 nt, Homo sapiens
ucaaguaccaaaauguuaau

SEQ ID NO: 796541 - RNA, 16 nt, Homo sapiens
ucaaguaccaccaagg

SEQ ID NO: 796542 - RNA, 16 nt, Homo sapiens
ucaaguagcugggacu

SEQ ID NO: 796543 - RNA, 15 nt, Homo sapiens
ucaaguccaucugac

SEQ ID NO: 796544 - RNA, 23 nt, Homo sapiens
ucaaguccauguuauucucucac

SEQ ID NO: 796545 - RNA, 23 nt, Homo sapiens
ucaagucuucccugaucaaguca

SEQ ID NO: 796546 - RNA, 21 nt, Homo sapiens
ucaagugauucuccugccuca

SEQ ID NO: 796547 - RNA, 23 nt, Homo sapiens
aggaagaagucuaagagugaagu

SEQ ID NO: 796548 - RNA, 15 nt, Homo sapiens
aggaagaaugaaacu

SEQ ID NO: 796549 - RNA, 14 nt, Homo sapiens
aggaagacuugaag

SEQ ID NO: 796550 - RNA, 15 nt, Homo sapiens
aggaagagaaaugca

SEQ ID NO: 796551 - RNA, 21 nt, Homo sapiens
aggaagaucuugagagcugcu

SEQ ID NO: 796552 - RNA, 18 nt, Homo sapiens
aggaagauggagguuuac

SEQ ID NO: 796553 - RNA, 12 nt, Homo sapiens
aggaagcucucu

SEQ ID NO: 796554 - RNA, 15 nt, Homo sapiens
aggaagcucucuuaa

SEQ ID NO: 796555 - RNA, 19 nt, Homo sapiens
aggaagcuucaaaacauug

SEQ ID NO: 796556 - RNA, 14 nt, Homo sapiens
aggaagcuuggcuu

SEQ ID NO: 796557 - RNA, 15 nt, Homo sapiens
aggaaggaacagcaa

SEQ ID NO: 796558 - RNA, 21 nt, Homo sapiens
aggaaggaacagcaauggugu

SEQ ID NO: 796559 - RNA, 15 nt, Homo sapiens
aggaagggagaacuu

SEQ ID NO: 796560 - RNA, 17 nt, Homo sapiens
aggaagggaucugagaa

SEQ ID NO: 796561 - RNA, 20 nt, Homo sapiens
aggaagggugaagccuuauu

SEQ ID NO: 796562 - RNA, 13 nt, Homo sapiens
aggaaguacugca

SEQ ID NO: 796563 - RNA, 14 nt, Homo sapiens
aggaaguacuucca

SEQ ID NO: 796564 - RNA, 18 nt, Homo sapiens
aggaauaagaauggagca

SEQ ID NO: 796565 - RNA, 15 nt, Homo sapiens
aggaauacauugcaa

SEQ ID NO: 796566 - RNA, 23 nt, Homo sapiens
aggaauaguugagccccaagucc

SEQ ID NO: 796567 - RNA, 13 nt, Homo sapiens
aggaauauuucaa

SEQ ID NO: 796568 - RNA, 19 nt, Homo sapiens
aggaauauuucaagcucug

SEQ ID NO: 796569 - RNA, 20 nt, Homo sapiens
aggaaucuccguagaauuuu

SEQ ID NO: 796570 - RNA, 21 nt, Homo sapiens
aggaaugcuuccgagacacca

SEQ ID NO: 796571 - RNA, 17 nt, Homo sapiens
aggaauggcugcaccuu

SEQ ID NO: 796572 - RNA, 13 nt, Homo sapiens
aggaauucagugc

SEQ ID NO: 796573 - RNA, 14 nt, Homo sapiens
aggaauugguuuca

SEQ ID NO: 796574 - RNA, 15 nt, Homo sapiens
aggaauuguuuuuau

SEQ ID NO: 796575 - RNA, 19 nt, Homo sapiens
aggaauuucaccuguaaac

SEQ ID NO: 796576 - RNA, 16 nt, Homo sapiens
aggaauuugcauuuag

SEQ ID NO: 796577 - RNA, 17 nt, Homo sapiens
aggaauuuugugugauu

SEQ ID NO: 796578 - RNA, 18 nt, Homo sapiens
aggacaagaggagcauga

SEQ ID NO: 796579 - RNA, 16 nt, Homo sapiens
aggacaagggcucaga

SEQ ID NO: 796580 - RNA, 18 nt, Homo sapiens
aggacaauaaauuugaug

SEQ ID NO: 796581 - RNA, 12 nt, Homo sapiens
aggacacaguga

SEQ ID NO: 796582 - RNA, 13 nt, Homo sapiens
aggacacagugau

SEQ ID NO: 796583 - RNA, 23 nt, Homo sapiens
aggacacagugaugaauguacua

SEQ ID NO: 796584 - RNA, 17 nt, Homo sapiens
aggacaccagccuggug

SEQ ID NO: 796585 - RNA, 13 nt, Homo sapiens
aggacaccaguga

SEQ ID NO: 796586 - RNA, 22 nt, Homo sapiens
aggacaccuuuuaacucaccuc

SEQ ID NO: 796587 - RNA, 13 nt, Homo sapiens
aggacacuuccug

SEQ ID NO: 796588 - RNA, 14 nt, Homo sapiens
aggacagcccuccu

SEQ ID NO: 796589 - RNA, 19 nt, Homo sapiens
ucacuucauagcucaccag

SEQ ID NO: 796590 - RNA, 15 nt, Homo sapiens
ucacuucugucuccu

SEQ ID NO: 796591 - RNA, 17 nt, Homo sapiens
ucacuugaauccauuga

SEQ ID NO: 796592 - RNA, 15 nt, Homo sapiens
ucacuugccaugcag

SEQ ID NO: 796593 - RNA, 18 nt, Homo sapiens
ucacuugccaugcaggaa

SEQ ID NO: 796594 - RNA, 14 nt, Homo sapiens
ucacuugcccugac

SEQ ID NO: 796595 - RNA, 18 nt, Homo sapiens
ucacuugguccuaccuau

SEQ ID NO: 796596 - RNA, 20 nt, Homo sapiens
ucacuuuacaaauucaagcc

SEQ ID NO: 796597 - RNA, 19 nt, Homo sapiens
ucacuuucucaguuuucau

SEQ ID NO: 796598 - RNA, 20 nt, Homo sapiens
ucagaaaaagcuagcacuaa

SEQ ID NO: 796599 - RNA, 21 nt, Homo sapiens
ucagaaaagagccacuuucaa

SEQ ID NO: 796600 - RNA, 22 nt, Homo sapiens
ucagaaacccuucagugcuaca

SEQ ID NO: 796601 - RNA, 16 nt, Homo sapiens
ucagaaacgaaaucua

SEQ ID NO: 796602 - RNA, 19 nt, Homo sapiens
ucagaaauaauaaccuguu

SEQ ID NO: 796603 - RNA, 12 nt, Homo sapiens
ucagaacaaaca

SEQ ID NO: 796604 - RNA, 17 nt, Homo sapiens
ucagaacaagcaauugu

SEQ ID NO: 796605 - RNA, 12 nt, Homo sapiens
ucagaacagccu

SEQ ID NO: 796606 - RNA, 16 nt, Homo sapiens
ucagaacugugccaca

SEQ ID NO: 796607 - RNA, 22 nt, Homo sapiens
ucagaagaaagaaucuuuccau

SEQ ID NO: 796608 - RNA, 15 nt, Homo sapiens
ucagaagacacugca

SEQ ID NO: 796609 - RNA, 19 nt, Homo sapiens
ucagaagaccccugacuca

SEQ ID NO: 796610 - RNA, 21 nt, Homo sapiens
ucagaagagguugggcuucca

SEQ ID NO: 796611 - RNA, 16 nt, Homo sapiens
ucagaagccuagggga

SEQ ID NO: 796612 - RNA, 19 nt, Homo sapiens
ucagaaggaucuucaucug

SEQ ID NO: 796613 - RNA, 16 nt, Homo sapiens
ucagaauauacccauc

SEQ ID NO: 796614 - RNA, 21 nt, Homo sapiens
ucagaaugggaggacuccaga

SEQ ID NO: 796615 - RNA, 16 nt, Homo sapiens
ucagaauucggugugc

SEQ ID NO: 796616 - RNA, 18 nt, Homo sapiens
ucagaauugcucaaagaa

SEQ ID NO: 796617 - RNA, 14 nt, Homo sapiens
ucagacaagcacua

SEQ ID NO: 796618 - RNA, 15 nt, Homo sapiens
ucagacaagcugcau

SEQ ID NO: 796619 - RNA, 15 nt, Homo sapiens
ucagacagaacuuga

SEQ ID NO: 796620 - RNA, 18 nt, Homo sapiens
ucagacauacagcugccu

SEQ ID NO: 796621 - RNA, 16 nt, Homo sapiens
ucagaccuggcugcuu

SEQ ID NO: 796622 - RNA, 15 nt, Homo sapiens
ucagacgagcaguga

SEQ ID NO: 796623 - RNA, 14 nt, Homo sapiens
ucagacucucagac

SEQ ID NO: 796624 - RNA, 20 nt, Homo sapiens
ucagacucuuggcuacagug

SEQ ID NO: 796625 - RNA, 18 nt, Homo sapiens
ucagagaaauacuuucag

SEQ ID NO: 796626 - RNA, 16 nt, Homo sapiens
ucagagaacuuuccca

SEQ ID NO: 796627 - RNA, 16 nt, Homo sapiens
ucagagaccagcacuc

SEQ ID NO: 796628 - RNA, 15 nt, Homo sapiens
ucagagaccauugca

SEQ ID NO: 796629 - RNA, 13 nt, Homo sapiens
ucagagcagugac

SEQ ID NO: 796630 - RNA, 14 nt, Homo sapiens
ucagagcagugacc

SEQ ID NO: 796631 - RNA, 19 nt, Homo sapiens
ucagagcaugauacaaauu

SEQ ID NO: 796632 - RNA, 15 nt, Homo sapiens
ucagagccaccccua

SEQ ID NO: 796633 - RNA, 10 nt, Homo sapiens
ucagagccag

SEQ ID NO: 796634 - RNA, 14 nt, Homo sapiens
ucagagccagugaa

SEQ ID NO: 796635 - RNA, 23 nt, Homo sapiens
ucagagcuccaguuugcauuugg

SEQ ID NO: 796636 - RNA, 16 nt, Homo sapiens
ucagagcucucucuac

SEQ ID NO: 796637 - RNA, 14 nt, Homo sapiens
ucagaggagcugca

SEQ ID NO: 796638 - RNA, 14 nt, Homo sapiens
ucagaggaguuuaa

SEQ ID NO: 796639 - RNA, 18 nt, Homo sapiens
ucagaggccugcugccag

SEQ ID NO: 796640 - RNA, 22 nt, Homo sapiens
ucagaguggaguugaaacugcu

SEQ ID NO: 796641 - RNA, 21 nt, Homo sapiens
ucagaguugcugcaaaccuga

SEQ ID NO: 796642 - RNA, 22 nt, Homo sapiens
ucagaguugcugcaaaccugac

SEQ ID NO: 796643 - RNA, 23 nt, Homo sapiens
ucagaguuugaaauaaaacuugg

SEQ ID NO: 796644 - RNA, 17 nt, Homo sapiens
ucagaguuuguguguau

SEQ ID NO: 796645 - RNA, 21 nt, Homo sapiens
ucagaguuuguguguauuugu

SEQ ID NO: 796646 - RNA, 18 nt, Homo sapiens
ucagauaaacaacaaaua

SEQ ID NO: 796647 - RNA, 13 nt, Homo sapiens
ucagauaugauau

SEQ ID NO: 796648 - RNA, 19 nt, Homo sapiens
ucagauauuguaagcauuc

SEQ ID NO: 796649 - RNA, 16 nt, Homo sapiens
ucagaucgaaauugga

SEQ ID NO: 796650 - RNA, 19 nt, Homo sapiens
ucagaucuaucuugucaau

SEQ ID NO: 796651 - RNA, 16 nt, Homo sapiens
ucagaucucaugggau

SEQ ID NO: 796652 - RNA, 14 nt, Homo sapiens
ucagaucugagguu

SEQ ID NO: 796653 - RNA, 19 nt, Homo sapiens
ucagaugcaauugcuccca

SEQ ID NO: 796654 - RNA, 23 nt, Homo sapiens
ucagaugcuguuaguaccuacau

SEQ ID NO: 796655 - RNA, 20 nt, Homo sapiens
ucagaugggucugauauuaa

SEQ ID NO: 796656 - RNA, 17 nt, Homo sapiens
ucagauguguguucuca

SEQ ID NO: 796657 - RNA, 23 nt, Homo sapiens
ucagauuaccaguuauaggaaca

SEQ ID NO: 796658 - RNA, 20 nt, Homo sapiens
ucagauuguuaucuaucaac

SEQ ID NO: 796659 - RNA, 18 nt, Homo sapiens
ucagauuugccauucaag

SEQ ID NO: 796660 - RNA, 21 nt, Homo sapiens
ucagcaaacuaaccagcauuc

SEQ ID NO: 796661 - RNA, 18 nt, Homo sapiens
ucagcaaacuccacaaag

SEQ ID NO: 796662 - RNA, 18 nt, Homo sapiens
ucagcaacaagacugcca

SEQ ID NO: 796663 - RNA, 14 nt, Homo sapiens
ucagcaacugaggu

SEQ ID NO: 796664 - RNA, 21 nt, Homo sapiens
ucagcaaguuagaacuagcca

SEQ ID NO: 796665 - RNA, 17 nt, Homo sapiens
ucagcaauacuaaggga

SEQ ID NO: 796666 - RNA, 15 nt, Homo sapiens
ucagcacaggaauuc

SEQ ID NO: 796667 - RNA, 23 nt, Homo sapiens
ucagcacugaaaauaccaucagg

SEQ ID NO: 796668 - RNA, 16 nt, Homo sapiens
ucagcaguccacaaag

SEQ ID NO: 796669 - RNA, 16 nt, Homo sapiens
ucagcagugaaguaua

SEQ ID NO: 796670 - RNA, 16 nt, Homo sapiens
ucagcauagccugccu

SEQ ID NO: 796671 - RNA, 22 nt, Homo sapiens
ucagcaucacccgggaacuuuu

SEQ ID NO: 796672 - RNA, 21 nt, Homo sapiens
ucagcauucaaaauaguucua

SEQ ID NO: 796673 - RNA, 20 nt, Homo sapiens
ucagccaauccgauugccuu

SEQ ID NO: 796674 - RNA, 15 nt, Homo sapiens
ucagccagucucaga

SEQ ID NO: 796675 - RNA, 19 nt, Homo sapiens
ucagccauaagaaagcacu

SEQ ID NO: 796676 - RNA, 14 nt, Homo sapiens
ucagcccaccaccc

SEQ ID NO: 796677 - RNA, 21 nt, Homo sapiens
ucagcccagcaccugcuccca

SEQ ID NO: 796678 - RNA, 11 nt, Homo sapiens
ucagcccagug

SEQ ID NO: 796679 - RNA, 16 nt, Homo sapiens
ucagcccucagaagaa

SEQ ID NO: 796680 - RNA, 20 nt, Homo sapiens
ucagcccugcaccaugcugc

SEQ ID NO: 796681 - RNA, 21 nt, Homo sapiens
ucagccuagagaccauguuga

SEQ ID NO: 796682 - RNA, 20 nt, Homo sapiens
ucagccuagccgaccucagc

SEQ ID NO: 796683 - RNA, 20 nt, Homo sapiens
ucagccucccaaagugcuga

SEQ ID NO: 796684 - RNA, 23 nt, Homo sapiens
ucagccucccaagcaccugggau

SEQ ID NO: 796685 - RNA, 16 nt, Homo sapiens
ucagccuggccagaca

SEQ ID NO: 796686 - RNA, 22 nt, Homo sapiens
ucagccuggccagacacaggcc

SEQ ID NO: 796687 - RNA, 15 nt, Homo sapiens
ucagccuuagcucuc

SEQ ID NO: 796688 - RNA, 14 nt, Homo sapiens
ucagcucucugcag

SEQ ID NO: 796689 - RNA, 17 nt, Homo sapiens
ucagcucucugggaccu

SEQ ID NO: 796690 - RNA, 17 nt, Homo sapiens
ucagcugaauucacuua

SEQ ID NO: 796691 - RNA, 17 nt, Homo sapiens
ucagcugagguuugcac

SEQ ID NO: 796692 - RNA, 13 nt, Homo sapiens
ucagcugaugcuc

SEQ ID NO: 796693 - RNA, 23 nt, Homo sapiens
ucagcugcagccacuuucugcca

SEQ ID NO: 796694 - RNA, 12 nt, Homo sapiens
ucagcugccuca

SEQ ID NO: 796695 - RNA, 19 nt, Homo sapiens
ucagcugcugaaauuugga

SEQ ID NO: 796696 - RNA, 23 nt, Homo sapiens
ucagcugggaugacuggcuuuga

SEQ ID NO: 796697 - RNA, 18 nt, Homo sapiens
ucagcuuaaaauccaaag

SEQ ID NO: 796698 - RNA, 23 nt, Homo sapiens
ucagcuucuaaucccagcacuuu

SEQ ID NO: 796699 - RNA, 15 nt, Homo sapiens
ucagcuucucaaagu

SEQ ID NO: 796700 - RNA, 11 nt, Homo sapiens
ucagcuuuauu

SEQ ID NO: 796701 - RNA, 20 nt, Homo sapiens
ucagcuuuucauaauaucua

SEQ ID NO: 796702 - RNA, 23 nt, Homo sapiens
ucagcuuuuguuguuuauauaca

SEQ ID NO: 796703 - RNA, 16 nt, Homo sapiens
aggacaggaggcggcc

SEQ ID NO: 796704 - RNA, 15 nt, Homo sapiens
aggacauacugcaug

SEQ ID NO: 796705 - RNA, 17 nt, Homo sapiens
aggacaucaaaguggua

SEQ ID NO: 796706 - RNA, 14 nt, Homo sapiens
aggaccaacaucca

SEQ ID NO: 796707 - RNA, 14 nt, Homo sapiens
aggaccaagcaucu

SEQ ID NO: 796708 - RNA, 18 nt, Homo sapiens
aggaccaauugacucuca

SEQ ID NO: 796709 - RNA, 13 nt, Homo sapiens
aggaccacagugg

SEQ ID NO: 796710 - RNA, 13 nt, Homo sapiens
aggaccacuccug

SEQ ID NO: 796711 - RNA, 20 nt, Homo sapiens
aggaccagguuugaugccug

SEQ ID NO: 796712 - RNA, 22 nt, Homo sapiens
aggacccugaaggggccaugau

SEQ ID NO: 796713 - RNA, 22 nt, Homo sapiens
aggaccugcauccuuccugggg

SEQ ID NO: 796714 - RNA, 18 nt, Homo sapiens
aggaccuuggaagagcaa

SEQ ID NO: 796715 - RNA, 15 nt, Homo sapiens
aggaccuuuccacca

SEQ ID NO: 796716 - RNA, 18 nt, Homo sapiens
aggacgugggcagcaaaa

SEQ ID NO: 796717 - RNA, 17 nt, Homo sapiens
aggacguugaggacuuu

SEQ ID NO: 796718 - RNA, 11 nt, Homo sapiens
aggacucuucc

SEQ ID NO: 796719 - RNA, 21 nt, Homo sapiens
aggacuguugugguacuggca

SEQ ID NO: 796720 - RNA, 15 nt, Homo sapiens
aggacuucuggcuau

SEQ ID NO: 796721 - RNA, 19 nt, Homo sapiens
aggacuugcuaaagcacuu

SEQ ID NO: 796722 - RNA, 20 nt, Homo sapiens
aggagaaacucccauguaug

SEQ ID NO: 796723 - RNA, 21 nt, Homo sapiens
aggagaacaucauaacccaug

SEQ ID NO: 796724 - RNA, 14 nt, Homo sapiens
aggagaaggggaag

SEQ ID NO: 796725 - RNA, 18 nt, Homo sapiens
aggagaauuuaaacaaug

SEQ ID NO: 796726 - RNA, 20 nt, Homo sapiens
aggagacacgacagcacaca

SEQ ID NO: 796727 - RNA, 14 nt, Homo sapiens
aggagacauugcuc

SEQ ID NO: 796728 - RNA, 12 nt, Homo sapiens
aggagaccaagg

SEQ ID NO: 796729 - RNA, 16 nt, Homo sapiens
aggagaccuccagcua

SEQ ID NO: 796730 - RNA, 16 nt, Homo sapiens
aggagacuaggaggga

SEQ ID NO: 796731 - RNA, 21 nt, Homo sapiens
aggagacuuaggaaccuacca

SEQ ID NO: 796732 - RNA, 13 nt, Homo sapiens
aggagaugugguc

SEQ ID NO: 796733 - RNA, 15 nt, Homo sapiens
aggagauuccuuucc

SEQ ID NO: 796734 - RNA, 23 nt, Homo sapiens
aggagcacauacuaccuagaagu

SEQ ID NO: 796735 - RNA, 11 nt, Homo sapiens
aggagcaggca

SEQ ID NO: 796736 - RNA, 18 nt, Homo sapiens
aggagccaccaguucuca

SEQ ID NO: 796737 - RNA, 19 nt, Homo sapiens
aggagccaccaguucucau

SEQ ID NO: 796738 - RNA, 20 nt, Homo sapiens
aggagcccuuacccucccac

SEQ ID NO: 796739 - RNA, 14 nt, Homo sapiens
aggagcugcaaauu

SEQ ID NO: 796740 - RNA, 16 nt, Homo sapiens
aggagcuggaaccaug

SEQ ID NO: 796741 - RNA, 15 nt, Homo sapiens
aggagcuugcaagaa

SEQ ID NO: 796742 - RNA, 14 nt, Homo sapiens
aggagcuuucucaa

SEQ ID NO: 796743 - RNA, 13 nt, Homo sapiens
aggagcuuugugu

SEQ ID NO: 796744 - RNA, 18 nt, Homo sapiens
aggaggagggaggccagg

SEQ ID NO: 796745 - RNA, 20 nt, Homo sapiens
aggaggaucauuugagcuca

SEQ ID NO: 796746 - RNA, 22 nt, Homo sapiens
aggaggaucauuugagcucaug

SEQ ID NO: 796747 - RNA, 16 nt, Homo sapiens
aggaggcacugcucau

SEQ ID NO: 796748 - RNA, 20 nt, Homo sapiens
aggaggcccagcugcucagu

SEQ ID NO: 796749 - RNA, 18 nt, Homo sapiens
aggaggcgcccuuggcuu

SEQ ID NO: 796750 - RNA, 17 nt, Homo sapiens
aggaggcugcaugcucu

SEQ ID NO: 796751 - RNA, 20 nt, Homo sapiens
aggagggacaugauggggaa

SEQ ID NO: 796752 - RNA, 14 nt, Homo sapiens
aggagggagcugcu

SEQ ID NO: 796753 - RNA, 16 nt, Homo sapiens
aggagggcccuaccug

SEQ ID NO: 796754 - RNA, 19 nt, Homo sapiens
aggaggggugaguccccua

SEQ ID NO: 796755 - RNA, 14 nt, Homo sapiens
aggagggugugagu

SEQ ID NO: 796756 - RNA, 16 nt, Homo sapiens
aggaggguugugcuac

SEQ ID NO: 796757 - RNA, 20 nt, Homo sapiens
aggagguggagguugcagug

SEQ ID NO: 796758 - RNA, 20 nt, Homo sapiens
aggagucaacguguuuaccu

SEQ ID NO: 796759 - RNA, 19 nt, Homo sapiens
aggagucgggagcacagcu

SEQ ID NO: 796760 - RNA, 20 nt, Homo sapiens
aggagugggaaaacacugcc

SEQ ID NO: 796761 - RNA, 17 nt, Homo sapiens
aggaguguccugcccau

SEQ ID NO: 796762 - RNA, 13 nt, Homo sapiens
aggaguucaagac

SEQ ID NO: 796763 - RNA, 18 nt, Homo sapiens
aggauacagaaaugcaaa

SEQ ID NO: 796764 - RNA, 17 nt, Homo sapiens
aggauagaauacaugga

SEQ ID NO: 796765 - RNA, 22 nt, Homo sapiens
aggauagggccgacgcugugcc

SEQ ID NO: 796766 - RNA, 16 nt, Homo sapiens
aggauaucacauugga

SEQ ID NO: 796767 - RNA, 12 nt, Homo sapiens
aggauaugcagu

SEQ ID NO: 796768 - RNA, 13 nt, Homo sapiens
aggauauuaacaa

SEQ ID NO: 796769 - RNA, 17 nt, Homo sapiens
aggauauuugcacuauu

SEQ ID NO: 796770 - RNA, 18 nt, Homo sapiens
aggaucacuugagcccag

SEQ ID NO: 796771 - RNA, 21 nt, Homo sapiens
aggaucagaugacucucucca

SEQ ID NO: 796772 - RNA, 19 nt, Homo sapiens
aggaucccugaucccauuu

SEQ ID NO: 796773 - RNA, 14 nt, Homo sapiens
aggaucucucagga

SEQ ID NO: 796774 - RNA, 14 nt, Homo sapiens
aggaucugcuccaa

SEQ ID NO: 796775 - RNA, 18 nt, Homo sapiens
aggaucuggagaaccuca

SEQ ID NO: 796776 - RNA, 20 nt, Homo sapiens
aggaucugugauuggcuggu

SEQ ID NO: 796777 - RNA, 21 nt, Homo sapiens
gcuccuuucuccagccagcaa

SEQ ID NO: 796778 - RNA, 14 nt, Homo sapiens
gcucuacaucuucu

SEQ ID NO: 796779 - RNA, 12 nt, Homo sapiens
gcucuagucacu

SEQ ID NO: 796780 - RNA, 16 nt, Homo sapiens
gcucucaaaucccucu

SEQ ID NO: 796781 - RNA, 19 nt, Homo sapiens
gcucucagaagguauuccu

SEQ ID NO: 796782 - RNA, 21 nt, Homo sapiens
gcucucccaacucuugcacag

SEQ ID NO: 796783 - RNA, 14 nt, Homo sapiens
gcucucgacaguau

SEQ ID NO: 796784 - RNA, 21 nt, Homo sapiens
gcucucuugugacgugcacug

SEQ ID NO: 796785 - RNA, 19 nt, Homo sapiens
gcucugagaaaccucggga

SEQ ID NO: 796786 - RNA, 19 nt, Homo sapiens
gcucugagccacaguggga

SEQ ID NO: 796787 - RNA, 16 nt, Homo sapiens
gcucugauggcugcuc

SEQ ID NO: 796788 - RNA, 22 nt, Homo sapiens
gcucugauggcugcuccacugg

SEQ ID NO: 796789 - RNA, 21 nt, Homo sapiens
gcucugcaauuccccucugcu

SEQ ID NO: 796790 - RNA, 14 nt, Homo sapiens
gcucugcacagaca

SEQ ID NO: 796791 - RNA, 20 nt, Homo sapiens
gcucugcagacugcugcuag

SEQ ID NO: 796792 - RNA, 17 nt, Homo sapiens
gcucugcagauccucug

SEQ ID NO: 796793 - RNA, 13 nt, Homo sapiens
gcucugccauuca

SEQ ID NO: 796794 - RNA, 18 nt, Homo sapiens
gcucugcuucuccaagga

SEQ ID NO: 796795 - RNA, 20 nt, Homo sapiens
gcucugcuugacaacaucug

SEQ ID NO: 796796 - RNA, 14 nt, Homo sapiens
gcucuggccacaac

SEQ ID NO: 796797 - RNA, 18 nt, Homo sapiens
gcucuggugacaccagcc

SEQ ID NO: 796798 - RNA, 16 nt, Homo sapiens
gcucugucuucuuugc

SEQ ID NO: 796799 - RNA, 19 nt, Homo sapiens
gcucugucuucuuugccca

SEQ ID NO: 796800 - RNA, 14 nt, Homo sapiens
gcucuguuacccag

SEQ ID NO: 796801 - RNA, 14 nt, Homo sapiens
gcucuguugcccaa

SEQ ID NO: 796802 - RNA, 16 nt, Homo sapiens
gcucuuagcagcuucc

SEQ ID NO: 796803 - RNA, 13 nt, Homo sapiens
gcucuuaggugcu

SEQ ID NO: 796804 - RNA, 19 nt, Homo sapiens
gcucuuaggugcuucuuca

SEQ ID NO: 796805 - RNA, 13 nt, Homo sapiens
gcucuucacugaa

SEQ ID NO: 796806 - RNA, 18 nt, Homo sapiens
gcucuucaucccauucca

SEQ ID NO: 796807 - RNA, 10 nt, Homo sapiens
gcucuuccaa

SEQ ID NO: 796808 - RNA, 15 nt, Homo sapiens
gcucuuucucugcca

SEQ ID NO: 796809 - RNA, 16 nt, Homo sapiens
gcucuuucucugccag

SEQ ID NO: 796810 - RNA, 21 nt, Homo sapiens
auuggcaccuaauccaggcag

SEQ ID NO: 796811 - RNA, 15 nt, Homo sapiens
auuggcagcucaaag

SEQ ID NO: 796812 - RNA, 22 nt, Homo sapiens
auuggcggggcuuaugacugca

SEQ ID NO: 796813 - RNA, 18 nt, Homo sapiens
auuggcuauaacaugucu

SEQ ID NO: 796814 - RNA, 14 nt, Homo sapiens
auuggcucuaguca

SEQ ID NO: 796815 - RNA, 23 nt, Homo sapiens
auugggaaaugaaaaaaaaaugg

SEQ ID NO: 796816 - RNA, 15 nt, Homo sapiens
auugggggacguggg

SEQ ID NO: 796817 - RNA, 22 nt, Homo sapiens
auugguccagcuugcucuucag

SEQ ID NO: 796818 - RNA, 14 nt, Homo sapiens
auuguaaauacugg

SEQ ID NO: 796819 - RNA, 16 nt, Homo sapiens
auuguacacgcugaug

SEQ ID NO: 796820 - RNA, 14 nt, Homo sapiens
auuguacauaaaag

SEQ ID NO: 796821 - RNA, 14 nt, Homo sapiens
auuguaccaugaaa

SEQ ID NO: 796822 - RNA, 14 nt, Homo sapiens
auuguacgaagagu

SEQ ID NO: 796823 - RNA, 14 nt, Homo sapiens
auuguaguguucaa

SEQ ID NO: 796824 - RNA, 13 nt, Homo sapiens
auuguaucucaua

SEQ ID NO: 796825 - RNA, 14 nt, Homo sapiens
auugucacagauga

SEQ ID NO: 796826 - RNA, 16 nt, Homo sapiens
auugucagaguucugc

SEQ ID NO: 796827 - RNA, 19 nt, Homo sapiens
auugucagaguucugcucu

SEQ ID NO: 796828 - RNA, 16 nt, Homo sapiens
auuguccauucuugcu

SEQ ID NO: 796829 - RNA, 19 nt, Homo sapiens
auuguccccuuuuuaguuu

SEQ ID NO: 796830 - RNA, 18 nt, Homo sapiens
auugucuguaaugacaaa

SEQ ID NO: 796831 - RNA, 15 nt, Homo sapiens
auugucuuagucaaa

SEQ ID NO: 796832 - RNA, 16 nt, Homo sapiens
auugugacuucacugu

SEQ ID NO: 796833 - RNA, 18 nt, Homo sapiens
auugugacuucacuguau

SEQ ID NO: 796834 - RNA, 15 nt, Homo sapiens
auugugagccaccac

SEQ ID NO: 796835 - RNA, 18 nt, Homo sapiens
auugugauauuuuuacuu

SEQ ID NO: 796836 - RNA, 17 nt, Homo sapiens
auugugcaguacuuugu

SEQ ID NO: 796837 - RNA, 23 nt, Homo sapiens
auugugccgagaaaagcauuuua

SEQ ID NO: 796838 - RNA, 20 nt, Homo sapiens
auugugcuucgagugacuga

SEQ ID NO: 796839 - RNA, 17 nt, Homo sapiens
auugugcuuucaccaga

SEQ ID NO: 796840 - RNA, 17 nt, Homo sapiens
auugugguuccaugcag

SEQ ID NO: 796841 - RNA, 21 nt, Homo sapiens
auugugugcgcugccuggcca

SEQ ID NO: 796842 - RNA, 14 nt, Homo sapiens
auugugugugcaag

SEQ ID NO: 796843 - RNA, 15 nt, Homo sapiens
auugugugugcaaga

SEQ ID NO: 796844 - RNA, 16 nt, Homo sapiens
auuguuaaaauaacua

SEQ ID NO: 796845 - RNA, 22 nt, Homo sapiens
auuguuaccugucauuuugcac

SEQ ID NO: 796846 - RNA, 20 nt, Homo sapiens
auuguuaggagugguucuca

SEQ ID NO: 796847 - RNA, 17 nt, Homo sapiens
auuguucaaagcacaga

SEQ ID NO: 796848 - RNA, 21 nt, Homo sapiens
auuguucuuauccucaauuca

SEQ ID NO: 796849 - RNA, 20 nt, Homo sapiens
auuguugaaagguaauuuga

SEQ ID NO: 796850 - RNA, 23 nt, Homo sapiens
auuguugaauguuucacuaguua

SEQ ID NO: 796851 - RNA, 16 nt, Homo sapiens
auuguugggaggacag

SEQ ID NO: 796852 - RNA, 21 nt, Homo sapiens
auuguuuggcaaugcacugaa

SEQ ID NO: 796853 - RNA, 14 nt, Homo sapiens
auuguuuucagugu

SEQ ID NO: 796854 - RNA, 17 nt, Homo sapiens
auuguuuucaguguaca

SEQ ID NO: 796855 - RNA, 21 nt, Homo sapiens
auuguuuuguggauaauugaa

SEQ ID NO: 796856 - RNA, 18 nt, Homo sapiens
auuuaaaacaucauuacu

SEQ ID NO: 796857 - RNA, 13 nt, Homo sapiens
auuuaaaacuggg

SEQ ID NO: 796858 - RNA, 20 nt, Homo sapiens
auuuaaaaggacugcugauu

SEQ ID NO: 796859 - RNA, 16 nt, Homo sapiens
auuuaaaaugagaucg

SEQ ID NO: 796860 - RNA, 17 nt, Homo sapiens
auuuaaaauugcuaugu

SEQ ID NO: 796861 - RNA, 23 nt, Homo sapiens
auuuaaagaaaauaaacaccauu

SEQ ID NO: 796862 - RNA, 19 nt, Homo sapiens
auuuaaagggaaaacccuc

SEQ ID NO: 796863 - RNA, 20 nt, Homo sapiens
auuuaaauaaaguuacuuga

SEQ ID NO: 796864 - RNA, 15 nt, Homo sapiens
auuuaaaugccauag

SEQ ID NO: 796865 - RNA, 19 nt, Homo sapiens
auuuaaauguuuaacauca

SEQ ID NO: 796866 - RNA, 18 nt, Homo sapiens
auuuaacaaaccugaaug

SEQ ID NO: 796867 - RNA, 22 nt, Homo sapiens
cauucuuccaucaucacuguaa

SEQ ID NO: 796868 - RNA, 22 nt, Homo sapiens
cauucuugcuugacucuacuau

SEQ ID NO: 796869 - RNA, 18 nt, Homo sapiens
cauucuuuaucuugacau

SEQ ID NO: 796870 - RNA, 23 nt, Homo sapiens
cauucuuuucagcuuguuucuau

SEQ ID NO: 796871 - RNA, 18 nt, Homo sapiens
cauucuuuuucuguugaa

SEQ ID NO: 796872 - RNA, 19 nt, Homo sapiens
cauucuuuuucuguugaaa

SEQ ID NO: 796873 - RNA, 15 nt, Homo sapiens
cauugaaagugcuuc

SEQ ID NO: 796874 - RNA, 14 nt, Homo sapiens
cauugaacucacca

SEQ ID NO: 796875 - RNA, 14 nt, Homo sapiens
cauugaacuuuaag

SEQ ID NO: 796876 - RNA, 21 nt, Homo sapiens
cauugaagauccgagugugau

SEQ ID NO: 796877 - RNA, 20 nt, Homo sapiens
cauugaccaagaacugcaug

SEQ ID NO: 796878 - RNA, 18 nt, Homo sapiens
cauugaccucaucauuaa

SEQ ID NO: 796879 - RNA, 23 nt, Homo sapiens
cauugagaacugcauauguuucg

SEQ ID NO: 796880 - RNA, 14 nt, Homo sapiens
cauugagcaguaua

SEQ ID NO: 796881 - RNA, 18 nt, Homo sapiens
cauugagcaguuagcuca

SEQ ID NO: 796882 - RNA, 18 nt, Homo sapiens
cauugagccaguggugcu

SEQ ID NO: 796883 - RNA, 22 nt, Homo sapiens
cauugagcgugaccuugcaaug

SEQ ID NO: 796884 - RNA, 15 nt, Homo sapiens
cauugagcugugcaa

SEQ ID NO: 796885 - RNA, 13 nt, Homo sapiens
cauugaugacccu

SEQ ID NO: 796886 - RNA, 23 nt, Homo sapiens
cauugaugcugcuggcuaagcau

SEQ ID NO: 796887 - RNA, 21 nt, Homo sapiens
cauugauguaaggacuguaaa

SEQ ID NO: 796888 - RNA, 22 nt, Homo sapiens
cauugauucguaugccagcuca

SEQ ID NO: 796889 - RNA, 18 nt, Homo sapiens
cauugcacauaagcuucc

SEQ ID NO: 796890 - RNA, 15 nt, Homo sapiens
cauugcaguuuaaga

SEQ ID NO: 796891 - RNA, 18 nt, Homo sapiens
cauugccaauuagacaaa

SEQ ID NO: 796892 - RNA, 18 nt, Homo sapiens
cauugcccgaaaccagag

SEQ ID NO: 796893 - RNA, 15 nt, Homo sapiens
cauugccuggacuga

SEQ ID NO: 796894 - RNA, 17 nt, Homo sapiens
cauugcgaccauuucuc

SEQ ID NO: 796895 - RNA, 13 nt, Homo sapiens
cauugcugccaag

SEQ ID NO: 796896 - RNA, 16 nt, Homo sapiens
cauugcuguucuacuu

SEQ ID NO: 796897 - RNA, 17 nt, Homo sapiens
cauugcuuuccacugag

SEQ ID NO: 796898 - RNA, 15 nt, Homo sapiens
cauuggaaagcacac

SEQ ID NO: 796899 - RNA, 13 nt, Homo sapiens
cauuggaagccau

SEQ ID NO: 796900 - RNA, 23 nt, Homo sapiens
cauuggagaaucucaacaugucu

SEQ ID NO: 796901 - RNA, 20 nt, Homo sapiens
cauuggauucaucagcauuu

SEQ ID NO: 796902 - RNA, 16 nt, Homo sapiens
cauuggcacaauguau

SEQ ID NO: 796903 - RNA, 16 nt, Homo sapiens
cauuggccgacaucac

SEQ ID NO: 796904 - RNA, 14 nt, Homo sapiens
cauugguccaagau

SEQ ID NO: 796905 - RNA, 12 nt, Homo sapiens
cauugucccuga

SEQ ID NO: 796906 - RNA, 23 nt, Homo sapiens
cauugucgcuauugauuuuuacu

SEQ ID NO: 796907 - RNA, 15 nt, Homo sapiens
cauugucuacuccua

SEQ ID NO: 796908 - RNA, 15 nt, Homo sapiens
cauugugaggguuaa

SEQ ID NO: 796909 - RNA, 17 nt, Homo sapiens
cauugugaucagcuagc

SEQ ID NO: 796910 - RNA, 18 nt, Homo sapiens
cauugugccuaaguccag

SEQ ID NO: 796911 - RNA, 21 nt, Homo sapiens
cauuguggcuccuaucugugu

SEQ ID NO: 796912 - RNA, 19 nt, Homo sapiens
cauuguuccugcgcugcaa

SEQ ID NO: 796913 - RNA, 18 nt, Homo sapiens
cauuguuguucugcucaa

SEQ ID NO: 796914 - RNA, 18 nt, Homo sapiens
cauuuaaauuuuacccuu

SEQ ID NO: 796915 - RNA, 19 nt, Homo sapiens
cauuuaauacccugcaaug

SEQ ID NO: 796916 - RNA, 13 nt, Homo sapiens
cauuuacagugua

SEQ ID NO: 796917 - RNA, 21 nt, Homo sapiens
cauuuagaacuugcagcugau

SEQ ID NO: 796918 - RNA, 21 nt, Homo sapiens
cauuuagaacuuuaagucuca

SEQ ID NO: 796919 - RNA, 22 nt, Homo sapiens
cauuuaggaaaaauaauucuau

SEQ ID NO: 796920 - RNA, 12 nt, Homo sapiens
cauuuaugcaca

SEQ ID NO: 796921 - RNA, 13 nt, Homo sapiens
cauuucaagacag

SEQ ID NO: 796922 - RNA, 14 nt, Homo sapiens
cauuucaagacaga

SEQ ID NO: 796923 - RNA, 17 nt, Homo sapiens
cauuucacacauaagaa

SEQ ID NO: 796924 - RNA, 14 nt, Homo sapiens
cauuucaccuguga

SEQ ID NO: 796925 - RNA, 17 nt, Homo sapiens
cauuucagaaagccuuu

SEQ ID NO: 796926 - RNA, 23 nt, Homo sapiens
cauuucagagaggccuuuuggaa

SEQ ID NO: 796927 - RNA, 13 nt, Homo sapiens
cauuucagagccc

SEQ ID NO: 796928 - RNA, 19 nt, Homo sapiens
cauuucagccaaacuguag

SEQ ID NO: 796929 - RNA, 18 nt, Homo sapiens
cauuucauacaacagaaa

SEQ ID NO: 796930 - RNA, 19 nt, Homo sapiens
cauuucauugcagauaugg

SEQ ID NO: 796931 - RNA, 16 nt, Homo sapiens
cauuuccaaauucaca

SEQ ID NO: 796932 - RNA, 17 nt, Homo sapiens
cauuuccaaauucacaa

SEQ ID NO: 796933 - RNA, 15 nt, Homo sapiens
cauuuccaagcacuu

SEQ ID NO: 796934 - RNA, 14 nt, Homo sapiens
cauuucccacaucu

SEQ ID NO: 796935 - RNA, 19 nt, Homo sapiens
cauuuccugacagaaggac

SEQ ID NO: 796936 - RNA, 22 nt, Homo sapiens
cauuucuacuuuuugcaccuua

SEQ ID NO: 796937 - RNA, 21 nt, Homo sapiens
cauuucuagacucaaaaccug

SEQ ID NO: 796938 - RNA, 23 nt, Homo sapiens
cauuucuagacucaaaaccugga

SEQ ID NO: 796939 - RNA, 23 nt, Homo sapiens
cauuucucaaaugcacaucucau

SEQ ID NO: 796940 - RNA, 23 nt, Homo sapiens
cauuucucauaccuuccccacau

SEQ ID NO: 796941 - RNA, 20 nt, Homo sapiens
cauuucucuacacuaagggg

SEQ ID NO: 796942 - RNA, 20 nt, Homo sapiens
cauuucuguucucauuugau

SEQ ID NO: 796943 - RNA, 17 nt, Homo sapiens
cauuucuugauguugcu

SEQ ID NO: 796944 - RNA, 17 nt, Homo sapiens
cauuucuuugcauucca

SEQ ID NO: 796945 - RNA, 14 nt, Homo sapiens
cauuugaacauguu

SEQ ID NO: 796946 - RNA, 14 nt, Homo sapiens
cauuugagcucaug

SEQ ID NO: 796947 - RNA, 20 nt, Homo sapiens
cauuugauauacaugcucaa

SEQ ID NO: 796948 - RNA, 21 nt, Homo sapiens
cauuugauauacaugcucaac

SEQ ID NO: 796949 - RNA, 22 nt, Homo sapiens
cauuugcaaaggcgacaauaaa

SEQ ID NO: 796950 - RNA, 14 nt, Homo sapiens
cauuugcuuugucc

SEQ ID NO: 796951 - RNA, 21 nt, Homo sapiens
cauuuggaccaauagcccaca

SEQ ID NO: 796952 - RNA, 22 nt, Homo sapiens
cauuuggagagggggccuggga

SEQ ID NO: 796953 - RNA, 20 nt, Homo sapiens
cauuugggugaacuguggac

SEQ ID NO: 796954 - RNA, 21 nt, Homo sapiens
cauuuggugguacuuuauucu

SEQ ID NO: 796955 - RNA, 21 nt, Homo sapiens
cauuuguaugucaaagcuuug

SEQ ID NO: 796956 - RNA, 22 nt, Homo sapiens
cauuuguggucacagccaugaa

SEQ ID NO: 796957 - RNA, 12 nt, Homo sapiens
cauuuguuuaaa

SEQ ID NO: 796958 - RNA, 15 nt, Homo sapiens
cauuuguuuaaaaag

SEQ ID NO: 796959 - RNA, 23 nt, Homo sapiens
cauuuguuuaaauucacaucuca

SEQ ID NO: 796960 - RNA, 19 nt, Homo sapiens
cauuuuacaggugcgaaug

SEQ ID NO: 796961 - RNA, 19 nt, Homo sapiens
cauuuuacucuuaugauca

SEQ ID NO: 796962 - RNA, 15 nt, Homo sapiens
cauuuuagacauuca

SEQ ID NO: 796963 - RNA, 20 nt, Homo sapiens
cauuuuagucaugcaaagau

SEQ ID NO: 796964 - RNA, 15 nt, Homo sapiens
cauuuuauaaauuca

SEQ ID NO: 796965 - RNA, 21 nt, Homo sapiens
cauuuuauuuagcaagguguu

SEQ ID NO: 796966 - RNA, 21 nt, Homo sapiens
cauuuuauuuuuucuugcaaa

SEQ ID NO: 796967 - RNA, 22 nt, Homo sapiens
cauuuuauuuuuucuugcaaau

SEQ ID NO: 796968 - RNA, 19 nt, Homo sapiens
cauuuucagucuuguagug

SEQ ID NO: 796969 - RNA, 18 nt, Homo sapiens
cauuuuccuaaacccagu

SEQ ID NO: 796970 - RNA, 19 nt, Homo sapiens
cauuuuccugagaccucaa

SEQ ID NO: 796971 - RNA, 22 nt, Homo sapiens
cauuuugaagugggauguuaau

SEQ ID NO: 796972 - RNA, 15 nt, Homo sapiens
cauuuugagguuuug

SEQ ID NO: 796973 - RNA, 18 nt, Homo sapiens
cauuuugcccuuccauag

SEQ ID NO: 796974 - RNA, 20 nt, Homo sapiens
cauuuugggccuugcuaaau

SEQ ID NO: 796975 - RNA, 15 nt, Homo sapiens
cauuuuguucuacau

SEQ ID NO: 796976 - RNA, 23 nt, Homo sapiens
cauuuuuagaacuccaguuuuca

SEQ ID NO: 796977 - RNA, 18 nt, Homo sapiens
cauuuuucucuugccauu

SEQ ID NO: 796978 - RNA, 14 nt, Homo sapiens
cauuuuucugggag

SEQ ID NO: 796979 - RNA, 12 nt, Homo sapiens
cauuuuugcaua

SEQ ID NO: 796980 - RNA, 11 nt, Homo sapiens
cauuuuugcug

SEQ ID NO: 796981 - RNA, 14 nt, Homo sapiens
cauuuuugcugaau

SEQ ID NO: 796982 - RNA, 19 nt, Homo sapiens
cauuuuuuaaaaaagcaag

SEQ ID NO: 796983 - RNA, 16 nt, Homo sapiens
cauuuuuuagucugua

SEQ ID NO: 796984 - RNA, 22 nt, Homo sapiens
cauuuuuuaugaacacuugaca

SEQ ID NO: 796985 - RNA, 13 nt, Homo sapiens
cauuuuuuuagaa

SEQ ID NO: 796986 - RNA, 17 nt, Homo sapiens
cauuuuuuucacuggag

SEQ ID NO: 796987 - RNA, 18 nt, Homo sapiens
cauuuuuuugcaugcaug

SEQ ID NO: 796988 - RNA, 18 nt, Homo sapiens
cauuuuuuuuucaaucaa

SEQ ID NO: 796989 - RNA, 19 nt, Homo sapiens
cauuuuuuuuucaaucaac

SEQ ID NO: 796990 - RNA, 15 nt, Homo sapiens
ccaaaaaacuacuuc

SEQ ID NO: 796991 - RNA, 16 nt, Homo sapiens
ccaaaaaugcacccaa

SEQ ID NO: 796992 - RNA, 18 nt, Homo sapiens
ccaaaacaaacaaacaga

SEQ ID NO: 796993 - RNA, 14 nt, Homo sapiens
ccaaaacaauuucu

SEQ ID NO: 796994 - RNA, 19 nt, Homo sapiens
ccaaaacccugaagccauu

SEQ ID NO: 796995 - RNA, 22 nt, Homo sapiens
ccaaaaccucaguuaaacugug

SEQ ID NO: 796996 - RNA, 16 nt, Homo sapiens
ccaaaaccugcuuccu

SEQ ID NO: 796997 - RNA, 17 nt, Homo sapiens
ccaaaacuauccugauu

SEQ ID NO: 796998 - RNA, 13 nt, Homo sapiens
ccaaaagaagccc

SEQ ID NO: 796999 - RNA, 12 nt, Homo sapiens
ccaaaaguuauu

SEQ ID NO: 797000 - RNA, 17 nt, Homo sapiens
ccaaaauaccagagccu

SEQ ID NO: 797001 - RNA, 21 nt, Homo sapiens
ccaaaauuaguuuguguuacu

SEQ ID NO: 797002 - RNA, 13 nt, Homo sapiens
ccaaacaaaauag

SEQ ID NO: 797003 - RNA, 23 nt, Homo sapiens
ccaaaccaauucaccaacacagu

SEQ ID NO: 797004 - RNA, 14 nt, Homo sapiens
ccaaaccacuccac

SEQ ID NO: 797005 - RNA, 22 nt, Homo sapiens
ccaaacccaugaggcaauguca

SEQ ID NO: 797006 - RNA, 22 nt, Homo sapiens
ccaaacggaagacuacagcaug

SEQ ID NO: 797007 - RNA, 17 nt, Homo sapiens
ccaaacucaaacuugag

SEQ ID NO: 797008 - RNA, 10 nt, Homo sapiens
ccaaacucag

SEQ ID NO: 797009 - RNA, 15 nt, Homo sapiens
ccaaacucugccagc

SEQ ID NO: 797010 - RNA, 20 nt, Homo sapiens
ccaaacucuucccucucuca

SEQ ID NO: 797011 - RNA, 16 nt, Homo sapiens
ccaaagaacaggugua

SEQ ID NO: 797012 - RNA, 17 nt, Homo sapiens
ccaaagaauauuccauu

SEQ ID NO: 797013 - RNA, 14 nt, Homo sapiens
ccaaagacaucagu

SEQ ID NO: 797014 - RNA, 19 nt, Homo sapiens
ccaaagauagacagguccu

SEQ ID NO: 797015 - RNA, 12 nt, Homo sapiens
ccaaagcacagc

SEQ ID NO: 797016 - RNA, 12 nt, Homo sapiens
ccaaagcacuuu

SEQ ID NO: 797017 - RNA, 18 nt, Homo sapiens
ccaaagccagaaccagau

SEQ ID NO: 797018 - RNA, 20 nt, Homo sapiens
ccaaagcuuuacuacugugg

SEQ ID NO: 797019 - RNA, 17 nt, Homo sapiens
ccaaaggaaggaagcaa

SEQ ID NO: 797020 - RNA, 19 nt, Homo sapiens
ccaaaggaauaaccuuucu

SEQ ID NO: 797021 - RNA, 20 nt, Homo sapiens
ccaaagggcaguggguggag

SEQ ID NO: 797022 - RNA, 20 nt, Homo sapiens
ccaaaguaaauguccugcua

SEQ ID NO: 797023 - RNA, 18 nt, Homo sapiens
ccaaaguuuucaaacugc

SEQ ID NO: 797024 - RNA, 12 nt, Homo sapiens
ccaaauaccuca

SEQ ID NO: 797025 - RNA, 14 nt, Homo sapiens
ccaaauaugagaug

SEQ ID NO: 797026 - RNA, 22 nt, Homo sapiens
ccaaauauguuaagggcuuuaa

SEQ ID NO: 797027 - RNA, 11 nt, Homo sapiens
ccaaaugaugc

SEQ ID NO: 797028 - RNA, 12 nt, Homo sapiens
ccaaauuuccag

SEQ ID NO: 797029 - RNA, 16 nt, Homo sapiens
ccaaauuuguauuuaa

SEQ ID NO: 797030 - RNA, 12 nt, Homo sapiens
ccaacaccacag

SEQ ID NO: 797031 - RNA, 12 nt, Homo sapiens
ccaacacccaaa

SEQ ID NO: 797032 - RNA, 13 nt, Homo sapiens
ccaacacccaaag

SEQ ID NO: 797033 - RNA, 21 nt, Homo sapiens
ccaacacugcucacagccuuu

SEQ ID NO: 797034 - RNA, 21 nt, Homo sapiens
ccaacagaagcuuccauucca

SEQ ID NO: 797035 - RNA, 18 nt, Homo sapiens
ccaacagccaagacccaa

SEQ ID NO: 797036 - RNA, 22 nt, Homo sapiens
ccaacaggcuguucugcacuga

SEQ ID NO: 797037 - RNA, 18 nt, Homo sapiens
ccaacagucaaaacagag

SEQ ID NO: 797038 - RNA, 21 nt, Homo sapiens
ccaacauaaaacaaaaccaag

SEQ ID NO: 797039 - RNA, 12 nt, Homo sapiens
ccaacaugguga

SEQ ID NO: 797040 - RNA, 16 nt, Homo sapiens
ccaacauuucucacug

SEQ ID NO: 797041 - RNA, 21 nt, Homo sapiens
ccaaccacagcaucgggagca

SEQ ID NO: 797042 - RNA, 15 nt, Homo sapiens
ccaacccacuggccc

SEQ ID NO: 797043 - RNA, 20 nt, Homo sapiens
ccaaccccccagcacugagg

SEQ ID NO: 797044 - RNA, 15 nt, Homo sapiens
ccaaccuggacuugu

SEQ ID NO: 797045 - RNA, 18 nt, Homo sapiens
ccaaccuuaaaccucuuc

SEQ ID NO: 797046 - RNA, 21 nt, Homo sapiens
ccaaccuucuugucauugaaa

SEQ ID NO: 797047 - RNA, 17 nt, Homo sapiens
ccaacgagcuguacaug

SEQ ID NO: 797048 - RNA, 19 nt, Homo sapiens
ccaacgcaccccugcacua

SEQ ID NO: 797049 - RNA, 16 nt, Homo sapiens
ccaacuacaaccaagc

SEQ ID NO: 797050 - RNA, 15 nt, Homo sapiens
ccaacuacagaaaga

SEQ ID NO: 797051 - RNA, 18 nt, Homo sapiens
ccaacugaucuguuauag

SEQ ID NO: 797052 - RNA, 20 nt, Homo sapiens
ccaacugucccuuuguuuga

SEQ ID NO: 797053 - RNA, 20 nt, Homo sapiens
ccaacuugccacauguucua

SEQ ID NO: 797054 - RNA, 23 nt, Homo sapiens
ccaacuuguaaauacaccaccuc

SEQ ID NO: 797055 - RNA, 16 nt, Homo sapiens
ccaacuuuguuuucca

SEQ ID NO: 797056 - RNA, 21 nt, Homo sapiens
ccaacuuuuaaugggauuuca

SEQ ID NO: 797057 - RNA, 15 nt, Homo sapiens
ccaagaaaugaacuu

SEQ ID NO: 797058 - RNA, 17 nt, Homo sapiens
ccaagaacuugcaauac

SEQ ID NO: 797059 - RNA, 15 nt, Homo sapiens
ccaagaauauaguua

SEQ ID NO: 797060 - RNA, 15 nt, Homo sapiens
ccaagacagugaagu

SEQ ID NO: 797061 - RNA, 15 nt, Homo sapiens
ccaagaccacccucc

SEQ ID NO: 797062 - RNA, 20 nt, Homo sapiens
ccaagacucugaaaucucag

SEQ ID NO: 797063 - RNA, 19 nt, Homo sapiens
ccaagagccugagugacag

SEQ ID NO: 797064 - RNA, 18 nt, Homo sapiens
ccaagaggagacuuuaau

SEQ ID NO: 797065 - RNA, 18 nt, Homo sapiens
ccaagagggcugcaaaag

SEQ ID NO: 797066 - RNA, 15 nt, Homo sapiens
ccaagagugaaggga

SEQ ID NO: 797067 - RNA, 20 nt, Homo sapiens
ccaagauggaugcgacccaa

SEQ ID NO: 797068 - RNA, 22 nt, Homo sapiens
ccaagauggaugcgacccaaga

SEQ ID NO: 797069 - RNA, 17 nt, Homo sapiens
ccaagauggguggcacc

SEQ ID NO: 797070 - RNA, 14 nt, Homo sapiens
ccaagcagagcuca

SEQ ID NO: 797071 - RNA, 13 nt, Homo sapiens
ccaagcagugcac

SEQ ID NO: 797072 - RNA, 17 nt, Homo sapiens
ccaagccauucacuucc

SEQ ID NO: 797073 - RNA, 22 nt, Homo sapiens
ccaagccuucgggcgucugugu

SEQ ID NO: 797074 - RNA, 21 nt, Homo sapiens
ccaagcugccucugggccaug

SEQ ID NO: 797075 - RNA, 22 nt, Homo sapiens
ccaagcuucaacccucagccuu

SEQ ID NO: 797076 - RNA, 22 nt, Homo sapiens
ccaaggaaacccccaguguaau

SEQ ID NO: 797077 - RNA, 19 nt, Homo sapiens
ccaaggaaacgcuaccucu

SEQ ID NO: 797078 - RNA, 19 nt, Homo sapiens
ccaaggaggaaaaacagac

SEQ ID NO: 797079 - RNA, 21 nt, Homo sapiens
ccaaggccuucuccuccccac

SEQ ID NO: 797080 - RNA, 22 nt, Homo sapiens
ccaaggcuuuugcaaagauaug

SEQ ID NO: 797081 - RNA, 22 nt, Homo sapiens
ccaagggcugaguguccagcac

SEQ ID NO: 797082 - RNA, 19 nt, Homo sapiens
ccaagggggugacuggaag

SEQ ID NO: 797083 - RNA, 22 nt, Homo sapiens
ccaaguaaacaggguaccucaa

SEQ ID NO: 797084 - RNA, 14 nt, Homo sapiens
ccaaguacacugag

SEQ ID NO: 797085 - RNA, 15 nt, Homo sapiens
ccaaguaugccuuaa

SEQ ID NO: 797086 - RNA, 16 nt, Homo sapiens
ccaaguauuuugccac

SEQ ID NO: 797087 - RNA, 11 nt, Homo sapiens
ccaagucacac

SEQ ID NO: 797088 - RNA, 14 nt, Homo sapiens
ccaagucauccucc

SEQ ID NO: 797089 - RNA, 22 nt, Homo sapiens
ccaagucauccucccaccucag

SEQ ID NO: 797090 - RNA, 16 nt, Homo sapiens
ccaagucucagaagag

SEQ ID NO: 797091 - RNA, 14 nt, Homo sapiens
ccaagucuuuccua

SEQ ID NO: 797092 - RNA, 16 nt, Homo sapiens
ccaagugauccuucca

SEQ ID NO: 797093 - RNA, 12 nt, Homo sapiens
ccaagugcaaua

SEQ ID NO: 797094 - RNA, 17 nt, Homo sapiens
ccaagugcugcacaaaa

SEQ ID NO: 797095 - RNA, 15 nt, Homo sapiens
ccaagugugaacaaa

SEQ ID NO: 797096 - RNA, 15 nt, Homo sapiens
cuuuuaaucagugaa

SEQ ID NO: 797097 - RNA, 20 nt, Homo sapiens
cuuuuaaugugaggaacuca

SEQ ID NO: 797098 - RNA, 13 nt, Homo sapiens
cuuuuaauucaaa

SEQ ID NO: 797099 - RNA, 23 nt, Homo sapiens
cuuuuacaaaaaaguaaccugaa

SEQ ID NO: 797100 - RNA, 16 nt, Homo sapiens
cuuuuacauacugcug

SEQ ID NO: 797101 - RNA, 21 nt, Homo sapiens
cuuuuacccggcacauucccc

SEQ ID NO: 797102 - RNA, 16 nt, Homo sapiens
cuuuuauaaagcaugu

SEQ ID NO: 797103 - RNA, 15 nt, Homo sapiens
cuuuuaugugucuca

SEQ ID NO: 797104 - RNA, 19 nt, Homo sapiens
cuuuuauuugaaaugucau

SEQ ID NO: 797105 - RNA, 23 nt, Homo sapiens
cuuuuauuuuacacagaaacacu

SEQ ID NO: 797106 - RNA, 13 nt, Homo sapiens
cuuuucacacugu

SEQ ID NO: 797107 - RNA, 23 nt, Homo sapiens
cuuuucaccaaaauuucuacacc

SEQ ID NO: 797108 - RNA, 14 nt, Homo sapiens
cuuuucaccaauga

SEQ ID NO: 797109 - RNA, 15 nt, Homo sapiens
cuuuucaccaaugag

SEQ ID NO: 797110 - RNA, 23 nt, Homo sapiens
cuuuucacugcuggcugccuuag

SEQ ID NO: 797111 - RNA, 22 nt, Homo sapiens
cuuuucauggucucugcaccca

SEQ ID NO: 797112 - RNA, 17 nt, Homo sapiens
cuuuucauuuuggcuca

SEQ ID NO: 797113 - RNA, 16 nt, Homo sapiens
gaaaauggccaugcag

SEQ ID NO: 797114 - RNA, 15 nt, Homo sapiens
gaaaauguccucccu

SEQ ID NO: 797115 - RNA, 17 nt, Homo sapiens
gaaaauguguucucgga

SEQ ID NO: 797116 - RNA, 14 nt, Homo sapiens
gaaaauuauaucuc

SEQ ID NO: 797117 - RNA, 18 nt, Homo sapiens
gaaaauuaugcaaaagca

SEQ ID NO: 797118 - RNA, 16 nt, Homo sapiens
gaaaauucgaaccagg

SEQ ID NO: 797119 - RNA, 17 nt, Homo sapiens
gaaaauuguugugcuua

SEQ ID NO: 797120 - RNA, 15 nt, Homo sapiens
gaaacaaacaucuaa

SEQ ID NO: 797121 - RNA, 12 nt, Homo sapiens
gaaacaacuugg

SEQ ID NO: 797122 - RNA, 14 nt, Homo sapiens
gaaacacacgugcu

SEQ ID NO: 797123 - RNA, 13 nt, Homo sapiens
gaaacacuaaaga

SEQ ID NO: 797124 - RNA, 16 nt, Homo sapiens
gaaaccaacacccaaa

SEQ ID NO: 797125 - RNA, 18 nt, Homo sapiens
gaaaccacacagacuugg

SEQ ID NO: 797126 - RNA, 13 nt, Homo sapiens
gaaaccacaguca

SEQ ID NO: 797127 - RNA, 10 nt, Homo sapiens
gaaaccagag

SEQ ID NO: 797128 - RNA, 14 nt, Homo sapiens
gaaaccccaucucu

SEQ ID NO: 797129 - RNA, 15 nt, Homo sapiens
gaaacccccagugua

SEQ ID NO: 797130 - RNA, 20 nt, Homo sapiens
gaaaccuguuaaaacaacca

SEQ ID NO: 797131 - RNA, 16 nt, Homo sapiens
gaaaccuuaguuucaa

SEQ ID NO: 797132 - RNA, 21 nt, Homo sapiens
gaaaccuuauuuuuucccaaa

SEQ ID NO: 797133 - RNA, 14 nt, Homo sapiens
gaaacgucaugugu

SEQ ID NO: 797134 - RNA, 20 nt, Homo sapiens
gaaacgucccacacuuugaa

SEQ ID NO: 797135 - RNA, 21 nt, Homo sapiens
gaaacuaaucuuaacccugug

SEQ ID NO: 797136 - RNA, 16 nt, Homo sapiens
gaaacuauaaguaauu

SEQ ID NO: 797137 - RNA, 14 nt, Homo sapiens
gaaacucaaaaaua

SEQ ID NO: 797138 - RNA, 16 nt, Homo sapiens
gaaacucacacucccc

SEQ ID NO: 797139 - RNA, 21 nt, Homo sapiens
gaaacucaguaugcugccccu

SEQ ID NO: 797140 - RNA, 13 nt, Homo sapiens
gaaacuccaucuc

SEQ ID NO: 797141 - RNA, 19 nt, Homo sapiens
gaaacuccaucucuacuga

SEQ ID NO: 797142 - RNA, 21 nt, Homo sapiens
gaaacuccuuuugcugucuuu

SEQ ID NO: 797143 - RNA, 15 nt, Homo sapiens
gaaacugaaacucac

SEQ ID NO: 797144 - RNA, 18 nt, Homo sapiens
gaaacugggaaacugggu

SEQ ID NO: 797145 - RNA, 16 nt, Homo sapiens
gaaacuguaaauaugu

SEQ ID NO: 797146 - RNA, 19 nt, Homo sapiens
gaaacuguagucucaggac

SEQ ID NO: 797147 - RNA, 22 nt, Homo sapiens
gaaacuguagucucaggaccua

SEQ ID NO: 797148 - RNA, 17 nt, Homo sapiens
gaaacuugcauacagag

SEQ ID NO: 797149 - RNA, 19 nt, Homo sapiens
gaaacuuuaaaagacugaa

SEQ ID NO: 797150 - RNA, 16 nt, Homo sapiens
gaaagaaaaauaccau

SEQ ID NO: 797151 - RNA, 13 nt, Homo sapiens
gaaagaaccagag

SEQ ID NO: 797152 - RNA, 15 nt, Homo sapiens
gaaagaacuaugaaa

SEQ ID NO: 797153 - RNA, 17 nt, Homo sapiens
gaaagaaggacccagaa

SEQ ID NO: 797154 - RNA, 23 nt, Homo sapiens
gaaagaauuauuuuuguguuucu

SEQ ID NO: 797155 - RNA, 18 nt, Homo sapiens
gaaagacuauucaaacag

SEQ ID NO: 797156 - RNA, 18 nt, Homo sapiens
gaaagacugagcucaagg

SEQ ID NO: 797157 - RNA, 17 nt, Homo sapiens
gaaagagagaagccagc

SEQ ID NO: 797158 - RNA, 22 nt, Homo sapiens
gaaagagcgucauguccuuggc

SEQ ID NO: 797159 - RNA, 13 nt, Homo sapiens
gaaagaucaaaga

SEQ ID NO: 797160 - RNA, 23 nt, Homo sapiens
gaaagaucguuuaaaaacaaagg

SEQ ID NO: 797161 - RNA, 18 nt, Homo sapiens
gaaagaugaucauuugua

SEQ ID NO: 797162 - RNA, 17 nt, Homo sapiens
gaaagaugcaguccuca

SEQ ID NO: 797163 - RNA, 14 nt, Homo sapiens
gaaagauggaacuu

SEQ ID NO: 797164 - RNA, 22 nt, Homo sapiens
gaaagaugguguggguguccug

SEQ ID NO: 797165 - RNA, 16 nt, Homo sapiens
gaaagauuacuuagag

SEQ ID NO: 797166 - RNA, 14 nt, Homo sapiens
gaaagauucaguga

SEQ ID NO: 797167 - RNA, 19 nt, Homo sapiens
gaaagcaacaaagauugag

SEQ ID NO: 797168 - RNA, 11 nt, Homo sapiens
gaaagcacuua

SEQ ID NO: 797169 - RNA, 18 nt, Homo sapiens
gaaagcuauauaagacaa

SEQ ID NO: 797170 - RNA, 18 nt, Homo sapiens
gaaagcuccuuccagacc

SEQ ID NO: 797171 - RNA, 15 nt, Homo sapiens
gaaagcugcugugau

SEQ ID NO: 797172 - RNA, 21 nt, Homo sapiens
gaaagcuggacugaccaaaga

SEQ ID NO: 797173 - RNA, 22 nt, Homo sapiens
gaaagcuguggccagcuuguua

SEQ ID NO: 797174 - RNA, 23 nt, Homo sapiens
gaaagcuuacauuuuccugagac

SEQ ID NO: 797175 - RNA, 16 nt, Homo sapiens
gaaaggaacacuggcu

SEQ ID NO: 797176 - RNA, 13 nt, Homo sapiens
gaaaggaagcauu

SEQ ID NO: 797177 - RNA, 22 nt, Homo sapiens
gaaaggagaacuauccaaaacu

SEQ ID NO: 797178 - RNA, 14 nt, Homo sapiens
gaaaggagacuaga

SEQ ID NO: 797179 - RNA, 19 nt, Homo sapiens
gaaaggauuuuaccaaagc

SEQ ID NO: 797180 - RNA, 23 nt, Homo sapiens
gaaaggcuguuaaauacaggaaa

SEQ ID NO: 797181 - RNA, 22 nt, Homo sapiens
gaaagggaagaucuuaugccuu

SEQ ID NO: 797182 - RNA, 19 nt, Homo sapiens
gaaagggauugcugaggca

SEQ ID NO: 797183 - RNA, 19 nt, Homo sapiens
gaaagggccacccaugaua

SEQ ID NO: 797184 - RNA, 22 nt, Homo sapiens
gaaagguacuauauuugcuaga

SEQ ID NO: 797185 - RNA, 15 nt, Homo sapiens
gaaagguauguuacu

SEQ ID NO: 797186 - RNA, 19 nt, Homo sapiens
gaaagguauguuacuguag

SEQ ID NO: 797187 - RNA, 20 nt, Homo sapiens
gaaaggugugcuagaacaag

SEQ ID NO: 797188 - RNA, 23 nt, Homo sapiens
gaaagguuuuauucuauauugcu

SEQ ID NO: 797189 - RNA, 16 nt, Homo sapiens
gaaaguacauuuggag

SEQ ID NO: 797190 - RNA, 14 nt, Homo sapiens
gaaagucacccaaa

SEQ ID NO: 797191 - RNA, 19 nt, Homo sapiens
gaaaguuacuguuaagggu

SEQ ID NO: 797192 - RNA, 16 nt, Homo sapiens
gaaaguuauugauaag

SEQ ID NO: 797193 - RNA, 20 nt, Homo sapiens
gaaaguucaacuuccaaagg

SEQ ID NO: 797194 - RNA, 14 nt, Homo sapiens
gaaaguucuggaaa

SEQ ID NO: 797195 - RNA, 22 nt, Homo sapiens
gaaaguuucagauuugccauuc

SEQ ID NO: 797196 - RNA, 15 nt, Homo sapiens
gaaaguuugcacugu

SEQ ID NO: 797197 - RNA, 19 nt, Homo sapiens
gaaauaaaguuggugacag

SEQ ID NO: 797198 - RNA, 14 nt, Homo sapiens
gaaauaaaugacaa

SEQ ID NO: 797199 - RNA, 15 nt, Homo sapiens
gaaauaacacuguga

SEQ ID NO: 797200 - RNA, 14 nt, Homo sapiens
gaaauaacugccuu

SEQ ID NO: 797201 - RNA, 13 nt, Homo sapiens
gaaauaagccccc

SEQ ID NO: 797202 - RNA, 13 nt, Homo sapiens
gaaauaauguucu

SEQ ID NO: 797203 - RNA, 17 nt, Homo sapiens
gaaauaauuuaguuucu

SEQ ID NO: 797204 - RNA, 17 nt, Homo sapiens
gaaauaccacaagccug

SEQ ID NO: 797205 - RNA, 19 nt, Homo sapiens
gaaauaccacaagccugag

SEQ ID NO: 797206 - RNA, 14 nt, Homo sapiens
gaaauacuacuccu

SEQ ID NO: 797207 - RNA, 16 nt, Homo sapiens
gaaauacucaugugca

SEQ ID NO: 797208 - RNA, 15 nt, Homo sapiens
gaaauagacaguaua

SEQ ID NO: 797209 - RNA, 16 nt, Homo sapiens
gaaauagacaguauau

SEQ ID NO: 797210 - RNA, 20 nt, Homo sapiens
gaaauaggauuuugaaccca

SEQ ID NO: 797211 - RNA, 15 nt, Homo sapiens
gaaauagugacaagu

SEQ ID NO: 797212 - RNA, 18 nt, Homo sapiens
gaaauaguucugugacua

SEQ ID NO: 797213 - RNA, 15 nt, Homo sapiens
gaaauauagugcaau

SEQ ID NO: 797214 - RNA, 23 nt, Homo sapiens
gaaauaucgcugaugcagacaca

SEQ ID NO: 797215 - RNA, 16 nt, Homo sapiens
gaaauauuauuggugu

SEQ ID NO: 797216 - RNA, 17 nt, Homo sapiens
gaaauauuuaaguauau

SEQ ID NO: 797217 - RNA, 20 nt, Homo sapiens
gaaauauuuagaagugcuaa

SEQ ID NO: 797218 - RNA, 16 nt, Homo sapiens
gaaaucaguguuuuag

SEQ ID NO: 797219 - RNA, 22 nt, Homo sapiens
gaaaucaguuucucaaacugag

SEQ ID NO: 797220 - RNA, 21 nt, Homo sapiens
gaaaucauaguuuaaacugca

SEQ ID NO: 797221 - RNA, 22 nt, Homo sapiens
gaaauccuuccuaaacccaaug

SEQ ID NO: 797222 - RNA, 22 nt, Homo sapiens
gaaaucuaccaagcuugcaaga

SEQ ID NO: 797223 - RNA, 13 nt, Homo sapiens
gaaaucuacugaa

SEQ ID NO: 797224 - RNA, 13 nt, Homo sapiens
gaaaucugccaau

SEQ ID NO: 797225 - RNA, 18 nt, Homo sapiens
gaaaucuguaaagccagu

SEQ ID NO: 797226 - RNA, 16 nt, Homo sapiens
gaaaucuuucucccuc

SEQ ID NO: 797227 - RNA, 22 nt, Homo sapiens
gaaaucuuucucccucaacuga

SEQ ID NO: 797228 - RNA, 21 nt, Homo sapiens
gaaaugaaacaaauaaucaca

SEQ ID NO: 797229 - RNA, 15 nt, Homo sapiens
gaaaugaaagggaaa

SEQ ID NO: 797230 - RNA, 22 nt, Homo sapiens
gaaaugaaagggaaacugggaa

SEQ ID NO: 797231 - RNA, 21 nt, Homo sapiens
gaaaugaauuccucauuugga

SEQ ID NO: 797232 - RNA, 17 nt, Homo sapiens
gaaaugccacugggaca

SEQ ID NO: 797233 - RNA, 13 nt, Homo sapiens
gaaaugcucuuuu

SEQ ID NO: 797234 - RNA, 18 nt, Homo sapiens
gaaaugcucuuuugcaca

SEQ ID NO: 797235 - RNA, 13 nt, Homo sapiens
gaaauggaaucag

SEQ ID NO: 797236 - RNA, 20 nt, Homo sapiens
gaaauggauuuaucaucacc

SEQ ID NO: 797237 - RNA, 15 nt, Homo sapiens
gaaaugggcagugaa

SEQ ID NO: 797238 - RNA, 12 nt, Homo sapiens
gaaauguagaau

SEQ ID NO: 797239 - RNA, 14 nt, Homo sapiens
gaaauguaugugcu

SEQ ID NO: 797240 - RNA, 19 nt, Homo sapiens
gaaaugucuggucugucca

SEQ ID NO: 797241 - RNA, 22 nt, Homo sapiens
gaaauguucguuuucuccugcc

SEQ ID NO: 797242 - RNA, 13 nt, Homo sapiens
gaaauuaaccaua

SEQ ID NO: 797243 - RNA, 15 nt, Homo sapiens
gaaauuaagacuuua

SEQ ID NO: 797244 - RNA, 17 nt, Homo sapiens
gaaauuaagacuuuaug

SEQ ID NO: 797245 - RNA, 11 nt, Homo sapiens
gaaauuacuua

SEQ ID NO: 797246 - RNA, 17 nt, Homo sapiens
gaaauuauacuuacuuc

SEQ ID NO: 797247 - RNA, 21 nt, Homo sapiens
gaaauuauggaauacaaaagu

SEQ ID NO: 797248 - RNA, 19 nt, Homo sapiens
gaaauucaggaugcuguga

SEQ ID NO: 797249 - RNA, 19 nt, Homo sapiens
gaaauucucaucaguccau

SEQ ID NO: 797250 - RNA, 18 nt, Homo sapiens
gaaauugauuaaggcuuu

SEQ ID NO: 797251 - RNA, 15 nt, Homo sapiens
gaaauuguaucucag

SEQ ID NO: 797252 - RNA, 15 nt, Homo sapiens
gaaauugucaaagac

SEQ ID NO: 797253 - RNA, 15 nt, Homo sapiens
gaaauugugugugca

SEQ ID NO: 797254 - RNA, 14 nt, Homo sapiens
gaaauuuaaaugac

SEQ ID NO: 797255 - RNA, 16 nt, Homo sapiens
gaaauuuauucacaua

SEQ ID NO: 797256 - RNA, 13 nt, Homo sapiens
gaaauuuggcaaa

SEQ ID NO: 797257 - RNA, 19 nt, Homo sapiens
gaaauuuugccugccauuu

SEQ ID NO: 797258 - RNA, 19 nt, Homo sapiens
gaaauuuuggugaaugugg

SEQ ID NO: 797259 - RNA, 20 nt, Homo sapiens
gaacaaaagaauaacauuuu

SEQ ID NO: 797260 - RNA, 15 nt, Homo sapiens
gaacaaacacugcag

SEQ ID NO: 797261 - RNA, 13 nt, Homo sapiens
gaacaaacagggc

SEQ ID NO: 797262 - RNA, 21 nt, Homo sapiens
gaacaaauguguuuuucuaua

SEQ ID NO: 797263 - RNA, 23 nt, Homo sapiens
gaacaaauucuuuaguacucaau

SEQ ID NO: 797264 - RNA, 15 nt, Homo sapiens
gaacaacauaucuca

SEQ ID NO: 797265 - RNA, 14 nt, Homo sapiens
gaacaacuaccuga

SEQ ID NO: 797266 - RNA, 17 nt, Homo sapiens
gaacaauccauaacuuu

SEQ ID NO: 797267 - RNA, 21 nt, Homo sapiens
gaacaaugaauuauccagcau

SEQ ID NO: 797268 - RNA, 19 nt, Homo sapiens
gaacaaugggaggcuguga

SEQ ID NO: 797269 - RNA, 15 nt, Homo sapiens
gaacaauugaaguaa

SEQ ID NO: 797270 - RNA, 14 nt, Homo sapiens
gaacacacagacuu

SEQ ID NO: 797271 - RNA, 18 nt, Homo sapiens
gaacacacagacuuucug

SEQ ID NO: 797272 - RNA, 15 nt, Homo sapiens
gaacacacaucccag

SEQ ID NO: 797273 - RNA, 12 nt, Homo sapiens
gaacacacuugg

SEQ ID NO: 797274 - RNA, 17 nt, Homo sapiens
gaacacagcaugugcca

SEQ ID NO: 797275 - RNA, 18 nt, Homo sapiens
gaacacagcaugugccaa

SEQ ID NO: 797276 - RNA, 19 nt, Homo sapiens
gaacacagcaugugccaag

SEQ ID NO: 797277 - RNA, 21 nt, Homo sapiens
gaacacaguuuagugcuuuac

SEQ ID NO: 797278 - RNA, 19 nt, Homo sapiens
gaacacccucuaaauggga

SEQ ID NO: 797279 - RNA, 16 nt, Homo sapiens
gaacaccuauugcacu

SEQ ID NO: 797280 - RNA, 19 nt, Homo sapiens
gaacacuaacucaccagcc

SEQ ID NO: 797281 - RNA, 18 nt, Homo sapiens
gaacacucuacuacaugu

SEQ ID NO: 797282 - RNA, 21 nt, Homo sapiens
gaacacuggcaacaacaaagc

SEQ ID NO: 797283 - RNA, 20 nt, Homo sapiens
gaacacugggggaggggaca

SEQ ID NO: 797284 - RNA, 24 nt, Homo sapiens
gaacacuuauguuauacaauacag

SEQ ID NO: 797285 - RNA, 19 nt, Homo sapiens
gaacagaaggaugaaugag

SEQ ID NO: 797286 - RNA, 19 nt, Homo sapiens
gaacagaucaggaauucua

SEQ ID NO: 797287 - RNA, 17 nt, Homo sapiens
gaacagccgcucacaau

SEQ ID NO: 797288 - RNA, 23 nt, Homo sapiens
gaacagcgggagaccugugcuag

SEQ ID NO: 797289 - RNA, 19 nt, Homo sapiens
gaacagcugugucugccaa

SEQ ID NO: 797290 - RNA, 13 nt, Homo sapiens
gaacagguucuua

SEQ ID NO: 797291 - RNA, 15 nt, Homo sapiens
gaacaguaacugcca

SEQ ID NO: 797292 - RNA, 17 nt, Homo sapiens
gaacaguuuuggcauaa

SEQ ID NO: 797293 - RNA, 23 nt, Homo sapiens
gaacauaaaaaauaaaguaccac

SEQ ID NO: 797294 - RNA, 15 nt, Homo sapiens
gaacauauguugcaa

SEQ ID NO: 797295 - RNA, 14 nt, Homo sapiens
gaacauauguuugc

SEQ ID NO: 797296 - RNA, 14 nt, Homo sapiens
gaacaucacauucc

SEQ ID NO: 797297 - RNA, 17 nt, Homo sapiens
gaacauccaaccuuccc

SEQ ID NO: 797298 - RNA, 21 nt, Homo sapiens
gaacaucuaaaagaugaaguu

SEQ ID NO: 797299 - RNA, 16 nt, Homo sapiens
gaacaugcacauuuau

SEQ ID NO: 797300 - RNA, 18 nt, Homo sapiens
gaacaugcuuuuacuuua

SEQ ID NO: 797301 - RNA, 15 nt, Homo sapiens
gaacauuguacuguu

SEQ ID NO: 797302 - RNA, 19 nt, Homo sapiens
gaaccaaaagaauuugcac

SEQ ID NO: 797303 - RNA, 20 nt, Homo sapiens
gaaccaaaucuggaagccaa

SEQ ID NO: 797304 - RNA, 13 nt, Homo sapiens
gaaccaacaucuu

SEQ ID NO: 797305 - RNA, 12 nt, Homo sapiens
gaaccacauauu

SEQ ID NO: 797306 - RNA, 13 nt, Homo sapiens
gaaccacuaugaa

SEQ ID NO: 797307 - RNA, 21 nt, Homo sapiens
gaaccccagcuucccuccagc

SEQ ID NO: 797308 - RNA, 23 nt, Homo sapiens
gaacccgggagguggagauugca

SEQ ID NO: 797309 - RNA, 17 nt, Homo sapiens
gaacccuagcuguguca

SEQ ID NO: 797310 - RNA, 13 nt, Homo sapiens
gaacccugugcug

SEQ ID NO: 797311 - RNA, 19 nt, Homo sapiens
gaacccuguuacacuauua

SEQ ID NO: 797312 - RNA, 16 nt, Homo sapiens
gaacccuuccugagac

SEQ ID NO: 797313 - RNA, 22 nt, Homo sapiens
gaacccuuggagccaauggaga

SEQ ID NO: 797314 - RNA, 13 nt, Homo sapiens
gaaccgcacagcu

SEQ ID NO: 797315 - RNA, 19 nt, Homo sapiens
gaaccucagccuggccaga

SEQ ID NO: 797316 - RNA, 18 nt, Homo sapiens
gaaccucucguaguccau

SEQ ID NO: 797317 - RNA, 21 nt, Homo sapiens
gaaccuggaaaaauuccagaa

SEQ ID NO: 797318 - RNA, 16 nt, Homo sapiens
gaaccuggaacuugga

SEQ ID NO: 797319 - RNA, 22 nt, Homo sapiens
gaaccuggauccagcacuggug

SEQ ID NO: 797320 - RNA, 16 nt, Homo sapiens
gaaccuguccuaagga

SEQ ID NO: 797321 - RNA, 22 nt, Homo sapiens
gaaccuguccuugcacacuccc

SEQ ID NO: 797322 - RNA, 11 nt, Homo sapiens
gaaccuuccau

SEQ ID NO: 797323 - RNA, 22 nt, Homo sapiens
gaaccuucuuaacaucacuguc

SEQ ID NO: 797324 - RNA, 23 nt, Homo sapiens
gaaccuucuuaacaucacugucu

SEQ ID NO: 797325 - RNA, 21 nt, Homo sapiens
gaaccuuuaaaguaaaggccu

SEQ ID NO: 797326 - RNA, 14 nt, Homo sapiens
gaacgaggauuuua

SEQ ID NO: 797327 - RNA, 14 nt, Homo sapiens
gaacgcugccucag

SEQ ID NO: 797328 - RNA, 12 nt, Homo sapiens
gaacgcuuucau

SEQ ID NO: 797329 - RNA, 17 nt, Homo sapiens
gaacuaaacucauuuau

SEQ ID NO: 797330 - RNA, 14 nt, Homo sapiens
gaacuaacugacag

SEQ ID NO: 797331 - RNA, 15 nt, Homo sapiens
gaacuacugcuggaa

SEQ ID NO: 797332 - RNA, 18 nt, Homo sapiens
gaacuagccaaaccagga

SEQ ID NO: 797333 - RNA, 21 nt, Homo sapiens
gaacuauaccugcuucaguga

SEQ ID NO: 797334 - RNA, 15 nt, Homo sapiens
gaacuaugaaaucaa

SEQ ID NO: 797335 - RNA, 14 nt, Homo sapiens
gaacuauguacuuu

SEQ ID NO: 797336 - RNA, 23 nt, Homo sapiens
gaacucaaauggggccagaucca

SEQ ID NO: 797337 - RNA, 14 nt, Homo sapiens
gaacucacuggggc

SEQ ID NO: 797338 - RNA, 22 nt, Homo sapiens
gaacucaguuaaaucuuugaag

SEQ ID NO: 797339 - RNA, 18 nt, Homo sapiens
gaacucaugucuuucuca

SEQ ID NO: 797340 - RNA, 19 nt, Homo sapiens
gaacucaugucuuucucag

SEQ ID NO: 797341 - RNA, 22 nt, Homo sapiens
gaacucauuccugccugucucc

SEQ ID NO: 797342 - RNA, 20 nt, Homo sapiens
gaacuccaccgaccaacugc

SEQ ID NO: 797343 - RNA, 16 nt, Homo sapiens
gagugauugguugcau

SEQ ID NO: 797344 - RNA, 15 nt, Homo sapiens
gagugcaaugaauga

SEQ ID NO: 797345 - RNA, 20 nt, Homo sapiens
gagugcaccacuucaaguga

SEQ ID NO: 797346 - RNA, 16 nt, Homo sapiens
gagugcaguggcgcga

SEQ ID NO: 797347 - RNA, 23 nt, Homo sapiens
gagugcccagaacuggacucagg

SEQ ID NO: 797348 - RNA, 21 nt, Homo sapiens
gagugccguaacaacuguggu

SEQ ID NO: 797349 - RNA, 22 nt, Homo sapiens
gagugccguaacaacugugguc

SEQ ID NO: 797350 - RNA, 20 nt, Homo sapiens
gagugcuuguccccuaagag

SEQ ID NO: 797351 - RNA, 16 nt, Homo sapiens
gaguggaguugaaacu

SEQ ID NO: 797352 - RNA, 15 nt, Homo sapiens
gaguggcccaagacu

SEQ ID NO: 797353 - RNA, 21 nt, Homo sapiens
gaguggcuuggccucaagaga

SEQ ID NO: 797354 - RNA, 16 nt, Homo sapiens
gaguggguuucacaag

SEQ ID NO: 797355 - RNA, 11 nt, Homo sapiens
gaguggugcca

SEQ ID NO: 797356 - RNA, 12 nt, Homo sapiens
gaguguacuuaa

SEQ ID NO: 797357 - RNA, 12 nt, Homo sapiens
gaguguagccua

SEQ ID NO: 797358 - RNA, 13 nt, Homo sapiens
gaguguagcugua

SEQ ID NO: 797359 - RNA, 16 nt, Homo sapiens
gaguguaguaaagccg

SEQ ID NO: 797360 - RNA, 14 nt, Homo sapiens
gagugucacugagc

SEQ ID NO: 797361 - RNA, 19 nt, Homo sapiens
gagugucacugagcugugu

SEQ ID NO: 797362 - RNA, 20 nt, Homo sapiens
gaguguuuuuacauugaucu

SEQ ID NO: 797363 - RNA, 16 nt, Homo sapiens
gaguuaaaacauuucu

SEQ ID NO: 797364 - RNA, 14 nt, Homo sapiens
gaguuaaagaccag

SEQ ID NO: 797365 - RNA, 15 nt, Homo sapiens
gaguucaagccugug

SEQ ID NO: 797366 - RNA, 14 nt, Homo sapiens
gaguucagugcuca

SEQ ID NO: 797367 - RNA, 22 nt, Homo sapiens
gaguuccuauaacacugugaag

SEQ ID NO: 797368 - RNA, 19 nt, Homo sapiens
gaguucgaggcugcaguca

SEQ ID NO: 797369 - RNA, 15 nt, Homo sapiens
gaguucuauccccaa

SEQ ID NO: 797370 - RNA, 22 nt, Homo sapiens
gaguugagucuccucucugaga

SEQ ID NO: 797371 - RNA, 19 nt, Homo sapiens
gaguugaucaaaaucaauu

SEQ ID NO: 797372 - RNA, 16 nt, Homo sapiens
gaguuguacacugugu

SEQ ID NO: 797373 - RNA, 21 nt, Homo sapiens
gaguuuaaauuugagaaucaa

SEQ ID NO: 797374 - RNA, 19 nt, Homo sapiens
gaguuucacaaauccuuca

SEQ ID NO: 797375 - RNA, 18 nt, Homo sapiens
gaguuuccacuaucccaa

SEQ ID NO: 797376 - RNA, 14 nt, Homo sapiens
gaguuucuguucuc

SEQ ID NO: 797377 - RNA, 15 nt, Homo sapiens
gaguuugucauuaua

SEQ ID NO: 797378 - RNA, 22 nt, Homo sapiens
gaguuuuauagccuggacugcu

SEQ ID NO: 797379 - RNA, 13 nt, Homo sapiens
gaguuuucugacc

SEQ ID NO: 797380 - RNA, 16 nt, Homo sapiens
gaguuuuuaaagccuu

SEQ ID NO: 797381 - RNA, 16 nt, Homo sapiens
gauaaaaagauggccu

SEQ ID NO: 797382 - RNA, 16 nt, Homo sapiens
gauaaacauuccuguu

SEQ ID NO: 797383 - RNA, 16 nt, Homo sapiens
gauaaauuccacugga

SEQ ID NO: 797384 - RNA, 18 nt, Homo sapiens
gauaacuaggaaauccau

SEQ ID NO: 797385 - RNA, 16 nt, Homo sapiens
gauaagagaauaccuu

SEQ ID NO: 797386 - RNA, 20 nt, Homo sapiens
gauaaguggccuugacacau

SEQ ID NO: 797387 - RNA, 19 nt, Homo sapiens
gauaaguguucuucagugu

SEQ ID NO: 797388 - RNA, 13 nt, Homo sapiens
gauaaguucauac

SEQ ID NO: 797389 - RNA, 20 nt, Homo sapiens
gauaauaacugucuucugga

SEQ ID NO: 797390 - RNA, 20 nt, Homo sapiens
gauaauagagggcuggaauu

SEQ ID NO: 797391 - RNA, 20 nt, Homo sapiens
gauaauaugaaaaucuccau

SEQ ID NO: 797392 - RNA, 19 nt, Homo sapiens
gauaauauugucugucucu

SEQ ID NO: 797393 - RNA, 17 nt, Homo sapiens
gauaaucaucucuguca

SEQ ID NO: 797394 - RNA, 19 nt, Homo sapiens
gauaaugcuguugccucau

SEQ ID NO: 797395 - RNA, 14 nt, Homo sapiens
gauacaaacugcag

SEQ ID NO: 797396 - RNA, 19 nt, Homo sapiens
gauacacuaaaaaucugag

SEQ ID NO: 797397 - RNA, 19 nt, Homo sapiens
gauacacuaugaagauguu

SEQ ID NO: 797398 - RNA, 16 nt, Homo sapiens
gauacagccugcaagu

SEQ ID NO: 797399 - RNA, 20 nt, Homo sapiens
gauacaugguugugaccuga

SEQ ID NO: 797400 - RNA, 13 nt, Homo sapiens
gauacauguaauu

SEQ ID NO: 797401 - RNA, 20 nt, Homo sapiens
gauacccaaguuauugggau

SEQ ID NO: 797402 - RNA, 20 nt, Homo sapiens
gauacgggggcugugacucu

SEQ ID NO: 797403 - RNA, 20 nt, Homo sapiens
gauacuaacauuuucauuga

SEQ ID NO: 797404 - RNA, 17 nt, Homo sapiens
gauacuaagcacaaagc

SEQ ID NO: 797405 - RNA, 19 nt, Homo sapiens
gauacugcgacuuucugcc

SEQ ID NO: 797406 - RNA, 17 nt, Homo sapiens
gauacuuuccugaaugu

SEQ ID NO: 797407 - RNA, 16 nt, Homo sapiens
gauacuuugacagugu

SEQ ID NO: 797408 - RNA, 16 nt, Homo sapiens
gauagaaagcauuaca

SEQ ID NO: 797409 - RNA, 19 nt, Homo sapiens
gauagaaccaccauaguga

SEQ ID NO: 797410 - RNA, 13 nt, Homo sapiens
gauagaaccugga

SEQ ID NO: 797411 - RNA, 14 nt, Homo sapiens
gauagaaggcuaug

SEQ ID NO: 797412 - RNA, 15 nt, Homo sapiens
gauagagaccaucuu

SEQ ID NO: 797413 - RNA, 19 nt, Homo sapiens
gauagaggaugggcagcug

SEQ ID NO: 797414 - RNA, 15 nt, Homo sapiens
gauagauauaugcuc

SEQ ID NO: 797415 - RNA, 14 nt, Homo sapiens
gauagaugcuggcc

SEQ ID NO: 797416 - RNA, 15 nt, Homo sapiens
gauaguaacaaugaa

SEQ ID NO: 797417 - RNA, 18 nt, Homo sapiens
gauaguacuaagcauuuc

SEQ ID NO: 797418 - RNA, 12 nt, Homo sapiens
gauagucugucc

SEQ ID NO: 797419 - RNA, 20 nt, Homo sapiens
gauauaauuuaacuguguuu

SEQ ID NO: 797420 - RNA, 12 nt, Homo sapiens
gauauaccaaau

SEQ ID NO: 797421 - RNA, 13 nt, Homo sapiens
gauauacuggccc

SEQ ID NO: 797422 - RNA, 22 nt, Homo sapiens
gauauaugcucugcauguuaca

SEQ ID NO: 797423 - RNA, 17 nt, Homo sapiens
gauaucaaaagcaaaua

SEQ ID NO: 797424 - RNA, 12 nt, Homo sapiens
gauaucaccucu

SEQ ID NO: 797425 - RNA, 17 nt, Homo sapiens
gauaucaccucucuuca

SEQ ID NO: 797426 - RNA, 18 nt, Homo sapiens
gauaucaccucucuucag

SEQ ID NO: 797427 - RNA, 18 nt, Homo sapiens
gauaucaccuucuucccc

SEQ ID NO: 797428 - RNA, 15 nt, Homo sapiens
gauaucaugccccug

SEQ ID NO: 797429 - RNA, 23 nt, Homo sapiens
gauaucauucagcaucuacucua

SEQ ID NO: 797430 - RNA, 19 nt, Homo sapiens
gauauccuacuuggcagaa

SEQ ID NO: 797431 - RNA, 12 nt, Homo sapiens
gauaucuacugu

SEQ ID NO: 797432 - RNA, 19 nt, Homo sapiens
gauaugacccacacugcca

SEQ ID NO: 797433 - RNA, 14 nt, Homo sapiens
gauaugcaguaugc

SEQ ID NO: 797434 - RNA, 18 nt, Homo sapiens
gauauuaacaacaauaac

SEQ ID NO: 797435 - RNA, 19 nt, Homo sapiens
gauauuugaagcaucacau

SEQ ID NO: 797436 - RNA, 17 nt, Homo sapiens
gauauuuuuuacuuuag

SEQ ID NO: 797437 - RNA, 19 nt, Homo sapiens
gauauuuuuuauacaguga

SEQ ID NO: 797438 - RNA, 15 nt, Homo sapiens
gaucaagaaugcaau

SEQ ID NO: 797439 - RNA, 19 nt, Homo sapiens
gaucaagguuaacaaagaa

SEQ ID NO: 797440 - RNA, 13 nt, Homo sapiens
gaucaauuacuua

SEQ ID NO: 797441 - RNA, 13 nt, Homo sapiens
gaucaauuguuaa

SEQ ID NO: 797442 - RNA, 14 nt, Homo sapiens
gaucacucucugcu

SEQ ID NO: 797443 - RNA, 14 nt, Homo sapiens
gaucacugaucuug

SEQ ID NO: 797444 - RNA, 12 nt, Homo sapiens
gaucacugccac

SEQ ID NO: 797445 - RNA, 21 nt, Homo sapiens
gaucacuggcuggccugagca

SEQ ID NO: 797446 - RNA, 23 nt, Homo sapiens
gaucacuuguuguuuuacuaaag

SEQ ID NO: 797447 - RNA, 18 nt, Homo sapiens
gaucagagcgcacaggga

SEQ ID NO: 797448 - RNA, 22 nt, Homo sapiens
gaucagcuaccaggcaggauau

SEQ ID NO: 797449 - RNA, 22 nt, Homo sapiens
gaucagcuuucaaagcauuuac

SEQ ID NO: 797450 - RNA, 17 nt, Homo sapiens
gaucaguugaggccagg

SEQ ID NO: 797451 - RNA, 20 nt, Homo sapiens
gaucauaccacggcacucca

SEQ ID NO: 797452 - RNA, 18 nt, Homo sapiens
gaucaucgccagaggugc

SEQ ID NO: 797453 - RNA, 18 nt, Homo sapiens
gaucaucuauguauucaa

SEQ ID NO: 797454 - RNA, 20 nt, Homo sapiens
gaucaucuauguauucaagu

SEQ ID NO: 797455 - RNA, 16 nt, Homo sapiens
gaucauuugagcucau

SEQ ID NO: 797456 - RNA, 18 nt, Homo sapiens
gaucauuuggagcucuug

SEQ ID NO: 797457 - RNA, 19 nt, Homo sapiens
gauccagggaaugaugaca

SEQ ID NO: 797458 - RNA, 21 nt, Homo sapiens
gauccccggggcggcaggaag

SEQ ID NO: 797459 - RNA, 16 nt, Homo sapiens
gaucccuaacuguucc

SEQ ID NO: 797460 - RNA, 12 nt, Homo sapiens
gaucccugacau

SEQ ID NO: 797461 - RNA, 19 nt, Homo sapiens
gauccgggagacugacacg

SEQ ID NO: 797462 - RNA, 19 nt, Homo sapiens
gauccuaagcaucuaaguu

SEQ ID NO: 797463 - RNA, 20 nt, Homo sapiens
gauccucacccgaaucuccu

SEQ ID NO: 797464 - RNA, 15 nt, Homo sapiens
ugcagagaugacugu

SEQ ID NO: 797465 - RNA, 21 nt, Homo sapiens
ugcagagccacagcugugcau

SEQ ID NO: 797466 - RNA, 19 nt, Homo sapiens
ugcagaggaaagacaggac

SEQ ID NO: 797467 - RNA, 19 nt, Homo sapiens
ugcagaggccugggggacc

SEQ ID NO: 797468 - RNA, 15 nt, Homo sapiens
ugcagagugcaacaa

SEQ ID NO: 797469 - RNA, 22 nt, Homo sapiens
ugcagauaugggacugauucug

SEQ ID NO: 797470 - RNA, 23 nt, Homo sapiens
ugcagaugagcagucacacuguu

SEQ ID NO: 797471 - RNA, 20 nt, Homo sapiens
ugcagaugccacccuagcca

SEQ ID NO: 797472 - RNA, 15 nt, Homo sapiens
ugcagcauuuacuau

SEQ ID NO: 797473 - RNA, 16 nt, Homo sapiens
ugcagccaaccaagau

SEQ ID NO: 797474 - RNA, 19 nt, Homo sapiens
ugcagccacuuucugccag

SEQ ID NO: 797475 - RNA, 20 nt, Homo sapiens
ugcagccacuuucugccagc

SEQ ID NO: 797476 - RNA, 13 nt, Homo sapiens
ugcagcucaaggg

SEQ ID NO: 797477 - RNA, 23 nt, Homo sapiens
ugcagcugggccccaugcucugc

SEQ ID NO: 797478 - RNA, 16 nt, Homo sapiens
ugcagcuuuauguuca

SEQ ID NO: 797479 - RNA, 22 nt, Homo sapiens
ugcaggaccuugggcacaucug

SEQ ID NO: 797480 - RNA, 20 nt, Homo sapiens
ugcaggagcuaguucucagc

SEQ ID NO: 797481 - RNA, 19 nt, Homo sapiens
ugcagggaaugcaauccuu

SEQ ID NO: 797482 - RNA, 12 nt, Homo sapiens
ugcagggccauc

SEQ ID NO: 797483 - RNA, 22 nt, Homo sapiens
ugcagguuccgauguuauuaga

SEQ ID NO: 797484 - RNA, 16 nt, Homo sapiens
ugcagguugcauaggu

SEQ ID NO: 797485 - RNA, 13 nt, Homo sapiens
ugcaguacuugau

SEQ ID NO: 797486 - RNA, 17 nt, Homo sapiens
ugcaguagcacgaucuc

SEQ ID NO: 797487 - RNA, 15 nt, Homo sapiens
ugcagucacagcuac

SEQ ID NO: 797488 - RNA, 14 nt, Homo sapiens
ugcagucacauuga

SEQ ID NO: 797489 - RNA, 12 nt, Homo sapiens
ugcagucacugg

SEQ ID NO: 797490 - RNA, 13 nt, Homo sapiens
ugcagucaucucc

SEQ ID NO: 797491 - RNA, 20 nt, Homo sapiens
ugcagugaauuuucauuucu

SEQ ID NO: 797492 - RNA, 13 nt, Homo sapiens
ugcagugagccaa

SEQ ID NO: 797493 - RNA, 16 nt, Homo sapiens
ugcagugagcccagau

SEQ ID NO: 797494 - RNA, 19 nt, Homo sapiens
ugcaguggcccccacagaa

SEQ ID NO: 797495 - RNA, 22 nt, Homo sapiens
ugcaguggcgcgaucucagcuc

SEQ ID NO: 797496 - RNA, 17 nt, Homo sapiens
ugcaguggcgugaucuc

SEQ ID NO: 797497 - RNA, 19 nt, Homo sapiens
ugcaguggcugugccacca

SEQ ID NO: 797498 - RNA, 18 nt, Homo sapiens
ugcaguucagcaccaccc

SEQ ID NO: 797499 - RNA, 21 nt, Homo sapiens
ugcaguucauccgcacuguaa

SEQ ID NO: 797500 - RNA, 17 nt, Homo sapiens
ugcaguugcucaggaca

SEQ ID NO: 797501 - RNA, 17 nt, Homo sapiens
ugcaguuucuuuucaca

SEQ ID NO: 797502 - RNA, 20 nt, Homo sapiens
ugcaguuucuuuucacauua

SEQ ID NO: 797503 - RNA, 19 nt, Homo sapiens
ugcauacuuugacaaggaa

SEQ ID NO: 797504 - RNA, 17 nt, Homo sapiens
ugcauagcaagugaaag

SEQ ID NO: 797505 - RNA, 21 nt, Homo sapiens
ugcauagcagaugguuuccac

SEQ ID NO: 797506 - RNA, 13 nt, Homo sapiens
ugcauagcucuau

SEQ ID NO: 797507 - RNA, 15 nt, Homo sapiens
ugcauagcuuugcac

SEQ ID NO: 797508 - RNA, 19 nt, Homo sapiens
ugcauagcuuugcacuuca

SEQ ID NO: 797509 - RNA, 20 nt, Homo sapiens
ugcauagcuuugcacuucaa

SEQ ID NO: 797510 - RNA, 18 nt, Homo sapiens
ugcauauguaaagcacau

SEQ ID NO: 797511 - RNA, 21 nt, Homo sapiens
ugcaucacggauggugcaugg

SEQ ID NO: 797512 - RNA, 19 nt, Homo sapiens
ugcaucacucauggaacac

SEQ ID NO: 797513 - RNA, 15 nt, Homo sapiens
ugcaucauccuugca

SEQ ID NO: 797514 - RNA, 19 nt, Homo sapiens
ugcauccagccuccugcua

SEQ ID NO: 797515 - RNA, 14 nt, Homo sapiens
ugcauccaugggca

SEQ ID NO: 797516 - RNA, 17 nt, Homo sapiens
ugcaucucaaaauuauu

SEQ ID NO: 797517 - RNA, 16 nt, Homo sapiens
ugcaucuuugccucaa

SEQ ID NO: 797518 - RNA, 16 nt, Homo sapiens
ugcaugauaucuucaa

SEQ ID NO: 797519 - RNA, 21 nt, Homo sapiens
ugcaugcaaaauauacacuca

SEQ ID NO: 797520 - RNA, 14 nt, Homo sapiens
ugcauggcuccaga

SEQ ID NO: 797521 - RNA, 15 nt, Homo sapiens
ugcauggggaggcac

SEQ ID NO: 797522 - RNA, 19 nt, Homo sapiens
ugcauguaccauuugcaug

SEQ ID NO: 797523 - RNA, 21 nt, Homo sapiens
ugcauguauuuauccaauaaa

SEQ ID NO: 797524 - RNA, 14 nt, Homo sapiens
ugcaugucuacuca

SEQ ID NO: 797525 - RNA, 14 nt, Homo sapiens
ugcauuauugacga

SEQ ID NO: 797526 - RNA, 16 nt, Homo sapiens
ugcauucacccagaca

SEQ ID NO: 797527 - RNA, 23 nt, Homo sapiens
ugcauugccuguaacaauguaau

SEQ ID NO: 797528 - RNA, 17 nt, Homo sapiens
ugcauugucuaaugaca

SEQ ID NO: 797529 - RNA, 22 nt, Homo sapiens
ugcauuuaaaauaccacuguaa

SEQ ID NO: 797530 - RNA, 11 nt, Homo sapiens
ugcauuuacuu

SEQ ID NO: 797531 - RNA, 20 nt, Homo sapiens
ugcauuuauggucaacacuu

SEQ ID NO: 797532 - RNA, 19 nt, Homo sapiens
ugcauuuauuauucucaaa

SEQ ID NO: 797533 - RNA, 16 nt, Homo sapiens
ugcauuuccuuucuac

SEQ ID NO: 797534 - RNA, 19 nt, Homo sapiens
ugcauuuguaauucaugaa

SEQ ID NO: 797535 - RNA, 21 nt, Homo sapiens
ugcauuugugguaaucuacac

SEQ ID NO: 797536 - RNA, 10 nt, Homo sapiens
ugccaaaaau

SEQ ID NO: 797537 - RNA, 20 nt, Homo sapiens
ugccaaaauccaaggcaauu

SEQ ID NO: 797538 - RNA, 20 nt, Homo sapiens
ugccaaacacauuuacccuu

SEQ ID NO: 797539 - RNA, 17 nt, Homo sapiens
ugccaaccuguucuuag

SEQ ID NO: 797540 - RNA, 13 nt, Homo sapiens
ugccaacugccag

SEQ ID NO: 797541 - RNA, 17 nt, Homo sapiens
ugccaagcagugcacau

SEQ ID NO: 797542 - RNA, 21 nt, Homo sapiens
ugccaagggggugacuggaag

SEQ ID NO: 797543 - RNA, 19 nt, Homo sapiens
ugccaagggguuaaugaaa

SEQ ID NO: 797544 - RNA, 21 nt, Homo sapiens
ugccacaaauuguauggugau

SEQ ID NO: 797545 - RNA, 19 nt, Homo sapiens
ugccacacccuccccauuc

SEQ ID NO: 797546 - RNA, 23 nt, Homo sapiens
ugccacagcuuuugcaacuuaau

SEQ ID NO: 797547 - RNA, 18 nt, Homo sapiens
ccugccucauccaccaau

SEQ ID NO: 797548 - RNA, 14 nt, Homo sapiens
ccugccuccugcca

SEQ ID NO: 797549 - RNA, 22 nt, Homo sapiens
ccugccuuuuaacguagauaua

SEQ ID NO: 797550 - RNA, 20 nt, Homo sapiens
ccugcgccuccagagguccu

SEQ ID NO: 797551 - RNA, 19 nt, Homo sapiens
ccugcgcgucaucucugac

SEQ ID NO: 797552 - RNA, 23 nt, Homo sapiens
ccugcgggcgcgggcagccaccc

SEQ ID NO: 797553 - RNA, 13 nt, Homo sapiens
ccugcuaaggagu

SEQ ID NO: 797554 - RNA, 21 nt, Homo sapiens
ccugcucagcagccagucuca

SEQ ID NO: 797555 - RNA, 20 nt, Homo sapiens
ccugcucagcccugcaccau

SEQ ID NO: 797556 - RNA, 15 nt, Homo sapiens
ccugcucuaacaccu

SEQ ID NO: 797557 - RNA, 13 nt, Homo sapiens
ccugcucuugcag

SEQ ID NO: 797558 - RNA, 16 nt, Homo sapiens
ccugcuggaucuugcc

SEQ ID NO: 797559 - RNA, 16 nt, Homo sapiens
ccugcuggggaccuug

SEQ ID NO: 797560 - RNA, 15 nt, Homo sapiens
ccugcuugcacacuu

SEQ ID NO: 797561 - RNA, 16 nt, Homo sapiens
ccuggaacccauguca

SEQ ID NO: 797562 - RNA, 20 nt, Homo sapiens
ccuggaaucaagaugucaga

SEQ ID NO: 797563 - RNA, 16 nt, Homo sapiens
ccuggacaaggucucu

SEQ ID NO: 797564 - RNA, 16 nt, Homo sapiens
ccuggacacucagacc

SEQ ID NO: 797565 - RNA, 14 nt, Homo sapiens
ccuggacacuguac

SEQ ID NO: 797566 - RNA, 14 nt, Homo sapiens
ccuggacagugacg

SEQ ID NO: 797567 - RNA, 16 nt, Homo sapiens
ccuggacgaagagcag

SEQ ID NO: 797568 - RNA, 17 nt, Homo sapiens
ccuggagacaaggugcu

SEQ ID NO: 797569 - RNA, 18 nt, Homo sapiens
ccuggagacaaggugcua

SEQ ID NO: 797570 - RNA, 14 nt, Homo sapiens
ccuggagauccucc

SEQ ID NO: 797571 - RNA, 20 nt, Homo sapiens
ccuggagcauggacagugug

SEQ ID NO: 797572 - RNA, 22 nt, Homo sapiens
ccuggaguguaugacugcacau

SEQ ID NO: 797573 - RNA, 12 nt, Homo sapiens
ccuggauaggca

SEQ ID NO: 797574 - RNA, 16 nt, Homo sapiens
ccuggauccagcacug

SEQ ID NO: 797575 - RNA, 19 nt, Homo sapiens
ccuggaucuccucaagucc

SEQ ID NO: 797576 - RNA, 13 nt, Homo sapiens
ccuggaugagaaa

SEQ ID NO: 797577 - RNA, 13 nt, Homo sapiens
ccuggaugugaau

SEQ ID NO: 797578 - RNA, 13 nt, Homo sapiens
ccuggauguugcu

SEQ ID NO: 797579 - RNA, 16 nt, Homo sapiens
ugccaguuucccaaaa

SEQ ID NO: 797580 - RNA, 23 nt, Homo sapiens
ugccaucaagaugagagaacugg

SEQ ID NO: 797581 - RNA, 20 nt, Homo sapiens
ugccaucaccacggcucacu

SEQ ID NO: 797582 - RNA, 20 nt, Homo sapiens
ugccauccucacccagcacc

SEQ ID NO: 797583 - RNA, 23 nt, Homo sapiens
ugccauccucccaaggggcccaa

SEQ ID NO: 797584 - RNA, 22 nt, Homo sapiens
ugccaucuguacauauuacugu

SEQ ID NO: 797585 - RNA, 12 nt, Homo sapiens
ugccaucuucag

SEQ ID NO: 797586 - RNA, 13 nt, Homo sapiens
ugccaucuuuauc

SEQ ID NO: 797587 - RNA, 15 nt, Homo sapiens
ugccaugcucagaaa

SEQ ID NO: 797588 - RNA, 23 nt, Homo sapiens
ugccauggaggcaugccaaaugu

SEQ ID NO: 797589 - RNA, 15 nt, Homo sapiens
ugccauggaucugau

SEQ ID NO: 797590 - RNA, 14 nt, Homo sapiens
ugccauuacauugc

SEQ ID NO: 797591 - RNA, 17 nt, Homo sapiens
ugccauucucuugcauu

SEQ ID NO: 797592 - RNA, 17 nt, Homo sapiens
ugccauuucugaacugu

SEQ ID NO: 797593 - RNA, 23 nt, Homo sapiens
ugccauuuucagaaucaucuuuu

SEQ ID NO: 797594 - RNA, 15 nt, Homo sapiens
ugcccaaaucuuuag

SEQ ID NO: 797595 - RNA, 21 nt, Homo sapiens
ugcccacauguguccauccca

SEQ ID NO: 797596 - RNA, 23 nt, Homo sapiens
ugcccacccagggaaggugcuga

SEQ ID NO: 797597 - RNA, 18 nt, Homo sapiens
ugcccacccgucuucaau

SEQ ID NO: 797598 - RNA, 14 nt, Homo sapiens
ugcccaccugugau

SEQ ID NO: 797599 - RNA, 15 nt, Homo sapiens
ugcccagacuacagg

SEQ ID NO: 797600 - RNA, 20 nt, Homo sapiens
ugcccagggcucagccuggu

SEQ ID NO: 797601 - RNA, 16 nt, Homo sapiens
ugcccaguacauuuaa

SEQ ID NO: 797602 - RNA, 22 nt, Homo sapiens
ugcccagucgaccccaaaggaa

SEQ ID NO: 797603 - RNA, 14 nt, Homo sapiens
ugcccagugugagg

SEQ ID NO: 797604 - RNA, 14 nt, Homo sapiens
ugcccaguguucuc

SEQ ID NO: 797605 - RNA, 13 nt, Homo sapiens
ugcccaucagggc

SEQ ID NO: 797606 - RNA, 18 nt, Homo sapiens
ugcccauccugacugaaa

SEQ ID NO: 797607 - RNA, 20 nt, Homo sapiens
ugccccaaacaaauaugcaa

SEQ ID NO: 797608 - RNA, 23 nt, Homo sapiens
ugccccaccccaccucacagcua

SEQ ID NO: 797609 - RNA, 16 nt, Homo sapiens
ugccccaccccaucca

SEQ ID NO: 797610 - RNA, 14 nt, Homo sapiens
ugccccaccuuuau

SEQ ID NO: 797611 - RNA, 19 nt, Homo sapiens
ugccccaucauugcaccug

SEQ ID NO: 797612 - RNA, 14 nt, Homo sapiens
ugcccccauuucac

SEQ ID NO: 797613 - RNA, 17 nt, Homo sapiens
ugccccccaugaggaag

SEQ ID NO: 797614 - RNA, 13 nt, Homo sapiens
ugcccccuuucag

SEQ ID NO: 797615 - RNA, 22 nt, Homo sapiens
ugccccuccccuccccguguaa

SEQ ID NO: 797616 - RNA, 12 nt, Homo sapiens
ugccccugccuu

SEQ ID NO: 797617 - RNA, 20 nt, Homo sapiens
ugcccgagagagcucuggcc

SEQ ID NO: 797618 - RNA, 15 nt, Homo sapiens
ugcccggcugugauu

SEQ ID NO: 797619 - RNA, 15 nt, Homo sapiens
ugcccguauccagag

SEQ ID NO: 797620 - RNA, 13 nt, Homo sapiens
ugcccuaaccuga

SEQ ID NO: 797621 - RNA, 21 nt, Homo sapiens
ugcccuccacuccacugccuu

SEQ ID NO: 797622 - RNA, 9 nt, Homo sapiens
ugcccuccc

SEQ ID NO: 797623 - RNA, 17 nt, Homo sapiens
ugcccucccgcaccuuc

SEQ ID NO: 797624 - RNA, 11 nt, Homo sapiens
ugcccucucag

SEQ ID NO: 797625 - RNA, 17 nt, Homo sapiens
ugcccucucccaaaaaa

SEQ ID NO: 797626 - RNA, 15 nt, Homo sapiens
ugcccuggcugugau

SEQ ID NO: 797627 - RNA, 18 nt, Homo sapiens
ugcccuggcugugaugag

SEQ ID NO: 797628 - RNA, 17 nt, Homo sapiens
ugcccuguaaccugacu

SEQ ID NO: 797629 - RNA, 21 nt, Homo sapiens
ugcccuuggagcugccgugcc

SEQ ID NO: 797630 - RNA, 20 nt, Homo sapiens
ugcccuugggguaagccaga

SEQ ID NO: 797631 - RNA, 11 nt, Homo sapiens
ugcccuuugag

SEQ ID NO: 797632 - RNA, 13 nt, Homo sapiens
ugccgcaccagcc

SEQ ID NO: 797633 - RNA, 14 nt, Homo sapiens
ugccgccagcugcc

SEQ ID NO: 797634 - RNA, 15 nt, Homo sapiens
ugccgcugucucuga

SEQ ID NO: 797635 - RNA, 22 nt, Homo sapiens
ugccggaggaaaagcagcucaa

SEQ ID NO: 797636 - RNA, 14 nt, Homo sapiens
ugccggaucugggc

SEQ ID NO: 797637 - RNA, 17 nt, Homo sapiens
ugccuaaaucccaagaa

SEQ ID NO: 797638 - RNA, 20 nt, Homo sapiens
ugccuaaauuuaaugcugcc

SEQ ID NO: 797639 - RNA, 22 nt, Homo sapiens
ugccuaaggugucugaguuucu

SEQ ID NO: 797640 - RNA, 16 nt, Homo sapiens
ugccuacacacacagc

SEQ ID NO: 797641 - RNA, 16 nt, Homo sapiens
ugccuagacuguuacu

SEQ ID NO: 797642 - RNA, 20 nt, Homo sapiens
ugccuagaguguagccuaaa

SEQ ID NO: 797643 - RNA, 17 nt, Homo sapiens
ugccuaucugaccaaac

SEQ ID NO: 797644 - RNA, 18 nt, Homo sapiens
ugccuauuuguguggaca

SEQ ID NO: 797645 - RNA, 13 nt, Homo sapiens
ugccucaagacua

SEQ ID NO: 797646 - RNA, 20 nt, Homo sapiens
ugccucaagccccagagugg

SEQ ID NO: 797647 - RNA, 23 nt, Homo sapiens
ugccucaccuaauaggcugggag

SEQ ID NO: 797648 - RNA, 18 nt, Homo sapiens
ugccucagccaguggcac

SEQ ID NO: 797649 - RNA, 22 nt, Homo sapiens
ugccucagccucccaauuagcu

SEQ ID NO: 797650 - RNA, 20 nt, Homo sapiens
ugccucagggcccaccggaa

SEQ ID NO: 797651 - RNA, 14 nt, Homo sapiens
ugccuccaccagca

SEQ ID NO: 797652 - RNA, 14 nt, Homo sapiens
ugccucccaaagug

SEQ ID NO: 797653 - RNA, 19 nt, Homo sapiens
ugccucccagguuccagca

SEQ ID NO: 797654 - RNA, 18 nt, Homo sapiens
ugccucccuccccagugc

SEQ ID NO: 797655 - RNA, 20 nt, Homo sapiens
ugccuccucagaggacaguu

SEQ ID NO: 797656 - RNA, 19 nt, Homo sapiens
ugccuccugaugggacaua

SEQ ID NO: 797657 - RNA, 16 nt, Homo sapiens
ugccuccugccugccc

SEQ ID NO: 797658 - RNA, 22 nt, Homo sapiens
ugccucuacuuugauucugaua

SEQ ID NO: 797659 - RNA, 17 nt, Homo sapiens
ugccucugaaaugccuc

SEQ ID NO: 797660 - RNA, 15 nt, Homo sapiens
ugccucuguauuuaa

SEQ ID NO: 797661 - RNA, 20 nt, Homo sapiens
ugccugauccuccaacagcu

SEQ ID NO: 797662 - RNA, 15 nt, Homo sapiens
ccugugucaucccau

SEQ ID NO: 797663 - RNA, 20 nt, Homo sapiens
ccuguguguccaaaacugcc

SEQ ID NO: 797664 - RNA, 21 nt, Homo sapiens
ccuguguguccaaaacugccu

SEQ ID NO: 797665 - RNA, 23 nt, Homo sapiens
ccuguuaccuacuuugacuuuuu

SEQ ID NO: 797666 - RNA, 13 nt, Homo sapiens
ccuguuacuuuac

SEQ ID NO: 797667 - RNA, 19 nt, Homo sapiens
ccuguucaaagaugcauuu

SEQ ID NO: 797668 - RNA, 22 nt, Homo sapiens
ccuguuccccaaggacucuucc

SEQ ID NO: 797669 - RNA, 15 nt, Homo sapiens
ccuuaaaccuaccuc

SEQ ID NO: 797670 - RNA, 12 nt, Homo sapiens
ccuuaaccuuaa

SEQ ID NO: 797671 - RNA, 20 nt, Homo sapiens
ccuuaacucaucuguuaucc

SEQ ID NO: 797672 - RNA, 15 nt, Homo sapiens
ccuuaagacagagua

SEQ ID NO: 797673 - RNA, 19 nt, Homo sapiens
ccuuaagacagaguauccu

SEQ ID NO: 797674 - RNA, 19 nt, Homo sapiens
ccuuaagagucauccagcu

SEQ ID NO: 797675 - RNA, 21 nt, Homo sapiens
ccuuaagcagaacaaaugugu

SEQ ID NO: 797676 - RNA, 20 nt, Homo sapiens
ccuuaaggauaucaguaaau

SEQ ID NO: 797677 - RNA, 21 nt, Homo sapiens
ccuuaagggacaacauccuua

SEQ ID NO: 797678 - RNA, 19 nt, Homo sapiens
ccuuaauucacucccacac

SEQ ID NO: 797679 - RNA, 15 nt, Homo sapiens
ccuuacuaugaucuc

SEQ ID NO: 797680 - RNA, 16 nt, Homo sapiens
ccuuacucugccagag

SEQ ID NO: 797681 - RNA, 15 nt, Homo sapiens
ccuuagcuggcauua

SEQ ID NO: 797682 - RNA, 18 nt, Homo sapiens
ccuuagcuuagaccucag

SEQ ID NO: 797683 - RNA, 12 nt, Homo sapiens
ccuuauggagcu

SEQ ID NO: 797684 - RNA, 22 nt, Homo sapiens
ccuuauggccaauaacuuuuca

SEQ ID NO: 797685 - RNA, 14 nt, Homo sapiens
ccuuauuugucugu

SEQ ID NO: 797686 - RNA, 14 nt, Homo sapiens
ccuucagacuggcc

SEQ ID NO: 797687 - RNA, 18 nt, Homo sapiens
ccuucaguuuauuuccac

SEQ ID NO: 797688 - RNA, 19 nt, Homo sapiens
ccuucaucuucacugcaau

SEQ ID NO: 797689 - RNA, 20 nt, Homo sapiens
ccuucauuaaugaugaucuu

SEQ ID NO: 797690 - RNA, 22 nt, Homo sapiens
ccuuccaacccauuagccauuu

SEQ ID NO: 797691 - RNA, 18 nt, Homo sapiens
ccuuccagaucacugcca

SEQ ID NO: 797692 - RNA, 17 nt, Homo sapiens
ccuuccagcuccuguaa

SEQ ID NO: 797693 - RNA, 18 nt, Homo sapiens
ugccuuucugguggcuuu

SEQ ID NO: 797694 - RNA, 20 nt, Homo sapiens
ugccuuuugcaccccuccca

SEQ ID NO: 797695 - RNA, 23 nt, Homo sapiens
ugccuuuuuauuuauauguacug

SEQ ID NO: 797696 - RNA, 19 nt, Homo sapiens
ugcgaaacgggggaaggga

SEQ ID NO: 797697 - RNA, 21 nt, Homo sapiens
ugcgaaacgggggaagggagc

SEQ ID NO: 797698 - RNA, 18 nt, Homo sapiens
ugcgaaaguaaaaacacu

SEQ ID NO: 797699 - RNA, 13 nt, Homo sapiens
ugcgaaauccaga

SEQ ID NO: 797700 - RNA, 13 nt, Homo sapiens
ugcgacccaagac

SEQ ID NO: 797701 - RNA, 21 nt, Homo sapiens
ugcgacccugggggcacagga

SEQ ID NO: 797702 - RNA, 15 nt, Homo sapiens
ugcgaggacaucaaa

SEQ ID NO: 797703 - RNA, 19 nt, Homo sapiens
ugcgcacaaggcugaccaa

SEQ ID NO: 797704 - RNA, 13 nt, Homo sapiens
ugcgcacaccgcc

SEQ ID NO: 797705 - RNA, 12 nt, Homo sapiens
ugcgcacugugu

SEQ ID NO: 797706 - RNA, 15 nt, Homo sapiens
ugcgccauugcacuc

SEQ ID NO: 797707 - RNA, 14 nt, Homo sapiens
ugcgccgggggacc

SEQ ID NO: 797708 - RNA, 23 nt, Homo sapiens
ugcgccgggggaccuggggacuc

SEQ ID NO: 797709 - RNA, 14 nt, Homo sapiens
ugcgcgucaucucu

SEQ ID NO: 797710 - RNA, 13 nt, Homo sapiens
ugcgcuguguaca

SEQ ID NO: 797711 - RNA, 19 nt, Homo sapiens
ugcgcuguguacaauguga

SEQ ID NO: 797712 - RNA, 11 nt, Homo sapiens
ugcggacauca

SEQ ID NO: 797713 - RNA, 16 nt, Homo sapiens
ugcggauggauggaag

SEQ ID NO: 797714 - RNA, 22 nt, Homo sapiens
ugcggugccuccucuugacuuc

SEQ ID NO: 797715 - RNA, 14 nt, Homo sapiens
ugcguggacucugc

SEQ ID NO: 797716 - RNA, 17 nt, Homo sapiens
ugcgugguauaaucucc

SEQ ID NO: 797717 - RNA, 13 nt, Homo sapiens
ugcguguguuugg

SEQ ID NO: 797718 - RNA, 21 nt, Homo sapiens
ugcuaaagaaaggaacuaagu

SEQ ID NO: 797719 - RNA, 22 nt, Homo sapiens
ugcuaaagcacuuugcacuuaa

SEQ ID NO: 797720 - RNA, 20 nt, Homo sapiens
ugcuaacauaaaauccaaua

SEQ ID NO: 797721 - RNA, 15 nt, Homo sapiens
ugcuaacuggguuaa

SEQ ID NO: 797722 - RNA, 14 nt, Homo sapiens
ugcuaacugguuaa

SEQ ID NO: 797723 - RNA, 22 nt, Homo sapiens
ugcuaagaagcgagcacugacc

SEQ ID NO: 797724 - RNA, 16 nt, Homo sapiens
ugcuaaggaguucuca

SEQ ID NO: 797725 - RNA, 17 nt, Homo sapiens
ugcuaaggcuccuccuu

SEQ ID NO: 797726 - RNA, 15 nt, Homo sapiens
ugcuaaguauuuccc

SEQ ID NO: 797727 - RNA, 18 nt, Homo sapiens
ugcuaagugcuuauuaca

SEQ ID NO: 797728 - RNA, 23 nt, Homo sapiens
ugcuaauaugaacagaaaugcau

SEQ ID NO: 797729 - RNA, 20 nt, Homo sapiens
ugcuaaugcaauuagcauua

SEQ ID NO: 797730 - RNA, 15 nt, Homo sapiens
ugcuaaugugugaug

SEQ ID NO: 797731 - RNA, 15 nt, Homo sapiens
ugcuaauucaaagcu

SEQ ID NO: 797732 - RNA, 17 nt, Homo sapiens
ugcuaauucaaagcucu

SEQ ID NO: 797733 - RNA, 18 nt, Homo sapiens
ugcuacaaaaacacagca

SEQ ID NO: 797734 - RNA, 15 nt, Homo sapiens
ugcuacaacauguga

SEQ ID NO: 797735 - RNA, 14 nt, Homo sapiens
ugcuacauacucca

SEQ ID NO: 797736 - RNA, 18 nt, Homo sapiens
ugcuacauucuaaugcau

SEQ ID NO: 797737 - RNA, 18 nt, Homo sapiens
ugcuaccacagcaacuau

SEQ ID NO: 797738 - RNA, 17 nt, Homo sapiens
ugcuaccaggaugcuaa

SEQ ID NO: 797739 - RNA, 14 nt, Homo sapiens
ugcuaccccuuuga

SEQ ID NO: 797740 - RNA, 20 nt, Homo sapiens
ugcuacccugaguucaucca

SEQ ID NO: 797741 - RNA, 22 nt, Homo sapiens
ugcuacuucacugucaucuuca

SEQ ID NO: 797742 - RNA, 18 nt, Homo sapiens
ugcuagaaaaauguucuu

SEQ ID NO: 797743 - RNA, 20 nt, Homo sapiens
ugcuagacaagcuuguccau

SEQ ID NO: 797744 - RNA, 17 nt, Homo sapiens
ugcuagacacacuccau

SEQ ID NO: 797745 - RNA, 14 nt, Homo sapiens
ugcuagacagccag

SEQ ID NO: 797746 - RNA, 19 nt, Homo sapiens
ugcuagacucuagacaaga

SEQ ID NO: 797747 - RNA, 17 nt, Homo sapiens
ugcuagagguugcagca

SEQ ID NO: 797748 - RNA, 22 nt, Homo sapiens
ugcuagcaaauggcagaaccaa

SEQ ID NO: 797749 - RNA, 22 nt, Homo sapiens
ugcuaggcugucugcgaagaag

SEQ ID NO: 797750 - RNA, 21 nt, Homo sapiens
ugcuauaaaugccagagccaa

SEQ ID NO: 797751 - RNA, 17 nt, Homo sapiens
ugcuauacacacacaca

SEQ ID NO: 797752 - RNA, 13 nt, Homo sapiens
ugcuauauccucu

SEQ ID NO: 797753 - RNA, 16 nt, Homo sapiens
ugcuauccccaucucc

SEQ ID NO: 797754 - RNA, 22 nt, Homo sapiens
ugcuaucuggaggccuuccagc

SEQ ID NO: 797755 - RNA, 16 nt, Homo sapiens
ugcuaugaaugauacc

SEQ ID NO: 797756 - RNA, 14 nt, Homo sapiens
ugcuaugaccauga

SEQ ID NO: 797757 - RNA, 16 nt, Homo sapiens
ugcuauugacaaguca

SEQ ID NO: 797758 - RNA, 16 nt, Homo sapiens
ugcucaaccacugugg

SEQ ID NO: 797759 - RNA, 18 nt, Homo sapiens
ugcucaagguuacuggga

SEQ ID NO: 797760 - RNA, 17 nt, Homo sapiens
ugcucacacauuacaac

SEQ ID NO: 797761 - RNA, 15 nt, Homo sapiens
ugcucaccugaggau

SEQ ID NO: 797762 - RNA, 19 nt, Homo sapiens
ugcucagcagccagucuca

SEQ ID NO: 797763 - RNA, 22 nt, Homo sapiens
ugcucagcccugcaccaugcug

SEQ ID NO: 797764 - RNA, 21 nt, Homo sapiens
ugcucagcgcuuaaaaaaaca

SEQ ID NO: 797765 - RNA, 14 nt, Homo sapiens
ugcucaguguuuca

SEQ ID NO: 797766 - RNA, 16 nt, Homo sapiens
ugcucauauugugauu

SEQ ID NO: 797767 - RNA, 17 nt, Homo sapiens
ugcucauauugugauuc

SEQ ID NO: 797768 - RNA, 22 nt, Homo sapiens
ugcuccaacccccgccaccuca

SEQ ID NO: 797769 - RNA, 23 nt, Homo sapiens
ugcuccaacccccgccaccucag

SEQ ID NO: 797770 - RNA, 12 nt, Homo sapiens
ugcuccaccagc

SEQ ID NO: 797771 - RNA, 21 nt, Homo sapiens
ugcuccagcaacugcccuucc

SEQ ID NO: 797772 - RNA, 17 nt, Homo sapiens
ugcuccaggaucuuuga

SEQ ID NO: 797773 - RNA, 17 nt, Homo sapiens
ugcuccauuaauccagg

SEQ ID NO: 797774 - RNA, 19 nt, Homo sapiens
ugcuccccacccgccuccc

SEQ ID NO: 797775 - RNA, 20 nt, Homo sapiens
ugcuccguaugccaagagga

SEQ ID NO: 797776 - RNA, 19 nt, Homo sapiens
ccuuucuugcagauucuau

SEQ ID NO: 797777 - RNA, 23 nt, Homo sapiens
ccuuucuuuuaaugaugccaugg

SEQ ID NO: 797778 - RNA, 21 nt, Homo sapiens
ccuuugcaguuggacucucag

SEQ ID NO: 797779 - RNA, 12 nt, Homo sapiens
ccuuugccagug

SEQ ID NO: 797780 - RNA, 13 nt, Homo sapiens
ccuuugccuucca

SEQ ID NO: 797781 - RNA, 21 nt, Homo sapiens
ccuuugcucuugggaagacca

SEQ ID NO: 797782 - RNA, 16 nt, Homo sapiens
ccuuugcuucaaauaa

SEQ ID NO: 797783 - RNA, 22 nt, Homo sapiens
ccuuuggauugacucugcauuu

SEQ ID NO: 797784 - RNA, 18 nt, Homo sapiens
ccuuuggccccacuuuga

SEQ ID NO: 797785 - RNA, 14 nt, Homo sapiens
ccuuuggcuucuga

SEQ ID NO: 797786 - RNA, 21 nt, Homo sapiens
ccuuuguacgcuuugcucaaa

SEQ ID NO: 797787 - RNA, 18 nt, Homo sapiens
ccuuugugguuacaguuu

SEQ ID NO: 797788 - RNA, 18 nt, Homo sapiens
ccuuugugugugugguuc

SEQ ID NO: 797789 - RNA, 19 nt, Homo sapiens
ccuuuguugucuacauuaa

SEQ ID NO: 797790 - RNA, 13 nt, Homo sapiens
ccuuuuacauacu

SEQ ID NO: 797791 - RNA, 14 nt, Homo sapiens
ccuuuucaugauuu

SEQ ID NO: 797792 - RNA, 21 nt, Homo sapiens
ccuuuuccuuauuugccuucu

SEQ ID NO: 797793 - RNA, 11 nt, Homo sapiens
ccuuuugcaac

SEQ ID NO: 797794 - RNA, 17 nt, Homo sapiens
ccuuuugcaaccaggaa

SEQ ID NO: 797795 - RNA, 22 nt, Homo sapiens
ccuuuugcacauaacaugcuuu

SEQ ID NO: 797796 - RNA, 16 nt, Homo sapiens
ccuuuuggcacugaga

SEQ ID NO: 797797 - RNA, 13 nt, Homo sapiens
ccuuuugggcuca

SEQ ID NO: 797798 - RNA, 21 nt, Homo sapiens
ccuuuugggcucaaagcccuu

SEQ ID NO: 797799 - RNA, 15 nt, Homo sapiens
ccuuuuucacuuuga

SEQ ID NO: 797800 - RNA, 18 nt, Homo sapiens
ccuuuuucccuucccucc

SEQ ID NO: 797801 - RNA, 14 nt, Homo sapiens
ccuuuuuguacuga

SEQ ID NO: 797802 - RNA, 17 nt, Homo sapiens
ccuuuuuuauacaggaa

SEQ ID NO: 797803 - RNA, 23 nt, Homo sapiens
ccuuuuuucaaaauccaaaaaga

SEQ ID NO: 797804 - RNA, 16 nt, Homo sapiens
ccuuuuuugcaugugc

SEQ ID NO: 797805 - RNA, 20 nt, Homo sapiens
cgaaaccccaucucuacuaa

SEQ ID NO: 797806 - RNA, 19 nt, Homo sapiens
cgaaacgggggaagggagc

SEQ ID NO: 797807 - RNA, 17 nt, Homo sapiens
ugcugaguuucuguucu

SEQ ID NO: 797808 - RNA, 14 nt, Homo sapiens
ugcugaugaucaaa

SEQ ID NO: 797809 - RNA, 17 nt, Homo sapiens
ugcugcaccccaugugg

SEQ ID NO: 797810 - RNA, 17 nt, Homo sapiens
ugcugcaccuggucaua

SEQ ID NO: 797811 - RNA, 19 nt, Homo sapiens
ugcugcaucccugugucca

SEQ ID NO: 797812 - RNA, 21 nt, Homo sapiens
ugcugccagccacuucauccc

SEQ ID NO: 797813 - RNA, 14 nt, Homo sapiens
ugcugccauccuca

SEQ ID NO: 797814 - RNA, 18 nt, Homo sapiens
ugcugcccgcucugcaga

SEQ ID NO: 797815 - RNA, 18 nt, Homo sapiens
ugcugcccugaugcgucu

SEQ ID NO: 797816 - RNA, 16 nt, Homo sapiens
ugcugcuacaaugucc

SEQ ID NO: 797817 - RNA, 13 nt, Homo sapiens
ugcugcuccaugg

SEQ ID NO: 797818 - RNA, 12 nt, Homo sapiens
ugcugcucucuc

SEQ ID NO: 797819 - RNA, 14 nt, Homo sapiens
ugcugcuuagcuug

SEQ ID NO: 797820 - RNA, 18 nt, Homo sapiens
ugcugcuuuaauucauaa

SEQ ID NO: 797821 - RNA, 15 nt, Homo sapiens
ugcuggaagcccagc

SEQ ID NO: 797822 - RNA, 16 nt, Homo sapiens
ugcuggaauuccuaac

SEQ ID NO: 797823 - RNA, 22 nt, Homo sapiens
ugcuggccaggguagacuugga

SEQ ID NO: 797824 - RNA, 12 nt, Homo sapiens
ugcugggaccug

SEQ ID NO: 797825 - RNA, 23 nt, Homo sapiens
ugcugggacugagccagucccag

SEQ ID NO: 797826 - RNA, 17 nt, Homo sapiens
ugcugggcccaccaccu

SEQ ID NO: 797827 - RNA, 14 nt, Homo sapiens
ugcuggggaagaca

SEQ ID NO: 797828 - RNA, 12 nt, Homo sapiens
ugcuggggaccu

SEQ ID NO: 797829 - RNA, 15 nt, Homo sapiens
ugcuggggaccucac

SEQ ID NO: 797830 - RNA, 23 nt, Homo sapiens
ugcuggggagccaaaggcaucca

SEQ ID NO: 797831 - RNA, 16 nt, Homo sapiens
ugcuggucuauuuuga

SEQ ID NO: 797832 - RNA, 13 nt, Homo sapiens
ugcuggugcacag

SEQ ID NO: 797833 - RNA, 13 nt, Homo sapiens
ugcuggugcauca

SEQ ID NO: 797834 - RNA, 20 nt, Homo sapiens
ugcuguagaaacacauaaca

SEQ ID NO: 797835 - RNA, 18 nt, Homo sapiens
ugcuguagacauuugcua

SEQ ID NO: 797836 - RNA, 13 nt, Homo sapiens
ugcuguagcuuau

SEQ ID NO: 797837 - RNA, 16 nt, Homo sapiens
ugcugucaacuuccca

SEQ ID NO: 797838 - RNA, 14 nt, Homo sapiens
ugcugucauaacau

SEQ ID NO: 797839 - RNA, 16 nt, Homo sapiens
ugcuguccaggcagcu

SEQ ID NO: 797840 - RNA, 20 nt, Homo sapiens
ugcugugacuagaaccauaa

SEQ ID NO: 797841 - RNA, 14 nt, Homo sapiens
ugcugugauuccac

SEQ ID NO: 797842 - RNA, 22 nt, Homo sapiens
ugcugugcguggaaugcccuuc

SEQ ID NO: 797843 - RNA, 16 nt, Homo sapiens
ugcuguggggaccaca

SEQ ID NO: 797844 - RNA, 14 nt, Homo sapiens
ugcuguucagugcc

SEQ ID NO: 797845 - RNA, 20 nt, Homo sapiens
ugcuguuuuuuggugguucu

SEQ ID NO: 797846 - RNA, 21 nt, Homo sapiens
ugcuuaauaaauuguguuucc

SEQ ID NO: 797847 - RNA, 19 nt, Homo sapiens
ugcuuaccuacauacgugu

SEQ ID NO: 797848 - RNA, 20 nt, Homo sapiens
ugcuuaccucucagccuuag

SEQ ID NO: 797849 - RNA, 21 nt, Homo sapiens
ugcuuaggcacucauggguaa

SEQ ID NO: 797850 - RNA, 19 nt, Homo sapiens
ugcuuagucccucaugcaa

SEQ ID NO: 797851 - RNA, 19 nt, Homo sapiens
ugcuucacaguagagccag

SEQ ID NO: 797852 - RNA, 23 nt, Homo sapiens
ugcuucagaguuuguguguauuu

SEQ ID NO: 797853 - RNA, 12 nt, Homo sapiens
ugcuucagccug

SEQ ID NO: 797854 - RNA, 16 nt, Homo sapiens
ugcuucaguugcauau

SEQ ID NO: 797855 - RNA, 11 nt, Homo sapiens
ugcuucauuaa

SEQ ID NO: 797856 - RNA, 19 nt, Homo sapiens
ugcuuccacuucuaugcaa

SEQ ID NO: 797857 - RNA, 23 nt, Homo sapiens
ugcuucccggcgucccuaccucc

SEQ ID NO: 797858 - RNA, 16 nt, Homo sapiens
ugcuuccguucaugga

SEQ ID NO: 797859 - RNA, 23 nt, Homo sapiens
ugcuuccuccuuugcucuuggga

SEQ ID NO: 797860 - RNA, 18 nt, Homo sapiens
ugcuuccugucugaguaa

SEQ ID NO: 797861 - RNA, 13 nt, Homo sapiens
ugcuuccuuccag

SEQ ID NO: 797862 - RNA, 14 nt, Homo sapiens
ugcuucgacuacug

SEQ ID NO: 797863 - RNA, 22 nt, Homo sapiens
ugcuucuaagaugccagcauau

SEQ ID NO: 797864 - RNA, 14 nt, Homo sapiens
ugcuucuccaccuc

SEQ ID NO: 797865 - RNA, 18 nt, Homo sapiens
ugcuucucuagcucucua

SEQ ID NO: 797866 - RNA, 15 nt, Homo sapiens
ugcuucugcacacaa

SEQ ID NO: 797867 - RNA, 18 nt, Homo sapiens
ugcuugaacccaagaggu

SEQ ID NO: 797868 - RNA, 19 nt, Homo sapiens
ugcuugaacccagaaggca

SEQ ID NO: 797869 - RNA, 14 nt, Homo sapiens
ugcuugaccaaaga

SEQ ID NO: 797870 - RNA, 13 nt, Homo sapiens
ugcuugauuccag

SEQ ID NO: 797871 - RNA, 17 nt, Homo sapiens
ugcuugcaauguaguca

SEQ ID NO: 797872 - RNA, 19 nt, Homo sapiens
ugcuugccauucucuugca

SEQ ID NO: 797873 - RNA, 18 nt, Homo sapiens
ugcuuguaguuauaguga

SEQ ID NO: 797874 - RNA, 13 nt, Homo sapiens
ugcuugucaucca

SEQ ID NO: 797875 - RNA, 17 nt, Homo sapiens
ugcuuuaaaaaaauaca

SEQ ID NO: 797876 - RNA, 13 nt, Homo sapiens
ugcuuuagaacuu

SEQ ID NO: 797877 - RNA, 18 nt, Homo sapiens
ugcuuuagcacaggacaa

SEQ ID NO: 797878 - RNA, 19 nt, Homo sapiens
ugcuuugcagccccacaga

SEQ ID NO: 797879 - RNA, 23 nt, Homo sapiens
ugcuuugccaaguugcugucacu

SEQ ID NO: 797880 - RNA, 16 nt, Homo sapiens
ugcuuugccagagcag

SEQ ID NO: 797881 - RNA, 19 nt, Homo sapiens
ugcuuugccauaaccacau

SEQ ID NO: 797882 - RNA, 16 nt, Homo sapiens
ugcuuugcugaccaaa

SEQ ID NO: 797883 - RNA, 11 nt, Homo sapiens
ugcuuuggacu

SEQ ID NO: 797884 - RNA, 14 nt, Homo sapiens
ugcuuuuaaaugca

SEQ ID NO: 797885 - RNA, 15 nt, Homo sapiens
ugcuuuucauuagca

SEQ ID NO: 797886 - RNA, 14 nt, Homo sapiens
ugcuuuucuguccu

SEQ ID NO: 797887 - RNA, 18 nt, Homo sapiens
ugcuuuuuggaaagucag

SEQ ID NO: 797888 - RNA, 21 nt, Homo sapiens
ugcuuuuuuugaaacuuugag

SEQ ID NO: 797889 - RNA, 20 nt, Homo sapiens
uggaaaaaaugauguucauu

SEQ ID NO: 797890 - RNA, 16 nt, Homo sapiens
uggaaaaagucacauu

SEQ ID NO: 797891 - RNA, 22 nt, Homo sapiens
uggaaaagcaacuucauuugac

SEQ ID NO: 797892 - RNA, 17 nt, Homo sapiens
cgccuugccuccucacc

SEQ ID NO: 797893 - RNA, 16 nt, Homo sapiens
cgcgcaggccugcgug

SEQ ID NO: 797894 - RNA, 13 nt, Homo sapiens
cgcgccuguaauc

SEQ ID NO: 797895 - RNA, 18 nt, Homo sapiens
cgcggugcugacugaggc

SEQ ID NO: 797896 - RNA, 14 nt, Homo sapiens
cgcguacagaucuc

SEQ ID NO: 797897 - RNA, 18 nt, Homo sapiens
cgcuacccacuucuaaau

SEQ ID NO: 797898 - RNA, 22 nt, Homo sapiens
cgcuaccucccuccccgucuca

SEQ ID NO: 797899 - RNA, 16 nt, Homo sapiens
cgcuauacugcacuua

SEQ ID NO: 797900 - RNA, 12 nt, Homo sapiens
cgcuauugauuu

SEQ ID NO: 797901 - RNA, 13 nt, Homo sapiens
cgcucaucaccua

SEQ ID NO: 797902 - RNA, 13 nt, Homo sapiens
cgcuccucgggaa

SEQ ID NO: 797903 - RNA, 22 nt, Homo sapiens
cgcuccuuugugugugugucag

SEQ ID NO: 797904 - RNA, 16 nt, Homo sapiens
cgcucucccuaccuug

SEQ ID NO: 797905 - RNA, 12 nt, Homo sapiens
cgcucugccauu

SEQ ID NO: 797906 - RNA, 12 nt, Homo sapiens
cgcucuguggau

SEQ ID NO: 797907 - RNA, 14 nt, Homo sapiens
cgcucuguugccca

SEQ ID NO: 797908 - RNA, 21 nt, Homo sapiens
cgcuggcuuuccagcuuagaa

SEQ ID NO: 797909 - RNA, 17 nt, Homo sapiens
cgcuuaucaacuaauga

SEQ ID NO: 797910 - RNA, 17 nt, Homo sapiens
cggaaaagacaagagcc

SEQ ID NO: 797911 - RNA, 14 nt, Homo sapiens
cggaacauguaaaa

SEQ ID NO: 797912 - RNA, 23 nt, Homo sapiens
cggaagcugucgacuucaugaca

SEQ ID NO: 797913 - RNA, 21 nt, Homo sapiens
cggaaggagggagcucugaug

SEQ ID NO: 797914 - RNA, 12 nt, Homo sapiens
cggaaucucagc

SEQ ID NO: 797915 - RNA, 21 nt, Homo sapiens
cggaaugucauagucuugaaa

SEQ ID NO: 797916 - RNA, 22 nt, Homo sapiens
cggacaagacccccagcacuug

SEQ ID NO: 797917 - RNA, 14 nt, Homo sapiens
cggacaaguuuuaa

SEQ ID NO: 797918 - RNA, 23 nt, Homo sapiens
cggacaugaaaggacccugugag

SEQ ID NO: 797919 - RNA, 15 nt, Homo sapiens
cggaccccagagccc

SEQ ID NO: 797920 - RNA, 22 nt, Homo sapiens
cggagaagagcuguucacagcc

SEQ ID NO: 797921 - RNA, 18 nt, Homo sapiens
cggagagagaauguauuu

SEQ ID NO: 797922 - RNA, 16 nt, Homo sapiens
uguucauccucauugc

SEQ ID NO: 797923 - RNA, 21 nt, Homo sapiens
uguucauccucauugccuccu

SEQ ID NO: 797924 - RNA, 11 nt, Homo sapiens
uguucaucuca

SEQ ID NO: 797925 - RNA, 11 nt, Homo sapiens
uguucaugccg

SEQ ID NO: 797926 - RNA, 20 nt, Homo sapiens
uguucauuuuagugacugua

SEQ ID NO: 797927 - RNA, 17 nt, Homo sapiens
uguuccaauuugacaaa

SEQ ID NO: 797928 - RNA, 23 nt, Homo sapiens
uguuccacuuguuugcacugugu

SEQ ID NO: 797929 - RNA, 22 nt, Homo sapiens
uguuccaugaaggcagagccau

SEQ ID NO: 797930 - RNA, 22 nt, Homo sapiens
uguucccacaccccaacacuuc

SEQ ID NO: 797931 - RNA, 15 nt, Homo sapiens
uguuccccucaccca

SEQ ID NO: 797932 - RNA, 19 nt, Homo sapiens
uguucccuagagagaauaa

SEQ ID NO: 797933 - RNA, 14 nt, Homo sapiens
uguucccucuggcu

SEQ ID NO: 797934 - RNA, 20 nt, Homo sapiens
uguucucuuuaaucagcuua

SEQ ID NO: 797935 - RNA, 18 nt, Homo sapiens
uguucugcauggauucag

SEQ ID NO: 797936 - RNA, 19 nt, Homo sapiens
uguucugcgcuguguacaa

SEQ ID NO: 797937 - RNA, 23 nt, Homo sapiens
uguucuucauuaccucagugaga

SEQ ID NO: 797938 - RNA, 14 nt, Homo sapiens
uguucuuugucuca

SEQ ID NO: 797939 - RNA, 14 nt, Homo sapiens
uguugaaacacuuu

SEQ ID NO: 797940 - RNA, 14 nt, Homo sapiens
uguugacugugauu

SEQ ID NO: 797941 - RNA, 21 nt, Homo sapiens
uguugagacugauucagagga

SEQ ID NO: 797942 - RNA, 14 nt, Homo sapiens
uguugagauccagu

SEQ ID NO: 797943 - RNA, 22 nt, Homo sapiens
uguugagaugugcuuugcugca

SEQ ID NO: 797944 - RNA, 13 nt, Homo sapiens
uguugagugccag

SEQ ID NO: 797945 - RNA, 20 nt, Homo sapiens
uguugauaaauuccacugga

SEQ ID NO: 797946 - RNA, 13 nt, Homo sapiens
uguugauagcaag

SEQ ID NO: 797947 - RNA, 11 nt, Homo sapiens
uguugauccca

SEQ ID NO: 797948 - RNA, 14 nt, Homo sapiens
uguugauuacauaa

SEQ ID NO: 797949 - RNA, 21 nt, Homo sapiens
uguugcggacaucauucugca

SEQ ID NO: 797950 - RNA, 23 nt, Homo sapiens
uguugcuauagagccuaccugua

SEQ ID NO: 797951 - RNA, 21 nt, Homo sapiens
uguugcuggacugucauagaa

SEQ ID NO: 797952 - RNA, 16 nt, Homo sapiens
uguugcuuaucauuug

SEQ ID NO: 797953 - RNA, 19 nt, Homo sapiens
uguugcuuccguucaugga

SEQ ID NO: 797954 - RNA, 12 nt, Homo sapiens
uguugcuuuaac

SEQ ID NO: 797955 - RNA, 21 nt, Homo sapiens
uguuggggaccucaccugcug

SEQ ID NO: 797956 - RNA, 14 nt, Homo sapiens
uguugguagcaauu

SEQ ID NO: 797957 - RNA, 14 nt, Homo sapiens
uguugguagccauu

SEQ ID NO: 797958 - RNA, 21 nt, Homo sapiens
uguuguaaccugcugugauac

SEQ ID NO: 797959 - RNA, 15 nt, Homo sapiens
uguuguacauuucac

SEQ ID NO: 797960 - RNA, 14 nt, Homo sapiens
uguuguccaggaaa

SEQ ID NO: 797961 - RNA, 12 nt, Homo sapiens
uguuuaaaccca

SEQ ID NO: 797962 - RNA, 17 nt, Homo sapiens
uguuuaaauagccuaaa

SEQ ID NO: 797963 - RNA, 19 nt, Homo sapiens
uguuuaaauucacaucuca

SEQ ID NO: 797964 - RNA, 19 nt, Homo sapiens
uguuuaagcccagccaagu

SEQ ID NO: 797965 - RNA, 17 nt, Homo sapiens
uguuuacaaggugacaa

SEQ ID NO: 797966 - RNA, 15 nt, Homo sapiens
uguuuacagacugug

SEQ ID NO: 797967 - RNA, 20 nt, Homo sapiens
uguuuaccucuucuaugcaa

SEQ ID NO: 797968 - RNA, 22 nt, Homo sapiens
uguuuagcgaacuuguauacuu

SEQ ID NO: 797969 - RNA, 14 nt, Homo sapiens
uguuuagugauauu

SEQ ID NO: 797970 - RNA, 15 nt, Homo sapiens
uguuuauacacugug

SEQ ID NO: 797971 - RNA, 17 nt, Homo sapiens
uguuuauauacuggguu

SEQ ID NO: 797972 - RNA, 14 nt, Homo sapiens
uguuuauuccugau

SEQ ID NO: 797973 - RNA, 17 nt, Homo sapiens
uguuuauucuugaugaa

SEQ ID NO: 797974 - RNA, 13 nt, Homo sapiens
uguuuccacuauu

SEQ ID NO: 797975 - RNA, 17 nt, Homo sapiens
uguuucccccacaguuu

SEQ ID NO: 797976 - RNA, 14 nt, Homo sapiens
uguuucccguauug

SEQ ID NO: 797977 - RNA, 21 nt, Homo sapiens
uguuucgcauuaagcacacac

SEQ ID NO: 797978 - RNA, 16 nt, Homo sapiens
uguuucuggauuugca

SEQ ID NO: 797979 - RNA, 20 nt, Homo sapiens
uguuucuugccugaacuccu

SEQ ID NO: 797980 - RNA, 16 nt, Homo sapiens
uguuucuuucauauga

SEQ ID NO: 797981 - RNA, 16 nt, Homo sapiens
uguuugaaauucuaga

SEQ ID NO: 797982 - RNA, 13 nt, Homo sapiens
uguuugaauuauc

SEQ ID NO: 797983 - RNA, 13 nt, Homo sapiens
uguuugaguuaaa

SEQ ID NO: 797984 - RNA, 24 nt, Homo sapiens
uguuugcacugugugcugacugaa

SEQ ID NO: 797985 - RNA, 23 nt, Homo sapiens
uguuugccaggacaugcaauaaa

SEQ ID NO: 797986 - RNA, 22 nt, Homo sapiens
uguuugcugauuauuuaugacc

SEQ ID NO: 797987 - RNA, 16 nt, Homo sapiens
uguuuggaaaagacag

SEQ ID NO: 797988 - RNA, 14 nt, Homo sapiens
uguuuggaaaccac

SEQ ID NO: 797989 - RNA, 20 nt, Homo sapiens
uguuuggaaaccacagucag

SEQ ID NO: 797990 - RNA, 14 nt, Homo sapiens
uguuuggagcucua

SEQ ID NO: 797991 - RNA, 23 nt, Homo sapiens
uguuugguaguuagccaucuaau

SEQ ID NO: 797992 - RNA, 17 nt, Homo sapiens
uguuuguaugucugugu

SEQ ID NO: 797993 - RNA, 11 nt, Homo sapiens
uguuugucagc

SEQ ID NO: 797994 - RNA, 12 nt, Homo sapiens
uguuugugauug

SEQ ID NO: 797995 - RNA, 16 nt, Homo sapiens
uguuuguuucauauau

SEQ ID NO: 797996 - RNA, 17 nt, Homo sapiens
uguuuguuuuugcuugu

SEQ ID NO: 797997 - RNA, 17 nt, Homo sapiens
uguuuuaaguugcuuua

SEQ ID NO: 797998 - RNA, 14 nt, Homo sapiens
uguuuuaccagcuc

SEQ ID NO: 797999 - RNA, 21 nt, Homo sapiens
uguuuuacuaaagaaagauua

SEQ ID NO: 798000 - RNA, 16 nt, Homo sapiens
uguuuuauauguugcu

SEQ ID NO: 798001 - RNA, 19 nt, Homo sapiens
uguuuucauaauaccucac

SEQ ID NO: 798002 - RNA, 19 nt, Homo sapiens
uguuuucccaaagcacuuu

SEQ ID NO: 798003 - RNA, 20 nt, Homo sapiens
uguuuugccauguuggccag

SEQ ID NO: 798004 - RNA, 22 nt, Homo sapiens
uguuuuguaucaaaaucacuau

SEQ ID NO: 798005 - RNA, 19 nt, Homo sapiens
uguuuuuaauaaagacagg

SEQ ID NO: 798006 - RNA, 17 nt, Homo sapiens
uguuuuucacauauaaa

SEQ ID NO: 798007 - RNA, 23 nt, Homo sapiens
uguuuuuugccacagcuuuugca

SEQ ID NO: 798008 - RNA, 20 nt, Homo sapiens
uguuuuuugccuaaauccaa

SEQ ID NO: 798009 - RNA, 19 nt, Homo sapiens
uuaaaaaaaaaaaguacaa

SEQ ID NO: 798010 - RNA, 14 nt, Homo sapiens
uuaaaaaacuucau

SEQ ID NO: 798011 - RNA, 12 nt, Homo sapiens
uuaaaaacuaaa

SEQ ID NO: 798012 - RNA, 23 nt, Homo sapiens
uuaaaaacuaaaaagccaucuga

SEQ ID NO: 798013 - RNA, 20 nt, Homo sapiens
cucuuuugagacuuugccca

SEQ ID NO: 798014 - RNA, 13 nt, Homo sapiens
cucuuuugcuuaa

SEQ ID NO: 798015 - RNA, 23 nt, Homo sapiens
cucuuuugugaugaacauauuca

SEQ ID NO: 798016 - RNA, 20 nt, Homo sapiens
cugaaaaaaacauauccaaa

SEQ ID NO: 798017 - RNA, 21 nt, Homo sapiens
cugaaaaaaacauauccaaaa

SEQ ID NO: 798018 - RNA, 23 nt, Homo sapiens
cugaaaaaugguaauuguugcua

SEQ ID NO: 798019 - RNA, 21 nt, Homo sapiens
cugaaaagaaaugcuaaugua

SEQ ID NO: 798020 - RNA, 16 nt, Homo sapiens
cugaaaagcaguucau

SEQ ID NO: 798021 - RNA, 13 nt, Homo sapiens
cugaaaauucugu

SEQ ID NO: 798022 - RNA, 13 nt, Homo sapiens
cugaaaauugcaa

SEQ ID NO: 798023 - RNA, 13 nt, Homo sapiens
cugaaacacuaaa

SEQ ID NO: 798024 - RNA, 16 nt, Homo sapiens
cugaaaccucugccuu

SEQ ID NO: 798025 - RNA, 18 nt, Homo sapiens
cugaaaccuuaguuucaa

SEQ ID NO: 798026 - RNA, 22 nt, Homo sapiens
cugaaacucacaguaauguguc

SEQ ID NO: 798027 - RNA, 21 nt, Homo sapiens
cugaaacucauagacacugau

SEQ ID NO: 798028 - RNA, 21 nt, Homo sapiens
cugaaacugaguugaauagag

SEQ ID NO: 798029 - RNA, 22 nt, Homo sapiens
cugaaacuucucaaccagaaga

SEQ ID NO: 798030 - RNA, 21 nt, Homo sapiens
cugaaagaacauggacuugua

SEQ ID NO: 798031 - RNA, 16 nt, Homo sapiens
cugaaagaucuuucag

SEQ ID NO: 798032 - RNA, 16 nt, Homo sapiens
cugaaagccuuaggga

SEQ ID NO: 798033 - RNA, 17 nt, Homo sapiens
cugaaagccuuagggaa

SEQ ID NO: 798034 - RNA, 18 nt, Homo sapiens
cugaaaggugauugcagc

SEQ ID NO: 798035 - RNA, 19 nt, Homo sapiens
cugaaaggugauugcagcu

SEQ ID NO: 798036 - RNA, 15 nt, Homo sapiens
cugaaauagaggcua

SEQ ID NO: 798037 - RNA, 21 nt, Homo sapiens
cugaaaucuccuuuagccauc

SEQ ID NO: 798038 - RNA, 12 nt, Homo sapiens
cugaaaugccuc

SEQ ID NO: 798039 - RNA, 23 nt, Homo sapiens
cugaaauuuuaauugaacuaaca

SEQ ID NO: 798040 - RNA, 16 nt, Homo sapiens
cugaacaaaagcucag

SEQ ID NO: 798041 - RNA, 23 nt, Homo sapiens
cugaacauaggaaaauagaaacu

SEQ ID NO: 798042 - RNA, 19 nt, Homo sapiens
cugaacauuaguugcacua

SEQ ID NO: 798043 - RNA, 14 nt, Homo sapiens
cugaaccaguccag

SEQ ID NO: 798044 - RNA, 19 nt, Homo sapiens
cugaaccauuccaacuuca

SEQ ID NO: 798045 - RNA, 16 nt, Homo sapiens
cugaaccuugagcaaa

SEQ ID NO: 798046 - RNA, 18 nt, Homo sapiens
cugaaccuugaggggcua

SEQ ID NO: 798047 - RNA, 16 nt, Homo sapiens
cugaacuacacugcau

SEQ ID NO: 798048 - RNA, 14 nt, Homo sapiens
cugaacuauuucag

SEQ ID NO: 798049 - RNA, 19 nt, Homo sapiens
cugaacucaaacugaggaa

SEQ ID NO: 798050 - RNA, 15 nt, Homo sapiens
cugaacucagcacau

SEQ ID NO: 798051 - RNA, 12 nt, Homo sapiens
cugaacuccaua

SEQ ID NO: 798052 - RNA, 20 nt, Homo sapiens
cugaacuccugccauagucu

SEQ ID NO: 798053 - RNA, 15 nt, Homo sapiens
cugaacuugccuuaa

SEQ ID NO: 798054 - RNA, 22 nt, Homo sapiens
cugaacuugccuuaaacacuca

SEQ ID NO: 798055 - RNA, 21 nt, Homo sapiens
cugaacuuugcaaagaccuuc

SEQ ID NO: 798056 - RNA, 20 nt, Homo sapiens
cugaagaccccaaagaucuc

SEQ ID NO: 798057 - RNA, 19 nt, Homo sapiens
cugaagaggaaaagucaaa

SEQ ID NO: 798058 - RNA, 14 nt, Homo sapiens
cugaagagguugaa

SEQ ID NO: 798059 - RNA, 20 nt, Homo sapiens
cugaagauugcgguuuacag

SEQ ID NO: 798060 - RNA, 23 nt, Homo sapiens
cugaagauugcgguuuacagcua

SEQ ID NO: 798061 - RNA, 22 nt, Homo sapiens
cugaagcucuucucuccagugu

SEQ ID NO: 798062 - RNA, 21 nt, Homo sapiens
cugaagcuuaggacuaccagc

SEQ ID NO: 798063 - RNA, 22 nt, Homo sapiens
cugaaggagcauaugauugcuc

SEQ ID NO: 798064 - RNA, 20 nt, Homo sapiens
cugaagggcaucaugcaucu

SEQ ID NO: 798065 - RNA, 14 nt, Homo sapiens
cugaaguacuuaaa

SEQ ID NO: 798066 - RNA, 23 nt, Homo sapiens
cugaaguaugguauuacaaaaca

SEQ ID NO: 798067 - RNA, 14 nt, Homo sapiens
cugaaguggcuaaa

SEQ ID NO: 798068 - RNA, 23 nt, Homo sapiens
cugaaguugcugagcaguauucc

SEQ ID NO: 798069 - RNA, 19 nt, Homo sapiens
cugaauaaauugaacuaaa

SEQ ID NO: 798070 - RNA, 13 nt, Homo sapiens
cugaauaauauca

SEQ ID NO: 798071 - RNA, 13 nt, Homo sapiens
cugaauacaagcc

SEQ ID NO: 798072 - RNA, 19 nt, Homo sapiens
cugaauaucagucacuguu

SEQ ID NO: 798073 - RNA, 13 nt, Homo sapiens
cugaaucacuuaa

SEQ ID NO: 798074 - RNA, 23 nt, Homo sapiens
cugaauccaaacuaauccaucac

SEQ ID NO: 798075 - RNA, 12 nt, Homo sapiens
cugaaucucaua

SEQ ID NO: 798076 - RNA, 21 nt, Homo sapiens
cugaaugcaccauggucaaaa

SEQ ID NO: 798077 - RNA, 13 nt, Homo sapiens
cugaaugcuccau

SEQ ID NO: 798078 - RNA, 17 nt, Homo sapiens
cugaaugggagccagaa

SEQ ID NO: 798079 - RNA, 23 nt, Homo sapiens
cugaauuaagcagcucaccaucc

SEQ ID NO: 798080 - RNA, 15 nt, Homo sapiens
cugaauuacagugaa

SEQ ID NO: 798081 - RNA, 18 nt, Homo sapiens
cugaauuaucuauuucau

SEQ ID NO: 798082 - RNA, 22 nt, Homo sapiens
cugaauuaugauggucugcauu

SEQ ID NO: 798083 - RNA, 16 nt, Homo sapiens
cugaauuaugcuucca

SEQ ID NO: 798084 - RNA, 17 nt, Homo sapiens
cugaauuaugcuuccac

SEQ ID NO: 798085 - RNA, 12 nt, Homo sapiens
cugaauucacuu

SEQ ID NO: 798086 - RNA, 14 nt, Homo sapiens
cugaauuccauaau

SEQ ID NO: 798087 - RNA, 15 nt, Homo sapiens
cugaauuccauaaua

SEQ ID NO: 798088 - RNA, 21 nt, Homo sapiens
cugaauucuuuccccaaagac

SEQ ID NO: 798089 - RNA, 18 nt, Homo sapiens
cugaauuggcuuccagau

SEQ ID NO: 798090 - RNA, 19 nt, Homo sapiens
cugaauuuacuuccuugca

SEQ ID NO: 798091 - RNA, 22 nt, Homo sapiens
cugacaaaggugguaaauucag

SEQ ID NO: 798092 - RNA, 16 nt, Homo sapiens
cugacaaugaagggaa

SEQ ID NO: 798093 - RNA, 11 nt, Homo sapiens
cugacacaaga

SEQ ID NO: 798094 - RNA, 17 nt, Homo sapiens
cugacacaggaaaccaa

SEQ ID NO: 798095 - RNA, 18 nt, Homo sapiens
cugacacagugcucgacc

SEQ ID NO: 798096 - RNA, 18 nt, Homo sapiens
cugacacauagaaaacaa

SEQ ID NO: 798097 - RNA, 12 nt, Homo sapiens
cugacaccuacc

SEQ ID NO: 798098 - RNA, 22 nt, Homo sapiens
cugacacggccucccucugcua

SEQ ID NO: 798099 - RNA, 21 nt, Homo sapiens
cugacacuaccuuaucaggca

SEQ ID NO: 798100 - RNA, 19 nt, Homo sapiens
cugacagaaggaacacugc

SEQ ID NO: 798101 - RNA, 16 nt, Homo sapiens
cugacagcuucaugaa

SEQ ID NO: 798102 - RNA, 22 nt, Homo sapiens
cugacagggacaugcccugugu

SEQ ID NO: 798103 - RNA, 14 nt, Homo sapiens
cugacaguuuacag

SEQ ID NO: 798104 - RNA, 21 nt, Homo sapiens
cugacauuucuucuagugaug

SEQ ID NO: 798105 - RNA, 16 nt, Homo sapiens
cugaccaaaacaaaca

SEQ ID NO: 798106 - RNA, 23 nt, Homo sapiens
cugaccaaacagccaacuagccc

SEQ ID NO: 798107 - RNA, 17 nt, Homo sapiens
cugaccaagugcuggcc

SEQ ID NO: 798108 - RNA, 11 nt, Homo sapiens
cugaccacaga

SEQ ID NO: 798109 - RNA, 14 nt, Homo sapiens
cugaccacagaauu

SEQ ID NO: 798110 - RNA, 13 nt, Homo sapiens
cugaccacuugag

SEQ ID NO: 798111 - RNA, 22 nt, Homo sapiens
cugaccauauugugcuucacag

SEQ ID NO: 798112 - RNA, 14 nt, Homo sapiens
cugacccaacuggg

SEQ ID NO: 798113 - RNA, 17 nt, Homo sapiens
cugacccagugccccca

SEQ ID NO: 798114 - RNA, 13 nt, Homo sapiens
cugaccccaaaga

SEQ ID NO: 798115 - RNA, 14 nt, Homo sapiens
cugaccccaaagac

SEQ ID NO: 798116 - RNA, 13 nt, Homo sapiens
cugaccccagugu

SEQ ID NO: 798117 - RNA, 20 nt, Homo sapiens
cugaccccgccucaccaaua

SEQ ID NO: 798118 - RNA, 13 nt, Homo sapiens
cugacccuagcuc

SEQ ID NO: 798119 - RNA, 19 nt, Homo sapiens
cugaccucaggugauccac

SEQ ID NO: 798120 - RNA, 14 nt, Homo sapiens
cugaccugccugua

SEQ ID NO: 798121 - RNA, 15 nt, Homo sapiens
cugaccuugugaucc

SEQ ID NO: 798122 - RNA, 16 nt, Homo sapiens
cugacgagcagggugg

SEQ ID NO: 798123 - RNA, 20 nt, Homo sapiens
cugacggaguccuguguuug

SEQ ID NO: 798124 - RNA, 20 nt, Homo sapiens
cugacgucagcgcaccaaaa

SEQ ID NO: 798125 - RNA, 16 nt, Homo sapiens
cugacuaauuaggcaa

SEQ ID NO: 798126 - RNA, 13 nt, Homo sapiens
cugacuacaaauu

SEQ ID NO: 798127 - RNA, 23 nt, Homo sapiens
cugacucaacauguuacugacca

SEQ ID NO: 798128 - RNA, 15 nt, Homo sapiens
uuaaaaagaaugacg

SEQ ID NO: 798129 - RNA, 19 nt, Homo sapiens
uuaaaaagauguauguucc

SEQ ID NO: 798130 - RNA, 15 nt, Homo sapiens
uuaaaaaggaaauuu

SEQ ID NO: 798131 - RNA, 18 nt, Homo sapiens
uuaaaaaguucauaacag

SEQ ID NO: 798132 - RNA, 19 nt, Homo sapiens
uuaaaaauuagcaugcugc

SEQ ID NO: 798133 - RNA, 21 nt, Homo sapiens
uuaaaaauuguuaauuuuucc

SEQ ID NO: 798134 - RNA, 13 nt, Homo sapiens
uuaaaaccaaaga

SEQ ID NO: 798135 - RNA, 22 nt, Homo sapiens
uuaaaacuucaguuucacagaa

SEQ ID NO: 798136 - RNA, 19 nt, Homo sapiens
uuaaaagacugcagcugcu

SEQ ID NO: 798137 - RNA, 16 nt, Homo sapiens
uuaaaagucaguauca

SEQ ID NO: 798138 - RNA, 22 nt, Homo sapiens
uuaaaagucuauuuuauuauga

SEQ ID NO: 798139 - RNA, 16 nt, Homo sapiens
uuaaaauaaugaacac

SEQ ID NO: 798140 - RNA, 21 nt, Homo sapiens
uuaaaauaaugaauacauuuc

SEQ ID NO: 798141 - RNA, 13 nt, Homo sapiens
uuaaaauaucucu

SEQ ID NO: 798142 - RNA, 22 nt, Homo sapiens
uuaaaauauuuaucugauuaag

SEQ ID NO: 798143 - RNA, 16 nt, Homo sapiens
uuaaaaucaugauccu

SEQ ID NO: 798144 - RNA, 14 nt, Homo sapiens
uuaaaaugagcauu

SEQ ID NO: 798145 - RNA, 14 nt, Homo sapiens
uuaaaaugucaaga

SEQ ID NO: 798146 - RNA, 17 nt, Homo sapiens
uuaaaauguuuacugua

SEQ ID NO: 798147 - RNA, 15 nt, Homo sapiens
uuaaaauuacauucu

SEQ ID NO: 798148 - RNA, 20 nt, Homo sapiens
uuaaaauugcuauguuacua

SEQ ID NO: 798149 - RNA, 15 nt, Homo sapiens
uuaaaauuuuguaug

SEQ ID NO: 798150 - RNA, 15 nt, Homo sapiens
uuaaacaaaaacuag

SEQ ID NO: 798151 - RNA, 18 nt, Homo sapiens
cugagaucuguugauuga

SEQ ID NO: 798152 - RNA, 22 nt, Homo sapiens
cugagaugaaaacuagggcuca

SEQ ID NO: 798153 - RNA, 18 nt, Homo sapiens
cugagaugugaacacauc

SEQ ID NO: 798154 - RNA, 22 nt, Homo sapiens
cugagcaccagggagcaguugc

SEQ ID NO: 798155 - RNA, 22 nt, Homo sapiens
cugagcaucacuagugacaagu

SEQ ID NO: 798156 - RNA, 17 nt, Homo sapiens
cugagccccuaccccac

SEQ ID NO: 798157 - RNA, 22 nt, Homo sapiens
cugagcccuacucccugcagau

SEQ ID NO: 798158 - RNA, 18 nt, Homo sapiens
cugagccgucagagcagu

SEQ ID NO: 798159 - RNA, 22 nt, Homo sapiens
cugagcuagaauuauucucuua

SEQ ID NO: 798160 - RNA, 23 nt, Homo sapiens
cugagcuggaaggggccacgugg

SEQ ID NO: 798161 - RNA, 18 nt, Homo sapiens
cugagcuggaucacuuga

SEQ ID NO: 798162 - RNA, 18 nt, Homo sapiens
cugagcuuaaauaacaaa

SEQ ID NO: 798163 - RNA, 22 nt, Homo sapiens
cugagcuuggcguuuggaccca

SEQ ID NO: 798164 - RNA, 22 nt, Homo sapiens
cugaggaaagauucaacugccu

SEQ ID NO: 798165 - RNA, 22 nt, Homo sapiens
cugaggaagcacagcagcaucu

SEQ ID NO: 798166 - RNA, 22 nt, Homo sapiens
cugaggaauuucaccuguaaac

SEQ ID NO: 798167 - RNA, 15 nt, Homo sapiens
cugaggaccuccaaa

SEQ ID NO: 798168 - RNA, 14 nt, Homo sapiens
cugaggaccucuca

SEQ ID NO: 798169 - RNA, 13 nt, Homo sapiens
cugaggacugugg

SEQ ID NO: 798170 - RNA, 15 nt, Homo sapiens
cugaggaugcaucuu

SEQ ID NO: 798171 - RNA, 22 nt, Homo sapiens
cugaggcaagagaauugcuuga

SEQ ID NO: 798172 - RNA, 17 nt, Homo sapiens
cugaggcagacagcagc

SEQ ID NO: 798173 - RNA, 22 nt, Homo sapiens
cugaggcaggaggauugcuuga

SEQ ID NO: 798174 - RNA, 14 nt, Homo sapiens
cugaggcauggugu

SEQ ID NO: 798175 - RNA, 15 nt, Homo sapiens
cugaggccacccacu

SEQ ID NO: 798176 - RNA, 18 nt, Homo sapiens
cugaggccacccacugac

SEQ ID NO: 798177 - RNA, 17 nt, Homo sapiens
cugaggcccagugcaua

SEQ ID NO: 798178 - RNA, 20 nt, Homo sapiens
cugaggccucacuacucgag

SEQ ID NO: 798179 - RNA, 19 nt, Homo sapiens
cugagggacaggaucuaua

SEQ ID NO: 798180 - RNA, 16 nt, Homo sapiens
cugagggagacugcaa

SEQ ID NO: 798181 - RNA, 19 nt, Homo sapiens
cugagggagacugcaaaug

SEQ ID NO: 798182 - RNA, 18 nt, Homo sapiens
cugagggcagugcccuuu

SEQ ID NO: 798183 - RNA, 17 nt, Homo sapiens
cugagggcccuguggag

SEQ ID NO: 798184 - RNA, 21 nt, Homo sapiens
cugagguauaaagacaaguau

SEQ ID NO: 798185 - RNA, 14 nt, Homo sapiens
cugagguuaugaac

SEQ ID NO: 798186 - RNA, 21 nt, Homo sapiens
cugagguucuugggauacaga

SEQ ID NO: 798187 - RNA, 17 nt, Homo sapiens
cugagguuuugaaagaa

SEQ ID NO: 798188 - RNA, 19 nt, Homo sapiens
cugaguagcuggauuacag

SEQ ID NO: 798189 - RNA, 17 nt, Homo sapiens
cugagucagacugucag

SEQ ID NO: 798190 - RNA, 18 nt, Homo sapiens
cugaguccaacaauguug

SEQ ID NO: 798191 - RNA, 16 nt, Homo sapiens
cugagugagccacaga

SEQ ID NO: 798192 - RNA, 18 nt, Homo sapiens
cugaguggcaggggacag

SEQ ID NO: 798193 - RNA, 13 nt, Homo sapiens
cugaguggucuga

SEQ ID NO: 798194 - RNA, 20 nt, Homo sapiens
cugaguuaaauaauugcucc

SEQ ID NO: 798195 - RNA, 16 nt, Homo sapiens
cugaguugcuuuucag

SEQ ID NO: 798196 - RNA, 15 nt, Homo sapiens
cugauaaacauuaaa

SEQ ID NO: 798197 - RNA, 20 nt, Homo sapiens
cugauaaacauuaaacacug

SEQ ID NO: 798198 - RNA, 14 nt, Homo sapiens
cugauaaaccaaaa

SEQ ID NO: 798199 - RNA, 18 nt, Homo sapiens
cugauaaggaucuaggag

SEQ ID NO: 798200 - RNA, 22 nt, Homo sapiens
cugauacacagaauauaaucuu

SEQ ID NO: 798201 - RNA, 15 nt, Homo sapiens
cugauaccacugcac

SEQ ID NO: 798202 - RNA, 16 nt, Homo sapiens
cugauacccuuugaaa

SEQ ID NO: 798203 - RNA, 22 nt, Homo sapiens
cugauauaacaaacuacaugua

SEQ ID NO: 798204 - RNA, 15 nt, Homo sapiens
cugauauuaaucaaa

SEQ ID NO: 798205 - RNA, 16 nt, Homo sapiens
cugauauuaaucaaaa

SEQ ID NO: 798206 - RNA, 18 nt, Homo sapiens
cugauccauaaagacaau

SEQ ID NO: 798207 - RNA, 13 nt, Homo sapiens
cugaucccagacc

SEQ ID NO: 798208 - RNA, 18 nt, Homo sapiens
cugauccuccaacagcug

SEQ ID NO: 798209 - RNA, 19 nt, Homo sapiens
cugaucuaacaaaauaagg

SEQ ID NO: 798210 - RNA, 13 nt, Homo sapiens
cugaucucaggga

SEQ ID NO: 798211 - RNA, 17 nt, Homo sapiens
cugaucugcggaucuca

SEQ ID NO: 798212 - RNA, 17 nt, Homo sapiens
cugaugacacauuuggc

SEQ ID NO: 798213 - RNA, 17 nt, Homo sapiens
cugauggaaaaugcaaa

SEQ ID NO: 798214 - RNA, 20 nt, Homo sapiens
cugauggccccuccagcaca

SEQ ID NO: 798215 - RNA, 15 nt, Homo sapiens
cugaugggaaaacug

SEQ ID NO: 798216 - RNA, 16 nt, Homo sapiens
cugauggugcugcuca

SEQ ID NO: 798217 - RNA, 17 nt, Homo sapiens
cugaugguggcucuggu

SEQ ID NO: 798218 - RNA, 16 nt, Homo sapiens
cugauguuaaccaaug

SEQ ID NO: 798219 - RNA, 16 nt, Homo sapiens
cugauguuucugugaa

SEQ ID NO: 798220 - RNA, 16 nt, Homo sapiens
cugauuacucagagca

SEQ ID NO: 798221 - RNA, 13 nt, Homo sapiens
cugauucauaaua

SEQ ID NO: 798222 - RNA, 17 nt, Homo sapiens
cugauucucuaugacau

SEQ ID NO: 798223 - RNA, 21 nt, Homo sapiens
cugauucuggcuuuaagccuu

SEQ ID NO: 798224 - RNA, 19 nt, Homo sapiens
cugauugaucacacagugu

SEQ ID NO: 798225 - RNA, 16 nt, Homo sapiens
cugauuggugauucaa

SEQ ID NO: 798226 - RNA, 14 nt, Homo sapiens
cugauuguuuucau

SEQ ID NO: 798227 - RNA, 22 nt, Homo sapiens
cugauuuaggagaagccaggaa

SEQ ID NO: 798228 - RNA, 14 nt, Homo sapiens
cugauuuauugaaa

SEQ ID NO: 798229 - RNA, 22 nt, Homo sapiens
cugauuucuuaggggaaggaga

SEQ ID NO: 798230 - RNA, 14 nt, Homo sapiens
cugauuugaugaua

SEQ ID NO: 798231 - RNA, 13 nt, Homo sapiens
cugauuugcaaua

SEQ ID NO: 798232 - RNA, 22 nt, Homo sapiens
cugauuuucaucaaaaccaaga

SEQ ID NO: 798233 - RNA, 15 nt, Homo sapiens
cugauuuucgcugau

SEQ ID NO: 798234 - RNA, 19 nt, Homo sapiens
cugauuuuggccaucagga

SEQ ID NO: 798235 - RNA, 16 nt, Homo sapiens
cugauuuuuagcuuua

SEQ ID NO: 798236 - RNA, 15 nt, Homo sapiens
cugcaaaaaaagccu

SEQ ID NO: 798237 - RNA, 23 nt, Homo sapiens
cugcaaaaaugaaauccagugag

SEQ ID NO: 798238 - RNA, 16 nt, Homo sapiens
cugcaaaacacuaaag

SEQ ID NO: 798239 - RNA, 14 nt, Homo sapiens
cugcaaaaugaagg

SEQ ID NO: 798240 - RNA, 19 nt, Homo sapiens
cugcaaacucacugcucaa

SEQ ID NO: 798241 - RNA, 12 nt, Homo sapiens
cugcaaagcuuu

SEQ ID NO: 798242 - RNA, 14 nt, Homo sapiens
cugcaaauacugua

SEQ ID NO: 798243 - RNA, 22 nt, Homo sapiens
uuaaguuuguaagacagugccc

SEQ ID NO: 798244 - RNA, 23 nt, Homo sapiens
uuaauaaaaaggaauacauugca

SEQ ID NO: 798245 - RNA, 16 nt, Homo sapiens
uuaauaaaccuuugca

SEQ ID NO: 798246 - RNA, 20 nt, Homo sapiens
uuaauaaagcauucuuuaac

SEQ ID NO: 798247 - RNA, 20 nt, Homo sapiens
uuaauaaauauuacagugaa

SEQ ID NO: 798248 - RNA, 21 nt, Homo sapiens
uuaauacagugagcucuagca

SEQ ID NO: 798249 - RNA, 13 nt, Homo sapiens
uuaauacuauuaa

SEQ ID NO: 798250 - RNA, 22 nt, Homo sapiens
uuaauacuccagagacagggaa

SEQ ID NO: 798251 - RNA, 13 nt, Homo sapiens
uuaauagcacuaa

SEQ ID NO: 798252 - RNA, 17 nt, Homo sapiens
uuaauagucauuccaaa

SEQ ID NO: 798253 - RNA, 19 nt, Homo sapiens
uuaauauacugcauauccu

SEQ ID NO: 798254 - RNA, 15 nt, Homo sapiens
uuaauauccaagacu

SEQ ID NO: 798255 - RNA, 17 nt, Homo sapiens
uuaauaugacaaaacaa

SEQ ID NO: 798256 - RNA, 20 nt, Homo sapiens
uuaauauuuuuccacuuaaa

SEQ ID NO: 798257 - RNA, 20 nt, Homo sapiens
uuaaucaguuguuuaauaau

SEQ ID NO: 798258 - RNA, 22 nt, Homo sapiens
uuaauccccaucauuacuggua

SEQ ID NO: 798259 - RNA, 15 nt, Homo sapiens
uuaauccuucuaguu

SEQ ID NO: 798260 - RNA, 17 nt, Homo sapiens
uuaaucuaccuugcagu

SEQ ID NO: 798261 - RNA, 20 nt, Homo sapiens
uuaaucuaccuugcagugua

SEQ ID NO: 798262 - RNA, 18 nt, Homo sapiens
uuaaucucuaaaauucua

SEQ ID NO: 798263 - RNA, 18 nt, Homo sapiens
uuaaucugagaggccaca

SEQ ID NO: 798264 - RNA, 21 nt, Homo sapiens
uuaaucuuaguguaugauuac

SEQ ID NO: 798265 - RNA, 13 nt, Homo sapiens
cugcacugugaac

SEQ ID NO: 798266 - RNA, 17 nt, Homo sapiens
cugcagaaacuacugac

SEQ ID NO: 798267 - RNA, 13 nt, Homo sapiens
cugcagaauccag

SEQ ID NO: 798268 - RNA, 20 nt, Homo sapiens
cugcagacuccaauggggcc

SEQ ID NO: 798269 - RNA, 16 nt, Homo sapiens
cugcagagauuucuca

SEQ ID NO: 798270 - RNA, 19 nt, Homo sapiens
cugcagagcugacccagag

SEQ ID NO: 798271 - RNA, 23 nt, Homo sapiens
cugcagaggggaaaccaguguag

SEQ ID NO: 798272 - RNA, 16 nt, Homo sapiens
cugcagauagaaagca

SEQ ID NO: 798273 - RNA, 23 nt, Homo sapiens
cugcagaucaagaaaucccugag

SEQ ID NO: 798274 - RNA, 21 nt, Homo sapiens
cugcagcgagccccccaugua

SEQ ID NO: 798275 - RNA, 17 nt, Homo sapiens
cugcagcucccauuuca

SEQ ID NO: 798276 - RNA, 20 nt, Homo sapiens
cugcagcuuucaagcucauc

SEQ ID NO: 798277 - RNA, 22 nt, Homo sapiens
cugcaggaacgagcacuggcca

SEQ ID NO: 798278 - RNA, 13 nt, Homo sapiens
cugcaggccaaga

SEQ ID NO: 798279 - RNA, 22 nt, Homo sapiens
cugcagggccauggcucagggu

SEQ ID NO: 798280 - RNA, 23 nt, Homo sapiens
cugcagggcccucccuuuuccca

SEQ ID NO: 798281 - RNA, 18 nt, Homo sapiens
cugcaggggcaaggggcu

SEQ ID NO: 798282 - RNA, 22 nt, Homo sapiens
cugcagggggugugucugcuca

SEQ ID NO: 798283 - RNA, 14 nt, Homo sapiens
cugcagucaucucc

SEQ ID NO: 798284 - RNA, 12 nt, Homo sapiens
cugcaguuuccu

SEQ ID NO: 798285 - RNA, 21 nt, Homo sapiens
cugcauagcagaccacacaga

SEQ ID NO: 798286 - RNA, 14 nt, Homo sapiens
cugcaucucaaaaa

SEQ ID NO: 798287 - RNA, 15 nt, Homo sapiens
cugcaugcucuggaa

SEQ ID NO: 798288 - RNA, 12 nt, Homo sapiens
cugcaugcugcc

SEQ ID NO: 798289 - RNA, 14 nt, Homo sapiens
cugcauggcaucag

SEQ ID NO: 798290 - RNA, 19 nt, Homo sapiens
cugcauggcaucagacuag

SEQ ID NO: 798291 - RNA, 15 nt, Homo sapiens
cugcauuagucucau

SEQ ID NO: 798292 - RNA, 15 nt, Homo sapiens
cugcauuccugauga

SEQ ID NO: 798293 - RNA, 17 nt, Homo sapiens
cugcauucuucugagca

SEQ ID NO: 798294 - RNA, 20 nt, Homo sapiens
cugcauugagaacugcauau

SEQ ID NO: 798295 - RNA, 12 nt, Homo sapiens
cugcauuuacag

SEQ ID NO: 798296 - RNA, 14 nt, Homo sapiens
cugcauuugcagau

SEQ ID NO: 798297 - RNA, 21 nt, Homo sapiens
cugcauuugccugucaugcgc

SEQ ID NO: 798298 - RNA, 20 nt, Homo sapiens
cugcauuuuccuaaacccag

SEQ ID NO: 798299 - RNA, 17 nt, Homo sapiens
cugccaagacagugaag

SEQ ID NO: 798300 - RNA, 15 nt, Homo sapiens
cugccaagacuccuc

SEQ ID NO: 798301 - RNA, 12 nt, Homo sapiens
cugccaaggugg

SEQ ID NO: 798302 - RNA, 17 nt, Homo sapiens
cugccacacucuccauc

SEQ ID NO: 798303 - RNA, 19 nt, Homo sapiens
cugccacacugauggcuca

SEQ ID NO: 798304 - RNA, 18 nt, Homo sapiens
cugccacagguaacauga

SEQ ID NO: 798305 - RNA, 14 nt, Homo sapiens
cugccacaguaaua

SEQ ID NO: 798306 - RNA, 19 nt, Homo sapiens
cugccaccaagauguguuc

SEQ ID NO: 798307 - RNA, 20 nt, Homo sapiens
cugccaccaggcacugccug

SEQ ID NO: 798308 - RNA, 21 nt, Homo sapiens
cugccacgagggcgacccggc

SEQ ID NO: 798309 - RNA, 15 nt, Homo sapiens
cugccacugacugca

SEQ ID NO: 798310 - RNA, 12 nt, Homo sapiens
cugccacugccg

SEQ ID NO: 798311 - RNA, 15 nt, Homo sapiens
cugccagcaucugca

SEQ ID NO: 798312 - RNA, 16 nt, Homo sapiens
cugccagccuggcuuc

SEQ ID NO: 798313 - RNA, 13 nt, Homo sapiens
cugccagggagcu

SEQ ID NO: 798314 - RNA, 20 nt, Homo sapiens
cugccagugccuuaccuccu

SEQ ID NO: 798315 - RNA, 21 nt, Homo sapiens
cugccaguugucuuaugugaa

SEQ ID NO: 798316 - RNA, 21 nt, Homo sapiens
cugccauaaauauuucucaac

SEQ ID NO: 798317 - RNA, 15 nt, Homo sapiens
cugccaucaugccug

SEQ ID NO: 798318 - RNA, 17 nt, Homo sapiens
cugccaucaugccugac

SEQ ID NO: 798319 - RNA, 23 nt, Homo sapiens
cugccaucauguuuacagaggac

SEQ ID NO: 798320 - RNA, 14 nt, Homo sapiens
cugccauccucacc

SEQ ID NO: 798321 - RNA, 16 nt, Homo sapiens
cugccauguuuaguga

SEQ ID NO: 798322 - RNA, 17 nt, Homo sapiens
cugccauugggacccuc

SEQ ID NO: 798323 - RNA, 19 nt, Homo sapiens
cugccauugucgucuuuau

SEQ ID NO: 798324 - RNA, 21 nt, Homo sapiens
cugccccaaacaaauaugcaa

SEQ ID NO: 798325 - RNA, 18 nt, Homo sapiens
cugccccugccccaaguc

SEQ ID NO: 798326 - RNA, 17 nt, Homo sapiens
cugcccgaaaagcauuu

SEQ ID NO: 798327 - RNA, 23 nt, Homo sapiens
cugcccgaggagcccugccugcc

SEQ ID NO: 798328 - RNA, 18 nt, Homo sapiens
cugcccgggagggcuucc

SEQ ID NO: 798329 - RNA, 12 nt, Homo sapiens
cugcccucccaa

SEQ ID NO: 798330 - RNA, 17 nt, Homo sapiens
cugcccucuauuuauua

SEQ ID NO: 798331 - RNA, 15 nt, Homo sapiens
cugcccuucaacaau

SEQ ID NO: 798332 - RNA, 20 nt, Homo sapiens
cugccgccucagcuucucaa

SEQ ID NO: 798333 - RNA, 22 nt, Homo sapiens
cugccggaaucacuucuccaau

SEQ ID NO: 798334 - RNA, 18 nt, Homo sapiens
cugccgucuucacuuccc

SEQ ID NO: 798335 - RNA, 17 nt, Homo sapiens
cugccuacuccaaaaug

SEQ ID NO: 798336 - RNA, 19 nt, Homo sapiens
cugccuaggaggcuggcca

SEQ ID NO: 798337 - RNA, 12 nt, Homo sapiens
cugccugagcac

SEQ ID NO: 798338 - RNA, 16 nt, Homo sapiens
cugccugagggccccu

SEQ ID NO: 798339 - RNA, 17 nt, Homo sapiens
cugccugcauucugaga

SEQ ID NO: 798340 - RNA, 14 nt, Homo sapiens
cugccugcugggga

SEQ ID NO: 798341 - RNA, 17 nt, Homo sapiens
cugccugggacacugcg

SEQ ID NO: 798342 - RNA, 21 nt, Homo sapiens
cugccuguuggcaggcccacu

SEQ ID NO: 798343 - RNA, 14 nt, Homo sapiens
cugccuuaaacaca

SEQ ID NO: 798344 - RNA, 18 nt, Homo sapiens
cugccuuaucuugcaccc

SEQ ID NO: 798345 - RNA, 16 nt, Homo sapiens
cugccuucaccccacu

SEQ ID NO: 798346 - RNA, 18 nt, Homo sapiens
cugccuugaagccacuga

SEQ ID NO: 798347 - RNA, 14 nt, Homo sapiens
cugccuuguguaca

SEQ ID NO: 798348 - RNA, 18 nt, Homo sapiens
cugccuuuaagccaaaga

SEQ ID NO: 798349 - RNA, 16 nt, Homo sapiens
cugcgaaauccagaac

SEQ ID NO: 798350 - RNA, 18 nt, Homo sapiens
cugcgcuucccugcaguc

SEQ ID NO: 798351 - RNA, 16 nt, Homo sapiens
cugcggaggggggcaa

SEQ ID NO: 798352 - RNA, 21 nt, Homo sapiens
cugcggcaguauguacuucag

SEQ ID NO: 798353 - RNA, 12 nt, Homo sapiens
cugcguguguau

SEQ ID NO: 798354 - RNA, 12 nt, Homo sapiens
cugcguuuucau

SEQ ID NO: 798355 - RNA, 22 nt, Homo sapiens
cugcuaaauaucaccuagcaug

SEQ ID NO: 798356 - RNA, 20 nt, Homo sapiens
cugcuaaggcuccuccuugc

SEQ ID NO: 798357 - RNA, 16 nt, Homo sapiens
cugcuaccucacuggg

SEQ ID NO: 798358 - RNA, 17 nt, Homo sapiens
uuacuuaugaugaugaa

SEQ ID NO: 798359 - RNA, 20 nt, Homo sapiens
uuacuuguguuacuugccaa

SEQ ID NO: 798360 - RNA, 22 nt, Homo sapiens
uuagaaacagaaauagacuuaa

SEQ ID NO: 798361 - RNA, 20 nt, Homo sapiens
uuagaaauauucuacuucuc

SEQ ID NO: 798362 - RNA, 15 nt, Homo sapiens
uuagaaauugcauuu

SEQ ID NO: 798363 - RNA, 12 nt, Homo sapiens
uuagaacaggga

SEQ ID NO: 798364 - RNA, 13 nt, Homo sapiens
uuagaacagucca

SEQ ID NO: 798365 - RNA, 12 nt, Homo sapiens
uuagaacuugca

SEQ ID NO: 798366 - RNA, 12 nt, Homo sapiens
uuagaagacauu

SEQ ID NO: 798367 - RNA, 17 nt, Homo sapiens
uuagaaguguuguaaaa

SEQ ID NO: 798368 - RNA, 18 nt, Homo sapiens
uuagaaucagaauuugau

SEQ ID NO: 798369 - RNA, 19 nt, Homo sapiens
uuagaauccgaagggaauu

SEQ ID NO: 798370 - RNA, 19 nt, Homo sapiens
uuagaauuaaaaaagcaua

SEQ ID NO: 798371 - RNA, 21 nt, Homo sapiens
uuagaauugcuggaugcauuu

SEQ ID NO: 798372 - RNA, 22 nt, Homo sapiens
uuagacaugacugaugacauau

SEQ ID NO: 798373 - RNA, 20 nt, Homo sapiens
uuagaccaagcuuguccaac

SEQ ID NO: 798374 - RNA, 22 nt, Homo sapiens
uuagaccccauacaaguuuaua

SEQ ID NO: 798375 - RNA, 21 nt, Homo sapiens
uuagacccgcccuccccuuuu

SEQ ID NO: 798376 - RNA, 19 nt, Homo sapiens
uuagacuuauaguccuccu

SEQ ID NO: 798377 - RNA, 19 nt, Homo sapiens
uuagagaaagaacuaugaa

SEQ ID NO: 798378 - RNA, 15 nt, Homo sapiens
uuagagagagaacuu

SEQ ID NO: 798379 - RNA, 16 nt, Homo sapiens
uuagagcugccugugc

SEQ ID NO: 798380 - RNA, 22 nt, Homo sapiens
uugcucuggacagagauggaag

SEQ ID NO: 798381 - RNA, 21 nt, Homo sapiens
uugcucuuggaaagcugauga

SEQ ID NO: 798382 - RNA, 16 nt, Homo sapiens
uugcucuuucaucucu

SEQ ID NO: 798383 - RNA, 13 nt, Homo sapiens
uugcugaaaccau

SEQ ID NO: 798384 - RNA, 16 nt, Homo sapiens
uugcugaguuguucua

SEQ ID NO: 798385 - RNA, 12 nt, Homo sapiens
uugcugcacuuu

SEQ ID NO: 798386 - RNA, 9 nt, Homo sapiens
uugcugcug

SEQ ID NO: 798387 - RNA, 16 nt, Homo sapiens
uugcuggcucugagaa

SEQ ID NO: 798388 - RNA, 16 nt, Homo sapiens
uugcuggugcaaagau

SEQ ID NO: 798389 - RNA, 20 nt, Homo sapiens
uugcuguccucucauuugca

SEQ ID NO: 798390 - RNA, 23 nt, Homo sapiens
uugcuguggacuauuauuacaua

SEQ ID NO: 798391 - RNA, 11 nt, Homo sapiens
uugcuguucua

SEQ ID NO: 798392 - RNA, 16 nt, Homo sapiens
uugcuguucugcugaa

SEQ ID NO: 798393 - RNA, 16 nt, Homo sapiens
uugcuucagacaugua

SEQ ID NO: 798394 - RNA, 13 nt, Homo sapiens
uugcuucagugga

SEQ ID NO: 798395 - RNA, 20 nt, Homo sapiens
uugcuucuguaguacuccuu

SEQ ID NO: 798396 - RNA, 21 nt, Homo sapiens
uugcuugccgagccuaaugaa

SEQ ID NO: 798397 - RNA, 10 nt, Homo sapiens
uugcuuuaug

SEQ ID NO: 798398 - RNA, 23 nt, Homo sapiens
uugcuuucccugaagcccuagua

SEQ ID NO: 798399 - RNA, 21 nt, Homo sapiens
uugcuuuccucugagauucua

SEQ ID NO: 798400 - RNA, 21 nt, Homo sapiens
uugcuuuccugcaucucugug

SEQ ID NO: 798401 - RNA, 13 nt, Homo sapiens
uugcuuugccaaa

SEQ ID NO: 798402 - RNA, 15 nt, Homo sapiens
uugcuuugccagagc

SEQ ID NO: 798403 - RNA, 16 nt, Homo sapiens
uugcuuugcugaccaa

SEQ ID NO: 798404 - RNA, 17 nt, Homo sapiens
uugcuuuugugaacuuu

SEQ ID NO: 798405 - RNA, 12 nt, Homo sapiens
uuggaaagcagc

SEQ ID NO: 798406 - RNA, 20 nt, Homo sapiens
uuggaaaucaguugugaaua

SEQ ID NO: 798407 - RNA, 14 nt, Homo sapiens
uuggaacagaaugu

SEQ ID NO: 798408 - RNA, 13 nt, Homo sapiens
uuggaaccagacu

SEQ ID NO: 798409 - RNA, 17 nt, Homo sapiens
uuggaacuuacauacau

SEQ ID NO: 798410 - RNA, 19 nt, Homo sapiens
uuggaagaaaagaaucaca

SEQ ID NO: 798411 - RNA, 15 nt, Homo sapiens
uuggaagcauacaaa

SEQ ID NO: 798412 - RNA, 23 nt, Homo sapiens
uuggaagcauacaaagcaguuua

SEQ ID NO: 798413 - RNA, 19 nt, Homo sapiens
uuggaaggccucccugggc

SEQ ID NO: 798414 - RNA, 13 nt, Homo sapiens
uuggaagucauuu

SEQ ID NO: 798415 - RNA, 19 nt, Homo sapiens
uuggaaucuaacgggcauu

SEQ ID NO: 798416 - RNA, 23 nt, Homo sapiens
uuggaauuaugucugcugaauaa

SEQ ID NO: 798417 - RNA, 22 nt, Homo sapiens
uuggacaaaccgagugcaauga

SEQ ID NO: 798418 - RNA, 14 nt, Homo sapiens
uuggacagcugcuu

SEQ ID NO: 798419 - RNA, 16 nt, Homo sapiens
uuggacauccccagaa

SEQ ID NO: 798420 - RNA, 19 nt, Homo sapiens
uuggacuguaagggauuga

SEQ ID NO: 798421 - RNA, 14 nt, Homo sapiens
uuggacugucuaua

SEQ ID NO: 798422 - RNA, 15 nt, Homo sapiens
uuggagaaaaugggu

SEQ ID NO: 798423 - RNA, 15 nt, Homo sapiens
uuggagcucuaucca

SEQ ID NO: 798424 - RNA, 19 nt, Homo sapiens
uuggaggcagggcugggaa

SEQ ID NO: 798425 - RNA, 21 nt, Homo sapiens
uuggagggggaggccccugag

SEQ ID NO: 798426 - RNA, 18 nt, Homo sapiens
uuggagugcgggugggcu

SEQ ID NO: 798427 - RNA, 12 nt, Homo sapiens
uuggaguuuucu

SEQ ID NO: 798428 - RNA, 12 nt, Homo sapiens
uuggcaaugcau

SEQ ID NO: 798429 - RNA, 14 nt, Homo sapiens
uuggcagcauucca

SEQ ID NO: 798430 - RNA, 16 nt, Homo sapiens
uuggcaguguggcagu

SEQ ID NO: 798431 - RNA, 22 nt, Homo sapiens
uuggccaaacaucagaccuguc

SEQ ID NO: 798432 - RNA, 17 nt, Homo sapiens
uuggccagcgucuugcu

SEQ ID NO: 798433 - RNA, 14 nt, Homo sapiens
uuggcccacacuga

SEQ ID NO: 798434 - RNA, 19 nt, Homo sapiens
uuggccucccaaagugcua

SEQ ID NO: 798435 - RNA, 14 nt, Homo sapiens
uuggcucaauccuc

SEQ ID NO: 798436 - RNA, 15 nt, Homo sapiens
uuggcucuacccuga

SEQ ID NO: 798437 - RNA, 13 nt, Homo sapiens
uuggcucuaguca

SEQ ID NO: 798438 - RNA, 23 nt, Homo sapiens
uuggcugggaagacuauggugcu

SEQ ID NO: 798439 - RNA, 14 nt, Homo sapiens
uuggcuucagggga

SEQ ID NO: 798440 - RNA, 15 nt, Homo sapiens
uuggcuucugugaug

SEQ ID NO: 798441 - RNA, 14 nt, Homo sapiens
uugggacaucaagc

SEQ ID NO: 798442 - RNA, 16 nt, Homo sapiens
uugggacccaaaacac

SEQ ID NO: 798443 - RNA, 22 nt, Homo sapiens
uugggaccuugcgugaagagca

SEQ ID NO: 798444 - RNA, 15 nt, Homo sapiens
uugggacucaggaua

SEQ ID NO: 798445 - RNA, 14 nt, Homo sapiens
uugggagcugccaa

SEQ ID NO: 798446 - RNA, 16 nt, Homo sapiens
uugggaggcugaggca

SEQ ID NO: 798447 - RNA, 23 nt, Homo sapiens
uugggaucaauaggaaagcauau

SEQ ID NO: 798448 - RNA, 16 nt, Homo sapiens
uugggauggcuuguag

SEQ ID NO: 798449 - RNA, 18 nt, Homo sapiens
uugggaugggaucccagg

SEQ ID NO: 798450 - RNA, 14 nt, Homo sapiens
uugggcaacagagc

SEQ ID NO: 798451 - RNA, 19 nt, Homo sapiens
uugggcaaggacaccauag

SEQ ID NO: 798452 - RNA, 16 nt, Homo sapiens
uugggcagacccugag

SEQ ID NO: 798453 - RNA, 22 nt, Homo sapiens
uugggcagagcuggcucugagc

SEQ ID NO: 798454 - RNA, 18 nt, Homo sapiens
uugggcaggucugagaua

SEQ ID NO: 798455 - RNA, 16 nt, Homo sapiens
uugggcugcuccucau

SEQ ID NO: 798456 - RNA, 16 nt, Homo sapiens
uuggggacaugugauu

SEQ ID NO: 798457 - RNA, 16 nt, Homo sapiens
uuggggccaccaaagc

SEQ ID NO: 798458 - RNA, 22 nt, Homo sapiens
uuggggccauugcuuaccuugg

SEQ ID NO: 798459 - RNA, 20 nt, Homo sapiens
uuggggcuaauuuaacaaga

SEQ ID NO: 798460 - RNA, 19 nt, Homo sapiens
uugggguauaggucucauc

SEQ ID NO: 798461 - RNA, 13 nt, Homo sapiens
uuggggucucuuu

SEQ ID NO: 798462 - RNA, 14 nt, Homo sapiens
uugguaugugcuag

SEQ ID NO: 798463 - RNA, 11 nt, Homo sapiens
uuggugaauga

SEQ ID NO: 798464 - RNA, 22 nt, Homo sapiens
uuggugagaaagggauugcuga

SEQ ID NO: 798465 - RNA, 15 nt, Homo sapiens
uugguggggggucca

SEQ ID NO: 798466 - RNA, 22 nt, Homo sapiens
uugguguauguaugaguaucug

SEQ ID NO: 798467 - RNA, 19 nt, Homo sapiens
uuggugugugugacaauuc

SEQ ID NO: 798468 - RNA, 19 nt, Homo sapiens
uugguuagacgccuuccag

SEQ ID NO: 798469 - RNA, 21 nt, Homo sapiens
uugguucaauaaagcacugag

SEQ ID NO: 798470 - RNA, 16 nt, Homo sapiens
uugguuccuucugccc

SEQ ID NO: 798471 - RNA, 15 nt, Homo sapiens
uugguugcauccagg

SEQ ID NO: 798472 - RNA, 19 nt, Homo sapiens
uugguuuccuucacagaaa

SEQ ID NO: 798473 - RNA, 20 nt, Homo sapiens
uuguaaaacaaaauuugacu

SEQ ID NO: 798474 - RNA, 18 nt, Homo sapiens
uuguaaaguuucuagaau

SEQ ID NO: 798475 - RNA, 12 nt, Homo sapiens
uuguaacaagaa

SEQ ID NO: 798476 - RNA, 22 nt, Homo sapiens
uuguaacgacuucuccaucucc

SEQ ID NO: 798477 - RNA, 18 nt, Homo sapiens
cuuucaaagcuaaauucc

SEQ ID NO: 798478 - RNA, 14 nt, Homo sapiens
cuuucaacuagaaa

SEQ ID NO: 798479 - RNA, 21 nt, Homo sapiens
cuuucaauuacaaagcaguua

SEQ ID NO: 798480 - RNA, 20 nt, Homo sapiens
cuuucacacuuccaccagcc

SEQ ID NO: 798481 - RNA, 15 nt, Homo sapiens
cuuucaccagaauuu

SEQ ID NO: 798482 - RNA, 21 nt, Homo sapiens
cuuucacccgcuccuacagcu

SEQ ID NO: 798483 - RNA, 15 nt, Homo sapiens
cuuucagaagguguu

SEQ ID NO: 798484 - RNA, 14 nt, Homo sapiens
cuuucagcauuagg

SEQ ID NO: 798485 - RNA, 19 nt, Homo sapiens
cuuucagcauuaggcuuuu

SEQ ID NO: 798486 - RNA, 19 nt, Homo sapiens
cuuucagccacaugcccca

SEQ ID NO: 798487 - RNA, 21 nt, Homo sapiens
cuuucagggguggcccaauga

SEQ ID NO: 798488 - RNA, 19 nt, Homo sapiens
cuuucaggguuuucuaacc

SEQ ID NO: 798489 - RNA, 20 nt, Homo sapiens
cuuuccaaaaggaacucuag

SEQ ID NO: 798490 - RNA, 13 nt, Homo sapiens
cuuuccaccaagc

SEQ ID NO: 798491 - RNA, 23 nt, Homo sapiens
cuuucccccuucccgccuuccaa

SEQ ID NO: 798492 - RNA, 20 nt, Homo sapiens
cuuucccuaauacaggguug

SEQ ID NO: 798493 - RNA, 13 nt, Homo sapiens
cuuucccuugugu

SEQ ID NO: 798494 - RNA, 14 nt, Homo sapiens
cuuuccuacucuca

SEQ ID NO: 798495 - RNA, 17 nt, Homo sapiens
gauccucagaacucuuu

SEQ ID NO: 798496 - RNA, 23 nt, Homo sapiens
gauccucauauggcccaguguca

SEQ ID NO: 798497 - RNA, 14 nt, Homo sapiens
gauccucugggaag

SEQ ID NO: 798498 - RNA, 18 nt, Homo sapiens
gauccuuagagguccucu

SEQ ID NO: 798499 - RNA, 20 nt, Homo sapiens
gaucgcgccacugcacucca

SEQ ID NO: 798500 - RNA, 20 nt, Homo sapiens
gaucggagccuccucucuca

SEQ ID NO: 798501 - RNA, 20 nt, Homo sapiens
gaucuaagccuuuccauaag

SEQ ID NO: 798502 - RNA, 15 nt, Homo sapiens
gaucucaaacuugau

SEQ ID NO: 798503 - RNA, 20 nt, Homo sapiens
gaucucaauuugcaguauuc

SEQ ID NO: 798504 - RNA, 14 nt, Homo sapiens
gaucucagcucacu

SEQ ID NO: 798505 - RNA, 23 nt, Homo sapiens
gaucucagcucacugcaaccucc

SEQ ID NO: 798506 - RNA, 14 nt, Homo sapiens
gaucucagggcaga

SEQ ID NO: 798507 - RNA, 22 nt, Homo sapiens
gaucucauaaugcuuuguuaaa

SEQ ID NO: 798508 - RNA, 15 nt, Homo sapiens
gaucucauguccucu

SEQ ID NO: 798509 - RNA, 19 nt, Homo sapiens
gaucuccaacagccagugu

SEQ ID NO: 798510 - RNA, 23 nt, Homo sapiens
gaucuccccucacacuuugccau

SEQ ID NO: 798511 - RNA, 15 nt, Homo sapiens
gaucuccugaccucg

SEQ ID NO: 798512 - RNA, 18 nt, Homo sapiens
gaucucggcucacugcaa

SEQ ID NO: 798513 - RNA, 16 nt, Homo sapiens
gaucucgguuugccaa

SEQ ID NO: 798514 - RNA, 14 nt, Homo sapiens
gaucugaacacagu

SEQ ID NO: 798515 - RNA, 20 nt, Homo sapiens
gaucugauaaggaucuagga

SEQ ID NO: 798516 - RNA, 23 nt, Homo sapiens
gaucugccgccucagcuucucaa

SEQ ID NO: 798517 - RNA, 23 nt, Homo sapiens
gaucuggaacccagacucagaca

SEQ ID NO: 798518 - RNA, 15 nt, Homo sapiens
gaucuggcacacucc

SEQ ID NO: 798519 - RNA, 15 nt, Homo sapiens
gaucuuaauuuacuu

SEQ ID NO: 798520 - RNA, 14 nt, Homo sapiens
gaucuucacucugg

SEQ ID NO: 798521 - RNA, 16 nt, Homo sapiens
gaucuuccagaagcug

SEQ ID NO: 798522 - RNA, 18 nt, Homo sapiens
gaucuuucugcaggaaau

SEQ ID NO: 798523 - RNA, 15 nt, Homo sapiens
gaucuuugacucuuu

SEQ ID NO: 798524 - RNA, 18 nt, Homo sapiens
gaucuuuguauauuacau

SEQ ID NO: 798525 - RNA, 18 nt, Homo sapiens
gaugaaaguacauuggga

SEQ ID NO: 798526 - RNA, 17 nt, Homo sapiens
gaugaaauuauuuguca

SEQ ID NO: 798527 - RNA, 20 nt, Homo sapiens
gaugaacccgaggcugagaa

SEQ ID NO: 798528 - RNA, 15 nt, Homo sapiens
gaugaagacaacagc

SEQ ID NO: 798529 - RNA, 21 nt, Homo sapiens
gaugaagacccuauuucagaa

SEQ ID NO: 798530 - RNA, 12 nt, Homo sapiens
gaugaagcucac

SEQ ID NO: 798531 - RNA, 23 nt, Homo sapiens
gaugaagcugagcuuuugaugcc

SEQ ID NO: 798532 - RNA, 23 nt, Homo sapiens
gaugaccacauaagaaggcaauu

SEQ ID NO: 798533 - RNA, 15 nt, Homo sapiens
gaugacccucugacc

SEQ ID NO: 798534 - RNA, 15 nt, Homo sapiens
gaugacccuuuucau

SEQ ID NO: 798535 - RNA, 21 nt, Homo sapiens
gaugacgauucuuaacaauaa

SEQ ID NO: 798536 - RNA, 17 nt, Homo sapiens
gaugaggcuggccaagc

SEQ ID NO: 798537 - RNA, 18 nt, Homo sapiens
gaugaguuaacugugaaa

SEQ ID NO: 798538 - RNA, 13 nt, Homo sapiens
gaugaucacugau

SEQ ID NO: 798539 - RNA, 21 nt, Homo sapiens
gaugaucccagucacuccucu

SEQ ID NO: 798540 - RNA, 13 nt, Homo sapiens
gaugaucuacuca

SEQ ID NO: 798541 - RNA, 22 nt, Homo sapiens
gaugaucuuuaaaauacacacu

SEQ ID NO: 798542 - RNA, 14 nt, Homo sapiens
gaugaugaugacuc

SEQ ID NO: 798543 - RNA, 18 nt, Homo sapiens
gaugauucccacccaaac

SEQ ID NO: 798544 - RNA, 21 nt, Homo sapiens
gaugauucuggauucuaaaca

SEQ ID NO: 798545 - RNA, 15 nt, Homo sapiens
gaugcaauacaagau

SEQ ID NO: 798546 - RNA, 17 nt, Homo sapiens
gaugcaauauaagcaua

SEQ ID NO: 798547 - RNA, 23 nt, Homo sapiens
gaugcaaucgguuuaaacauggc

SEQ ID NO: 798548 - RNA, 16 nt, Homo sapiens
gaugcagaaagacguu

SEQ ID NO: 798549 - RNA, 14 nt, Homo sapiens
gaugcagaguaagu

SEQ ID NO: 798550 - RNA, 17 nt, Homo sapiens
gaugcagcuacuggaau

SEQ ID NO: 798551 - RNA, 16 nt, Homo sapiens
gaugcagcucuuggga

SEQ ID NO: 798552 - RNA, 20 nt, Homo sapiens
gaugcagcucuugggaccgu

SEQ ID NO: 798553 - RNA, 18 nt, Homo sapiens
gaugcaucuuguuucaua

SEQ ID NO: 798554 - RNA, 23 nt, Homo sapiens
gaugcccaccguuaggauucagg

SEQ ID NO: 798555 - RNA, 13 nt, Homo sapiens
gaugccuccuugg

SEQ ID NO: 798556 - RNA, 21 nt, Homo sapiens
gaugcggaaggauugcaaugc

SEQ ID NO: 798557 - RNA, 12 nt, Homo sapiens
gaugcugaccuc

SEQ ID NO: 798558 - RNA, 20 nt, Homo sapiens
gaugcugaggccacccacug

SEQ ID NO: 798559 - RNA, 16 nt, Homo sapiens
gaugcugccugaguca

SEQ ID NO: 798560 - RNA, 18 nt, Homo sapiens
gauggaaguugcagugag

SEQ ID NO: 798561 - RNA, 22 nt, Homo sapiens
gauggacaagauuaccccaccu

SEQ ID NO: 798562 - RNA, 22 nt, Homo sapiens
gauggacuugugauuggcugca

SEQ ID NO: 798563 - RNA, 18 nt, Homo sapiens
gauggagccagcucugca

SEQ ID NO: 798564 - RNA, 19 nt, Homo sapiens
gauggaggggugguccuga

SEQ ID NO: 798565 - RNA, 16 nt, Homo sapiens
gauggauagucugucc

SEQ ID NO: 798566 - RNA, 16 nt, Homo sapiens
gauggcaccacugcac

SEQ ID NO: 798567 - RNA, 18 nt, Homo sapiens
gauggcaccacugcacuc

SEQ ID NO: 798568 - RNA, 20 nt, Homo sapiens
gauggcauuuggucucaggc

SEQ ID NO: 798569 - RNA, 21 nt, Homo sapiens
gauggccucucucaaaagaga

SEQ ID NO: 798570 - RNA, 20 nt, Homo sapiens
gauggcgcuauugcacucca

SEQ ID NO: 798571 - RNA, 19 nt, Homo sapiens
gaugggauggguuccagag

SEQ ID NO: 798572 - RNA, 15 nt, Homo sapiens
gaugggcaacuggcu

SEQ ID NO: 798573 - RNA, 21 nt, Homo sapiens
gaugggcccuaugucucagga

SEQ ID NO: 798574 - RNA, 22 nt, Homo sapiens
gaugggguuucaccaucuuggc

SEQ ID NO: 798575 - RNA, 13 nt, Homo sapiens
gauggguggcacc

SEQ ID NO: 798576 - RNA, 17 nt, Homo sapiens
gaugguccgugcccagg

SEQ ID NO: 798577 - RNA, 14 nt, Homo sapiens
gauggugaccuggg

SEQ ID NO: 798578 - RNA, 21 nt, Homo sapiens
gaugguggccgcccacccgcc

SEQ ID NO: 798579 - RNA, 16 nt, Homo sapiens
gauggugguauuguga

SEQ ID NO: 798580 - RNA, 19 nt, Homo sapiens
gaugguuuuaucuucccuu

SEQ ID NO: 798581 - RNA, 14 nt, Homo sapiens
gauguaaccaagcu

SEQ ID NO: 798582 - RNA, 21 nt, Homo sapiens
gauguaaucucucugcagcug

SEQ ID NO: 798583 - RNA, 19 nt, Homo sapiens
gaugucauggagugacaga

SEQ ID NO: 798584 - RNA, 17 nt, Homo sapiens
gaugucucuuguagaag

SEQ ID NO: 798585 - RNA, 15 nt, Homo sapiens
gauguggagugagaa

SEQ ID NO: 798586 - RNA, 20 nt, Homo sapiens
gauguggguaagaggagcag

SEQ ID NO: 798587 - RNA, 20 nt, Homo sapiens
gauguggguguccugcagaa

SEQ ID NO: 798588 - RNA, 14 nt, Homo sapiens
gaugugucaucuaa

SEQ ID NO: 798589 - RNA, 19 nt, Homo sapiens
gauguguuaggaaugucaa

SEQ ID NO: 798590 - RNA, 21 nt, Homo sapiens
gauguuagaaagugcugauaa

SEQ ID NO: 798591 - RNA, 18 nt, Homo sapiens
gauguuccagugaggaac

SEQ ID NO: 798592 - RNA, 20 nt, Homo sapiens
gauguugacgccuaacugaa

SEQ ID NO: 798593 - RNA, 22 nt, Homo sapiens
gauguuguacgcacuggagcug

SEQ ID NO: 798594 - RNA, 21 nt, Homo sapiens
gauguuucugugaaauucuca

SEQ ID NO: 798595 - RNA, 20 nt, Homo sapiens
gauguuugaggcuuucagaa

SEQ ID NO: 798596 - RNA, 20 nt, Homo sapiens
gauguuuugucccauuuccu

SEQ ID NO: 798597 - RNA, 14 nt, Homo sapiens
gauuaaccucugca

SEQ ID NO: 798598 - RNA, 13 nt, Homo sapiens
gauuaacuccucc

SEQ ID NO: 798599 - RNA, 22 nt, Homo sapiens
gauuaagauauucagaaguaua

SEQ ID NO: 798600 - RNA, 21 nt, Homo sapiens
gauuacaaaucagaagucauc

SEQ ID NO: 798601 - RNA, 17 nt, Homo sapiens
gauuacaggcauguguc

SEQ ID NO: 798602 - RNA, 19 nt, Homo sapiens
gauuacaggcgugagccac

SEQ ID NO: 798603 - RNA, 16 nt, Homo sapiens
gauuaccgacacuguc

SEQ ID NO: 798604 - RNA, 14 nt, Homo sapiens
gauuaccugccaau

SEQ ID NO: 798605 - RNA, 23 nt, Homo sapiens
gauuacucuccauaucccuuccu

SEQ ID NO: 798606 - RNA, 19 nt, Homo sapiens
gauuacuuugcugccuuaa

SEQ ID NO: 798607 - RNA, 16 nt, Homo sapiens
gauuagguagacuuug

SEQ ID NO: 798608 - RNA, 20 nt, Homo sapiens
gauuagguguucaggccagu

SEQ ID NO: 798609 - RNA, 22 nt, Homo sapiens
gauuauaaaaaauguaacauca

SEQ ID NO: 798610 - RNA, 13 nt, Homo sapiens
gauuauaaacuga

SEQ ID NO: 798611 - RNA, 13 nt, Homo sapiens
gauuauagauucu

SEQ ID NO: 798612 - RNA, 20 nt, Homo sapiens
gauuaugaugcauacaguuu

SEQ ID NO: 798613 - RNA, 13 nt, Homo sapiens
gauuauuaauauc

SEQ ID NO: 798614 - RNA, 17 nt, Homo sapiens
gauucaacacugugcac

SEQ ID NO: 798615 - RNA, 18 nt, Homo sapiens
gauucaacacugugcacg

SEQ ID NO: 798616 - RNA, 20 nt, Homo sapiens
gauucacugcauggcuccca

SEQ ID NO: 798617 - RNA, 17 nt, Homo sapiens
gauucagaugucauuua

SEQ ID NO: 798618 - RNA, 13 nt, Homo sapiens
gauucagucacau

SEQ ID NO: 798619 - RNA, 22 nt, Homo sapiens
gauucaugauuuauaaaugcca

SEQ ID NO: 798620 - RNA, 14 nt, Homo sapiens
gauucaugccaauu

SEQ ID NO: 798621 - RNA, 22 nt, Homo sapiens
gauuccaacauuucucacugaa

SEQ ID NO: 798622 - RNA, 14 nt, Homo sapiens
gauuccacuaucuc

SEQ ID NO: 798623 - RNA, 19 nt, Homo sapiens
gauuccagcagugaaugcu

SEQ ID NO: 798624 - RNA, 14 nt, Homo sapiens
gauucccuguggug

SEQ ID NO: 798625 - RNA, 22 nt, Homo sapiens
gauuccuuuugauggggagaaa

SEQ ID NO: 798626 - RNA, 22 nt, Homo sapiens
gauuccuuuuuucaaaauccaa

SEQ ID NO: 798627 - RNA, 16 nt, Homo sapiens
gauucgcccaccucag

SEQ ID NO: 798628 - RNA, 20 nt, Homo sapiens
gauucgugacaacaugcgac

SEQ ID NO: 798629 - RNA, 17 nt, Homo sapiens
gauucuaaaacauucuu

SEQ ID NO: 798630 - RNA, 14 nt, Homo sapiens
gauucuaaucucau

SEQ ID NO: 798631 - RNA, 20 nt, Homo sapiens
gauucuccaggccauuuaau

SEQ ID NO: 798632 - RNA, 12 nt, Homo sapiens
gauucuccuuca

SEQ ID NO: 798633 - RNA, 23 nt, Homo sapiens
gauucucuuuaaaaaagacugaa

SEQ ID NO: 798634 - RNA, 18 nt, Homo sapiens
gauucugauaaugcucac

SEQ ID NO: 798635 - RNA, 19 nt, Homo sapiens
gauucugccuuguuucaua

SEQ ID NO: 798636 - RNA, 12 nt, Homo sapiens
gauucuucagcu

SEQ ID NO: 798637 - RNA, 15 nt, Homo sapiens
gauucuucucuuaau

SEQ ID NO: 798638 - RNA, 23 nt, Homo sapiens
gauucuucucuuaauuucauaga

SEQ ID NO: 798639 - RNA, 18 nt, Homo sapiens
gauucuuuccauuaugau

SEQ ID NO: 798640 - RNA, 17 nt, Homo sapiens
gauugaaggugaccucu

SEQ ID NO: 798641 - RNA, 18 nt, Homo sapiens
gauugacacacagcacuc

SEQ ID NO: 798642 - RNA, 19 nt, Homo sapiens
gauugacguaccgugcauc

SEQ ID NO: 798643 - RNA, 19 nt, Homo sapiens
gauugaggagcugcacuga

SEQ ID NO: 798644 - RNA, 22 nt, Homo sapiens
gauugaggccaagaguuaaaga

SEQ ID NO: 798645 - RNA, 13 nt, Homo sapiens
gauugcaaugccc

SEQ ID NO: 798646 - RNA, 14 nt, Homo sapiens
gauugcagacuguu

SEQ ID NO: 798647 - RNA, 19 nt, Homo sapiens
gauugcgccauugcacucc

SEQ ID NO: 798648 - RNA, 20 nt, Homo sapiens
gauuggauuauucauuuaaa

SEQ ID NO: 798649 - RNA, 19 nt, Homo sapiens
gauuggcuauaacaugucu

SEQ ID NO: 798650 - RNA, 19 nt, Homo sapiens
gauugguguucguuuccau

SEQ ID NO: 798651 - RNA, 17 nt, Homo sapiens
gauuguggaaaauggag

SEQ ID NO: 798652 - RNA, 17 nt, Homo sapiens
gauuguucaucaugaca

SEQ ID NO: 798653 - RNA, 18 nt, Homo sapiens
gauuguuguguagucaag

SEQ ID NO: 798654 - RNA, 15 nt, Homo sapiens
gauuguuguuugcca

SEQ ID NO: 798655 - RNA, 20 nt, Homo sapiens
gauuuaaaaaaagaacauaa

SEQ ID NO: 798656 - RNA, 16 nt, Homo sapiens
gauuuaagcaaaggcu

SEQ ID NO: 798657 - RNA, 21 nt, Homo sapiens
gauuuagaaaaaaguuuacaa

SEQ ID NO: 798658 - RNA, 22 nt, Homo sapiens
gauuuaggccuuaacacacugg

SEQ ID NO: 798659 - RNA, 23 nt, Homo sapiens
gauuuaggccuuaacacacuggc

SEQ ID NO: 798660 - RNA, 14 nt, Homo sapiens
gauuuaugugcacu

SEQ ID NO: 798661 - RNA, 13 nt, Homo sapiens
gauuucaggauac

SEQ ID NO: 798662 - RNA, 15 nt, Homo sapiens
gauuucaugauuuca

SEQ ID NO: 798663 - RNA, 19 nt, Homo sapiens
gauuucccacugcacucca

SEQ ID NO: 798664 - RNA, 23 nt, Homo sapiens
gauuuccuccucccagugccuuc

SEQ ID NO: 798665 - RNA, 23 nt, Homo sapiens
gauuuccugcugccauccucacc

SEQ ID NO: 798666 - RNA, 19 nt, Homo sapiens
gauuuccuugugcaaaaua

SEQ ID NO: 798667 - RNA, 16 nt, Homo sapiens
gauuucuuaguucaua

SEQ ID NO: 798668 - RNA, 18 nt, Homo sapiens
gauuucuucgcugcucua

SEQ ID NO: 798669 - RNA, 21 nt, Homo sapiens
gauuugaacccccgccauccu

SEQ ID NO: 798670 - RNA, 15 nt, Homo sapiens
gauuugaacuugcuc

SEQ ID NO: 798671 - RNA, 22 nt, Homo sapiens
gauuugauugggaugaaugcca

SEQ ID NO: 798672 - RNA, 14 nt, Homo sapiens
gauuugccauucaa

SEQ ID NO: 798673 - RNA, 15 nt, Homo sapiens
gauuugccauucaag

SEQ ID NO: 798674 - RNA, 20 nt, Homo sapiens
gauuugccguaccaaucucu

SEQ ID NO: 798675 - RNA, 11 nt, Homo sapiens
gauuugcucag

SEQ ID NO: 798676 - RNA, 23 nt, Homo sapiens
gauuugggcuacccuaaagggag

SEQ ID NO: 798677 - RNA, 17 nt, Homo sapiens
gauuuggggccucaaga

SEQ ID NO: 798678 - RNA, 20 nt, Homo sapiens
gauuugguacuuuugagugu

SEQ ID NO: 798679 - RNA, 13 nt, Homo sapiens
gauuuggugacca

SEQ ID NO: 798680 - RNA, 22 nt, Homo sapiens
gauuugucccuaugcauaucag

SEQ ID NO: 798681 - RNA, 12 nt, Homo sapiens
gauuuguugcca

SEQ ID NO: 798682 - RNA, 18 nt, Homo sapiens
gauuuguuuugcauuccu

SEQ ID NO: 798683 - RNA, 15 nt, Homo sapiens
gauuuuaccaaagca

SEQ ID NO: 798684 - RNA, 19 nt, Homo sapiens
gauuuuaccaaagcaucaa

SEQ ID NO: 798685 - RNA, 12 nt, Homo sapiens
gauuuucuugcc

SEQ ID NO: 798686 - RNA, 13 nt, Homo sapiens
gauuuugaaccca

SEQ ID NO: 798687 - RNA, 22 nt, Homo sapiens
gauuuugaacuugaguaauuca

SEQ ID NO: 798688 - RNA, 18 nt, Homo sapiens
gauuuugaaucaagcaau

SEQ ID NO: 798689 - RNA, 15 nt, Homo sapiens
gauuuugucuaccau

SEQ ID NO: 798690 - RNA, 18 nt, Homo sapiens
gauuuuuuccucugcauu

SEQ ID NO: 798691 - RNA, 19 nt, Homo sapiens
gauuuuuuucauuuugcca

SEQ ID NO: 798692 - RNA, 22 nt, Homo sapiens
gauuuuuuuuaauuaccaugcu

SEQ ID NO: 798693 - RNA, 22 nt, Homo sapiens
gauuuuuuuuucauacacuuau

SEQ ID NO: 798694 - RNA, 13 nt, Homo sapiens
gcaaaaaguauug

SEQ ID NO: 798695 - RNA, 14 nt, Homo sapiens
gcaaaaaucuccca

SEQ ID NO: 798696 - RNA, 19 nt, Homo sapiens
gcaaaaauggauauuauua

SEQ ID NO: 798697 - RNA, 17 nt, Homo sapiens
gcaaaacuccaucucaa

SEQ ID NO: 798698 - RNA, 15 nt, Homo sapiens
gcaaaacuccgucuc

SEQ ID NO: 798699 - RNA, 20 nt, Homo sapiens
gcaaaacuccgucucaaaaa

SEQ ID NO: 798700 - RNA, 19 nt, Homo sapiens
gcaaaagcaggcgacaaaa

SEQ ID NO: 798701 - RNA, 12 nt, Homo sapiens
gcaaaagucauu

SEQ ID NO: 798702 - RNA, 16 nt, Homo sapiens
gcaaaaucaucuuaca

SEQ ID NO: 798703 - RNA, 15 nt, Homo sapiens
gcaaaaugcuuacag

SEQ ID NO: 798704 - RNA, 21 nt, Homo sapiens
gcaaacaugcaagaugaaccu

SEQ ID NO: 798705 - RNA, 18 nt, Homo sapiens
gcaaacucacugcucaag

SEQ ID NO: 798706 - RNA, 13 nt, Homo sapiens
gcaaacuuauuug

SEQ ID NO: 798707 - RNA, 14 nt, Homo sapiens
gcaaagacaucaaa

SEQ ID NO: 798708 - RNA, 12 nt, Homo sapiens
gcaaagagccag

SEQ ID NO: 798709 - RNA, 14 nt, Homo sapiens
gcaaagagccagca

SEQ ID NO: 798710 - RNA, 18 nt, Homo sapiens
gcaaagauccccaaaaca

SEQ ID NO: 798711 - RNA, 20 nt, Homo sapiens
gcaaagcaaauguugggaaa

SEQ ID NO: 798712 - RNA, 22 nt, Homo sapiens
gcaaaggaaaaauugaugaaua

SEQ ID NO: 798713 - RNA, 19 nt, Homo sapiens
gcaaaggaaacuuugcaga

SEQ ID NO: 798714 - RNA, 12 nt, Homo sapiens
gcaaaggaacua

SEQ ID NO: 798715 - RNA, 17 nt, Homo sapiens
gcaaagggagcacuggg

SEQ ID NO: 798716 - RNA, 18 nt, Homo sapiens
gcaaagggagcacugggu

SEQ ID NO: 798717 - RNA, 15 nt, Homo sapiens
gcaaagggagcagaa

SEQ ID NO: 798718 - RNA, 21 nt, Homo sapiens
gcaaagucaucaaagauugag

SEQ ID NO: 798719 - RNA, 15 nt, Homo sapiens
gcaaauaaaccacuu

SEQ ID NO: 798720 - RNA, 15 nt, Homo sapiens
gcaaauacaaucagc

SEQ ID NO: 798721 - RNA, 15 nt, Homo sapiens
gcaaauacacuccag

SEQ ID NO: 798722 - RNA, 15 nt, Homo sapiens
gcaaauagccacaau

SEQ ID NO: 798723 - RNA, 18 nt, Homo sapiens
gcaaauaguagacauuug

SEQ ID NO: 798724 - RNA, 17 nt, Homo sapiens
gcuuuggaugucuuugc

SEQ ID NO: 798725 - RNA, 20 nt, Homo sapiens
gcuuugggugccuuugccac

SEQ ID NO: 798726 - RNA, 22 nt, Homo sapiens
gcuuuggguggcucacuacuga

SEQ ID NO: 798727 - RNA, 14 nt, Homo sapiens
gcuuugguuuauau

SEQ ID NO: 798728 - RNA, 17 nt, Homo sapiens
gcuuuguaugacaguga

SEQ ID NO: 798729 - RNA, 23 nt, Homo sapiens
gcuuuguugaaugaagcagagaa

SEQ ID NO: 798730 - RNA, 17 nt, Homo sapiens
gcuuuuaaaugaccaaa

SEQ ID NO: 798731 - RNA, 17 nt, Homo sapiens
gcuuuucuaacuaagag

SEQ ID NO: 798732 - RNA, 18 nt, Homo sapiens
gcuuuugagaaccaagua

SEQ ID NO: 798733 - RNA, 23 nt, Homo sapiens
gcuuuugcccacacacuuuccau

SEQ ID NO: 798734 - RNA, 16 nt, Homo sapiens
gcuuuugcuugcaaug

SEQ ID NO: 798735 - RNA, 23 nt, Homo sapiens
gcuuuuucacagucacugaugua

SEQ ID NO: 798736 - RNA, 18 nt, Homo sapiens
gcuuuuuuaaacuugaau

SEQ ID NO: 798737 - RNA, 15 nt, Homo sapiens
ggaaaaaaagcaaaa

SEQ ID NO: 798738 - RNA, 21 nt, Homo sapiens
ggaaaaaaauaguaaagccaa

SEQ ID NO: 798739 - RNA, 16 nt, Homo sapiens
ggaaaacgaagcucau

SEQ ID NO: 798740 - RNA, 12 nt, Homo sapiens
ggaaaacuacug

SEQ ID NO: 798741 - RNA, 23 nt, Homo sapiens
ggaaaagaaagaagagaagggga

SEQ ID NO: 798742 - RNA, 21 nt, Homo sapiens
ggaaaagagcgcaucaggccu

SEQ ID NO: 798743 - RNA, 20 nt, Homo sapiens
ggaaaaggggugaccuagua

SEQ ID NO: 798744 - RNA, 22 nt, Homo sapiens
ggaaaaguguaauagcauacau

SEQ ID NO: 798745 - RNA, 19 nt, Homo sapiens
ggaaaaguuagucaauccu

SEQ ID NO: 798746 - RNA, 17 nt, Homo sapiens
ggaaaauaaacaucagu

SEQ ID NO: 798747 - RNA, 20 nt, Homo sapiens
ggaaaauauaauauuuacug

SEQ ID NO: 798748 - RNA, 14 nt, Homo sapiens
ggaaaauucuuaaa

SEQ ID NO: 798749 - RNA, 23 nt, Homo sapiens
ggaaacaauauaaccacaaagca

SEQ ID NO: 798750 - RNA, 11 nt, Homo sapiens
ggaaacagcau

SEQ ID NO: 798751 - RNA, 16 nt, Homo sapiens
ggaaaccacagucagu

SEQ ID NO: 798752 - RNA, 14 nt, Homo sapiens
ggaaaccaguguag

SEQ ID NO: 798753 - RNA, 21 nt, Homo sapiens
ggaaaccaguuuggugauaua

SEQ ID NO: 798754 - RNA, 18 nt, Homo sapiens
ggaaacccccaguguaau

SEQ ID NO: 798755 - RNA, 16 nt, Homo sapiens
ggaaaccgccuaguuu

SEQ ID NO: 798756 - RNA, 16 nt, Homo sapiens
ggaaaccgcugccuuu

SEQ ID NO: 798757 - RNA, 18 nt, Homo sapiens
ggaaaccugcccugccug

SEQ ID NO: 798758 - RNA, 17 nt, Homo sapiens
ggaaaccuuccacccag

SEQ ID NO: 798759 - RNA, 16 nt, Homo sapiens
ggaaacuauucaugaa

SEQ ID NO: 798760 - RNA, 17 nt, Homo sapiens
ggaaacucacacucccc

SEQ ID NO: 798761 - RNA, 20 nt, Homo sapiens
ggaaacucggcagcccuucc

SEQ ID NO: 798762 - RNA, 19 nt, Homo sapiens
ggaaagagcacccucgaga

SEQ ID NO: 798763 - RNA, 20 nt, Homo sapiens
ggaaagcauaugcagccaac

SEQ ID NO: 798764 - RNA, 16 nt, Homo sapiens
ggaaaggcaggugggc

SEQ ID NO: 798765 - RNA, 17 nt, Homo sapiens
ggaaagggcagggccaa

SEQ ID NO: 798766 - RNA, 15 nt, Homo sapiens
ggaaaggggguccca

SEQ ID NO: 798767 - RNA, 13 nt, Homo sapiens
ggaaagguccugc

SEQ ID NO: 798768 - RNA, 16 nt, Homo sapiens
ggaaagucacccaaac

SEQ ID NO: 798769 - RNA, 21 nt, Homo sapiens
ggaaagucacccaaacacuuc

SEQ ID NO: 798770 - RNA, 15 nt, Homo sapiens
ggaaauaacugccuu

SEQ ID NO: 798771 - RNA, 22 nt, Homo sapiens
ggaaaucugccaugagcacaaa

SEQ ID NO: 798772 - RNA, 17 nt, Homo sapiens
ggaaaugagaacauucc

SEQ ID NO: 798773 - RNA, 15 nt, Homo sapiens
ggaaauguagcacuu

SEQ ID NO: 798774 - RNA, 11 nt, Homo sapiens
ggaaaugucac

SEQ ID NO: 798775 - RNA, 15 nt, Homo sapiens
ggaaauuaagacuuu

SEQ ID NO: 798776 - RNA, 16 nt, Homo sapiens
ggaaauuccaacagau

SEQ ID NO: 798777 - RNA, 19 nt, Homo sapiens
ggaaauuguuuauguguua

SEQ ID NO: 798778 - RNA, 18 nt, Homo sapiens
ggaaauuuuucagacuuu

SEQ ID NO: 798779 - RNA, 14 nt, Homo sapiens
ggaacaagcaugau

SEQ ID NO: 798780 - RNA, 12 nt, Homo sapiens
ggaacaauccau

SEQ ID NO: 798781 - RNA, 18 nt, Homo sapiens
ggaacacauaagaacugu

SEQ ID NO: 798782 - RNA, 13 nt, Homo sapiens
ggaacagaauguu

SEQ ID NO: 798783 - RNA, 18 nt, Homo sapiens
ggaacagacaacagaagu

SEQ ID NO: 798784 - RNA, 17 nt, Homo sapiens
ggaaccacgucugcuaa

SEQ ID NO: 798785 - RNA, 17 nt, Homo sapiens
ggaaccgggaagggugg

SEQ ID NO: 798786 - RNA, 21 nt, Homo sapiens
ggaaccucagccuggccagac

SEQ ID NO: 798787 - RNA, 17 nt, Homo sapiens
ggaaccuguccuaagga

SEQ ID NO: 798788 - RNA, 23 nt, Homo sapiens
ggaacuagaaagaaggacccaga

SEQ ID NO: 798789 - RNA, 14 nt, Homo sapiens
ggaacucacuuucc

SEQ ID NO: 798790 - RNA, 14 nt, Homo sapiens
ggaacucagaucca

SEQ ID NO: 798791 - RNA, 22 nt, Homo sapiens
ggaacuccagagaugagugucu

SEQ ID NO: 798792 - RNA, 13 nt, Homo sapiens
ggaacucucucca

SEQ ID NO: 798793 - RNA, 23 nt, Homo sapiens
ggaacugggccaacucaccugag

SEQ ID NO: 798794 - RNA, 19 nt, Homo sapiens
ggaagaaacaaaguugaac

SEQ ID NO: 798795 - RNA, 15 nt, Homo sapiens
ggaagaacugugaua

SEQ ID NO: 798796 - RNA, 23 nt, Homo sapiens
ggaagaccagcuuugcagugaca

SEQ ID NO: 798797 - RNA, 16 nt, Homo sapiens
ggaagacuauggugcu

SEQ ID NO: 798798 - RNA, 22 nt, Homo sapiens
ggaagagcccgcagggccaugc

SEQ ID NO: 798799 - RNA, 18 nt, Homo sapiens
ccacaccugcagugccag

SEQ ID NO: 798800 - RNA, 16 nt, Homo sapiens
ccacaccugggcauuu

SEQ ID NO: 798801 - RNA, 17 nt, Homo sapiens
ccacacggcugaccuca

SEQ ID NO: 798802 - RNA, 19 nt, Homo sapiens
ccacacugauccuggagaa

SEQ ID NO: 798803 - RNA, 14 nt, Homo sapiens
ccacacuuccauga

SEQ ID NO: 798804 - RNA, 19 nt, Homo sapiens
ccacagaaagcuccuucca

SEQ ID NO: 798805 - RNA, 22 nt, Homo sapiens
ccacagaaagcuccuuccagac

SEQ ID NO: 798806 - RNA, 22 nt, Homo sapiens
ccacagaaggaggaaguggaag

SEQ ID NO: 798807 - RNA, 19 nt, Homo sapiens
ccacagacgggcacacaga

SEQ ID NO: 798808 - RNA, 23 nt, Homo sapiens
ccacagagaaguuuguagccagg

SEQ ID NO: 798809 - RNA, 21 nt, Homo sapiens
ccacagagagggagagcagag

SEQ ID NO: 798810 - RNA, 18 nt, Homo sapiens
ccacagaugauacuucca

SEQ ID NO: 798811 - RNA, 10 nt, Homo sapiens
ccacagcagg

SEQ ID NO: 798812 - RNA, 18 nt, Homo sapiens
ccacagccaggccgagag

SEQ ID NO: 798813 - RNA, 12 nt, Homo sapiens
ccacagccaugg

SEQ ID NO: 798814 - RNA, 21 nt, Homo sapiens
ccacagccccucaaagacuuu

SEQ ID NO: 798815 - RNA, 20 nt, Homo sapiens
ccacagcgaaggcacaugcc

SEQ ID NO: 798816 - RNA, 21 nt, Homo sapiens
ccacagcgagggcagcugcua

SEQ ID NO: 798817 - RNA, 17 nt, Homo sapiens
ccacagcuggcucugac

SEQ ID NO: 798818 - RNA, 13 nt, Homo sapiens
ccacagcugugca

SEQ ID NO: 798819 - RNA, 19 nt, Homo sapiens
ccacagcugugcaugcuca

SEQ ID NO: 798820 - RNA, 17 nt, Homo sapiens
ccacaggaccccaagaa

SEQ ID NO: 798821 - RNA, 19 nt, Homo sapiens
ccacaggcaaaacucagua

SEQ ID NO: 798822 - RNA, 14 nt, Homo sapiens
ccacaggcacaggu

SEQ ID NO: 798823 - RNA, 21 nt, Homo sapiens
ccacaggccugagauuucauc

SEQ ID NO: 798824 - RNA, 17 nt, Homo sapiens
ccacaguacucacuuuu

SEQ ID NO: 798825 - RNA, 12 nt, Homo sapiens
ccacagucagug

SEQ ID NO: 798826 - RNA, 14 nt, Homo sapiens
ccacagucagugga

SEQ ID NO: 798827 - RNA, 17 nt, Homo sapiens
ccacauaagaaggcaau

SEQ ID NO: 798828 - RNA, 20 nt, Homo sapiens
ccacauaagaaggcaauuuu

SEQ ID NO: 798829 - RNA, 19 nt, Homo sapiens
ccacauauuuuagacacuu

SEQ ID NO: 798830 - RNA, 21 nt, Homo sapiens
ccacauauuuuagacacuucc

SEQ ID NO: 798831 - RNA, 13 nt, Homo sapiens
ccacaucccacau

SEQ ID NO: 798832 - RNA, 14 nt, Homo sapiens
ccacaugaccucca

SEQ ID NO: 798833 - RNA, 23 nt, Homo sapiens
ccacauggccgggcccucuguag

SEQ ID NO: 798834 - RNA, 22 nt, Homo sapiens
ccacaugugacacauaugcacc

SEQ ID NO: 798835 - RNA, 18 nt, Homo sapiens
ccaccaauugagcaagau

SEQ ID NO: 798836 - RNA, 20 nt, Homo sapiens
ccaccaccaaaacugcuccu

SEQ ID NO: 798837 - RNA, 15 nt, Homo sapiens
ccaccaccacuggcc

SEQ ID NO: 798838 - RNA, 21 nt, Homo sapiens
ccaccacuuuuggauuuuaug

SEQ ID NO: 798839 - RNA, 18 nt, Homo sapiens
ccaccagccugcacuacu

SEQ ID NO: 798840 - RNA, 19 nt, Homo sapiens
ccaccauaaaucacaucau

SEQ ID NO: 798841 - RNA, 19 nt, Homo sapiens
ccaccauucacauuugaug

SEQ ID NO: 798842 - RNA, 19 nt, Homo sapiens
ccaccauuccugccuuuaa

SEQ ID NO: 798843 - RNA, 17 nt, Homo sapiens
ccaccauugucagcuca

SEQ ID NO: 798844 - RNA, 19 nt, Homo sapiens
ccaccauuguucauuugug

SEQ ID NO: 798845 - RNA, 12 nt, Homo sapiens
ccaccauuuaug

SEQ ID NO: 798846 - RNA, 14 nt, Homo sapiens
ccacccaacccaaa

SEQ ID NO: 798847 - RNA, 16 nt, Homo sapiens
ccacccaccuuugcca

SEQ ID NO: 798848 - RNA, 12 nt, Homo sapiens
ccaccccaagag

SEQ ID NO: 798849 - RNA, 13 nt, Homo sapiens
ccaccccaagaga

SEQ ID NO: 798850 - RNA, 14 nt, Homo sapiens
ccaccccaagagaa

SEQ ID NO: 798851 - RNA, 13 nt, Homo sapiens
ccaccccagcuca

SEQ ID NO: 798852 - RNA, 24 nt, Homo sapiens
ccaccccagguuuuucaucugaaa

SEQ ID NO: 798853 - RNA, 14 nt, Homo sapiens
ccacccccagcuca

SEQ ID NO: 798854 - RNA, 16 nt, Homo sapiens
ccacccccagcucaau

SEQ ID NO: 798855 - RNA, 14 nt, Homo sapiens
ccacccgaugcugc

SEQ ID NO: 798856 - RNA, 15 nt, Homo sapiens
ccacccgggggagcc

SEQ ID NO: 798857 - RNA, 19 nt, Homo sapiens
ccacccgugggaaugcugc

SEQ ID NO: 798858 - RNA, 15 nt, Homo sapiens
ccacccuaccaugaa

SEQ ID NO: 798859 - RNA, 21 nt, Homo sapiens
ccacccuagccaaugucuccu

SEQ ID NO: 798860 - RNA, 13 nt, Homo sapiens
ccacccuaguccc

SEQ ID NO: 798861 - RNA, 14 nt, Homo sapiens
ccacccucuuccca

SEQ ID NO: 798862 - RNA, 22 nt, Homo sapiens
ccacccuuggaggcugucuucu

SEQ ID NO: 798863 - RNA, 20 nt, Homo sapiens
ccaccuaauccuucuggcaa

SEQ ID NO: 798864 - RNA, 21 nt, Homo sapiens
ccaccuacuuuucuuuccuca

SEQ ID NO: 798865 - RNA, 21 nt, Homo sapiens
ccaccuaugccagugcucaag

SEQ ID NO: 798866 - RNA, 14 nt, Homo sapiens
ccaccucaccaaaa

SEQ ID NO: 798867 - RNA, 15 nt, Homo sapiens
ccaccuccugcaaua

SEQ ID NO: 798868 - RNA, 10 nt, Homo sapiens
ccaccugcua

SEQ ID NO: 798869 - RNA, 15 nt, Homo sapiens
ccaccuggacgaaga

SEQ ID NO: 798870 - RNA, 20 nt, Homo sapiens
ccaccuggggaugaagcuca

SEQ ID NO: 798871 - RNA, 14 nt, Homo sapiens
ccaccugucccacu

SEQ ID NO: 798872 - RNA, 22 nt, Homo sapiens
ccaccuguuaaaauguacacug

SEQ ID NO: 798873 - RNA, 15 nt, Homo sapiens
ccaccuuaguacuuu

SEQ ID NO: 798874 - RNA, 21 nt, Homo sapiens
ccaccuucuucuccuacauau

SEQ ID NO: 798875 - RNA, 15 nt, Homo sapiens
gcaaaucaacacuuu

SEQ ID NO: 798876 - RNA, 21 nt, Homo sapiens
gcaaaugacaugcacugaccc

SEQ ID NO: 798877 - RNA, 15 nt, Homo sapiens
gcaaauggugcugaa

SEQ ID NO: 798878 - RNA, 15 nt, Homo sapiens
gcaaauguacuucuc

SEQ ID NO: 798879 - RNA, 21 nt, Homo sapiens
gcaaauguguacgugcaugcu

SEQ ID NO: 798880 - RNA, 20 nt, Homo sapiens
gcaaauuaguugguuugugu

SEQ ID NO: 798881 - RNA, 16 nt, Homo sapiens
gcaaauucaagagccu

SEQ ID NO: 798882 - RNA, 21 nt, Homo sapiens
gcaacaagaccaccacuucga

SEQ ID NO: 798883 - RNA, 14 nt, Homo sapiens
gcaacaagaucuga

SEQ ID NO: 798884 - RNA, 23 nt, Homo sapiens
gcaacaauaaugauuuucuugcc

SEQ ID NO: 798885 - RNA, 23 nt, Homo sapiens
gcaacaauauccuuuuacugcag

SEQ ID NO: 798886 - RNA, 20 nt, Homo sapiens
gcaacaaugagcagaccaac

SEQ ID NO: 798887 - RNA, 18 nt, Homo sapiens
gcaacacugcuguccaca

SEQ ID NO: 798888 - RNA, 21 nt, Homo sapiens
gcaacagagcaagacuccauc

SEQ ID NO: 798889 - RNA, 21 nt, Homo sapiens
gcaacagauaaguuugcaguu

SEQ ID NO: 798890 - RNA, 21 nt, Homo sapiens
gcaacaggauugaucauucuu

SEQ ID NO: 798891 - RNA, 11 nt, Homo sapiens
gcaacaucucu

SEQ ID NO: 798892 - RNA, 16 nt, Homo sapiens
gcaacaucucugggaa

SEQ ID NO: 798893 - RNA, 12 nt, Homo sapiens
gcaaccaggaac

SEQ ID NO: 798894 - RNA, 16 nt, Homo sapiens
gcaacccgguuuacca

SEQ ID NO: 798895 - RNA, 19 nt, Homo sapiens
gcaacccgguuuaccaguu

SEQ ID NO: 798896 - RNA, 20 nt, Homo sapiens
gcaaccuccgccucccaggu

SEQ ID NO: 798897 - RNA, 12 nt, Homo sapiens
gcaaccucugua

SEQ ID NO: 798898 - RNA, 14 nt, Homo sapiens
gcaaccucuuugcu

SEQ ID NO: 798899 - RNA, 18 nt, Homo sapiens
gcaacgccgugggcugcg

SEQ ID NO: 798900 - RNA, 16 nt, Homo sapiens
gcaacuaggccuucag

SEQ ID NO: 798901 - RNA, 17 nt, Homo sapiens
gcaacugcgacaaaaca

SEQ ID NO: 798902 - RNA, 11 nt, Homo sapiens
gcaacugcugu

SEQ ID NO: 798903 - RNA, 22 nt, Homo sapiens
gcaacuuaagcugggauaauca

SEQ ID NO: 798904 - RNA, 15 nt, Homo sapiens
gcaagaagcuguuac

SEQ ID NO: 798905 - RNA, 20 nt, Homo sapiens
gcaagaccacgucucuaaau

SEQ ID NO: 798906 - RNA, 16 nt, Homo sapiens
gcaagacuccaucuca

SEQ ID NO: 798907 - RNA, 12 nt, Homo sapiens
gcaagagacugg

SEQ ID NO: 798908 - RNA, 22 nt, Homo sapiens
gcaagagaggaugacacaucaa

SEQ ID NO: 798909 - RNA, 19 nt, Homo sapiens
gcaagagugauugcagcuu

SEQ ID NO: 798910 - RNA, 16 nt, Homo sapiens
gcaagaguggacugaa

SEQ ID NO: 798911 - RNA, 23 nt, Homo sapiens
gcaagaugcgcacugcauuccac

SEQ ID NO: 798912 - RNA, 16 nt, Homo sapiens
gcaagccugucuucag

SEQ ID NO: 798913 - RNA, 17 nt, Homo sapiens
gcaagccuugcuagaca

SEQ ID NO: 798914 - RNA, 15 nt, Homo sapiens
gcaagcucugccucc

SEQ ID NO: 798915 - RNA, 22 nt, Homo sapiens
gcaagcugggacuggcaggaaa

SEQ ID NO: 798916 - RNA, 21 nt, Homo sapiens
gcaaggaagguaaaaaguuaa

SEQ ID NO: 798917 - RNA, 16 nt, Homo sapiens
gcaaggcacugacuga

SEQ ID NO: 798918 - RNA, 18 nt, Homo sapiens
gcaaggccugguguuucu

SEQ ID NO: 798919 - RNA, 15 nt, Homo sapiens
gcaaggccugugcug

SEQ ID NO: 798920 - RNA, 22 nt, Homo sapiens
gcaagggaggaacaaaugaaga

SEQ ID NO: 798921 - RNA, 13 nt, Homo sapiens
gcaagguguuucu

SEQ ID NO: 798922 - RNA, 19 nt, Homo sapiens
gcaagguuuuagcuuucag

SEQ ID NO: 798923 - RNA, 21 nt, Homo sapiens
gcaaguagcacaugguuuaaa

SEQ ID NO: 798924 - RNA, 14 nt, Homo sapiens
gcaagucacuggcc

SEQ ID NO: 798925 - RNA, 16 nt, Homo sapiens
gcaagucccugacucu

SEQ ID NO: 798926 - RNA, 15 nt, Homo sapiens
gcaagugaaagcaag

SEQ ID NO: 798927 - RNA, 15 nt, Homo sapiens
gcaaguggcuuucaa

SEQ ID NO: 798928 - RNA, 13 nt, Homo sapiens
gcaaguuacugca

SEQ ID NO: 798929 - RNA, 16 nt, Homo sapiens
gcaaguuuccaucauc

SEQ ID NO: 798930 - RNA, 18 nt, Homo sapiens
gcaauaaaaaucauagua

SEQ ID NO: 798931 - RNA, 22 nt, Homo sapiens
gcaauaaacauacgugugcaug

SEQ ID NO: 798932 - RNA, 17 nt, Homo sapiens
gcaauaauaagugaugu

SEQ ID NO: 798933 - RNA, 13 nt, Homo sapiens
gcaauaccaaugu

SEQ ID NO: 798934 - RNA, 12 nt, Homo sapiens
gcaauacuguag

SEQ ID NO: 798935 - RNA, 19 nt, Homo sapiens
gcaauagacacauacaugu

SEQ ID NO: 798936 - RNA, 18 nt, Homo sapiens
gcaauagcccugauuaac

SEQ ID NO: 798937 - RNA, 16 nt, Homo sapiens
gcaauauggaagcaac

SEQ ID NO: 798938 - RNA, 14 nt, Homo sapiens
gcaauauuccagua

SEQ ID NO: 798939 - RNA, 15 nt, Homo sapiens
gcaaucaugagcaag

SEQ ID NO: 798940 - RNA, 14 nt, Homo sapiens
gcaaucuuugccuu

SEQ ID NO: 798941 - RNA, 22 nt, Homo sapiens
gcaaugaggcagauagcacugg

SEQ ID NO: 798942 - RNA, 17 nt, Homo sapiens
gcaaugaugacccacua

SEQ ID NO: 798943 - RNA, 18 nt, Homo sapiens
gcaaugcuaauucaaugc

SEQ ID NO: 798944 - RNA, 21 nt, Homo sapiens
gcaauggaagcccucaaagaa

SEQ ID NO: 798945 - RNA, 23 nt, Homo sapiens
gcaauggugucaguauccaggcu

SEQ ID NO: 798946 - RNA, 16 nt, Homo sapiens
gcaauguauagugucu

SEQ ID NO: 798947 - RNA, 22 nt, Homo sapiens
gcaauuccgcauuuaauucaug

SEQ ID NO: 798948 - RNA, 12 nt, Homo sapiens
gcaauugcucau

SEQ ID NO: 798949 - RNA, 17 nt, Homo sapiens
gcaauugcucaugcaua

SEQ ID NO: 798950 - RNA, 20 nt, Homo sapiens
gcaauuguuacaaguguucu

SEQ ID NO: 798951 - RNA, 22 nt, Homo sapiens
gcaauuucauaugcuguauauc

SEQ ID NO: 798952 - RNA, 23 nt, Homo sapiens
gcaauuuuaguguauuaaucaua

SEQ ID NO: 798953 - RNA, 14 nt, Homo sapiens
gcacaaacaauaug

SEQ ID NO: 798954 - RNA, 20 nt, Homo sapiens
gcacaaagcucaagaugaca

SEQ ID NO: 798955 - RNA, 21 nt, Homo sapiens
gcacaaagcucaagaugacag

SEQ ID NO: 798956 - RNA, 22 nt, Homo sapiens
gcacaaaucuugggucuugggg

SEQ ID NO: 798957 - RNA, 19 nt, Homo sapiens
gcacaacaguucucuucua

SEQ ID NO: 798958 - RNA, 14 nt, Homo sapiens
gcacaagccacaag

SEQ ID NO: 798959 - RNA, 15 nt, Homo sapiens
gcacaaggccuugcc

SEQ ID NO: 798960 - RNA, 23 nt, Homo sapiens
gcacaauaacuaguaauaccaaa

SEQ ID NO: 798961 - RNA, 16 nt, Homo sapiens
gcacaauuguaauuga

SEQ ID NO: 798962 - RNA, 22 nt, Homo sapiens
gcacaauuucccuucauacucc

SEQ ID NO: 798963 - RNA, 18 nt, Homo sapiens
gcacaauuugcacuaaau

SEQ ID NO: 798964 - RNA, 18 nt, Homo sapiens
gcacacagagauucugga

SEQ ID NO: 798965 - RNA, 23 nt, Homo sapiens
gcacacagcuuagaagugcuaua

SEQ ID NO: 798966 - RNA, 23 nt, Homo sapiens
gcacaccccuggggcugagucuc

SEQ ID NO: 798967 - RNA, 17 nt, Homo sapiens
gcacacccuccagagac

SEQ ID NO: 798968 - RNA, 21 nt, Homo sapiens
gcacaccucugcaccuuugca

SEQ ID NO: 798969 - RNA, 17 nt, Homo sapiens
gcacacgaguuccagac

SEQ ID NO: 798970 - RNA, 21 nt, Homo sapiens
gcacacuagccucuccaggaa

SEQ ID NO: 798971 - RNA, 19 nt, Homo sapiens
gcacacuccccugcacugg

SEQ ID NO: 798972 - RNA, 20 nt, Homo sapiens
gcacacuuaugggccaagcc

SEQ ID NO: 798973 - RNA, 17 nt, Homo sapiens
gcacagaaauuuucaau

SEQ ID NO: 798974 - RNA, 18 nt, Homo sapiens
gcacagaaggaaucugug

SEQ ID NO: 798975 - RNA, 19 nt, Homo sapiens
aaacuuugaggaacauuca

SEQ ID NO: 798976 - RNA, 20 nt, Homo sapiens
aaacuuugaggaacauucaa

SEQ ID NO: 798977 - RNA, 23 nt, Homo sapiens
aaacuuuuguucuuuaauaugcu

SEQ ID NO: 798978 - RNA, 23 nt, Homo sapiens
aaacuuuuuuucuguaccaguua

SEQ ID NO: 798979 - RNA, 23 nt, Homo sapiens
aaagaaaaauaucuuggccuaaa

SEQ ID NO: 798980 - RNA, 21 nt, Homo sapiens
aaagaaacuauaaaguuuuau

SEQ ID NO: 798981 - RNA, 12 nt, Homo sapiens
aaagaaauccau

SEQ ID NO: 798982 - RNA, 20 nt, Homo sapiens
aaagaaauccauaucuuaaa

SEQ ID NO: 798983 - RNA, 17 nt, Homo sapiens
aaagaaauugcaugcag

SEQ ID NO: 798984 - RNA, 19 nt, Homo sapiens
aaagaacaacuugcuacug

SEQ ID NO: 798985 - RNA, 13 nt, Homo sapiens
aaagaaccaaaag

SEQ ID NO: 798986 - RNA, 11 nt, Homo sapiens
aaagaagggau

SEQ ID NO: 798987 - RNA, 22 nt, Homo sapiens
aaagaagguuggugaauuucac

SEQ ID NO: 798988 - RNA, 22 nt, Homo sapiens
aaagaaguaugguaaucuuuac

SEQ ID NO: 798989 - RNA, 14 nt, Homo sapiens
aaagaauacagaaa

SEQ ID NO: 798990 - RNA, 15 nt, Homo sapiens
aaagaaucuacuaua

SEQ ID NO: 798991 - RNA, 12 nt, Homo sapiens
aaagaauuacag

SEQ ID NO: 798992 - RNA, 18 nt, Homo sapiens
aaagacaggguuucacca

SEQ ID NO: 798993 - RNA, 17 nt, Homo sapiens
aaagacaucagucucca

SEQ ID NO: 798994 - RNA, 21 nt, Homo sapiens
aaagaccaaauuccuuggcau

SEQ ID NO: 798995 - RNA, 14 nt, Homo sapiens
aaagaccuaugagc

SEQ ID NO: 798996 - RNA, 18 nt, Homo sapiens
aaagaccuuccagcuccu

SEQ ID NO: 798997 - RNA, 18 nt, Homo sapiens
aaagacgauuugucaguu

SEQ ID NO: 798998 - RNA, 19 nt, Homo sapiens
aaagacugcagcugcugaa

SEQ ID NO: 798999 - RNA, 17 nt, Homo sapiens
aaagacuguacaaagua

SEQ ID NO: 799000 - RNA, 14 nt, Homo sapiens
aaagacuguagaag

SEQ ID NO: 799001 - RNA, 15 nt, Homo sapiens
aaagacuuaagccca

SEQ ID NO: 799002 - RNA, 16 nt, Homo sapiens
aaagagccacuuucaa

SEQ ID NO: 799003 - RNA, 15 nt, Homo sapiens
aaagaggcagcuuga

SEQ ID NO: 799004 - RNA, 17 nt, Homo sapiens
aaagagggcuuccucua

SEQ ID NO: 799005 - RNA, 20 nt, Homo sapiens
aaagaggguaacaauaggaa

SEQ ID NO: 799006 - RNA, 14 nt, Homo sapiens
aaagaguaucauca

SEQ ID NO: 799007 - RNA, 21 nt, Homo sapiens
aaagaguaugagucuucugua

SEQ ID NO: 799008 - RNA, 15 nt, Homo sapiens
aaagaguucccugca

SEQ ID NO: 799009 - RNA, 14 nt, Homo sapiens
aaagauacagggga

SEQ ID NO: 799010 - RNA, 20 nt, Homo sapiens
aaagauaugugggugcuccu

SEQ ID NO: 799011 - RNA, 22 nt, Homo sapiens
aaagauccaagaaggccuucau

SEQ ID NO: 799012 - RNA, 14 nt, Homo sapiens
aaagaucguuuaaa

SEQ ID NO: 799013 - RNA, 23 nt, Homo sapiens
aaagaucguuuaaaaacaaagga

SEQ ID NO: 799014 - RNA, 23 nt, Homo sapiens
aaagaucuuuuccagaguaugca

SEQ ID NO: 799015 - RNA, 16 nt, Homo sapiens
aaagaugaaguuuuau

SEQ ID NO: 799016 - RNA, 19 nt, Homo sapiens
aaagaugaccuacagugcu

SEQ ID NO: 799017 - RNA, 13 nt, Homo sapiens
aaagaugagaucg

SEQ ID NO: 799018 - RNA, 12 nt, Homo sapiens
aaagaugcagug

SEQ ID NO: 799019 - RNA, 20 nt, Homo sapiens
aaagaugcauuuucacugca

SEQ ID NO: 799020 - RNA, 21 nt, Homo sapiens
aaagaugcauuuucacugcaa

SEQ ID NO: 799021 - RNA, 23 nt, Homo sapiens
aaagauguacaaaacaguuugaa

SEQ ID NO: 799022 - RNA, 16 nt, Homo sapiens
aaagauguuugucaga

SEQ ID NO: 799023 - RNA, 20 nt, Homo sapiens
aaagauuaggugagguuuau

SEQ ID NO: 799024 - RNA, 17 nt, Homo sapiens
aaagauucagugacgga

SEQ ID NO: 799025 - RNA, 17 nt, Homo sapiens
aaagauucaugauuuau

SEQ ID NO: 799026 - RNA, 20 nt, Homo sapiens
aaagauucuucuguguuuau

SEQ ID NO: 799027 - RNA, 23 nt, Homo sapiens
aaagauuggacaccccugcuaua

SEQ ID NO: 799028 - RNA, 15 nt, Homo sapiens
aaagauuucaaauaa

SEQ ID NO: 799029 - RNA, 15 nt, Homo sapiens
aaagauuugugaacu

SEQ ID NO: 799030 - RNA, 19 nt, Homo sapiens
aaagcaaaauacaucagcu

SEQ ID NO: 799031 - RNA, 19 nt, Homo sapiens
aaagcaaacuuaagaaaca

SEQ ID NO: 799032 - RNA, 14 nt, Homo sapiens
aaagcaagacccua

SEQ ID NO: 799033 - RNA, 15 nt, Homo sapiens
aaagcaaguugccug

SEQ ID NO: 799034 - RNA, 14 nt, Homo sapiens
aaagcaauaaccuc

SEQ ID NO: 799035 - RNA, 21 nt, Homo sapiens
aaagcaauucagaaaggaugc

SEQ ID NO: 799036 - RNA, 13 nt, Homo sapiens
aaagcacagauuu

SEQ ID NO: 799037 - RNA, 12 nt, Homo sapiens
aaagcacaguuu

SEQ ID NO: 799038 - RNA, 20 nt, Homo sapiens
aaagcacugaccugucaugc

SEQ ID NO: 799039 - RNA, 21 nt, Homo sapiens
aaagcaguaaauuugcuagca

SEQ ID NO: 799040 - RNA, 20 nt, Homo sapiens
aaagcaguggcuccauuggu

SEQ ID NO: 799041 - RNA, 15 nt, Homo sapiens
aaagcauaaaaaggu

SEQ ID NO: 799042 - RNA, 20 nt, Homo sapiens
aaagcaucaauacaaccagc

SEQ ID NO: 799043 - RNA, 21 nt, Homo sapiens
aaagcaucaauacaaccagcc

SEQ ID NO: 799044 - RNA, 13 nt, Homo sapiens
aaagcaucaccuc

SEQ ID NO: 799045 - RNA, 13 nt, Homo sapiens
aaagcauccuccu

SEQ ID NO: 799046 - RNA, 15 nt, Homo sapiens
aaagcauuguccaaa

SEQ ID NO: 799047 - RNA, 17 nt, Homo sapiens
aaagcauuuauuaagaa

SEQ ID NO: 799048 - RNA, 18 nt, Homo sapiens
aaagccuccgcugggcuu

SEQ ID NO: 799049 - RNA, 13 nt, Homo sapiens
aaagccuccucau

SEQ ID NO: 799050 - RNA, 20 nt, Homo sapiens
aaagccuuauuuuucaaaag

SEQ ID NO: 799051 - RNA, 18 nt, Homo sapiens
aaagcggggcuucaucug

SEQ ID NO: 799052 - RNA, 17 nt, Homo sapiens
aaagcuaaaguaucugu

SEQ ID NO: 799053 - RNA, 19 nt, Homo sapiens
aaagcuaaauguacauguu

SEQ ID NO: 799054 - RNA, 17 nt, Homo sapiens
aaagcuaguguaccucc

SEQ ID NO: 799055 - RNA, 17 nt, Homo sapiens
aaagcucaaaguaugca

SEQ ID NO: 799056 - RNA, 18 nt, Homo sapiens
aaagcugauuacugucaa

SEQ ID NO: 799057 - RNA, 22 nt, Homo sapiens
aaagcugauuacugucaauaaa

SEQ ID NO: 799058 - RNA, 21 nt, Homo sapiens
aaagcuggugucugauuuugg

SEQ ID NO: 799059 - RNA, 17 nt, Homo sapiens
aaagcuguuaggcucac

SEQ ID NO: 799060 - RNA, 12 nt, Homo sapiens
aaagcuucacag

SEQ ID NO: 799061 - RNA, 18 nt, Homo sapiens
aaagcuucuaucccagga

SEQ ID NO: 799062 - RNA, 19 nt, Homo sapiens
aaagcuuggugucuuggca

SEQ ID NO: 799063 - RNA, 24 nt, Homo sapiens
aaagcuuugggggagugggcgcag

SEQ ID NO: 799064 - RNA, 20 nt, Homo sapiens
aaaggaaaaauguacuuaaa

SEQ ID NO: 799065 - RNA, 17 nt, Homo sapiens
aaaggaaaccacaguga

SEQ ID NO: 799066 - RNA, 16 nt, Homo sapiens
aaaggaaagauuugcc

SEQ ID NO: 799067 - RNA, 19 nt, Homo sapiens
aaaggaaagauuugccaau

SEQ ID NO: 799068 - RNA, 13 nt, Homo sapiens
aaaggaacaaaua

SEQ ID NO: 799069 - RNA, 21 nt, Homo sapiens
aaaggacaccuuuuaacucac

SEQ ID NO: 799070 - RNA, 15 nt, Homo sapiens
aaaggaccaguaugc

SEQ ID NO: 799071 - RNA, 14 nt, Homo sapiens
aaaggacuauaaga

SEQ ID NO: 799072 - RNA, 17 nt, Homo sapiens
aaaggagaacuauccaa

SEQ ID NO: 799073 - RNA, 15 nt, Homo sapiens
aaaggagcuuucuca

SEQ ID NO: 799074 - RNA, 15 nt, Homo sapiens
aaaggauaugcagua

SEQ ID NO: 799075 - RNA, 13 nt, Homo sapiens
aaaggauuuuaca

SEQ ID NO: 799076 - RNA, 17 nt, Homo sapiens
aaaggauuuuacagaaa

SEQ ID NO: 799077 - RNA, 15 nt, Homo sapiens
aaaggcagcccucac

SEQ ID NO: 799078 - RNA, 13 nt, Homo sapiens
aaaggcagcugcc

SEQ ID NO: 799079 - RNA, 19 nt, Homo sapiens
aaaggcagcugccucugcu

SEQ ID NO: 799080 - RNA, 11 nt, Homo sapiens
aaaggcaguuc

SEQ ID NO: 799081 - RNA, 16 nt, Homo sapiens
aaaggccccugcaaug

SEQ ID NO: 799082 - RNA, 16 nt, Homo sapiens
aaaggcugaagcuuuu

SEQ ID NO: 799083 - RNA, 14 nt, Homo sapiens
aaaggcugcuguga

SEQ ID NO: 799084 - RNA, 15 nt, Homo sapiens
aaagggaccagggga

SEQ ID NO: 799085 - RNA, 18 nt, Homo sapiens
aaagggaggaggugcaca

SEQ ID NO: 799086 - RNA, 20 nt, Homo sapiens
aaaggggaaauaacugccuu

SEQ ID NO: 799087 - RNA, 12 nt, Homo sapiens
aaaggggacaag

SEQ ID NO: 799088 - RNA, 14 nt, Homo sapiens
aaaggggacaagga

SEQ ID NO: 799089 - RNA, 13 nt, Homo sapiens
aaagggggcugca

SEQ ID NO: 799090 - RNA, 17 nt, Homo sapiens
aaccaucacugguugca

SEQ ID NO: 799091 - RNA, 14 nt, Homo sapiens
aaccaucagcauca

SEQ ID NO: 799092 - RNA, 16 nt, Homo sapiens
aaccauccagugacaa

SEQ ID NO: 799093 - RNA, 18 nt, Homo sapiens
aaccaucgguccacaccu

SEQ ID NO: 799094 - RNA, 19 nt, Homo sapiens
aaccaucugaagaaacuuc

SEQ ID NO: 799095 - RNA, 20 nt, Homo sapiens
aaccauuccaacuucaauuu

SEQ ID NO: 799096 - RNA, 18 nt, Homo sapiens
aaccauugcugacuuuag

SEQ ID NO: 799097 - RNA, 13 nt, Homo sapiens
aaccauuuacuua

SEQ ID NO: 799098 - RNA, 12 nt, Homo sapiens
aaccauuugcac

SEQ ID NO: 799099 - RNA, 11 nt, Homo sapiens
aacccaaagug

SEQ ID NO: 799100 - RNA, 14 nt, Homo sapiens
aacccaaugccugu

SEQ ID NO: 799101 - RNA, 15 nt, Homo sapiens
aacccaaugccugug

SEQ ID NO: 799102 - RNA, 12 nt, Homo sapiens
aacccaccagcc

SEQ ID NO: 799103 - RNA, 12 nt, Homo sapiens
aacccagacuca

SEQ ID NO: 799104 - RNA, 16 nt, Homo sapiens
aacccaguugcugauc

SEQ ID NO: 799105 - RNA, 15 nt, Homo sapiens
aacccauacaaugua

SEQ ID NO: 799106 - RNA, 18 nt, Homo sapiens
aacccaucgguaggcaaa

SEQ ID NO: 799107 - RNA, 19 nt, Homo sapiens
aacccauguugaucuuucu

SEQ ID NO: 799108 - RNA, 23 nt, Homo sapiens
aacccauuccaguacaguauucu

SEQ ID NO: 799109 - RNA, 16 nt, Homo sapiens
aaccccaaacuguuga

SEQ ID NO: 799110 - RNA, 16 nt, Homo sapiens
aaccccaagcugccuc

SEQ ID NO: 799111 - RNA, 21 nt, Homo sapiens
aaccccaagcugccucugggc

SEQ ID NO: 799112 - RNA, 11 nt, Homo sapiens
aaccccagugg

SEQ ID NO: 799113 - RNA, 12 nt, Homo sapiens
aaccccaucucu

SEQ ID NO: 799114 - RNA, 13 nt, Homo sapiens
aaccccaugggcu

SEQ ID NO: 799115 - RNA, 21 nt, Homo sapiens
aaccccauguccucagcauuu

SEQ ID NO: 799116 - RNA, 15 nt, Homo sapiens
aacccccaguguaau

SEQ ID NO: 799117 - RNA, 21 nt, Homo sapiens
aaccccuuacccaucucucua

SEQ ID NO: 799118 - RNA, 12 nt, Homo sapiens
aaccccuuccag

SEQ ID NO: 799119 - RNA, 14 nt, Homo sapiens
aaccccuucuuuac

SEQ ID NO: 799120 - RNA, 14 nt, Homo sapiens
aacccggagagugc

SEQ ID NO: 799121 - RNA, 22 nt, Homo sapiens
aacccuacuuugcuuccgccac

SEQ ID NO: 799122 - RNA, 23 nt, Homo sapiens
aacccuagauugggguagaggga

SEQ ID NO: 799123 - RNA, 18 nt, Homo sapiens
aacccucacaagcaugaa

SEQ ID NO: 799124 - RNA, 15 nt, Homo sapiens
aacccucagcacugu

SEQ ID NO: 799125 - RNA, 16 nt, Homo sapiens
aacccugcccugcccc

SEQ ID NO: 799126 - RNA, 22 nt, Homo sapiens
aacccugcugaacacagugucu

SEQ ID NO: 799127 - RNA, 19 nt, Homo sapiens
aacccuguauggcacuuau

SEQ ID NO: 799128 - RNA, 13 nt, Homo sapiens
aacccuguguuca

SEQ ID NO: 799129 - RNA, 20 nt, Homo sapiens
aaccgacacuccuacaagau

SEQ ID NO: 799130 - RNA, 22 nt, Homo sapiens
aaccgaugguccucacaagccu

SEQ ID NO: 799131 - RNA, 21 nt, Homo sapiens
aaccgcugccuuuaucuugaa

SEQ ID NO: 799132 - RNA, 17 nt, Homo sapiens
aaccggggccuacuaga

SEQ ID NO: 799133 - RNA, 17 nt, Homo sapiens
aaccuaauaucacuuaa

SEQ ID NO: 799134 - RNA, 13 nt, Homo sapiens
aaccuacaguuuu

SEQ ID NO: 799135 - RNA, 19 nt, Homo sapiens
aaccuacccugguccaguc

SEQ ID NO: 799136 - RNA, 14 nt, Homo sapiens
aaccuaguacugcc

SEQ ID NO: 799137 - RNA, 17 nt, Homo sapiens
aaccuaugaaacuauug

SEQ ID NO: 799138 - RNA, 23 nt, Homo sapiens
aaccuaugauauuuucugugccu

SEQ ID NO: 799139 - RNA, 23 nt, Homo sapiens
aaccuauuuaaaacagugaauua

SEQ ID NO: 799140 - RNA, 12 nt, Homo sapiens
aaccuauuuuca

SEQ ID NO: 799141 - RNA, 13 nt, Homo sapiens
aaccucaaaguga

SEQ ID NO: 799142 - RNA, 16 nt, Homo sapiens
aaccucaaagugacua

SEQ ID NO: 799143 - RNA, 22 nt, Homo sapiens
aaccucacaaaguagaggaauc

SEQ ID NO: 799144 - RNA, 20 nt, Homo sapiens
aaccucagccuggccagaca

SEQ ID NO: 799145 - RNA, 11 nt, Homo sapiens
aaccucagggc

SEQ ID NO: 799146 - RNA, 21 nt, Homo sapiens
aaccucaguuauuacauguaa

SEQ ID NO: 799147 - RNA, 12 nt, Homo sapiens
aaccucauuaau

SEQ ID NO: 799148 - RNA, 20 nt, Homo sapiens
aaccuccgccucccggguuc

SEQ ID NO: 799149 - RNA, 22 nt, Homo sapiens
aaccucuagagucacugauaca

SEQ ID NO: 799150 - RNA, 13 nt, Homo sapiens
aaccucuaugcaa

SEQ ID NO: 799151 - RNA, 13 nt, Homo sapiens
aaccucucgccau

SEQ ID NO: 799152 - RNA, 14 nt, Homo sapiens
aaccucugccuccc

SEQ ID NO: 799153 - RNA, 15 nt, Homo sapiens
aaccugauuacagaa

SEQ ID NO: 799154 - RNA, 20 nt, Homo sapiens
aaccugcaaagaucuguccu

SEQ ID NO: 799155 - RNA, 14 nt, Homo sapiens
aaccugcugaaggg

SEQ ID NO: 799156 - RNA, 21 nt, Homo sapiens
aaccuggagccacuucuaucu

SEQ ID NO: 799157 - RNA, 16 nt, Homo sapiens
aaccuguaacucacau

SEQ ID NO: 799158 - RNA, 23 nt, Homo sapiens
aaccuguccuaaggaaccuuccu

SEQ ID NO: 799159 - RNA, 15 nt, Homo sapiens
aaccuguccuugcac

SEQ ID NO: 799160 - RNA, 14 nt, Homo sapiens
aaccugugugccau

SEQ ID NO: 799161 - RNA, 13 nt, Homo sapiens
aaccuuaauugac

SEQ ID NO: 799162 - RNA, 19 nt, Homo sapiens
aaccuucacaucugucacg

SEQ ID NO: 799163 - RNA, 15 nt, Homo sapiens
aaccuuccacccagu

SEQ ID NO: 799164 - RNA, 13 nt, Homo sapiens
aaccuuccaucuc

SEQ ID NO: 799165 - RNA, 21 nt, Homo sapiens
aaccuuccauucacaccagcu

SEQ ID NO: 799166 - RNA, 16 nt, Homo sapiens
aaccuugaaugcugcc

SEQ ID NO: 799167 - RNA, 22 nt, Homo sapiens
aaccuuggaccacuccuguccc

SEQ ID NO: 799168 - RNA, 14 nt, Homo sapiens
aaccuuggcauaag

SEQ ID NO: 799169 - RNA, 16 nt, Homo sapiens
aaccuuugcuauguaa

SEQ ID NO: 799170 - RNA, 16 nt, Homo sapiens
aacgaaugguacuaca

SEQ ID NO: 799171 - RNA, 21 nt, Homo sapiens
aacgaauggucuuugcuccag

SEQ ID NO: 799172 - RNA, 14 nt, Homo sapiens
aacgacacauucag

SEQ ID NO: 799173 - RNA, 18 nt, Homo sapiens
aacgacgggggcaggugc

SEQ ID NO: 799174 - RNA, 19 nt, Homo sapiens
aacgacuacccagaagugu

SEQ ID NO: 799175 - RNA, 21 nt, Homo sapiens
aacgagcauaguccaaaaagc

SEQ ID NO: 799176 - RNA, 23 nt, Homo sapiens
aacgauacaaauuuggccuuaag

SEQ ID NO: 799177 - RNA, 12 nt, Homo sapiens
aacgcacaggaa

SEQ ID NO: 799178 - RNA, 13 nt, Homo sapiens
aacgcauugccac

SEQ ID NO: 799179 - RNA, 11 nt, Homo sapiens
aacgccagucu

SEQ ID NO: 799180 - RNA, 19 nt, Homo sapiens
aacgcccuuuccuccucag

SEQ ID NO: 799181 - RNA, 23 nt, Homo sapiens
aacgccgcugacugccacccaca

SEQ ID NO: 799182 - RNA, 14 nt, Homo sapiens
aacgccuggugccc

SEQ ID NO: 799183 - RNA, 18 nt, Homo sapiens
aacgcuaacaauuucuca

SEQ ID NO: 799184 - RNA, 15 nt, Homo sapiens
aacggagagugcuug

SEQ ID NO: 799185 - RNA, 18 nt, Homo sapiens
aacggcuccaggauuuua

SEQ ID NO: 799186 - RNA, 22 nt, Homo sapiens
aacgggacccccuggcccugcc

SEQ ID NO: 799187 - RNA, 20 nt, Homo sapiens
aacgguuaagaaagcacuua

SEQ ID NO: 799188 - RNA, 23 nt, Homo sapiens
aacgguuuuuuucuuuggcugca

SEQ ID NO: 799189 - RNA, 14 nt, Homo sapiens
aacgucaucucagg

SEQ ID NO: 799190 - RNA, 15 nt, Homo sapiens
aacguccacaugaaa

SEQ ID NO: 799191 - RNA, 16 nt, Homo sapiens
aacgucuuuuuauauc

SEQ ID NO: 799192 - RNA, 15 nt, Homo sapiens
aacguucugcugcuu

SEQ ID NO: 799193 - RNA, 19 nt, Homo sapiens
aacguuugucauuccaguu

SEQ ID NO: 799194 - RNA, 20 nt, Homo sapiens
aacuaagucaggauguuaac

SEQ ID NO: 799195 - RNA, 22 nt, Homo sapiens
aacuaauaaaagcauaaaugca

SEQ ID NO: 799196 - RNA, 23 nt, Homo sapiens
aacuaaucugauguuaaccaaug

SEQ ID NO: 799197 - RNA, 21 nt, Homo sapiens
aacuaccaaauuagugaacca

SEQ ID NO: 799198 - RNA, 18 nt, Homo sapiens
aacuacccaccuggggau

SEQ ID NO: 799199 - RNA, 19 nt, Homo sapiens
aacuacccagguauuacac

SEQ ID NO: 799200 - RNA, 11 nt, Homo sapiens
aacuaccuccu

SEQ ID NO: 799201 - RNA, 17 nt, Homo sapiens
aacuaccuccucagucu

SEQ ID NO: 799202 - RNA, 12 nt, Homo sapiens
aacuacuucuua

SEQ ID NO: 799203 - RNA, 16 nt, Homo sapiens
aacuagaaaucugcca

SEQ ID NO: 799204 - RNA, 23 nt, Homo sapiens
aacuagccagacaaaauuugaga

SEQ ID NO: 799205 - RNA, 18 nt, Homo sapiens
aauuuugucaacuaccca

SEQ ID NO: 799206 - RNA, 15 nt, Homo sapiens
aauuuuuacugagaa

SEQ ID NO: 799207 - RNA, 23 nt, Homo sapiens
aauuuuuauuguuguacauacga

SEQ ID NO: 799208 - RNA, 17 nt, Homo sapiens
aauuuuuccugcauguu

SEQ ID NO: 799209 - RNA, 21 nt, Homo sapiens
aauuuuucucuaacucagaaa

SEQ ID NO: 799210 - RNA, 12 nt, Homo sapiens
aauuuuugcaaa

SEQ ID NO: 799211 - RNA, 15 nt, Homo sapiens
aauuuuuuaaauuga

SEQ ID NO: 799212 - RNA, 23 nt, Homo sapiens
aauuuuuuaguauaaguacauua

SEQ ID NO: 799213 - RNA, 19 nt, Homo sapiens
aauuuuuuugaaucuuucg

SEQ ID NO: 799214 - RNA, 19 nt, Homo sapiens
acaaaaaaaaaauuugcca

SEQ ID NO: 799215 - RNA, 12 nt, Homo sapiens
acaaaaaaccag

SEQ ID NO: 799216 - RNA, 15 nt, Homo sapiens
acaaaaaauacuuua

SEQ ID NO: 799217 - RNA, 20 nt, Homo sapiens
acaaaaacagguauauacuu

SEQ ID NO: 799218 - RNA, 19 nt, Homo sapiens
acaaaaaggcaaauauuga

SEQ ID NO: 799219 - RNA, 21 nt, Homo sapiens
acaaaaauguaaugaucauaa

SEQ ID NO: 799220 - RNA, 17 nt, Homo sapiens
acaaaaccaagccuugg

SEQ ID NO: 799221 - RNA, 23 nt, Homo sapiens
acaaaaccuacacacauaccuuc

SEQ ID NO: 799222 - RNA, 12 nt, Homo sapiens
acaaaagaauaa

SEQ ID NO: 799223 - RNA, 15 nt, Homo sapiens
acaaaagcccaaugu

SEQ ID NO: 799224 - RNA, 19 nt, Homo sapiens
acaaaauagacaauuugca

SEQ ID NO: 799225 - RNA, 21 nt, Homo sapiens
acaaaauauuucuaagcuuau

SEQ ID NO: 799226 - RNA, 21 nt, Homo sapiens
acaaaaucaaauaauaccuua

SEQ ID NO: 799227 - RNA, 13 nt, Homo sapiens
acaaaaugauacu

SEQ ID NO: 799228 - RNA, 18 nt, Homo sapiens
acaaaaugauuuugaaga

SEQ ID NO: 799229 - RNA, 12 nt, Homo sapiens
acaaaaugccaa

SEQ ID NO: 799230 - RNA, 14 nt, Homo sapiens
acaaaaugcugaca

SEQ ID NO: 799231 - RNA, 23 nt, Homo sapiens
acaaaauuuuauuuugugcucau

SEQ ID NO: 799232 - RNA, 22 nt, Homo sapiens
acaaacaaaaaacccauguguu

SEQ ID NO: 799233 - RNA, 15 nt, Homo sapiens
acaaacacugccaua

SEQ ID NO: 799234 - RNA, 15 nt, Homo sapiens
acaaacaucauuuua

SEQ ID NO: 799235 - RNA, 14 nt, Homo sapiens
acaaaccauuaccu

SEQ ID NO: 799236 - RNA, 17 nt, Homo sapiens
acaaaccauuaccugua

SEQ ID NO: 799237 - RNA, 14 nt, Homo sapiens
acaaaccauuuugu

SEQ ID NO: 799238 - RNA, 14 nt, Homo sapiens
acaaacccaagggc

SEQ ID NO: 799239 - RNA, 17 nt, Homo sapiens
acaaaccucaagccagc

SEQ ID NO: 799240 - RNA, 16 nt, Homo sapiens
acaaaccucacugaga

SEQ ID NO: 799241 - RNA, 16 nt, Homo sapiens
acaaacuacauguaau

SEQ ID NO: 799242 - RNA, 13 nt, Homo sapiens
acaaacucucacc

SEQ ID NO: 799243 - RNA, 11 nt, Homo sapiens
acaaacugcaa

SEQ ID NO: 799244 - RNA, 14 nt, Homo sapiens
acaaacugucuaaa

SEQ ID NO: 799245 - RNA, 15 nt, Homo sapiens
acaaacuucaaagag

SEQ ID NO: 799246 - RNA, 18 nt, Homo sapiens
acaaacuucaaagaggaa

SEQ ID NO: 799247 - RNA, 16 nt, Homo sapiens
acaaagcacaguuuga

SEQ ID NO: 799248 - RNA, 13 nt, Homo sapiens
acaaagcaguuua

SEQ ID NO: 799249 - RNA, 14 nt, Homo sapiens
acaaagcauuuuca

SEQ ID NO: 799250 - RNA, 23 nt, Homo sapiens
acaaagcccuguccuucagucuu

SEQ ID NO: 799251 - RNA, 16 nt, Homo sapiens
acaaagcgagauccca

SEQ ID NO: 799252 - RNA, 19 nt, Homo sapiens
acaaaggacagaguaugaa

SEQ ID NO: 799253 - RNA, 19 nt, Homo sapiens
acaaaggcugaacuggauu

SEQ ID NO: 799254 - RNA, 18 nt, Homo sapiens
acaaagggaaagccucug

SEQ ID NO: 799255 - RNA, 16 nt, Homo sapiens
acaaagggauguucac

SEQ ID NO: 799256 - RNA, 15 nt, Homo sapiens
acaaagguugcagug

SEQ ID NO: 799257 - RNA, 14 nt, Homo sapiens
acaaaguacauucu

SEQ ID NO: 799258 - RNA, 20 nt, Homo sapiens
acaaaguagaggaauccaug

SEQ ID NO: 799259 - RNA, 14 nt, Homo sapiens
acaaaguauuugcu

SEQ ID NO: 799260 - RNA, 18 nt, Homo sapiens
acaaaguccacuuuacuc

SEQ ID NO: 799261 - RNA, 21 nt, Homo sapiens
acaaagugaggagaaugaaau

SEQ ID NO: 799262 - RNA, 16 nt, Homo sapiens
acaaauaaaaaauuca

SEQ ID NO: 799263 - RNA, 13 nt, Homo sapiens
acaaauauacauu

SEQ ID NO: 799264 - RNA, 17 nt, Homo sapiens
acaaauauucucucugu

SEQ ID NO: 799265 - RNA, 18 nt, Homo sapiens
acaaaucugccaaaauau

SEQ ID NO: 799266 - RNA, 19 nt, Homo sapiens
acaaaugaauaaaugcaua

SEQ ID NO: 799267 - RNA, 22 nt, Homo sapiens
acaaaugucuaucaacuuuaau

SEQ ID NO: 799268 - RNA, 20 nt, Homo sapiens
acaaauuagccauuucacuc

SEQ ID NO: 799269 - RNA, 24 nt, Homo sapiens
acaaauuagccauuucacucucaa

SEQ ID NO: 799270 - RNA, 16 nt, Homo sapiens
acaaauucaagccuua

SEQ ID NO: 799271 - RNA, 22 nt, Homo sapiens
acaaauuuaugcauuucauuca

SEQ ID NO: 799272 - RNA, 18 nt, Homo sapiens
acaaauuugugugacaga

SEQ ID NO: 799273 - RNA, 16 nt, Homo sapiens
acaacaauaauaaaga

SEQ ID NO: 799274 - RNA, 13 nt, Homo sapiens
acaacagcaucuu

SEQ ID NO: 799275 - RNA, 14 nt, Homo sapiens
acaacaucauucca

SEQ ID NO: 799276 - RNA, 19 nt, Homo sapiens
acaacaugcgaccgugacc

SEQ ID NO: 799277 - RNA, 14 nt, Homo sapiens
acaacauuuacuua

SEQ ID NO: 799278 - RNA, 22 nt, Homo sapiens
acaaccaacagaaaacauccca

SEQ ID NO: 799279 - RNA, 15 nt, Homo sapiens
acaaccaaccaauac

SEQ ID NO: 799280 - RNA, 23 nt, Homo sapiens
acaaccaaccaccuuuccagcca

SEQ ID NO: 799281 - RNA, 21 nt, Homo sapiens
acaaccaugagaccacuguua

SEQ ID NO: 799282 - RNA, 22 nt, Homo sapiens
acaacccagaauggucauuuca

SEQ ID NO: 799283 - RNA, 17 nt, Homo sapiens
acaaccgguaaccaaag

SEQ ID NO: 799284 - RNA, 20 nt, Homo sapiens
acaaccuagggugccuuaaa

SEQ ID NO: 799285 - RNA, 19 nt, Homo sapiens
acaaccucauuuuaacuca

SEQ ID NO: 799286 - RNA, 15 nt, Homo sapiens
acaaccuuccagcuc

SEQ ID NO: 799287 - RNA, 15 nt, Homo sapiens
acaacgccuggugcc

SEQ ID NO: 799288 - RNA, 18 nt, Homo sapiens
acaacuguggucaauccg

SEQ ID NO: 799289 - RNA, 16 nt, Homo sapiens
acaacuucaauaucca

SEQ ID NO: 799290 - RNA, 20 nt, Homo sapiens
acaacuuggguucuucucag

SEQ ID NO: 799291 - RNA, 21 nt, Homo sapiens
acaacuuguauuuccaaaccu

SEQ ID NO: 799292 - RNA, 17 nt, Homo sapiens
acaagaaaaucaaauau

SEQ ID NO: 799293 - RNA, 21 nt, Homo sapiens
acaagaaaauguauccaagga

SEQ ID NO: 799294 - RNA, 13 nt, Homo sapiens
acaagaacaauga

SEQ ID NO: 799295 - RNA, 12 nt, Homo sapiens
acaagaagccac

SEQ ID NO: 799296 - RNA, 23 nt, Homo sapiens
acaagaaucuagaaaaucagauc

SEQ ID NO: 799297 - RNA, 16 nt, Homo sapiens
acaagaauggucuuuc

SEQ ID NO: 799298 - RNA, 22 nt, Homo sapiens
acaagaauuucuugguaagaag

SEQ ID NO: 799299 - RNA, 13 nt, Homo sapiens
acaagagaagcuu

SEQ ID NO: 799300 - RNA, 15 nt, Homo sapiens
acaagagaucuacac

SEQ ID NO: 799301 - RNA, 16 nt, Homo sapiens
acaagagcgagacucc

SEQ ID NO: 799302 - RNA, 21 nt, Homo sapiens
acaagagugagacuccaccuc

SEQ ID NO: 799303 - RNA, 19 nt, Homo sapiens
acaagauauuguacauaaa

SEQ ID NO: 799304 - RNA, 19 nt, Homo sapiens
acaagauccuuaaugcaga

SEQ ID NO: 799305 - RNA, 20 nt, Homo sapiens
acaagauccuuaaugcagag

SEQ ID NO: 799306 - RNA, 11 nt, Homo sapiens
acaagcauuuu

SEQ ID NO: 799307 - RNA, 13 nt, Homo sapiens
acaagccaaagag

SEQ ID NO: 799308 - RNA, 22 nt, Homo sapiens
acaagcucugcgccaaucacag

SEQ ID NO: 799309 - RNA, 21 nt, Homo sapiens
acaagcugacuuggcacuuaa

SEQ ID NO: 799310 - RNA, 19 nt, Homo sapiens
acaagcuugucaaugauuu

SEQ ID NO: 799311 - RNA, 15 nt, Homo sapiens
acaagcuuuaugugg

SEQ ID NO: 799312 - RNA, 20 nt, Homo sapiens
acaaggaaggaaaagaaaga

SEQ ID NO: 799313 - RNA, 18 nt, Homo sapiens
acaaggauagaugcuggc

SEQ ID NO: 799314 - RNA, 18 nt, Homo sapiens
acaaggcugaccaagaga

SEQ ID NO: 799315 - RNA, 19 nt, Homo sapiens
acaaggcuuuaucucaggg

SEQ ID NO: 799316 - RNA, 22 nt, Homo sapiens
acaagggacuagugagucagca

SEQ ID NO: 799317 - RNA, 18 nt, Homo sapiens
acaagggcugcaaugccc

SEQ ID NO: 799318 - RNA, 22 nt, Homo sapiens
acaagggggaagggaugcaggg

SEQ ID NO: 799319 - RNA, 19 nt, Homo sapiens
acauugaaagagaaccagu

SEQ ID NO: 799320 - RNA, 21 nt, Homo sapiens
acauugaagguauaugccaaa

SEQ ID NO: 799321 - RNA, 19 nt, Homo sapiens
acauugaauggaucaauac

SEQ ID NO: 799322 - RNA, 20 nt, Homo sapiens
acauugaccaagaacugcau

SEQ ID NO: 799323 - RNA, 15 nt, Homo sapiens
acauugccuguucug

SEQ ID NO: 799324 - RNA, 19 nt, Homo sapiens
acauugccuucuggagcug

SEQ ID NO: 799325 - RNA, 16 nt, Homo sapiens
acauugcuuuacuguc

SEQ ID NO: 799326 - RNA, 18 nt, Homo sapiens
acauugcuuuacugucaa

SEQ ID NO: 799327 - RNA, 22 nt, Homo sapiens
acauuggcaccuaauccaggca

SEQ ID NO: 799328 - RNA, 13 nt, Homo sapiens
acauuguacuguu

SEQ ID NO: 799329 - RNA, 20 nt, Homo sapiens
acauugugggauguucagca

SEQ ID NO: 799330 - RNA, 23 nt, Homo sapiens
acauuguguucccauuucagcug

SEQ ID NO: 799331 - RNA, 16 nt, Homo sapiens
acauuuaaaauucaau

SEQ ID NO: 799332 - RNA, 13 nt, Homo sapiens
acauuuacaauaa

SEQ ID NO: 799333 - RNA, 21 nt, Homo sapiens
acauuuagcugugcucagaag

SEQ ID NO: 799334 - RNA, 17 nt, Homo sapiens
acauuuccucagucaag

SEQ ID NO: 799335 - RNA, 13 nt, Homo sapiens
acauuuccuuaca

SEQ ID NO: 799336 - RNA, 22 nt, Homo sapiens
acauuucuaagucaaacacuug

SEQ ID NO: 799337 - RNA, 14 nt, Homo sapiens
acauuucucacuga

SEQ ID NO: 799338 - RNA, 14 nt, Homo sapiens
acauuucucugagc

SEQ ID NO: 799339 - RNA, 22 nt, Homo sapiens
acauuucuggacaguaccugau

SEQ ID NO: 799340 - RNA, 20 nt, Homo sapiens
acauuugacaaaacuaaccu

SEQ ID NO: 799341 - RNA, 16 nt, Homo sapiens
acauuugcuguuuuaa

SEQ ID NO: 799342 - RNA, 14 nt, Homo sapiens
acauuuggcauuug

SEQ ID NO: 799343 - RNA, 15 nt, Homo sapiens
acauuuggccacaaa

SEQ ID NO: 799344 - RNA, 19 nt, Homo sapiens
acauuuguauuuugugaug

SEQ ID NO: 799345 - RNA, 15 nt, Homo sapiens
acauuugugaacuca

SEQ ID NO: 799346 - RNA, 12 nt, Homo sapiens
acauuuguucca

SEQ ID NO: 799347 - RNA, 20 nt, Homo sapiens
acauuuuaauuuuaguuuca

SEQ ID NO: 799348 - RNA, 16 nt, Homo sapiens
acauuuuaucauuaaa

SEQ ID NO: 799349 - RNA, 22 nt, Homo sapiens
acauuuuauuuuuucuugcaaa

SEQ ID NO: 799350 - RNA, 13 nt, Homo sapiens
acauuuugacaca

SEQ ID NO: 799351 - RNA, 14 nt, Homo sapiens
acauuuuguauauu

SEQ ID NO: 799352 - RNA, 22 nt, Homo sapiens
acauuuuuaaaaauugucauuu

SEQ ID NO: 799353 - RNA, 22 nt, Homo sapiens
acauuuuuaaaagaacaaugac

SEQ ID NO: 799354 - RNA, 17 nt, Homo sapiens
acauuuuucaacauuuu

SEQ ID NO: 799355 - RNA, 19 nt, Homo sapiens
acauuuuucccuauuuucc

SEQ ID NO: 799356 - RNA, 18 nt, Homo sapiens
acauuuuuccguuugcuu

SEQ ID NO: 799357 - RNA, 16 nt, Homo sapiens
acauuuuuguacuaac

SEQ ID NO: 799358 - RNA, 15 nt, Homo sapiens
acauuuuuuaccaaa

SEQ ID NO: 799359 - RNA, 17 nt, Homo sapiens
acauuuuuuugcaugca

SEQ ID NO: 799360 - RNA, 13 nt, Homo sapiens
accaaaaagggau

SEQ ID NO: 799361 - RNA, 17 nt, Homo sapiens
accaaaacugugcagag

SEQ ID NO: 799362 - RNA, 18 nt, Homo sapiens
accaaaauagucuucuca

SEQ ID NO: 799363 - RNA, 16 nt, Homo sapiens
accaaacucaguucaa

SEQ ID NO: 799364 - RNA, 19 nt, Homo sapiens
accaaacucauucaccaaa

SEQ ID NO: 799365 - RNA, 17 nt, Homo sapiens
accaaacugccucaauc

SEQ ID NO: 799366 - RNA, 21 nt, Homo sapiens
accaaagaauuguaggcagug

SEQ ID NO: 799367 - RNA, 16 nt, Homo sapiens
accaaagacaucaguc

SEQ ID NO: 799368 - RNA, 20 nt, Homo sapiens
accaaagacaucagucucca

SEQ ID NO: 799369 - RNA, 16 nt, Homo sapiens
accaaagagggcuucc

SEQ ID NO: 799370 - RNA, 15 nt, Homo sapiens
accaaagcugcccac

SEQ ID NO: 799371 - RNA, 13 nt, Homo sapiens
accaaaucucagu

SEQ ID NO: 799372 - RNA, 18 nt, Homo sapiens
accaaaugaugccacuuc

SEQ ID NO: 799373 - RNA, 18 nt, Homo sapiens
accaaaugcuuuuccuca

SEQ ID NO: 799374 - RNA, 13 nt, Homo sapiens
accaaauggccag

SEQ ID NO: 799375 - RNA, 11 nt, Homo sapiens
accaaccaaac

SEQ ID NO: 799376 - RNA, 23 nt, Homo sapiens
accaaccaccuuuccagccauag

SEQ ID NO: 799377 - RNA, 15 nt, Homo sapiens
accaacccucagagc

SEQ ID NO: 799378 - RNA, 22 nt, Homo sapiens
accaacugaaguggcuaaagag

SEQ ID NO: 799379 - RNA, 22 nt, Homo sapiens
accaacuuuuaaugggauuuca

SEQ ID NO: 799380 - RNA, 14 nt, Homo sapiens
accaagaacugcau

SEQ ID NO: 799381 - RNA, 21 nt, Homo sapiens
accaagauauuuuuaucccaa

SEQ ID NO: 799382 - RNA, 14 nt, Homo sapiens
accaagaucuccaa

SEQ ID NO: 799383 - RNA, 17 nt, Homo sapiens
accaagcagagcucaca

SEQ ID NO: 799384 - RNA, 23 nt, Homo sapiens
accaagccuuggcucuacccuga

SEQ ID NO: 799385 - RNA, 14 nt, Homo sapiens
accaaggaagcagc

SEQ ID NO: 799386 - RNA, 23 nt, Homo sapiens
accaaggggugggccacagccau

SEQ ID NO: 799387 - RNA, 16 nt, Homo sapiens
accaaguauagccuau

SEQ ID NO: 799388 - RNA, 14 nt, Homo sapiens
accaaguugugcuu

SEQ ID NO: 799389 - RNA, 23 nt, Homo sapiens
accaauaaagugacccuguucuc

SEQ ID NO: 799390 - RNA, 16 nt, Homo sapiens
accaauaccuccucca

SEQ ID NO: 799391 - RNA, 19 nt, Homo sapiens
accaauacuacugacgucc

SEQ ID NO: 799392 - RNA, 15 nt, Homo sapiens
accaauagcaucugu

SEQ ID NO: 799393 - RNA, 19 nt, Homo sapiens
accaauagggcugagcucu

SEQ ID NO: 799394 - RNA, 18 nt, Homo sapiens
accaaugaaaacauguac

SEQ ID NO: 799395 - RNA, 20 nt, Homo sapiens
accaaugaaaacauguacua

SEQ ID NO: 799396 - RNA, 21 nt, Homo sapiens
accaaugugugaaguaugcac

SEQ ID NO: 799397 - RNA, 12 nt, Homo sapiens
accaauguucua

SEQ ID NO: 799398 - RNA, 17 nt, Homo sapiens
accaauugugcugccau

SEQ ID NO: 799399 - RNA, 13 nt, Homo sapiens
accacaacugaca

SEQ ID NO: 799400 - RNA, 19 nt, Homo sapiens
accacaacugacacaggaa

SEQ ID NO: 799401 - RNA, 21 nt, Homo sapiens
accacaacugacacaggaaac

SEQ ID NO: 799402 - RNA, 12 nt, Homo sapiens
accacaaggaaa

SEQ ID NO: 799403 - RNA, 18 nt, Homo sapiens
accacaauaccacuauca

SEQ ID NO: 799404 - RNA, 11 nt, Homo sapiens
accacacaaag

SEQ ID NO: 799405 - RNA, 15 nt, Homo sapiens
accacacauauugca

SEQ ID NO: 799406 - RNA, 16 nt, Homo sapiens
accacacauauugcac

SEQ ID NO: 799407 - RNA, 20 nt, Homo sapiens
accacagagcugucacuuuu

SEQ ID NO: 799408 - RNA, 18 nt, Homo sapiens
accacagauucagacuug

SEQ ID NO: 799409 - RNA, 17 nt, Homo sapiens
accacauccuccgucca

SEQ ID NO: 799410 - RNA, 20 nt, Homo sapiens
accaccagugagacaagcug

SEQ ID NO: 799411 - RNA, 15 nt, Homo sapiens
accacccagaguggc

SEQ ID NO: 799412 - RNA, 14 nt, Homo sapiens
accaccuaauauca

SEQ ID NO: 799413 - RNA, 15 nt, Homo sapiens
accaccuuucacaaa

SEQ ID NO: 799414 - RNA, 13 nt, Homo sapiens
accacgacuggcc

SEQ ID NO: 799415 - RNA, 17 nt, Homo sapiens
accacugcacuccaguc

SEQ ID NO: 799416 - RNA, 16 nt, Homo sapiens
accacugcacugucug

SEQ ID NO: 799417 - RNA, 22 nt, Homo sapiens
accacugguuaaaauaaagccu

SEQ ID NO: 799418 - RNA, 12 nt, Homo sapiens
accacuuccagg

SEQ ID NO: 799419 - RNA, 17 nt, Homo sapiens
accacuucgaaaccugg

SEQ ID NO: 799420 - RNA, 15 nt, Homo sapiens
accagaaacaccccu

SEQ ID NO: 799421 - RNA, 13 nt, Homo sapiens
accagaaguggac

SEQ ID NO: 799422 - RNA, 13 nt, Homo sapiens
accagaauucccu

SEQ ID NO: 799423 - RNA, 14 nt, Homo sapiens
accagaauucccuu

SEQ ID NO: 799424 - RNA, 15 nt, Homo sapiens
accagacccugaauu

SEQ ID NO: 799425 - RNA, 19 nt, Homo sapiens
accagacgguucaccagcc

SEQ ID NO: 799426 - RNA, 14 nt, Homo sapiens
accagagcauuucc

SEQ ID NO: 799427 - RNA, 18 nt, Homo sapiens
accagagcgugcacuugu

SEQ ID NO: 799428 - RNA, 12 nt, Homo sapiens
accagagcucua

SEQ ID NO: 799429 - RNA, 13 nt, Homo sapiens
accagagcugucu

SEQ ID NO: 799430 - RNA, 15 nt, Homo sapiens
accagaggagccuuu

SEQ ID NO: 799431 - RNA, 11 nt, Homo sapiens
accagaggcag

SEQ ID NO: 799432 - RNA, 12 nt, Homo sapiens
accagaggucag

SEQ ID NO: 799433 - RNA, 16 nt, Homo sapiens
accagaggugcuucug

SEQ ID NO: 799434 - RNA, 16 nt, Homo sapiens
accagauuugaggcug

SEQ ID NO: 799435 - RNA, 18 nt, Homo sapiens
acucaucuuagugccuga

SEQ ID NO: 799436 - RNA, 15 nt, Homo sapiens
acucaugaagcauac

SEQ ID NO: 799437 - RNA, 18 nt, Homo sapiens
acucaugaagcauacccc

SEQ ID NO: 799438 - RNA, 16 nt, Homo sapiens
acucauggccuugucu

SEQ ID NO: 799439 - RNA, 16 nt, Homo sapiens
acucaugucuuucuca

SEQ ID NO: 799440 - RNA, 16 nt, Homo sapiens
acucauuaaugaauca

SEQ ID NO: 799441 - RNA, 19 nt, Homo sapiens
acucauucucuucuugcua

SEQ ID NO: 799442 - RNA, 13 nt, Homo sapiens
acucauugcugag

SEQ ID NO: 799443 - RNA, 18 nt, Homo sapiens
acucauuucacagccuuu

SEQ ID NO: 799444 - RNA, 22 nt, Homo sapiens
acuccaaacagaccccuguuca

SEQ ID NO: 799445 - RNA, 23 nt, Homo sapiens
acuccacagcggaggagaccagc

SEQ ID NO: 799446 - RNA, 12 nt, Homo sapiens
acuccaccucaa

SEQ ID NO: 799447 - RNA, 13 nt, Homo sapiens
acuccaccucaaa

SEQ ID NO: 799448 - RNA, 18 nt, Homo sapiens
acuccagccugggcaaca

SEQ ID NO: 799449 - RNA, 21 nt, Homo sapiens
acuccagccugggcaacacag

SEQ ID NO: 799450 - RNA, 18 nt, Homo sapiens
acuccagccugggugaca

SEQ ID NO: 799451 - RNA, 16 nt, Homo sapiens
acuccagcucugagac

SEQ ID NO: 799452 - RNA, 18 nt, Homo sapiens
acuccaggaaaagccauu

SEQ ID NO: 799453 - RNA, 18 nt, Homo sapiens
acuccaggcccaaggcuc

SEQ ID NO: 799454 - RNA, 14 nt, Homo sapiens
acuccauacauaac

SEQ ID NO: 799455 - RNA, 19 nt, Homo sapiens
acuccaucauggcugcuug

SEQ ID NO: 799456 - RNA, 18 nt, Homo sapiens
acuccaucgugugugccu

SEQ ID NO: 799457 - RNA, 12 nt, Homo sapiens
acuccaucucaa

SEQ ID NO: 799458 - RNA, 19 nt, Homo sapiens
acuccaucucaaaacaaaa

SEQ ID NO: 799459 - RNA, 19 nt, Homo sapiens
acuccaugcuccuugagag

SEQ ID NO: 799460 - RNA, 18 nt, Homo sapiens
acuccaugcugccagccu

SEQ ID NO: 799461 - RNA, 19 nt, Homo sapiens
acuccauuggaucugcaag

SEQ ID NO: 799462 - RNA, 16 nt, Homo sapiens
acucccagaaccacua

SEQ ID NO: 799463 - RNA, 19 nt, Homo sapiens
acucccagauggcucuuuc

SEQ ID NO: 799464 - RNA, 21 nt, Homo sapiens
acucccagauggcucuuucua

SEQ ID NO: 799465 - RNA, 16 nt, Homo sapiens
acuccccaacugaguu

SEQ ID NO: 799466 - RNA, 23 nt, Homo sapiens
acuccccauuaacagauggaaaa

SEQ ID NO: 799467 - RNA, 20 nt, Homo sapiens
acucccuccucaccucugga

SEQ ID NO: 799468 - RNA, 13 nt, Homo sapiens
acuccgaacaauu

SEQ ID NO: 799469 - RNA, 14 nt, Homo sapiens
acuccgugaggcug

SEQ ID NO: 799470 - RNA, 14 nt, Homo sapiens
acuccuagcugacu

SEQ ID NO: 799471 - RNA, 22 nt, Homo sapiens
acuccucaaaagcaaaugagau

SEQ ID NO: 799472 - RNA, 22 nt, Homo sapiens
acuccucagaucugaacacagu

SEQ ID NO: 799473 - RNA, 19 nt, Homo sapiens
acuccucaggcagcgugug

SEQ ID NO: 799474 - RNA, 19 nt, Homo sapiens
acuccuccaaggaaaggga

SEQ ID NO: 799475 - RNA, 19 nt, Homo sapiens
acuccucuuuccuuccuuc

SEQ ID NO: 799476 - RNA, 14 nt, Homo sapiens
acuccugaccucag

SEQ ID NO: 799477 - RNA, 16 nt, Homo sapiens
acuccugccaguugaa

SEQ ID NO: 799478 - RNA, 14 nt, Homo sapiens
acuccugccauagu

SEQ ID NO: 799479 - RNA, 16 nt, Homo sapiens
acuccugcccuguugu

SEQ ID NO: 799480 - RNA, 19 nt, Homo sapiens
acuccuguaggaagguuaa

SEQ ID NO: 799481 - RNA, 12 nt, Homo sapiens
acuccuucagga

SEQ ID NO: 799482 - RNA, 22 nt, Homo sapiens
acuccuuguaaagacuguagaa

SEQ ID NO: 799483 - RNA, 21 nt, Homo sapiens
acuccuuuugguuuaccuggg

SEQ ID NO: 799484 - RNA, 19 nt, Homo sapiens
acucgagaccauccuggcc

SEQ ID NO: 799485 - RNA, 19 nt, Homo sapiens
acucgcccgcccacugucc

SEQ ID NO: 799486 - RNA, 14 nt, Homo sapiens
acucggauuccagc

SEQ ID NO: 799487 - RNA, 16 nt, Homo sapiens
acucggcgugcuccuu

SEQ ID NO: 799488 - RNA, 21 nt, Homo sapiens
acucgggaccaauacuacuga

SEQ ID NO: 799489 - RNA, 22 nt, Homo sapiens
acucgggaccaauacuacugac

SEQ ID NO: 799490 - RNA, 20 nt, Homo sapiens
acucuaggggucaggcucca

SEQ ID NO: 799491 - RNA, 22 nt, Homo sapiens
acucuauguuuggcuucagugu

SEQ ID NO: 799492 - RNA, 20 nt, Homo sapiens
acucucagcagcuaugguag

SEQ ID NO: 799493 - RNA, 23 nt, Homo sapiens
acucucauuccccagguggcuga

SEQ ID NO: 799494 - RNA, 14 nt, Homo sapiens
acucuccuagucaa

SEQ ID NO: 799495 - RNA, 21 nt, Homo sapiens
acucucuuuccuugagcuguu

SEQ ID NO: 799496 - RNA, 23 nt, Homo sapiens
acucucuuuuuuuuuaaggugaa

SEQ ID NO: 799497 - RNA, 15 nt, Homo sapiens
acucugaauccucau

SEQ ID NO: 799498 - RNA, 23 nt, Homo sapiens
acucugaggcucuuucugggcca

SEQ ID NO: 799499 - RNA, 12 nt, Homo sapiens
acucugcacaug

SEQ ID NO: 799500 - RNA, 19 nt, Homo sapiens
acucugcacaugucuugua

SEQ ID NO: 799501 - RNA, 15 nt, Homo sapiens
acucugcacuacucc

SEQ ID NO: 799502 - RNA, 14 nt, Homo sapiens
acucugcacuccau

SEQ ID NO: 799503 - RNA, 24 nt, Homo sapiens
acucugccagaguagugaagcuaa

SEQ ID NO: 799504 - RNA, 14 nt, Homo sapiens
acucugccauuaaa

SEQ ID NO: 799505 - RNA, 19 nt, Homo sapiens
acucugggcugccauguga

SEQ ID NO: 799506 - RNA, 12 nt, Homo sapiens
acucugguggca

SEQ ID NO: 799507 - RNA, 21 nt, Homo sapiens
acucuguagcuuaaaccaaca

SEQ ID NO: 799508 - RNA, 15 nt, Homo sapiens
acucugucucaaaaa

SEQ ID NO: 799509 - RNA, 20 nt, Homo sapiens
acucugucuuaaaugagaag

SEQ ID NO: 799510 - RNA, 17 nt, Homo sapiens
acucuguuauuuagacu

SEQ ID NO: 799511 - RNA, 21 nt, Homo sapiens
acucuuagauggauucuccac

SEQ ID NO: 799512 - RNA, 17 nt, Homo sapiens
acucuucccucucucac

SEQ ID NO: 799513 - RNA, 18 nt, Homo sapiens
acucuucgaagccuugcc

SEQ ID NO: 799514 - RNA, 17 nt, Homo sapiens
acucuucuaacacaaaa

SEQ ID NO: 799515 - RNA, 20 nt, Homo sapiens
acucuucuuacuggugcuau

SEQ ID NO: 799516 - RNA, 12 nt, Homo sapiens
acucuugcaggg

SEQ ID NO: 799517 - RNA, 16 nt, Homo sapiens
acucuugucacccagg

SEQ ID NO: 799518 - RNA, 21 nt, Homo sapiens
acucuugugaauuauucugau

SEQ ID NO: 799519 - RNA, 19 nt, Homo sapiens
acucuuuggguccauucag

SEQ ID NO: 799520 - RNA, 21 nt, Homo sapiens
acucuuuggguccauucagau

SEQ ID NO: 799521 - RNA, 14 nt, Homo sapiens
acugaaaaugugcu

SEQ ID NO: 799522 - RNA, 13 nt, Homo sapiens
acugaaacuggaa

SEQ ID NO: 799523 - RNA, 17 nt, Homo sapiens
acugaaaugaccaagac

SEQ ID NO: 799524 - RNA, 21 nt, Homo sapiens
acugaacuuaauaacugugua

SEQ ID NO: 799525 - RNA, 16 nt, Homo sapiens
acugaaggcauaugca

SEQ ID NO: 799526 - RNA, 16 nt, Homo sapiens
acugaaggugauggag

SEQ ID NO: 799527 - RNA, 19 nt, Homo sapiens
acugaaguagugugcaguu

SEQ ID NO: 799528 - RNA, 16 nt, Homo sapiens
acugaaucuaccugcc

SEQ ID NO: 799529 - RNA, 19 nt, Homo sapiens
acugaaucugcuaccaaaa

SEQ ID NO: 799530 - RNA, 15 nt, Homo sapiens
acugaauuaaugaca

SEQ ID NO: 799531 - RNA, 15 nt, Homo sapiens
acugaauucagcacc

SEQ ID NO: 799532 - RNA, 19 nt, Homo sapiens
acugaauuggcuuccagau

SEQ ID NO: 799533 - RNA, 16 nt, Homo sapiens
acugaauuuugggacu

SEQ ID NO: 799534 - RNA, 20 nt, Homo sapiens
acugaauuuugggacuucua

SEQ ID NO: 799535 - RNA, 20 nt, Homo sapiens
acugacacaagaauggucuu

SEQ ID NO: 799536 - RNA, 14 nt, Homo sapiens
acugacacaggaaa

SEQ ID NO: 799537 - RNA, 15 nt, Homo sapiens
acugacagauuucca

SEQ ID NO: 799538 - RNA, 20 nt, Homo sapiens
acugaccauauugugcuuca

SEQ ID NO: 799539 - RNA, 14 nt, Homo sapiens
acugaccuaccuca

SEQ ID NO: 799540 - RNA, 21 nt, Homo sapiens
acugacucugacucaucccca

SEQ ID NO: 799541 - RNA, 18 nt, Homo sapiens
acugacugccuugcuaaa

SEQ ID NO: 799542 - RNA, 17 nt, Homo sapiens
acugacuuucugauuac

SEQ ID NO: 799543 - RNA, 18 nt, Homo sapiens
acugagaaauuauacuua

SEQ ID NO: 799544 - RNA, 13 nt, Homo sapiens
acugagauuacag

SEQ ID NO: 799545 - RNA, 16 nt, Homo sapiens
acugagccagucccag

SEQ ID NO: 799546 - RNA, 15 nt, Homo sapiens
acugagcuacuagag

SEQ ID NO: 799547 - RNA, 18 nt, Homo sapiens
acugagcugggcaggaag

SEQ ID NO: 799548 - RNA, 15 nt, Homo sapiens
acugaggaauuucac

SEQ ID NO: 799549 - RNA, 19 nt, Homo sapiens
agcaaggcacagccuuugc

SEQ ID NO: 799550 - RNA, 19 nt, Homo sapiens
agcaaggcuuugguuucca

SEQ ID NO: 799551 - RNA, 16 nt, Homo sapiens
agcaagggggcccaaa

SEQ ID NO: 799552 - RNA, 18 nt, Homo sapiens
agcaaguaagcuagccag

SEQ ID NO: 799553 - RNA, 16 nt, Homo sapiens
agcaagucacuggcca

SEQ ID NO: 799554 - RNA, 19 nt, Homo sapiens
agcaagucacuggccagug

SEQ ID NO: 799555 - RNA, 17 nt, Homo sapiens
agcaagugugcucuccu

SEQ ID NO: 799556 - RNA, 15 nt, Homo sapiens
agcaaguguucacaa

SEQ ID NO: 799557 - RNA, 19 nt, Homo sapiens
agcaauacguuugugcaga

SEQ ID NO: 799558 - RNA, 21 nt, Homo sapiens
agcaauggaguggcugccaug

SEQ ID NO: 799559 - RNA, 16 nt, Homo sapiens
agcaaugucugugcua

SEQ ID NO: 799560 - RNA, 21 nt, Homo sapiens
agcaaugugccuugauugauu

SEQ ID NO: 799561 - RNA, 16 nt, Homo sapiens
agcaauucuccugccu

SEQ ID NO: 799562 - RNA, 14 nt, Homo sapiens
agcaauuucuaauu

SEQ ID NO: 799563 - RNA, 16 nt, Homo sapiens
agcacaaggccuugcc

SEQ ID NO: 799564 - RNA, 18 nt, Homo sapiens
agcacaauuugcacuaaa

SEQ ID NO: 799565 - RNA, 21 nt, Homo sapiens
agcacacacacauaagcacug

SEQ ID NO: 799566 - RNA, 21 nt, Homo sapiens
agcacacacuucacaaagcca

SEQ ID NO: 799567 - RNA, 18 nt, Homo sapiens
agcacacccgugugcaca

SEQ ID NO: 799568 - RNA, 20 nt, Homo sapiens
agcacaccuguguccaagaa

SEQ ID NO: 799569 - RNA, 17 nt, Homo sapiens
agcacacuuaugggcca

SEQ ID NO: 799570 - RNA, 19 nt, Homo sapiens
agcacacuuuacacaagaa

SEQ ID NO: 799571 - RNA, 20 nt, Homo sapiens
agcacagaaggaaucugugc

SEQ ID NO: 799572 - RNA, 19 nt, Homo sapiens
agcacagaauuugucagaa

SEQ ID NO: 799573 - RNA, 15 nt, Homo sapiens
agcacagauuugcau

SEQ ID NO: 799574 - RNA, 15 nt, Homo sapiens
agcacagcuccugcc

SEQ ID NO: 799575 - RNA, 19 nt, Homo sapiens
agcacagcuugaccugagg

SEQ ID NO: 799576 - RNA, 14 nt, Homo sapiens
agcacauucgggac

SEQ ID NO: 799577 - RNA, 16 nt, Homo sapiens
agcacccugcaaaaug

SEQ ID NO: 799578 - RNA, 19 nt, Homo sapiens
agcaccuccuccaugcagg

SEQ ID NO: 799579 - RNA, 14 nt, Homo sapiens
agcacggacuguca

SEQ ID NO: 799580 - RNA, 20 nt, Homo sapiens
agcacggugacucuguccag

SEQ ID NO: 799581 - RNA, 15 nt, Homo sapiens
agcacguggagcucu

SEQ ID NO: 799582 - RNA, 13 nt, Homo sapiens
agcacgugucuca

SEQ ID NO: 799583 - RNA, 13 nt, Homo sapiens
agcacuaaccaau

SEQ ID NO: 799584 - RNA, 21 nt, Homo sapiens
agcacuccccagagcugugcc

SEQ ID NO: 799585 - RNA, 16 nt, Homo sapiens
agcacucgagaccauc

SEQ ID NO: 799586 - RNA, 20 nt, Homo sapiens
agcacuggaaccaccuggac

SEQ ID NO: 799587 - RNA, 19 nt, Homo sapiens
agcacugggugaccagcug

SEQ ID NO: 799588 - RNA, 14 nt, Homo sapiens
agcacuggguguga

SEQ ID NO: 799589 - RNA, 19 nt, Homo sapiens
agcacuggugaacugagcu

SEQ ID NO: 799590 - RNA, 17 nt, Homo sapiens
agcacugucucaguuuc

SEQ ID NO: 799591 - RNA, 14 nt, Homo sapiens
agcacuuccauggg

SEQ ID NO: 799592 - RNA, 22 nt, Homo sapiens
agcacuugcaaccgucuguuau

SEQ ID NO: 799593 - RNA, 21 nt, Homo sapiens
agcagaaauauagugcaauag

SEQ ID NO: 799594 - RNA, 22 nt, Homo sapiens
agcagaaaucuagaagacuguc

SEQ ID NO: 799595 - RNA, 18 nt, Homo sapiens
agcagaagcucucgaugg

SEQ ID NO: 799596 - RNA, 23 nt, Homo sapiens
agcagaccaccccgccugcccuc

SEQ ID NO: 799597 - RNA, 22 nt, Homo sapiens
agcagaccuaccugcaguggga

SEQ ID NO: 799598 - RNA, 14 nt, Homo sapiens
agcagauacuuugu

SEQ ID NO: 799599 - RNA, 18 nt, Homo sapiens
agcagauggaaugcugug

SEQ ID NO: 799600 - RNA, 13 nt, Homo sapiens
agcagauggagua

SEQ ID NO: 799601 - RNA, 23 nt, Homo sapiens
agcagcacagucacccauggaac

SEQ ID NO: 799602 - RNA, 12 nt, Homo sapiens
agcagcacugga

SEQ ID NO: 799603 - RNA, 14 nt, Homo sapiens
agcagccagcaccc

SEQ ID NO: 799604 - RNA, 12 nt, Homo sapiens
agcagccagcug

SEQ ID NO: 799605 - RNA, 15 nt, Homo sapiens
agcagccagucucag

SEQ ID NO: 799606 - RNA, 18 nt, Homo sapiens
agcagccaguucaaaaac

SEQ ID NO: 799607 - RNA, 21 nt, Homo sapiens
agcagcccuaaggaucucuca

SEQ ID NO: 799608 - RNA, 16 nt, Homo sapiens
agcagcuaucucucag

SEQ ID NO: 799609 - RNA, 19 nt, Homo sapiens
agcagcuaucucucaguga

SEQ ID NO: 799610 - RNA, 23 nt, Homo sapiens
agcagcuaucucucagugaacug

SEQ ID NO: 799611 - RNA, 13 nt, Homo sapiens
agcagcucaagaa

SEQ ID NO: 799612 - RNA, 20 nt, Homo sapiens
agcagcucacacccuaccuu

SEQ ID NO: 799613 - RNA, 20 nt, Homo sapiens
agcagcugucagaacacucc

SEQ ID NO: 799614 - RNA, 11 nt, Homo sapiens
agcagcugugc

SEQ ID NO: 799615 - RNA, 20 nt, Homo sapiens
agcagcuuagacagcagggc

SEQ ID NO: 799616 - RNA, 15 nt, Homo sapiens
agcaggaaaccugug

SEQ ID NO: 799617 - RNA, 13 nt, Homo sapiens
agcaggagcagcu

SEQ ID NO: 799618 - RNA, 20 nt, Homo sapiens
agcaggcuccuggcugugcc

SEQ ID NO: 799619 - RNA, 19 nt, Homo sapiens
agcagggauuagguguuca

SEQ ID NO: 799620 - RNA, 19 nt, Homo sapiens
agcagggccaaagcacagc

SEQ ID NO: 799621 - RNA, 18 nt, Homo sapiens
agcagguaaggaaagggc

SEQ ID NO: 799622 - RNA, 16 nt, Homo sapiens
agcagguccugcggaa

SEQ ID NO: 799623 - RNA, 21 nt, Homo sapiens
agcagguguaaccguaaccca

SEQ ID NO: 799624 - RNA, 13 nt, Homo sapiens
agcaguagcauca

SEQ ID NO: 799625 - RNA, 19 nt, Homo sapiens
agcaguauuaacuucacag

SEQ ID NO: 799626 - RNA, 22 nt, Homo sapiens
agcagucacacuguuacuccac

SEQ ID NO: 799627 - RNA, 15 nt, Homo sapiens
agcagucagcccuua

SEQ ID NO: 799628 - RNA, 12 nt, Homo sapiens
agcagugaccca

SEQ ID NO: 799629 - RNA, 17 nt, Homo sapiens
agcagugggcagguggc

SEQ ID NO: 799630 - RNA, 21 nt, Homo sapiens
agcaguugaaacaagaagcca

SEQ ID NO: 799631 - RNA, 22 nt, Homo sapiens
agcauaacaagguccaagauac

SEQ ID NO: 799632 - RNA, 14 nt, Homo sapiens
agcauaaugcuccc

SEQ ID NO: 799633 - RNA, 18 nt, Homo sapiens
agcauaccaacacgagca

SEQ ID NO: 799634 - RNA, 13 nt, Homo sapiens
agcauacuucaaa

SEQ ID NO: 799635 - RNA, 12 nt, Homo sapiens
agcauacuuugu

SEQ ID NO: 799636 - RNA, 20 nt, Homo sapiens
agcauagaaaccacuagaaa

SEQ ID NO: 799637 - RNA, 18 nt, Homo sapiens
agcauagggucacuuugc

SEQ ID NO: 799638 - RNA, 15 nt, Homo sapiens
agcaucaaucuuguu

SEQ ID NO: 799639 - RNA, 14 nt, Homo sapiens
agcaucaccucagg

SEQ ID NO: 799640 - RNA, 13 nt, Homo sapiens
agcaucacugccc

SEQ ID NO: 799641 - RNA, 20 nt, Homo sapiens
agcaucccccaaaguucaca

SEQ ID NO: 799642 - RNA, 21 nt, Homo sapiens
agcaucgugcuguuugccuug

SEQ ID NO: 799643 - RNA, 21 nt, Homo sapiens
agcaucuaaguuauaagacuc

SEQ ID NO: 799644 - RNA, 22 nt, Homo sapiens
agcaucucccaguucauaauca

SEQ ID NO: 799645 - RNA, 20 nt, Homo sapiens
agcaucugaccaucugugac

SEQ ID NO: 799646 - RNA, 17 nt, Homo sapiens
agcaugaaccacccaga

SEQ ID NO: 799647 - RNA, 17 nt, Homo sapiens
agcaugaauaaaacacu

SEQ ID NO: 799648 - RNA, 14 nt, Homo sapiens
agcaugagacuuuc

SEQ ID NO: 799649 - RNA, 23 nt, Homo sapiens
agcaugaggacagaccacagagc

SEQ ID NO: 799650 - RNA, 22 nt, Homo sapiens
agcaugauaggauuuggggcag

SEQ ID NO: 799651 - RNA, 22 nt, Homo sapiens
agcaugaucaguguaugcgaaa

SEQ ID NO: 799652 - RNA, 17 nt, Homo sapiens
agcaugauuuauacuca

SEQ ID NO: 799653 - RNA, 13 nt, Homo sapiens
agcaugcuacagu

SEQ ID NO: 799654 - RNA, 22 nt, Homo sapiens
agcaugcuuugcugcuaugaaa

SEQ ID NO: 799655 - RNA, 14 nt, Homo sapiens
agcauggaacacuu

SEQ ID NO: 799656 - RNA, 18 nt, Homo sapiens
agcauggaggaggaggga

SEQ ID NO: 799657 - RNA, 21 nt, Homo sapiens
agcauggccccaguccaugcu

SEQ ID NO: 799658 - RNA, 20 nt, Homo sapiens
agcauggcuaauagggccac

SEQ ID NO: 799659 - RNA, 16 nt, Homo sapiens
agcaugggaggugagg

SEQ ID NO: 799660 - RNA, 22 nt, Homo sapiens
agcauggguccuugaugccaga

SEQ ID NO: 799661 - RNA, 15 nt, Homo sapiens
agcauguacuccccu

SEQ ID NO: 799662 - RNA, 20 nt, Homo sapiens
agcaugucucaauaguaaaa

SEQ ID NO: 799663 - RNA, 14 nt, Homo sapiens
agcuguagccaugg

SEQ ID NO: 799664 - RNA, 23 nt, Homo sapiens
agcuguauaauuaauugucauua

SEQ ID NO: 799665 - RNA, 14 nt, Homo sapiens
agcugucacuuuug

SEQ ID NO: 799666 - RNA, 17 nt, Homo sapiens
agcugucaggcugauua

SEQ ID NO: 799667 - RNA, 23 nt, Homo sapiens
agcugucuuccuguguaccucua

SEQ ID NO: 799668 - RNA, 18 nt, Homo sapiens
agcugugaagacuugccu

SEQ ID NO: 799669 - RNA, 16 nt, Homo sapiens
agcugugaugguaccu

SEQ ID NO: 799670 - RNA, 15 nt, Homo sapiens
agcugugcaggcaug

SEQ ID NO: 799671 - RNA, 11 nt, Homo sapiens
agcugugcugc

SEQ ID NO: 799672 - RNA, 18 nt, Homo sapiens
agcuguggaggauugcua

SEQ ID NO: 799673 - RNA, 21 nt, Homo sapiens
agcuguggccuaggcuaccuc

SEQ ID NO: 799674 - RNA, 20 nt, Homo sapiens
agcuguggggaacacagcua

SEQ ID NO: 799675 - RNA, 18 nt, Homo sapiens
agcugugguaaggguugg

SEQ ID NO: 799676 - RNA, 13 nt, Homo sapiens
agcugugucugcc

SEQ ID NO: 799677 - RNA, 18 nt, Homo sapiens
agcuguuauuuuuaggca

SEQ ID NO: 799678 - RNA, 24 nt, Homo sapiens
agcuguugcggacaucauucugca

SEQ ID NO: 799679 - RNA, 21 nt, Homo sapiens
agcuguuggaaggacuagguc

SEQ ID NO: 799680 - RNA, 17 nt, Homo sapiens
agcuguuuauggccuca

SEQ ID NO: 799681 - RNA, 18 nt, Homo sapiens
agcuguuuauggccucag

SEQ ID NO: 799682 - RNA, 14 nt, Homo sapiens
agcuguuuccauag

SEQ ID NO: 799683 - RNA, 15 nt, Homo sapiens
agcuuaauaaguauu

SEQ ID NO: 799684 - RNA, 20 nt, Homo sapiens
agcuuacaagccagcuggag

SEQ ID NO: 799685 - RNA, 12 nt, Homo sapiens
agcuuacaggaa

SEQ ID NO: 799686 - RNA, 21 nt, Homo sapiens
agcuuacauugaaaacagaua

SEQ ID NO: 799687 - RNA, 20 nt, Homo sapiens
agcuuacccaagcuguggca

SEQ ID NO: 799688 - RNA, 15 nt, Homo sapiens
agcuuagaguucuuc

SEQ ID NO: 799689 - RNA, 12 nt, Homo sapiens
agcuuagcuguc

SEQ ID NO: 799690 - RNA, 17 nt, Homo sapiens
agcuuagcugucucaga

SEQ ID NO: 799691 - RNA, 17 nt, Homo sapiens
agcuuaucucuuuuaua

SEQ ID NO: 799692 - RNA, 14 nt, Homo sapiens
agcuucaaacugca

SEQ ID NO: 799693 - RNA, 14 nt, Homo sapiens
agcuucaccagagc

SEQ ID NO: 799694 - RNA, 14 nt, Homo sapiens
agcuucacugucau

SEQ ID NO: 799695 - RNA, 17 nt, Homo sapiens
agcuucagagccuagcc

SEQ ID NO: 799696 - RNA, 15 nt, Homo sapiens
agcuucaugccuuug

SEQ ID NO: 799697 - RNA, 17 nt, Homo sapiens
agcuucccacaccugcc

SEQ ID NO: 799698 - RNA, 22 nt, Homo sapiens
agcuuccuucugggacuggaca

SEQ ID NO: 799699 - RNA, 21 nt, Homo sapiens
agcuucuaaucccagcacuuu

SEQ ID NO: 799700 - RNA, 15 nt, Homo sapiens
agcuucugcaauguu

SEQ ID NO: 799701 - RNA, 16 nt, Homo sapiens
agcuucuggagcagaa

SEQ ID NO: 799702 - RNA, 17 nt, Homo sapiens
agcuucuggggaugcag

SEQ ID NO: 799703 - RNA, 15 nt, Homo sapiens
agcuucuuacuggau

SEQ ID NO: 799704 - RNA, 17 nt, Homo sapiens
agcuucuucacaggcac

SEQ ID NO: 799705 - RNA, 13 nt, Homo sapiens
agcuugcagugag

SEQ ID NO: 799706 - RNA, 18 nt, Homo sapiens
agcuugcauagucaauau

SEQ ID NO: 799707 - RNA, 23 nt, Homo sapiens
agcuugccaauggcggacucaaa

SEQ ID NO: 799708 - RNA, 14 nt, Homo sapiens
agcuugcugucacu

SEQ ID NO: 799709 - RNA, 15 nt, Homo sapiens
agcuuggacuacaca

SEQ ID NO: 799710 - RNA, 17 nt, Homo sapiens
agcuuggacuacacaau

SEQ ID NO: 799711 - RNA, 17 nt, Homo sapiens
agcuuggugucuuggca

SEQ ID NO: 799712 - RNA, 22 nt, Homo sapiens
agcuugucugguaaguggcuuc

SEQ ID NO: 799713 - RNA, 20 nt, Homo sapiens
agcuuguguccuguccuuuc

SEQ ID NO: 799714 - RNA, 18 nt, Homo sapiens
agcuuguuucuauacugu

SEQ ID NO: 799715 - RNA, 22 nt, Homo sapiens
agcuuuauuuuuuaaguauuua

SEQ ID NO: 799716 - RNA, 21 nt, Homo sapiens
agcuuucccugccucucauca

SEQ ID NO: 799717 - RNA, 13 nt, Homo sapiens
agcuuucucaggg

SEQ ID NO: 799718 - RNA, 19 nt, Homo sapiens
agcuuugcagauaacaaaa

SEQ ID NO: 799719 - RNA, 13 nt, Homo sapiens
agcuuugcaggau

SEQ ID NO: 799720 - RNA, 12 nt, Homo sapiens
agcuuugcugcu

SEQ ID NO: 799721 - RNA, 15 nt, Homo sapiens
agcuuuggaccuaau

SEQ ID NO: 799722 - RNA, 16 nt, Homo sapiens
agcuuugggugccuuu

SEQ ID NO: 799723 - RNA, 18 nt, Homo sapiens
agcuuuucauaauaucua

SEQ ID NO: 799724 - RNA, 23 nt, Homo sapiens
agcuuuucuuuuuuaauuuccag

SEQ ID NO: 799725 - RNA, 23 nt, Homo sapiens
agcuuuugaggggcugacuucaa

SEQ ID NO: 799726 - RNA, 18 nt, Homo sapiens
agcuuuuuacucaaagag

SEQ ID NO: 799727 - RNA, 20 nt, Homo sapiens
aggaaaaaccaauagcuuua

SEQ ID NO: 799728 - RNA, 22 nt, Homo sapiens
aggaaaacuacugauacuuuca

SEQ ID NO: 799729 - RNA, 16 nt, Homo sapiens
aggaaaagacaccugu

SEQ ID NO: 799730 - RNA, 14 nt, Homo sapiens
aggaaaagcaagaa

SEQ ID NO: 799731 - RNA, 13 nt, Homo sapiens
aggaaaaggcccc

SEQ ID NO: 799732 - RNA, 18 nt, Homo sapiens
aggaaaagggagcuauga

SEQ ID NO: 799733 - RNA, 14 nt, Homo sapiens
aggaaaagugcaag

SEQ ID NO: 799734 - RNA, 18 nt, Homo sapiens
aggaaaaucacaucucca

SEQ ID NO: 799735 - RNA, 20 nt, Homo sapiens
aggaaaauguucauguucau

SEQ ID NO: 799736 - RNA, 15 nt, Homo sapiens
aggaaaauuucacau

SEQ ID NO: 799737 - RNA, 13 nt, Homo sapiens
aggaaacaaccau

SEQ ID NO: 799738 - RNA, 14 nt, Homo sapiens
aggaaacaauauaa

SEQ ID NO: 799739 - RNA, 12 nt, Homo sapiens
aggaaacaguua

SEQ ID NO: 799740 - RNA, 13 nt, Homo sapiens
aggaaacaguuaa

SEQ ID NO: 799741 - RNA, 21 nt, Homo sapiens
aggaaaccaacacccaaagca

SEQ ID NO: 799742 - RNA, 15 nt, Homo sapiens
aggaaacuaauuucc

SEQ ID NO: 799743 - RNA, 20 nt, Homo sapiens
aggaaacuccacaucugccu

SEQ ID NO: 799744 - RNA, 21 nt, Homo sapiens
aggaaacuccacaucugccuu

SEQ ID NO: 799745 - RNA, 13 nt, Homo sapiens
aggaaacuugaaa

SEQ ID NO: 799746 - RNA, 22 nt, Homo sapiens
aggaaacuugcauacagagaca

SEQ ID NO: 799747 - RNA, 13 nt, Homo sapiens
aggaaacuuugca

SEQ ID NO: 799748 - RNA, 22 nt, Homo sapiens
aggaaagaaucucuugagacau

SEQ ID NO: 799749 - RNA, 12 nt, Homo sapiens
aggaaagacagg

SEQ ID NO: 799750 - RNA, 22 nt, Homo sapiens
aggaaagagcuccaaauugaau

SEQ ID NO: 799751 - RNA, 13 nt, Homo sapiens
aggaaagcaauaa

SEQ ID NO: 799752 - RNA, 16 nt, Homo sapiens
aggaaaggauuuuacc

SEQ ID NO: 799753 - RNA, 22 nt, Homo sapiens
aggaaaggauuuuaccaaagca

SEQ ID NO: 799754 - RNA, 18 nt, Homo sapiens
aggaaaggcaggagccag

SEQ ID NO: 799755 - RNA, 16 nt, Homo sapiens
aggaaagucacccaaa

SEQ ID NO: 799756 - RNA, 12 nt, Homo sapiens
aggaaagugauu

SEQ ID NO: 799757 - RNA, 23 nt, Homo sapiens
aggaaauaguaccuucaauacuu

SEQ ID NO: 799758 - RNA, 22 nt, Homo sapiens
aggaaaucaaauaugcaaagca

SEQ ID NO: 799759 - RNA, 19 nt, Homo sapiens
aggaaauggagaagcucug

SEQ ID NO: 799760 - RNA, 20 nt, Homo sapiens
aggaaauggagaagcucugu

SEQ ID NO: 799761 - RNA, 19 nt, Homo sapiens
aggaaauggcuuugugauu

SEQ ID NO: 799762 - RNA, 19 nt, Homo sapiens
aggaaauguaagauuucau

SEQ ID NO: 799763 - RNA, 20 nt, Homo sapiens
aggaaauucuccacugugca

SEQ ID NO: 799764 - RNA, 15 nt, Homo sapiens
aggaacaacagcauc

SEQ ID NO: 799765 - RNA, 15 nt, Homo sapiens
aggaacaaucuuugc

SEQ ID NO: 799766 - RNA, 13 nt, Homo sapiens
aggaacacuggcu

SEQ ID NO: 799767 - RNA, 16 nt, Homo sapiens
aggaacagcaauggug

SEQ ID NO: 799768 - RNA, 12 nt, Homo sapiens
aggaacaggugg

SEQ ID NO: 799769 - RNA, 22 nt, Homo sapiens
aggaacagugugguuugggaaa

SEQ ID NO: 799770 - RNA, 18 nt, Homo sapiens
aggaacauugcagagcua

SEQ ID NO: 799771 - RNA, 15 nt, Homo sapiens
aggaaccagcaggau

SEQ ID NO: 799772 - RNA, 17 nt, Homo sapiens
aggaaccaggaggacaa

SEQ ID NO: 799773 - RNA, 12 nt, Homo sapiens
aggaaccuacca

SEQ ID NO: 799774 - RNA, 19 nt, Homo sapiens
aggaaccucucgccaugau

SEQ ID NO: 799775 - RNA, 17 nt, Homo sapiens
aggaacucacauacuga

SEQ ID NO: 799776 - RNA, 18 nt, Homo sapiens
aggaagaagauagaucca

SEQ ID NO: 799777 - RNA, 15 nt, Homo sapiens
aggaagauggagguu

SEQ ID NO: 799778 - RNA, 22 nt, Homo sapiens
aggggcccaaauucuuucagug

SEQ ID NO: 799779 - RNA, 18 nt, Homo sapiens
aggggcccuggccaggac

SEQ ID NO: 799780 - RNA, 20 nt, Homo sapiens
aggggccuuagggcacuggg

SEQ ID NO: 799781 - RNA, 16 nt, Homo sapiens
aggggcuggaagggaa

SEQ ID NO: 799782 - RNA, 13 nt, Homo sapiens
aggggcuguguuu

SEQ ID NO: 799783 - RNA, 15 nt, Homo sapiens
agggggagaaugggu

SEQ ID NO: 799784 - RNA, 20 nt, Homo sapiens
agggggcgcucaggacccag

SEQ ID NO: 799785 - RNA, 16 nt, Homo sapiens
agggggucucuguuaa

SEQ ID NO: 799786 - RNA, 23 nt, Homo sapiens
agggggugggggugccgcuuucu

SEQ ID NO: 799787 - RNA, 23 nt, Homo sapiens
agggggugggggugcugcucucu

SEQ ID NO: 799788 - RNA, 23 nt, Homo sapiens
aggggguucuuauuuugcauucc

SEQ ID NO: 799789 - RNA, 12 nt, Homo sapiens
aggggguugugg

SEQ ID NO: 799790 - RNA, 15 nt, Homo sapiens
agggguauguucccu

SEQ ID NO: 799791 - RNA, 18 nt, Homo sapiens
aggggugggccugugaau

SEQ ID NO: 799792 - RNA, 22 nt, Homo sapiens
aggggugggggugccgcucucu

SEQ ID NO: 799793 - RNA, 19 nt, Homo sapiens
aggggugguccugacucaa

SEQ ID NO: 799794 - RNA, 18 nt, Homo sapiens
agggguuauagcuucagg

SEQ ID NO: 799795 - RNA, 18 nt, Homo sapiens
agggguucuugagccagc

SEQ ID NO: 799796 - RNA, 24 nt, Homo sapiens
agggguugagggaagguucuucau

SEQ ID NO: 799797 - RNA, 15 nt, Homo sapiens
agggguuucagaauu

SEQ ID NO: 799798 - RNA, 15 nt, Homo sapiens
agggguuucuucaag

SEQ ID NO: 799799 - RNA, 18 nt, Homo sapiens
aggguaacuuaacagagu

SEQ ID NO: 799800 - RNA, 12 nt, Homo sapiens
aggguacaugug

SEQ ID NO: 799801 - RNA, 20 nt, Homo sapiens
aggguacuuuaagacauacu

SEQ ID NO: 799802 - RNA, 22 nt, Homo sapiens
aggguauaaauuauauccguga

SEQ ID NO: 799803 - RNA, 14 nt, Homo sapiens
aggguccaguggau

SEQ ID NO: 799804 - RNA, 15 nt, Homo sapiens
agggucccucugugu

SEQ ID NO: 799805 - RNA, 18 nt, Homo sapiens
aggguccuccuccaucuu

SEQ ID NO: 799806 - RNA, 13 nt, Homo sapiens
aggguccucuagc

SEQ ID NO: 799807 - RNA, 19 nt, Homo sapiens
agggucuucuuacaugcau

SEQ ID NO: 799808 - RNA, 23 nt, Homo sapiens
agggugacccugaagugagcaca

SEQ ID NO: 799809 - RNA, 18 nt, Homo sapiens
agggugacugaugauaca

SEQ ID NO: 799810 - RNA, 13 nt, Homo sapiens
agggugcagucca

SEQ ID NO: 799811 - RNA, 14 nt, Homo sapiens
agggugcaguccag

SEQ ID NO: 799812 - RNA, 16 nt, Homo sapiens
aggguggcccuugcag

SEQ ID NO: 799813 - RNA, 15 nt, Homo sapiens
agggugggcucugac

SEQ ID NO: 799814 - RNA, 14 nt, Homo sapiens
agggugggggugcu

SEQ ID NO: 799815 - RNA, 19 nt, Homo sapiens
agggugugggccaccagag

SEQ ID NO: 799816 - RNA, 17 nt, Homo sapiens
aggguuuguaauacuuu

SEQ ID NO: 799817 - RNA, 15 nt, Homo sapiens
aggguuuugacacuu

SEQ ID NO: 799818 - RNA, 14 nt, Homo sapiens
agguaaaacagggc

SEQ ID NO: 799819 - RNA, 21 nt, Homo sapiens
agguaacaugauuguuugaca

SEQ ID NO: 799820 - RNA, 14 nt, Homo sapiens
agguacaaguggcu

SEQ ID NO: 799821 - RNA, 15 nt, Homo sapiens
agguacaaguggcug

SEQ ID NO: 799822 - RNA, 18 nt, Homo sapiens
agguacagaaaacauguu

SEQ ID NO: 799823 - RNA, 16 nt, Homo sapiens
agguacagcagaaagg

SEQ ID NO: 799824 - RNA, 20 nt, Homo sapiens
agguaccagcugcgcuugcu

SEQ ID NO: 799825 - RNA, 17 nt, Homo sapiens
agguacgaugacagugu

SEQ ID NO: 799826 - RNA, 20 nt, Homo sapiens
agguacuauauuugcuagac

SEQ ID NO: 799827 - RNA, 21 nt, Homo sapiens
agguagcauucuuuggaguua

SEQ ID NO: 799828 - RNA, 16 nt, Homo sapiens
agguaguuaagggaug

SEQ ID NO: 799829 - RNA, 19 nt, Homo sapiens
agguauaaggacucacaca

SEQ ID NO: 799830 - RNA, 18 nt, Homo sapiens
agguaugccaccaacacu

SEQ ID NO: 799831 - RNA, 16 nt, Homo sapiens
aggucaaggcugcagu

SEQ ID NO: 799832 - RNA, 22 nt, Homo sapiens
aggucaaggcuucagugagcca

SEQ ID NO: 799833 - RNA, 18 nt, Homo sapiens
aggucaaggugagcagaa

SEQ ID NO: 799834 - RNA, 12 nt, Homo sapiens
aggucaccagcu

SEQ ID NO: 799835 - RNA, 21 nt, Homo sapiens
aggucacugcuagagacgcug

SEQ ID NO: 799836 - RNA, 14 nt, Homo sapiens
aggucagccuggaa

SEQ ID NO: 799837 - RNA, 12 nt, Homo sapiens
aggucaggagau

SEQ ID NO: 799838 - RNA, 15 nt, Homo sapiens
aggucaggaguucaa

SEQ ID NO: 799839 - RNA, 15 nt, Homo sapiens
aggucaggaguucga

SEQ ID NO: 799840 - RNA, 23 nt, Homo sapiens
aggucaucaaacauuugccaagu

SEQ ID NO: 799841 - RNA, 14 nt, Homo sapiens
agguccaccugcua

SEQ ID NO: 799842 - RNA, 15 nt, Homo sapiens
aggucccucagacau

SEQ ID NO: 799843 - RNA, 17 nt, Homo sapiens
aggucccuggaccagcc

SEQ ID NO: 799844 - RNA, 13 nt, Homo sapiens
agguccucuacuu

SEQ ID NO: 799845 - RNA, 22 nt, Homo sapiens
agguccugcuccgcugccugga

SEQ ID NO: 799846 - RNA, 15 nt, Homo sapiens
aggucggcacuugga

SEQ ID NO: 799847 - RNA, 20 nt, Homo sapiens
aggucucaggagaagggaua

SEQ ID NO: 799848 - RNA, 13 nt, Homo sapiens
aggucuccaaaau

SEQ ID NO: 799849 - RNA, 19 nt, Homo sapiens
aggucuccaaacugauuaa

SEQ ID NO: 799850 - RNA, 14 nt, Homo sapiens
aggucuccaagacc

SEQ ID NO: 799851 - RNA, 13 nt, Homo sapiens
aggucuccgggga

SEQ ID NO: 799852 - RNA, 21 nt, Homo sapiens
aggucugagauaaaacgaucu

SEQ ID NO: 799853 - RNA, 18 nt, Homo sapiens
aggucuucaaucuuaaaa

SEQ ID NO: 799854 - RNA, 21 nt, Homo sapiens
aggucuugcaguggcuuuuca

SEQ ID NO: 799855 - RNA, 22 nt, Homo sapiens
aggugaacaagguaaaacaacu

SEQ ID NO: 799856 - RNA, 15 nt, Homo sapiens
aggugaagcacauac

SEQ ID NO: 799857 - RNA, 15 nt, Homo sapiens
aggugacugaaggcu

SEQ ID NO: 799858 - RNA, 13 nt, Homo sapiens
aggugacugggaa

SEQ ID NO: 799859 - RNA, 15 nt, Homo sapiens
aggugagaaaaccau

SEQ ID NO: 799860 - RNA, 17 nt, Homo sapiens
aggugagaaaaccaugg

SEQ ID NO: 799861 - RNA, 21 nt, Homo sapiens
aggugaggauuccaaaaacau

SEQ ID NO: 799862 - RNA, 15 nt, Homo sapiens
aggugauagcauugc

SEQ ID NO: 799863 - RNA, 23 nt, Homo sapiens
aggugauccacccaccuuggccu

SEQ ID NO: 799864 - RNA, 16 nt, Homo sapiens
aggugauuccagugaa

SEQ ID NO: 799865 - RNA, 21 nt, Homo sapiens
aggugcagaccuugggggaag

SEQ ID NO: 799866 - RNA, 16 nt, Homo sapiens
aggugcccagggccag

SEQ ID NO: 799867 - RNA, 18 nt, Homo sapiens
aggugcccagggccagug

SEQ ID NO: 799868 - RNA, 14 nt, Homo sapiens
aggugccucagacu

SEQ ID NO: 799869 - RNA, 17 nt, Homo sapiens
aggugccuccaggugug

SEQ ID NO: 799870 - RNA, 20 nt, Homo sapiens
aggugcguaguccaacucuu

SEQ ID NO: 799871 - RNA, 19 nt, Homo sapiens
aggugcguguucagcagaa

SEQ ID NO: 799872 - RNA, 21 nt, Homo sapiens
aggugcugggcuggacuggcc

SEQ ID NO: 799873 - RNA, 16 nt, Homo sapiens
aggugcuuauucucaa

SEQ ID NO: 799874 - RNA, 23 nt, Homo sapiens
aggugcuucgaagaauguugccc

SEQ ID NO: 799875 - RNA, 21 nt, Homo sapiens
aggugcuugacauaauuucac

SEQ ID NO: 799876 - RNA, 23 nt, Homo sapiens
agguggagguugcagugagccaa

SEQ ID NO: 799877 - RNA, 16 nt, Homo sapiens
agguggaucaccugag

SEQ ID NO: 799878 - RNA, 22 nt, Homo sapiens
agguggcuuuuagcauucugug

SEQ ID NO: 799879 - RNA, 15 nt, Homo sapiens
aggugggaggaucac

SEQ ID NO: 799880 - RNA, 19 nt, Homo sapiens
aggugggccuugcuaccuc

SEQ ID NO: 799881 - RNA, 22 nt, Homo sapiens
aggugggcugccugcuguguua

SEQ ID NO: 799882 - RNA, 19 nt, Homo sapiens
agguggggauccugccuaa

SEQ ID NO: 799883 - RNA, 22 nt, Homo sapiens
aggugggugugggacaccuggg

SEQ ID NO: 799884 - RNA, 16 nt, Homo sapiens
aggugguggcacugag

SEQ ID NO: 799885 - RNA, 17 nt, Homo sapiens
agguguaacacuuguca

SEQ ID NO: 799886 - RNA, 13 nt, Homo sapiens
aggugucauccac

SEQ ID NO: 799887 - RNA, 16 nt, Homo sapiens
aggugucucuuucauc

SEQ ID NO: 799888 - RNA, 10 nt, Homo sapiens
aggugucuga

SEQ ID NO: 799889 - RNA, 16 nt, Homo sapiens
aggugugcccuguaca

SEQ ID NO: 799890 - RNA, 16 nt, Homo sapiens
agguguuacuagaagg

SEQ ID NO: 799891 - RNA, 23 nt, Homo sapiens
agguguucuucauuaccucagug

SEQ ID NO: 799892 - RNA, 17 nt, Homo sapiens
aguugucuuuccuggca

SEQ ID NO: 799893 - RNA, 14 nt, Homo sapiens
aguuguuccaggga

SEQ ID NO: 799894 - RNA, 15 nt, Homo sapiens
aguuguucuguuaac

SEQ ID NO: 799895 - RNA, 22 nt, Homo sapiens
aguuguuuuaauaacuuaucua

SEQ ID NO: 799896 - RNA, 22 nt, Homo sapiens
aguuuaaaaaaauaacaucuga

SEQ ID NO: 799897 - RNA, 21 nt, Homo sapiens
aguuuaaaucaagauuaugau

SEQ ID NO: 799898 - RNA, 14 nt, Homo sapiens
aguuuaaaugagac

SEQ ID NO: 799899 - RNA, 23 nt, Homo sapiens
aguuuaacauuagcuaaaacugc

SEQ ID NO: 799900 - RNA, 13 nt, Homo sapiens
aguuuacaggaua

SEQ ID NO: 799901 - RNA, 16 nt, Homo sapiens
aguuuacugaagcaaa

SEQ ID NO: 799902 - RNA, 20 nt, Homo sapiens
aguuuagauugugaggcaau

SEQ ID NO: 799903 - RNA, 20 nt, Homo sapiens
aguuuauaagacuggaauau

SEQ ID NO: 799904 - RNA, 19 nt, Homo sapiens
aguuuauggauaugcugcu

SEQ ID NO: 799905 - RNA, 21 nt, Homo sapiens
aguuuauuuuuauacuuucag

SEQ ID NO: 799906 - RNA, 19 nt, Homo sapiens
aguuucaaaagcaaaacau

SEQ ID NO: 799907 - RNA, 18 nt, Homo sapiens
aguuucaaacuuacuauu

SEQ ID NO: 799908 - RNA, 15 nt, Homo sapiens
aguuucaaguuuuaa

SEQ ID NO: 799909 - RNA, 18 nt, Homo sapiens
aguuucacuguacugcau

SEQ ID NO: 799910 - RNA, 21 nt, Homo sapiens
aguuuccacuaucccaaucaa

SEQ ID NO: 799911 - RNA, 17 nt, Homo sapiens
aguuuccauauguuaua

SEQ ID NO: 799912 - RNA, 18 nt, Homo sapiens
aguuuccuaugggaacaa

SEQ ID NO: 799913 - RNA, 17 nt, Homo sapiens
aguuucuaagauucuaa

SEQ ID NO: 799914 - RNA, 17 nt, Homo sapiens
aguuucuggcucuugag

SEQ ID NO: 799915 - RNA, 23 nt, Homo sapiens
aguuucuugcuuggaagccaggu

SEQ ID NO: 799916 - RNA, 22 nt, Homo sapiens
aguuugaacaaaaucuccucuu

SEQ ID NO: 799917 - RNA, 23 nt, Homo sapiens
aguuugaacucuguaaaaccuca

SEQ ID NO: 799918 - RNA, 13 nt, Homo sapiens
aguuugagaccag

SEQ ID NO: 799919 - RNA, 15 nt, Homo sapiens
aguuugcacaacaag

SEQ ID NO: 799920 - RNA, 16 nt, Homo sapiens
aguuugcuugauauau

SEQ ID NO: 799921 - RNA, 19 nt, Homo sapiens
aguuugcuuuguaugcacu

SEQ ID NO: 799922 - RNA, 23 nt, Homo sapiens
aguuugcuuuuugcguacacaga

SEQ ID NO: 799923 - RNA, 22 nt, Homo sapiens
aguuuggcugcugucauaacau

SEQ ID NO: 799924 - RNA, 21 nt, Homo sapiens
aguuuguagccagguacugca

SEQ ID NO: 799925 - RNA, 22 nt, Homo sapiens
aguuuguguguauuuguauuaa

SEQ ID NO: 799926 - RNA, 21 nt, Homo sapiens
aguuuuaauaagaacagauca

SEQ ID NO: 799927 - RNA, 13 nt, Homo sapiens
aguuuuaccucuu

SEQ ID NO: 799928 - RNA, 17 nt, Homo sapiens
aguuuuauuuacuucug

SEQ ID NO: 799929 - RNA, 19 nt, Homo sapiens
aguuuuccuucuguuaaaa

SEQ ID NO: 799930 - RNA, 19 nt, Homo sapiens
aguuuucuagaugacauaa

SEQ ID NO: 799931 - RNA, 21 nt, Homo sapiens
aguuuuggcaaggcugacaga

SEQ ID NO: 799932 - RNA, 15 nt, Homo sapiens
aguuuuggcauaaua

SEQ ID NO: 799933 - RNA, 19 nt, Homo sapiens
aguuuuguacauaacuuag

SEQ ID NO: 799934 - RNA, 13 nt, Homo sapiens
aguuuuguugccc

SEQ ID NO: 799935 - RNA, 10 nt, Homo sapiens
aguuuuuacu

SEQ ID NO: 799936 - RNA, 13 nt, Homo sapiens
aguuuuucagcuu

SEQ ID NO: 799937 - RNA, 19 nt, Homo sapiens
aguuuuugcuuccugcuau

SEQ ID NO: 799938 - RNA, 18 nt, Homo sapiens
auaaaaaauaaaguacca

SEQ ID NO: 799939 - RNA, 15 nt, Homo sapiens
auaaaaacauuucuu

SEQ ID NO: 799940 - RNA, 14 nt, Homo sapiens
auaaaaagaguaug

SEQ ID NO: 799941 - RNA, 15 nt, Homo sapiens
auaaaaagugacaca

SEQ ID NO: 799942 - RNA, 16 nt, Homo sapiens
auaaaacaaaaccaag

SEQ ID NO: 799943 - RNA, 13 nt, Homo sapiens
auaaaacagcugc

SEQ ID NO: 799944 - RNA, 21 nt, Homo sapiens
auaaaaccauuuuuugaacca

SEQ ID NO: 799945 - RNA, 23 nt, Homo sapiens
auaaaaccuguucucuuuaauca

SEQ ID NO: 799946 - RNA, 21 nt, Homo sapiens
auaaaagaaccgagcaauuuu

SEQ ID NO: 799947 - RNA, 18 nt, Homo sapiens
auaaaauaaaugagcuau

SEQ ID NO: 799948 - RNA, 14 nt, Homo sapiens
auaaaauauguaca

SEQ ID NO: 799949 - RNA, 15 nt, Homo sapiens
auaaaauauucacuc

SEQ ID NO: 799950 - RNA, 18 nt, Homo sapiens
auaaaauccugugcaaua

SEQ ID NO: 799951 - RNA, 19 nt, Homo sapiens
auaaaaucugugaauuaaa

SEQ ID NO: 799952 - RNA, 17 nt, Homo sapiens
auaaaauguaauuacuu

SEQ ID NO: 799953 - RNA, 21 nt, Homo sapiens
auaaaauguuuaaucucugcu

SEQ ID NO: 799954 - RNA, 14 nt, Homo sapiens
auaaaauuagcuug

SEQ ID NO: 799955 - RNA, 15 nt, Homo sapiens
auaaaauuaugccau

SEQ ID NO: 799956 - RNA, 14 nt, Homo sapiens
auaaaauugcacuu

SEQ ID NO: 799957 - RNA, 23 nt, Homo sapiens
auaaaauuggcaccaugugccau

SEQ ID NO: 799958 - RNA, 20 nt, Homo sapiens
auaaacaaauaacaaugugc

SEQ ID NO: 799959 - RNA, 22 nt, Homo sapiens
auaaacagacuguuaauuauag

SEQ ID NO: 799960 - RNA, 22 nt, Homo sapiens
auaaacauccuucaagaacucu

SEQ ID NO: 799961 - RNA, 15 nt, Homo sapiens
auaaaccaguugaau

SEQ ID NO: 799962 - RNA, 17 nt, Homo sapiens
auaaaccugaccuccuu

SEQ ID NO: 799963 - RNA, 16 nt, Homo sapiens
auaaaccuggagauau

SEQ ID NO: 799964 - RNA, 21 nt, Homo sapiens
auaaaccugggcucagccuga

SEQ ID NO: 799965 - RNA, 12 nt, Homo sapiens
auaaacuaccaa

SEQ ID NO: 799966 - RNA, 20 nt, Homo sapiens
auaaacuaguuuccagugga

SEQ ID NO: 799967 - RNA, 19 nt, Homo sapiens
auaaacuauuuauaucaca

SEQ ID NO: 799968 - RNA, 16 nt, Homo sapiens
auaaacucauuuaacu

SEQ ID NO: 799969 - RNA, 16 nt, Homo sapiens
auaaacucauuuaucu

SEQ ID NO: 799970 - RNA, 12 nt, Homo sapiens
auaaacugagcc

SEQ ID NO: 799971 - RNA, 15 nt, Homo sapiens
auaaacuucagggau

SEQ ID NO: 799972 - RNA, 12 nt, Homo sapiens
auaaacuuuauu

SEQ ID NO: 799973 - RNA, 23 nt, Homo sapiens
auaaagaagguuggugaauuuca

SEQ ID NO: 799974 - RNA, 19 nt, Homo sapiens
auaaagacaaucacugcca

SEQ ID NO: 799975 - RNA, 15 nt, Homo sapiens
auaaagacaggguuu

SEQ ID NO: 799976 - RNA, 15 nt, Homo sapiens
auaaagaccugagaa

SEQ ID NO: 799977 - RNA, 17 nt, Homo sapiens
auaaagagccauaguuu

SEQ ID NO: 799978 - RNA, 20 nt, Homo sapiens
auaaagaggaucguagugug

SEQ ID NO: 799979 - RNA, 15 nt, Homo sapiens
auaaagcacugagca

SEQ ID NO: 799980 - RNA, 18 nt, Homo sapiens
auaaagccaaauuuccag

SEQ ID NO: 799981 - RNA, 19 nt, Homo sapiens
auaaaggcagcugccucug

SEQ ID NO: 799982 - RNA, 18 nt, Homo sapiens
auaaaggcaguuuucuaa

SEQ ID NO: 799983 - RNA, 22 nt, Homo sapiens
auaaaggcccagacuccauggu

SEQ ID NO: 799984 - RNA, 22 nt, Homo sapiens
auaaaggucuuugcacauguga

SEQ ID NO: 799985 - RNA, 12 nt, Homo sapiens
auaaaguaccac

SEQ ID NO: 799986 - RNA, 22 nt, Homo sapiens
auaaaguaccacacauauugca

SEQ ID NO: 799987 - RNA, 23 nt, Homo sapiens
auaaaguauccaugcaugugcau

SEQ ID NO: 799988 - RNA, 18 nt, Homo sapiens
auaaagucacuuccagug

SEQ ID NO: 799989 - RNA, 15 nt, Homo sapiens
auaaagucucucuga

SEQ ID NO: 799990 - RNA, 14 nt, Homo sapiens
auaaaguuccuuaa

SEQ ID NO: 799991 - RNA, 15 nt, Homo sapiens
auaaaguugcuguga

SEQ ID NO: 799992 - RNA, 16 nt, Homo sapiens
auaaauaaaagcuaga

SEQ ID NO: 799993 - RNA, 14 nt, Homo sapiens
auaaauacugucaa

SEQ ID NO: 799994 - RNA, 14 nt, Homo sapiens
auaaauauacagua

SEQ ID NO: 799995 - RNA, 19 nt, Homo sapiens
auaaaucaaugucacuuaa

SEQ ID NO: 799996 - RNA, 22 nt, Homo sapiens
auaaauccauccauccaaaggc

SEQ ID NO: 799997 - RNA, 22 nt, Homo sapiens
auaaaucucuucuuugcugcag

SEQ ID NO: 799998 - RNA, 18 nt, Homo sapiens
auaaaucugacccagugc

SEQ ID NO: 799999 - RNA, 20 nt, Homo sapiens
auaaaugaaguauuucucac

SEQ ID NO: 800000 - RNA, 15 nt, Homo sapiens
auaaaugaaugaaua

SEQ ID NO: 800001 - RNA, 13 nt, Homo sapiens
auaaaugacuguu

SEQ ID NO: 800002 - RNA, 19 nt, Homo sapiens
auaaaugcccaucagauau

SEQ ID NO: 800003 - RNA, 19 nt, Homo sapiens
auaaauguaaauauguaca

SEQ ID NO: 800004 - RNA, 20 nt, Homo sapiens
auaaauguaaauauguacac

SEQ ID NO: 800005 - RNA, 19 nt, Homo sapiens
auaaauguaauagccaaac

SEQ ID NO: 800006 - RNA, 19 nt, Homo sapiens
auguguauguacguuugua

SEQ ID NO: 800007 - RNA, 21 nt, Homo sapiens
auguguauuuuucaaggcauu

SEQ ID NO: 800008 - RNA, 15 nt, Homo sapiens
augugucaucuagca

SEQ ID NO: 800009 - RNA, 14 nt, Homo sapiens
augugugaggagcu

SEQ ID NO: 800010 - RNA, 23 nt, Homo sapiens
auguguggaaguuauuaacuuua

SEQ ID NO: 800011 - RNA, 15 nt, Homo sapiens
auguguggacugugg

SEQ ID NO: 800012 - RNA, 16 nt, Homo sapiens
auguguguguguugug

SEQ ID NO: 800013 - RNA, 17 nt, Homo sapiens
auguguguuuucuaaua

SEQ ID NO: 800014 - RNA, 17 nt, Homo sapiens
auguguuaaaauacuca

SEQ ID NO: 800015 - RNA, 16 nt, Homo sapiens
auguguuaagugcagg

SEQ ID NO: 800016 - RNA, 18 nt, Homo sapiens
auguguuauuacuuccuc

SEQ ID NO: 800017 - RNA, 11 nt, Homo sapiens
auguguugccc

SEQ ID NO: 800018 - RNA, 18 nt, Homo sapiens
auguguuuuagaugguuu

SEQ ID NO: 800019 - RNA, 17 nt, Homo sapiens
auguuaaagaugcacag

SEQ ID NO: 800020 - RNA, 15 nt, Homo sapiens
auguuaaccaaugua

SEQ ID NO: 800021 - RNA, 16 nt, Homo sapiens
auguuaaccaauguau

SEQ ID NO: 800022 - RNA, 15 nt, Homo sapiens
auguuaagaguacua

SEQ ID NO: 800023 - RNA, 18 nt, Homo sapiens
auguuaagcucuuuauga

SEQ ID NO: 800024 - RNA, 21 nt, Homo sapiens
auguuacggcaucacacuuau

SEQ ID NO: 800025 - RNA, 18 nt, Homo sapiens
auguuagacucuggucau

SEQ ID NO: 800026 - RNA, 19 nt, Homo sapiens
auguuagggugcucuggaa

SEQ ID NO: 800027 - RNA, 12 nt, Homo sapiens
auguuauaucau

SEQ ID NO: 800028 - RNA, 11 nt, Homo sapiens
auguuaugcug

SEQ ID NO: 800029 - RNA, 13 nt, Homo sapiens
auguuaugugcaa

SEQ ID NO: 800030 - RNA, 20 nt, Homo sapiens
auguucacaagguaccccaa

SEQ ID NO: 800031 - RNA, 15 nt, Homo sapiens
auguucacugugagu

SEQ ID NO: 800032 - RNA, 15 nt, Homo sapiens
auguucacuguggca

SEQ ID NO: 800033 - RNA, 22 nt, Homo sapiens
auguuccaaacccuccugggaa

SEQ ID NO: 800034 - RNA, 16 nt, Homo sapiens
auguuccuacgggcuu

SEQ ID NO: 800035 - RNA, 21 nt, Homo sapiens
auguuccugccuccuugauau

SEQ ID NO: 800036 - RNA, 13 nt, Homo sapiens
auguucuccauuu

SEQ ID NO: 800037 - RNA, 19 nt, Homo sapiens
auguucugugacugaagaa

SEQ ID NO: 800038 - RNA, 18 nt, Homo sapiens
auguucugugggggucau

SEQ ID NO: 800039 - RNA, 19 nt, Homo sapiens
auguugccaccuguuaaaa

SEQ ID NO: 800040 - RNA, 23 nt, Homo sapiens
auguugguguuccacguguuuua

SEQ ID NO: 800041 - RNA, 23 nt, Homo sapiens
auguuguguggcaaugggauuug

SEQ ID NO: 800042 - RNA, 14 nt, Homo sapiens
auguuuaaagauca

SEQ ID NO: 800043 - RNA, 18 nt, Homo sapiens
auguuuacagacugugag

SEQ ID NO: 800044 - RNA, 12 nt, Homo sapiens
auguuuacuucu

SEQ ID NO: 800045 - RNA, 17 nt, Homo sapiens
auguuuauuuacuaauu

SEQ ID NO: 800046 - RNA, 14 nt, Homo sapiens
auguuucacagugg

SEQ ID NO: 800047 - RNA, 21 nt, Homo sapiens
auguuuccacuggcuuuugcc

SEQ ID NO: 800048 - RNA, 23 nt, Homo sapiens
auguuucgugaaguauacuguau

SEQ ID NO: 800049 - RNA, 15 nt, Homo sapiens
auguuugcaaacuug

SEQ ID NO: 800050 - RNA, 16 nt, Homo sapiens
auguuugcacuuguga

SEQ ID NO: 800051 - RNA, 16 nt, Homo sapiens
auguuugccuucugca

SEQ ID NO: 800052 - RNA, 16 nt, Homo sapiens
auguuuggaaaccaca

SEQ ID NO: 800053 - RNA, 13 nt, Homo sapiens
auguuugucagau

SEQ ID NO: 800054 - RNA, 16 nt, Homo sapiens
auguuuguccugaaca

SEQ ID NO: 800055 - RNA, 23 nt, Homo sapiens
auguuugucuuuuaaugcuucau

SEQ ID NO: 800056 - RNA, 16 nt, Homo sapiens
auguuuuauuuugcca

SEQ ID NO: 800057 - RNA, 18 nt, Homo sapiens
auguuuuuaauucuagua

SEQ ID NO: 800058 - RNA, 22 nt, Homo sapiens
auuaaaaaagcucaaugcauug

SEQ ID NO: 800059 - RNA, 17 nt, Homo sapiens
auuaaaaaaucagagaa

SEQ ID NO: 800060 - RNA, 19 nt, Homo sapiens
auuaaaaagauagacuuca

SEQ ID NO: 800061 - RNA, 13 nt, Homo sapiens
auuaaacacugua

SEQ ID NO: 800062 - RNA, 20 nt, Homo sapiens
auuaaacuugucagaauuuc

SEQ ID NO: 800063 - RNA, 17 nt, Homo sapiens
auuaaauacagacacua

SEQ ID NO: 800064 - RNA, 14 nt, Homo sapiens
auuaaaugugucau

SEQ ID NO: 800065 - RNA, 22 nt, Homo sapiens
auuaaauuuuaauguaaaauuc

SEQ ID NO: 800066 - RNA, 17 nt, Homo sapiens
auuaacaaaugugcugc

SEQ ID NO: 800067 - RNA, 17 nt, Homo sapiens
auuaacauaauauaugu

SEQ ID NO: 800068 - RNA, 15 nt, Homo sapiens
auuaacauggccauu

SEQ ID NO: 800069 - RNA, 22 nt, Homo sapiens
auuaaccucugcacuacugaca

SEQ ID NO: 800070 - RNA, 17 nt, Homo sapiens
auuaacuauaacaauca

SEQ ID NO: 800071 - RNA, 20 nt, Homo sapiens
auuaacucaccagauuuacu

SEQ ID NO: 800072 - RNA, 23 nt, Homo sapiens
auuaacuuuaauguuuuuugcca

SEQ ID NO: 800073 - RNA, 11 nt, Homo sapiens
auuaacuuuau

SEQ ID NO: 800074 - RNA, 18 nt, Homo sapiens
auuaagaaagacuaucua

SEQ ID NO: 800075 - RNA, 13 nt, Homo sapiens
auuaagaaugcca

SEQ ID NO: 800076 - RNA, 23 nt, Homo sapiens
auuaagcagaaauccugcaauga

SEQ ID NO: 800077 - RNA, 12 nt, Homo sapiens
auuaagcaugaa

SEQ ID NO: 800078 - RNA, 11 nt, Homo sapiens
auuaaggggau

SEQ ID NO: 800079 - RNA, 15 nt, Homo sapiens
auuaaguacaaccaa

SEQ ID NO: 800080 - RNA, 23 nt, Homo sapiens
auuaauaacgucuuuuuauaucu

SEQ ID NO: 800081 - RNA, 16 nt, Homo sapiens
auuaauaagaacuuga

SEQ ID NO: 800082 - RNA, 23 nt, Homo sapiens
auuaauacucugcagugauuaga

SEQ ID NO: 800083 - RNA, 18 nt, Homo sapiens
auuaauaucaacucugaa

SEQ ID NO: 800084 - RNA, 17 nt, Homo sapiens
auuaaucucuaaaauuc

SEQ ID NO: 800085 - RNA, 22 nt, Homo sapiens
auuaaugccuuuaaaguaugaa

SEQ ID NO: 800086 - RNA, 19 nt, Homo sapiens
auuaauggauucaguauua

SEQ ID NO: 800087 - RNA, 23 nt, Homo sapiens
auuacaaaugguuaccuuguuau

SEQ ID NO: 800088 - RNA, 16 nt, Homo sapiens
auuacaacuagaucaa

SEQ ID NO: 800089 - RNA, 17 nt, Homo sapiens
auuacaacuagaucaag

SEQ ID NO: 800090 - RNA, 22 nt, Homo sapiens
auuacaaggcuuuaucucaggg

SEQ ID NO: 800091 - RNA, 17 nt, Homo sapiens
auuacaggcgugaucca

SEQ ID NO: 800092 - RNA, 21 nt, Homo sapiens
auuacaggcgugauccaccac

SEQ ID NO: 800093 - RNA, 12 nt, Homo sapiens
auuacaggugug

SEQ ID NO: 800094 - RNA, 18 nt, Homo sapiens
auuacaggugugagccac

SEQ ID NO: 800095 - RNA, 20 nt, Homo sapiens
auuacaguacacauccccag

SEQ ID NO: 800096 - RNA, 23 nt, Homo sapiens
auuacauuccuaacuagaauuag

SEQ ID NO: 800097 - RNA, 21 nt, Homo sapiens
auuaccaaccuguuaccuacu

SEQ ID NO: 800098 - RNA, 18 nt, Homo sapiens
auuaccggcgugagccac

SEQ ID NO: 800099 - RNA, 18 nt, Homo sapiens
auuacuggcaugagccac

SEQ ID NO: 800100 - RNA, 21 nt, Homo sapiens
auuacuggccuuuuucauuua

SEQ ID NO: 800101 - RNA, 18 nt, Homo sapiens
auuacuguugcauuuacu

SEQ ID NO: 800102 - RNA, 20 nt, Homo sapiens
auuacuguugcauuuacuuu

SEQ ID NO: 800103 - RNA, 21 nt, Homo sapiens
auuacuguuuugggccuccau

SEQ ID NO: 800104 - RNA, 22 nt, Homo sapiens
auuacuuauuuauccuaguauu

SEQ ID NO: 800105 - RNA, 19 nt, Homo sapiens
auuagaaaaaaauuacuaa

SEQ ID NO: 800106 - RNA, 17 nt, Homo sapiens
auuagaaggcaaguuuc

SEQ ID NO: 800107 - RNA, 16 nt, Homo sapiens
auuagaguauuuucca

SEQ ID NO: 800108 - RNA, 16 nt, Homo sapiens
auuagaugaacucaac

SEQ ID NO: 800109 - RNA, 23 nt, Homo sapiens
auuagauuuggaggcuaccucac

SEQ ID NO: 800110 - RNA, 15 nt, Homo sapiens
auuagcaaagcaaaa

SEQ ID NO: 800111 - RNA, 19 nt, Homo sapiens
auuagcaauugacugucac

SEQ ID NO: 800112 - RNA, 23 nt, Homo sapiens
auuagcagucccuccacauuucc

SEQ ID NO: 800113 - RNA, 19 nt, Homo sapiens
auuagcccgcuagcauuag

SEQ ID NO: 800114 - RNA, 18 nt, Homo sapiens
auuagccgggcauggugg

SEQ ID NO: 800115 - RNA, 18 nt, Homo sapiens
auuagccggucauggugg

SEQ ID NO: 800116 - RNA, 13 nt, Homo sapiens
auuagcucacuga

SEQ ID NO: 800117 - RNA, 18 nt, Homo sapiens
auuagcuuguuaguaaug

SEQ ID NO: 800118 - RNA, 16 nt, Homo sapiens
auuaggaaauucugau

SEQ ID NO: 800119 - RNA, 20 nt, Homo sapiens
auuaguacuuauguugcaca

SEQ ID NO: 800120 - RNA, 17 nt, Homo sapiens
auuuacaguuacugccu

SEQ ID NO: 800121 - RNA, 12 nt, Homo sapiens
auuuacauguau

SEQ ID NO: 800122 - RNA, 19 nt, Homo sapiens
auuuacauuuaauacagau

SEQ ID NO: 800123 - RNA, 11 nt, Homo sapiens
auuuacuacag

SEQ ID NO: 800124 - RNA, 13 nt, Homo sapiens
auuuacuggaccc

SEQ ID NO: 800125 - RNA, 17 nt, Homo sapiens
auuuacuuuaagcauug

SEQ ID NO: 800126 - RNA, 19 nt, Homo sapiens
auuuagaaaaaaguuuaca

SEQ ID NO: 800127 - RNA, 20 nt, Homo sapiens
auuuagaaaaaaguuuacaa

SEQ ID NO: 800128 - RNA, 22 nt, Homo sapiens
auuuagaaaauagagcuuuuaa

SEQ ID NO: 800129 - RNA, 21 nt, Homo sapiens
auuuagaaaauuuuguauuaa

SEQ ID NO: 800130 - RNA, 12 nt, Homo sapiens
auuuagaacuug

SEQ ID NO: 800131 - RNA, 21 nt, Homo sapiens
auuuagaccccauacaaguuu

SEQ ID NO: 800132 - RNA, 12 nt, Homo sapiens
auuuagacucau

SEQ ID NO: 800133 - RNA, 17 nt, Homo sapiens
auuuagacucaucuuac

SEQ ID NO: 800134 - RNA, 22 nt, Homo sapiens
auuuagaguagguauuaaucuu

SEQ ID NO: 800135 - RNA, 20 nt, Homo sapiens
auuuagaguucuagaccucu

SEQ ID NO: 800136 - RNA, 16 nt, Homo sapiens
auuuagauaugcaaaa

SEQ ID NO: 800137 - RNA, 22 nt, Homo sapiens
auuuagauccugguuucauaac

SEQ ID NO: 800138 - RNA, 15 nt, Homo sapiens
auuuagaucucauaa

SEQ ID NO: 800139 - RNA, 16 nt, Homo sapiens
auuuagcugugcucag

SEQ ID NO: 800140 - RNA, 18 nt, Homo sapiens
auuuaggaccaauaccuc

SEQ ID NO: 800141 - RNA, 22 nt, Homo sapiens
auuuaggccuuaacacacuggc

SEQ ID NO: 800142 - RNA, 14 nt, Homo sapiens
auuuagugacuuaa

SEQ ID NO: 800143 - RNA, 14 nt, Homo sapiens
auuuaguuccacaa

SEQ ID NO: 800144 - RNA, 14 nt, Homo sapiens
auuuauauguacug

SEQ ID NO: 800145 - RNA, 23 nt, Homo sapiens
auuuauccaaaauguguauuucu

SEQ ID NO: 800146 - RNA, 20 nt, Homo sapiens
auuuauccagaaaacuguga

SEQ ID NO: 800147 - RNA, 22 nt, Homo sapiens
auuuaucguauagguugaugaa

SEQ ID NO: 800148 - RNA, 17 nt, Homo sapiens
auuuaucuuuaccaaaa

SEQ ID NO: 800149 - RNA, 12 nt, Homo sapiens
auuuaugaaggc

SEQ ID NO: 800150 - RNA, 19 nt, Homo sapiens
auuuaugacagugaacauu

SEQ ID NO: 800151 - RNA, 15 nt, Homo sapiens
auuuaugaugcacuu

SEQ ID NO: 800152 - RNA, 16 nt, Homo sapiens
auuuaugaugcacuua

SEQ ID NO: 800153 - RNA, 22 nt, Homo sapiens
auuuaugaugcacuuauucaau

SEQ ID NO: 800154 - RNA, 20 nt, Homo sapiens
auuuaugccucuguauuuaa

SEQ ID NO: 800155 - RNA, 22 nt, Homo sapiens
auuuauggucuucaaccaaggc

SEQ ID NO: 800156 - RNA, 21 nt, Homo sapiens
auuuaugguucucaggccuga

SEQ ID NO: 800157 - RNA, 13 nt, Homo sapiens
auuuaugugaugg

SEQ ID NO: 800158 - RNA, 18 nt, Homo sapiens
auuuauuguucgaugccu

SEQ ID NO: 800159 - RNA, 15 nt, Homo sapiens
auuuauuuaagcuua

SEQ ID NO: 800160 - RNA, 17 nt, Homo sapiens
auuuauuuacagaugaa

SEQ ID NO: 800161 - RNA, 16 nt, Homo sapiens
auuuauuuauuacccu

SEQ ID NO: 800162 - RNA, 18 nt, Homo sapiens
auuuauuuuccuaaagag

SEQ ID NO: 800163 - RNA, 23 nt, Homo sapiens
auuucaaaacucauuuccuaugu

SEQ ID NO: 800164 - RNA, 13 nt, Homo sapiens
auuucaaagggaa

SEQ ID NO: 800165 - RNA, 14 nt, Homo sapiens
auuucaaagggaaa

SEQ ID NO: 800166 - RNA, 15 nt, Homo sapiens
auuucaacaagaaua

SEQ ID NO: 800167 - RNA, 16 nt, Homo sapiens
auuucaagacagauug

SEQ ID NO: 800168 - RNA, 15 nt, Homo sapiens
auuucaagucucuca

SEQ ID NO: 800169 - RNA, 14 nt, Homo sapiens
auuucaauuccugu

SEQ ID NO: 800170 - RNA, 14 nt, Homo sapiens
auuucacaagcuau

SEQ ID NO: 800171 - RNA, 16 nt, Homo sapiens
auuucacaagcuauuc

SEQ ID NO: 800172 - RNA, 14 nt, Homo sapiens
auuucacagugugu

SEQ ID NO: 800173 - RNA, 13 nt, Homo sapiens
auuucacauuaau

SEQ ID NO: 800174 - RNA, 15 nt, Homo sapiens
auuucaccaccaaau

SEQ ID NO: 800175 - RNA, 14 nt, Homo sapiens
auuucaccacugaa

SEQ ID NO: 800176 - RNA, 16 nt, Homo sapiens
auuucaccuacuuugu

SEQ ID NO: 800177 - RNA, 18 nt, Homo sapiens
auuucagauaaacaacaa

SEQ ID NO: 800178 - RNA, 15 nt, Homo sapiens
auuucagcagggaug

SEQ ID NO: 800179 - RNA, 12 nt, Homo sapiens
auuucagccaaa

SEQ ID NO: 800180 - RNA, 18 nt, Homo sapiens
auuucagccaaacuguag

SEQ ID NO: 800181 - RNA, 15 nt, Homo sapiens
auuucagcugaucag

SEQ ID NO: 800182 - RNA, 22 nt, Homo sapiens
auuucauacaacagaaaccaga

SEQ ID NO: 800183 - RNA, 18 nt, Homo sapiens
auuucauaccuaucaucu

SEQ ID NO: 800184 - RNA, 20 nt, Homo sapiens
auuucauaccuaucaucuua

SEQ ID NO: 800185 - RNA, 21 nt, Homo sapiens
auuucauaccuaucaucuuaa

SEQ ID NO: 800186 - RNA, 14 nt, Homo sapiens
auuucauaccucag

SEQ ID NO: 800187 - RNA, 15 nt, Homo sapiens
auuucauaguuucaa

SEQ ID NO: 800188 - RNA, 12 nt, Homo sapiens
auuucaucucuu

SEQ ID NO: 800189 - RNA, 12 nt, Homo sapiens
auuucaucugcu

SEQ ID NO: 800190 - RNA, 20 nt, Homo sapiens
auuucaugauuucauuucaa

SEQ ID NO: 800191 - RNA, 13 nt, Homo sapiens
auuucauggugac

SEQ ID NO: 800192 - RNA, 16 nt, Homo sapiens
auuucaugucacuaaa

SEQ ID NO: 800193 - RNA, 14 nt, Homo sapiens
auuucaugugucaa

SEQ ID NO: 800194 - RNA, 13 nt, Homo sapiens
auuucauuaucau

SEQ ID NO: 800195 - RNA, 20 nt, Homo sapiens
auuucauucugaaacauaau

SEQ ID NO: 800196 - RNA, 14 nt, Homo sapiens
auuuccaacuuuau

SEQ ID NO: 800197 - RNA, 13 nt, Homo sapiens
auuuccacaaaau

SEQ ID NO: 800198 - RNA, 21 nt, Homo sapiens
auuuccacuauuuucaaagaa

SEQ ID NO: 800199 - RNA, 15 nt, Homo sapiens
auuuccacugaacaa

SEQ ID NO: 800200 - RNA, 18 nt, Homo sapiens
auuuccauagucaaugau

SEQ ID NO: 800201 - RNA, 12 nt, Homo sapiens
auuucccaggac

SEQ ID NO: 800202 - RNA, 23 nt, Homo sapiens
auuuccccaccccagcucaugcc

SEQ ID NO: 800203 - RNA, 15 nt, Homo sapiens
auuuccccagccaca

SEQ ID NO: 800204 - RNA, 22 nt, Homo sapiens
auuuccuaaugucagaguagaa

SEQ ID NO: 800205 - RNA, 21 nt, Homo sapiens
auuuccugacagaaggacuca

SEQ ID NO: 800206 - RNA, 19 nt, Homo sapiens
auuuccugauacauuaaaa

SEQ ID NO: 800207 - RNA, 23 nt, Homo sapiens
auuuccuuaaacuguguggacug

SEQ ID NO: 800208 - RNA, 23 nt, Homo sapiens
auuuccuuucuacaauuucaauu

SEQ ID NO: 800209 - RNA, 18 nt, Homo sapiens
auuuccuuuuugacacug

SEQ ID NO: 800210 - RNA, 15 nt, Homo sapiens
auuucggagcaugaa

SEQ ID NO: 800211 - RNA, 16 nt, Homo sapiens
auuucuaaaagucuga

SEQ ID NO: 800212 - RNA, 16 nt, Homo sapiens
auuucuaauggcccau

SEQ ID NO: 800213 - RNA, 17 nt, Homo sapiens
auuucuagaacccguga

SEQ ID NO: 800214 - RNA, 20 nt, Homo sapiens
auuucuaguaggcagcaaaa

SEQ ID NO: 800215 - RNA, 16 nt, Homo sapiens
auuucuaucugcaaau

SEQ ID NO: 800216 - RNA, 17 nt, Homo sapiens
auuucucaaaugcacau

SEQ ID NO: 800217 - RNA, 23 nt, Homo sapiens
auuucucaaucagugcagugaua

SEQ ID NO: 800218 - RNA, 14 nt, Homo sapiens
auuucucaguauca

SEQ ID NO: 800219 - RNA, 13 nt, Homo sapiens
auuucucauauca

SEQ ID NO: 800220 - RNA, 22 nt, Homo sapiens
auuucucauaucaacuuaguca

SEQ ID NO: 800221 - RNA, 19 nt, Homo sapiens
auuucuccucccuuccuuu

SEQ ID NO: 800222 - RNA, 19 nt, Homo sapiens
auuucucuaacuccugcca

SEQ ID NO: 800223 - RNA, 16 nt, Homo sapiens
auuucucuuccuaaau

SEQ ID NO: 800224 - RNA, 21 nt, Homo sapiens
auuucucuuccuaaauuucau

SEQ ID NO: 800225 - RNA, 13 nt, Homo sapiens
auuucucuugcaa

SEQ ID NO: 800226 - RNA, 23 nt, Homo sapiens
auuucugguuguuaugugaucau

SEQ ID NO: 800227 - RNA, 21 nt, Homo sapiens
auuucuguugaggcugcagau

SEQ ID NO: 800228 - RNA, 19 nt, Homo sapiens
auuucuuaucaccacagua

SEQ ID NO: 800229 - RNA, 13 nt, Homo sapiens
auuucuucagucc

SEQ ID NO: 800230 - RNA, 16 nt, Homo sapiens
auuucuucuacugcua

SEQ ID NO: 800231 - RNA, 13 nt, Homo sapiens
auuucuugauuaa

SEQ ID NO: 800232 - RNA, 23 nt, Homo sapiens
auuucuuucuuugcaccaaagac

SEQ ID NO: 800233 - RNA, 11 nt, Homo sapiens
auuucuuugcc

SEQ ID NO: 800234 - RNA, 15 nt, Homo sapiens
auuucuuuguuauca

SEQ ID NO: 800235 - RNA, 13 nt, Homo sapiens
caaauugaucaag

SEQ ID NO: 800236 - RNA, 14 nt, Homo sapiens
caaauugccugcaa

SEQ ID NO: 800237 - RNA, 19 nt, Homo sapiens
caaauugcugggauuacag

SEQ ID NO: 800238 - RNA, 17 nt, Homo sapiens
caaauuuaugcauuuca

SEQ ID NO: 800239 - RNA, 18 nt, Homo sapiens
caacaaaaagaacaaauc

SEQ ID NO: 800240 - RNA, 16 nt, Homo sapiens
caacaaagauugagaa

SEQ ID NO: 800241 - RNA, 18 nt, Homo sapiens
caacaaaggcugaacugg

SEQ ID NO: 800242 - RNA, 16 nt, Homo sapiens
caacaacucugauuaa

SEQ ID NO: 800243 - RNA, 19 nt, Homo sapiens
caacaacuuacacuuauuu

SEQ ID NO: 800244 - RNA, 21 nt, Homo sapiens
caacaagauuuccuugugcaa

SEQ ID NO: 800245 - RNA, 15 nt, Homo sapiens
caacaaggacagccc

SEQ ID NO: 800246 - RNA, 16 nt, Homo sapiens
caacaauaaauaugua

SEQ ID NO: 800247 - RNA, 17 nt, Homo sapiens
caacaauacaugcugcu

SEQ ID NO: 800248 - RNA, 23 nt, Homo sapiens
caacaauccuucuauucuagccu

SEQ ID NO: 800249 - RNA, 17 nt, Homo sapiens
caacaaugguugaauga

SEQ ID NO: 800250 - RNA, 20 nt, Homo sapiens
caacaaugguugaaugaaua

SEQ ID NO: 800251 - RNA, 13 nt, Homo sapiens
caacacacacugu

SEQ ID NO: 800252 - RNA, 11 nt, Homo sapiens
caacacaguga

SEQ ID NO: 800253 - RNA, 20 nt, Homo sapiens
caacacaugucuagcuuuca

SEQ ID NO: 800254 - RNA, 23 nt, Homo sapiens
caacacgagcaggcuacugucag

SEQ ID NO: 800255 - RNA, 13 nt, Homo sapiens
caacacugcucac

SEQ ID NO: 800256 - RNA, 14 nt, Homo sapiens
caacacugcucaca

SEQ ID NO: 800257 - RNA, 22 nt, Homo sapiens
caacacugugcccugguggaga

SEQ ID NO: 800258 - RNA, 20 nt, Homo sapiens
caacagaacauauguugcaa

SEQ ID NO: 800259 - RNA, 18 nt, Homo sapiens
caacagaagcuuccauuc

SEQ ID NO: 800260 - RNA, 14 nt, Homo sapiens
caacagacaaguga

SEQ ID NO: 800261 - RNA, 23 nt, Homo sapiens
caacagagaggaccaacauccag

SEQ ID NO: 800262 - RNA, 17 nt, Homo sapiens
caacagagcgagauucc

SEQ ID NO: 800263 - RNA, 20 nt, Homo sapiens
caacagauuuuauugaauga

SEQ ID NO: 800264 - RNA, 23 nt, Homo sapiens
caacagcaccuccccgcugggaa

SEQ ID NO: 800265 - RNA, 13 nt, Homo sapiens
caacagcagugau

SEQ ID NO: 800266 - RNA, 16 nt, Homo sapiens
caacagcauaacuaaa

SEQ ID NO: 800267 - RNA, 12 nt, Homo sapiens
caacagccaugc

SEQ ID NO: 800268 - RNA, 21 nt, Homo sapiens
caacaggcuguucugcacuga

SEQ ID NO: 800269 - RNA, 21 nt, Homo sapiens
caacagggaagaaacuuucug

SEQ ID NO: 800270 - RNA, 15 nt, Homo sapiens
caacaguucaaagaa

SEQ ID NO: 800271 - RNA, 18 nt, Homo sapiens
caacaguuuuuuaugcua

SEQ ID NO: 800272 - RNA, 21 nt, Homo sapiens
caacauaaaacaaaaccaagc

SEQ ID NO: 800273 - RNA, 16 nt, Homo sapiens
caacaucccacagugg

SEQ ID NO: 800274 - RNA, 14 nt, Homo sapiens
caacaucccauugc

SEQ ID NO: 800275 - RNA, 24 nt, Homo sapiens
caacaucgugaaaccccaucucua

SEQ ID NO: 800276 - RNA, 21 nt, Homo sapiens
caacaucuucauagaugaaug

SEQ ID NO: 800277 - RNA, 17 nt, Homo sapiens
caacaugcgaccgugac

SEQ ID NO: 800278 - RNA, 21 nt, Homo sapiens
caacauggcaaaaccccaucu

SEQ ID NO: 800279 - RNA, 15 nt, Homo sapiens
caacauggggaccag

SEQ ID NO: 800280 - RNA, 21 nt, Homo sapiens
caacaugguaaaaccccaucu

SEQ ID NO: 800281 - RNA, 21 nt, Homo sapiens
caacauggugaaaccccaucu

SEQ ID NO: 800282 - RNA, 21 nt, Homo sapiens
caacauggugaaaccucaucu

SEQ ID NO: 800283 - RNA, 14 nt, Homo sapiens
caacauuaugaucu

SEQ ID NO: 800284 - RNA, 12 nt, Homo sapiens
caaccaagaaug

SEQ ID NO: 800285 - RNA, 12 nt, Homo sapiens
caaccaauucca

SEQ ID NO: 800286 - RNA, 15 nt, Homo sapiens
caaccaauuuacacu

SEQ ID NO: 800287 - RNA, 20 nt, Homo sapiens
caaccaccuuuccagccaua

SEQ ID NO: 800288 - RNA, 22 nt, Homo sapiens
caaccagccaggcagguccaca

SEQ ID NO: 800289 - RNA, 17 nt, Homo sapiens
caaccaggccuucaucc

SEQ ID NO: 800290 - RNA, 15 nt, Homo sapiens
caaccauaccuuccu

SEQ ID NO: 800291 - RNA, 14 nt, Homo sapiens
caacccacuggccc

SEQ ID NO: 800292 - RNA, 22 nt, Homo sapiens
caacccauauuucauccaggag

SEQ ID NO: 800293 - RNA, 18 nt, Homo sapiens
caacccauucacuacagg

SEQ ID NO: 800294 - RNA, 17 nt, Homo sapiens
caaccccgcccuaggcc

SEQ ID NO: 800295 - RNA, 15 nt, Homo sapiens
caaccccugcuccag

SEQ ID NO: 800296 - RNA, 17 nt, Homo sapiens
caacccggcacugcccu

SEQ ID NO: 800297 - RNA, 18 nt, Homo sapiens
caacccgguuuaccaguu

SEQ ID NO: 800298 - RNA, 21 nt, Homo sapiens
caacccucucucuuaccuggg

SEQ ID NO: 800299 - RNA, 18 nt, Homo sapiens
caacccuuccugcugcug

SEQ ID NO: 800300 - RNA, 18 nt, Homo sapiens
caaccgagaagguuuauc

SEQ ID NO: 800301 - RNA, 20 nt, Homo sapiens
caaccuaagggcccaaaggc

SEQ ID NO: 800302 - RNA, 16 nt, Homo sapiens
caaccuguuaccuacu

SEQ ID NO: 800303 - RNA, 16 nt, Homo sapiens
caaccuugcugggacu

SEQ ID NO: 800304 - RNA, 18 nt, Homo sapiens
caacgccucacugaaaca

SEQ ID NO: 800305 - RNA, 22 nt, Homo sapiens
caacgguauccagggacuauga

SEQ ID NO: 800306 - RNA, 18 nt, Homo sapiens
caacuaaugccuuacucu

SEQ ID NO: 800307 - RNA, 17 nt, Homo sapiens
caacuaccuagacugga

SEQ ID NO: 800308 - RNA, 12 nt, Homo sapiens
caacuaccugag

SEQ ID NO: 800309 - RNA, 15 nt, Homo sapiens
caacuacugugauca

SEQ ID NO: 800310 - RNA, 13 nt, Homo sapiens
caacuaugauuau

SEQ ID NO: 800311 - RNA, 18 nt, Homo sapiens
caacuauuuauugaauga

SEQ ID NO: 800312 - RNA, 16 nt, Homo sapiens
caacucacaccugccu

SEQ ID NO: 800313 - RNA, 15 nt, Homo sapiens
caacuccaggauuua

SEQ ID NO: 800314 - RNA, 20 nt, Homo sapiens
caacucuaccccugcuccca

SEQ ID NO: 800315 - RNA, 16 nt, Homo sapiens
caacucugcacuccau

SEQ ID NO: 800316 - RNA, 14 nt, Homo sapiens
caacucuugcacag

SEQ ID NO: 800317 - RNA, 12 nt, Homo sapiens
caacugauugca

SEQ ID NO: 800318 - RNA, 19 nt, Homo sapiens
caacugccauguuuugcca

SEQ ID NO: 800319 - RNA, 18 nt, Homo sapiens
caacugcccaguuuccag

SEQ ID NO: 800320 - RNA, 20 nt, Homo sapiens
caacuggcuucugugcacua

SEQ ID NO: 800321 - RNA, 19 nt, Homo sapiens
caacugggucugacaugaa

SEQ ID NO: 800322 - RNA, 16 nt, Homo sapiens
caacugugugauuaaa

SEQ ID NO: 800323 - RNA, 20 nt, Homo sapiens
caacuguuucccugcugaau

SEQ ID NO: 800324 - RNA, 14 nt, Homo sapiens
caacuuaacaugaa

SEQ ID NO: 800325 - RNA, 16 nt, Homo sapiens
caacuuaagcugggau

SEQ ID NO: 800326 - RNA, 14 nt, Homo sapiens
caacuucaaguaua

SEQ ID NO: 800327 - RNA, 16 nt, Homo sapiens
caacuuccgcugaggg

SEQ ID NO: 800328 - RNA, 12 nt, Homo sapiens
caacuugauguu

SEQ ID NO: 800329 - RNA, 19 nt, Homo sapiens
caacuuggcauuucuauac

SEQ ID NO: 800330 - RNA, 18 nt, Homo sapiens
caacuuggguucuucuca

SEQ ID NO: 800331 - RNA, 22 nt, Homo sapiens
caacuuuagcuaguaucuucaa

SEQ ID NO: 800332 - RNA, 19 nt, Homo sapiens
caacuuugaaacuggaaua

SEQ ID NO: 800333 - RNA, 13 nt, Homo sapiens
caagaaaaauaau

SEQ ID NO: 800334 - RNA, 17 nt, Homo sapiens
caagaaaauaaaacuaa

SEQ ID NO: 800335 - RNA, 15 nt, Homo sapiens
caagaaaucagccau

SEQ ID NO: 800336 - RNA, 16 nt, Homo sapiens
caagaaaucagccaua

SEQ ID NO: 800337 - RNA, 15 nt, Homo sapiens
caagaaaucugacaa

SEQ ID NO: 800338 - RNA, 13 nt, Homo sapiens
caagaaauuggaa

SEQ ID NO: 800339 - RNA, 17 nt, Homo sapiens
caagaacauucuaccaa

SEQ ID NO: 800340 - RNA, 22 nt, Homo sapiens
caagaaccgguuuccaaagaca

SEQ ID NO: 800341 - RNA, 13 nt, Homo sapiens
caagaacuugcaa

SEQ ID NO: 800342 - RNA, 15 nt, Homo sapiens
caagaacuugcaaua

SEQ ID NO: 800343 - RNA, 19 nt, Homo sapiens
caagaagcguuaugugcag

SEQ ID NO: 800344 - RNA, 21 nt, Homo sapiens
caagaagugaagaaugcacaa

SEQ ID NO: 800345 - RNA, 23 nt, Homo sapiens
caagaauagaugcugacuguacu

SEQ ID NO: 800346 - RNA, 11 nt, Homo sapiens
caagacauuuc

SEQ ID NO: 800347 - RNA, 20 nt, Homo sapiens
caagacauuugcugaacuca

SEQ ID NO: 800348 - RNA, 23 nt, Homo sapiens
caagaccagagacccaacagcag

SEQ ID NO: 800349 - RNA, 12 nt, Homo sapiens
caagaccuaguc

SEQ ID NO: 800350 - RNA, 17 nt, Homo sapiens
caccuuugucgcugggu

SEQ ID NO: 800351 - RNA, 14 nt, Homo sapiens
caccuuuuaacuca

SEQ ID NO: 800352 - RNA, 20 nt, Homo sapiens
cacgaaagaaauguaccuuc

SEQ ID NO: 800353 - RNA, 16 nt, Homo sapiens
cacgaacccaccugcu

SEQ ID NO: 800354 - RNA, 22 nt, Homo sapiens
cacgagcuagcuucugcaaugu

SEQ ID NO: 800355 - RNA, 17 nt, Homo sapiens
cacgcaugugugcugca

SEQ ID NO: 800356 - RNA, 13 nt, Homo sapiens
cacgccuacuuaa

SEQ ID NO: 800357 - RNA, 16 nt, Homo sapiens
cacgccuguaauccca

SEQ ID NO: 800358 - RNA, 13 nt, Homo sapiens
cacgccuguaauu

SEQ ID NO: 800359 - RNA, 15 nt, Homo sapiens
cacgcgccuguaauc

SEQ ID NO: 800360 - RNA, 20 nt, Homo sapiens
cacgcuccuauaggaccaag

SEQ ID NO: 800361 - RNA, 13 nt, Homo sapiens
cacgcugaaggcu

SEQ ID NO: 800362 - RNA, 15 nt, Homo sapiens
cacgcugaaggcuua

SEQ ID NO: 800363 - RNA, 18 nt, Homo sapiens
cacgcuuuuaauucucau

SEQ ID NO: 800364 - RNA, 15 nt, Homo sapiens
cacggcccugacuga

SEQ ID NO: 800365 - RNA, 15 nt, Homo sapiens
cacgggacugacgca

SEQ ID NO: 800366 - RNA, 17 nt, Homo sapiens
cacgggcaaucaugagc

SEQ ID NO: 800367 - RNA, 21 nt, Homo sapiens
cacgucaggagaggccagcug

SEQ ID NO: 800368 - RNA, 14 nt, Homo sapiens
cacgucauguuucu

SEQ ID NO: 800369 - RNA, 23 nt, Homo sapiens
cacgucauuaagguuaugcacug

SEQ ID NO: 800370 - RNA, 22 nt, Homo sapiens
cacgucuccuccucgaagccau

SEQ ID NO: 800371 - RNA, 15 nt, Homo sapiens
cacguggccucguga

SEQ ID NO: 800372 - RNA, 13 nt, Homo sapiens
cacguguccugua

SEQ ID NO: 800373 - RNA, 15 nt, Homo sapiens
cacgugucuauaaug

SEQ ID NO: 800374 - RNA, 21 nt, Homo sapiens
cacguguucccgacauaacau

SEQ ID NO: 800375 - RNA, 21 nt, Homo sapiens
cacguugccaggggcuugaga

SEQ ID NO: 800376 - RNA, 21 nt, Homo sapiens
cacguuuaaucccagcacuuu

SEQ ID NO: 800377 - RNA, 16 nt, Homo sapiens
cacuaaaagaucgcag

SEQ ID NO: 800378 - RNA, 22 nt, Homo sapiens
cacuaacuuaauguguauucau

SEQ ID NO: 800379 - RNA, 22 nt, Homo sapiens
cacuaagggguauguucccucu

SEQ ID NO: 800380 - RNA, 17 nt, Homo sapiens
cacuaaugugucaucua

SEQ ID NO: 800381 - RNA, 15 nt, Homo sapiens
cacuaauugcuuucu

SEQ ID NO: 800382 - RNA, 18 nt, Homo sapiens
cacuaauugguacuuuua

SEQ ID NO: 800383 - RNA, 19 nt, Homo sapiens
cacuaauuuauaacuauua

SEQ ID NO: 800384 - RNA, 22 nt, Homo sapiens
cacuaauuugauguuuacaggu

SEQ ID NO: 800385 - RNA, 22 nt, Homo sapiens
cacuacaaccuccgccucccau

SEQ ID NO: 800386 - RNA, 15 nt, Homo sapiens
cacuacgugacugug

SEQ ID NO: 800387 - RNA, 19 nt, Homo sapiens
cacuagaggaaaccaguuu

SEQ ID NO: 800388 - RNA, 18 nt, Homo sapiens
cacuagccagacacucug

SEQ ID NO: 800389 - RNA, 16 nt, Homo sapiens
cacuagccugugcacg

SEQ ID NO: 800390 - RNA, 12 nt, Homo sapiens
cacuagucucac

SEQ ID NO: 800391 - RNA, 17 nt, Homo sapiens
cacuagucucaccagcc

SEQ ID NO: 800392 - RNA, 14 nt, Homo sapiens
cacuauaucuguau

SEQ ID NO: 800393 - RNA, 20 nt, Homo sapiens
cacuaugaagguaaagggag

SEQ ID NO: 800394 - RNA, 23 nt, Homo sapiens
cacuauuaaguggguuugcccca

SEQ ID NO: 800395 - RNA, 22 nt, Homo sapiens
cacuauuaaucuuucuuuugau

SEQ ID NO: 800396 - RNA, 16 nt, Homo sapiens
cacuauuuucaaagaa

SEQ ID NO: 800397 - RNA, 12 nt, Homo sapiens
cacucaaugucu

SEQ ID NO: 800398 - RNA, 14 nt, Homo sapiens
cacucaaugucuua

SEQ ID NO: 800399 - RNA, 12 nt, Homo sapiens
cacucacuccag

SEQ ID NO: 800400 - RNA, 21 nt, Homo sapiens
cacucagccucauucagcaug

SEQ ID NO: 800401 - RNA, 13 nt, Homo sapiens
cacucagcugucc

SEQ ID NO: 800402 - RNA, 17 nt, Homo sapiens
cacucagugcagcaaua

SEQ ID NO: 800403 - RNA, 16 nt, Homo sapiens
cacucaugcacacaga

SEQ ID NO: 800404 - RNA, 12 nt, Homo sapiens
cacucauuccuu

SEQ ID NO: 800405 - RNA, 16 nt, Homo sapiens
cacuccacucugauuc

SEQ ID NO: 800406 - RNA, 22 nt, Homo sapiens
cacuccagcccuguccccugaa

SEQ ID NO: 800407 - RNA, 15 nt, Homo sapiens
cacuccagcucugag

SEQ ID NO: 800408 - RNA, 21 nt, Homo sapiens
cacuccccagagcugugccag

SEQ ID NO: 800409 - RNA, 20 nt, Homo sapiens
cacucccuguuuuaauucaa

SEQ ID NO: 800410 - RNA, 16 nt, Homo sapiens
cacuccucuaagacaa

SEQ ID NO: 800411 - RNA, 13 nt, Homo sapiens
cacuccuucagga

SEQ ID NO: 800412 - RNA, 15 nt, Homo sapiens
cacuccuuuuuugca

SEQ ID NO: 800413 - RNA, 20 nt, Homo sapiens
cacucuacuaaugccucuuc

SEQ ID NO: 800414 - RNA, 22 nt, Homo sapiens
cacucucuaaaucuuccuugug

SEQ ID NO: 800415 - RNA, 21 nt, Homo sapiens
cacugaaaaugucacauucua

SEQ ID NO: 800416 - RNA, 18 nt, Homo sapiens
cacugaaaauucgaacca

SEQ ID NO: 800417 - RNA, 22 nt, Homo sapiens
cacugaaaugaccaagacaggu

SEQ ID NO: 800418 - RNA, 14 nt, Homo sapiens
cacugaacaaaacc

SEQ ID NO: 800419 - RNA, 23 nt, Homo sapiens
cacugaacuccaccgaccaacug

SEQ ID NO: 800420 - RNA, 13 nt, Homo sapiens
cacugacagauuu

SEQ ID NO: 800421 - RNA, 18 nt, Homo sapiens
cacugaccaagugcuggc

SEQ ID NO: 800422 - RNA, 17 nt, Homo sapiens
cacugacucugacucau

SEQ ID NO: 800423 - RNA, 13 nt, Homo sapiens
cacugacugagau

SEQ ID NO: 800424 - RNA, 15 nt, Homo sapiens
cacugaggacugugg

SEQ ID NO: 800425 - RNA, 22 nt, Homo sapiens
cacugaggagacagaaagccuc

SEQ ID NO: 800426 - RNA, 22 nt, Homo sapiens
cacugauauuuuuuauacagug

SEQ ID NO: 800427 - RNA, 19 nt, Homo sapiens
cacugauccuggagaaaag

SEQ ID NO: 800428 - RNA, 20 nt, Homo sapiens
cacugaucuaagcaguggca

SEQ ID NO: 800429 - RNA, 21 nt, Homo sapiens
cacugaucugcuagugcugua

SEQ ID NO: 800430 - RNA, 18 nt, Homo sapiens
cacugauggaaaauacca

SEQ ID NO: 800431 - RNA, 16 nt, Homo sapiens
cacugauguacaauua

SEQ ID NO: 800432 - RNA, 17 nt, Homo sapiens
cacugcacagcagaucc

SEQ ID NO: 800433 - RNA, 20 nt, Homo sapiens
cacugcacagugcaucucag

SEQ ID NO: 800434 - RNA, 13 nt, Homo sapiens
cacugcacuccag

SEQ ID NO: 800435 - RNA, 15 nt, Homo sapiens
cacugcacuccagcu

SEQ ID NO: 800436 - RNA, 14 nt, Homo sapiens
cacugcagucagau

SEQ ID NO: 800437 - RNA, 14 nt, Homo sapiens
cacugcagugcuga

SEQ ID NO: 800438 - RNA, 18 nt, Homo sapiens
cacugcauuccacaggug

SEQ ID NO: 800439 - RNA, 9 nt, Homo sapiens
cacugccaa

SEQ ID NO: 800440 - RNA, 10 nt, Homo sapiens
cacugccaaa

SEQ ID NO: 800441 - RNA, 19 nt, Homo sapiens
cacugccaggccagccucc

SEQ ID NO: 800442 - RNA, 23 nt, Homo sapiens
cacugcccucuuguggugcauug

SEQ ID NO: 800443 - RNA, 18 nt, Homo sapiens
cacugccugucccagaga

SEQ ID NO: 800444 - RNA, 16 nt, Homo sapiens
cacugcggaagccaaa

SEQ ID NO: 800445 - RNA, 14 nt, Homo sapiens
cacugcuugaggga

SEQ ID NO: 800446 - RNA, 17 nt, Homo sapiens
cacuggaaaaguguaau

SEQ ID NO: 800447 - RNA, 14 nt, Homo sapiens
cacuggacucuccg

SEQ ID NO: 800448 - RNA, 16 nt, Homo sapiens
cacuggaguccagucu

SEQ ID NO: 800449 - RNA, 17 nt, Homo sapiens
cacuggauauguuguua

SEQ ID NO: 800450 - RNA, 18 nt, Homo sapiens
cacuggcagcaucuucac

SEQ ID NO: 800451 - RNA, 14 nt, Homo sapiens
cacuggcaggugug

SEQ ID NO: 800452 - RNA, 21 nt, Homo sapiens
cacuggccacaauacccaccu

SEQ ID NO: 800453 - RNA, 22 nt, Homo sapiens
cacuggccccucaaaucgucca

SEQ ID NO: 800454 - RNA, 17 nt, Homo sapiens
cacugggugaccagcug

SEQ ID NO: 800455 - RNA, 22 nt, Homo sapiens
cacugggugguggccugguccc

SEQ ID NO: 800456 - RNA, 13 nt, Homo sapiens
cacuggguugacu

SEQ ID NO: 800457 - RNA, 18 nt, Homo sapiens
cacuggucaggugcuucu

SEQ ID NO: 800458 - RNA, 16 nt, Homo sapiens
cacuggugccauguca

SEQ ID NO: 800459 - RNA, 22 nt, Homo sapiens
cacuggugguucuacugaccca

SEQ ID NO: 800460 - RNA, 16 nt, Homo sapiens
cacugguugcacuuau

SEQ ID NO: 800461 - RNA, 11 nt, Homo sapiens
cacuguacaag

SEQ ID NO: 800462 - RNA, 17 nt, Homo sapiens
cacuguaugauuuauaa

SEQ ID NO: 800463 - RNA, 20 nt, Homo sapiens
cacugucaugcuucaucauu

SEQ ID NO: 800464 - RNA, 23 nt, Homo sapiens
cacuguccugggcgcccuggaag

SEQ ID NO: 800465 - RNA, 22 nt, Homo sapiens
cauuaagguuaugcacugccug

SEQ ID NO: 800466 - RNA, 14 nt, Homo sapiens
cauuaaucuaagaa

SEQ ID NO: 800467 - RNA, 13 nt, Homo sapiens
cauuaauguguaa

SEQ ID NO: 800468 - RNA, 18 nt, Homo sapiens
cauuacaauuuucuguaa

SEQ ID NO: 800469 - RNA, 20 nt, Homo sapiens
cauuaccagcuuaaaacacu

SEQ ID NO: 800470 - RNA, 17 nt, Homo sapiens
cauuaccuccauccauc

SEQ ID NO: 800471 - RNA, 15 nt, Homo sapiens
cauuacuauucacug

SEQ ID NO: 800472 - RNA, 17 nt, Homo sapiens
cauuacuuuuucauaua

SEQ ID NO: 800473 - RNA, 17 nt, Homo sapiens
cauuagaacaaaggaca

SEQ ID NO: 800474 - RNA, 13 nt, Homo sapiens
cauuagagucagc

SEQ ID NO: 800475 - RNA, 15 nt, Homo sapiens
cauuagauaaacaca

SEQ ID NO: 800476 - RNA, 18 nt, Homo sapiens
cauuagcaguugcucaca

SEQ ID NO: 800477 - RNA, 20 nt, Homo sapiens
cauuagcuuugggugccuuu

SEQ ID NO: 800478 - RNA, 20 nt, Homo sapiens
cauuaggucccucacuccac

SEQ ID NO: 800479 - RNA, 18 nt, Homo sapiens
cauuaguauuucacaaga

SEQ ID NO: 800480 - RNA, 16 nt, Homo sapiens
cauuagucaauaacua

SEQ ID NO: 800481 - RNA, 19 nt, Homo sapiens
cauuagucaauaacuaaac

SEQ ID NO: 800482 - RNA, 16 nt, Homo sapiens
cauuagucucauguga

SEQ ID NO: 800483 - RNA, 20 nt, Homo sapiens
cauuaucagccugugccacg

SEQ ID NO: 800484 - RNA, 18 nt, Homo sapiens
cauuaucauaugaacuug

SEQ ID NO: 800485 - RNA, 22 nt, Homo sapiens
cauuaucucaaaacugcacugu

SEQ ID NO: 800486 - RNA, 16 nt, Homo sapiens
cauuaugagaggcaau

SEQ ID NO: 800487 - RNA, 21 nt, Homo sapiens
cauuaugaguaguguggaauu

SEQ ID NO: 800488 - RNA, 16 nt, Homo sapiens
cauuaugccacuuccu

SEQ ID NO: 800489 - RNA, 17 nt, Homo sapiens
cauuauuaaauguuucu

SEQ ID NO: 800490 - RNA, 15 nt, Homo sapiens
cauuauuagcacuuc

SEQ ID NO: 800491 - RNA, 19 nt, Homo sapiens
cauuauugacgaacuggcu

SEQ ID NO: 800492 - RNA, 18 nt, Homo sapiens
cauucaacagagacugaa

SEQ ID NO: 800493 - RNA, 17 nt, Homo sapiens
cauucaacucuccaaug

SEQ ID NO: 800494 - RNA, 16 nt, Homo sapiens
cauucaauauugacau

SEQ ID NO: 800495 - RNA, 15 nt, Homo sapiens
cauucacaccagcua

SEQ ID NO: 800496 - RNA, 22 nt, Homo sapiens
cauucacaguucuuugggccag

SEQ ID NO: 800497 - RNA, 21 nt, Homo sapiens
cauucacauuugauguacaug

SEQ ID NO: 800498 - RNA, 19 nt, Homo sapiens
cauucagagcuauggugcu

SEQ ID NO: 800499 - RNA, 14 nt, Homo sapiens
cauucagagucagc

SEQ ID NO: 800500 - RNA, 20 nt, Homo sapiens
cauucagagucagccaggac

SEQ ID NO: 800501 - RNA, 21 nt, Homo sapiens
cauucagggcuauuuuuuccc

SEQ ID NO: 800502 - RNA, 13 nt, Homo sapiens
cauucaguauuaa

SEQ ID NO: 800503 - RNA, 20 nt, Homo sapiens
cauucauccuuccauccauc

SEQ ID NO: 800504 - RNA, 14 nt, Homo sapiens
cauucaugcaagag

SEQ ID NO: 800505 - RNA, 18 nt, Homo sapiens
cauuccaagacucuagag

SEQ ID NO: 800506 - RNA, 19 nt, Homo sapiens
cauuccacacagaaugcaa

SEQ ID NO: 800507 - RNA, 16 nt, Homo sapiens
cauuccauuugaagca

SEQ ID NO: 800508 - RNA, 23 nt, Homo sapiens
cauucccaacgugcaaagccaag

SEQ ID NO: 800509 - RNA, 15 nt, Homo sapiens
cauucccugccuugc

SEQ ID NO: 800510 - RNA, 18 nt, Homo sapiens
cauucccuuuuccauaua

SEQ ID NO: 800511 - RNA, 17 nt, Homo sapiens
cauuccgagauuuuaaa

SEQ ID NO: 800512 - RNA, 20 nt, Homo sapiens
cauuccguuaggaauaacac

SEQ ID NO: 800513 - RNA, 20 nt, Homo sapiens
cauuccugaaagaaacaguu

SEQ ID NO: 800514 - RNA, 13 nt, Homo sapiens
cauuccugaagaa

SEQ ID NO: 800515 - RNA, 20 nt, Homo sapiens
cauuccugauaugauuuaaa

SEQ ID NO: 800516 - RNA, 13 nt, Homo sapiens
cauuccugcucaa

SEQ ID NO: 800517 - RNA, 15 nt, Homo sapiens
cauucuaaaccaaaa

SEQ ID NO: 800518 - RNA, 15 nt, Homo sapiens
cauucuagauccugc

SEQ ID NO: 800519 - RNA, 13 nt, Homo sapiens
cauucuagguagg

SEQ ID NO: 800520 - RNA, 17 nt, Homo sapiens
cauucuaguacuuggga

SEQ ID NO: 800521 - RNA, 14 nt, Homo sapiens
cauucucaagcccu

SEQ ID NO: 800522 - RNA, 13 nt, Homo sapiens
cauucucacauaa

SEQ ID NO: 800523 - RNA, 16 nt, Homo sapiens
cauucuccugccucag

SEQ ID NO: 800524 - RNA, 18 nt, Homo sapiens
cauucucuucccagugaa

SEQ ID NO: 800525 - RNA, 19 nt, Homo sapiens
cauucucuucuugcuauau

SEQ ID NO: 800526 - RNA, 17 nt, Homo sapiens
cauucugaaacauaauu

SEQ ID NO: 800527 - RNA, 18 nt, Homo sapiens
cauucugcaagcacaucu

SEQ ID NO: 800528 - RNA, 14 nt, Homo sapiens
cauucuuauugaca

SEQ ID NO: 800529 - RNA, 13 nt, Homo sapiens
cauucuuccaaaa

SEQ ID NO: 800530 - RNA, 11 nt, Homo sapiens
cauucuuguuc

SEQ ID NO: 800531 - RNA, 17 nt, Homo sapiens
cauucuuguucagauua

SEQ ID NO: 800532 - RNA, 23 nt, Homo sapiens
cauucuuguuuuaagugccuuua

SEQ ID NO: 800533 - RNA, 20 nt, Homo sapiens
cauugaaagagaaccaguuu

SEQ ID NO: 800534 - RNA, 18 nt, Homo sapiens
cauugaacagcaaaguag

SEQ ID NO: 800535 - RNA, 20 nt, Homo sapiens
cauugaagauccgaguguga

SEQ ID NO: 800536 - RNA, 22 nt, Homo sapiens
cauugcaagcuucuuuuaguug

SEQ ID NO: 800537 - RNA, 20 nt, Homo sapiens
cauugcacucuagccuggca

SEQ ID NO: 800538 - RNA, 24 nt, Homo sapiens
cauugcacucuagccuggcaacag

SEQ ID NO: 800539 - RNA, 20 nt, Homo sapiens
cauugccaauuagacaaaca

SEQ ID NO: 800540 - RNA, 21 nt, Homo sapiens
cauugccauagcugacuacaa

SEQ ID NO: 800541 - RNA, 17 nt, Homo sapiens
cauugcucuugagucuu

SEQ ID NO: 800542 - RNA, 14 nt, Homo sapiens
cauugcugcauauu

SEQ ID NO: 800543 - RNA, 14 nt, Homo sapiens
cauugcugcugcua

SEQ ID NO: 800544 - RNA, 23 nt, Homo sapiens
cauugcuuuugggagacuggaaa

SEQ ID NO: 800545 - RNA, 14 nt, Homo sapiens
cauuggaagcuuug

SEQ ID NO: 800546 - RNA, 17 nt, Homo sapiens
cauuggaauaaggcaug

SEQ ID NO: 800547 - RNA, 19 nt, Homo sapiens
cauuggaauucuacuggaa

SEQ ID NO: 800548 - RNA, 16 nt, Homo sapiens
cauuggagagcugucu

SEQ ID NO: 800549 - RNA, 16 nt, Homo sapiens
cauugguccaagauuc

SEQ ID NO: 800550 - RNA, 12 nt, Homo sapiens
cauugguguuga

SEQ ID NO: 800551 - RNA, 19 nt, Homo sapiens
cauugguguugacauacau

SEQ ID NO: 800552 - RNA, 23 nt, Homo sapiens
cauugguuggaagcuaccagagc

SEQ ID NO: 800553 - RNA, 21 nt, Homo sapiens
cauuguauauauguguaugca

SEQ ID NO: 800554 - RNA, 19 nt, Homo sapiens
cauuguauuccuccugaga

SEQ ID NO: 800555 - RNA, 21 nt, Homo sapiens
cauugucccugaaugcuccau

SEQ ID NO: 800556 - RNA, 21 nt, Homo sapiens
cauuguccuccuuuucacuuu

SEQ ID NO: 800557 - RNA, 13 nt, Homo sapiens
cauuguccugguu

SEQ ID NO: 800558 - RNA, 17 nt, Homo sapiens
cauuguccuguagcuuu

SEQ ID NO: 800559 - RNA, 22 nt, Homo sapiens
cauugucguauaggcauguaaa

SEQ ID NO: 800560 - RNA, 20 nt, Homo sapiens
cauugugacuguguuugcau

SEQ ID NO: 800561 - RNA, 17 nt, Homo sapiens
cauugugcugcaccugg

SEQ ID NO: 800562 - RNA, 17 nt, Homo sapiens
cauuguggcuccuaucu

SEQ ID NO: 800563 - RNA, 20 nt, Homo sapiens
cauuguuaagaaaguauuug

SEQ ID NO: 800564 - RNA, 20 nt, Homo sapiens
cauuguuccugcgcugcaaa

SEQ ID NO: 800565 - RNA, 19 nt, Homo sapiens
cauuuaaaacauugcaaau

SEQ ID NO: 800566 - RNA, 15 nt, Homo sapiens
cauuuaauagacuua

SEQ ID NO: 800567 - RNA, 22 nt, Homo sapiens
cauuuacagaaacgcauccagc

SEQ ID NO: 800568 - RNA, 15 nt, Homo sapiens
cauuuaccaguauag

SEQ ID NO: 800569 - RNA, 20 nt, Homo sapiens
cauuuacuuagcagaaccac

SEQ ID NO: 800570 - RNA, 11 nt, Homo sapiens
cauuuacuuuu

SEQ ID NO: 800571 - RNA, 22 nt, Homo sapiens
cauuuagaaaauagagcuuuua

SEQ ID NO: 800572 - RNA, 18 nt, Homo sapiens
cauuuagaacuugcagcu

SEQ ID NO: 800573 - RNA, 20 nt, Homo sapiens
cauuuagugaaguugugcaa

SEQ ID NO: 800574 - RNA, 21 nt, Homo sapiens
cauuuagugaaguugugcaac

SEQ ID NO: 800575 - RNA, 18 nt, Homo sapiens
cauuuauauagauuauaa

SEQ ID NO: 800576 - RNA, 22 nt, Homo sapiens
cauuuauauugcagauugaaua

SEQ ID NO: 800577 - RNA, 14 nt, Homo sapiens
cauuuaucaccucu

SEQ ID NO: 800578 - RNA, 21 nt, Homo sapiens
cauuuaucuuuuguauaucua

SEQ ID NO: 800579 - RNA, 21 nt, Homo sapiens
ccaugacccaccccugugcuc

SEQ ID NO: 800580 - RNA, 17 nt, Homo sapiens
ccaugauggcaacagau

SEQ ID NO: 800581 - RNA, 20 nt, Homo sapiens
ccaugauggccuuacacuga

SEQ ID NO: 800582 - RNA, 23 nt, Homo sapiens
ccaugcaauuuuauuaaaugcau

SEQ ID NO: 800583 - RNA, 15 nt, Homo sapiens
ccaugcagcugcucc

SEQ ID NO: 800584 - RNA, 17 nt, Homo sapiens
ccaugccagacccacug

SEQ ID NO: 800585 - RNA, 19 nt, Homo sapiens
ccaugccagacccacugaa

SEQ ID NO: 800586 - RNA, 14 nt, Homo sapiens
ccaugccugagggu

SEQ ID NO: 800587 - RNA, 21 nt, Homo sapiens
ccaugcguguuucugacucug

SEQ ID NO: 800588 - RNA, 13 nt, Homo sapiens
ccaugcucaagau

SEQ ID NO: 800589 - RNA, 17 nt, Homo sapiens
ccaugcucaccaaggaa

SEQ ID NO: 800590 - RNA, 12 nt, Homo sapiens
ccaugcugccag

SEQ ID NO: 800591 - RNA, 22 nt, Homo sapiens
ccaugcugcuggggaagacagu

SEQ ID NO: 800592 - RNA, 22 nt, Homo sapiens
ccauggagacaagggcaucauc

SEQ ID NO: 800593 - RNA, 16 nt, Homo sapiens
ccauggaggcaugcca

SEQ ID NO: 800594 - RNA, 14 nt, Homo sapiens
ccauggaugcaugc

SEQ ID NO: 800595 - RNA, 22 nt, Homo sapiens
ccauggauuucauggugauucc

SEQ ID NO: 800596 - RNA, 23 nt, Homo sapiens
ccaugggcuagugugaguggcag

SEQ ID NO: 800597 - RNA, 21 nt, Homo sapiens
ccauggggcugauuguauuua

SEQ ID NO: 800598 - RNA, 17 nt, Homo sapiens
ccauggucaaugcaguu

SEQ ID NO: 800599 - RNA, 13 nt, Homo sapiens
ccauggugagcuc

SEQ ID NO: 800600 - RNA, 16 nt, Homo sapiens
ccauggugcuuguuaa

SEQ ID NO: 800601 - RNA, 16 nt, Homo sapiens
ccauguaaauugcaaa

SEQ ID NO: 800602 - RNA, 18 nt, Homo sapiens
ccauguaaauugcaaaua

SEQ ID NO: 800603 - RNA, 19 nt, Homo sapiens
ccauguaaucugacgucau

SEQ ID NO: 800604 - RNA, 23 nt, Homo sapiens
ccauguacucaaguaccaccaag

SEQ ID NO: 800605 - RNA, 10 nt, Homo sapiens
ccauguccaa

SEQ ID NO: 800606 - RNA, 21 nt, Homo sapiens
ccaugucuuuggacaaccaug

SEQ ID NO: 800607 - RNA, 15 nt, Homo sapiens
ccaugugcaccugcc

SEQ ID NO: 800608 - RNA, 20 nt, Homo sapiens
ccauguucacaccgcugcac

SEQ ID NO: 800609 - RNA, 23 nt, Homo sapiens
ccauguuggcuagacuagucuca

SEQ ID NO: 800610 - RNA, 22 nt, Homo sapiens
ccauguuguaaugcugcacuuc

SEQ ID NO: 800611 - RNA, 14 nt, Homo sapiens
ccauguuucucaca

SEQ ID NO: 800612 - RNA, 13 nt, Homo sapiens
ccauuaccuccau

SEQ ID NO: 800613 - RNA, 13 nt, Homo sapiens
ccauuacuuugau

SEQ ID NO: 800614 - RNA, 13 nt, Homo sapiens
ccauucacaauaa

SEQ ID NO: 800615 - RNA, 15 nt, Homo sapiens
ccauucacaccagcu

SEQ ID NO: 800616 - RNA, 19 nt, Homo sapiens
ccauucacuucauaaucca

SEQ ID NO: 800617 - RNA, 16 nt, Homo sapiens
ccauucagagcuaugg

SEQ ID NO: 800618 - RNA, 23 nt, Homo sapiens
ccauuccaggcagccucugucag

SEQ ID NO: 800619 - RNA, 16 nt, Homo sapiens
ccauucccccaugugg

SEQ ID NO: 800620 - RNA, 18 nt, Homo sapiens
ccauucuccugccucagc

SEQ ID NO: 800621 - RNA, 13 nt, Homo sapiens
ccauugcaaugaa

SEQ ID NO: 800622 - RNA, 13 nt, Homo sapiens
ccauugcacucca

SEQ ID NO: 800623 - RNA, 12 nt, Homo sapiens
ccauugcugcca

SEQ ID NO: 800624 - RNA, 14 nt, Homo sapiens
ccauugcuuaccuu

SEQ ID NO: 800625 - RNA, 19 nt, Homo sapiens
ccauuguccuccuuuucac

SEQ ID NO: 800626 - RNA, 12 nt, Homo sapiens
ccauuguucacc

SEQ ID NO: 800627 - RNA, 22 nt, Homo sapiens
ccauuuauaauguuaguagaaa

SEQ ID NO: 800628 - RNA, 16 nt, Homo sapiens
ccauuucagccaaacu

SEQ ID NO: 800629 - RNA, 13 nt, Homo sapiens
ccauuuccugaga

SEQ ID NO: 800630 - RNA, 17 nt, Homo sapiens
ccauuugaagcagugau

SEQ ID NO: 800631 - RNA, 18 nt, Homo sapiens
ccauuugcuaguucugcu

SEQ ID NO: 800632 - RNA, 20 nt, Homo sapiens
ccauuuguguacacagucag

SEQ ID NO: 800633 - RNA, 14 nt, Homo sapiens
ccauuuugcaaaau

SEQ ID NO: 800634 - RNA, 19 nt, Homo sapiens
ccauuuugguuuuccuuaa

SEQ ID NO: 800635 - RNA, 23 nt, Homo sapiens
ccauuuuguggauuguguccuau

SEQ ID NO: 800636 - RNA, 23 nt, Homo sapiens
ccauuuuuuucauuguguucucu

SEQ ID NO: 800637 - RNA, 20 nt, Homo sapiens
cccaaaaacaagcaaaacca

SEQ ID NO: 800638 - RNA, 17 nt, Homo sapiens
cccaaaaauuacuuugg

SEQ ID NO: 800639 - RNA, 23 nt, Homo sapiens
cccaaaacgucuuauugugguag

SEQ ID NO: 800640 - RNA, 17 nt, Homo sapiens
cccaaaacugucauccu

SEQ ID NO: 800641 - RNA, 12 nt, Homo sapiens
cccaaacacuuc

SEQ ID NO: 800642 - RNA, 21 nt, Homo sapiens
cccaaacuugcuuuaugccuu

SEQ ID NO: 800643 - RNA, 23 nt, Homo sapiens
cccaaaggaacacugacaucaau

SEQ ID NO: 800644 - RNA, 14 nt, Homo sapiens
cccaaagugcuagu

SEQ ID NO: 800645 - RNA, 19 nt, Homo sapiens
cccaaagugcuaguauuau

SEQ ID NO: 800646 - RNA, 14 nt, Homo sapiens
cccaaauccagugu

SEQ ID NO: 800647 - RNA, 18 nt, Homo sapiens
cccaaauucuuucagugg

SEQ ID NO: 800648 - RNA, 16 nt, Homo sapiens
cccaaauuucauaccu

SEQ ID NO: 800649 - RNA, 16 nt, Homo sapiens
cccaacaaaccaucca

SEQ ID NO: 800650 - RNA, 15 nt, Homo sapiens
cccaacccuaucucc

SEQ ID NO: 800651 - RNA, 14 nt, Homo sapiens
cccaacgcacagga

SEQ ID NO: 800652 - RNA, 14 nt, Homo sapiens
cccaacucuuacuc

SEQ ID NO: 800653 - RNA, 18 nt, Homo sapiens
cccaagauugagcucucu

SEQ ID NO: 800654 - RNA, 14 nt, Homo sapiens
cccaagcuggagug

SEQ ID NO: 800655 - RNA, 14 nt, Homo sapiens
cccaagcuucccuc

SEQ ID NO: 800656 - RNA, 11 nt, Homo sapiens
cccaaggagcu

SEQ ID NO: 800657 - RNA, 14 nt, Homo sapiens
cccaaguaggcauu

SEQ ID NO: 800658 - RNA, 12 nt, Homo sapiens
cccaaguauuuu

SEQ ID NO: 800659 - RNA, 15 nt, Homo sapiens
cccaagucccuguca

SEQ ID NO: 800660 - RNA, 18 nt, Homo sapiens
cccaagugaaaucaaagg

SEQ ID NO: 800661 - RNA, 18 nt, Homo sapiens
cccaaguuauugggaugu

SEQ ID NO: 800662 - RNA, 15 nt, Homo sapiens
cccaauaaaggcagc

SEQ ID NO: 800663 - RNA, 20 nt, Homo sapiens
cccaauuuuaaaaaauaaca

SEQ ID NO: 800664 - RNA, 18 nt, Homo sapiens
cccacaccaacgagguga

SEQ ID NO: 800665 - RNA, 22 nt, Homo sapiens
cccacacccuggaggauuucau

SEQ ID NO: 800666 - RNA, 12 nt, Homo sapiens
cccacacuuuga

SEQ ID NO: 800667 - RNA, 23 nt, Homo sapiens
cccacagcugagaauguggaaua

SEQ ID NO: 800668 - RNA, 19 nt, Homo sapiens
cccacaugugacacauaug

SEQ ID NO: 800669 - RNA, 14 nt, Homo sapiens
cccaccaacucugc

SEQ ID NO: 800670 - RNA, 14 nt, Homo sapiens
cccaccaccugucc

SEQ ID NO: 800671 - RNA, 17 nt, Homo sapiens
cccacccccuucucugc

SEQ ID NO: 800672 - RNA, 21 nt, Homo sapiens
cccacccccuucucugcucca

SEQ ID NO: 800673 - RNA, 15 nt, Homo sapiens
cccacccgucuucaa

SEQ ID NO: 800674 - RNA, 16 nt, Homo sapiens
cccaccgguccagcug

SEQ ID NO: 800675 - RNA, 17 nt, Homo sapiens
cccaccuccugcaauaa

SEQ ID NO: 800676 - RNA, 17 nt, Homo sapiens
cccaccuggugugacuu

SEQ ID NO: 800677 - RNA, 10 nt, Homo sapiens
cccacgcacg

SEQ ID NO: 800678 - RNA, 20 nt, Homo sapiens
cccacgcugaccaugcguca

SEQ ID NO: 800679 - RNA, 19 nt, Homo sapiens
cccacggcaccucggggac

SEQ ID NO: 800680 - RNA, 13 nt, Homo sapiens
cccacucuaggag

SEQ ID NO: 800681 - RNA, 13 nt, Homo sapiens
cccacugcuucua

SEQ ID NO: 800682 - RNA, 16 nt, Homo sapiens
cccacuggucugcuua

SEQ ID NO: 800683 - RNA, 17 nt, Homo sapiens
cccacuguaugauuuau

SEQ ID NO: 800684 - RNA, 16 nt, Homo sapiens
cccagaacuggacuca

SEQ ID NO: 800685 - RNA, 14 nt, Homo sapiens
cccagaauagcuuu

SEQ ID NO: 800686 - RNA, 21 nt, Homo sapiens
cccagaaugagacauccagca

SEQ ID NO: 800687 - RNA, 20 nt, Homo sapiens
cccagacaauuccauucaau

SEQ ID NO: 800688 - RNA, 13 nt, Homo sapiens
cccagacacuggc

SEQ ID NO: 800689 - RNA, 16 nt, Homo sapiens
cccagacuugcacugg

SEQ ID NO: 800690 - RNA, 14 nt, Homo sapiens
cccagagaagccaa

SEQ ID NO: 800691 - RNA, 20 nt, Homo sapiens
cccagagcaucuugcaucca

SEQ ID NO: 800692 - RNA, 20 nt, Homo sapiens
cccagagguuaucugccugg

SEQ ID NO: 800693 - RNA, 15 nt, Homo sapiens
cccagauagguggug

SEQ ID NO: 800694 - RNA, 23 nt, Homo sapiens
ccucucugagucaaauccagugg

SEQ ID NO: 800695 - RNA, 14 nt, Homo sapiens
ccucugaaaugccu

SEQ ID NO: 800696 - RNA, 11 nt, Homo sapiens
ccucugcauuu

SEQ ID NO: 800697 - RNA, 10 nt, Homo sapiens
ccucugccac

SEQ ID NO: 800698 - RNA, 14 nt, Homo sapiens
ccucugccacugac

SEQ ID NO: 800699 - RNA, 20 nt, Homo sapiens
ccucugccagcgccaaaaca

SEQ ID NO: 800700 - RNA, 22 nt, Homo sapiens
ccucugccggucccccaugcca

SEQ ID NO: 800701 - RNA, 16 nt, Homo sapiens
ccucugcgucuauccu

SEQ ID NO: 800702 - RNA, 20 nt, Homo sapiens
ccucugcgucuuuuuacuca

SEQ ID NO: 800703 - RNA, 14 nt, Homo sapiens
ccucugcugccaug

SEQ ID NO: 800704 - RNA, 16 nt, Homo sapiens
ccucuggagcccuaac

SEQ ID NO: 800705 - RNA, 19 nt, Homo sapiens
ccucugucaacaucaaaga

SEQ ID NO: 800706 - RNA, 14 nt, Homo sapiens
ccucugucuccuaa

SEQ ID NO: 800707 - RNA, 23 nt, Homo sapiens
ccucuuaagaucugacugccaaa

SEQ ID NO: 800708 - RNA, 19 nt, Homo sapiens
ccucuucaaaggugacuuc

SEQ ID NO: 800709 - RNA, 22 nt, Homo sapiens
ccucuuccccagaaaggagacu

SEQ ID NO: 800710 - RNA, 17 nt, Homo sapiens
ccucuuggcugccuugu

SEQ ID NO: 800711 - RNA, 23 nt, Homo sapiens
ccucuuguaagucaucuacuuaa

SEQ ID NO: 800712 - RNA, 22 nt, Homo sapiens
ccucuuguugcagagauuuccu

SEQ ID NO: 800713 - RNA, 14 nt, Homo sapiens
ccucuuuaaaaaca

SEQ ID NO: 800714 - RNA, 19 nt, Homo sapiens
ccucuuuccuuccuuccuc

SEQ ID NO: 800715 - RNA, 20 nt, Homo sapiens
ccucuuuguuuaucucugag

SEQ ID NO: 800716 - RNA, 15 nt, Homo sapiens
ccucuuuucucugug

SEQ ID NO: 800717 - RNA, 18 nt, Homo sapiens
ccucuuuucucugugcuu

SEQ ID NO: 800718 - RNA, 21 nt, Homo sapiens
ccucuuuugagacuuugccca

SEQ ID NO: 800719 - RNA, 14 nt, Homo sapiens
ccugaaaaacugau

SEQ ID NO: 800720 - RNA, 20 nt, Homo sapiens
ccugaaaaggacuucuggcu

SEQ ID NO: 800721 - RNA, 18 nt, Homo sapiens
ccugaaacugaguugaau

SEQ ID NO: 800722 - RNA, 14 nt, Homo sapiens
ccugaaagauacag

SEQ ID NO: 800723 - RNA, 16 nt, Homo sapiens
ccugaaccuuccaucu

SEQ ID NO: 800724 - RNA, 14 nt, Homo sapiens
ccugaagaaccagu

SEQ ID NO: 800725 - RNA, 19 nt, Homo sapiens
ccugaagaugggagccuuu

SEQ ID NO: 800726 - RNA, 20 nt, Homo sapiens
ccugaaguguggcugcaucu

SEQ ID NO: 800727 - RNA, 23 nt, Homo sapiens
ccugaauaaagauucuacaacac

SEQ ID NO: 800728 - RNA, 23 nt, Homo sapiens
ccugaauauuuguuauguagaua

SEQ ID NO: 800729 - RNA, 22 nt, Homo sapiens
ccugaauucuuuuucauuugag

SEQ ID NO: 800730 - RNA, 14 nt, Homo sapiens
ccugacaaccacug

SEQ ID NO: 800731 - RNA, 14 nt, Homo sapiens
ccugacaauggcag

SEQ ID NO: 800732 - RNA, 21 nt, Homo sapiens
ccugacaccgucccucaguga

SEQ ID NO: 800733 - RNA, 14 nt, Homo sapiens
ccugacacuauuca

SEQ ID NO: 800734 - RNA, 15 nt, Homo sapiens
ccugacagaugucag

SEQ ID NO: 800735 - RNA, 17 nt, Homo sapiens
ccugacccuacuucuuu

SEQ ID NO: 800736 - RNA, 12 nt, Homo sapiens
ccugaccucacu

SEQ ID NO: 800737 - RNA, 19 nt, Homo sapiens
ccugaccugucaccgugag

SEQ ID NO: 800738 - RNA, 14 nt, Homo sapiens
ccugaccugucuca

SEQ ID NO: 800739 - RNA, 18 nt, Homo sapiens
ccugacuccuccaaggaa

SEQ ID NO: 800740 - RNA, 18 nt, Homo sapiens
ccugacuccugacuugua

SEQ ID NO: 800741 - RNA, 17 nt, Homo sapiens
ccugacuguaaaugcuc

SEQ ID NO: 800742 - RNA, 19 nt, Homo sapiens
ccugagaaacccaccagcc

SEQ ID NO: 800743 - RNA, 15 nt, Homo sapiens
ccugagaagccagug

SEQ ID NO: 800744 - RNA, 13 nt, Homo sapiens
ccugagaccucua

SEQ ID NO: 800745 - RNA, 21 nt, Homo sapiens
ccugagaggaaccagagcaga

SEQ ID NO: 800746 - RNA, 17 nt, Homo sapiens
ccugagaguggugcccu

SEQ ID NO: 800747 - RNA, 20 nt, Homo sapiens
ccugagaucugcacagucag

SEQ ID NO: 800748 - RNA, 20 nt, Homo sapiens
ccugagcccuacucccugca

SEQ ID NO: 800749 - RNA, 13 nt, Homo sapiens
ccugagcuaaaua

SEQ ID NO: 800750 - RNA, 11 nt, Homo sapiens
ccugaggaaug

SEQ ID NO: 800751 - RNA, 18 nt, Homo sapiens
ccugaguagcugggacua

SEQ ID NO: 800752 - RNA, 14 nt, Homo sapiens
ccugagucccuuaa

SEQ ID NO: 800753 - RNA, 24 nt, Homo sapiens
ccugauaaacauuaaacacuguaa

SEQ ID NO: 800754 - RNA, 13 nt, Homo sapiens
ccugauacauuaa

SEQ ID NO: 800755 - RNA, 21 nt, Homo sapiens
ccugauauucaggcuacucau

SEQ ID NO: 800756 - RNA, 13 nt, Homo sapiens
ccugaugagauuu

SEQ ID NO: 800757 - RNA, 12 nt, Homo sapiens
ccugauuuacua

SEQ ID NO: 800758 - RNA, 19 nt, Homo sapiens
ccugcaauucuacaguuuc

SEQ ID NO: 800759 - RNA, 13 nt, Homo sapiens
ccugcacaagcca

SEQ ID NO: 800760 - RNA, 17 nt, Homo sapiens
ccugcaccacucucuuc

SEQ ID NO: 800761 - RNA, 16 nt, Homo sapiens
ccugcagaagaagcug

SEQ ID NO: 800762 - RNA, 19 nt, Homo sapiens
ccugcagaagaagcuggug

SEQ ID NO: 800763 - RNA, 16 nt, Homo sapiens
ccugcagagugcaaca

SEQ ID NO: 800764 - RNA, 20 nt, Homo sapiens
ccugcagcccaaaacccagg

SEQ ID NO: 800765 - RNA, 22 nt, Homo sapiens
ccugcagcccauggugagcucu

SEQ ID NO: 800766 - RNA, 17 nt, Homo sapiens
ccugcaggcaggaacaa

SEQ ID NO: 800767 - RNA, 20 nt, Homo sapiens
ccugcagggacuccaugcug

SEQ ID NO: 800768 - RNA, 19 nt, Homo sapiens
ccugcaggugagcaggcag

SEQ ID NO: 800769 - RNA, 15 nt, Homo sapiens
ccugcauugcucucc

SEQ ID NO: 800770 - RNA, 12 nt, Homo sapiens
ccugccaagagg

SEQ ID NO: 800771 - RNA, 10 nt, Homo sapiens
ccugccaagu

SEQ ID NO: 800772 - RNA, 15 nt, Homo sapiens
ccugcccaccaagaa

SEQ ID NO: 800773 - RNA, 21 nt, Homo sapiens
ccugcccacuuagccguccau

SEQ ID NO: 800774 - RNA, 22 nt, Homo sapiens
ccugccccagaggucgcagcua

SEQ ID NO: 800775 - RNA, 16 nt, Homo sapiens
ccugcccuagcuccac

SEQ ID NO: 800776 - RNA, 17 nt, Homo sapiens
ccugcccucugcucugc

SEQ ID NO: 800777 - RNA, 15 nt, Homo sapiens
ccugccggugcacag

SEQ ID NO: 800778 - RNA, 13 nt, Homo sapiens
ccugccgucuuca

SEQ ID NO: 800779 - RNA, 22 nt, Homo sapiens
ccugccgucuucacuuccccac

SEQ ID NO: 800780 - RNA, 14 nt, Homo sapiens
ccugccuaggaauu

SEQ ID NO: 800781 - RNA, 20 nt, Homo sapiens
ccugccucagccucccaauu

SEQ ID NO: 800782 - RNA, 22 nt, Homo sapiens
ccugccucccaagguccucuca

SEQ ID NO: 800783 - RNA, 23 nt, Homo sapiens
ccugccucccacuucacugcgaa

SEQ ID NO: 800784 - RNA, 20 nt, Homo sapiens
ccugccuccugccaccccuu

SEQ ID NO: 800785 - RNA, 22 nt, Homo sapiens
ccugccucuuccugcagccuca

SEQ ID NO: 800786 - RNA, 19 nt, Homo sapiens
ccugccuguggcgccgucu

SEQ ID NO: 800787 - RNA, 20 nt, Homo sapiens
ccugcgacccugggggcaca

SEQ ID NO: 800788 - RNA, 15 nt, Homo sapiens
ccugcucagcagcca

SEQ ID NO: 800789 - RNA, 18 nt, Homo sapiens
ccugcucagcccugcacc

SEQ ID NO: 800790 - RNA, 17 nt, Homo sapiens
ccugcuccagcagcaca

SEQ ID NO: 800791 - RNA, 20 nt, Homo sapiens
ccugcucuaaggcaguagaa

SEQ ID NO: 800792 - RNA, 21 nt, Homo sapiens
ccugcucuggagccugcagau

SEQ ID NO: 800793 - RNA, 14 nt, Homo sapiens
ccugcugaagcugc

SEQ ID NO: 800794 - RNA, 22 nt, Homo sapiens
ccugcugaccucccagugaccc

SEQ ID NO: 800795 - RNA, 22 nt, Homo sapiens
ccugcugacuauuugaccccca

SEQ ID NO: 800796 - RNA, 18 nt, Homo sapiens
ccugcugagggaccagcc

SEQ ID NO: 800797 - RNA, 17 nt, Homo sapiens
ccugcugcuggugcaca

SEQ ID NO: 800798 - RNA, 14 nt, Homo sapiens
ccugcugcuugccc

SEQ ID NO: 800799 - RNA, 16 nt, Homo sapiens
ccugcugggaagagcu

SEQ ID NO: 800800 - RNA, 23 nt, Homo sapiens
ccugcuggggaccucaccugcug

SEQ ID NO: 800801 - RNA, 15 nt, Homo sapiens
ccugcuguccuggug

SEQ ID NO: 800802 - RNA, 17 nt, Homo sapiens
ccugcuguugguccucu

SEQ ID NO: 800803 - RNA, 23 nt, Homo sapiens
ccugcuuagcugccuugagcuaa

SEQ ID NO: 800804 - RNA, 13 nt, Homo sapiens
ccugcuuugcauc

SEQ ID NO: 800805 - RNA, 15 nt, Homo sapiens
ccugcuuugcaucuu

SEQ ID NO: 800806 - RNA, 22 nt, Homo sapiens
ccuggaacaccagcagcacugg

SEQ ID NO: 800807 - RNA, 19 nt, Homo sapiens
ccuggaagcaggugcuaca

SEQ ID NO: 800808 - RNA, 15 nt, Homo sapiens
cucuacgugcuccuc

SEQ ID NO: 800809 - RNA, 13 nt, Homo sapiens
cucuacucuuaca

SEQ ID NO: 800810 - RNA, 22 nt, Homo sapiens
cucuacugaggugcuauguucu

SEQ ID NO: 800811 - RNA, 22 nt, Homo sapiens
cucuacuugcaagccucaaaga

SEQ ID NO: 800812 - RNA, 18 nt, Homo sapiens
cucuagagaaaagucuac

SEQ ID NO: 800813 - RNA, 17 nt, Homo sapiens
cucuagagucacugaua

SEQ ID NO: 800814 - RNA, 21 nt, Homo sapiens
cucuagccuggcaacagagcg

SEQ ID NO: 800815 - RNA, 12 nt, Homo sapiens
cucuagcucucu

SEQ ID NO: 800816 - RNA, 13 nt, Homo sapiens
cucuagcuguucu

SEQ ID NO: 800817 - RNA, 23 nt, Homo sapiens
cucuaggccucuccaguuugcac

SEQ ID NO: 800818 - RNA, 19 nt, Homo sapiens
cucuagggaaucuggauua

SEQ ID NO: 800819 - RNA, 21 nt, Homo sapiens
cucuagguacgaugacagugu

SEQ ID NO: 800820 - RNA, 19 nt, Homo sapiens
cucuaguaagaugcacuga

SEQ ID NO: 800821 - RNA, 14 nt, Homo sapiens
cucuagugggacag

SEQ ID NO: 800822 - RNA, 15 nt, Homo sapiens
cucuaguucuuaaca

SEQ ID NO: 800823 - RNA, 22 nt, Homo sapiens
cucuauacaaaaugauuuugaa

SEQ ID NO: 800824 - RNA, 12 nt, Homo sapiens
cucuauaccaau

SEQ ID NO: 800825 - RNA, 21 nt, Homo sapiens
cucuauagacucuaggacaua

SEQ ID NO: 800826 - RNA, 21 nt, Homo sapiens
cucuaugguguggcaaagccu

SEQ ID NO: 800827 - RNA, 15 nt, Homo sapiens
cucuauuccaaaaag

SEQ ID NO: 800828 - RNA, 19 nt, Homo sapiens
cucuauugauguacagucu

SEQ ID NO: 800829 - RNA, 21 nt, Homo sapiens
cucuauuuguaauugaacuua

SEQ ID NO: 800830 - RNA, 20 nt, Homo sapiens
cucucaaguagcugggacua

SEQ ID NO: 800831 - RNA, 20 nt, Homo sapiens
cucucaaugaauaauuguau

SEQ ID NO: 800832 - RNA, 13 nt, Homo sapiens
cucucacccucau

SEQ ID NO: 800833 - RNA, 21 nt, Homo sapiens
cucucagaggccugcugccag

SEQ ID NO: 800834 - RNA, 12 nt, Homo sapiens
cucucagccuua

SEQ ID NO: 800835 - RNA, 23 nt, Homo sapiens
cucucaggaucaagaaaguguug

SEQ ID NO: 800836 - RNA, 15 nt, Homo sapiens
cucucagugccuucu

SEQ ID NO: 800837 - RNA, 16 nt, Homo sapiens
cucucaguguuuugga

SEQ ID NO: 800838 - RNA, 15 nt, Homo sapiens
cucucaucaacugaa

SEQ ID NO: 800839 - RNA, 12 nt, Homo sapiens
cucuccaaaggc

SEQ ID NO: 800840 - RNA, 22 nt, Homo sapiens
cucuccauaucuccuuccccua

SEQ ID NO: 800841 - RNA, 21 nt, Homo sapiens
cucucccaaaaaacuacuucu

SEQ ID NO: 800842 - RNA, 18 nt, Homo sapiens
cucucccaggacccauca

SEQ ID NO: 800843 - RNA, 19 nt, Homo sapiens
cucuccccaggcauuugcc

SEQ ID NO: 800844 - RNA, 14 nt, Homo sapiens
cucucccugccaag

SEQ ID NO: 800845 - RNA, 18 nt, Homo sapiens
cucucgacaguauccaca

SEQ ID NO: 800846 - RNA, 18 nt, Homo sapiens
cucucuaccagucuauuu

SEQ ID NO: 800847 - RNA, 22 nt, Homo sapiens
cucucucaaaagagaaaaacaa

SEQ ID NO: 800848 - RNA, 14 nt, Homo sapiens
cucucucaaagugc

SEQ ID NO: 800849 - RNA, 14 nt, Homo sapiens
cucucucacacaca

SEQ ID NO: 800850 - RNA, 15 nt, Homo sapiens
cucucucauacccuc

SEQ ID NO: 800851 - RNA, 11 nt, Homo sapiens
cucucucauga

SEQ ID NO: 800852 - RNA, 14 nt, Homo sapiens
cucucuccugucca

SEQ ID NO: 800853 - RNA, 9 nt, Homo sapiens
cucucucug

SEQ ID NO: 800854 - RNA, 13 nt, Homo sapiens
cucucucugaggg

SEQ ID NO: 800855 - RNA, 16 nt, Homo sapiens
cucucugcaagacaga

SEQ ID NO: 800856 - RNA, 23 nt, Homo sapiens
cucucugcaagacagaaaccucc

SEQ ID NO: 800857 - RNA, 19 nt, Homo sapiens
cucucuggaaggagacuga

SEQ ID NO: 800858 - RNA, 23 nt, Homo sapiens
cucucugggccucaguuuuccca

SEQ ID NO: 800859 - RNA, 14 nt, Homo sapiens
cucucuucucucca

SEQ ID NO: 800860 - RNA, 15 nt, Homo sapiens
cucucuucugcucca

SEQ ID NO: 800861 - RNA, 19 nt, Homo sapiens
cucucuuuccuccacccau

SEQ ID NO: 800862 - RNA, 23 nt, Homo sapiens
cucucuuucuagaggugcuacau

SEQ ID NO: 800863 - RNA, 19 nt, Homo sapiens
cucugaagcuaauuguacu

SEQ ID NO: 800864 - RNA, 12 nt, Homo sapiens
cucugaagucac

SEQ ID NO: 800865 - RNA, 23 nt, Homo sapiens
cucugaagucacaucacaggaca

SEQ ID NO: 800866 - RNA, 15 nt, Homo sapiens
cucugacaguccaca

SEQ ID NO: 800867 - RNA, 18 nt, Homo sapiens
cucugacaguccacaggg

SEQ ID NO: 800868 - RNA, 15 nt, Homo sapiens
cucugaccugcacug

SEQ ID NO: 800869 - RNA, 13 nt, Homo sapiens
cucugaccuguac

SEQ ID NO: 800870 - RNA, 13 nt, Homo sapiens
cucugaccuuuca

SEQ ID NO: 800871 - RNA, 17 nt, Homo sapiens
cucugacgcuugugaca

SEQ ID NO: 800872 - RNA, 21 nt, Homo sapiens
cucugacgcuugugacagugc

SEQ ID NO: 800873 - RNA, 19 nt, Homo sapiens
cucugagaagacacaaggu

SEQ ID NO: 800874 - RNA, 15 nt, Homo sapiens
cucugaggcuaugga

SEQ ID NO: 800875 - RNA, 17 nt, Homo sapiens
cucugaggcuauggagg

SEQ ID NO: 800876 - RNA, 21 nt, Homo sapiens
cucugaggggaggcaccucca

SEQ ID NO: 800877 - RNA, 22 nt, Homo sapiens
cucugagucagugguuauuuga

SEQ ID NO: 800878 - RNA, 12 nt, Homo sapiens
cucugauaccuc

SEQ ID NO: 800879 - RNA, 15 nt, Homo sapiens
cucugauaugggacu

SEQ ID NO: 800880 - RNA, 23 nt, Homo sapiens
cucugaugacccugaaucugauc

SEQ ID NO: 800881 - RNA, 14 nt, Homo sapiens
cucugcaacacuuu

SEQ ID NO: 800882 - RNA, 20 nt, Homo sapiens
cucugcaacugcucagcucu

SEQ ID NO: 800883 - RNA, 14 nt, Homo sapiens
cucugcacagacaa

SEQ ID NO: 800884 - RNA, 12 nt, Homo sapiens
cucugcacaugu

SEQ ID NO: 800885 - RNA, 13 nt, Homo sapiens
cucugcacauguc

SEQ ID NO: 800886 - RNA, 15 nt, Homo sapiens
cucugcaccuuugca

SEQ ID NO: 800887 - RNA, 18 nt, Homo sapiens
cucugcacuccauggcca

SEQ ID NO: 800888 - RNA, 15 nt, Homo sapiens
cucugcagaagccaa

SEQ ID NO: 800889 - RNA, 18 nt, Homo sapiens
cucugcagacugcugcua

SEQ ID NO: 800890 - RNA, 16 nt, Homo sapiens
cucugcaguacuugau

SEQ ID NO: 800891 - RNA, 14 nt, Homo sapiens
cucugcauguguaa

SEQ ID NO: 800892 - RNA, 17 nt, Homo sapiens
cucugccaagauccauc

SEQ ID NO: 800893 - RNA, 13 nt, Homo sapiens
cucugccacugac

SEQ ID NO: 800894 - RNA, 19 nt, Homo sapiens
cucugccagccacauccaa

SEQ ID NO: 800895 - RNA, 13 nt, Homo sapiens
cucugccaugugg

SEQ ID NO: 800896 - RNA, 11 nt, Homo sapiens
cucugccauuc

SEQ ID NO: 800897 - RNA, 20 nt, Homo sapiens
cucugcccugcccuagcucc

SEQ ID NO: 800898 - RNA, 19 nt, Homo sapiens
cucugcccuucagccuuca

SEQ ID NO: 800899 - RNA, 18 nt, Homo sapiens
cucugccucccuagcuuu

SEQ ID NO: 800900 - RNA, 18 nt, Homo sapiens
cucugccugaaggcucac

SEQ ID NO: 800901 - RNA, 24 nt, Homo sapiens
cucugccuuaaacacacauugcag

SEQ ID NO: 800902 - RNA, 14 nt, Homo sapiens
cucugccuuuauga

SEQ ID NO: 800903 - RNA, 17 nt, Homo sapiens
cucugcuccccugugaa

SEQ ID NO: 800904 - RNA, 19 nt, Homo sapiens
cucugcuuccagcaguauu

SEQ ID NO: 800905 - RNA, 19 nt, Homo sapiens
cucugcuugauuuuugccu

SEQ ID NO: 800906 - RNA, 19 nt, Homo sapiens
cucugcuuuuaacuuuaua

SEQ ID NO: 800907 - RNA, 17 nt, Homo sapiens
cucuggagaguaaucug

SEQ ID NO: 800908 - RNA, 16 nt, Homo sapiens
cucuggaggaaguucu

SEQ ID NO: 800909 - RNA, 18 nt, Homo sapiens
cucuggaggaaguucucc

SEQ ID NO: 800910 - RNA, 15 nt, Homo sapiens
cucuggcacagugua

SEQ ID NO: 800911 - RNA, 17 nt, Homo sapiens
cucuggcgacaguuuuc

SEQ ID NO: 800912 - RNA, 22 nt, Homo sapiens
cucuggcugucugucugcagug

SEQ ID NO: 800913 - RNA, 21 nt, Homo sapiens
cucugggaaguggucagcgca

SEQ ID NO: 800914 - RNA, 15 nt, Homo sapiens
cucugggaagugugg

SEQ ID NO: 800915 - RNA, 21 nt, Homo sapiens
cucugggaauuuggagugacc

SEQ ID NO: 800916 - RNA, 22 nt, Homo sapiens
cucugggaauuuggagugacca

SEQ ID NO: 800917 - RNA, 17 nt, Homo sapiens
cucugggaccacugggu

SEQ ID NO: 800918 - RNA, 14 nt, Homo sapiens
cucugggaggccau

SEQ ID NO: 800919 - RNA, 22 nt, Homo sapiens
cucuggggucuuuuuaugcauu

SEQ ID NO: 800920 - RNA, 17 nt, Homo sapiens
cucuggucauagaaaca

SEQ ID NO: 800921 - RNA, 16 nt, Homo sapiens
cucuggugcugcagua

SEQ ID NO: 800922 - RNA, 16 nt, Homo sapiens
cucugguggagacaaa

SEQ ID NO: 800923 - RNA, 20 nt, Homo sapiens
cuggguuuggaccccagcug

SEQ ID NO: 800924 - RNA, 15 nt, Homo sapiens
cugguaaucuugcuc

SEQ ID NO: 800925 - RNA, 16 nt, Homo sapiens
cugguagaaaggcagu

SEQ ID NO: 800926 - RNA, 22 nt, Homo sapiens
cugguaggaagauggagguuua

SEQ ID NO: 800927 - RNA, 17 nt, Homo sapiens
cugguagguugggacac

SEQ ID NO: 800928 - RNA, 16 nt, Homo sapiens
cugguauauccaaaag

SEQ ID NO: 800929 - RNA, 16 nt, Homo sapiens
cugguauguguggaug

SEQ ID NO: 800930 - RNA, 23 nt, Homo sapiens
cugguauuaacuuuauacacuug

SEQ ID NO: 800931 - RNA, 15 nt, Homo sapiens
cuggucaaguuguaa

SEQ ID NO: 800932 - RNA, 17 nt, Homo sapiens
cuggucagguauuucag

SEQ ID NO: 800933 - RNA, 23 nt, Homo sapiens
cuggucauggaauggcagguguc

SEQ ID NO: 800934 - RNA, 18 nt, Homo sapiens
cuggucauuaaugugucc

SEQ ID NO: 800935 - RNA, 19 nt, Homo sapiens
cugguccagggcuagugac

SEQ ID NO: 800936 - RNA, 21 nt, Homo sapiens
cuggucccggggccagcacuu

SEQ ID NO: 800937 - RNA, 16 nt, Homo sapiens
cugguccugacuuccc

SEQ ID NO: 800938 - RNA, 13 nt, Homo sapiens
cugguccuuccag

SEQ ID NO: 800939 - RNA, 15 nt, Homo sapiens
cuggucuauaccuua

SEQ ID NO: 800940 - RNA, 23 nt, Homo sapiens
cuggucucaaacuccugggcuca

SEQ ID NO: 800941 - RNA, 15 nt, Homo sapiens
cuggucuccuugaga

SEQ ID NO: 800942 - RNA, 16 nt, Homo sapiens
cuggucuuggugaaca

SEQ ID NO: 800943 - RNA, 13 nt, Homo sapiens
cuggucuugugga

SEQ ID NO: 800944 - RNA, 18 nt, Homo sapiens
cuggugacaccagccuuu

SEQ ID NO: 800945 - RNA, 16 nt, Homo sapiens
cuggugagucaccacu

SEQ ID NO: 800946 - RNA, 13 nt, Homo sapiens
cuggugcaaagau

SEQ ID NO: 800947 - RNA, 22 nt, Homo sapiens
cugguggcacaggaguguccuc

SEQ ID NO: 800948 - RNA, 13 nt, Homo sapiens
cugguggggcuga

SEQ ID NO: 800949 - RNA, 18 nt, Homo sapiens
cuggugggugguguccug

SEQ ID NO: 800950 - RNA, 19 nt, Homo sapiens
cuggugguucuacugaccc

SEQ ID NO: 800951 - RNA, 14 nt, Homo sapiens
cugguguccugacc

SEQ ID NO: 800952 - RNA, 21 nt, Homo sapiens
cugguguucuguuucaaugua

SEQ ID NO: 800953 - RNA, 15 nt, Homo sapiens
cugguuagaaaugca

SEQ ID NO: 800954 - RNA, 22 nt, Homo sapiens
cugguugaaaaauggcaaagaa

SEQ ID NO: 800955 - RNA, 23 nt, Homo sapiens
cugguugaacucugguggcacag

SEQ ID NO: 800956 - RNA, 13 nt, Homo sapiens
cugguugauuugu

SEQ ID NO: 800957 - RNA, 14 nt, Homo sapiens
cugguuguucuguu

SEQ ID NO: 800958 - RNA, 19 nt, Homo sapiens
cugguuugaaagauuauga

SEQ ID NO: 800959 - RNA, 13 nt, Homo sapiens
cugguuugacuca

SEQ ID NO: 800960 - RNA, 14 nt, Homo sapiens
cuguaaacuuccaa

SEQ ID NO: 800961 - RNA, 16 nt, Homo sapiens
cuguaaacuuccaagc

SEQ ID NO: 800962 - RNA, 12 nt, Homo sapiens
cuguaaauaugu

SEQ ID NO: 800963 - RNA, 15 nt, Homo sapiens
cuguaagcuccauga

SEQ ID NO: 800964 - RNA, 22 nt, Homo sapiens
cuguaaggcaggcccauucaga

SEQ ID NO: 800965 - RNA, 22 nt, Homo sapiens
cuguaauauuguaaauacugga

SEQ ID NO: 800966 - RNA, 20 nt, Homo sapiens
cuguaaucccagcacuuuag

SEQ ID NO: 800967 - RNA, 23 nt, Homo sapiens
cuguaaucccagcacuuugggag

SEQ ID NO: 800968 - RNA, 19 nt, Homo sapiens
cuguaauggguaauucuga

SEQ ID NO: 800969 - RNA, 12 nt, Homo sapiens
cuguacauucuu

SEQ ID NO: 800970 - RNA, 16 nt, Homo sapiens
cuguaccacaucugcu

SEQ ID NO: 800971 - RNA, 12 nt, Homo sapiens
cuguaccaguua

SEQ ID NO: 800972 - RNA, 22 nt, Homo sapiens
cuguacccuugagaccuggaac

SEQ ID NO: 800973 - RNA, 18 nt, Homo sapiens
cuguaccuagaauagucu

SEQ ID NO: 800974 - RNA, 23 nt, Homo sapiens
cuguaccuugcuguggggcuaca

SEQ ID NO: 800975 - RNA, 16 nt, Homo sapiens
cuguagaaauguaucc

SEQ ID NO: 800976 - RNA, 22 nt, Homo sapiens
cuguagaaugauuucaugcuau

SEQ ID NO: 800977 - RNA, 13 nt, Homo sapiens
cuguagaguugcu

SEQ ID NO: 800978 - RNA, 15 nt, Homo sapiens
cuguagccacuggca

SEQ ID NO: 800979 - RNA, 16 nt, Homo sapiens
cuguagcgucuguaua

SEQ ID NO: 800980 - RNA, 15 nt, Homo sapiens
cuguaggaagucauc

SEQ ID NO: 800981 - RNA, 14 nt, Homo sapiens
cuguagucccagcu

SEQ ID NO: 800982 - RNA, 14 nt, Homo sapiens
cuguagucccaguu

SEQ ID NO: 800983 - RNA, 15 nt, Homo sapiens
cuguaguuacugugg

SEQ ID NO: 800984 - RNA, 17 nt, Homo sapiens
cuguaguucuaagacuc

SEQ ID NO: 800985 - RNA, 23 nt, Homo sapiens
cuguaguugcguggacucugcac

SEQ ID NO: 800986 - RNA, 17 nt, Homo sapiens
cuguaguuuaugaugca

SEQ ID NO: 800987 - RNA, 23 nt, Homo sapiens
cuguauagacaugcuaccacugg

SEQ ID NO: 800988 - RNA, 16 nt, Homo sapiens
cuguauagggcucguu

SEQ ID NO: 800989 - RNA, 19 nt, Homo sapiens
cuguauauacaauaacaua

SEQ ID NO: 800990 - RNA, 22 nt, Homo sapiens
cuguauaugauucucugugguu

SEQ ID NO: 800991 - RNA, 13 nt, Homo sapiens
cuguaucugugua

SEQ ID NO: 800992 - RNA, 15 nt, Homo sapiens
cuguauuaguuuuug

SEQ ID NO: 800993 - RNA, 23 nt, Homo sapiens
cuguauucuguuugcguacuugu

SEQ ID NO: 800994 - RNA, 14 nt, Homo sapiens
cuguauugagcaag

SEQ ID NO: 800995 - RNA, 19 nt, Homo sapiens
cuguauuucgaaugagucu

SEQ ID NO: 800996 - RNA, 21 nt, Homo sapiens
cuguauuugaaauaagaauuc

SEQ ID NO: 800997 - RNA, 21 nt, Homo sapiens
cuguauuuucgggauucuuug

SEQ ID NO: 800998 - RNA, 16 nt, Homo sapiens
cugucaaaacuacuga

SEQ ID NO: 800999 - RNA, 15 nt, Homo sapiens
cugucacaaccaaga

SEQ ID NO: 801000 - RNA, 15 nt, Homo sapiens
cugucaccagagcuu

SEQ ID NO: 801001 - RNA, 18 nt, Homo sapiens
cugucacucagcugagaa

SEQ ID NO: 801002 - RNA, 22 nt, Homo sapiens
cugucagaaaaagcuagcacua

SEQ ID NO: 801003 - RNA, 23 nt, Homo sapiens
cugucagaaaaagcuagcacuaa

SEQ ID NO: 801004 - RNA, 16 nt, Homo sapiens
cugucagaggcuaaga

SEQ ID NO: 801005 - RNA, 18 nt, Homo sapiens
cugucagcuuccaaacau

SEQ ID NO: 801006 - RNA, 15 nt, Homo sapiens
cugucaggacaccag

SEQ ID NO: 801007 - RNA, 23 nt, Homo sapiens
cugucaguuauucuugcaaagau

SEQ ID NO: 801008 - RNA, 15 nt, Homo sapiens
cugucauaacaucca

SEQ ID NO: 801009 - RNA, 16 nt, Homo sapiens
cugucauccucaggaa

SEQ ID NO: 801010 - RNA, 13 nt, Homo sapiens
cugucaugguccu

SEQ ID NO: 801011 - RNA, 17 nt, Homo sapiens
cugucccauucuagauc

SEQ ID NO: 801012 - RNA, 13 nt, Homo sapiens
cuguccccugaaa

SEQ ID NO: 801013 - RNA, 21 nt, Homo sapiens
cuguccccuucucucaucucu

SEQ ID NO: 801014 - RNA, 19 nt, Homo sapiens
cugucccucauccauagca

SEQ ID NO: 801015 - RNA, 22 nt, Homo sapiens
cugucccuccaggcccaucuca

SEQ ID NO: 801016 - RNA, 23 nt, Homo sapiens
cugucccuccaggcccaucucaa

SEQ ID NO: 801017 - RNA, 16 nt, Homo sapiens
cuguccuagucuugau

SEQ ID NO: 801018 - RNA, 13 nt, Homo sapiens
cuguccucaagua

SEQ ID NO: 801019 - RNA, 22 nt, Homo sapiens
cuguccucagccuugccagaga

SEQ ID NO: 801020 - RNA, 22 nt, Homo sapiens
cuguccugcagcaaacacucca

SEQ ID NO: 801021 - RNA, 15 nt, Homo sapiens
cuguccuggcuacua

SEQ ID NO: 801022 - RNA, 12 nt, Homo sapiens
cuguccuugccc

SEQ ID NO: 801023 - RNA, 17 nt, Homo sapiens
cuguccuuucuugcaga

SEQ ID NO: 801024 - RNA, 14 nt, Homo sapiens
cugucgcccagugc

SEQ ID NO: 801025 - RNA, 13 nt, Homo sapiens
cugucuacugugg

SEQ ID NO: 801026 - RNA, 16 nt, Homo sapiens
cugucuagacuggccu

SEQ ID NO: 801027 - RNA, 11 nt, Homo sapiens
cugucuaggac

SEQ ID NO: 801028 - RNA, 24 nt, Homo sapiens
cugucucacauacauaagcagcau

SEQ ID NO: 801029 - RNA, 17 nt, Homo sapiens
cugucucaccauguaca

SEQ ID NO: 801030 - RNA, 12 nt, Homo sapiens
cugucucugagg

SEQ ID NO: 801031 - RNA, 15 nt, Homo sapiens
cugucugaccagaga

SEQ ID NO: 801032 - RNA, 17 nt, Homo sapiens
cugucuggcccugggga

SEQ ID NO: 801033 - RNA, 19 nt, Homo sapiens
cugucuucacauguaugga

SEQ ID NO: 801034 - RNA, 19 nt, Homo sapiens
cugucuucagagaacccac

SEQ ID NO: 801035 - RNA, 20 nt, Homo sapiens
cugucuuccaaggagaccaa

SEQ ID NO: 801036 - RNA, 22 nt, Homo sapiens
cugucuucguauucccauuaga

SEQ ID NO: 801037 - RNA, 20 nt, Homo sapiens
cugucuuuauaaucuacucc

SEQ ID NO: 801038 - RNA, 16 nt, Homo sapiens
cuuuccucagaucauc

SEQ ID NO: 801039 - RNA, 10 nt, Homo sapiens
cuuuccugcc

SEQ ID NO: 801040 - RNA, 12 nt, Homo sapiens
cuuuccuuccau

SEQ ID NO: 801041 - RNA, 16 nt, Homo sapiens
cuuuccuuucuuuacu

SEQ ID NO: 801042 - RNA, 17 nt, Homo sapiens
cuuucggggugcuccug

SEQ ID NO: 801043 - RNA, 15 nt, Homo sapiens
cuuucgguacuguaa

SEQ ID NO: 801044 - RNA, 14 nt, Homo sapiens
cuuucuaagcccug

SEQ ID NO: 801045 - RNA, 22 nt, Homo sapiens
cuuucuacaacugauugcaaca

SEQ ID NO: 801046 - RNA, 16 nt, Homo sapiens
cuuucuacaggccagc

SEQ ID NO: 801047 - RNA, 21 nt, Homo sapiens
cuuucucaaucuugaacucau

SEQ ID NO: 801048 - RNA, 16 nt, Homo sapiens
cuuucuccugugccca

SEQ ID NO: 801049 - RNA, 20 nt, Homo sapiens
cuuucugagaguuggcucag

SEQ ID NO: 801050 - RNA, 18 nt, Homo sapiens
cuuucugccaacuuuguu

SEQ ID NO: 801051 - RNA, 20 nt, Homo sapiens
cuuucugccagcaucugcag

SEQ ID NO: 801052 - RNA, 20 nt, Homo sapiens
cuuucugcuuacaaagacaa

SEQ ID NO: 801053 - RNA, 11 nt, Homo sapiens
cuuucugugac

SEQ ID NO: 801054 - RNA, 12 nt, Homo sapiens
cuuucuuugcac

SEQ ID NO: 801055 - RNA, 20 nt, Homo sapiens
cuuugaaacuccaugcaaac

SEQ ID NO: 801056 - RNA, 23 nt, Homo sapiens
cuuugaaacuccaugcaaaccau

SEQ ID NO: 801057 - RNA, 22 nt, Homo sapiens
cuuugaagaauauuuguaguua

SEQ ID NO: 801058 - RNA, 17 nt, Homo sapiens
cuuugaauacugugaaa

SEQ ID NO: 801059 - RNA, 22 nt, Homo sapiens
cuuugagaggaagggugaagcc

SEQ ID NO: 801060 - RNA, 20 nt, Homo sapiens
cuuugauccuucugagcucc

SEQ ID NO: 801061 - RNA, 17 nt, Homo sapiens
cuuugcaccaaagacau

SEQ ID NO: 801062 - RNA, 19 nt, Homo sapiens
cuuugcauguauuagcuca

SEQ ID NO: 801063 - RNA, 17 nt, Homo sapiens
cuuugcauugaauuugg

SEQ ID NO: 801064 - RNA, 16 nt, Homo sapiens
cuuugcccagacauuu

SEQ ID NO: 801065 - RNA, 22 nt, Homo sapiens
cuuugcccccgacggcugugac

SEQ ID NO: 801066 - RNA, 20 nt, Homo sapiens
cuuugccuucucuguucccu

SEQ ID NO: 801067 - RNA, 14 nt, Homo sapiens
cuuugcuauuguga

SEQ ID NO: 801068 - RNA, 18 nt, Homo sapiens
cuuugcucccugcaagaa

SEQ ID NO: 801069 - RNA, 16 nt, Homo sapiens
cuuugcucucuggcca

SEQ ID NO: 801070 - RNA, 14 nt, Homo sapiens
cuuugcugcacaaa

SEQ ID NO: 801071 - RNA, 20 nt, Homo sapiens
cuuugcugcacaaacaugaa

SEQ ID NO: 801072 - RNA, 16 nt, Homo sapiens
cuuugcugcuaugaaa

SEQ ID NO: 801073 - RNA, 20 nt, Homo sapiens
cuuugcugcuggugcuaaaa

SEQ ID NO: 801074 - RNA, 19 nt, Homo sapiens
cuuugcugguguagucuuu

SEQ ID NO: 801075 - RNA, 20 nt, Homo sapiens
cuuuggaaacaggaccacaa

SEQ ID NO: 801076 - RNA, 17 nt, Homo sapiens
cuuuggaacaagacagc

SEQ ID NO: 801077 - RNA, 14 nt, Homo sapiens
cuuuggcacugggg

SEQ ID NO: 801078 - RNA, 15 nt, Homo sapiens
cuuuggccauuccaa

SEQ ID NO: 801079 - RNA, 18 nt, Homo sapiens
cuuuggccccacuuugaa

SEQ ID NO: 801080 - RNA, 15 nt, Homo sapiens
cuuuggcgaccuccu

SEQ ID NO: 801081 - RNA, 23 nt, Homo sapiens
cuuuggggcauagaucagaagac

SEQ ID NO: 801082 - RNA, 20 nt, Homo sapiens
cuuuggguccauucagauga

SEQ ID NO: 801083 - RNA, 21 nt, Homo sapiens
cuuugggugccuuugccacaa

SEQ ID NO: 801084 - RNA, 11 nt, Homo sapiens
cuuuggugggg

SEQ ID NO: 801085 - RNA, 21 nt, Homo sapiens
cuuuguaagagcaaaagccuc

SEQ ID NO: 801086 - RNA, 17 nt, Homo sapiens
cuuuguaauauuuucca

SEQ ID NO: 801087 - RNA, 14 nt, Homo sapiens
cuuuguaccaucug

SEQ ID NO: 801088 - RNA, 20 nt, Homo sapiens
cuuuguagaguuuugucauu

SEQ ID NO: 801089 - RNA, 22 nt, Homo sapiens
cuuuguauuaugugucacaugg

SEQ ID NO: 801090 - RNA, 17 nt, Homo sapiens
cuuuguauuugguaaau

SEQ ID NO: 801091 - RNA, 22 nt, Homo sapiens
cuuugucaccacguggggcuca

SEQ ID NO: 801092 - RNA, 17 nt, Homo sapiens
cuuugucccguggcauu

SEQ ID NO: 801093 - RNA, 13 nt, Homo sapiens
cuuugucuugccc

SEQ ID NO: 801094 - RNA, 17 nt, Homo sapiens
cuuugugauuccaugga

SEQ ID NO: 801095 - RNA, 15 nt, Homo sapiens
cuuugugcuugucau

SEQ ID NO: 801096 - RNA, 15 nt, Homo sapiens
cuuugugguagcuua

SEQ ID NO: 801097 - RNA, 20 nt, Homo sapiens
cuuuguguagaaagccaaau

SEQ ID NO: 801098 - RNA, 15 nt, Homo sapiens
cuuuguguccagagu

SEQ ID NO: 801099 - RNA, 15 nt, Homo sapiens
cuuuguucugugauu

SEQ ID NO: 801100 - RNA, 11 nt, Homo sapiens
cuuuguugccc

SEQ ID NO: 801101 - RNA, 19 nt, Homo sapiens
cuuuguuuuuuaauguugu

SEQ ID NO: 801102 - RNA, 22 nt, Homo sapiens
cuuuuaaaaacuagagcacaga

SEQ ID NO: 801103 - RNA, 15 nt, Homo sapiens
cuuuuaacccagugu

SEQ ID NO: 801104 - RNA, 21 nt, Homo sapiens
cuuuuaacuuuauaaauccag

SEQ ID NO: 801105 - RNA, 15 nt, Homo sapiens
cuuuuaagaaacaca

SEQ ID NO: 801106 - RNA, 22 nt, Homo sapiens
cuuuuaaggcuaaaacuuaaca

SEQ ID NO: 801107 - RNA, 23 nt, Homo sapiens
cuuuuaaguugcugaugaacucu

SEQ ID NO: 801108 - RNA, 17 nt, Homo sapiens
cuuuuaaucaacuguag

SEQ ID NO: 801109 - RNA, 17 nt, Homo sapiens
cuuuuaaugcuucauuc

SEQ ID NO: 801110 - RNA, 12 nt, Homo sapiens
cuuuuacauucu

SEQ ID NO: 801111 - RNA, 19 nt, Homo sapiens
cuuuuauuuagggccuuuu

SEQ ID NO: 801112 - RNA, 19 nt, Homo sapiens
cuuuuauuuuacacagaaa

SEQ ID NO: 801113 - RNA, 23 nt, Homo sapiens
cuuuuauuuuuuaagguaacaaa

SEQ ID NO: 801114 - RNA, 18 nt, Homo sapiens
cuuuucaaucuucuacuu

SEQ ID NO: 801115 - RNA, 21 nt, Homo sapiens
cuuuucaccaaugagccuuag

SEQ ID NO: 801116 - RNA, 16 nt, Homo sapiens
cuuuucaccaggggug

SEQ ID NO: 801117 - RNA, 21 nt, Homo sapiens
cuuuucaccaggggugcucac

SEQ ID NO: 801118 - RNA, 15 nt, Homo sapiens
cuuuucagcugaggu

SEQ ID NO: 801119 - RNA, 17 nt, Homo sapiens
cuuuucaucuaauguga

SEQ ID NO: 801120 - RNA, 15 nt, Homo sapiens
cuuuucaugauuuua

SEQ ID NO: 801121 - RNA, 18 nt, Homo sapiens
cuuuucauuaaagaaugu

SEQ ID NO: 801122 - RNA, 12 nt, Homo sapiens
cuuuucauuuaa

SEQ ID NO: 801123 - RNA, 16 nt, Homo sapiens
cuuuuccacuccauug

SEQ ID NO: 801124 - RNA, 14 nt, Homo sapiens
cuuuuccagaguau

SEQ ID NO: 801125 - RNA, 16 nt, Homo sapiens
cuuuuccccaguccca

SEQ ID NO: 801126 - RNA, 19 nt, Homo sapiens
cuuuuccugauaaagcaca

SEQ ID NO: 801127 - RNA, 22 nt, Homo sapiens
cuuuuccugcucccuaaccuuu

SEQ ID NO: 801128 - RNA, 19 nt, Homo sapiens
cuuuucggucuuucccauu

SEQ ID NO: 801129 - RNA, 19 nt, Homo sapiens
cuuuucucacaaaaaggca

SEQ ID NO: 801130 - RNA, 14 nt, Homo sapiens
cuuuucucaggacc

SEQ ID NO: 801131 - RNA, 13 nt, Homo sapiens
cuuuucugaauua

SEQ ID NO: 801132 - RNA, 16 nt, Homo sapiens
cuuuucugaucugcag

SEQ ID NO: 801133 - RNA, 22 nt, Homo sapiens
cuuuucugccugcuccugcuua

SEQ ID NO: 801134 - RNA, 21 nt, Homo sapiens
cuuuucuggcaaaaaggagcc

SEQ ID NO: 801135 - RNA, 23 nt, Homo sapiens
cuuuucuggccaaaagcaguaaa

SEQ ID NO: 801136 - RNA, 22 nt, Homo sapiens
cuuuucuuuuuuuuuuacuuuu

SEQ ID NO: 801137 - RNA, 15 nt, Homo sapiens
cuuuugaacuuguca

SEQ ID NO: 801138 - RNA, 21 nt, Homo sapiens
cuuuugaauuaugcuuuguag

SEQ ID NO: 801139 - RNA, 18 nt, Homo sapiens
cuuuugaauuuuugguua

SEQ ID NO: 801140 - RNA, 20 nt, Homo sapiens
cuuuugacacugcucuaaca

SEQ ID NO: 801141 - RNA, 15 nt, Homo sapiens
cuuuugaccaaauaa

SEQ ID NO: 801142 - RNA, 21 nt, Homo sapiens
cuuuugagcuauucaccucag

SEQ ID NO: 801143 - RNA, 20 nt, Homo sapiens
cuuuugaggggcugacuuca

SEQ ID NO: 801144 - RNA, 23 nt, Homo sapiens
cuuuugaugccaggugcaaucua

SEQ ID NO: 801145 - RNA, 15 nt, Homo sapiens
cuuuugcacaaggaa

SEQ ID NO: 801146 - RNA, 11 nt, Homo sapiens
cuuuugcacau

SEQ ID NO: 801147 - RNA, 19 nt, Homo sapiens
cuuuugccaguauuaugca

SEQ ID NO: 801148 - RNA, 13 nt, Homo sapiens
cuuuugcuugcaa

SEQ ID NO: 801149 - RNA, 16 nt, Homo sapiens
cuuuuggaacauuucu

SEQ ID NO: 801150 - RNA, 15 nt, Homo sapiens
cuuuuguaagacauu

SEQ ID NO: 801151 - RNA, 15 nt, Homo sapiens
cuuuuguaccaaaua

SEQ ID NO: 801152 - RNA, 20 nt, Homo sapiens
gaggugggauccucccucau

SEQ ID NO: 801153 - RNA, 13 nt, Homo sapiens
gagguugaagcua

SEQ ID NO: 801154 - RNA, 16 nt, Homo sapiens
gagguuugcacuuccu

SEQ ID NO: 801155 - RNA, 18 nt, Homo sapiens
gagguuuggaagagugaa

SEQ ID NO: 801156 - RNA, 15 nt, Homo sapiens
gaguaaauacaggua

SEQ ID NO: 801157 - RNA, 16 nt, Homo sapiens
gaguaaauacagguag

SEQ ID NO: 801158 - RNA, 18 nt, Homo sapiens
gaguaaauauauauguca

SEQ ID NO: 801159 - RNA, 13 nt, Homo sapiens
gaguaacaauaca

SEQ ID NO: 801160 - RNA, 17 nt, Homo sapiens
gaguaacaggugccuuc

SEQ ID NO: 801161 - RNA, 12 nt, Homo sapiens
gaguaagccagu

SEQ ID NO: 801162 - RNA, 12 nt, Homo sapiens
gaguaagggaag

SEQ ID NO: 801163 - RNA, 18 nt, Homo sapiens
gaguaauacaucaaagag

SEQ ID NO: 801164 - RNA, 16 nt, Homo sapiens
gaguacaaggucauca

SEQ ID NO: 801165 - RNA, 19 nt, Homo sapiens
gaguaccuacugugugcca

SEQ ID NO: 801166 - RNA, 15 nt, Homo sapiens
gaguagauacucuca

SEQ ID NO: 801167 - RNA, 12 nt, Homo sapiens
gaguagcuggau

SEQ ID NO: 801168 - RNA, 22 nt, Homo sapiens
gagucaauccccucauucagga

SEQ ID NO: 801169 - RNA, 14 nt, Homo sapiens
gagucacacagugu

SEQ ID NO: 801170 - RNA, 23 nt, Homo sapiens
gagucacccaugaagacaggaca

SEQ ID NO: 801171 - RNA, 23 nt, Homo sapiens
gagucaccuccuccacucacucc

SEQ ID NO: 801172 - RNA, 12 nt, Homo sapiens
gagucacugccu

SEQ ID NO: 801173 - RNA, 18 nt, Homo sapiens
gagucagcugcugacccu

SEQ ID NO: 801174 - RNA, 19 nt, Homo sapiens
gagucaggcuucucuugcu

SEQ ID NO: 801175 - RNA, 13 nt, Homo sapiens
gagucagugcauu

SEQ ID NO: 801176 - RNA, 18 nt, Homo sapiens
gagucauggcuaauuuaa

SEQ ID NO: 801177 - RNA, 14 nt, Homo sapiens
gaguccacuuuguu

SEQ ID NO: 801178 - RNA, 17 nt, Homo sapiens
gaguccaggguggauga

SEQ ID NO: 801179 - RNA, 22 nt, Homo sapiens
gaguccaggguggaugaucuca

SEQ ID NO: 801180 - RNA, 19 nt, Homo sapiens
gagucccacggaaugggga

SEQ ID NO: 801181 - RNA, 16 nt, Homo sapiens
gagucccuccaaaggg

SEQ ID NO: 801182 - RNA, 15 nt, Homo sapiens
gaguccuaggacuua

SEQ ID NO: 801183 - RNA, 16 nt, Homo sapiens
gaguccuaggacuuaa

SEQ ID NO: 801184 - RNA, 16 nt, Homo sapiens
gaguccuuucuuccau

SEQ ID NO: 801185 - RNA, 17 nt, Homo sapiens
gagucggccaccacaga

SEQ ID NO: 801186 - RNA, 13 nt, Homo sapiens
gagucuagauuca

SEQ ID NO: 801187 - RNA, 13 nt, Homo sapiens
gagucuagauucu

SEQ ID NO: 801188 - RNA, 12 nt, Homo sapiens
gagucuauguuc

SEQ ID NO: 801189 - RNA, 18 nt, Homo sapiens
gagucuauguucaaagac

SEQ ID NO: 801190 - RNA, 13 nt, Homo sapiens
gagucucaagggu

SEQ ID NO: 801191 - RNA, 20 nt, Homo sapiens
gagucucacuuugacaccca

SEQ ID NO: 801192 - RNA, 18 nt, Homo sapiens
gagucuccucucugagac

SEQ ID NO: 801193 - RNA, 18 nt, Homo sapiens
gagucugaacagcuguaa

SEQ ID NO: 801194 - RNA, 20 nt, Homo sapiens
gagucuguacuaaacaguaa

SEQ ID NO: 801195 - RNA, 18 nt, Homo sapiens
gagucuugcucuguuacc

SEQ ID NO: 801196 - RNA, 19 nt, Homo sapiens
gagucuuugguucuaagga

SEQ ID NO: 801197 - RNA, 17 nt, Homo sapiens
gagugagaacagcauuu

SEQ ID NO: 801198 - RNA, 15 nt, Homo sapiens
gagugagcaaggggg

SEQ ID NO: 801199 - RNA, 14 nt, Homo sapiens
gagugauccuccaa

SEQ ID NO: 801200 - RNA, 23 nt, Homo sapiens
gagugauugacacacagcacucu

SEQ ID NO: 801201 - RNA, 14 nt, Homo sapiens
gagugcaacccagu

SEQ ID NO: 801202 - RNA, 22 nt, Homo sapiens
gagugcaacccagucacacugu

SEQ ID NO: 801203 - RNA, 11 nt, Homo sapiens
gagugcagugg

SEQ ID NO: 801204 - RNA, 21 nt, Homo sapiens
gagugcaguggcaucaucuca

SEQ ID NO: 801205 - RNA, 19 nt, Homo sapiens
gagugcaguggcgugaucu

SEQ ID NO: 801206 - RNA, 16 nt, Homo sapiens
gagugcucaccgccuc

SEQ ID NO: 801207 - RNA, 12 nt, Homo sapiens
gaguggcccaag

SEQ ID NO: 801208 - RNA, 20 nt, Homo sapiens
gaguggcucacccuguccag

SEQ ID NO: 801209 - RNA, 21 nt, Homo sapiens
gagugggcugggcccucuguc

SEQ ID NO: 801210 - RNA, 21 nt, Homo sapiens
gagugggguuuucuugaacau

SEQ ID NO: 801211 - RNA, 17 nt, Homo sapiens
gaguggucgagugacac

SEQ ID NO: 801212 - RNA, 13 nt, Homo sapiens
gaguggucuucaa

SEQ ID NO: 801213 - RNA, 19 nt, Homo sapiens
gagugucaugaagugcaca

SEQ ID NO: 801214 - RNA, 21 nt, Homo sapiens
gaguguccggcugaggccuga

SEQ ID NO: 801215 - RNA, 13 nt, Homo sapiens
gagugugcugcua

SEQ ID NO: 801216 - RNA, 13 nt, Homo sapiens
gaguguguggucu

SEQ ID NO: 801217 - RNA, 15 nt, Homo sapiens
gaguuaacugugaaa

SEQ ID NO: 801218 - RNA, 14 nt, Homo sapiens
gaguuacaguucug

SEQ ID NO: 801219 - RNA, 21 nt, Homo sapiens
gaguuaccacuuuccacuccc

SEQ ID NO: 801220 - RNA, 14 nt, Homo sapiens
gaguucagguugcc

SEQ ID NO: 801221 - RNA, 20 nt, Homo sapiens
gaguucccuaaacaaaagca

SEQ ID NO: 801222 - RNA, 9 nt, Homo sapiens
gaguucucu

SEQ ID NO: 801223 - RNA, 14 nt, Homo sapiens
gaguugacucggug

SEQ ID NO: 801224 - RNA, 20 nt, Homo sapiens
gaguugccaggcacuuugag

SEQ ID NO: 801225 - RNA, 23 nt, Homo sapiens
gaguuggacuucagucuugccua

SEQ ID NO: 801226 - RNA, 16 nt, Homo sapiens
gaguuggcaugacucu

SEQ ID NO: 801227 - RNA, 22 nt, Homo sapiens
gaguuggcaugacucuugacuc

SEQ ID NO: 801228 - RNA, 18 nt, Homo sapiens
gaguugggacaauugcuu

SEQ ID NO: 801229 - RNA, 23 nt, Homo sapiens
gaguuggggccauugcuuaccuu

SEQ ID NO: 801230 - RNA, 21 nt, Homo sapiens
gaguuuagugugauaaaggca

SEQ ID NO: 801231 - RNA, 20 nt, Homo sapiens
gaguuugugucuguugcuug

SEQ ID NO: 801232 - RNA, 20 nt, Homo sapiens
gaguuuguguguauuuguau

SEQ ID NO: 801233 - RNA, 23 nt, Homo sapiens
gauaaaacacuaacuuaaugugu

SEQ ID NO: 801234 - RNA, 12 nt, Homo sapiens
gauaaaccaaaa

SEQ ID NO: 801235 - RNA, 14 nt, Homo sapiens
gauaaaccaguuga

SEQ ID NO: 801236 - RNA, 18 nt, Homo sapiens
gauaaacucagaucugau

SEQ ID NO: 801237 - RNA, 16 nt, Homo sapiens
gauaaagcaguauuug

SEQ ID NO: 801238 - RNA, 15 nt, Homo sapiens
gauaaaguuccuuaa

SEQ ID NO: 801239 - RNA, 18 nt, Homo sapiens
gauaaauccaucacuaua

SEQ ID NO: 801240 - RNA, 17 nt, Homo sapiens
gauaacauacuucuuac

SEQ ID NO: 801241 - RNA, 19 nt, Homo sapiens
gauaagaaaugaucuuuac

SEQ ID NO: 801242 - RNA, 19 nt, Homo sapiens
gauaagccacucugucccu

SEQ ID NO: 801243 - RNA, 14 nt, Homo sapiens
gauaaggcucugaa

SEQ ID NO: 801244 - RNA, 12 nt, Homo sapiens
gauaagguuaua

SEQ ID NO: 801245 - RNA, 19 nt, Homo sapiens
gauaaguggggacuagugu

SEQ ID NO: 801246 - RNA, 24 nt, Homo sapiens
gauaauauccagccucccacaaga

SEQ ID NO: 801247 - RNA, 12 nt, Homo sapiens
gauaauucuuaa

SEQ ID NO: 801248 - RNA, 20 nt, Homo sapiens
gauacaaugaacacuuauaa

SEQ ID NO: 801249 - RNA, 17 nt, Homo sapiens
gauacacugaaaggaaa

SEQ ID NO: 801250 - RNA, 23 nt, Homo sapiens
gauacacugaaguuaacagagac

SEQ ID NO: 801251 - RNA, 18 nt, Homo sapiens
gauacagaaaugcaaaag

SEQ ID NO: 801252 - RNA, 21 nt, Homo sapiens
gauacagacauucaaugaauu

SEQ ID NO: 801253 - RNA, 18 nt, Homo sapiens
gauacauaaacuuuugca

SEQ ID NO: 801254 - RNA, 12 nt, Homo sapiens
gauacauuuaau

SEQ ID NO: 801255 - RNA, 13 nt, Homo sapiens
gauaccacugcac

SEQ ID NO: 801256 - RNA, 22 nt, Homo sapiens
gauaccuguaguggaacuaaaa

SEQ ID NO: 801257 - RNA, 22 nt, Homo sapiens
gauacugcucaucauuccuuga

SEQ ID NO: 801258 - RNA, 13 nt, Homo sapiens
gauacugcugagu

SEQ ID NO: 801259 - RNA, 16 nt, Homo sapiens
gauacugcuuuucacc

SEQ ID NO: 801260 - RNA, 21 nt, Homo sapiens
gauacuuggaugcagcucuug

SEQ ID NO: 801261 - RNA, 17 nt, Homo sapiens
gauacuuuagccaucau

SEQ ID NO: 801262 - RNA, 11 nt, Homo sapiens
gauacuuugac

SEQ ID NO: 801263 - RNA, 14 nt, Homo sapiens
gauagaagauuguu

SEQ ID NO: 801264 - RNA, 20 nt, Homo sapiens
gauagaagauuguuggugaa

SEQ ID NO: 801265 - RNA, 16 nt, Homo sapiens
gauagaaugauguuuu

SEQ ID NO: 801266 - RNA, 18 nt, Homo sapiens
gauagacagguccugauu

SEQ ID NO: 801267 - RNA, 12 nt, Homo sapiens
gcaaugugcuac

SEQ ID NO: 801268 - RNA, 13 nt, Homo sapiens
gcaauuguggaag

SEQ ID NO: 801269 - RNA, 21 nt, Homo sapiens
gcaauuuaauauuuugcacag

SEQ ID NO: 801270 - RNA, 20 nt, Homo sapiens
gcacaaaagcagauacuuga

SEQ ID NO: 801271 - RNA, 16 nt, Homo sapiens
gcacaaagcccauagc

SEQ ID NO: 801272 - RNA, 13 nt, Homo sapiens
gcacaagccagac

SEQ ID NO: 801273 - RNA, 15 nt, Homo sapiens
gcacaagccagaccc

SEQ ID NO: 801274 - RNA, 12 nt, Homo sapiens
gcacaaggaaau

SEQ ID NO: 801275 - RNA, 13 nt, Homo sapiens
gcacaaggccuug

SEQ ID NO: 801276 - RNA, 16 nt, Homo sapiens
gcacaaggcugaccaa

SEQ ID NO: 801277 - RNA, 15 nt, Homo sapiens
gcacaauaugggcac

SEQ ID NO: 801278 - RNA, 20 nt, Homo sapiens
gcacaaugucaugucuguga

SEQ ID NO: 801279 - RNA, 15 nt, Homo sapiens
gcacacacaaaccua

SEQ ID NO: 801280 - RNA, 22 nt, Homo sapiens
gcacacacacauaagcacugaa

SEQ ID NO: 801281 - RNA, 23 nt, Homo sapiens
gcacacauugaagguauaugcca

SEQ ID NO: 801282 - RNA, 17 nt, Homo sapiens
gcacacccgugugcaca

SEQ ID NO: 801283 - RNA, 20 nt, Homo sapiens
gcacaccucagccccacuga

SEQ ID NO: 801284 - RNA, 18 nt, Homo sapiens
gcacacuccccugcacug

SEQ ID NO: 801285 - RNA, 12 nt, Homo sapiens
gcacacuggaau

SEQ ID NO: 801286 - RNA, 21 nt, Homo sapiens
gcacagaaggaaucugugcag

SEQ ID NO: 801287 - RNA, 11 nt, Homo sapiens
gcacagccacc

SEQ ID NO: 801288 - RNA, 12 nt, Homo sapiens
gcacagccaccc

SEQ ID NO: 801289 - RNA, 14 nt, Homo sapiens
gcacagcugcauua

SEQ ID NO: 801290 - RNA, 19 nt, Homo sapiens
gcacaggcaagaguguucu

SEQ ID NO: 801291 - RNA, 14 nt, Homo sapiens
gcacaggcagaugu

SEQ ID NO: 801292 - RNA, 22 nt, Homo sapiens
gcacaggcagauguuugccuca

SEQ ID NO: 801293 - RNA, 21 nt, Homo sapiens
gcacaggcgcaucccaggccu

SEQ ID NO: 801294 - RNA, 18 nt, Homo sapiens
gcacagggggaggccaua

SEQ ID NO: 801295 - RNA, 16 nt, Homo sapiens
gcacagucugaugaca

SEQ ID NO: 801296 - RNA, 19 nt, Homo sapiens
gcacaguguaauccagggg

SEQ ID NO: 801297 - RNA, 22 nt, Homo sapiens
gcacauaaacucuuuuaucucc

SEQ ID NO: 801298 - RNA, 21 nt, Homo sapiens
gcacauauccaggcaccagga

SEQ ID NO: 801299 - RNA, 22 nt, Homo sapiens
gcacauauggaauuuugcaaag

SEQ ID NO: 801300 - RNA, 15 nt, Homo sapiens
gcacaucaauuacaa

SEQ ID NO: 801301 - RNA, 17 nt, Homo sapiens
gcacaucugcugugguc

SEQ ID NO: 801302 - RNA, 19 nt, Homo sapiens
gcacaugccuuaagccagu

SEQ ID NO: 801303 - RNA, 15 nt, Homo sapiens
gcacaugucuuguac

SEQ ID NO: 801304 - RNA, 20 nt, Homo sapiens
gcacauguuguucucauuga

SEQ ID NO: 801305 - RNA, 18 nt, Homo sapiens
gcacauuucauaguuuca

SEQ ID NO: 801306 - RNA, 10 nt, Homo sapiens
gcaccaaaga

SEQ ID NO: 801307 - RNA, 11 nt, Homo sapiens
gcaccaaagac

SEQ ID NO: 801308 - RNA, 16 nt, Homo sapiens
gcaccaacaucuacaa

SEQ ID NO: 801309 - RNA, 16 nt, Homo sapiens
gcaccaccaagccaag

SEQ ID NO: 801310 - RNA, 14 nt, Homo sapiens
gcaccacccuaguc

SEQ ID NO: 801311 - RNA, 10 nt, Homo sapiens
gcaccaccuc

SEQ ID NO: 801312 - RNA, 14 nt, Homo sapiens
gcaccacugcacuc

SEQ ID NO: 801313 - RNA, 15 nt, Homo sapiens
gcaccacuguguauu

SEQ ID NO: 801314 - RNA, 10 nt, Homo sapiens
gcaccagagg

SEQ ID NO: 801315 - RNA, 18 nt, Homo sapiens
gcaccagagggauaaaaa

SEQ ID NO: 801316 - RNA, 21 nt, Homo sapiens
gcaccaggcacgaacccaccu

SEQ ID NO: 801317 - RNA, 13 nt, Homo sapiens
gcaccaugcugcu

SEQ ID NO: 801318 - RNA, 13 nt, Homo sapiens
gcaccauucugac

SEQ ID NO: 801319 - RNA, 19 nt, Homo sapiens
gcaccauuucugucacuca

SEQ ID NO: 801320 - RNA, 16 nt, Homo sapiens
gcacccaacuagcucu

SEQ ID NO: 801321 - RNA, 22 nt, Homo sapiens
gcacccaugacaaucaccuuca

SEQ ID NO: 801322 - RNA, 18 nt, Homo sapiens
gcaccccacacuggagcc

SEQ ID NO: 801323 - RNA, 12 nt, Homo sapiens
gcaccccagugg

SEQ ID NO: 801324 - RNA, 13 nt, Homo sapiens
gcaccccaugcca

SEQ ID NO: 801325 - RNA, 17 nt, Homo sapiens
gcaccccccaagcuguu

SEQ ID NO: 801326 - RNA, 21 nt, Homo sapiens
gcacccggcucguguauuuau

SEQ ID NO: 801327 - RNA, 13 nt, Homo sapiens
gcacccuacaggg

SEQ ID NO: 801328 - RNA, 14 nt, Homo sapiens
gcaccgagaccaaa

SEQ ID NO: 801329 - RNA, 17 nt, Homo sapiens
gcaccuccagccugaac

SEQ ID NO: 801330 - RNA, 13 nt, Homo sapiens
gcaccucuuccuu

SEQ ID NO: 801331 - RNA, 20 nt, Homo sapiens
gcaccugagacccuacugaa

SEQ ID NO: 801332 - RNA, 22 nt, Homo sapiens
gcaccuggcuaguuucuaacau

SEQ ID NO: 801333 - RNA, 12 nt, Homo sapiens
gcaccugggauu

SEQ ID NO: 801334 - RNA, 14 nt, Homo sapiens
gcaccuucagacuu

SEQ ID NO: 801335 - RNA, 19 nt, Homo sapiens
gcaccuucccucucaccau

SEQ ID NO: 801336 - RNA, 15 nt, Homo sapiens
gcaccuuuugcacau

SEQ ID NO: 801337 - RNA, 18 nt, Homo sapiens
gcacgguggcucaggccu

SEQ ID NO: 801338 - RNA, 16 nt, Homo sapiens
gcacgucuugcuauuu

SEQ ID NO: 801339 - RNA, 18 nt, Homo sapiens
gcacucaaagcuuguuaa

SEQ ID NO: 801340 - RNA, 20 nt, Homo sapiens
gcacucaccucacuguucaa

SEQ ID NO: 801341 - RNA, 17 nt, Homo sapiens
gcacucagggagcauuu

SEQ ID NO: 801342 - RNA, 22 nt, Homo sapiens
gcacucugaguuuaccauuugu

SEQ ID NO: 801343 - RNA, 16 nt, Homo sapiens
gcacucugguggcagg

SEQ ID NO: 801344 - RNA, 19 nt, Homo sapiens
gcacugaaaauaccaucag

SEQ ID NO: 801345 - RNA, 24 nt, Homo sapiens
gcacugaaaucacuuuaccugcag

SEQ ID NO: 801346 - RNA, 18 nt, Homo sapiens
gcacugacagauuuccau

SEQ ID NO: 801347 - RNA, 14 nt, Homo sapiens
gcacugagggccac

SEQ ID NO: 801348 - RNA, 14 nt, Homo sapiens
gcacugaucaccca

SEQ ID NO: 801349 - RNA, 22 nt, Homo sapiens
gcacugggcucugauggcugcu

SEQ ID NO: 801350 - RNA, 13 nt, Homo sapiens
gcacuggggccac

SEQ ID NO: 801351 - RNA, 19 nt, Homo sapiens
gcacuggggccacccagcc

SEQ ID NO: 801352 - RNA, 15 nt, Homo sapiens
gcacuggugggccau

SEQ ID NO: 801353 - RNA, 18 nt, Homo sapiens
gcacugugaagacccagc

SEQ ID NO: 801354 - RNA, 13 nt, Homo sapiens
gcacugugucauc

SEQ ID NO: 801355 - RNA, 23 nt, Homo sapiens
gcacuuauaagaaagaucaaaga

SEQ ID NO: 801356 - RNA, 16 nt, Homo sapiens
gcacuugugcuuucag

SEQ ID NO: 801357 - RNA, 17 nt, Homo sapiens
gcacuuugggaggccaa

SEQ ID NO: 801358 - RNA, 20 nt, Homo sapiens
gcagaaauccugcaaugaaa

SEQ ID NO: 801359 - RNA, 23 nt, Homo sapiens
gcagaaauuuaucuuucaaagag

SEQ ID NO: 801360 - RNA, 13 nt, Homo sapiens
gcagaagaagcug

SEQ ID NO: 801361 - RNA, 19 nt, Homo sapiens
gcagaagccaaucauuuca

SEQ ID NO: 801362 - RNA, 13 nt, Homo sapiens
gcagaaguauucu

SEQ ID NO: 801363 - RNA, 22 nt, Homo sapiens
gcagaagucaacgccucggugg

SEQ ID NO: 801364 - RNA, 20 nt, Homo sapiens
gcagaauguuguacuugaaa

SEQ ID NO: 801365 - RNA, 18 nt, Homo sapiens
gcagaauucaaaagugau

SEQ ID NO: 801366 - RNA, 13 nt, Homo sapiens
gcagacaccagca

SEQ ID NO: 801367 - RNA, 14 nt, Homo sapiens
gcagacaccagcag

SEQ ID NO: 801368 - RNA, 21 nt, Homo sapiens
gcagacaccagcagcccuguc

SEQ ID NO: 801369 - RNA, 15 nt, Homo sapiens
gcagacacuaaagac

SEQ ID NO: 801370 - RNA, 19 nt, Homo sapiens
gcagacaggugugcagauu

SEQ ID NO: 801371 - RNA, 19 nt, Homo sapiens
gcagacauagaagagccaa

SEQ ID NO: 801372 - RNA, 15 nt, Homo sapiens
gcagacucgggacca

SEQ ID NO: 801373 - RNA, 16 nt, Homo sapiens
gcagacucgggaccaa

SEQ ID NO: 801374 - RNA, 16 nt, Homo sapiens
gcagacugauuggccu

SEQ ID NO: 801375 - RNA, 15 nt, Homo sapiens
gcagagacacuuugu

SEQ ID NO: 801376 - RNA, 22 nt, Homo sapiens
gcagagagguggagaacuggga

SEQ ID NO: 801377 - RNA, 15 nt, Homo sapiens
gcagagaugacuguc

SEQ ID NO: 801378 - RNA, 18 nt, Homo sapiens
gcagagcaugaccugagg

SEQ ID NO: 801379 - RNA, 17 nt, Homo sapiens
gcagagcauucagacuc

SEQ ID NO: 801380 - RNA, 21 nt, Homo sapiens
gcagagccacagcugugcaug

SEQ ID NO: 801381 - RNA, 15 nt, Homo sapiens
gcagaggcaacacug

SEQ ID NO: 801382 - RNA, 21 nt, Homo sapiens
gcagagggagguagaagccau

SEQ ID NO: 801383 - RNA, 14 nt, Homo sapiens
gcccacacccaggc

SEQ ID NO: 801384 - RNA, 13 nt, Homo sapiens
gcccacaucccag

SEQ ID NO: 801385 - RNA, 22 nt, Homo sapiens
gcccacauguguccaucccagc

SEQ ID NO: 801386 - RNA, 14 nt, Homo sapiens
gcccaccaccuguc

SEQ ID NO: 801387 - RNA, 17 nt, Homo sapiens
gcccacggcucaaguga

SEQ ID NO: 801388 - RNA, 19 nt, Homo sapiens
gcccacuguccugggccug

SEQ ID NO: 801389 - RNA, 21 nt, Homo sapiens
gcccagaaaaccuccaguagu

SEQ ID NO: 801390 - RNA, 22 nt, Homo sapiens
gcccagaaaucugggauguacu

SEQ ID NO: 801391 - RNA, 12 nt, Homo sapiens
gcccagacuaca

SEQ ID NO: 801392 - RNA, 17 nt, Homo sapiens
gcccagagcccagcucc

SEQ ID NO: 801393 - RNA, 17 nt, Homo sapiens
gcccagaugaucacuga

SEQ ID NO: 801394 - RNA, 13 nt, Homo sapiens
gcccagaugcucu

SEQ ID NO: 801395 - RNA, 14 nt, Homo sapiens
gcccagcaccugcu

SEQ ID NO: 801396 - RNA, 22 nt, Homo sapiens
gcccagcaccugcucccagugg

SEQ ID NO: 801397 - RNA, 11 nt, Homo sapiens
gcccagcacug

SEQ ID NO: 801398 - RNA, 15 nt, Homo sapiens
gcccagcacuugaau

SEQ ID NO: 801399 - RNA, 13 nt, Homo sapiens
gcccagcaggggc

SEQ ID NO: 801400 - RNA, 19 nt, Homo sapiens
gcccagcaggggcccucac

SEQ ID NO: 801401 - RNA, 20 nt, Homo sapiens
gcccagcgcucuccuggacg

SEQ ID NO: 801402 - RNA, 13 nt, Homo sapiens
gcccagcggcccc

SEQ ID NO: 801403 - RNA, 16 nt, Homo sapiens
gcccagcuacauuccu

SEQ ID NO: 801404 - RNA, 14 nt, Homo sapiens
gcccagcugcaccu

SEQ ID NO: 801405 - RNA, 16 nt, Homo sapiens
gcccagcugcaccugc

SEQ ID NO: 801406 - RNA, 22 nt, Homo sapiens
gcccagcugcucagugcaacug

SEQ ID NO: 801407 - RNA, 21 nt, Homo sapiens
gcccaggaucguuuuuuccca

SEQ ID NO: 801408 - RNA, 20 nt, Homo sapiens
gcccaggauggagugcaaug

SEQ ID NO: 801409 - RNA, 17 nt, Homo sapiens
gcccaggauggcuuuga

SEQ ID NO: 801410 - RNA, 14 nt, Homo sapiens
gcccaggcacuggg

SEQ ID NO: 801411 - RNA, 18 nt, Homo sapiens
gcccaggccagagugcag

SEQ ID NO: 801412 - RNA, 20 nt, Homo sapiens
gcccaggccagagugcagug

SEQ ID NO: 801413 - RNA, 19 nt, Homo sapiens
gcccaggcuggagugcagu

SEQ ID NO: 801414 - RNA, 20 nt, Homo sapiens
gcccaggcuggaguggagug

SEQ ID NO: 801415 - RNA, 19 nt, Homo sapiens
gcccagggccacucugccu

SEQ ID NO: 801416 - RNA, 22 nt, Homo sapiens
gcccagguucgagacccaaacc

SEQ ID NO: 801417 - RNA, 15 nt, Homo sapiens
gcccagucgacccca

SEQ ID NO: 801418 - RNA, 12 nt, Homo sapiens
gcccagugcaaa

SEQ ID NO: 801419 - RNA, 13 nt, Homo sapiens
gcccagugcaaac

SEQ ID NO: 801420 - RNA, 17 nt, Homo sapiens
gcccagugcacugaaag

SEQ ID NO: 801421 - RNA, 11 nt, Homo sapiens
gcccagugcau

SEQ ID NO: 801422 - RNA, 19 nt, Homo sapiens
gcccagugcauaugcaaug

SEQ ID NO: 801423 - RNA, 14 nt, Homo sapiens
gcccaguguucucc

SEQ ID NO: 801424 - RNA, 21 nt, Homo sapiens
gcccaguguuguuuguaaaua

SEQ ID NO: 801425 - RNA, 16 nt, Homo sapiens
gcccauagaaacauga

SEQ ID NO: 801426 - RNA, 22 nt, Homo sapiens
gcccaucaggcaguguuaccug

SEQ ID NO: 801427 - RNA, 18 nt, Homo sapiens
gcccauccccaggcaccu

SEQ ID NO: 801428 - RNA, 20 nt, Homo sapiens
gcccaugcaauuuuauuaaa

SEQ ID NO: 801429 - RNA, 20 nt, Homo sapiens
gcccaugcuaugaguuuucu

SEQ ID NO: 801430 - RNA, 17 nt, Homo sapiens
gcccaugcugagcucau

SEQ ID NO: 801431 - RNA, 21 nt, Homo sapiens
gcccauggugagcucugggaa

SEQ ID NO: 801432 - RNA, 17 nt, Homo sapiens
gcccaugugcaccugcc

SEQ ID NO: 801433 - RNA, 16 nt, Homo sapiens
gcccauuucuccauac

SEQ ID NO: 801434 - RNA, 20 nt, Homo sapiens
gcccauuuuucuagacuguc

SEQ ID NO: 801435 - RNA, 19 nt, Homo sapiens
gccccacagggcaaggaca

SEQ ID NO: 801436 - RNA, 22 nt, Homo sapiens
gccccacauguccagcaccuug

SEQ ID NO: 801437 - RNA, 18 nt, Homo sapiens
gccccacugacacccagu

SEQ ID NO: 801438 - RNA, 20 nt, Homo sapiens
gccccacugacacccagugu

SEQ ID NO: 801439 - RNA, 12 nt, Homo sapiens
gccccacugcca

SEQ ID NO: 801440 - RNA, 13 nt, Homo sapiens
gccccacuugaag

SEQ ID NO: 801441 - RNA, 14 nt, Homo sapiens
gccccagaucugcc

SEQ ID NO: 801442 - RNA, 15 nt, Homo sapiens
gccccagcaccaacc

SEQ ID NO: 801443 - RNA, 23 nt, Homo sapiens
gccccagcacuaaagcaguggac

SEQ ID NO: 801444 - RNA, 16 nt, Homo sapiens
gccccagccccuucca

SEQ ID NO: 801445 - RNA, 16 nt, Homo sapiens
gccccaggaucacucu

SEQ ID NO: 801446 - RNA, 14 nt, Homo sapiens
gccccaggcugaga

SEQ ID NO: 801447 - RNA, 16 nt, Homo sapiens
gccccagucggcccca

SEQ ID NO: 801448 - RNA, 18 nt, Homo sapiens
gccccaucagcuccagcu

SEQ ID NO: 801449 - RNA, 20 nt, Homo sapiens
gccccauccaacacuggaug

SEQ ID NO: 801450 - RNA, 23 nt, Homo sapiens
gccccauccuguguuaucugugg

SEQ ID NO: 801451 - RNA, 13 nt, Homo sapiens
gccccauguaucu

SEQ ID NO: 801452 - RNA, 13 nt, Homo sapiens
gcccccacugacc

SEQ ID NO: 801453 - RNA, 18 nt, Homo sapiens
gcccccaggggcaggacu

SEQ ID NO: 801454 - RNA, 20 nt, Homo sapiens
gcccccaguaucucuucagu

SEQ ID NO: 801455 - RNA, 14 nt, Homo sapiens
gcccccaucaccca

SEQ ID NO: 801456 - RNA, 20 nt, Homo sapiens
gccccccuugccagacaugu

SEQ ID NO: 801457 - RNA, 20 nt, Homo sapiens
gcccccgccugccaccggag

SEQ ID NO: 801458 - RNA, 22 nt, Homo sapiens
gcccccuccaggagagagccag

SEQ ID NO: 801459 - RNA, 21 nt, Homo sapiens
gcccccuucaagccugugcaa

SEQ ID NO: 801460 - RNA, 18 nt, Homo sapiens
gccccuauugagaaguuu

SEQ ID NO: 801461 - RNA, 13 nt, Homo sapiens
gccccuccaaacc

SEQ ID NO: 801462 - RNA, 16 nt, Homo sapiens
gccccuccagcacaca

SEQ ID NO: 801463 - RNA, 15 nt, Homo sapiens
gccccuccagcacca

SEQ ID NO: 801464 - RNA, 18 nt, Homo sapiens
gccccuccgaugcugagg

SEQ ID NO: 801465 - RNA, 18 nt, Homo sapiens
gccccucgcugcugcuac

SEQ ID NO: 801466 - RNA, 14 nt, Homo sapiens
gccccucucaccaa

SEQ ID NO: 801467 - RNA, 14 nt, Homo sapiens
gccccucugaccug

SEQ ID NO: 801468 - RNA, 17 nt, Homo sapiens
gccccucugaccugcac

SEQ ID NO: 801469 - RNA, 22 nt, Homo sapiens
gccccucuuccccaaugcucca

SEQ ID NO: 801470 - RNA, 16 nt, Homo sapiens
gccccuggcacucuug

SEQ ID NO: 801471 - RNA, 23 nt, Homo sapiens
gccccugguuaagggagaucugg

SEQ ID NO: 801472 - RNA, 19 nt, Homo sapiens
gccccugucucggggcuug

SEQ ID NO: 801473 - RNA, 22 nt, Homo sapiens
gccccuuacuaugaucucagga

SEQ ID NO: 801474 - RNA, 15 nt, Homo sapiens
gccccuuccauggua

SEQ ID NO: 801475 - RNA, 13 nt, Homo sapiens
gcccgaaaagcau

SEQ ID NO: 801476 - RNA, 19 nt, Homo sapiens
gcccgcagugcugggacca

SEQ ID NO: 801477 - RNA, 15 nt, Homo sapiens
gcccgcuagcauuag

SEQ ID NO: 801478 - RNA, 18 nt, Homo sapiens
gcccggaccuccaucaga

SEQ ID NO: 801479 - RNA, 19 nt, Homo sapiens
gcccggugguuugccaugu

SEQ ID NO: 801480 - RNA, 19 nt, Homo sapiens
gcccguaaucccagcuacu

SEQ ID NO: 801481 - RNA, 20 nt, Homo sapiens
gcccgucauguuccucaaaa

SEQ ID NO: 801482 - RNA, 21 nt, Homo sapiens
gcccgucauguuccucaaaag

SEQ ID NO: 801483 - RNA, 16 nt, Homo sapiens
gcccgucggagcugcc

SEQ ID NO: 801484 - RNA, 15 nt, Homo sapiens
gcccuaaaaugacaa

SEQ ID NO: 801485 - RNA, 15 nt, Homo sapiens
gcccuacaaaggcua

SEQ ID NO: 801486 - RNA, 17 nt, Homo sapiens
gcccuagaugcacgugg

SEQ ID NO: 801487 - RNA, 23 nt, Homo sapiens
gcccuauggauuugaaguuugcc

SEQ ID NO: 801488 - RNA, 20 nt, Homo sapiens
gcccucagaagaaaacuuuu

SEQ ID NO: 801489 - RNA, 20 nt, Homo sapiens
gcccucauacccaugcacag

SEQ ID NO: 801490 - RNA, 19 nt, Homo sapiens
gcccucaugaucauucuca

SEQ ID NO: 801491 - RNA, 17 nt, Homo sapiens
gcccuccucccugucau

SEQ ID NO: 801492 - RNA, 18 nt, Homo sapiens
gcccuccucugcacuccc

SEQ ID NO: 801493 - RNA, 15 nt, Homo sapiens
gcccuccucugucaa

SEQ ID NO: 801494 - RNA, 17 nt, Homo sapiens
gcccuccuuagaccuga

SEQ ID NO: 801495 - RNA, 22 nt, Homo sapiens
gcccucuacagccugacuuucu

SEQ ID NO: 801496 - RNA, 15 nt, Homo sapiens
gcccucucucugggc

SEQ ID NO: 801497 - RNA, 20 nt, Homo sapiens
gcccucugaacuugccuuaa

SEQ ID NO: 801498 - RNA, 16 nt, Homo sapiens
gcggcuuucacugcug

SEQ ID NO: 801499 - RNA, 19 nt, Homo sapiens
gcggcuuucacugcugagu

SEQ ID NO: 801500 - RNA, 16 nt, Homo sapiens
gcgggacucuguccaa

SEQ ID NO: 801501 - RNA, 13 nt, Homo sapiens
gcgggacugcugg

SEQ ID NO: 801502 - RNA, 18 nt, Homo sapiens
gcgggagggccugcagug

SEQ ID NO: 801503 - RNA, 22 nt, Homo sapiens
gcgggauuuaugugcacugccu

SEQ ID NO: 801504 - RNA, 18 nt, Homo sapiens
gcgggccagccaggcggg

SEQ ID NO: 801505 - RNA, 12 nt, Homo sapiens
gcggggugggca

SEQ ID NO: 801506 - RNA, 12 nt, Homo sapiens
gcguacacagag

SEQ ID NO: 801507 - RNA, 14 nt, Homo sapiens
gcguagacaggugu

SEQ ID NO: 801508 - RNA, 20 nt, Homo sapiens
gcgucaucucugacacggcc

SEQ ID NO: 801509 - RNA, 20 nt, Homo sapiens
gcguccauauuuaacaugua

SEQ ID NO: 801510 - RNA, 18 nt, Homo sapiens
gcgucccagucucuggca

SEQ ID NO: 801511 - RNA, 17 nt, Homo sapiens
gcguccgaggacuuugg

SEQ ID NO: 801512 - RNA, 17 nt, Homo sapiens
gcgucuacccagacuca

SEQ ID NO: 801513 - RNA, 16 nt, Homo sapiens
gcgucucugcuuuaaa

SEQ ID NO: 801514 - RNA, 17 nt, Homo sapiens
gcgugaccuugcaaugu

SEQ ID NO: 801515 - RNA, 19 nt, Homo sapiens
gcgugauccaccacaccug

SEQ ID NO: 801516 - RNA, 21 nt, Homo sapiens
gcgugcugguccccuccucag

SEQ ID NO: 801517 - RNA, 21 nt, Homo sapiens
gcgugguauaaucuccauuuc

SEQ ID NO: 801518 - RNA, 16 nt, Homo sapiens
gcgugugccugugugc

SEQ ID NO: 801519 - RNA, 23 nt, Homo sapiens
gcguuacacccuuucuugacaaa

SEQ ID NO: 801520 - RNA, 14 nt, Homo sapiens
gcguucuucauuca

SEQ ID NO: 801521 - RNA, 23 nt, Homo sapiens
gcguuuggacccaguucagugag

SEQ ID NO: 801522 - RNA, 14 nt, Homo sapiens
gcguuuucauuugu

SEQ ID NO: 801523 - RNA, 16 nt, Homo sapiens
gcguuuuucucaaagg

SEQ ID NO: 801524 - RNA, 18 nt, Homo sapiens
gcuaaacccagaugguuu

SEQ ID NO: 801525 - RNA, 16 nt, Homo sapiens
gcuaaagacugaucuc

SEQ ID NO: 801526 - RNA, 17 nt, Homo sapiens
gcuaaagacugaucuca

SEQ ID NO: 801527 - RNA, 18 nt, Homo sapiens
gcuaaaggaagugaaucu

SEQ ID NO: 801528 - RNA, 12 nt, Homo sapiens
gcuaaauaucac

SEQ ID NO: 801529 - RNA, 22 nt, Homo sapiens
gcuaaauucacagcgcuaugca

SEQ ID NO: 801530 - RNA, 20 nt, Homo sapiens
gcuaacccccuucuacugag

SEQ ID NO: 801531 - RNA, 18 nt, Homo sapiens
gcuaaccuguuacacugg

SEQ ID NO: 801532 - RNA, 21 nt, Homo sapiens
gcuaagauuuagagaugaauu

SEQ ID NO: 801533 - RNA, 17 nt, Homo sapiens
gcuaaggacauuuccca

SEQ ID NO: 801534 - RNA, 21 nt, Homo sapiens
gcuaauguaauaacugugaag

SEQ ID NO: 801535 - RNA, 18 nt, Homo sapiens
gcuaauuagaaauauucu

SEQ ID NO: 801536 - RNA, 23 nt, Homo sapiens
gcuaauucuacucacagugcuuu

SEQ ID NO: 801537 - RNA, 21 nt, Homo sapiens
gcuaauugcuggcuggcugcc

SEQ ID NO: 801538 - RNA, 18 nt, Homo sapiens
gcuaauuuugaaugcccu

SEQ ID NO: 801539 - RNA, 16 nt, Homo sapiens
gcuacaaaaacacagc

SEQ ID NO: 801540 - RNA, 14 nt, Homo sapiens
gcuacaacauguga

SEQ ID NO: 801541 - RNA, 21 nt, Homo sapiens
gcuacaaucuguucaauguuu

SEQ ID NO: 801542 - RNA, 19 nt, Homo sapiens
gcuacacagaucacagcuu

SEQ ID NO: 801543 - RNA, 24 nt, Homo sapiens
gcuacagugucucgaugccauaau

SEQ ID NO: 801544 - RNA, 14 nt, Homo sapiens
gcuaccaguauuua

SEQ ID NO: 801545 - RNA, 17 nt, Homo sapiens
gcuaccuacauacaauu

SEQ ID NO: 801546 - RNA, 19 nt, Homo sapiens
gcuaccucacuaugcugcu

SEQ ID NO: 801547 - RNA, 23 nt, Homo sapiens
gcuaccugcucagcccugcacca

SEQ ID NO: 801548 - RNA, 14 nt, Homo sapiens
gcuacgaccugguc

SEQ ID NO: 801549 - RNA, 20 nt, Homo sapiens
gcuacuaccuagggcacuuu

SEQ ID NO: 801550 - RNA, 21 nt, Homo sapiens
gcuacuagagauauucuuauu

SEQ ID NO: 801551 - RNA, 18 nt, Homo sapiens
gcuacucagaagccugag

SEQ ID NO: 801552 - RNA, 19 nt, Homo sapiens
gcuacugcaaaugcuauau

SEQ ID NO: 801553 - RNA, 20 nt, Homo sapiens
gcuacuuaacaaaguaaaca

SEQ ID NO: 801554 - RNA, 15 nt, Homo sapiens
gcuacuucccuuccu

SEQ ID NO: 801555 - RNA, 13 nt, Homo sapiens
gcuacuugggagg

SEQ ID NO: 801556 - RNA, 12 nt, Homo sapiens
gcuagaaggaau

SEQ ID NO: 801557 - RNA, 18 nt, Homo sapiens
gcuagacaagcuugucca

SEQ ID NO: 801558 - RNA, 14 nt, Homo sapiens
gcuagacuagucuc

SEQ ID NO: 801559 - RNA, 18 nt, Homo sapiens
gcuagagcugacagcuuu

SEQ ID NO: 801560 - RNA, 18 nt, Homo sapiens
gcuagaggacuucuggca

SEQ ID NO: 801561 - RNA, 15 nt, Homo sapiens
gcuaggaacuuggga

SEQ ID NO: 801562 - RNA, 19 nt, Homo sapiens
gcuaggaugguucugugac

SEQ ID NO: 801563 - RNA, 22 nt, Homo sapiens
gcuaggcgcuggggagacugau

SEQ ID NO: 801564 - RNA, 15 nt, Homo sapiens
gcuagggaauaucaa

SEQ ID NO: 801565 - RNA, 12 nt, Homo sapiens
gcuagggguccu

SEQ ID NO: 801566 - RNA, 19 nt, Homo sapiens
gcuaggguggcccuugcag

SEQ ID NO: 801567 - RNA, 16 nt, Homo sapiens
gcuagguaucauucaa

SEQ ID NO: 801568 - RNA, 16 nt, Homo sapiens
gcuagguucagcuuuc

SEQ ID NO: 801569 - RNA, 17 nt, Homo sapiens
gcuaguccucacuucua

SEQ ID NO: 801570 - RNA, 20 nt, Homo sapiens
gcuagugacuugugucccau

SEQ ID NO: 801571 - RNA, 16 nt, Homo sapiens
gcuaguucuaauuuca

SEQ ID NO: 801572 - RNA, 15 nt, Homo sapiens
gcuaguuugaccuca

SEQ ID NO: 801573 - RNA, 14 nt, Homo sapiens
gcuauaaagcagua

SEQ ID NO: 801574 - RNA, 15 nt, Homo sapiens
gcuauaauaaagaag

SEQ ID NO: 801575 - RNA, 13 nt, Homo sapiens
gcuauaggugcua

SEQ ID NO: 801576 - RNA, 15 nt, Homo sapiens
gcuauagugaacucc

SEQ ID NO: 801577 - RNA, 13 nt, Homo sapiens
gcuauauugcacu

SEQ ID NO: 801578 - RNA, 19 nt, Homo sapiens
gcuaucacuguacuuguag

SEQ ID NO: 801579 - RNA, 14 nt, Homo sapiens
gcuaucagugcuuu

SEQ ID NO: 801580 - RNA, 15 nt, Homo sapiens
gcuauccacagcuua

SEQ ID NO: 801581 - RNA, 23 nt, Homo sapiens
gcuaucucucagugaacugugag

SEQ ID NO: 801582 - RNA, 16 nt, Homo sapiens
gcuaucuguagaauua

SEQ ID NO: 801583 - RNA, 14 nt, Homo sapiens
gcuaugagcuuuua

SEQ ID NO: 801584 - RNA, 21 nt, Homo sapiens
gcuauggaggguccuccucca

SEQ ID NO: 801585 - RNA, 20 nt, Homo sapiens
gcuauggggauagaugugug

SEQ ID NO: 801586 - RNA, 18 nt, Homo sapiens
gcuaugguucucucgcaa

SEQ ID NO: 801587 - RNA, 14 nt, Homo sapiens
gcuauguaaggguc

SEQ ID NO: 801588 - RNA, 18 nt, Homo sapiens
gcuauugaagaugcugcc

SEQ ID NO: 801589 - RNA, 18 nt, Homo sapiens
gcuauuuugugaagccau

SEQ ID NO: 801590 - RNA, 20 nt, Homo sapiens
gcucaaagcccuuccuaccu

SEQ ID NO: 801591 - RNA, 11 nt, Homo sapiens
gcucaaaggga

SEQ ID NO: 801592 - RNA, 16 nt, Homo sapiens
gcucaaaucuauucag

SEQ ID NO: 801593 - RNA, 11 nt, Homo sapiens
gcucaagaaca

SEQ ID NO: 801594 - RNA, 23 nt, Homo sapiens
gcucaagaacgagaagcagcauu

SEQ ID NO: 801595 - RNA, 19 nt, Homo sapiens
gcucaauauuccugaauga

SEQ ID NO: 801596 - RNA, 13 nt, Homo sapiens
gcucaaugcaaau

SEQ ID NO: 801597 - RNA, 19 nt, Homo sapiens
gcucacaaaccaugcaaau

SEQ ID NO: 801598 - RNA, 13 nt, Homo sapiens
gcucacaccaaau

SEQ ID NO: 801599 - RNA, 18 nt, Homo sapiens
gcucacacccuaccuucc

SEQ ID NO: 801600 - RNA, 23 nt, Homo sapiens
gcucacauuucauuagugagcca

SEQ ID NO: 801601 - RNA, 15 nt, Homo sapiens
gcucaccuuuaucac

SEQ ID NO: 801602 - RNA, 21 nt, Homo sapiens
gcucaccuuuaucaccucauu

SEQ ID NO: 801603 - RNA, 20 nt, Homo sapiens
gcucacgccuguaaucccag

SEQ ID NO: 801604 - RNA, 23 nt, Homo sapiens
gcucacuacugaacacaugugua

SEQ ID NO: 801605 - RNA, 18 nt, Homo sapiens
gcucacugaaucuucacg

SEQ ID NO: 801606 - RNA, 16 nt, Homo sapiens
gcucacugcaaccucc

SEQ ID NO: 801607 - RNA, 17 nt, Homo sapiens
gcucacugcaaccucug

SEQ ID NO: 801608 - RNA, 22 nt, Homo sapiens
gcucacugugcuggggcacggc

SEQ ID NO: 801609 - RNA, 15 nt, Homo sapiens
gcucagaaaggaaau

SEQ ID NO: 801610 - RNA, 12 nt, Homo sapiens
gcucagccacag

SEQ ID NO: 801611 - RNA, 18 nt, Homo sapiens
gcucaggagccaccagca

SEQ ID NO: 801612 - RNA, 20 nt, Homo sapiens
gcucagguuuugagaagcca

SEQ ID NO: 801613 - RNA, 17 nt, Homo sapiens
guaaaacuauauucuca

SEQ ID NO: 801614 - RNA, 23 nt, Homo sapiens
guaaaacuauauucucaguguag

SEQ ID NO: 801615 - RNA, 17 nt, Homo sapiens
guaaaagugcuuuccau

SEQ ID NO: 801616 - RNA, 14 nt, Homo sapiens
guaaaaucuuggca

SEQ ID NO: 801617 - RNA, 12 nt, Homo sapiens
guaaaggcagua

SEQ ID NO: 801618 - RNA, 22 nt, Homo sapiens
guaaaguauuauuuauuugaau

SEQ ID NO: 801619 - RNA, 15 nt, Homo sapiens
guaaagugauguuug

SEQ ID NO: 801620 - RNA, 14 nt, Homo sapiens
guaaauaacaggca

SEQ ID NO: 801621 - RNA, 21 nt, Homo sapiens
guaaauacacauagcauguaa

SEQ ID NO: 801622 - RNA, 21 nt, Homo sapiens
guaaaucauguugaucaugua

SEQ ID NO: 801623 - RNA, 19 nt, Homo sapiens
guaaauccugccauuuaaa

SEQ ID NO: 801624 - RNA, 18 nt, Homo sapiens
guaaaucuagaguuuaua

SEQ ID NO: 801625 - RNA, 22 nt, Homo sapiens
guaaaugaucacuccaggauau

SEQ ID NO: 801626 - RNA, 14 nt, Homo sapiens
guaaaugcuccauu

SEQ ID NO: 801627 - RNA, 15 nt, Homo sapiens
guaaauguuuagguu

SEQ ID NO: 801628 - RNA, 12 nt, Homo sapiens
guaaauguuucu

SEQ ID NO: 801629 - RNA, 15 nt, Homo sapiens
guaaauucaaccacu

SEQ ID NO: 801630 - RNA, 13 nt, Homo sapiens
guaaauugcaaau

SEQ ID NO: 801631 - RNA, 14 nt, Homo sapiens
guaaauugcaaaua

SEQ ID NO: 801632 - RNA, 19 nt, Homo sapiens
guaacaagaaaacauaaga

SEQ ID NO: 801633 - RNA, 17 nt, Homo sapiens
guaacauuucuguucuc

SEQ ID NO: 801634 - RNA, 16 nt, Homo sapiens
guaacauuugcuguuu

SEQ ID NO: 801635 - RNA, 16 nt, Homo sapiens
guaaccaaauguuggc

SEQ ID NO: 801636 - RNA, 21 nt, Homo sapiens
guaaccaggucguccaagcaa

SEQ ID NO: 801637 - RNA, 18 nt, Homo sapiens
guaaccuagugaauuucu

SEQ ID NO: 801638 - RNA, 14 nt, Homo sapiens
guaacuagugaaau

SEQ ID NO: 801639 - RNA, 21 nt, Homo sapiens
guaacucacauucucuuccca

SEQ ID NO: 801640 - RNA, 12 nt, Homo sapiens
guaacuccagau

SEQ ID NO: 801641 - RNA, 17 nt, Homo sapiens
guaacucuuucugagga

SEQ ID NO: 801642 - RNA, 18 nt, Homo sapiens
guaacugauaaaccaaaa

SEQ ID NO: 801643 - RNA, 17 nt, Homo sapiens
guaacugugacugauga

SEQ ID NO: 801644 - RNA, 17 nt, Homo sapiens
guaagaaaaaucugcua

SEQ ID NO: 801645 - RNA, 18 nt, Homo sapiens
guaagaaagugaagcaaa

SEQ ID NO: 801646 - RNA, 22 nt, Homo sapiens
guaagaaauaacacugugaaug

SEQ ID NO: 801647 - RNA, 18 nt, Homo sapiens
guaagaacuguacauugu

SEQ ID NO: 801648 - RNA, 15 nt, Homo sapiens
guaagaagcugugaa

SEQ ID NO: 801649 - RNA, 21 nt, Homo sapiens
guaagacccuuauugcugucc

SEQ ID NO: 801650 - RNA, 14 nt, Homo sapiens
guaagagguguuau

SEQ ID NO: 801651 - RNA, 22 nt, Homo sapiens
guaagaucguucucugccucac

SEQ ID NO: 801652 - RNA, 15 nt, Homo sapiens
guaagccaagucaug

SEQ ID NO: 801653 - RNA, 21 nt, Homo sapiens
guaagccuguuggauaaagac

SEQ ID NO: 801654 - RNA, 14 nt, Homo sapiens
guaagcuaucugug

SEQ ID NO: 801655 - RNA, 14 nt, Homo sapiens
guaagcucuacuga

SEQ ID NO: 801656 - RNA, 22 nt, Homo sapiens
guaagcucuacugaggugcuau

SEQ ID NO: 801657 - RNA, 21 nt, Homo sapiens
guaaggacggacucacuucuc

SEQ ID NO: 801658 - RNA, 14 nt, Homo sapiens
guaaggcucuagau

SEQ ID NO: 801659 - RNA, 15 nt, Homo sapiens
guaagggaaacugcc

SEQ ID NO: 801660 - RNA, 17 nt, Homo sapiens
guaagggaaacugccag

SEQ ID NO: 801661 - RNA, 21 nt, Homo sapiens
guaaguggaggaaauguugga

SEQ ID NO: 801662 - RNA, 21 nt, Homo sapiens
guaaguggcuucucugugaau

SEQ ID NO: 801663 - RNA, 14 nt, Homo sapiens
guaaguguucucau

SEQ ID NO: 801664 - RNA, 23 nt, Homo sapiens
guaaguugaauggccugccuuga

SEQ ID NO: 801665 - RNA, 17 nt, Homo sapiens
guaauaaaaagccucuu

SEQ ID NO: 801666 - RNA, 15 nt, Homo sapiens
guaauaacugugaag

SEQ ID NO: 801667 - RNA, 13 nt, Homo sapiens
guaauaagcaauc

SEQ ID NO: 801668 - RNA, 17 nt, Homo sapiens
guaauaagcaaucaagg

SEQ ID NO: 801669 - RNA, 13 nt, Homo sapiens
guaauaagggaaa

SEQ ID NO: 801670 - RNA, 23 nt, Homo sapiens
guaauaauaaaucguccucccag

SEQ ID NO: 801671 - RNA, 16 nt, Homo sapiens
guaauacuucauucuc

SEQ ID NO: 801672 - RNA, 16 nt, Homo sapiens
guaaucccaacacuuu

SEQ ID NO: 801673 - RNA, 17 nt, Homo sapiens
guaaucuacaccaauga

SEQ ID NO: 801674 - RNA, 21 nt, Homo sapiens
guaaucuaccaguggugcuca

SEQ ID NO: 801675 - RNA, 21 nt, Homo sapiens
guaaucuagguguggcuguga

SEQ ID NO: 801676 - RNA, 17 nt, Homo sapiens
guaaucuuggguuucua

SEQ ID NO: 801677 - RNA, 21 nt, Homo sapiens
guaaugacaaauaaguggaaa

SEQ ID NO: 801678 - RNA, 17 nt, Homo sapiens
guaaugcucugaccaag

SEQ ID NO: 801679 - RNA, 17 nt, Homo sapiens
guaaugcugcacagaaa

SEQ ID NO: 801680 - RNA, 22 nt, Homo sapiens
guaauguuccugaaaauugcaa

SEQ ID NO: 801681 - RNA, 18 nt, Homo sapiens
guaauuaaaggaacagag

SEQ ID NO: 801682 - RNA, 21 nt, Homo sapiens
guaauuauguuuucaacacuu

SEQ ID NO: 801683 - RNA, 18 nt, Homo sapiens
guaauuccuguuacuuua

SEQ ID NO: 801684 - RNA, 23 nt, Homo sapiens
guaauucuaaaugaauguuuaca

SEQ ID NO: 801685 - RNA, 18 nt, Homo sapiens
guaauugcauuucugcuc

SEQ ID NO: 801686 - RNA, 23 nt, Homo sapiens
guaauugcauuucugcucuucca

SEQ ID NO: 801687 - RNA, 14 nt, Homo sapiens
guaauuguacaaua

SEQ ID NO: 801688 - RNA, 19 nt, Homo sapiens
guaauuuaaaaagugcuau

SEQ ID NO: 801689 - RNA, 18 nt, Homo sapiens
guaauuuaaaauugugau

SEQ ID NO: 801690 - RNA, 14 nt, Homo sapiens
guaauuuaugcaag

SEQ ID NO: 801691 - RNA, 15 nt, Homo sapiens
guacaaacccaaaaa

SEQ ID NO: 801692 - RNA, 16 nt, Homo sapiens
guacaaagguugcagu

SEQ ID NO: 801693 - RNA, 17 nt, Homo sapiens
guacaaagguugcagug

SEQ ID NO: 801694 - RNA, 18 nt, Homo sapiens
guacaaguuuuguauaaa

SEQ ID NO: 801695 - RNA, 14 nt, Homo sapiens
guacaauaaucucu

SEQ ID NO: 801696 - RNA, 14 nt, Homo sapiens
guacaauacaaugu

SEQ ID NO: 801697 - RNA, 17 nt, Homo sapiens
guacagaauucugcuac

SEQ ID NO: 801698 - RNA, 19 nt, Homo sapiens
guacagaccaccuuucaca

SEQ ID NO: 801699 - RNA, 13 nt, Homo sapiens
guacagaugaaug

SEQ ID NO: 801700 - RNA, 15 nt, Homo sapiens
guacaggcaacaaug

SEQ ID NO: 801701 - RNA, 14 nt, Homo sapiens
guacaggcaguuag

SEQ ID NO: 801702 - RNA, 20 nt, Homo sapiens
guacaggucacccaucagga

SEQ ID NO: 801703 - RNA, 10 nt, Homo sapiens
guacaguuuu

SEQ ID NO: 801704 - RNA, 11 nt, Homo sapiens
guacaguuuuu

SEQ ID NO: 801705 - RNA, 21 nt, Homo sapiens
guacaucaaguccaucugaca

SEQ ID NO: 801706 - RNA, 17 nt, Homo sapiens
guacaugguguuugugg

SEQ ID NO: 801707 - RNA, 13 nt, Homo sapiens
guacaugugcaca

SEQ ID NO: 801708 - RNA, 22 nt, Homo sapiens
guacauucaauguuuaugcaag

SEQ ID NO: 801709 - RNA, 21 nt, Homo sapiens
guacauuggcugguaacaguu

SEQ ID NO: 801710 - RNA, 19 nt, Homo sapiens
guacauuuaaaauugcuau

SEQ ID NO: 801711 - RNA, 17 nt, Homo sapiens
guacauuuggcauuugu

SEQ ID NO: 801712 - RNA, 14 nt, Homo sapiens
guaccacacauauu

SEQ ID NO: 801713 - RNA, 15 nt, Homo sapiens
guaccacacauauug

SEQ ID NO: 801714 - RNA, 15 nt, Homo sapiens
guaccacuacuuaga

SEQ ID NO: 801715 - RNA, 11 nt, Homo sapiens
guaccaguuaa

SEQ ID NO: 801716 - RNA, 12 nt, Homo sapiens
guaccauagaaa

SEQ ID NO: 801717 - RNA, 21 nt, Homo sapiens
guacccaggcuuuagcauuau

SEQ ID NO: 801718 - RNA, 17 nt, Homo sapiens
guaccccugaggaaaca

SEQ ID NO: 801719 - RNA, 20 nt, Homo sapiens
guacccucgcaugacuguua

SEQ ID NO: 801720 - RNA, 14 nt, Homo sapiens
guacccucucagcu

SEQ ID NO: 801721 - RNA, 14 nt, Homo sapiens
guaccucucuuaua

SEQ ID NO: 801722 - RNA, 20 nt, Homo sapiens
guaccuguacuaaaccaccu

SEQ ID NO: 801723 - RNA, 18 nt, Homo sapiens
guaccuugaacacugggg

SEQ ID NO: 801724 - RNA, 22 nt, Homo sapiens
guaccuuuguguccuuguucau

SEQ ID NO: 801725 - RNA, 20 nt, Homo sapiens
guacgaucuuucuggcaaau

SEQ ID NO: 801726 - RNA, 15 nt, Homo sapiens
guacgaugacagugu

SEQ ID NO: 801727 - RNA, 14 nt, Homo sapiens
guacgcccaggaca

SEQ ID NO: 801728 - RNA, 14 nt, Homo sapiens
gucuccuugcacuu

SEQ ID NO: 801729 - RNA, 18 nt, Homo sapiens
gucuccuuugcacugagg

SEQ ID NO: 801730 - RNA, 21 nt, Homo sapiens
gucucgaacuccuggccucaa

SEQ ID NO: 801731 - RNA, 15 nt, Homo sapiens
gucucgcagccugaa

SEQ ID NO: 801732 - RNA, 13 nt, Homo sapiens
gucucgcuuuguu

SEQ ID NO: 801733 - RNA, 15 nt, Homo sapiens
gucucuaaccauuca

SEQ ID NO: 801734 - RNA, 16 nt, Homo sapiens
gucucuaaccauucaa

SEQ ID NO: 801735 - RNA, 18 nt, Homo sapiens
gucucuacuaaaaauaca

SEQ ID NO: 801736 - RNA, 20 nt, Homo sapiens
gucucucggguucaagcaau

SEQ ID NO: 801737 - RNA, 16 nt, Homo sapiens
gucucucugccaagau

SEQ ID NO: 801738 - RNA, 18 nt, Homo sapiens
gucucuucuuggggccca

SEQ ID NO: 801739 - RNA, 13 nt, Homo sapiens
gucugaccagaga

SEQ ID NO: 801740 - RNA, 13 nt, Homo sapiens
gucugaccuggug

SEQ ID NO: 801741 - RNA, 14 nt, Homo sapiens
gucugagaccacuu

SEQ ID NO: 801742 - RNA, 15 nt, Homo sapiens
gucugauaaacugac

SEQ ID NO: 801743 - RNA, 18 nt, Homo sapiens
gucugccagccagcagcc

SEQ ID NO: 801744 - RNA, 17 nt, Homo sapiens
gucugccuggaggccag

SEQ ID NO: 801745 - RNA, 22 nt, Homo sapiens
gucuggagaagguauuagcaaa

SEQ ID NO: 801746 - RNA, 15 nt, Homo sapiens
gucuggcccaccagg

SEQ ID NO: 801747 - RNA, 16 nt, Homo sapiens
gucugggccacucagg

SEQ ID NO: 801748 - RNA, 17 nt, Homo sapiens
gucugggccacucaggg

SEQ ID NO: 801749 - RNA, 21 nt, Homo sapiens
gucugguucacaguuuagcau

SEQ ID NO: 801750 - RNA, 19 nt, Homo sapiens
gucuguaaaaaauggagcu

SEQ ID NO: 801751 - RNA, 20 nt, Homo sapiens
gucuguagcuccucaacuca

SEQ ID NO: 801752 - RNA, 21 nt, Homo sapiens
gucugucucgaugccugauuc

SEQ ID NO: 801753 - RNA, 14 nt, Homo sapiens
gucugucucuauau

SEQ ID NO: 801754 - RNA, 19 nt, Homo sapiens
gucugucucuuggcuauuu

SEQ ID NO: 801755 - RNA, 22 nt, Homo sapiens
gucugugcauuucugguugcac

SEQ ID NO: 801756 - RNA, 15 nt, Homo sapiens
gucuguggagccauc

SEQ ID NO: 801757 - RNA, 11 nt, Homo sapiens
gucuguuggca

SEQ ID NO: 801758 - RNA, 13 nt, Homo sapiens
gucuuagcucugg

SEQ ID NO: 801759 - RNA, 12 nt, Homo sapiens
gucuuagucaaa

SEQ ID NO: 801760 - RNA, 14 nt, Homo sapiens
gucuuauccuccac

SEQ ID NO: 801761 - RNA, 20 nt, Homo sapiens
gucuuaugaaacaauuugag

SEQ ID NO: 801762 - RNA, 14 nt, Homo sapiens
gucuucacacugcg

SEQ ID NO: 801763 - RNA, 14 nt, Homo sapiens
gucuucacauguau

SEQ ID NO: 801764 - RNA, 23 nt, Homo sapiens
gucuucagccuagccgaccucag

SEQ ID NO: 801765 - RNA, 18 nt, Homo sapiens
gucuucauccccucagaa

SEQ ID NO: 801766 - RNA, 20 nt, Homo sapiens
gucuucccuucugauugaug

SEQ ID NO: 801767 - RNA, 15 nt, Homo sapiens
gucuuccugcauuca

SEQ ID NO: 801768 - RNA, 14 nt, Homo sapiens
gucuucuaauuccu

SEQ ID NO: 801769 - RNA, 17 nt, Homo sapiens
gucuucuagcugcagau

SEQ ID NO: 801770 - RNA, 17 nt, Homo sapiens
gucuucugccuguuaua

SEQ ID NO: 801771 - RNA, 17 nt, Homo sapiens
gucuucuggacaggcuc

SEQ ID NO: 801772 - RNA, 22 nt, Homo sapiens
gucuucuuuuguggugucuucc

SEQ ID NO: 801773 - RNA, 17 nt, Homo sapiens
gucuugacgggagcauu

SEQ ID NO: 801774 - RNA, 19 nt, Homo sapiens
gucuugacucauggcagcu

SEQ ID NO: 801775 - RNA, 14 nt, Homo sapiens
gucuugccaugugc

SEQ ID NO: 801776 - RNA, 16 nt, Homo sapiens
gucuugcucuguuacc

SEQ ID NO: 801777 - RNA, 18 nt, Homo sapiens
gucuuggaacauuggaau

SEQ ID NO: 801778 - RNA, 15 nt, Homo sapiens
gucuuggacacugua

SEQ ID NO: 801779 - RNA, 15 nt, Homo sapiens
gucuuggaccagggc

SEQ ID NO: 801780 - RNA, 16 nt, Homo sapiens
gucuuggccucccaaa

SEQ ID NO: 801781 - RNA, 22 nt, Homo sapiens
gucuuggcucacugcaacuucu

SEQ ID NO: 801782 - RNA, 12 nt, Homo sapiens
gucuuggcuuuu

SEQ ID NO: 801783 - RNA, 20 nt, Homo sapiens
gucuuggggacuaacccaau

SEQ ID NO: 801784 - RNA, 17 nt, Homo sapiens
gucuugguucuaaaggu

SEQ ID NO: 801785 - RNA, 17 nt, Homo sapiens
gucuugucuuagcucug

SEQ ID NO: 801786 - RNA, 17 nt, Homo sapiens
gucuuguguauuugucu

SEQ ID NO: 801787 - RNA, 17 nt, Homo sapiens
gucuuguugauuuccuc

SEQ ID NO: 801788 - RNA, 13 nt, Homo sapiens
gucuuuaacucau

SEQ ID NO: 801789 - RNA, 14 nt, Homo sapiens
gucuuugcagagaa

SEQ ID NO: 801790 - RNA, 16 nt, Homo sapiens
gucuuuguucugugau

SEQ ID NO: 801791 - RNA, 17 nt, Homo sapiens
gucuuuuccacuccuau

SEQ ID NO: 801792 - RNA, 17 nt, Homo sapiens
gucuuuuguaauaucaa

SEQ ID NO: 801793 - RNA, 17 nt, Homo sapiens
gucuuuuuuauguuaaa

SEQ ID NO: 801794 - RNA, 17 nt, Homo sapiens
gugaaaauccaucucau

SEQ ID NO: 801795 - RNA, 22 nt, Homo sapiens
gugaaacgucccacacuuugaa

SEQ ID NO: 801796 - RNA, 20 nt, Homo sapiens
gugaaauaccacaagccuga

SEQ ID NO: 801797 - RNA, 14 nt, Homo sapiens
gugaaaugcuggca

SEQ ID NO: 801798 - RNA, 17 nt, Homo sapiens
gugaaauuaagcauuuu

SEQ ID NO: 801799 - RNA, 23 nt, Homo sapiens
gugaaauuuacaguuacugccua

SEQ ID NO: 801800 - RNA, 14 nt, Homo sapiens
gugaacacaucagc

SEQ ID NO: 801801 - RNA, 15 nt, Homo sapiens
gugaacacaucagcu

SEQ ID NO: 801802 - RNA, 18 nt, Homo sapiens
gugaacacuagccagaca

SEQ ID NO: 801803 - RNA, 14 nt, Homo sapiens
gugaacaguguaua

SEQ ID NO: 801804 - RNA, 12 nt, Homo sapiens
gugaaccaaaga

SEQ ID NO: 801805 - RNA, 15 nt, Homo sapiens
gugaacugugagggu

SEQ ID NO: 801806 - RNA, 22 nt, Homo sapiens
gugaagaacuauuuuauucuaa

SEQ ID NO: 801807 - RNA, 16 nt, Homo sapiens
gugaagacuugccuuu

SEQ ID NO: 801808 - RNA, 19 nt, Homo sapiens
gugaaggauaagagaaaca

SEQ ID NO: 801809 - RNA, 16 nt, Homo sapiens
gugaaguauacuguau

SEQ ID NO: 801810 - RNA, 20 nt, Homo sapiens
gugaauacauucuuugcuag

SEQ ID NO: 801811 - RNA, 14 nt, Homo sapiens
gugaaucagacccu

SEQ ID NO: 801812 - RNA, 13 nt, Homo sapiens
gugaauccaggag

SEQ ID NO: 801813 - RNA, 11 nt, Homo sapiens
gugaaucugau

SEQ ID NO: 801814 - RNA, 17 nt, Homo sapiens
gugaaugggacuauuca

SEQ ID NO: 801815 - RNA, 17 nt, Homo sapiens
gugaauggucucuguca

SEQ ID NO: 801816 - RNA, 23 nt, Homo sapiens
gugacaagaauuguuaccuguca

SEQ ID NO: 801817 - RNA, 16 nt, Homo sapiens
gugacacaaucucggc

SEQ ID NO: 801818 - RNA, 17 nt, Homo sapiens
gugacagaaucuuguau

SEQ ID NO: 801819 - RNA, 21 nt, Homo sapiens
gugacagacaggcucuuagca

SEQ ID NO: 801820 - RNA, 21 nt, Homo sapiens
gugacagccccuuauuugcac

SEQ ID NO: 801821 - RNA, 23 nt, Homo sapiens
gugacauauucugaggaccucca

SEQ ID NO: 801822 - RNA, 23 nt, Homo sapiens
gugaccauggaggccagugccag

SEQ ID NO: 801823 - RNA, 16 nt, Homo sapiens
gugaccccugaccuca

SEQ ID NO: 801824 - RNA, 23 nt, Homo sapiens
gugaccccugaccucacugugac

SEQ ID NO: 801825 - RNA, 18 nt, Homo sapiens
gugacuauaaagcuguua

SEQ ID NO: 801826 - RNA, 14 nt, Homo sapiens
gugacuaucacccc

SEQ ID NO: 801827 - RNA, 14 nt, Homo sapiens
gugacuguggcaca

SEQ ID NO: 801828 - RNA, 16 nt, Homo sapiens
gugacuguguuugcau

SEQ ID NO: 801829 - RNA, 19 nt, Homo sapiens
gugacuguguuugcauugu

SEQ ID NO: 801830 - RNA, 23 nt, Homo sapiens
gugagaacagcauuuagugaagu

SEQ ID NO: 801831 - RNA, 15 nt, Homo sapiens
gugagacuccaucuc

SEQ ID NO: 801832 - RNA, 21 nt, Homo sapiens
gugagacuucuguuugaucac

SEQ ID NO: 801833 - RNA, 20 nt, Homo sapiens
gugagcauggaacacuucga

SEQ ID NO: 801834 - RNA, 23 nt, Homo sapiens
gugagcguagcagcucagcucuu

SEQ ID NO: 801835 - RNA, 16 nt, Homo sapiens
gugagcuaugcaaaca

SEQ ID NO: 801836 - RNA, 19 nt, Homo sapiens
gugaggaagccuauuugaa

SEQ ID NO: 801837 - RNA, 19 nt, Homo sapiens
gugaggcuguccuguacau

SEQ ID NO: 801838 - RNA, 18 nt, Homo sapiens
gugagggaucacugccaa

SEQ ID NO: 801839 - RNA, 18 nt, Homo sapiens
gugagggcucacucagcc

SEQ ID NO: 801840 - RNA, 12 nt, Homo sapiens
gugagggguccc

SEQ ID NO: 801841 - RNA, 15 nt, Homo sapiens
gugagguucuugggu

SEQ ID NO: 801842 - RNA, 18 nt, Homo sapiens
gugaguauugcuuauaug

SEQ ID NO: 801843 - RNA, 20 nt, Homo sapiens
guuuguggccucagaauuga

SEQ ID NO: 801844 - RNA, 17 nt, Homo sapiens
guuugugggacuggguu

SEQ ID NO: 801845 - RNA, 19 nt, Homo sapiens
guuuguguguugucucuug

SEQ ID NO: 801846 - RNA, 12 nt, Homo sapiens
guuuguguuacc

SEQ ID NO: 801847 - RNA, 19 nt, Homo sapiens
guuuguuauuuacacuggu

SEQ ID NO: 801848 - RNA, 17 nt, Homo sapiens
guuuguuucauauauac

SEQ ID NO: 801849 - RNA, 12 nt, Homo sapiens
guuuguuucauu

SEQ ID NO: 801850 - RNA, 17 nt, Homo sapiens
guuuuaaaaaaucucaa

SEQ ID NO: 801851 - RNA, 14 nt, Homo sapiens
guuuuaaaguucau

SEQ ID NO: 801852 - RNA, 17 nt, Homo sapiens
guuuuaacaguucacuu

SEQ ID NO: 801853 - RNA, 18 nt, Homo sapiens
guuuuaaguuguuugcau

SEQ ID NO: 801854 - RNA, 12 nt, Homo sapiens
guuuuaccagcu

SEQ ID NO: 801855 - RNA, 12 nt, Homo sapiens
guuuuagaacca

SEQ ID NO: 801856 - RNA, 18 nt, Homo sapiens
guuuuagcacccccaugg

SEQ ID NO: 801857 - RNA, 16 nt, Homo sapiens
guuuuauauguugcua

SEQ ID NO: 801858 - RNA, 21 nt, Homo sapiens
guuuuauucugacuuccucug

SEQ ID NO: 801859 - RNA, 13 nt, Homo sapiens
guuuuauuuugaa

SEQ ID NO: 801860 - RNA, 16 nt, Homo sapiens
guuuucaccauucaaa

SEQ ID NO: 801861 - RNA, 14 nt, Homo sapiens
guuuucacuuguau

SEQ ID NO: 801862 - RNA, 11 nt, Homo sapiens
guuuucagugu

SEQ ID NO: 801863 - RNA, 14 nt, Homo sapiens
guuuucaguguaca

SEQ ID NO: 801864 - RNA, 13 nt, Homo sapiens
guuuucauaauac

SEQ ID NO: 801865 - RNA, 18 nt, Homo sapiens
guuuucauaauaccucac

SEQ ID NO: 801866 - RNA, 14 nt, Homo sapiens
guuuucuaccuccu

SEQ ID NO: 801867 - RNA, 21 nt, Homo sapiens
guuuucugagcccgggcugcc

SEQ ID NO: 801868 - RNA, 23 nt, Homo sapiens
guuuucuggggaaaggggacaag

SEQ ID NO: 801869 - RNA, 18 nt, Homo sapiens
guuuucuugaacauacuu

SEQ ID NO: 801870 - RNA, 19 nt, Homo sapiens
guuuucuugcucaaaggga

SEQ ID NO: 801871 - RNA, 16 nt, Homo sapiens
guuuugaaaugcagaa

SEQ ID NO: 801872 - RNA, 23 nt, Homo sapiens
guuuuggaagcucugaagucaca

SEQ ID NO: 801873 - RNA, 18 nt, Homo sapiens
guuuuggagaguuugccu

SEQ ID NO: 801874 - RNA, 21 nt, Homo sapiens
guuuuguaaauguacugguaa

SEQ ID NO: 801875 - RNA, 17 nt, Homo sapiens
guuuuguaagaugcugg

SEQ ID NO: 801876 - RNA, 23 nt, Homo sapiens
guuuuguagagauggggucucac

SEQ ID NO: 801877 - RNA, 21 nt, Homo sapiens
guuuuguaggagacuugccag

SEQ ID NO: 801878 - RNA, 19 nt, Homo sapiens
guuuugucagacuuccaaa

SEQ ID NO: 801879 - RNA, 17 nt, Homo sapiens
guuuugugagaacuaau

SEQ ID NO: 801880 - RNA, 14 nt, Homo sapiens
guuuugugccuuug

SEQ ID NO: 801881 - RNA, 23 nt, Homo sapiens
guuuuguugagcaugacagccug

SEQ ID NO: 801882 - RNA, 15 nt, Homo sapiens
guuuuguuuccucug

SEQ ID NO: 801883 - RNA, 14 nt, Homo sapiens
guuuuuagcuggug

SEQ ID NO: 801884 - RNA, 20 nt, Homo sapiens
guuuuuauauuaauguacuu

SEQ ID NO: 801885 - RNA, 23 nt, Homo sapiens
guuuuuggaauuaugucugcuga

SEQ ID NO: 801886 - RNA, 18 nt, Homo sapiens
guuuuuuuuaaucaucaa

SEQ ID NO: 801887 - RNA, 23 nt, Homo sapiens
uaaaaaaaaaaaaaaaagugaug

SEQ ID NO: 801888 - RNA, 23 nt, Homo sapiens
uaaaaaaaaaaaauggcuucaga

SEQ ID NO: 801889 - RNA, 18 nt, Homo sapiens
uaaaaaaaaaaggaugaa

SEQ ID NO: 801890 - RNA, 11 nt, Homo sapiens
uaaaaaaagca

SEQ ID NO: 801891 - RNA, 16 nt, Homo sapiens
uaaaaaaauuagugag

SEQ ID NO: 801892 - RNA, 13 nt, Homo sapiens
uaaaaaaauucca

SEQ ID NO: 801893 - RNA, 22 nt, Homo sapiens
uaaaaaacauaaauuucuuuaa

SEQ ID NO: 801894 - RNA, 14 nt, Homo sapiens
uaaaaaacauauau

SEQ ID NO: 801895 - RNA, 16 nt, Homo sapiens
uaaaaaacuucaugua

SEQ ID NO: 801896 - RNA, 16 nt, Homo sapiens
uaaaaaagaucuccaa

SEQ ID NO: 801897 - RNA, 15 nt, Homo sapiens
uaaaaaagccuuccu

SEQ ID NO: 801898 - RNA, 19 nt, Homo sapiens
uaaaaaaugucucauguca

SEQ ID NO: 801899 - RNA, 19 nt, Homo sapiens
uaaaaaccccaaacuguug

SEQ ID NO: 801900 - RNA, 23 nt, Homo sapiens
uaaaaacuuccuucaaucuucau

SEQ ID NO: 801901 - RNA, 12 nt, Homo sapiens
uaaaaacuugua

SEQ ID NO: 801902 - RNA, 20 nt, Homo sapiens
uaaaaagccugcaauuucau

SEQ ID NO: 801903 - RNA, 23 nt, Homo sapiens
uaaaaagcgggcacgggcccgug

SEQ ID NO: 801904 - RNA, 17 nt, Homo sapiens
uaaaaaggaaguacugc

SEQ ID NO: 801905 - RNA, 20 nt, Homo sapiens
uaaaaagugacacagcagcu

SEQ ID NO: 801906 - RNA, 14 nt, Homo sapiens
uaaaaagugcuaua

SEQ ID NO: 801907 - RNA, 16 nt, Homo sapiens
uaaaaauaaacauguu

SEQ ID NO: 801908 - RNA, 17 nt, Homo sapiens
uaaaaauacacaugaaa

SEQ ID NO: 801909 - RNA, 17 nt, Homo sapiens
uaaaaauagucuuccac

SEQ ID NO: 801910 - RNA, 18 nt, Homo sapiens
uaaaaaucacuuucauaa

SEQ ID NO: 801911 - RNA, 14 nt, Homo sapiens
uaaaaaucugagaa

SEQ ID NO: 801912 - RNA, 16 nt, Homo sapiens
uaaaaaugaaaauucu

SEQ ID NO: 801913 - RNA, 18 nt, Homo sapiens
uaaaaaugagugcuuaaa

SEQ ID NO: 801914 - RNA, 14 nt, Homo sapiens
uaaaaaugcaacuu

SEQ ID NO: 801915 - RNA, 19 nt, Homo sapiens
uaaaaaugcugcucucagc

SEQ ID NO: 801916 - RNA, 17 nt, Homo sapiens
uaaaaauguccugccuu

SEQ ID NO: 801917 - RNA, 17 nt, Homo sapiens
uaaaaaugucucagcaa

SEQ ID NO: 801918 - RNA, 17 nt, Homo sapiens
uaaaacaaaauuugacu

SEQ ID NO: 801919 - RNA, 11 nt, Homo sapiens
uaaaacaaaga

SEQ ID NO: 801920 - RNA, 15 nt, Homo sapiens
uaaaacaauacucaa

SEQ ID NO: 801921 - RNA, 17 nt, Homo sapiens
uaaaacacagcuuuaca

SEQ ID NO: 801922 - RNA, 11 nt, Homo sapiens
uaaaacacuua

SEQ ID NO: 801923 - RNA, 13 nt, Homo sapiens
uaaaacagaaucu

SEQ ID NO: 801924 - RNA, 21 nt, Homo sapiens
uaaaacagguagaauuaucua

SEQ ID NO: 801925 - RNA, 23 nt, Homo sapiens
uaaaacauuuguuucccccacag

SEQ ID NO: 801926 - RNA, 13 nt, Homo sapiens
uaaaaccaaagag

SEQ ID NO: 801927 - RNA, 22 nt, Homo sapiens
uaaaaccaucaaaaauauucca

SEQ ID NO: 801928 - RNA, 15 nt, Homo sapiens
uaaaaccccaucucu

SEQ ID NO: 801929 - RNA, 20 nt, Homo sapiens
uaaaacuagugacagcuugu

SEQ ID NO: 801930 - RNA, 19 nt, Homo sapiens
uaaaacugccuuucuggug

SEQ ID NO: 801931 - RNA, 23 nt, Homo sapiens
uaaaacugccuuucugguggcuu

SEQ ID NO: 801932 - RNA, 14 nt, Homo sapiens
uaaaacuggaccug

SEQ ID NO: 801933 - RNA, 12 nt, Homo sapiens
uaaaacuuuccu

SEQ ID NO: 801934 - RNA, 19 nt, Homo sapiens
uaaaacuuuucugcugaua

SEQ ID NO: 801935 - RNA, 22 nt, Homo sapiens
uaaaagaaggaacauugcagag

SEQ ID NO: 801936 - RNA, 15 nt, Homo sapiens
uaaaagaaggaugaa

SEQ ID NO: 801937 - RNA, 22 nt, Homo sapiens
uaaaagaauaaaauugcacuuu

SEQ ID NO: 801938 - RNA, 14 nt, Homo sapiens
uaaaagcaaaagag

SEQ ID NO: 801939 - RNA, 22 nt, Homo sapiens
uaaaagcaauucugacugucca

SEQ ID NO: 801940 - RNA, 17 nt, Homo sapiens
uaaaagcacaaguacuu

SEQ ID NO: 801941 - RNA, 20 nt, Homo sapiens
uaaaagcacaaguacuuuug

SEQ ID NO: 801942 - RNA, 15 nt, Homo sapiens
uaaaagcacacuccc

SEQ ID NO: 801943 - RNA, 19 nt, Homo sapiens
uaaaagcagcaucugcuaa

SEQ ID NO: 801944 - RNA, 15 nt, Homo sapiens
uaaaagccccagcuu

SEQ ID NO: 801945 - RNA, 18 nt, Homo sapiens
uaaaagcgaccucucuug

SEQ ID NO: 801946 - RNA, 20 nt, Homo sapiens
uaaaagcuauaaagcaguau

SEQ ID NO: 801947 - RNA, 24 nt, Homo sapiens
uaaaaggaaauguaaaagcacaug

SEQ ID NO: 801948 - RNA, 19 nt, Homo sapiens
uaaaaggcaaauguguaca

SEQ ID NO: 801949 - RNA, 21 nt, Homo sapiens
uaaaagggucguuaccagaga

SEQ ID NO: 801950 - RNA, 16 nt, Homo sapiens
uaaaagguaugcaauc

SEQ ID NO: 801951 - RNA, 21 nt, Homo sapiens
uaaaagguuaauuucugucaa

SEQ ID NO: 801952 - RNA, 15 nt, Homo sapiens
uaaaagucuaugauc

SEQ ID NO: 801953 - RNA, 16 nt, Homo sapiens
uaaaagugacucucag

SEQ ID NO: 801954 - RNA, 13 nt, Homo sapiens
uaaaaguuacuua

SEQ ID NO: 801955 - RNA, 12 nt, Homo sapiens
uaaaaguucuuu

SEQ ID NO: 801956 - RNA, 23 nt, Homo sapiens
uaaaaguuuuuuauuaugcauua

SEQ ID NO: 801957 - RNA, 19 nt, Homo sapiens
uaaaauaaaauauacccau

SEQ ID NO: 801958 - RNA, 18 nt, Homo sapiens
uaagggucgaaagcucua

SEQ ID NO: 801959 - RNA, 13 nt, Homo sapiens
uaagguacuagca

SEQ ID NO: 801960 - RNA, 13 nt, Homo sapiens
uaagguacuuaaa

SEQ ID NO: 801961 - RNA, 20 nt, Homo sapiens
uaagguacuuaaagcuucua

SEQ ID NO: 801962 - RNA, 17 nt, Homo sapiens
uaagguagcugcagaua

SEQ ID NO: 801963 - RNA, 20 nt, Homo sapiens
uaaggucacauugugccuuu

SEQ ID NO: 801964 - RNA, 18 nt, Homo sapiens
uaagguccgguguucuaa

SEQ ID NO: 801965 - RNA, 19 nt, Homo sapiens
uaagguugcacacaguaca

SEQ ID NO: 801966 - RNA, 14 nt, Homo sapiens
uaagguuugcaaau

SEQ ID NO: 801967 - RNA, 13 nt, Homo sapiens
uaaguaaaaccac

SEQ ID NO: 801968 - RNA, 22 nt, Homo sapiens
uaaguaaaauccccuucgcuga

SEQ ID NO: 801969 - RNA, 17 nt, Homo sapiens
uaaguaccacucaggcc

SEQ ID NO: 801970 - RNA, 14 nt, Homo sapiens
uaaguacuuugcug

SEQ ID NO: 801971 - RNA, 22 nt, Homo sapiens
uaaguaggaugaaucauauuca

SEQ ID NO: 801972 - RNA, 22 nt, Homo sapiens
uaaguaguugguuuccuucaca

SEQ ID NO: 801973 - RNA, 17 nt, Homo sapiens
uaaguauaaguauucaa

SEQ ID NO: 801974 - RNA, 17 nt, Homo sapiens
uaaguaucuugugcuuc

SEQ ID NO: 801975 - RNA, 14 nt, Homo sapiens
uaaguaugggauga

SEQ ID NO: 801976 - RNA, 15 nt, Homo sapiens
uaaguauucaaguau

SEQ ID NO: 801977 - RNA, 14 nt, Homo sapiens
uaaguauuuccaua

SEQ ID NO: 801978 - RNA, 21 nt, Homo sapiens
uaaguauuucccagcacauga

SEQ ID NO: 801979 - RNA, 18 nt, Homo sapiens
uaaguauuuuccuaagca

SEQ ID NO: 801980 - RNA, 18 nt, Homo sapiens
uaagugaagugauacuau

SEQ ID NO: 801981 - RNA, 16 nt, Homo sapiens
uaagugacacagacau

SEQ ID NO: 801982 - RNA, 16 nt, Homo sapiens
uaagugccugagacac

SEQ ID NO: 801983 - RNA, 23 nt, Homo sapiens
uaaguggggugggaaggggagca

SEQ ID NO: 801984 - RNA, 20 nt, Homo sapiens
uaaguucaggcagcacauca

SEQ ID NO: 801985 - RNA, 16 nt, Homo sapiens
uaaguucuuaugagga

SEQ ID NO: 801986 - RNA, 18 nt, Homo sapiens
uaaguugucgaacaguag

SEQ ID NO: 801987 - RNA, 22 nt, Homo sapiens
uaaguuuuaggguacaugugca

SEQ ID NO: 801988 - RNA, 21 nt, Homo sapiens
uaauaaaaccggucacugaug

SEQ ID NO: 801989 - RNA, 19 nt, Homo sapiens
uaauaaaacuaaacuuuca

SEQ ID NO: 801990 - RNA, 17 nt, Homo sapiens
uaauaaacauccuucaa

SEQ ID NO: 801991 - RNA, 13 nt, Homo sapiens
uaauaaagacagg

SEQ ID NO: 801992 - RNA, 15 nt, Homo sapiens
uaauaaaguauauaa

SEQ ID NO: 801993 - RNA, 22 nt, Homo sapiens
uaauaaaguuuuuuuccaaaag

SEQ ID NO: 801994 - RNA, 18 nt, Homo sapiens
uaauaacugucuucugga

SEQ ID NO: 801995 - RNA, 13 nt, Homo sapiens
uaauaacugugaa

SEQ ID NO: 801996 - RNA, 20 nt, Homo sapiens
uaauaagauauuuaguaaua

SEQ ID NO: 801997 - RNA, 11 nt, Homo sapiens
uaauaagcaau

SEQ ID NO: 801998 - RNA, 13 nt, Homo sapiens
uaauaagugcuuu

SEQ ID NO: 801999 - RNA, 14 nt, Homo sapiens
uaauaauuauucau

SEQ ID NO: 802000 - RNA, 13 nt, Homo sapiens
uaauaauugauca

SEQ ID NO: 802001 - RNA, 12 nt, Homo sapiens
uaauacagauaa

SEQ ID NO: 802002 - RNA, 15 nt, Homo sapiens
uaauacagggcauuu

SEQ ID NO: 802003 - RNA, 15 nt, Homo sapiens
uaauacaucaaagag

SEQ ID NO: 802004 - RNA, 17 nt, Homo sapiens
uaauaccagaacucuaa

SEQ ID NO: 802005 - RNA, 19 nt, Homo sapiens
uaauaccucuuacuuugcu

SEQ ID NO: 802006 - RNA, 18 nt, Homo sapiens
uaauacguagcucucuua

SEQ ID NO: 802007 - RNA, 22 nt, Homo sapiens
uaauacuccagagacagggaaa

SEQ ID NO: 802008 - RNA, 18 nt, Homo sapiens
uaauacuccuaagacuua

SEQ ID NO: 802009 - RNA, 23 nt, Homo sapiens
uaauagagauuaaaaacaacaaa

SEQ ID NO: 802010 - RNA, 21 nt, Homo sapiens
uaauagguauauagaacacaa

SEQ ID NO: 802011 - RNA, 12 nt, Homo sapiens
uaauagucauca

SEQ ID NO: 802012 - RNA, 16 nt, Homo sapiens
uaauagucuuugccag

SEQ ID NO: 802013 - RNA, 16 nt, Homo sapiens
uaauagugacauauau

SEQ ID NO: 802014 - RNA, 15 nt, Homo sapiens
uaauaguucagugua

SEQ ID NO: 802015 - RNA, 22 nt, Homo sapiens
uaauaguucuauccuuuugccu

SEQ ID NO: 802016 - RNA, 18 nt, Homo sapiens
uaauaguuuugauccuaa

SEQ ID NO: 802017 - RNA, 17 nt, Homo sapiens
uaauauaagcugccaua

SEQ ID NO: 802018 - RNA, 13 nt, Homo sapiens
uaauauacuuuaa

SEQ ID NO: 802019 - RNA, 15 nt, Homo sapiens
uaauaucaacucuga

SEQ ID NO: 802020 - RNA, 15 nt, Homo sapiens
uaauaugacaaaaca

SEQ ID NO: 802021 - RNA, 15 nt, Homo sapiens
uaauaugagauuucu

SEQ ID NO: 802022 - RNA, 23 nt, Homo sapiens
uaauaugaguaauacaucaaaga

SEQ ID NO: 802023 - RNA, 17 nt, Homo sapiens
uaauaugccuagcacaa

SEQ ID NO: 802024 - RNA, 13 nt, Homo sapiens
uaauauguacuaa

SEQ ID NO: 802025 - RNA, 14 nt, Homo sapiens
uaauaugugccuua

SEQ ID NO: 802026 - RNA, 14 nt, Homo sapiens
uaauauucaaugaa

SEQ ID NO: 802027 - RNA, 17 nt, Homo sapiens
uaauauuucaagugccu

SEQ ID NO: 802028 - RNA, 18 nt, Homo sapiens
uaauauuuuaaauugcuu

SEQ ID NO: 802029 - RNA, 17 nt, Homo sapiens
uaauauuuuccuaguag

SEQ ID NO: 802030 - RNA, 15 nt, Homo sapiens
uaaucaccucucugu

SEQ ID NO: 802031 - RNA, 12 nt, Homo sapiens
uaaucagcauua

SEQ ID NO: 802032 - RNA, 15 nt, Homo sapiens
uaaucaucaaaaaga

SEQ ID NO: 802033 - RNA, 21 nt, Homo sapiens
uaaucauguuaccauuacaaa

SEQ ID NO: 802034 - RNA, 12 nt, Homo sapiens
uaauccaggcac

SEQ ID NO: 802035 - RNA, 19 nt, Homo sapiens
uaaucccaacacuuugaga

SEQ ID NO: 802036 - RNA, 19 nt, Homo sapiens
uaaucccagcacuuuggca

SEQ ID NO: 802037 - RNA, 13 nt, Homo sapiens
uaaucccauuucc

SEQ ID NO: 802038 - RNA, 23 nt, Homo sapiens
uaaucccgauucacccuguccaa

SEQ ID NO: 802039 - RNA, 15 nt, Homo sapiens
uaauccuucuggcaa

SEQ ID NO: 802040 - RNA, 22 nt, Homo sapiens
uaaucuagagaaggcauuucau

SEQ ID NO: 802041 - RNA, 14 nt, Homo sapiens
uaaucuaugaauuc

SEQ ID NO: 802042 - RNA, 15 nt, Homo sapiens
uaaucucuauuugag

SEQ ID NO: 802043 - RNA, 11 nt, Homo sapiens
uaaucucucac

SEQ ID NO: 802044 - RNA, 20 nt, Homo sapiens
uaaucugaccguucuauugu

SEQ ID NO: 802045 - RNA, 15 nt, Homo sapiens
uaaucuggugacaaa

SEQ ID NO: 802046 - RNA, 13 nt, Homo sapiens
uaaucuguagggc

SEQ ID NO: 802047 - RNA, 21 nt, Homo sapiens
uaaucuuaaauuuauuagaua

SEQ ID NO: 802048 - RNA, 19 nt, Homo sapiens
uaaucuuauuuauaccuca

SEQ ID NO: 802049 - RNA, 15 nt, Homo sapiens
uaaugaaaaugaaua

SEQ ID NO: 802050 - RNA, 20 nt, Homo sapiens
uaaugaaaaugaauaucuau

SEQ ID NO: 802051 - RNA, 15 nt, Homo sapiens
uaaugaaaaugucag

SEQ ID NO: 802052 - RNA, 13 nt, Homo sapiens
uaaugaacagugu

SEQ ID NO: 802053 - RNA, 22 nt, Homo sapiens
uaaugaacaguguaccuuuuaa

SEQ ID NO: 802054 - RNA, 17 nt, Homo sapiens
uaaugaacuaacugaca

SEQ ID NO: 802055 - RNA, 17 nt, Homo sapiens
uaaugaauacauuucca

SEQ ID NO: 802056 - RNA, 18 nt, Homo sapiens
uaaugaauacauuuccaa

SEQ ID NO: 802057 - RNA, 18 nt, Homo sapiens
uaaugacaaaggcacuga

SEQ ID NO: 802058 - RNA, 14 nt, Homo sapiens
uaaugacauaaaaa

SEQ ID NO: 802059 - RNA, 16 nt, Homo sapiens
uaaugagacugaccau

SEQ ID NO: 802060 - RNA, 23 nt, Homo sapiens
uaaugaguuaagcugaagaguuu

SEQ ID NO: 802061 - RNA, 14 nt, Homo sapiens
uaaugauacuuaac

SEQ ID NO: 802062 - RNA, 16 nt, Homo sapiens
uaaugaucaaaacaug

SEQ ID NO: 802063 - RNA, 14 nt, Homo sapiens
uaaugauuaaagac

SEQ ID NO: 802064 - RNA, 19 nt, Homo sapiens
uaaugauucugauauguau

SEQ ID NO: 802065 - RNA, 17 nt, Homo sapiens
uaaugcuguugccucau

SEQ ID NO: 802066 - RNA, 15 nt, Homo sapiens
uaaugcuuuguuaaa

SEQ ID NO: 802067 - RNA, 14 nt, Homo sapiens
uaauggaauuuaga

SEQ ID NO: 802068 - RNA, 20 nt, Homo sapiens
uaauggagaggaaaccagau

SEQ ID NO: 802069 - RNA, 13 nt, Homo sapiens
uaauggcacugau

SEQ ID NO: 802070 - RNA, 20 nt, Homo sapiens
uaauggcagcuagugccuuu

SEQ ID NO: 802071 - RNA, 21 nt, Homo sapiens
uaaugguguagaacacuaauu

SEQ ID NO: 802072 - RNA, 16 nt, Homo sapiens
uaauguaaauaaacua

SEQ ID NO: 802073 - RNA, 20 nt, Homo sapiens
ucaccacguggggcucacuu

SEQ ID NO: 802074 - RNA, 16 nt, Homo sapiens
ucaccacuaccagcca

SEQ ID NO: 802075 - RNA, 10 nt, Homo sapiens
ucaccacugu

SEQ ID NO: 802076 - RNA, 15 nt, Homo sapiens
ucaccagagcauuuc

SEQ ID NO: 802077 - RNA, 19 nt, Homo sapiens
ucaccagagcuucucuggg

SEQ ID NO: 802078 - RNA, 16 nt, Homo sapiens
ucaccagcccuagcug

SEQ ID NO: 802079 - RNA, 14 nt, Homo sapiens
ucaccaggggagga

SEQ ID NO: 802080 - RNA, 19 nt, Homo sapiens
ucaccaggggugcucaccu

SEQ ID NO: 802081 - RNA, 16 nt, Homo sapiens
ucaccaucaauccuga

SEQ ID NO: 802082 - RNA, 22 nt, Homo sapiens
ucaccauggcccccucaucaua

SEQ ID NO: 802083 - RNA, 14 nt, Homo sapiens
ucaccauggccuua

SEQ ID NO: 802084 - RNA, 17 nt, Homo sapiens
ucaccauguacauagcu

SEQ ID NO: 802085 - RNA, 19 nt, Homo sapiens
ucaccauguauuuuguaaa

SEQ ID NO: 802086 - RNA, 17 nt, Homo sapiens
ucacccacaauugccuu

SEQ ID NO: 802087 - RNA, 21 nt, Homo sapiens
ucacccagcuaaucuguaggg

SEQ ID NO: 802088 - RNA, 20 nt, Homo sapiens
ucacccagguuggagugcag

SEQ ID NO: 802089 - RNA, 19 nt, Homo sapiens
ucacccaucaaaagcacca

SEQ ID NO: 802090 - RNA, 18 nt, Homo sapiens
ucaccccaacuaguagcu

SEQ ID NO: 802091 - RNA, 18 nt, Homo sapiens
ucaccccacucagcucac

SEQ ID NO: 802092 - RNA, 19 nt, Homo sapiens
ucacccggcccccaugcaa

SEQ ID NO: 802093 - RNA, 13 nt, Homo sapiens
ucacccugccuua

SEQ ID NO: 802094 - RNA, 17 nt, Homo sapiens
ucacccugucaaguuaa

SEQ ID NO: 802095 - RNA, 14 nt, Homo sapiens
ucacccuguccaaa

SEQ ID NO: 802096 - RNA, 16 nt, Homo sapiens
ucaccgcauggacaag

SEQ ID NO: 802097 - RNA, 22 nt, Homo sapiens
ucaccggagcuuucaaagaagg

SEQ ID NO: 802098 - RNA, 17 nt, Homo sapiens
ucaccguccucacccau

SEQ ID NO: 802099 - RNA, 14 nt, Homo sapiens
ucaccgugagcagc

SEQ ID NO: 802100 - RNA, 20 nt, Homo sapiens
ucaccuaaacuuguacuuua

SEQ ID NO: 802101 - RNA, 18 nt, Homo sapiens
ucaccuacauuaucucac

SEQ ID NO: 802102 - RNA, 19 nt, Homo sapiens
ucaccuagaacgugcaucc

SEQ ID NO: 802103 - RNA, 20 nt, Homo sapiens
ucaccuagcagccucaaaac

SEQ ID NO: 802104 - RNA, 19 nt, Homo sapiens
ucaccucagggguuaagag

SEQ ID NO: 802105 - RNA, 19 nt, Homo sapiens
ucaccuccaagcauuucau

SEQ ID NO: 802106 - RNA, 23 nt, Homo sapiens
ucaccuccggucgugucucuggu

SEQ ID NO: 802107 - RNA, 15 nt, Homo sapiens
ucaccuccucuguga

SEQ ID NO: 802108 - RNA, 17 nt, Homo sapiens
ucaccuccucugugauu

SEQ ID NO: 802109 - RNA, 14 nt, Homo sapiens
ucaccucucuucag

SEQ ID NO: 802110 - RNA, 15 nt, Homo sapiens
ucaccucuuccucug

SEQ ID NO: 802111 - RNA, 14 nt, Homo sapiens
ucaccucuugccuu

SEQ ID NO: 802112 - RNA, 16 nt, Homo sapiens
ucaccucuugccuucu

SEQ ID NO: 802113 - RNA, 21 nt, Homo sapiens
ucaccugcuggggaccucacc

SEQ ID NO: 802114 - RNA, 21 nt, Homo sapiens
ucaccuggacuuaagcaucug

SEQ ID NO: 802115 - RNA, 19 nt, Homo sapiens
ucaccuggccugguugugu

SEQ ID NO: 802116 - RNA, 19 nt, Homo sapiens
ucaccugggaccuuacucc

SEQ ID NO: 802117 - RNA, 16 nt, Homo sapiens
ucaccugguaccugga

SEQ ID NO: 802118 - RNA, 20 nt, Homo sapiens
ucaccugugacuccuguugc

SEQ ID NO: 802119 - RNA, 13 nt, Homo sapiens
ucaccuuacaggg

SEQ ID NO: 802120 - RNA, 15 nt, Homo sapiens
ucaccuucuagucuu

SEQ ID NO: 802121 - RNA, 13 nt, Homo sapiens
ucaccuucuuccc

SEQ ID NO: 802122 - RNA, 19 nt, Homo sapiens
ucaccuugggaugaugccu

SEQ ID NO: 802123 - RNA, 21 nt, Homo sapiens
ucaccuugggaugaugccuca

SEQ ID NO: 802124 - RNA, 17 nt, Homo sapiens
ucaccuuuguaagacau

SEQ ID NO: 802125 - RNA, 22 nt, Homo sapiens
ucacgaguaagauuaagagcaa

SEQ ID NO: 802126 - RNA, 18 nt, Homo sapiens
ucacggcugcgcacugug

SEQ ID NO: 802127 - RNA, 17 nt, Homo sapiens
ucacguuuccuuuucau

SEQ ID NO: 802128 - RNA, 15 nt, Homo sapiens
ucacuaauacacagu

SEQ ID NO: 802129 - RNA, 21 nt, Homo sapiens
ucacuaauuuaaguacuugag

SEQ ID NO: 802130 - RNA, 21 nt, Homo sapiens
ucacuacaaucgcuaccugac

SEQ ID NO: 802131 - RNA, 18 nt, Homo sapiens
ucacuacugaacacaugu

SEQ ID NO: 802132 - RNA, 18 nt, Homo sapiens
ucacuagaaguccugcug

SEQ ID NO: 802133 - RNA, 20 nt, Homo sapiens
ucacuagaaguccugcugga

SEQ ID NO: 802134 - RNA, 13 nt, Homo sapiens
ucacuagcagcug

SEQ ID NO: 802135 - RNA, 23 nt, Homo sapiens
ucacuagccaugauaacugcaau

SEQ ID NO: 802136 - RNA, 21 nt, Homo sapiens
ucacuaggcccccacuugccu

SEQ ID NO: 802137 - RNA, 16 nt, Homo sapiens
ucacuaugaagguaaa

SEQ ID NO: 802138 - RNA, 15 nt, Homo sapiens
ucacuaugacacuga

SEQ ID NO: 802139 - RNA, 17 nt, Homo sapiens
ucacuauugaugcauuu

SEQ ID NO: 802140 - RNA, 22 nt, Homo sapiens
ucacucaagaguucagugcuca

SEQ ID NO: 802141 - RNA, 15 nt, Homo sapiens
ucacucauagccacu

SEQ ID NO: 802142 - RNA, 15 nt, Homo sapiens
ucacucauccauccc

SEQ ID NO: 802143 - RNA, 21 nt, Homo sapiens
ucacucauuaaugaaucacau

SEQ ID NO: 802144 - RNA, 14 nt, Homo sapiens
ucacucauugcuga

SEQ ID NO: 802145 - RNA, 20 nt, Homo sapiens
ucacuccaggauauugacaa

SEQ ID NO: 802146 - RNA, 19 nt, Homo sapiens
ucacuccccacaucccauc

SEQ ID NO: 802147 - RNA, 18 nt, Homo sapiens
ucacucuugaaguccagg

SEQ ID NO: 802148 - RNA, 17 nt, Homo sapiens
ucacugaaaccaggugg

SEQ ID NO: 802149 - RNA, 13 nt, Homo sapiens
ucacugaacucca

SEQ ID NO: 802150 - RNA, 9 nt, Homo sapiens
ucacugaga

SEQ ID NO: 802151 - RNA, 14 nt, Homo sapiens
ucacugcaaccucc

SEQ ID NO: 802152 - RNA, 18 nt, Homo sapiens
ucacugcagggcacugug

SEQ ID NO: 802153 - RNA, 14 nt, Homo sapiens
ucacugcucuucag

SEQ ID NO: 802154 - RNA, 22 nt, Homo sapiens
ucacugcugcaaauacuguaua

SEQ ID NO: 802155 - RNA, 16 nt, Homo sapiens
ucacugcuguagacau

SEQ ID NO: 802156 - RNA, 15 nt, Homo sapiens
ucacuggaaagggga

SEQ ID NO: 802157 - RNA, 23 nt, Homo sapiens
ucacuggcagccugcaccuggug

SEQ ID NO: 802158 - RNA, 24 nt, Homo sapiens
ucacuggccccuacuuuguggcaa

SEQ ID NO: 802159 - RNA, 19 nt, Homo sapiens
ucacugguauuaacuuuau

SEQ ID NO: 802160 - RNA, 14 nt, Homo sapiens
ucacugguugcacu

SEQ ID NO: 802161 - RNA, 14 nt, Homo sapiens
ucacuguacuugua

SEQ ID NO: 802162 - RNA, 19 nt, Homo sapiens
ucacuguauauaaacauau

SEQ ID NO: 802163 - RNA, 16 nt, Homo sapiens
ucacugucaucuucaa

SEQ ID NO: 802164 - RNA, 15 nt, Homo sapiens
ucacuguccugugaa

SEQ ID NO: 802165 - RNA, 17 nt, Homo sapiens
ucacugucuugccagau

SEQ ID NO: 802166 - RNA, 19 nt, Homo sapiens
ucacugugcuccaaccuga

SEQ ID NO: 802167 - RNA, 23 nt, Homo sapiens
ucacuguggaagaaauuccuucc

SEQ ID NO: 802168 - RNA, 17 nt, Homo sapiens
ucacuguguuacugcuu

SEQ ID NO: 802169 - RNA, 22 nt, Homo sapiens
ucacuuaaacuugcaucacuua

SEQ ID NO: 802170 - RNA, 14 nt, Homo sapiens
ucacuuaaucuuuc

SEQ ID NO: 802171 - RNA, 13 nt, Homo sapiens
ucacuucaguugc

SEQ ID NO: 802172 - RNA, 18 nt, Homo sapiens
ucacuucccuacauggag

SEQ ID NO: 802173 - RNA, 14 nt, Homo sapiens
ucacuucuaccugc

SEQ ID NO: 802174 - RNA, 18 nt, Homo sapiens
ucacuucucacaaugucc

SEQ ID NO: 802175 - RNA, 15 nt, Homo sapiens
ucacuugaguguaau

SEQ ID NO: 802176 - RNA, 23 nt, Homo sapiens
ucacuugccaaaauccaaggcaa

SEQ ID NO: 802177 - RNA, 20 nt, Homo sapiens
ucacuuggaagauuuguaua

SEQ ID NO: 802178 - RNA, 13 nt, Homo sapiens
ucacuuguacaaa

SEQ ID NO: 802179 - RNA, 20 nt, Homo sapiens
ucacuugugcaguguugaca

SEQ ID NO: 802180 - RNA, 23 nt, Homo sapiens
ucagaaaaaggaaaccacaguga

SEQ ID NO: 802181 - RNA, 20 nt, Homo sapiens
ucagaaacaggugcaucugg

SEQ ID NO: 802182 - RNA, 15 nt, Homo sapiens
ucagaaagauaagcc

SEQ ID NO: 802183 - RNA, 13 nt, Homo sapiens
ucagaaagggauu

SEQ ID NO: 802184 - RNA, 21 nt, Homo sapiens
ucagaaaguaacaaucuaugg

SEQ ID NO: 802185 - RNA, 20 nt, Homo sapiens
ucagaaauaugacaauuaau

SEQ ID NO: 802186 - RNA, 18 nt, Homo sapiens
ucagaaaugcugucauaa

SEQ ID NO: 802187 - RNA, 23 nt, Homo sapiens
uccaucacccucuuccugugauc

SEQ ID NO: 802188 - RNA, 18 nt, Homo sapiens
uccaucacguuagcuguc

SEQ ID NO: 802189 - RNA, 19 nt, Homo sapiens
uccaucagagccagucuca

SEQ ID NO: 802190 - RNA, 13 nt, Homo sapiens
uccaucagauucu

SEQ ID NO: 802191 - RNA, 14 nt, Homo sapiens
uccaucagauucug

SEQ ID NO: 802192 - RNA, 15 nt, Homo sapiens
uccaucaucacugua

SEQ ID NO: 802193 - RNA, 17 nt, Homo sapiens
uccaucauggcugcuug

SEQ ID NO: 802194 - RNA, 15 nt, Homo sapiens
uccaucaugucugua

SEQ ID NO: 802195 - RNA, 14 nt, Homo sapiens
uccauccaguuccu

SEQ ID NO: 802196 - RNA, 17 nt, Homo sapiens
uccauccauuaccucca

SEQ ID NO: 802197 - RNA, 14 nt, Homo sapiens
uccaucccagacau

SEQ ID NO: 802198 - RNA, 16 nt, Homo sapiens
uccaucccuccauuca

SEQ ID NO: 802199 - RNA, 20 nt, Homo sapiens
uccauccuuuacguguuuaa

SEQ ID NO: 802200 - RNA, 21 nt, Homo sapiens
uccaucucucauccuccagua

SEQ ID NO: 802201 - RNA, 17 nt, Homo sapiens
uccaucucugccuguca

SEQ ID NO: 802202 - RNA, 17 nt, Homo sapiens
uccaucucugucucaaa

SEQ ID NO: 802203 - RNA, 12 nt, Homo sapiens
uccaucugucca

SEQ ID NO: 802204 - RNA, 15 nt, Homo sapiens
uccaugaacaucaug

SEQ ID NO: 802205 - RNA, 21 nt, Homo sapiens
uccaugaacaucauggacuga

SEQ ID NO: 802206 - RNA, 13 nt, Homo sapiens
uccaugcaugugc

SEQ ID NO: 802207 - RNA, 22 nt, Homo sapiens
uccaugcugcaaaggagaagca

SEQ ID NO: 802208 - RNA, 13 nt, Homo sapiens
uccaugcugccag

SEQ ID NO: 802209 - RNA, 14 nt, Homo sapiens
uccaugcugugcgc

SEQ ID NO: 802210 - RNA, 17 nt, Homo sapiens
uccauguaaauugcaaa

SEQ ID NO: 802211 - RNA, 11 nt, Homo sapiens
uccaugucucg

SEQ ID NO: 802212 - RNA, 12 nt, Homo sapiens
uccaugugaaau

SEQ ID NO: 802213 - RNA, 17 nt, Homo sapiens
uccauguuugcaccugu

SEQ ID NO: 802214 - RNA, 22 nt, Homo sapiens
uccauguuugcaccugugcauu

SEQ ID NO: 802215 - RNA, 20 nt, Homo sapiens
uccauuaaauggucuaaaau

SEQ ID NO: 802216 - RNA, 16 nt, Homo sapiens
uccauuaaguacaugu

SEQ ID NO: 802217 - RNA, 17 nt, Homo sapiens
uccauucacaccagcua

SEQ ID NO: 802218 - RNA, 23 nt, Homo sapiens
uccauucauaaggauucagggaa

SEQ ID NO: 802219 - RNA, 14 nt, Homo sapiens
uccauucuucgaca

SEQ ID NO: 802220 - RNA, 17 nt, Homo sapiens
uccauugguguugacau

SEQ ID NO: 802221 - RNA, 20 nt, Homo sapiens
uccauuucccacaucuuucc

SEQ ID NO: 802222 - RNA, 16 nt, Homo sapiens
uccauuugcaaauaua

SEQ ID NO: 802223 - RNA, 20 nt, Homo sapiens
uccauuuuaacaacugcucu

SEQ ID NO: 802224 - RNA, 21 nt, Homo sapiens
uccauuuuuccucuguucaca

SEQ ID NO: 802225 - RNA, 19 nt, Homo sapiens
ucccaaagccagaaccaga

SEQ ID NO: 802226 - RNA, 13 nt, Homo sapiens
ucccaaagugcug

SEQ ID NO: 802227 - RNA, 19 nt, Homo sapiens
ucccaaagugcugaauuaa

SEQ ID NO: 802228 - RNA, 14 nt, Homo sapiens
ucccaacacuguca

SEQ ID NO: 802229 - RNA, 13 nt, Homo sapiens
ucccaacccauuc

SEQ ID NO: 802230 - RNA, 22 nt, Homo sapiens
ucccaaccccaguggauucuca

SEQ ID NO: 802231 - RNA, 23 nt, Homo sapiens
ucccaaccucaaugcccugccau

SEQ ID NO: 802232 - RNA, 14 nt, Homo sapiens
ucccaacucuugca

SEQ ID NO: 802233 - RNA, 20 nt, Homo sapiens
ucccaagcaccugggauuac

SEQ ID NO: 802234 - RNA, 12 nt, Homo sapiens
ucccaagcugcc

SEQ ID NO: 802235 - RNA, 20 nt, Homo sapiens
ucccaaguaacugggauuac

SEQ ID NO: 802236 - RNA, 14 nt, Homo sapiens
ucccaaguaugccu

SEQ ID NO: 802237 - RNA, 16 nt, Homo sapiens
ucccaaguaugccuua

SEQ ID NO: 802238 - RNA, 23 nt, Homo sapiens
ucccaauaacuaaugcuaagaaa

SEQ ID NO: 802239 - RNA, 16 nt, Homo sapiens
ucccaaucaaagaauu

SEQ ID NO: 802240 - RNA, 16 nt, Homo sapiens
ucccaaucagcacuga

SEQ ID NO: 802241 - RNA, 17 nt, Homo sapiens
ucccaaucagcacugaa

SEQ ID NO: 802242 - RNA, 22 nt, Homo sapiens
ucccaauuucagacucccauuc

SEQ ID NO: 802243 - RNA, 17 nt, Homo sapiens
ucccacauccaacucca

SEQ ID NO: 802244 - RNA, 15 nt, Homo sapiens
ucccacauuagcuug

SEQ ID NO: 802245 - RNA, 13 nt, Homo sapiens
ucccaccauuccc

SEQ ID NO: 802246 - RNA, 21 nt, Homo sapiens
ucccacccacaugugacacau

SEQ ID NO: 802247 - RNA, 16 nt, Homo sapiens
ucccacccaccuguag

SEQ ID NO: 802248 - RNA, 17 nt, Homo sapiens
ucccaccccggccucca

SEQ ID NO: 802249 - RNA, 14 nt, Homo sapiens
ucccaccucagccu

SEQ ID NO: 802250 - RNA, 14 nt, Homo sapiens
ucccaccugcaucu

SEQ ID NO: 802251 - RNA, 14 nt, Homo sapiens
ucccacuccugcug

SEQ ID NO: 802252 - RNA, 15 nt, Homo sapiens
ucccacugcacucca

SEQ ID NO: 802253 - RNA, 13 nt, Homo sapiens
ucccacuguauga

SEQ ID NO: 802254 - RNA, 22 nt, Homo sapiens
ucccacuuggaggccuuucauc

SEQ ID NO: 802255 - RNA, 15 nt, Homo sapiens
ucccacuugucaugu

SEQ ID NO: 802256 - RNA, 18 nt, Homo sapiens
ucccagaaacaucucugg

SEQ ID NO: 802257 - RNA, 16 nt, Homo sapiens
ucccagaaaggucucu

SEQ ID NO: 802258 - RNA, 18 nt, Homo sapiens
ucccagacggucaggaaa

SEQ ID NO: 802259 - RNA, 13 nt, Homo sapiens
ucccagagcaccu

SEQ ID NO: 802260 - RNA, 22 nt, Homo sapiens
ucccagaggcagagccugaguc

SEQ ID NO: 802261 - RNA, 16 nt, Homo sapiens
ucccagagucaucuga

SEQ ID NO: 802262 - RNA, 16 nt, Homo sapiens
ucccagauacacuaaa

SEQ ID NO: 802263 - RNA, 17 nt, Homo sapiens
ucccagauggcuggaag

SEQ ID NO: 802264 - RNA, 13 nt, Homo sapiens
ucccagcacuuuu

SEQ ID NO: 802265 - RNA, 23 nt, Homo sapiens
ucccagcagcccuaaggaucucu

SEQ ID NO: 802266 - RNA, 18 nt, Homo sapiens
ucccagccucuugcucag

SEQ ID NO: 802267 - RNA, 20 nt, Homo sapiens
ucccagcguuaacacaaaau

SEQ ID NO: 802268 - RNA, 22 nt, Homo sapiens
ucccagcuacucagguggcuaa

SEQ ID NO: 802269 - RNA, 15 nt, Homo sapiens
ucccagcuacucggg

SEQ ID NO: 802270 - RNA, 17 nt, Homo sapiens
ucccagcugaaggcagu

SEQ ID NO: 802271 - RNA, 20 nt, Homo sapiens
ucccaggacagaaagaucuu

SEQ ID NO: 802272 - RNA, 13 nt, Homo sapiens
ucccaggccaggc

SEQ ID NO: 802273 - RNA, 16 nt, Homo sapiens
ucccagggcucugcag

SEQ ID NO: 802274 - RNA, 23 nt, Homo sapiens
ucccaggguggacuucagugugu

SEQ ID NO: 802275 - RNA, 22 nt, Homo sapiens
ucccagguguuaacauuccaag

SEQ ID NO: 802276 - RNA, 18 nt, Homo sapiens
ucccagguucaagugcuu

SEQ ID NO: 802277 - RNA, 19 nt, Homo sapiens
ucccaguccaccugaggaa

SEQ ID NO: 802278 - RNA, 16 nt, Homo sapiens
ucccagugaugcugua

SEQ ID NO: 802279 - RNA, 20 nt, Homo sapiens
ucccauaauugcuuugccaa

SEQ ID NO: 802280 - RNA, 21 nt, Homo sapiens
ucccauaauugcuuugccaaa

SEQ ID NO: 802281 - RNA, 17 nt, Homo sapiens
ucccauccuugaugcaa

SEQ ID NO: 802282 - RNA, 21 nt, Homo sapiens
ucccauggguuaagagcucac

SEQ ID NO: 802283 - RNA, 16 nt, Homo sapiens
ucccauggucaaugca

SEQ ID NO: 802284 - RNA, 20 nt, Homo sapiens
ucccaugugagucccuguga

SEQ ID NO: 802285 - RNA, 21 nt, Homo sapiens
ucccaugugagucccugugau

SEQ ID NO: 802286 - RNA, 22 nt, Homo sapiens
ucccauuacuuugauaucugau

SEQ ID NO: 802287 - RNA, 16 nt, Homo sapiens
ucccauuccugaagaa

SEQ ID NO: 802288 - RNA, 21 nt, Homo sapiens
ucccauuuuucucuugccauu

SEQ ID NO: 802289 - RNA, 16 nt, Homo sapiens
uccccaaccacuucau

SEQ ID NO: 802290 - RNA, 15 nt, Homo sapiens
uccccaacuucccua

SEQ ID NO: 802291 - RNA, 17 nt, Homo sapiens
uccccaagcaccuuccc

SEQ ID NO: 802292 - RNA, 22 nt, Homo sapiens
uccccaauuggcucuagucacu

SEQ ID NO: 802293 - RNA, 17 nt, Homo sapiens
uccccacacagggcacu

SEQ ID NO: 802294 - RNA, 14 nt, Homo sapiens
uccccacacuccac

SEQ ID NO: 802295 - RNA, 15 nt, Homo sapiens
uccccacacuccacu

SEQ ID NO: 802296 - RNA, 13 nt, Homo sapiens
uccccacagugcc

SEQ ID NO: 802297 - RNA, 17 nt, Homo sapiens
uccccacccagucucau

SEQ ID NO: 802298 - RNA, 19 nt, Homo sapiens
uccccacccagucucaugu

SEQ ID NO: 802299 - RNA, 22 nt, Homo sapiens
uccccacugcucucugugguga

SEQ ID NO: 802300 - RNA, 13 nt, Homo sapiens
uccccagagcugu

SEQ ID NO: 802301 - RNA, 16 nt, Homo sapiens
uccccagaugugacua

SEQ ID NO: 802302 - RNA, 23 nt, Homo sapiens
ucucaaaacagagggcugcauuc

SEQ ID NO: 802303 - RNA, 22 nt, Homo sapiens
ucucaaacacaguuacacuugu

SEQ ID NO: 802304 - RNA, 20 nt, Homo sapiens
ucucaaacuccugaccucaa

SEQ ID NO: 802305 - RNA, 19 nt, Homo sapiens
ucucaaaggcccucaguga

SEQ ID NO: 802306 - RNA, 19 nt, Homo sapiens
ucucaaaguacugggauua

SEQ ID NO: 802307 - RNA, 16 nt, Homo sapiens
ucucaaaugcacaucu

SEQ ID NO: 802308 - RNA, 22 nt, Homo sapiens
ucucaaauucauggugcacuga

SEQ ID NO: 802309 - RNA, 20 nt, Homo sapiens
ucucaacuggguccagaaga

SEQ ID NO: 802310 - RNA, 14 nt, Homo sapiens
ucucaauaguaaaa

SEQ ID NO: 802311 - RNA, 17 nt, Homo sapiens
ucucaaucagugcagug

SEQ ID NO: 802312 - RNA, 16 nt, Homo sapiens
ucucaaucuugaacuc

SEQ ID NO: 802313 - RNA, 14 nt, Homo sapiens
ucucaauguacaua

SEQ ID NO: 802314 - RNA, 16 nt, Homo sapiens
ucucacagauugcugc

SEQ ID NO: 802315 - RNA, 22 nt, Homo sapiens
ucucacauaagcccaguucauc

SEQ ID NO: 802316 - RNA, 15 nt, Homo sapiens
ucucacccauuaucu

SEQ ID NO: 802317 - RNA, 18 nt, Homo sapiens
ucucaccuuaccugguga

SEQ ID NO: 802318 - RNA, 21 nt, Homo sapiens
ucucacuacuugaccauucuc

SEQ ID NO: 802319 - RNA, 23 nt, Homo sapiens
ucucacucccuguuuuaauucaa

SEQ ID NO: 802320 - RNA, 14 nt, Homo sapiens
ucucacuugucuca

SEQ ID NO: 802321 - RNA, 18 nt, Homo sapiens
ucucacuugugcaguguu

SEQ ID NO: 802322 - RNA, 18 nt, Homo sapiens
ucucagaagccuagggga

SEQ ID NO: 802323 - RNA, 14 nt, Homo sapiens
ucucagaagguauu

SEQ ID NO: 802324 - RNA, 16 nt, Homo sapiens
ucucagaauccaaaga

SEQ ID NO: 802325 - RNA, 14 nt, Homo sapiens
ucucagaauucuuc

SEQ ID NO: 802326 - RNA, 14 nt, Homo sapiens
ucucagaggacaau

SEQ ID NO: 802327 - RNA, 18 nt, Homo sapiens
ucucagagugacagucau

SEQ ID NO: 802328 - RNA, 15 nt, Homo sapiens
ucucagauuccaugc

SEQ ID NO: 802329 - RNA, 20 nt, Homo sapiens
ucucagcccccgcccgucac

SEQ ID NO: 802330 - RNA, 18 nt, Homo sapiens
ucucagcuaccuaagaaa

SEQ ID NO: 802331 - RNA, 13 nt, Homo sapiens
ucucagcucacua

SEQ ID NO: 802332 - RNA, 20 nt, Homo sapiens
ucucagcucacuacaaccuc

SEQ ID NO: 802333 - RNA, 22 nt, Homo sapiens
ucucagcucacuacaaccuccg

SEQ ID NO: 802334 - RNA, 21 nt, Homo sapiens
ucucagcucacugcaaccucc

SEQ ID NO: 802335 - RNA, 16 nt, Homo sapiens
ucucaggaccucugua

SEQ ID NO: 802336 - RNA, 21 nt, Homo sapiens
ucucaggcucuugacuacuug

SEQ ID NO: 802337 - RNA, 21 nt, Homo sapiens
ucucagggaagcccagcucca

SEQ ID NO: 802338 - RNA, 20 nt, Homo sapiens
ucucaggggccaacuaggca

SEQ ID NO: 802339 - RNA, 20 nt, Homo sapiens
ucucaggggucuuaccuuga

SEQ ID NO: 802340 - RNA, 20 nt, Homo sapiens
ucucaguaccccauggagcu

SEQ ID NO: 802341 - RNA, 17 nt, Homo sapiens
ucucaguaucaguauuu

SEQ ID NO: 802342 - RNA, 17 nt, Homo sapiens
ucucagugaaauaacua

SEQ ID NO: 802343 - RNA, 20 nt, Homo sapiens
ucucagugcuuugcauguau

SEQ ID NO: 802344 - RNA, 16 nt, Homo sapiens
ucucaguggagccuua

SEQ ID NO: 802345 - RNA, 15 nt, Homo sapiens
ucucaguucuugagg

SEQ ID NO: 802346 - RNA, 14 nt, Homo sapiens
ucucauaaaugagg

SEQ ID NO: 802347 - RNA, 20 nt, Homo sapiens
ucucauacugucugggauua

SEQ ID NO: 802348 - RNA, 12 nt, Homo sapiens
ucucauaggaga

SEQ ID NO: 802349 - RNA, 16 nt, Homo sapiens
ucucaucagacucuga

SEQ ID NO: 802350 - RNA, 16 nt, Homo sapiens
ucucaucaguccauug

SEQ ID NO: 802351 - RNA, 23 nt, Homo sapiens
ucucaucaguguccucuugcuca

SEQ ID NO: 802352 - RNA, 22 nt, Homo sapiens
ucucaucucuucagguucucau

SEQ ID NO: 802353 - RNA, 16 nt, Homo sapiens
ucucaucuuucuugau

SEQ ID NO: 802354 - RNA, 17 nt, Homo sapiens
ucucaugauaccaccuu

SEQ ID NO: 802355 - RNA, 13 nt, Homo sapiens
ucucauuccagag

SEQ ID NO: 802356 - RNA, 19 nt, Homo sapiens
ucucauuuaaaaugagauc

SEQ ID NO: 802357 - RNA, 16 nt, Homo sapiens
ucucauuuagaacuug

SEQ ID NO: 802358 - RNA, 17 nt, Homo sapiens
ucucauuuauauugcag

SEQ ID NO: 802359 - RNA, 21 nt, Homo sapiens
ucucauuuauauugcagauug

SEQ ID NO: 802360 - RNA, 21 nt, Homo sapiens
ucucauuuggucugccagaau

SEQ ID NO: 802361 - RNA, 14 nt, Homo sapiens
ucuccaaaugagau

SEQ ID NO: 802362 - RNA, 17 nt, Homo sapiens
ucuccaaaugagaucua

SEQ ID NO: 802363 - RNA, 21 nt, Homo sapiens
ucuccaaccccccagcacuga

SEQ ID NO: 802364 - RNA, 18 nt, Homo sapiens
ucuccacacccacuuugu

SEQ ID NO: 802365 - RNA, 14 nt, Homo sapiens
ucuccaucccugaa

SEQ ID NO: 802366 - RNA, 20 nt, Homo sapiens
ucuccaugaauuaguucucc

SEQ ID NO: 802367 - RNA, 13 nt, Homo sapiens
ucuccaugcucac

SEQ ID NO: 802368 - RNA, 18 nt, Homo sapiens
ucucccaaaaaacuacuu

SEQ ID NO: 802369 - RNA, 21 nt, Homo sapiens
ucucccacuaaaacugcauuu

SEQ ID NO: 802370 - RNA, 21 nt, Homo sapiens
ucucccagugacaacaucgca

SEQ ID NO: 802371 - RNA, 17 nt, Homo sapiens
ucuccccaggcauuugc

SEQ ID NO: 802372 - RNA, 13 nt, Homo sapiens
ucuccccaugugc

SEQ ID NO: 802373 - RNA, 13 nt, Homo sapiens
ucuccccucugca

SEQ ID NO: 802374 - RNA, 17 nt, Homo sapiens
ucuccccugcacuguaa

SEQ ID NO: 802375 - RNA, 17 nt, Homo sapiens
ucucccuccaguccucu

SEQ ID NO: 802376 - RNA, 22 nt, Homo sapiens
ucucccucuggucuacucuaga

SEQ ID NO: 802377 - RNA, 13 nt, Homo sapiens
ucucccugccaag

SEQ ID NO: 802378 - RNA, 14 nt, Homo sapiens
ucucccugccaagu

SEQ ID NO: 802379 - RNA, 14 nt, Homo sapiens
ucucccuugcccuc

SEQ ID NO: 802380 - RNA, 13 nt, Homo sapiens
ucuccgacucugc

SEQ ID NO: 802381 - RNA, 18 nt, Homo sapiens
ucuccgcaucgcauccuc

SEQ ID NO: 802382 - RNA, 16 nt, Homo sapiens
ucuccguaauuagcau

SEQ ID NO: 802383 - RNA, 17 nt, Homo sapiens
ucuccuaaagcuuuuau

SEQ ID NO: 802384 - RNA, 21 nt, Homo sapiens
ucuccuaagcuggagugcagu

SEQ ID NO: 802385 - RNA, 18 nt, Homo sapiens
ucuccuauguaguucuca

SEQ ID NO: 802386 - RNA, 15 nt, Homo sapiens
ucuccuauguggcag

SEQ ID NO: 802387 - RNA, 17 nt, Homo sapiens
ucuccuauguggcagcu

SEQ ID NO: 802388 - RNA, 21 nt, Homo sapiens
ucuccucaacccacauggggu

SEQ ID NO: 802389 - RNA, 12 nt, Homo sapiens
ucuccucagggu

SEQ ID NO: 802390 - RNA, 18 nt, Homo sapiens
ucuccucccaagguuuga

SEQ ID NO: 802391 - RNA, 15 nt, Homo sapiens
ucuccucucuuggca

SEQ ID NO: 802392 - RNA, 16 nt, Homo sapiens
ucuccugccaccaaga

SEQ ID NO: 802393 - RNA, 16 nt, Homo sapiens
ucuccuucccauuucu

SEQ ID NO: 802394 - RNA, 18 nt, Homo sapiens
ucuccuuugcaggcucau

SEQ ID NO: 802395 - RNA, 15 nt, Homo sapiens
ucuccuuuuacuuca

SEQ ID NO: 802396 - RNA, 15 nt, Homo sapiens
ucuccuuuugaccaa

SEQ ID NO: 802397 - RNA, 20 nt, Homo sapiens
ucucgaagugcugagauuac

SEQ ID NO: 802398 - RNA, 18 nt, Homo sapiens
ucucgcucuguugcccag

SEQ ID NO: 802399 - RNA, 18 nt, Homo sapiens
ucucgcuuuguugcccag

SEQ ID NO: 802400 - RNA, 15 nt, Homo sapiens
ucucggcucacugaa

SEQ ID NO: 802401 - RNA, 20 nt, Homo sapiens
ucucggcuuauggcaaccuc

SEQ ID NO: 802402 - RNA, 17 nt, Homo sapiens
ucucgggugggggagcc

SEQ ID NO: 802403 - RNA, 18 nt, Homo sapiens
ucucgguagcugugcgug

SEQ ID NO: 802404 - RNA, 14 nt, Homo sapiens
ucucgugcauuuca

SEQ ID NO: 802405 - RNA, 15 nt, Homo sapiens
ucucgugcauuucaa

SEQ ID NO: 802406 - RNA, 17 nt, Homo sapiens
ucucuaaaauucuaguc

SEQ ID NO: 802407 - RNA, 16 nt, Homo sapiens
ucucuaacuccugcca

SEQ ID NO: 802408 - RNA, 15 nt, Homo sapiens
ucucuacuaaaacau

SEQ ID NO: 802409 - RNA, 17 nt, Homo sapiens
ucucuacuaaaaguaca

SEQ ID NO: 802410 - RNA, 19 nt, Homo sapiens
ucucuacuaccacaaggaa

SEQ ID NO: 802411 - RNA, 16 nt, Homo sapiens
ucucuaggccucucca

SEQ ID NO: 802412 - RNA, 17 nt, Homo sapiens
ucucuagugucuuuugc

SEQ ID NO: 802413 - RNA, 23 nt, Homo sapiens
ucucuaugccagcucagucccau

SEQ ID NO: 802414 - RNA, 16 nt, Homo sapiens
ucucuccaguguuucu

SEQ ID NO: 802415 - RNA, 19 nt, Homo sapiens
ucucuccaguguuucuaca

SEQ ID NO: 802416 - RNA, 19 nt, Homo sapiens
ucucuccccagaugugacu

SEQ ID NO: 802417 - RNA, 20 nt, Homo sapiens
ugcuaaucacauccacaaaa

SEQ ID NO: 802418 - RNA, 21 nt, Homo sapiens
ugcuaaucagggaggucauuu

SEQ ID NO: 802419 - RNA, 23 nt, Homo sapiens
ugcuaaucaugugggugagccag

SEQ ID NO: 802420 - RNA, 20 nt, Homo sapiens
ugcuaaucuucuuaugcaau

SEQ ID NO: 802421 - RNA, 17 nt, Homo sapiens
ugcuacaaaaacacagc

SEQ ID NO: 802422 - RNA, 21 nt, Homo sapiens
ugcuacagcaauuucuaauuu

SEQ ID NO: 802423 - RNA, 20 nt, Homo sapiens
ugcuacccauuuacaaauaa

SEQ ID NO: 802424 - RNA, 17 nt, Homo sapiens
ugcuaccugugagcauc

SEQ ID NO: 802425 - RNA, 24 nt, Homo sapiens
ugcuacugauuguuucauugcgaa

SEQ ID NO: 802426 - RNA, 16 nt, Homo sapiens
ugcuacuuaacaaagu

SEQ ID NO: 802427 - RNA, 23 nt, Homo sapiens
ugcuagaaaguuaggggguucuu

SEQ ID NO: 802428 - RNA, 23 nt, Homo sapiens
ugcuagaacaacgccugucacag

SEQ ID NO: 802429 - RNA, 12 nt, Homo sapiens
ugcuagaacaag

SEQ ID NO: 802430 - RNA, 17 nt, Homo sapiens
ugcuagaugcugugaca

SEQ ID NO: 802431 - RNA, 13 nt, Homo sapiens
ugcuagcaguaaa

SEQ ID NO: 802432 - RNA, 13 nt, Homo sapiens
ugcuagcuguaga

SEQ ID NO: 802433 - RNA, 20 nt, Homo sapiens
ugcuaggcgcuggggagacu

SEQ ID NO: 802434 - RNA, 17 nt, Homo sapiens
ugcuagggaaacuuccc

SEQ ID NO: 802435 - RNA, 13 nt, Homo sapiens
ugcuagggaccuc

SEQ ID NO: 802436 - RNA, 18 nt, Homo sapiens
ugcuauauaguaucuacc

SEQ ID NO: 802437 - RNA, 18 nt, Homo sapiens
ugcuauauugcacuguga

SEQ ID NO: 802438 - RNA, 19 nt, Homo sapiens
ugcuaugaagcguugaugg

SEQ ID NO: 802439 - RNA, 14 nt, Homo sapiens
ugcuaugacuguau

SEQ ID NO: 802440 - RNA, 15 nt, Homo sapiens
ugcuauguucugucu

SEQ ID NO: 802441 - RNA, 19 nt, Homo sapiens
ugcuauuuauuuuccuaaa

SEQ ID NO: 802442 - RNA, 21 nt, Homo sapiens
ugcucaaaauugcuucuaaaa

SEQ ID NO: 802443 - RNA, 22 nt, Homo sapiens
ugcucaacaauuuauccauuca

SEQ ID NO: 802444 - RNA, 19 nt, Homo sapiens
ugcucaauaaaaauguguu

SEQ ID NO: 802445 - RNA, 16 nt, Homo sapiens
ugcucaauacaucuca

SEQ ID NO: 802446 - RNA, 18 nt, Homo sapiens
ugcucaaucccugaggac

SEQ ID NO: 802447 - RNA, 17 nt, Homo sapiens
ugcucagacccaacagc

SEQ ID NO: 802448 - RNA, 20 nt, Homo sapiens
ugcucagagaaggaaaagac

SEQ ID NO: 802449 - RNA, 16 nt, Homo sapiens
ugcucagcagccaguc

SEQ ID NO: 802450 - RNA, 17 nt, Homo sapiens
ugcucagcaugauucuu

SEQ ID NO: 802451 - RNA, 21 nt, Homo sapiens
ugcucagcccugcaccaugcu

SEQ ID NO: 802452 - RNA, 19 nt, Homo sapiens
ugcucaggagccaccagca

SEQ ID NO: 802453 - RNA, 20 nt, Homo sapiens
ugcucaggcuugaaaugcau

SEQ ID NO: 802454 - RNA, 20 nt, Homo sapiens
ugcucaguguuuuugugaau

SEQ ID NO: 802455 - RNA, 14 nt, Homo sapiens
ugcucauaugcaug

SEQ ID NO: 802456 - RNA, 19 nt, Homo sapiens
ugcucauugcuaaccacug

SEQ ID NO: 802457 - RNA, 16 nt, Homo sapiens
ugcuccaagauucuag

SEQ ID NO: 802458 - RNA, 20 nt, Homo sapiens
ugcuccagauuagagccugu

SEQ ID NO: 802459 - RNA, 17 nt, Homo sapiens
ugcucccaacccauuca

SEQ ID NO: 802460 - RNA, 21 nt, Homo sapiens
ugcucccagcagcccuaagga

SEQ ID NO: 802461 - RNA, 13 nt, Homo sapiens
ugcucccaucauu

SEQ ID NO: 802462 - RNA, 23 nt, Homo sapiens
ugcuccccaggccaccccgcuga

SEQ ID NO: 802463 - RNA, 14 nt, Homo sapiens
ugcuccccugccac

SEQ ID NO: 802464 - RNA, 17 nt, Homo sapiens
ugcucccugacagcacc

SEQ ID NO: 802465 - RNA, 16 nt, Homo sapiens
ugcuccuccuacccuu

SEQ ID NO: 802466 - RNA, 19 nt, Homo sapiens
ugcuccuccuccuguauuc

SEQ ID NO: 802467 - RNA, 14 nt, Homo sapiens
ugcucgugugauuu

SEQ ID NO: 802468 - RNA, 17 nt, Homo sapiens
ugcucuaggaagacauu

SEQ ID NO: 802469 - RNA, 21 nt, Homo sapiens
ugcucuccccuccucggagga

SEQ ID NO: 802470 - RNA, 16 nt, Homo sapiens
ugcucucucugagggg

SEQ ID NO: 802471 - RNA, 16 nt, Homo sapiens
ugcucuucagccauag

SEQ ID NO: 802472 - RNA, 16 nt, Homo sapiens
ugcucuucaucccauu

SEQ ID NO: 802473 - RNA, 14 nt, Homo sapiens
ugcucuugccaaaa

SEQ ID NO: 802474 - RNA, 16 nt, Homo sapiens
ugcucuuggcugaccc

SEQ ID NO: 802475 - RNA, 20 nt, Homo sapiens
ugcucuugggaagaccagcu

SEQ ID NO: 802476 - RNA, 18 nt, Homo sapiens
ugcucuuucaucucugcu

SEQ ID NO: 802477 - RNA, 15 nt, Homo sapiens
ugcucuuuugugaug

SEQ ID NO: 802478 - RNA, 17 nt, Homo sapiens
ugcucuuuugugaugaa

SEQ ID NO: 802479 - RNA, 17 nt, Homo sapiens
ugcugaaaaaucaucca

SEQ ID NO: 802480 - RNA, 19 nt, Homo sapiens
ugcugaaacucagugcaaa

SEQ ID NO: 802481 - RNA, 13 nt, Homo sapiens
ugcugaacagugg

SEQ ID NO: 802482 - RNA, 14 nt, Homo sapiens
ugcugaacauugga

SEQ ID NO: 802483 - RNA, 18 nt, Homo sapiens
ugcugaacuccuuguuag

SEQ ID NO: 802484 - RNA, 14 nt, Homo sapiens
ugcugaagcugcug

SEQ ID NO: 802485 - RNA, 13 nt, Homo sapiens
ugcugaagggcag

SEQ ID NO: 802486 - RNA, 23 nt, Homo sapiens
ugcugaauauauagaauucagaa

SEQ ID NO: 802487 - RNA, 22 nt, Homo sapiens
ugcugaaucaaaucucuuccac

SEQ ID NO: 802488 - RNA, 17 nt, Homo sapiens
ugcugaaugccucgcuc

SEQ ID NO: 802489 - RNA, 18 nt, Homo sapiens
ugcugacaacuuagcuca

SEQ ID NO: 802490 - RNA, 14 nt, Homo sapiens
ugcugaccaauugu

SEQ ID NO: 802491 - RNA, 19 nt, Homo sapiens
ugcugaggccacccacuga

SEQ ID NO: 802492 - RNA, 21 nt, Homo sapiens
ugcugaggccacccacugacc

SEQ ID NO: 802493 - RNA, 23 nt, Homo sapiens
ugcugagggaccuuggagagcuc

SEQ ID NO: 802494 - RNA, 20 nt, Homo sapiens
ugcugaguauguuaagcucu

SEQ ID NO: 802495 - RNA, 19 nt, Homo sapiens
ugcugagugaaugaacaaa

SEQ ID NO: 802496 - RNA, 18 nt, Homo sapiens
ugcugauaucaacagcuu

SEQ ID NO: 802497 - RNA, 15 nt, Homo sapiens
ugcugaucgugcuaa

SEQ ID NO: 802498 - RNA, 22 nt, Homo sapiens
ugcugauguauuucaagucucu

SEQ ID NO: 802499 - RNA, 17 nt, Homo sapiens
ugcugcaaauacuguau

SEQ ID NO: 802500 - RNA, 20 nt, Homo sapiens
ugcugcacaaacaugaaaau

SEQ ID NO: 802501 - RNA, 23 nt, Homo sapiens
ugcugcacagaaauuuucaauuu

SEQ ID NO: 802502 - RNA, 18 nt, Homo sapiens
ugcugcaggcguacaggu

SEQ ID NO: 802503 - RNA, 15 nt, Homo sapiens
ugcugcagucaucua

SEQ ID NO: 802504 - RNA, 20 nt, Homo sapiens
ugcugccaaccauaccuucc

SEQ ID NO: 802505 - RNA, 16 nt, Homo sapiens
ugcugccacacugucu

SEQ ID NO: 802506 - RNA, 17 nt, Homo sapiens
ugcugccaggcacuguu

SEQ ID NO: 802507 - RNA, 14 nt, Homo sapiens
ugcugccauuugau

SEQ ID NO: 802508 - RNA, 19 nt, Homo sapiens
ugcugcugagugcaccacu

SEQ ID NO: 802509 - RNA, 23 nt, Homo sapiens
ugcugcugagugcaccacuucaa

SEQ ID NO: 802510 - RNA, 14 nt, Homo sapiens
ugcugcugcugcaa

SEQ ID NO: 802511 - RNA, 12 nt, Homo sapiens
ugcugcugcuuc

SEQ ID NO: 802512 - RNA, 14 nt, Homo sapiens
ugcugcugucuaca

SEQ ID NO: 802513 - RNA, 12 nt, Homo sapiens
ugcugcuuuaau

SEQ ID NO: 802514 - RNA, 13 nt, Homo sapiens
ugcuggaaaaagc

SEQ ID NO: 802515 - RNA, 16 nt, Homo sapiens
ugcuggaaaugcugac

SEQ ID NO: 802516 - RNA, 22 nt, Homo sapiens
ugcuggaaguagaauuugucca

SEQ ID NO: 802517 - RNA, 14 nt, Homo sapiens
ugcuggacugugga

SEQ ID NO: 802518 - RNA, 19 nt, Homo sapiens
ugcuggagaggaacccaga

SEQ ID NO: 802519 - RNA, 19 nt, Homo sapiens
ugcuggaggaauuuuguca

SEQ ID NO: 802520 - RNA, 14 nt, Homo sapiens
ugcuggaucuugcc

SEQ ID NO: 802521 - RNA, 14 nt, Homo sapiens
ugcuggaugcauuu

SEQ ID NO: 802522 - RNA, 19 nt, Homo sapiens
ugcuggauggccugaggaa

SEQ ID NO: 802523 - RNA, 14 nt, Homo sapiens
ugcuggcagaaagc

SEQ ID NO: 802524 - RNA, 13 nt, Homo sapiens
ugcuggcauuugc

SEQ ID NO: 802525 - RNA, 15 nt, Homo sapiens
ugcuggcauuugcac

SEQ ID NO: 802526 - RNA, 22 nt, Homo sapiens
ugcuggcauuugcaccuaccuc

SEQ ID NO: 802527 - RNA, 18 nt, Homo sapiens
ugcuggccuggaucuccc

SEQ ID NO: 802528 - RNA, 14 nt, Homo sapiens
ugcuggcucucaga

SEQ ID NO: 802529 - RNA, 20 nt, Homo sapiens
ugcugggcacuucaucugau

SEQ ID NO: 802530 - RNA, 18 nt, Homo sapiens
ugcugggcucuccaccuc

SEQ ID NO: 802531 - RNA, 16 nt, Homo sapiens
uggccuaugcacauau

SEQ ID NO: 802532 - RNA, 22 nt, Homo sapiens
uggccuaugcacauauggacuc

SEQ ID NO: 802533 - RNA, 23 nt, Homo sapiens
uggccucacccaccccugcacag

SEQ ID NO: 802534 - RNA, 17 nt, Homo sapiens
uggccuccccugccacc

SEQ ID NO: 802535 - RNA, 22 nt, Homo sapiens
uggccuccccugccaccaggcc

SEQ ID NO: 802536 - RNA, 15 nt, Homo sapiens
uggccuccugugcau

SEQ ID NO: 802537 - RNA, 16 nt, Homo sapiens
uggccucgcuguucuc

SEQ ID NO: 802538 - RNA, 14 nt, Homo sapiens
uggccucucuagca

SEQ ID NO: 802539 - RNA, 14 nt, Homo sapiens
uggccucugcugaa

SEQ ID NO: 802540 - RNA, 23 nt, Homo sapiens
uggccucugcugaaugcagggaa

SEQ ID NO: 802541 - RNA, 19 nt, Homo sapiens
uggccugcugugauuccac

SEQ ID NO: 802542 - RNA, 12 nt, Homo sapiens
uggccugugcug

SEQ ID NO: 802543 - RNA, 16 nt, Homo sapiens
uggccugugucccaug

SEQ ID NO: 802544 - RNA, 23 nt, Homo sapiens
uggccuuccacgucuuccuccaa

SEQ ID NO: 802545 - RNA, 15 nt, Homo sapiens
uggccuucugggaac

SEQ ID NO: 802546 - RNA, 17 nt, Homo sapiens
uggccuugaaaccaccu

SEQ ID NO: 802547 - RNA, 13 nt, Homo sapiens
uggccuugcagcu

SEQ ID NO: 802548 - RNA, 17 nt, Homo sapiens
uggccuugugucacugg

SEQ ID NO: 802549 - RNA, 14 nt, Homo sapiens
uggcgacugucaug

SEQ ID NO: 802550 - RNA, 21 nt, Homo sapiens
uggcgcaaucucggcucacug

SEQ ID NO: 802551 - RNA, 22 nt, Homo sapiens
uggcggcugugcaucaguggga

SEQ ID NO: 802552 - RNA, 21 nt, Homo sapiens
uggcggcuuccuguccacucu

SEQ ID NO: 802553 - RNA, 19 nt, Homo sapiens
uggcggggcgcagugcugu

SEQ ID NO: 802554 - RNA, 18 nt, Homo sapiens
uggcgguggaccaaagga

SEQ ID NO: 802555 - RNA, 18 nt, Homo sapiens
uggcgugaucucagcuca

SEQ ID NO: 802556 - RNA, 19 nt, Homo sapiens
uggcuaaacagauguaaug

SEQ ID NO: 802557 - RNA, 22 nt, Homo sapiens
uggcuaacuauauuugcuuuuu

SEQ ID NO: 802558 - RNA, 17 nt, Homo sapiens
uggcuacacacaaacca

SEQ ID NO: 802559 - RNA, 19 nt, Homo sapiens
uggcuacacacaaaccagu

SEQ ID NO: 802560 - RNA, 22 nt, Homo sapiens
uggcuacacucaucugacucau

SEQ ID NO: 802561 - RNA, 15 nt, Homo sapiens
uggcuagaguuucca

SEQ ID NO: 802562 - RNA, 15 nt, Homo sapiens
uggcucacaccugua

SEQ ID NO: 802563 - RNA, 14 nt, Homo sapiens
uggcucacuacuga

SEQ ID NO: 802564 - RNA, 13 nt, Homo sapiens
uggcucacugcaa

SEQ ID NO: 802565 - RNA, 23 nt, Homo sapiens
uggcucagcucggggagccuuag

SEQ ID NO: 802566 - RNA, 14 nt, Homo sapiens
uggcucccaggaca

SEQ ID NO: 802567 - RNA, 21 nt, Homo sapiens
uggcucccugggcagugcucc

SEQ ID NO: 802568 - RNA, 13 nt, Homo sapiens
uggcuccuaucug

SEQ ID NO: 802569 - RNA, 16 nt, Homo sapiens
uggcuccucuacuguu

SEQ ID NO: 802570 - RNA, 13 nt, Homo sapiens
uggcucucggcac

SEQ ID NO: 802571 - RNA, 23 nt, Homo sapiens
uggcucuggugugaaguuugcuu

SEQ ID NO: 802572 - RNA, 13 nt, Homo sapiens
uggcucuuucuau

SEQ ID NO: 802573 - RNA, 21 nt, Homo sapiens
uggcugaaagguuaauucucu

SEQ ID NO: 802574 - RNA, 16 nt, Homo sapiens
uggcugaggauuucaa

SEQ ID NO: 802575 - RNA, 19 nt, Homo sapiens
uggcugaugauccagaaca

SEQ ID NO: 802576 - RNA, 20 nt, Homo sapiens
uggcugaugggaaccauuuc

SEQ ID NO: 802577 - RNA, 16 nt, Homo sapiens
uggcugccugcaucua

SEQ ID NO: 802578 - RNA, 12 nt, Homo sapiens
uggcuggcugcc

SEQ ID NO: 802579 - RNA, 16 nt, Homo sapiens
uggcuggcuuguuuga

SEQ ID NO: 802580 - RNA, 22 nt, Homo sapiens
uggcuggcuuguuugauuucaa

SEQ ID NO: 802581 - RNA, 16 nt, Homo sapiens
uggcugggaacaacuu

SEQ ID NO: 802582 - RNA, 24 nt, Homo sapiens
uggcugggaacaacuucaguccaa

SEQ ID NO: 802583 - RNA, 22 nt, Homo sapiens
uggcugggaagacuauggugcu

SEQ ID NO: 802584 - RNA, 22 nt, Homo sapiens
uggcuggggccgcugggguccg

SEQ ID NO: 802585 - RNA, 11 nt, Homo sapiens
uggcugugagc

SEQ ID NO: 802586 - RNA, 17 nt, Homo sapiens
uggcuguguuugcagcc

SEQ ID NO: 802587 - RNA, 18 nt, Homo sapiens
uggcuguuauucuuccac

SEQ ID NO: 802588 - RNA, 21 nt, Homo sapiens
uggcuuaaaagcaaguuucag

SEQ ID NO: 802589 - RNA, 20 nt, Homo sapiens
uggcuuaagugagcagaaca

SEQ ID NO: 802590 - RNA, 19 nt, Homo sapiens
uggcuucugcuugucaucc

SEQ ID NO: 802591 - RNA, 14 nt, Homo sapiens
uggcuugacucagg

SEQ ID NO: 802592 - RNA, 14 nt, Homo sapiens
uggcuuuaugcaaa

SEQ ID NO: 802593 - RNA, 15 nt, Homo sapiens
uggcuuuaugugcaa

SEQ ID NO: 802594 - RNA, 17 nt, Homo sapiens
uggcuuuaugugcaaaa

SEQ ID NO: 802595 - RNA, 22 nt, Homo sapiens
ugggaacaguaaagaaagcaga

SEQ ID NO: 802596 - RNA, 19 nt, Homo sapiens
ugggaacaugcgugugacc

SEQ ID NO: 802597 - RNA, 19 nt, Homo sapiens
ugggaaccauuucaagaca

SEQ ID NO: 802598 - RNA, 18 nt, Homo sapiens
ugggaagacuauggugcu

SEQ ID NO: 802599 - RNA, 20 nt, Homo sapiens
ugggaagagaagagggccca

SEQ ID NO: 802600 - RNA, 20 nt, Homo sapiens
ugggaagagcguagacaggu

SEQ ID NO: 802601 - RNA, 21 nt, Homo sapiens
ugggaagauaggcucugcaca

SEQ ID NO: 802602 - RNA, 16 nt, Homo sapiens
ugggaagccugugcca

SEQ ID NO: 802603 - RNA, 18 nt, Homo sapiens
ugggaaggaaacaaccau

SEQ ID NO: 802604 - RNA, 19 nt, Homo sapiens
ugggaaggagggagcugcu

SEQ ID NO: 802605 - RNA, 19 nt, Homo sapiens
ugggaaggcuaaguucagu

SEQ ID NO: 802606 - RNA, 16 nt, Homo sapiens
ugggaagggcagggaa

SEQ ID NO: 802607 - RNA, 21 nt, Homo sapiens
ugggaaggggagcacaauuuc

SEQ ID NO: 802608 - RNA, 15 nt, Homo sapiens
ugggaauaauugcuu

SEQ ID NO: 802609 - RNA, 23 nt, Homo sapiens
ugggaauacaggggugaaagggg

SEQ ID NO: 802610 - RNA, 20 nt, Homo sapiens
ugggaauguauuauucugca

SEQ ID NO: 802611 - RNA, 15 nt, Homo sapiens
ugggaaugucucuuu

SEQ ID NO: 802612 - RNA, 23 nt, Homo sapiens
ugggaaugucucuuuggcgaccu

SEQ ID NO: 802613 - RNA, 17 nt, Homo sapiens
ugggaccacuggguaca

SEQ ID NO: 802614 - RNA, 12 nt, Homo sapiens
ugggaccccaaa

SEQ ID NO: 802615 - RNA, 16 nt, Homo sapiens
ugggacccuguugaug

SEQ ID NO: 802616 - RNA, 14 nt, Homo sapiens
ugggacguggucag

SEQ ID NO: 802617 - RNA, 21 nt, Homo sapiens
ugggacuacaggcacaggcca

SEQ ID NO: 802618 - RNA, 17 nt, Homo sapiens
ugggacuacaggcucau

SEQ ID NO: 802619 - RNA, 23 nt, Homo sapiens
ugggacuacaggcucaugccauc

SEQ ID NO: 802620 - RNA, 15 nt, Homo sapiens
ugggacucaggauau

SEQ ID NO: 802621 - RNA, 14 nt, Homo sapiens
ugggacuuauguau

SEQ ID NO: 802622 - RNA, 18 nt, Homo sapiens
ugggacuucagcucagag

SEQ ID NO: 802623 - RNA, 18 nt, Homo sapiens
ugggagaaggacuaucaa

SEQ ID NO: 802624 - RNA, 20 nt, Homo sapiens
ugggagacuggaaaagggaa

SEQ ID NO: 802625 - RNA, 13 nt, Homo sapiens
ugggagcaaaaaa

SEQ ID NO: 802626 - RNA, 18 nt, Homo sapiens
ugggagccagaauucacu

SEQ ID NO: 802627 - RNA, 18 nt, Homo sapiens
ugggagccagggcugucu

SEQ ID NO: 802628 - RNA, 15 nt, Homo sapiens
ugggagcuuauugcu

SEQ ID NO: 802629 - RNA, 19 nt, Homo sapiens
ugggagcuucccacaccug

SEQ ID NO: 802630 - RNA, 18 nt, Homo sapiens
ugggaggagggagaggga

SEQ ID NO: 802631 - RNA, 21 nt, Homo sapiens
ugggaggcagagguugcagug

SEQ ID NO: 802632 - RNA, 21 nt, Homo sapiens
ugggaggcugaggcagcagac

SEQ ID NO: 802633 - RNA, 13 nt, Homo sapiens
ugggaggcuguga

SEQ ID NO: 802634 - RNA, 23 nt, Homo sapiens
ugggaucacgaggaaaagagaag

SEQ ID NO: 802635 - RNA, 16 nt, Homo sapiens
ugggauguccacagau

SEQ ID NO: 802636 - RNA, 15 nt, Homo sapiens
ugggauguucagcac

SEQ ID NO: 802637 - RNA, 13 nt, Homo sapiens
ugggauuacaggg

SEQ ID NO: 802638 - RNA, 15 nt, Homo sapiens
ugggauuacagggau

SEQ ID NO: 802639 - RNA, 15 nt, Homo sapiens
ugggauuacaggugu

SEQ ID NO: 802640 - RNA, 19 nt, Homo sapiens
ugggauuuaaagccuuuag

SEQ ID NO: 802641 - RNA, 19 nt, Homo sapiens
ugggcaacaagagcaaaac

SEQ ID NO: 802642 - RNA, 21 nt, Homo sapiens
ugggcaacagagcaagacucc

SEQ ID NO: 802643 - RNA, 18 nt, Homo sapiens
ugggcaacagagcaagau

SEQ ID NO: 802644 - RNA, 14 nt, Homo sapiens
ugggcacaguggac

SEQ ID NO: 802645 - RNA, 11 nt, Homo sapiens
ugucacuaaac

SEQ ID NO: 802646 - RNA, 16 nt, Homo sapiens
ugucacuaaacaagaa

SEQ ID NO: 802647 - RNA, 23 nt, Homo sapiens
ugucacuaaacaagaaaucugac

SEQ ID NO: 802648 - RNA, 17 nt, Homo sapiens
ugucacuagucucacca

SEQ ID NO: 802649 - RNA, 18 nt, Homo sapiens
ugucacuguuccuuguca

SEQ ID NO: 802650 - RNA, 23 nt, Homo sapiens
ugucacuucgcgugcccucgcug

SEQ ID NO: 802651 - RNA, 22 nt, Homo sapiens
ugucagaaaaagcuagcacuaa

SEQ ID NO: 802652 - RNA, 21 nt, Homo sapiens
ugucagaaacacugaagccau

SEQ ID NO: 802653 - RNA, 21 nt, Homo sapiens
ugucagaaaccaguuauguga

SEQ ID NO: 802654 - RNA, 22 nt, Homo sapiens
ugucagaaaccugcagggacuc

SEQ ID NO: 802655 - RNA, 13 nt, Homo sapiens
ugucagaguagaa

SEQ ID NO: 802656 - RNA, 19 nt, Homo sapiens
ugucagauagucuauguau

SEQ ID NO: 802657 - RNA, 17 nt, Homo sapiens
ugucagauuaccaguua

SEQ ID NO: 802658 - RNA, 20 nt, Homo sapiens
ugucagcuacuaaugauguu

SEQ ID NO: 802659 - RNA, 16 nt, Homo sapiens
ugucaggauucuucaa

SEQ ID NO: 802660 - RNA, 18 nt, Homo sapiens
ugucagggguuucuucaa

SEQ ID NO: 802661 - RNA, 20 nt, Homo sapiens
ugucagggguuucuucaaga

SEQ ID NO: 802662 - RNA, 20 nt, Homo sapiens
ugucaucagccaccauccua

SEQ ID NO: 802663 - RNA, 21 nt, Homo sapiens
ugucaucaucacccuuucauu

SEQ ID NO: 802664 - RNA, 21 nt, Homo sapiens
ugucauccucaaagaaagugu

SEQ ID NO: 802665 - RNA, 22 nt, Homo sapiens
ugucaucuuccuggaagcagag

SEQ ID NO: 802666 - RNA, 21 nt, Homo sapiens
ugucaucuuuuuccacuuuga

SEQ ID NO: 802667 - RNA, 12 nt, Homo sapiens
ugucauguguau

SEQ ID NO: 802668 - RNA, 20 nt, Homo sapiens
ugucauuuugcacuguaaau

SEQ ID NO: 802669 - RNA, 14 nt, Homo sapiens
uguccaaaacugcc

SEQ ID NO: 802670 - RNA, 22 nt, Homo sapiens
uguccaacaagccccacagccc

SEQ ID NO: 802671 - RNA, 20 nt, Homo sapiens
uguccaauuuguaaguaaca

SEQ ID NO: 802672 - RNA, 12 nt, Homo sapiens
uguccagaguuu

SEQ ID NO: 802673 - RNA, 15 nt, Homo sapiens
uguccagcacaccug

SEQ ID NO: 802674 - RNA, 13 nt, Homo sapiens
uguccagcaccuu

SEQ ID NO: 802675 - RNA, 16 nt, Homo sapiens
ugucccagaaugccuc

SEQ ID NO: 802676 - RNA, 13 nt, Homo sapiens
ugucccagaguua

SEQ ID NO: 802677 - RNA, 12 nt, Homo sapiens
ugucccauuucc

SEQ ID NO: 802678 - RNA, 17 nt, Homo sapiens
ugucccccaacuugaga

SEQ ID NO: 802679 - RNA, 20 nt, Homo sapiens
uguccccuucucucaucucu

SEQ ID NO: 802680 - RNA, 20 nt, Homo sapiens
ugucccggggcuccacugaa

SEQ ID NO: 802681 - RNA, 15 nt, Homo sapiens
ugucccugacuguaa

SEQ ID NO: 802682 - RNA, 15 nt, Homo sapiens
ugucccuguagcuca

SEQ ID NO: 802683 - RNA, 22 nt, Homo sapiens
ugucccugugggugaaacagaa

SEQ ID NO: 802684 - RNA, 22 nt, Homo sapiens
ugucccuugccucaaugccagu

SEQ ID NO: 802685 - RNA, 15 nt, Homo sapiens
ugucccuuugcuccc

SEQ ID NO: 802686 - RNA, 21 nt, Homo sapiens
uguccgggcucagaaugggag

SEQ ID NO: 802687 - RNA, 19 nt, Homo sapiens
uguccguccacccuuccau

SEQ ID NO: 802688 - RNA, 13 nt, Homo sapiens
uguccuaugcgcu

SEQ ID NO: 802689 - RNA, 19 nt, Homo sapiens
uguccucagccuugccaga

SEQ ID NO: 802690 - RNA, 17 nt, Homo sapiens
uguccugauggcccaaa

SEQ ID NO: 802691 - RNA, 13 nt, Homo sapiens
uguccugggguau

SEQ ID NO: 802692 - RNA, 22 nt, Homo sapiens
uguccuggugcucucugccacu

SEQ ID NO: 802693 - RNA, 22 nt, Homo sapiens
uguccuuggcagaggcagggaa

SEQ ID NO: 802694 - RNA, 19 nt, Homo sapiens
uguccuuuuucacuuugaa

SEQ ID NO: 802695 - RNA, 20 nt, Homo sapiens
ugucgcccaggcuggagugc

SEQ ID NO: 802696 - RNA, 14 nt, Homo sapiens
ugucgcuaugugac

SEQ ID NO: 802697 - RNA, 13 nt, Homo sapiens
ugucguagccaag

SEQ ID NO: 802698 - RNA, 18 nt, Homo sapiens
ugucuacauuaaaucacu

SEQ ID NO: 802699 - RNA, 12 nt, Homo sapiens
ugucuacugugg

SEQ ID NO: 802700 - RNA, 23 nt, Homo sapiens
ugucuaggcuggaagagccaaag

SEQ ID NO: 802701 - RNA, 18 nt, Homo sapiens
ugucuaguuugcauacuu

SEQ ID NO: 802702 - RNA, 22 nt, Homo sapiens
ugucuauaucauaacuauacuu

SEQ ID NO: 802703 - RNA, 18 nt, Homo sapiens
ugucuauuuucucaguca

SEQ ID NO: 802704 - RNA, 13 nt, Homo sapiens
ugucucaaaaaau

SEQ ID NO: 802705 - RNA, 16 nt, Homo sapiens
ugucucaaauucaugg

SEQ ID NO: 802706 - RNA, 14 nt, Homo sapiens
ugucuccagaguug

SEQ ID NO: 802707 - RNA, 15 nt, Homo sapiens
ugucuccagcugccu

SEQ ID NO: 802708 - RNA, 15 nt, Homo sapiens
ugucucccccaacac

SEQ ID NO: 802709 - RNA, 21 nt, Homo sapiens
ugucuccuccccuucccccac

SEQ ID NO: 802710 - RNA, 18 nt, Homo sapiens
ugucuccuuucucuuaug

SEQ ID NO: 802711 - RNA, 14 nt, Homo sapiens
ugucucgaguccua

SEQ ID NO: 802712 - RNA, 17 nt, Homo sapiens
ugucucgaugccauaau

SEQ ID NO: 802713 - RNA, 19 nt, Homo sapiens
ugucucgaugccauaauca

SEQ ID NO: 802714 - RNA, 19 nt, Homo sapiens
ugucucgcuauacugcacu

SEQ ID NO: 802715 - RNA, 21 nt, Homo sapiens
ugucucggagggauuccccua

SEQ ID NO: 802716 - RNA, 13 nt, Homo sapiens
ugucucuaccuaa

SEQ ID NO: 802717 - RNA, 15 nt, Homo sapiens
ugucucuauauugcu

SEQ ID NO: 802718 - RNA, 12 nt, Homo sapiens
ugucucucauga

SEQ ID NO: 802719 - RNA, 14 nt, Homo sapiens
ugucucucugccaa

SEQ ID NO: 802720 - RNA, 12 nt, Homo sapiens
ugucucugccug

SEQ ID NO: 802721 - RNA, 12 nt, Homo sapiens
ugucucugugag

SEQ ID NO: 802722 - RNA, 23 nt, Homo sapiens
ugucugaacuugcauugugauug

SEQ ID NO: 802723 - RNA, 17 nt, Homo sapiens
ugucugaauauucuaga

SEQ ID NO: 802724 - RNA, 18 nt, Homo sapiens
ugucugaauauucuagaa

SEQ ID NO: 802725 - RNA, 15 nt, Homo sapiens
ugucugaccagagaa

SEQ ID NO: 802726 - RNA, 12 nt, Homo sapiens
ugucugagacag

SEQ ID NO: 802727 - RNA, 13 nt, Homo sapiens
ugucugauucuau

SEQ ID NO: 802728 - RNA, 13 nt, Homo sapiens
ugucugccaaaca

SEQ ID NO: 802729 - RNA, 19 nt, Homo sapiens
ugucugccagccagcagcc

SEQ ID NO: 802730 - RNA, 16 nt, Homo sapiens
ugucuggcguucucaa

SEQ ID NO: 802731 - RNA, 14 nt, Homo sapiens
ugucuggugggugg

SEQ ID NO: 802732 - RNA, 22 nt, Homo sapiens
ugucuuacuauuauagcaacuu

SEQ ID NO: 802733 - RNA, 22 nt, Homo sapiens
ugucuucccaaacccagucucc

SEQ ID NO: 802734 - RNA, 14 nt, Homo sapiens
ugucuucuacagau

SEQ ID NO: 802735 - RNA, 15 nt, Homo sapiens
ugucuucuuugccca

SEQ ID NO: 802736 - RNA, 15 nt, Homo sapiens
ugucuuggagugcau

SEQ ID NO: 802737 - RNA, 15 nt, Homo sapiens
ugucuuguucaccuu

SEQ ID NO: 802738 - RNA, 17 nt, Homo sapiens
ugucuuuauucuuauua

SEQ ID NO: 802739 - RNA, 19 nt, Homo sapiens
ugucuuucucagaggacaa

SEQ ID NO: 802740 - RNA, 21 nt, Homo sapiens
ugucuuucugagcacacuuua

SEQ ID NO: 802741 - RNA, 15 nt, Homo sapiens
ugugaaaacaucuca

SEQ ID NO: 802742 - RNA, 15 nt, Homo sapiens
ugugaaacacagcug

SEQ ID NO: 802743 - RNA, 17 nt, Homo sapiens
ugugaaacaguugcugu

SEQ ID NO: 802744 - RNA, 19 nt, Homo sapiens
ugugaaacugaaggucaau

SEQ ID NO: 802745 - RNA, 17 nt, Homo sapiens
ugugaaacuggcacuga

SEQ ID NO: 802746 - RNA, 20 nt, Homo sapiens
ugugaaauucacaguaauau

SEQ ID NO: 802747 - RNA, 21 nt, Homo sapiens
ugugaacguggggugagggau

SEQ ID NO: 802748 - RNA, 16 nt, Homo sapiens
ugugaacuugaagaag

SEQ ID NO: 802749 - RNA, 16 nt, Homo sapiens
ugugaagcaaggagcu

SEQ ID NO: 802750 - RNA, 16 nt, Homo sapiens
ugugaagccugcagag

SEQ ID NO: 802751 - RNA, 18 nt, Homo sapiens
ugugaaguucaucuugca

SEQ ID NO: 802752 - RNA, 19 nt, Homo sapiens
ugugaaguuugcuuuguac

SEQ ID NO: 802753 - RNA, 19 nt, Homo sapiens
ugugaauguaaaacagagc

SEQ ID NO: 802754 - RNA, 16 nt, Homo sapiens
ugugaauuauugacac

SEQ ID NO: 802755 - RNA, 13 nt, Homo sapiens
ugugacacauaug

SEQ ID NO: 802756 - RNA, 14 nt, Homo sapiens
ugugacacauaugc

SEQ ID NO: 802757 - RNA, 18 nt, Homo sapiens
ugugacaccuaacucuuu

SEQ ID NO: 802758 - RNA, 20 nt, Homo sapiens
ugugaccacugaauucacuc

SEQ ID NO: 802759 - RNA, 19 nt, Homo sapiens
ugugacccuugucaucucu

SEQ ID NO: 802760 - RNA, 15 nt, Homo sapiens
uguuucccagauuuc

SEQ ID NO: 802761 - RNA, 22 nt, Homo sapiens
uguuuccuaugacauuacugua

SEQ ID NO: 802762 - RNA, 22 nt, Homo sapiens
uguuuccuuuaauuuuuuacua

SEQ ID NO: 802763 - RNA, 12 nt, Homo sapiens
uguuucuauacu

SEQ ID NO: 802764 - RNA, 23 nt, Homo sapiens
uguuucuccuuaguuggcuggaa

SEQ ID NO: 802765 - RNA, 21 nt, Homo sapiens
uguuucuuaagggcacacaca

SEQ ID NO: 802766 - RNA, 22 nt, Homo sapiens
uguuucuugccugaacuccugc

SEQ ID NO: 802767 - RNA, 22 nt, Homo sapiens
uguuugaaauucuagagccagc

SEQ ID NO: 802768 - RNA, 18 nt, Homo sapiens
uguuugauuucaacauga

SEQ ID NO: 802769 - RNA, 18 nt, Homo sapiens
uguuugcacuuggcaaaa

SEQ ID NO: 802770 - RNA, 19 nt, Homo sapiens
uguuugcacuuggcaaaaa

SEQ ID NO: 802771 - RNA, 19 nt, Homo sapiens
uguuuggaaaccacaguca

SEQ ID NO: 802772 - RNA, 16 nt, Homo sapiens
uguuuggaugaaaaaa

SEQ ID NO: 802773 - RNA, 18 nt, Homo sapiens
uguuuggguauccugccc

SEQ ID NO: 802774 - RNA, 19 nt, Homo sapiens
uguuuguaugucuguguau

SEQ ID NO: 802775 - RNA, 14 nt, Homo sapiens
uguuugucuuccau

SEQ ID NO: 802776 - RNA, 23 nt, Homo sapiens
uguuugugacccugagaaggcaa

SEQ ID NO: 802777 - RNA, 21 nt, Homo sapiens
uguuuuaaacucuccuaguca

SEQ ID NO: 802778 - RNA, 20 nt, Homo sapiens
uguuuuaacguucugcugcu

SEQ ID NO: 802779 - RNA, 20 nt, Homo sapiens
uguuuuacccuauacaucca

SEQ ID NO: 802780 - RNA, 18 nt, Homo sapiens
uguuuucauaauaccuca

SEQ ID NO: 802781 - RNA, 17 nt, Homo sapiens
uguuuuccugcugguaa

SEQ ID NO: 802782 - RNA, 21 nt, Homo sapiens
uguuuucugacuaauuaggca

SEQ ID NO: 802783 - RNA, 24 nt, Homo sapiens
uguuuugauucccgggcuuaccag

SEQ ID NO: 802784 - RNA, 14 nt, Homo sapiens
uguuuugcacuuuu

SEQ ID NO: 802785 - RNA, 12 nt, Homo sapiens
uguuuuguacaa

SEQ ID NO: 802786 - RNA, 13 nt, Homo sapiens
uguuuuuaagcug

SEQ ID NO: 802787 - RNA, 23 nt, Homo sapiens
uguuuuuuuuuuuuuugagacag

SEQ ID NO: 802788 - RNA, 20 nt, Homo sapiens
uuaaaaaaaaauacugaugu

SEQ ID NO: 802789 - RNA, 20 nt, Homo sapiens
uuaaaaaaaauuaaaaccaa

SEQ ID NO: 802790 - RNA, 20 nt, Homo sapiens
uuaaaaaaauuuuugcaaau

SEQ ID NO: 802791 - RNA, 13 nt, Homo sapiens
uuaaaaagcaaag

SEQ ID NO: 802792 - RNA, 16 nt, Homo sapiens
uuaaaaagcacagggg

SEQ ID NO: 802793 - RNA, 15 nt, Homo sapiens
uuaaaacauguaaua

SEQ ID NO: 802794 - RNA, 19 nt, Homo sapiens
uuaaaacuggaccuguaua

SEQ ID NO: 802795 - RNA, 15 nt, Homo sapiens
uuaaaacuucaguuu

SEQ ID NO: 802796 - RNA, 21 nt, Homo sapiens
uuaaaaggaaauguaaaagca

SEQ ID NO: 802797 - RNA, 14 nt, Homo sapiens
uuaaaaggggccca

SEQ ID NO: 802798 - RNA, 21 nt, Homo sapiens
uuaaaagggucguuaccagag

SEQ ID NO: 802799 - RNA, 22 nt, Homo sapiens
uuaaaagguuaaauauugucau

SEQ ID NO: 802800 - RNA, 19 nt, Homo sapiens
uuaaaaguuauuuguucau

SEQ ID NO: 802801 - RNA, 15 nt, Homo sapiens
uuaaaauaaauuccu

SEQ ID NO: 802802 - RNA, 13 nt, Homo sapiens
uuaaaauaaugaa

SEQ ID NO: 802803 - RNA, 17 nt, Homo sapiens
uuaaaauaaugaauaca

SEQ ID NO: 802804 - RNA, 16 nt, Homo sapiens
uuaaaaucugugaaga

SEQ ID NO: 802805 - RNA, 19 nt, Homo sapiens
uuaaaaugauuugggaaaa

SEQ ID NO: 802806 - RNA, 18 nt, Homo sapiens
uuaaaauggcuacacuca

SEQ ID NO: 802807 - RNA, 15 nt, Homo sapiens
uuaaaauguuuacug

SEQ ID NO: 802808 - RNA, 15 nt, Homo sapiens
uuaaaauucaauuag

SEQ ID NO: 802809 - RNA, 14 nt, Homo sapiens
uuaaaauucuccug

SEQ ID NO: 802810 - RNA, 19 nt, Homo sapiens
uuaaacacacauugcagcu

SEQ ID NO: 802811 - RNA, 13 nt, Homo sapiens
uuaaacaugagaa

SEQ ID NO: 802812 - RNA, 22 nt, Homo sapiens
uuaaacccaagugcugcacaaa

SEQ ID NO: 802813 - RNA, 14 nt, Homo sapiens
uuaaacccacagcc

SEQ ID NO: 802814 - RNA, 18 nt, Homo sapiens
uuaaacccacagccaaac

SEQ ID NO: 802815 - RNA, 19 nt, Homo sapiens
uuaaacucuggacacucua

SEQ ID NO: 802816 - RNA, 11 nt, Homo sapiens
uuaaacucugu

SEQ ID NO: 802817 - RNA, 14 nt, Homo sapiens
uuaaacugauucau

SEQ ID NO: 802818 - RNA, 12 nt, Homo sapiens
uuaaacugugua

SEQ ID NO: 802819 - RNA, 18 nt, Homo sapiens
uuaaacuuaccugggcau

SEQ ID NO: 802820 - RNA, 12 nt, Homo sapiens
uuaaacuugaaa

SEQ ID NO: 802821 - RNA, 13 nt, Homo sapiens
uuaaacuugaauu

SEQ ID NO: 802822 - RNA, 15 nt, Homo sapiens
uuaaagaaccaucag

SEQ ID NO: 802823 - RNA, 14 nt, Homo sapiens
uuaaagacguaaaa

SEQ ID NO: 802824 - RNA, 17 nt, Homo sapiens
uuaaagagggacaggcu

SEQ ID NO: 802825 - RNA, 19 nt, Homo sapiens
uuaaagauggauuugaaaa

SEQ ID NO: 802826 - RNA, 15 nt, Homo sapiens
uuaaagaugguuuau

SEQ ID NO: 802827 - RNA, 13 nt, Homo sapiens
uuaaagccuccuc

SEQ ID NO: 802828 - RNA, 16 nt, Homo sapiens
uuaaaggaaaaucaca

SEQ ID NO: 802829 - RNA, 23 nt, Homo sapiens
uuaaaggaaaaucacaucuccag

SEQ ID NO: 802830 - RNA, 18 nt, Homo sapiens
uuaaaggcaucuacacaa

SEQ ID NO: 802831 - RNA, 18 nt, Homo sapiens
uuaaagggaaaacccuca

SEQ ID NO: 802832 - RNA, 16 nt, Homo sapiens
uuaaagguaaaacaug

SEQ ID NO: 802833 - RNA, 16 nt, Homo sapiens
uuaaauaaagucucuc

SEQ ID NO: 802834 - RNA, 18 nt, Homo sapiens
uuaaauaaaguuacuuga

SEQ ID NO: 802835 - RNA, 20 nt, Homo sapiens
uuaaauaacaaaacugugcc

SEQ ID NO: 802836 - RNA, 15 nt, Homo sapiens
uuaaauaagauucua

SEQ ID NO: 802837 - RNA, 13 nt, Homo sapiens
uuaaauacuauua

SEQ ID NO: 802838 - RNA, 17 nt, Homo sapiens
uuaaauauauaauguug

SEQ ID NO: 802839 - RNA, 23 nt, Homo sapiens
uuaaauccuuugcuucauuccaa

SEQ ID NO: 802840 - RNA, 19 nt, Homo sapiens
uuaaaucugugaugauccu

SEQ ID NO: 802841 - RNA, 15 nt, Homo sapiens
uuaaaugaccaaaga

SEQ ID NO: 802842 - RNA, 16 nt, Homo sapiens
uuaaaugauacaguau

SEQ ID NO: 802843 - RNA, 10 nt, Homo sapiens
uuaaaugcag

SEQ ID NO: 802844 - RNA, 22 nt, Homo sapiens
uuaaaugccccccucccaacag

SEQ ID NO: 802845 - RNA, 14 nt, Homo sapiens
uuaaauggcuuuau

SEQ ID NO: 802846 - RNA, 22 nt, Homo sapiens
uuaaaugguuggcccccaaaga

SEQ ID NO: 802847 - RNA, 20 nt, Homo sapiens
uuaaauuaaugaacauaugu

SEQ ID NO: 802848 - RNA, 14 nt, Homo sapiens
uuaaauuacaauuu

SEQ ID NO: 802849 - RNA, 16 nt, Homo sapiens
uuaaauuaugcaacgu

SEQ ID NO: 802850 - RNA, 19 nt, Homo sapiens
uuaaauuuugaaaacugug

SEQ ID NO: 802851 - RNA, 15 nt, Homo sapiens
uuaacaaaauccuca

SEQ ID NO: 802852 - RNA, 13 nt, Homo sapiens
uuaacaaacucuu

SEQ ID NO: 802853 - RNA, 17 nt, Homo sapiens
uuaacaaaugugcugcu

SEQ ID NO: 802854 - RNA, 23 nt, Homo sapiens
uuaacaaauuauguuacaucugu

SEQ ID NO: 802855 - RNA, 21 nt, Homo sapiens
uuaacacccuuuagaaccuua

SEQ ID NO: 802856 - RNA, 21 nt, Homo sapiens
uuaacacgugaauauuuugcu

SEQ ID NO: 802857 - RNA, 15 nt, Homo sapiens
uuaacacucaugaag

SEQ ID NO: 802858 - RNA, 13 nt, Homo sapiens
uuaacaggauauu

SEQ ID NO: 802859 - RNA, 13 nt, Homo sapiens
uuaacauaagaaa

SEQ ID NO: 802860 - RNA, 15 nt, Homo sapiens
uuaacaucauugcau

SEQ ID NO: 802861 - RNA, 11 nt, Homo sapiens
uuaacaucuca

SEQ ID NO: 802862 - RNA, 11 nt, Homo sapiens
uuaacaugucg

SEQ ID NO: 802863 - RNA, 14 nt, Homo sapiens
uuaacauuccucau

SEQ ID NO: 802864 - RNA, 13 nt, Homo sapiens
uuaacccagugua

SEQ ID NO: 802865 - RNA, 20 nt, Homo sapiens
uuaaccuaauaucacuuaaa

SEQ ID NO: 802866 - RNA, 15 nt, Homo sapiens
uuaacggugcuaaaa

SEQ ID NO: 802867 - RNA, 17 nt, Homo sapiens
uuaacggugcuaaaaau

SEQ ID NO: 802868 - RNA, 14 nt, Homo sapiens
uuaacgucaucuca

SEQ ID NO: 802869 - RNA, 23 nt, Homo sapiens
uuaacuauaacaaucacuggcua

SEQ ID NO: 802870 - RNA, 15 nt, Homo sapiens
uuaacugaacuuaau

SEQ ID NO: 802871 - RNA, 21 nt, Homo sapiens
uuaacugagcuacuagagaua

SEQ ID NO: 802872 - RNA, 19 nt, Homo sapiens
uuaacuguuguagaagaca

SEQ ID NO: 802873 - RNA, 21 nt, Homo sapiens
uuaacuuccaauuuacauacu

SEQ ID NO: 802874 - RNA, 19 nt, Homo sapiens
uuaacuuuuuuucuucuac

SEQ ID NO: 802875 - RNA, 19 nt, Homo sapiens
uuguucaaaauaaugaagu

SEQ ID NO: 802876 - RNA, 15 nt, Homo sapiens
uuguucauacauauu

SEQ ID NO: 802877 - RNA, 22 nt, Homo sapiens
uuguuccugccacuguguacug

SEQ ID NO: 802878 - RNA, 21 nt, Homo sapiens
uuguucguauuuagaauggga

SEQ ID NO: 802879 - RNA, 19 nt, Homo sapiens
uuguucuguuuugugagaa

SEQ ID NO: 802880 - RNA, 21 nt, Homo sapiens
uuguucuuuaaagucaggucc

SEQ ID NO: 802881 - RNA, 13 nt, Homo sapiens
uuguugacuguga

SEQ ID NO: 802882 - RNA, 14 nt, Homo sapiens
uuguugacugugau

SEQ ID NO: 802883 - RNA, 16 nt, Homo sapiens
uuguuggauaaaucag

SEQ ID NO: 802884 - RNA, 13 nt, Homo sapiens
uuguugugugugc

SEQ ID NO: 802885 - RNA, 15 nt, Homo sapiens
uuguuguuucuugcc

SEQ ID NO: 802886 - RNA, 18 nt, Homo sapiens
uuguuuacagucauugga

SEQ ID NO: 802887 - RNA, 22 nt, Homo sapiens
uuguuuccucuuccaaaguaaa

SEQ ID NO: 802888 - RNA, 14 nt, Homo sapiens
uuguuucuguagaa

SEQ ID NO: 802889 - RNA, 17 nt, Homo sapiens
uuguuugccaggacaug

SEQ ID NO: 802890 - RNA, 15 nt, Homo sapiens
uuguuugcuucuugc

SEQ ID NO: 802891 - RNA, 19 nt, Homo sapiens
uuguuuuacccuauacauc

SEQ ID NO: 802892 - RNA, 22 nt, Homo sapiens
uuguuuucagcacugauggaaa

SEQ ID NO: 802893 - RNA, 19 nt, Homo sapiens
uuguuuugaagcuguugcu

SEQ ID NO: 802894 - RNA, 19 nt, Homo sapiens
uuuaaaaaaaaaaacaaag

SEQ ID NO: 802895 - RNA, 16 nt, Homo sapiens
uuuaaaaaaauaacau

SEQ ID NO: 802896 - RNA, 15 nt, Homo sapiens
uuuaaaaaauaacau

SEQ ID NO: 802897 - RNA, 18 nt, Homo sapiens
uuuaaaaaggaauuuugu

SEQ ID NO: 802898 - RNA, 12 nt, Homo sapiens
uuuaaaacaaag

SEQ ID NO: 802899 - RNA, 12 nt, Homo sapiens
uuuaaaacacac

SEQ ID NO: 802900 - RNA, 13 nt, Homo sapiens
uuuaaaacacaug

SEQ ID NO: 802901 - RNA, 13 nt, Homo sapiens
uuuaaaacaucau

SEQ ID NO: 802902 - RNA, 21 nt, Homo sapiens
uuuaaaauaaaugaagugaga

SEQ ID NO: 802903 - RNA, 20 nt, Homo sapiens
uuuaaaauaaauuccuacaa

SEQ ID NO: 802904 - RNA, 15 nt, Homo sapiens
uuuaaaauucaauua

SEQ ID NO: 802905 - RNA, 18 nt, Homo sapiens
uuuaaacaaugaagugaa

SEQ ID NO: 802906 - RNA, 20 nt, Homo sapiens
uuuaaacuaucuugugugau

SEQ ID NO: 802907 - RNA, 16 nt, Homo sapiens
uuuaaagacucaaggu

SEQ ID NO: 802908 - RNA, 14 nt, Homo sapiens
uuuaaagccuccuc

SEQ ID NO: 802909 - RNA, 21 nt, Homo sapiens
uuuaaaguauguuauugcaua

SEQ ID NO: 802910 - RNA, 17 nt, Homo sapiens
uuuaaauaaaagcacaa

SEQ ID NO: 802911 - RNA, 20 nt, Homo sapiens
uuuaaauagggcauaccauu

SEQ ID NO: 802912 - RNA, 13 nt, Homo sapiens
uuuaaaucaagga

SEQ ID NO: 802913 - RNA, 14 nt, Homo sapiens
uuuaaaucaaggaa

SEQ ID NO: 802914 - RNA, 12 nt, Homo sapiens
uuuaaaugaagu

SEQ ID NO: 802915 - RNA, 22 nt, Homo sapiens
uuuaaauguaaaauauuugaga

SEQ ID NO: 802916 - RNA, 17 nt, Homo sapiens
uuuaaaugucugcaugc

SEQ ID NO: 802917 - RNA, 22 nt, Homo sapiens
uuuaaauuacaauuuuaucugu

SEQ ID NO: 802918 - RNA, 13 nt, Homo sapiens
uuuaacaaguaua

SEQ ID NO: 802919 - RNA, 13 nt, Homo sapiens
uuuaacagccucu

SEQ ID NO: 802920 - RNA, 16 nt, Homo sapiens
uuuaacauacaaucau

SEQ ID NO: 802921 - RNA, 14 nt, Homo sapiens
uuuaacccauuugu

SEQ ID NO: 802922 - RNA, 14 nt, Homo sapiens
uuuaaccuaugaua

SEQ ID NO: 802923 - RNA, 21 nt, Homo sapiens
uuuaaccucuagagucacuga

SEQ ID NO: 802924 - RNA, 21 nt, Homo sapiens
uuuaacuagaauuuauucaau

SEQ ID NO: 802925 - RNA, 20 nt, Homo sapiens
uuuaacuggugaagagaaaa

SEQ ID NO: 802926 - RNA, 22 nt, Homo sapiens
uuuaacuuuauaaauccaguga

SEQ ID NO: 802927 - RNA, 19 nt, Homo sapiens
uuuaagaaaaacaugucau

SEQ ID NO: 802928 - RNA, 15 nt, Homo sapiens
uuuaagaauuucaca

SEQ ID NO: 802929 - RNA, 19 nt, Homo sapiens
uuuaagauauauacaugga

SEQ ID NO: 802930 - RNA, 13 nt, Homo sapiens
uuuaagcaucaaa

SEQ ID NO: 802931 - RNA, 18 nt, Homo sapiens
uuuaaggcaauauauaau

SEQ ID NO: 802932 - RNA, 19 nt, Homo sapiens
uuuaagguuuuuacuguga

SEQ ID NO: 802933 - RNA, 22 nt, Homo sapiens
uuuaaguacuugagacucuuga

SEQ ID NO: 802934 - RNA, 15 nt, Homo sapiens
uuuaaguauauagua

SEQ ID NO: 802935 - RNA, 17 nt, Homo sapiens
uuuaaguauauaguaua

SEQ ID NO: 802936 - RNA, 13 nt, Homo sapiens
uuuaagucaguga

SEQ ID NO: 802937 - RNA, 13 nt, Homo sapiens
uuuaagugaagga

SEQ ID NO: 802938 - RNA, 19 nt, Homo sapiens
uuuaauaaaaaucauggaa

SEQ ID NO: 802939 - RNA, 14 nt, Homo sapiens
uuuaauaccagaua

SEQ ID NO: 802940 - RNA, 18 nt, Homo sapiens
uuuaauacccugcaaugu

SEQ ID NO: 802941 - RNA, 12 nt, Homo sapiens
uuuaaucagcuu

SEQ ID NO: 802942 - RNA, 17 nt, Homo sapiens
uuuaaucccagcacuuu

SEQ ID NO: 802943 - RNA, 12 nt, Homo sapiens
uuuaaugaguca

SEQ ID NO: 802944 - RNA, 16 nt, Homo sapiens
uuuaaugauaaguaaa

SEQ ID NO: 802945 - RNA, 16 nt, Homo sapiens
uuuaauggaaaccaag

SEQ ID NO: 802946 - RNA, 20 nt, Homo sapiens
uuuaauggaaucagauauug

SEQ ID NO: 802947 - RNA, 23 nt, Homo sapiens
uuuaauggcaauaggacauugug

SEQ ID NO: 802948 - RNA, 17 nt, Homo sapiens
uuuaauguuuccuuuaa

SEQ ID NO: 802949 - RNA, 19 nt, Homo sapiens
uuuaauuaaucaugaaugu

SEQ ID NO: 802950 - RNA, 20 nt, Homo sapiens
uuuaauucuaguuucucuca

SEQ ID NO: 802951 - RNA, 13 nt, Homo sapiens
uuuaauucugucu

SEQ ID NO: 802952 - RNA, 16 nt, Homo sapiens
uuuaauucugucuugu

SEQ ID NO: 802953 - RNA, 13 nt, Homo sapiens
uuuaauuuacacu

SEQ ID NO: 802954 - RNA, 17 nt, Homo sapiens
uuuaauuuuaaugcugu

SEQ ID NO: 802955 - RNA, 16 nt, Homo sapiens
uuuacaaaagauguau

SEQ ID NO: 802956 - RNA, 16 nt, Homo sapiens
uuuacaaaauacaaaa

SEQ ID NO: 802957 - RNA, 23 nt, Homo sapiens
uuuacaauaaaacuuugcugcca

SEQ ID NO: 802958 - RNA, 19 nt, Homo sapiens
uuuacacuacauuguacaa

SEQ ID NO: 802959 - RNA, 20 nt, Homo sapiens
uuuacagacaauaaaaugga

SEQ ID NO: 802960 - RNA, 18 nt, Homo sapiens
uuuacagugcuauuuacu

SEQ ID NO: 802961 - RNA, 14 nt, Homo sapiens
uuuacaguggaauc

SEQ ID NO: 802962 - RNA, 17 nt, Homo sapiens
uuuacaguuacaguuga

SEQ ID NO: 802963 - RNA, 21 nt, Homo sapiens
uuuacauaucaccucauggcc

SEQ ID NO: 802964 - RNA, 12 nt, Homo sapiens
uuuacauucaau

SEQ ID NO: 802965 - RNA, 14 nt, Homo sapiens
uuuacauucugcaa

SEQ ID NO: 802966 - RNA, 11 nt, Homo sapiens
uuuacauuuaa

SEQ ID NO: 802967 - RNA, 11 nt, Homo sapiens
uuuaccaaagc

SEQ ID NO: 802968 - RNA, 20 nt, Homo sapiens
uuuaccaaucaacagcaugu

SEQ ID NO: 802969 - RNA, 19 nt, Homo sapiens
uuuacccugaggucacugc

SEQ ID NO: 802970 - RNA, 14 nt, Homo sapiens
uuuaccuaaucucc

SEQ ID NO: 802971 - RNA, 15 nt, Homo sapiens
uuuaccuauccacaa

SEQ ID NO: 802972 - RNA, 17 nt, Homo sapiens
uuuaccucuucuaugca

SEQ ID NO: 802973 - RNA, 13 nt, Homo sapiens
uuuacgacaagga

SEQ ID NO: 802974 - RNA, 21 nt, Homo sapiens
uuuacuggugcagaugguuga

SEQ ID NO: 802975 - RNA, 16 nt, Homo sapiens
uuuacuuuuaccacua

SEQ ID NO: 802976 - RNA, 20 nt, Homo sapiens
uuuacuuuuaccacuauuua

SEQ ID NO: 802977 - RNA, 23 nt, Homo sapiens
uuuagaaaaaaguuuacaacaua

SEQ ID NO: 802978 - RNA, 18 nt, Homo sapiens
uuuagaacuugcagcuga

SEQ ID NO: 802979 - RNA, 15 nt, Homo sapiens
uuuagaauaaaucaa

SEQ ID NO: 802980 - RNA, 18 nt, Homo sapiens
uuuagauaugacauuuau

SEQ ID NO: 802981 - RNA, 20 nt, Homo sapiens
uuuagccaguuguugccaac

SEQ ID NO: 802982 - RNA, 18 nt, Homo sapiens
uuuagccuggauguugcu

SEQ ID NO: 802983 - RNA, 14 nt, Homo sapiens
uuuagcuaccucac

SEQ ID NO: 802984 - RNA, 22 nt, Homo sapiens
uuuagcuaccucacuaugcugc

SEQ ID NO: 802985 - RNA, 16 nt, Homo sapiens
uuuaggacaucuuaaa

SEQ ID NO: 802986 - RNA, 18 nt, Homo sapiens
uuuaguacaauaaucucu

SEQ ID NO: 802987 - RNA, 14 nt, Homo sapiens
uuuaguaguuuaau

SEQ ID NO: 802988 - RNA, 21 nt, Homo sapiens
uuuagucauuaauguguaaca

SEQ ID NO: 802989 - RNA, 23 nt, Homo sapiens
uuuagucuaacaacugcccaguu

SEQ ID NO: 802990 - RNA, 21 nt, Homo sapiens
uuuuacauuucauacaacaga

SEQ ID NO: 802991 - RNA, 23 nt, Homo sapiens
uuuuacccugaggucacugcuag

SEQ ID NO: 802992 - RNA, 22 nt, Homo sapiens
uuuuagaauuaaaaaagcauac

SEQ ID NO: 802993 - RNA, 23 nt, Homo sapiens
uuuuagguagaaaaacauauucu

SEQ ID NO: 802994 - RNA, 14 nt, Homo sapiens
uuuuagugugugca

SEQ ID NO: 802995 - RNA, 22 nt, Homo sapiens
uuuuauaaagucuaagcaagau

SEQ ID NO: 802996 - RNA, 22 nt, Homo sapiens
uuuuauagcugcuuggauucuc

SEQ ID NO: 802997 - RNA, 21 nt, Homo sapiens
uuuuauaugcuuuuucucaga

SEQ ID NO: 802998 - RNA, 23 nt, Homo sapiens
uuuuaucuucagaaauucucugc

SEQ ID NO: 802999 - RNA, 16 nt, Homo sapiens
uuuuaucuugcacuua

SEQ ID NO: 803000 - RNA, 15 nt, Homo sapiens
uuuuaugaucuuggc

SEQ ID NO: 803001 - RNA, 20 nt, Homo sapiens
uuuuaugccuuuauauacuu

SEQ ID NO: 803002 - RNA, 22 nt, Homo sapiens
uuuuauggacaguaaguccagu

SEQ ID NO: 803003 - RNA, 14 nt, Homo sapiens
uuuuauugccuuga

SEQ ID NO: 803004 - RNA, 12 nt, Homo sapiens
uuuuauugcucg

SEQ ID NO: 803005 - RNA, 14 nt, Homo sapiens
uuuuauuuauaugu

SEQ ID NO: 803006 - RNA, 14 nt, Homo sapiens
uuuuauuuaugaua

SEQ ID NO: 803007 - RNA, 13 nt, Homo sapiens
uuuucaaggcauu

SEQ ID NO: 803008 - RNA, 16 nt, Homo sapiens
uuuucaaggccuucag

SEQ ID NO: 803009 - RNA, 19 nt, Homo sapiens
uuuucaauuugagauucua

SEQ ID NO: 803010 - RNA, 13 nt, Homo sapiens
uuuucacauaucu

SEQ ID NO: 803011 - RNA, 13 nt, Homo sapiens
uuuucaccaauga

SEQ ID NO: 803012 - RNA, 13 nt, Homo sapiens
uuuucaccccacc

SEQ ID NO: 803013 - RNA, 14 nt, Homo sapiens
uuuucagacuuuaa

SEQ ID NO: 803014 - RNA, 17 nt, Homo sapiens
uuuucaguuuuaccucu

SEQ ID NO: 803015 - RNA, 21 nt, Homo sapiens
uuuucauuagauacaguagug

SEQ ID NO: 803016 - RNA, 12 nt, Homo sapiens
uuuucauuugag

SEQ ID NO: 803017 - RNA, 14 nt, Homo sapiens
uuuuccaacuacua

SEQ ID NO: 803018 - RNA, 12 nt, Homo sapiens
uuuuccacauuc

SEQ ID NO: 803019 - RNA, 16 nt, Homo sapiens
uuuuccacugccuggg

SEQ ID NO: 803020 - RNA, 13 nt, Homo sapiens
uuuuccacuuaga

SEQ ID NO: 803021 - RNA, 12 nt, Homo sapiens
uuuuccuauaau

SEQ ID NO: 803022 - RNA, 23 nt, Homo sapiens
uuuuccuucuacagcagcacugu

SEQ ID NO: 803023 - RNA, 13 nt, Homo sapiens
uuuuccuucucau

SEQ ID NO: 803024 - RNA, 23 nt, Homo sapiens
uuuucgaacaccaaaaaugaugc

SEQ ID NO: 803025 - RNA, 14 nt, Homo sapiens
uuuucggccuucug

SEQ ID NO: 803026 - RNA, 21 nt, Homo sapiens
uuuucuaagguucucauagga

SEQ ID NO: 803027 - RNA, 20 nt, Homo sapiens
uuuucuacaugaugcccugc

SEQ ID NO: 803028 - RNA, 15 nt, Homo sapiens
uuuucuagacugucu

SEQ ID NO: 803029 - RNA, 14 nt, Homo sapiens
uuuucucacaaaaa

SEQ ID NO: 803030 - RNA, 22 nt, Homo sapiens
uuuucuccccucauaucugcgu

SEQ ID NO: 803031 - RNA, 17 nt, Homo sapiens
uuuucucuaacuucuca

SEQ ID NO: 803032 - RNA, 20 nt, Homo sapiens
uuuucucuuagaacauugua

SEQ ID NO: 803033 - RNA, 12 nt, Homo sapiens
uuuucucuugcc

SEQ ID NO: 803034 - RNA, 13 nt, Homo sapiens
uuuucugaagaca

SEQ ID NO: 803035 - RNA, 19 nt, Homo sapiens
uuuucuguaaauaaccuau

SEQ ID NO: 803036 - RNA, 21 nt, Homo sapiens
uuuucuuguccucauucuugc

SEQ ID NO: 803037 - RNA, 21 nt, Homo sapiens
uuuugaaaaggcgguacuagu

SEQ ID NO: 803038 - RNA, 13 nt, Homo sapiens
uuuugacucugcc

SEQ ID NO: 803039 - RNA, 22 nt, Homo sapiens
uuuugagacaaagucucacugu

SEQ ID NO: 803040 - RNA, 21 nt, Homo sapiens
uuuugagcacuuuucaaacaa

SEQ ID NO: 803041 - RNA, 23 nt, Homo sapiens
uuuugagucuauccuagucuuca

SEQ ID NO: 803042 - RNA, 14 nt, Homo sapiens
uuuugauagcuuua

SEQ ID NO: 803043 - RNA, 21 nt, Homo sapiens
uuuugcaauuggaauaaucac

SEQ ID NO: 803044 - RNA, 15 nt, Homo sapiens
uuuugcacaaggaaa

SEQ ID NO: 803045 - RNA, 14 nt, Homo sapiens
uuuugcaugcaugc

SEQ ID NO: 803046 - RNA, 21 nt, Homo sapiens
uuuugcccacacacuuuccau

SEQ ID NO: 803047 - RNA, 15 nt, Homo sapiens
uuuugccuguaagaa

SEQ ID NO: 803048 - RNA, 15 nt, Homo sapiens
uuuuggaacauuucu

SEQ ID NO: 803049 - RNA, 17 nt, Homo sapiens
uuuuggagaaaugucau

SEQ ID NO: 803050 - RNA, 22 nt, Homo sapiens
uuuuggaucuaucaccugucau

SEQ ID NO: 803051 - RNA, 13 nt, Homo sapiens
uuuuggcuugacu

SEQ ID NO: 803052 - RNA, 20 nt, Homo sapiens
uuuugguagaugcaugacuu

SEQ ID NO: 803053 - RNA, 18 nt, Homo sapiens
uuuuguaaaacaaugcca

SEQ ID NO: 803054 - RNA, 15 nt, Homo sapiens
uuuuguaccaaauag

SEQ ID NO: 803055 - RNA, 22 nt, Homo sapiens
uuuugucagaggcuccaaauag

SEQ ID NO: 803056 - RNA, 19 nt, Homo sapiens
uuuugucauguagcuguuu

SEQ ID NO: 803057 - RNA, 13 nt, Homo sapiens
uuuugucauucag

SEQ ID NO: 803058 - RNA, 23 nt, Homo sapiens
uuuugucgauuaguaaaagugcu

SEQ ID NO: 803059 - RNA, 13 nt, Homo sapiens
uuuugucuaugaa

SEQ ID NO: 803060 - RNA, 21 nt, Homo sapiens
uuuugugggcugguugcugua

SEQ ID NO: 803061 - RNA, 16 nt, Homo sapiens
uuuuguguuuugguua

SEQ ID NO: 803062 - RNA, 16 nt, Homo sapiens
uuuuguuacagauuaa

SEQ ID NO: 803063 - RNA, 13 nt, Homo sapiens
uuuuguucauaca

SEQ ID NO: 803064 - RNA, 11 nt, Homo sapiens
uuuuguuccag

SEQ ID NO: 803065 - RNA, 14 nt, Homo sapiens
uuuuguugccuuca

SEQ ID NO: 803066 - RNA, 18 nt, Homo sapiens
uuuuguuuugaagcuguu

SEQ ID NO: 803067 - RNA, 16 nt, Homo sapiens
uuuuuaaaaaagcaag

SEQ ID NO: 803068 - RNA, 16 nt, Homo sapiens
uuuuuaaaaaaguaag

SEQ ID NO: 803069 - RNA, 19 nt, Homo sapiens
uuuuuaaaguuucuugcau

SEQ ID NO: 803070 - RNA, 16 nt, Homo sapiens
uuuuuaaggagcaaaa

SEQ ID NO: 803071 - RNA, 15 nt, Homo sapiens
uuuuuaauagcacua

SEQ ID NO: 803072 - RNA, 15 nt, Homo sapiens
uuuuuaaugaucucg

SEQ ID NO: 803073 - RNA, 21 nt, Homo sapiens
uuuuuaauggcaauaggacau

SEQ ID NO: 803074 - RNA, 15 nt, Homo sapiens
uuuuuacugcucuga

SEQ ID NO: 803075 - RNA, 12 nt, Homo sapiens
uuuuuagcuuua

SEQ ID NO: 803076 - RNA, 20 nt, Homo sapiens
uuuuuauaaaaaugagugcu

SEQ ID NO: 803077 - RNA, 13 nt, Homo sapiens
uuuuuauacugua

SEQ ID NO: 803078 - RNA, 12 nt, Homo sapiens
uuuuuauagguu

SEQ ID NO: 803079 - RNA, 20 nt, Homo sapiens
uuuuuauauauaugcauaua

SEQ ID NO: 803080 - RNA, 19 nt, Homo sapiens
uuuuuauggcugcauagua

SEQ ID NO: 803081 - RNA, 22 nt, Homo sapiens
uuuuuaugugcuaugcaaaaua

SEQ ID NO: 803082 - RNA, 13 nt, Homo sapiens
uuuuuauuucuga

SEQ ID NO: 803083 - RNA, 14 nt, Homo sapiens
uuuuuauuugcuca

SEQ ID NO: 803084 - RNA, 13 nt, Homo sapiens
uuuuucaagagcu

SEQ ID NO: 803085 - RNA, 14 nt, Homo sapiens
uuuuucaagagcuc

SEQ ID NO: 803086 - RNA, 15 nt, Homo sapiens
uuuuucacaauguga

SEQ ID NO: 803087 - RNA, 15 nt, Homo sapiens
uuuuucccaguauuu

SEQ ID NO: 803088 - RNA, 15 nt, Homo sapiens
uuuuucuauuguacu

SEQ ID NO: 803089 - RNA, 20 nt, Homo sapiens
uuuuucucagaucugguuuc

SEQ ID NO: 803090 - RNA, 22 nt, Homo sapiens
uuuuucugauagaaaugguuuc

SEQ ID NO: 803091 - RNA, 22 nt, Homo sapiens
uuuuucuggccucgcuguucuc

SEQ ID NO: 803092 - RNA, 15 nt, Homo sapiens
uuuuucuuuuuccac

SEQ ID NO: 803093 - RNA, 18 nt, Homo sapiens
uuuuugcugcugccucuu

SEQ ID NO: 803094 - RNA, 23 nt, Homo sapiens
uuuuuggaauuaugucugcugaa

SEQ ID NO: 803095 - RNA, 14 nt, Homo sapiens
uuuuuguaacugga

SEQ ID NO: 803096 - RNA, 16 nt, Homo sapiens
uuuuuguacuuuggaa

SEQ ID NO: 803097 - RNA, 12 nt, Homo sapiens
uuuuugugauca

SEQ ID NO: 803098 - RNA, 19 nt, Homo sapiens
uuuuuuaaaaaauagcagc

SEQ ID NO: 803099 - RNA, 11 nt, Homo sapiens
uuuuuuacucg

SEQ ID NO: 803100 - RNA, 13 nt, Homo sapiens
uuuuuuauuggaa

SEQ ID NO: 803101 - RNA, 21 nt, Homo sapiens
uuuuuucacucauagccacuu

SEQ ID NO: 803102 - RNA, 16 nt, Homo sapiens
uuuuuuggugguucug

SEQ ID NO: 803103 - RNA, 15 nt, Homo sapiens
guucccccagcaagc

SEQ ID NO: 803104 - RNA, 16 nt, Homo sapiens
cacauaacaugcuuua

SEQ ID NO: 803105 - RNA, 13 nt, Homo sapiens
cacauacuaccua

SEQ ID NO: 803106 - RNA, 16 nt, Homo sapiens
cacauagauaccuuca

SEQ ID NO: 803107 - RNA, 15 nt, Homo sapiens
cacauaggcuggugg

SEQ ID NO: 803108 - RNA, 13 nt, Homo sapiens
cacauauaacaug

SEQ ID NO: 803109 - RNA, 18 nt, Homo sapiens
cacauauggaauuuugca

SEQ ID NO: 803110 - RNA, 22 nt, Homo sapiens
cacauauggacucugcacauga

SEQ ID NO: 803111 - RNA, 16 nt, Homo sapiens
cacaucagcaauuuca

SEQ ID NO: 803112 - RNA, 14 nt, Homo sapiens
cacauccagccuaa

SEQ ID NO: 803113 - RNA, 17 nt, Homo sapiens
cacaucccaucgucucg

SEQ ID NO: 803114 - RNA, 15 nt, Homo sapiens
cacaucuauugcaga

SEQ ID NO: 803115 - RNA, 13 nt, Homo sapiens
cacaucugcauuu

SEQ ID NO: 803116 - RNA, 12 nt, Homo sapiens
cacaucugucac

SEQ ID NO: 803117 - RNA, 15 nt, Homo sapiens
cacaucuuaaauuca

SEQ ID NO: 803118 - RNA, 14 nt, Homo sapiens
cacaugaccuccau

SEQ ID NO: 803119 - RNA, 17 nt, Homo sapiens
cacaugaggccaucuca

SEQ ID NO: 803120 - RNA, 15 nt, Homo sapiens
cacaugcacacacac

SEQ ID NO: 803121 - RNA, 20 nt, Homo sapiens
cacaugccuguaaucccagc

SEQ ID NO: 803122 - RNA, 20 nt, Homo sapiens
cacauggcggagaguuuuaa

SEQ ID NO: 803123 - RNA, 14 nt, Homo sapiens
cacauggcugggau

SEQ ID NO: 803124 - RNA, 15 nt, Homo sapiens
cacauggugugaguc

SEQ ID NO: 803125 - RNA, 16 nt, Homo sapiens
cacaugucuuguacau

SEQ ID NO: 803126 - RNA, 15 nt, Homo sapiens
cacaugugacacaua

SEQ ID NO: 803127 - RNA, 20 nt, Homo sapiens
cacaugugacacauaugcac

SEQ ID NO: 803128 - RNA, 23 nt, Homo sapiens
cacauguguaugauacuaaagac

SEQ ID NO: 803129 - RNA, 23 nt, Homo sapiens
cacauuaacucccuccaccagcc

SEQ ID NO: 803130 - RNA, 16 nt, Homo sapiens
cacauuaaucucaaag

SEQ ID NO: 803131 - RNA, 14 nt, Homo sapiens
cacauuaucuucau

SEQ ID NO: 803132 - RNA, 13 nt, Homo sapiens
cacauucuauuaa

SEQ ID NO: 803133 - RNA, 23 nt, Homo sapiens
cacauuggauucaucagcauuug

SEQ ID NO: 803134 - RNA, 20 nt, Homo sapiens
cacauuuagaaaagugaauu

SEQ ID NO: 803135 - RNA, 21 nt, Homo sapiens
cacauuuagauccugguuuca

SEQ ID NO: 803136 - RNA, 18 nt, Homo sapiens
cacauuuauauauauaug

SEQ ID NO: 803137 - RNA, 22 nt, Homo sapiens
cacauuucauugucuuagucaa

SEQ ID NO: 803138 - RNA, 15 nt, Homo sapiens
cacauuugauguaca

SEQ ID NO: 803139 - RNA, 19 nt, Homo sapiens
cacauuugguuucugaaua

SEQ ID NO: 803140 - RNA, 23 nt, Homo sapiens
cacauuugucaguauuuuugccg

SEQ ID NO: 803141 - RNA, 22 nt, Homo sapiens
cacauuuuuuuaugcucuugaa

SEQ ID NO: 803142 - RNA, 14 nt, Homo sapiens
caccaaacucuuaa

SEQ ID NO: 803143 - RNA, 21 nt, Homo sapiens
caccaaagaauuguaggcagu

SEQ ID NO: 803144 - RNA, 13 nt, Homo sapiens
caccaaaguucua

SEQ ID NO: 803145 - RNA, 23 nt, Homo sapiens
caccaaaucagcugcuacuacuc

SEQ ID NO: 803146 - RNA, 14 nt, Homo sapiens
caccaacgagguga

SEQ ID NO: 803147 - RNA, 13 nt, Homo sapiens
caccaacuccuaa

SEQ ID NO: 803148 - RNA, 15 nt, Homo sapiens
caccaaguuaccuac

SEQ ID NO: 803149 - RNA, 16 nt, Homo sapiens
caccaaugagccuuag

SEQ ID NO: 803150 - RNA, 17 nt, Homo sapiens
caccaauuaucaucuuu

SEQ ID NO: 803151 - RNA, 23 nt, Homo sapiens
caccaccuggggagagccugcuu

SEQ ID NO: 803152 - RNA, 15 nt, Homo sapiens
caccacgacuggcca

SEQ ID NO: 803153 - RNA, 16 nt, Homo sapiens
caccacgccuggcuaa

SEQ ID NO: 803154 - RNA, 14 nt, Homo sapiens
caccacugcuuuaa

SEQ ID NO: 803155 - RNA, 22 nt, Homo sapiens
caccagagggauaaaaacaaua

SEQ ID NO: 803156 - RNA, 18 nt, Homo sapiens
caccagccccacugccag

SEQ ID NO: 803157 - RNA, 17 nt, Homo sapiens
caccagccccagcaaga

SEQ ID NO: 803158 - RNA, 15 nt, Homo sapiens
caccagcccuagcug

SEQ ID NO: 803159 - RNA, 21 nt, Homo sapiens
caccagcccugaccccagugu

SEQ ID NO: 803160 - RNA, 23 nt, Homo sapiens
caccaggaauccccaacaugcac

SEQ ID NO: 803161 - RNA, 16 nt, Homo sapiens
caccaggggugcucac

SEQ ID NO: 803162 - RNA, 14 nt, Homo sapiens
caccagucaccucg

SEQ ID NO: 803163 - RNA, 15 nt, Homo sapiens
caccauagugucaca

SEQ ID NO: 803164 - RNA, 15 nt, Homo sapiens
caccaucauguuuca

SEQ ID NO: 803165 - RNA, 18 nt, Homo sapiens
caccauccugcagccucc

SEQ ID NO: 803166 - RNA, 14 nt, Homo sapiens
caccaucugauuaa

SEQ ID NO: 803167 - RNA, 15 nt, Homo sapiens
caccaugaacuugau

SEQ ID NO: 803168 - RNA, 21 nt, Homo sapiens
caccauggucaucaccacccu

SEQ ID NO: 803169 - RNA, 20 nt, Homo sapiens
caccauguacauagcuugau

SEQ ID NO: 803170 - RNA, 18 nt, Homo sapiens
caccauguuugagcucag

SEQ ID NO: 803171 - RNA, 18 nt, Homo sapiens
caccauucccugccuugc

SEQ ID NO: 803172 - RNA, 22 nt, Homo sapiens
caccauugcacuccacccuggg

SEQ ID NO: 803173 - RNA, 20 nt, Homo sapiens
cacccaagccugauccagcc

SEQ ID NO: 803174 - RNA, 14 nt, Homo sapiens
cacccacaacaucu

SEQ ID NO: 803175 - RNA, 13 nt, Homo sapiens
cacccacauguga

SEQ ID NO: 803176 - RNA, 18 nt, Homo sapiens
cacccacccuguggcuca

SEQ ID NO: 803177 - RNA, 21 nt, Homo sapiens
cacccaccuuuggaaagcucu

SEQ ID NO: 803178 - RNA, 17 nt, Homo sapiens
cacccacugacccaacu

SEQ ID NO: 803179 - RNA, 22 nt, Homo sapiens
cacccagacuggaaugcaguga

SEQ ID NO: 803180 - RNA, 20 nt, Homo sapiens
cacccaggcuggacugcaau

SEQ ID NO: 803181 - RNA, 19 nt, Homo sapiens
cacccaggucccccgacug

SEQ ID NO: 803182 - RNA, 19 nt, Homo sapiens
cacccagguuggagugcag

SEQ ID NO: 803183 - RNA, 23 nt, Homo sapiens
cacccaguugccaaaguuuugcu

SEQ ID NO: 803184 - RNA, 23 nt, Homo sapiens
cacccaucguccaccccagugug

SEQ ID NO: 803185 - RNA, 13 nt, Homo sapiens
caccccagugugc

SEQ ID NO: 803186 - RNA, 19 nt, Homo sapiens
cacccccaccauccaggug

SEQ ID NO: 803187 - RNA, 14 nt, Homo sapiens
cacccccgugucca

SEQ ID NO: 803188 - RNA, 21 nt, Homo sapiens
cacccccugcuccaccagcag

SEQ ID NO: 803189 - RNA, 20 nt, Homo sapiens
cacccccuucucugcuccac

SEQ ID NO: 803190 - RNA, 18 nt, Homo sapiens
caccccuaaucugcagug

SEQ ID NO: 803191 - RNA, 21 nt, Homo sapiens
caccccucaaaaaaagccuuu

SEQ ID NO: 803192 - RNA, 17 nt, Homo sapiens
cacccgcccacagccag

SEQ ID NO: 803193 - RNA, 20 nt, Homo sapiens
cacccggcucguguauuuau

SEQ ID NO: 803194 - RNA, 23 nt, Homo sapiens
cacccuccagaauccugauggua

SEQ ID NO: 803195 - RNA, 15 nt, Homo sapiens
cacccuccuacaggu

SEQ ID NO: 803196 - RNA, 19 nt, Homo sapiens
cacccugcaggacuugcca

SEQ ID NO: 803197 - RNA, 17 nt, Homo sapiens
cacccugccccuugcca

SEQ ID NO: 803198 - RNA, 21 nt, Homo sapiens
cacccuggaaccgggaagggu

SEQ ID NO: 803199 - RNA, 16 nt, Homo sapiens
cacccuggacaaagaa

SEQ ID NO: 803200 - RNA, 21 nt, Homo sapiens
cacccuguccaaacugccuaa

SEQ ID NO: 803201 - RNA, 16 nt, Homo sapiens
cacccuugcccggcug

SEQ ID NO: 803202 - RNA, 17 nt, Homo sapiens
aaaaagcuaaugugcag

SEQ ID NO: 803203 - RNA, 13 nt, Homo sapiens
aaaaagcugcuuc

SEQ ID NO: 803204 - RNA, 15 nt, Homo sapiens
aaaaagcuucugugg

SEQ ID NO: 803205 - RNA, 23 nt, Homo sapiens
aaaaaggagccuuuugcucucug

SEQ ID NO: 803206 - RNA, 14 nt, Homo sapiens
aaaaaggccaaaga

SEQ ID NO: 803207 - RNA, 19 nt, Homo sapiens
aaaaagggggcugcauucu

SEQ ID NO: 803208 - RNA, 16 nt, Homo sapiens
aaaaaguauguucuaa

SEQ ID NO: 803209 - RNA, 16 nt, Homo sapiens
aaaaaguuaaacauug

SEQ ID NO: 803210 - RNA, 19 nt, Homo sapiens
aaaaauaaaaaagaucucc

SEQ ID NO: 803211 - RNA, 16 nt, Homo sapiens
aaaaauaaaaauucau

SEQ ID NO: 803212 - RNA, 19 nt, Homo sapiens
aaaaauaaaaugcauuuaa

SEQ ID NO: 803213 - RNA, 15 nt, Homo sapiens
aaaaauaaaguacca

SEQ ID NO: 803214 - RNA, 20 nt, Homo sapiens
aaaaauaaaguaccacacau

SEQ ID NO: 803215 - RNA, 23 nt, Homo sapiens
aaaaauacggcuuuuccaaugau

SEQ ID NO: 803216 - RNA, 15 nt, Homo sapiens
aaaaauagcagcuuu

SEQ ID NO: 803217 - RNA, 15 nt, Homo sapiens
aaaaauaguucuaaa

SEQ ID NO: 803218 - RNA, 17 nt, Homo sapiens
aaaaaucagcuggguac

SEQ ID NO: 803219 - RNA, 17 nt, Homo sapiens
aaaaaucauaguacucu

SEQ ID NO: 803220 - RNA, 16 nt, Homo sapiens
aaaaaucucccaguga

SEQ ID NO: 803221 - RNA, 17 nt, Homo sapiens
aaaaaugaaauccagug

SEQ ID NO: 803222 - RNA, 14 nt, Homo sapiens
aaaaaugacuaaaa

SEQ ID NO: 803223 - RNA, 21 nt, Homo sapiens
aaaaaugagcauacaucuuaa

SEQ ID NO: 803224 - RNA, 17 nt, Homo sapiens
aaaaaugaugcgcauca

SEQ ID NO: 803225 - RNA, 16 nt, Homo sapiens
aaaaaugcacccaacu

SEQ ID NO: 803226 - RNA, 23 nt, Homo sapiens
aaaaauggauacuggugcaguca

SEQ ID NO: 803227 - RNA, 16 nt, Homo sapiens
aaaaauggauagcuca

SEQ ID NO: 803228 - RNA, 21 nt, Homo sapiens
aaaaauguaucugugugugau

SEQ ID NO: 803229 - RNA, 15 nt, Homo sapiens
aaaaauguguuccau

SEQ ID NO: 803230 - RNA, 20 nt, Homo sapiens
aaaaauuagcaugcugcuuu

SEQ ID NO: 803231 - RNA, 21 nt, Homo sapiens
aaaaauuguaucucauuacuu

SEQ ID NO: 803232 - RNA, 16 nt, Homo sapiens
aaaaauugucugcauu

SEQ ID NO: 803233 - RNA, 16 nt, Homo sapiens
aaaaauuuuuauguaa

SEQ ID NO: 803234 - RNA, 10 nt, Homo sapiens
aaaacaaaga

SEQ ID NO: 803235 - RNA, 19 nt, Homo sapiens
aaaacaaagcaacaaauua

SEQ ID NO: 803236 - RNA, 23 nt, Homo sapiens
aaaacaaagcaacaaauuaacua

SEQ ID NO: 803237 - RNA, 13 nt, Homo sapiens
aaaacaaccaaca

SEQ ID NO: 803238 - RNA, 20 nt, Homo sapiens
aaaacaacuucaauauccaa

SEQ ID NO: 803239 - RNA, 16 nt, Homo sapiens
aaaacaccuagcuuua

SEQ ID NO: 803240 - RNA, 11 nt, Homo sapiens
aaaacacugcc

SEQ ID NO: 803241 - RNA, 16 nt, Homo sapiens
aaaacagaacacuuau

SEQ ID NO: 803242 - RNA, 23 nt, Homo sapiens
aaaacagaacaucauuagaacaa

SEQ ID NO: 803243 - RNA, 18 nt, Homo sapiens
aaaacagccucacagaag

SEQ ID NO: 803244 - RNA, 19 nt, Homo sapiens
aaaacagguauauacuuug

SEQ ID NO: 803245 - RNA, 20 nt, Homo sapiens
aaaacagucuacauugagca

SEQ ID NO: 803246 - RNA, 14 nt, Homo sapiens
aaaacagugucuug

SEQ ID NO: 803247 - RNA, 13 nt, Homo sapiens
aaaacauauccaa

SEQ ID NO: 803248 - RNA, 18 nt, Homo sapiens
aaaacaugauuguuuaca

SEQ ID NO: 803249 - RNA, 10 nt, Homo sapiens
aaaacaugca

SEQ ID NO: 803250 - RNA, 16 nt, Homo sapiens
aaaacauguaugugca

SEQ ID NO: 803251 - RNA, 13 nt, Homo sapiens
aaaacauguuaau

SEQ ID NO: 803252 - RNA, 11 nt, Homo sapiens
aaaacauucaa

SEQ ID NO: 803253 - RNA, 15 nt, Homo sapiens
aaaacauugauaauu

SEQ ID NO: 803254 - RNA, 14 nt, Homo sapiens
cacaagccugagaa

SEQ ID NO: 803255 - RNA, 13 nt, Homo sapiens
cacaaggacccuu

SEQ ID NO: 803256 - RNA, 18 nt, Homo sapiens
cacaaggaccucuuuacu

SEQ ID NO: 803257 - RNA, 22 nt, Homo sapiens
cacaaggcagccugaacacuca

SEQ ID NO: 803258 - RNA, 15 nt, Homo sapiens
cacaaggugauuuca

SEQ ID NO: 803259 - RNA, 21 nt, Homo sapiens
cacaaggugauuucagacugc

SEQ ID NO: 803260 - RNA, 21 nt, Homo sapiens
cacaaguaacacauuuggcca

SEQ ID NO: 803261 - RNA, 22 nt, Homo sapiens
cacaagugguguuuauugcaau

SEQ ID NO: 803262 - RNA, 23 nt, Homo sapiens
cacaagugguguuuauugcaaua

SEQ ID NO: 803263 - RNA, 13 nt, Homo sapiens
cacaauacaguau

SEQ ID NO: 803264 - RNA, 14 nt, Homo sapiens
cacaauacaguauu

SEQ ID NO: 803265 - RNA, 20 nt, Homo sapiens
cacaauagcaguugaaacaa

SEQ ID NO: 803266 - RNA, 15 nt, Homo sapiens
cacaauccuccaaga

SEQ ID NO: 803267 - RNA, 15 nt, Homo sapiens
cacaaugaugaugau

SEQ ID NO: 803268 - RNA, 16 nt, Homo sapiens
cacaauguuucuucau

SEQ ID NO: 803269 - RNA, 12 nt, Homo sapiens
cacaauucacua

SEQ ID NO: 803270 - RNA, 22 nt, Homo sapiens
cacaauuccauuuccaguucau

SEQ ID NO: 803271 - RNA, 20 nt, Homo sapiens
cacacaaaaaaucaaguuga

SEQ ID NO: 803272 - RNA, 21 nt, Homo sapiens
cacacaaaaagugucucugcc

SEQ ID NO: 803273 - RNA, 21 nt, Homo sapiens
cacacaaagaggaugauuucc

SEQ ID NO: 803274 - RNA, 21 nt, Homo sapiens
cacacacagucccauuugcau

SEQ ID NO: 803275 - RNA, 18 nt, Homo sapiens
cacacacauaagcacuga

SEQ ID NO: 803276 - RNA, 13 nt, Homo sapiens
cacacacauggaa

SEQ ID NO: 803277 - RNA, 13 nt, Homo sapiens
cacacacccagcu

SEQ ID NO: 803278 - RNA, 15 nt, Homo sapiens
cacacaccucucaag

SEQ ID NO: 803279 - RNA, 15 nt, Homo sapiens
cacacaccuguaguc

SEQ ID NO: 803280 - RNA, 17 nt, Homo sapiens
cacacacgaugcauuua

SEQ ID NO: 803281 - RNA, 18 nt, Homo sapiens
cacacacgaugcauuuaa

SEQ ID NO: 803282 - RNA, 21 nt, Homo sapiens
cacacacgcuuucuuaugcaa

SEQ ID NO: 803283 - RNA, 13 nt, Homo sapiens
cacacacuggccu

SEQ ID NO: 803284 - RNA, 22 nt, Homo sapiens
cacacacuguucugaaagugac

SEQ ID NO: 803285 - RNA, 22 nt, Homo sapiens
cacacagcuacucuccccacga

SEQ ID NO: 803286 - RNA, 12 nt, Homo sapiens
cacacccacuaa

SEQ ID NO: 803287 - RNA, 13 nt, Homo sapiens
cacaccccagugg

SEQ ID NO: 803288 - RNA, 20 nt, Homo sapiens
cacaccccucaaaaaaagcc

SEQ ID NO: 803289 - RNA, 16 nt, Homo sapiens
cacacccgugagaaau

SEQ ID NO: 803290 - RNA, 19 nt, Homo sapiens
cacacccgugugcacacuc

SEQ ID NO: 803291 - RNA, 17 nt, Homo sapiens
cacacccuccccauuca

SEQ ID NO: 803292 - RNA, 20 nt, Homo sapiens
cacaccguggccuaccuggg

SEQ ID NO: 803293 - RNA, 22 nt, Homo sapiens
cacaccugggcauuuggugaga

SEQ ID NO: 803294 - RNA, 18 nt, Homo sapiens
cacacgagcuagcuucug

SEQ ID NO: 803295 - RNA, 13 nt, Homo sapiens
cacacgaugcauu

SEQ ID NO: 803296 - RNA, 14 nt, Homo sapiens
cacacgaugcauuu

SEQ ID NO: 803297 - RNA, 13 nt, Homo sapiens
cacacgcacucuc

SEQ ID NO: 803298 - RNA, 23 nt, Homo sapiens
cacacgcacugcgccugucagua

SEQ ID NO: 803299 - RNA, 13 nt, Homo sapiens
cacacgcauuaau

SEQ ID NO: 803300 - RNA, 16 nt, Homo sapiens
cacacgccuccuguag

SEQ ID NO: 803301 - RNA, 22 nt, Homo sapiens
cacacgcuuucuuaugcaaucu

SEQ ID NO: 803302 - RNA, 17 nt, Homo sapiens
cacacggcugaccucau

SEQ ID NO: 803303 - RNA, 22 nt, Homo sapiens
cacacucgcccgcccacugucc

SEQ ID NO: 803304 - RNA, 15 nt, Homo sapiens
cacacugaaucagcu

SEQ ID NO: 803305 - RNA, 14 nt, Homo sapiens
cacacugcuagcaa

SEQ ID NO: 803306 - RNA, 11 nt, Homo sapiens
cacacuggccu

SEQ ID NO: 803307 - RNA, 16 nt, Homo sapiens
cacacuguaaauauga

SEQ ID NO: 803308 - RNA, 19 nt, Homo sapiens
cacacuguucugaaaguga

SEQ ID NO: 803309 - RNA, 12 nt, Homo sapiens
cacacuucauug

SEQ ID NO: 803310 - RNA, 15 nt, Homo sapiens
cacacuugugugugg

SEQ ID NO: 803311 - RNA, 20 nt, Homo sapiens
cacacuuuguaauuugcaaa

SEQ ID NO: 803312 - RNA, 22 nt, Homo sapiens
cacagaaaaggcugcugugaac

SEQ ID NO: 803313 - RNA, 14 nt, Homo sapiens
cacagaaacacugc

SEQ ID NO: 803314 - RNA, 14 nt, Homo sapiens
cacagaaaugcugc

SEQ ID NO: 803315 - RNA, 21 nt, Homo sapiens
cacagaacuauguacuuuaaa

SEQ ID NO: 803316 - RNA, 16 nt, Homo sapiens
cacagaacugaucuca

SEQ ID NO: 803317 - RNA, 14 nt, Homo sapiens
cacagaaggaauaa

SEQ ID NO: 803318 - RNA, 18 nt, Homo sapiens
cacagaaggaaucugugc

SEQ ID NO: 803319 - RNA, 22 nt, Homo sapiens
cacagaagggugugggccacca

SEQ ID NO: 803320 - RNA, 19 nt, Homo sapiens
cacagaauauguauguaua

SEQ ID NO: 803321 - RNA, 16 nt, Homo sapiens
cacagaauuuaagcaa

SEQ ID NO: 803322 - RNA, 20 nt, Homo sapiens
cacagacauuuugugugaga

SEQ ID NO: 803323 - RNA, 14 nt, Homo sapiens
cacagacgggcaca

SEQ ID NO: 803324 - RNA, 11 nt, Homo sapiens
cacagacugac

SEQ ID NO: 803325 - RNA, 18 nt, Homo sapiens
cacagagaaggcuaugua

SEQ ID NO: 803326 - RNA, 13 nt, Homo sapiens
cacagagcuacau

SEQ ID NO: 803327 - RNA, 17 nt, Homo sapiens
cacagagcuacauggug

SEQ ID NO: 803328 - RNA, 22 nt, Homo sapiens
cacagauguuugaggcuuucag

SEQ ID NO: 803329 - RNA, 22 nt, Homo sapiens
cacagauuauguuccugcugua

SEQ ID NO: 803330 - RNA, 17 nt, Homo sapiens
cacagcaacaaugacuu

SEQ ID NO: 803331 - RNA, 17 nt, Homo sapiens
cacagcaagaugaauuu

SEQ ID NO: 803332 - RNA, 16 nt, Homo sapiens
cacagcacucucuaaa

SEQ ID NO: 803333 - RNA, 23 nt, Homo sapiens
cacagcagcaccuccuccaugca

SEQ ID NO: 803334 - RNA, 23 nt, Homo sapiens
cacagcaucgggagcacccagag

SEQ ID NO: 803335 - RNA, 13 nt, Homo sapiens
cacagcauuguau

SEQ ID NO: 803336 - RNA, 14 nt, Homo sapiens
cacagcccagccac

SEQ ID NO: 803337 - RNA, 17 nt, Homo sapiens
cacagcccucaugauca

SEQ ID NO: 803338 - RNA, 22 nt, Homo sapiens
cacagcccucaugaucauucuc

SEQ ID NO: 803339 - RNA, 21 nt, Homo sapiens
cacagcccugagugucccaag

SEQ ID NO: 803340 - RNA, 20 nt, Homo sapiens
cacagccgccugaaagccac

SEQ ID NO: 803341 - RNA, 17 nt, Homo sapiens
cacagcggagucugucc

SEQ ID NO: 803342 - RNA, 23 nt, Homo sapiens
cacagcucccggcgggugcucug

SEQ ID NO: 803343 - RNA, 20 nt, Homo sapiens
cacagcuccugccaggguga

SEQ ID NO: 803344 - RNA, 20 nt, Homo sapiens
cacagcugaacuuguugaga

SEQ ID NO: 803345 - RNA, 18 nt, Homo sapiens
cacagcugggcaggguga

SEQ ID NO: 803346 - RNA, 14 nt, Homo sapiens
cacaggaguguccu

SEQ ID NO: 803347 - RNA, 22 nt, Homo sapiens
cacaggcagcuggaugagacuu

SEQ ID NO: 803348 - RNA, 16 nt, Homo sapiens
cacaggcagguacugu

SEQ ID NO: 803349 - RNA, 19 nt, Homo sapiens
cacaggcagugcaugugaa

SEQ ID NO: 803350 - RNA, 14 nt, Homo sapiens
cacaggcaucagga

SEQ ID NO: 803351 - RNA, 17 nt, Homo sapiens
cacaggcccuagcuuua

SEQ ID NO: 803352 - RNA, 17 nt, Homo sapiens
cacaggcgaggacccug

SEQ ID NO: 803353 - RNA, 22 nt, Homo sapiens
auuagauuuggaggcuaccuca

SEQ ID NO: 803354 - RNA, 23 nt, Homo sapiens
auuagcagcaucuuuaacacagc

SEQ ID NO: 803355 - RNA, 22 nt, Homo sapiens
auuagcauucugguuuugacau

SEQ ID NO: 803356 - RNA, 19 nt, Homo sapiens
auuagccauuucacucuca

SEQ ID NO: 803357 - RNA, 21 nt, Homo sapiens
auuagcccaacuagaagccua

SEQ ID NO: 803358 - RNA, 13 nt, Homo sapiens
caauacaauguac

SEQ ID NO: 803359 - RNA, 19 nt, Homo sapiens
caauacaauguacaauuau

SEQ ID NO: 803360 - RNA, 15 nt, Homo sapiens
caauacaugcugcua

SEQ ID NO: 803361 - RNA, 17 nt, Homo sapiens
caauacauuuuuuucuc

SEQ ID NO: 803362 - RNA, 15 nt, Homo sapiens
caauaccaaauagcu

SEQ ID NO: 803363 - RNA, 12 nt, Homo sapiens
caauaccaaugu

SEQ ID NO: 803364 - RNA, 14 nt, Homo sapiens
caauaccaauguuc

SEQ ID NO: 803365 - RNA, 20 nt, Homo sapiens
caauacccaccucuguggau

SEQ ID NO: 803366 - RNA, 22 nt, Homo sapiens
caauaccguguggcccaagacc

SEQ ID NO: 803367 - RNA, 18 nt, Homo sapiens
caauacucaaaagagaga

SEQ ID NO: 803368 - RNA, 14 nt, Homo sapiens
caauacugcccaag

SEQ ID NO: 803369 - RNA, 21 nt, Homo sapiens
caauagaaggauguacauuuc

SEQ ID NO: 803370 - RNA, 14 nt, Homo sapiens
caauagaucuccag

SEQ ID NO: 803371 - RNA, 14 nt, Homo sapiens
caauaguaaaagau

SEQ ID NO: 803372 - RNA, 17 nt, Homo sapiens
caauagugaaaugccac

SEQ ID NO: 803373 - RNA, 16 nt, Homo sapiens
caauauuaacauaaga

SEQ ID NO: 803374 - RNA, 15 nt, Homo sapiens
caauauuacuuuguc

SEQ ID NO: 803375 - RNA, 23 nt, Homo sapiens
caauauuguaauccuagcacuuu

SEQ ID NO: 803376 - RNA, 20 nt, Homo sapiens
caauauuuaguaaagcuuuu

SEQ ID NO: 803377 - RNA, 18 nt, Homo sapiens
caauauuugguauuucaa

SEQ ID NO: 803378 - RNA, 17 nt, Homo sapiens
caaucaaggccacugcu

SEQ ID NO: 803379 - RNA, 13 nt, Homo sapiens
caaucagcacuga

SEQ ID NO: 803380 - RNA, 17 nt, Homo sapiens
caaucagcccagugcaa

SEQ ID NO: 803381 - RNA, 19 nt, Homo sapiens
caaucaguauaauucugua

SEQ ID NO: 803382 - RNA, 17 nt, Homo sapiens
caaucagugcagugaua

SEQ ID NO: 803383 - RNA, 17 nt, Homo sapiens
caaucauaauaccugcu

SEQ ID NO: 803384 - RNA, 22 nt, Homo sapiens
caaucaugaaauaugcaucuca

SEQ ID NO: 803385 - RNA, 15 nt, Homo sapiens
caaucauuucuauua

SEQ ID NO: 803386 - RNA, 15 nt, Homo sapiens
caauccaucucucaa

SEQ ID NO: 803387 - RNA, 19 nt, Homo sapiens
caaucuacaacuggaagau

SEQ ID NO: 803388 - RNA, 18 nt, Homo sapiens
caaucuauuuuugugugc

SEQ ID NO: 803389 - RNA, 15 nt, Homo sapiens
caaucucaauuccau

SEQ ID NO: 803390 - RNA, 22 nt, Homo sapiens
caaucucccgugggcaucucaa

SEQ ID NO: 803391 - RNA, 18 nt, Homo sapiens
caaucucggcucacugaa

SEQ ID NO: 803392 - RNA, 18 nt, Homo sapiens
caaucucugccauaucag

SEQ ID NO: 803393 - RNA, 18 nt, Homo sapiens
caaucugcaguuuaacaa

SEQ ID NO: 803394 - RNA, 14 nt, Homo sapiens
caaucuucuacuuu

SEQ ID NO: 803395 - RNA, 12 nt, Homo sapiens
caaugaagggaa

SEQ ID NO: 803396 - RNA, 14 nt, Homo sapiens
caaugaauccccaa

SEQ ID NO: 803397 - RNA, 16 nt, Homo sapiens
caaugaugguuuaaua

SEQ ID NO: 803398 - RNA, 14 nt, Homo sapiens
caaugcaaaugucu

SEQ ID NO: 803399 - RNA, 16 nt, Homo sapiens
caaugcacgaucucag

SEQ ID NO: 803400 - RNA, 15 nt, Homo sapiens
caaugccaaucuuca

SEQ ID NO: 803401 - RNA, 16 nt, Homo sapiens
caaugccaugaacaaa

SEQ ID NO: 803402 - RNA, 23 nt, Homo sapiens
caaugccccuggaucuaccagca

SEQ ID NO: 803403 - RNA, 18 nt, Homo sapiens
caaugcccucauacccau

SEQ ID NO: 803404 - RNA, 18 nt, Homo sapiens
caaugccuacagcugucu

SEQ ID NO: 803405 - RNA, 17 nt, Homo sapiens
caaugcuucuagaguuu

SEQ ID NO: 803406 - RNA, 21 nt, Homo sapiens
caaugcuuugggaggccaagg

SEQ ID NO: 803407 - RNA, 18 nt, Homo sapiens
caauggaguggcugccau

SEQ ID NO: 803408 - RNA, 18 nt, Homo sapiens
caaugggaggcugugauu

SEQ ID NO: 803409 - RNA, 15 nt, Homo sapiens
caauggggccaguca

SEQ ID NO: 803410 - RNA, 14 nt, Homo sapiens
caaugguugaauga

SEQ ID NO: 803411 - RNA, 22 nt, Homo sapiens
caauguacaguugaaauaacug

SEQ ID NO: 803412 - RNA, 15 nt, Homo sapiens
caaugucaaugugaa

SEQ ID NO: 803413 - RNA, 13 nt, Homo sapiens
caaugucacuuaa

SEQ ID NO: 803414 - RNA, 18 nt, Homo sapiens
caaugucaugucugugau

SEQ ID NO: 803415 - RNA, 19 nt, Homo sapiens
caaugucuuaggucaggag

SEQ ID NO: 803416 - RNA, 16 nt, Homo sapiens
caaugugcugcugcuu

SEQ ID NO: 803417 - RNA, 23 nt, Homo sapiens
caauguuuuaaggucuaucuuaa

SEQ ID NO: 803418 - RNA, 18 nt, Homo sapiens
caauuacucagguuugag

SEQ ID NO: 803419 - RNA, 21 nt, Homo sapiens
caauuagcaauugacugucac

SEQ ID NO: 803420 - RNA, 13 nt, Homo sapiens
caauuagcauuau

SEQ ID NO: 803421 - RNA, 15 nt, Homo sapiens
caauuaguggucaua

SEQ ID NO: 803422 - RNA, 13 nt, Homo sapiens
caauuauauaaau

SEQ ID NO: 803423 - RNA, 13 nt, Homo sapiens
caauuaugucucu

SEQ ID NO: 803424 - RNA, 16 nt, Homo sapiens
caauucauucauuugc

SEQ ID NO: 803425 - RNA, 20 nt, Homo sapiens
caauuccaaaggaaucucca

SEQ ID NO: 803426 - RNA, 23 nt, Homo sapiens
caauucccaccuaugagugagaa

SEQ ID NO: 803427 - RNA, 13 nt, Homo sapiens
caauuccucuggg

SEQ ID NO: 803428 - RNA, 15 nt, Homo sapiens
caauuccucugggaa

SEQ ID NO: 803429 - RNA, 17 nt, Homo sapiens
caauuccugacacuuga

SEQ ID NO: 803430 - RNA, 12 nt, Homo sapiens
caauucuaguca

SEQ ID NO: 803431 - RNA, 18 nt, Homo sapiens
caauucuggacagacaga

SEQ ID NO: 803432 - RNA, 23 nt, Homo sapiens
caauucugugacauacauauuau

SEQ ID NO: 803433 - RNA, 21 nt, Homo sapiens
caauucuuuguauaugcauuc

SEQ ID NO: 803434 - RNA, 19 nt, Homo sapiens
caauugaccuucucccuca

SEQ ID NO: 803435 - RNA, 14 nt, Homo sapiens
caauugcucaugca

SEQ ID NO: 803436 - RNA, 18 nt, Homo sapiens
caauuguccccagggaca

SEQ ID NO: 803437 - RNA, 21 nt, Homo sapiens
caauuguuauguguuuagaau

SEQ ID NO: 803438 - RNA, 17 nt, Homo sapiens
caauuugacaaaaccca

SEQ ID NO: 803439 - RNA, 22 nt, Homo sapiens
caauuugagauucuacaguaag

SEQ ID NO: 803440 - RNA, 13 nt, Homo sapiens
caauuugccuuuu

SEQ ID NO: 803441 - RNA, 16 nt, Homo sapiens
caauuuguauaucaug

SEQ ID NO: 803442 - RNA, 23 nt, Homo sapiens
caauuuuaaaaaauaacauauuc

SEQ ID NO: 803443 - RNA, 21 nt, Homo sapiens
caauuuuccuuggaacacaua

SEQ ID NO: 803444 - RNA, 15 nt, Homo sapiens
caauuuucuguaaga

SEQ ID NO: 803445 - RNA, 18 nt, Homo sapiens
caauuuuuuaucaugcau

SEQ ID NO: 803446 - RNA, 23 nt, Homo sapiens
cacaaaaaaugaggaauagcaaa

SEQ ID NO: 803447 - RNA, 20 nt, Homo sapiens
cacaaaauguaggguuauaa

SEQ ID NO: 803448 - RNA, 14 nt, Homo sapiens
cacaaaauucuuau

SEQ ID NO: 803449 - RNA, 14 nt, Homo sapiens
cacaaaauugggaa

SEQ ID NO: 803450 - RNA, 12 nt, Homo sapiens
cacaaacaauau

SEQ ID NO: 803451 - RNA, 18 nt, Homo sapiens
cacaaacccugcugaaca

SEQ ID NO: 803452 - RNA, 13 nt, Homo sapiens
cacaaacugugaa

SEQ ID NO: 803453 - RNA, 16 nt, Homo sapiens
cacaaagacuccuucg

SEQ ID NO: 803454 - RNA, 18 nt, Homo sapiens
cacaaagcucaagaugac

SEQ ID NO: 803455 - RNA, 22 nt, Homo sapiens
cacaaaggaaguccaaccugag

SEQ ID NO: 803456 - RNA, 11 nt, Homo sapiens
cacaaagggaa

SEQ ID NO: 803457 - RNA, 16 nt, Homo sapiens
cacaaaguccacuuua

SEQ ID NO: 803458 - RNA, 18 nt, Homo sapiens
auuagcugggaagaccaa

SEQ ID NO: 803459 - RNA, 15 nt, Homo sapiens
auuaggcaagaauaa

SEQ ID NO: 803460 - RNA, 15 nt, Homo sapiens
auuaguaaaagugcu

SEQ ID NO: 803461 - RNA, 21 nt, Homo sapiens
auuaguguugaaccaaugcuu

SEQ ID NO: 803462 - RNA, 23 nt, Homo sapiens
auuaguuaaugagccaucacuag

SEQ ID NO: 803463 - RNA, 20 nt, Homo sapiens
auuaguugaaaggccucaag

SEQ ID NO: 803464 - RNA, 12 nt, Homo sapiens
auuaguuuacau

SEQ ID NO: 803465 - RNA, 17 nt, Homo sapiens
auuauaauauacuauau

SEQ ID NO: 803466 - RNA, 20 nt, Homo sapiens
auuauaauaugugccuuaag

SEQ ID NO: 803467 - RNA, 15 nt, Homo sapiens
auuauaccucaaugu

SEQ ID NO: 803468 - RNA, 13 nt, Homo sapiens
auuauaguacuga

SEQ ID NO: 803469 - RNA, 15 nt, Homo sapiens
auuauaguagcuuau

SEQ ID NO: 803470 - RNA, 12 nt, Homo sapiens
auuauauagaaa

SEQ ID NO: 803471 - RNA, 18 nt, Homo sapiens
auuaucaagggcacaguu

SEQ ID NO: 803472 - RNA, 19 nt, Homo sapiens
auuaucacauuaaucucaa

SEQ ID NO: 803473 - RNA, 21 nt, Homo sapiens
auuaucauaugaacuugucag

SEQ ID NO: 803474 - RNA, 13 nt, Homo sapiens
auuaucaugcaaa

SEQ ID NO: 803475 - RNA, 14 nt, Homo sapiens
auuauccacaugaa

SEQ ID NO: 803476 - RNA, 21 nt, Homo sapiens
auuaucgggagcagugucuuc

SEQ ID NO: 803477 - RNA, 13 nt, Homo sapiens
auuaucucacuua

SEQ ID NO: 803478 - RNA, 22 nt, Homo sapiens
auuaucugugucaaaagccaga

SEQ ID NO: 803479 - RNA, 16 nt, Homo sapiens
auuaugauguccaggg

SEQ ID NO: 803480 - RNA, 16 nt, Homo sapiens
auuaugcagacaaccu

SEQ ID NO: 803481 - RNA, 21 nt, Homo sapiens
auuaugcagacaaccucauca

SEQ ID NO: 803482 - RNA, 21 nt, Homo sapiens
auuaugcauauauaaguuuac

SEQ ID NO: 803483 - RNA, 13 nt, Homo sapiens
auuauguauaaca

SEQ ID NO: 803484 - RNA, 20 nt, Homo sapiens
auuaugucucuucugagcua

SEQ ID NO: 803485 - RNA, 18 nt, Homo sapiens
auuauguggcccucugga

SEQ ID NO: 803486 - RNA, 14 nt, Homo sapiens
auuauuaacaaagu

SEQ ID NO: 803487 - RNA, 18 nt, Homo sapiens
auuauucaagugccucuu

SEQ ID NO: 803488 - RNA, 19 nt, Homo sapiens
auuauugacacugaacuua

SEQ ID NO: 803489 - RNA, 14 nt, Homo sapiens
auuauugugacuuc

SEQ ID NO: 803490 - RNA, 16 nt, Homo sapiens
auuauugugacuucac

SEQ ID NO: 803491 - RNA, 14 nt, Homo sapiens
auuauuuccagugu

SEQ ID NO: 803492 - RNA, 19 nt, Homo sapiens
auuauuuggagccugccaa

SEQ ID NO: 803493 - RNA, 16 nt, Homo sapiens
auuauuuuacaaucaa

SEQ ID NO: 803494 - RNA, 16 nt, Homo sapiens
auuauuuucacuguag

SEQ ID NO: 803495 - RNA, 14 nt, Homo sapiens
auuauuuugcacug

SEQ ID NO: 803496 - RNA, 20 nt, Homo sapiens
auuauuuuugagacagaguc

SEQ ID NO: 803497 - RNA, 18 nt, Homo sapiens
auuauuuuuuauacugua

SEQ ID NO: 803498 - RNA, 20 nt, Homo sapiens
auucaaaagguuauauacca

SEQ ID NO: 803499 - RNA, 13 nt, Homo sapiens
auucaacaaauau

SEQ ID NO: 803500 - RNA, 20 nt, Homo sapiens
auucaacagagacugaauag

SEQ ID NO: 803501 - RNA, 14 nt, Homo sapiens
auucaagaaugcca

SEQ ID NO: 803502 - RNA, 14 nt, Homo sapiens
auucaaggggagcc

SEQ ID NO: 803503 - RNA, 13 nt, Homo sapiens
auucaauacaggc

SEQ ID NO: 803504 - RNA, 15 nt, Homo sapiens
auucaauccuacuuu

SEQ ID NO: 803505 - RNA, 21 nt, Homo sapiens
auucaauuaguggucauaaaa

SEQ ID NO: 803506 - RNA, 21 nt, Homo sapiens
auucaauucuuuuaacuguug

SEQ ID NO: 803507 - RNA, 19 nt, Homo sapiens
auucaauuuuaaagacuca

SEQ ID NO: 803508 - RNA, 18 nt, Homo sapiens
auucacaaaauuuccaca

SEQ ID NO: 803509 - RNA, 14 nt, Homo sapiens
auucacacaaagac

SEQ ID NO: 803510 - RNA, 19 nt, Homo sapiens
auucacagaauagcacaaa

SEQ ID NO: 803511 - RNA, 20 nt, Homo sapiens
auucacagaauagcacaaac

SEQ ID NO: 803512 - RNA, 18 nt, Homo sapiens
auucacagcaagucacug

SEQ ID NO: 803513 - RNA, 14 nt, Homo sapiens
auucacaguaauau

SEQ ID NO: 803514 - RNA, 21 nt, Homo sapiens
auucacaguaauaugguuccc

SEQ ID NO: 803515 - RNA, 14 nt, Homo sapiens
auucaccaacacag

SEQ ID NO: 803516 - RNA, 15 nt, Homo sapiens
auucacccuguccaa

SEQ ID NO: 803517 - RNA, 18 nt, Homo sapiens
auucacuagaccagaagu

SEQ ID NO: 803518 - RNA, 18 nt, Homo sapiens
auucacuucgccauucau

SEQ ID NO: 803519 - RNA, 17 nt, Homo sapiens
auucagaaagcauuuau

SEQ ID NO: 803520 - RNA, 20 nt, Homo sapiens
auucagaaauucuccaggau

SEQ ID NO: 803521 - RNA, 17 nt, Homo sapiens
auucagaaggaucuuca

SEQ ID NO: 803522 - RNA, 23 nt, Homo sapiens
auucagagcuaauaagugcuuuc

SEQ ID NO: 803523 - RNA, 13 nt, Homo sapiens
auucagcacuuaa

SEQ ID NO: 803524 - RNA, 14 nt, Homo sapiens
auucagcaugucca

SEQ ID NO: 803525 - RNA, 18 nt, Homo sapiens
auucagcccucagaagaa

SEQ ID NO: 803526 - RNA, 21 nt, Homo sapiens
auucaggacuuaacggcucca

SEQ ID NO: 803527 - RNA, 18 nt, Homo sapiens
auucaggcuacucauuca

SEQ ID NO: 803528 - RNA, 16 nt, Homo sapiens
auucagguauguugcc

SEQ ID NO: 803529 - RNA, 12 nt, Homo sapiens
auucagucacau

SEQ ID NO: 803530 - RNA, 11 nt, Homo sapiens
auucagugacg

SEQ ID NO: 803531 - RNA, 23 nt, Homo sapiens
auucagugagggucuucuuacau

SEQ ID NO: 803532 - RNA, 22 nt, Homo sapiens
auucauaaaaauaaccaaaaaa

SEQ ID NO: 803533 - RNA, 15 nt, Homo sapiens
auucauaaccaaaga

SEQ ID NO: 803534 - RNA, 18 nt, Homo sapiens
auucauaccuugauggua

SEQ ID NO: 803535 - RNA, 15 nt, Homo sapiens
auucauauaggccag

SEQ ID NO: 803536 - RNA, 22 nt, Homo sapiens
auucauauaggccagaguugca

SEQ ID NO: 803537 - RNA, 17 nt, Homo sapiens
auucauauuuacuucuu

SEQ ID NO: 803538 - RNA, 22 nt, Homo sapiens
auucauccuuccauccaucuuu

SEQ ID NO: 803539 - RNA, 20 nt, Homo sapiens
auucauguucaugugauuaa

SEQ ID NO: 803540 - RNA, 22 nt, Homo sapiens
auucauuuuuaagauagaacac

SEQ ID NO: 803541 - RNA, 21 nt, Homo sapiens
auuccaaacacauacaggaag

SEQ ID NO: 803542 - RNA, 22 nt, Homo sapiens
auuccaacagcucaagucuucc

SEQ ID NO: 803543 - RNA, 18 nt, Homo sapiens
auuccaacauuucucacu

SEQ ID NO: 803544 - RNA, 23 nt, Homo sapiens
auuccacacccucacugcuguag

SEQ ID NO: 803545 - RNA, 23 nt, Homo sapiens
auuccacuuaggaagaaaugccc

SEQ ID NO: 803546 - RNA, 16 nt, Homo sapiens
auuccagaucuuucag

SEQ ID NO: 803547 - RNA, 22 nt, Homo sapiens
auuccagcaguuguuccaggga

SEQ ID NO: 803548 - RNA, 17 nt, Homo sapiens
auuccaggcagccucug

SEQ ID NO: 803549 - RNA, 19 nt, Homo sapiens
auuccaggcugagccauga

SEQ ID NO: 803550 - RNA, 17 nt, Homo sapiens
auuccaguacaguauuc

SEQ ID NO: 803551 - RNA, 20 nt, Homo sapiens
auuccagucaaaucugggcu

SEQ ID NO: 803552 - RNA, 18 nt, Homo sapiens
auuccauaaaucuauugu

SEQ ID NO: 803553 - RNA, 18 nt, Homo sapiens
auuccauaauacauaaca

SEQ ID NO: 803554 - RNA, 18 nt, Homo sapiens
auuccauggauugauuca

SEQ ID NO: 803555 - RNA, 18 nt, Homo sapiens
auucccaagcuuuuggag

SEQ ID NO: 803556 - RNA, 20 nt, Homo sapiens
auucccaccauucuaccuga

SEQ ID NO: 803557 - RNA, 11 nt, Homo sapiens
auucccacugc

SEQ ID NO: 803558 - RNA, 13 nt, Homo sapiens
auucccacugccg

SEQ ID NO: 803559 - RNA, 13 nt, Homo sapiens
auucccauucuac

SEQ ID NO: 803560 - RNA, 17 nt, Homo sapiens
auucccauuuugcaaaa

SEQ ID NO: 803561 - RNA, 22 nt, Homo sapiens
auucccugaaucugugccugca

SEQ ID NO: 803562 - RNA, 19 nt, Homo sapiens
auuccguugucuguggaug

SEQ ID NO: 803563 - RNA, 18 nt, Homo sapiens
auuccuaacuagaauuag

SEQ ID NO: 803564 - RNA, 14 nt, Homo sapiens
auuccuacaaagau

SEQ ID NO: 803565 - RNA, 23 nt, Homo sapiens
auuccuagaaauugaacaaaaau

SEQ ID NO: 803566 - RNA, 19 nt, Homo sapiens
auuccuauauaguuuauug

SEQ ID NO: 803567 - RNA, 12 nt, Homo sapiens
auuccuaucuca

SEQ ID NO: 803568 - RNA, 13 nt, Homo sapiens
auuccuaucucau

SEQ ID NO: 803569 - RNA, 19 nt, Homo sapiens
auuccuauuggaaacagag

SEQ ID NO: 803570 - RNA, 23 nt, Homo sapiens
auuccuccagacguccaccucag

SEQ ID NO: 803571 - RNA, 14 nt, Homo sapiens
auuccugaagggaa

SEQ ID NO: 803572 - RNA, 16 nt, Homo sapiens
auuccugaucccaugg

SEQ ID NO: 803573 - RNA, 10 nt, Homo sapiens
auguucaagc

SEQ ID NO: 803574 - RNA, 14 nt, Homo sapiens
auguucacugugag

SEQ ID NO: 803575 - RNA, 14 nt, Homo sapiens
auguucagcacugu

SEQ ID NO: 803576 - RNA, 20 nt, Homo sapiens
auguucauaguuacauauuu

SEQ ID NO: 803577 - RNA, 21 nt, Homo sapiens
auguucuacuuaaauauauua

SEQ ID NO: 803578 - RNA, 12 nt, Homo sapiens
auguaaccaagc

SEQ ID NO: 803579 - RNA, 13 nt, Homo sapiens
auguaacugcuga

SEQ ID NO: 803580 - RNA, 14 nt, Homo sapiens
auguaacugugcca

SEQ ID NO: 803581 - RNA, 22 nt, Homo sapiens
auguaagauuauagauucuaaa

SEQ ID NO: 803582 - RNA, 14 nt, Homo sapiens
acagaagcuguuuu

SEQ ID NO: 803583 - RNA, 15 nt, Homo sapiens
acagaauagcacaaa

SEQ ID NO: 803584 - RNA, 18 nt, Homo sapiens
acagaaugguggagugua

SEQ ID NO: 803585 - RNA, 18 nt, Homo sapiens
acagaauuaagaaauacu

SEQ ID NO: 803586 - RNA, 20 nt, Homo sapiens
acagacaagugacuguaucu

SEQ ID NO: 803587 - RNA, 20 nt, Homo sapiens
acagacacucccacuuggca

SEQ ID NO: 803588 - RNA, 23 nt, Homo sapiens
acagacacucccacuuggcauca

SEQ ID NO: 803589 - RNA, 14 nt, Homo sapiens
acagacaggcucuu

SEQ ID NO: 803590 - RNA, 18 nt, Homo sapiens
acagaccaccuuucacaa

SEQ ID NO: 803591 - RNA, 20 nt, Homo sapiens
acagaccuaggauuucauga

SEQ ID NO: 803592 - RNA, 11 nt, Homo sapiens
acagaccucag

SEQ ID NO: 803593 - RNA, 12 nt, Homo sapiens
acagacgugugc

SEQ ID NO: 803594 - RNA, 23 nt, Homo sapiens
acagacucugauucuacagugau

SEQ ID NO: 803595 - RNA, 13 nt, Homo sapiens
acagacugugagu

SEQ ID NO: 803596 - RNA, 22 nt, Homo sapiens
acagacugugaguacagcagaa

SEQ ID NO: 803597 - RNA, 20 nt, Homo sapiens
acagacuugaacauuugcag

SEQ ID NO: 803598 - RNA, 16 nt, Homo sapiens
acagacuugaaugcua

SEQ ID NO: 803599 - RNA, 13 nt, Homo sapiens
acagagagacaga

SEQ ID NO: 803600 - RNA, 18 nt, Homo sapiens
acagagaggaggggacca

SEQ ID NO: 803601 - RNA, 15 nt, Homo sapiens
acagagaugugauaa

SEQ ID NO: 803602 - RNA, 21 nt, Homo sapiens
acagagcaagacuccaucuca

SEQ ID NO: 803603 - RNA, 14 nt, Homo sapiens
acagagccuugaga

SEQ ID NO: 803604 - RNA, 12 nt, Homo sapiens
acagagcgagau

SEQ ID NO: 803605 - RNA, 16 nt, Homo sapiens
acagaggagaugccac

SEQ ID NO: 803606 - RNA, 18 nt, Homo sapiens
acagaggauuugcucugg

SEQ ID NO: 803607 - RNA, 16 nt, Homo sapiens
acagagggcugcauuc

SEQ ID NO: 803608 - RNA, 16 nt, Homo sapiens
acagaguagaaacuca

SEQ ID NO: 803609 - RNA, 21 nt, Homo sapiens
acagagucccuggcuccucua

SEQ ID NO: 803610 - RNA, 21 nt, Homo sapiens
acagagugagacuccaucuca

SEQ ID NO: 803611 - RNA, 23 nt, Homo sapiens
acagagugagacuccaucucaaa

SEQ ID NO: 803612 - RNA, 13 nt, Homo sapiens
acagagugcaacc

SEQ ID NO: 803613 - RNA, 17 nt, Homo sapiens
acagagugcaacccagu

SEQ ID NO: 803614 - RNA, 17 nt, Homo sapiens
acagagugcauugugag

SEQ ID NO: 803615 - RNA, 13 nt, Homo sapiens
cccagcacuguga

SEQ ID NO: 803616 - RNA, 13 nt, Homo sapiens
cccagcacuuugg

SEQ ID NO: 803617 - RNA, 14 nt, Homo sapiens
cccagcagaucuca

SEQ ID NO: 803618 - RNA, 17 nt, Homo sapiens
cccagcagcucaagaag

SEQ ID NO: 803619 - RNA, 15 nt, Homo sapiens
cccagcagggccuca

SEQ ID NO: 803620 - RNA, 20 nt, Homo sapiens
cccagcagugucacucugua

SEQ ID NO: 803621 - RNA, 19 nt, Homo sapiens
cccagcaucccuggagcag

SEQ ID NO: 803622 - RNA, 21 nt, Homo sapiens
cccagccaaguccaagagggc

SEQ ID NO: 803623 - RNA, 23 nt, Homo sapiens
cccagccaucugcccaggggugc

SEQ ID NO: 803624 - RNA, 13 nt, Homo sapiens
cccagcccaauaa

SEQ ID NO: 803625 - RNA, 23 nt, Homo sapiens
cccagcccagggcuccugcacuu

SEQ ID NO: 803626 - RNA, 15 nt, Homo sapiens
cccagccugaaagau

SEQ ID NO: 803627 - RNA, 15 nt, Homo sapiens
cccagcgagcucuca

SEQ ID NO: 803628 - RNA, 13 nt, Homo sapiens
cccagcuacuuga

SEQ ID NO: 803629 - RNA, 15 nt, Homo sapiens
cccagcuacuuuaac

SEQ ID NO: 803630 - RNA, 17 nt, Homo sapiens
cccagcugaaggcagug

SEQ ID NO: 803631 - RNA, 17 nt, Homo sapiens
cccagcuguagccaugg

SEQ ID NO: 803632 - RNA, 21 nt, Homo sapiens
cccagcuuaauggcucaugac

SEQ ID NO: 803633 - RNA, 17 nt, Homo sapiens
cccagcuuagaguucuu

SEQ ID NO: 803634 - RNA, 19 nt, Homo sapiens
cccagcuugggcccagcug

SEQ ID NO: 803635 - RNA, 19 nt, Homo sapiens
cccagcuuugcugccugag

SEQ ID NO: 803636 - RNA, 16 nt, Homo sapiens
acacccuuucuugaca

SEQ ID NO: 803637 - RNA, 16 nt, Homo sapiens
acaccgcugcacucaa

SEQ ID NO: 803638 - RNA, 14 nt, Homo sapiens
acaccuauugcacu

SEQ ID NO: 803639 - RNA, 12 nt, Homo sapiens
acaccucagugg

SEQ ID NO: 803640 - RNA, 20 nt, Homo sapiens
acaccucccccugcugcugc

SEQ ID NO: 803641 - RNA, 13 nt, Homo sapiens
acaccucccugaa

SEQ ID NO: 803642 - RNA, 18 nt, Homo sapiens
acaccugcagugccagcu

SEQ ID NO: 803643 - RNA, 20 nt, Homo sapiens
acaccuggcccuugcaaucu

SEQ ID NO: 803644 - RNA, 21 nt, Homo sapiens
acaccuguaaucccagcacuu

SEQ ID NO: 803645 - RNA, 15 nt, Homo sapiens
acaccuguacauucu

SEQ ID NO: 803646 - RNA, 19 nt, Homo sapiens
acaccuguagucccagcua

SEQ ID NO: 803647 - RNA, 16 nt, Homo sapiens
acaccuuggacuguua

SEQ ID NO: 803648 - RNA, 20 nt, Homo sapiens
acaccuuggccuucugggaa

SEQ ID NO: 803649 - RNA, 15 nt, Homo sapiens
acacgaagccagcag

SEQ ID NO: 803650 - RNA, 17 nt, Homo sapiens
acacgagcaaacccaga

SEQ ID NO: 803651 - RNA, 15 nt, Homo sapiens
acacgaugcauuuaa

SEQ ID NO: 803652 - RNA, 12 nt, Homo sapiens
acacgcauuaau

SEQ ID NO: 803653 - RNA, 21 nt, Homo sapiens
acacgcccuccccagacucca

SEQ ID NO: 803654 - RNA, 15 nt, Homo sapiens
acacggacugugcau

SEQ ID NO: 803655 - RNA, 18 nt, Homo sapiens
acacguacaaaauccagc

SEQ ID NO: 803656 - RNA, 19 nt, Homo sapiens
acacuaaauccccucacua

SEQ ID NO: 803657 - RNA, 23 nt, Homo sapiens
acacuaacuuaauguguauucau

SEQ ID NO: 803658 - RNA, 21 nt, Homo sapiens
acacuacacagcacaccagcc

SEQ ID NO: 803659 - RNA, 16 nt, Homo sapiens
acacuaccuuaucagg

SEQ ID NO: 803660 - RNA, 18 nt, Homo sapiens
acacuagaaaacuugacu

SEQ ID NO: 803661 - RNA, 14 nt, Homo sapiens
acacuagccagaca

SEQ ID NO: 803662 - RNA, 22 nt, Homo sapiens
acacuaugcacugcuguaacug

SEQ ID NO: 803663 - RNA, 20 nt, Homo sapiens
acacuauuuaucugugcaaa

SEQ ID NO: 803664 - RNA, 17 nt, Homo sapiens
acacucaaaucaagaaa

SEQ ID NO: 803665 - RNA, 23 nt, Homo sapiens
acacucaccugcacuaacagagu

SEQ ID NO: 803666 - RNA, 18 nt, Homo sapiens
acacucaucacacuucau

SEQ ID NO: 803667 - RNA, 20 nt, Homo sapiens
acacucccacuuggcaucau

SEQ ID NO: 803668 - RNA, 17 nt, Homo sapiens
acacucucuucucugcu

SEQ ID NO: 803669 - RNA, 15 nt, Homo sapiens
acacugaaguuaaca

SEQ ID NO: 803670 - RNA, 19 nt, Homo sapiens
acacugaaucucaccugcu

SEQ ID NO: 803671 - RNA, 16 nt, Homo sapiens
acacugaccuguguuc

SEQ ID NO: 803672 - RNA, 20 nt, Homo sapiens
acacugagcaagaucuuguc

SEQ ID NO: 803673 - RNA, 23 nt, Homo sapiens
acacugaggccuuguguccuuua

SEQ ID NO: 803674 - RNA, 13 nt, Homo sapiens
acacugauuccuu

SEQ ID NO: 803675 - RNA, 16 nt, Homo sapiens
acacugauuccuuuau

SEQ ID NO: 803676 - RNA, 16 nt, Homo sapiens
acacugcacacaguga

SEQ ID NO: 803677 - RNA, 18 nt, Homo sapiens
acacugcaguuuccugga

SEQ ID NO: 803678 - RNA, 13 nt, Homo sapiens
acacugcuuuaaa

SEQ ID NO: 803679 - RNA, 18 nt, Homo sapiens
acacuggaacauggcuag

SEQ ID NO: 803680 - RNA, 13 nt, Homo sapiens
acacuggauccau

SEQ ID NO: 803681 - RNA, 15 nt, Homo sapiens
acacuggauggucau

SEQ ID NO: 803682 - RNA, 19 nt, Homo sapiens
acacugggugcgucuccag

SEQ ID NO: 803683 - RNA, 15 nt, Homo sapiens
acacuggugccaugu

SEQ ID NO: 803684 - RNA, 21 nt, Homo sapiens
acacuguaaucuuaaaagugu

SEQ ID NO: 803685 - RNA, 18 nt, Homo sapiens
acacugucacuagucuca

SEQ ID NO: 803686 - RNA, 19 nt, Homo sapiens
acacugucacuagucucac

SEQ ID NO: 803687 - RNA, 12 nt, Homo sapiens
acacugucuucc

SEQ ID NO: 803688 - RNA, 19 nt, Homo sapiens
acacugugaacucaaucuc

SEQ ID NO: 803689 - RNA, 13 nt, Homo sapiens
acacugugcccug

SEQ ID NO: 803690 - RNA, 13 nt, Homo sapiens
acacugugucauu

SEQ ID NO: 803691 - RNA, 23 nt, Homo sapiens
acacuguguccuggugcucucug

SEQ ID NO: 803692 - RNA, 13 nt, Homo sapiens
acacuucagaucu

SEQ ID NO: 803693 - RNA, 21 nt, Homo sapiens
acacuucauuguaaaucacuu

SEQ ID NO: 803694 - RNA, 16 nt, Homo sapiens
acacuuccaccagccu

SEQ ID NO: 803695 - RNA, 16 nt, Homo sapiens
acacuuccauuaacuu

SEQ ID NO: 803696 - RNA, 14 nt, Homo sapiens
acacuuccccaucu

SEQ ID NO: 803697 - RNA, 19 nt, Homo sapiens
acacuucugugagaccccc

SEQ ID NO: 803698 - RNA, 21 nt, Homo sapiens
acacuuggagcccgugcagua

SEQ ID NO: 803699 - RNA, 14 nt, Homo sapiens
acacuuggaugcag

SEQ ID NO: 803700 - RNA, 19 nt, Homo sapiens
acacuugguuagacgccuu

SEQ ID NO: 803701 - RNA, 15 nt, Homo sapiens
acacuuuccaucucu

SEQ ID NO: 803702 - RNA, 18 nt, Homo sapiens
acacuuuuccacauucca

SEQ ID NO: 803703 - RNA, 20 nt, Homo sapiens
acacuuuuccacauuccagu

SEQ ID NO: 803704 - RNA, 17 nt, Homo sapiens
acagaaaagacucugac

SEQ ID NO: 803705 - RNA, 17 nt, Homo sapiens
acagaaagacugagcuc

SEQ ID NO: 803706 - RNA, 19 nt, Homo sapiens
acagaaagcuccuuccaga

SEQ ID NO: 803707 - RNA, 21 nt, Homo sapiens
acagaaaguucuuaaacucag

SEQ ID NO: 803708 - RNA, 22 nt, Homo sapiens
acagaaauuaagauguugucuu

SEQ ID NO: 803709 - RNA, 15 nt, Homo sapiens
acagaaauucugcaa

SEQ ID NO: 803710 - RNA, 12 nt, Homo sapiens
acagaacaaagu

SEQ ID NO: 803711 - RNA, 16 nt, Homo sapiens
acagaacaccuaugca

SEQ ID NO: 803712 - RNA, 18 nt, Homo sapiens
acagaacaccuaugcaaa

SEQ ID NO: 803713 - RNA, 23 nt, Homo sapiens
acagaaccuucaacccagugggu

SEQ ID NO: 803714 - RNA, 12 nt, Homo sapiens
acagaacuacuu

SEQ ID NO: 803715 - RNA, 13 nt, Homo sapiens
acagaacuacuuc

SEQ ID NO: 803716 - RNA, 20 nt, Homo sapiens
acagaagcggcucaguucac

SEQ ID NO: 803717 - RNA, 19 nt, Homo sapiens
cuauaucaaacaugcacac

SEQ ID NO: 803718 - RNA, 15 nt, Homo sapiens
cuauauccugugacu

SEQ ID NO: 803719 - RNA, 22 nt, Homo sapiens
cuauaucucauuucauucucac

SEQ ID NO: 803720 - RNA, 14 nt, Homo sapiens
cuauaucugagaga

SEQ ID NO: 803721 - RNA, 12 nt, Homo sapiens
cuauaucuguau

SEQ ID NO: 803722 - RNA, 18 nt, Homo sapiens
cuauauuaucaugcaaau

SEQ ID NO: 803723 - RNA, 20 nt, Homo sapiens
cuauauucucaguguagggc

SEQ ID NO: 803724 - RNA, 14 nt, Homo sapiens
cuauauugcacugu

SEQ ID NO: 803725 - RNA, 13 nt, Homo sapiens
cuauauugguuua

SEQ ID NO: 803726 - RNA, 20 nt, Homo sapiens
cuaucaacaccacuaggaau

SEQ ID NO: 803727 - RNA, 12 nt, Homo sapiens
cuaucacuguac

SEQ ID NO: 803728 - RNA, 22 nt, Homo sapiens
cuaucacuuuaaauacuauuau

SEQ ID NO: 803729 - RNA, 19 nt, Homo sapiens
cuaucauaauucagcacuu

SEQ ID NO: 803730 - RNA, 21 nt, Homo sapiens
cuaucaucauccuacaacuca

SEQ ID NO: 803731 - RNA, 17 nt, Homo sapiens
cuaucauggaaugagac

SEQ ID NO: 803732 - RNA, 19 nt, Homo sapiens
cuaucauggaaugagacug

SEQ ID NO: 803733 - RNA, 20 nt, Homo sapiens
cuauccugaauaaagcagac

SEQ ID NO: 803734 - RNA, 15 nt, Homo sapiens
cuauccugauuccaa

SEQ ID NO: 803735 - RNA, 12 nt, Homo sapiens
cuauccuuccag

SEQ ID NO: 803736 - RNA, 14 nt, Homo sapiens
cuaucgaacuucac

SEQ ID NO: 803737 - RNA, 17 nt, Homo sapiens
cuaucuagaacuugaga

SEQ ID NO: 803738 - RNA, 21 nt, Homo sapiens
cuaucuccagcggcccuguca

SEQ ID NO: 803739 - RNA, 15 nt, Homo sapiens
cuaucuggaagccac

SEQ ID NO: 803740 - RNA, 22 nt, Homo sapiens
cuaugaaaaauguguuccauug

SEQ ID NO: 803741 - RNA, 21 nt, Homo sapiens
cuaugaaaacagcuaucucac

SEQ ID NO: 803742 - RNA, 18 nt, Homo sapiens
cuaugaaaauuauaucuc

SEQ ID NO: 803743 - RNA, 19 nt, Homo sapiens
cuaugaaugauacccugaa

SEQ ID NO: 803744 - RNA, 15 nt, Homo sapiens
cuaugacacugagca

SEQ ID NO: 803745 - RNA, 22 nt, Homo sapiens
cuaugagaccguucgcauggca

SEQ ID NO: 803746 - RNA, 17 nt, Homo sapiens
cuaugagcacauaggac

SEQ ID NO: 803747 - RNA, 12 nt, Homo sapiens
cuaugagucuag

SEQ ID NO: 803748 - RNA, 13 nt, Homo sapiens
cuaugaguuuucu

SEQ ID NO: 803749 - RNA, 22 nt, Homo sapiens
cuaugauauuuucugugccuga

SEQ ID NO: 803750 - RNA, 15 nt, Homo sapiens
cuaugaucacaguga

SEQ ID NO: 803751 - RNA, 23 nt, Homo sapiens
cuaugaucuugagggcagacagc

SEQ ID NO: 803752 - RNA, 15 nt, Homo sapiens
cuaugcaagccuugc

SEQ ID NO: 803753 - RNA, 14 nt, Homo sapiens
cuaugcacauaugg

SEQ ID NO: 803754 - RNA, 24 nt, Homo sapiens
cuaugccagcaaccuuguaagcua

SEQ ID NO: 803755 - RNA, 18 nt, Homo sapiens
cuaugccuguauuuccaa

SEQ ID NO: 803756 - RNA, 14 nt, Homo sapiens
cuaugcugcuucca

SEQ ID NO: 803757 - RNA, 21 nt, Homo sapiens
cuaugguguguuguaucuuug

SEQ ID NO: 803758 - RNA, 19 nt, Homo sapiens
cuauguaaacaaaccacag

SEQ ID NO: 803759 - RNA, 13 nt, Homo sapiens
cuauguacuguaa

SEQ ID NO: 803760 - RNA, 14 nt, Homo sapiens
cuaugucucaggag

SEQ ID NO: 803761 - RNA, 14 nt, Homo sapiens
cuaugugcuccuaa

SEQ ID NO: 803762 - RNA, 15 nt, Homo sapiens
cuauguggcuguauc

SEQ ID NO: 803763 - RNA, 14 nt, Homo sapiens
cuauguucaaagac

SEQ ID NO: 803764 - RNA, 20 nt, Homo sapiens
cuauguucaaagacugugaa

SEQ ID NO: 803765 - RNA, 13 nt, Homo sapiens
cuauguucuuagu

SEQ ID NO: 803766 - RNA, 19 nt, Homo sapiens
cuauuaaaauucugauguu

SEQ ID NO: 803767 - RNA, 16 nt, Homo sapiens
cuauuaauacucugca

SEQ ID NO: 803768 - RNA, 17 nt, Homo sapiens
cuauuaauacucugcag

SEQ ID NO: 803769 - RNA, 14 nt, Homo sapiens
cuauuaauucuuaa

SEQ ID NO: 803770 - RNA, 23 nt, Homo sapiens
cuauuaggugcaauuucaagguu

SEQ ID NO: 803771 - RNA, 13 nt, Homo sapiens
cuauuauccuucu

SEQ ID NO: 803772 - RNA, 12 nt, Homo sapiens
cuauuaucucaa

SEQ ID NO: 803773 - RNA, 20 nt, Homo sapiens
cuauucaggcuguuguuggc

SEQ ID NO: 803774 - RNA, 23 nt, Homo sapiens
cuauucaggcuguuguuggcuua

SEQ ID NO: 803775 - RNA, 22 nt, Homo sapiens
cuauuccaaucuacaacuggaa

SEQ ID NO: 803776 - RNA, 22 nt, Homo sapiens
cuauuccauggcuaacuggcga

SEQ ID NO: 803777 - RNA, 23 nt, Homo sapiens
cuauucuauaaaacucugcaugu

SEQ ID NO: 803778 - RNA, 15 nt, Homo sapiens
cuauucucaugccuc

SEQ ID NO: 803779 - RNA, 17 nt, Homo sapiens
cuauucucaugccucag

SEQ ID NO: 803780 - RNA, 17 nt, Homo sapiens
cuauucuguaucauuga

SEQ ID NO: 803781 - RNA, 16 nt, Homo sapiens
cuauucuugauguaaa

SEQ ID NO: 803782 - RNA, 16 nt, Homo sapiens
cuauugaagaugcugc

SEQ ID NO: 803783 - RNA, 16 nt, Homo sapiens
cuauugacuucaauga

SEQ ID NO: 803784 - RNA, 12 nt, Homo sapiens
cuauugcugcuc

SEQ ID NO: 803785 - RNA, 13 nt, Homo sapiens
cuauuuaaagcau

SEQ ID NO: 803786 - RNA, 15 nt, Homo sapiens
cuauuuaaguuauca

SEQ ID NO: 803787 - RNA, 21 nt, Homo sapiens
cuauuuagaaauggauuuauc

SEQ ID NO: 803788 - RNA, 22 nt, Homo sapiens
cuauuuauuaaaaacaugacca

SEQ ID NO: 803789 - RNA, 23 nt, Homo sapiens
cuauuucaucuauuuuuggcagu

SEQ ID NO: 803790 - RNA, 22 nt, Homo sapiens
cuauuucauguuuuugaucaaa

SEQ ID NO: 803791 - RNA, 13 nt, Homo sapiens
cuauuuccacuga

SEQ ID NO: 803792 - RNA, 23 nt, Homo sapiens
cuauuucgaguguuguguuaaaa

SEQ ID NO: 803793 - RNA, 17 nt, Homo sapiens
cuauuucuccaaagccu

SEQ ID NO: 803794 - RNA, 19 nt, Homo sapiens
cuauuucugaagaggcuuc

SEQ ID NO: 803795 - RNA, 22 nt, Homo sapiens
cuauuucuguauauaaaggugc

SEQ ID NO: 803796 - RNA, 18 nt, Homo sapiens
cuauuucuucuacugcua

SEQ ID NO: 803797 - RNA, 15 nt, Homo sapiens
cuauuugaacaagug

SEQ ID NO: 803798 - RNA, 14 nt, Homo sapiens
cuauuuguacaauu

SEQ ID NO: 803799 - RNA, 18 nt, Homo sapiens
cuauuuuauuuguauuca

SEQ ID NO: 803800 - RNA, 22 nt, Homo sapiens
cuauuuuuaaugaaacuucaaa

SEQ ID NO: 803801 - RNA, 17 nt, Homo sapiens
cuauuuuugugugcugu

SEQ ID NO: 803802 - RNA, 21 nt, Homo sapiens
cuauuuuuguuaagcgugucu

SEQ ID NO: 803803 - RNA, 22 nt, Homo sapiens
cucaaaauaccaugccauuuaa

SEQ ID NO: 803804 - RNA, 22 nt, Homo sapiens
cucaaacggaggaagcccacau

SEQ ID NO: 803805 - RNA, 18 nt, Homo sapiens
cucaaacuccugaccuca

SEQ ID NO: 803806 - RNA, 18 nt, Homo sapiens
cucaaaguacugggauua

SEQ ID NO: 803807 - RNA, 14 nt, Homo sapiens
cucaaaguuucaga

SEQ ID NO: 803808 - RNA, 18 nt, Homo sapiens
cucaaaucugagggagcu

SEQ ID NO: 803809 - RNA, 17 nt, Homo sapiens
cucaaaugcacaucuca

SEQ ID NO: 803810 - RNA, 20 nt, Homo sapiens
cucaaauucauggugcacug

SEQ ID NO: 803811 - RNA, 20 nt, Homo sapiens
cucaaauuggugaacagugu

SEQ ID NO: 803812 - RNA, 22 nt, Homo sapiens
cucaacaaugguugaaugaaua

SEQ ID NO: 803813 - RNA, 21 nt, Homo sapiens
cucaacagagaggaccaacau

SEQ ID NO: 803814 - RNA, 14 nt, Homo sapiens
cucaacaugucucc

SEQ ID NO: 803815 - RNA, 23 nt, Homo sapiens
cucaacauguuacugaccagcaa

SEQ ID NO: 803816 - RNA, 21 nt, Homo sapiens
cucaaccagagucacccaguu

SEQ ID NO: 803817 - RNA, 14 nt, Homo sapiens
cucaaccuauggua

SEQ ID NO: 803818 - RNA, 18 nt, Homo sapiens
cucaacguugcuccccau

SEQ ID NO: 803819 - RNA, 15 nt, Homo sapiens
cucaacuaacaaaau

SEQ ID NO: 803820 - RNA, 14 nt, Homo sapiens
cucaagaacacaug

SEQ ID NO: 803821 - RNA, 14 nt, Homo sapiens
cucaagaccagaga

SEQ ID NO: 803822 - RNA, 14 nt, Homo sapiens
cucaagaguacaga

SEQ ID NO: 803823 - RNA, 15 nt, Homo sapiens
cucaagauucaguag

SEQ ID NO: 803824 - RNA, 21 nt, Homo sapiens
cucaaggcugugcaggcacau

SEQ ID NO: 803825 - RNA, 23 nt, Homo sapiens
cucaaggguuauagacugccaug

SEQ ID NO: 803826 - RNA, 19 nt, Homo sapiens
cucaagguggucaguaaau

SEQ ID NO: 803827 - RNA, 14 nt, Homo sapiens
cucaaguacucaaa

SEQ ID NO: 803828 - RNA, 17 nt, Homo sapiens
cucaagugaauuugaau

SEQ ID NO: 803829 - RNA, 20 nt, Homo sapiens
cucaaguucauugaugaccc

SEQ ID NO: 803830 - RNA, 15 nt, Homo sapiens
cucaauauuccugaa

SEQ ID NO: 803831 - RNA, 21 nt, Homo sapiens
ccccagugguauccugugaca

SEQ ID NO: 803832 - RNA, 23 nt, Homo sapiens
ccccaguucaaucucccgcugcu

SEQ ID NO: 803833 - RNA, 15 nt, Homo sapiens
ccccaucucccugcc

SEQ ID NO: 803834 - RNA, 22 nt, Homo sapiens
ccccauucucaaaaacaaagag

SEQ ID NO: 803835 - RNA, 18 nt, Homo sapiens
cccccacgugacagugcc

SEQ ID NO: 803836 - RNA, 16 nt, Homo sapiens
cccccacugaccagaa

SEQ ID NO: 803837 - RNA, 13 nt, Homo sapiens
cccccacugccac

SEQ ID NO: 803838 - RNA, 15 nt, Homo sapiens
cccccagcacugagg

SEQ ID NO: 803839 - RNA, 14 nt, Homo sapiens
cccccagcuaagaa

SEQ ID NO: 803840 - RNA, 21 nt, Homo sapiens
cccccagugggcauagucagu

SEQ ID NO: 803841 - RNA, 12 nt, Homo sapiens
cccccauuucac

SEQ ID NO: 803842 - RNA, 21 nt, Homo sapiens
cccccgggacugggcuaggag

SEQ ID NO: 803843 - RNA, 21 nt, Homo sapiens
cccccucccaacagcgcuuua

SEQ ID NO: 803844 - RNA, 20 nt, Homo sapiens
cccccuuuagcgggacucag

SEQ ID NO: 803845 - RNA, 17 nt, Homo sapiens
cccccuuucacacugga

SEQ ID NO: 803846 - RNA, 23 nt, Homo sapiens
ccccgccugagucagugcucuca

SEQ ID NO: 803847 - RNA, 23 nt, Homo sapiens
ccccgcuugguggccugggaucu

SEQ ID NO: 803848 - RNA, 12 nt, Homo sapiens
ccccggcccacc

SEQ ID NO: 803849 - RNA, 21 nt, Homo sapiens
ccccgggaugcaccgguuauu

SEQ ID NO: 803850 - RNA, 17 nt, Homo sapiens
cuaagucaguuucacau

SEQ ID NO: 803851 - RNA, 15 nt, Homo sapiens
cuaagugcccaaagu

SEQ ID NO: 803852 - RNA, 18 nt, Homo sapiens
cuaaguggaauagccucc

SEQ ID NO: 803853 - RNA, 15 nt, Homo sapiens
cuaaguuauuuacuu

SEQ ID NO: 803854 - RNA, 15 nt, Homo sapiens
cuaauaaguauauaa

SEQ ID NO: 803855 - RNA, 12 nt, Homo sapiens
cuaauacuacug

SEQ ID NO: 803856 - RNA, 16 nt, Homo sapiens
cuaauagcagaaauaa

SEQ ID NO: 803857 - RNA, 13 nt, Homo sapiens
cuaauaugccuag

SEQ ID NO: 803858 - RNA, 18 nt, Homo sapiens
cuaauaugccuagcacaa

SEQ ID NO: 803859 - RNA, 24 nt, Homo sapiens
cuaaucaagaaaaacaucuuuggc

SEQ ID NO: 803860 - RNA, 19 nt, Homo sapiens
cuaaucacauccacaaaac

SEQ ID NO: 803861 - RNA, 14 nt, Homo sapiens
cuaaucaccaaagg

SEQ ID NO: 803862 - RNA, 17 nt, Homo sapiens
cuaaucagcauucucac

SEQ ID NO: 803863 - RNA, 16 nt, Homo sapiens
cuaaucccagcacuuu

SEQ ID NO: 803864 - RNA, 19 nt, Homo sapiens
cuaaugagacugaccauau

SEQ ID NO: 803865 - RNA, 19 nt, Homo sapiens
cuaauggggacacagauca

SEQ ID NO: 803866 - RNA, 15 nt, Homo sapiens
cuaauguaauaacug

SEQ ID NO: 803867 - RNA, 20 nt, Homo sapiens
cuaauguaccaaugaugaau

SEQ ID NO: 803868 - RNA, 22 nt, Homo sapiens
cuaauguugacuuuaauacucu

SEQ ID NO: 803869 - RNA, 22 nt, Homo sapiens
cuaauguuugugagaagcuucu

SEQ ID NO: 803870 - RNA, 18 nt, Homo sapiens
cuaauuaaagaugguuua

SEQ ID NO: 803871 - RNA, 14 nt, Homo sapiens
cuaauuauuuacuc

SEQ ID NO: 803872 - RNA, 19 nt, Homo sapiens
cuaauucagugucacauga

SEQ ID NO: 803873 - RNA, 21 nt, Homo sapiens
cuaauucccauuuugcaaaau

SEQ ID NO: 803874 - RNA, 16 nt, Homo sapiens
cuaauucucuguggaa

SEQ ID NO: 803875 - RNA, 18 nt, Homo sapiens
cuaauucuuguagaugca

SEQ ID NO: 803876 - RNA, 14 nt, Homo sapiens
cuaauugcuuucug

SEQ ID NO: 803877 - RNA, 19 nt, Homo sapiens
cuaauuuaaguacuugaga

SEQ ID NO: 803878 - RNA, 15 nt, Homo sapiens
cuaauuuuguugaaa

SEQ ID NO: 803879 - RNA, 21 nt, Homo sapiens
cuaauuuuuggagaaauguca

SEQ ID NO: 803880 - RNA, 13 nt, Homo sapiens
cuacaaaaacaca

SEQ ID NO: 803881 - RNA, 19 nt, Homo sapiens
cuacaaaaccucaaaccag

SEQ ID NO: 803882 - RNA, 14 nt, Homo sapiens
cuacaaaaugccaa

SEQ ID NO: 803883 - RNA, 17 nt, Homo sapiens
cuacaaacuucaaagag

SEQ ID NO: 803884 - RNA, 13 nt, Homo sapiens
cuacaaagauauu

SEQ ID NO: 803885 - RNA, 18 nt, Homo sapiens
cuacaaagcuuugcuaca

SEQ ID NO: 803886 - RNA, 23 nt, Homo sapiens
cuacaaaggaaauaucaaagugu

SEQ ID NO: 803887 - RNA, 18 nt, Homo sapiens
cuacaacccuacccuggc

SEQ ID NO: 803888 - RNA, 22 nt, Homo sapiens
cuacaauuaauaguuugucuau

SEQ ID NO: 803889 - RNA, 14 nt, Homo sapiens
cuacacaauuuaau

SEQ ID NO: 803890 - RNA, 20 nt, Homo sapiens
cuacacacauaccuucaugu

SEQ ID NO: 803891 - RNA, 20 nt, Homo sapiens
cuacacacguaccuucaugu

SEQ ID NO: 803892 - RNA, 17 nt, Homo sapiens
cuacacagaucacagcu

SEQ ID NO: 803893 - RNA, 18 nt, Homo sapiens
cuacacagcacaccagcc

SEQ ID NO: 803894 - RNA, 17 nt, Homo sapiens
cuacacaggagucuuca

SEQ ID NO: 803895 - RNA, 20 nt, Homo sapiens
cuacacaguaaaaacuugua

SEQ ID NO: 803896 - RNA, 21 nt, Homo sapiens
cuacaccaaugaaaacaugua

SEQ ID NO: 803897 - RNA, 15 nt, Homo sapiens
cuacacggcugugac

SEQ ID NO: 803898 - RNA, 21 nt, Homo sapiens
cuacagaugguagaacuaaac

SEQ ID NO: 803899 - RNA, 17 nt, Homo sapiens
cuacagcuacauugaga

SEQ ID NO: 803900 - RNA, 18 nt, Homo sapiens
cuacagcugucuucacau

SEQ ID NO: 803901 - RNA, 18 nt, Homo sapiens
cuacaggcucaugccauc

SEQ ID NO: 803902 - RNA, 22 nt, Homo sapiens
cuacagggagaaaauccagguc

SEQ ID NO: 803903 - RNA, 19 nt, Homo sapiens
cuacagggccacaacugcc

SEQ ID NO: 803904 - RNA, 23 nt, Homo sapiens
cuacagggcgagacucugucuca

SEQ ID NO: 803905 - RNA, 19 nt, Homo sapiens
cuacaggugaaggcucuca

SEQ ID NO: 803906 - RNA, 15 nt, Homo sapiens
cuacaguaacuguga

SEQ ID NO: 803907 - RNA, 13 nt, Homo sapiens
cuacagugcugug

SEQ ID NO: 803908 - RNA, 14 nt, Homo sapiens
cuacauaauuguga

SEQ ID NO: 803909 - RNA, 18 nt, Homo sapiens
cuacauagugacaugcac

SEQ ID NO: 803910 - RNA, 17 nt, Homo sapiens
cuacaugaaauaaugca

SEQ ID NO: 803911 - RNA, 19 nt, Homo sapiens
cuacauggaguauauguca

SEQ ID NO: 803912 - RNA, 14 nt, Homo sapiens
cuacauuaucucac

SEQ ID NO: 803913 - RNA, 15 nt, Homo sapiens
cuacauucuaaugca

SEQ ID NO: 803914 - RNA, 15 nt, Homo sapiens
cuacauugugcugca

SEQ ID NO: 803915 - RNA, 17 nt, Homo sapiens
cuacauuucugcagauc

SEQ ID NO: 803916 - RNA, 19 nt, Homo sapiens
cuaccaagaacugaaggca

SEQ ID NO: 803917 - RNA, 13 nt, Homo sapiens
cuaccacaaggaa

SEQ ID NO: 803918 - RNA, 15 nt, Homo sapiens
cuaccacagugucug

SEQ ID NO: 803919 - RNA, 12 nt, Homo sapiens
cuaccacuguau

SEQ ID NO: 803920 - RNA, 13 nt, Homo sapiens
cuaccagucuauu

SEQ ID NO: 803921 - RNA, 19 nt, Homo sapiens
cuaccaucugcauggggcu

SEQ ID NO: 803922 - RNA, 13 nt, Homo sapiens
cuacccaguacuc

SEQ ID NO: 803923 - RNA, 13 nt, Homo sapiens
cuacccauuuaca

SEQ ID NO: 803924 - RNA, 19 nt, Homo sapiens
cuaccccgagggcgccaug

SEQ ID NO: 803925 - RNA, 14 nt, Homo sapiens
cuacccgagcccag

SEQ ID NO: 803926 - RNA, 15 nt, Homo sapiens
cuacccuaaagggag

SEQ ID NO: 803927 - RNA, 18 nt, Homo sapiens
cuacccuauucuauccau

SEQ ID NO: 803928 - RNA, 18 nt, Homo sapiens
cuacccugcugaccuccc

SEQ ID NO: 803929 - RNA, 16 nt, Homo sapiens
cuacccuggcacuaua

SEQ ID NO: 803930 - RNA, 17 nt, Homo sapiens
cuacccuuggcagugug

SEQ ID NO: 803931 - RNA, 15 nt, Homo sapiens
cuaccguaaaugucc

SEQ ID NO: 803932 - RNA, 16 nt, Homo sapiens
cuaccucaccugggca

SEQ ID NO: 803933 - RNA, 13 nt, Homo sapiens
cuaccugccucag

SEQ ID NO: 803934 - RNA, 23 nt, Homo sapiens
cuaccuuccccagacuugcacug

SEQ ID NO: 803935 - RNA, 16 nt, Homo sapiens
cuacgguuaugaaggc

SEQ ID NO: 803936 - RNA, 19 nt, Homo sapiens
cuacgugacuguggcacac

SEQ ID NO: 803937 - RNA, 17 nt, Homo sapiens
cuacuacccgagcccag

SEQ ID NO: 803938 - RNA, 20 nt, Homo sapiens
cuacuaccuagggcacuuua

SEQ ID NO: 803939 - RNA, 19 nt, Homo sapiens
cuacucaagaggcugaggc

SEQ ID NO: 803940 - RNA, 20 nt, Homo sapiens
cuacucaggaggcugagaca

SEQ ID NO: 803941 - RNA, 16 nt, Homo sapiens
cuacucagguggcuaa

SEQ ID NO: 803942 - RNA, 12 nt, Homo sapiens
cuacuccaaaau

SEQ ID NO: 803943 - RNA, 21 nt, Homo sapiens
cuacuccccuuaaucuaaucu

SEQ ID NO: 803944 - RNA, 22 nt, Homo sapiens
cuacucccuuauguguugugua

SEQ ID NO: 803945 - RNA, 22 nt, Homo sapiens
cuacuccuagaagaaccaaaua

SEQ ID NO: 803946 - RNA, 15 nt, Homo sapiens
cuacuccucugcagu

SEQ ID NO: 803947 - RNA, 20 nt, Homo sapiens
cuacuccuuguaaagacugu

SEQ ID NO: 803948 - RNA, 23 nt, Homo sapiens
cuacucuguuccuucacauccug

SEQ ID NO: 803949 - RNA, 22 nt, Homo sapiens
cuacucuuacagagccuugaga

SEQ ID NO: 803950 - RNA, 23 nt, Homo sapiens
cuacugaaaggcaguagucauuu

SEQ ID NO: 803951 - RNA, 17 nt, Homo sapiens
cuacugacagggagcag

SEQ ID NO: 803952 - RNA, 14 nt, Homo sapiens
cuacugacccaacu

SEQ ID NO: 803953 - RNA, 12 nt, Homo sapiens
cuacugacgucc

SEQ ID NO: 803954 - RNA, 14 nt, Homo sapiens
cuacugagccuuca

SEQ ID NO: 803955 - RNA, 17 nt, Homo sapiens
cuacugcagcaccucca

SEQ ID NO: 803956 - RNA, 23 nt, Homo sapiens
cucacaaaaaggcaaauauugaa

SEQ ID NO: 803957 - RNA, 22 nt, Homo sapiens
cucacaaaguagaggaauccau

SEQ ID NO: 803958 - RNA, 22 nt, Homo sapiens
cucacaaaguccacuuuacuca

SEQ ID NO: 803959 - RNA, 23 nt, Homo sapiens
cucacaaugucccuucagcaccu

SEQ ID NO: 803960 - RNA, 20 nt, Homo sapiens
cucacacaaauuaaaauaca

SEQ ID NO: 803961 - RNA, 13 nt, Homo sapiens
cucacaccuguaa

SEQ ID NO: 803962 - RNA, 16 nt, Homo sapiens
cucacacuaaucugaa

SEQ ID NO: 803963 - RNA, 14 nt, Homo sapiens
cucacagagugcau

SEQ ID NO: 803964 - RNA, 21 nt, Homo sapiens
cucacagagugcauugugagg

SEQ ID NO: 803965 - RNA, 16 nt, Homo sapiens
cucacauauaacaugc

SEQ ID NO: 803966 - RNA, 20 nt, Homo sapiens
cucaccaauacacggacaca

SEQ ID NO: 803967 - RNA, 22 nt, Homo sapiens
cucaccaccacacuacacagca

SEQ ID NO: 803968 - RNA, 15 nt, Homo sapiens
cucaccagccccacu

SEQ ID NO: 803969 - RNA, 17 nt, Homo sapiens
cucacccagucuucuac

SEQ ID NO: 803970 - RNA, 19 nt, Homo sapiens
cucaccuagccugaugaga

SEQ ID NO: 803971 - RNA, 14 nt, Homo sapiens
cucaccuccaccuu

SEQ ID NO: 803972 - RNA, 15 nt, Homo sapiens
cucaccugcugggga

SEQ ID NO: 803973 - RNA, 22 nt, Homo sapiens
cucaccugcuggggaccucacc

SEQ ID NO: 803974 - RNA, 16 nt, Homo sapiens
cucaccugggaaauca

SEQ ID NO: 803975 - RNA, 15 nt, Homo sapiens
cucaccuugucucau

SEQ ID NO: 803976 - RNA, 14 nt, Homo sapiens
cucacgcagacaca

SEQ ID NO: 803977 - RNA, 13 nt, Homo sapiens
cucacgccuguaa

SEQ ID NO: 803978 - RNA, 14 nt, Homo sapiens
cucacgccuguaau

SEQ ID NO: 803979 - RNA, 13 nt, Homo sapiens
cucacuacugaac

SEQ ID NO: 803980 - RNA, 15 nt, Homo sapiens
cucacucuguuuccu

SEQ ID NO: 803981 - RNA, 19 nt, Homo sapiens
cucacuguguuacugcuuu

SEQ ID NO: 803982 - RNA, 19 nt, Homo sapiens
cucacuguucaaucauuga

SEQ ID NO: 803983 - RNA, 14 nt, Homo sapiens
cucacuuaucccaa

SEQ ID NO: 803984 - RNA, 21 nt, Homo sapiens
cucacuuuuuccaaaugaucc

SEQ ID NO: 803985 - RNA, 15 nt, Homo sapiens
cucagaaaagcccug

SEQ ID NO: 803986 - RNA, 12 nt, Homo sapiens
cucagaaccaaa

SEQ ID NO: 803987 - RNA, 14 nt, Homo sapiens
cucagaagcacaga

SEQ ID NO: 803988 - RNA, 15 nt, Homo sapiens
cucagaauauaccca

SEQ ID NO: 803989 - RNA, 15 nt, Homo sapiens
cucagaauccaaaga

SEQ ID NO: 803990 - RNA, 21 nt, Homo sapiens
cucagaaugggaggacuccag

SEQ ID NO: 803991 - RNA, 21 nt, Homo sapiens
cucagaauucggugugcugcc

SEQ ID NO: 803992 - RNA, 13 nt, Homo sapiens
cucagagcacaga

SEQ ID NO: 803993 - RNA, 19 nt, Homo sapiens
cucagagcuccucacuuag

SEQ ID NO: 803994 - RNA, 20 nt, Homo sapiens
cucagaggacuggacgugcu

SEQ ID NO: 803995 - RNA, 17 nt, Homo sapiens
cucagagugacagucau

SEQ ID NO: 803996 - RNA, 23 nt, Homo sapiens
cucagaguguuuaauuguacuca

SEQ ID NO: 803997 - RNA, 15 nt, Homo sapiens
cucagaucauuauca

SEQ ID NO: 803998 - RNA, 13 nt, Homo sapiens
cucagauguugaa

SEQ ID NO: 803999 - RNA, 13 nt, Homo sapiens
cucagcaacagug

SEQ ID NO: 804000 - RNA, 18 nt, Homo sapiens
cucagcaguugacaucca

SEQ ID NO: 804001 - RNA, 20 nt, Homo sapiens
cucagccacacccaggcacu

SEQ ID NO: 804002 - RNA, 15 nt, Homo sapiens
cucagccccacugac

SEQ ID NO: 804003 - RNA, 18 nt, Homo sapiens
cucagccucccaaagugc

SEQ ID NO: 804004 - RNA, 16 nt, Homo sapiens
cucagccuccugagua

SEQ ID NO: 804005 - RNA, 17 nt, Homo sapiens
cucagccuccugaguag

SEQ ID NO: 804006 - RNA, 20 nt, Homo sapiens
cucagccucucaaguagcug

SEQ ID NO: 804007 - RNA, 14 nt, Homo sapiens
cucagccugaucag

SEQ ID NO: 804008 - RNA, 16 nt, Homo sapiens
cucagcucacugcaac

SEQ ID NO: 804009 - RNA, 15 nt, Homo sapiens
cucagcucucuggga

SEQ ID NO: 804010 - RNA, 16 nt, Homo sapiens
cucagcugcacauucc

SEQ ID NO: 804011 - RNA, 20 nt, Homo sapiens
cucagcugccaagcacucga

SEQ ID NO: 804012 - RNA, 19 nt, Homo sapiens
cucagcuguccugcagcaa

SEQ ID NO: 804013 - RNA, 14 nt, Homo sapiens
cucagcuucucaaa

SEQ ID NO: 804014 - RNA, 15 nt, Homo sapiens
cucagcuucuucaca

SEQ ID NO: 804015 - RNA, 15 nt, Homo sapiens
cucagcuuuccuuaa

SEQ ID NO: 804016 - RNA, 13 nt, Homo sapiens
cucaggacagaug

SEQ ID NO: 804017 - RNA, 16 nt, Homo sapiens
cucaggaccuagggau

SEQ ID NO: 804018 - RNA, 15 nt, Homo sapiens
cucaggagaagggau

SEQ ID NO: 804019 - RNA, 16 nt, Homo sapiens
cucaggagaagggaua

SEQ ID NO: 804020 - RNA, 21 nt, Homo sapiens
cucaggaggcugagacaggag

SEQ ID NO: 804021 - RNA, 22 nt, Homo sapiens
cucaggauauuaguuaaugagc

SEQ ID NO: 804022 - RNA, 22 nt, Homo sapiens
cucaggauccagucccuuacac

SEQ ID NO: 804023 - RNA, 14 nt, Homo sapiens
cucaggcacacagc

SEQ ID NO: 804024 - RNA, 19 nt, Homo sapiens
cucaggcacacagcuacuc

SEQ ID NO: 804025 - RNA, 21 nt, Homo sapiens
cucaggccugaggugugugcc

SEQ ID NO: 804026 - RNA, 23 nt, Homo sapiens
cucagggcagccucccccggcuc

SEQ ID NO: 804027 - RNA, 20 nt, Homo sapiens
cucaggggccaacuaggcag

SEQ ID NO: 804028 - RNA, 17 nt, Homo sapiens
cucaggggucuuaccuu

SEQ ID NO: 804029 - RNA, 22 nt, Homo sapiens
cucaggggucuuaccuugaacu

SEQ ID NO: 804030 - RNA, 19 nt, Homo sapiens
cucagggguuaagagcuca

SEQ ID NO: 804031 - RNA, 18 nt, Homo sapiens
cucagggucaaagacaga

SEQ ID NO: 804032 - RNA, 20 nt, Homo sapiens
cucaggguccagacccugaa

SEQ ID NO: 804033 - RNA, 14 nt, Homo sapiens
cucagggugggggg

SEQ ID NO: 804034 - RNA, 22 nt, Homo sapiens
cucagguagaagguugacacag

SEQ ID NO: 804035 - RNA, 22 nt, Homo sapiens
cucaggucccaggcuccuaugc

SEQ ID NO: 804036 - RNA, 14 nt, Homo sapiens
cucaggugcugucc

SEQ ID NO: 804037 - RNA, 16 nt, Homo sapiens
cucagguguugccaaa

SEQ ID NO: 804038 - RNA, 17 nt, Homo sapiens
cucaguagagaucuaua

SEQ ID NO: 804039 - RNA, 19 nt, Homo sapiens
cucagucauuuuuaaccuc

SEQ ID NO: 804040 - RNA, 17 nt, Homo sapiens
cucagucccaucagaga

SEQ ID NO: 804041 - RNA, 14 nt, Homo sapiens
cucagucucaggag

SEQ ID NO: 804042 - RNA, 16 nt, Homo sapiens
cucagugaagguggug

SEQ ID NO: 804043 - RNA, 12 nt, Homo sapiens
cucagugagaua

SEQ ID NO: 804044 - RNA, 10 nt, Homo sapiens
cucagugcag

SEQ ID NO: 804045 - RNA, 12 nt, Homo sapiens
cucagugccacu

SEQ ID NO: 804046 - RNA, 19 nt, Homo sapiens
cucaguguaccacuacuua

SEQ ID NO: 804047 - RNA, 21 nt, Homo sapiens
cucaguguaccacuacuuaga

SEQ ID NO: 804048 - RNA, 15 nt, Homo sapiens
cucagugucauuuau

SEQ ID NO: 804049 - RNA, 22 nt, Homo sapiens
cucaguguuucauauucaugca

SEQ ID NO: 804050 - RNA, 21 nt, Homo sapiens
cucaguguuuuggacuccauc

SEQ ID NO: 804051 - RNA, 17 nt, Homo sapiens
cucaguucgaccaaacu

SEQ ID NO: 804052 - RNA, 21 nt, Homo sapiens
cucaguuggaaucauugcuaa

SEQ ID NO: 804053 - RNA, 17 nt, Homo sapiens
cucaguuucacuuucac

SEQ ID NO: 804054 - RNA, 23 nt, Homo sapiens
cucaguuucauuaacuggugaau

SEQ ID NO: 804055 - RNA, 14 nt, Homo sapiens
cucaguuugcauau

SEQ ID NO: 804056 - RNA, 20 nt, Homo sapiens
cucaguuuuuaucaggcuuu

SEQ ID NO: 804057 - RNA, 16 nt, Homo sapiens
cucauaaacugccaag

SEQ ID NO: 804058 - RNA, 21 nt, Homo sapiens
cucauaauagucguaagugga

SEQ ID NO: 804059 - RNA, 14 nt, Homo sapiens
cucauacccaugca

SEQ ID NO: 804060 - RNA, 17 nt, Homo sapiens
cucauaguaauaagaug

SEQ ID NO: 804061 - RNA, 13 nt, Homo sapiens
cucauauugugau

SEQ ID NO: 804062 - RNA, 13 nt, Homo sapiens
cucaucaaucaaa

SEQ ID NO: 804063 - RNA, 12 nt, Homo sapiens
cucaucaaugug

SEQ ID NO: 804064 - RNA, 13 nt, Homo sapiens
cucaucacuagga

SEQ ID NO: 804065 - RNA, 17 nt, Homo sapiens
cuacuuuaacaccaggu

SEQ ID NO: 804066 - RNA, 13 nt, Homo sapiens
cuacuuugcagau

SEQ ID NO: 804067 - RNA, 14 nt, Homo sapiens
cuacuuugcagaug

SEQ ID NO: 804068 - RNA, 18 nt, Homo sapiens
cuacuuuuggugcuuaaa

SEQ ID NO: 804069 - RNA, 15 nt, Homo sapiens
cuacuuuuugcaccu

SEQ ID NO: 804070 - RNA, 18 nt, Homo sapiens
cuagaaaaggcagcuaaa

SEQ ID NO: 804071 - RNA, 19 nt, Homo sapiens
cuagaaacaaacaucuaau

SEQ ID NO: 804072 - RNA, 18 nt, Homo sapiens
cuagaaagagaaacaguu

SEQ ID NO: 804073 - RNA, 12 nt, Homo sapiens
cuagaaauaucu

SEQ ID NO: 804074 - RNA, 17 nt, Homo sapiens
cuagaaccucucguagu

SEQ ID NO: 804075 - RNA, 14 nt, Homo sapiens
cuagaacucuccau

SEQ ID NO: 804076 - RNA, 15 nt, Homo sapiens
cuagaagccaaggga

SEQ ID NO: 804077 - RNA, 16 nt, Homo sapiens
cuagaaucuucuuaca

SEQ ID NO: 804078 - RNA, 22 nt, Homo sapiens
cuagaauguggauuugauucau

SEQ ID NO: 804079 - RNA, 16 nt, Homo sapiens
cuagaauuuuauauca

SEQ ID NO: 804080 - RNA, 13 nt, Homo sapiens
cuagacagcuuuu

SEQ ID NO: 804081 - RNA, 18 nt, Homo sapiens
cuagacauggagguucua

SEQ ID NO: 804082 - RNA, 22 nt, Homo sapiens
cuagacccagguggagggcaca

SEQ ID NO: 804083 - RNA, 17 nt, Homo sapiens
cuagaccucaguuauuu

SEQ ID NO: 804084 - RNA, 17 nt, Homo sapiens
cuagacuguuacuuugg

SEQ ID NO: 804085 - RNA, 19 nt, Homo sapiens
cuagagacagugaugccug

SEQ ID NO: 804086 - RNA, 23 nt, Homo sapiens
cuagagacgcugauccauaaaga

SEQ ID NO: 804087 - RNA, 19 nt, Homo sapiens
cuagagauaaaacagaauc

SEQ ID NO: 804088 - RNA, 14 nt, Homo sapiens
cuagagaugacuga

SEQ ID NO: 804089 - RNA, 18 nt, Homo sapiens
cuagagcacacuguagca

SEQ ID NO: 804090 - RNA, 18 nt, Homo sapiens
cuagagccgugaugccuc

SEQ ID NO: 804091 - RNA, 16 nt, Homo sapiens
cuagaggcaagccugg

SEQ ID NO: 804092 - RNA, 17 nt, Homo sapiens
cuagaguaggugcagaa

SEQ ID NO: 804093 - RNA, 14 nt, Homo sapiens
cuagaguguagccu

SEQ ID NO: 804094 - RNA, 12 nt, Homo sapiens
cuagaguuuuau

SEQ ID NO: 804095 - RNA, 14 nt, Homo sapiens
cuagauacagaaua

SEQ ID NO: 804096 - RNA, 14 nt, Homo sapiens
cuagauacucgugu

SEQ ID NO: 804097 - RNA, 14 nt, Homo sapiens
cuagauacuggaaa

SEQ ID NO: 804098 - RNA, 15 nt, Homo sapiens
cuagauccacacaca

SEQ ID NO: 804099 - RNA, 19 nt, Homo sapiens
cuagaugaguaaucugauu

SEQ ID NO: 804100 - RNA, 18 nt, Homo sapiens
cuagauuuucuacuuuau

SEQ ID NO: 804101 - RNA, 20 nt, Homo sapiens
cuagauuuuuaagagaauua

SEQ ID NO: 804102 - RNA, 21 nt, Homo sapiens
cuagcacuuugggagacugaa

SEQ ID NO: 804103 - RNA, 20 nt, Homo sapiens
cuagcacuuugggaggccaa

SEQ ID NO: 804104 - RNA, 18 nt, Homo sapiens
cuagcaggccuaagacau

SEQ ID NO: 804105 - RNA, 14 nt, Homo sapiens
cuagcaucccugag

SEQ ID NO: 804106 - RNA, 12 nt, Homo sapiens
cuagcauuguaa

SEQ ID NO: 804107 - RNA, 23 nt, Homo sapiens
cuagcauuguaaaauuauuucau

SEQ ID NO: 804108 - RNA, 18 nt, Homo sapiens
cuagcccucucacauuua

SEQ ID NO: 804109 - RNA, 14 nt, Homo sapiens
cuagccgaccucag

SEQ ID NO: 804110 - RNA, 13 nt, Homo sapiens
cuagccugugcac

SEQ ID NO: 804111 - RNA, 17 nt, Homo sapiens
cuagccuugcacuuuca

SEQ ID NO: 804112 - RNA, 17 nt, Homo sapiens
cuagcuagaaauaugau

SEQ ID NO: 804113 - RNA, 20 nt, Homo sapiens
cuagcugugucagaaucucc

SEQ ID NO: 804114 - RNA, 23 nt, Homo sapiens
cuagcuuacugaguuaucaggug

SEQ ID NO: 804115 - RNA, 19 nt, Homo sapiens
cuagcuuagugcuaugugu

SEQ ID NO: 804116 - RNA, 21 nt, Homo sapiens
cuaggaaaaucacuugccaaa

SEQ ID NO: 804117 - RNA, 13 nt, Homo sapiens
cuaggaaaucaca

SEQ ID NO: 804118 - RNA, 18 nt, Homo sapiens
cuaggaaauccauucaca

SEQ ID NO: 804119 - RNA, 15 nt, Homo sapiens
cuaggagaccaaggc

SEQ ID NO: 804120 - RNA, 15 nt, Homo sapiens
cuaggaggaaaaaga

SEQ ID NO: 804121 - RNA, 19 nt, Homo sapiens
cuaggaguugaguacagug

SEQ ID NO: 804122 - RNA, 16 nt, Homo sapiens
cuaggaugguucugug

SEQ ID NO: 804123 - RNA, 15 nt, Homo sapiens
cuaggaugugaugau

SEQ ID NO: 804124 - RNA, 15 nt, Homo sapiens
cuaggcaauguacuc

SEQ ID NO: 804125 - RNA, 21 nt, Homo sapiens
cuaggccucuccaguuugcac

SEQ ID NO: 804126 - RNA, 23 nt, Homo sapiens
cuaggcgugguggugcaugccug

SEQ ID NO: 804127 - RNA, 19 nt, Homo sapiens
cuagggauucaggcugcuu

SEQ ID NO: 804128 - RNA, 22 nt, Homo sapiens
cuagggucaggcggggugcugu

SEQ ID NO: 804129 - RNA, 17 nt, Homo sapiens
cuagguaggggcccacu

SEQ ID NO: 804130 - RNA, 13 nt, Homo sapiens
cuagguucaggaa

SEQ ID NO: 804131 - RNA, 16 nt, Homo sapiens
cuaguaagaugcacug

SEQ ID NO: 804132 - RNA, 17 nt, Homo sapiens
cuaguaagaugcacuga

SEQ ID NO: 804133 - RNA, 19 nt, Homo sapiens
cuaguaagaugcacugaaa

SEQ ID NO: 804134 - RNA, 20 nt, Homo sapiens
cuaguaagaugcacugaaaa

SEQ ID NO: 804135 - RNA, 18 nt, Homo sapiens
cuagucacgcaugcagug

SEQ ID NO: 804136 - RNA, 21 nt, Homo sapiens
cuagucacuaccuucaugcau

SEQ ID NO: 804137 - RNA, 15 nt, Homo sapiens
cuagucugcuagcca

SEQ ID NO: 804138 - RNA, 19 nt, Homo sapiens
cuagucugcuagccaggau

SEQ ID NO: 804139 - RNA, 16 nt, Homo sapiens
cuagucuugaucuguu

SEQ ID NO: 804140 - RNA, 19 nt, Homo sapiens
cuagugagucagcaccuug

SEQ ID NO: 804141 - RNA, 22 nt, Homo sapiens
cuagugcugacgauguucugua

SEQ ID NO: 804142 - RNA, 23 nt, Homo sapiens
cuagugcuuccacuucuaugcaa

SEQ ID NO: 804143 - RNA, 21 nt, Homo sapiens
cuagugguaaaacauccaaga

SEQ ID NO: 804144 - RNA, 17 nt, Homo sapiens
cuaguuaggagcccacc

SEQ ID NO: 804145 - RNA, 20 nt, Homo sapiens
cuaguucagacacuuuggaa

SEQ ID NO: 804146 - RNA, 13 nt, Homo sapiens
cuaguucuaccuc

SEQ ID NO: 804147 - RNA, 21 nt, Homo sapiens
cuaguucuccccgauggggca

SEQ ID NO: 804148 - RNA, 20 nt, Homo sapiens
cuaguuugaccucacaguga

SEQ ID NO: 804149 - RNA, 14 nt, Homo sapiens
cuaguuuucaauca

SEQ ID NO: 804150 - RNA, 19 nt, Homo sapiens
cuauaaaacucugcaugua

SEQ ID NO: 804151 - RNA, 20 nt, Homo sapiens
cuauaaagguugacaauaaa

SEQ ID NO: 804152 - RNA, 23 nt, Homo sapiens
cuauaacaugucuuucagcauua

SEQ ID NO: 804153 - RNA, 12 nt, Homo sapiens
cuauaagccaga

SEQ ID NO: 804154 - RNA, 21 nt, Homo sapiens
cuauaauuuaccuaagauuac

SEQ ID NO: 804155 - RNA, 18 nt, Homo sapiens
cuauacaaaaugauuuug

SEQ ID NO: 804156 - RNA, 23 nt, Homo sapiens
cuauacaaacuacagaguuuaug

SEQ ID NO: 804157 - RNA, 15 nt, Homo sapiens
cuauacacacacaca

SEQ ID NO: 804158 - RNA, 18 nt, Homo sapiens
cuauaccaauaaagugac

SEQ ID NO: 804159 - RNA, 19 nt, Homo sapiens
cuauaccaauaaagugacc

SEQ ID NO: 804160 - RNA, 20 nt, Homo sapiens
cuauaccgcuucgacuggaa

SEQ ID NO: 804161 - RNA, 19 nt, Homo sapiens
cuauacuugguuugcuacc

SEQ ID NO: 804162 - RNA, 18 nt, Homo sapiens
cuauagacuguaagcucc

SEQ ID NO: 804163 - RNA, 22 nt, Homo sapiens
cuauagcaacucauugguggua

SEQ ID NO: 804164 - RNA, 17 nt, Homo sapiens
cuauaggaacauaugaa

SEQ ID NO: 804165 - RNA, 12 nt, Homo sapiens
cuauagucccag

SEQ ID NO: 804166 - RNA, 13 nt, Homo sapiens
cuauaguucuaga

SEQ ID NO: 804167 - RNA, 23 nt, Homo sapiens
cuauaguuugucaucccugauga

SEQ ID NO: 804168 - RNA, 14 nt, Homo sapiens
cuauauaagacaag

SEQ ID NO: 804169 - RNA, 18 nt, Homo sapiens
cuauauacuauaugauuc

SEQ ID NO: 804170 - RNA, 22 nt, Homo sapiens
cuauaucaaaaaaccuuuacag

SEQ ID NO: 804171 - RNA, 23 nt, Homo sapiens
agaacagaaaacaagaagucaua

SEQ ID NO: 804172 - RNA, 14 nt, Homo sapiens
agaacagagugcaa

SEQ ID NO: 804173 - RNA, 20 nt, Homo sapiens
agaacagagugcaacccagu

SEQ ID NO: 804174 - RNA, 12 nt, Homo sapiens
agaacagcauuu

SEQ ID NO: 804175 - RNA, 11 nt, Homo sapiens
agaacagggaa

SEQ ID NO: 804176 - RNA, 17 nt, Homo sapiens
agaacagguucuuaaaa

SEQ ID NO: 804177 - RNA, 19 nt, Homo sapiens
agaacaguaacugccauca

SEQ ID NO: 804178 - RNA, 19 nt, Homo sapiens
agaacauauguugcaagac

SEQ ID NO: 804179 - RNA, 20 nt, Homo sapiens
agaacaucauaacccaugaa

SEQ ID NO: 804180 - RNA, 18 nt, Homo sapiens
agaacaucauuacuuaug

SEQ ID NO: 804181 - RNA, 16 nt, Homo sapiens
agaaccacacuugaaa

SEQ ID NO: 804182 - RNA, 20 nt, Homo sapiens
agaaccagagaggcucugag

SEQ ID NO: 804183 - RNA, 16 nt, Homo sapiens
agaaccagggcucuuc

SEQ ID NO: 804184 - RNA, 23 nt, Homo sapiens
agaaccauccauaguaguaugau

SEQ ID NO: 804185 - RNA, 16 nt, Homo sapiens
agaacccgggcugugu

SEQ ID NO: 804186 - RNA, 13 nt, Homo sapiens
agaacccuuccug

SEQ ID NO: 804187 - RNA, 14 nt, Homo sapiens
agaaccgagcaaag

SEQ ID NO: 804188 - RNA, 15 nt, Homo sapiens
agaaccucagaucag

SEQ ID NO: 804189 - RNA, 17 nt, Homo sapiens
agaaccuuaaagaacca

SEQ ID NO: 804190 - RNA, 13 nt, Homo sapiens
agaaccuugccug

SEQ ID NO: 804191 - RNA, 18 nt, Homo sapiens
agaacggggcucuucuca

SEQ ID NO: 804192 - RNA, 13 nt, Homo sapiens
agaacuacauauu

SEQ ID NO: 804193 - RNA, 13 nt, Homo sapiens
agaacuacuucuu

SEQ ID NO: 804194 - RNA, 17 nt, Homo sapiens
agaacucaacuguauaa

SEQ ID NO: 804195 - RNA, 15 nt, Homo sapiens
agaacucacuggggc

SEQ ID NO: 804196 - RNA, 21 nt, Homo sapiens
agaacucuagagagccuuaac

SEQ ID NO: 804197 - RNA, 12 nt, Homo sapiens
agaacucuccau

SEQ ID NO: 804198 - RNA, 15 nt, Homo sapiens
agaacugaaggcaua

SEQ ID NO: 804199 - RNA, 18 nt, Homo sapiens
agaacugcacgguacaaa

SEQ ID NO: 804200 - RNA, 23 nt, Homo sapiens
agaacuggaaagacauagccaac

SEQ ID NO: 804201 - RNA, 22 nt, Homo sapiens
agaacuggaggaguuccuugau

SEQ ID NO: 804202 - RNA, 15 nt, Homo sapiens
agaacuguacauugu

SEQ ID NO: 804203 - RNA, 13 nt, Homo sapiens
agaacuguucauu

SEQ ID NO: 804204 - RNA, 22 nt, Homo sapiens
agaacuuaagucucgaauguaa

SEQ ID NO: 804205 - RNA, 23 nt, Homo sapiens
agaacuucacagugacacuggac

SEQ ID NO: 804206 - RNA, 14 nt, Homo sapiens
agaacuugaaugug

SEQ ID NO: 804207 - RNA, 19 nt, Homo sapiens
agaacuuuaaagcucagga

SEQ ID NO: 804208 - RNA, 24 nt, Homo sapiens
agaagaaacgucuauguguacaga

SEQ ID NO: 804209 - RNA, 14 nt, Homo sapiens
agaagaagaaggag

SEQ ID NO: 804210 - RNA, 15 nt, Homo sapiens
agaagaagcuacugc

SEQ ID NO: 804211 - RNA, 18 nt, Homo sapiens
agaagaauuggccaucuu

SEQ ID NO: 804212 - RNA, 23 nt, Homo sapiens
agaagacugucagcuuccaaaca

SEQ ID NO: 804213 - RNA, 15 nt, Homo sapiens
agaagagaagcugcu

SEQ ID NO: 804214 - RNA, 15 nt, Homo sapiens
agaagagaaggggag

SEQ ID NO: 804215 - RNA, 14 nt, Homo sapiens
agaagagcuguuca

SEQ ID NO: 804216 - RNA, 19 nt, Homo sapiens
agaagagggucugcauuuu

SEQ ID NO: 804217 - RNA, 22 nt, Homo sapiens
agaagauaugugaagaaaaaug

SEQ ID NO: 804218 - RNA, 18 nt, Homo sapiens
agaagauuuuaugcugcu

SEQ ID NO: 804219 - RNA, 14 nt, Homo sapiens
agaagcagaccuca

SEQ ID NO: 804220 - RNA, 21 nt, Homo sapiens
agaagcaguggccuuauugca

SEQ ID NO: 804221 - RNA, 21 nt, Homo sapiens
agaagcaguuguaccaaguga

SEQ ID NO: 804222 - RNA, 13 nt, Homo sapiens
agaagcaugucuc

SEQ ID NO: 804223 - RNA, 19 nt, Homo sapiens
agaagccaaacagcaagaa

SEQ ID NO: 804224 - RNA, 16 nt, Homo sapiens
agaagccaacuaugau

SEQ ID NO: 804225 - RNA, 13 nt, Homo sapiens
agaagccagcuuu

SEQ ID NO: 804226 - RNA, 15 nt, Homo sapiens
agaagcccauaucac

SEQ ID NO: 804227 - RNA, 12 nt, Homo sapiens
agaagcccugau

SEQ ID NO: 804228 - RNA, 22 nt, Homo sapiens
agaagcccugauguguccucag

SEQ ID NO: 804229 - RNA, 18 nt, Homo sapiens
agaagccuauguccguuc

SEQ ID NO: 804230 - RNA, 23 nt, Homo sapiens
agaagcguuaugugcaguacuua

SEQ ID NO: 804231 - RNA, 23 nt, Homo sapiens
agaagcuaaauccuuuacuguua

SEQ ID NO: 804232 - RNA, 18 nt, Homo sapiens
agaagcuggaaaguguga

SEQ ID NO: 804233 - RNA, 22 nt, Homo sapiens
agaagcuugcugguagcacuug

SEQ ID NO: 804234 - RNA, 14 nt, Homo sapiens
agaaggaagggcag

SEQ ID NO: 804235 - RNA, 14 nt, Homo sapiens
agaaggaauaagca

SEQ ID NO: 804236 - RNA, 22 nt, Homo sapiens
agaaggacacuagccugugcac

SEQ ID NO: 804237 - RNA, 14 nt, Homo sapiens
agaaggaucuucau

SEQ ID NO: 804238 - RNA, 20 nt, Homo sapiens
agaaggauguacauuuccaa

SEQ ID NO: 804239 - RNA, 22 nt, Homo sapiens
agaaggcagcaggcggccuuug

SEQ ID NO: 804240 - RNA, 14 nt, Homo sapiens
agaaggcagugucc

SEQ ID NO: 804241 - RNA, 20 nt, Homo sapiens
agaaggcuucuuagcgcagu

SEQ ID NO: 804242 - RNA, 20 nt, Homo sapiens
agaagggauaucuacugugg

SEQ ID NO: 804243 - RNA, 22 nt, Homo sapiens
agaagggauaucuacugugguc

SEQ ID NO: 804244 - RNA, 22 nt, Homo sapiens
agaagggaucccuaacuguucc

SEQ ID NO: 804245 - RNA, 10 nt, Homo sapiens
agaagggaug

SEQ ID NO: 804246 - RNA, 15 nt, Homo sapiens
agaagggccagauuu

SEQ ID NO: 804247 - RNA, 14 nt, Homo sapiens
agaagggcuaucau

SEQ ID NO: 804248 - RNA, 18 nt, Homo sapiens
agaaggggaggacacugg

SEQ ID NO: 804249 - RNA, 13 nt, Homo sapiens
agaagguauuaag

SEQ ID NO: 804250 - RNA, 20 nt, Homo sapiens
agaaggucauaagggagcau

SEQ ID NO: 804251 - RNA, 21 nt, Homo sapiens
agaaggugccacuuuacccac

SEQ ID NO: 804252 - RNA, 22 nt, Homo sapiens
agaaggugccacuuuacccacc

SEQ ID NO: 804253 - RNA, 13 nt, Homo sapiens
agaaggugccgug

SEQ ID NO: 804254 - RNA, 21 nt, Homo sapiens
agaagguuggugaauuucaca

SEQ ID NO: 804255 - RNA, 21 nt, Homo sapiens
agaaguacaaagguugcagug

SEQ ID NO: 804256 - RNA, 17 nt, Homo sapiens
agaaguacugccaauac

SEQ ID NO: 804257 - RNA, 15 nt, Homo sapiens
agaagucaacgccuc

SEQ ID NO: 804258 - RNA, 16 nt, Homo sapiens
agaagucacugaacaa

SEQ ID NO: 804259 - RNA, 19 nt, Homo sapiens
agaaguccccucuacuuua

SEQ ID NO: 804260 - RNA, 18 nt, Homo sapiens
agaaguuaauccacaucu

SEQ ID NO: 804261 - RNA, 13 nt, Homo sapiens
agaaguuccucaa

SEQ ID NO: 804262 - RNA, 22 nt, Homo sapiens
agaaguugaaacucacuaguaa

SEQ ID NO: 804263 - RNA, 21 nt, Homo sapiens
agaaguuuggcugcugucaua

SEQ ID NO: 804264 - RNA, 18 nt, Homo sapiens
agaaguuuguagccaggu

SEQ ID NO: 804265 - RNA, 19 nt, Homo sapiens
agaauaaaaacuuccuuca

SEQ ID NO: 804266 - RNA, 15 nt, Homo sapiens
agaauaaagauuuau

SEQ ID NO: 804267 - RNA, 17 nt, Homo sapiens
agaauaaaggcaguuuu

SEQ ID NO: 804268 - RNA, 18 nt, Homo sapiens
agaauaaggaacaacguu

SEQ ID NO: 804269 - RNA, 23 nt, Homo sapiens
agaauaaggcuuuuucuucccuu

SEQ ID NO: 804270 - RNA, 12 nt, Homo sapiens
agaauaaugugu

SEQ ID NO: 804271 - RNA, 17 nt, Homo sapiens
agaauacuggucucagg

SEQ ID NO: 804272 - RNA, 22 nt, Homo sapiens
agaauagaaacguaaacuauga

SEQ ID NO: 804273 - RNA, 14 nt, Homo sapiens
agaauagcacaaac

SEQ ID NO: 804274 - RNA, 13 nt, Homo sapiens
agaauagucucac

SEQ ID NO: 804275 - RNA, 19 nt, Homo sapiens
agaauauguuucaaacuuu

SEQ ID NO: 804276 - RNA, 12 nt, Homo sapiens
agaauauuuacu

SEQ ID NO: 804277 - RNA, 13 nt, Homo sapiens
agaaucaagauac

SEQ ID NO: 804278 - RNA, 16 nt, Homo sapiens
agaaucacaguacuuu

SEQ ID NO: 804279 - RNA, 16 nt, Homo sapiens
agcuuauagucuucca

SEQ ID NO: 804280 - RNA, 13 nt, Homo sapiens
agcuucaacuuuu

SEQ ID NO: 804281 - RNA, 15 nt, Homo sapiens
agcuucacauuugcg

SEQ ID NO: 804282 - RNA, 23 nt, Homo sapiens
agcuucacauuugcguguaucua

SEQ ID NO: 804283 - RNA, 20 nt, Homo sapiens
agcuucaccagagcauuucc

SEQ ID NO: 804284 - RNA, 18 nt, Homo sapiens
agcuucagaaaggggcau

SEQ ID NO: 804285 - RNA, 22 nt, Homo sapiens
agcuucagcucaacucacagcu

SEQ ID NO: 804286 - RNA, 12 nt, Homo sapiens
agcuuccaugag

SEQ ID NO: 804287 - RNA, 17 nt, Homo sapiens
agcuuccuucugugaaa

SEQ ID NO: 804288 - RNA, 13 nt, Homo sapiens
agcuucuaacuca

SEQ ID NO: 804289 - RNA, 14 nt, Homo sapiens
agcuucuaacucau

SEQ ID NO: 804290 - RNA, 15 nt, Homo sapiens
agcuucuaccuggaa

SEQ ID NO: 804291 - RNA, 19 nt, Homo sapiens
agcuucugcuuuucugccc

SEQ ID NO: 804292 - RNA, 16 nt, Homo sapiens
agcuucuucacaggca

SEQ ID NO: 804293 - RNA, 12 nt, Homo sapiens
acuuagugacaa

SEQ ID NO: 804294 - RNA, 22 nt, Homo sapiens
acuuaguuugugauguaaggca

SEQ ID NO: 804295 - RNA, 21 nt, Homo sapiens
acuuauaagaaagaucaaaga

SEQ ID NO: 804296 - RNA, 14 nt, Homo sapiens
acuuaucaacauuu

SEQ ID NO: 804297 - RNA, 19 nt, Homo sapiens
acuuaucacgccuacuuaa

SEQ ID NO: 804298 - RNA, 22 nt, Homo sapiens
acuuaucccaagagaaugaaau

SEQ ID NO: 804299 - RNA, 15 nt, Homo sapiens
acuuaugaugaugaa

SEQ ID NO: 804300 - RNA, 15 nt, Homo sapiens
acuuauuaacuaaga

SEQ ID NO: 804301 - RNA, 17 nt, Homo sapiens
acuuauuggaacucugc

SEQ ID NO: 804302 - RNA, 23 nt, Homo sapiens
acuucaaguauaacaacuuugaa

SEQ ID NO: 804303 - RNA, 13 nt, Homo sapiens
acuucaagugacc

SEQ ID NO: 804304 - RNA, 20 nt, Homo sapiens
acuucaaguuaaagugaaua

SEQ ID NO: 804305 - RNA, 19 nt, Homo sapiens
acuucacccacgcauauac

SEQ ID NO: 804306 - RNA, 18 nt, Homo sapiens
acuucaccuaacuagaga

SEQ ID NO: 804307 - RNA, 14 nt, Homo sapiens
acuucaccuacauu

SEQ ID NO: 804308 - RNA, 20 nt, Homo sapiens
acuucacuaaugaucacauu

SEQ ID NO: 804309 - RNA, 20 nt, Homo sapiens
acuucagagacuaucugauu

SEQ ID NO: 804310 - RNA, 11 nt, Homo sapiens
acuucagucuu

SEQ ID NO: 804311 - RNA, 15 nt, Homo sapiens
acuucagucuugccu

SEQ ID NO: 804312 - RNA, 14 nt, Homo sapiens
acuucauaauccag

SEQ ID NO: 804313 - RNA, 17 nt, Homo sapiens
acuucauucucucucau

SEQ ID NO: 804314 - RNA, 18 nt, Homo sapiens
acuucauuugaugcuaaa

SEQ ID NO: 804315 - RNA, 11 nt, Homo sapiens
acuuccaaagg

SEQ ID NO: 804316 - RNA, 23 nt, Homo sapiens
acuuccaagcuggcuuuucccau

SEQ ID NO: 804317 - RNA, 13 nt, Homo sapiens
acuuccacaagag

SEQ ID NO: 804318 - RNA, 18 nt, Homo sapiens
acuuccacaagagugaau

SEQ ID NO: 804319 - RNA, 13 nt, Homo sapiens
acuuccaccagcc

SEQ ID NO: 804320 - RNA, 18 nt, Homo sapiens
acuuccaccagccugcac

SEQ ID NO: 804321 - RNA, 14 nt, Homo sapiens
acuuccagcauuua

SEQ ID NO: 804322 - RNA, 19 nt, Homo sapiens
acuuccaggggaaccugcc

SEQ ID NO: 804323 - RNA, 21 nt, Homo sapiens
acuuccaucuagucacaaaga

SEQ ID NO: 804324 - RNA, 22 nt, Homo sapiens
acuuccaugagaagaagcagau

SEQ ID NO: 804325 - RNA, 12 nt, Homo sapiens
acuuccauuccc

SEQ ID NO: 804326 - RNA, 16 nt, Homo sapiens
acuucccuacauggag

SEQ ID NO: 804327 - RNA, 14 nt, Homo sapiens
acuucgaaaccugg

SEQ ID NO: 804328 - RNA, 12 nt, Homo sapiens
acuucuaugcaa

SEQ ID NO: 804329 - RNA, 19 nt, Homo sapiens
acuucucugugaacuauua

SEQ ID NO: 804330 - RNA, 20 nt, Homo sapiens
acuucucugugaacuauuaa

SEQ ID NO: 804331 - RNA, 21 nt, Homo sapiens
acuucucugugaacuauuaau

SEQ ID NO: 804332 - RNA, 15 nt, Homo sapiens
acuucugacuacuug

SEQ ID NO: 804333 - RNA, 16 nt, Homo sapiens
acuucugcuggcauca

SEQ ID NO: 804334 - RNA, 17 nt, Homo sapiens
acuucuggaacauucca

SEQ ID NO: 804335 - RNA, 15 nt, Homo sapiens
acuucugucuucaca

SEQ ID NO: 804336 - RNA, 21 nt, Homo sapiens
acuucugucuucacaacagau

SEQ ID NO: 804337 - RNA, 22 nt, Homo sapiens
acuucugucuucacaacagauu

SEQ ID NO: 804338 - RNA, 17 nt, Homo sapiens
acuucuuauacauuuga

SEQ ID NO: 804339 - RNA, 17 nt, Homo sapiens
acuugaaacagauucag

SEQ ID NO: 804340 - RNA, 13 nt, Homo sapiens
acuugaaaccugg

SEQ ID NO: 804341 - RNA, 22 nt, Homo sapiens
acuugaaaccugggcauggugg

SEQ ID NO: 804342 - RNA, 23 nt, Homo sapiens
acuugaaaccugggcaugguggc

SEQ ID NO: 804343 - RNA, 21 nt, Homo sapiens
acuugaaaugcucuuuugcac

SEQ ID NO: 804344 - RNA, 20 nt, Homo sapiens
acuugaaauucucaucaguc

SEQ ID NO: 804345 - RNA, 16 nt, Homo sapiens
acuugaacauuugcag

SEQ ID NO: 804346 - RNA, 16 nt, Homo sapiens
acuugaagcacuuaag

SEQ ID NO: 804347 - RNA, 19 nt, Homo sapiens
acuugacaacaucccacag

SEQ ID NO: 804348 - RNA, 13 nt, Homo sapiens
acuugacauuccu

SEQ ID NO: 804349 - RNA, 12 nt, Homo sapiens
acuugaccaaua

SEQ ID NO: 804350 - RNA, 22 nt, Homo sapiens
acuugacugggugagacccaaa

SEQ ID NO: 804351 - RNA, 14 nt, Homo sapiens
acuugagccaucca

SEQ ID NO: 804352 - RNA, 17 nt, Homo sapiens
acuugagcgugaaucug

SEQ ID NO: 804353 - RNA, 19 nt, Homo sapiens
acuugaggccugaucugcc

SEQ ID NO: 804354 - RNA, 18 nt, Homo sapiens
acuugaguuuuggcaagg

SEQ ID NO: 804355 - RNA, 18 nt, Homo sapiens
acuugaugauacaaugaa

SEQ ID NO: 804356 - RNA, 17 nt, Homo sapiens
acuugauguguuaucuc

SEQ ID NO: 804357 - RNA, 13 nt, Homo sapiens
acuugcacugggg

SEQ ID NO: 804358 - RNA, 17 nt, Homo sapiens
acuugcauacagagaca

SEQ ID NO: 804359 - RNA, 21 nt, Homo sapiens
acuugcauccaacuccaggau

SEQ ID NO: 804360 - RNA, 14 nt, Homo sapiens
acuugcguccugca

SEQ ID NO: 804361 - RNA, 17 nt, Homo sapiens
acuugcuaaagcacuuu

SEQ ID NO: 804362 - RNA, 14 nt, Homo sapiens
acuugcugccugaa

SEQ ID NO: 804363 - RNA, 20 nt, Homo sapiens
acuugcuuagguugucuuga

SEQ ID NO: 804364 - RNA, 23 nt, Homo sapiens
acuuggaagggggagacaggaag

SEQ ID NO: 804365 - RNA, 12 nt, Homo sapiens
acuuggcacuua

SEQ ID NO: 804366 - RNA, 15 nt, Homo sapiens
acuuggcaucauuca

SEQ ID NO: 804367 - RNA, 18 nt, Homo sapiens
acuugggaaacuauucau

SEQ ID NO: 804368 - RNA, 17 nt, Homo sapiens
acuuggucagagccacu

SEQ ID NO: 804369 - RNA, 21 nt, Homo sapiens
acuugucagugggaaacaaac

SEQ ID NO: 804370 - RNA, 18 nt, Homo sapiens
acuuguccuuuuguacca

SEQ ID NO: 804371 - RNA, 19 nt, Homo sapiens
acuugucuucccuucugau

SEQ ID NO: 804372 - RNA, 14 nt, Homo sapiens
acuugugauucaaa

SEQ ID NO: 804373 - RNA, 22 nt, Homo sapiens
acuugugugugggcugugagug

SEQ ID NO: 804374 - RNA, 13 nt, Homo sapiens
acuuguguuacuu

SEQ ID NO: 804375 - RNA, 18 nt, Homo sapiens
acuuguucuguacuugua

SEQ ID NO: 804376 - RNA, 17 nt, Homo sapiens
acuuguuugucuuccau

SEQ ID NO: 804377 - RNA, 15 nt, Homo sapiens
acuuguuuuaugcuc

SEQ ID NO: 804378 - RNA, 15 nt, Homo sapiens
acuuuaaauacuauu

SEQ ID NO: 804379 - RNA, 16 nt, Homo sapiens
acuuuaacugacuuaa

SEQ ID NO: 804380 - RNA, 22 nt, Homo sapiens
acuuuaagaacaaacucugaaa

SEQ ID NO: 804381 - RNA, 16 nt, Homo sapiens
acuuuaagaaguaauu

SEQ ID NO: 804382 - RNA, 14 nt, Homo sapiens
acuuuaagauguuu

SEQ ID NO: 804383 - RNA, 14 nt, Homo sapiens
acuuuaaguauaca

SEQ ID NO: 804384 - RNA, 14 nt, Homo sapiens
acuuuaaugaacua

SEQ ID NO: 804385 - RNA, 15 nt, Homo sapiens
acuuuaaugaacuaa

SEQ ID NO: 804386 - RNA, 12 nt, Homo sapiens
acuuuaccugcu

SEQ ID NO: 804387 - RNA, 13 nt, Homo sapiens
acuuuagaaauaa

SEQ ID NO: 804388 - RNA, 20 nt, Homo sapiens
acuuuagacuucccacuguu

SEQ ID NO: 804389 - RNA, 20 nt, Homo sapiens
acuuuagaguagcaugagag

SEQ ID NO: 804390 - RNA, 14 nt, Homo sapiens
acuuuauaaaucca

SEQ ID NO: 804391 - RNA, 18 nt, Homo sapiens
acuuuaucuaauaccucu

SEQ ID NO: 804392 - RNA, 22 nt, Homo sapiens
acuuuauucggaccaagcagag

SEQ ID NO: 804393 - RNA, 12 nt, Homo sapiens
acuuuauucuug

SEQ ID NO: 804394 - RNA, 17 nt, Homo sapiens
acuuuauuucugaucua

SEQ ID NO: 804395 - RNA, 18 nt, Homo sapiens
acuuucagguacuaaaua

SEQ ID NO: 804396 - RNA, 20 nt, Homo sapiens
acuuucagguacuaaauacc

SEQ ID NO: 804397 - RNA, 14 nt, Homo sapiens
acuuucagugcuuu

SEQ ID NO: 804398 - RNA, 13 nt, Homo sapiens
acuuuccaucucu

SEQ ID NO: 804399 - RNA, 15 nt, Homo sapiens
acuuuccuucccucu

SEQ ID NO: 804400 - RNA, 17 nt, Homo sapiens
acuuucuacaggccagc

SEQ ID NO: 804401 - RNA, 18 nt, Homo sapiens
acuuucuuaucacuuaua

SEQ ID NO: 804402 - RNA, 16 nt, Homo sapiens
acuuucuuuacuccau

SEQ ID NO: 804403 - RNA, 13 nt, Homo sapiens
acuuugaccuaaa

SEQ ID NO: 804404 - RNA, 17 nt, Homo sapiens
cauuauuuugaauguga

SEQ ID NO: 804405 - RNA, 15 nt, Homo sapiens
cauucaacucggaaa

SEQ ID NO: 804406 - RNA, 14 nt, Homo sapiens
cauucaauauugac

SEQ ID NO: 804407 - RNA, 18 nt, Homo sapiens
cauucaauguuuaugcaa

SEQ ID NO: 804408 - RNA, 22 nt, Homo sapiens
cauucaauguuuaugcaaggaa

SEQ ID NO: 804409 - RNA, 17 nt, Homo sapiens
cauucaauuagugguca

SEQ ID NO: 804410 - RNA, 22 nt, Homo sapiens
cauucacagcaagucacuggcc

SEQ ID NO: 804411 - RNA, 13 nt, Homo sapiens
cauucacaguucu

SEQ ID NO: 804412 - RNA, 17 nt, Homo sapiens
cauucacccagacagcu

SEQ ID NO: 804413 - RNA, 17 nt, Homo sapiens
cauucacuugcauuucu

SEQ ID NO: 804414 - RNA, 19 nt, Homo sapiens
cauucaguuaaaaauccag

SEQ ID NO: 804415 - RNA, 14 nt, Homo sapiens
cauucauccuucca

SEQ ID NO: 804416 - RNA, 15 nt, Homo sapiens
cauucauccuuccau

SEQ ID NO: 804417 - RNA, 16 nt, Homo sapiens
cauucaucucauucca

SEQ ID NO: 804418 - RNA, 17 nt, Homo sapiens
cauucaugugggcauuu

SEQ ID NO: 804419 - RNA, 19 nt, Homo sapiens
cauucaugugggcauuucu

SEQ ID NO: 804420 - RNA, 12 nt, Homo sapiens
cauucauuugca

SEQ ID NO: 804421 - RNA, 12 nt, Homo sapiens
cauuccaaauau

SEQ ID NO: 804422 - RNA, 18 nt, Homo sapiens
cauuccagaaucuugacu

SEQ ID NO: 804423 - RNA, 18 nt, Homo sapiens
cauuccagacugcuucca

SEQ ID NO: 804424 - RNA, 13 nt, Homo sapiens
cauucccccaugu

SEQ ID NO: 804425 - RNA, 17 nt, Homo sapiens
cauucccucucaucuca

SEQ ID NO: 804426 - RNA, 15 nt, Homo sapiens
cauuccugaagggaa

SEQ ID NO: 804427 - RNA, 14 nt, Homo sapiens
cauuccuucccacc

SEQ ID NO: 804428 - RNA, 18 nt, Homo sapiens
cauuccuucuuucacagg

SEQ ID NO: 804429 - RNA, 17 nt, Homo sapiens
cauuccuuugucuucaa

SEQ ID NO: 804430 - RNA, 21 nt, Homo sapiens
cauucggggaagcugcacaug

SEQ ID NO: 804431 - RNA, 19 nt, Homo sapiens
cauucgucuuguuguuauu

SEQ ID NO: 804432 - RNA, 14 nt, Homo sapiens
cauucuaaaccaaa

SEQ ID NO: 804433 - RNA, 14 nt, Homo sapiens
cauucuacugaaaa

SEQ ID NO: 804434 - RNA, 21 nt, Homo sapiens
cauucuauuccauguuugcac

SEQ ID NO: 804435 - RNA, 17 nt, Homo sapiens
cauucuauuuuggguau

SEQ ID NO: 804436 - RNA, 19 nt, Homo sapiens
cauucucuuugauaacaaa

SEQ ID NO: 804437 - RNA, 16 nt, Homo sapiens
cauucugaccauuuca

SEQ ID NO: 804438 - RNA, 14 nt, Homo sapiens
cauucugcuacuuc

SEQ ID NO: 804439 - RNA, 17 nt, Homo sapiens
cauucuguuagauacua

SEQ ID NO: 804440 - RNA, 18 nt, Homo sapiens
cauucuuaacaaacucuu

SEQ ID NO: 804441 - RNA, 18 nt, Homo sapiens
cauucuucugagcacugu

SEQ ID NO: 804442 - RNA, 19 nt, Homo sapiens
cauucuucugagcacuguu

SEQ ID NO: 804443 - RNA, 18 nt, Homo sapiens
cauucuuguucagauuaa

SEQ ID NO: 804444 - RNA, 19 nt, Homo sapiens
cauugacgagcaugagcug

SEQ ID NO: 804445 - RNA, 12 nt, Homo sapiens
cauugagcauuu

SEQ ID NO: 804446 - RNA, 14 nt, Homo sapiens
cauugagcauuuga

SEQ ID NO: 804447 - RNA, 22 nt, Homo sapiens
cauugaucuuuugcuaaugcaa

SEQ ID NO: 804448 - RNA, 17 nt, Homo sapiens
cauugauuuaauguaau

SEQ ID NO: 804449 - RNA, 15 nt, Homo sapiens
cauugcacauaagcu

SEQ ID NO: 804450 - RNA, 18 nt, Homo sapiens
cauugcacuccagccugg

SEQ ID NO: 804451 - RNA, 18 nt, Homo sapiens
cauugcacucuagccugg

SEQ ID NO: 804452 - RNA, 14 nt, Homo sapiens
cauugcacuuugau

SEQ ID NO: 804453 - RNA, 10 nt, Homo sapiens
cauugcagag

SEQ ID NO: 804454 - RNA, 15 nt, Homo sapiens
cauugccugcagauu

SEQ ID NO: 804455 - RNA, 18 nt, Homo sapiens
cauugccuggacugacca

SEQ ID NO: 804456 - RNA, 13 nt, Homo sapiens
cauugccuguaac

SEQ ID NO: 804457 - RNA, 18 nt, Homo sapiens
cauugccuucuggagcug

SEQ ID NO: 804458 - RNA, 20 nt, Homo sapiens
cauugcgucggaaagccaag

SEQ ID NO: 804459 - RNA, 17 nt, Homo sapiens
cauugcuaaacugauga

SEQ ID NO: 804460 - RNA, 21 nt, Homo sapiens
cauugcuaaacugaugacuua

SEQ ID NO: 804461 - RNA, 23 nt, Homo sapiens
cauugcucagcccgcuuggccac

SEQ ID NO: 804462 - RNA, 12 nt, Homo sapiens
cauugcugccaa

SEQ ID NO: 804463 - RNA, 20 nt, Homo sapiens
cauugcuguaccacaucugc

SEQ ID NO: 804464 - RNA, 21 nt, Homo sapiens
cauugcugugugaauccagga

SEQ ID NO: 804465 - RNA, 17 nt, Homo sapiens
cauugcuguucuacuuu

SEQ ID NO: 804466 - RNA, 22 nt, Homo sapiens
cauugcuuuugggagacuggaa

SEQ ID NO: 804467 - RNA, 13 nt, Homo sapiens
uacugaauuccau

SEQ ID NO: 804468 - RNA, 22 nt, Homo sapiens
uacugaauuuugagucuauccu

SEQ ID NO: 804469 - RNA, 16 nt, Homo sapiens
uacugauaaaccuaau

SEQ ID NO: 804470 - RNA, 19 nt, Homo sapiens
uacugaugaaaucugcuag

SEQ ID NO: 804471 - RNA, 15 nt, Homo sapiens
uacugaugacagugu

SEQ ID NO: 804472 - RNA, 16 nt, Homo sapiens
uacugauucacugcau

SEQ ID NO: 804473 - RNA, 21 nt, Homo sapiens
uacugcaaagucgccagucac

SEQ ID NO: 804474 - RNA, 13 nt, Homo sapiens
uacugcauuuaca

SEQ ID NO: 804475 - RNA, 17 nt, Homo sapiens
uacugccaucuuuauca

SEQ ID NO: 804476 - RNA, 16 nt, Homo sapiens
uacugcccaggccuau

SEQ ID NO: 804477 - RNA, 17 nt, Homo sapiens
uacugcuaccacaacua

SEQ ID NO: 804478 - RNA, 11 nt, Homo sapiens
uacugcugcug

SEQ ID NO: 804479 - RNA, 14 nt, Homo sapiens
uacugcuguaaaua

SEQ ID NO: 804480 - RNA, 12 nt, Homo sapiens
uacugcugugaa

SEQ ID NO: 804481 - RNA, 17 nt, Homo sapiens
uacugcuugaccaaaga

SEQ ID NO: 804482 - RNA, 18 nt, Homo sapiens
uacugcuugaccaaagag

SEQ ID NO: 804483 - RNA, 16 nt, Homo sapiens
uacuggaaauguagca

SEQ ID NO: 804484 - RNA, 23 nt, Homo sapiens
uacuggaaugguguuuugucaga

SEQ ID NO: 804485 - RNA, 23 nt, Homo sapiens
uacuggcgauuuuacucauuguc

SEQ ID NO: 804486 - RNA, 14 nt, Homo sapiens
uacuggguucuuag

SEQ ID NO: 804487 - RNA, 15 nt, Homo sapiens
uacuggucucaggcc

SEQ ID NO: 804488 - RNA, 18 nt, Homo sapiens
uacuggucuuguggaauu

SEQ ID NO: 804489 - RNA, 22 nt, Homo sapiens
uacuguacccucgcaugacugu

SEQ ID NO: 804490 - RNA, 14 nt, Homo sapiens
uacuguaguaauua

SEQ ID NO: 804491 - RNA, 18 nt, Homo sapiens
uacuguaguaauuacucu

SEQ ID NO: 804492 - RNA, 19 nt, Homo sapiens
uacugucaaacaauaaagg

SEQ ID NO: 804493 - RNA, 21 nt, Homo sapiens
uacugucuuacuauuauagca

SEQ ID NO: 804494 - RNA, 19 nt, Homo sapiens
uacugugaaacuggcacug

SEQ ID NO: 804495 - RNA, 15 nt, Homo sapiens
uacugugaccaugga

SEQ ID NO: 804496 - RNA, 21 nt, Homo sapiens
uacuguguuucgcauuaagca

SEQ ID NO: 804497 - RNA, 19 nt, Homo sapiens
uacuguugcacugaugucc

SEQ ID NO: 804498 - RNA, 12 nt, Homo sapiens
uacuguuuccau

SEQ ID NO: 804499 - RNA, 20 nt, Homo sapiens
uacuguuuucugggccagug

SEQ ID NO: 804500 - RNA, 21 nt, Homo sapiens
uacuguuuucugggccaguga

SEQ ID NO: 804501 - RNA, 15 nt, Homo sapiens
uacuuaaacuuccac

SEQ ID NO: 804502 - RNA, 21 nt, Homo sapiens
uacuuaacaaaguaaacaaaa

SEQ ID NO: 804503 - RNA, 13 nt, Homo sapiens
uacuuaaugcaca

SEQ ID NO: 804504 - RNA, 22 nt, Homo sapiens
uacuuacuucuggcauaacuaa

SEQ ID NO: 804505 - RNA, 13 nt, Homo sapiens
uacuuagcagcua

SEQ ID NO: 804506 - RNA, 17 nt, Homo sapiens
uacuuagcagcuaucuc

SEQ ID NO: 804507 - RNA, 14 nt, Homo sapiens
uacuuaugaugaug

SEQ ID NO: 804508 - RNA, 21 nt, Homo sapiens
uacuuauguugcacaaugaga

SEQ ID NO: 804509 - RNA, 20 nt, Homo sapiens
uacuuauuguauuuaugugu

SEQ ID NO: 804510 - RNA, 22 nt, Homo sapiens
uacuucaacacuucauguauug

SEQ ID NO: 804511 - RNA, 15 nt, Homo sapiens
uacuucaguaauaau

SEQ ID NO: 804512 - RNA, 17 nt, Homo sapiens
uacuucagugcaccuac

SEQ ID NO: 804513 - RNA, 11 nt, Homo sapiens
uacuucauuaa

SEQ ID NO: 804514 - RNA, 17 nt, Homo sapiens
uacuuccagauggcugc

SEQ ID NO: 804515 - RNA, 18 nt, Homo sapiens
uacuuccucauaccacau

SEQ ID NO: 804516 - RNA, 16 nt, Homo sapiens
uacuucgaugaugaug

SEQ ID NO: 804517 - RNA, 14 nt, Homo sapiens
uacuucugagcaaa

SEQ ID NO: 804518 - RNA, 18 nt, Homo sapiens
uacuucuuauacauuuga

SEQ ID NO: 804519 - RNA, 21 nt, Homo sapiens
uacuugauaauauuagugauu

SEQ ID NO: 804520 - RNA, 17 nt, Homo sapiens
uacuugcaagccucaaa

SEQ ID NO: 804521 - RNA, 16 nt, Homo sapiens
uacuuggaacuaggcu

SEQ ID NO: 804522 - RNA, 19 nt, Homo sapiens
uacuugggagaccuguaau

SEQ ID NO: 804523 - RNA, 22 nt, Homo sapiens
uacuugggaggcugagccagga

SEQ ID NO: 804524 - RNA, 20 nt, Homo sapiens
uacuugggaggcugaggcag

SEQ ID NO: 804525 - RNA, 20 nt, Homo sapiens
uacuugugaaacacagcugu

SEQ ID NO: 804526 - RNA, 21 nt, Homo sapiens
uacuugugaaacacagcuguu

SEQ ID NO: 804527 - RNA, 14 nt, Homo sapiens
uacuuuacaaacca

SEQ ID NO: 804528 - RNA, 16 nt, Homo sapiens
uacuuuacaaaccauu

SEQ ID NO: 804529 - RNA, 14 nt, Homo sapiens
uacuuucacacuaa

SEQ ID NO: 804530 - RNA, 16 nt, Homo sapiens
uacuuucccucaucca

SEQ ID NO: 804531 - RNA, 17 nt, Homo sapiens
uacuuucuguugccaca

SEQ ID NO: 804532 - RNA, 12 nt, Homo sapiens
uacuuugugcau

SEQ ID NO: 804533 - RNA, 15 nt, Homo sapiens
uacuuuguuaggauu

SEQ ID NO: 804534 - RNA, 16 nt, Homo sapiens
uacuuuucacacuguc

SEQ ID NO: 804535 - RNA, 19 nt, Homo sapiens
uacuuuuuuauagcuuaac

SEQ ID NO: 804536 - RNA, 22 nt, Homo sapiens
uacuuuuuuguuaauaagcaaa

SEQ ID NO: 804537 - RNA, 14 nt, Homo sapiens
uagaaaaaggaaug

SEQ ID NO: 804538 - RNA, 20 nt, Homo sapiens
uagaaaauaaaacugagcua

SEQ ID NO: 804539 - RNA, 14 nt, Homo sapiens
uagaaaaugaggaa

SEQ ID NO: 804540 - RNA, 14 nt, Homo sapiens
uagaaaauucauaa

SEQ ID NO: 804541 - RNA, 20 nt, Homo sapiens
uagaaacucaggauggucau

SEQ ID NO: 804542 - RNA, 15 nt, Homo sapiens
uagaaagaugagauc

SEQ ID NO: 804543 - RNA, 19 nt, Homo sapiens
uagaaagcauuuugggauc

SEQ ID NO: 804544 - RNA, 14 nt, Homo sapiens
uagaaagggucccu

SEQ ID NO: 804545 - RNA, 12 nt, Homo sapiens
uagaaaguaaaa

SEQ ID NO: 804546 - RNA, 16 nt, Homo sapiens
uagaaauaauaugcau

SEQ ID NO: 804547 - RNA, 13 nt, Homo sapiens
uagaaaugagauc

SEQ ID NO: 804548 - RNA, 13 nt, Homo sapiens
uagaaaugcaaaa

SEQ ID NO: 804549 - RNA, 13 nt, Homo sapiens
uagaaauggauuu

SEQ ID NO: 804550 - RNA, 19 nt, Homo sapiens
uagaaauguauccugauaa

SEQ ID NO: 804551 - RNA, 22 nt, Homo sapiens
uagaacaaaggacagaguauga

SEQ ID NO: 804552 - RNA, 22 nt, Homo sapiens
uagaaccucucguaguccauca

SEQ ID NO: 804553 - RNA, 17 nt, Homo sapiens
uagaaccuggagccacu

SEQ ID NO: 804554 - RNA, 23 nt, Homo sapiens
uagaacucugggcugccauguga

SEQ ID NO: 804555 - RNA, 19 nt, Homo sapiens
uagaagaaccaaauaccuc

SEQ ID NO: 804556 - RNA, 18 nt, Homo sapiens
uagaagaagcuacugcau

SEQ ID NO: 804557 - RNA, 19 nt, Homo sapiens
uagaagauuuuaugcugcu

SEQ ID NO: 804558 - RNA, 14 nt, Homo sapiens
uagaagcacuacac

SEQ ID NO: 804559 - RNA, 17 nt, Homo sapiens
uagaagcagcauaggaa

SEQ ID NO: 804560 - RNA, 11 nt, Homo sapiens
uagaagccaag

SEQ ID NO: 804561 - RNA, 20 nt, Homo sapiens
uagaagccaagggaaagggg

SEQ ID NO: 804562 - RNA, 16 nt, Homo sapiens
uagaagccacagugcc

SEQ ID NO: 804563 - RNA, 21 nt, Homo sapiens
uagaagcuguaacagaauaca

SEQ ID NO: 804564 - RNA, 24 nt, Homo sapiens
uagaagggccagauuucauucuca

SEQ ID NO: 804565 - RNA, 19 nt, Homo sapiens
uagaauaggcagggggccc

SEQ ID NO: 804566 - RNA, 18 nt, Homo sapiens
uagaaugcuuuuguuaaa

SEQ ID NO: 804567 - RNA, 12 nt, Homo sapiens
uagaauucugaa

SEQ ID NO: 804568 - RNA, 13 nt, Homo sapiens
uagaauuuauuca

SEQ ID NO: 804569 - RNA, 17 nt, Homo sapiens
uagaauuuugaguauuc

SEQ ID NO: 804570 - RNA, 15 nt, Homo sapiens
uagacaauuugcaca

SEQ ID NO: 804571 - RNA, 21 nt, Homo sapiens
uagacacaauuucauuuccag

SEQ ID NO: 804572 - RNA, 16 nt, Homo sapiens
ugacucaagaagugaa

SEQ ID NO: 804573 - RNA, 14 nt, Homo sapiens
ugacucagaauauu

SEQ ID NO: 804574 - RNA, 15 nt, Homo sapiens
ugacucaggauuuaa

SEQ ID NO: 804575 - RNA, 23 nt, Homo sapiens
ugacucaggauuuaaaaacugga

SEQ ID NO: 804576 - RNA, 15 nt, Homo sapiens
ugacucauggcagcu

SEQ ID NO: 804577 - RNA, 15 nt, Homo sapiens
ugacuccauucaaau

SEQ ID NO: 804578 - RNA, 23 nt, Homo sapiens
ugacucccaaguuuccauagcaa

SEQ ID NO: 804579 - RNA, 19 nt, Homo sapiens
ugacucccagaucagucag

SEQ ID NO: 804580 - RNA, 17 nt, Homo sapiens
ugacucuaaaugcaguu

SEQ ID NO: 804581 - RNA, 19 nt, Homo sapiens
ugacucuagcaaggcucau

SEQ ID NO: 804582 - RNA, 16 nt, Homo sapiens
ugacucucagcagcua

SEQ ID NO: 804583 - RNA, 14 nt, Homo sapiens
ugacucugacucau

SEQ ID NO: 804584 - RNA, 12 nt, Homo sapiens
ugacucugcauu

SEQ ID NO: 804585 - RNA, 15 nt, Homo sapiens
ugacucuugacucuu

SEQ ID NO: 804586 - RNA, 16 nt, Homo sapiens
ugacugccacccacac

SEQ ID NO: 804587 - RNA, 15 nt, Homo sapiens
ugacuggcaguauua

SEQ ID NO: 804588 - RNA, 12 nt, Homo sapiens
ugacuguaucug

SEQ ID NO: 804589 - RNA, 14 nt, Homo sapiens
ugacuguaucuuga

SEQ ID NO: 804590 - RNA, 16 nt, Homo sapiens
ugacuguucuugguaa

SEQ ID NO: 804591 - RNA, 19 nt, Homo sapiens
ugacuuagcgucaagacau

SEQ ID NO: 804592 - RNA, 13 nt, Homo sapiens
ugacuucacugua

SEQ ID NO: 804593 - RNA, 14 nt, Homo sapiens
ugacuucacuguau

SEQ ID NO: 804594 - RNA, 14 nt, Homo sapiens
ugacuucaugcuau

SEQ ID NO: 804595 - RNA, 22 nt, Homo sapiens
ugacuuccugaacaaccagcug

SEQ ID NO: 804596 - RNA, 19 nt, Homo sapiens
ugacuuguuugucuuccau

SEQ ID NO: 804597 - RNA, 17 nt, Homo sapiens
ugacuuuagguucacau

SEQ ID NO: 804598 - RNA, 21 nt, Homo sapiens
ugacuuuauauggaugauuca

SEQ ID NO: 804599 - RNA, 20 nt, Homo sapiens
ugacuuugcuugcuuugaag

SEQ ID NO: 804600 - RNA, 15 nt, Homo sapiens
ugacuuuuccauuga

SEQ ID NO: 804601 - RNA, 17 nt, Homo sapiens
ugacuuuuucagaguug

SEQ ID NO: 804602 - RNA, 23 nt, Homo sapiens
ugagaaaaguuuaaagacacuua

SEQ ID NO: 804603 - RNA, 17 nt, Homo sapiens
ugagaaaauaucuugcu

SEQ ID NO: 804604 - RNA, 23 nt, Homo sapiens
ugagaaaauaucuugcuuucaaa

SEQ ID NO: 804605 - RNA, 23 nt, Homo sapiens
ugagaaaaugccucaauucacau

SEQ ID NO: 804606 - RNA, 18 nt, Homo sapiens
ugagaaacucuacaugua

SEQ ID NO: 804607 - RNA, 15 nt, Homo sapiens
ugagaaacugauuua

SEQ ID NO: 804608 - RNA, 23 nt, Homo sapiens
ugagaaauuuacuacaguaguua

SEQ ID NO: 804609 - RNA, 17 nt, Homo sapiens
ugagaacagauaaagau

SEQ ID NO: 804610 - RNA, 16 nt, Homo sapiens
ugagaaccauuuacuu

SEQ ID NO: 804611 - RNA, 14 nt, Homo sapiens
ugagaacugcauau

SEQ ID NO: 804612 - RNA, 15 nt, Homo sapiens
ugagaacuugacaag

SEQ ID NO: 804613 - RNA, 15 nt, Homo sapiens
ugagaagaugaucca

SEQ ID NO: 804614 - RNA, 21 nt, Homo sapiens
ugagaagauuuuaaaaccauu

SEQ ID NO: 804615 - RNA, 14 nt, Homo sapiens
ugagaagccuucag

SEQ ID NO: 804616 - RNA, 15 nt, Homo sapiens
ugagaagucacucac

SEQ ID NO: 804617 - RNA, 18 nt, Homo sapiens
ccaagacucccagaucag

SEQ ID NO: 804618 - RNA, 16 nt, Homo sapiens
ccaagagguacuguaa

SEQ ID NO: 804619 - RNA, 19 nt, Homo sapiens
ccaagauuuuuuauuugag

SEQ ID NO: 804620 - RNA, 18 nt, Homo sapiens
ccaagcacagugccugca

SEQ ID NO: 804621 - RNA, 14 nt, Homo sapiens
ccaagccuccacag

SEQ ID NO: 804622 - RNA, 13 nt, Homo sapiens
ccaagccugacca

SEQ ID NO: 804623 - RNA, 23 nt, Homo sapiens
ccaagcgcgguuacuauggccag

SEQ ID NO: 804624 - RNA, 15 nt, Homo sapiens
ccaagcuggagugaa

SEQ ID NO: 804625 - RNA, 18 nt, Homo sapiens
ccaaggaaacccccagug

SEQ ID NO: 804626 - RNA, 23 nt, Homo sapiens
ccaaggaaacccccaguguaaua

SEQ ID NO: 804627 - RNA, 22 nt, Homo sapiens
ccaaggaacucuacuucaguca

SEQ ID NO: 804628 - RNA, 15 nt, Homo sapiens
ccaaggacucuucca

SEQ ID NO: 804629 - RNA, 13 nt, Homo sapiens
ccaaggagaccaa

SEQ ID NO: 804630 - RNA, 19 nt, Homo sapiens
ccaaggaggggcuguaaaa

SEQ ID NO: 804631 - RNA, 16 nt, Homo sapiens
ccaaggauauuuacag

SEQ ID NO: 804632 - RNA, 21 nt, Homo sapiens
ccaaggccacggagcaguuca

SEQ ID NO: 804633 - RNA, 22 nt, Homo sapiens
ccaaggcugagacagugaauuu

SEQ ID NO: 804634 - RNA, 20 nt, Homo sapiens
ccaaggcuuuugcaaagaua

SEQ ID NO: 804635 - RNA, 17 nt, Homo sapiens
ccaagggaucugccauu

SEQ ID NO: 804636 - RNA, 21 nt, Homo sapiens
ccaagggcuucugcacccucc

SEQ ID NO: 804637 - RNA, 18 nt, Homo sapiens
ccaaggggguggacgcaa

SEQ ID NO: 804638 - RNA, 18 nt, Homo sapiens
ccaaggguacuaaggaau

SEQ ID NO: 804639 - RNA, 14 nt, Homo sapiens
ccaagguaggcaga

SEQ ID NO: 804640 - RNA, 13 nt, Homo sapiens
ccaagguccguga

SEQ ID NO: 804641 - RNA, 11 nt, Homo sapiens
ccaagguccug

SEQ ID NO: 804642 - RNA, 19 nt, Homo sapiens
ccaagguggagggaaggau

SEQ ID NO: 804643 - RNA, 19 nt, Homo sapiens
ccaaggugggcagaucacu

SEQ ID NO: 804644 - RNA, 15 nt, Homo sapiens
ccaagguuuaaagag

SEQ ID NO: 804645 - RNA, 20 nt, Homo sapiens
ccaagguuuaaagagucuag

SEQ ID NO: 804646 - RNA, 14 nt, Homo sapiens
ccaaguaccaguau

SEQ ID NO: 804647 - RNA, 15 nt, Homo sapiens
ccaagucaugugcau

SEQ ID NO: 804648 - RNA, 17 nt, Homo sapiens
ccaagucuaaugaagag

SEQ ID NO: 804649 - RNA, 15 nt, Homo sapiens
ccaagugaguugaau

SEQ ID NO: 804650 - RNA, 14 nt, Homo sapiens
ccaagugauaauuu

SEQ ID NO: 804651 - RNA, 11 nt, Homo sapiens
ccaagugcaau

SEQ ID NO: 804652 - RNA, 16 nt, Homo sapiens
ccaagugccagucuug

SEQ ID NO: 804653 - RNA, 16 nt, Homo sapiens
ccaagugggauuugca

SEQ ID NO: 804654 - RNA, 22 nt, Homo sapiens
ccaaguguaaaaacaaugugcu

SEQ ID NO: 804655 - RNA, 11 nt, Homo sapiens
ccaagugugaa

SEQ ID NO: 804656 - RNA, 22 nt, Homo sapiens
ccaaguuaccuacaagaacaau

SEQ ID NO: 804657 - RNA, 19 nt, Homo sapiens
ccaauaaaggcagcugccu

SEQ ID NO: 804658 - RNA, 14 nt, Homo sapiens
ccaauaaagugacc

SEQ ID NO: 804659 - RNA, 22 nt, Homo sapiens
ccaauaaauuuguaacuuugca

SEQ ID NO: 804660 - RNA, 19 nt, Homo sapiens
ccaauaccguguggcccaa

SEQ ID NO: 804661 - RNA, 13 nt, Homo sapiens
ccaauacuacuga

SEQ ID NO: 804662 - RNA, 19 nt, Homo sapiens
ccaauagggcugagcucuc

SEQ ID NO: 804663 - RNA, 20 nt, Homo sapiens
ccaaucagcuuuuguucuag

SEQ ID NO: 804664 - RNA, 14 nt, Homo sapiens
ccaaucauuuuaau

SEQ ID NO: 804665 - RNA, 12 nt, Homo sapiens
ccaauccccucc

SEQ ID NO: 804666 - RNA, 21 nt, Homo sapiens
ccaauccuuaaauaugugaaa

SEQ ID NO: 804667 - RNA, 13 nt, Homo sapiens
ccaaugaagaaga

SEQ ID NO: 804668 - RNA, 18 nt, Homo sapiens
ccaaugagacucuagggu

SEQ ID NO: 804669 - RNA, 22 nt, Homo sapiens
ccaaugaggucugaaauggagg

SEQ ID NO: 804670 - RNA, 13 nt, Homo sapiens
ccaaugaugguca

SEQ ID NO: 804671 - RNA, 19 nt, Homo sapiens
ccaaugguguagcuguccu

SEQ ID NO: 804672 - RNA, 16 nt, Homo sapiens
ccaaugucuuuugaca

SEQ ID NO: 804673 - RNA, 15 nt, Homo sapiens
ccaaugugugaagua

SEQ ID NO: 804674 - RNA, 23 nt, Homo sapiens
ccaauguucuaaaguuuugcaac

SEQ ID NO: 804675 - RNA, 22 nt, Homo sapiens
ccaauucuaacagcaaauaaca

SEQ ID NO: 804676 - RNA, 21 nt, Homo sapiens
ccaauugacucucacacugaa

SEQ ID NO: 804677 - RNA, 21 nt, Homo sapiens
ccacuuccuuuuaacugccaa

SEQ ID NO: 804678 - RNA, 16 nt, Homo sapiens
ccacuucuaaauagca

SEQ ID NO: 804679 - RNA, 11 nt, Homo sapiens
ccacuucucac

SEQ ID NO: 804680 - RNA, 15 nt, Homo sapiens
ccacuucugugccac

SEQ ID NO: 804681 - RNA, 21 nt, Homo sapiens
ccacuugacauuccuugucac

SEQ ID NO: 804682 - RNA, 17 nt, Homo sapiens
ccacuuggcaucauuca

SEQ ID NO: 804683 - RNA, 13 nt, Homo sapiens
ccacuuugacucc

SEQ ID NO: 804684 - RNA, 21 nt, Homo sapiens
ccacuuuggcugaacuacaag

SEQ ID NO: 804685 - RNA, 14 nt, Homo sapiens
ccagaaaagcaaua

SEQ ID NO: 804686 - RNA, 17 nt, Homo sapiens
ccagaaaagcaguggcu

SEQ ID NO: 804687 - RNA, 15 nt, Homo sapiens
ccagaaaucaaaaag

SEQ ID NO: 804688 - RNA, 18 nt, Homo sapiens
ccagaaauugugugugca

SEQ ID NO: 804689 - RNA, 14 nt, Homo sapiens
ccagaacccuuccu

SEQ ID NO: 804690 - RNA, 17 nt, Homo sapiens
ccagaaccuguccuugc

SEQ ID NO: 804691 - RNA, 16 nt, Homo sapiens
ccagaagaauauucag

SEQ ID NO: 804692 - RNA, 14 nt, Homo sapiens
ccagaagagguaua

SEQ ID NO: 804693 - RNA, 16 nt, Homo sapiens
ccagaagcuguacuuu

SEQ ID NO: 804694 - RNA, 17 nt, Homo sapiens
ccagaagcuuccauagu

SEQ ID NO: 804695 - RNA, 23 nt, Homo sapiens
ccagaagcuuccauaguggugca

SEQ ID NO: 804696 - RNA, 15 nt, Homo sapiens
ccagaaggcaaaaag

SEQ ID NO: 804697 - RNA, 22 nt, Homo sapiens
ccagaaggcagagguugcagug

SEQ ID NO: 804698 - RNA, 14 nt, Homo sapiens
ccagaauacugggu

SEQ ID NO: 804699 - RNA, 22 nt, Homo sapiens
ccagaaucuugacuuucugauu

SEQ ID NO: 804700 - RNA, 18 nt, Homo sapiens
ccagaaugaaaacuguaa

SEQ ID NO: 804701 - RNA, 18 nt, Homo sapiens
ccagacaccaugugcaau

SEQ ID NO: 804702 - RNA, 15 nt, Homo sapiens
ccagacccacugaaa

SEQ ID NO: 804703 - RNA, 11 nt, Homo sapiens
ccagaccucaa

SEQ ID NO: 804704 - RNA, 22 nt, Homo sapiens
ccagacucagguuccagaacag

SEQ ID NO: 804705 - RNA, 23 nt, Homo sapiens
ccagacuugcacuggggugggau

SEQ ID NO: 804706 - RNA, 20 nt, Homo sapiens
ccagagacauacuugaaggg

SEQ ID NO: 804707 - RNA, 14 nt, Homo sapiens
ccagagcaaaauaa

SEQ ID NO: 804708 - RNA, 15 nt, Homo sapiens
ccagagcaucuugca

SEQ ID NO: 804709 - RNA, 15 nt, Homo sapiens
ccagagcgugcacuu

SEQ ID NO: 804710 - RNA, 16 nt, Homo sapiens
ccagagcuacugacua

SEQ ID NO: 804711 - RNA, 17 nt, Homo sapiens
ccagagcugugccugcu

SEQ ID NO: 804712 - RNA, 17 nt, Homo sapiens
ccagaggaaacuugcau

SEQ ID NO: 804713 - RNA, 20 nt, Homo sapiens
ccagaggaagggacaccaag

SEQ ID NO: 804714 - RNA, 19 nt, Homo sapiens
ccagaggaaguuauggcag

SEQ ID NO: 804715 - RNA, 17 nt, Homo sapiens
ccagaggaauccuggca

SEQ ID NO: 804716 - RNA, 12 nt, Homo sapiens
ccagaggcaucu

SEQ ID NO: 804717 - RNA, 22 nt, Homo sapiens
ccagagguauuccucucuuaaa

SEQ ID NO: 804718 - RNA, 18 nt, Homo sapiens
ccagaggucuggcccuau

SEQ ID NO: 804719 - RNA, 19 nt, Homo sapiens
ccagaggugucacccaaac

SEQ ID NO: 804720 - RNA, 12 nt, Homo sapiens
ccagaguaguuu

SEQ ID NO: 804721 - RNA, 23 nt, Homo sapiens
ccagaguccuuuccaaggcuucu

SEQ ID NO: 804722 - RNA, 17 nt, Homo sapiens
ccagagugauucuaguu

SEQ ID NO: 804723 - RNA, 12 nt, Homo sapiens
ccagagugcagu

SEQ ID NO: 804724 - RNA, 13 nt, Homo sapiens
ccagaguggccca

SEQ ID NO: 804725 - RNA, 17 nt, Homo sapiens
ccagaguggcccaagac

SEQ ID NO: 804726 - RNA, 16 nt, Homo sapiens
ccagaguugcaaagau

SEQ ID NO: 804727 - RNA, 19 nt, Homo sapiens
ccagaguugcugugccgug

SEQ ID NO: 804728 - RNA, 22 nt, Homo sapiens
ccagaguuggacccgaccccaa

SEQ ID NO: 804729 - RNA, 15 nt, Homo sapiens
ccagaguuguucucu

SEQ ID NO: 804730 - RNA, 19 nt, Homo sapiens
ccagaguuuuuaaagccuu

SEQ ID NO: 804731 - RNA, 22 nt, Homo sapiens
ccagauacauggugaugguuag

SEQ ID NO: 804732 - RNA, 23 nt, Homo sapiens
uguuaggacauaaacccuugcca

SEQ ID NO: 804733 - RNA, 14 nt, Homo sapiens
uguuagguucacac

SEQ ID NO: 804734 - RNA, 23 nt, Homo sapiens
uguuaguaaauaaaauuaacaaa

SEQ ID NO: 804735 - RNA, 14 nt, Homo sapiens
uguuaguucccaac

SEQ ID NO: 804736 - RNA, 21 nt, Homo sapiens
uguuauaacucugcacuacuc

SEQ ID NO: 804737 - RNA, 18 nt, Homo sapiens
uguuaucuaucaacuaua

SEQ ID NO: 804738 - RNA, 17 nt, Homo sapiens
uguuauguuugcacuuu

SEQ ID NO: 804739 - RNA, 16 nt, Homo sapiens
uguuauugauguugcu

SEQ ID NO: 804740 - RNA, 12 nt, Homo sapiens
uguuauuuacac

SEQ ID NO: 804741 - RNA, 13 nt, Homo sapiens
uguuauuuaucaa

SEQ ID NO: 804742 - RNA, 11 nt, Homo sapiens
uguucaaagac

SEQ ID NO: 804743 - RNA, 12 nt, Homo sapiens
uguucaaagcac

SEQ ID NO: 804744 - RNA, 12 nt, Homo sapiens
uguucaaaugua

SEQ ID NO: 804745 - RNA, 14 nt, Homo sapiens
uguucaaugauuau

SEQ ID NO: 804746 - RNA, 18 nt, Homo sapiens
uguucacaaacuaccucu

SEQ ID NO: 804747 - RNA, 20 nt, Homo sapiens
uguucacagccagacuggca

SEQ ID NO: 804748 - RNA, 16 nt, Homo sapiens
uguucacugaagguga

SEQ ID NO: 804749 - RNA, 12 nt, Homo sapiens
uguucacuuuau

SEQ ID NO: 804750 - RNA, 18 nt, Homo sapiens
uguucagagaggccuuuu

SEQ ID NO: 804751 - RNA, 17 nt, Homo sapiens
uguucagggcugugauc

SEQ ID NO: 804752 - RNA, 17 nt, Homo sapiens
uguucauggacuauucc

SEQ ID NO: 804753 - RNA, 15 nt, Homo sapiens
uguucauguuacuca

SEQ ID NO: 804754 - RNA, 18 nt, Homo sapiens
uguucauguuacucauga

SEQ ID NO: 804755 - RNA, 16 nt, Homo sapiens
uguucauuauaaucuc

SEQ ID NO: 804756 - RNA, 14 nt, Homo sapiens
uguuccagacucag

SEQ ID NO: 804757 - RNA, 18 nt, Homo sapiens
uguuccagaggagcucuc

SEQ ID NO: 804758 - RNA, 14 nt, Homo sapiens
uguuccccacugac

SEQ ID NO: 804759 - RNA, 21 nt, Homo sapiens
uguucccccagccugccaaau

SEQ ID NO: 804760 - RNA, 21 nt, Homo sapiens
uguucccuaggggacacuucc

SEQ ID NO: 804761 - RNA, 22 nt, Homo sapiens
uguucccuccccgaucaucuuu

SEQ ID NO: 804762 - RNA, 15 nt, Homo sapiens
uguuccuagaaugca

SEQ ID NO: 804763 - RNA, 20 nt, Homo sapiens
uguuccucaagguccauuau

SEQ ID NO: 804764 - RNA, 16 nt, Homo sapiens
uguuccugacuuuaua

SEQ ID NO: 804765 - RNA, 14 nt, Homo sapiens
uguuccuuaccaag

SEQ ID NO: 804766 - RNA, 13 nt, Homo sapiens
uguucuacacuca

SEQ ID NO: 804767 - RNA, 23 nt, Homo sapiens
uguucuacuuuuugguacaggua

SEQ ID NO: 804768 - RNA, 14 nt, Homo sapiens
uguucuauugcuga

SEQ ID NO: 804769 - RNA, 19 nt, Homo sapiens
uguucucaacuucaaaagu

SEQ ID NO: 804770 - RNA, 21 nt, Homo sapiens
uguucucauuugaucagggga

SEQ ID NO: 804771 - RNA, 20 nt, Homo sapiens
uguucugacccugcuucaaa

SEQ ID NO: 804772 - RNA, 13 nt, Homo sapiens
uguucugcacuga

SEQ ID NO: 804773 - RNA, 18 nt, Homo sapiens
uguucugcagucaucucc

SEQ ID NO: 804774 - RNA, 21 nt, Homo sapiens
uguucuggggggacccagugc

SEQ ID NO: 804775 - RNA, 23 nt, Homo sapiens
uguucuggggggacccagugcag

SEQ ID NO: 804776 - RNA, 14 nt, Homo sapiens
uguucugugccugc

SEQ ID NO: 804777 - RNA, 15 nt, Homo sapiens
uguucuuagagugua

SEQ ID NO: 804778 - RNA, 17 nt, Homo sapiens
uguucuuagguuuacug

SEQ ID NO: 804779 - RNA, 19 nt, Homo sapiens
uguucuucuucauauucua

SEQ ID NO: 804780 - RNA, 14 nt, Homo sapiens
uguugaacuuagaa

SEQ ID NO: 804781 - RNA, 14 nt, Homo sapiens
uguugaaguuuaca

SEQ ID NO: 804782 - RNA, 18 nt, Homo sapiens
uguugaaucugagcugca

SEQ ID NO: 804783 - RNA, 22 nt, Homo sapiens
uguugaggacaauuucauucca

SEQ ID NO: 804784 - RNA, 18 nt, Homo sapiens
uguugauaaaccauaaau

SEQ ID NO: 804785 - RNA, 24 nt, Homo sapiens
uguugauaaauccaucacuauaau

SEQ ID NO: 804786 - RNA, 22 nt, Homo sapiens
uguugauacuagcauacuuaaa

SEQ ID NO: 804787 - RNA, 12 nt, Homo sapiens
uguugaucccaa

SEQ ID NO: 804788 - RNA, 22 nt, Homo sapiens
uguugcaaacucaguuccaaag

SEQ ID NO: 804789 - RNA, 13 nt, Homo sapiens
uguugcccauuua

SEQ ID NO: 804790 - RNA, 17 nt, Homo sapiens
uguugccuucaucuuca

SEQ ID NO: 804791 - RNA, 17 nt, Homo sapiens
uguugcuuccguucaug

SEQ ID NO: 804792 - RNA, 15 nt, Homo sapiens
uguugcuuguaauca

SEQ ID NO: 804793 - RNA, 14 nt, Homo sapiens
uguuggagccugca

SEQ ID NO: 804794 - RNA, 21 nt, Homo sapiens
uguuggccaggauggucucga

SEQ ID NO: 804795 - RNA, 18 nt, Homo sapiens
uguuggguugaauauauu

SEQ ID NO: 804796 - RNA, 15 nt, Homo sapiens
uguuguacuugaaaa

SEQ ID NO: 804797 - RNA, 13 nt, Homo sapiens
uguuguagacuua

SEQ ID NO: 804798 - RNA, 20 nt, Homo sapiens
uguuguaucaaagugugaua

SEQ ID NO: 804799 - RNA, 18 nt, Homo sapiens
uguuguguauuccacuua

SEQ ID NO: 804800 - RNA, 21 nt, Homo sapiens
uguuguguuuuuaacauguca

SEQ ID NO: 804801 - RNA, 19 nt, Homo sapiens
uguuuacagaggacaguau

SEQ ID NO: 804802 - RNA, 15 nt, Homo sapiens
uguuuacagcacuac

SEQ ID NO: 804803 - RNA, 13 nt, Homo sapiens
uguuuacccagua

SEQ ID NO: 804804 - RNA, 16 nt, Homo sapiens
uguuuacccaguauuc

SEQ ID NO: 804805 - RNA, 12 nt, Homo sapiens
uguuuacuguaa

SEQ ID NO: 804806 - RNA, 17 nt, Homo sapiens
uguuuauacacugugua

SEQ ID NO: 804807 - RNA, 14 nt, Homo sapiens
uguuuauucuucca

SEQ ID NO: 804808 - RNA, 14 nt, Homo sapiens
uguuuauugcaaua

SEQ ID NO: 804809 - RNA, 20 nt, Homo sapiens
uguuucaaggcacucuagau

SEQ ID NO: 804810 - RNA, 15 nt, Homo sapiens
uguuucacagagugu

SEQ ID NO: 804811 - RNA, 21 nt, Homo sapiens
uguuucaccaguguuuuaccc

SEQ ID NO: 804812 - RNA, 13 nt, Homo sapiens
uguuucaguguga

SEQ ID NO: 804813 - RNA, 17 nt, Homo sapiens
uguuucaguucagauaa

SEQ ID NO: 804814 - RNA, 14 nt, Homo sapiens
uguuuccagaauug

SEQ ID NO: 804815 - RNA, 17 nt, Homo sapiens
uguuuccagcuugcauu

SEQ ID NO: 804816 - RNA, 21 nt, Homo sapiens
uguuucuaaaacuaugguucc

SEQ ID NO: 804817 - RNA, 14 nt, Homo sapiens
uguuucuauucuaa

SEQ ID NO: 804818 - RNA, 22 nt, Homo sapiens
uguuucucugccgcuaccuccc

SEQ ID NO: 804819 - RNA, 16 nt, Homo sapiens
uguuucugcuaugacc

SEQ ID NO: 804820 - RNA, 15 nt, Homo sapiens
uguuucuuugaucau

SEQ ID NO: 804821 - RNA, 13 nt, Homo sapiens
uguuugcacugug

SEQ ID NO: 804822 - RNA, 11 nt, Homo sapiens
uguuugcacuu

SEQ ID NO: 804823 - RNA, 12 nt, Homo sapiens
uguuugcacuuu

SEQ ID NO: 804824 - RNA, 13 nt, Homo sapiens
uguuugcacuuug

SEQ ID NO: 804825 - RNA, 14 nt, Homo sapiens
uguuugcauaaagu

SEQ ID NO: 804826 - RNA, 17 nt, Homo sapiens
uguuuggaaaccacagu

SEQ ID NO: 804827 - RNA, 18 nt, Homo sapiens
uguuuggaauaaagucaa

SEQ ID NO: 804828 - RNA, 15 nt, Homo sapiens
uguuuggacuuuuau

SEQ ID NO: 804829 - RNA, 19 nt, Homo sapiens
uguuuguaaauaagagauu

SEQ ID NO: 804830 - RNA, 17 nt, Homo sapiens
uguuugucagauaugau

SEQ ID NO: 804831 - RNA, 15 nt, Homo sapiens
uguuugucagcaucu

SEQ ID NO: 804832 - RNA, 19 nt, Homo sapiens
uguuuguccguccaugcca

SEQ ID NO: 804833 - RNA, 18 nt, Homo sapiens
ggaaguuucuggugccau

SEQ ID NO: 804834 - RNA, 14 nt, Homo sapiens
ggaauaaaaccauc

SEQ ID NO: 804835 - RNA, 15 nt, Homo sapiens
ggaauaaggccuuaa

SEQ ID NO: 804836 - RNA, 15 nt, Homo sapiens
ggaauacagaagcag

SEQ ID NO: 804837 - RNA, 22 nt, Homo sapiens
ggaauauaaacaggaucucaaa

SEQ ID NO: 804838 - RNA, 23 nt, Homo sapiens
ggaauauauuugugugugugaua

SEQ ID NO: 804839 - RNA, 15 nt, Homo sapiens
ggaaucaacagggca

SEQ ID NO: 804840 - RNA, 22 nt, Homo sapiens
ggaaucacuucuccaaucagug

SEQ ID NO: 804841 - RNA, 15 nt, Homo sapiens
ggaaucccacuguau

SEQ ID NO: 804842 - RNA, 16 nt, Homo sapiens
ggaaucuucaccucag

SEQ ID NO: 804843 - RNA, 19 nt, Homo sapiens
ggaaugauugguagcaaag

SEQ ID NO: 804844 - RNA, 15 nt, Homo sapiens
ggaaugccgcugucu

SEQ ID NO: 804845 - RNA, 23 nt, Homo sapiens
ggaaugccgcugucucugagggg

SEQ ID NO: 804846 - RNA, 12 nt, Homo sapiens
ggaauguguucg

SEQ ID NO: 804847 - RNA, 21 nt, Homo sapiens
ggaauuaggaagaccaagaca

SEQ ID NO: 804848 - RNA, 18 nt, Homo sapiens
ggaauuaugucugcugaa

SEQ ID NO: 804849 - RNA, 16 nt, Homo sapiens
ggaauuauucccauga

SEQ ID NO: 804850 - RNA, 19 nt, Homo sapiens
ggaauuauuuugaauguca

SEQ ID NO: 804851 - RNA, 21 nt, Homo sapiens
uacaaucagcccagugcaaac

SEQ ID NO: 804852 - RNA, 13 nt, Homo sapiens
uacaaucuggcuc

SEQ ID NO: 804853 - RNA, 22 nt, Homo sapiens
uacaaugaaagcccucaugugc

SEQ ID NO: 804854 - RNA, 19 nt, Homo sapiens
uacaaugaaguuaagguua

SEQ ID NO: 804855 - RNA, 16 nt, Homo sapiens
uacaauguauguaauu

SEQ ID NO: 804856 - RNA, 20 nt, Homo sapiens
uacaauuaaaacuaagcaca

SEQ ID NO: 804857 - RNA, 12 nt, Homo sapiens
uacaauugugag

SEQ ID NO: 804858 - RNA, 20 nt, Homo sapiens
uacaauuucacuuagucugu

SEQ ID NO: 804859 - RNA, 18 nt, Homo sapiens
uacaauuuuuuaucaugc

SEQ ID NO: 804860 - RNA, 15 nt, Homo sapiens
uacacaaggaaggca

SEQ ID NO: 804861 - RNA, 18 nt, Homo sapiens
uacacacuuuuuaagaaa

SEQ ID NO: 804862 - RNA, 17 nt, Homo sapiens
uacacagaaacacugcc

SEQ ID NO: 804863 - RNA, 18 nt, Homo sapiens
uacacagaaacacugccu

SEQ ID NO: 804864 - RNA, 15 nt, Homo sapiens
uacacagaauauaau

SEQ ID NO: 804865 - RNA, 20 nt, Homo sapiens
uacacaucacacccauuuaa

SEQ ID NO: 804866 - RNA, 23 nt, Homo sapiens
uacaccaaugaaaacauguacua

SEQ ID NO: 804867 - RNA, 23 nt, Homo sapiens
uacacccaauuuuaaaaaauaac

SEQ ID NO: 804868 - RNA, 19 nt, Homo sapiens
uacaccugcggggccaccc

SEQ ID NO: 804869 - RNA, 15 nt, Homo sapiens
uacacgcgugugcuc

SEQ ID NO: 804870 - RNA, 23 nt, Homo sapiens
uacacgggaccagcucacguaau

SEQ ID NO: 804871 - RNA, 19 nt, Homo sapiens
uacacuaaaaaucugagaa

SEQ ID NO: 804872 - RNA, 16 nt, Homo sapiens
uacacuaaaguuacaa

SEQ ID NO: 804873 - RNA, 18 nt, Homo sapiens
uacacuaaaguuacaaac

SEQ ID NO: 804874 - RNA, 18 nt, Homo sapiens
uacacuaaauccccucac

SEQ ID NO: 804875 - RNA, 15 nt, Homo sapiens
uacacuacauuguac

SEQ ID NO: 804876 - RNA, 12 nt, Homo sapiens
uacacuaugaag

SEQ ID NO: 804877 - RNA, 20 nt, Homo sapiens
uacacuccagccugagcaac

SEQ ID NO: 804878 - RNA, 16 nt, Homo sapiens
uacacucuugauucua

SEQ ID NO: 804879 - RNA, 18 nt, Homo sapiens
uacacugauacacuugaa

SEQ ID NO: 804880 - RNA, 19 nt, Homo sapiens
uacacugcggaagccaaag

SEQ ID NO: 804881 - RNA, 22 nt, Homo sapiens
uacacugcggaagccaaaggca

SEQ ID NO: 804882 - RNA, 22 nt, Homo sapiens
uacacuugugcacccucuaucc

SEQ ID NO: 804883 - RNA, 23 nt, Homo sapiens
uacacuuuaugccggaugugcuu

SEQ ID NO: 804884 - RNA, 18 nt, Homo sapiens
uacagaaaagacucugac

SEQ ID NO: 804885 - RNA, 16 nt, Homo sapiens
uacagaaaucaauggu

SEQ ID NO: 804886 - RNA, 15 nt, Homo sapiens
uacagaaaugcaaaa

SEQ ID NO: 804887 - RNA, 15 nt, Homo sapiens
uacagaauauacuua

SEQ ID NO: 804888 - RNA, 22 nt, Homo sapiens
uacagacaagguucugcccuua

SEQ ID NO: 804889 - RNA, 20 nt, Homo sapiens
uacagacagaaggugcuaag

SEQ ID NO: 804890 - RNA, 13 nt, Homo sapiens
uacagacauacau

SEQ ID NO: 804891 - RNA, 18 nt, Homo sapiens
uacagacucugauucuac

SEQ ID NO: 804892 - RNA, 13 nt, Homo sapiens
uacagacugggga

SEQ ID NO: 804893 - RNA, 13 nt, Homo sapiens
uacagacugugag

SEQ ID NO: 804894 - RNA, 18 nt, Homo sapiens
uacagacuucuccagacc

SEQ ID NO: 804895 - RNA, 18 nt, Homo sapiens
uacagagaugcaaugaua

SEQ ID NO: 804896 - RNA, 14 nt, Homo sapiens
uacagaggacagua

SEQ ID NO: 804897 - RNA, 13 nt, Homo sapiens
uacagaguuuuag

SEQ ID NO: 804898 - RNA, 14 nt, Homo sapiens
uacagauacuguga

SEQ ID NO: 804899 - RNA, 22 nt, Homo sapiens
uacagaucaucuuggaacugca

SEQ ID NO: 804900 - RNA, 15 nt, Homo sapiens
uacagaugaaugaua

SEQ ID NO: 804901 - RNA, 16 nt, Homo sapiens
uacagauuuaagaaua

SEQ ID NO: 804902 - RNA, 21 nt, Homo sapiens
uacagcaacaggaaucucaga

SEQ ID NO: 804903 - RNA, 16 nt, Homo sapiens
uacagcacuacucugu

SEQ ID NO: 804904 - RNA, 20 nt, Homo sapiens
uacagcagaaaggagaacua

SEQ ID NO: 804905 - RNA, 14 nt, Homo sapiens
uacagcagcacugu

SEQ ID NO: 804906 - RNA, 20 nt, Homo sapiens
uacagccagcagcacaguca

SEQ ID NO: 804907 - RNA, 16 nt, Homo sapiens
uacagcuaacccucac

SEQ ID NO: 804908 - RNA, 20 nt, Homo sapiens
uacagcuaucgaacuucaca

SEQ ID NO: 804909 - RNA, 14 nt, Homo sapiens
uacagcucuggcca

SEQ ID NO: 804910 - RNA, 19 nt, Homo sapiens
uacagcuguauugucugaa

SEQ ID NO: 804911 - RNA, 17 nt, Homo sapiens
uacaggaagcaccccau

SEQ ID NO: 804912 - RNA, 23 nt, Homo sapiens
uacaggaagcaccccaugccaaa

SEQ ID NO: 804913 - RNA, 17 nt, Homo sapiens
uacaggaggcagacaau

SEQ ID NO: 804914 - RNA, 19 nt, Homo sapiens
uacaggaggcagacaauga

SEQ ID NO: 804915 - RNA, 14 nt, Homo sapiens
uacaggcacccacc

SEQ ID NO: 804916 - RNA, 14 nt, Homo sapiens
uacaggcgugagcc

SEQ ID NO: 804917 - RNA, 20 nt, Homo sapiens
uacagggacacuaucacuca

SEQ ID NO: 804918 - RNA, 15 nt, Homo sapiens
uacagggaguguagu

SEQ ID NO: 804919 - RNA, 18 nt, Homo sapiens
uacaggugaaggcucuca

SEQ ID NO: 804920 - RNA, 14 nt, Homo sapiens
uacaggugcgaaug

SEQ ID NO: 804921 - RNA, 13 nt, Homo sapiens
uacaggugugagc

SEQ ID NO: 804922 - RNA, 18 nt, Homo sapiens
uacaggugugugccacca

SEQ ID NO: 804923 - RNA, 14 nt, Homo sapiens
uacaguaagcauag

SEQ ID NO: 804924 - RNA, 15 nt, Homo sapiens
uacaguacacagaua

SEQ ID NO: 804925 - RNA, 17 nt, Homo sapiens
uacagugcagagccuuc

SEQ ID NO: 804926 - RNA, 17 nt, Homo sapiens
uacagugccacugcaau

SEQ ID NO: 804927 - RNA, 20 nt, Homo sapiens
uacaguguauguacuaagca

SEQ ID NO: 804928 - RNA, 17 nt, Homo sapiens
uacaguuagcagggaug

SEQ ID NO: 804929 - RNA, 17 nt, Homo sapiens
uacaguucugugguuuc

SEQ ID NO: 804930 - RNA, 15 nt, Homo sapiens
uacaguugaauuuua

SEQ ID NO: 804931 - RNA, 13 nt, Homo sapiens
uacauaaaaaagu

SEQ ID NO: 804932 - RNA, 19 nt, Homo sapiens
uacauaaaguauccaugca

SEQ ID NO: 804933 - RNA, 20 nt, Homo sapiens
uacauaacuccugucccuuu

SEQ ID NO: 804934 - RNA, 15 nt, Homo sapiens
uacauaacuugauau

SEQ ID NO: 804935 - RNA, 16 nt, Homo sapiens
uacauaauauaugacu

SEQ ID NO: 804936 - RNA, 15 nt, Homo sapiens
uacauaauguauugu

SEQ ID NO: 804937 - RNA, 22 nt, Homo sapiens
uacauaauuuaaaagcacacuc

SEQ ID NO: 804938 - RNA, 20 nt, Homo sapiens
uacauacaggccauacuuua

SEQ ID NO: 804939 - RNA, 17 nt, Homo sapiens
uacauaggucuguaugg

SEQ ID NO: 804940 - RNA, 20 nt, Homo sapiens
uacauauauacauugcuuag

SEQ ID NO: 804941 - RNA, 14 nt, Homo sapiens
uacauauauguaua

SEQ ID NO: 804942 - RNA, 17 nt, Homo sapiens
uacauauguauacaugu

SEQ ID NO: 804943 - RNA, 14 nt, Homo sapiens
uacauauuaucuca

SEQ ID NO: 804944 - RNA, 15 nt, Homo sapiens
uacauauuaucucau

SEQ ID NO: 804945 - RNA, 16 nt, Homo sapiens
uacaucccagccugug

SEQ ID NO: 804946 - RNA, 15 nt, Homo sapiens
uacaucuaacucauc

SEQ ID NO: 804947 - RNA, 17 nt, Homo sapiens
uacaucucccagacucu

SEQ ID NO: 804948 - RNA, 11 nt, Homo sapiens
uacaucuggcc

SEQ ID NO: 804949 - RNA, 16 nt, Homo sapiens
uacaugagccagugau

SEQ ID NO: 804950 - RNA, 15 nt, Homo sapiens
uacaugcaacagaag

SEQ ID NO: 804951 - RNA, 16 nt, Homo sapiens
uacaugcuggggucaa

SEQ ID NO: 804952 - RNA, 11 nt, Homo sapiens
uacauggaaua

SEQ ID NO: 804953 - RNA, 20 nt, Homo sapiens
uacauggaauaacauguaau

SEQ ID NO: 804954 - RNA, 22 nt, Homo sapiens
uacauguaugaaauugguuuuc

SEQ ID NO: 804955 - RNA, 13 nt, Homo sapiens
uacaugugcacau

SEQ ID NO: 804956 - RNA, 14 nt, Homo sapiens
uacaugugcacauu

SEQ ID NO: 804957 - RNA, 16 nt, Homo sapiens
uacauuaucucacuua

SEQ ID NO: 804958 - RNA, 23 nt, Homo sapiens
uacucaaggaauuugcauuuagu

SEQ ID NO: 804959 - RNA, 13 nt, Homo sapiens
uacucacauauaa

SEQ ID NO: 804960 - RNA, 21 nt, Homo sapiens
uacucacuuuuuccaaaugau

SEQ ID NO: 804961 - RNA, 13 nt, Homo sapiens
uacuccucugcag

SEQ ID NO: 804962 - RNA, 19 nt, Homo sapiens
uacucgagcccacccagca

SEQ ID NO: 804963 - RNA, 20 nt, Homo sapiens
uacucgggaggcugaggcag

SEQ ID NO: 804964 - RNA, 16 nt, Homo sapiens
uacucuuaugaucaau

SEQ ID NO: 804965 - RNA, 18 nt, Homo sapiens
uacucuugaaauguagaa

SEQ ID NO: 804966 - RNA, 17 nt, Homo sapiens
uacucuugucauuuuua

SEQ ID NO: 804967 - RNA, 13 nt, Homo sapiens
gucucagcugcug

SEQ ID NO: 804968 - RNA, 14 nt, Homo sapiens
gucucaucucuuca

SEQ ID NO: 804969 - RNA, 13 nt, Homo sapiens
gucucauuuagaa

SEQ ID NO: 804970 - RNA, 13 nt, Homo sapiens
gucuccaagacca

SEQ ID NO: 804971 - RNA, 22 nt, Homo sapiens
gugagcuggauagacuugggau

SEQ ID NO: 804972 - RNA, 13 nt, Homo sapiens
gugagcugucacu

SEQ ID NO: 804973 - RNA, 20 nt, Homo sapiens
gugaggaacccugaucucuc

SEQ ID NO: 804974 - RNA, 22 nt, Homo sapiens
gugaggaugucugggccacuca

SEQ ID NO: 804975 - RNA, 15 nt, Homo sapiens
gugaggcggcagcug

SEQ ID NO: 804976 - RNA, 19 nt, Homo sapiens
gugaggcggcccugaccaa

SEQ ID NO: 804977 - RNA, 14 nt, Homo sapiens
gugaggggcucucu

SEQ ID NO: 804978 - RNA, 15 nt, Homo sapiens
gugagggugcugacu

SEQ ID NO: 804979 - RNA, 12 nt, Homo sapiens
gugaggugagcc

SEQ ID NO: 804980 - RNA, 19 nt, Homo sapiens
gugagguuaguucugugug

SEQ ID NO: 804981 - RNA, 15 nt, Homo sapiens
gugaguggcagccau

SEQ ID NO: 804982 - RNA, 14 nt, Homo sapiens
gugaguuugagcug

SEQ ID NO: 804983 - RNA, 13 nt, Homo sapiens
gugauacccaagu

SEQ ID NO: 804984 - RNA, 16 nt, Homo sapiens
gugauacguacagcca

SEQ ID NO: 804985 - RNA, 19 nt, Homo sapiens
gugaucaacuguucagggu

SEQ ID NO: 804986 - RNA, 17 nt, Homo sapiens
gugaucccagcuacuca

SEQ ID NO: 804987 - RNA, 18 nt, Homo sapiens
gugaucgucccaucccca

SEQ ID NO: 804988 - RNA, 15 nt, Homo sapiens
gugaucucagcucac

SEQ ID NO: 804989 - RNA, 15 nt, Homo sapiens
gugaugcaugagcuc

SEQ ID NO: 804990 - RNA, 14 nt, Homo sapiens
gugaugccauuaca

SEQ ID NO: 804991 - RNA, 23 nt, Homo sapiens
gugaugccucccuguugaagcuc

SEQ ID NO: 804992 - RNA, 23 nt, Homo sapiens
gugauggcgcgggaggcaccagc

SEQ ID NO: 804993 - RNA, 21 nt, Homo sapiens
gugaugggccccucagccagg

SEQ ID NO: 804994 - RNA, 21 nt, Homo sapiens
gugauguaccaguuuguccau

SEQ ID NO: 804995 - RNA, 20 nt, Homo sapiens
gugaugugugagcuaugcaa

SEQ ID NO: 804996 - RNA, 21 nt, Homo sapiens
gugaugugugagcuaugcaaa

SEQ ID NO: 804997 - RNA, 20 nt, Homo sapiens
gugauucaccucuucuuucc

SEQ ID NO: 804998 - RNA, 16 nt, Homo sapiens
gugauugacacacagc

SEQ ID NO: 804999 - RNA, 17 nt, Homo sapiens
gugauugcagcuuuaug

SEQ ID NO: 805000 - RNA, 18 nt, Homo sapiens
gugauuuggaccauggca

SEQ ID NO: 805001 - RNA, 20 nt, Homo sapiens
gugcaaaagugaaacauaca

SEQ ID NO: 805002 - RNA, 15 nt, Homo sapiens
gugcacaagucuuuc

SEQ ID NO: 805003 - RNA, 21 nt, Homo sapiens
gugcacauccgcgugugccug

SEQ ID NO: 805004 - RNA, 18 nt, Homo sapiens
gugcaccacuucaaguga

SEQ ID NO: 805005 - RNA, 19 nt, Homo sapiens
gugcacccucuaucccaau

SEQ ID NO: 805006 - RNA, 15 nt, Homo sapiens
gugcaccugggagaa

SEQ ID NO: 805007 - RNA, 17 nt, Homo sapiens
gugcacgagcuggccca

SEQ ID NO: 805008 - RNA, 20 nt, Homo sapiens
gugcacgcaggcacagcagc

SEQ ID NO: 805009 - RNA, 18 nt, Homo sapiens
gugcacuagccugugauu

SEQ ID NO: 805010 - RNA, 21 nt, Homo sapiens
gugcagagaugacuguccaag

SEQ ID NO: 805011 - RNA, 16 nt, Homo sapiens
gugcagccguuugaga

SEQ ID NO: 805012 - RNA, 16 nt, Homo sapiens
gugcaggacagcucuu

SEQ ID NO: 805013 - RNA, 18 nt, Homo sapiens
gugcagggaaccgugaua

SEQ ID NO: 805014 - RNA, 16 nt, Homo sapiens
gugcagggacaaagag

SEQ ID NO: 805015 - RNA, 16 nt, Homo sapiens
gugcaguagccguuug

SEQ ID NO: 805016 - RNA, 12 nt, Homo sapiens
gugcagucacug

SEQ ID NO: 805017 - RNA, 20 nt, Homo sapiens
gugcaguggcaugaugucaa

SEQ ID NO: 805018 - RNA, 18 nt, Homo sapiens
gugcaugugagcacaugc

SEQ ID NO: 805019 - RNA, 14 nt, Homo sapiens
gugcauucuggcca

SEQ ID NO: 805020 - RNA, 22 nt, Homo sapiens
gugcauuggaagaccccaccca

SEQ ID NO: 805021 - RNA, 19 nt, Homo sapiens
gugcauuuuuaaacuugaa

SEQ ID NO: 805022 - RNA, 19 nt, Homo sapiens
gugccaaaaaucuuuucau

SEQ ID NO: 805023 - RNA, 16 nt, Homo sapiens
gugccaaagcuuuacu

SEQ ID NO: 805024 - RNA, 23 nt, Homo sapiens
gugccaaagcuuuacuacugugg

SEQ ID NO: 805025 - RNA, 18 nt, Homo sapiens
gugccaauauuucugaua

SEQ ID NO: 805026 - RNA, 13 nt, Homo sapiens
gugccagaccuca

SEQ ID NO: 805027 - RNA, 18 nt, Homo sapiens
gugccagauauaacuguc

SEQ ID NO: 805028 - RNA, 16 nt, Homo sapiens
gugccaggauggaaug

SEQ ID NO: 805029 - RNA, 16 nt, Homo sapiens
gugccagugcacuccg

SEQ ID NO: 805030 - RNA, 17 nt, Homo sapiens
gugccaguggcuuauua

SEQ ID NO: 805031 - RNA, 15 nt, Homo sapiens
gugccaguucuuucc

SEQ ID NO: 805032 - RNA, 18 nt, Homo sapiens
gugccauccccaccuuca

SEQ ID NO: 805033 - RNA, 21 nt, Homo sapiens
gugccaucuguagcuauaaug

SEQ ID NO: 805034 - RNA, 23 nt, Homo sapiens
gugcccaaacaccagucaccucg

SEQ ID NO: 805035 - RNA, 15 nt, Homo sapiens
gugcccacauuugau

SEQ ID NO: 805036 - RNA, 15 nt, Homo sapiens
gugcccaccaacauc

SEQ ID NO: 805037 - RNA, 18 nt, Homo sapiens
gugcccaggguuuugccc

SEQ ID NO: 805038 - RNA, 13 nt, Homo sapiens
gugcccaugugua

SEQ ID NO: 805039 - RNA, 13 nt, Homo sapiens
gugcccuugcccu

SEQ ID NO: 805040 - RNA, 19 nt, Homo sapiens
gugccuccucagaggacag

SEQ ID NO: 805041 - RNA, 22 nt, Homo sapiens
gugccucugggacuggacaauu

SEQ ID NO: 805042 - RNA, 17 nt, Homo sapiens
gugccugcucagcagcc

SEQ ID NO: 805043 - RNA, 22 nt, Homo sapiens
gugccugcucagcagccagucu

SEQ ID NO: 805044 - RNA, 14 nt, Homo sapiens
gugccuuccauaau

SEQ ID NO: 805045 - RNA, 12 nt, Homo sapiens
gugccuucugcc

SEQ ID NO: 805046 - RNA, 14 nt, Homo sapiens
gugccuuuugcaga

SEQ ID NO: 805047 - RNA, 16 nt, Homo sapiens
gugcgcaauugcucau

SEQ ID NO: 805048 - RNA, 13 nt, Homo sapiens
gugcggugcauac

SEQ ID NO: 805049 - RNA, 20 nt, Homo sapiens
gugcgugcgcaucuugccuc

SEQ ID NO: 805050 - RNA, 21 nt, Homo sapiens
gugcuaaagccaaccagccuu

SEQ ID NO: 805051 - RNA, 15 nt, Homo sapiens
gugcuauacacacac

SEQ ID NO: 805052 - RNA, 17 nt, Homo sapiens
gugcuaucgcaccacug

SEQ ID NO: 805053 - RNA, 17 nt, Homo sapiens
gugcucaauagcuugaa

SEQ ID NO: 805054 - RNA, 20 nt, Homo sapiens
gugcucacccguaggcaaau

SEQ ID NO: 805055 - RNA, 15 nt, Homo sapiens
gugcuccgugccucc

SEQ ID NO: 805056 - RNA, 20 nt, Homo sapiens
gugcuccuccuuggugccug

SEQ ID NO: 805057 - RNA, 20 nt, Homo sapiens
gugcucucugccacuggaag

SEQ ID NO: 805058 - RNA, 17 nt, Homo sapiens
gugcucuggcaccauca

SEQ ID NO: 805059 - RNA, 22 nt, Homo sapiens
gugcucuuguuuugucuugaaa

SEQ ID NO: 805060 - RNA, 12 nt, Homo sapiens
gugcugcaccug

SEQ ID NO: 805061 - RNA, 13 nt, Homo sapiens
gugcugcuuuaau

SEQ ID NO: 805062 - RNA, 19 nt, Homo sapiens
gugcuggcauuacaggugu

SEQ ID NO: 805063 - RNA, 11 nt, Homo sapiens
gugcugggauu

SEQ ID NO: 805064 - RNA, 14 nt, Homo sapiens
gugcuguaauuuaa

SEQ ID NO: 805065 - RNA, 15 nt, Homo sapiens
gugcugucauuauuu

SEQ ID NO: 805066 - RNA, 18 nt, Homo sapiens
gugcuguggccugggcaa

SEQ ID NO: 805067 - RNA, 22 nt, Homo sapiens
gugcuuccacuucuaugcaaau

SEQ ID NO: 805068 - RNA, 17 nt, Homo sapiens
gugcuuugcauguauua

SEQ ID NO: 805069 - RNA, 20 nt, Homo sapiens
gugcuuuuaaaaaaaaauac

SEQ ID NO: 805070 - RNA, 19 nt, Homo sapiens
guggaaaacgaagcucauu

SEQ ID NO: 805071 - RNA, 18 nt, Homo sapiens
guggaacccccaucucua

SEQ ID NO: 805072 - RNA, 14 nt, Homo sapiens
guggaauguguaua

SEQ ID NO: 805073 - RNA, 21 nt, Homo sapiens
guggaccacugcaugagcuuu

SEQ ID NO: 805074 - RNA, 17 nt, Homo sapiens
guggacucagcagugac

SEQ ID NO: 805075 - RNA, 12 nt, Homo sapiens
guggacugugcc

SEQ ID NO: 805076 - RNA, 14 nt, Homo sapiens
guggacugugcugg

SEQ ID NO: 805077 - RNA, 20 nt, Homo sapiens
guggagaacugggauuugaa

SEQ ID NO: 805078 - RNA, 18 nt, Homo sapiens
guggagauuuacacuaca

SEQ ID NO: 805079 - RNA, 15 nt, Homo sapiens
guggaggauugcuau

SEQ ID NO: 805080 - RNA, 13 nt, Homo sapiens
guggagguugcag

SEQ ID NO: 805081 - RNA, 16 nt, Homo sapiens
guggagguugcaguga

SEQ ID NO: 805082 - RNA, 14 nt, Homo sapiens
guggauaauuccaa

SEQ ID NO: 805083 - RNA, 17 nt, Homo sapiens
guggaucuuugcuacug

SEQ ID NO: 805084 - RNA, 12 nt, Homo sapiens
guggaugugaug

SEQ ID NO: 805085 - RNA, 22 nt, Homo sapiens
gcuucugcugcccugaugcguc

SEQ ID NO: 805086 - RNA, 22 nt, Homo sapiens
gcuucuggagcagaacuuucca

SEQ ID NO: 805087 - RNA, 18 nt, Homo sapiens
gcuucuguaguacuccuu

SEQ ID NO: 805088 - RNA, 12 nt, Homo sapiens
gcuucuguggug

SEQ ID NO: 805089 - RNA, 23 nt, Homo sapiens
gcuucuuauucgggugugagucu

SEQ ID NO: 805090 - RNA, 15 nt, Homo sapiens
gcuucuucacaggca

SEQ ID NO: 805091 - RNA, 23 nt, Homo sapiens
gcuucuuuucacuucagagcaca

SEQ ID NO: 805092 - RNA, 16 nt, Homo sapiens
gcuugaagccaaagaa

SEQ ID NO: 805093 - RNA, 23 nt, Homo sapiens
gcuugaagccuccacaccagcug

SEQ ID NO: 805094 - RNA, 21 nt, Homo sapiens
gcuugacaccugucuugaaua

SEQ ID NO: 805095 - RNA, 20 nt, Homo sapiens
gcuugacauaauuucacuga

SEQ ID NO: 805096 - RNA, 15 nt, Homo sapiens
gcuugacauaccuac

SEQ ID NO: 805097 - RNA, 13 nt, Homo sapiens
gcuugaccaaaga

SEQ ID NO: 805098 - RNA, 21 nt, Homo sapiens
gcuugagcaaccuggcuaaga

SEQ ID NO: 805099 - RNA, 18 nt, Homo sapiens
gcuugcagagcaugaccu

SEQ ID NO: 805100 - RNA, 19 nt, Homo sapiens
gcuugcagagcaugaccug

SEQ ID NO: 805101 - RNA, 23 nt, Homo sapiens
gcuugccugcagggccauggcuc

SEQ ID NO: 805102 - RNA, 17 nt, Homo sapiens
gcuugcugcucaucuga

SEQ ID NO: 805103 - RNA, 20 nt, Homo sapiens
gcuggucucaaacuccugac

SEQ ID NO: 805104 - RNA, 21 nt, Homo sapiens
gcuggugaauaacuaugccag

SEQ ID NO: 805105 - RNA, 14 nt, Homo sapiens
gcugguggcaauaa

SEQ ID NO: 805106 - RNA, 15 nt, Homo sapiens
gcugguguagucuuu

SEQ ID NO: 805107 - RNA, 16 nt, Homo sapiens
gcuguauguaaacugu

SEQ ID NO: 805108 - RNA, 17 nt, Homo sapiens
gcuguauuuaauggcau

SEQ ID NO: 805109 - RNA, 22 nt, Homo sapiens
gcugucaacuucccaucuggcu

SEQ ID NO: 805110 - RNA, 13 nt, Homo sapiens
gcugucacuuuuu

SEQ ID NO: 805111 - RNA, 17 nt, Homo sapiens
gcugucagaugucacau

SEQ ID NO: 805112 - RNA, 20 nt, Homo sapiens
gcugucaguaugacauuuca

SEQ ID NO: 805113 - RNA, 13 nt, Homo sapiens
gcuguccacauga

SEQ ID NO: 805114 - RNA, 14 nt, Homo sapiens
gcuguccuccagag

SEQ ID NO: 805115 - RNA, 21 nt, Homo sapiens
gcuguccucucauuugcaguc

SEQ ID NO: 805116 - RNA, 13 nt, Homo sapiens
gcuguccuuuuag

SEQ ID NO: 805117 - RNA, 20 nt, Homo sapiens
gcugucuauguggcuguauc

SEQ ID NO: 805118 - RNA, 12 nt, Homo sapiens
gcugucucugag

SEQ ID NO: 805119 - RNA, 12 nt, Homo sapiens
gcugucugcuca

SEQ ID NO: 805120 - RNA, 17 nt, Homo sapiens
gcugugaaagaaccaaa

SEQ ID NO: 805121 - RNA, 15 nt, Homo sapiens
gcugugaugcaugag

SEQ ID NO: 805122 - RNA, 15 nt, Homo sapiens
gcugugaugguaccu

SEQ ID NO: 805123 - RNA, 18 nt, Homo sapiens
gcugugaugguaccuggg

SEQ ID NO: 805124 - RNA, 18 nt, Homo sapiens
gcugugauuugcugugua

SEQ ID NO: 805125 - RNA, 21 nt, Homo sapiens
gcugugcauagugguuggcac

SEQ ID NO: 805126 - RNA, 16 nt, Homo sapiens
gcugugcaucaguggg

SEQ ID NO: 805127 - RNA, 17 nt, Homo sapiens
gcugugcaucaguggga

SEQ ID NO: 805128 - RNA, 23 nt, Homo sapiens
gcugugcccagcaggcccagcau

SEQ ID NO: 805129 - RNA, 17 nt, Homo sapiens
gcuguggaccguggaca

SEQ ID NO: 805130 - RNA, 14 nt, Homo sapiens
gcuguggacugucc

SEQ ID NO: 805131 - RNA, 14 nt, Homo sapiens
gcuguggaugcuuc

SEQ ID NO: 805132 - RNA, 14 nt, Homo sapiens
gcuguggcggacac

SEQ ID NO: 805133 - RNA, 19 nt, Homo sapiens
gcuguggggaacacagcua

SEQ ID NO: 805134 - RNA, 16 nt, Homo sapiens
gcuguguacaauguga

SEQ ID NO: 805135 - RNA, 20 nt, Homo sapiens
gcuguguguccuugcauggc

SEQ ID NO: 805136 - RNA, 23 nt, Homo sapiens
gcuguguuugcagccugcucuag

SEQ ID NO: 805137 - RNA, 15 nt, Homo sapiens
gcuguuaccauucac

SEQ ID NO: 805138 - RNA, 19 nt, Homo sapiens
gcuguuauucuuguuauac

SEQ ID NO: 805139 - RNA, 14 nt, Homo sapiens
gcuguuccugagaa

SEQ ID NO: 805140 - RNA, 15 nt, Homo sapiens
gcuguuccugagaaa

SEQ ID NO: 805141 - RNA, 21 nt, Homo sapiens
gcuguucuucuguucugcaga

SEQ ID NO: 805142 - RNA, 21 nt, Homo sapiens
gcuguuggacagcugcuugug

SEQ ID NO: 805143 - RNA, 18 nt, Homo sapiens
gcuguuuccaggaaauua

SEQ ID NO: 805144 - RNA, 20 nt, Homo sapiens
gcuguuuccauagggugaca

SEQ ID NO: 805145 - RNA, 14 nt, Homo sapiens
gcuguuuguuucau

SEQ ID NO: 805146 - RNA, 19 nt, Homo sapiens
gcuguuuuguggauuuuug

SEQ ID NO: 805147 - RNA, 17 nt, Homo sapiens
gcuuaaaagaaacuaua

SEQ ID NO: 805148 - RNA, 23 nt, Homo sapiens
gcuuaaaauccaaagugucauau

SEQ ID NO: 805149 - RNA, 19 nt, Homo sapiens
gcuuaaacccauacaaugu

SEQ ID NO: 805150 - RNA, 22 nt, Homo sapiens
gcuuaauggaugggcagucauu

SEQ ID NO: 805151 - RNA, 11 nt, Homo sapiens
gcuuacaggaa

SEQ ID NO: 805152 - RNA, 18 nt, Homo sapiens
gcuuacauuuuuacaaua

SEQ ID NO: 805153 - RNA, 16 nt, Homo sapiens
gcuuaccaaaguauua

SEQ ID NO: 805154 - RNA, 19 nt, Homo sapiens
gcuuaccuaucuguggaaa

SEQ ID NO: 805155 - RNA, 18 nt, Homo sapiens
gcuuaccugaacaggaau

SEQ ID NO: 805156 - RNA, 22 nt, Homo sapiens
gcuuagaauugcuggaugcauu

SEQ ID NO: 805157 - RNA, 14 nt, Homo sapiens
gcuuagacagcagg

SEQ ID NO: 805158 - RNA, 15 nt, Homo sapiens
gcuuagagaggacaa

SEQ ID NO: 805159 - RNA, 14 nt, Homo sapiens
gcuuagcuugaggg

SEQ ID NO: 805160 - RNA, 18 nt, Homo sapiens
gcuuaggaugugugcaug

SEQ ID NO: 805161 - RNA, 19 nt, Homo sapiens
gcuuaguauuucucaggaa

SEQ ID NO: 805162 - RNA, 16 nt, Homo sapiens
gcuuagugcacaagca

SEQ ID NO: 805163 - RNA, 21 nt, Homo sapiens
gcuuauacacuuacacuuuau

SEQ ID NO: 805164 - RNA, 18 nt, Homo sapiens
gcuuauaucuggccucug

SEQ ID NO: 805165 - RNA, 22 nt, Homo sapiens
gcuuauggauucauauaggcca

SEQ ID NO: 805166 - RNA, 20 nt, Homo sapiens
gcuuauuuuuuucuacauaa

SEQ ID NO: 805167 - RNA, 13 nt, Homo sapiens
gcuucacaguacc

SEQ ID NO: 805168 - RNA, 13 nt, Homo sapiens
gcuucacauucau

SEQ ID NO: 805169 - RNA, 13 nt, Homo sapiens
gcuucacugacca

SEQ ID NO: 805170 - RNA, 14 nt, Homo sapiens
gcuucacugucauc

SEQ ID NO: 805171 - RNA, 12 nt, Homo sapiens
gcuucagaguuu

SEQ ID NO: 805172 - RNA, 13 nt, Homo sapiens
gcuucagccugag

SEQ ID NO: 805173 - RNA, 18 nt, Homo sapiens
gcuucagugacaaacaua

SEQ ID NO: 805174 - RNA, 16 nt, Homo sapiens
gcuucaguguuuugaa

SEQ ID NO: 805175 - RNA, 14 nt, Homo sapiens
gcuucaguugcaua

SEQ ID NO: 805176 - RNA, 19 nt, Homo sapiens
gcuucaguugcauaucuua

SEQ ID NO: 805177 - RNA, 21 nt, Homo sapiens
gcuucauaaaugaagcagcuu

SEQ ID NO: 805178 - RNA, 24 nt, Homo sapiens
gcuucaugugcugccugcaagcuu

SEQ ID NO: 805179 - RNA, 15 nt, Homo sapiens
gcuucauuguuacau

SEQ ID NO: 805180 - RNA, 14 nt, Homo sapiens
gcuuccacuucuau

SEQ ID NO: 805181 - RNA, 16 nt, Homo sapiens
gcuuccagaaaacccc

SEQ ID NO: 805182 - RNA, 13 nt, Homo sapiens
gcuuccaucugcc

SEQ ID NO: 805183 - RNA, 13 nt, Homo sapiens
gcuucccacuggg

SEQ ID NO: 805184 - RNA, 21 nt, Homo sapiens
gcuucccagcaccaacaugua

SEQ ID NO: 805185 - RNA, 23 nt, Homo sapiens
gcuucccggcgucccuaccuccu

SEQ ID NO: 805186 - RNA, 16 nt, Homo sapiens
gcuuccuucugugaaa

SEQ ID NO: 805187 - RNA, 12 nt, Homo sapiens
gcuucgcuggaa

SEQ ID NO: 805188 - RNA, 13 nt, Homo sapiens
gcuucgcuggaaa

SEQ ID NO: 805189 - RNA, 15 nt, Homo sapiens
gcuucuaccuggaaa

SEQ ID NO: 805190 - RNA, 17 nt, Homo sapiens
gcuucuagaguuuuaua

SEQ ID NO: 805191 - RNA, 18 nt, Homo sapiens
gcuucuauaauuuugccu

SEQ ID NO: 805192 - RNA, 19 nt, Homo sapiens
gcuucucaaaguacuggga

SEQ ID NO: 805193 - RNA, 20 nt, Homo sapiens
gcuucuccaauucugcccaa

SEQ ID NO: 805194 - RNA, 12 nt, Homo sapiens
gcuucuccuucu

SEQ ID NO: 805195 - RNA, 23 nt, Homo sapiens
gcuucuccuucuccuucccauuu

SEQ ID NO: 805196 - RNA, 20 nt, Homo sapiens
gcuucucuugcuaccuguga

SEQ ID NO: 805197 - RNA, 14 nt, Homo sapiens
gcuucugcacacaa

SEQ ID NO: 805198 - RNA, 16 nt, Homo sapiens
cacccccaccauccag

SEQ ID NO: 805199 - RNA, 14 nt, Homo sapiens
cacccccagcucaa

SEQ ID NO: 805200 - RNA, 23 nt, Homo sapiens
caccccccagaaccuguccuugc

SEQ ID NO: 805201 - RNA, 21 nt, Homo sapiens
caccccggggacccugugaca

SEQ ID NO: 805202 - RNA, 12 nt, Homo sapiens
caccccgugcca

SEQ ID NO: 805203 - RNA, 18 nt, Homo sapiens
caccccuacacugugaag

SEQ ID NO: 805204 - RNA, 18 nt, Homo sapiens
caccccucccugcuugca

SEQ ID NO: 805205 - RNA, 17 nt, Homo sapiens
caccccuuuucgucacg

SEQ ID NO: 805206 - RNA, 16 nt, Homo sapiens
cacccgacuccucaaa

SEQ ID NO: 805207 - RNA, 13 nt, Homo sapiens
cacccgugagaaa

SEQ ID NO: 805208 - RNA, 14 nt, Homo sapiens
cacccgugugcaca

SEQ ID NO: 805209 - RNA, 19 nt, Homo sapiens
cacccuccccucucuugca

SEQ ID NO: 805210 - RNA, 16 nt, Homo sapiens
cacccucuuccuguga

SEQ ID NO: 805211 - RNA, 16 nt, Homo sapiens
cacccugauccucacc

SEQ ID NO: 805212 - RNA, 16 nt, Homo sapiens
cacccugggaguuucc

SEQ ID NO: 805213 - RNA, 15 nt, Homo sapiens
cacccugggcuccac

SEQ ID NO: 805214 - RNA, 22 nt, Homo sapiens
cacccuggugugacucuaguga

SEQ ID NO: 805215 - RNA, 22 nt, Homo sapiens
cacccugguucccaccauuccc

SEQ ID NO: 805216 - RNA, 20 nt, Homo sapiens
cacccuguggcucacagugg

SEQ ID NO: 805217 - RNA, 12 nt, Homo sapiens
cacccuuucauu

SEQ ID NO: 805218 - RNA, 23 nt, Homo sapiens
cacccuuugugguuacaguuuga

SEQ ID NO: 805219 - RNA, 15 nt, Homo sapiens
caccgacaacaugcu

SEQ ID NO: 805220 - RNA, 21 nt, Homo sapiens
caccgcaggggacugucucag

SEQ ID NO: 805221 - RNA, 18 nt, Homo sapiens
caccgcugccagcacaga

SEQ ID NO: 805222 - RNA, 21 nt, Homo sapiens
caccgugaccccuguccccac

SEQ ID NO: 805223 - RNA, 18 nt, Homo sapiens
caccguggccuaccuggg

SEQ ID NO: 805224 - RNA, 12 nt, Homo sapiens
caccuaauccag

SEQ ID NO: 805225 - RNA, 14 nt, Homo sapiens
caccuacugcacuu

SEQ ID NO: 805226 - RNA, 15 nt, Homo sapiens
caccuacugcuuacu

SEQ ID NO: 805227 - RNA, 13 nt, Homo sapiens
caccuagacugua

SEQ ID NO: 805228 - RNA, 16 nt, Homo sapiens
caccuagacuguaaac

SEQ ID NO: 805229 - RNA, 24 nt, Homo sapiens
caccuauucuguaguugcagcuga

SEQ ID NO: 805230 - RNA, 20 nt, Homo sapiens
caccucacaggccccaggaa

SEQ ID NO: 805231 - RNA, 14 nt, Homo sapiens
cacuccuucucuca

SEQ ID NO: 805232 - RNA, 13 nt, Homo sapiens
cacucuacuacau

SEQ ID NO: 805233 - RNA, 17 nt, Homo sapiens
cacucugggcuguaacg

SEQ ID NO: 805234 - RNA, 18 nt, Homo sapiens
cacucuguaguuacugug

SEQ ID NO: 805235 - RNA, 22 nt, Homo sapiens
cacucuuaucuacauaaggaug

SEQ ID NO: 805236 - RNA, 23 nt, Homo sapiens
cacucuuauucccaaacuacaga

SEQ ID NO: 805237 - RNA, 16 nt, Homo sapiens
cacucuugauucuaca

SEQ ID NO: 805238 - RNA, 14 nt, Homo sapiens
cacugaaaauguca

SEQ ID NO: 805239 - RNA, 22 nt, Homo sapiens
cacugaaaaugucacauucuau

SEQ ID NO: 805240 - RNA, 23 nt, Homo sapiens
cacugaagaagucacugaacaaa

SEQ ID NO: 805241 - RNA, 13 nt, Homo sapiens
cacugaagcacca

SEQ ID NO: 805242 - RNA, 17 nt, Homo sapiens
cacugaagcaccacagg

SEQ ID NO: 805243 - RNA, 20 nt, Homo sapiens
cacugaaucuccccuccuca

SEQ ID NO: 805244 - RNA, 20 nt, Homo sapiens
cacugaauuuuguguguacc

SEQ ID NO: 805245 - RNA, 15 nt, Homo sapiens
cacugacaguuaaua

SEQ ID NO: 805246 - RNA, 22 nt, Homo sapiens
cacugagaagucaaacauuuca

SEQ ID NO: 805247 - RNA, 21 nt, Homo sapiens
cacugagcccuucccaggcug

SEQ ID NO: 805248 - RNA, 13 nt, Homo sapiens
cacugagggccac

SEQ ID NO: 805249 - RNA, 18 nt, Homo sapiens
cacugaggguggcacuca

SEQ ID NO: 805250 - RNA, 22 nt, Homo sapiens
cacugaucugcuagugcuguaa

SEQ ID NO: 805251 - RNA, 20 nt, Homo sapiens
cacugaugaguuucacugua

SEQ ID NO: 805252 - RNA, 22 nt, Homo sapiens
cacugauggaaaauaccagugu

SEQ ID NO: 805253 - RNA, 21 nt, Homo sapiens
cacugcaaauaaacuugguag

SEQ ID NO: 805254 - RNA, 18 nt, Homo sapiens
cacugcaauccugucuuu

SEQ ID NO: 805255 - RNA, 18 nt, Homo sapiens
cacugcacacagugacuu

SEQ ID NO: 805256 - RNA, 14 nt, Homo sapiens
cacugcacugucug

SEQ ID NO: 805257 - RNA, 13 nt, Homo sapiens
cacugcauacaau

SEQ ID NO: 805258 - RNA, 21 nt, Homo sapiens
cacugccagggguucuugagc

SEQ ID NO: 805259 - RNA, 23 nt, Homo sapiens
cacugccuaggaggcuggccaag

SEQ ID NO: 805260 - RNA, 22 nt, Homo sapiens
cacugccucucccuggcccuca

SEQ ID NO: 805261 - RNA, 16 nt, Homo sapiens
cacugcgggacagagg

SEQ ID NO: 805262 - RNA, 22 nt, Homo sapiens
cacugcugcuucauguuugccu

SEQ ID NO: 805263 - RNA, 11 nt, Homo sapiens
cacugcuguag

SEQ ID NO: 805264 - RNA, 20 nt, Homo sapiens
cacugcuuuaaacugcauuu

SEQ ID NO: 805265 - RNA, 22 nt, Homo sapiens
cacuggauugacuuugcuguca

SEQ ID NO: 805266 - RNA, 18 nt, Homo sapiens
cacuggcaucucacuuua

SEQ ID NO: 805267 - RNA, 20 nt, Homo sapiens
cacuggcaucucacuuuaug

SEQ ID NO: 805268 - RNA, 16 nt, Homo sapiens
cacuggccauucuuau

SEQ ID NO: 805269 - RNA, 17 nt, Homo sapiens
cacuggcguuacugcuu

SEQ ID NO: 805270 - RNA, 14 nt, Homo sapiens
cacuggcucuccaa

SEQ ID NO: 805271 - RNA, 13 nt, Homo sapiens
cacuggcuugaag

SEQ ID NO: 805272 - RNA, 17 nt, Homo sapiens
cacugggaggagucuau

SEQ ID NO: 805273 - RNA, 17 nt, Homo sapiens
cacugggucucacuccu

SEQ ID NO: 805274 - RNA, 21 nt, Homo sapiens
cacugggugagagaggaauaa

SEQ ID NO: 805275 - RNA, 20 nt, Homo sapiens
cacuggguuacagaaucaca

SEQ ID NO: 805276 - RNA, 22 nt, Homo sapiens
cacugguccccucuuuucccuu

SEQ ID NO: 805277 - RNA, 18 nt, Homo sapiens
cacuggucuaauguuugu

SEQ ID NO: 805278 - RNA, 13 nt, Homo sapiens
cacuggucuguag

SEQ ID NO: 805279 - RNA, 11 nt, Homo sapiens
cacuguacuua

SEQ ID NO: 805280 - RNA, 15 nt, Homo sapiens
cacuguauuccuguc

SEQ ID NO: 805281 - RNA, 22 nt, Homo sapiens
cacugucugagaauuuccaaaa

SEQ ID NO: 805282 - RNA, 18 nt, Homo sapiens
cacugucuugccagauua

SEQ ID NO: 805283 - RNA, 12 nt, Homo sapiens
cacugugcccag

SEQ ID NO: 805284 - RNA, 23 nt, Homo sapiens
cacuguggagacuuucuguuacu

SEQ ID NO: 805285 - RNA, 21 nt, Homo sapiens
cacuguggcauugucuguaau

SEQ ID NO: 805286 - RNA, 22 nt, Homo sapiens
cacugugucacccagacuggaa

SEQ ID NO: 805287 - RNA, 14 nt, Homo sapiens
cacuguucaucuca

SEQ ID NO: 805288 - RNA, 17 nt, Homo sapiens
cacuuaagacuguguau

SEQ ID NO: 805289 - RNA, 13 nt, Homo sapiens
cacuuacagaauu

SEQ ID NO: 805290 - RNA, 20 nt, Homo sapiens
cacuuacugacuuugcauuu

SEQ ID NO: 805291 - RNA, 16 nt, Homo sapiens
cacuuagcccaagagg

SEQ ID NO: 805292 - RNA, 18 nt, Homo sapiens
cacuuaucagcaugaaga

SEQ ID NO: 805293 - RNA, 21 nt, Homo sapiens
cacuuccaccagccugcacua

SEQ ID NO: 805294 - RNA, 22 nt, Homo sapiens
cacuucgcgugcccucgcugcu

SEQ ID NO: 805295 - RNA, 13 nt, Homo sapiens
cacuugaagcacu

SEQ ID NO: 805296 - RNA, 19 nt, Homo sapiens
cacuugaaggaagaagucu

SEQ ID NO: 805297 - RNA, 18 nt, Homo sapiens
cacuugaauccauugaaa

SEQ ID NO: 805298 - RNA, 18 nt, Homo sapiens
cacuugaaugugucacua

SEQ ID NO: 805299 - RNA, 15 nt, Homo sapiens
cacuugaugauacaa

SEQ ID NO: 805300 - RNA, 20 nt, Homo sapiens
cacuugccuucuucacccag

SEQ ID NO: 805301 - RNA, 16 nt, Homo sapiens
cacuuggaugcagggu

SEQ ID NO: 805302 - RNA, 19 nt, Homo sapiens
cacuugggucuucccugua

SEQ ID NO: 805303 - RNA, 16 nt, Homo sapiens
cacuugucaaagaagg

SEQ ID NO: 805304 - RNA, 22 nt, Homo sapiens
cacuugucaaagaaggugcuga

SEQ ID NO: 805305 - RNA, 15 nt, Homo sapiens
cacuugugacuuuug

SEQ ID NO: 805306 - RNA, 22 nt, Homo sapiens
cacuuguucuguacuuguaaaa

SEQ ID NO: 805307 - RNA, 22 nt, Homo sapiens
cacuuguuguugaacauggcua

SEQ ID NO: 805308 - RNA, 15 nt, Homo sapiens
cacuuuaaaccuguu

SEQ ID NO: 805309 - RNA, 14 nt, Homo sapiens
cacuuucugcacuu

SEQ ID NO: 805310 - RNA, 20 nt, Homo sapiens
cacuuugaaggggccucacc

SEQ ID NO: 805311 - RNA, 19 nt, Homo sapiens
cacuuuggacuucucugaa

SEQ ID NO: 805312 - RNA, 19 nt, Homo sapiens
cacuuugggaggccgaggu

SEQ ID NO: 805313 - RNA, 19 nt, Homo sapiens
cacaguacacaccagaaga

SEQ ID NO: 805314 - RNA, 11 nt, Homo sapiens
cacaguacuuu

SEQ ID NO: 805315 - RNA, 17 nt, Homo sapiens
cacaguacuuuauugua

SEQ ID NO: 805316 - RNA, 15 nt, Homo sapiens
cacagucaguggagc

SEQ ID NO: 805317 - RNA, 22 nt, Homo sapiens
cacaguccaaccagaaacaccc

SEQ ID NO: 805318 - RNA, 22 nt, Homo sapiens
cacagucucuuuaaucuucagu

SEQ ID NO: 805319 - RNA, 15 nt, Homo sapiens
cacagucuuggcuca

SEQ ID NO: 805320 - RNA, 13 nt, Homo sapiens
cacagugcccaag

SEQ ID NO: 805321 - RNA, 13 nt, Homo sapiens
cacagugucacug

SEQ ID NO: 805322 - RNA, 19 nt, Homo sapiens
cacagugugugacuuacag

SEQ ID NO: 805323 - RNA, 13 nt, Homo sapiens
cacaguguuuuaa

SEQ ID NO: 805324 - RNA, 16 nt, Homo sapiens
cacaguuaucaaaaag

SEQ ID NO: 805325 - RNA, 22 nt, Homo sapiens
cacauaaccucucugugccauc

SEQ ID NO: 805326 - RNA, 20 nt, Homo sapiens
cacauacgugagggggagcu

SEQ ID NO: 805327 - RNA, 15 nt, Homo sapiens
cacauacgugcacag

SEQ ID NO: 805328 - RNA, 19 nt, Homo sapiens
cacauagauuaauggcacu

SEQ ID NO: 805329 - RNA, 20 nt, Homo sapiens
cacauagcaggggcaccuuc

SEQ ID NO: 805330 - RNA, 22 nt, Homo sapiens
cacauaguuaaaaaagaaacaa

SEQ ID NO: 805331 - RNA, 13 nt, Homo sapiens
cacauaugcaccu

SEQ ID NO: 805332 - RNA, 18 nt, Homo sapiens
cacauauggacucugcac

SEQ ID NO: 805333 - RNA, 21 nt, Homo sapiens
cacaucaauuacaagcuguag

SEQ ID NO: 805334 - RNA, 18 nt, Homo sapiens
cacauccagccuuggaau

SEQ ID NO: 805335 - RNA, 18 nt, Homo sapiens
cacauccccagaauccau

SEQ ID NO: 805336 - RNA, 15 nt, Homo sapiens
cacaucuuuccucaa

SEQ ID NO: 805337 - RNA, 16 nt, Homo sapiens
cacaugaauauaaaug

SEQ ID NO: 805338 - RNA, 23 nt, Homo sapiens
cacaugaaucccacccacaugug

SEQ ID NO: 805339 - RNA, 15 nt, Homo sapiens
cacaugaugugcaua

SEQ ID NO: 805340 - RNA, 23 nt, Homo sapiens
cacaugcacacacacacaucuca

SEQ ID NO: 805341 - RNA, 17 nt, Homo sapiens
cacaugcccaugaugag

SEQ ID NO: 805342 - RNA, 16 nt, Homo sapiens
cacaugccuugcaaug

SEQ ID NO: 805343 - RNA, 22 nt, Homo sapiens
cacaugccuuuuaaaaguucuu

SEQ ID NO: 805344 - RNA, 17 nt, Homo sapiens
cacauggaaggugaugg

SEQ ID NO: 805345 - RNA, 20 nt, Homo sapiens
cacauggaaucaaucuuuaa

SEQ ID NO: 805346 - RNA, 21 nt, Homo sapiens
cacauggccuaugcacauaug

SEQ ID NO: 805347 - RNA, 14 nt, Homo sapiens
gauuuuaccaaagc

SEQ ID NO: 805348 - RNA, 14 nt, Homo sapiens
gauuuuaugcugcu

SEQ ID NO: 805349 - RNA, 22 nt, Homo sapiens
gauuuucaugauucaugagcug

SEQ ID NO: 805350 - RNA, 15 nt, Homo sapiens
gauuuucuauuuaug

SEQ ID NO: 805351 - RNA, 22 nt, Homo sapiens
gauuuugaaauauaguaaacac

SEQ ID NO: 805352 - RNA, 20 nt, Homo sapiens
gauuuugaaauuuuuauuaa

SEQ ID NO: 805353 - RNA, 18 nt, Homo sapiens
gauuuugaagagauuuua

SEQ ID NO: 805354 - RNA, 21 nt, Homo sapiens
gauuuuuagccccaaaucucu

SEQ ID NO: 805355 - RNA, 17 nt, Homo sapiens
gauuuuuagcuuuacaa

SEQ ID NO: 805356 - RNA, 20 nt, Homo sapiens
gauuuuuuaaauugucauaa

SEQ ID NO: 805357 - RNA, 17 nt, Homo sapiens
gauuuuuuccucugcau

SEQ ID NO: 805358 - RNA, 13 nt, Homo sapiens
gcaaaaaaagccu

SEQ ID NO: 805359 - RNA, 20 nt, Homo sapiens
gcaaaaaaauuaaauuauuu

SEQ ID NO: 805360 - RNA, 11 nt, Homo sapiens
gcaaaaaucuc

SEQ ID NO: 805361 - RNA, 13 nt, Homo sapiens
gcaaaaccaaaga

SEQ ID NO: 805362 - RNA, 16 nt, Homo sapiens
gcaaaaccucauuuaa

SEQ ID NO: 805363 - RNA, 16 nt, Homo sapiens
gcaaaacuccaucuca

SEQ ID NO: 805364 - RNA, 21 nt, Homo sapiens
gcaaaacucuacuuaauccaa

SEQ ID NO: 805365 - RNA, 14 nt, Homo sapiens
gcaaaacuuuggca

SEQ ID NO: 805366 - RNA, 16 nt, Homo sapiens
gcaaaagaaagaacca

SEQ ID NO: 805367 - RNA, 17 nt, Homo sapiens
gcaaaauauuugacuau

SEQ ID NO: 805368 - RNA, 20 nt, Homo sapiens
gcaaaaucuuguuaauguca

SEQ ID NO: 805369 - RNA, 20 nt, Homo sapiens
gcaaaaugaaaaugucaaua

SEQ ID NO: 805370 - RNA, 19 nt, Homo sapiens
gcaaaauuuuuuuaaucuu

SEQ ID NO: 805371 - RNA, 14 nt, Homo sapiens
gcaaaccauuuuua

SEQ ID NO: 805372 - RNA, 23 nt, Homo sapiens
gcaaacccaaaaccucaugacag

SEQ ID NO: 805373 - RNA, 17 nt, Homo sapiens
gcaaacuuuguauuaau

SEQ ID NO: 805374 - RNA, 14 nt, Homo sapiens
gcaaagaugcauuu

SEQ ID NO: 805375 - RNA, 18 nt, Homo sapiens
gcaaagaugcauuuucac

SEQ ID NO: 805376 - RNA, 21 nt, Homo sapiens
gcaaagcgugucccauagaaa

SEQ ID NO: 805377 - RNA, 17 nt, Homo sapiens
gcaaaggaaaaauugau

SEQ ID NO: 805378 - RNA, 13 nt, Homo sapiens
gcaaagugcugua

SEQ ID NO: 805379 - RNA, 13 nt, Homo sapiens
gcaaauacaauca

SEQ ID NO: 805380 - RNA, 21 nt, Homo sapiens
gcaaauacaaucagcccagug

SEQ ID NO: 805381 - RNA, 13 nt, Homo sapiens
gcaaauacuguau

SEQ ID NO: 805382 - RNA, 14 nt, Homo sapiens
gcaaaugaguauuu

SEQ ID NO: 805383 - RNA, 13 nt, Homo sapiens
gcaaaugcaaaaa

SEQ ID NO: 805384 - RNA, 14 nt, Homo sapiens
gcaaaugcuguauu

SEQ ID NO: 805385 - RNA, 16 nt, Homo sapiens
gcaaauuaacuaauuu

SEQ ID NO: 805386 - RNA, 16 nt, Homo sapiens
gcaaauuaguugguuu

SEQ ID NO: 805387 - RNA, 19 nt, Homo sapiens
gcaaauuaguugguuugug

SEQ ID NO: 805388 - RNA, 18 nt, Homo sapiens
gcaacaagaccaccacuu

SEQ ID NO: 805389 - RNA, 22 nt, Homo sapiens
gcaacaagaccaccacuucgaa

SEQ ID NO: 805390 - RNA, 17 nt, Homo sapiens
gcaacaauaaaguacuu

SEQ ID NO: 805391 - RNA, 13 nt, Homo sapiens
gcaacaaugacuu

SEQ ID NO: 805392 - RNA, 17 nt, Homo sapiens
gcaacaauuuaugaauu

SEQ ID NO: 805393 - RNA, 15 nt, Homo sapiens
gcaacacagccacua

SEQ ID NO: 805394 - RNA, 14 nt, Homo sapiens
gcaacacagugaga

SEQ ID NO: 805395 - RNA, 12 nt, Homo sapiens
gcaacagacugu

SEQ ID NO: 805396 - RNA, 14 nt, Homo sapiens
gcaacagacuugaa

SEQ ID NO: 805397 - RNA, 15 nt, Homo sapiens
gcaacagagcaagac

SEQ ID NO: 805398 - RNA, 17 nt, Homo sapiens
gcaacagccaaguggaa

SEQ ID NO: 805399 - RNA, 20 nt, Homo sapiens
gcaaccagaggaaacuugca

SEQ ID NO: 805400 - RNA, 18 nt, Homo sapiens
gcaacccagucacacugu

SEQ ID NO: 805401 - RNA, 18 nt, Homo sapiens
gcaaccucugccucccag

SEQ ID NO: 805402 - RNA, 16 nt, Homo sapiens
gcaaccucuuugcuca

SEQ ID NO: 805403 - RNA, 23 nt, Homo sapiens
gcaacguaagauguccuccuuga

SEQ ID NO: 805404 - RNA, 14 nt, Homo sapiens
gcaacucuguaaau

SEQ ID NO: 805405 - RNA, 23 nt, Homo sapiens
gcaacugggucugacaugaacac

SEQ ID NO: 805406 - RNA, 12 nt, Homo sapiens
auuccuuuauga

SEQ ID NO: 805407 - RNA, 23 nt, Homo sapiens
auucgaaugacgguaaguguucu

SEQ ID NO: 805408 - RNA, 21 nt, Homo sapiens
auucgcccuccucccugucau

SEQ ID NO: 805409 - RNA, 21 nt, Homo sapiens
auucgcugcaaccuguugaua

SEQ ID NO: 805410 - RNA, 14 nt, Homo sapiens
auucggaccaagca

SEQ ID NO: 805411 - RNA, 17 nt, Homo sapiens
auucgugacaacaugcg

SEQ ID NO: 805412 - RNA, 20 nt, Homo sapiens
auucgugcauuuuuggauca

SEQ ID NO: 805413 - RNA, 19 nt, Homo sapiens
auucgugguaucugugaac

SEQ ID NO: 805414 - RNA, 20 nt, Homo sapiens
auucuaaauccgacuugaau

SEQ ID NO: 805415 - RNA, 13 nt, Homo sapiens
auucuaggcaucc

SEQ ID NO: 805416 - RNA, 20 nt, Homo sapiens
auucuagugaaugaaucuca

SEQ ID NO: 805417 - RNA, 17 nt, Homo sapiens
auucuaguuucucucaa

SEQ ID NO: 805418 - RNA, 14 nt, Homo sapiens
auucuauaaauuca

SEQ ID NO: 805419 - RNA, 20 nt, Homo sapiens
auucuaugccuguauuucca

SEQ ID NO: 805420 - RNA, 17 nt, Homo sapiens
auucucaaaaacaaaga

SEQ ID NO: 805421 - RNA, 15 nt, Homo sapiens
auucucacccuguga

SEQ ID NO: 805422 - RNA, 16 nt, Homo sapiens
auucucaucaguccau

SEQ ID NO: 805423 - RNA, 19 nt, Homo sapiens
auucucaucaguccauugc

SEQ ID NO: 805424 - RNA, 13 nt, Homo sapiens
auucuccaguauu

SEQ ID NO: 805425 - RNA, 16 nt, Homo sapiens
auucucggcucagguu

SEQ ID NO: 805426 - RNA, 22 nt, Homo sapiens
auucucguauccaacccaagga

SEQ ID NO: 805427 - RNA, 21 nt, Homo sapiens
auucucucacaguguacucua

SEQ ID NO: 805428 - RNA, 16 nt, Homo sapiens
auucucucuccuguac

SEQ ID NO: 805429 - RNA, 13 nt, Homo sapiens
auucucugaguca

SEQ ID NO: 805430 - RNA, 21 nt, Homo sapiens
auucucuggcuguaaggcucu

SEQ ID NO: 805431 - RNA, 22 nt, Homo sapiens
auucucuguaaguguagcucaa

SEQ ID NO: 805432 - RNA, 22 nt, Homo sapiens
auucucugugguauccaagaau

SEQ ID NO: 805433 - RNA, 16 nt, Homo sapiens
auucucuucacagugc

SEQ ID NO: 805434 - RNA, 16 nt, Homo sapiens
auucucuucacuccca

SEQ ID NO: 805435 - RNA, 18 nt, Homo sapiens
auucucuucgcugugaug

SEQ ID NO: 805436 - RNA, 17 nt, Homo sapiens
auucugauaaugcucac

SEQ ID NO: 805437 - RNA, 17 nt, Homo sapiens
auucugauguccauuug

SEQ ID NO: 805438 - RNA, 21 nt, Homo sapiens
auucugauguuucugugaaau

SEQ ID NO: 805439 - RNA, 23 nt, Homo sapiens
auucugauucuuuuuuaugcaga

SEQ ID NO: 805440 - RNA, 19 nt, Homo sapiens
auucugauuuuacauguaa

SEQ ID NO: 805441 - RNA, 21 nt, Homo sapiens
auucugccgcccccuccugaa

SEQ ID NO: 805442 - RNA, 17 nt, Homo sapiens
auucugccgugugcccu

SEQ ID NO: 805443 - RNA, 20 nt, Homo sapiens
auucugcuaccucacugggg

SEQ ID NO: 805444 - RNA, 17 nt, Homo sapiens
auucuggaaaagcaaaa

SEQ ID NO: 805445 - RNA, 20 nt, Homo sapiens
auucuggcccagccaaucua

SEQ ID NO: 805446 - RNA, 18 nt, Homo sapiens
auucugguuuugacauca

SEQ ID NO: 805447 - RNA, 14 nt, Homo sapiens
auucugugacauuu

SEQ ID NO: 805448 - RNA, 17 nt, Homo sapiens
auucuuacauuuuacuu

SEQ ID NO: 805449 - RNA, 22 nt, Homo sapiens
auucuuaguuguucaguugcca

SEQ ID NO: 805450 - RNA, 16 nt, Homo sapiens
auuaagguuaugcacu

SEQ ID NO: 805451 - RNA, 14 nt, Homo sapiens
auuaagugacuaua

SEQ ID NO: 805452 - RNA, 22 nt, Homo sapiens
auuaagugacuauagaaugcaa

SEQ ID NO: 805453 - RNA, 13 nt, Homo sapiens
auuaaguuaucuu

SEQ ID NO: 805454 - RNA, 20 nt, Homo sapiens
auuaauaaagauggcacuuu

SEQ ID NO: 805455 - RNA, 14 nt, Homo sapiens
auuaauaaagcauu

SEQ ID NO: 805456 - RNA, 21 nt, Homo sapiens
auuaauaaagcauucuuuaac

SEQ ID NO: 805457 - RNA, 19 nt, Homo sapiens
auuaauacucugcagugau

SEQ ID NO: 805458 - RNA, 17 nt, Homo sapiens
auuaaucaucuauaaag

SEQ ID NO: 805459 - RNA, 13 nt, Homo sapiens
auuaauccaaagc

SEQ ID NO: 805460 - RNA, 12 nt, Homo sapiens
auuaaugaacau

SEQ ID NO: 805461 - RNA, 22 nt, Homo sapiens
auuaaugacaaaggcacugagg

SEQ ID NO: 805462 - RNA, 12 nt, Homo sapiens
auuaaugaugau

SEQ ID NO: 805463 - RNA, 14 nt, Homo sapiens
auuaauguuuucaa

SEQ ID NO: 805464 - RNA, 16 nt, Homo sapiens
auuaauuaauauucau

SEQ ID NO: 805465 - RNA, 15 nt, Homo sapiens
auuaauuacugugug

SEQ ID NO: 805466 - RNA, 17 nt, Homo sapiens
auuaauugucauuauuu

SEQ ID NO: 805467 - RNA, 19 nt, Homo sapiens
auuaauuguuuugcacuuu

SEQ ID NO: 805468 - RNA, 14 nt, Homo sapiens
auuaauuucagucu

SEQ ID NO: 805469 - RNA, 23 nt, Homo sapiens
auuaauuuggagcacaaaauuca

SEQ ID NO: 805470 - RNA, 22 nt, Homo sapiens
auuaauuuuuaaggauguugcc

SEQ ID NO: 805471 - RNA, 15 nt, Homo sapiens
auuacaaaacucaga

SEQ ID NO: 805472 - RNA, 22 nt, Homo sapiens
auuacaagcuguagaccaccua

SEQ ID NO: 805473 - RNA, 14 nt, Homo sapiens
auuacaauugucau

SEQ ID NO: 805474 - RNA, 16 nt, Homo sapiens
auuacaggcacccacc

SEQ ID NO: 805475 - RNA, 23 nt, Homo sapiens
auuacaguauccaaugucuuuug

SEQ ID NO: 805476 - RNA, 21 nt, Homo sapiens
auuacaguguccuaccacucu

SEQ ID NO: 805477 - RNA, 15 nt, Homo sapiens
auuaccuccauccau

SEQ ID NO: 805478 - RNA, 15 nt, Homo sapiens
auuacuagaagauga

SEQ ID NO: 805479 - RNA, 14 nt, Homo sapiens
auuacuauaugcaa

SEQ ID NO: 805480 - RNA, 13 nt, Homo sapiens
auuacuaucauaa

SEQ ID NO: 805481 - RNA, 23 nt, Homo sapiens
auuacuaucauaauucagcacuu

SEQ ID NO: 805482 - RNA, 15 nt, Homo sapiens
auuacuaucauggca

SEQ ID NO: 805483 - RNA, 20 nt, Homo sapiens
auuacuauugcaaaagggaa

SEQ ID NO: 805484 - RNA, 13 nt, Homo sapiens
auuacugucuuua

SEQ ID NO: 805485 - RNA, 19 nt, Homo sapiens
auuacuguugcauuuacuu

SEQ ID NO: 805486 - RNA, 21 nt, Homo sapiens
auuacuguugcauuuacuuuu

SEQ ID NO: 805487 - RNA, 16 nt, Homo sapiens
auuacuuguguuacuu

SEQ ID NO: 805488 - RNA, 22 nt, Homo sapiens
auuagacagaacaccuaugcaa

SEQ ID NO: 805489 - RNA, 13 nt, Homo sapiens
auuagagaagcug

SEQ ID NO: 805490 - RNA, 18 nt, Homo sapiens
auuagaucaauuacuuau

SEQ ID NO: 805491 - RNA, 15 nt, Homo sapiens
auuagaugcacuuaa

SEQ ID NO: 805492 - RNA, 19 nt, Homo sapiens
auuagauugcaaagcaaug

SEQ ID NO: 805493 - RNA, 23 nt, Homo sapiens
auuagauuucuauaggauuuuuc

SEQ ID NO: 805494 - RNA, 22 nt, Homo sapiens
auuagcaaguuacagugaugcu

SEQ ID NO: 805495 - RNA, 23 nt, Homo sapiens
auuagcauggccccaguccaugc

SEQ ID NO: 805496 - RNA, 16 nt, Homo sapiens
auuagcccaacuagaa

SEQ ID NO: 805497 - RNA, 17 nt, Homo sapiens
auuagccgggcauggug

SEQ ID NO: 805498 - RNA, 20 nt, Homo sapiens
auuagccgggcaugguggca

SEQ ID NO: 805499 - RNA, 18 nt, Homo sapiens
auuagcucacugaaucuu

SEQ ID NO: 805500 - RNA, 19 nt, Homo sapiens
auuagcugaguguagugac

SEQ ID NO: 805501 - RNA, 10 nt, Homo sapiens
auuagcugug

SEQ ID NO: 805502 - RNA, 19 nt, Homo sapiens
auuagcuuugggugccuuu

SEQ ID NO: 805503 - RNA, 15 nt, Homo sapiens
auuagcuuuuucuca

SEQ ID NO: 805504 - RNA, 15 nt, Homo sapiens
auuaggaaaauauaa

SEQ ID NO: 805505 - RNA, 15 nt, Homo sapiens
auuaggaaguguaac

SEQ ID NO: 805506 - RNA, 20 nt, Homo sapiens
auuaggaccugguucuggac

SEQ ID NO: 805507 - RNA, 15 nt, Homo sapiens
auuagguagacuuug

SEQ ID NO: 805508 - RNA, 20 nt, Homo sapiens
auuagguauaucucccagug

SEQ ID NO: 805509 - RNA, 18 nt, Homo sapiens
auuaggucccucacucca

SEQ ID NO: 805510 - RNA, 13 nt, Homo sapiens
auuaggugcaauu

SEQ ID NO: 805511 - RNA, 18 nt, Homo sapiens
auuaguaaaagugcuuuc

SEQ ID NO: 805512 - RNA, 13 nt, Homo sapiens
auuaguugcacua

SEQ ID NO: 805513 - RNA, 15 nt, Homo sapiens
auuauaaaggccagc

SEQ ID NO: 805514 - RNA, 14 nt, Homo sapiens
auuauaacuguaaa

SEQ ID NO: 805515 - RNA, 23 nt, Homo sapiens
auuauaagggagagcugagccag

SEQ ID NO: 805516 - RNA, 24 nt, Homo sapiens
auuauacgcuggcaacacagaggc

SEQ ID NO: 805517 - RNA, 21 nt, Homo sapiens
auuauauaaaauacauaauau

SEQ ID NO: 805518 - RNA, 19 nt, Homo sapiens
auuauauaaaucauuucaa

SEQ ID NO: 805519 - RNA, 16 nt, Homo sapiens
gaggugaucuagcaga

SEQ ID NO: 805520 - RNA, 21 nt, Homo sapiens
gaggugcagcuggaggcugcu

SEQ ID NO: 805521 - RNA, 18 nt, Homo sapiens
gaggugcgcucaccucag

SEQ ID NO: 805522 - RNA, 20 nt, Homo sapiens
gagguggagauugcagugag

SEQ ID NO: 805523 - RNA, 18 nt, Homo sapiens
gagguggagguugcagug

SEQ ID NO: 805524 - RNA, 20 nt, Homo sapiens
gagguggagguugcagugag

SEQ ID NO: 805525 - RNA, 20 nt, Homo sapiens
gaggugggaggauugcuuga

SEQ ID NO: 805526 - RNA, 15 nt, Homo sapiens
gaggugggauccucc

SEQ ID NO: 805527 - RNA, 20 nt, Homo sapiens
gagguggggcuggaugucuc

SEQ ID NO: 805528 - RNA, 21 nt, Homo sapiens
gagguggguggaucaccugag

SEQ ID NO: 805529 - RNA, 14 nt, Homo sapiens
gagguuaaggcaua

SEQ ID NO: 805530 - RNA, 23 nt, Homo sapiens
gagguuaucugucugcauuuuaa

SEQ ID NO: 805531 - RNA, 14 nt, Homo sapiens
gagguugaagccaa

SEQ ID NO: 805532 - RNA, 15 nt, Homo sapiens
gagguugaagccaag

SEQ ID NO: 805533 - RNA, 14 nt, Homo sapiens
gagguugcagggag

SEQ ID NO: 805534 - RNA, 13 nt, Homo sapiens
gagguugcaguga

SEQ ID NO: 805535 - RNA, 18 nt, Homo sapiens
gagguugcagugagccau

SEQ ID NO: 805536 - RNA, 17 nt, Homo sapiens
gagguugcagugagcug

SEQ ID NO: 805537 - RNA, 16 nt, Homo sapiens
gagguugggcuuccau

SEQ ID NO: 805538 - RNA, 19 nt, Homo sapiens
gaguaaauauauaugucaa

SEQ ID NO: 805539 - RNA, 19 nt, Homo sapiens
gaguaacauuugcuguuuu

SEQ ID NO: 805540 - RNA, 15 nt, Homo sapiens
gaguaagcaguguua

SEQ ID NO: 805541 - RNA, 17 nt, Homo sapiens
gaguacaaggucaucau

SEQ ID NO: 805542 - RNA, 20 nt, Homo sapiens
gaguaccuacugugugccag

SEQ ID NO: 805543 - RNA, 15 nt, Homo sapiens
gaguaccugcaaaaa

SEQ ID NO: 805544 - RNA, 13 nt, Homo sapiens
gaguaccuggacc

SEQ ID NO: 805545 - RNA, 16 nt, Homo sapiens
gaguagggaguucauc

SEQ ID NO: 805546 - RNA, 14 nt, Homo sapiens
gaguauccuaccca

SEQ ID NO: 805547 - RNA, 22 nt, Homo sapiens
gaguauuccaugagcugcucau

SEQ ID NO: 805548 - RNA, 14 nt, Homo sapiens
gagucacugauaca

SEQ ID NO: 805549 - RNA, 15 nt, Homo sapiens
gagucacugccaagu

SEQ ID NO: 805550 - RNA, 19 nt, Homo sapiens
gagucacugccaagucaua

SEQ ID NO: 805551 - RNA, 16 nt, Homo sapiens
gaguccaacaauguug

SEQ ID NO: 805552 - RNA, 15 nt, Homo sapiens
gaguccaagaaucca

SEQ ID NO: 805553 - RNA, 14 nt, Homo sapiens
gagucccagagcuc

SEQ ID NO: 805554 - RNA, 18 nt, Homo sapiens
gagucgggagcacagcug

SEQ ID NO: 805555 - RNA, 16 nt, Homo sapiens
gagucucucacugucg

SEQ ID NO: 805556 - RNA, 17 nt, Homo sapiens
gagucucuucuccacug

SEQ ID NO: 805557 - RNA, 18 nt, Homo sapiens
gagucucuucuccacugg

SEQ ID NO: 805558 - RNA, 23 nt, Homo sapiens
gagucugccccacauguggccau

SEQ ID NO: 805559 - RNA, 21 nt, Homo sapiens
gagucugugcaguuucugaca

SEQ ID NO: 805560 - RNA, 14 nt, Homo sapiens
gagucugugcucuu

SEQ ID NO: 805561 - RNA, 20 nt, Homo sapiens
gagucuugcucuguugccca

SEQ ID NO: 805562 - RNA, 23 nt, Homo sapiens
gagugaaggugcuggaaagggag

SEQ ID NO: 805563 - RNA, 17 nt, Homo sapiens
gagugaauuugaccuag

SEQ ID NO: 805564 - RNA, 14 nt, Homo sapiens
gagugacagucaua

SEQ ID NO: 805565 - RNA, 13 nt, Homo sapiens
gagugagacucca

SEQ ID NO: 805566 - RNA, 19 nt, Homo sapiens
gagugagacuccaucucaa

SEQ ID NO: 805567 - RNA, 15 nt, Homo sapiens
gagugcagugagcua

SEQ ID NO: 805568 - RNA, 11 nt, Homo sapiens
gagugcagugc

SEQ ID NO: 805569 - RNA, 19 nt, Homo sapiens
gagugcauugugaggguua

SEQ ID NO: 805570 - RNA, 14 nt, Homo sapiens
gagugcucuugcua

SEQ ID NO: 805571 - RNA, 22 nt, Homo sapiens
gaguggcccaagacucccagau

SEQ ID NO: 805572 - RNA, 11 nt, Homo sapiens
gaguggcugca

SEQ ID NO: 805573 - RNA, 16 nt, Homo sapiens
gaguguaguuuacaga

SEQ ID NO: 805574 - RNA, 21 nt, Homo sapiens
gagugucaugaagugcacagg

SEQ ID NO: 805575 - RNA, 13 nt, Homo sapiens
uuaagcagcucac

SEQ ID NO: 805576 - RNA, 18 nt, Homo sapiens
uuaagcauuuugaaacaa

SEQ ID NO: 805577 - RNA, 19 nt, Homo sapiens
uuaagcuauccacagcuua

SEQ ID NO: 805578 - RNA, 18 nt, Homo sapiens
uuaaggcucugugccuug

SEQ ID NO: 805579 - RNA, 13 nt, Homo sapiens
uuaagggggaaaa

SEQ ID NO: 805580 - RNA, 16 nt, Homo sapiens
uuaaggguacaguuug

SEQ ID NO: 805581 - RNA, 13 nt, Homo sapiens
uuaagguacuuaa

SEQ ID NO: 805582 - RNA, 18 nt, Homo sapiens
uuaaggugaaccaaagaa

SEQ ID NO: 805583 - RNA, 16 nt, Homo sapiens
uuaagugaauacauua

SEQ ID NO: 805584 - RNA, 13 nt, Homo sapiens
uuaaguggcagaa

SEQ ID NO: 805585 - RNA, 12 nt, Homo sapiens
uuaaguuuugau

SEQ ID NO: 805586 - RNA, 21 nt, Homo sapiens
uuaauaaaaauuauuaccagu

SEQ ID NO: 805587 - RNA, 23 nt, Homo sapiens
uuaauaaagaugaguugguucuc

SEQ ID NO: 805588 - RNA, 16 nt, Homo sapiens
uuaauaaagcauucuu

SEQ ID NO: 805589 - RNA, 13 nt, Homo sapiens
uuaauaaauaugu

SEQ ID NO: 805590 - RNA, 20 nt, Homo sapiens
uuaauacagggcauuuuggu

SEQ ID NO: 805591 - RNA, 19 nt, Homo sapiens
uuaauagaaauaaauuccu

SEQ ID NO: 805592 - RNA, 12 nt, Homo sapiens
uuaauagacuga

SEQ ID NO: 805593 - RNA, 18 nt, Homo sapiens
uuaauaggaaaaacggaa

SEQ ID NO: 805594 - RNA, 21 nt, Homo sapiens
uuaauagggauuuuuucagcu

SEQ ID NO: 805595 - RNA, 12 nt, Homo sapiens
uuaauauacugc

SEQ ID NO: 805596 - RNA, 18 nt, Homo sapiens
uuaauauauaguccagac

SEQ ID NO: 805597 - RNA, 16 nt, Homo sapiens
uuaauaucaacucuga

SEQ ID NO: 805598 - RNA, 15 nt, Homo sapiens
uuaauaugagcuuca

SEQ ID NO: 805599 - RNA, 20 nt, Homo sapiens
uuaauauuuuccuaguagau

SEQ ID NO: 805600 - RNA, 14 nt, Homo sapiens
uuaaucacugcauu

SEQ ID NO: 805601 - RNA, 20 nt, Homo sapiens
uuaauccaauauuuugccuu

SEQ ID NO: 805602 - RNA, 22 nt, Homo sapiens
uuaaucucuaaaauucuagucu

SEQ ID NO: 805603 - RNA, 18 nt, Homo sapiens
uuaaugaauaucaggcua

SEQ ID NO: 805604 - RNA, 19 nt, Homo sapiens
uuaaugaaugagucuguug

SEQ ID NO: 805605 - RNA, 14 nt, Homo sapiens
uuaaugacaguuuu

SEQ ID NO: 805606 - RNA, 23 nt, Homo sapiens
uuaaugagauguuauuacuguuu

SEQ ID NO: 805607 - RNA, 19 nt, Homo sapiens
uuaauggaaucagauauug

SEQ ID NO: 805608 - RNA, 20 nt, Homo sapiens
uuaauggcucaugaccugga

SEQ ID NO: 805609 - RNA, 13 nt, Homo sapiens
uuaauguacaagu

SEQ ID NO: 805610 - RNA, 21 nt, Homo sapiens
uuaauguauuuguuugcaauu

SEQ ID NO: 805611 - RNA, 17 nt, Homo sapiens
uuaaugucuggugcuuu

SEQ ID NO: 805612 - RNA, 18 nt, Homo sapiens
uuaauuaauggaaucuuc

SEQ ID NO: 805613 - RNA, 13 nt, Homo sapiens
uuaauuauugcuu

SEQ ID NO: 805614 - RNA, 22 nt, Homo sapiens
uuaauucacagaauagcacaaa

SEQ ID NO: 805615 - RNA, 21 nt, Homo sapiens
uuaauucccuuuuaacccagu

SEQ ID NO: 805616 - RNA, 12 nt, Homo sapiens
uuaauucuagua

SEQ ID NO: 805617 - RNA, 19 nt, Homo sapiens
uuaauucucuuucaaagcu

SEQ ID NO: 805618 - RNA, 14 nt, Homo sapiens
uuaauuguacucaa

SEQ ID NO: 805619 - RNA, 18 nt, Homo sapiens
uuaauuguuuugcacuuu

SEQ ID NO: 805620 - RNA, 14 nt, Homo sapiens
uuaauuuacuuuaa

SEQ ID NO: 805621 - RNA, 18 nt, Homo sapiens
uuaauuuauuuuuuaccg

SEQ ID NO: 805622 - RNA, 13 nt, Homo sapiens
uuaauuucaggaa

SEQ ID NO: 805623 - RNA, 12 nt, Homo sapiens
uuaauuucuaac

SEQ ID NO: 805624 - RNA, 15 nt, Homo sapiens
uuaauuucugucaaa

SEQ ID NO: 805625 - RNA, 21 nt, Homo sapiens
uuaauuucugucaaaugcagu

SEQ ID NO: 805626 - RNA, 13 nt, Homo sapiens
uuaauuuguccuu

SEQ ID NO: 805627 - RNA, 20 nt, Homo sapiens
uuaauuuuaaccaaaacaug

SEQ ID NO: 805628 - RNA, 19 nt, Homo sapiens
uuaauuuuaguuucaugag

SEQ ID NO: 805629 - RNA, 18 nt, Homo sapiens
uuaauuuucuauguguug

SEQ ID NO: 805630 - RNA, 22 nt, Homo sapiens
uuaauuuuuaaggauguugcca

SEQ ID NO: 805631 - RNA, 23 nt, Homo sapiens
uuacaaaacaugauuguuuacag

SEQ ID NO: 805632 - RNA, 17 nt, Homo sapiens
uuacaaaccucaagcca

SEQ ID NO: 805633 - RNA, 13 nt, Homo sapiens
uuacaaacugcaa

SEQ ID NO: 805634 - RNA, 19 nt, Homo sapiens
uuacaaagacaaagccuua

SEQ ID NO: 805635 - RNA, 19 nt, Homo sapiens
uuacaacuuguauuuccaa

SEQ ID NO: 805636 - RNA, 17 nt, Homo sapiens
uuacaagagcuguucau

SEQ ID NO: 805637 - RNA, 21 nt, Homo sapiens
uuacaauaaucauucuggaua

SEQ ID NO: 805638 - RNA, 20 nt, Homo sapiens
uuacaaucagccacauucua

SEQ ID NO: 805639 - RNA, 14 nt, Homo sapiens
uuacacaaagggaa

SEQ ID NO: 805640 - RNA, 14 nt, Homo sapiens
uuacacaagaaucu

SEQ ID NO: 805641 - RNA, 12 nt, Homo sapiens
uuacacauagca

SEQ ID NO: 805642 - RNA, 19 nt, Homo sapiens
uuacacccuuucuugacaa

SEQ ID NO: 805643 - RNA, 20 nt, Homo sapiens
uuacacccuuucuugacaaa

SEQ ID NO: 805644 - RNA, 13 nt, Homo sapiens
uuacagaaaucaa

SEQ ID NO: 805645 - RNA, 16 nt, Homo sapiens
uuacagacaugagccu

SEQ ID NO: 805646 - RNA, 23 nt, Homo sapiens
uuacagagagcuugcugugacua

SEQ ID NO: 805647 - RNA, 18 nt, Homo sapiens
uuacagagaggauacauu

SEQ ID NO: 805648 - RNA, 18 nt, Homo sapiens
uuacagcuuucugugcag

SEQ ID NO: 805649 - RNA, 21 nt, Homo sapiens
uuacaguaaucccauuuccca

SEQ ID NO: 805650 - RNA, 18 nt, Homo sapiens
uuacagugccacugcaau

SEQ ID NO: 805651 - RNA, 22 nt, Homo sapiens
uuacaguguagaguaacacaua

SEQ ID NO: 805652 - RNA, 21 nt, Homo sapiens
uuacaguucguccugacuaca

SEQ ID NO: 805653 - RNA, 12 nt, Homo sapiens
uuacaguuuaca

SEQ ID NO: 805654 - RNA, 16 nt, Homo sapiens
uuacaguuugagacuu

SEQ ID NO: 805655 - RNA, 22 nt, Homo sapiens
uuacauaaaaccaaguuuuacu

SEQ ID NO: 805656 - RNA, 18 nt, Homo sapiens
uuacauacaugcuuugaa

SEQ ID NO: 805657 - RNA, 13 nt, Homo sapiens
uuacaucuuucac

SEQ ID NO: 805658 - RNA, 16 nt, Homo sapiens
uuacauguaauuugau

SEQ ID NO: 805659 - RNA, 22 nt, Homo sapiens
uuacauuauuaaauguuucuca

SEQ ID NO: 805660 - RNA, 22 nt, Homo sapiens
uuacauuuuccugagaccucaa

SEQ ID NO: 805661 - RNA, 15 nt, Homo sapiens
uuaccaaaauucacu

SEQ ID NO: 805662 - RNA, 17 nt, Homo sapiens
uuaccaaacauuacaaa

SEQ ID NO: 805663 - RNA, 19 nt, Homo sapiens
uuaccaaagaagaguuuac

SEQ ID NO: 805664 - RNA, 10 nt, Homo sapiens
uuaccaaagc

SEQ ID NO: 805665 - RNA, 19 nt, Homo sapiens
uuaccaaggaugaaagagg

SEQ ID NO: 805666 - RNA, 20 nt, Homo sapiens
uuaccaaggaugaaagagga

SEQ ID NO: 805667 - RNA, 22 nt, Homo sapiens
uuaccacuugugauucaaacaa

SEQ ID NO: 805668 - RNA, 15 nt, Homo sapiens
uuaccauguauguau

SEQ ID NO: 805669 - RNA, 22 nt, Homo sapiens
uuacccagagaauauauacauu

SEQ ID NO: 805670 - RNA, 22 nt, Homo sapiens
uuaccccuuuucggccccaugu

SEQ ID NO: 805671 - RNA, 22 nt, Homo sapiens
uuacccuuuggccccacuuuga

SEQ ID NO: 805672 - RNA, 13 nt, Homo sapiens
uuaccuauacauu

SEQ ID NO: 805673 - RNA, 15 nt, Homo sapiens
uuaccucacagugau

SEQ ID NO: 805674 - RNA, 15 nt, Homo sapiens
uuaccuccucauggc

SEQ ID NO: 805675 - RNA, 22 nt, Homo sapiens
uuaccucugaguuguguuccac

SEQ ID NO: 805676 - RNA, 12 nt, Homo sapiens
uuaccucugaua

SEQ ID NO: 805677 - RNA, 23 nt, Homo sapiens
uuaccucuuuaaaaacaaaacaa

SEQ ID NO: 805678 - RNA, 17 nt, Homo sapiens
ugcuggugaacacugug

SEQ ID NO: 805679 - RNA, 14 nt, Homo sapiens
ugcuggugaaccag

SEQ ID NO: 805680 - RNA, 20 nt, Homo sapiens
ugcuggugaauaacuaugcc

SEQ ID NO: 805681 - RNA, 20 nt, Homo sapiens
ugcugguguccugaccaccc

SEQ ID NO: 805682 - RNA, 21 nt, Homo sapiens
ugcuguaauauuguaaauacu

SEQ ID NO: 805683 - RNA, 21 nt, Homo sapiens
ugcuguagacauuugcuauga

SEQ ID NO: 805684 - RNA, 20 nt, Homo sapiens
ugcuguauaugcaaugucca

SEQ ID NO: 805685 - RNA, 18 nt, Homo sapiens
ugcuguauccauccaugg

SEQ ID NO: 805686 - RNA, 14 nt, Homo sapiens
ugcuguaugcugau

SEQ ID NO: 805687 - RNA, 21 nt, Homo sapiens
ugcuguaugcugaucaucgcc

SEQ ID NO: 805688 - RNA, 16 nt, Homo sapiens
ugcugucacaaccaag

SEQ ID NO: 805689 - RNA, 17 nt, Homo sapiens
ugcugucacaaccaaga

SEQ ID NO: 805690 - RNA, 17 nt, Homo sapiens
ugcugucuucagucuca

SEQ ID NO: 805691 - RNA, 23 nt, Homo sapiens
ugcugucuucagucucacagaga

SEQ ID NO: 805692 - RNA, 17 nt, Homo sapiens
ugcuguugcugauuuua

SEQ ID NO: 805693 - RNA, 19 nt, Homo sapiens
ugcuguuuaaagucacauc

SEQ ID NO: 805694 - RNA, 13 nt, Homo sapiens
ugcuuacaaagac

SEQ ID NO: 805695 - RNA, 22 nt, Homo sapiens
ugcuuagaugagggugacuguc

SEQ ID NO: 805696 - RNA, 16 nt, Homo sapiens
ugcuuaugacaucacu

SEQ ID NO: 805697 - RNA, 16 nt, Homo sapiens
ugcuuaugguugauca

SEQ ID NO: 805698 - RNA, 22 nt, Homo sapiens
ugcuucaaguguugcucuugga

SEQ ID NO: 805699 - RNA, 17 nt, Homo sapiens
ugcuucagacauguaau

SEQ ID NO: 805700 - RNA, 13 nt, Homo sapiens
ugcuucagaguuu

SEQ ID NO: 805701 - RNA, 16 nt, Homo sapiens
ugcuucaguacuugug

SEQ ID NO: 805702 - RNA, 13 nt, Homo sapiens
ugcuucaucugcu

SEQ ID NO: 805703 - RNA, 14 nt, Homo sapiens
ugcuuccaacaagg

SEQ ID NO: 805704 - RNA, 17 nt, Homo sapiens
ugcuuccacuucuaugc

SEQ ID NO: 805705 - RNA, 18 nt, Homo sapiens
ugcuucccauccuacccu

SEQ ID NO: 805706 - RNA, 18 nt, Homo sapiens
ugcuuccucccaacaagc

SEQ ID NO: 805707 - RNA, 21 nt, Homo sapiens
ugcuuccucccaacaagcagc

SEQ ID NO: 805708 - RNA, 11 nt, Homo sapiens
ugcuuccucuu

SEQ ID NO: 805709 - RNA, 14 nt, Homo sapiens
ugcuuccugucuua

SEQ ID NO: 805710 - RNA, 15 nt, Homo sapiens
ugcuucuacuuucau

SEQ ID NO: 805711 - RNA, 18 nt, Homo sapiens
ugcuucugcacacaaaac

SEQ ID NO: 805712 - RNA, 22 nt, Homo sapiens
ugcuucuucuacuucagucuuc

SEQ ID NO: 805713 - RNA, 21 nt, Homo sapiens
ugcuugaaccaaaauggugaa

SEQ ID NO: 805714 - RNA, 15 nt, Homo sapiens
ugcuugaauggagcu

SEQ ID NO: 805715 - RNA, 19 nt, Homo sapiens
ugcuugaauugcaaggcua

SEQ ID NO: 805716 - RNA, 19 nt, Homo sapiens
ugcuugacucuacuauuaa

SEQ ID NO: 805717 - RNA, 20 nt, Homo sapiens
ugcuugccgacuggcuguga

SEQ ID NO: 805718 - RNA, 14 nt, Homo sapiens
ugcuugcugcucau

SEQ ID NO: 805719 - RNA, 19 nt, Homo sapiens
ugcuugcuggccacaagga

SEQ ID NO: 805720 - RNA, 14 nt, Homo sapiens
ugcuuggauucucu

SEQ ID NO: 805721 - RNA, 17 nt, Homo sapiens
ugcuugggcugacccag

SEQ ID NO: 805722 - RNA, 15 nt, Homo sapiens
ugcuuguaacaagaa

SEQ ID NO: 805723 - RNA, 15 nt, Homo sapiens
ugcuuguuauauuaa

SEQ ID NO: 805724 - RNA, 22 nt, Homo sapiens
ugcuuuaaauggaaacagacuc

SEQ ID NO: 805725 - RNA, 24 nt, Homo sapiens
ugcuuuaaauggaaacagacucau

SEQ ID NO: 805726 - RNA, 16 nt, Homo sapiens
ugcuuuaaauugugcc

SEQ ID NO: 805727 - RNA, 21 nt, Homo sapiens
ugcuuugaaacuugccugggg

SEQ ID NO: 805728 - RNA, 15 nt, Homo sapiens
ugcuuugcaaagacc

SEQ ID NO: 805729 - RNA, 22 nt, Homo sapiens
ugcuuugcaggaagugucuaga

SEQ ID NO: 805730 - RNA, 13 nt, Homo sapiens
ugcuuugccaaaa

SEQ ID NO: 805731 - RNA, 17 nt, Homo sapiens
ugcuuuguaugcacuuu

SEQ ID NO: 805732 - RNA, 20 nt, Homo sapiens
ugcuuuguuaucaaauggac

SEQ ID NO: 805733 - RNA, 22 nt, Homo sapiens
ugcuuuguuuuaauaaacagua

SEQ ID NO: 805734 - RNA, 14 nt, Homo sapiens
ugcuuuugccacuu

SEQ ID NO: 805735 - RNA, 23 nt, Homo sapiens
uggaaaaaaacaaaaacagaauu

SEQ ID NO: 805736 - RNA, 16 nt, Homo sapiens
uggaaaaaacucugaa

SEQ ID NO: 805737 - RNA, 17 nt, Homo sapiens
uggaaaaagccugugaa

SEQ ID NO: 805738 - RNA, 13 nt, Homo sapiens
uggaaaagcaaaa

SEQ ID NO: 805739 - RNA, 22 nt, Homo sapiens
uggaaaagcaaaacuguagggg

SEQ ID NO: 805740 - RNA, 19 nt, Homo sapiens
uggaaaaggaagacuagag

SEQ ID NO: 805741 - RNA, 22 nt, Homo sapiens
uggaaaaggggugaccuaguag

SEQ ID NO: 805742 - RNA, 15 nt, Homo sapiens
uggaaaauaccagug

SEQ ID NO: 805743 - RNA, 15 nt, Homo sapiens
uggaaaauaccuaau

SEQ ID NO: 805744 - RNA, 18 nt, Homo sapiens
uggaaaaugcaaaagcac

SEQ ID NO: 805745 - RNA, 14 nt, Homo sapiens
uggaaacaggacca

SEQ ID NO: 805746 - RNA, 16 nt, Homo sapiens
uggaaacauggaggaa

SEQ ID NO: 805747 - RNA, 20 nt, Homo sapiens
uggaaaccugcccugccuga

SEQ ID NO: 805748 - RNA, 17 nt, Homo sapiens
uggaaagacauagccaa

SEQ ID NO: 805749 - RNA, 16 nt, Homo sapiens
uggaaagacugggaca

SEQ ID NO: 805750 - RNA, 16 nt, Homo sapiens
uggaaaguaacuguga

SEQ ID NO: 805751 - RNA, 18 nt, Homo sapiens
uggaaagugcucagugaa

SEQ ID NO: 805752 - RNA, 14 nt, Homo sapiens
uggaaauaaaguca

SEQ ID NO: 805753 - RNA, 13 nt, Homo sapiens
uggaaaugccauu

SEQ ID NO: 805754 - RNA, 21 nt, Homo sapiens
uggaaaugugaauaaguaaag

SEQ ID NO: 805755 - RNA, 15 nt, Homo sapiens
uggaacaacuuguag

SEQ ID NO: 805756 - RNA, 23 nt, Homo sapiens
uggaacacauaagaacugugcag

SEQ ID NO: 805757 - RNA, 20 nt, Homo sapiens
uggaacacuucgaguuccca

SEQ ID NO: 805758 - RNA, 21 nt, Homo sapiens
uggaacagcauuacccuccuc

SEQ ID NO: 805759 - RNA, 20 nt, Homo sapiens
uggaacauauagaaugcaga

SEQ ID NO: 805760 - RNA, 18 nt, Homo sapiens
uggaacauuggaauguuc

SEQ ID NO: 805761 - RNA, 12 nt, Homo sapiens
uggaacauuucu

SEQ ID NO: 805762 - RNA, 14 nt, Homo sapiens
uggaaccccagcuu

SEQ ID NO: 805763 - RNA, 14 nt, Homo sapiens
uggaacuacuguac

SEQ ID NO: 805764 - RNA, 23 nt, Homo sapiens
uggaacucugugcaggugcugcc

SEQ ID NO: 805765 - RNA, 15 nt, Homo sapiens
uggaacuguugaaag

SEQ ID NO: 805766 - RNA, 17 nt, Homo sapiens
uggaagaagcacugaug

SEQ ID NO: 805767 - RNA, 18 nt, Homo sapiens
uggaagacugugcagaag

SEQ ID NO: 805768 - RNA, 13 nt, Homo sapiens
uggaagauuggaa

SEQ ID NO: 805769 - RNA, 16 nt, Homo sapiens
uggaagcccuccuucc

SEQ ID NO: 805770 - RNA, 15 nt, Homo sapiens
uggaagcucugaagu

SEQ ID NO: 805771 - RNA, 22 nt, Homo sapiens
uggaagcucugaagucacauca

SEQ ID NO: 805772 - RNA, 21 nt, Homo sapiens
uggaagcuuguugaaaaccca

SEQ ID NO: 805773 - RNA, 15 nt, Homo sapiens
ugcuaaagccaggau

SEQ ID NO: 805774 - RNA, 17 nt, Homo sapiens
ugcuaagguucuaaggc

SEQ ID NO: 805775 - RNA, 12 nt, Homo sapiens
ugcuaagugugc

SEQ ID NO: 805776 - RNA, 20 nt, Homo sapiens
ugcuacaaauacucuuagga

SEQ ID NO: 805777 - RNA, 19 nt, Homo sapiens
ugcuacccaugacuuuaua

SEQ ID NO: 805778 - RNA, 16 nt, Homo sapiens
ugcuaccucacugggg

SEQ ID NO: 805779 - RNA, 14 nt, Homo sapiens
ugcuaccugugagc

SEQ ID NO: 805780 - RNA, 16 nt, Homo sapiens
ugcuagaagacagaca

SEQ ID NO: 805781 - RNA, 15 nt, Homo sapiens
ugcuagaagcuguaa

SEQ ID NO: 805782 - RNA, 18 nt, Homo sapiens
ugcuagacuccucaggag

SEQ ID NO: 805783 - RNA, 12 nt, Homo sapiens
ugcuagagccag

SEQ ID NO: 805784 - RNA, 19 nt, Homo sapiens
ugcuagcagcugugauggu

SEQ ID NO: 805785 - RNA, 18 nt, Homo sapiens
ugcuagggaaacuucccg

SEQ ID NO: 805786 - RNA, 17 nt, Homo sapiens
ugcuauaaguucuuuuc

SEQ ID NO: 805787 - RNA, 12 nt, Homo sapiens
ugcuauaaucau

SEQ ID NO: 805788 - RNA, 18 nt, Homo sapiens
ugcuauacugcauacuuu

SEQ ID NO: 805789 - RNA, 19 nt, Homo sapiens
ugcuauagagccuaccugu

SEQ ID NO: 805790 - RNA, 16 nt, Homo sapiens
ugcuauaugauuuagc

SEQ ID NO: 805791 - RNA, 15 nt, Homo sapiens
ugcuaucgcaccacu

SEQ ID NO: 805792 - RNA, 16 nt, Homo sapiens
ugcuaucgccaucaca

SEQ ID NO: 805793 - RNA, 12 nt, Homo sapiens
ugcuaucugggc

SEQ ID NO: 805794 - RNA, 18 nt, Homo sapiens
ugcuaugcaaaauagaca

SEQ ID NO: 805795 - RNA, 21 nt, Homo sapiens
ugcuaugcuaaaccuccugcc

SEQ ID NO: 805796 - RNA, 23 nt, Homo sapiens
ugcuauuuauuuuccuaaagaga

SEQ ID NO: 805797 - RNA, 20 nt, Homo sapiens
ugcuauuuuauuuguauuca

SEQ ID NO: 805798 - RNA, 22 nt, Homo sapiens
ugcucaagccggaaacucggca

SEQ ID NO: 805799 - RNA, 20 nt, Homo sapiens
ugcucacacauuacaacagu

SEQ ID NO: 805800 - RNA, 13 nt, Homo sapiens
ugcucaccaagga

SEQ ID NO: 805801 - RNA, 17 nt, Homo sapiens
ugcucaccugaggauaa

SEQ ID NO: 805802 - RNA, 22 nt, Homo sapiens
ugcucacgucaaaugcauacaa

SEQ ID NO: 805803 - RNA, 20 nt, Homo sapiens
ugcucacuugguccuaccua

SEQ ID NO: 805804 - RNA, 16 nt, Homo sapiens
ugcucagccaccaucu

SEQ ID NO: 805805 - RNA, 15 nt, Homo sapiens
ugcucagcuguggcu

SEQ ID NO: 805806 - RNA, 18 nt, Homo sapiens
ugcucaggagccaccagc

SEQ ID NO: 805807 - RNA, 24 nt, Homo sapiens
ugcucaguggaucacacacaugga

SEQ ID NO: 805808 - RNA, 20 nt, Homo sapiens
ugcucaguguccagcuucca

SEQ ID NO: 805809 - RNA, 21 nt, Homo sapiens
ugcucauuuuuucuucuccua

SEQ ID NO: 805810 - RNA, 14 nt, Homo sapiens
ugcuccacagggcc

SEQ ID NO: 805811 - RNA, 19 nt, Homo sapiens
ugcuccacuggguuacaga

SEQ ID NO: 805812 - RNA, 18 nt, Homo sapiens
ugcuccagcaacugcccu

SEQ ID NO: 805813 - RNA, 12 nt, Homo sapiens
ugcuccaucucc

SEQ ID NO: 805814 - RNA, 14 nt, Homo sapiens
ugcuccccugugaa

SEQ ID NO: 805815 - RNA, 21 nt, Homo sapiens
ugcucccuccucuccuaccca

SEQ ID NO: 805816 - RNA, 21 nt, Homo sapiens
ugcucccuggaggcacgcacc

SEQ ID NO: 805817 - RNA, 15 nt, Homo sapiens
ugcuccucacuggag

SEQ ID NO: 805818 - RNA, 17 nt, Homo sapiens
ugcuccugaagcccuau

SEQ ID NO: 805819 - RNA, 19 nt, Homo sapiens
ugcucuaacuggacaugaa

SEQ ID NO: 805820 - RNA, 16 nt, Homo sapiens
ugcucuaugucugccu

SEQ ID NO: 805821 - RNA, 20 nt, Homo sapiens
ugcucucccgguucuuccag

SEQ ID NO: 805822 - RNA, 12 nt, Homo sapiens
ugcucucugagu

SEQ ID NO: 805823 - RNA, 14 nt, Homo sapiens
ugcucugaccaagc

SEQ ID NO: 805824 - RNA, 12 nt, Homo sapiens
ugcucugccauc

SEQ ID NO: 805825 - RNA, 20 nt, Homo sapiens
ugcucugcuugacaacaucu

SEQ ID NO: 805826 - RNA, 19 nt, Homo sapiens
ugcucuggaggaaguucuc

SEQ ID NO: 805827 - RNA, 20 nt, Homo sapiens
ugcucuggaggaaguucucc

SEQ ID NO: 805828 - RNA, 15 nt, Homo sapiens
ugcucuuagcugucu

SEQ ID NO: 805829 - RNA, 16 nt, Homo sapiens
ugcucuugagucuuug

SEQ ID NO: 805830 - RNA, 18 nt, Homo sapiens
ugcucuugagucuuugca

SEQ ID NO: 805831 - RNA, 19 nt, Homo sapiens
ugcucuugagucuuugcag

SEQ ID NO: 805832 - RNA, 20 nt, Homo sapiens
ugcucuugagucuuugcaga

SEQ ID NO: 805833 - RNA, 18 nt, Homo sapiens
ugcucuugggaagaccag

SEQ ID NO: 805834 - RNA, 16 nt, Homo sapiens
ugcucuuucucugcca

SEQ ID NO: 805835 - RNA, 15 nt, Homo sapiens
ugcucuuuguggcag

SEQ ID NO: 805836 - RNA, 14 nt, Homo sapiens
ugcucuuuugcaca

SEQ ID NO: 805837 - RNA, 15 nt, Homo sapiens
ugcucuuuugcacaa

SEQ ID NO: 805838 - RNA, 14 nt, Homo sapiens
ugcugaaaauugcc

SEQ ID NO: 805839 - RNA, 15 nt, Homo sapiens
ugcugaaacaacaaa

SEQ ID NO: 805840 - RNA, 18 nt, Homo sapiens
ugcugaaacucagugcaa

SEQ ID NO: 805841 - RNA, 12 nt, Homo sapiens
ugcugaaaucau

SEQ ID NO: 805842 - RNA, 22 nt, Homo sapiens
ugcugaaggaagaaaaaguguu

SEQ ID NO: 805843 - RNA, 22 nt, Homo sapiens
ugcugaaggagggucaccgcau

SEQ ID NO: 805844 - RNA, 14 nt, Homo sapiens
ugcugaaugaagcu

SEQ ID NO: 805845 - RNA, 13 nt, Homo sapiens
ugcugaaugcagg

SEQ ID NO: 805846 - RNA, 21 nt, Homo sapiens
ugcugaaugggacccuguuga

SEQ ID NO: 805847 - RNA, 19 nt, Homo sapiens
ugcugaauuucaggcauuu

SEQ ID NO: 805848 - RNA, 21 nt, Homo sapiens
ugcugacauggaccuacugca

SEQ ID NO: 805849 - RNA, 18 nt, Homo sapiens
ugcugaccaaaugccugg

SEQ ID NO: 805850 - RNA, 18 nt, Homo sapiens
ugcugacgggacccacau

SEQ ID NO: 805851 - RNA, 15 nt, Homo sapiens
ugcugagcaguauuc

SEQ ID NO: 805852 - RNA, 20 nt, Homo sapiens
ugcugaggccacccacugac

SEQ ID NO: 805853 - RNA, 23 nt, Homo sapiens
ugcugaggcccagugcauaugca

SEQ ID NO: 805854 - RNA, 23 nt, Homo sapiens
ugcugagugaaugaacaaaugaa

SEQ ID NO: 805855 - RNA, 15 nt, Homo sapiens
ugcugauaaguagca

SEQ ID NO: 805856 - RNA, 22 nt, Homo sapiens
ugcugaugaucaaaaccugugc

SEQ ID NO: 805857 - RNA, 19 nt, Homo sapiens
ugcugauuauuuaugaccu

SEQ ID NO: 805858 - RNA, 15 nt, Homo sapiens
ugcugauuuggugac

SEQ ID NO: 805859 - RNA, 19 nt, Homo sapiens
ugcugcaaaggagaagcac

SEQ ID NO: 805860 - RNA, 13 nt, Homo sapiens
ugcugcagagaaa

SEQ ID NO: 805861 - RNA, 23 nt, Homo sapiens
ugcugcaggccgugugucuguca

SEQ ID NO: 805862 - RNA, 22 nt, Homo sapiens
ugcugcauacuuugacaaggaa

SEQ ID NO: 805863 - RNA, 15 nt, Homo sapiens
ugcugcaugcgacag

SEQ ID NO: 805864 - RNA, 15 nt, Homo sapiens
ugcugccacacuguc

SEQ ID NO: 805865 - RNA, 15 nt, Homo sapiens
ugcugccagcacagu

SEQ ID NO: 805866 - RNA, 15 nt, Homo sapiens
ugcugccauccucac

SEQ ID NO: 805867 - RNA, 14 nt, Homo sapiens
ugcugccaugugga

SEQ ID NO: 805868 - RNA, 19 nt, Homo sapiens
ugcccugggauguccacag

SEQ ID NO: 805869 - RNA, 20 nt, Homo sapiens
ugcccugggauguccacaga

SEQ ID NO: 805870 - RNA, 15 nt, Homo sapiens
ugcccuucacuguca

SEQ ID NO: 805871 - RNA, 18 nt, Homo sapiens
ugcccuucucaagacuuu

SEQ ID NO: 805872 - RNA, 14 nt, Homo sapiens
ugcccuuugggguc

SEQ ID NO: 805873 - RNA, 19 nt, Homo sapiens
ugccgaaaacaggagcaaa

SEQ ID NO: 805874 - RNA, 16 nt, Homo sapiens
ugccgacuggcuguga

SEQ ID NO: 805875 - RNA, 22 nt, Homo sapiens
ugccgcaugcucccuccucucc

SEQ ID NO: 805876 - RNA, 19 nt, Homo sapiens
ugccgccuccuugugcaca

SEQ ID NO: 805877 - RNA, 13 nt, Homo sapiens
ugccgcuaccucc

SEQ ID NO: 805878 - RNA, 14 nt, Homo sapiens
ugccgcuaccuccc

SEQ ID NO: 805879 - RNA, 12 nt, Homo sapiens
ugccgcucucuc

SEQ ID NO: 805880 - RNA, 17 nt, Homo sapiens
ugccgcucucucugagg

SEQ ID NO: 805881 - RNA, 17 nt, Homo sapiens
ugccgcugucucugagg

SEQ ID NO: 805882 - RNA, 15 nt, Homo sapiens
ugccggaugugcuuu

SEQ ID NO: 805883 - RNA, 18 nt, Homo sapiens
ugccggucccccaugcca

SEQ ID NO: 805884 - RNA, 23 nt, Homo sapiens
ugccggucccccaugccaccacc

SEQ ID NO: 805885 - RNA, 21 nt, Homo sapiens
ugccguaacaacuguggucaa

SEQ ID NO: 805886 - RNA, 17 nt, Homo sapiens
ugccguauaggauguca

SEQ ID NO: 805887 - RNA, 21 nt, Homo sapiens
ugccguuuccccuccuuggcu

SEQ ID NO: 805888 - RNA, 23 nt, Homo sapiens
ugccguuuucuugcucaaaggga

SEQ ID NO: 805889 - RNA, 23 nt, Homo sapiens
ugccuaacuuauccaucuuugaa

SEQ ID NO: 805890 - RNA, 15 nt, Homo sapiens
ugccuaacuuguaaa

SEQ ID NO: 805891 - RNA, 19 nt, Homo sapiens
ugccuacgauugaaaugaa

SEQ ID NO: 805892 - RNA, 21 nt, Homo sapiens
ugccuacuaucaaacuagcug

SEQ ID NO: 805893 - RNA, 14 nt, Homo sapiens
ugccuacuccaaaa

SEQ ID NO: 805894 - RNA, 15 nt, Homo sapiens
ugccuagaaauaucu

SEQ ID NO: 805895 - RNA, 21 nt, Homo sapiens
ugccuagauuagguagacuuu

SEQ ID NO: 805896 - RNA, 19 nt, Homo sapiens
ugccuaguaacacauaugu

SEQ ID NO: 805897 - RNA, 16 nt, Homo sapiens
ugccuaucugaccaaa

SEQ ID NO: 805898 - RNA, 18 nt, Homo sapiens
ugccuauuugaaguacag

SEQ ID NO: 805899 - RNA, 16 nt, Homo sapiens
ugccucacuuccuaca

SEQ ID NO: 805900 - RNA, 17 nt, Homo sapiens
ugccucagacuccgccc

SEQ ID NO: 805901 - RNA, 20 nt, Homo sapiens
ugccucaggccagggcucac

SEQ ID NO: 805902 - RNA, 15 nt, Homo sapiens
ugccuccaagccauu

SEQ ID NO: 805903 - RNA, 22 nt, Homo sapiens
ugccuccauucugaccauuuca

SEQ ID NO: 805904 - RNA, 18 nt, Homo sapiens
ugccucccagguucaagu

SEQ ID NO: 805905 - RNA, 21 nt, Homo sapiens
ugccuccccugucucuaagga

SEQ ID NO: 805906 - RNA, 22 nt, Homo sapiens
ugccuccuggacuguucacggc

SEQ ID NO: 805907 - RNA, 15 nt, Homo sapiens
ugccuccuuguauua

SEQ ID NO: 805908 - RNA, 18 nt, Homo sapiens
ugccuccuuugcaccuga

SEQ ID NO: 805909 - RNA, 23 nt, Homo sapiens
ugccucgucauggccagcugcca

SEQ ID NO: 805910 - RNA, 13 nt, Homo sapiens
ugccucuacuuug

SEQ ID NO: 805911 - RNA, 23 nt, Homo sapiens
ugccucucacaaugaaggaaguu

SEQ ID NO: 805912 - RNA, 15 nt, Homo sapiens
ugccucugugcacag

SEQ ID NO: 805913 - RNA, 22 nt, Homo sapiens
ugccugaaggcucacaccucau

SEQ ID NO: 805914 - RNA, 10 nt, Homo sapiens
ugccugagau

SEQ ID NO: 805915 - RNA, 11 nt, Homo sapiens
ugccugccauu

SEQ ID NO: 805916 - RNA, 20 nt, Homo sapiens
ugccugccccccucaucuca

SEQ ID NO: 805917 - RNA, 19 nt, Homo sapiens
ugccuggaacaccagcagc

SEQ ID NO: 805918 - RNA, 14 nt, Homo sapiens
ugccuggacacugu

SEQ ID NO: 805919 - RNA, 16 nt, Homo sapiens
ugccuggacacuguac

SEQ ID NO: 805920 - RNA, 13 nt, Homo sapiens
ugccugggaugau

SEQ ID NO: 805921 - RNA, 19 nt, Homo sapiens
ugccugggccugugcagca

SEQ ID NO: 805922 - RNA, 16 nt, Homo sapiens
ugccugggggcugugg

SEQ ID NO: 805923 - RNA, 20 nt, Homo sapiens
ugccuguaaucucagcacuu

SEQ ID NO: 805924 - RNA, 15 nt, Homo sapiens
ugccuguagucucag

SEQ ID NO: 805925 - RNA, 16 nt, Homo sapiens
ugccuguauuuccaac

SEQ ID NO: 805926 - RNA, 11 nt, Homo sapiens
ugccugugauu

SEQ ID NO: 805927 - RNA, 16 nt, Homo sapiens
ugccugugauuuccua

SEQ ID NO: 805928 - RNA, 20 nt, Homo sapiens
ugccugugguuaacaucuca

SEQ ID NO: 805929 - RNA, 15 nt, Homo sapiens
ugccuguguccugau

SEQ ID NO: 805930 - RNA, 21 nt, Homo sapiens
ugccugugugggacugagaug

SEQ ID NO: 805931 - RNA, 18 nt, Homo sapiens
ugccuuaaaaccaaagag

SEQ ID NO: 805932 - RNA, 14 nt, Homo sapiens
ugccuuaacuggag

SEQ ID NO: 805933 - RNA, 17 nt, Homo sapiens
ugccuuagguugcugac

SEQ ID NO: 805934 - RNA, 17 nt, Homo sapiens
ugccuuaugggcugaag

SEQ ID NO: 805935 - RNA, 17 nt, Homo sapiens
ugccuucaacaacguga

SEQ ID NO: 805936 - RNA, 20 nt, Homo sapiens
ugccuucaauaaaugguaua

SEQ ID NO: 805937 - RNA, 13 nt, Homo sapiens
ugccuucacccau

SEQ ID NO: 805938 - RNA, 14 nt, Homo sapiens
ugccuucacccaua

SEQ ID NO: 805939 - RNA, 17 nt, Homo sapiens
ugccuucacugugcucc

SEQ ID NO: 805940 - RNA, 16 nt, Homo sapiens
ugccuucacuuuacaa

SEQ ID NO: 805941 - RNA, 22 nt, Homo sapiens
ugccuucagaggauaaauauca

SEQ ID NO: 805942 - RNA, 20 nt, Homo sapiens
ugccuucaucuucacugcaa

SEQ ID NO: 805943 - RNA, 20 nt, Homo sapiens
ugccuuccucucucuaccag

SEQ ID NO: 805944 - RNA, 13 nt, Homo sapiens
ugccuucucagga

SEQ ID NO: 805945 - RNA, 14 nt, Homo sapiens
ugccuucucaggaa

SEQ ID NO: 805946 - RNA, 13 nt, Homo sapiens
ugccuucuccuau

SEQ ID NO: 805947 - RNA, 21 nt, Homo sapiens
ugccuucuccuauuucuccaa

SEQ ID NO: 805948 - RNA, 20 nt, Homo sapiens
ugccuucuuauugcuuuuau

SEQ ID NO: 805949 - RNA, 23 nt, Homo sapiens
ugccuugggucucagcugcugac

SEQ ID NO: 805950 - RNA, 18 nt, Homo sapiens
ugccuuuaaaucugugau

SEQ ID NO: 805951 - RNA, 18 nt, Homo sapiens
ugccuuuaagccaaagaa

SEQ ID NO: 805952 - RNA, 20 nt, Homo sapiens
ugccuuucugguggcuuuuu

SEQ ID NO: 805953 - RNA, 16 nt, Homo sapiens
ugccuuuggcacucug

SEQ ID NO: 805954 - RNA, 17 nt, Homo sapiens
ugccuuuguaaguuauu

SEQ ID NO: 805955 - RNA, 13 nt, Homo sapiens
ugccuuuugcaac

SEQ ID NO: 805956 - RNA, 16 nt, Homo sapiens
ugccuuuugcaaccag

SEQ ID NO: 805957 - RNA, 23 nt, Homo sapiens
ugccuuuuuuuuaaggagcaaaa

SEQ ID NO: 805958 - RNA, 21 nt, Homo sapiens
ugcgaaugacaguagcauuau

SEQ ID NO: 805959 - RNA, 14 nt, Homo sapiens
ugcgaggacaucaa

SEQ ID NO: 805960 - RNA, 15 nt, Homo sapiens
ugcgauagagucuca

SEQ ID NO: 805961 - RNA, 16 nt, Homo sapiens
ugcgccaaucccgcca

SEQ ID NO: 805962 - RNA, 22 nt, Homo sapiens
ugcgccaaucccgccaugcuca

SEQ ID NO: 805963 - RNA, 22 nt, Homo sapiens
cuuuagagccagcccauggcuu

SEQ ID NO: 805964 - RNA, 17 nt, Homo sapiens
cuuuagagucuaagaaa

SEQ ID NO: 805965 - RNA, 13 nt, Homo sapiens
cuuuagaugcuga

SEQ ID NO: 805966 - RNA, 21 nt, Homo sapiens
cuuuagucaggaauggcugca

SEQ ID NO: 805967 - RNA, 19 nt, Homo sapiens
cuuuaguccuucugccauu

SEQ ID NO: 805968 - RNA, 16 nt, Homo sapiens
cuuuaguuccuacuuu

SEQ ID NO: 805969 - RNA, 13 nt, Homo sapiens
cuuuauaacccau

SEQ ID NO: 805970 - RNA, 13 nt, Homo sapiens
cuuuaucaaagaa

SEQ ID NO: 805971 - RNA, 17 nt, Homo sapiens
cuuuaucuugacauuca

SEQ ID NO: 805972 - RNA, 19 nt, Homo sapiens
cuuuaugaaguuaacaguc

SEQ ID NO: 805973 - RNA, 21 nt, Homo sapiens
cuuuaugauaucaaagacuca

SEQ ID NO: 805974 - RNA, 12 nt, Homo sapiens
cuuuaugcaaau

SEQ ID NO: 805975 - RNA, 16 nt, Homo sapiens
cuuuaugcaaauacaa

SEQ ID NO: 805976 - RNA, 20 nt, Homo sapiens
cuuuaugcaaauacaaucag

SEQ ID NO: 805977 - RNA, 21 nt, Homo sapiens
cuuuaugcaaauacaaucagc

SEQ ID NO: 805978 - RNA, 15 nt, Homo sapiens
cuuuaugugcaaaau

SEQ ID NO: 805979 - RNA, 17 nt, Homo sapiens
cuuuauuggcugagaua

SEQ ID NO: 805980 - RNA, 12 nt, Homo sapiens
cuuuauuguaca

SEQ ID NO: 805981 - RNA, 12 nt, Homo sapiens
cuuuauuuuaga

SEQ ID NO: 805982 - RNA, 12 nt, Homo sapiens
cuuuauuuuggc

SEQ ID NO: 805983 - RNA, 14 nt, Homo sapiens
cuuucaaagcauuu

SEQ ID NO: 805984 - RNA, 15 nt, Homo sapiens
cuuucaacuugcauc

SEQ ID NO: 805985 - RNA, 15 nt, Homo sapiens
cuuucacacuggauc

SEQ ID NO: 805986 - RNA, 14 nt, Homo sapiens
cuuucacucuguca

SEQ ID NO: 805987 - RNA, 12 nt, Homo sapiens
cuuucacuuuga

SEQ ID NO: 805988 - RNA, 13 nt, Homo sapiens
cuuucacuuugaa

SEQ ID NO: 805989 - RNA, 21 nt, Homo sapiens
cuuucagaacaaacauuaaau

SEQ ID NO: 805990 - RNA, 14 nt, Homo sapiens
cuuucaggacucua

SEQ ID NO: 805991 - RNA, 22 nt, Homo sapiens
cuuucaguauguccccauaaga

SEQ ID NO: 805992 - RNA, 14 nt, Homo sapiens
cuuucagugcuuuu

SEQ ID NO: 805993 - RNA, 20 nt, Homo sapiens
cuuuccauccauuaccucca

SEQ ID NO: 805994 - RNA, 12 nt, Homo sapiens
cuuuccaucucu

SEQ ID NO: 805995 - RNA, 22 nt, Homo sapiens
cuuucccacucaccuuucucca

SEQ ID NO: 805996 - RNA, 21 nt, Homo sapiens
cuuucccagucccauuccuca

SEQ ID NO: 805997 - RNA, 19 nt, Homo sapiens
cuuucccauggucaaugca

SEQ ID NO: 805998 - RNA, 20 nt, Homo sapiens
cuuucccauuucuaccuaag

SEQ ID NO: 805999 - RNA, 13 nt, Homo sapiens
cuuuccccaaaga

SEQ ID NO: 806000 - RNA, 21 nt, Homo sapiens
cuuucccccuucccgccuucc

SEQ ID NO: 806001 - RNA, 13 nt, Homo sapiens
cuuucccuaccuu

SEQ ID NO: 806002 - RNA, 18 nt, Homo sapiens
cuuucccucauccaugcu

SEQ ID NO: 806003 - RNA, 19 nt, Homo sapiens
cuuucccuucaguacccuc

SEQ ID NO: 806004 - RNA, 15 nt, Homo sapiens
cuuucccuuuaucag

SEQ ID NO: 806005 - RNA, 13 nt, Homo sapiens
cuuuccucaaaaa

SEQ ID NO: 806006 - RNA, 20 nt, Homo sapiens
cuuuccucgccugacaacca

SEQ ID NO: 806007 - RNA, 22 nt, Homo sapiens
cuuuccugguucugucuagacu

SEQ ID NO: 806008 - RNA, 18 nt, Homo sapiens
cuuuccuguuccagagag

SEQ ID NO: 806009 - RNA, 13 nt, Homo sapiens
cuuucgaggccug

SEQ ID NO: 806010 - RNA, 23 nt, Homo sapiens
cuuucguagccuaaaagacaauu

SEQ ID NO: 806011 - RNA, 16 nt, Homo sapiens
cuuucgucuacugcaa

SEQ ID NO: 806012 - RNA, 13 nt, Homo sapiens
cuuucuaacaaaa

SEQ ID NO: 806013 - RNA, 21 nt, Homo sapiens
cuuucuacaggccagcagggg

SEQ ID NO: 806014 - RNA, 16 nt, Homo sapiens
cuuucucuaauguugu

SEQ ID NO: 806015 - RNA, 14 nt, Homo sapiens
cuuucucucucuaa

SEQ ID NO: 806016 - RNA, 14 nt, Homo sapiens
cuuucucugagggg

SEQ ID NO: 806017 - RNA, 20 nt, Homo sapiens
cuuucucugccagugacaga

SEQ ID NO: 806018 - RNA, 17 nt, Homo sapiens
cuuucugaauugcacau

SEQ ID NO: 806019 - RNA, 16 nt, Homo sapiens
cuuucugacaaaaagu

SEQ ID NO: 806020 - RNA, 16 nt, Homo sapiens
cuuucugccagcaucu

SEQ ID NO: 806021 - RNA, 17 nt, Homo sapiens
cuuucugcuuacaaaga

SEQ ID NO: 806022 - RNA, 23 nt, Homo sapiens
cuuucuggaaguuucuggugcca

SEQ ID NO: 806023 - RNA, 13 nt, Homo sapiens
cuuucuguugcca

SEQ ID NO: 806024 - RNA, 19 nt, Homo sapiens
cuuucuguuuggacccaug

SEQ ID NO: 806025 - RNA, 23 nt, Homo sapiens
cuuucuuaaugugugugccaaug

SEQ ID NO: 806026 - RNA, 21 nt, Homo sapiens
cuuucuucaccaagugcaaua

SEQ ID NO: 806027 - RNA, 23 nt, Homo sapiens
cuuucuucaccaagugcaauaga

SEQ ID NO: 806028 - RNA, 20 nt, Homo sapiens
cuuucuuuccaaaacauuuc

SEQ ID NO: 806029 - RNA, 19 nt, Homo sapiens
cuuugaaguagguggcuug

SEQ ID NO: 806030 - RNA, 13 nt, Homo sapiens
cuuugaauguggc

SEQ ID NO: 806031 - RNA, 17 nt, Homo sapiens
cuuugacugugauuuua

SEQ ID NO: 806032 - RNA, 21 nt, Homo sapiens
cuuugagaggcugagguggua

SEQ ID NO: 806033 - RNA, 16 nt, Homo sapiens
cuuugagccugggaaa

SEQ ID NO: 806034 - RNA, 21 nt, Homo sapiens
cuuugagcugcugacugccaa

SEQ ID NO: 806035 - RNA, 16 nt, Homo sapiens
cuuugaggaacauuca

SEQ ID NO: 806036 - RNA, 17 nt, Homo sapiens
cuuugaguagauccauu

SEQ ID NO: 806037 - RNA, 14 nt, Homo sapiens
cuuugauaucugau

SEQ ID NO: 806038 - RNA, 22 nt, Homo sapiens
cuuugaucccugacaucuggaa

SEQ ID NO: 806039 - RNA, 12 nt, Homo sapiens
cuuugcaaagac

SEQ ID NO: 806040 - RNA, 13 nt, Homo sapiens
cuuugcacugagg

SEQ ID NO: 806041 - RNA, 11 nt, Homo sapiens
cuuugcacuug

SEQ ID NO: 806042 - RNA, 19 nt, Homo sapiens
cuuugccacacacaguuac

SEQ ID NO: 806043 - RNA, 16 nt, Homo sapiens
cuuugccacacugugg

SEQ ID NO: 806044 - RNA, 21 nt, Homo sapiens
cuuugccauaaccacauuuaa

SEQ ID NO: 806045 - RNA, 23 nt, Homo sapiens
cuuugccccugagacaaauggag

SEQ ID NO: 806046 - RNA, 23 nt, Homo sapiens
cuuugccggaggaaaagcagcuc

SEQ ID NO: 806047 - RNA, 19 nt, Homo sapiens
cuuugccucuucuuugugc

SEQ ID NO: 806048 - RNA, 20 nt, Homo sapiens
cuuugcuacaaauuuaugca

SEQ ID NO: 806049 - RNA, 15 nt, Homo sapiens
cuuugcucaguggau

SEQ ID NO: 806050 - RNA, 23 nt, Homo sapiens
cuuugcucaguggaucacacaca

SEQ ID NO: 806051 - RNA, 15 nt, Homo sapiens
cuuugcucccugcaa

SEQ ID NO: 806052 - RNA, 20 nt, Homo sapiens
cuuugcucccuguugcugaa

SEQ ID NO: 806053 - RNA, 14 nt, Homo sapiens
cuuugcucugaaug

SEQ ID NO: 806054 - RNA, 15 nt, Homo sapiens
cuuugcucuuuggua

SEQ ID NO: 806055 - RNA, 19 nt, Homo sapiens
cuuugcugaaugucauuuu

SEQ ID NO: 806056 - RNA, 17 nt, Homo sapiens
cuuugcugcagucaucu

SEQ ID NO: 806057 - RNA, 14 nt, Homo sapiens
cuuugcugccugag

SEQ ID NO: 806058 - RNA, 23 nt, Homo sapiens
cugagaccaaagaagcugcuguu

SEQ ID NO: 806059 - RNA, 15 nt, Homo sapiens
cugagaccucaauga

SEQ ID NO: 806060 - RNA, 16 nt, Homo sapiens
cugagagacccaagga

SEQ ID NO: 806061 - RNA, 22 nt, Homo sapiens
cugagaggcaggcauagaggcu

SEQ ID NO: 806062 - RNA, 21 nt, Homo sapiens
cugagauagcagaggggcucc

SEQ ID NO: 806063 - RNA, 19 nt, Homo sapiens
cugagauauauuugcuaga

SEQ ID NO: 806064 - RNA, 17 nt, Homo sapiens
cugagaugcaggugaug

SEQ ID NO: 806065 - RNA, 18 nt, Homo sapiens
cugagaugguaugcacaa

SEQ ID NO: 806066 - RNA, 12 nt, Homo sapiens
cugagauuacag

SEQ ID NO: 806067 - RNA, 22 nt, Homo sapiens
cugagauuacagacaugagccu

SEQ ID NO: 806068 - RNA, 19 nt, Homo sapiens
cugagauucgaauccucaa

SEQ ID NO: 806069 - RNA, 20 nt, Homo sapiens
cugagauugugccacuguac

SEQ ID NO: 806070 - RNA, 14 nt, Homo sapiens
cugagcaaggaguu

SEQ ID NO: 806071 - RNA, 18 nt, Homo sapiens
cugagcacagcugcauua

SEQ ID NO: 806072 - RNA, 17 nt, Homo sapiens
cugagcacggacucucc

SEQ ID NO: 806073 - RNA, 20 nt, Homo sapiens
cugagcacuguuuauacacu

SEQ ID NO: 806074 - RNA, 19 nt, Homo sapiens
cugagcagaauacuggucu

SEQ ID NO: 806075 - RNA, 19 nt, Homo sapiens
cugagcagguguucuucau

SEQ ID NO: 806076 - RNA, 23 nt, Homo sapiens
cugagcagguguucuucauuacc

SEQ ID NO: 806077 - RNA, 17 nt, Homo sapiens
cugagcagugccagcuu

SEQ ID NO: 806078 - RNA, 16 nt, Homo sapiens
cugagcauaaugcucc

SEQ ID NO: 806079 - RNA, 17 nt, Homo sapiens
cugagcaucacuaguga

SEQ ID NO: 806080 - RNA, 14 nt, Homo sapiens
cugagccacagaaa

SEQ ID NO: 806081 - RNA, 18 nt, Homo sapiens
cugagcccauaggucuca

SEQ ID NO: 806082 - RNA, 21 nt, Homo sapiens
cugagcccugguguguuucca

SEQ ID NO: 806083 - RNA, 13 nt, Homo sapiens
cugagcuauuuca

SEQ ID NO: 806084 - RNA, 15 nt, Homo sapiens
cugagcuugagcucc

SEQ ID NO: 806085 - RNA, 19 nt, Homo sapiens
cugaggaaguugauucuua

SEQ ID NO: 806086 - RNA, 19 nt, Homo sapiens
cugaggaauggacauuucu

SEQ ID NO: 806087 - RNA, 18 nt, Homo sapiens
cugaggagauacugaaca

SEQ ID NO: 806088 - RNA, 19 nt, Homo sapiens
cugaggaggaggacacagc

SEQ ID NO: 806089 - RNA, 20 nt, Homo sapiens
cugaggaggaggacacagca

SEQ ID NO: 806090 - RNA, 19 nt, Homo sapiens
cugaggaggggccugggca

SEQ ID NO: 806091 - RNA, 18 nt, Homo sapiens
cugaggcagcgaccucaa

SEQ ID NO: 806092 - RNA, 22 nt, Homo sapiens
cugaggcaggagaauugcuuga

SEQ ID NO: 806093 - RNA, 21 nt, Homo sapiens
cugaggcccagugcauaugca

SEQ ID NO: 806094 - RNA, 22 nt, Homo sapiens
cugaggcccagugcauaugcaa

SEQ ID NO: 806095 - RNA, 21 nt, Homo sapiens
cugaggcggagaauugcuuga

SEQ ID NO: 806096 - RNA, 16 nt, Homo sapiens
cugaggggcaucugcc

SEQ ID NO: 806097 - RNA, 16 nt, Homo sapiens
cugagggggugggggu

SEQ ID NO: 806098 - RNA, 17 nt, Homo sapiens
cugagguauaaagacaa

SEQ ID NO: 806099 - RNA, 15 nt, Homo sapiens
cugagguuggauuug

SEQ ID NO: 806100 - RNA, 18 nt, Homo sapiens
cugaguaagcccucagga

SEQ ID NO: 806101 - RNA, 14 nt, Homo sapiens
cugaguauuuucac

SEQ ID NO: 806102 - RNA, 17 nt, Homo sapiens
cugagucaaauccagug

SEQ ID NO: 806103 - RNA, 18 nt, Homo sapiens
cugagucaaauccagugg

SEQ ID NO: 806104 - RNA, 14 nt, Homo sapiens
cugagucaccuccu

SEQ ID NO: 806105 - RNA, 15 nt, Homo sapiens
cugagucaucuguua

SEQ ID NO: 806106 - RNA, 13 nt, Homo sapiens
cugaguccagagc

SEQ ID NO: 806107 - RNA, 19 nt, Homo sapiens
cugaguccagagcuugugc

SEQ ID NO: 806108 - RNA, 15 nt, Homo sapiens
cugagugagccacag

SEQ ID NO: 806109 - RNA, 23 nt, Homo sapiens
cugagugcuagaguaggugcaga

SEQ ID NO: 806110 - RNA, 20 nt, Homo sapiens
cugaguggaaugcagggaag

SEQ ID NO: 806111 - RNA, 15 nt, Homo sapiens
cugaguggugccaaa

SEQ ID NO: 806112 - RNA, 16 nt, Homo sapiens
cugaguggugccaaac

SEQ ID NO: 806113 - RNA, 13 nt, Homo sapiens
cugaguguggacu

SEQ ID NO: 806114 - RNA, 18 nt, Homo sapiens
cugaguuaugauguaauc

SEQ ID NO: 806115 - RNA, 13 nt, Homo sapiens
cugaguucuuaga

SEQ ID NO: 806116 - RNA, 14 nt, Homo sapiens
cugaguugcuuuua

SEQ ID NO: 806117 - RNA, 13 nt, Homo sapiens
cugauaaacacaa

SEQ ID NO: 806118 - RNA, 14 nt, Homo sapiens
cugauaaaccuaau

SEQ ID NO: 806119 - RNA, 21 nt, Homo sapiens
cugauaaaccuaauauucaau

SEQ ID NO: 806120 - RNA, 13 nt, Homo sapiens
cugauacauuaaa

SEQ ID NO: 806121 - RNA, 13 nt, Homo sapiens
cugauaccacugc

SEQ ID NO: 806122 - RNA, 12 nt, Homo sapiens
cugauaccucaa

SEQ ID NO: 806123 - RNA, 12 nt, Homo sapiens
cugauacugcug

SEQ ID NO: 806124 - RNA, 15 nt, Homo sapiens
cugauacuuuagcca

SEQ ID NO: 806125 - RNA, 18 nt, Homo sapiens
cugauacuuugacagugu

SEQ ID NO: 806126 - RNA, 14 nt, Homo sapiens
cugauagcuuacac

SEQ ID NO: 806127 - RNA, 14 nt, Homo sapiens
cugauaguauuccu

SEQ ID NO: 806128 - RNA, 17 nt, Homo sapiens
cugauaugggacugagc

SEQ ID NO: 806129 - RNA, 15 nt, Homo sapiens
cugaucauguaugca

SEQ ID NO: 806130 - RNA, 14 nt, Homo sapiens
cugauccagccuuu

SEQ ID NO: 806131 - RNA, 21 nt, Homo sapiens
cugauccuccaacagcuguca

SEQ ID NO: 806132 - RNA, 12 nt, Homo sapiens
cugauccugcug

SEQ ID NO: 806133 - RNA, 15 nt, Homo sapiens
cugauccuggagaaa

SEQ ID NO: 806134 - RNA, 13 nt, Homo sapiens
cugaucuauacaa

SEQ ID NO: 806135 - RNA, 11 nt, Homo sapiens
cugaucugcag

SEQ ID NO: 806136 - RNA, 20 nt, Homo sapiens
cugaucugcaguuuuugccu

SEQ ID NO: 806137 - RNA, 24 nt, Homo sapiens
cugaucugcggaucucagcuuuga

SEQ ID NO: 806138 - RNA, 18 nt, Homo sapiens
cugaucugcuagugcugu

SEQ ID NO: 806139 - RNA, 20 nt, Homo sapiens
cugaucuucccaccucacag

SEQ ID NO: 806140 - RNA, 13 nt, Homo sapiens
cucuaacauuucc

SEQ ID NO: 806141 - RNA, 14 nt, Homo sapiens
cucuaaccagugua

SEQ ID NO: 806142 - RNA, 19 nt, Homo sapiens
cucuaaccaguguacaggu

SEQ ID NO: 806143 - RNA, 13 nt, Homo sapiens
cucuaacccagug

SEQ ID NO: 806144 - RNA, 15 nt, Homo sapiens
cucuaacucacugcc

SEQ ID NO: 806145 - RNA, 20 nt, Homo sapiens
cucuaacucagaaacaucag

SEQ ID NO: 806146 - RNA, 18 nt, Homo sapiens
cucuaagcacauuccaaa

SEQ ID NO: 806147 - RNA, 23 nt, Homo sapiens
cucuaagcacauuccaaacuuua

SEQ ID NO: 806148 - RNA, 17 nt, Homo sapiens
cucuaagccaacuuuaa

SEQ ID NO: 806149 - RNA, 18 nt, Homo sapiens
cucuaaugagacugacca

SEQ ID NO: 806150 - RNA, 19 nt, Homo sapiens
cucuaauguaccaaugaug

SEQ ID NO: 806151 - RNA, 18 nt, Homo sapiens
cucuaauucacagugcuc

SEQ ID NO: 806152 - RNA, 20 nt, Homo sapiens
cucuaauuguccauucuugc

SEQ ID NO: 806153 - RNA, 19 nt, Homo sapiens
cucuaccagucuauuucca

SEQ ID NO: 806154 - RNA, 22 nt, Homo sapiens
cucuacccuauacaacuggaca

SEQ ID NO: 806155 - RNA, 12 nt, Homo sapiens
cucuacccugag

SEQ ID NO: 806156 - RNA, 17 nt, Homo sapiens
cucuacgucccagggag

SEQ ID NO: 806157 - RNA, 19 nt, Homo sapiens
cucuacuaaaauucaaaaa

SEQ ID NO: 806158 - RNA, 16 nt, Homo sapiens
cucuacuaaugccucu

SEQ ID NO: 806159 - RNA, 18 nt, Homo sapiens
cucuacuccuaccucagc

SEQ ID NO: 806160 - RNA, 13 nt, Homo sapiens
cucuagaagccaa

SEQ ID NO: 806161 - RNA, 14 nt, Homo sapiens
cucuagaagccaag

SEQ ID NO: 806162 - RNA, 19 nt, Homo sapiens
cucuagacaagauauugua

SEQ ID NO: 806163 - RNA, 14 nt, Homo sapiens
cucuagauugagag

SEQ ID NO: 806164 - RNA, 17 nt, Homo sapiens
cucuaguaagaugcacu

SEQ ID NO: 806165 - RNA, 18 nt, Homo sapiens
cucuagugucuuuugccu

SEQ ID NO: 806166 - RNA, 21 nt, Homo sapiens
cucuaguuucuuccuguagua

SEQ ID NO: 806167 - RNA, 13 nt, Homo sapiens
cucuaucuuccuc

SEQ ID NO: 806168 - RNA, 19 nt, Homo sapiens
cucuaugccagcucagucc

SEQ ID NO: 806169 - RNA, 17 nt, Homo sapiens
cucuaugguguggcaaa

SEQ ID NO: 806170 - RNA, 14 nt, Homo sapiens
cucuaugucugccu

SEQ ID NO: 806171 - RNA, 17 nt, Homo sapiens
cucuauuuuuuacuaca

SEQ ID NO: 806172 - RNA, 22 nt, Homo sapiens
cucucaagacggagaugcaugg

SEQ ID NO: 806173 - RNA, 16 nt, Homo sapiens
cucucaagcuagccag

SEQ ID NO: 806174 - RNA, 17 nt, Homo sapiens
cucucaagcuagccaga

SEQ ID NO: 806175 - RNA, 16 nt, Homo sapiens
cucucaaugaauaauu

SEQ ID NO: 806176 - RNA, 18 nt, Homo sapiens
cucugucaacaucaaaga

SEQ ID NO: 806177 - RNA, 15 nt, Homo sapiens
cucuguccuacuucu

SEQ ID NO: 806178 - RNA, 12 nt, Homo sapiens
cucuguccuucg

SEQ ID NO: 806179 - RNA, 15 nt, Homo sapiens
cucugucuccuaagc

SEQ ID NO: 806180 - RNA, 13 nt, Homo sapiens
cucugucuucuuu

SEQ ID NO: 806181 - RNA, 23 nt, Homo sapiens
cucugugagggugcugacuggcu

SEQ ID NO: 806182 - RNA, 18 nt, Homo sapiens
cucugugcaggugcugcc

SEQ ID NO: 806183 - RNA, 23 nt, Homo sapiens
cucugugucaaggugaagcacau

SEQ ID NO: 806184 - RNA, 20 nt, Homo sapiens
cucuguuuauagugacccac

SEQ ID NO: 806185 - RNA, 23 nt, Homo sapiens
cucuguuucucuuuccuuggcuc

SEQ ID NO: 806186 - RNA, 17 nt, Homo sapiens
cucuguuugugggacug

SEQ ID NO: 806187 - RNA, 17 nt, Homo sapiens
cucuuaaucaaauagca

SEQ ID NO: 806188 - RNA, 23 nt, Homo sapiens
cucuuagagaaagaacuaugaaa

SEQ ID NO: 806189 - RNA, 15 nt, Homo sapiens
cucuuagauucuuaa

SEQ ID NO: 806190 - RNA, 17 nt, Homo sapiens
cucuuagcuuacaggaa

SEQ ID NO: 806191 - RNA, 17 nt, Homo sapiens
cucuuaugugugccuuu

SEQ ID NO: 806192 - RNA, 17 nt, Homo sapiens
cucuucaaucucuggaa

SEQ ID NO: 806193 - RNA, 10 nt, Homo sapiens
cucuucacau

SEQ ID NO: 806194 - RNA, 22 nt, Homo sapiens
cucuucagaacacacagacuuu

SEQ ID NO: 806195 - RNA, 21 nt, Homo sapiens
cucuucauauucagcuugcac

SEQ ID NO: 806196 - RNA, 17 nt, Homo sapiens
cucuucaucccauucca

SEQ ID NO: 806197 - RNA, 14 nt, Homo sapiens
cucuucauugucua

SEQ ID NO: 806198 - RNA, 15 nt, Homo sapiens
cucuucccaguucag

SEQ ID NO: 806199 - RNA, 17 nt, Homo sapiens
cucuucccccaccacca

SEQ ID NO: 806200 - RNA, 16 nt, Homo sapiens
cucuucccccaugugc

SEQ ID NO: 806201 - RNA, 16 nt, Homo sapiens
cucuuccuaaguauau

SEQ ID NO: 806202 - RNA, 12 nt, Homo sapiens
cucuuccuugaa

SEQ ID NO: 806203 - RNA, 23 nt, Homo sapiens
cucuucuaaaaaaugauacacac

SEQ ID NO: 806204 - RNA, 22 nt, Homo sapiens
cucuucugaauaaagcaauuag

SEQ ID NO: 806205 - RNA, 16 nt, Homo sapiens
cucuucugccuucuca

SEQ ID NO: 806206 - RNA, 22 nt, Homo sapiens
cucuucuuccccagguccuucc

SEQ ID NO: 806207 - RNA, 20 nt, Homo sapiens
cucuucuuuuucuuaccucc

SEQ ID NO: 806208 - RNA, 16 nt, Homo sapiens
cucuugaaauguagaa

SEQ ID NO: 806209 - RNA, 20 nt, Homo sapiens
cucuugagggagcuuagcca

SEQ ID NO: 806210 - RNA, 22 nt, Homo sapiens
cucuugcacagucacugcucuu

SEQ ID NO: 806211 - RNA, 10 nt, Homo sapiens
cucuugcccu

SEQ ID NO: 806212 - RNA, 22 nt, Homo sapiens
cucuugcuaccugugagcaucc

SEQ ID NO: 806213 - RNA, 12 nt, Homo sapiens
cucuugcucaaa

SEQ ID NO: 806214 - RNA, 13 nt, Homo sapiens
cucuugcugccac

SEQ ID NO: 806215 - RNA, 21 nt, Homo sapiens
cucuugcuggaacuguugaaa

SEQ ID NO: 806216 - RNA, 15 nt, Homo sapiens
cucuuggcugacccc

SEQ ID NO: 806217 - RNA, 20 nt, Homo sapiens
cucuuggguucaagugauuc

SEQ ID NO: 806218 - RNA, 17 nt, Homo sapiens
cucuuguauaugaugau

SEQ ID NO: 806219 - RNA, 18 nt, Homo sapiens
cucuuguauaugaugauc

SEQ ID NO: 806220 - RNA, 20 nt, Homo sapiens
cucuugugaauuauucugau

SEQ ID NO: 806221 - RNA, 22 nt, Homo sapiens
cucuugugacgugcacugugaa

SEQ ID NO: 806222 - RNA, 14 nt, Homo sapiens
cucuuguucccaca

SEQ ID NO: 806223 - RNA, 15 nt, Homo sapiens
cucuuuaaucuucag

SEQ ID NO: 806224 - RNA, 22 nt, Homo sapiens
cucuuucccuuccccugugguc

SEQ ID NO: 806225 - RNA, 18 nt, Homo sapiens
cucuuuccuccugcuuca

SEQ ID NO: 806226 - RNA, 18 nt, Homo sapiens
cucuuugaucuacuugcc

SEQ ID NO: 806227 - RNA, 12 nt, Homo sapiens
cucuuuggugua

SEQ ID NO: 806228 - RNA, 14 nt, Homo sapiens
cucuuuugcacaag

SEQ ID NO: 806229 - RNA, 15 nt, Homo sapiens
cucuuuuggccaaau

SEQ ID NO: 806230 - RNA, 16 nt, Homo sapiens
cucuuuuuuucuuguc

SEQ ID NO: 806231 - RNA, 22 nt, Homo sapiens
cugaaaaaaacauauccaaaau

SEQ ID NO: 806232 - RNA, 19 nt, Homo sapiens
cugaaaagacucaguguuc

SEQ ID NO: 806233 - RNA, 18 nt, Homo sapiens
cugaaaaucgaguuuuuc

SEQ ID NO: 806234 - RNA, 14 nt, Homo sapiens
cugaaagaagacau

SEQ ID NO: 806235 - RNA, 15 nt, Homo sapiens
cugaaagaagacauc

SEQ ID NO: 806236 - RNA, 12 nt, Homo sapiens
cugaaagccaca

SEQ ID NO: 806237 - RNA, 13 nt, Homo sapiens
cugaaagccucac

SEQ ID NO: 806238 - RNA, 23 nt, Homo sapiens
cugaaagcuuuauacaguugaau

SEQ ID NO: 806239 - RNA, 17 nt, Homo sapiens
cugaaaggaacacuggc

SEQ ID NO: 806240 - RNA, 20 nt, Homo sapiens
cugaaaggagacauugcucu

SEQ ID NO: 806241 - RNA, 15 nt, Homo sapiens
cugaaaggaugugga

SEQ ID NO: 806242 - RNA, 18 nt, Homo sapiens
cugaaaggggcagauuaa

SEQ ID NO: 806243 - RNA, 17 nt, Homo sapiens
cugaaagugacagagac

SEQ ID NO: 806244 - RNA, 15 nt, Homo sapiens
cugaaauaauuugag

SEQ ID NO: 806245 - RNA, 14 nt, Homo sapiens
cugaaauacuuaau

SEQ ID NO: 806246 - RNA, 17 nt, Homo sapiens
cugaaauagaggcuaaa

SEQ ID NO: 806247 - RNA, 23 nt, Homo sapiens
cugaaauucaggaugcugugaua

SEQ ID NO: 806248 - RNA, 23 nt, Homo sapiens
cugaaauuuaucuuuucuucuau

SEQ ID NO: 806249 - RNA, 19 nt, Homo sapiens
cugaacaaaaccuacacac

SEQ ID NO: 806250 - RNA, 18 nt, Homo sapiens
cugaacaccuauugcacu

SEQ ID NO: 806251 - RNA, 18 nt, Homo sapiens
cugaacauccuuccuucc

SEQ ID NO: 806252 - RNA, 18 nt, Homo sapiens
cugaacauuaguugcacu

SEQ ID NO: 806253 - RNA, 14 nt, Homo sapiens
cugaaccauuccaa

SEQ ID NO: 806254 - RNA, 15 nt, Homo sapiens
cugaacccugugcug

SEQ ID NO: 806255 - RNA, 17 nt, Homo sapiens
cugaaccgcacagcuca

SEQ ID NO: 806256 - RNA, 16 nt, Homo sapiens
cugaaccuuccaucuc

SEQ ID NO: 806257 - RNA, 22 nt, Homo sapiens
cugaacuauuuuaaauaaaaua

SEQ ID NO: 806258 - RNA, 21 nt, Homo sapiens
cugaacucuucagaacacaca

SEQ ID NO: 806259 - RNA, 18 nt, Homo sapiens
cugaacugagccuagcua

SEQ ID NO: 806260 - RNA, 14 nt, Homo sapiens
cugaagaaugaaga

SEQ ID NO: 806261 - RNA, 17 nt, Homo sapiens
cugaagaaugaagacca

SEQ ID NO: 806262 - RNA, 21 nt, Homo sapiens
cugaagcccucccagguguua

SEQ ID NO: 806263 - RNA, 20 nt, Homo sapiens
cugaaggaauagccagagag

SEQ ID NO: 806264 - RNA, 20 nt, Homo sapiens
cugaaggcagucauaucaaa

SEQ ID NO: 806265 - RNA, 15 nt, Homo sapiens
cugaaggcauaugca

SEQ ID NO: 806266 - RNA, 21 nt, Homo sapiens
cugaaggcauaugcacaguca

SEQ ID NO: 806267 - RNA, 22 nt, Homo sapiens
cugaagggaacuagagguguua

SEQ ID NO: 806268 - RNA, 22 nt, Homo sapiens
cugaaggugauucaccaaaaua

SEQ ID NO: 806269 - RNA, 14 nt, Homo sapiens
cugaaguagccuga

SEQ ID NO: 806270 - RNA, 14 nt, Homo sapiens
cugaagucacauca

SEQ ID NO: 806271 - RNA, 21 nt, Homo sapiens
cugaagucaccucuugguuac

SEQ ID NO: 806272 - RNA, 17 nt, Homo sapiens
cugaagugaacuaugaa

SEQ ID NO: 806273 - RNA, 12 nt, Homo sapiens
cugaagugcuua

SEQ ID NO: 806274 - RNA, 20 nt, Homo sapiens
cugaaguguggcugcaucuu

SEQ ID NO: 806275 - RNA, 16 nt, Homo sapiens
cugaaguuuccgcccc

SEQ ID NO: 806276 - RNA, 15 nt, Homo sapiens
cugaauaaacaggaa

SEQ ID NO: 806277 - RNA, 15 nt, Homo sapiens
cugaauccagaucau

SEQ ID NO: 806278 - RNA, 18 nt, Homo sapiens
cugaauccucaugaggcu

SEQ ID NO: 806279 - RNA, 21 nt, Homo sapiens
cugaaugcuccagucaacaaa

SEQ ID NO: 806280 - RNA, 21 nt, Homo sapiens
cugaaugguuccaugccugag

SEQ ID NO: 806281 - RNA, 15 nt, Homo sapiens
cugaaugguuuucaa

SEQ ID NO: 806282 - RNA, 14 nt, Homo sapiens
cugaauguccugac

SEQ ID NO: 806283 - RNA, 18 nt, Homo sapiens
cugaaugugccuaaugga

SEQ ID NO: 806284 - RNA, 17 nt, Homo sapiens
cugaauuaugauggucu

SEQ ID NO: 806285 - RNA, 12 nt, Homo sapiens
cugaauucacuc

SEQ ID NO: 806286 - RNA, 18 nt, Homo sapiens
cugaauucacuccaguca

SEQ ID NO: 806287 - RNA, 20 nt, Homo sapiens
cugaauucuuuuucauuuga

SEQ ID NO: 806288 - RNA, 20 nt, Homo sapiens
cugaauuuggccugcacuaa

SEQ ID NO: 806289 - RNA, 22 nt, Homo sapiens
cugaauuuuuaaaacccauuua

SEQ ID NO: 806290 - RNA, 17 nt, Homo sapiens
cugacaaugaagggaaa

SEQ ID NO: 806291 - RNA, 16 nt, Homo sapiens
ccuugcccuuggagcu

SEQ ID NO: 806292 - RNA, 22 nt, Homo sapiens
ccuugccuaaauuuaaugcugc

SEQ ID NO: 806293 - RNA, 18 nt, Homo sapiens
ccuugcuagacagccagg

SEQ ID NO: 806294 - RNA, 18 nt, Homo sapiens
ccuugcugggccagggaa

SEQ ID NO: 806295 - RNA, 14 nt, Homo sapiens
ccuugcuuccugau

SEQ ID NO: 806296 - RNA, 18 nt, Homo sapiens
ccuugcuuucggagcucc

SEQ ID NO: 806297 - RNA, 21 nt, Homo sapiens
ccuuggaagggcguucuaggu

SEQ ID NO: 806298 - RNA, 17 nt, Homo sapiens
ccuuggcaguguggcag

SEQ ID NO: 806299 - RNA, 17 nt, Homo sapiens
ccuuggcaugccuucca

SEQ ID NO: 806300 - RNA, 18 nt, Homo sapiens
ccuuggcaugccuuccag

SEQ ID NO: 806301 - RNA, 18 nt, Homo sapiens
ccuuggccgcaccuaaag

SEQ ID NO: 806302 - RNA, 13 nt, Homo sapiens
ccuuggccgugag

SEQ ID NO: 806303 - RNA, 16 nt, Homo sapiens
ccuuggccucugcuaa

SEQ ID NO: 806304 - RNA, 22 nt, Homo sapiens
ccuuggcucccauucacucuuc

SEQ ID NO: 806305 - RNA, 16 nt, Homo sapiens
ccuuggcugacaugaa

SEQ ID NO: 806306 - RNA, 16 nt, Homo sapiens
ccuuggcugucugugg

SEQ ID NO: 806307 - RNA, 12 nt, Homo sapiens
ccuuggcuuuau

SEQ ID NO: 806308 - RNA, 14 nt, Homo sapiens
ccuuggcuuuaugc

SEQ ID NO: 806309 - RNA, 19 nt, Homo sapiens
ccuugggagguuuuauucu

SEQ ID NO: 806310 - RNA, 21 nt, Homo sapiens
ccuugggaugaugccucauga

SEQ ID NO: 806311 - RNA, 16 nt, Homo sapiens
ccuugggcugcuccuc

SEQ ID NO: 806312 - RNA, 12 nt, Homo sapiens
ccuuggggccug

SEQ ID NO: 806313 - RNA, 15 nt, Homo sapiens
ccuuggugugcugua

SEQ ID NO: 806314 - RNA, 16 nt, Homo sapiens
ccuuguaaagacugua

SEQ ID NO: 806315 - RNA, 19 nt, Homo sapiens
ccuuguaauucuaaaugaa

SEQ ID NO: 806316 - RNA, 13 nt, Homo sapiens
ccuugugaaggaa

SEQ ID NO: 806317 - RNA, 19 nt, Homo sapiens
ccuugugagagcccauucc

SEQ ID NO: 806318 - RNA, 19 nt, Homo sapiens
ccuugugguugaaaaccac

SEQ ID NO: 806319 - RNA, 20 nt, Homo sapiens
ccuugugguugaaaaccaca

SEQ ID NO: 806320 - RNA, 14 nt, Homo sapiens
ccuugugucuguac

SEQ ID NO: 806321 - RNA, 15 nt, Homo sapiens
ccuuguuaaaucauu

SEQ ID NO: 806322 - RNA, 19 nt, Homo sapiens
ccuuguuauuuaacccauu

SEQ ID NO: 806323 - RNA, 19 nt, Homo sapiens
ccuuguuccaauuugacaa

SEQ ID NO: 806324 - RNA, 19 nt, Homo sapiens
ccuuguuucagggcugugg

SEQ ID NO: 806325 - RNA, 14 nt, Homo sapiens
ccuuguuucuacug

SEQ ID NO: 806326 - RNA, 15 nt, Homo sapiens
ccuuguuucuacugu

SEQ ID NO: 806327 - RNA, 22 nt, Homo sapiens
ccuuuaacuuucagaggcaaua

SEQ ID NO: 806328 - RNA, 14 nt, Homo sapiens
ccuuuaccccucau

SEQ ID NO: 806329 - RNA, 21 nt, Homo sapiens
ccuuuaccuuuuaugcaaaag

SEQ ID NO: 806330 - RNA, 16 nt, Homo sapiens
ccuuuagcgggacuca

SEQ ID NO: 806331 - RNA, 15 nt, Homo sapiens
ccuuuaguggagcca

SEQ ID NO: 806332 - RNA, 18 nt, Homo sapiens
ccuuuaucaccucauucu

SEQ ID NO: 806333 - RNA, 17 nt, Homo sapiens
ccuuuauguaagaauga

SEQ ID NO: 806334 - RNA, 23 nt, Homo sapiens
ccuuucacccucaugaaaacaca

SEQ ID NO: 806335 - RNA, 19 nt, Homo sapiens
ccuuucauggucugcugag

SEQ ID NO: 806336 - RNA, 17 nt, Homo sapiens
ccuuuccugaugccccu

SEQ ID NO: 806337 - RNA, 19 nt, Homo sapiens
ccuuuccuuccaucccuac

SEQ ID NO: 806338 - RNA, 18 nt, Homo sapiens
ccuuuccuuuucuuuaaa

SEQ ID NO: 806339 - RNA, 17 nt, Homo sapiens
ccugaugcgucuaccca

SEQ ID NO: 806340 - RNA, 18 nt, Homo sapiens
ccugaugcgucuacccag

SEQ ID NO: 806341 - RNA, 14 nt, Homo sapiens
ccugauguguccuc

SEQ ID NO: 806342 - RNA, 18 nt, Homo sapiens
ccugauucccugugguga

SEQ ID NO: 806343 - RNA, 21 nt, Homo sapiens
ccugcaaacucacugcucaag

SEQ ID NO: 806344 - RNA, 18 nt, Homo sapiens
ccugcaauguggugacac

SEQ ID NO: 806345 - RNA, 15 nt, Homo sapiens
ccugcacagugacuu

SEQ ID NO: 806346 - RNA, 14 nt, Homo sapiens
ccugcaccaugcug

SEQ ID NO: 806347 - RNA, 16 nt, Homo sapiens
ccugcaccaugcugcu

SEQ ID NO: 806348 - RNA, 23 nt, Homo sapiens
ccugcacucccuccuggagcucu

SEQ ID NO: 806349 - RNA, 14 nt, Homo sapiens
ccugcacuguaaaa

SEQ ID NO: 806350 - RNA, 22 nt, Homo sapiens
ccugcagaagaagcuggugccc

SEQ ID NO: 806351 - RNA, 16 nt, Homo sapiens
ccugcagaauccagcu

SEQ ID NO: 806352 - RNA, 22 nt, Homo sapiens
ccugcagccuccuccugaccac

SEQ ID NO: 806353 - RNA, 18 nt, Homo sapiens
ccugcaggcuuagguccu

SEQ ID NO: 806354 - RNA, 19 nt, Homo sapiens
ccugcagggacuccaugcu

SEQ ID NO: 806355 - RNA, 13 nt, Homo sapiens
ccugcauuaacug

SEQ ID NO: 806356 - RNA, 13 nt, Homo sapiens
ccugccaccuuca

SEQ ID NO: 806357 - RNA, 14 nt, Homo sapiens
ccugccacugugua

SEQ ID NO: 806358 - RNA, 20 nt, Homo sapiens
ccugccacuguguacugugg

SEQ ID NO: 806359 - RNA, 14 nt, Homo sapiens
ccugccauagucuu

SEQ ID NO: 806360 - RNA, 16 nt, Homo sapiens
ccugccaucuucccag

SEQ ID NO: 806361 - RNA, 10 nt, Homo sapiens
ccugccauuc

SEQ ID NO: 806362 - RNA, 21 nt, Homo sapiens
ccugcccccuguacauuugug

SEQ ID NO: 806363 - RNA, 20 nt, Homo sapiens
ccugcccugggauguccaca

SEQ ID NO: 806364 - RNA, 10 nt, Homo sapiens
ccugcccuug

SEQ ID NO: 806365 - RNA, 21 nt, Homo sapiens
ccugccugcaucugugaaaag

SEQ ID NO: 806366 - RNA, 18 nt, Homo sapiens
ccugccuucacugugcuc

SEQ ID NO: 806367 - RNA, 17 nt, Homo sapiens
ccugccuuuucauugcc

SEQ ID NO: 806368 - RNA, 13 nt, Homo sapiens
ccugcggaugcau

SEQ ID NO: 806369 - RNA, 14 nt, Homo sapiens
ccugcgugcgcugg

SEQ ID NO: 806370 - RNA, 21 nt, Homo sapiens
ccugcguguccccgugcagua

SEQ ID NO: 806371 - RNA, 20 nt, Homo sapiens
ccugcguucuccccaugaac

SEQ ID NO: 806372 - RNA, 14 nt, Homo sapiens
ccugcuaaagagug

SEQ ID NO: 806373 - RNA, 16 nt, Homo sapiens
ccugcuagcuguagaa

SEQ ID NO: 806374 - RNA, 19 nt, Homo sapiens
ccugcucccagcagcccua

SEQ ID NO: 806375 - RNA, 18 nt, Homo sapiens
ccugcugaagcugcugca

SEQ ID NO: 806376 - RNA, 20 nt, Homo sapiens
ccugcugaagcugcugcagc

SEQ ID NO: 806377 - RNA, 13 nt, Homo sapiens
ccugcugaccuca

SEQ ID NO: 806378 - RNA, 11 nt, Homo sapiens
ccugcugagga

SEQ ID NO: 806379 - RNA, 14 nt, Homo sapiens
ccugcuggggaccu

SEQ ID NO: 806380 - RNA, 22 nt, Homo sapiens
ccugcuggggaccucaccugcu

SEQ ID NO: 806381 - RNA, 19 nt, Homo sapiens
ccugcuggugagaggugca

SEQ ID NO: 806382 - RNA, 13 nt, Homo sapiens
ccugcugugauga

SEQ ID NO: 806383 - RNA, 12 nt, Homo sapiens
ccugcugugauu

SEQ ID NO: 806384 - RNA, 18 nt, Homo sapiens
ccugcuuuggcagugcca

SEQ ID NO: 806385 - RNA, 23 nt, Homo sapiens
ccuggaaaagaagaaacuuugcc

SEQ ID NO: 806386 - RNA, 20 nt, Homo sapiens
ccuggaaagaaaaagcaaua

SEQ ID NO: 806387 - RNA, 22 nt, Homo sapiens
ccuggaaauaucaguuacucag

SEQ ID NO: 806388 - RNA, 18 nt, Homo sapiens
ccuggaaggacacaguga

SEQ ID NO: 806389 - RNA, 13 nt, Homo sapiens
ccuggacuuuccu

SEQ ID NO: 806390 - RNA, 16 nt, Homo sapiens
ccuggagaguacauuu

SEQ ID NO: 806391 - RNA, 18 nt, Homo sapiens
ccuggagcccgaggcacc

SEQ ID NO: 806392 - RNA, 17 nt, Homo sapiens
ccuggagccuccacugc

SEQ ID NO: 806393 - RNA, 15 nt, Homo sapiens
ccuggaggcacugaa

SEQ ID NO: 806394 - RNA, 12 nt, Homo sapiens
ccuggaggccag

SEQ ID NO: 806395 - RNA, 23 nt, Homo sapiens
ccuggaguguaugacugcacaug

SEQ ID NO: 806396 - RNA, 21 nt, Homo sapiens
ccuggaguuuaauacagugag

SEQ ID NO: 806397 - RNA, 16 nt, Homo sapiens
ccuggaucuaccagca

SEQ ID NO: 806398 - RNA, 17 nt, Homo sapiens
ccuggaucuaccagcau

SEQ ID NO: 806399 - RNA, 21 nt, Homo sapiens
ccuggauuuccugcugccauc

SEQ ID NO: 806400 - RNA, 14 nt, Homo sapiens
ccuggauuuugccc

SEQ ID NO: 806401 - RNA, 13 nt, Homo sapiens
ccuggcaauguuu

SEQ ID NO: 806402 - RNA, 15 nt, Homo sapiens
ccuggcacacaucag

SEQ ID NO: 806403 - RNA, 15 nt, Homo sapiens
ccuggcagcucugga

SEQ ID NO: 806404 - RNA, 14 nt, Homo sapiens
ccuggcauggcacc

SEQ ID NO: 806405 - RNA, 18 nt, Homo sapiens
ccuggccaacauggcaaa

SEQ ID NO: 806406 - RNA, 21 nt, Homo sapiens
ccuggcccccacccucugcca

SEQ ID NO: 806407 - RNA, 15 nt, Homo sapiens
ccuggccgaugguac

SEQ ID NO: 806408 - RNA, 14 nt, Homo sapiens
ccuggccucacugg

SEQ ID NO: 806409 - RNA, 19 nt, Homo sapiens
ccuggccugguugugugca

SEQ ID NO: 806410 - RNA, 21 nt, Homo sapiens
ccuggcucgcagggugcagga

SEQ ID NO: 806411 - RNA, 22 nt, Homo sapiens
ccuggcugagagaggaagagcu

SEQ ID NO: 806412 - RNA, 16 nt, Homo sapiens
ccuggcugaugaucca

SEQ ID NO: 806413 - RNA, 20 nt, Homo sapiens
ccuggcuggggccuguugaa

SEQ ID NO: 806414 - RNA, 14 nt, Homo sapiens
ccuggcugugauga

SEQ ID NO: 806415 - RNA, 18 nt, Homo sapiens
ccuggcuuuacagacaaa

SEQ ID NO: 806416 - RNA, 19 nt, Homo sapiens
ccugggaauguauuauucu

SEQ ID NO: 806417 - RNA, 13 nt, Homo sapiens
ccugggaccucac

SEQ ID NO: 806418 - RNA, 18 nt, Homo sapiens
ccugggaggaaauuugaa

SEQ ID NO: 806419 - RNA, 21 nt, Homo sapiens
ccugggaggaaauuugaaugg

SEQ ID NO: 806420 - RNA, 23 nt, Homo sapiens
ccugggagguagagguugcacug

SEQ ID NO: 806421 - RNA, 15 nt, Homo sapiens
ccugggaugggcucc

SEQ ID NO: 806422 - RNA, 17 nt, Homo sapiens
ccugggcagagggccug

SEQ ID NO: 806423 - RNA, 14 nt, Homo sapiens
ccugggcauggugg

SEQ ID NO: 806424 - RNA, 22 nt, Homo sapiens
ccugggcauuguugagguuaag

SEQ ID NO: 806425 - RNA, 22 nt, Homo sapiens
ccuggggaagcugcgggcaccc

SEQ ID NO: 806426 - RNA, 18 nt, Homo sapiens
ccuggggaagcugugaaa

SEQ ID NO: 806427 - RNA, 21 nt, Homo sapiens
ccuggggaugaagcucacugg

SEQ ID NO: 806428 - RNA, 17 nt, Homo sapiens
ccuggggcgagcacugu

SEQ ID NO: 806429 - RNA, 18 nt, Homo sapiens
ccugggggcagugacugg

SEQ ID NO: 806430 - RNA, 22 nt, Homo sapiens
ccuggggugggaucugagcucc

SEQ ID NO: 806431 - RNA, 20 nt, Homo sapiens
ccugggguguuaguggcacc

SEQ ID NO: 806432 - RNA, 15 nt, Homo sapiens
ccugguauauccaaa

SEQ ID NO: 806433 - RNA, 19 nt, Homo sapiens
ccuggucaacauggugaaa

SEQ ID NO: 806434 - RNA, 19 nt, Homo sapiens
ccugguggauacuguagaa

SEQ ID NO: 806435 - RNA, 18 nt, Homo sapiens
ccugguguagcacuuaac

SEQ ID NO: 806436 - RNA, 14 nt, Homo sapiens
ccugguguguuucc

SEQ ID NO: 806437 - RNA, 12 nt, Homo sapiens
ccugguguuucu

SEQ ID NO: 806438 - RNA, 21 nt, Homo sapiens
ccugguuaaauuugaauuuca

SEQ ID NO: 806439 - RNA, 21 nt, Homo sapiens
ccugguucccaccauucccug

SEQ ID NO: 806440 - RNA, 12 nt, Homo sapiens
ccugguucucau

SEQ ID NO: 806441 - RNA, 14 nt, Homo sapiens
ccugguugugugca

SEQ ID NO: 806442 - RNA, 16 nt, Homo sapiens
ccugguugugugcaca

SEQ ID NO: 806443 - RNA, 18 nt, Homo sapiens
ccuguaaagaaacauuuc

SEQ ID NO: 806444 - RNA, 18 nt, Homo sapiens
ccuguaacucacauucuc

SEQ ID NO: 806445 - RNA, 17 nt, Homo sapiens
ccuguaaucucagcacu

SEQ ID NO: 806446 - RNA, 20 nt, Homo sapiens
ccuguaccccagcacuugug

SEQ ID NO: 806447 - RNA, 14 nt, Homo sapiens
ccuguacucuugaa

SEQ ID NO: 806448 - RNA, 18 nt, Homo sapiens
ccuguagacuagugccgu

SEQ ID NO: 806449 - RNA, 14 nt, Homo sapiens
ccuguagugagaaa

SEQ ID NO: 806450 - RNA, 12 nt, Homo sapiens
ccuguauuccca

SEQ ID NO: 806451 - RNA, 15 nt, Homo sapiens
ccuguauuugagaga

SEQ ID NO: 806452 - RNA, 20 nt, Homo sapiens
ccugucaagguuuguguuac

SEQ ID NO: 806453 - RNA, 19 nt, Homo sapiens
ccugucaauacuauggagu

SEQ ID NO: 806454 - RNA, 17 nt, Homo sapiens
ccucugcuccugugguc

SEQ ID NO: 806455 - RNA, 17 nt, Homo sapiens
ccucugcuuuugcacac

SEQ ID NO: 806456 - RNA, 20 nt, Homo sapiens
ccucuguauuaguuuuugau

SEQ ID NO: 806457 - RNA, 21 nt, Homo sapiens
ccucugugcuucgacuacugc

SEQ ID NO: 806458 - RNA, 23 nt, Homo sapiens
ccucuuaaaaaauaaaaacugac

SEQ ID NO: 806459 - RNA, 21 nt, Homo sapiens
ccucuuagccucuggaucuag

SEQ ID NO: 806460 - RNA, 17 nt, Homo sapiens
ccucuucaccuuauuca

SEQ ID NO: 806461 - RNA, 14 nt, Homo sapiens
ccucuuccccagaa

SEQ ID NO: 806462 - RNA, 24 nt, Homo sapiens
ccucuuccccagaaaggagacuag

SEQ ID NO: 806463 - RNA, 20 nt, Homo sapiens
ccucuucccuucaacaugaa

SEQ ID NO: 806464 - RNA, 21 nt, Homo sapiens
ccucuuccgugacgucacugg

SEQ ID NO: 806465 - RNA, 21 nt, Homo sapiens
ccucuuccuccucgcugccag

SEQ ID NO: 806466 - RNA, 19 nt, Homo sapiens
ccucuucugacgugccuuu

SEQ ID NO: 806467 - RNA, 15 nt, Homo sapiens
ccucuucugcucuuu

SEQ ID NO: 806468 - RNA, 14 nt, Homo sapiens
ccucuucugugguc

SEQ ID NO: 806469 - RNA, 18 nt, Homo sapiens
ccucuucuuugugccuuu

SEQ ID NO: 806470 - RNA, 13 nt, Homo sapiens
ccucuugcucaaa

SEQ ID NO: 806471 - RNA, 22 nt, Homo sapiens
ccucuuggagaagucucagcua

SEQ ID NO: 806472 - RNA, 16 nt, Homo sapiens
ccucuuguguaacuaa

SEQ ID NO: 806473 - RNA, 19 nt, Homo sapiens
ccucuuuccucuguggcaa

SEQ ID NO: 806474 - RNA, 14 nt, Homo sapiens
ccucuuugucccag

SEQ ID NO: 806475 - RNA, 12 nt, Homo sapiens
ccucuuuuccaa

SEQ ID NO: 806476 - RNA, 17 nt, Homo sapiens
ccugaaaauugcaauac

SEQ ID NO: 806477 - RNA, 16 nt, Homo sapiens
ccugaaauaauuugag

SEQ ID NO: 806478 - RNA, 18 nt, Homo sapiens
ccugaacaggaauccuua

SEQ ID NO: 806479 - RNA, 16 nt, Homo sapiens
ccugaacauccuuccu

SEQ ID NO: 806480 - RNA, 14 nt, Homo sapiens
ccugaaccccaugg

SEQ ID NO: 806481 - RNA, 17 nt, Homo sapiens
ccugaaccuugagcaaa

SEQ ID NO: 806482 - RNA, 19 nt, Homo sapiens
ccugaaccuugagcaaauu

SEQ ID NO: 806483 - RNA, 15 nt, Homo sapiens
ccugaagaaccaguc

SEQ ID NO: 806484 - RNA, 16 nt, Homo sapiens
ccugaagaacugucua

SEQ ID NO: 806485 - RNA, 19 nt, Homo sapiens
ccugaagcguuuuucucaa

SEQ ID NO: 806486 - RNA, 20 nt, Homo sapiens
ccugaaggaaaauaaacuga

SEQ ID NO: 806487 - RNA, 22 nt, Homo sapiens
ccugaauucuuuccccaaagac

SEQ ID NO: 806488 - RNA, 21 nt, Homo sapiens
ccugaauucuuuuucauuuga

SEQ ID NO: 806489 - RNA, 22 nt, Homo sapiens
ccugacagaaggugccacuuua

SEQ ID NO: 806490 - RNA, 18 nt, Homo sapiens
ccugaccccauuccugau

SEQ ID NO: 806491 - RNA, 22 nt, Homo sapiens
ccugaccucaaguaauccaccu

SEQ ID NO: 806492 - RNA, 16 nt, Homo sapiens
ccugaccucacuguga

SEQ ID NO: 806493 - RNA, 17 nt, Homo sapiens
ccugaccucaggugauu

SEQ ID NO: 806494 - RNA, 15 nt, Homo sapiens
ccugaccuccgcccc

SEQ ID NO: 806495 - RNA, 16 nt, Homo sapiens
ccugaccuucugggac

SEQ ID NO: 806496 - RNA, 18 nt, Homo sapiens
ccugacgugcagccacac

SEQ ID NO: 806497 - RNA, 13 nt, Homo sapiens
ccugagaccaguu

SEQ ID NO: 806498 - RNA, 20 nt, Homo sapiens
ccugagaugauuuggucaga

SEQ ID NO: 806499 - RNA, 21 nt, Homo sapiens
ccugagauucagaugucauuu

SEQ ID NO: 806500 - RNA, 16 nt, Homo sapiens
ccugagauucuuuaag

SEQ ID NO: 806501 - RNA, 19 nt, Homo sapiens
ccugagcaacagagugaga

SEQ ID NO: 806502 - RNA, 20 nt, Homo sapiens
ccugagcaaugucugugcua

SEQ ID NO: 806503 - RNA, 17 nt, Homo sapiens
ccugagcagugccagcu

SEQ ID NO: 806504 - RNA, 15 nt, Homo sapiens
ccugagccacaaaaa

SEQ ID NO: 806505 - RNA, 16 nt, Homo sapiens
ccugagccacagaaag

SEQ ID NO: 806506 - RNA, 20 nt, Homo sapiens
ccugagcccaggagguggag

SEQ ID NO: 806507 - RNA, 14 nt, Homo sapiens
ccugaggacaggag

SEQ ID NO: 806508 - RNA, 20 nt, Homo sapiens
ccugaggacaggaguuugag

SEQ ID NO: 806509 - RNA, 15 nt, Homo sapiens
ccugaggaccucuca

SEQ ID NO: 806510 - RNA, 18 nt, Homo sapiens
ccugaggacugauuucag

SEQ ID NO: 806511 - RNA, 17 nt, Homo sapiens
ccugaggauaacucaau

SEQ ID NO: 806512 - RNA, 20 nt, Homo sapiens
ccugaguucauccaggccca

SEQ ID NO: 806513 - RNA, 19 nt, Homo sapiens
ccugauacaggcauggcag

SEQ ID NO: 806514 - RNA, 18 nt, Homo sapiens
ccugaucgccaaccuuuc

SEQ ID NO: 806515 - RNA, 18 nt, Homo sapiens
ccugaugaaaacauagca

SEQ ID NO: 806516 - RNA, 17 nt, Homo sapiens
ccugaugcagccugugg

SEQ ID NO: 806517 - RNA, 21 nt, Homo sapiens
auuacccccucauuguuuauu

SEQ ID NO: 806518 - RNA, 12 nt, Homo sapiens
auuacccuccua

SEQ ID NO: 806519 - RNA, 23 nt, Homo sapiens
auuaccuccauccauccuuccaa

SEQ ID NO: 806520 - RNA, 12 nt, Homo sapiens
auuaccuucuau

SEQ ID NO: 806521 - RNA, 16 nt, Homo sapiens
auuacuaucauaauuc

SEQ ID NO: 806522 - RNA, 21 nt, Homo sapiens
auuacugcuaaguauuuccca

SEQ ID NO: 806523 - RNA, 21 nt, Homo sapiens
auuacuuugauaucugaucaa

SEQ ID NO: 806524 - RNA, 14 nt, Homo sapiens
auuagaagacauuu

SEQ ID NO: 806525 - RNA, 22 nt, Homo sapiens
auuagaagccugcagaauccag

SEQ ID NO: 806526 - RNA, 17 nt, Homo sapiens
auuagagaagcugaaag

SEQ ID NO: 806527 - RNA, 13 nt, Homo sapiens
auuagagccugua

SEQ ID NO: 806528 - RNA, 13 nt, Homo sapiens
auuagaugaacuc

SEQ ID NO: 806529 - RNA, 22 nt, Homo sapiens
auuagauguuucaacugugcuc

SEQ ID NO: 806530 - RNA, 14 nt, Homo sapiens
auuagcaaagcaaa

SEQ ID NO: 806531 - RNA, 22 nt, Homo sapiens
auuagcaugcugcuuuuuguac

SEQ ID NO: 806532 - RNA, 20 nt, Homo sapiens
auuagcauucugguuuugac

SEQ ID NO: 806533 - RNA, 11 nt, Homo sapiens
auuagccagau

SEQ ID NO: 806534 - RNA, 19 nt, Homo sapiens
auuagccaguaccagcuuu

SEQ ID NO: 806535 - RNA, 20 nt, Homo sapiens
auuagccauuucacucucaa

SEQ ID NO: 806536 - RNA, 15 nt, Homo sapiens
auuagcucacugaau

SEQ ID NO: 806537 - RNA, 22 nt, Homo sapiens
auuagcucacugaaucuucacg

SEQ ID NO: 806538 - RNA, 17 nt, Homo sapiens
auuagcuggcgcauauu

SEQ ID NO: 806539 - RNA, 22 nt, Homo sapiens
auuagcuuguuaguaaugcucu

SEQ ID NO: 806540 - RNA, 18 nt, Homo sapiens
auuaggcuguaacuacuu

SEQ ID NO: 806541 - RNA, 23 nt, Homo sapiens
auuaggcuuuuaagaaacacagg

SEQ ID NO: 806542 - RNA, 19 nt, Homo sapiens
auuagguguucaggccagu

SEQ ID NO: 806543 - RNA, 18 nt, Homo sapiens
auuaguacuuauguugca

SEQ ID NO: 806544 - RNA, 18 nt, Homo sapiens
auuaguaugguucaagau

SEQ ID NO: 806545 - RNA, 16 nt, Homo sapiens
auuagugcuagucuca

SEQ ID NO: 806546 - RNA, 16 nt, Homo sapiens
auuauaaauaaauaga

SEQ ID NO: 806547 - RNA, 12 nt, Homo sapiens
auuauaacuuaa

SEQ ID NO: 806548 - RNA, 19 nt, Homo sapiens
auuauaauaugugccuuaa

SEQ ID NO: 806549 - RNA, 12 nt, Homo sapiens
auuauacagaua

SEQ ID NO: 806550 - RNA, 19 nt, Homo sapiens
auuauacuuacuucuggca

SEQ ID NO: 806551 - RNA, 21 nt, Homo sapiens
auuauagaauucuguacuuga

SEQ ID NO: 806552 - RNA, 15 nt, Homo sapiens
auuauauauacaugg

SEQ ID NO: 806553 - RNA, 20 nt, Homo sapiens
auuauauauuccgcacucaa

SEQ ID NO: 806554 - RNA, 18 nt, Homo sapiens
auuauauucacagacuga

SEQ ID NO: 806555 - RNA, 13 nt, Homo sapiens
auuauauuugaca

SEQ ID NO: 806556 - RNA, 14 nt, Homo sapiens
auuauauuugacau

SEQ ID NO: 806557 - RNA, 18 nt, Homo sapiens
auuauauuuuuacauaua

SEQ ID NO: 806558 - RNA, 13 nt, Homo sapiens
auuaucaaaaagc

SEQ ID NO: 806559 - RNA, 16 nt, Homo sapiens
auuauccuucuacuug

SEQ ID NO: 806560 - RNA, 23 nt, Homo sapiens
auuaucucaaaacugcacuguca

SEQ ID NO: 806561 - RNA, 17 nt, Homo sapiens
auuaugcauaaagccaa

SEQ ID NO: 806562 - RNA, 20 nt, Homo sapiens
auuaugcauuauaucaaauc

SEQ ID NO: 806563 - RNA, 20 nt, Homo sapiens
auuauggcaagugauaucac

SEQ ID NO: 806564 - RNA, 15 nt, Homo sapiens
auuauguauguuuac

SEQ ID NO: 806565 - RNA, 16 nt, Homo sapiens
auuaugucguaaguca

SEQ ID NO: 806566 - RNA, 22 nt, Homo sapiens
auuauguuuugcauguaugacu

SEQ ID NO: 806567 - RNA, 14 nt, Homo sapiens
auuauuauccuccu

SEQ ID NO: 806568 - RNA, 14 nt, Homo sapiens
auuauuauguucuu

SEQ ID NO: 806569 - RNA, 18 nt, Homo sapiens
auuauuauucuucauaac

SEQ ID NO: 806570 - RNA, 17 nt, Homo sapiens
auuauuccaagccuuau

SEQ ID NO: 806571 - RNA, 13 nt, Homo sapiens
auuauucccauga

SEQ ID NO: 806572 - RNA, 15 nt, Homo sapiens
auuauucccauucua

SEQ ID NO: 806573 - RNA, 21 nt, Homo sapiens
auuauucccauucuacauacu

SEQ ID NO: 806574 - RNA, 20 nt, Homo sapiens
auuauucuuguaguuuaccu

SEQ ID NO: 806575 - RNA, 19 nt, Homo sapiens
auuauuuauugcuguguaa

SEQ ID NO: 806576 - RNA, 16 nt, Homo sapiens
auuuaacagugcaaaa

SEQ ID NO: 806577 - RNA, 22 nt, Homo sapiens
auuuaaccaaccuaagggccca

SEQ ID NO: 806578 - RNA, 20 nt, Homo sapiens
auuuaagugaauacauuaac

SEQ ID NO: 806579 - RNA, 18 nt, Homo sapiens
auuuaaguuaucaacuuu

SEQ ID NO: 806580 - RNA, 21 nt, Homo sapiens
auuuaauaaaugugccuucau

SEQ ID NO: 806581 - RNA, 16 nt, Homo sapiens
auuuaauauuuugcac

SEQ ID NO: 806582 - RNA, 19 nt, Homo sapiens
auuuaaugaauacuugcua

SEQ ID NO: 806583 - RNA, 21 nt, Homo sapiens
auuuaauggaaucagauauug

SEQ ID NO: 806584 - RNA, 19 nt, Homo sapiens
auuuaauguuuuuaaucac

SEQ ID NO: 806585 - RNA, 16 nt, Homo sapiens
auuuacacuacauugu

SEQ ID NO: 806586 - RNA, 21 nt, Homo sapiens
auuuacagaaaagacucugac

SEQ ID NO: 806587 - RNA, 23 nt, Homo sapiens
auuuacagaaaagacucugacca

SEQ ID NO: 806588 - RNA, 21 nt, Homo sapiens
auuuacaugaauugcauuuua

SEQ ID NO: 806589 - RNA, 11 nt, Homo sapiens
auuuacauuca

SEQ ID NO: 806590 - RNA, 20 nt, Homo sapiens
auuuacauuuaauacagaua

SEQ ID NO: 806591 - RNA, 17 nt, Homo sapiens
auuuaccuauacauuau

SEQ ID NO: 806592 - RNA, 17 nt, Homo sapiens
auuuacucaaagacaua

SEQ ID NO: 806593 - RNA, 11 nt, Homo sapiens
auuuacuuaac

SEQ ID NO: 806594 - RNA, 19 nt, Homo sapiens
auuuagaagccaacuauga

SEQ ID NO: 806595 - RNA, 23 nt, Homo sapiens
auuuagaagccaacuaugauuau

SEQ ID NO: 806596 - RNA, 18 nt, Homo sapiens
auuuagaccccauacaag

SEQ ID NO: 806597 - RNA, 23 nt, Homo sapiens
auuuagaccccauacaaguuuau

SEQ ID NO: 806598 - RNA, 21 nt, Homo sapiens
auuuagacucaucuuacugua

SEQ ID NO: 806599 - RNA, 23 nt, Homo sapiens
auuuagcaagguguuucugggcu

SEQ ID NO: 806600 - RNA, 18 nt, Homo sapiens
auuuaguaacaguuguga

SEQ ID NO: 806601 - RNA, 18 nt, Homo sapiens
auuuagugaaguugugca

SEQ ID NO: 806602 - RNA, 18 nt, Homo sapiens
auuuaguucaacuguaua

SEQ ID NO: 806603 - RNA, 13 nt, Homo sapiens
auuuauaacucau

SEQ ID NO: 806604 - RNA, 15 nt, Homo sapiens
auuuauaacucauca

SEQ ID NO: 806605 - RNA, 16 nt, Homo sapiens
auuuauaagugacuuu

SEQ ID NO: 806606 - RNA, 19 nt, Homo sapiens
auuuauaccucaguuugca

SEQ ID NO: 806607 - RNA, 21 nt, Homo sapiens
auuuauacucacugagucuua

SEQ ID NO: 806608 - RNA, 15 nt, Homo sapiens
auuuauagcuaugaa

SEQ ID NO: 806609 - RNA, 18 nt, Homo sapiens
auuuauagcuaugaaacc

SEQ ID NO: 806610 - RNA, 12 nt, Homo sapiens
auuuauauaugu

SEQ ID NO: 806611 - RNA, 23 nt, Homo sapiens
auuuauaucgcuggccagcauua

SEQ ID NO: 806612 - RNA, 15 nt, Homo sapiens
auuuauauuccauuu

SEQ ID NO: 806613 - RNA, 17 nt, Homo sapiens
auuuauauugcagauug

SEQ ID NO: 806614 - RNA, 13 nt, Homo sapiens
auuuaucacugaa

SEQ ID NO: 806615 - RNA, 14 nt, Homo sapiens
auuuaucagugaca

SEQ ID NO: 806616 - RNA, 22 nt, Homo sapiens
auuuaucuauaauuuaccuaag

SEQ ID NO: 806617 - RNA, 14 nt, Homo sapiens
auuuaucucaaaaa

SEQ ID NO: 806618 - RNA, 15 nt, Homo sapiens
auuuaucugugcaaa

SEQ ID NO: 806619 - RNA, 19 nt, Homo sapiens
auuuaucugugcaaauccu

SEQ ID NO: 806620 - RNA, 23 nt, Homo sapiens
auuuaucugugcaaauccuugau

SEQ ID NO: 806621 - RNA, 12 nt, Homo sapiens
auuuaucugugu

SEQ ID NO: 806622 - RNA, 18 nt, Homo sapiens
auuuaugaagaaaauacu

SEQ ID NO: 806623 - RNA, 16 nt, Homo sapiens
auuuaugaccuaaguc

SEQ ID NO: 806624 - RNA, 19 nt, Homo sapiens
auuuauggucaacacuuaa

SEQ ID NO: 806625 - RNA, 20 nt, Homo sapiens
auuuauggucaacacuuaag

SEQ ID NO: 806626 - RNA, 15 nt, Homo sapiens
auuuaugguucucag

SEQ ID NO: 806627 - RNA, 13 nt, Homo sapiens
auuuauguguaua

SEQ ID NO: 806628 - RNA, 13 nt, Homo sapiens
auuuauguuuauu

SEQ ID NO: 806629 - RNA, 14 nt, Homo sapiens
auuuauuaccucug

SEQ ID NO: 806630 - RNA, 12 nt, Homo sapiens
auuuauucacau

SEQ ID NO: 806631 - RNA, 14 nt, Homo sapiens
auuuauuguauuag

SEQ ID NO: 806632 - RNA, 16 nt, Homo sapiens
auuuauuuaagcauca

SEQ ID NO: 806633 - RNA, 15 nt, Homo sapiens
auuuauuuacacucu

SEQ ID NO: 806634 - RNA, 21 nt, Homo sapiens
auuuauuuugagaagcucuga

SEQ ID NO: 806635 - RNA, 20 nt, Homo sapiens
auuuauuuuguguuguucau

SEQ ID NO: 806636 - RNA, 19 nt, Homo sapiens
auuucaaaauauacauuca

SEQ ID NO: 806637 - RNA, 22 nt, Homo sapiens
auuucaaaauucuccaacagcu

SEQ ID NO: 806638 - RNA, 20 nt, Homo sapiens
auuucaaagggaaacuuuaa

SEQ ID NO: 806639 - RNA, 22 nt, Homo sapiens
auuucaaaguuuuguuguacuu

SEQ ID NO: 806640 - RNA, 22 nt, Homo sapiens
auuucaaauuguuuucagugaa

SEQ ID NO: 806641 - RNA, 14 nt, Homo sapiens
auuucaagugccua

SEQ ID NO: 806642 - RNA, 16 nt, Homo sapiens
auuucaccaccaaaug

SEQ ID NO: 806643 - RNA, 14 nt, Homo sapiens
auuucacgcuuuua

SEQ ID NO: 806644 - RNA, 13 nt, Homo sapiens
auuucacucucaa

SEQ ID NO: 806645 - RNA, 19 nt, Homo sapiens
auuucacucucaaacuuca

SEQ ID NO: 806646 - RNA, 14 nt, Homo sapiens
auuucacuugauga

SEQ ID NO: 806647 - RNA, 14 nt, Homo sapiens
auuucagacauuuu

SEQ ID NO: 806648 - RNA, 17 nt, Homo sapiens
auuucagagagcuucuu

SEQ ID NO: 806649 - RNA, 13 nt, Homo sapiens
auuucagcaaacg

SEQ ID NO: 806650 - RNA, 22 nt, Homo sapiens
auuucagggucuuggcugccug

SEQ ID NO: 806651 - RNA, 15 nt, Homo sapiens
auuucauaaacaacu

SEQ ID NO: 806652 - RNA, 13 nt, Homo sapiens
auuucauacugua

SEQ ID NO: 806653 - RNA, 21 nt, Homo sapiens
auuucaugggacuaaaugaac

SEQ ID NO: 806654 - RNA, 22 nt, Homo sapiens
auuucauguuuuugaucaaaaa

SEQ ID NO: 806655 - RNA, 18 nt, Homo sapiens
auuucauuuguaacuuua

SEQ ID NO: 806656 - RNA, 21 nt, Homo sapiens
auuuccacaaaaucuguccaa

SEQ ID NO: 806657 - RNA, 14 nt, Homo sapiens
auuuccauagucaa

SEQ ID NO: 806658 - RNA, 14 nt, Homo sapiens
auuuccaucuguau

SEQ ID NO: 806659 - RNA, 18 nt, Homo sapiens
auuucccacugcacucca

SEQ ID NO: 806660 - RNA, 19 nt, Homo sapiens
auuucccaggacccugaag

SEQ ID NO: 806661 - RNA, 18 nt, Homo sapiens
auuuccccuuaucuuucu

SEQ ID NO: 806662 - RNA, 17 nt, Homo sapiens
auuucccugguagugua

SEQ ID NO: 806663 - RNA, 19 nt, Homo sapiens
auuuccguaccccugagga

SEQ ID NO: 806664 - RNA, 15 nt, Homo sapiens
auuuccuaaggcaug

SEQ ID NO: 806665 - RNA, 16 nt, Homo sapiens
auuuccuaaggcaugu

SEQ ID NO: 806666 - RNA, 20 nt, Homo sapiens
auuuccuaaugucagaguag

SEQ ID NO: 806667 - RNA, 23 nt, Homo sapiens
auuuccuauagcuacauguucuu

SEQ ID NO: 806668 - RNA, 14 nt, Homo sapiens
auuuccucuuauca

SEQ ID NO: 806669 - RNA, 13 nt, Homo sapiens
auuuccugacaga

SEQ ID NO: 806670 - RNA, 17 nt, Homo sapiens
auuuccuguuugaaaua

SEQ ID NO: 806671 - RNA, 22 nt, Homo sapiens
auuuccuuacagaacuacuucu

SEQ ID NO: 806672 - RNA, 13 nt, Homo sapiens
auuuccuuuaugu

SEQ ID NO: 806673 - RNA, 17 nt, Homo sapiens
auuuccuuuucuucccu

SEQ ID NO: 806674 - RNA, 15 nt, Homo sapiens
auuuccuuuuugaca

SEQ ID NO: 806675 - RNA, 19 nt, Homo sapiens
auuuccuuuuugacacuga

SEQ ID NO: 806676 - RNA, 23 nt, Homo sapiens
auuucuacuucuggaagucaucu

SEQ ID NO: 806677 - RNA, 16 nt, Homo sapiens
auuucuagaagcacau

SEQ ID NO: 806678 - RNA, 15 nt, Homo sapiens
auuucuauaaauaga

SEQ ID NO: 806679 - RNA, 20 nt, Homo sapiens
auuucuaucagccuugcuaa

SEQ ID NO: 806680 - RNA, 21 nt, Homo sapiens
auuucucaaaugcacaucuca

SEQ ID NO: 806681 - RNA, 18 nt, Homo sapiens
auuucucaguaucaguau

SEQ ID NO: 806682 - RNA, 20 nt, Homo sapiens
auuucucaguaucaguauuu

SEQ ID NO: 806683 - RNA, 19 nt, Homo sapiens
auuucucauugacuuuuau

SEQ ID NO: 806684 - RNA, 23 nt, Homo sapiens
auuucucauuugaguauuacaau

SEQ ID NO: 806685 - RNA, 17 nt, Homo sapiens
auuucucuaacccuauc

SEQ ID NO: 806686 - RNA, 17 nt, Homo sapiens
auuucugaacuguuaca

SEQ ID NO: 806687 - RNA, 15 nt, Homo sapiens
auuucugcaucagcu

SEQ ID NO: 806688 - RNA, 23 nt, Homo sapiens
auuucugcuaaauaucaccuagc

SEQ ID NO: 806689 - RNA, 19 nt, Homo sapiens
auuucuggaaaacugccuu

SEQ ID NO: 806690 - RNA, 20 nt, Homo sapiens
ucucaaacuccugaccucag

SEQ ID NO: 806691 - RNA, 16 nt, Homo sapiens
ucucaaacuucacuaa

SEQ ID NO: 806692 - RNA, 23 nt, Homo sapiens
ucucaaagaaauauuaagcaugu

SEQ ID NO: 806693 - RNA, 17 nt, Homo sapiens
ucucaaagaaggcauuu

SEQ ID NO: 806694 - RNA, 19 nt, Homo sapiens
ucucaaagguaauucugaa

SEQ ID NO: 806695 - RNA, 14 nt, Homo sapiens
ucucaaaugcacau

SEQ ID NO: 806696 - RNA, 19 nt, Homo sapiens
ucucaaaugcacaucucau

SEQ ID NO: 806697 - RNA, 14 nt, Homo sapiens
ucucaagacuuuag

SEQ ID NO: 806698 - RNA, 23 nt, Homo sapiens
ucucaauaacaaacuggcugcuu

SEQ ID NO: 806699 - RNA, 16 nt, Homo sapiens
ucucaauguacauaga

SEQ ID NO: 806700 - RNA, 12 nt, Homo sapiens
ucucaauucuuu

SEQ ID NO: 806701 - RNA, 17 nt, Homo sapiens
ucucacaaaaaggcaaa

SEQ ID NO: 806702 - RNA, 12 nt, Homo sapiens
ucucacaaacau

SEQ ID NO: 806703 - RNA, 18 nt, Homo sapiens
ucucacagagaagcuccu

SEQ ID NO: 806704 - RNA, 13 nt, Homo sapiens
ucucacagcaaca

SEQ ID NO: 806705 - RNA, 19 nt, Homo sapiens
ucucacccauuaucuggaa

SEQ ID NO: 806706 - RNA, 17 nt, Homo sapiens
ucucacugaaacauuua

SEQ ID NO: 806707 - RNA, 20 nt, Homo sapiens
ucucagaacuccugugugug

SEQ ID NO: 806708 - RNA, 17 nt, Homo sapiens
ucucagaauaacuaccu

SEQ ID NO: 806709 - RNA, 13 nt, Homo sapiens
ucucagcacuuug

SEQ ID NO: 806710 - RNA, 21 nt, Homo sapiens
ucucagccuaccaugagaaua

SEQ ID NO: 806711 - RNA, 17 nt, Homo sapiens
ucucagccuccugagua

SEQ ID NO: 806712 - RNA, 13 nt, Homo sapiens
ucucagcucacug

SEQ ID NO: 806713 - RNA, 16 nt, Homo sapiens
ucucagcucacugcaa

SEQ ID NO: 806714 - RNA, 21 nt, Homo sapiens
ucucagcucacugcaaccucu

SEQ ID NO: 806715 - RNA, 17 nt, Homo sapiens
ucucagcuccaauuuca

SEQ ID NO: 806716 - RNA, 19 nt, Homo sapiens
ucucaggagcuugcaagaa

SEQ ID NO: 806717 - RNA, 23 nt, Homo sapiens
ucucagguaggaagcaacagcuu

SEQ ID NO: 806718 - RNA, 24 nt, Homo sapiens
ucucagguaggaagcaacagcuuc

SEQ ID NO: 806719 - RNA, 18 nt, Homo sapiens
ucucagguguugccaaau

SEQ ID NO: 806720 - RNA, 21 nt, Homo sapiens
ucucagugcuucuuacuauua

SEQ ID NO: 806721 - RNA, 14 nt, Homo sapiens
ucucaguuaggaga

SEQ ID NO: 806722 - RNA, 17 nt, Homo sapiens
ucucauaccucugacca

SEQ ID NO: 806723 - RNA, 19 nt, Homo sapiens
ucucaucuuucuugaucaa

SEQ ID NO: 806724 - RNA, 17 nt, Homo sapiens
ucucaugauagaaggcu

SEQ ID NO: 806725 - RNA, 20 nt, Homo sapiens
ucucaugccucagccucuca

SEQ ID NO: 806726 - RNA, 10 nt, Homo sapiens
ucucauguca

SEQ ID NO: 806727 - RNA, 14 nt, Homo sapiens
ucucauuacagauu

SEQ ID NO: 806728 - RNA, 22 nt, Homo sapiens
ucucauuauugagauucaucca

SEQ ID NO: 806729 - RNA, 17 nt, Homo sapiens
ucucauucugugccauu

SEQ ID NO: 806730 - RNA, 16 nt, Homo sapiens
ucucauugacuuuuau

SEQ ID NO: 806731 - RNA, 18 nt, Homo sapiens
ucucauuuagaacuugca

SEQ ID NO: 806732 - RNA, 24 nt, Homo sapiens
ucucauuuauauugcagauugaau

SEQ ID NO: 806733 - RNA, 19 nt, Homo sapiens
ucuccaacagccagugugu

SEQ ID NO: 806734 - RNA, 14 nt, Homo sapiens
ucuccaaccacugu

SEQ ID NO: 806735 - RNA, 18 nt, Homo sapiens
ucuccaaggcagggacca

SEQ ID NO: 806736 - RNA, 19 nt, Homo sapiens
auaacuggaaaacagaaca

SEQ ID NO: 806737 - RNA, 22 nt, Homo sapiens
auaacuggcuucugcuugucau

SEQ ID NO: 806738 - RNA, 12 nt, Homo sapiens
auaacugugaag

SEQ ID NO: 806739 - RNA, 20 nt, Homo sapiens
auaacuuggccauguucucc

SEQ ID NO: 806740 - RNA, 20 nt, Homo sapiens
auaacuuuucaccaaugagc

SEQ ID NO: 806741 - RNA, 19 nt, Homo sapiens
auaagaaacuuauuucuca

SEQ ID NO: 806742 - RNA, 14 nt, Homo sapiens
auaagaaagcacua

SEQ ID NO: 806743 - RNA, 15 nt, Homo sapiens
auaagaaagcacuau

SEQ ID NO: 806744 - RNA, 18 nt, Homo sapiens
auaagacaaacacugcca

SEQ ID NO: 806745 - RNA, 15 nt, Homo sapiens
auaagaccucuggca

SEQ ID NO: 806746 - RNA, 14 nt, Homo sapiens
auaagacuacugaa

SEQ ID NO: 806747 - RNA, 13 nt, Homo sapiens
auaagagauuugg

SEQ ID NO: 806748 - RNA, 19 nt, Homo sapiens
auaagauauuuaguaauau

SEQ ID NO: 806749 - RNA, 20 nt, Homo sapiens
auaagauugacuuugaaucu

SEQ ID NO: 806750 - RNA, 11 nt, Homo sapiens
auaagcaagag

SEQ ID NO: 806751 - RNA, 18 nt, Homo sapiens
auaagcaggacagaggau

SEQ ID NO: 806752 - RNA, 18 nt, Homo sapiens
auaagcccaguucaucac

SEQ ID NO: 806753 - RNA, 22 nt, Homo sapiens
auaagcucuccccaaacuugcu

SEQ ID NO: 806754 - RNA, 15 nt, Homo sapiens
auaaggaaagcaaua

SEQ ID NO: 806755 - RNA, 15 nt, Homo sapiens
auaaggauucaggga

SEQ ID NO: 806756 - RNA, 16 nt, Homo sapiens
auaaggugcuaucugu

SEQ ID NO: 806757 - RNA, 16 nt, Homo sapiens
auaaguuaacuuccaa

SEQ ID NO: 806758 - RNA, 14 nt, Homo sapiens
auaaguucauacau

SEQ ID NO: 806759 - RNA, 22 nt, Homo sapiens
auaauaaaaaaauuagugagua

SEQ ID NO: 806760 - RNA, 24 nt, Homo sapiens
auaauaaaaaaauuagugaguaua

SEQ ID NO: 806761 - RNA, 21 nt, Homo sapiens
auaauaaaacuaaacuuucau

SEQ ID NO: 806762 - RNA, 16 nt, Homo sapiens
auaauaaacaguggaa

SEQ ID NO: 806763 - RNA, 13 nt, Homo sapiens
auaauaacucaua

SEQ ID NO: 806764 - RNA, 17 nt, Homo sapiens
auaauaaugaugaugau

SEQ ID NO: 806765 - RNA, 21 nt, Homo sapiens
auaauagguauauagaacaca

SEQ ID NO: 806766 - RNA, 14 nt, Homo sapiens
auaauauaagccau

SEQ ID NO: 806767 - RNA, 24 nt, Homo sapiens
auaauauccagccucccacaagaa

SEQ ID NO: 806768 - RNA, 17 nt, Homo sapiens
auaauaugaaaaucucc

SEQ ID NO: 806769 - RNA, 17 nt, Homo sapiens
auaauaugugccuuaag

SEQ ID NO: 806770 - RNA, 18 nt, Homo sapiens
auaaucacaacccuucag

SEQ ID NO: 806771 - RNA, 19 nt, Homo sapiens
auaaucacauuaucaucug

SEQ ID NO: 806772 - RNA, 20 nt, Homo sapiens
auaaucacauuaucaucuga

SEQ ID NO: 806773 - RNA, 16 nt, Homo sapiens
auaaucagugugucua

SEQ ID NO: 806774 - RNA, 12 nt, Homo sapiens
auaaucuuaucu

SEQ ID NO: 806775 - RNA, 13 nt, Homo sapiens
auaaucuucugcc

SEQ ID NO: 806776 - RNA, 21 nt, Homo sapiens
auaaucuuuggguaacuucaa

SEQ ID NO: 806777 - RNA, 22 nt, Homo sapiens
auaaugaauacauuuccaaaau

SEQ ID NO: 806778 - RNA, 13 nt, Homo sapiens
auaaugagcaugu

SEQ ID NO: 806779 - RNA, 14 nt, Homo sapiens
auaaugauacuuaa

SEQ ID NO: 806780 - RNA, 15 nt, Homo sapiens
auaaugcucacuugg

SEQ ID NO: 806781 - RNA, 12 nt, Homo sapiens
auaaugcugaag

SEQ ID NO: 806782 - RNA, 17 nt, Homo sapiens
auaaugcuguugccuca

SEQ ID NO: 806783 - RNA, 16 nt, Homo sapiens
auaaugcuuuguuaaa

SEQ ID NO: 806784 - RNA, 16 nt, Homo sapiens
auaauggggcagacac

SEQ ID NO: 806785 - RNA, 19 nt, Homo sapiens
auaaugguugacuggguuu

SEQ ID NO: 806786 - RNA, 22 nt, Homo sapiens
auaauguacucacauauaacau

SEQ ID NO: 806787 - RNA, 21 nt, Homo sapiens
auaauuaccaauaucuugcca

SEQ ID NO: 806788 - RNA, 22 nt, Homo sapiens
auaauuaccaauaucuugccag

SEQ ID NO: 806789 - RNA, 14 nt, Homo sapiens
auaauucagcacuu

SEQ ID NO: 806790 - RNA, 19 nt, Homo sapiens
auaauucagcacuuaacua

SEQ ID NO: 806791 - RNA, 22 nt, Homo sapiens
auaauucagcacuuaacuauga

SEQ ID NO: 806792 - RNA, 22 nt, Homo sapiens
auaauuccuauauccugugacu

SEQ ID NO: 806793 - RNA, 23 nt, Homo sapiens
auaauuccuauauccugugacug

SEQ ID NO: 806794 - RNA, 16 nt, Homo sapiens
auaauucuacuuugag

SEQ ID NO: 806795 - RNA, 23 nt, Homo sapiens
auaauugcuccuauacuauugaa

SEQ ID NO: 806796 - RNA, 12 nt, Homo sapiens
auaauuguguag

SEQ ID NO: 806797 - RNA, 21 nt, Homo sapiens
auaauuuaacuguguuuuagg

SEQ ID NO: 806798 - RNA, 19 nt, Homo sapiens
auaauuuauacaggucaua

SEQ ID NO: 806799 - RNA, 16 nt, Homo sapiens
auaauuucaaaccaca

SEQ ID NO: 806800 - RNA, 13 nt, Homo sapiens
auaauuugaucuu

SEQ ID NO: 806801 - RNA, 16 nt, Homo sapiens
auaauuuuaugcugga

SEQ ID NO: 806802 - RNA, 12 nt, Homo sapiens
auacaaaccuac

SEQ ID NO: 806803 - RNA, 12 nt, Homo sapiens
auacaaccagcc

SEQ ID NO: 806804 - RNA, 16 nt, Homo sapiens
auacaagaaagcaaug

SEQ ID NO: 806805 - RNA, 16 nt, Homo sapiens
auaucgagaacugcca

SEQ ID NO: 806806 - RNA, 14 nt, Homo sapiens
auaucuaguaugaa

SEQ ID NO: 806807 - RNA, 16 nt, Homo sapiens
auaucuaugcugagua

SEQ ID NO: 806808 - RNA, 20 nt, Homo sapiens
auaucuauuauucaaaaaau

SEQ ID NO: 806809 - RNA, 14 nt, Homo sapiens
auaucuauuugaga

SEQ ID NO: 806810 - RNA, 21 nt, Homo sapiens
auaucugugaggugcugauga

SEQ ID NO: 806811 - RNA, 16 nt, Homo sapiens
auaucuugcuuucaaa

SEQ ID NO: 806812 - RNA, 23 nt, Homo sapiens
auaucuugcuuucaaauuggcac

SEQ ID NO: 806813 - RNA, 16 nt, Homo sapiens
auaucuuguagcuuua

SEQ ID NO: 806814 - RNA, 17 nt, Homo sapiens
auaucuuguagcuuuau

SEQ ID NO: 806815 - RNA, 19 nt, Homo sapiens
auaucuuuuguaagacauu

SEQ ID NO: 806816 - RNA, 16 nt, Homo sapiens
auaugaaaaucuccau

SEQ ID NO: 806817 - RNA, 15 nt, Homo sapiens
auaugaaggauuacu

SEQ ID NO: 806818 - RNA, 19 nt, Homo sapiens
auaugagacguuuuuggaa

SEQ ID NO: 806819 - RNA, 18 nt, Homo sapiens
auaugauuuuuauccaug

SEQ ID NO: 806820 - RNA, 21 nt, Homo sapiens
auaugcacaauagcaguugaa

SEQ ID NO: 806821 - RNA, 18 nt, Homo sapiens
auaugcaccuugugucug

SEQ ID NO: 806822 - RNA, 14 nt, Homo sapiens
auaugcaucuggcc

SEQ ID NO: 806823 - RNA, 14 nt, Homo sapiens
auaugcugccaaau

SEQ ID NO: 806824 - RNA, 20 nt, Homo sapiens
auaugcuuggcuaacuauau

SEQ ID NO: 806825 - RNA, 18 nt, Homo sapiens
auauggaagcaaccagca

SEQ ID NO: 806826 - RNA, 22 nt, Homo sapiens
auauggcaaauagccacaauua

SEQ ID NO: 806827 - RNA, 18 nt, Homo sapiens
auaugggacugagccugg

SEQ ID NO: 806828 - RNA, 15 nt, Homo sapiens
auaugggcacuuuaa

SEQ ID NO: 806829 - RNA, 16 nt, Homo sapiens
auauggugaagggaag

SEQ ID NO: 806830 - RNA, 20 nt, Homo sapiens
auauguaauucuuuccauca

SEQ ID NO: 806831 - RNA, 20 nt, Homo sapiens
auauguacuuguuugcuaug

SEQ ID NO: 806832 - RNA, 20 nt, Homo sapiens
auauguauacaugugccaug

SEQ ID NO: 806833 - RNA, 14 nt, Homo sapiens
auauguauauacau

SEQ ID NO: 806834 - RNA, 15 nt, Homo sapiens
auauguaucauaaaa

SEQ ID NO: 806835 - RNA, 17 nt, Homo sapiens
auauguaugcaccucaa

SEQ ID NO: 806836 - RNA, 21 nt, Homo sapiens
auauguauuauaggaggagcu

SEQ ID NO: 806837 - RNA, 19 nt, Homo sapiens
auaugugggugcuccucuu

SEQ ID NO: 806838 - RNA, 23 nt, Homo sapiens
auaugugggugucagucagggac

SEQ ID NO: 806839 - RNA, 19 nt, Homo sapiens
auauguuagaaucaaauac

SEQ ID NO: 806840 - RNA, 15 nt, Homo sapiens
auauguucccuccag

SEQ ID NO: 806841 - RNA, 15 nt, Homo sapiens
auauuaaaacacuua

SEQ ID NO: 806842 - RNA, 14 nt, Homo sapiens
auauuaaacaucca

SEQ ID NO: 806843 - RNA, 15 nt, Homo sapiens
auauuaaacauccac

SEQ ID NO: 806844 - RNA, 15 nt, Homo sapiens
auauuaacacgcugc

SEQ ID NO: 806845 - RNA, 14 nt, Homo sapiens
auauuaacauucuu

SEQ ID NO: 806846 - RNA, 17 nt, Homo sapiens
auauuaagauucuugac

SEQ ID NO: 806847 - RNA, 21 nt, Homo sapiens
auauuaagcaaacacuugaag

SEQ ID NO: 806848 - RNA, 19 nt, Homo sapiens
auauuacugucuuuauucu

SEQ ID NO: 806849 - RNA, 18 nt, Homo sapiens
auauucaacagcucacca

SEQ ID NO: 806850 - RNA, 15 nt, Homo sapiens
auauucaaugcauuu

SEQ ID NO: 806851 - RNA, 16 nt, Homo sapiens
auauucaggacuugaa

SEQ ID NO: 806852 - RNA, 22 nt, Homo sapiens
caccuaauguuuaugagccaga

SEQ ID NO: 806853 - RNA, 14 nt, Homo sapiens
caccuacacaggag

SEQ ID NO: 806854 - RNA, 16 nt, Homo sapiens
caccuacauuaucuca

SEQ ID NO: 806855 - RNA, 19 nt, Homo sapiens
caccuacgcgagucuuacu

SEQ ID NO: 806856 - RNA, 13 nt, Homo sapiens
caccuagucugua

SEQ ID NO: 806857 - RNA, 21 nt, Homo sapiens
caccuagugcuuccacuucua

SEQ ID NO: 806858 - RNA, 16 nt, Homo sapiens
caccucagaguggagu

SEQ ID NO: 806859 - RNA, 19 nt, Homo sapiens
caccucagccccacugaca

SEQ ID NO: 806860 - RNA, 19 nt, Homo sapiens
caccucauucugaacccuu

SEQ ID NO: 806861 - RNA, 19 nt, Homo sapiens
caccucccauuacuuugau

SEQ ID NO: 806862 - RNA, 22 nt, Homo sapiens
caccuccuagaggugggcagcu

SEQ ID NO: 806863 - RNA, 22 nt, Homo sapiens
caccucuaaucuggauguuaag

SEQ ID NO: 806864 - RNA, 23 nt, Homo sapiens
caccucugauggcugaagaaugu

SEQ ID NO: 806865 - RNA, 14 nt, Homo sapiens
caccucugcaccuu

SEQ ID NO: 806866 - RNA, 19 nt, Homo sapiens
caccugacaauggcagcua

SEQ ID NO: 806867 - RNA, 18 nt, Homo sapiens
caccugacacaccaggcg

SEQ ID NO: 806868 - RNA, 15 nt, Homo sapiens
caccugacucuugca

SEQ ID NO: 806869 - RNA, 13 nt, Homo sapiens
caccugagcauga

SEQ ID NO: 806870 - RNA, 14 nt, Homo sapiens
caccugcuccagaa

SEQ ID NO: 806871 - RNA, 20 nt, Homo sapiens
caccugcugguuguugccag

SEQ ID NO: 806872 - RNA, 16 nt, Homo sapiens
caccugcuucugaacu

SEQ ID NO: 806873 - RNA, 23 nt, Homo sapiens
caccuggccugguugugugcaca

SEQ ID NO: 806874 - RNA, 20 nt, Homo sapiens
caccugggccgggcuguaga

SEQ ID NO: 806875 - RNA, 18 nt, Homo sapiens
caccuggugggugguguc

SEQ ID NO: 806876 - RNA, 12 nt, Homo sapiens
caccuguaggca

SEQ ID NO: 806877 - RNA, 14 nt, Homo sapiens
caccugugaguuua

SEQ ID NO: 806878 - RNA, 16 nt, Homo sapiens
caccuucaaaauguuc

SEQ ID NO: 806879 - RNA, 16 nt, Homo sapiens
caccuucaagcagcug

SEQ ID NO: 806880 - RNA, 13 nt, Homo sapiens
caccuucaccucg

SEQ ID NO: 806881 - RNA, 16 nt, Homo sapiens
caccuuggcaccagac

SEQ ID NO: 806882 - RNA, 13 nt, Homo sapiens
caccuugucacau

SEQ ID NO: 806883 - RNA, 14 nt, Homo sapiens
caccuugucaugua

SEQ ID NO: 806884 - RNA, 16 nt, Homo sapiens
caccuugucugcuaaa

SEQ ID NO: 806885 - RNA, 15 nt, Homo sapiens
caccuugugucugua

SEQ ID NO: 806886 - RNA, 17 nt, Homo sapiens
caccuugugucuguaca

SEQ ID NO: 806887 - RNA, 15 nt, Homo sapiens
caccuuuagguucuu

SEQ ID NO: 806888 - RNA, 17 nt, Homo sapiens
caccuuuccagccauag

SEQ ID NO: 806889 - RNA, 13 nt, Homo sapiens
caccuuuuacucu

SEQ ID NO: 806890 - RNA, 21 nt, Homo sapiens
cacgagcuagcuucugcaaug

SEQ ID NO: 806891 - RNA, 12 nt, Homo sapiens
cacgaugcauuu

SEQ ID NO: 806892 - RNA, 14 nt, Homo sapiens
cacgaugcauuuaa

SEQ ID NO: 806893 - RNA, 20 nt, Homo sapiens
cacgaugcauuuaauaaaga

SEQ ID NO: 806894 - RNA, 19 nt, Homo sapiens
cacgaugguggaaacagug

SEQ ID NO: 806895 - RNA, 15 nt, Homo sapiens
cacgcaagggcauca

SEQ ID NO: 806896 - RNA, 12 nt, Homo sapiens
cacgcacgcaca

SEQ ID NO: 806897 - RNA, 13 nt, Homo sapiens
cacgcagggccau

SEQ ID NO: 806898 - RNA, 13 nt, Homo sapiens
cacgcagucugcu

SEQ ID NO: 806899 - RNA, 19 nt, Homo sapiens
cacgcagucugcuucagug

SEQ ID NO: 806900 - RNA, 18 nt, Homo sapiens
cacgcaugugugcugcag

SEQ ID NO: 806901 - RNA, 18 nt, Homo sapiens
cacgccauuguacuccag

SEQ ID NO: 806902 - RNA, 15 nt, Homo sapiens
cacgccuacuuaaga

SEQ ID NO: 806903 - RNA, 13 nt, Homo sapiens
cacgccuguaauc

SEQ ID NO: 806904 - RNA, 15 nt, Homo sapiens
cacgccugugcagug

SEQ ID NO: 806905 - RNA, 18 nt, Homo sapiens
cacgcggauuaauuugca

SEQ ID NO: 806906 - RNA, 18 nt, Homo sapiens
cacgcuaguaacuccucu

SEQ ID NO: 806907 - RNA, 17 nt, Homo sapiens
cacgcucuggugcaguc

SEQ ID NO: 806908 - RNA, 20 nt, Homo sapiens
cacgcugcaccuaaagccua

SEQ ID NO: 806909 - RNA, 19 nt, Homo sapiens
cacgcuguuuguuucauau

SEQ ID NO: 806910 - RNA, 22 nt, Homo sapiens
cacggaguggcuugagcuucug

SEQ ID NO: 806911 - RNA, 17 nt, Homo sapiens
cacggauccauguagca

SEQ ID NO: 806912 - RNA, 18 nt, Homo sapiens
cacggaugacuuaacugc

SEQ ID NO: 806913 - RNA, 19 nt, Homo sapiens
cacggccccggguccagga

SEQ ID NO: 806914 - RNA, 22 nt, Homo sapiens
cacggcuccuccuuaugacucc

SEQ ID NO: 806915 - RNA, 18 nt, Homo sapiens
cacggcugcgcacugugu

SEQ ID NO: 806916 - RNA, 17 nt, Homo sapiens
cacggcuucacugacca

SEQ ID NO: 806917 - RNA, 23 nt, Homo sapiens
cacggugcccaaacaccagucac

SEQ ID NO: 806918 - RNA, 19 nt, Homo sapiens
cacgguuuggaaauauuca

SEQ ID NO: 806919 - RNA, 13 nt, Homo sapiens
cacgucugccagg

SEQ ID NO: 806920 - RNA, 13 nt, Homo sapiens
cacgucugcuaac

SEQ ID NO: 806921 - RNA, 12 nt, Homo sapiens
cacgucuuuucu

SEQ ID NO: 806922 - RNA, 12 nt, Homo sapiens
cacguggagcuc

SEQ ID NO: 806923 - RNA, 15 nt, Homo sapiens
cacguggggcccacu

SEQ ID NO: 806924 - RNA, 14 nt, Homo sapiens
cacguguccgucca

SEQ ID NO: 806925 - RNA, 19 nt, Homo sapiens
cacguuccacgacagauga

SEQ ID NO: 806926 - RNA, 20 nt, Homo sapiens
cacguuuaaucccagcacuu

SEQ ID NO: 806927 - RNA, 13 nt, Homo sapiens
cacuaaagcuuca

SEQ ID NO: 806928 - RNA, 15 nt, Homo sapiens
cacuaaauccccuca

SEQ ID NO: 806929 - RNA, 20 nt, Homo sapiens
cacuaagaauucaaacuggg

SEQ ID NO: 806930 - RNA, 13 nt, Homo sapiens
cacuaaucugaaa

SEQ ID NO: 806931 - RNA, 13 nt, Homo sapiens
cacuaaugcuuua

SEQ ID NO: 806932 - RNA, 15 nt, Homo sapiens
cacuacaacagaauu

SEQ ID NO: 806933 - RNA, 19 nt, Homo sapiens
cacuacaaucgcuaccuga

SEQ ID NO: 806934 - RNA, 19 nt, Homo sapiens
cacuacauuguacaaggaa

SEQ ID NO: 806935 - RNA, 22 nt, Homo sapiens
cacuaccauugcuguucuacuu

SEQ ID NO: 806936 - RNA, 16 nt, Homo sapiens
cacuaccguaaauguc

SEQ ID NO: 806937 - RNA, 22 nt, Homo sapiens
cacuagaauauuuaaaacauca

SEQ ID NO: 806938 - RNA, 22 nt, Homo sapiens
cacuagccaugauaacugcaau

SEQ ID NO: 806939 - RNA, 15 nt, Homo sapiens
cacuagcccaaugaa

SEQ ID NO: 806940 - RNA, 15 nt, Homo sapiens
cacuagccugugauu

SEQ ID NO: 806941 - RNA, 20 nt, Homo sapiens
cacuaggaggucaucaaccg

SEQ ID NO: 806942 - RNA, 13 nt, Homo sapiens
cacuaucacuuua

SEQ ID NO: 806943 - RNA, 11 nt, Homo sapiens
cacuaucuuuc

SEQ ID NO: 806944 - RNA, 20 nt, Homo sapiens
cacuauuaaguggguuugcc

SEQ ID NO: 806945 - RNA, 21 nt, Homo sapiens
cacuauuuccaaaagcacaug

SEQ ID NO: 806946 - RNA, 16 nt, Homo sapiens
cacucaaugccaacuu

SEQ ID NO: 806947 - RNA, 13 nt, Homo sapiens
cacucacacuggc

SEQ ID NO: 806948 - RNA, 16 nt, Homo sapiens
cacucaccucacuguu

SEQ ID NO: 806949 - RNA, 19 nt, Homo sapiens
cacucagagaugcauuugg

SEQ ID NO: 806950 - RNA, 21 nt, Homo sapiens
cacucaggccaacaagccaac

SEQ ID NO: 806951 - RNA, 15 nt, Homo sapiens
cacuccacagaguga

SEQ ID NO: 806952 - RNA, 21 nt, Homo sapiens
cacuccaguggcagacaaaca

SEQ ID NO: 806953 - RNA, 23 nt, Homo sapiens
cacucccaccugacacaccaggc

SEQ ID NO: 806954 - RNA, 14 nt, Homo sapiens
cacucccaguccaa

SEQ ID NO: 806955 - RNA, 13 nt, Homo sapiens
cacuccccuaggg

SEQ ID NO: 806956 - RNA, 16 nt, Homo sapiens
cacucccuggcucuca

SEQ ID NO: 806957 - RNA, 14 nt, Homo sapiens
cacucccuuuccaa

SEQ ID NO: 806958 - RNA, 23 nt, Homo sapiens
cacuccgagaggugggccagucu

SEQ ID NO: 806959 - RNA, 21 nt, Homo sapiens
cacuccuucucucacuguguu

SEQ ID NO: 806960 - RNA, 19 nt, Homo sapiens
cacuccuuuuuugcaugug

SEQ ID NO: 806961 - RNA, 22 nt, Homo sapiens
cacucgggugcguguguuugua

SEQ ID NO: 806962 - RNA, 19 nt, Homo sapiens
cacucuacccuauacaacu

SEQ ID NO: 806963 - RNA, 16 nt, Homo sapiens
cacucucagugcuucu

SEQ ID NO: 806964 - RNA, 17 nt, Homo sapiens
cacucugauucaccucu

SEQ ID NO: 806965 - RNA, 15 nt, Homo sapiens
cacucuggaaccuua

SEQ ID NO: 806966 - RNA, 23 nt, Homo sapiens
cacucugguggcaggugccuugu

SEQ ID NO: 806967 - RNA, 17 nt, Homo sapiens
cacucuguaauaguuca

SEQ ID NO: 806968 - RNA, 12 nt, Homo sapiens
cacucugucauc

SEQ ID NO: 806969 - RNA, 14 nt, Homo sapiens
cacucuuguaauaa

SEQ ID NO: 806970 - RNA, 18 nt, Homo sapiens
cacugaaaauaccaucag

SEQ ID NO: 806971 - RNA, 14 nt, Homo sapiens
cacugaaaccaggu

SEQ ID NO: 806972 - RNA, 15 nt, Homo sapiens
cacugaacuuugcaa

SEQ ID NO: 806973 - RNA, 13 nt, Homo sapiens
cacugaaucagcu

SEQ ID NO: 806974 - RNA, 18 nt, Homo sapiens
cacugaauuaaucaucua

SEQ ID NO: 806975 - RNA, 14 nt, Homo sapiens
cacugaauucacuc

SEQ ID NO: 806976 - RNA, 22 nt, Homo sapiens
cacugaccagcggcugcucaag

SEQ ID NO: 806977 - RNA, 22 nt, Homo sapiens
cacugacccuggucaccagagg

SEQ ID NO: 806978 - RNA, 16 nt, Homo sapiens
cacugacucugacuca

SEQ ID NO: 806979 - RNA, 13 nt, Homo sapiens
cacugacuugaga

SEQ ID NO: 806980 - RNA, 15 nt, Homo sapiens
cacugagagggcaau

SEQ ID NO: 806981 - RNA, 10 nt, Homo sapiens
cacugagaua

SEQ ID NO: 806982 - RNA, 19 nt, Homo sapiens
cacugaggagauacugaac

SEQ ID NO: 806983 - RNA, 20 nt, Homo sapiens
cacugaggcagcgaccucaa

SEQ ID NO: 806984 - RNA, 16 nt, Homo sapiens
cacugaggguggcacu

SEQ ID NO: 806985 - RNA, 19 nt, Homo sapiens
cacugaggguggcacucaa

SEQ ID NO: 806986 - RNA, 17 nt, Homo sapiens
cacugauacacagaaua

SEQ ID NO: 806987 - RNA, 20 nt, Homo sapiens
cacugaucacccaaugcauc

SEQ ID NO: 806988 - RNA, 17 nt, Homo sapiens
cacugaucuaagcagug

SEQ ID NO: 806989 - RNA, 20 nt, Homo sapiens
cacugaucugcuagugcugu

SEQ ID NO: 806990 - RNA, 17 nt, Homo sapiens
cacugaucuugucauua

SEQ ID NO: 806991 - RNA, 23 nt, Homo sapiens
cacugauuccuuuaugaugacug

SEQ ID NO: 806992 - RNA, 20 nt, Homo sapiens
cacugcaaauaaacuuggua

SEQ ID NO: 806993 - RNA, 13 nt, Homo sapiens
cacugcaagaagu

SEQ ID NO: 806994 - RNA, 16 nt, Homo sapiens
cacugcaagcucugcc

SEQ ID NO: 806995 - RNA, 14 nt, Homo sapiens
cacugcaaugucaa

SEQ ID NO: 806996 - RNA, 13 nt, Homo sapiens
cacugcacccucc

SEQ ID NO: 806997 - RNA, 21 nt, Homo sapiens
cacugcacucaaccuuaagac

SEQ ID NO: 806998 - RNA, 12 nt, Homo sapiens
cacugcacucca

SEQ ID NO: 806999 - RNA, 13 nt, Homo sapiens
cacugcauuucau

SEQ ID NO: 807000 - RNA, 14 nt, Homo sapiens
cacugccacacucu

SEQ ID NO: 807001 - RNA, 18 nt, Homo sapiens
cacugcccccugcugcca

SEQ ID NO: 807002 - RNA, 21 nt, Homo sapiens
cacugcccccugcugccaugu

SEQ ID NO: 807003 - RNA, 17 nt, Homo sapiens
cacugccccucucucag

SEQ ID NO: 807004 - RNA, 16 nt, Homo sapiens
cacugccugccaugua

SEQ ID NO: 807005 - RNA, 22 nt, Homo sapiens
cacugccuggcccaaaacgucu

SEQ ID NO: 807006 - RNA, 17 nt, Homo sapiens
cacugcggaagccaaag

SEQ ID NO: 807007 - RNA, 21 nt, Homo sapiens
cacugcggaagccaaaggcag

SEQ ID NO: 807008 - RNA, 18 nt, Homo sapiens
cacugcgggagcucugua

SEQ ID NO: 807009 - RNA, 17 nt, Homo sapiens
cacugcucucuguggug

SEQ ID NO: 807010 - RNA, 13 nt, Homo sapiens
cacugcuguccac

SEQ ID NO: 807011 - RNA, 16 nt, Homo sapiens
cacugcuugaaccaaa

SEQ ID NO: 807012 - RNA, 12 nt, Homo sapiens
cacugcuuuaaa

SEQ ID NO: 807013 - RNA, 21 nt, Homo sapiens
cacuggaauauaaaacaguca

SEQ ID NO: 807014 - RNA, 22 nt, Homo sapiens
cacuggaauauaaaacagucau

SEQ ID NO: 807015 - RNA, 19 nt, Homo sapiens
cacuggagguugaagccaa

SEQ ID NO: 807016 - RNA, 14 nt, Homo sapiens
cacuggcagccugc

SEQ ID NO: 807017 - RNA, 17 nt, Homo sapiens
cacugggccagcccugc

SEQ ID NO: 807018 - RNA, 17 nt, Homo sapiens
cacugggccugucacug

SEQ ID NO: 807019 - RNA, 19 nt, Homo sapiens
cacugggcucugauggcug

SEQ ID NO: 807020 - RNA, 18 nt, Homo sapiens
cacugggugccaaguccu

SEQ ID NO: 807021 - RNA, 21 nt, Homo sapiens
cacuggugggccauuagauuu

SEQ ID NO: 807022 - RNA, 17 nt, Homo sapiens
cacugguuuacacuuua

SEQ ID NO: 807023 - RNA, 12 nt, Homo sapiens
cacuguaaaaug

SEQ ID NO: 807024 - RNA, 14 nt, Homo sapiens
cacuguaaagacaa

SEQ ID NO: 807025 - RNA, 22 nt, Homo sapiens
cacuguaaucuuaaaaguguaa

SEQ ID NO: 807026 - RNA, 13 nt, Homo sapiens
cacuguacuugua

SEQ ID NO: 807027 - RNA, 14 nt, Homo sapiens
cacuguacuuguag

SEQ ID NO: 807028 - RNA, 13 nt, Homo sapiens
cacugucaucuuc

SEQ ID NO: 807029 - RNA, 21 nt, Homo sapiens
cacuguccugggccugcagaa

SEQ ID NO: 807030 - RNA, 22 nt, Homo sapiens
cacuguccugggcgcccuggaa

SEQ ID NO: 807031 - RNA, 16 nt, Homo sapiens
cacugucugacuuuag

SEQ ID NO: 807032 - RNA, 13 nt, Homo sapiens
cacugugaagggu

SEQ ID NO: 807033 - RNA, 23 nt, Homo sapiens
cacugugagugaaaauuuuuaca

SEQ ID NO: 807034 - RNA, 22 nt, Homo sapiens
cacugugagugguucaagcaca

SEQ ID NO: 807035 - RNA, 21 nt, Homo sapiens
cacugugcucagccaccaucu

SEQ ID NO: 807036 - RNA, 19 nt, Homo sapiens
cacuguguacaccucugga

SEQ ID NO: 807037 - RNA, 16 nt, Homo sapiens
cacugugucauucugu

SEQ ID NO: 807038 - RNA, 19 nt, Homo sapiens
cacuguuaauauucuauua

SEQ ID NO: 807039 - RNA, 13 nt, Homo sapiens
cacuguucaucuc

SEQ ID NO: 807040 - RNA, 18 nt, Homo sapiens
cacuguucuuguauugua

SEQ ID NO: 807041 - RNA, 19 nt, Homo sapiens
cacuguuuauacacugugu

SEQ ID NO: 807042 - RNA, 21 nt, Homo sapiens
cacuguuuugaaucucauaau

SEQ ID NO: 807043 - RNA, 16 nt, Homo sapiens
cacuguuuuuuuccca

SEQ ID NO: 807044 - RNA, 15 nt, Homo sapiens
cacuuaaccauucca

SEQ ID NO: 807045 - RNA, 15 nt, Homo sapiens
cacuuaguaugcagu

SEQ ID NO: 807046 - RNA, 19 nt, Homo sapiens
cacuuaguccuuuaucauc

SEQ ID NO: 807047 - RNA, 13 nt, Homo sapiens
cacuuaguuauuu

SEQ ID NO: 807048 - RNA, 22 nt, Homo sapiens
cacuuauaagaaagaucaaaga

SEQ ID NO: 807049 - RNA, 19 nt, Homo sapiens
cacuuaugauuucaugugc

SEQ ID NO: 807050 - RNA, 14 nt, Homo sapiens
cacuucagaucuga

SEQ ID NO: 807051 - RNA, 15 nt, Homo sapiens
cacuucagucugugu

SEQ ID NO: 807052 - RNA, 20 nt, Homo sapiens
cacuucauccccucccagau

SEQ ID NO: 807053 - RNA, 12 nt, Homo sapiens
cacuucaucuga

SEQ ID NO: 807054 - RNA, 13 nt, Homo sapiens
cacuucaucugau

SEQ ID NO: 807055 - RNA, 14 nt, Homo sapiens
cacuuccaccagcc

SEQ ID NO: 807056 - RNA, 20 nt, Homo sapiens
cacuucccagagcaucuugc

SEQ ID NO: 807057 - RNA, 16 nt, Homo sapiens
cacuuccccacaggcu

SEQ ID NO: 807058 - RNA, 17 nt, Homo sapiens
cacuucccuacauggag

SEQ ID NO: 807059 - RNA, 20 nt, Homo sapiens
cacuuccguagacuguuuag

SEQ ID NO: 807060 - RNA, 18 nt, Homo sapiens
cacuucgccauucauuca

SEQ ID NO: 807061 - RNA, 22 nt, Homo sapiens
cacuucuaccugcccccaucau

SEQ ID NO: 807062 - RNA, 19 nt, Homo sapiens
cacuucucaucauauugua

SEQ ID NO: 807063 - RNA, 15 nt, Homo sapiens
cacuugacauuccuu

SEQ ID NO: 807064 - RNA, 20 nt, Homo sapiens
cacuugauguguagacaugu

SEQ ID NO: 807065 - RNA, 20 nt, Homo sapiens
cacuugugugugggcuguga

SEQ ID NO: 807066 - RNA, 17 nt, Homo sapiens
cacuuuaacugacuuaa

SEQ ID NO: 807067 - RNA, 21 nt, Homo sapiens
cacuuuaauuaccaaccuguu

SEQ ID NO: 807068 - RNA, 21 nt, Homo sapiens
cacuuuacacaagaaucuaga

SEQ ID NO: 807069 - RNA, 23 nt, Homo sapiens
cacuuugaagcaaauacaauuca

SEQ ID NO: 807070 - RNA, 19 nt, Homo sapiens
cacuuugagaagcugaggu

SEQ ID NO: 807071 - RNA, 16 nt, Homo sapiens
cacuuugaggacauuu

SEQ ID NO: 807072 - RNA, 19 nt, Homo sapiens
cacuuugggaggcugaggc

SEQ ID NO: 807073 - RNA, 19 nt, Homo sapiens
cacuuugggaggcugaggu

SEQ ID NO: 807074 - RNA, 18 nt, Homo sapiens
cacuuugucuaacucaga

SEQ ID NO: 807075 - RNA, 22 nt, Homo sapiens
cacuuuguugcaagaugugaau

SEQ ID NO: 807076 - RNA, 14 nt, Homo sapiens
cacuuuuuccaaau

SEQ ID NO: 807077 - RNA, 16 nt, Homo sapiens
cagaaaacaagaugag

SEQ ID NO: 807078 - RNA, 17 nt, Homo sapiens
cagaaaaccucuccuga

SEQ ID NO: 807079 - RNA, 21 nt, Homo sapiens
cagaaaauaaaauauucacuc

SEQ ID NO: 807080 - RNA, 12 nt, Homo sapiens
cagaaacaucuc

SEQ ID NO: 807081 - RNA, 21 nt, Homo sapiens
cagaaacccuucagugcuaca

SEQ ID NO: 807082 - RNA, 22 nt, Homo sapiens
cagaaaccugcagggacuccau

SEQ ID NO: 807083 - RNA, 21 nt, Homo sapiens
cagaaagcaucccucacccau

SEQ ID NO: 807084 - RNA, 18 nt, Homo sapiens
cagaaagcugcuugccau

SEQ ID NO: 807085 - RNA, 19 nt, Homo sapiens
cagaaaggagaacuaucca

SEQ ID NO: 807086 - RNA, 22 nt, Homo sapiens
cagaaagggauugcuuugcauu

SEQ ID NO: 807087 - RNA, 18 nt, Homo sapiens
cagaaaguggccaugcca

SEQ ID NO: 807088 - RNA, 19 nt, Homo sapiens
cagaaaguggccaugccac

SEQ ID NO: 807089 - RNA, 18 nt, Homo sapiens
cagaaauaaagaucucag

SEQ ID NO: 807090 - RNA, 15 nt, Homo sapiens
cagaaauacaugaaa

SEQ ID NO: 807091 - RNA, 21 nt, Homo sapiens
cagaaaucugggauguacugu

SEQ ID NO: 807092 - RNA, 22 nt, Homo sapiens
cagaaaugcugccugccugucu

SEQ ID NO: 807093 - RNA, 15 nt, Homo sapiens
cagaaauucuggccc

SEQ ID NO: 807094 - RNA, 22 nt, Homo sapiens
cagaaauugugugugcaagaaa

SEQ ID NO: 807095 - RNA, 19 nt, Homo sapiens
cagaaauuuggcauugauc

SEQ ID NO: 807096 - RNA, 22 nt, Homo sapiens
cagaacagugguggcaacauuc

SEQ ID NO: 807097 - RNA, 12 nt, Homo sapiens
cagaaccaaagc

SEQ ID NO: 807098 - RNA, 17 nt, Homo sapiens
cagaacccagauuuccu

SEQ ID NO: 807099 - RNA, 12 nt, Homo sapiens
cagaacccugcu

SEQ ID NO: 807100 - RNA, 14 nt, Homo sapiens
cagaacuaaacuca

SEQ ID NO: 807101 - RNA, 12 nt, Homo sapiens
cagaacuacuuc

SEQ ID NO: 807102 - RNA, 19 nt, Homo sapiens
cagaagaagcuggugcccu

SEQ ID NO: 807103 - RNA, 18 nt, Homo sapiens
cagaagaauauucaggac

SEQ ID NO: 807104 - RNA, 16 nt, Homo sapiens
cagaagacacugcaaa

SEQ ID NO: 807105 - RNA, 22 nt, Homo sapiens
cagaagauaacuugagcaccgu

SEQ ID NO: 807106 - RNA, 16 nt, Homo sapiens
cagaagaugccagcuu

SEQ ID NO: 807107 - RNA, 23 nt, Homo sapiens
cagaagcgcuccaguaucuccaa

SEQ ID NO: 807108 - RNA, 13 nt, Homo sapiens
cagaaggacucag

SEQ ID NO: 807109 - RNA, 22 nt, Homo sapiens
cagaaggagggcagagccaugg

SEQ ID NO: 807110 - RNA, 20 nt, Homo sapiens
cagaaggcaaaguuuacaga

SEQ ID NO: 807111 - RNA, 23 nt, Homo sapiens
cagaaggcagagguugcagugag

SEQ ID NO: 807112 - RNA, 12 nt, Homo sapiens
cagaagggauaa

SEQ ID NO: 807113 - RNA, 18 nt, Homo sapiens
cagaaguauuuucuaguu

SEQ ID NO: 807114 - RNA, 19 nt, Homo sapiens
cagaaguccccucuacuuu

SEQ ID NO: 807115 - RNA, 23 nt, Homo sapiens
cagaagugcucuuuguggcagug

SEQ ID NO: 807116 - RNA, 16 nt, Homo sapiens
cagaaguuaguuugua

SEQ ID NO: 807117 - RNA, 21 nt, Homo sapiens
cagaaguuugcaaauaggcag

SEQ ID NO: 807118 - RNA, 21 nt, Homo sapiens
cagaauaaugaauggacucaa

SEQ ID NO: 807119 - RNA, 20 nt, Homo sapiens
cagaauaggaaaacauugca

SEQ ID NO: 807120 - RNA, 20 nt, Homo sapiens
cagaauauuagccaguacca

SEQ ID NO: 807121 - RNA, 20 nt, Homo sapiens
cagaaucauaugauucugcu

SEQ ID NO: 807122 - RNA, 15 nt, Homo sapiens
cagaaucccuuaaca

SEQ ID NO: 807123 - RNA, 14 nt, Homo sapiens
cagaaucucugagc

SEQ ID NO: 807124 - RNA, 17 nt, Homo sapiens
cagaaugaaaacuguaa

SEQ ID NO: 807125 - RNA, 20 nt, Homo sapiens
cagaaugcaaccaagucaca

SEQ ID NO: 807126 - RNA, 21 nt, Homo sapiens
cagaaugcaaccaagucacac

SEQ ID NO: 807127 - RNA, 17 nt, Homo sapiens
cagaaugccgcaugaca

SEQ ID NO: 807128 - RNA, 18 nt, Homo sapiens
cagaaugcugcaggacuu

SEQ ID NO: 807129 - RNA, 22 nt, Homo sapiens
cagaaugcugcaggacuugaga

SEQ ID NO: 807130 - RNA, 19 nt, Homo sapiens
cagaauguagcaucugaga

SEQ ID NO: 807131 - RNA, 23 nt, Homo sapiens
cagaauguggguauugaguguga

SEQ ID NO: 807132 - RNA, 19 nt, Homo sapiens
cagaauuaugaagagguau

SEQ ID NO: 807133 - RNA, 18 nt, Homo sapiens
cagaauucggugugcugc

SEQ ID NO: 807134 - RNA, 17 nt, Homo sapiens
cagaauucuaagcuggu

SEQ ID NO: 807135 - RNA, 12 nt, Homo sapiens
cagaauugcuca

SEQ ID NO: 807136 - RNA, 18 nt, Homo sapiens
cagaauuuaagcaagaaa

SEQ ID NO: 807137 - RNA, 20 nt, Homo sapiens
cagacaaaauuugagaauac

SEQ ID NO: 807138 - RNA, 16 nt, Homo sapiens
cagacaacagaaguca

SEQ ID NO: 807139 - RNA, 23 nt, Homo sapiens
cagacaacaguugcacagugccu

SEQ ID NO: 807140 - RNA, 19 nt, Homo sapiens
cagacaacuuguccugacu

SEQ ID NO: 807141 - RNA, 13 nt, Homo sapiens
cagacaagcacua

SEQ ID NO: 807142 - RNA, 14 nt, Homo sapiens
cagacaagcacuau

SEQ ID NO: 807143 - RNA, 13 nt, Homo sapiens
cagacaauuccau

SEQ ID NO: 807144 - RNA, 14 nt, Homo sapiens
cagacacccaggac

SEQ ID NO: 807145 - RNA, 22 nt, Homo sapiens
cagacacuaaagacuggguuac

SEQ ID NO: 807146 - RNA, 21 nt, Homo sapiens
cagacagcagaauuccucuua

SEQ ID NO: 807147 - RNA, 19 nt, Homo sapiens
cagacauacauuuaugcac

SEQ ID NO: 807148 - RNA, 20 nt, Homo sapiens
cagacauacauuucucauac

SEQ ID NO: 807149 - RNA, 18 nt, Homo sapiens
cagacauacgaaacacaa

SEQ ID NO: 807150 - RNA, 22 nt, Homo sapiens
cagacaucgguguucuucuucc

SEQ ID NO: 807151 - RNA, 13 nt, Homo sapiens
cagacaugccaca

SEQ ID NO: 807152 - RNA, 17 nt, Homo sapiens
cagacaugccacaagga

SEQ ID NO: 807153 - RNA, 18 nt, Homo sapiens
cagacauuuugugugaga

SEQ ID NO: 807154 - RNA, 16 nt, Homo sapiens
cagaccacugucucca

SEQ ID NO: 807155 - RNA, 11 nt, Homo sapiens
cagacccagug

SEQ ID NO: 807156 - RNA, 12 nt, Homo sapiens
cagacccagugg

SEQ ID NO: 807157 - RNA, 16 nt, Homo sapiens
cagacgagcagugacg

SEQ ID NO: 807158 - RNA, 22 nt, Homo sapiens
cagacgcguuggcacaguucau

SEQ ID NO: 807159 - RNA, 18 nt, Homo sapiens
cagacggcggccaggcac

SEQ ID NO: 807160 - RNA, 16 nt, Homo sapiens
cagacgguucaccagc

SEQ ID NO: 807161 - RNA, 21 nt, Homo sapiens
cagacguccaccucagugcac

SEQ ID NO: 807162 - RNA, 16 nt, Homo sapiens
cagacucagacuccau

SEQ ID NO: 807163 - RNA, 16 nt, Homo sapiens
cagacucccgcgugaa

SEQ ID NO: 807164 - RNA, 14 nt, Homo sapiens
cagacucgggacca

SEQ ID NO: 807165 - RNA, 17 nt, Homo sapiens
cagacucugauucuaca

SEQ ID NO: 807166 - RNA, 17 nt, Homo sapiens
cagacugaaccagucca

SEQ ID NO: 807167 - RNA, 16 nt, Homo sapiens
cagacugacaaaugug

SEQ ID NO: 807168 - RNA, 20 nt, Homo sapiens
cagacugcaugacagucaca

SEQ ID NO: 807169 - RNA, 20 nt, Homo sapiens
cagacuggugggcuagccaa

SEQ ID NO: 807170 - RNA, 16 nt, Homo sapiens
cagacugucaagaaga

SEQ ID NO: 807171 - RNA, 16 nt, Homo sapiens
cagacugugucuuauu

SEQ ID NO: 807172 - RNA, 14 nt, Homo sapiens
cagacuucaucuuc

SEQ ID NO: 807173 - RNA, 20 nt, Homo sapiens
cagacuucccugaauguauu

SEQ ID NO: 807174 - RNA, 21 nt, Homo sapiens
cagacuuuguguucauuucau

SEQ ID NO: 807175 - RNA, 15 nt, Homo sapiens
cagagaaaaugagaa

SEQ ID NO: 807176 - RNA, 16 nt, Homo sapiens
cagagaaagaaguccu

SEQ ID NO: 807177 - RNA, 14 nt, Homo sapiens
cagagaaaggauug

SEQ ID NO: 807178 - RNA, 19 nt, Homo sapiens
cagagaaaucugcauucua

SEQ ID NO: 807179 - RNA, 21 nt, Homo sapiens
cagagaagaccaaagcauugc

SEQ ID NO: 807180 - RNA, 13 nt, Homo sapiens
cagagaagccaaa

SEQ ID NO: 807181 - RNA, 16 nt, Homo sapiens
cagagaagcuccugcu

SEQ ID NO: 807182 - RNA, 21 nt, Homo sapiens
cagagaaguucuggcugaaca

SEQ ID NO: 807183 - RNA, 22 nt, Homo sapiens
cagagacacuaacgacuucagg

SEQ ID NO: 807184 - RNA, 20 nt, Homo sapiens
cagagacaggcccaagagau

SEQ ID NO: 807185 - RNA, 15 nt, Homo sapiens
cagagaccauugcaa

SEQ ID NO: 807186 - RNA, 21 nt, Homo sapiens
cagagagacagacuugagaac

SEQ ID NO: 807187 - RNA, 18 nt, Homo sapiens
cagagaggaggggaccaa

SEQ ID NO: 807188 - RNA, 17 nt, Homo sapiens
cagagaggcucugagaa

SEQ ID NO: 807189 - RNA, 21 nt, Homo sapiens
cagagaguguacaucauguua

SEQ ID NO: 807190 - RNA, 16 nt, Homo sapiens
cagagauaaaccaaua

SEQ ID NO: 807191 - RNA, 20 nt, Homo sapiens
cagagaucgagaccauccua

SEQ ID NO: 807192 - RNA, 13 nt, Homo sapiens
cagagaugacugu

SEQ ID NO: 807193 - RNA, 15 nt, Homo sapiens
cagagaugacugucc

SEQ ID NO: 807194 - RNA, 19 nt, Homo sapiens
cagagaugccuccaccgcu

SEQ ID NO: 807195 - RNA, 21 nt, Homo sapiens
cagagauggucacaugaccca

SEQ ID NO: 807196 - RNA, 15 nt, Homo sapiens
cagagcaagacuguc

SEQ ID NO: 807197 - RNA, 22 nt, Homo sapiens
cagagcaauuccaggcugagcc

SEQ ID NO: 807198 - RNA, 13 nt, Homo sapiens
cagagcauugcua

SEQ ID NO: 807199 - RNA, 21 nt, Homo sapiens
cagagccaccugacucuugca

SEQ ID NO: 807200 - RNA, 18 nt, Homo sapiens
cagagccagaugcaggac

SEQ ID NO: 807201 - RNA, 21 nt, Homo sapiens
cagagccagccggcuaugaaa

SEQ ID NO: 807202 - RNA, 16 nt, Homo sapiens
cagagccagucucacc

SEQ ID NO: 807203 - RNA, 12 nt, Homo sapiens
cagagccaguga

SEQ ID NO: 807204 - RNA, 20 nt, Homo sapiens
cagagcccuucacugccaug

SEQ ID NO: 807205 - RNA, 21 nt, Homo sapiens
cagagcccuucacugccauga

SEQ ID NO: 807206 - RNA, 13 nt, Homo sapiens
cagagccuagcca

SEQ ID NO: 807207 - RNA, 14 nt, Homo sapiens
cagagccugaguca

SEQ ID NO: 807208 - RNA, 20 nt, Homo sapiens
cagagccuucaagugccaaa

SEQ ID NO: 807209 - RNA, 17 nt, Homo sapiens
cagagcgagacuccauc

SEQ ID NO: 807210 - RNA, 15 nt, Homo sapiens
cagagcuauggugcu

SEQ ID NO: 807211 - RNA, 22 nt, Homo sapiens
cagagcucaagauucagacucc

SEQ ID NO: 807212 - RNA, 22 nt, Homo sapiens
cagagcuccaguuugcauuugg

SEQ ID NO: 807213 - RNA, 14 nt, Homo sapiens
cagagcugugccug

SEQ ID NO: 807214 - RNA, 14 nt, Homo sapiens
cagaggaaguggaa

SEQ ID NO: 807215 - RNA, 20 nt, Homo sapiens
cagaggagggcgugacucac

SEQ ID NO: 807216 - RNA, 14 nt, Homo sapiens
cagaggauggugag

SEQ ID NO: 807217 - RNA, 22 nt, Homo sapiens
cagaggcagcccgcacaccugc

SEQ ID NO: 807218 - RNA, 21 nt, Homo sapiens
cagaggccaguuaaaguagau

SEQ ID NO: 807219 - RNA, 19 nt, Homo sapiens
cagaggcguacuacccagc

SEQ ID NO: 807220 - RNA, 14 nt, Homo sapiens
cagaggcugcagga

SEQ ID NO: 807221 - RNA, 17 nt, Homo sapiens
cagaggcugcaggacuu

SEQ ID NO: 807222 - RNA, 15 nt, Homo sapiens
cagaggcuucuucag

SEQ ID NO: 807223 - RNA, 16 nt, Homo sapiens
cagagggcaggggugc

SEQ ID NO: 807224 - RNA, 20 nt, Homo sapiens
cagagggcaggggugcugug

SEQ ID NO: 807225 - RNA, 17 nt, Homo sapiens
cagagggccauugaacu

SEQ ID NO: 807226 - RNA, 19 nt, Homo sapiens
cagaggggaaagacuucca

SEQ ID NO: 807227 - RNA, 15 nt, Homo sapiens
cagaggguacuuuaa

SEQ ID NO: 807228 - RNA, 17 nt, Homo sapiens
cagaggucugugcugag

SEQ ID NO: 807229 - RNA, 16 nt, Homo sapiens
cagagguugcagugag

SEQ ID NO: 807230 - RNA, 19 nt, Homo sapiens
cagagguugcagugagcug

SEQ ID NO: 807231 - RNA, 20 nt, Homo sapiens
cagagguugcagugagcuga

SEQ ID NO: 807232 - RNA, 17 nt, Homo sapiens
cagagguuugagaccga

SEQ ID NO: 807233 - RNA, 21 nt, Homo sapiens
cagagguuugcuuccucagua

SEQ ID NO: 807234 - RNA, 13 nt, Homo sapiens
cagaguaucagau

SEQ ID NO: 807235 - RNA, 15 nt, Homo sapiens
cagaguccuuuccaa

SEQ ID NO: 807236 - RNA, 21 nt, Homo sapiens
cagagucucgcucuguugccc

SEQ ID NO: 807237 - RNA, 21 nt, Homo sapiens
cagagucuugcucuguugccc

SEQ ID NO: 807238 - RNA, 16 nt, Homo sapiens
cagagugacagucaua

SEQ ID NO: 807239 - RNA, 19 nt, Homo sapiens
cagagugauugguugcauc

SEQ ID NO: 807240 - RNA, 18 nt, Homo sapiens
cagagugcacagcugucc

SEQ ID NO: 807241 - RNA, 23 nt, Homo sapiens
cagagugcaguggcgcgaucuca

SEQ ID NO: 807242 - RNA, 16 nt, Homo sapiens
cagaguggcccaagac

SEQ ID NO: 807243 - RNA, 15 nt, Homo sapiens
cagaguugcuuuaaa

SEQ ID NO: 807244 - RNA, 23 nt, Homo sapiens
cagaguuggacuucuagacucac

SEQ ID NO: 807245 - RNA, 22 nt, Homo sapiens
cagaguuuuagaaaugagaucu

SEQ ID NO: 807246 - RNA, 16 nt, Homo sapiens
cagauaaguuggagca

SEQ ID NO: 807247 - RNA, 19 nt, Homo sapiens
cagauacacuaaaguuaca

SEQ ID NO: 807248 - RNA, 23 nt, Homo sapiens
cagauacccuguuucuggaguca

SEQ ID NO: 807249 - RNA, 20 nt, Homo sapiens
cagauacugugagcuuacau

SEQ ID NO: 807250 - RNA, 14 nt, Homo sapiens
cagauagaaagcau

SEQ ID NO: 807251 - RNA, 16 nt, Homo sapiens
cagauagaaagcauua

SEQ ID NO: 807252 - RNA, 18 nt, Homo sapiens
cagauagauauaugcucu

SEQ ID NO: 807253 - RNA, 22 nt, Homo sapiens
cagauaugggacugauucugug

SEQ ID NO: 807254 - RNA, 17 nt, Homo sapiens
cagauauuacagcuuau

SEQ ID NO: 807255 - RNA, 12 nt, Homo sapiens
cagaucaagaaa

SEQ ID NO: 807256 - RNA, 19 nt, Homo sapiens
cagaucacugccacacucu

SEQ ID NO: 807257 - RNA, 22 nt, Homo sapiens
cagaucgauccuggauucacuc

SEQ ID NO: 807258 - RNA, 19 nt, Homo sapiens
cagaucgcaccacugcacu

SEQ ID NO: 807259 - RNA, 17 nt, Homo sapiens
cagaucuaucuugucaa

SEQ ID NO: 807260 - RNA, 22 nt, Homo sapiens
cagaucuggucuaguuaaccua

SEQ ID NO: 807261 - RNA, 17 nt, Homo sapiens
ccucugaccugcacugg

SEQ ID NO: 807262 - RNA, 18 nt, Homo sapiens
ccucugaguuaaauaauu

SEQ ID NO: 807263 - RNA, 14 nt, Homo sapiens
ccucugcauuuaca

SEQ ID NO: 807264 - RNA, 16 nt, Homo sapiens
ccucugcuacuccauc

SEQ ID NO: 807265 - RNA, 18 nt, Homo sapiens
ccucugcuguagcuuaug

SEQ ID NO: 807266 - RNA, 21 nt, Homo sapiens
ccucuggucgcuccugcccac

SEQ ID NO: 807267 - RNA, 19 nt, Homo sapiens
ccucuguccccuucucuca

SEQ ID NO: 807268 - RNA, 17 nt, Homo sapiens
ccucuugacuuccccac

SEQ ID NO: 807269 - RNA, 18 nt, Homo sapiens
ccucuugcucagagcuag

SEQ ID NO: 807270 - RNA, 15 nt, Homo sapiens
ccucuuggugggugu

SEQ ID NO: 807271 - RNA, 15 nt, Homo sapiens
ccucuuucuucauuc

SEQ ID NO: 807272 - RNA, 22 nt, Homo sapiens
ccucuuugucauaccuuuggau

SEQ ID NO: 807273 - RNA, 16 nt, Homo sapiens
ccucuuuguuuaucuc

SEQ ID NO: 807274 - RNA, 20 nt, Homo sapiens
ccucuuuguuucugcuucau

SEQ ID NO: 807275 - RNA, 15 nt, Homo sapiens
ccugaaaauucugua

SEQ ID NO: 807276 - RNA, 21 nt, Homo sapiens
ccugaaacaacuuggaaagau

SEQ ID NO: 807277 - RNA, 12 nt, Homo sapiens
ccugaaagccac

SEQ ID NO: 807278 - RNA, 13 nt, Homo sapiens
ccugaaagccaca

SEQ ID NO: 807279 - RNA, 14 nt, Homo sapiens
ccugaaagccacaa

SEQ ID NO: 807280 - RNA, 20 nt, Homo sapiens
ccugaaauuuauucacauau

SEQ ID NO: 807281 - RNA, 23 nt, Homo sapiens
ccugaaauuucucauuaguggua

SEQ ID NO: 807282 - RNA, 15 nt, Homo sapiens
ccugaacucauucuc

SEQ ID NO: 807283 - RNA, 20 nt, Homo sapiens
ccugaacucccagaaccacu

SEQ ID NO: 807284 - RNA, 13 nt, Homo sapiens
ccugaacuugccu

SEQ ID NO: 807285 - RNA, 15 nt, Homo sapiens
ccugaagcaaauggg

SEQ ID NO: 807286 - RNA, 20 nt, Homo sapiens
ccugaagcguuuuucucaaa

SEQ ID NO: 807287 - RNA, 22 nt, Homo sapiens
ccugaaucugugccugcacuga

SEQ ID NO: 807288 - RNA, 13 nt, Homo sapiens
ccugaaugaaaua

SEQ ID NO: 807289 - RNA, 14 nt, Homo sapiens
ccugacaccugcuu

SEQ ID NO: 807290 - RNA, 18 nt, Homo sapiens
ccugacagaaggacucag

SEQ ID NO: 807291 - RNA, 14 nt, Homo sapiens
ccugaccacccucc

SEQ ID NO: 807292 - RNA, 16 nt, Homo sapiens
ccugacgucaguaguu

SEQ ID NO: 807293 - RNA, 18 nt, Homo sapiens
ccugacucuugcaggggu

SEQ ID NO: 807294 - RNA, 15 nt, Homo sapiens
ccugagacaaaugga

SEQ ID NO: 807295 - RNA, 13 nt, Homo sapiens
ccugagaccucaa

SEQ ID NO: 807296 - RNA, 13 nt, Homo sapiens
ccugagagucagc

SEQ ID NO: 807297 - RNA, 22 nt, Homo sapiens
ccugagauucuuuaaggagaua

SEQ ID NO: 807298 - RNA, 19 nt, Homo sapiens
ccugagcagaauacugguc

SEQ ID NO: 807299 - RNA, 22 nt, Homo sapiens
ccugagcaggaaaguuuaccca

SEQ ID NO: 807300 - RNA, 16 nt, Homo sapiens
ccugagcgagugucca

SEQ ID NO: 807301 - RNA, 15 nt, Homo sapiens
ccugaggaagaugac

SEQ ID NO: 807302 - RNA, 20 nt, Homo sapiens
ccugaggaggaggacacagc

SEQ ID NO: 807303 - RNA, 20 nt, Homo sapiens
ccugaggguggagacuaagc

SEQ ID NO: 807304 - RNA, 14 nt, Homo sapiens
ccugaggucgucaa

SEQ ID NO: 807305 - RNA, 15 nt, Homo sapiens
ccugagucagugcuc

SEQ ID NO: 807306 - RNA, 17 nt, Homo sapiens
ccugaguggugccaaac

SEQ ID NO: 807307 - RNA, 23 nt, Homo sapiens
ccugaguggugccaaacaaaaag

SEQ ID NO: 807308 - RNA, 18 nt, Homo sapiens
ccugauagucaccugcug

SEQ ID NO: 807309 - RNA, 15 nt, Homo sapiens
ccugaucuuucuaga

SEQ ID NO: 807310 - RNA, 18 nt, Homo sapiens
ccugauggagugugcaga

SEQ ID NO: 807311 - RNA, 15 nt, Homo sapiens
ccugauggugcugcu

SEQ ID NO: 807312 - RNA, 21 nt, Homo sapiens
ccugauugaucacacaguguu

SEQ ID NO: 807313 - RNA, 14 nt, Homo sapiens
ccugauuucucuga

SEQ ID NO: 807314 - RNA, 22 nt, Homo sapiens
ccugcacagccucuaguguccg

SEQ ID NO: 807315 - RNA, 13 nt, Homo sapiens
ccugcacagugac

SEQ ID NO: 807316 - RNA, 22 nt, Homo sapiens
ccugcacccaugacaaucaccu

SEQ ID NO: 807317 - RNA, 14 nt, Homo sapiens
ccugcaccugugca

SEQ ID NO: 807318 - RNA, 12 nt, Homo sapiens
ccugcacucuca

SEQ ID NO: 807319 - RNA, 23 nt, Homo sapiens
ccugcacuggggagcccgucuca

SEQ ID NO: 807320 - RNA, 17 nt, Homo sapiens
ccugcagaauccagcua

SEQ ID NO: 807321 - RNA, 20 nt, Homo sapiens
ccugcagaggucugugcuga

SEQ ID NO: 807322 - RNA, 18 nt, Homo sapiens
ccugcagccucacuucua

SEQ ID NO: 807323 - RNA, 20 nt, Homo sapiens
ccugcagccuccuccugacc

SEQ ID NO: 807324 - RNA, 17 nt, Homo sapiens
ccugcaggacuugccac

SEQ ID NO: 807325 - RNA, 19 nt, Homo sapiens
ccugcaggagaaagccaag

SEQ ID NO: 807326 - RNA, 19 nt, Homo sapiens
ccugcaggccaagagcaga

SEQ ID NO: 807327 - RNA, 17 nt, Homo sapiens
ccugcaggcuccaugca

SEQ ID NO: 807328 - RNA, 19 nt, Homo sapiens
ccugcaggcuggagacugg

SEQ ID NO: 807329 - RNA, 15 nt, Homo sapiens
ccugcagggccagac

SEQ ID NO: 807330 - RNA, 12 nt, Homo sapiens
ccugcaggugag

SEQ ID NO: 807331 - RNA, 16 nt, Homo sapiens
ccugcagugauucagc

SEQ ID NO: 807332 - RNA, 15 nt, Homo sapiens
ccugcaguuggcaga

SEQ ID NO: 807333 - RNA, 14 nt, Homo sapiens
ccugcaugcugaaa

SEQ ID NO: 807334 - RNA, 16 nt, Homo sapiens
ccugcauucacccaga

SEQ ID NO: 807335 - RNA, 11 nt, Homo sapiens
ccugccaagag

SEQ ID NO: 807336 - RNA, 22 nt, Homo sapiens
ccugccccaaacaaauaugcaa

SEQ ID NO: 807337 - RNA, 20 nt, Homo sapiens
ccugccccaccccauccagc

SEQ ID NO: 807338 - RNA, 21 nt, Homo sapiens
ccugccccagauuuacuaaau

SEQ ID NO: 807339 - RNA, 18 nt, Homo sapiens
ccugccccccucaucuca

SEQ ID NO: 807340 - RNA, 19 nt, Homo sapiens
ccugcccccgcucccgcuc

SEQ ID NO: 807341 - RNA, 20 nt, Homo sapiens
ccugcccuucaacaauggcc

SEQ ID NO: 807342 - RNA, 17 nt, Homo sapiens
ccugcccuucucaagac

SEQ ID NO: 807343 - RNA, 18 nt, Homo sapiens
ccugcccuugaacccccu

SEQ ID NO: 807344 - RNA, 18 nt, Homo sapiens
ugcaccuguacucaggag

SEQ ID NO: 807345 - RNA, 21 nt, Homo sapiens
ugcaccuguccccacccucca

SEQ ID NO: 807346 - RNA, 15 nt, Homo sapiens
ugcaccugugcauuu

SEQ ID NO: 807347 - RNA, 17 nt, Homo sapiens
ugcaccuuugaaaugca

SEQ ID NO: 807348 - RNA, 14 nt, Homo sapiens
ugcacuaacagagu

SEQ ID NO: 807349 - RNA, 13 nt, Homo sapiens
ugcacuacugaca

SEQ ID NO: 807350 - RNA, 20 nt, Homo sapiens
ugcacuauguauauacauau

SEQ ID NO: 807351 - RNA, 16 nt, Homo sapiens
ugcacuauuuccacau

SEQ ID NO: 807352 - RNA, 22 nt, Homo sapiens
ugcacuccagccugagugacag

SEQ ID NO: 807353 - RNA, 20 nt, Homo sapiens
ugcacuccagucuggaugac

SEQ ID NO: 807354 - RNA, 19 nt, Homo sapiens
ugcacuccagucuggcaac

SEQ ID NO: 807355 - RNA, 22 nt, Homo sapiens
ugcacucuugaacugggcgaau

SEQ ID NO: 807356 - RNA, 16 nt, Homo sapiens
ugcacugaucacccaa

SEQ ID NO: 807357 - RNA, 23 nt, Homo sapiens
ugcacuggaaccauugcuuuacu

SEQ ID NO: 807358 - RNA, 20 nt, Homo sapiens
ugcacuguaaaaugugggau

SEQ ID NO: 807359 - RNA, 23 nt, Homo sapiens
ugcacugugguuucagaugugca

SEQ ID NO: 807360 - RNA, 12 nt, Homo sapiens
ugcacuucaaaa

SEQ ID NO: 807361 - RNA, 15 nt, Homo sapiens
ugcacuuguggcaac

SEQ ID NO: 807362 - RNA, 20 nt, Homo sapiens
ugcacuuguggcaacagaua

SEQ ID NO: 807363 - RNA, 10 nt, Homo sapiens
ugcacuuugu

SEQ ID NO: 807364 - RNA, 11 nt, Homo sapiens
ugcacuuuuaa

SEQ ID NO: 807365 - RNA, 21 nt, Homo sapiens
ugcacuuuuagaaaugcauau

SEQ ID NO: 807366 - RNA, 22 nt, Homo sapiens
ugcagaagcaaacaagcuugau

SEQ ID NO: 807367 - RNA, 24 nt, Homo sapiens
ugcagaagcgcuccaguaucucca

SEQ ID NO: 807368 - RNA, 21 nt, Homo sapiens
ugcagaauacaguaagcugcu

SEQ ID NO: 807369 - RNA, 17 nt, Homo sapiens
ugcagaauccaaaguaa

SEQ ID NO: 807370 - RNA, 19 nt, Homo sapiens
ugcagaauugagagugauu

SEQ ID NO: 807371 - RNA, 23 nt, Homo sapiens
ugcagacaggccaugugagccac

SEQ ID NO: 807372 - RNA, 22 nt, Homo sapiens
ugcagacagucuguuaugcacu

SEQ ID NO: 807373 - RNA, 21 nt, Homo sapiens
ugcagacguuaugaucuugcu

SEQ ID NO: 807374 - RNA, 14 nt, Homo sapiens
ugcagagaugacug

SEQ ID NO: 807375 - RNA, 21 nt, Homo sapiens
ccuggauuuucuuucuaugua

SEQ ID NO: 807376 - RNA, 18 nt, Homo sapiens
ccuggcaagugggugaaa

SEQ ID NO: 807377 - RNA, 18 nt, Homo sapiens
ccuggcacuaacguugag

SEQ ID NO: 807378 - RNA, 22 nt, Homo sapiens
ccuggcacucuuguucccacac

SEQ ID NO: 807379 - RNA, 19 nt, Homo sapiens
ccuggcagcaugacucaga

SEQ ID NO: 807380 - RNA, 23 nt, Homo sapiens
ccuggcauuauguccacugugua

SEQ ID NO: 807381 - RNA, 23 nt, Homo sapiens
ccuggccaaauuuugauccuaac

SEQ ID NO: 807382 - RNA, 13 nt, Homo sapiens
ccuggccagacac

SEQ ID NO: 807383 - RNA, 17 nt, Homo sapiens
ccuggccaggagcucuu

SEQ ID NO: 807384 - RNA, 14 nt, Homo sapiens
ccuggccauuucca

SEQ ID NO: 807385 - RNA, 16 nt, Homo sapiens
ccuggcccagaugauc

SEQ ID NO: 807386 - RNA, 15 nt, Homo sapiens
ccuggcccucaguuu

SEQ ID NO: 807387 - RNA, 18 nt, Homo sapiens
ccuggccuggcacacauc

SEQ ID NO: 807388 - RNA, 23 nt, Homo sapiens
ccuggccuuaaaaggggcccaag

SEQ ID NO: 807389 - RNA, 15 nt, Homo sapiens
ccuggcugcacucuu

SEQ ID NO: 807390 - RNA, 16 nt, Homo sapiens
ccuggcuuugccucuu

SEQ ID NO: 807391 - RNA, 17 nt, Homo sapiens
ccugggaaaggacccac

SEQ ID NO: 807392 - RNA, 17 nt, Homo sapiens
ccugggaaauaagcccc

SEQ ID NO: 807393 - RNA, 15 nt, Homo sapiens
ccugggaggagagaa

SEQ ID NO: 807394 - RNA, 15 nt, Homo sapiens
ccugggccucauggc

SEQ ID NO: 807395 - RNA, 24 nt, Homo sapiens
ccugggccuggagggggagcacca

SEQ ID NO: 807396 - RNA, 14 nt, Homo sapiens
ccugggcugugcua

SEQ ID NO: 807397 - RNA, 19 nt, Homo sapiens
ccuggggccucaccugcug

SEQ ID NO: 807398 - RNA, 19 nt, Homo sapiens
ccuggggcgagcacuguga

SEQ ID NO: 807399 - RNA, 20 nt, Homo sapiens
ccuggggcgagcacugugag

SEQ ID NO: 807400 - RNA, 17 nt, Homo sapiens
ccuggggcugaucucag

SEQ ID NO: 807401 - RNA, 20 nt, Homo sapiens
ccuggggcugaucucaggga

SEQ ID NO: 807402 - RNA, 18 nt, Homo sapiens
ccugggugacagagugag

SEQ ID NO: 807403 - RNA, 17 nt, Homo sapiens
ccuggguggggcugcuc

SEQ ID NO: 807404 - RNA, 16 nt, Homo sapiens
ccugggugguacccag

SEQ ID NO: 807405 - RNA, 14 nt, Homo sapiens
ccuggguucuucca

SEQ ID NO: 807406 - RNA, 20 nt, Homo sapiens
ccugguauuuucaaccauaa

SEQ ID NO: 807407 - RNA, 17 nt, Homo sapiens
ccuggucaacaugguga

SEQ ID NO: 807408 - RNA, 22 nt, Homo sapiens
ccuggucagugguggucuucaa

SEQ ID NO: 807409 - RNA, 22 nt, Homo sapiens
ccuggugggugguguccugaag

SEQ ID NO: 807410 - RNA, 18 nt, Homo sapiens
ccugguuccacucuggag

SEQ ID NO: 807411 - RNA, 15 nt, Homo sapiens
ccugguuugacucag

SEQ ID NO: 807412 - RNA, 12 nt, Homo sapiens
ccuguaaauaua

SEQ ID NO: 807413 - RNA, 12 nt, Homo sapiens
ccuguaacacau

SEQ ID NO: 807414 - RNA, 18 nt, Homo sapiens
ccuguaaucccagcacuu

SEQ ID NO: 807415 - RNA, 20 nt, Homo sapiens
ccuguaaucucagcacuuug

SEQ ID NO: 807416 - RNA, 14 nt, Homo sapiens
ccuguacacaggcg

SEQ ID NO: 807417 - RNA, 12 nt, Homo sapiens
ccuguacauucu

SEQ ID NO: 807418 - RNA, 23 nt, Homo sapiens
ccuguagcaaccuucugcauuca

SEQ ID NO: 807419 - RNA, 16 nt, Homo sapiens
ccuguagggaacuuuc

SEQ ID NO: 807420 - RNA, 13 nt, Homo sapiens
ccuguagucccag

SEQ ID NO: 807421 - RNA, 15 nt, Homo sapiens
ccuguagucccagcu

SEQ ID NO: 807422 - RNA, 16 nt, Homo sapiens
ccuguagucccagcua

SEQ ID NO: 807423 - RNA, 18 nt, Homo sapiens
ccuguauucuacagcaga

SEQ ID NO: 807424 - RNA, 23 nt, Homo sapiens
ccuguauucucaaacacaguuac

SEQ ID NO: 807425 - RNA, 14 nt, Homo sapiens
ccugucaaauauca

SEQ ID NO: 807426 - RNA, 17 nt, Homo sapiens
ccugucaauacuaugga

SEQ ID NO: 807427 - RNA, 23 nt, Homo sapiens
ccugucauugcgaccauuucuca

SEQ ID NO: 807428 - RNA, 16 nt, Homo sapiens
ccuguccagaccuuug

SEQ ID NO: 807429 - RNA, 17 nt, Homo sapiens
ccugucccaaccccagu

SEQ ID NO: 807430 - RNA, 15 nt, Homo sapiens
ccugucccuugccuc

SEQ ID NO: 807431 - RNA, 22 nt, Homo sapiens
ccuguccuuucuugcagauucu

SEQ ID NO: 807432 - RNA, 16 nt, Homo sapiens
ccugucuaacugcugu

SEQ ID NO: 807433 - RNA, 15 nt, Homo sapiens
ccugucuacucaucc

SEQ ID NO: 807434 - RNA, 18 nt, Homo sapiens
ccugucugaaggacacuu

SEQ ID NO: 807435 - RNA, 21 nt, Homo sapiens
ccugucugcuaggcgcugggg

SEQ ID NO: 807436 - RNA, 19 nt, Homo sapiens
ccugucuggcucaggguca

SEQ ID NO: 807437 - RNA, 17 nt, Homo sapiens
ccugucuuccugcauuc

SEQ ID NO: 807438 - RNA, 16 nt, Homo sapiens
ccugucuugcugucau

SEQ ID NO: 807439 - RNA, 15 nt, Homo sapiens
ccugucuuuaaggaa

SEQ ID NO: 807440 - RNA, 16 nt, Homo sapiens
ccugucuuucagcauu

SEQ ID NO: 807441 - RNA, 18 nt, Homo sapiens
ccugucuuucagcauuca

SEQ ID NO: 807442 - RNA, 13 nt, Homo sapiens
ccugugaaugcca

SEQ ID NO: 807443 - RNA, 21 nt, Homo sapiens
ccugugacaacacucaucaca

SEQ ID NO: 807444 - RNA, 22 nt, Homo sapiens
ccugugacaacacucaucacac

SEQ ID NO: 807445 - RNA, 17 nt, Homo sapiens
ccugugaccagcacugu

SEQ ID NO: 807446 - RNA, 12 nt, Homo sapiens
ccugugacuguc

SEQ ID NO: 807447 - RNA, 15 nt, Homo sapiens
ccugugaggugcaga

SEQ ID NO: 807448 - RNA, 14 nt, Homo sapiens
ccugugcauuuucu

SEQ ID NO: 807449 - RNA, 17 nt, Homo sapiens
ccugugccagaccucaa

SEQ ID NO: 807450 - RNA, 19 nt, Homo sapiens
ccugugcccuagaugcacg

SEQ ID NO: 807451 - RNA, 19 nt, Homo sapiens
ccugugcccucaccaccac

SEQ ID NO: 807452 - RNA, 15 nt, Homo sapiens
ccugugccuccucag

SEQ ID NO: 807453 - RNA, 21 nt, Homo sapiens
ccugugcugggccaguggcug

SEQ ID NO: 807454 - RNA, 15 nt, Homo sapiens
ccuguggccuugccc

SEQ ID NO: 807455 - RNA, 13 nt, Homo sapiens
ccuguggugaccc

SEQ ID NO: 807456 - RNA, 19 nt, Homo sapiens
ccugugguuacagugcaga

SEQ ID NO: 807457 - RNA, 22 nt, Homo sapiens
ccuguguaaaacuauauucuca

SEQ ID NO: 807458 - RNA, 19 nt, Homo sapiens
ugccaccaacacugcucac

SEQ ID NO: 807459 - RNA, 19 nt, Homo sapiens
ugccaccacgucuggcuaa

SEQ ID NO: 807460 - RNA, 11 nt, Homo sapiens
ugccacccaca

SEQ ID NO: 807461 - RNA, 20 nt, Homo sapiens
ugccacccaggcuggagugc

SEQ ID NO: 807462 - RNA, 15 nt, Homo sapiens
ugccacccuaccugu

SEQ ID NO: 807463 - RNA, 16 nt, Homo sapiens
ugccaccggaggucac

SEQ ID NO: 807464 - RNA, 15 nt, Homo sapiens
ugccaccuucaaguu

SEQ ID NO: 807465 - RNA, 18 nt, Homo sapiens
ugccacucagagacuuca

SEQ ID NO: 807466 - RNA, 17 nt, Homo sapiens
ugccacucccugagcuu

SEQ ID NO: 807467 - RNA, 15 nt, Homo sapiens
ugccacugcacucca

SEQ ID NO: 807468 - RNA, 14 nt, Homo sapiens
ugccacugccuucg

SEQ ID NO: 807469 - RNA, 15 nt, Homo sapiens
ugccacuggggaaaa

SEQ ID NO: 807470 - RNA, 14 nt, Homo sapiens
ugccacuucccaga

SEQ ID NO: 807471 - RNA, 16 nt, Homo sapiens
ugccacuucuaagaaa

SEQ ID NO: 807472 - RNA, 22 nt, Homo sapiens
ugccacuucuaagaaaagccua

SEQ ID NO: 807473 - RNA, 17 nt, Homo sapiens
ugccacuugacauuccu

SEQ ID NO: 807474 - RNA, 17 nt, Homo sapiens
ugccacuuuacccaccu

SEQ ID NO: 807475 - RNA, 19 nt, Homo sapiens
ugccacuuuacccaccuag

SEQ ID NO: 807476 - RNA, 12 nt, Homo sapiens
ugccagacauug

SEQ ID NO: 807477 - RNA, 18 nt, Homo sapiens
ugccagacauugcucuca

SEQ ID NO: 807478 - RNA, 21 nt, Homo sapiens
ugccagacccacugaaaugac

SEQ ID NO: 807479 - RNA, 22 nt, Homo sapiens
ugccagaggcugaugucaagca

SEQ ID NO: 807480 - RNA, 13 nt, Homo sapiens
ugccagcaucugc

SEQ ID NO: 807481 - RNA, 15 nt, Homo sapiens
ugccagcaucugcag

SEQ ID NO: 807482 - RNA, 21 nt, Homo sapiens
ugccagcaucugcagccacuu

SEQ ID NO: 807483 - RNA, 21 nt, Homo sapiens
ugccaggcacuguucaucuca

SEQ ID NO: 807484 - RNA, 18 nt, Homo sapiens
ugccaggcuggagugcag

SEQ ID NO: 807485 - RNA, 20 nt, Homo sapiens
ugccaggcuggagugcagug

SEQ ID NO: 807486 - RNA, 21 nt, Homo sapiens
ugccaggugcaaucuacugga

SEQ ID NO: 807487 - RNA, 18 nt, Homo sapiens
ugccaguauguuccaaac

SEQ ID NO: 807488 - RNA, 14 nt, Homo sapiens
ugccagugcacucc

SEQ ID NO: 807489 - RNA, 15 nt, Homo sapiens
ugccagugccucuca

SEQ ID NO: 807490 - RNA, 21 nt, Homo sapiens
ccuuccagggccugagcagcu

SEQ ID NO: 807491 - RNA, 16 nt, Homo sapiens
ccuuccaggugggugu

SEQ ID NO: 807492 - RNA, 16 nt, Homo sapiens
ccuuccaugugccuuu

SEQ ID NO: 807493 - RNA, 20 nt, Homo sapiens
ccuuccccagacuugcacug

SEQ ID NO: 807494 - RNA, 23 nt, Homo sapiens
ccuuccccagcgucccagucucu

SEQ ID NO: 807495 - RNA, 21 nt, Homo sapiens
ccuuccucucaagcuagccag

SEQ ID NO: 807496 - RNA, 21 nt, Homo sapiens
ccuuccucugauuuacauuca

SEQ ID NO: 807497 - RNA, 20 nt, Homo sapiens
ccuuccucuuugaauucuuc

SEQ ID NO: 807498 - RNA, 16 nt, Homo sapiens
ccuuccuugaccagca

SEQ ID NO: 807499 - RNA, 13 nt, Homo sapiens
ccuuccuugccua

SEQ ID NO: 807500 - RNA, 20 nt, Homo sapiens
ccuucggagccaacaagacc

SEQ ID NO: 807501 - RNA, 18 nt, Homo sapiens
ccuucggcuccgggcaaa

SEQ ID NO: 807502 - RNA, 18 nt, Homo sapiens
ccuucggguuggcaaaau

SEQ ID NO: 807503 - RNA, 19 nt, Homo sapiens
ccuucuacagcagcacugu

SEQ ID NO: 807504 - RNA, 19 nt, Homo sapiens
ccuucucggagacccauug

SEQ ID NO: 807505 - RNA, 16 nt, Homo sapiens
ccuucucucacugugu

SEQ ID NO: 807506 - RNA, 15 nt, Homo sapiens
ccuucucugcuccac

SEQ ID NO: 807507 - RNA, 18 nt, Homo sapiens
ccuucucuucucuuugcu

SEQ ID NO: 807508 - RNA, 14 nt, Homo sapiens
ccuucugacuguuu

SEQ ID NO: 807509 - RNA, 17 nt, Homo sapiens
ccuucuggcaagccugu

SEQ ID NO: 807510 - RNA, 15 nt, Homo sapiens
ccuucugggacaugg

SEQ ID NO: 807511 - RNA, 20 nt, Homo sapiens
ccuucugggacuggacagcu

SEQ ID NO: 807512 - RNA, 22 nt, Homo sapiens
ccuucugggacuggacagcuuu

SEQ ID NO: 807513 - RNA, 12 nt, Homo sapiens
ccuucuuaacau

SEQ ID NO: 807514 - RNA, 15 nt, Homo sapiens
ccuucuugcuucuca

SEQ ID NO: 807515 - RNA, 16 nt, Homo sapiens
ccuucuugucauugaa

SEQ ID NO: 807516 - RNA, 15 nt, Homo sapiens
ccuucuuugcugcug

SEQ ID NO: 807517 - RNA, 17 nt, Homo sapiens
ccuucuuugucuugccc

SEQ ID NO: 807518 - RNA, 18 nt, Homo sapiens
ccuugagagacccagcug

SEQ ID NO: 807519 - RNA, 19 nt, Homo sapiens
ccuugauauaaaaaaucuu

SEQ ID NO: 807520 - RNA, 22 nt, Homo sapiens
ccuugaucuuaacaaagccuuu

SEQ ID NO: 807521 - RNA, 13 nt, Homo sapiens
ccuugcaccugca

SEQ ID NO: 807522 - RNA, 16 nt, Homo sapiens
ccuugcccccauuuca

SEQ ID NO: 807523 - RNA, 21 nt, Homo sapiens
ccuuggagaggagaguggcag

SEQ ID NO: 807524 - RNA, 21 nt, Homo sapiens
ccuuggaggcugucuucucag

SEQ ID NO: 807525 - RNA, 17 nt, Homo sapiens
ccuuggcaccagacacc

SEQ ID NO: 807526 - RNA, 16 nt, Homo sapiens
ccuuggccucccagaa

SEQ ID NO: 807527 - RNA, 15 nt, Homo sapiens
ccuuggcucaauccu

SEQ ID NO: 807528 - RNA, 16 nt, Homo sapiens
ccuuggcuucugugau

SEQ ID NO: 807529 - RNA, 21 nt, Homo sapiens
ccuuggcuuuaugcaaauaca

SEQ ID NO: 807530 - RNA, 15 nt, Homo sapiens
ccuugggaugaucuu

SEQ ID NO: 807531 - RNA, 16 nt, Homo sapiens
ccuuggggagcacuug

SEQ ID NO: 807532 - RNA, 17 nt, Homo sapiens
ccuuggggagcacuugu

SEQ ID NO: 807533 - RNA, 17 nt, Homo sapiens
ccuuggggucacuccuu

SEQ ID NO: 807534 - RNA, 17 nt, Homo sapiens
ccuugguggagcagcca

SEQ ID NO: 807535 - RNA, 23 nt, Homo sapiens
ccuuggugugcuguauccaucca

SEQ ID NO: 807536 - RNA, 21 nt, Homo sapiens
ccuuguaauaccugauugauc

SEQ ID NO: 807537 - RNA, 14 nt, Homo sapiens
ccuuguacuuuuca

SEQ ID NO: 807538 - RNA, 20 nt, Homo sapiens
ccuugucccccgugaucucc

SEQ ID NO: 807539 - RNA, 17 nt, Homo sapiens
ccuuguccucagggcua

SEQ ID NO: 807540 - RNA, 20 nt, Homo sapiens
ccuugugguuuguggcuuua

SEQ ID NO: 807541 - RNA, 13 nt, Homo sapiens
ccuugugucacug

SEQ ID NO: 807542 - RNA, 22 nt, Homo sapiens
ccuuguuguuguguugagaucc

SEQ ID NO: 807543 - RNA, 23 nt, Homo sapiens
ccuuuaaaucugugaugauccuc

SEQ ID NO: 807544 - RNA, 19 nt, Homo sapiens
ccuuuaacugacaagccau

SEQ ID NO: 807545 - RNA, 18 nt, Homo sapiens
ccuuuaagccugcauucu

SEQ ID NO: 807546 - RNA, 21 nt, Homo sapiens
ccuuuaagccugcauucuuaa

SEQ ID NO: 807547 - RNA, 13 nt, Homo sapiens
ccuuuacaccaac

SEQ ID NO: 807548 - RNA, 16 nt, Homo sapiens
ccuuuacguucaucac

SEQ ID NO: 807549 - RNA, 15 nt, Homo sapiens
ccuuuacuagauucu

SEQ ID NO: 807550 - RNA, 16 nt, Homo sapiens
ccuuuacugugcuuau

SEQ ID NO: 807551 - RNA, 24 nt, Homo sapiens
ccuuuagaggguaccgucuucucc

SEQ ID NO: 807552 - RNA, 19 nt, Homo sapiens
ccuuuagcuguguuauuau

SEQ ID NO: 807553 - RNA, 17 nt, Homo sapiens
ccuuuaucauccuuaaa

SEQ ID NO: 807554 - RNA, 12 nt, Homo sapiens
ccuuuaucucaa

SEQ ID NO: 807555 - RNA, 14 nt, Homo sapiens
ccuuuaucucugag

SEQ ID NO: 807556 - RNA, 19 nt, Homo sapiens
ccuuuaugcagagccacag

SEQ ID NO: 807557 - RNA, 13 nt, Homo sapiens
ccuuuaugugaau

SEQ ID NO: 807558 - RNA, 18 nt, Homo sapiens
ccuuucaagacagaaaga

SEQ ID NO: 807559 - RNA, 17 nt, Homo sapiens
ccuuucacuaaaacaca

SEQ ID NO: 807560 - RNA, 13 nt, Homo sapiens
ccuuucacuuacc

SEQ ID NO: 807561 - RNA, 20 nt, Homo sapiens
ccuuucagaugucuucugcc

SEQ ID NO: 807562 - RNA, 21 nt, Homo sapiens
ccuuucaucuggauucuacaa

SEQ ID NO: 807563 - RNA, 11 nt, Homo sapiens
ccuuucaucuu

SEQ ID NO: 807564 - RNA, 18 nt, Homo sapiens
ccuuuccaagucacuaga

SEQ ID NO: 807565 - RNA, 19 nt, Homo sapiens
ccuuuccaagucacuagaa

SEQ ID NO: 807566 - RNA, 16 nt, Homo sapiens
ccuuuccauaaggaau

SEQ ID NO: 807567 - RNA, 16 nt, Homo sapiens
ccuuucccaucuucca

SEQ ID NO: 807568 - RNA, 13 nt, Homo sapiens
ccuuuccuuccag

SEQ ID NO: 807569 - RNA, 23 nt, Homo sapiens
ccuuucuacaacugauugcaaca

SEQ ID NO: 807570 - RNA, 18 nt, Homo sapiens
ccuuucuguugccaguca

SEQ ID NO: 807571 - RNA, 21 nt, Homo sapiens
ccuuucuguugccagucagca

SEQ ID NO: 807572 - RNA, 15 nt, Homo sapiens
ccuuucuuacauuag

SEQ ID NO: 807573 - RNA, 22 nt, Homo sapiens
ugccugcagaggucugugcuga

SEQ ID NO: 807574 - RNA, 21 nt, Homo sapiens
ugccugcuggggauuacucga

SEQ ID NO: 807575 - RNA, 16 nt, Homo sapiens
ugccuggaacaccagc

SEQ ID NO: 807576 - RNA, 15 nt, Homo sapiens
ugccugggacacugc

SEQ ID NO: 807577 - RNA, 19 nt, Homo sapiens
ugccuggggccucaccugc

SEQ ID NO: 807578 - RNA, 15 nt, Homo sapiens
ugccugguaccagag

SEQ ID NO: 807579 - RNA, 16 nt, Homo sapiens
ugccugguaccagagg

SEQ ID NO: 807580 - RNA, 20 nt, Homo sapiens
ugccuggucugucuggaucc

SEQ ID NO: 807581 - RNA, 14 nt, Homo sapiens
ugccuguaaucuca

SEQ ID NO: 807582 - RNA, 23 nt, Homo sapiens
ugccuguagagacaauacaguaa

SEQ ID NO: 807583 - RNA, 11 nt, Homo sapiens
ugccugugacu

SEQ ID NO: 807584 - RNA, 16 nt, Homo sapiens
ugccugugaucccagc

SEQ ID NO: 807585 - RNA, 18 nt, Homo sapiens
ugccugugccuuuugcca

SEQ ID NO: 807586 - RNA, 18 nt, Homo sapiens
ugccuguucuaugccuuu

SEQ ID NO: 807587 - RNA, 21 nt, Homo sapiens
ugccuuaaacacacauugcag

SEQ ID NO: 807588 - RNA, 14 nt, Homo sapiens
ugccuuaagccagu

SEQ ID NO: 807589 - RNA, 15 nt, Homo sapiens
ugccuuagucucagu

SEQ ID NO: 807590 - RNA, 14 nt, Homo sapiens
ugccuuaucuugca

SEQ ID NO: 807591 - RNA, 14 nt, Homo sapiens
ugccuuauugcugu

SEQ ID NO: 807592 - RNA, 22 nt, Homo sapiens
ugccuucagcccuaacauagug

SEQ ID NO: 807593 - RNA, 16 nt, Homo sapiens
ugccuuccacaauuca

SEQ ID NO: 807594 - RNA, 18 nt, Homo sapiens
ugccuuccagcacccugc

SEQ ID NO: 807595 - RNA, 23 nt, Homo sapiens
ugccuuccauuuugaagugggau

SEQ ID NO: 807596 - RNA, 18 nt, Homo sapiens
ugccuucuaggucacuuc

SEQ ID NO: 807597 - RNA, 14 nt, Homo sapiens
ugccuucucaugau

SEQ ID NO: 807598 - RNA, 15 nt, Homo sapiens
ugccuucugcacaua

SEQ ID NO: 807599 - RNA, 19 nt, Homo sapiens
ugccuucugugcauccuca

SEQ ID NO: 807600 - RNA, 16 nt, Homo sapiens
ugccuucuuauugcuu

SEQ ID NO: 807601 - RNA, 21 nt, Homo sapiens
ugccuucuuauugcuuuuaug

SEQ ID NO: 807602 - RNA, 18 nt, Homo sapiens
ugccuugcuaaaagauua

SEQ ID NO: 807603 - RNA, 12 nt, Homo sapiens
ugccuugcugac

SEQ ID NO: 807604 - RNA, 16 nt, Homo sapiens
ugccuuuaagccaaag

SEQ ID NO: 807605 - RNA, 19 nt, Homo sapiens
cgaaaugcuaugacuguau

SEQ ID NO: 807606 - RNA, 17 nt, Homo sapiens
cgaaccuacaguuuuaa

SEQ ID NO: 807607 - RNA, 22 nt, Homo sapiens
cgaacgcucuuagcuuucucag

SEQ ID NO: 807608 - RNA, 22 nt, Homo sapiens
cgaacuauuuucaaagacuuaa

SEQ ID NO: 807609 - RNA, 14 nt, Homo sapiens
cgaagacuauuuag

SEQ ID NO: 807610 - RNA, 20 nt, Homo sapiens
cgaagacuauuuaguggaac

SEQ ID NO: 807611 - RNA, 20 nt, Homo sapiens
cgaagaugauuucaguucau

SEQ ID NO: 807612 - RNA, 18 nt, Homo sapiens
cgaagcggagagagccaa

SEQ ID NO: 807613 - RNA, 13 nt, Homo sapiens
cgacaccguguca

SEQ ID NO: 807614 - RNA, 12 nt, Homo sapiens
cgacaguuuucc

SEQ ID NO: 807615 - RNA, 21 nt, Homo sapiens
cgacauaacauuguacuguaa

SEQ ID NO: 807616 - RNA, 18 nt, Homo sapiens
cgacauggagaccaucua

SEQ ID NO: 807617 - RNA, 24 nt, Homo sapiens
cgacauggcuccggccucugccuu

SEQ ID NO: 807618 - RNA, 22 nt, Homo sapiens
cgaccaccuccaggacucagug

SEQ ID NO: 807619 - RNA, 17 nt, Homo sapiens
cgaccccaccacagucc

SEQ ID NO: 807620 - RNA, 18 nt, Homo sapiens
cgacuggggaguccucau

SEQ ID NO: 807621 - RNA, 12 nt, Homo sapiens
cgagacuccauc

SEQ ID NO: 807622 - RNA, 15 nt, Homo sapiens
cgagacuccaucucu

SEQ ID NO: 807623 - RNA, 21 nt, Homo sapiens
cgagacuccguuuccaaaaaa

SEQ ID NO: 807624 - RNA, 17 nt, Homo sapiens
cgagaggugggccaguc

SEQ ID NO: 807625 - RNA, 23 nt, Homo sapiens
cgagaguguguguauauguauua

SEQ ID NO: 807626 - RNA, 11 nt, Homo sapiens
cgagaucucag

SEQ ID NO: 807627 - RNA, 14 nt, Homo sapiens
cgagaucucaggag

SEQ ID NO: 807628 - RNA, 21 nt, Homo sapiens
cgagaucucgccacugcacuc

SEQ ID NO: 807629 - RNA, 18 nt, Homo sapiens
cgagcacauagagcuuuu

SEQ ID NO: 807630 - RNA, 16 nt, Homo sapiens
cgagcacgagcuggaa

SEQ ID NO: 807631 - RNA, 15 nt, Homo sapiens
cgagcagaugaugcc

SEQ ID NO: 807632 - RNA, 23 nt, Homo sapiens
cgagccccucggcucuggaggca

SEQ ID NO: 807633 - RNA, 14 nt, Homo sapiens
cgagccugcacugg

SEQ ID NO: 807634 - RNA, 19 nt, Homo sapiens
cgagcuagcuucugcaaug

SEQ ID NO: 807635 - RNA, 20 nt, Homo sapiens
cgagcuagcuucugcaaugu

SEQ ID NO: 807636 - RNA, 20 nt, Homo sapiens
cgaggcggguggaucacuug

SEQ ID NO: 807637 - RNA, 20 nt, Homo sapiens
cgagggccgcccgcucccuu

SEQ ID NO: 807638 - RNA, 22 nt, Homo sapiens
cgagucaauccccucauucagg

SEQ ID NO: 807639 - RNA, 17 nt, Homo sapiens
cgaguggauaauuccaa

SEQ ID NO: 807640 - RNA, 14 nt, Homo sapiens
cgaguuccagaccc

SEQ ID NO: 807641 - RNA, 17 nt, Homo sapiens
cgaguuguggaaagccu

SEQ ID NO: 807642 - RNA, 14 nt, Homo sapiens
cgauaaagggauuu

SEQ ID NO: 807643 - RNA, 13 nt, Homo sapiens
cgauacaaagugu

SEQ ID NO: 807644 - RNA, 12 nt, Homo sapiens
cgaucucagcuc

SEQ ID NO: 807645 - RNA, 13 nt, Homo sapiens
cgaucuccugacc

SEQ ID NO: 807646 - RNA, 15 nt, Homo sapiens
cgaucucuccuggcc

SEQ ID NO: 807647 - RNA, 17 nt, Homo sapiens
cgauggaucuguggucc

SEQ ID NO: 807648 - RNA, 22 nt, Homo sapiens
cgauguucuguacaacuuaacu

SEQ ID NO: 807649 - RNA, 16 nt, Homo sapiens
cgauugaaagaaccag

SEQ ID NO: 807650 - RNA, 19 nt, Homo sapiens
cgauugaaagaaccagaga

SEQ ID NO: 807651 - RNA, 23 nt, Homo sapiens
cgauuucucucucucccccucag

SEQ ID NO: 807652 - RNA, 20 nt, Homo sapiens
cgcaaacgugaaauucuauu

SEQ ID NO: 807653 - RNA, 16 nt, Homo sapiens
cgcaagaccagucacu

SEQ ID NO: 807654 - RNA, 18 nt, Homo sapiens
cgcaaggccugugcugca

SEQ ID NO: 807655 - RNA, 12 nt, Homo sapiens
cgcaauacugua

SEQ ID NO: 807656 - RNA, 20 nt, Homo sapiens
cgcacaaggcugaccaagag

SEQ ID NO: 807657 - RNA, 13 nt, Homo sapiens
cgcacaugcacac

SEQ ID NO: 807658 - RNA, 12 nt, Homo sapiens
cgcaccaugugg

SEQ ID NO: 807659 - RNA, 17 nt, Homo sapiens
cgcaccauuucugucac

SEQ ID NO: 807660 - RNA, 16 nt, Homo sapiens
cgcaccuugucaugua

SEQ ID NO: 807661 - RNA, 20 nt, Homo sapiens
cgcagacacacccacagaag

SEQ ID NO: 807662 - RNA, 20 nt, Homo sapiens
cgcagcccuggcagggggca

SEQ ID NO: 807663 - RNA, 16 nt, Homo sapiens
cgcauagacugaggua

SEQ ID NO: 807664 - RNA, 23 nt, Homo sapiens
cgcauauacauaaaguauccaug

SEQ ID NO: 807665 - RNA, 16 nt, Homo sapiens
cgccaaaacaagccaa

SEQ ID NO: 807666 - RNA, 21 nt, Homo sapiens
cgccagcagcgcgcaggccug

SEQ ID NO: 807667 - RNA, 17 nt, Homo sapiens
cgccagcguguggagca

SEQ ID NO: 807668 - RNA, 16 nt, Homo sapiens
cgcccaggcuggagug

SEQ ID NO: 807669 - RNA, 20 nt, Homo sapiens
cgcccaggcuggagugcagu

SEQ ID NO: 807670 - RNA, 23 nt, Homo sapiens
cgcccagugcagucggugguacc

SEQ ID NO: 807671 - RNA, 19 nt, Homo sapiens
cgcccccuccgcccugcca

SEQ ID NO: 807672 - RNA, 19 nt, Homo sapiens
cgccccucgcugcugcuac

SEQ ID NO: 807673 - RNA, 16 nt, Homo sapiens
cgccccuuccuagguc

SEQ ID NO: 807674 - RNA, 19 nt, Homo sapiens
cgcccuccucccugucaua

SEQ ID NO: 807675 - RNA, 12 nt, Homo sapiens
cgcccucggggc

SEQ ID NO: 807676 - RNA, 19 nt, Homo sapiens
cgcccuugagcuacuucaa

SEQ ID NO: 807677 - RNA, 21 nt, Homo sapiens
cgcccuuggcuucugugauga

SEQ ID NO: 807678 - RNA, 14 nt, Homo sapiens
cgccgccgcugccc

SEQ ID NO: 807679 - RNA, 22 nt, Homo sapiens
cgccucccuaguuagcauccag

SEQ ID NO: 807680 - RNA, 15 nt, Homo sapiens
cgccugacaaccacu

SEQ ID NO: 807681 - RNA, 16 nt, Homo sapiens
cgccugacaaccacug

SEQ ID NO: 807682 - RNA, 13 nt, Homo sapiens
cgccugcugggga

SEQ ID NO: 807683 - RNA, 22 nt, Homo sapiens
cgccuguaaucccagcacuuug

SEQ ID NO: 807684 - RNA, 11 nt, Homo sapiens
cgccuguaauu

SEQ ID NO: 807685 - RNA, 18 nt, Homo sapiens
cgccuguaauuccagcua

SEQ ID NO: 807686 - RNA, 22 nt, Homo sapiens
cgccuguggacagccugaguca

SEQ ID NO: 807687 - RNA, 14 nt, Homo sapiens
cgccuuacuggcaa

SEQ ID NO: 807688 - RNA, 15 nt, Homo sapiens
cgccuuccaaaaccu

SEQ ID NO: 807689 - RNA, 18 nt, Homo sapiens
ugcuccguggacugcagu

SEQ ID NO: 807690 - RNA, 13 nt, Homo sapiens
ugcuccucagggg

SEQ ID NO: 807691 - RNA, 22 nt, Homo sapiens
ugcucuacuuuuuccuuuuacc

SEQ ID NO: 807692 - RNA, 21 nt, Homo sapiens
ugcucuccggcgcagacaggc

SEQ ID NO: 807693 - RNA, 22 nt, Homo sapiens
ugcucucgcaccuuuccaaagu

SEQ ID NO: 807694 - RNA, 14 nt, Homo sapiens
ugcucucucugagg

SEQ ID NO: 807695 - RNA, 12 nt, Homo sapiens
ugcucucuucag

SEQ ID NO: 807696 - RNA, 21 nt, Homo sapiens
ugcucucuugugacgugcacu

SEQ ID NO: 807697 - RNA, 20 nt, Homo sapiens
ugcucugaauguccugacac

SEQ ID NO: 807698 - RNA, 18 nt, Homo sapiens
ugcucugagaauuguuga

SEQ ID NO: 807699 - RNA, 23 nt, Homo sapiens
ugcucugagaauuguugagauac

SEQ ID NO: 807700 - RNA, 13 nt, Homo sapiens
ugcucugagccac

SEQ ID NO: 807701 - RNA, 23 nt, Homo sapiens
ugcucugggacguggacaugccu

SEQ ID NO: 807702 - RNA, 23 nt, Homo sapiens
ugcucuucagaugccacuucuaa

SEQ ID NO: 807703 - RNA, 13 nt, Homo sapiens
ugcucuugccaaa

SEQ ID NO: 807704 - RNA, 13 nt, Homo sapiens
ugcucuugucggg

SEQ ID NO: 807705 - RNA, 19 nt, Homo sapiens
ugcucuuuugcacaaggaa

SEQ ID NO: 807706 - RNA, 23 nt, Homo sapiens
ugcugaaaaaucauccaagacag

SEQ ID NO: 807707 - RNA, 21 nt, Homo sapiens
ugcugaacugaaggcucagau

SEQ ID NO: 807708 - RNA, 20 nt, Homo sapiens
ugcugaagaggguugguaua

SEQ ID NO: 807709 - RNA, 16 nt, Homo sapiens
ugcugaauaaaugauu

SEQ ID NO: 807710 - RNA, 22 nt, Homo sapiens
ugcugaaugggacccuguugau

SEQ ID NO: 807711 - RNA, 15 nt, Homo sapiens
ugcugaaugucauuu

SEQ ID NO: 807712 - RNA, 22 nt, Homo sapiens
ugcugacaaccauuaaagucag

SEQ ID NO: 807713 - RNA, 15 nt, Homo sapiens
ugcugaccaaauggc

SEQ ID NO: 807714 - RNA, 16 nt, Homo sapiens
ugcugaccucaccugg

SEQ ID NO: 807715 - RNA, 23 nt, Homo sapiens
ugcugacugaggccugcuucccc

SEQ ID NO: 807716 - RNA, 15 nt, Homo sapiens
ugcugaggcccagug

SEQ ID NO: 807717 - RNA, 17 nt, Homo sapiens
ugcugagggucugggau

SEQ ID NO: 807718 - RNA, 23 nt, Homo sapiens
ugcugagugcaccacuucaagug

SEQ ID NO: 807719 - RNA, 14 nt, Homo sapiens
cucugccugcauuc

SEQ ID NO: 807720 - RNA, 15 nt, Homo sapiens
cucugccuuaaacac

SEQ ID NO: 807721 - RNA, 20 nt, Homo sapiens
cucugcuacuccauccugaa

SEQ ID NO: 807722 - RNA, 14 nt, Homo sapiens
cucugcuucuccaa

SEQ ID NO: 807723 - RNA, 20 nt, Homo sapiens
cucuggacacucuauaugua

SEQ ID NO: 807724 - RNA, 15 nt, Homo sapiens
cucuggacaguugug

SEQ ID NO: 807725 - RNA, 22 nt, Homo sapiens
cucuggaccugucucuaccuaa

SEQ ID NO: 807726 - RNA, 17 nt, Homo sapiens
cucuggagcagccaagg

SEQ ID NO: 807727 - RNA, 20 nt, Homo sapiens
cucuggaugaaggcaaaaac

SEQ ID NO: 807728 - RNA, 13 nt, Homo sapiens
cucuggauugaga

SEQ ID NO: 807729 - RNA, 15 nt, Homo sapiens
cucuggccacuauua

SEQ ID NO: 807730 - RNA, 23 nt, Homo sapiens
cucuggccaggauggaggggugg

SEQ ID NO: 807731 - RNA, 15 nt, Homo sapiens
cucugggcacagugg

SEQ ID NO: 807732 - RNA, 23 nt, Homo sapiens
cucuggggguccucucugaguca

SEQ ID NO: 807733 - RNA, 17 nt, Homo sapiens
cucuggggucuuuuuau

SEQ ID NO: 807734 - RNA, 16 nt, Homo sapiens
cucuggguugugcaca

SEQ ID NO: 807735 - RNA, 16 nt, Homo sapiens
cucuggugacaccagc

SEQ ID NO: 807736 - RNA, 13 nt, Homo sapiens
cucugguggcaca

SEQ ID NO: 807737 - RNA, 21 nt, Homo sapiens
cucugguggcaggugccuugu

SEQ ID NO: 807738 - RNA, 11 nt, Homo sapiens
cucuguaaaac

SEQ ID NO: 807739 - RNA, 15 nt, Homo sapiens
cucuguaauugaaua

SEQ ID NO: 807740 - RNA, 20 nt, Homo sapiens
cucuguagcuuaaaccaaca

SEQ ID NO: 807741 - RNA, 20 nt, Homo sapiens
cucuguaguuuaugaugcaa

SEQ ID NO: 807742 - RNA, 22 nt, Homo sapiens
cucuguaguuuaugaugcaaau

SEQ ID NO: 807743 - RNA, 22 nt, Homo sapiens
cucuguauuccgauacaaagug

SEQ ID NO: 807744 - RNA, 19 nt, Homo sapiens
cucugucuuaaaugagaag

SEQ ID NO: 807745 - RNA, 21 nt, Homo sapiens
cucugugaacgauuuagaaag

SEQ ID NO: 807746 - RNA, 19 nt, Homo sapiens
cucugugcagucacuggag

SEQ ID NO: 807747 - RNA, 12 nt, Homo sapiens
cucugugccuug

SEQ ID NO: 807748 - RNA, 20 nt, Homo sapiens
cucugugcuucgacuacugc

SEQ ID NO: 807749 - RNA, 21 nt, Homo sapiens
cucuguggaaugaauacacac

SEQ ID NO: 807750 - RNA, 18 nt, Homo sapiens
cucugugucucuccauca

SEQ ID NO: 807751 - RNA, 14 nt, Homo sapiens
cucugugugcacac

SEQ ID NO: 807752 - RNA, 23 nt, Homo sapiens
cucuguuacuccauuacugugau

SEQ ID NO: 807753 - RNA, 15 nt, Homo sapiens
cucuguuguccuccc

SEQ ID NO: 807754 - RNA, 22 nt, Homo sapiens
cucuguuucgguugacccaggu

SEQ ID NO: 807755 - RNA, 16 nt, Homo sapiens
cucuguuucuuccuuu

SEQ ID NO: 807756 - RNA, 19 nt, Homo sapiens
cucuuaaugugcagcaaaa

SEQ ID NO: 807757 - RNA, 14 nt, Homo sapiens
cucuuaauguugcu

SEQ ID NO: 807758 - RNA, 15 nt, Homo sapiens
cucuuacaaccaaga

SEQ ID NO: 807759 - RNA, 12 nt, Homo sapiens
cucuuacacaua

SEQ ID NO: 807760 - RNA, 19 nt, Homo sapiens
cucuuacagagccuugaga

SEQ ID NO: 807761 - RNA, 17 nt, Homo sapiens
cucuuaccugggaccuc

SEQ ID NO: 807762 - RNA, 15 nt, Homo sapiens
cucuuaccuguuauu

SEQ ID NO: 807763 - RNA, 20 nt, Homo sapiens
cucuuacguuuaacauacaa

SEQ ID NO: 807764 - RNA, 21 nt, Homo sapiens
cucuuagagaaagaacuauga

SEQ ID NO: 807765 - RNA, 15 nt, Homo sapiens
cucuuagcacacuca

SEQ ID NO: 807766 - RNA, 19 nt, Homo sapiens
cucuuagccucuggaucua

SEQ ID NO: 807767 - RNA, 14 nt, Homo sapiens
cucuucacagugcc

SEQ ID NO: 807768 - RNA, 22 nt, Homo sapiens
cucuucagucucuauaccaaua

SEQ ID NO: 807769 - RNA, 15 nt, Homo sapiens
cucuucagugacucc

SEQ ID NO: 807770 - RNA, 16 nt, Homo sapiens
cucuucaguuaauucu

SEQ ID NO: 807771 - RNA, 18 nt, Homo sapiens
cucuucaucccauuccag

SEQ ID NO: 807772 - RNA, 15 nt, Homo sapiens
cucuuccaccacaga

SEQ ID NO: 807773 - RNA, 21 nt, Homo sapiens
cucuucccuucccagaccagg

SEQ ID NO: 807774 - RNA, 13 nt, Homo sapiens
cucuuccugugau

SEQ ID NO: 807775 - RNA, 16 nt, Homo sapiens
cucuuccugugaucca

SEQ ID NO: 807776 - RNA, 13 nt, Homo sapiens
cucuuccuugaau

SEQ ID NO: 807777 - RNA, 13 nt, Homo sapiens
cucuucuaugcaa

SEQ ID NO: 807778 - RNA, 14 nt, Homo sapiens
cucuucucauuuca

SEQ ID NO: 807779 - RNA, 12 nt, Homo sapiens
cucuucugcaag

SEQ ID NO: 807780 - RNA, 13 nt, Homo sapiens
cucuucuguggac

SEQ ID NO: 807781 - RNA, 22 nt, Homo sapiens
cucuucuucuuuccuuccauca

SEQ ID NO: 807782 - RNA, 19 nt, Homo sapiens
cucuucuuggggcccagug

SEQ ID NO: 807783 - RNA, 21 nt, Homo sapiens
cucuucuuggggcccagugca

SEQ ID NO: 807784 - RNA, 20 nt, Homo sapiens
cucuucuuuagaacagggaa

SEQ ID NO: 807785 - RNA, 13 nt, Homo sapiens
cucuugaggccag

SEQ ID NO: 807786 - RNA, 17 nt, Homo sapiens
cucuugagucacacugc

SEQ ID NO: 807787 - RNA, 13 nt, Homo sapiens
cucuugcacucaa

SEQ ID NO: 807788 - RNA, 17 nt, Homo sapiens
cucuugcccauccugac

SEQ ID NO: 807789 - RNA, 18 nt, Homo sapiens
cucuugccuuuuacuuaa

SEQ ID NO: 807790 - RNA, 22 nt, Homo sapiens
cucuuggagcugagaugagccc

SEQ ID NO: 807791 - RNA, 13 nt, Homo sapiens
cucuuggaugcag

SEQ ID NO: 807792 - RNA, 16 nt, Homo sapiens
cucuuggaugcagcuu

SEQ ID NO: 807793 - RNA, 13 nt, Homo sapiens
cucuuggcaucga

SEQ ID NO: 807794 - RNA, 20 nt, Homo sapiens
cucuugggaagaccagcuuu

SEQ ID NO: 807795 - RNA, 21 nt, Homo sapiens
cucuuguccucuucugcucuu

SEQ ID NO: 807796 - RNA, 17 nt, Homo sapiens
cucuuguggugcauuga

SEQ ID NO: 807797 - RNA, 17 nt, Homo sapiens
cucuuuaaauggcuuua

SEQ ID NO: 807798 - RNA, 13 nt, Homo sapiens
cucuuuaacaagg

SEQ ID NO: 807799 - RNA, 16 nt, Homo sapiens
cucuuuaaucagcuua

SEQ ID NO: 807800 - RNA, 12 nt, Homo sapiens
cucuuuaccucc

SEQ ID NO: 807801 - RNA, 13 nt, Homo sapiens
cucuuuaugacug

SEQ ID NO: 807802 - RNA, 12 nt, Homo sapiens
cucuuucacuuc

SEQ ID NO: 807803 - RNA, 15 nt, Homo sapiens
cucuuucccaacccc

SEQ ID NO: 807804 - RNA, 16 nt, Homo sapiens
cucuuuccuauuucag

SEQ ID NO: 807805 - RNA, 12 nt, Homo sapiens
cucuuucuugga

SEQ ID NO: 807806 - RNA, 14 nt, Homo sapiens
cucuuuuagcugau

SEQ ID NO: 807807 - RNA, 17 nt, Homo sapiens
cucuuuuagcugaugaa

SEQ ID NO: 807808 - RNA, 19 nt, Homo sapiens
cucuuuuaggaggcacaac

SEQ ID NO: 807809 - RNA, 17 nt, Homo sapiens
cucuuuugaauccaugc

SEQ ID NO: 807810 - RNA, 13 nt, Homo sapiens
uguuacagauuaa

SEQ ID NO: 807811 - RNA, 16 nt, Homo sapiens
uguuacagcuucgcug

SEQ ID NO: 807812 - RNA, 22 nt, Homo sapiens
uguuacaggaagucccuugcca

SEQ ID NO: 807813 - RNA, 20 nt, Homo sapiens
uguuacgcacacguacuuaa

SEQ ID NO: 807814 - RNA, 11 nt, Homo sapiens
uguuacuguga

SEQ ID NO: 807815 - RNA, 11 nt, Homo sapiens
uguuagauauu

SEQ ID NO: 807816 - RNA, 18 nt, Homo sapiens
uguuagauauuuuucaua

SEQ ID NO: 807817 - RNA, 15 nt, Homo sapiens
uguuagaucagggga

SEQ ID NO: 807818 - RNA, 19 nt, Homo sapiens
uguuagugugugugcaugu

SEQ ID NO: 807819 - RNA, 19 nt, Homo sapiens
uguuauaacucugcacuac

SEQ ID NO: 807820 - RNA, 15 nt, Homo sapiens
uguuauaucagggaa

SEQ ID NO: 807821 - RNA, 19 nt, Homo sapiens
uguuauaucaucaauacuu

SEQ ID NO: 807822 - RNA, 17 nt, Homo sapiens
uguuauauucagugugu

SEQ ID NO: 807823 - RNA, 14 nt, Homo sapiens
uguuaucagucaua

SEQ ID NO: 807824 - RNA, 20 nt, Homo sapiens
uguuaucagucauaacuaaa

SEQ ID NO: 807825 - RNA, 20 nt, Homo sapiens
uguuaucuguguagcaagcu

SEQ ID NO: 807826 - RNA, 23 nt, Homo sapiens
uguuaugcauagcuuugcacuuc

SEQ ID NO: 807827 - RNA, 23 nt, Homo sapiens
uguuauuauauuccguagguaga

SEQ ID NO: 807828 - RNA, 22 nt, Homo sapiens
uguuauuuaaugagucagucaa

SEQ ID NO: 807829 - RNA, 22 nt, Homo sapiens
uguuauuuucuguugaaguuua

SEQ ID NO: 807830 - RNA, 18 nt, Homo sapiens
uguucaacauuaacauug

SEQ ID NO: 807831 - RNA, 22 nt, Homo sapiens
uguucaauggaugaauuucuaa

SEQ ID NO: 807832 - RNA, 15 nt, Homo sapiens
uguucaccuucaaaa

SEQ ID NO: 807833 - RNA, 15 nt, Homo sapiens
uguucagggcuguga

SEQ ID NO: 807834 - RNA, 23 nt, Homo sapiens
uuaaacacacauugcagcuucaa

SEQ ID NO: 807835 - RNA, 14 nt, Homo sapiens
uuaaacaccuccuc

SEQ ID NO: 807836 - RNA, 15 nt, Homo sapiens
uuaaacaccuccuca

SEQ ID NO: 807837 - RNA, 16 nt, Homo sapiens
uuaaacauacgacuua

SEQ ID NO: 807838 - RNA, 22 nt, Homo sapiens
uuaaacauuaauagcagccuuu

SEQ ID NO: 807839 - RNA, 18 nt, Homo sapiens
uuaaaccuuaagauacua

SEQ ID NO: 807840 - RNA, 23 nt, Homo sapiens
uuaaacuggaaaggaucugugau

SEQ ID NO: 807841 - RNA, 22 nt, Homo sapiens
uuaaacuugaaauauauaauau

SEQ ID NO: 807842 - RNA, 18 nt, Homo sapiens
uuaaacuugcaucacuua

SEQ ID NO: 807843 - RNA, 12 nt, Homo sapiens
uuaaacuuucaa

SEQ ID NO: 807844 - RNA, 16 nt, Homo sapiens
uuaaacuuuuaauuca

SEQ ID NO: 807845 - RNA, 17 nt, Homo sapiens
uuaaacuuuuuuaacca

SEQ ID NO: 807846 - RNA, 12 nt, Homo sapiens
uuaaagaaagaa

SEQ ID NO: 807847 - RNA, 15 nt, Homo sapiens
uuaaagaauaugacu

SEQ ID NO: 807848 - RNA, 11 nt, Homo sapiens
uuaaagacaug

SEQ ID NO: 807849 - RNA, 13 nt, Homo sapiens
uuaaagagucuag

SEQ ID NO: 807850 - RNA, 19 nt, Homo sapiens
uuaaagcauauuggugcua

SEQ ID NO: 807851 - RNA, 14 nt, Homo sapiens
uuaaagccuccuca

SEQ ID NO: 807852 - RNA, 22 nt, Homo sapiens
uuaaagcucauaaacugccaag

SEQ ID NO: 807853 - RNA, 19 nt, Homo sapiens
uuaaaggaaaaucacaucu

SEQ ID NO: 807854 - RNA, 22 nt, Homo sapiens
uuaaaggcugugguaguacucc

SEQ ID NO: 807855 - RNA, 19 nt, Homo sapiens
uuaaaggggguaugugaua

SEQ ID NO: 807856 - RNA, 19 nt, Homo sapiens
uuaaaguaaugagcaugau

SEQ ID NO: 807857 - RNA, 19 nt, Homo sapiens
uuaaaguauaugugcaguc

SEQ ID NO: 807858 - RNA, 12 nt, Homo sapiens
uuaaagucagaa

SEQ ID NO: 807859 - RNA, 21 nt, Homo sapiens
uuaaagucagguccaauuugu

SEQ ID NO: 807860 - RNA, 18 nt, Homo sapiens
uuaaauaaacacagucca

SEQ ID NO: 807861 - RNA, 15 nt, Homo sapiens
uuaaauaaaccucaa

SEQ ID NO: 807862 - RNA, 19 nt, Homo sapiens
uuaaauaaaguuacuugaa

SEQ ID NO: 807863 - RNA, 17 nt, Homo sapiens
uuaaauaaaucauaaaa

SEQ ID NO: 807864 - RNA, 19 nt, Homo sapiens
uuaaauaaaucauuaauac

SEQ ID NO: 807865 - RNA, 20 nt, Homo sapiens
uuaaauauauaauguugcca

SEQ ID NO: 807866 - RNA, 16 nt, Homo sapiens
uuaaauaugaaugaac

SEQ ID NO: 807867 - RNA, 14 nt, Homo sapiens
uuaaaucaaaaggg

SEQ ID NO: 807868 - RNA, 14 nt, Homo sapiens
uuaaaucaagauua

SEQ ID NO: 807869 - RNA, 12 nt, Homo sapiens
uuaaaucacuug

SEQ ID NO: 807870 - RNA, 18 nt, Homo sapiens
uuaaauccaacuuucaca

SEQ ID NO: 807871 - RNA, 19 nt, Homo sapiens
uuaaaucuuuggauuugau

SEQ ID NO: 807872 - RNA, 19 nt, Homo sapiens
uuaaauggaaacagacuca

SEQ ID NO: 807873 - RNA, 22 nt, Homo sapiens
uuaaauggcuuuugccacauac

SEQ ID NO: 807874 - RNA, 21 nt, Homo sapiens
uuaaaugguguuuuauuacaa

SEQ ID NO: 807875 - RNA, 15 nt, Homo sapiens
uuaaauguuucucaa

SEQ ID NO: 807876 - RNA, 18 nt, Homo sapiens
uuaaauuccugguggaua

SEQ ID NO: 807877 - RNA, 16 nt, Homo sapiens
uuaaauuguaaaugaa

SEQ ID NO: 807878 - RNA, 12 nt, Homo sapiens
uuaaauugugcc

SEQ ID NO: 807879 - RNA, 17 nt, Homo sapiens
uuaaauuuaauaccaga

SEQ ID NO: 807880 - RNA, 21 nt, Homo sapiens
uuaaauuuauuugaaaaugca

SEQ ID NO: 807881 - RNA, 18 nt, Homo sapiens
uuaaauuuuauaugggcu

SEQ ID NO: 807882 - RNA, 18 nt, Homo sapiens
uuaacaaaugugcugcuu

SEQ ID NO: 807883 - RNA, 18 nt, Homo sapiens
uuaacaaccgacacuccu

SEQ ID NO: 807884 - RNA, 11 nt, Homo sapiens
uuaacaaucua

SEQ ID NO: 807885 - RNA, 16 nt, Homo sapiens
uuaacacugcaaauaa

SEQ ID NO: 807886 - RNA, 17 nt, Homo sapiens
uuaacacuuaaauuucu

SEQ ID NO: 807887 - RNA, 21 nt, Homo sapiens
uuaacagaugcaaugugcuac

SEQ ID NO: 807888 - RNA, 21 nt, Homo sapiens
uuaacagauggaaaaacugag

SEQ ID NO: 807889 - RNA, 19 nt, Homo sapiens
uuaacaguuguauuuaaca

SEQ ID NO: 807890 - RNA, 15 nt, Homo sapiens
uuaacaucacugucu

SEQ ID NO: 807891 - RNA, 18 nt, Homo sapiens
uuaacaucuacaaucagu

SEQ ID NO: 807892 - RNA, 13 nt, Homo sapiens
uuaacaucucaga

SEQ ID NO: 807893 - RNA, 18 nt, Homo sapiens
uuaacauggacaugaucu

SEQ ID NO: 807894 - RNA, 17 nt, Homo sapiens
uuaacauuccucaugaa

SEQ ID NO: 807895 - RNA, 22 nt, Homo sapiens
uuaacccauuugucucuacuuu

SEQ ID NO: 807896 - RNA, 14 nt, Homo sapiens
uuaacuacugaaua

SEQ ID NO: 807897 - RNA, 13 nt, Homo sapiens
uuaacuauaacaa

SEQ ID NO: 807898 - RNA, 16 nt, Homo sapiens
uuaacucauaugaucu

SEQ ID NO: 807899 - RNA, 18 nt, Homo sapiens
uuaacucccuccaccagc

SEQ ID NO: 807900 - RNA, 11 nt, Homo sapiens
uuaacuccucc

SEQ ID NO: 807901 - RNA, 20 nt, Homo sapiens
uuaacugcauaauagccuaa

SEQ ID NO: 807902 - RNA, 11 nt, Homo sapiens
uuaacugccaa

SEQ ID NO: 807903 - RNA, 19 nt, Homo sapiens
uuaacuggucuccuugcuu

SEQ ID NO: 807904 - RNA, 12 nt, Homo sapiens
uuaacuggugaa

SEQ ID NO: 807905 - RNA, 20 nt, Homo sapiens
uuaacugugaaauaccacaa

SEQ ID NO: 807906 - RNA, 14 nt, Homo sapiens
uuaagaaacacagg

SEQ ID NO: 807907 - RNA, 22 nt, Homo sapiens
uuaagaaacacaggguuuugua

SEQ ID NO: 807908 - RNA, 15 nt, Homo sapiens
uuaagaaagcacuua

SEQ ID NO: 807909 - RNA, 14 nt, Homo sapiens
uuaagaauuucaca

SEQ ID NO: 807910 - RNA, 17 nt, Homo sapiens
uuaagacagagucucac

SEQ ID NO: 807911 - RNA, 14 nt, Homo sapiens
uuaagaguccaaga

SEQ ID NO: 807912 - RNA, 15 nt, Homo sapiens
uuaagaguuacuuaa

SEQ ID NO: 807913 - RNA, 23 nt, Homo sapiens
uuaagaucugacugccaaauaaa

SEQ ID NO: 807914 - RNA, 22 nt, Homo sapiens
uuaagauuuggucacacucuca

SEQ ID NO: 807915 - RNA, 23 nt, Homo sapiens
uuaagcugggauaaucacauuau

SEQ ID NO: 807916 - RNA, 23 nt, Homo sapiens
uuaaggauaaaucauaaagucag

SEQ ID NO: 807917 - RNA, 15 nt, Homo sapiens
uuaaggauugugaua

SEQ ID NO: 807918 - RNA, 23 nt, Homo sapiens
uuaagggaacugaaucacuuaaa

SEQ ID NO: 807919 - RNA, 21 nt, Homo sapiens
uuaagguuuguuuucauuaaa

SEQ ID NO: 807920 - RNA, 22 nt, Homo sapiens
uuaaguaagcaacagcauaaca

SEQ ID NO: 807921 - RNA, 22 nt, Homo sapiens
uuaaguauguuauuuucuguug

SEQ ID NO: 807922 - RNA, 14 nt, Homo sapiens
uuaagucaaagaag

SEQ ID NO: 807923 - RNA, 17 nt, Homo sapiens
uuaagugagcagaacag

SEQ ID NO: 807924 - RNA, 22 nt, Homo sapiens
uuaaguggggugggaaggggag

SEQ ID NO: 807925 - RNA, 20 nt, Homo sapiens
uuaaguucaggcagcacauc

SEQ ID NO: 807926 - RNA, 22 nt, Homo sapiens
cugacuccuuagagacaucaaa

SEQ ID NO: 807927 - RNA, 19 nt, Homo sapiens
cugacucucgugcauuuca

SEQ ID NO: 807928 - RNA, 21 nt, Homo sapiens
cugacucucugugaccugccc

SEQ ID NO: 807929 - RNA, 20 nt, Homo sapiens
cugacugaagugaacuauga

SEQ ID NO: 807930 - RNA, 20 nt, Homo sapiens
cugacuguuuauuuaaggau

SEQ ID NO: 807931 - RNA, 23 nt, Homo sapiens
cugacuucagugggacucgguga

SEQ ID NO: 807932 - RNA, 17 nt, Homo sapiens
cugacuugaguguuccu

SEQ ID NO: 807933 - RNA, 16 nt, Homo sapiens
cugacuuggcacuuaa

SEQ ID NO: 807934 - RNA, 18 nt, Homo sapiens
cugacuuguuugucuucc

SEQ ID NO: 807935 - RNA, 21 nt, Homo sapiens
cugagaaaaucccucccugac

SEQ ID NO: 807936 - RNA, 23 nt, Homo sapiens
cugagaaauaaaaagccugucau

SEQ ID NO: 807937 - RNA, 14 nt, Homo sapiens
cugagaagaucuga

SEQ ID NO: 807938 - RNA, 19 nt, Homo sapiens
cugagaagucaaacauuuc

SEQ ID NO: 807939 - RNA, 16 nt, Homo sapiens
cugagaaucagacuga

SEQ ID NO: 807940 - RNA, 18 nt, Homo sapiens
cugagaaucagacugaca

SEQ ID NO: 807941 - RNA, 15 nt, Homo sapiens
cugagacagcuuguc

SEQ ID NO: 807942 - RNA, 16 nt, Homo sapiens
cugagacagugaauuu

SEQ ID NO: 807943 - RNA, 20 nt, Homo sapiens
cugagacccuuuucucagga

SEQ ID NO: 807944 - RNA, 18 nt, Homo sapiens
cugagacuuucagugcac

SEQ ID NO: 807945 - RNA, 20 nt, Homo sapiens
cugagagccgggaaggggaa

SEQ ID NO: 807946 - RNA, 12 nt, Homo sapiens
cugagagucuag

SEQ ID NO: 807947 - RNA, 17 nt, Homo sapiens
cugagauauauuugcua

SEQ ID NO: 807948 - RNA, 18 nt, Homo sapiens
uuaaugaaauaucuguau

SEQ ID NO: 807949 - RNA, 14 nt, Homo sapiens
uuaaugaacauaug

SEQ ID NO: 807950 - RNA, 20 nt, Homo sapiens
uuaaugaacaugugaaguua

SEQ ID NO: 807951 - RNA, 12 nt, Homo sapiens
uuaaugagauag

SEQ ID NO: 807952 - RNA, 22 nt, Homo sapiens
uuaaugcagagcuagaggacuu

SEQ ID NO: 807953 - RNA, 13 nt, Homo sapiens
uuaaugcuucauu

SEQ ID NO: 807954 - RNA, 12 nt, Homo sapiens
uuaaugcuugua

SEQ ID NO: 807955 - RNA, 16 nt, Homo sapiens
uuaauggaaaccaagc

SEQ ID NO: 807956 - RNA, 21 nt, Homo sapiens
uuaaugguagcaacugaaaga

SEQ ID NO: 807957 - RNA, 19 nt, Homo sapiens
uuaauguguuaagugcagg

SEQ ID NO: 807958 - RNA, 19 nt, Homo sapiens
uuaauuaaguacaaccaac

SEQ ID NO: 807959 - RNA, 14 nt, Homo sapiens
uuaauuaaucauga

SEQ ID NO: 807960 - RNA, 17 nt, Homo sapiens
uuaauuacaacugcuau

SEQ ID NO: 807961 - RNA, 14 nt, Homo sapiens
uuaauuacauacag

SEQ ID NO: 807962 - RNA, 14 nt, Homo sapiens
uuaauuagcccaac

SEQ ID NO: 807963 - RNA, 21 nt, Homo sapiens
uuaauuaugaaaacuagcauu

SEQ ID NO: 807964 - RNA, 15 nt, Homo sapiens
uuaauucagucucag

SEQ ID NO: 807965 - RNA, 20 nt, Homo sapiens
uuaauucucauuuguucuca

SEQ ID NO: 807966 - RNA, 24 nt, Homo sapiens
uuaauuuacagaaaucaaugguag

SEQ ID NO: 807967 - RNA, 18 nt, Homo sapiens
uuaauuuacuuuaagcau

SEQ ID NO: 807968 - RNA, 11 nt, Homo sapiens
uuaauuuccag

SEQ ID NO: 807969 - RNA, 16 nt, Homo sapiens
uuaauuugcacagugu

SEQ ID NO: 807970 - RNA, 22 nt, Homo sapiens
uuaauuuuccuuugucauuucc

SEQ ID NO: 807971 - RNA, 17 nt, Homo sapiens
uuacaaaaaaauacaaa

SEQ ID NO: 807972 - RNA, 13 nt, Homo sapiens
uuacaaaauauuc

SEQ ID NO: 807973 - RNA, 15 nt, Homo sapiens
uuacaaaaugccaag

SEQ ID NO: 807974 - RNA, 20 nt, Homo sapiens
uuacaaaccauuaccuguac

SEQ ID NO: 807975 - RNA, 15 nt, Homo sapiens
uuacaaacugcaaua

SEQ ID NO: 807976 - RNA, 16 nt, Homo sapiens
uuacaaaggugaaaau

SEQ ID NO: 807977 - RNA, 20 nt, Homo sapiens
uuacaauaggaguggugauu

SEQ ID NO: 807978 - RNA, 13 nt, Homo sapiens
uuacaauugugag

SEQ ID NO: 807979 - RNA, 14 nt, Homo sapiens
uuacacacaaaaaa

SEQ ID NO: 807980 - RNA, 17 nt, Homo sapiens
uuacacacaugagggcu

SEQ ID NO: 807981 - RNA, 12 nt, Homo sapiens
uuacacugcgga

SEQ ID NO: 807982 - RNA, 14 nt, Homo sapiens
uuacagaacuacuu

SEQ ID NO: 807983 - RNA, 15 nt, Homo sapiens
uuacagaacuacuuc

SEQ ID NO: 807984 - RNA, 22 nt, Homo sapiens
uuacagaauaacugguacacuu

SEQ ID NO: 807985 - RNA, 21 nt, Homo sapiens
uuacagaaucacagcccucau

SEQ ID NO: 807986 - RNA, 18 nt, Homo sapiens
uuacagacucugauucua

SEQ ID NO: 807987 - RNA, 12 nt, Homo sapiens
uuacagcuuucu

SEQ ID NO: 807988 - RNA, 13 nt, Homo sapiens
uuacagcuuucug

SEQ ID NO: 807989 - RNA, 12 nt, Homo sapiens
uuacagugcaga

SEQ ID NO: 807990 - RNA, 14 nt, Homo sapiens
uuacauaucaccuc

SEQ ID NO: 807991 - RNA, 17 nt, Homo sapiens
uuacauauuaaauaugu

SEQ ID NO: 807992 - RNA, 23 nt, Homo sapiens
uuacauugagcgugaccuugcaa

SEQ ID NO: 807993 - RNA, 20 nt, Homo sapiens
uuacauuuauuuauccagaa

SEQ ID NO: 807994 - RNA, 16 nt, Homo sapiens
uuaccaaaaaccaugu

SEQ ID NO: 807995 - RNA, 16 nt, Homo sapiens
uuaccaaaauucacua

SEQ ID NO: 807996 - RNA, 16 nt, Homo sapiens
uuaccaaacgauuccg

SEQ ID NO: 807997 - RNA, 19 nt, Homo sapiens
uuaccaaagcaucaauaca

SEQ ID NO: 807998 - RNA, 20 nt, Homo sapiens
uuaccaaagcaucaauacaa

SEQ ID NO: 807999 - RNA, 13 nt, Homo sapiens
uuaccaaaggaua

SEQ ID NO: 808000 - RNA, 17 nt, Homo sapiens
uuaccagaagcuuccau

SEQ ID NO: 808001 - RNA, 20 nt, Homo sapiens
uuaccagacgguucaccagc

SEQ ID NO: 808002 - RNA, 14 nt, Homo sapiens
uuaccagcaagaau

SEQ ID NO: 808003 - RNA, 10 nt, Homo sapiens
uuaccaucug

SEQ ID NO: 808004 - RNA, 22 nt, Homo sapiens
uuaccauuuguaauaaaguaua

SEQ ID NO: 808005 - RNA, 22 nt, Homo sapiens
uuacccuaaagugcaaaaguga

SEQ ID NO: 808006 - RNA, 17 nt, Homo sapiens
uuacccugaggucacug

SEQ ID NO: 808007 - RNA, 15 nt, Homo sapiens
uuacccuugaucuua

SEQ ID NO: 808008 - RNA, 15 nt, Homo sapiens
uuaccgacacuguca

SEQ ID NO: 808009 - RNA, 21 nt, Homo sapiens
uuaccuccauccauccuucca

SEQ ID NO: 808010 - RNA, 17 nt, Homo sapiens
uuaccucuucuaugcaa

SEQ ID NO: 808011 - RNA, 13 nt, Homo sapiens
uuaccugacacaa

SEQ ID NO: 808012 - RNA, 17 nt, Homo sapiens
uuaccugggaccucaca

SEQ ID NO: 808013 - RNA, 23 nt, Homo sapiens
uuaccugguagaucaagcauuac

SEQ ID NO: 808014 - RNA, 16 nt, Homo sapiens
uuacgcaaugcuucua

SEQ ID NO: 808015 - RNA, 17 nt, Homo sapiens
uuacgcccaucucagga

SEQ ID NO: 808016 - RNA, 16 nt, Homo sapiens
uuacgcucaucaccua

SEQ ID NO: 808017 - RNA, 22 nt, Homo sapiens
uuacuaaagguuuuaaccgcac

SEQ ID NO: 808018 - RNA, 20 nt, Homo sapiens
uuacuaaauuuucuaauuaa

SEQ ID NO: 808019 - RNA, 13 nt, Homo sapiens
uuacuaaucuuuc

SEQ ID NO: 808020 - RNA, 19 nt, Homo sapiens
uuacuauauucuuacccua

SEQ ID NO: 808021 - RNA, 17 nt, Homo sapiens
uuacuaucacacaugaa

SEQ ID NO: 808022 - RNA, 16 nt, Homo sapiens
uuacuaucauggcaua

SEQ ID NO: 808023 - RNA, 16 nt, Homo sapiens
uuacuaugaucucagg

SEQ ID NO: 808024 - RNA, 17 nt, Homo sapiens
uuacuaugaucucagga

SEQ ID NO: 808025 - RNA, 21 nt, Homo sapiens
uuacuauguuucucagauucc

SEQ ID NO: 808026 - RNA, 15 nt, Homo sapiens
uuacuauucacugau

SEQ ID NO: 808027 - RNA, 21 nt, Homo sapiens
uuacuauucuguaucauugau

SEQ ID NO: 808028 - RNA, 18 nt, Homo sapiens
uuacuccaucauggcugc

SEQ ID NO: 808029 - RNA, 16 nt, Homo sapiens
uuacucuaacaaacaa

SEQ ID NO: 808030 - RNA, 23 nt, Homo sapiens
uuacucuaagaucuuagauucuc

SEQ ID NO: 808031 - RNA, 23 nt, Homo sapiens
uuacucuauacauucaacagaga

SEQ ID NO: 808032 - RNA, 21 nt, Homo sapiens
uuacugaaagaaaaagaccua

SEQ ID NO: 808033 - RNA, 19 nt, Homo sapiens
uuacugaucucuuuaagua

SEQ ID NO: 808034 - RNA, 17 nt, Homo sapiens
uuacugaucuuacucac

SEQ ID NO: 808035 - RNA, 15 nt, Homo sapiens
uuacugaugugauau

SEQ ID NO: 808036 - RNA, 14 nt, Homo sapiens
uuacugcacucaga

SEQ ID NO: 808037 - RNA, 21 nt, Homo sapiens
uuacuguauauaaacuccuua

SEQ ID NO: 808038 - RNA, 20 nt, Homo sapiens
uuacuguugcuuuagucacu

SEQ ID NO: 808039 - RNA, 19 nt, Homo sapiens
uuacuguuuugggccucca

SEQ ID NO: 808040 - RNA, 17 nt, Homo sapiens
uuacuuaccuaaacaga

SEQ ID NO: 808041 - RNA, 21 nt, Homo sapiens
cugcaacaacgccuggugccc

SEQ ID NO: 808042 - RNA, 21 nt, Homo sapiens
cugcaaccugauugauuauau

SEQ ID NO: 808043 - RNA, 16 nt, Homo sapiens
cugcaacgcugccuuu

SEQ ID NO: 808044 - RNA, 13 nt, Homo sapiens
cugcaacggaauu

SEQ ID NO: 808045 - RNA, 15 nt, Homo sapiens
cugcaagauggacac

SEQ ID NO: 808046 - RNA, 16 nt, Homo sapiens
cugcaagcacaucugc

SEQ ID NO: 808047 - RNA, 16 nt, Homo sapiens
cugcaagcuucuugcu

SEQ ID NO: 808048 - RNA, 20 nt, Homo sapiens
cugcaauccagccugggcaa

SEQ ID NO: 808049 - RNA, 19 nt, Homo sapiens
cugcaaucugagccagugc

SEQ ID NO: 808050 - RNA, 20 nt, Homo sapiens
cugcacaaaagcagauacuu

SEQ ID NO: 808051 - RNA, 23 nt, Homo sapiens
cugcacaaaagcagauacuugag

SEQ ID NO: 808052 - RNA, 18 nt, Homo sapiens
cugcacacccuccagaga

SEQ ID NO: 808053 - RNA, 23 nt, Homo sapiens
cugcacaugucuuguacaugugu

SEQ ID NO: 808054 - RNA, 12 nt, Homo sapiens
cugcacaugugc

SEQ ID NO: 808055 - RNA, 13 nt, Homo sapiens
cugcaccaugcug

SEQ ID NO: 808056 - RNA, 15 nt, Homo sapiens
cugcaccaugcugcu

SEQ ID NO: 808057 - RNA, 19 nt, Homo sapiens
cugcaccccauguggguga

SEQ ID NO: 808058 - RNA, 19 nt, Homo sapiens
cugcaccuacccacaugca

SEQ ID NO: 808059 - RNA, 20 nt, Homo sapiens
cugcacuccagccuggggga

SEQ ID NO: 808060 - RNA, 19 nt, Homo sapiens
cugcacuccagucuggcaa

SEQ ID NO: 808061 - RNA, 23 nt, Homo sapiens
cugcacugaggcagcgaccucaa

SEQ ID NO: 808062 - RNA, 15 nt, Homo sapiens
cugcacugaugcugc

SEQ ID NO: 808063 - RNA, 20 nt, Homo sapiens
uuagagcugccugugccuuu

SEQ ID NO: 808064 - RNA, 13 nt, Homo sapiens
uuagagcugggaa

SEQ ID NO: 808065 - RNA, 14 nt, Homo sapiens
uuagagcuuccaaa

SEQ ID NO: 808066 - RNA, 16 nt, Homo sapiens
uuagauaauucuuaaa

SEQ ID NO: 808067 - RNA, 16 nt, Homo sapiens
uuagauuauauauucc

SEQ ID NO: 808068 - RNA, 16 nt, Homo sapiens
uuagcaaggggcucag

SEQ ID NO: 808069 - RNA, 14 nt, Homo sapiens
uuagcacacucaca

SEQ ID NO: 808070 - RNA, 18 nt, Homo sapiens
uuagcacuauuuacauac

SEQ ID NO: 808071 - RNA, 22 nt, Homo sapiens
uuagcagggauguuccuuacca

SEQ ID NO: 808072 - RNA, 20 nt, Homo sapiens
uuagcauauuuuaaugcagu

SEQ ID NO: 808073 - RNA, 21 nt, Homo sapiens
uuagcaugacccuaaaauucu

SEQ ID NO: 808074 - RNA, 13 nt, Homo sapiens
uuagcaugcugcu

SEQ ID NO: 808075 - RNA, 16 nt, Homo sapiens
uuagccagauuugucu

SEQ ID NO: 808076 - RNA, 16 nt, Homo sapiens
uuagccauuucacucu

SEQ ID NO: 808077 - RNA, 21 nt, Homo sapiens
uuagcccuguguccugaguua

SEQ ID NO: 808078 - RNA, 23 nt, Homo sapiens
uuagcgucaagacauuugcugaa

SEQ ID NO: 808079 - RNA, 18 nt, Homo sapiens
uuagcuacacagugcaga

SEQ ID NO: 808080 - RNA, 12 nt, Homo sapiens
uuagcuuuacaa

SEQ ID NO: 808081 - RNA, 22 nt, Homo sapiens
uuaggaaauuuaagacuagaua

SEQ ID NO: 808082 - RNA, 23 nt, Homo sapiens
uuaggaagaaaugcccaaaagag

SEQ ID NO: 808083 - RNA, 13 nt, Homo sapiens
uuaggacuuucca

SEQ ID NO: 808084 - RNA, 23 nt, Homo sapiens
uuaggaggcugcaugcucuggaa

SEQ ID NO: 808085 - RNA, 13 nt, Homo sapiens
uuaggauuacuua

SEQ ID NO: 808086 - RNA, 23 nt, Homo sapiens
uuaggauuuucacauucuuggcu

SEQ ID NO: 808087 - RNA, 20 nt, Homo sapiens
uuaggccuccggaugacugc

SEQ ID NO: 808088 - RNA, 15 nt, Homo sapiens
uuaggcuauucacaa

SEQ ID NO: 808089 - RNA, 12 nt, Homo sapiens
uuagggggaaaa

SEQ ID NO: 808090 - RNA, 20 nt, Homo sapiens
uuaggguacaugugcacauu

SEQ ID NO: 808091 - RNA, 21 nt, Homo sapiens
uuaggugcuucuucacuucag

SEQ ID NO: 808092 - RNA, 22 nt, Homo sapiens
uuagguuuuuuuuuuuuuuaac

SEQ ID NO: 808093 - RNA, 22 nt, Homo sapiens
uuaguagagacgagguuucacu

SEQ ID NO: 808094 - RNA, 21 nt, Homo sapiens
uuaguagagacgggauuuccc

SEQ ID NO: 808095 - RNA, 14 nt, Homo sapiens
uuaguauaaguaca

SEQ ID NO: 808096 - RNA, 21 nt, Homo sapiens
uuaguauaauugaccuacuuu

SEQ ID NO: 808097 - RNA, 16 nt, Homo sapiens
uuaguauucauucugc

SEQ ID NO: 808098 - RNA, 10 nt, Homo sapiens
uuagucaauc

SEQ ID NO: 808099 - RNA, 22 nt, Homo sapiens
uuagucgcuaacuuaguaagug

SEQ ID NO: 808100 - RNA, 16 nt, Homo sapiens
uuagucucaagggcua

SEQ ID NO: 808101 - RNA, 15 nt, Homo sapiens
uuagugauauuacau

SEQ ID NO: 808102 - RNA, 12 nt, Homo sapiens
uuagugcacuga

SEQ ID NO: 808103 - RNA, 18 nt, Homo sapiens
uuaguggauggaauauca

SEQ ID NO: 808104 - RNA, 18 nt, Homo sapiens
uuagugucucauguggaa

SEQ ID NO: 808105 - RNA, 13 nt, Homo sapiens
uuagugugccuuc

SEQ ID NO: 808106 - RNA, 14 nt, Homo sapiens
uuaguucucaggca

SEQ ID NO: 808107 - RNA, 20 nt, Homo sapiens
uuaguugcacuaacugcugg

SEQ ID NO: 808108 - RNA, 22 nt, Homo sapiens
uuaguugguuugugugaucaua

SEQ ID NO: 808109 - RNA, 23 nt, Homo sapiens
uuaguuguaaaccaagugaucaa

SEQ ID NO: 808110 - RNA, 15 nt, Homo sapiens
uuaguuuuugaucaa

SEQ ID NO: 808111 - RNA, 13 nt, Homo sapiens
uuauaaaaaugag

SEQ ID NO: 808112 - RNA, 17 nt, Homo sapiens
uuauaaaagcaaaagag

SEQ ID NO: 808113 - RNA, 16 nt, Homo sapiens
uuauaaaauuaagcaa

SEQ ID NO: 808114 - RNA, 16 nt, Homo sapiens
uuauaaauccagugac

SEQ ID NO: 808115 - RNA, 14 nt, Homo sapiens
uuauaacagaauua

SEQ ID NO: 808116 - RNA, 22 nt, Homo sapiens
uuauaacagaauuaaaguagau

SEQ ID NO: 808117 - RNA, 15 nt, Homo sapiens
uuauaaccuggcaaa

SEQ ID NO: 808118 - RNA, 17 nt, Homo sapiens
uuauaacguguucaaua

SEQ ID NO: 808119 - RNA, 19 nt, Homo sapiens
uuauaacguguucaauauu

SEQ ID NO: 808120 - RNA, 20 nt, Homo sapiens
uuauaagaaagaucaaagac

SEQ ID NO: 808121 - RNA, 23 nt, Homo sapiens
uuauaagagggcauauacaguga

SEQ ID NO: 808122 - RNA, 23 nt, Homo sapiens
uuauaagcagguguauacuuuua

SEQ ID NO: 808123 - RNA, 18 nt, Homo sapiens
uuauaauaaauauauaca

SEQ ID NO: 808124 - RNA, 14 nt, Homo sapiens
uuauaauauacuau

SEQ ID NO: 808125 - RNA, 18 nt, Homo sapiens
uuauaauuccuauauccu

SEQ ID NO: 808126 - RNA, 13 nt, Homo sapiens
uuauacacugugu

SEQ ID NO: 808127 - RNA, 12 nt, Homo sapiens
uuauacagugau

SEQ ID NO: 808128 - RNA, 19 nt, Homo sapiens
uuauacauguguaaacaau

SEQ ID NO: 808129 - RNA, 17 nt, Homo sapiens
uuauacauuauuuuaca

SEQ ID NO: 808130 - RNA, 19 nt, Homo sapiens
uuauacucacugagucuua

SEQ ID NO: 808131 - RNA, 11 nt, Homo sapiens
uuauacuccuc

SEQ ID NO: 808132 - RNA, 20 nt, Homo sapiens
uuauagaugaguuuugccag

SEQ ID NO: 808133 - RNA, 23 nt, Homo sapiens
uuauaggccugucccuugccucu

SEQ ID NO: 808134 - RNA, 23 nt, Homo sapiens
uuauagggaugaguccccuguga

SEQ ID NO: 808135 - RNA, 22 nt, Homo sapiens
uuauaguccuccuggaacuuga

SEQ ID NO: 808136 - RNA, 14 nt, Homo sapiens
uuauagucuuccag

SEQ ID NO: 808137 - RNA, 16 nt, Homo sapiens
uuauauacaguacaca

SEQ ID NO: 808138 - RNA, 15 nt, Homo sapiens
uuauaucauauguau

SEQ ID NO: 808139 - RNA, 21 nt, Homo sapiens
uuauaugaccauauuuacucu

SEQ ID NO: 808140 - RNA, 13 nt, Homo sapiens
uuauauggaugau

SEQ ID NO: 808141 - RNA, 16 nt, Homo sapiens
uuauauguugcuauaa

SEQ ID NO: 808142 - RNA, 18 nt, Homo sapiens
uuauauuaaaacacuuag

SEQ ID NO: 808143 - RNA, 13 nt, Homo sapiens
uuaucacacuuug

SEQ ID NO: 808144 - RNA, 18 nt, Homo sapiens
uuaucacuuaaacuugca

SEQ ID NO: 808145 - RNA, 17 nt, Homo sapiens
uuaucagaauucucaga

SEQ ID NO: 808146 - RNA, 16 nt, Homo sapiens
uuaucagcaugaagaa

SEQ ID NO: 808147 - RNA, 14 nt, Homo sapiens
uuaucagccugugc

SEQ ID NO: 808148 - RNA, 20 nt, Homo sapiens
uuaucaucccaacagccaag

SEQ ID NO: 808149 - RNA, 12 nt, Homo sapiens
uuaucaucugaa

SEQ ID NO: 808150 - RNA, 21 nt, Homo sapiens
uuaucaugcaaaugcuguauu

SEQ ID NO: 808151 - RNA, 16 nt, Homo sapiens
uuaucaugcauguccu

SEQ ID NO: 808152 - RNA, 13 nt, Homo sapiens
uuaucauuuauca

SEQ ID NO: 808153 - RNA, 19 nt, Homo sapiens
uuauccagaaaacugugau

SEQ ID NO: 808154 - RNA, 20 nt, Homo sapiens
uuaucccccaaaaugcauuu

SEQ ID NO: 808155 - RNA, 13 nt, Homo sapiens
uuaucccucucuu

SEQ ID NO: 808156 - RNA, 23 nt, Homo sapiens
cugcuagcaaauggcagaaccaa

SEQ ID NO: 808157 - RNA, 17 nt, Homo sapiens
cugcuaggcgcugggga

SEQ ID NO: 808158 - RNA, 18 nt, Homo sapiens
cugcuauaggucagagau

SEQ ID NO: 808159 - RNA, 22 nt, Homo sapiens
cugcucagcccugcaccaugcu

SEQ ID NO: 808160 - RNA, 18 nt, Homo sapiens
cugcucaggcccaugcua

SEQ ID NO: 808161 - RNA, 14 nt, Homo sapiens
cugcucagggcugg

SEQ ID NO: 808162 - RNA, 15 nt, Homo sapiens
cugcucauauuguga

SEQ ID NO: 808163 - RNA, 17 nt, Homo sapiens
cugcucauuacaguucu

SEQ ID NO: 808164 - RNA, 13 nt, Homo sapiens
cugcuccaacccc

SEQ ID NO: 808165 - RNA, 16 nt, Homo sapiens
cugcuccaguccugga

SEQ ID NO: 808166 - RNA, 21 nt, Homo sapiens
cugcucccaccaccagugaga

SEQ ID NO: 808167 - RNA, 21 nt, Homo sapiens
cugcucccugcacccaugaca

SEQ ID NO: 808168 - RNA, 13 nt, Homo sapiens
cugcucccuggca

SEQ ID NO: 808169 - RNA, 15 nt, Homo sapiens
cugcucucuguggug

SEQ ID NO: 808170 - RNA, 14 nt, Homo sapiens
cugcucugccugga

SEQ ID NO: 808171 - RNA, 17 nt, Homo sapiens
cugcucuuguucuacug

SEQ ID NO: 808172 - RNA, 23 nt, Homo sapiens
cugcucuuucucugccagugaca

SEQ ID NO: 808173 - RNA, 18 nt, Homo sapiens
cugcugaaacaacaaaua

SEQ ID NO: 808174 - RNA, 18 nt, Homo sapiens
cugcugaacacagugucu

SEQ ID NO: 808175 - RNA, 17 nt, Homo sapiens
cugcugaaggaggguca

SEQ ID NO: 808176 - RNA, 21 nt, Homo sapiens
cugcugaaggcagucauauca

SEQ ID NO: 808177 - RNA, 11 nt, Homo sapiens
cugcugaccaa

SEQ ID NO: 808178 - RNA, 20 nt, Homo sapiens
cuuuccuccacccauaauaa

SEQ ID NO: 808179 - RNA, 15 nt, Homo sapiens
cuuuccugcaacuca

SEQ ID NO: 808180 - RNA, 13 nt, Homo sapiens
cuuuccuguucca

SEQ ID NO: 808181 - RNA, 12 nt, Homo sapiens
cuuuccuugccu

SEQ ID NO: 808182 - RNA, 23 nt, Homo sapiens
cuuuccuugugguugaaaaccac

SEQ ID NO: 808183 - RNA, 16 nt, Homo sapiens
cuuucgccgaaugggg

SEQ ID NO: 808184 - RNA, 19 nt, Homo sapiens
cuuucguaauagcucagau

SEQ ID NO: 808185 - RNA, 22 nt, Homo sapiens
cuuucguucugcugaccaaaug

SEQ ID NO: 808186 - RNA, 22 nt, Homo sapiens
cuuucuaggagggagacacugg

SEQ ID NO: 808187 - RNA, 21 nt, Homo sapiens
cuuucucaggaccuaguugcu

SEQ ID NO: 808188 - RNA, 19 nt, Homo sapiens
cuuucucaguucagaguug

SEQ ID NO: 808189 - RNA, 21 nt, Homo sapiens
cuuucucccaggccaggcucc

SEQ ID NO: 808190 - RNA, 12 nt, Homo sapiens
cuuucucuaaaa

SEQ ID NO: 808191 - RNA, 12 nt, Homo sapiens
cuuucucugagg

SEQ ID NO: 808192 - RNA, 23 nt, Homo sapiens
cuuucugaggagcuguuacugaa

SEQ ID NO: 808193 - RNA, 13 nt, Homo sapiens
cuuucugcacuua

SEQ ID NO: 808194 - RNA, 20 nt, Homo sapiens
cuuucugcaggaaauaguca

SEQ ID NO: 808195 - RNA, 21 nt, Homo sapiens
cuuucugcaugaccaaaguga

SEQ ID NO: 808196 - RNA, 17 nt, Homo sapiens
cuuucugcccuucuccc

SEQ ID NO: 808197 - RNA, 13 nt, Homo sapiens
cuuucugccuuua

SEQ ID NO: 808198 - RNA, 15 nt, Homo sapiens
cuuucuggacuccca

SEQ ID NO: 808199 - RNA, 16 nt, Homo sapiens
cuuucugugcagagau

SEQ ID NO: 808200 - RNA, 22 nt, Homo sapiens
cuuucugugcagagaugacugu

SEQ ID NO: 808201 - RNA, 13 nt, Homo sapiens
cuuucuguugaaa

SEQ ID NO: 808202 - RNA, 22 nt, Homo sapiens
cuuucuugauugguucuuccaa

SEQ ID NO: 808203 - RNA, 11 nt, Homo sapiens
cuuucuugcag

SEQ ID NO: 808204 - RNA, 18 nt, Homo sapiens
cuuucuuuagcaugcuac

SEQ ID NO: 808205 - RNA, 17 nt, Homo sapiens
cuuucuuuugauaaauc

SEQ ID NO: 808206 - RNA, 21 nt, Homo sapiens
cuuugaagcaaauacaauuca

SEQ ID NO: 808207 - RNA, 18 nt, Homo sapiens
cuuugaaugcggcccaac

SEQ ID NO: 808208 - RNA, 17 nt, Homo sapiens
cuuugacaaauuacaaa

SEQ ID NO: 808209 - RNA, 22 nt, Homo sapiens
cuuugacaauuacucagguuug

SEQ ID NO: 808210 - RNA, 13 nt, Homo sapiens
cuuugacaguguu

SEQ ID NO: 808211 - RNA, 14 nt, Homo sapiens
cuuugacaguguuu

SEQ ID NO: 808212 - RNA, 15 nt, Homo sapiens
cuuugacaguguuuu

SEQ ID NO: 808213 - RNA, 20 nt, Homo sapiens
cuuugaccuaaauuauuuac

SEQ ID NO: 808214 - RNA, 17 nt, Homo sapiens
cuuugagacugggucuc

SEQ ID NO: 808215 - RNA, 21 nt, Homo sapiens
cuuugagcacacuuuacacaa

SEQ ID NO: 808216 - RNA, 22 nt, Homo sapiens
cuuugauagauuucuacacuga

SEQ ID NO: 808217 - RNA, 17 nt, Homo sapiens
cuuugauauccaugcca

SEQ ID NO: 808218 - RNA, 18 nt, Homo sapiens
cuuugaucuacuugccuc

SEQ ID NO: 808219 - RNA, 16 nt, Homo sapiens
cuuugauucuguaaua

SEQ ID NO: 808220 - RNA, 14 nt, Homo sapiens
cuuugcacauguga

SEQ ID NO: 808221 - RNA, 14 nt, Homo sapiens
cuuugcaccaaaga

SEQ ID NO: 808222 - RNA, 20 nt, Homo sapiens
cuuugcagagaaccucagau

SEQ ID NO: 808223 - RNA, 16 nt, Homo sapiens
cuuugccaaaauacca

SEQ ID NO: 808224 - RNA, 14 nt, Homo sapiens
cuuugccacaaagc

SEQ ID NO: 808225 - RNA, 17 nt, Homo sapiens
cuuugccacacuguggu

SEQ ID NO: 808226 - RNA, 18 nt, Homo sapiens
cuuugccacacuguggua

SEQ ID NO: 808227 - RNA, 21 nt, Homo sapiens
cuuugccagaggcugauguca

SEQ ID NO: 808228 - RNA, 19 nt, Homo sapiens
cuuugcccaaaacugucau

SEQ ID NO: 808229 - RNA, 14 nt, Homo sapiens
cuuugccccugaga

SEQ ID NO: 808230 - RNA, 23 nt, Homo sapiens
cuuugccucuucuuugugccuuu

SEQ ID NO: 808231 - RNA, 17 nt, Homo sapiens
cuuugccuucauucugc

SEQ ID NO: 808232 - RNA, 15 nt, Homo sapiens
cuuugccuuuaucuc

SEQ ID NO: 808233 - RNA, 14 nt, Homo sapiens
cuuugcucccugca

SEQ ID NO: 808234 - RNA, 17 nt, Homo sapiens
cuuugcucucuggccac

SEQ ID NO: 808235 - RNA, 16 nt, Homo sapiens
cuuugcucuugccaaa

SEQ ID NO: 808236 - RNA, 20 nt, Homo sapiens
cuuugcugaaugucauuuua

SEQ ID NO: 808237 - RNA, 18 nt, Homo sapiens
cuuugcugcuggugcuaa

SEQ ID NO: 808238 - RNA, 23 nt, Homo sapiens
cuuugcugugaggcuguccugua

SEQ ID NO: 808239 - RNA, 17 nt, Homo sapiens
cuuugcuucauuccaaa

SEQ ID NO: 808240 - RNA, 21 nt, Homo sapiens
cuuugcuuuaaguguaacugg

SEQ ID NO: 808241 - RNA, 19 nt, Homo sapiens
cuuuggaccuaauccaagc

SEQ ID NO: 808242 - RNA, 17 nt, Homo sapiens
cuuuggagaugcugagg

SEQ ID NO: 808243 - RNA, 20 nt, Homo sapiens
cuuuggauccugggucaaaa

SEQ ID NO: 808244 - RNA, 14 nt, Homo sapiens
cuuuggccauucca

SEQ ID NO: 808245 - RNA, 14 nt, Homo sapiens
cuuuggguacuuau

SEQ ID NO: 808246 - RNA, 18 nt, Homo sapiens
cuuugguuaauguugauu

SEQ ID NO: 808247 - RNA, 15 nt, Homo sapiens
cuuuguaugcacuuu

SEQ ID NO: 808248 - RNA, 11 nt, Homo sapiens
cuuugucacaa

SEQ ID NO: 808249 - RNA, 15 nt, Homo sapiens
cuuugucagcaauac

SEQ ID NO: 808250 - RNA, 21 nt, Homo sapiens
cuuuguccacugucaggguug

SEQ ID NO: 808251 - RNA, 16 nt, Homo sapiens
cuuugucucaaaauaa

SEQ ID NO: 808252 - RNA, 12 nt, Homo sapiens
cuuugucugucg

SEQ ID NO: 808253 - RNA, 15 nt, Homo sapiens
cuuugucuugccccu

SEQ ID NO: 808254 - RNA, 18 nt, Homo sapiens
cuuugugcuugucauucc

SEQ ID NO: 808255 - RNA, 20 nt, Homo sapiens
cuuugugcuugucauuccag

SEQ ID NO: 808256 - RNA, 18 nt, Homo sapiens
cuuuguggcaguggccag

SEQ ID NO: 808257 - RNA, 13 nt, Homo sapiens
cuuuguguagaaa

SEQ ID NO: 808258 - RNA, 18 nt, Homo sapiens
cuuuguguagaaagccaa

SEQ ID NO: 808259 - RNA, 19 nt, Homo sapiens
cuuuguguagaaagccaaa

SEQ ID NO: 808260 - RNA, 16 nt, Homo sapiens
cuuuguguuuggauca

SEQ ID NO: 808261 - RNA, 14 nt, Homo sapiens
cuuuguuaggauuu

SEQ ID NO: 808262 - RNA, 16 nt, Homo sapiens
cuuuguuaucuuccac

SEQ ID NO: 808263 - RNA, 23 nt, Homo sapiens
cuuuguucuggggggacccagug

SEQ ID NO: 808264 - RNA, 16 nt, Homo sapiens
cuuuguugcucagcaa

SEQ ID NO: 808265 - RNA, 14 nt, Homo sapiens
cuuuguuugucaca

SEQ ID NO: 808266 - RNA, 18 nt, Homo sapiens
cuuuuaaaaacauaacau

SEQ ID NO: 808267 - RNA, 19 nt, Homo sapiens
cuuuuaaaaugcaauguaa

SEQ ID NO: 808268 - RNA, 16 nt, Homo sapiens
cuuuuaaaaugcccuu

SEQ ID NO: 808269 - RNA, 18 nt, Homo sapiens
cuuuuaaaugaccaaaga

SEQ ID NO: 808270 - RNA, 16 nt, Homo sapiens
cuuuuaaaugcauaaa

SEQ ID NO: 808271 - RNA, 13 nt, Homo sapiens
cuuuuaacagugu

SEQ ID NO: 808272 - RNA, 16 nt, Homo sapiens
cuuuuaacugccaaga

SEQ ID NO: 808273 - RNA, 18 nt, Homo sapiens
cuuuuaagcagugaguua

SEQ ID NO: 808274 - RNA, 17 nt, Homo sapiens
cuuuuaagugccuugga

SEQ ID NO: 808275 - RNA, 21 nt, Homo sapiens
ucuuaacuggucuccuugcuu

SEQ ID NO: 808276 - RNA, 16 nt, Homo sapiens
ucuuaacuucuugcuu

SEQ ID NO: 808277 - RNA, 13 nt, Homo sapiens
ucuuaacuugaag

SEQ ID NO: 808278 - RNA, 16 nt, Homo sapiens
ucuuaaguagggacuu

SEQ ID NO: 808279 - RNA, 18 nt, Homo sapiens
ucuuaaguguuucucaaa

SEQ ID NO: 808280 - RNA, 12 nt, Homo sapiens
ucuuaauuccca

SEQ ID NO: 808281 - RNA, 21 nt, Homo sapiens
ucuuaauuuacuuuaagcauu

SEQ ID NO: 808282 - RNA, 18 nt, Homo sapiens
ucuuacaaaggugaaaau

SEQ ID NO: 808283 - RNA, 21 nt, Homo sapiens
ucuuacaaccaagaacauuau

SEQ ID NO: 808284 - RNA, 16 nt, Homo sapiens
ucuuacaauugcacug

SEQ ID NO: 808285 - RNA, 15 nt, Homo sapiens
ucuuaccugggaccu

SEQ ID NO: 808286 - RNA, 15 nt, Homo sapiens
ucuuacuggugcuau

SEQ ID NO: 808287 - RNA, 22 nt, Homo sapiens
ucuuacuuugaguuagugccau

SEQ ID NO: 808288 - RNA, 16 nt, Homo sapiens
ucuuagaaauacuugu

SEQ ID NO: 808289 - RNA, 20 nt, Homo sapiens
ucuuagaagcacuacaccuu

SEQ ID NO: 808290 - RNA, 14 nt, Homo sapiens
ucuuagagcaaaga

SEQ ID NO: 808291 - RNA, 21 nt, Homo sapiens
ucuuagcagcuuccagauuga

SEQ ID NO: 808292 - RNA, 23 nt, Homo sapiens
ucuuagcuccccuccaaccuggg

SEQ ID NO: 808293 - RNA, 21 nt, Homo sapiens
ucuuagcucuuaauuguucau

SEQ ID NO: 808294 - RNA, 11 nt, Homo sapiens
ucuuagcuguc

SEQ ID NO: 808295 - RNA, 17 nt, Homo sapiens
ucuuagcugucugcuca

SEQ ID NO: 808296 - RNA, 20 nt, Homo sapiens
ucuuagugcuucagaguuug

SEQ ID NO: 808297 - RNA, 22 nt, Homo sapiens
ucuuaguguaugauuacuggcc

SEQ ID NO: 808298 - RNA, 13 nt, Homo sapiens
ucuuagugucacu

SEQ ID NO: 808299 - RNA, 19 nt, Homo sapiens
ucuuaugccauauaauuca

SEQ ID NO: 808300 - RNA, 15 nt, Homo sapiens
ucuuaugccauguua

SEQ ID NO: 808301 - RNA, 12 nt, Homo sapiens
ucuuauggggcc

SEQ ID NO: 808302 - RNA, 16 nt, Homo sapiens
ucuuaugugugccuuu

SEQ ID NO: 808303 - RNA, 18 nt, Homo sapiens
ucuuauuaaucauacaaa

SEQ ID NO: 808304 - RNA, 17 nt, Homo sapiens
ucuuauuugaugguggu

SEQ ID NO: 808305 - RNA, 15 nt, Homo sapiens
ucuuauuuucucaau

SEQ ID NO: 808306 - RNA, 14 nt, Homo sapiens
ucuucaaacuguga

SEQ ID NO: 808307 - RNA, 15 nt, Homo sapiens
ucuucaagguuugga

SEQ ID NO: 808308 - RNA, 19 nt, Homo sapiens
ucuucaauaugaaucuaua

SEQ ID NO: 808309 - RNA, 20 nt, Homo sapiens
ucuucaauuuauuacugaaa

SEQ ID NO: 808310 - RNA, 19 nt, Homo sapiens
ucuucacucugaauccuca

SEQ ID NO: 808311 - RNA, 22 nt, Homo sapiens
ucuucagagauaggccuguggg

SEQ ID NO: 808312 - RNA, 18 nt, Homo sapiens
ucuucagaggagaaagaa

SEQ ID NO: 808313 - RNA, 13 nt, Homo sapiens
ucuucagaugcca

SEQ ID NO: 808314 - RNA, 13 nt, Homo sapiens
ucuucagucucac

SEQ ID NO: 808315 - RNA, 16 nt, Homo sapiens
ucuucaucccauucca

SEQ ID NO: 808316 - RNA, 20 nt, Homo sapiens
ucuucaugaguagugggcua

SEQ ID NO: 808317 - RNA, 20 nt, Homo sapiens
ucuucaugcuuuugcuugca

SEQ ID NO: 808318 - RNA, 12 nt, Homo sapiens
ucuucauuaccu

SEQ ID NO: 808319 - RNA, 14 nt, Homo sapiens
ucuucauuaccuca

SEQ ID NO: 808320 - RNA, 20 nt, Homo sapiens
ucuucauuaccucagugaga

SEQ ID NO: 808321 - RNA, 15 nt, Homo sapiens
ucuucauuucaggaa

SEQ ID NO: 808322 - RNA, 15 nt, Homo sapiens
ucuuccaacccacug

SEQ ID NO: 808323 - RNA, 14 nt, Homo sapiens
ucuuccagaaacua

SEQ ID NO: 808324 - RNA, 22 nt, Homo sapiens
ucuuccagugguuugagacacu

SEQ ID NO: 808325 - RNA, 14 nt, Homo sapiens
ucuucccaugcauu

SEQ ID NO: 808326 - RNA, 18 nt, Homo sapiens
ucuucccccuuucuaaaa

SEQ ID NO: 808327 - RNA, 19 nt, Homo sapiens
ucuuccccuaaugccuauc

SEQ ID NO: 808328 - RNA, 14 nt, Homo sapiens
ucuucccuaccuca

SEQ ID NO: 808329 - RNA, 15 nt, Homo sapiens
ucuucccucucugca

SEQ ID NO: 808330 - RNA, 15 nt, Homo sapiens
ucuucccuuaccuca

SEQ ID NO: 808331 - RNA, 19 nt, Homo sapiens
ucuucccuuuuacauacug

SEQ ID NO: 808332 - RNA, 19 nt, Homo sapiens
ucuuccgucuaaucucuca

SEQ ID NO: 808333 - RNA, 19 nt, Homo sapiens
ucuuccucccugggggccc

SEQ ID NO: 808334 - RNA, 19 nt, Homo sapiens
ucuuccucuagacuuggag

SEQ ID NO: 808335 - RNA, 19 nt, Homo sapiens
ucuuccugaguggugccaa

SEQ ID NO: 808336 - RNA, 13 nt, Homo sapiens
ucuuccugcauuc

SEQ ID NO: 808337 - RNA, 15 nt, Homo sapiens
ucuuccuguguccug

SEQ ID NO: 808338 - RNA, 15 nt, Homo sapiens
ucuuccuuagacuua

SEQ ID NO: 808339 - RNA, 13 nt, Homo sapiens
ucuucuaacacaa

SEQ ID NO: 808340 - RNA, 19 nt, Homo sapiens
ucuucuauuaaucaagaga

SEQ ID NO: 808341 - RNA, 13 nt, Homo sapiens
ucuucucauuuca

SEQ ID NO: 808342 - RNA, 15 nt, Homo sapiens
ucuucucuccagugu

SEQ ID NO: 808343 - RNA, 15 nt, Homo sapiens
ucuucucugcacuua

SEQ ID NO: 808344 - RNA, 22 nt, Homo sapiens
ucuucucugcugaguuugccuu

SEQ ID NO: 808345 - RNA, 19 nt, Homo sapiens
gcugggaagacuauggugc

SEQ ID NO: 808346 - RNA, 16 nt, Homo sapiens
gcugggaugagaggaa

SEQ ID NO: 808347 - RNA, 14 nt, Homo sapiens
gcugggcaggguga

SEQ ID NO: 808348 - RNA, 13 nt, Homo sapiens
gcugggccauguc

SEQ ID NO: 808349 - RNA, 17 nt, Homo sapiens
gcugggccauguccaaa

SEQ ID NO: 808350 - RNA, 18 nt, Homo sapiens
gcugggccauguccaaag

SEQ ID NO: 808351 - RNA, 19 nt, Homo sapiens
gcugggccauguccaaaga

SEQ ID NO: 808352 - RNA, 14 nt, Homo sapiens
gcugggcucugcca

SEQ ID NO: 808353 - RNA, 22 nt, Homo sapiens
gcugggcuucacggcugccagg

SEQ ID NO: 808354 - RNA, 22 nt, Homo sapiens
gcugggucagggccagacugga

SEQ ID NO: 808355 - RNA, 23 nt, Homo sapiens
gcuggguccuugggccuggccag

SEQ ID NO: 808356 - RNA, 17 nt, Homo sapiens
gcugguaaucuugcucu

SEQ ID NO: 808357 - RNA, 22 nt, Homo sapiens
gcuggucccggggccagcacuu

SEQ ID NO: 808358 - RNA, 17 nt, Homo sapiens
gcuggugaacacuguga

SEQ ID NO: 808359 - RNA, 14 nt, Homo sapiens
gcuguaacuacuuu

SEQ ID NO: 808360 - RNA, 15 nt, Homo sapiens
gcuguacccuugaga

SEQ ID NO: 808361 - RNA, 16 nt, Homo sapiens
gcuguagaccaccuaa

SEQ ID NO: 808362 - RNA, 18 nt, Homo sapiens
gcuguauugcccccaugg

SEQ ID NO: 808363 - RNA, 18 nt, Homo sapiens
gcuguauuuguucaguga

SEQ ID NO: 808364 - RNA, 14 nt, Homo sapiens
gcuguauuuuagaa

SEQ ID NO: 808365 - RNA, 13 nt, Homo sapiens
gcugucaauguuu

SEQ ID NO: 808366 - RNA, 19 nt, Homo sapiens
gcugucacucugugccuuu

SEQ ID NO: 808367 - RNA, 22 nt, Homo sapiens
gcugucagcccaugugcaccug

SEQ ID NO: 808368 - RNA, 18 nt, Homo sapiens
gcugucaggacaccagcc

SEQ ID NO: 808369 - RNA, 16 nt, Homo sapiens
gcuguccacaugaccu

SEQ ID NO: 808370 - RNA, 19 nt, Homo sapiens
gcuguccacaugaccucca

SEQ ID NO: 808371 - RNA, 18 nt, Homo sapiens
gcuguccauguauucaca

SEQ ID NO: 808372 - RNA, 19 nt, Homo sapiens
gcugucccugcagggccau

SEQ ID NO: 808373 - RNA, 21 nt, Homo sapiens
gcuguccucucagaacuccug

SEQ ID NO: 808374 - RNA, 16 nt, Homo sapiens
gcugucgacuucauga

SEQ ID NO: 808375 - RNA, 21 nt, Homo sapiens
gcugucuacaaaaugccaagg

SEQ ID NO: 808376 - RNA, 14 nt, Homo sapiens
gcugucuucuggac

SEQ ID NO: 808377 - RNA, 18 nt, Homo sapiens
gcugugaaagaaccaaaa

SEQ ID NO: 808378 - RNA, 23 nt, Homo sapiens
gcugugaaauccauauauaugaa

SEQ ID NO: 808379 - RNA, 16 nt, Homo sapiens
gcugugauacacugaa

SEQ ID NO: 808380 - RNA, 16 nt, Homo sapiens
cagaucugugccccau

SEQ ID NO: 808381 - RNA, 17 nt, Homo sapiens
cagaucuuugcugccag

SEQ ID NO: 808382 - RNA, 22 nt, Homo sapiens
cagaucuuugcugccagccacu

SEQ ID NO: 808383 - RNA, 16 nt, Homo sapiens
cagaugagcagucaca

SEQ ID NO: 808384 - RNA, 16 nt, Homo sapiens
cagaugauacuuccaa

SEQ ID NO: 808385 - RNA, 22 nt, Homo sapiens
cagaugauauaauuuaacugug

SEQ ID NO: 808386 - RNA, 20 nt, Homo sapiens
cagaugauuuucuucuccau

SEQ ID NO: 808387 - RNA, 12 nt, Homo sapiens
cagaugcaauac

SEQ ID NO: 808388 - RNA, 22 nt, Homo sapiens
cagaugccuggacagaggacaa

SEQ ID NO: 808389 - RNA, 21 nt, Homo sapiens
cagaugcuguuaguaccuaca

SEQ ID NO: 808390 - RNA, 20 nt, Homo sapiens
cagauggaaugcuguguuaa

SEQ ID NO: 808391 - RNA, 23 nt, Homo sapiens
cagaugggcuguuucguguagug

SEQ ID NO: 808392 - RNA, 23 nt, Homo sapiens
cagauguauuaaaaaaagauuug

SEQ ID NO: 808393 - RNA, 19 nt, Homo sapiens
cagaugugaaaacaucuca

SEQ ID NO: 808394 - RNA, 19 nt, Homo sapiens
cagauguuuacagacugug

SEQ ID NO: 808395 - RNA, 18 nt, Homo sapiens
cagauuaagaguugccaa

SEQ ID NO: 808396 - RNA, 17 nt, Homo sapiens
cagauuagagccuguaa

SEQ ID NO: 808397 - RNA, 20 nt, Homo sapiens
cagauuaguucuuuuugcca

SEQ ID NO: 808398 - RNA, 15 nt, Homo sapiens
cagauucagccucag

SEQ ID NO: 808399 - RNA, 13 nt, Homo sapiens
cagauucuuucag

SEQ ID NO: 808400 - RNA, 13 nt, Homo sapiens
cagauuggaccag

SEQ ID NO: 808401 - RNA, 16 nt, Homo sapiens
cagauuguccuggaac

SEQ ID NO: 808402 - RNA, 14 nt, Homo sapiens
cagauuguguacau

SEQ ID NO: 808403 - RNA, 18 nt, Homo sapiens
cagauuuaagccuuacaa

SEQ ID NO: 808404 - RNA, 16 nt, Homo sapiens
cagauuuacuaaauca

SEQ ID NO: 808405 - RNA, 19 nt, Homo sapiens
cagauuuccuaacucuggu

SEQ ID NO: 808406 - RNA, 13 nt, Homo sapiens
cagauuugcacug

SEQ ID NO: 808407 - RNA, 14 nt, Homo sapiens
cagauuuuacuguc

SEQ ID NO: 808408 - RNA, 17 nt, Homo sapiens
cagauuuucaugcaaaa

SEQ ID NO: 808409 - RNA, 15 nt, Homo sapiens
cagauuuuugcaaua

SEQ ID NO: 808410 - RNA, 19 nt, Homo sapiens
cagauuuuuuccucugcau

SEQ ID NO: 808411 - RNA, 17 nt, Homo sapiens
cagcaaaacgacacugc

SEQ ID NO: 808412 - RNA, 21 nt, Homo sapiens
cagcaaaagaagacaacauuu

SEQ ID NO: 808413 - RNA, 22 nt, Homo sapiens
cagcaaacaggugcuaauuugu

SEQ ID NO: 808414 - RNA, 19 nt, Homo sapiens
cagcaaacguugggcauca

SEQ ID NO: 808415 - RNA, 18 nt, Homo sapiens
cagcaacaagacugccag

SEQ ID NO: 808416 - RNA, 14 nt, Homo sapiens
cagcaacacagcca

SEQ ID NO: 808417 - RNA, 21 nt, Homo sapiens
cagcaacacagccacuaaaac

SEQ ID NO: 808418 - RNA, 14 nt, Homo sapiens
cagcaacauccaga

SEQ ID NO: 808419 - RNA, 14 nt, Homo sapiens
cagcaagacuuuau

SEQ ID NO: 808420 - RNA, 17 nt, Homo sapiens
cagcaaggaaagcucac

SEQ ID NO: 808421 - RNA, 15 nt, Homo sapiens
cagcaauacaaagac

SEQ ID NO: 808422 - RNA, 16 nt, Homo sapiens
cagcaauuugauaaaa

SEQ ID NO: 808423 - RNA, 18 nt, Homo sapiens
cagcacaaacacaccucu

SEQ ID NO: 808424 - RNA, 17 nt, Homo sapiens
cagcacaagggcacauu

SEQ ID NO: 808425 - RNA, 20 nt, Homo sapiens
cagcacaccugccgucuuca

SEQ ID NO: 808426 - RNA, 23 nt, Homo sapiens
cauguuuauaaaucuuaugcucu

SEQ ID NO: 808427 - RNA, 22 nt, Homo sapiens
cauguuucaagaaaauggauuu

SEQ ID NO: 808428 - RNA, 16 nt, Homo sapiens
cauguuucucacauug

SEQ ID NO: 808429 - RNA, 22 nt, Homo sapiens
cauguuucugcuaugaccauga

SEQ ID NO: 808430 - RNA, 21 nt, Homo sapiens
cauguuugaaucuacauucac

SEQ ID NO: 808431 - RNA, 20 nt, Homo sapiens
cauguuugccuucugcacau

SEQ ID NO: 808432 - RNA, 20 nt, Homo sapiens
cauguuuguuucuguagaaa

SEQ ID NO: 808433 - RNA, 21 nt, Homo sapiens
cauguuuuccgugaaaacgga

SEQ ID NO: 808434 - RNA, 23 nt, Homo sapiens
cauguuuugauuuguagcacuga

SEQ ID NO: 808435 - RNA, 18 nt, Homo sapiens
cauguuuuguugcucagu

SEQ ID NO: 808436 - RNA, 12 nt, Homo sapiens
cauguuuuuacc

SEQ ID NO: 808437 - RNA, 22 nt, Homo sapiens
cauuaaaaaaauuagaaaguag

SEQ ID NO: 808438 - RNA, 17 nt, Homo sapiens
cauuaaaaaaauuccau

SEQ ID NO: 808439 - RNA, 21 nt, Homo sapiens
cauuaaaagcauuguccaaaa

SEQ ID NO: 808440 - RNA, 13 nt, Homo sapiens
cauuaaaagcuac

SEQ ID NO: 808441 - RNA, 15 nt, Homo sapiens
cauuaaacacuguaa

SEQ ID NO: 808442 - RNA, 15 nt, Homo sapiens
cauuaaacuuaccug

SEQ ID NO: 808443 - RNA, 14 nt, Homo sapiens
cauuaaacuugaag

SEQ ID NO: 808444 - RNA, 14 nt, Homo sapiens
cauuaaaucacuug

SEQ ID NO: 808445 - RNA, 16 nt, Homo sapiens
cauuaaaucacuugaa

SEQ ID NO: 808446 - RNA, 14 nt, Homo sapiens
cauuaaaucuauga

SEQ ID NO: 808447 - RNA, 16 nt, Homo sapiens
cauuaacucccuccac

SEQ ID NO: 808448 - RNA, 18 nt, Homo sapiens
cauuaauagcagccuuuc

SEQ ID NO: 808449 - RNA, 18 nt, Homo sapiens
cauuaauauuuaccaaag

SEQ ID NO: 808450 - RNA, 16 nt, Homo sapiens
cauuaauauuugcuga

SEQ ID NO: 808451 - RNA, 23 nt, Homo sapiens
cauuaaugagauguuauuacugu

SEQ ID NO: 808452 - RNA, 15 nt, Homo sapiens
cauuaauguuaauuc

SEQ ID NO: 808453 - RNA, 20 nt, Homo sapiens
cauuaauuaguuccaguuuc

SEQ ID NO: 808454 - RNA, 20 nt, Homo sapiens
cauuaccagacgguucacca

SEQ ID NO: 808455 - RNA, 16 nt, Homo sapiens
cauuaccuccauccau

SEQ ID NO: 808456 - RNA, 19 nt, Homo sapiens
cauuacuuugauaucugau

SEQ ID NO: 808457 - RNA, 14 nt, Homo sapiens
cauuagaaagcaaa

SEQ ID NO: 808458 - RNA, 17 nt, Homo sapiens
cauuagaaagcaaagau

SEQ ID NO: 808459 - RNA, 19 nt, Homo sapiens
cauuagaccaagcuugucc

SEQ ID NO: 808460 - RNA, 20 nt, Homo sapiens
cauuagcauucugguuuuga

SEQ ID NO: 808461 - RNA, 23 nt, Homo sapiens
cauuagcauucugguuuugacau

SEQ ID NO: 808462 - RNA, 14 nt, Homo sapiens
cauuaguugcacua

SEQ ID NO: 808463 - RNA, 20 nt, Homo sapiens
cauuaguugcacuaacugcu

SEQ ID NO: 808464 - RNA, 15 nt, Homo sapiens
cauuaucucacuuag

SEQ ID NO: 808465 - RNA, 15 nt, Homo sapiens
cauuaugcaaaugga

SEQ ID NO: 808466 - RNA, 17 nt, Homo sapiens
cauuaugcaaauggaga

SEQ ID NO: 808467 - RNA, 15 nt, Homo sapiens
cauuauguucaucac

SEQ ID NO: 808468 - RNA, 17 nt, Homo sapiens
cauuauucaagaaugaa

SEQ ID NO: 808469 - RNA, 16 nt, Homo sapiens
cauuauugacgaacug

SEQ ID NO: 808470 - RNA, 15 nt, Homo sapiens
cauucaaaauaguuc

SEQ ID NO: 808471 - RNA, 14 nt, Homo sapiens
cauucacaccagcu

SEQ ID NO: 808472 - RNA, 14 nt, Homo sapiens
cauucacagagccu

SEQ ID NO: 808473 - RNA, 19 nt, Homo sapiens
cauucacauuugauguaca

SEQ ID NO: 808474 - RNA, 18 nt, Homo sapiens
cauucacuucgccauuca

SEQ ID NO: 808475 - RNA, 17 nt, Homo sapiens
cauucaguuagcaaaga

SEQ ID NO: 808476 - RNA, 20 nt, Homo sapiens
cauucaucuuguguuuuaua

SEQ ID NO: 808477 - RNA, 12 nt, Homo sapiens
cauucauugcag

SEQ ID NO: 808478 - RNA, 20 nt, Homo sapiens
cauuccacacagaaugcaac

SEQ ID NO: 808479 - RNA, 14 nt, Homo sapiens
cauuccagcucugc

SEQ ID NO: 808480 - RNA, 12 nt, Homo sapiens
cauuccaggaaa

SEQ ID NO: 808481 - RNA, 13 nt, Homo sapiens
cauuccaggaaac

SEQ ID NO: 808482 - RNA, 11 nt, Homo sapiens
cauucccugag

SEQ ID NO: 808483 - RNA, 12 nt, Homo sapiens
cauuccuaacac

SEQ ID NO: 808484 - RNA, 22 nt, Homo sapiens
cauuccucagcuucuucacagg

SEQ ID NO: 808485 - RNA, 21 nt, Homo sapiens
cauuccugaaagaaacaguua

SEQ ID NO: 808486 - RNA, 19 nt, Homo sapiens
cauuccugaagaaccaguc

SEQ ID NO: 808487 - RNA, 14 nt, Homo sapiens
cauuccugauccca

SEQ ID NO: 808488 - RNA, 19 nt, Homo sapiens
cauuccuucacucauccag

SEQ ID NO: 808489 - RNA, 14 nt, Homo sapiens
cauuccuugucacc

SEQ ID NO: 808490 - RNA, 16 nt, Homo sapiens
cauuccuuugucuuca

SEQ ID NO: 808491 - RNA, 20 nt, Homo sapiens
cauucuagcugagaagcaau

SEQ ID NO: 808492 - RNA, 12 nt, Homo sapiens
cauucuccugcc

SEQ ID NO: 808493 - RNA, 15 nt, Homo sapiens
cauucuccugccuca

SEQ ID NO: 808494 - RNA, 16 nt, Homo sapiens
cauucucuagacaaaa

SEQ ID NO: 808495 - RNA, 14 nt, Homo sapiens
cauucugaccauuu

SEQ ID NO: 808496 - RNA, 17 nt, Homo sapiens
cauucugcaacccgguu

SEQ ID NO: 808497 - RNA, 17 nt, Homo sapiens
cauucugcauugcuaga

SEQ ID NO: 808498 - RNA, 14 nt, Homo sapiens
cauucuuccaaaaa

SEQ ID NO: 808499 - RNA, 21 nt, Homo sapiens
auugagauaauaucugugagg

SEQ ID NO: 808500 - RNA, 19 nt, Homo sapiens
auugagauaaugauacuua

SEQ ID NO: 808501 - RNA, 20 nt, Homo sapiens
auugagauucauccauauug

SEQ ID NO: 808502 - RNA, 13 nt, Homo sapiens
auugagcauuuga

SEQ ID NO: 808503 - RNA, 21 nt, Homo sapiens
auugagcccaaaaacaagcaa

SEQ ID NO: 808504 - RNA, 17 nt, Homo sapiens
auugaggagcugcacug

SEQ ID NO: 808505 - RNA, 18 nt, Homo sapiens
auugaggagcugcacuga

SEQ ID NO: 808506 - RNA, 19 nt, Homo sapiens
auugaggagcugcacugau

SEQ ID NO: 808507 - RNA, 15 nt, Homo sapiens
auugaggaguugccu

SEQ ID NO: 808508 - RNA, 16 nt, Homo sapiens
auugauaaguucauac

SEQ ID NO: 808509 - RNA, 14 nt, Homo sapiens
auugaugacccucu

SEQ ID NO: 808510 - RNA, 15 nt, Homo sapiens
auugaugagcaagac

SEQ ID NO: 808511 - RNA, 16 nt, Homo sapiens
auugauguuaacaaga

SEQ ID NO: 808512 - RNA, 12 nt, Homo sapiens
auugauguugcu

SEQ ID NO: 808513 - RNA, 13 nt, Homo sapiens
auugauguugcug

SEQ ID NO: 808514 - RNA, 11 nt, Homo sapiens
auugauuucaa

SEQ ID NO: 808515 - RNA, 17 nt, Homo sapiens
auugauuuuaaccaaug

SEQ ID NO: 808516 - RNA, 15 nt, Homo sapiens
auugcaaaagggaac

SEQ ID NO: 808517 - RNA, 18 nt, Homo sapiens
auugcaaauaaaccacuu

SEQ ID NO: 808518 - RNA, 22 nt, Homo sapiens
auugcaaauaaaccacuuucua

SEQ ID NO: 808519 - RNA, 19 nt, Homo sapiens
auugcaauaaauggcuuga

SEQ ID NO: 808520 - RNA, 17 nt, Homo sapiens
auugcaauacauuucaa

SEQ ID NO: 808521 - RNA, 13 nt, Homo sapiens
auugcaaugcccg

SEQ ID NO: 808522 - RNA, 21 nt, Homo sapiens
auugcacgggagaauauacaa

SEQ ID NO: 808523 - RNA, 15 nt, Homo sapiens
auugcacuccagucu

SEQ ID NO: 808524 - RNA, 14 nt, Homo sapiens
auugcaucaguuca

SEQ ID NO: 808525 - RNA, 19 nt, Homo sapiens
auugccacggaaacauaca

SEQ ID NO: 808526 - RNA, 16 nt, Homo sapiens
auugcccgaaaccaga

SEQ ID NO: 808527 - RNA, 16 nt, Homo sapiens
auugccuacaauaaaa

SEQ ID NO: 808528 - RNA, 18 nt, Homo sapiens
auugccuacaauaaaaag

SEQ ID NO: 808529 - RNA, 14 nt, Homo sapiens
auugccucuacuuu

SEQ ID NO: 808530 - RNA, 13 nt, Homo sapiens
auugccugccaga

SEQ ID NO: 808531 - RNA, 17 nt, Homo sapiens
auugccuguaacacaua

SEQ ID NO: 808532 - RNA, 19 nt, Homo sapiens
auugccuuauuugucugua

SEQ ID NO: 808533 - RNA, 18 nt, Homo sapiens
auugccuugagguacuuu

SEQ ID NO: 808534 - RNA, 20 nt, Homo sapiens
auugcgaccauuucucagca

SEQ ID NO: 808535 - RNA, 16 nt, Homo sapiens
auugcgcucucaagac

SEQ ID NO: 808536 - RNA, 13 nt, Homo sapiens
auugcuacaaauc

SEQ ID NO: 808537 - RNA, 16 nt, Homo sapiens
auugcuaguucuaauu

SEQ ID NO: 808538 - RNA, 22 nt, Homo sapiens
auugcucccuaccagcugaaca

SEQ ID NO: 808539 - RNA, 16 nt, Homo sapiens
auugcucucccucgug

SEQ ID NO: 808540 - RNA, 16 nt, Homo sapiens
auugcucuugagucuu

SEQ ID NO: 808541 - RNA, 21 nt, Homo sapiens
auugcucuugagucuuugcag

SEQ ID NO: 808542 - RNA, 13 nt, Homo sapiens
auugcugacuuua

SEQ ID NO: 808543 - RNA, 13 nt, Homo sapiens
auugcugcucucu

SEQ ID NO: 808544 - RNA, 23 nt, Homo sapiens
auugcuuugccaaaauaccagag

SEQ ID NO: 808545 - RNA, 15 nt, Homo sapiens
auugcuuuuaugaua

SEQ ID NO: 808546 - RNA, 20 nt, Homo sapiens
auugcuuuuguugugacuuu

SEQ ID NO: 808547 - RNA, 16 nt, Homo sapiens
auuggaacucuacuca

SEQ ID NO: 808548 - RNA, 19 nt, Homo sapiens
auuggaaucuucaccucag

SEQ ID NO: 808549 - RNA, 22 nt, Homo sapiens
auuggaaugcagaggucuccaa

SEQ ID NO: 808550 - RNA, 18 nt, Homo sapiens
auuggaauucuacuggaa

SEQ ID NO: 808551 - RNA, 19 nt, Homo sapiens
auuggaauucuacuggaaa

SEQ ID NO: 808552 - RNA, 12 nt, Homo sapiens
auuggacuccag

SEQ ID NO: 808553 - RNA, 22 nt, Homo sapiens
auuggacuccaggccugaccag

SEQ ID NO: 808554 - RNA, 15 nt, Homo sapiens
auuggacugucuuua

SEQ ID NO: 808555 - RNA, 15 nt, Homo sapiens
auuggaugucaauag

SEQ ID NO: 808556 - RNA, 22 nt, Homo sapiens
auuggauuuccuaauacuguca

SEQ ID NO: 808557 - RNA, 23 nt, Homo sapiens
ccaaguuccaaaauaaagcauaa

SEQ ID NO: 808558 - RNA, 21 nt, Homo sapiens
ccaaguugagauuuuaauucu

SEQ ID NO: 808559 - RNA, 19 nt, Homo sapiens
ccaaguuuauauacaauua

SEQ ID NO: 808560 - RNA, 16 nt, Homo sapiens
ccaaguuuccauagca

SEQ ID NO: 808561 - RNA, 17 nt, Homo sapiens
ccaauaaaaaugucuca

SEQ ID NO: 808562 - RNA, 17 nt, Homo sapiens
ccaauaaaagcucuucu

SEQ ID NO: 808563 - RNA, 17 nt, Homo sapiens
ccaauaaaggucccuua

SEQ ID NO: 808564 - RNA, 22 nt, Homo sapiens
ccaauaccguguggcccaagac

SEQ ID NO: 808565 - RNA, 10 nt, Homo sapiens
ccaauacugc

SEQ ID NO: 808566 - RNA, 12 nt, Homo sapiens
ccaauagcuuua

SEQ ID NO: 808567 - RNA, 18 nt, Homo sapiens
ccaauagggcugagcucu

SEQ ID NO: 808568 - RNA, 15 nt, Homo sapiens
ccaauaucuugccag

SEQ ID NO: 808569 - RNA, 19 nt, Homo sapiens
ccaaucagcuuuuguucua

SEQ ID NO: 808570 - RNA, 15 nt, Homo sapiens
ccaauccaacaucca

SEQ ID NO: 808571 - RNA, 14 nt, Homo sapiens
ccaaucccgugaaa

SEQ ID NO: 808572 - RNA, 16 nt, Homo sapiens
ccaauccuaguugucu

SEQ ID NO: 808573 - RNA, 23 nt, Homo sapiens
ccaaucucugccauaucagugaa

SEQ ID NO: 808574 - RNA, 14 nt, Homo sapiens
ccaaugccugugaa

SEQ ID NO: 808575 - RNA, 16 nt, Homo sapiens
ccaauggcggacucaa

SEQ ID NO: 808576 - RNA, 15 nt, Homo sapiens
ccaauggugcuuccc

SEQ ID NO: 808577 - RNA, 13 nt, Homo sapiens
ccaauguauuuau

SEQ ID NO: 808578 - RNA, 22 nt, Homo sapiens
ccaauguucuaaaguuuugcaa

SEQ ID NO: 808579 - RNA, 20 nt, Homo sapiens
ccaauuagacaaacagcauc

SEQ ID NO: 808580 - RNA, 15 nt, Homo sapiens
ccaauuagcucuaua

SEQ ID NO: 808581 - RNA, 16 nt, Homo sapiens
ccaauuccaaguuuua

SEQ ID NO: 808582 - RNA, 23 nt, Homo sapiens
ccaauucuaaauccgacuugaau

SEQ ID NO: 808583 - RNA, 12 nt, Homo sapiens
ccaauugaugua

SEQ ID NO: 808584 - RNA, 19 nt, Homo sapiens
ccaauugcuggaguacuua

SEQ ID NO: 808585 - RNA, 23 nt, Homo sapiens
ccaauuugguaaaaaugcugcuc

SEQ ID NO: 808586 - RNA, 13 nt, Homo sapiens
ccacaaaauacac

SEQ ID NO: 808587 - RNA, 12 nt, Homo sapiens
ccacaacaugaa

SEQ ID NO: 808588 - RNA, 13 nt, Homo sapiens
ccacaaccaaaaa

SEQ ID NO: 808589 - RNA, 14 nt, Homo sapiens
ccacaaccaaaaaa

SEQ ID NO: 808590 - RNA, 13 nt, Homo sapiens
ccacaacugacac

SEQ ID NO: 808591 - RNA, 14 nt, Homo sapiens
ccacaaggaccucu

SEQ ID NO: 808592 - RNA, 20 nt, Homo sapiens
ccacaauucacuagaccaga

SEQ ID NO: 808593 - RNA, 11 nt, Homo sapiens
ccacacaagcg

SEQ ID NO: 808594 - RNA, 11 nt, Homo sapiens
ccacacauauu

SEQ ID NO: 808595 - RNA, 19 nt, Homo sapiens
ccacacauuaguacuuaug

SEQ ID NO: 808596 - RNA, 15 nt, Homo sapiens
ccacacccacuuugu

SEQ ID NO: 808597 - RNA, 18 nt, Homo sapiens
gcugugaugcaugagcuc

SEQ ID NO: 808598 - RNA, 22 nt, Homo sapiens
gcugugauuguacuguacauaa

SEQ ID NO: 808599 - RNA, 20 nt, Homo sapiens
gcugugcccacacacaccca

SEQ ID NO: 808600 - RNA, 13 nt, Homo sapiens
gcugugccccuga

SEQ ID NO: 808601 - RNA, 14 nt, Homo sapiens
gcuguggacuauua

SEQ ID NO: 808602 - RNA, 18 nt, Homo sapiens
gcuguggcagaguuacag

SEQ ID NO: 808603 - RNA, 23 nt, Homo sapiens
gcuguggccgucuccucccucag

SEQ ID NO: 808604 - RNA, 23 nt, Homo sapiens
gcuguggggaccacacugauccu

SEQ ID NO: 808605 - RNA, 14 nt, Homo sapiens
gcuguguaagcuca

SEQ ID NO: 808606 - RNA, 17 nt, Homo sapiens
gcuguguguccuugcau

SEQ ID NO: 808607 - RNA, 19 nt, Homo sapiens
gcuguguugggugguugcc

SEQ ID NO: 808608 - RNA, 18 nt, Homo sapiens
gcuguguuuccaucucaa

SEQ ID NO: 808609 - RNA, 23 nt, Homo sapiens
gcuguucacagccagacuggcac

SEQ ID NO: 808610 - RNA, 15 nt, Homo sapiens
gcuguuccuguucag

SEQ ID NO: 808611 - RNA, 15 nt, Homo sapiens
gcuguucugcacuga

SEQ ID NO: 808612 - RNA, 17 nt, Homo sapiens
gcuguugacaucagccu

SEQ ID NO: 808613 - RNA, 15 nt, Homo sapiens
gcuguugagggccaa

SEQ ID NO: 808614 - RNA, 15 nt, Homo sapiens
gcuguuguuccauug

SEQ ID NO: 808615 - RNA, 17 nt, Homo sapiens
gcuguuuaguaguugaa

SEQ ID NO: 808616 - RNA, 22 nt, Homo sapiens
gcuguuuguuucauauauacag

SEQ ID NO: 808617 - RNA, 21 nt, Homo sapiens
gcuguuuugauuuguacugaa

SEQ ID NO: 808618 - RNA, 13 nt, Homo sapiens
gcuuaaaauaagc

SEQ ID NO: 808619 - RNA, 16 nt, Homo sapiens
gcuuaaaaucugugaa

SEQ ID NO: 808620 - RNA, 20 nt, Homo sapiens
gcuuaaccuuuccaguuuau

SEQ ID NO: 808621 - RNA, 15 nt, Homo sapiens
gcuuaagugacaaag

SEQ ID NO: 808622 - RNA, 14 nt, Homo sapiens
gcuuaauguuuauu

SEQ ID NO: 808623 - RNA, 19 nt, Homo sapiens
gcuuacagggcuaggcagu

SEQ ID NO: 808624 - RNA, 21 nt, Homo sapiens
gcuuaccagaagcuuccauag

SEQ ID NO: 808625 - RNA, 18 nt, Homo sapiens
gcuuaccuacauacgugu

SEQ ID NO: 808626 - RNA, 14 nt, Homo sapiens
gcuuagaagugcua

SEQ ID NO: 808627 - RNA, 13 nt, Homo sapiens
gcuuagaccucag

SEQ ID NO: 808628 - RNA, 22 nt, Homo sapiens
gcuuagaugagggugacuguca

SEQ ID NO: 808629 - RNA, 22 nt, Homo sapiens
gcuuaggccucucugccuggga

SEQ ID NO: 808630 - RNA, 15 nt, Homo sapiens
gcuuaguauuucuca

SEQ ID NO: 808631 - RNA, 16 nt, Homo sapiens
gcuuaguauuucucag

SEQ ID NO: 808632 - RNA, 18 nt, Homo sapiens
gcuuauauuaagcaaaca

SEQ ID NO: 808633 - RNA, 14 nt, Homo sapiens
gcuuauauuuagaa

SEQ ID NO: 808634 - RNA, 15 nt, Homo sapiens
gcuuaucauuugaaa

SEQ ID NO: 808635 - RNA, 18 nt, Homo sapiens
gcuuaucuuagaagcacu

SEQ ID NO: 808636 - RNA, 20 nt, Homo sapiens
gcuuauucaucuguuuuucu

SEQ ID NO: 808637 - RNA, 19 nt, Homo sapiens
gcuuauuuugguugcaguu

SEQ ID NO: 808638 - RNA, 21 nt, Homo sapiens
gcuucaaauaaaguccugaca

SEQ ID NO: 808639 - RNA, 23 nt, Homo sapiens
gcuucaaauaaaguccugacacu

SEQ ID NO: 808640 - RNA, 15 nt, Homo sapiens
gcuucaaaugcaaau

SEQ ID NO: 808641 - RNA, 19 nt, Homo sapiens
gcuucaaguguugcucuug

SEQ ID NO: 808642 - RNA, 17 nt, Homo sapiens
gcuucaguacuugugaa

SEQ ID NO: 808643 - RNA, 20 nt, Homo sapiens
gcuucagugacaaacauauc

SEQ ID NO: 808644 - RNA, 15 nt, Homo sapiens
gcuucaguugcauau

SEQ ID NO: 808645 - RNA, 18 nt, Homo sapiens
gcuucaguuuuacucugc

SEQ ID NO: 808646 - RNA, 23 nt, Homo sapiens
gcuucauaaaugaagcagcuuua

SEQ ID NO: 808647 - RNA, 20 nt, Homo sapiens
gcuucauauaccagcaauau

SEQ ID NO: 808648 - RNA, 21 nt, Homo sapiens
gcuucauguuugccuucugca

SEQ ID NO: 808649 - RNA, 17 nt, Homo sapiens
gcuucauuccaaucuau

SEQ ID NO: 808650 - RNA, 14 nt, Homo sapiens
gcuuccaucugccc

SEQ ID NO: 808651 - RNA, 18 nt, Homo sapiens
gcuucccgcugcacaugg

SEQ ID NO: 808652 - RNA, 22 nt, Homo sapiens
gcuucccucucagcugcuggga

SEQ ID NO: 808653 - RNA, 14 nt, Homo sapiens
gcuuccuaacugcu

SEQ ID NO: 808654 - RNA, 20 nt, Homo sapiens
gcuuccucaguaacauuucu

SEQ ID NO: 808655 - RNA, 10 nt, Homo sapiens
gcuuccucua

SEQ ID NO: 808656 - RNA, 18 nt, Homo sapiens
gcuuccucuagaagccaa

SEQ ID NO: 808657 - RNA, 12 nt, Homo sapiens
gcuuccugauga

SEQ ID NO: 808658 - RNA, 14 nt, Homo sapiens
gcuuccugugacag

SEQ ID NO: 808659 - RNA, 12 nt, Homo sapiens
gcuucgacuacu

SEQ ID NO: 808660 - RNA, 14 nt, Homo sapiens
gcuucgacuacugc

SEQ ID NO: 808661 - RNA, 20 nt, Homo sapiens
gcuucuaaucccagcacuuu

SEQ ID NO: 808662 - RNA, 17 nt, Homo sapiens
gcuucuacagacuguag

SEQ ID NO: 808663 - RNA, 16 nt, Homo sapiens
gcuucucccaguguga

SEQ ID NO: 808664 - RNA, 17 nt, Homo sapiens
gcuucucucuccagggu

SEQ ID NO: 808665 - RNA, 22 nt, Homo sapiens
gcuucucuugcuaccugugagc

SEQ ID NO: 808666 - RNA, 20 nt, Homo sapiens
gcuucugagagcaaagggaa

SEQ ID NO: 808667 - RNA, 21 nt, Homo sapiens
gcuucuggggguagaucucaa

SEQ ID NO: 808668 - RNA, 17 nt, Homo sapiens
gcuucuucacaggcacu

SEQ ID NO: 808669 - RNA, 21 nt, Homo sapiens
gcuucuuccccucugcggcuu

SEQ ID NO: 808670 - RNA, 15 nt, Homo sapiens
gcuucuucucaaagc

SEQ ID NO: 808671 - RNA, 14 nt, Homo sapiens
gcuucuugccucug

SEQ ID NO: 808672 - RNA, 19 nt, Homo sapiens
gcuugacaccugucuugaa

SEQ ID NO: 808673 - RNA, 13 nt, Homo sapiens
gcuugagucacca

SEQ ID NO: 808674 - RNA, 14 nt, Homo sapiens
ggaagagggcagua

SEQ ID NO: 808675 - RNA, 19 nt, Homo sapiens
ggaagaucagcacccuaag

SEQ ID NO: 808676 - RNA, 23 nt, Homo sapiens
ggaagaucuugagagcugcugag

SEQ ID NO: 808677 - RNA, 16 nt, Homo sapiens
ggaagauggagacacc

SEQ ID NO: 808678 - RNA, 17 nt, Homo sapiens
ggaagcaauaaagcucu

SEQ ID NO: 808679 - RNA, 10 nt, Homo sapiens
ggaagccagg

SEQ ID NO: 808680 - RNA, 21 nt, Homo sapiens
ggaagcccagcuccagggcca

SEQ ID NO: 808681 - RNA, 22 nt, Homo sapiens
ggaagccccauccaacacugga

SEQ ID NO: 808682 - RNA, 19 nt, Homo sapiens
ggaagccugugccagcacc

SEQ ID NO: 808683 - RNA, 14 nt, Homo sapiens
ggaagccuguggug

SEQ ID NO: 808684 - RNA, 20 nt, Homo sapiens
ggaagcggagcuugcaguga

SEQ ID NO: 808685 - RNA, 17 nt, Homo sapiens
ggaagcucugaagucac

SEQ ID NO: 808686 - RNA, 16 nt, Homo sapiens
ggaagcugucccucac

SEQ ID NO: 808687 - RNA, 22 nt, Homo sapiens
ggaaggaggccaagcagugccu

SEQ ID NO: 808688 - RNA, 13 nt, Homo sapiens
ggaagggacacca

SEQ ID NO: 808689 - RNA, 19 nt, Homo sapiens
ggaagggccuacagcccau

SEQ ID NO: 808690 - RNA, 19 nt, Homo sapiens
ggaagggggguugcagugg

SEQ ID NO: 808691 - RNA, 22 nt, Homo sapiens
ggaaggucucaggagaagggau

SEQ ID NO: 808692 - RNA, 13 nt, Homo sapiens
ggaaggucuucaa

SEQ ID NO: 808693 - RNA, 15 nt, Homo sapiens
ggaagguggggcccu

SEQ ID NO: 808694 - RNA, 18 nt, Homo sapiens
ggaaguaaccauuugcac

SEQ ID NO: 808695 - RNA, 19 nt, Homo sapiens
ggaaguaaccauuugcacu

SEQ ID NO: 808696 - RNA, 11 nt, Homo sapiens
ggaaguacugc

SEQ ID NO: 808697 - RNA, 15 nt, Homo sapiens
ggaaguagcugucag

SEQ ID NO: 808698 - RNA, 13 nt, Homo sapiens
ggaagucaucuca

SEQ ID NO: 808699 - RNA, 13 nt, Homo sapiens
ggaaguccaucug

SEQ ID NO: 808700 - RNA, 21 nt, Homo sapiens
ggaaguuucguaugcacuccc

SEQ ID NO: 808701 - RNA, 20 nt, Homo sapiens
ggaaguuucuggugccauuu

SEQ ID NO: 808702 - RNA, 14 nt, Homo sapiens
ggaauaaguguuua

SEQ ID NO: 808703 - RNA, 12 nt, Homo sapiens
ggaauaauucaa

SEQ ID NO: 808704 - RNA, 21 nt, Homo sapiens
ggaauacugugcauaagccau

SEQ ID NO: 808705 - RNA, 15 nt, Homo sapiens
ggaauaugaccauuu

SEQ ID NO: 808706 - RNA, 22 nt, Homo sapiens
ggaauaugaccauuugacuguu

SEQ ID NO: 808707 - RNA, 18 nt, Homo sapiens
ggaauauuuaaacaguag

SEQ ID NO: 808708 - RNA, 12 nt, Homo sapiens
ggaaucagagag

SEQ ID NO: 808709 - RNA, 21 nt, Homo sapiens
ggaauccauguaaauugcaaa

SEQ ID NO: 808710 - RNA, 22 nt, Homo sapiens
ggaauccuggcagcccagagac

SEQ ID NO: 808711 - RNA, 14 nt, Homo sapiens
ggaaucgacuguau

SEQ ID NO: 808712 - RNA, 16 nt, Homo sapiens
ggaaucuucugaauuu

SEQ ID NO: 808713 - RNA, 22 nt, Homo sapiens
ggaaugacuggggagggcugca

SEQ ID NO: 808714 - RNA, 18 nt, Homo sapiens
cuuuucccauugccaugc

SEQ ID NO: 808715 - RNA, 16 nt, Homo sapiens
cuuuucccuugcugua

SEQ ID NO: 808716 - RNA, 17 nt, Homo sapiens
cuuuuccugcucccuaa

SEQ ID NO: 808717 - RNA, 18 nt, Homo sapiens
cuuuuccugcucccuaac

SEQ ID NO: 808718 - RNA, 15 nt, Homo sapiens
cuuuuccuuucugcc

SEQ ID NO: 808719 - RNA, 16 nt, Homo sapiens
cuuuuccuuucugcca

SEQ ID NO: 808720 - RNA, 16 nt, Homo sapiens
cuuuucuaacucuccc

SEQ ID NO: 808721 - RNA, 19 nt, Homo sapiens
cuuuucuaaucacaguguu

SEQ ID NO: 808722 - RNA, 20 nt, Homo sapiens
cuuuucuaaucacaguguug

SEQ ID NO: 808723 - RNA, 18 nt, Homo sapiens
cuuuucucagacucacca

SEQ ID NO: 808724 - RNA, 21 nt, Homo sapiens
cuuuucucagacucaccaacu

SEQ ID NO: 808725 - RNA, 22 nt, Homo sapiens
cuuuucuccucacuguauccag

SEQ ID NO: 808726 - RNA, 19 nt, Homo sapiens
cuuuucuggaauguaauca

SEQ ID NO: 808727 - RNA, 20 nt, Homo sapiens
cuuuucuggggaaagacacu

SEQ ID NO: 808728 - RNA, 22 nt, Homo sapiens
cuuuucugugccagacauugcu

SEQ ID NO: 808729 - RNA, 20 nt, Homo sapiens
cuuuucuuuuuuaauuucca

SEQ ID NO: 808730 - RNA, 16 nt, Homo sapiens
cuuuugaacuugucac

SEQ ID NO: 808731 - RNA, 12 nt, Homo sapiens
cuuuugaagucc

SEQ ID NO: 808732 - RNA, 14 nt, Homo sapiens
cuuuugaauugcac

SEQ ID NO: 808733 - RNA, 14 nt, Homo sapiens
cuuuugacauuuua

SEQ ID NO: 808734 - RNA, 13 nt, Homo sapiens
cuuuugaccaaau

SEQ ID NO: 808735 - RNA, 17 nt, Homo sapiens
cuuuugagaaccaagua

SEQ ID NO: 808736 - RNA, 17 nt, Homo sapiens
cuuuugagaauguuuga

SEQ ID NO: 808737 - RNA, 17 nt, Homo sapiens
cuuuugcaacuuaauac

SEQ ID NO: 808738 - RNA, 18 nt, Homo sapiens
cuuuugcacaaggaaaua

SEQ ID NO: 808739 - RNA, 16 nt, Homo sapiens
cuuuugcauaaaagac

SEQ ID NO: 808740 - RNA, 10 nt, Homo sapiens
cuuuugccac

SEQ ID NO: 808741 - RNA, 20 nt, Homo sapiens
cuuuugcuucaguugcauau

SEQ ID NO: 808742 - RNA, 20 nt, Homo sapiens
cuuuugguagagaaggagca

SEQ ID NO: 808743 - RNA, 20 nt, Homo sapiens
cuuuuguaaaaaugucccca

SEQ ID NO: 808744 - RNA, 14 nt, Homo sapiens
cuuuugucccagaa

SEQ ID NO: 808745 - RNA, 17 nt, Homo sapiens
cuuuugugcaaagccaa

SEQ ID NO: 808746 - RNA, 22 nt, Homo sapiens
cuuuugugcuccccuuugccua

SEQ ID NO: 808747 - RNA, 18 nt, Homo sapiens
cuuuuguuuugaguuacu

SEQ ID NO: 808748 - RNA, 15 nt, Homo sapiens
cuuuuuauacuauua

SEQ ID NO: 808749 - RNA, 14 nt, Homo sapiens
cuuuuucacuuuga

SEQ ID NO: 808750 - RNA, 13 nt, Homo sapiens
cuuuuuccacaag

SEQ ID NO: 808751 - RNA, 20 nt, Homo sapiens
cuuuuuccuggcucaucucu

SEQ ID NO: 808752 - RNA, 15 nt, Homo sapiens
cuuuuucuauauucu

SEQ ID NO: 808753 - RNA, 16 nt, Homo sapiens
cuuuuucugagcuuuu

SEQ ID NO: 808754 - RNA, 18 nt, Homo sapiens
cuuuuucuucuucccucc

SEQ ID NO: 808755 - RNA, 22 nt, Homo sapiens
cuuuuucuugaauauuugccac

SEQ ID NO: 808756 - RNA, 13 nt, Homo sapiens
cuuuuucuuugaa

SEQ ID NO: 808757 - RNA, 16 nt, Homo sapiens
cuuuuugcaugcuuau

SEQ ID NO: 808758 - RNA, 13 nt, Homo sapiens
cuuuuuguacuga

SEQ ID NO: 808759 - RNA, 17 nt, Homo sapiens
cuuuuuuucuguaccag

SEQ ID NO: 808760 - RNA, 20 nt, Homo sapiens
cuuuuuuucuuguccucauu

SEQ ID NO: 808761 - RNA, 17 nt, Homo sapiens
gaaaaaaaaacagccac

SEQ ID NO: 808762 - RNA, 19 nt, Homo sapiens
gaaaaacauuccaggaaac

SEQ ID NO: 808763 - RNA, 13 nt, Homo sapiens
gaaaaacuuccau

SEQ ID NO: 808764 - RNA, 15 nt, Homo sapiens
gaaaaacuuccauga

SEQ ID NO: 808765 - RNA, 20 nt, Homo sapiens
gaaaaagguuugcauucuca

SEQ ID NO: 808766 - RNA, 12 nt, Homo sapiens
gaaaaauaauca

SEQ ID NO: 808767 - RNA, 14 nt, Homo sapiens
gaaaaaucaaguau

SEQ ID NO: 808768 - RNA, 18 nt, Homo sapiens
gaaaaaucauccaagaca

SEQ ID NO: 808769 - RNA, 18 nt, Homo sapiens
gaaaaaucaugggccaga

SEQ ID NO: 808770 - RNA, 15 nt, Homo sapiens
gaaaacagaaaccau

SEQ ID NO: 808771 - RNA, 12 nt, Homo sapiens
gaaaacauugca

SEQ ID NO: 808772 - RNA, 21 nt, Homo sapiens
gaaaaccacagucaguggaga

SEQ ID NO: 808773 - RNA, 14 nt, Homo sapiens
gaaaaccuccagua

SEQ ID NO: 808774 - RNA, 18 nt, Homo sapiens
gaaaacuacugauacuuu

SEQ ID NO: 808775 - RNA, 19 nt, Homo sapiens
gaaaacuagcauuacauua

SEQ ID NO: 808776 - RNA, 19 nt, Homo sapiens
gaaaacuaggcaauguacu

SEQ ID NO: 808777 - RNA, 20 nt, Homo sapiens
gaaaacuaggcaauguacuc

SEQ ID NO: 808778 - RNA, 21 nt, Homo sapiens
gaaaacugauucucuaugaca

SEQ ID NO: 808779 - RNA, 13 nt, Homo sapiens
gaaaacuguaguc

SEQ ID NO: 808780 - RNA, 15 nt, Homo sapiens
gaaaacugugcaaug

SEQ ID NO: 808781 - RNA, 21 nt, Homo sapiens
gaaaagaaagugaaaguuuua

SEQ ID NO: 808782 - RNA, 22 nt, Homo sapiens
gaaaagaacuaggacugaacua

SEQ ID NO: 808783 - RNA, 20 nt, Homo sapiens
gaaaagauuauauauuauuu

SEQ ID NO: 808784 - RNA, 19 nt, Homo sapiens
gaaaagcacuuugaaaaau

SEQ ID NO: 808785 - RNA, 17 nt, Homo sapiens
gaaaagcccccaguuaa

SEQ ID NO: 808786 - RNA, 20 nt, Homo sapiens
gaaaagccuaaucacaguuu

SEQ ID NO: 808787 - RNA, 16 nt, Homo sapiens
gaaaagggcugacauu

SEQ ID NO: 808788 - RNA, 18 nt, Homo sapiens
gaaaaggggacaguuuuu

SEQ ID NO: 808789 - RNA, 19 nt, Homo sapiens
gaaaagguucuucaucccu

SEQ ID NO: 808790 - RNA, 16 nt, Homo sapiens
gaaaaguccacauaac

SEQ ID NO: 808791 - RNA, 14 nt, Homo sapiens
gaaaagucuacccc

SEQ ID NO: 808792 - RNA, 16 nt, Homo sapiens
gaaaaguguaauagca

SEQ ID NO: 808793 - RNA, 13 nt, Homo sapiens
gaaaaguuaguca

SEQ ID NO: 808794 - RNA, 21 nt, Homo sapiens
gaaaaguuagucaauccuguc

SEQ ID NO: 808795 - RNA, 21 nt, Homo sapiens
gaaaaguugaaauguguaauu

SEQ ID NO: 808796 - RNA, 20 nt, Homo sapiens
gaaaaguugaugguauucau

SEQ ID NO: 808797 - RNA, 14 nt, Homo sapiens
gaaaauaaacauca

SEQ ID NO: 808798 - RNA, 14 nt, Homo sapiens
gaaaauaacaaagc

SEQ ID NO: 808799 - RNA, 19 nt, Homo sapiens
gaaaauaacaaagcccuua

SEQ ID NO: 808800 - RNA, 18 nt, Homo sapiens
gaaaauaauuaauuucau

SEQ ID NO: 808801 - RNA, 15 nt, Homo sapiens
gaaaauaguguaaga

SEQ ID NO: 808802 - RNA, 18 nt, Homo sapiens
gaaaauaucuugcuuuca

SEQ ID NO: 808803 - RNA, 12 nt, Homo sapiens
gaaaauaugccu

SEQ ID NO: 808804 - RNA, 21 nt, Homo sapiens
gaaaauauuuuguugccuuca

SEQ ID NO: 808805 - RNA, 16 nt, Homo sapiens
gaaaaucaccauuccg

SEQ ID NO: 808806 - RNA, 17 nt, Homo sapiens
gaaaaucaucaagaagg

SEQ ID NO: 808807 - RNA, 12 nt, Homo sapiens
gaaaauccagaa

SEQ ID NO: 808808 - RNA, 16 nt, Homo sapiens
gaaaaucuccaucuca

SEQ ID NO: 808809 - RNA, 21 nt, Homo sapiens
gaaaaugaucuuaauuuacuu

SEQ ID NO: 808810 - RNA, 13 nt, Homo sapiens
gaaaaugcauuag

SEQ ID NO: 808811 - RNA, 20 nt, Homo sapiens
gaaaaugccucaauucacau

SEQ ID NO: 808812 - RNA, 19 nt, Homo sapiens
guauaaugguugacugggu

SEQ ID NO: 808813 - RNA, 11 nt, Homo sapiens
guauacugugu

SEQ ID NO: 808814 - RNA, 16 nt, Homo sapiens
guauagaguacugcag

SEQ ID NO: 808815 - RNA, 23 nt, Homo sapiens
guauagcauuuuuauucaugcca

SEQ ID NO: 808816 - RNA, 22 nt, Homo sapiens
guauagcuuaccugaacaggaa

SEQ ID NO: 808817 - RNA, 23 nt, Homo sapiens
guauaguaaaugccucauuuaau

SEQ ID NO: 808818 - RNA, 13 nt, Homo sapiens
guauagugucuau

SEQ ID NO: 808819 - RNA, 13 nt, Homo sapiens
guauaguguucac

SEQ ID NO: 808820 - RNA, 23 nt, Homo sapiens
guauaguguucacaaacugugaa

SEQ ID NO: 808821 - RNA, 18 nt, Homo sapiens
guauauaaauacaugcac

SEQ ID NO: 808822 - RNA, 21 nt, Homo sapiens
guauauaaauuuucccaaaac

SEQ ID NO: 808823 - RNA, 15 nt, Homo sapiens
guauauauauauagu

SEQ ID NO: 808824 - RNA, 18 nt, Homo sapiens
guauauauguauaugugc

SEQ ID NO: 808825 - RNA, 19 nt, Homo sapiens
guauauauuuacaugucuu

SEQ ID NO: 808826 - RNA, 22 nt, Homo sapiens
guauaucaugaaacacuucuca

SEQ ID NO: 808827 - RNA, 23 nt, Homo sapiens
guauaucaugaaacacuucucau

SEQ ID NO: 808828 - RNA, 20 nt, Homo sapiens
guauaugauucucugugguu

SEQ ID NO: 808829 - RNA, 20 nt, Homo sapiens
guauaugugcauggacugug

SEQ ID NO: 808830 - RNA, 19 nt, Homo sapiens
guauauuaagaagcaauaa

SEQ ID NO: 808831 - RNA, 17 nt, Homo sapiens
guauauuugguacugua

SEQ ID NO: 808832 - RNA, 13 nt, Homo sapiens
guauauuuuggga

SEQ ID NO: 808833 - RNA, 13 nt, Homo sapiens
guaucaacacugu

SEQ ID NO: 808834 - RNA, 14 nt, Homo sapiens
guaucaacacuguu

SEQ ID NO: 808835 - RNA, 18 nt, Homo sapiens
guaucauguauggugaua

SEQ ID NO: 808836 - RNA, 15 nt, Homo sapiens
guaucauuacaauuu

SEQ ID NO: 808837 - RNA, 12 nt, Homo sapiens
guaucauucaac

SEQ ID NO: 808838 - RNA, 15 nt, Homo sapiens
guaucccuacaucua

SEQ ID NO: 808839 - RNA, 18 nt, Homo sapiens
guauccugugacauguaa

SEQ ID NO: 808840 - RNA, 14 nt, Homo sapiens
guaucgcugagacu

SEQ ID NO: 808841 - RNA, 18 nt, Homo sapiens
guaucguuuguuuaugaa

SEQ ID NO: 808842 - RNA, 18 nt, Homo sapiens
guaucuauuuguacaauu

SEQ ID NO: 808843 - RNA, 15 nt, Homo sapiens
guaucuugauaucuc

SEQ ID NO: 808844 - RNA, 18 nt, Homo sapiens
guaugaaagagcaaguga

SEQ ID NO: 808845 - RNA, 22 nt, Homo sapiens
guaugccaccaacacugcucac

SEQ ID NO: 808846 - RNA, 18 nt, Homo sapiens
guauggaauacaguguua

SEQ ID NO: 808847 - RNA, 17 nt, Homo sapiens
guauguacuaagcagua

SEQ ID NO: 808848 - RNA, 14 nt, Homo sapiens
guaugucuaccugg

SEQ ID NO: 808849 - RNA, 14 nt, Homo sapiens
guaugucuguuacc

SEQ ID NO: 808850 - RNA, 19 nt, Homo sapiens
guaugucuuggacacugua

SEQ ID NO: 808851 - RNA, 13 nt, Homo sapiens
guaugugccaaag

SEQ ID NO: 808852 - RNA, 18 nt, Homo sapiens
guauguguaaaacaaucu

SEQ ID NO: 808853 - RNA, 14 nt, Homo sapiens
guauuaaaaagccu

SEQ ID NO: 808854 - RNA, 14 nt, Homo sapiens
guauuaaaagcuaa

SEQ ID NO: 808855 - RNA, 18 nt, Homo sapiens
guauuaaacucuaaugua

SEQ ID NO: 808856 - RNA, 19 nt, Homo sapiens
guauuaauccccaucauua

SEQ ID NO: 808857 - RNA, 21 nt, Homo sapiens
guauuaggucgguacuaagaa

SEQ ID NO: 808858 - RNA, 14 nt, Homo sapiens
guauuauacaugug

SEQ ID NO: 808859 - RNA, 20 nt, Homo sapiens
guauuauuucaccagcagca

SEQ ID NO: 808860 - RNA, 17 nt, Homo sapiens
guauuauuuuacaauca

SEQ ID NO: 808861 - RNA, 20 nt, Homo sapiens
guauucaaauuugugucaua

SEQ ID NO: 808862 - RNA, 12 nt, Homo sapiens
guauuccauuuu

SEQ ID NO: 808863 - RNA, 19 nt, Homo sapiens
guauuccgauacaaagugu

SEQ ID NO: 808864 - RNA, 16 nt, Homo sapiens
guauuccuccugagau

SEQ ID NO: 808865 - RNA, 14 nt, Homo sapiens
guauuccugucauu

SEQ ID NO: 808866 - RNA, 21 nt, Homo sapiens
guauuccuuuauacacagugg

SEQ ID NO: 808867 - RNA, 21 nt, Homo sapiens
guauucuguuugcguacuugu

SEQ ID NO: 808868 - RNA, 18 nt, Homo sapiens
guauucuuuuccaagcuc

SEQ ID NO: 808869 - RNA, 23 nt, Homo sapiens
gucagaacagagugcaacccagu

SEQ ID NO: 808870 - RNA, 17 nt, Homo sapiens
gucagaauaguccuugg

SEQ ID NO: 808871 - RNA, 21 nt, Homo sapiens
gucagaauccuuuacauucaa

SEQ ID NO: 808872 - RNA, 23 nt, Homo sapiens
gucagaauuucuuugucauucaa

SEQ ID NO: 808873 - RNA, 15 nt, Homo sapiens
gucagagaugggcug

SEQ ID NO: 808874 - RNA, 20 nt, Homo sapiens
gucagaggcuaauucugcag

SEQ ID NO: 808875 - RNA, 13 nt, Homo sapiens
gucagaguucugc

SEQ ID NO: 808876 - RNA, 15 nt, Homo sapiens
gucagaugaggcaaa

SEQ ID NO: 808877 - RNA, 12 nt, Homo sapiens
gucagaugucac

SEQ ID NO: 808878 - RNA, 20 nt, Homo sapiens
gucagauuugaacucuucaa

SEQ ID NO: 808879 - RNA, 17 nt, Homo sapiens
gucagccauaucuccau

SEQ ID NO: 808880 - RNA, 17 nt, Homo sapiens
gucagcuguggggaaca

SEQ ID NO: 808881 - RNA, 22 nt, Homo sapiens
gucagcuguggggaacacagcu

SEQ ID NO: 808882 - RNA, 19 nt, Homo sapiens
gucaggaaaacuguuccaa

SEQ ID NO: 808883 - RNA, 23 nt, Homo sapiens
gucaggaacagaaggaugaauga

SEQ ID NO: 808884 - RNA, 21 nt, Homo sapiens
gucaggcagguuugccaguga

SEQ ID NO: 808885 - RNA, 21 nt, Homo sapiens
gucaggcggggugcuguggug

SEQ ID NO: 808886 - RNA, 16 nt, Homo sapiens
gucagggccagacugg

SEQ ID NO: 808887 - RNA, 17 nt, Homo sapiens
gucagggguuucuucaa

SEQ ID NO: 808888 - RNA, 20 nt, Homo sapiens
gucagggugaacugcaaagc

SEQ ID NO: 808889 - RNA, 16 nt, Homo sapiens
gucagucucucaccac

SEQ ID NO: 808890 - RNA, 22 nt, Homo sapiens
gucagugcugccaguuucccaa

SEQ ID NO: 808891 - RNA, 20 nt, Homo sapiens
gucagugcuucgugccucga

SEQ ID NO: 808892 - RNA, 17 nt, Homo sapiens
gucaguuauucuugcaa

SEQ ID NO: 808893 - RNA, 17 nt, Homo sapiens
gucaguucuaaccuccu

SEQ ID NO: 808894 - RNA, 13 nt, Homo sapiens
gucauaacaucca

SEQ ID NO: 808895 - RNA, 18 nt, Homo sapiens
gucauaccuuuggauuua

SEQ ID NO: 808896 - RNA, 21 nt, Homo sapiens
gucauaguggguggauuuguu

SEQ ID NO: 808897 - RNA, 13 nt, Homo sapiens
gucaucaccaccc

SEQ ID NO: 808898 - RNA, 15 nt, Homo sapiens
gucauccagcucacu

SEQ ID NO: 808899 - RNA, 17 nt, Homo sapiens
gucauccagcucacuca

SEQ ID NO: 808900 - RNA, 16 nt, Homo sapiens
gucaucuguaccucug

SEQ ID NO: 808901 - RNA, 16 nt, Homo sapiens
gucaugcuucaucauu

SEQ ID NO: 808902 - RNA, 18 nt, Homo sapiens
gucauggaggccaagaac

SEQ ID NO: 808903 - RNA, 20 nt, Homo sapiens
gucauggaggccaagaacuu

SEQ ID NO: 808904 - RNA, 24 nt, Homo sapiens
gucauggcaccaaagccaccagac

SEQ ID NO: 808905 - RNA, 13 nt, Homo sapiens
gucaugggguccc

SEQ ID NO: 808906 - RNA, 17 nt, Homo sapiens
gucaugucugugauugc

SEQ ID NO: 808907 - RNA, 23 nt, Homo sapiens
gucauuauuuuuguuagcaaaga

SEQ ID NO: 808908 - RNA, 23 nt, Homo sapiens
gucauuggccacugucuccacuc

SEQ ID NO: 808909 - RNA, 19 nt, Homo sapiens
gucauuggccgacaucaca

SEQ ID NO: 808910 - RNA, 20 nt, Homo sapiens
gucauuggccgacaucacag

SEQ ID NO: 808911 - RNA, 23 nt, Homo sapiens
gucauuuauucaaguauugagaa

SEQ ID NO: 808912 - RNA, 14 nt, Homo sapiens
gucauuuccggacu

SEQ ID NO: 808913 - RNA, 21 nt, Homo sapiens
gucauuuggugccaguauuuu

SEQ ID NO: 808914 - RNA, 14 nt, Homo sapiens
gucauuuugcacug

SEQ ID NO: 808915 - RNA, 18 nt, Homo sapiens
gucauuuugcacuguaaa

SEQ ID NO: 808916 - RNA, 20 nt, Homo sapiens
guccaaaacugccucaggag

SEQ ID NO: 808917 - RNA, 21 nt, Homo sapiens
guccaaccagaccuggaagaa

SEQ ID NO: 808918 - RNA, 13 nt, Homo sapiens
guccaacugucaa

SEQ ID NO: 808919 - RNA, 20 nt, Homo sapiens
guccaacugucaaccuagaa

SEQ ID NO: 808920 - RNA, 13 nt, Homo sapiens
guccaagggccau

SEQ ID NO: 808921 - RNA, 20 nt, Homo sapiens
guccaauacacgcgugugcu

SEQ ID NO: 808922 - RNA, 19 nt, Homo sapiens
guccacccaggcugcacug

SEQ ID NO: 808923 - RNA, 13 nt, Homo sapiens
guccaccucccau

SEQ ID NO: 808924 - RNA, 23 nt, Homo sapiens
guccagaaauugugugugcaaga

SEQ ID NO: 808925 - RNA, 14 nt, Homo sapiens
guccuggcugugaa

SEQ ID NO: 808926 - RNA, 23 nt, Homo sapiens
guccuguuaacgucaucucaggg

SEQ ID NO: 808927 - RNA, 22 nt, Homo sapiens
guccuucaaguuagcucaggag

SEQ ID NO: 808928 - RNA, 13 nt, Homo sapiens
guccuuccugacc

SEQ ID NO: 808929 - RNA, 17 nt, Homo sapiens
guccuucgcccugugca

SEQ ID NO: 808930 - RNA, 22 nt, Homo sapiens
guccuugaugccagagggccag

SEQ ID NO: 808931 - RNA, 16 nt, Homo sapiens
guccuuugggacucau

SEQ ID NO: 808932 - RNA, 23 nt, Homo sapiens
gucgagacuucacgggcaaucau

SEQ ID NO: 808933 - RNA, 20 nt, Homo sapiens
gucgauccuggggcccucag

SEQ ID NO: 808934 - RNA, 15 nt, Homo sapiens
gucggcacccuggug

SEQ ID NO: 808935 - RNA, 14 nt, Homo sapiens
gucguaagucacug

SEQ ID NO: 808936 - RNA, 21 nt, Homo sapiens
gucguuuauauuguagcaguu

SEQ ID NO: 808937 - RNA, 16 nt, Homo sapiens
gucuaaaaacaccaaa

SEQ ID NO: 808938 - RNA, 22 nt, Homo sapiens
gucuaaauaaaugaaguauuuc

SEQ ID NO: 808939 - RNA, 12 nt, Homo sapiens
gucuaacgcuga

SEQ ID NO: 808940 - RNA, 14 nt, Homo sapiens
gucuaaucucucac

SEQ ID NO: 808941 - RNA, 12 nt, Homo sapiens
gucuacauuucu

SEQ ID NO: 808942 - RNA, 17 nt, Homo sapiens
gucuacuguggugaucu

SEQ ID NO: 808943 - RNA, 17 nt, Homo sapiens
gucuagacacaauuuca

SEQ ID NO: 808944 - RNA, 21 nt, Homo sapiens
gucuaggcuggaagagccaaa

SEQ ID NO: 808945 - RNA, 17 nt, Homo sapiens
gucuagguacuucaggg

SEQ ID NO: 808946 - RNA, 19 nt, Homo sapiens
gucuaggucuccucagggu

SEQ ID NO: 808947 - RNA, 16 nt, Homo sapiens
gucuauuaauauucag

SEQ ID NO: 808948 - RNA, 21 nt, Homo sapiens
gucuauuccaggcaugcacaa

SEQ ID NO: 808949 - RNA, 12 nt, Homo sapiens
gucuauuuccac

SEQ ID NO: 808950 - RNA, 15 nt, Homo sapiens
gucuauuuccacuga

SEQ ID NO: 808951 - RNA, 16 nt, Homo sapiens
gucuauuuccacugaa

SEQ ID NO: 808952 - RNA, 18 nt, Homo sapiens
gucuauuuucucagucau

SEQ ID NO: 808953 - RNA, 15 nt, Homo sapiens
gucucaaacuccuga

SEQ ID NO: 808954 - RNA, 19 nt, Homo sapiens
gucucaagagggcacuggu

SEQ ID NO: 808955 - RNA, 17 nt, Homo sapiens
gucucacaguguugccc

SEQ ID NO: 808956 - RNA, 20 nt, Homo sapiens
gucucaugcggacccucaca

SEQ ID NO: 808957 - RNA, 19 nt, Homo sapiens
gucuccacuaaaugagcuc

SEQ ID NO: 808958 - RNA, 14 nt, Homo sapiens
gucuccaugcucac

SEQ ID NO: 808959 - RNA, 23 nt, Homo sapiens
gucuccuggaccuugacagagca

SEQ ID NO: 808960 - RNA, 17 nt, Homo sapiens
gucucggggcuugcccc

SEQ ID NO: 808961 - RNA, 21 nt, Homo sapiens
gucucuaaugucugcagcuca

SEQ ID NO: 808962 - RNA, 15 nt, Homo sapiens
gucucuauaccaaua

SEQ ID NO: 808963 - RNA, 16 nt, Homo sapiens
gucucucuccagguca

SEQ ID NO: 808964 - RNA, 18 nt, Homo sapiens
gucucucuuuggcuggaa

SEQ ID NO: 808965 - RNA, 21 nt, Homo sapiens
gucucugccugcggcccagaa

SEQ ID NO: 808966 - RNA, 22 nt, Homo sapiens
gucucuucggcagggaggugaa

SEQ ID NO: 808967 - RNA, 17 nt, Homo sapiens
gucucuucuaagcaaaa

SEQ ID NO: 808968 - RNA, 13 nt, Homo sapiens
gucugaacaaagu

SEQ ID NO: 808969 - RNA, 19 nt, Homo sapiens
gucugaacggcugaauaug

SEQ ID NO: 808970 - RNA, 21 nt, Homo sapiens
gucugaguaagcccucaggag

SEQ ID NO: 808971 - RNA, 16 nt, Homo sapiens
gucugcuuaaagcuuc

SEQ ID NO: 808972 - RNA, 21 nt, Homo sapiens
gucuggcccgcaauacuguag

SEQ ID NO: 808973 - RNA, 19 nt, Homo sapiens
gucuggcugaggauuucaa

SEQ ID NO: 808974 - RNA, 18 nt, Homo sapiens
gucugggagucacacagu

SEQ ID NO: 808975 - RNA, 15 nt, Homo sapiens
gucugggcaccaccu

SEQ ID NO: 808976 - RNA, 19 nt, Homo sapiens
gucuggggagaauguaauc

SEQ ID NO: 808977 - RNA, 19 nt, Homo sapiens
gucugguugggcagccaga

SEQ ID NO: 808978 - RNA, 17 nt, Homo sapiens
gucuguaaaaaauggag

SEQ ID NO: 808979 - RNA, 15 nt, Homo sapiens
gucuguccaccccau

SEQ ID NO: 808980 - RNA, 16 nt, Homo sapiens
gucugucuacauuucu

SEQ ID NO: 808981 - RNA, 14 nt, Homo sapiens
gugaauuauucuga

SEQ ID NO: 808982 - RNA, 19 nt, Homo sapiens
gugaauuauugacacugaa

SEQ ID NO: 808983 - RNA, 16 nt, Homo sapiens
gugaauuucacaagcu

SEQ ID NO: 808984 - RNA, 23 nt, Homo sapiens
gugaauuuuucucuaacucagaa

SEQ ID NO: 808985 - RNA, 20 nt, Homo sapiens
gugacaaaaugauacuguga

SEQ ID NO: 808986 - RNA, 23 nt, Homo sapiens
gugacaaccgaguggcugucauc

SEQ ID NO: 808987 - RNA, 12 nt, Homo sapiens
gugacacauaug

SEQ ID NO: 808988 - RNA, 13 nt, Homo sapiens
gugacacauaugc

SEQ ID NO: 808989 - RNA, 12 nt, Homo sapiens
gugacaccucac

SEQ ID NO: 808990 - RNA, 20 nt, Homo sapiens
gugacagaccacaucuuuau

SEQ ID NO: 808991 - RNA, 17 nt, Homo sapiens
gugacagagcccagcau

SEQ ID NO: 808992 - RNA, 18 nt, Homo sapiens
gugacagcuuuccucaaa

SEQ ID NO: 808993 - RNA, 19 nt, Homo sapiens
gugacauauauauguauau

SEQ ID NO: 808994 - RNA, 22 nt, Homo sapiens
gugacauccacaaaugcaguuu

SEQ ID NO: 808995 - RNA, 22 nt, Homo sapiens
gugaccccucagggguuucauu

SEQ ID NO: 808996 - RNA, 16 nt, Homo sapiens
gugacgugcacuguga

SEQ ID NO: 808997 - RNA, 18 nt, Homo sapiens
gugacuucccuucuaacc

SEQ ID NO: 808998 - RNA, 12 nt, Homo sapiens
gugacuuucuaa

SEQ ID NO: 808999 - RNA, 15 nt, Homo sapiens
gugagaaauagcuga

SEQ ID NO: 809000 - RNA, 13 nt, Homo sapiens
gugagaacaucau

SEQ ID NO: 809001 - RNA, 13 nt, Homo sapiens
gugagaaguucau

SEQ ID NO: 809002 - RNA, 20 nt, Homo sapiens
gugagaaucaaaacucuccu

SEQ ID NO: 809003 - RNA, 17 nt, Homo sapiens
gugagaccccuucucaa

SEQ ID NO: 809004 - RNA, 23 nt, Homo sapiens
gugagagaaagagagaagccagc

SEQ ID NO: 809005 - RNA, 15 nt, Homo sapiens
gugagagaaucugcc

SEQ ID NO: 809006 - RNA, 19 nt, Homo sapiens
gugagaucggugcguucuc

SEQ ID NO: 809007 - RNA, 14 nt, Homo sapiens
gugagcaacugcga

SEQ ID NO: 809008 - RNA, 17 nt, Homo sapiens
gugagcaccugagcaug

SEQ ID NO: 809009 - RNA, 13 nt, Homo sapiens
gugagcacgcuga

SEQ ID NO: 809010 - RNA, 11 nt, Homo sapiens
gugagcacuag

SEQ ID NO: 809011 - RNA, 14 nt, Homo sapiens
gugagcaugagcuc

SEQ ID NO: 809012 - RNA, 15 nt, Homo sapiens
gugagccaagauugc

SEQ ID NO: 809013 - RNA, 13 nt, Homo sapiens
gugagcuaugcaa

SEQ ID NO: 809014 - RNA, 13 nt, Homo sapiens
gugagcucuggga

SEQ ID NO: 809015 - RNA, 15 nt, Homo sapiens
gugagcugagauugc

SEQ ID NO: 809016 - RNA, 14 nt, Homo sapiens
gugaggcuguaaag

SEQ ID NO: 809017 - RNA, 14 nt, Homo sapiens
gugaggggcaagcu

SEQ ID NO: 809018 - RNA, 17 nt, Homo sapiens
gugaggggcucucucau

SEQ ID NO: 809019 - RNA, 18 nt, Homo sapiens
gugaggugcugaugagug

SEQ ID NO: 809020 - RNA, 18 nt, Homo sapiens
gugaguaagagcuggugu

SEQ ID NO: 809021 - RNA, 13 nt, Homo sapiens
gugagucaccugc

SEQ ID NO: 809022 - RNA, 19 nt, Homo sapiens
gugaguccccuacucccuc

SEQ ID NO: 809023 - RNA, 16 nt, Homo sapiens
gugagucccugugaug

SEQ ID NO: 809024 - RNA, 16 nt, Homo sapiens
gugagugagacucugc

SEQ ID NO: 809025 - RNA, 23 nt, Homo sapiens
gugauacaacuucaagugcaugc

SEQ ID NO: 809026 - RNA, 19 nt, Homo sapiens
gugauauacugguucacau

SEQ ID NO: 809027 - RNA, 13 nt, Homo sapiens
gugauauaugcau

SEQ ID NO: 809028 - RNA, 15 nt, Homo sapiens
gugauauaugcaugu

SEQ ID NO: 809029 - RNA, 16 nt, Homo sapiens
gugauauucuaagacu

SEQ ID NO: 809030 - RNA, 22 nt, Homo sapiens
gugaucagaccauaauguuaca

SEQ ID NO: 809031 - RNA, 16 nt, Homo sapiens
gugauccgccuaccuc

SEQ ID NO: 809032 - RNA, 12 nt, Homo sapiens
gugaucucaggg

SEQ ID NO: 809033 - RNA, 18 nt, Homo sapiens
gugaucuugagaaccuuu

SEQ ID NO: 809034 - RNA, 14 nt, Homo sapiens
gugaucuuggcuca

SEQ ID NO: 809035 - RNA, 17 nt, Homo sapiens
gugaugaaaacauucaa

SEQ ID NO: 809036 - RNA, 16 nt, Homo sapiens
gugaugagagaaugga

SEQ ID NO: 809037 - RNA, 23 nt, Homo sapiens
gugauggagaugcagucacuuau

SEQ ID NO: 809038 - RNA, 21 nt, Homo sapiens
gugauguguccugauaagcug

SEQ ID NO: 809039 - RNA, 22 nt, Homo sapiens
uaaucagguccucagagaauuu

SEQ ID NO: 809040 - RNA, 22 nt, Homo sapiens
uaaucaucuaagucaguaccca

SEQ ID NO: 809041 - RNA, 20 nt, Homo sapiens
uaaucaugugggugagccag

SEQ ID NO: 809042 - RNA, 23 nt, Homo sapiens
uaaucauuuguuuacauuugaug

SEQ ID NO: 809043 - RNA, 18 nt, Homo sapiens
uaauccaauauuuugccu

SEQ ID NO: 809044 - RNA, 13 nt, Homo sapiens
uaauccacuuugc

SEQ ID NO: 809045 - RNA, 16 nt, Homo sapiens
uaauccagucuaucau

SEQ ID NO: 809046 - RNA, 17 nt, Homo sapiens
uaauccaucacuagcca

SEQ ID NO: 809047 - RNA, 17 nt, Homo sapiens
uaaucccaacacuuuga

SEQ ID NO: 809048 - RNA, 15 nt, Homo sapiens
uaaucccagcacuuu

SEQ ID NO: 809049 - RNA, 21 nt, Homo sapiens
uaaucccagcacuuuggcagg

SEQ ID NO: 809050 - RNA, 14 nt, Homo sapiens
uaaucccagcauuu

SEQ ID NO: 809051 - RNA, 14 nt, Homo sapiens
uaaucuaguuuaca

SEQ ID NO: 809052 - RNA, 17 nt, Homo sapiens
uaaucuauuauuuggag

SEQ ID NO: 809053 - RNA, 17 nt, Homo sapiens
uaaucucauaccucuga

SEQ ID NO: 809054 - RNA, 17 nt, Homo sapiens
uaaucucucugcagcug

SEQ ID NO: 809055 - RNA, 16 nt, Homo sapiens
uaaucugagaggccac

SEQ ID NO: 809056 - RNA, 18 nt, Homo sapiens
uaaucuucugccuucuca

SEQ ID NO: 809057 - RNA, 19 nt, Homo sapiens
uaaucuucuuaugcaauuu

SEQ ID NO: 809058 - RNA, 20 nt, Homo sapiens
uaaucuugcucugcuugaca

SEQ ID NO: 809059 - RNA, 23 nt, Homo sapiens
uaaugaaaaugaauaucuauuaa

SEQ ID NO: 809060 - RNA, 22 nt, Homo sapiens
uaaugaaagacuguacaaagua

SEQ ID NO: 809061 - RNA, 13 nt, Homo sapiens
uaaugaacaugug

SEQ ID NO: 809062 - RNA, 16 nt, Homo sapiens
uaaugaauacauuucc

SEQ ID NO: 809063 - RNA, 22 nt, Homo sapiens
uaaugaauuauaacaguuauau

SEQ ID NO: 809064 - RNA, 18 nt, Homo sapiens
uaaugaauuuuuaugaua

SEQ ID NO: 809065 - RNA, 19 nt, Homo sapiens
uaaugagaauuccuuagca

SEQ ID NO: 809066 - RNA, 22 nt, Homo sapiens
uaaugauuauauaaaauacaua

SEQ ID NO: 809067 - RNA, 14 nt, Homo sapiens
uaaugccucuucau

SEQ ID NO: 809068 - RNA, 19 nt, Homo sapiens
uaaugcucaacaauuuauc

SEQ ID NO: 809069 - RNA, 16 nt, Homo sapiens
uaaugcucugaccaag

SEQ ID NO: 809070 - RNA, 17 nt, Homo sapiens
uaauggcaauaggacau

SEQ ID NO: 809071 - RNA, 12 nt, Homo sapiens
uaauggcauuuu

SEQ ID NO: 809072 - RNA, 19 nt, Homo sapiens
uaauggguaugcucagguc

SEQ ID NO: 809073 - RNA, 18 nt, Homo sapiens
uaaugguuuuuaacaccu

SEQ ID NO: 809074 - RNA, 20 nt, Homo sapiens
uaaugguuuuuguuaguuca

SEQ ID NO: 809075 - RNA, 17 nt, Homo sapiens
uaauguauuaugagcca

SEQ ID NO: 809076 - RNA, 14 nt, Homo sapiens
uaaugucaccaccu

SEQ ID NO: 809077 - RNA, 23 nt, Homo sapiens
uaaugucuccuuugcucuugcca

SEQ ID NO: 809078 - RNA, 23 nt, Homo sapiens
uaaugucuuuaaaaguauccaga

SEQ ID NO: 809079 - RNA, 23 nt, Homo sapiens
uaaugugaaguagaauccuaaau

SEQ ID NO: 809080 - RNA, 18 nt, Homo sapiens
uaaugugcugagcauuuu

SEQ ID NO: 809081 - RNA, 16 nt, Homo sapiens
uaauguguauucauuu

SEQ ID NO: 809082 - RNA, 18 nt, Homo sapiens
uaauguguuaagugcagg

SEQ ID NO: 809083 - RNA, 15 nt, Homo sapiens
uaauguuauuuccac

SEQ ID NO: 809084 - RNA, 18 nt, Homo sapiens
uaauguugcccaguguga

SEQ ID NO: 809085 - RNA, 13 nt, Homo sapiens
uaauguugcuuag

SEQ ID NO: 809086 - RNA, 22 nt, Homo sapiens
uaauguuguaauucaugccagg

SEQ ID NO: 809087 - RNA, 16 nt, Homo sapiens
uaauguuuauuguuca

SEQ ID NO: 809088 - RNA, 22 nt, Homo sapiens
uaauuaaaaaaaaaacuucauu

SEQ ID NO: 809089 - RNA, 12 nt, Homo sapiens
uaauuaaaucca

SEQ ID NO: 809090 - RNA, 21 nt, Homo sapiens
uaauuaaauucugagccugau

SEQ ID NO: 809091 - RNA, 13 nt, Homo sapiens
uaauuaaguacaa

SEQ ID NO: 809092 - RNA, 18 nt, Homo sapiens
uaauuaaguacaaccaac

SEQ ID NO: 809093 - RNA, 17 nt, Homo sapiens
uaauuacauuggcacaa

SEQ ID NO: 809094 - RNA, 16 nt, Homo sapiens
uaauuaccaaccuguu

SEQ ID NO: 809095 - RNA, 13 nt, Homo sapiens
uacagaugaacuc

SEQ ID NO: 809096 - RNA, 16 nt, Homo sapiens
uacagcaacaauuuau

SEQ ID NO: 809097 - RNA, 14 nt, Homo sapiens
uacagcacuacucu

SEQ ID NO: 809098 - RNA, 23 nt, Homo sapiens
uacagcagaaaaucuuuuacuag

SEQ ID NO: 809099 - RNA, 10 nt, Homo sapiens
uacagcagca

SEQ ID NO: 809100 - RNA, 16 nt, Homo sapiens
uacagcaggugcucaa

SEQ ID NO: 809101 - RNA, 19 nt, Homo sapiens
uacagcaugacguaguauu

SEQ ID NO: 809102 - RNA, 20 nt, Homo sapiens
uacagcuuucugugcagaga

SEQ ID NO: 809103 - RNA, 17 nt, Homo sapiens
uacaggaaguaguucua

SEQ ID NO: 809104 - RNA, 13 nt, Homo sapiens
uacaggacuguaa

SEQ ID NO: 809105 - RNA, 19 nt, Homo sapiens
uacaggcaacaaugagcag

SEQ ID NO: 809106 - RNA, 18 nt, Homo sapiens
uacaggcucaugccauca

SEQ ID NO: 809107 - RNA, 14 nt, Homo sapiens
uacagggcuaggca

SEQ ID NO: 809108 - RNA, 21 nt, Homo sapiens
uacaggggccaaagccaggca

SEQ ID NO: 809109 - RNA, 20 nt, Homo sapiens
uacaggggcccgccaccaca

SEQ ID NO: 809110 - RNA, 14 nt, Homo sapiens
uacaggugaggcaa

SEQ ID NO: 809111 - RNA, 18 nt, Homo sapiens
uacagguuuuaaaagccu

SEQ ID NO: 809112 - RNA, 22 nt, Homo sapiens
uacaguaacaaauaaagugcag

SEQ ID NO: 809113 - RNA, 14 nt, Homo sapiens
uacagucaucugcc

SEQ ID NO: 809114 - RNA, 18 nt, Homo sapiens
uacagucugucaugaaca

SEQ ID NO: 809115 - RNA, 23 nt, Homo sapiens
uacagugaagaguaaguuuuccc

SEQ ID NO: 809116 - RNA, 22 nt, Homo sapiens
uacagugaugcugugcuaugaa

SEQ ID NO: 809117 - RNA, 11 nt, Homo sapiens
uacaguggaau

SEQ ID NO: 809118 - RNA, 17 nt, Homo sapiens
uacaguguccuaccacu

SEQ ID NO: 809119 - RNA, 17 nt, Homo sapiens
uacaguuacaguugaug

SEQ ID NO: 809120 - RNA, 20 nt, Homo sapiens
uacaguuugagacuuccaaa

SEQ ID NO: 809121 - RNA, 22 nt, Homo sapiens
uacauaaaguauccaugcaugu

SEQ ID NO: 809122 - RNA, 22 nt, Homo sapiens
uacauaacugaaaaugugcuau

SEQ ID NO: 809123 - RNA, 23 nt, Homo sapiens
uacauaacuuagagacuuuagag

SEQ ID NO: 809124 - RNA, 22 nt, Homo sapiens
uacauaauuaaauuuuaaugua

SEQ ID NO: 809125 - RNA, 19 nt, Homo sapiens
uacauaauugcuguucugc

SEQ ID NO: 809126 - RNA, 13 nt, Homo sapiens
uacauacugcugu

SEQ ID NO: 809127 - RNA, 13 nt, Homo sapiens
uacauagugaaaa

SEQ ID NO: 809128 - RNA, 19 nt, Homo sapiens
uacauauaucucugugucu

SEQ ID NO: 809129 - RNA, 17 nt, Homo sapiens
uacauaucccuuccaga

SEQ ID NO: 809130 - RNA, 15 nt, Homo sapiens
uacauaugagaauau

SEQ ID NO: 809131 - RNA, 21 nt, Homo sapiens
uacauaugagaauauaccuua

SEQ ID NO: 809132 - RNA, 15 nt, Homo sapiens
uacauauuacuguug

SEQ ID NO: 809133 - RNA, 23 nt, Homo sapiens
uacauauuccaugggacuuuccu

SEQ ID NO: 809134 - RNA, 17 nt, Homo sapiens
uacaucaaaaucuggca

SEQ ID NO: 809135 - RNA, 20 nt, Homo sapiens
uacauccagucacuuugcca

SEQ ID NO: 809136 - RNA, 14 nt, Homo sapiens
uacaucuaacucau

SEQ ID NO: 809137 - RNA, 15 nt, Homo sapiens
uacaucugcaauaug

SEQ ID NO: 809138 - RNA, 21 nt, Homo sapiens
uacaucugcaauaugaauuca

SEQ ID NO: 809139 - RNA, 23 nt, Homo sapiens
uacaucugcaauaugaauucaag

SEQ ID NO: 809140 - RNA, 19 nt, Homo sapiens
uacaucuuuucuaaucaca

SEQ ID NO: 809141 - RNA, 19 nt, Homo sapiens
uacaugaaauaaugcacug

SEQ ID NO: 809142 - RNA, 13 nt, Homo sapiens
uacaugcauuuga

SEQ ID NO: 809143 - RNA, 16 nt, Homo sapiens
uacauguaauuugaug

SEQ ID NO: 809144 - RNA, 15 nt, Homo sapiens
uacaugugcacauug

SEQ ID NO: 809145 - RNA, 13 nt, Homo sapiens
uacaugugccaug

SEQ ID NO: 809146 - RNA, 16 nt, Homo sapiens
uacauguguagccugu

SEQ ID NO: 809147 - RNA, 19 nt, Homo sapiens
uacauuaaaucacuugaau

SEQ ID NO: 809148 - RNA, 15 nt, Homo sapiens
uacauucaacagaga

SEQ ID NO: 809149 - RNA, 19 nt, Homo sapiens
uacauuccucagcugccaa

SEQ ID NO: 809150 - RNA, 19 nt, Homo sapiens
uacauucgugugugucugc

SEQ ID NO: 809151 - RNA, 20 nt, Homo sapiens
uacauucugcaagcacaucu

SEQ ID NO: 809152 - RNA, 20 nt, Homo sapiens
uacauucuuuaucuugacau

SEQ ID NO: 809153 - RNA, 23 nt, Homo sapiens
uacauugaucuuuugcuaaugca

SEQ ID NO: 809154 - RNA, 17 nt, Homo sapiens
uacauuggcacaaugua

SEQ ID NO: 809155 - RNA, 23 nt, Homo sapiens
uacauuguuugucugucuucaua

SEQ ID NO: 809156 - RNA, 13 nt, Homo sapiens
uacauuuaugcac

SEQ ID NO: 809157 - RNA, 17 nt, Homo sapiens
uacauuuaugcacauuc

SEQ ID NO: 809158 - RNA, 13 nt, Homo sapiens
uacauuucauuaa

SEQ ID NO: 809159 - RNA, 14 nt, Homo sapiens
uacauuucucauac

SEQ ID NO: 809160 - RNA, 14 nt, Homo sapiens
uacauuucugcaga

SEQ ID NO: 809161 - RNA, 22 nt, Homo sapiens
uacauuugaugcaugucuuuua

SEQ ID NO: 809162 - RNA, 16 nt, Homo sapiens
uacauuugugcuccau

SEQ ID NO: 809163 - RNA, 19 nt, Homo sapiens
uacauuuuauuaagcuuuu

SEQ ID NO: 809164 - RNA, 19 nt, Homo sapiens
uaccaaagcaucaauacaa

SEQ ID NO: 809165 - RNA, 15 nt, Homo sapiens
uaccaagccugccau

SEQ ID NO: 809166 - RNA, 23 nt, Homo sapiens
uaccaaguuuuauugucaagaca

SEQ ID NO: 809167 - RNA, 13 nt, Homo sapiens
uaccaaucauuuu

SEQ ID NO: 809168 - RNA, 14 nt, Homo sapiens
uaccaaucucugaa

SEQ ID NO: 809169 - RNA, 21 nt, Homo sapiens
uaccacaaggaaaauaguuua

SEQ ID NO: 809170 - RNA, 13 nt, Homo sapiens
uaccacacauauu

SEQ ID NO: 809171 - RNA, 12 nt, Homo sapiens
uaccacaguguc

SEQ ID NO: 809172 - RNA, 19 nt, Homo sapiens
uaccacaucugcucuaggg

SEQ ID NO: 809173 - RNA, 23 nt, Homo sapiens
uaccacuacuuagagauauguau

SEQ ID NO: 809174 - RNA, 15 nt, Homo sapiens
uaccacucuaaucaa

SEQ ID NO: 809175 - RNA, 19 nt, Homo sapiens
uaccacuugugauucaaac

SEQ ID NO: 809176 - RNA, 20 nt, Homo sapiens
uaccagacgguucaccagcc

SEQ ID NO: 809177 - RNA, 17 nt, Homo sapiens
uaccagagcgugcacuu

SEQ ID NO: 809178 - RNA, 17 nt, Homo sapiens
uaccaguauaagcaucu

SEQ ID NO: 809179 - RNA, 22 nt, Homo sapiens
uaccaguauaagcaucugccau

SEQ ID NO: 809180 - RNA, 13 nt, Homo sapiens
uaccagugugcuu

SEQ ID NO: 809181 - RNA, 17 nt, Homo sapiens
uaccaguuguucauuga

SEQ ID NO: 809182 - RNA, 19 nt, Homo sapiens
uaccauauucagcauuuga

SEQ ID NO: 809183 - RNA, 23 nt, Homo sapiens
uaccaucuuguauacacauauau

SEQ ID NO: 809184 - RNA, 14 nt, Homo sapiens
uaccauuuccucag

SEQ ID NO: 809185 - RNA, 16 nt, Homo sapiens
uacccacuggucugcu

SEQ ID NO: 809186 - RNA, 14 nt, Homo sapiens
uacccagacucaga

SEQ ID NO: 809187 - RNA, 18 nt, Homo sapiens
uacccaugcacaguacaa

SEQ ID NO: 809188 - RNA, 19 nt, Homo sapiens
uacccauuuacaaauaaga

SEQ ID NO: 809189 - RNA, 23 nt, Homo sapiens
uaccccaccacgauguggcccug

SEQ ID NO: 809190 - RNA, 17 nt, Homo sapiens
uaccccagucccaggga

SEQ ID NO: 809191 - RNA, 14 nt, Homo sapiens
uacccuauacaucc

SEQ ID NO: 809192 - RNA, 16 nt, Homo sapiens
uacccucccaccacuc

SEQ ID NO: 809193 - RNA, 15 nt, Homo sapiens
uaccgcccucggggc

SEQ ID NO: 809194 - RNA, 16 nt, Homo sapiens
uaccguguggcccaag

SEQ ID NO: 809195 - RNA, 15 nt, Homo sapiens
uaccuaauuguggau

SEQ ID NO: 809196 - RNA, 15 nt, Homo sapiens
uaccuaccacagugu

SEQ ID NO: 809197 - RNA, 19 nt, Homo sapiens
uaccuagcuggcucuguga

SEQ ID NO: 809198 - RNA, 17 nt, Homo sapiens
uaccuagggcacuuuaa

SEQ ID NO: 809199 - RNA, 22 nt, Homo sapiens
uaccuauacaauguauguaauu

SEQ ID NO: 809200 - RNA, 15 nt, Homo sapiens
uaccucaagacucac

SEQ ID NO: 809201 - RNA, 23 nt, Homo sapiens
uaccucacagagugcauugugag

SEQ ID NO: 809202 - RNA, 13 nt, Homo sapiens
uaccucaccuggg

SEQ ID NO: 809203 - RNA, 18 nt, Homo sapiens
uaccucacuaugcugcuu

SEQ ID NO: 809204 - RNA, 20 nt, Homo sapiens
uaccucauaguaucuucacu

SEQ ID NO: 809205 - RNA, 20 nt, Homo sapiens
uaccuccauccauccuucca

SEQ ID NO: 809206 - RNA, 21 nt, Homo sapiens
uaccuccauccauccuuccaa

SEQ ID NO: 809207 - RNA, 17 nt, Homo sapiens
uaccucuaaguacauau

SEQ ID NO: 809208 - RNA, 23 nt, Homo sapiens
uaccucuaaguacauauguagau

SEQ ID NO: 809209 - RNA, 19 nt, Homo sapiens
uaccucuagaaucccagca

SEQ ID NO: 809210 - RNA, 21 nt, Homo sapiens
uaccucugagaagacacaagg

SEQ ID NO: 809211 - RNA, 17 nt, Homo sapiens
uaccucugauaccucaa

SEQ ID NO: 809212 - RNA, 16 nt, Homo sapiens
uaccugagacuuaaga

SEQ ID NO: 809213 - RNA, 15 nt, Homo sapiens
uaccugaggccagga

SEQ ID NO: 809214 - RNA, 20 nt, Homo sapiens
uaccuggauguucuuuuuac

SEQ ID NO: 809215 - RNA, 14 nt, Homo sapiens
uaccugggaccuca

SEQ ID NO: 809216 - RNA, 17 nt, Homo sapiens
uaccugucauuuugcac

SEQ ID NO: 809217 - RNA, 20 nt, Homo sapiens
uaccuguggugauguugcca

SEQ ID NO: 809218 - RNA, 18 nt, Homo sapiens
uaccuuaagagacacucc

SEQ ID NO: 809219 - RNA, 22 nt, Homo sapiens
uaccuuccccacaucugagaga

SEQ ID NO: 809220 - RNA, 20 nt, Homo sapiens
uaccuuccccagacuugcac

SEQ ID NO: 809221 - RNA, 19 nt, Homo sapiens
uaccuugggggaaccugga

SEQ ID NO: 809222 - RNA, 15 nt, Homo sapiens
uaccuuucagugcag

SEQ ID NO: 809223 - RNA, 15 nt, Homo sapiens
uaccuuuccugaugc

SEQ ID NO: 809224 - RNA, 21 nt, Homo sapiens
uaccuuuuaauuaaugaaaua

SEQ ID NO: 809225 - RNA, 14 nt, Homo sapiens
uaccuuuuuugaua

SEQ ID NO: 809226 - RNA, 23 nt, Homo sapiens
uacgaaacacaaaccacaacuga

SEQ ID NO: 809227 - RNA, 13 nt, Homo sapiens
uacgcacauaccu

SEQ ID NO: 809228 - RNA, 21 nt, Homo sapiens
uacgcacuggagcugcacugc

SEQ ID NO: 809229 - RNA, 14 nt, Homo sapiens
uacgcaucagacag

SEQ ID NO: 809230 - RNA, 14 nt, Homo sapiens
uacgggggcuguga

SEQ ID NO: 809231 - RNA, 15 nt, Homo sapiens
uacgguuaugaaggc

SEQ ID NO: 809232 - RNA, 18 nt, Homo sapiens
uacgugagaaauagcuga

SEQ ID NO: 809233 - RNA, 20 nt, Homo sapiens
uacguucagaggugcagcug

SEQ ID NO: 809234 - RNA, 16 nt, Homo sapiens
uacuaaaaauacagaa

SEQ ID NO: 809235 - RNA, 14 nt, Homo sapiens
uacuaaaccucaca

SEQ ID NO: 809236 - RNA, 19 nt, Homo sapiens
uacuaaacuucaccuacau

SEQ ID NO: 809237 - RNA, 23 nt, Homo sapiens
uacuaaauguauuuuagacuucc

SEQ ID NO: 809238 - RNA, 19 nt, Homo sapiens
uacuaaauuuucuaauuaa

SEQ ID NO: 809239 - RNA, 18 nt, Homo sapiens
uacuaacauuuucauuga

SEQ ID NO: 809240 - RNA, 17 nt, Homo sapiens
uacuacccgagcccagc

SEQ ID NO: 809241 - RNA, 22 nt, Homo sapiens
uacuacccgagcccagcuacau

SEQ ID NO: 809242 - RNA, 14 nt, Homo sapiens
uacuaggugccuuu

SEQ ID NO: 809243 - RNA, 22 nt, Homo sapiens
uacuaguguguguguguauaua

SEQ ID NO: 809244 - RNA, 16 nt, Homo sapiens
uacuaguuuucaauca

SEQ ID NO: 809245 - RNA, 16 nt, Homo sapiens
uacuaguuuugcugaa

SEQ ID NO: 809246 - RNA, 16 nt, Homo sapiens
uacuaucacacaugaa

SEQ ID NO: 809247 - RNA, 15 nt, Homo sapiens
uacuaucauaauuca

SEQ ID NO: 809248 - RNA, 18 nt, Homo sapiens
uacuaugugccaguuccu

SEQ ID NO: 809249 - RNA, 22 nt, Homo sapiens
uacuauuaagcaagaaugcagu

SEQ ID NO: 809250 - RNA, 13 nt, Homo sapiens
uacucaacccauu

SEQ ID NO: 809251 - RNA, 13 nt, Homo sapiens
uacucaaguacca

SEQ ID NO: 809252 - RNA, 19 nt, Homo sapiens
uacucaaguaccaccaagg

SEQ ID NO: 809253 - RNA, 20 nt, Homo sapiens
uacucagcauuugauuaaca

SEQ ID NO: 809254 - RNA, 14 nt, Homo sapiens
uacucagcuuuuuc

SEQ ID NO: 809255 - RNA, 13 nt, Homo sapiens
uacucagugcuaa

SEQ ID NO: 809256 - RNA, 14 nt, Homo sapiens
uacuccagccuggg

SEQ ID NO: 809257 - RNA, 17 nt, Homo sapiens
uacuccccaacugaguu

SEQ ID NO: 809258 - RNA, 20 nt, Homo sapiens
uacucccucuucacuguggc

SEQ ID NO: 809259 - RNA, 20 nt, Homo sapiens
uacucccugcuaaagagugu

SEQ ID NO: 809260 - RNA, 19 nt, Homo sapiens
uacuccgugaggcugcugc

SEQ ID NO: 809261 - RNA, 16 nt, Homo sapiens
uacuccuuccaucaaa

SEQ ID NO: 809262 - RNA, 13 nt, Homo sapiens
uacucgucuuccu

SEQ ID NO: 809263 - RNA, 15 nt, Homo sapiens
uacucucaugcugca

SEQ ID NO: 809264 - RNA, 22 nt, Homo sapiens
uacucugaagggcaucaugcau

SEQ ID NO: 809265 - RNA, 14 nt, Homo sapiens
uacucuguccaggc

SEQ ID NO: 809266 - RNA, 23 nt, Homo sapiens
uacucuuccgauguuugugucac

SEQ ID NO: 809267 - RNA, 18 nt, Homo sapiens
ccacgucccugcacucuc

SEQ ID NO: 809268 - RNA, 18 nt, Homo sapiens
ccacguggggcucacuuu

SEQ ID NO: 809269 - RNA, 19 nt, Homo sapiens
ccacguucucacacccacc

SEQ ID NO: 809270 - RNA, 15 nt, Homo sapiens
ccacuaaaauacaua

SEQ ID NO: 809271 - RNA, 14 nt, Homo sapiens
ccacuaagaauuca

SEQ ID NO: 809272 - RNA, 21 nt, Homo sapiens
ccacuaccagccagccucaga

SEQ ID NO: 809273 - RNA, 20 nt, Homo sapiens
ccacuagaagcaacuaggaa

SEQ ID NO: 809274 - RNA, 20 nt, Homo sapiens
ccacuaggaucccacuggcg

SEQ ID NO: 809275 - RNA, 18 nt, Homo sapiens
ccacuaucccaaucaaag

SEQ ID NO: 809276 - RNA, 11 nt, Homo sapiens
ccacucaggcc

SEQ ID NO: 809277 - RNA, 15 nt, Homo sapiens
ccacucaguugcaac

SEQ ID NO: 809278 - RNA, 23 nt, Homo sapiens
ccacucccagauggcucuuucua

SEQ ID NO: 809279 - RNA, 15 nt, Homo sapiens
ccacucccuuugcca

SEQ ID NO: 809280 - RNA, 15 nt, Homo sapiens
ccacuccuguuccuu

SEQ ID NO: 809281 - RNA, 19 nt, Homo sapiens
ccacucugauucaccucuu

SEQ ID NO: 809282 - RNA, 16 nt, Homo sapiens
ccacucuguaauaguu

SEQ ID NO: 809283 - RNA, 18 nt, Homo sapiens
ccacugaagcaccacagg

SEQ ID NO: 809284 - RNA, 12 nt, Homo sapiens
ccacugaccaga

SEQ ID NO: 809285 - RNA, 20 nt, Homo sapiens
ccacugaucucuacuaccac

SEQ ID NO: 809286 - RNA, 22 nt, Homo sapiens
ccacugcacuccagucuggcaa

SEQ ID NO: 809287 - RNA, 21 nt, Homo sapiens
ccacugcccccugcugccaug

SEQ ID NO: 809288 - RNA, 22 nt, Homo sapiens
ccacugccuuuucucacucaga

SEQ ID NO: 809289 - RNA, 14 nt, Homo sapiens
ccacuggacuugag

SEQ ID NO: 809290 - RNA, 20 nt, Homo sapiens
ccacuggcuuuugccuguaa

SEQ ID NO: 809291 - RNA, 18 nt, Homo sapiens
ccacugggucucacuccu

SEQ ID NO: 809292 - RNA, 19 nt, Homo sapiens
ccacuuaaaaaauguccau

SEQ ID NO: 809293 - RNA, 13 nt, Homo sapiens
ccacuucaccccc

SEQ ID NO: 809294 - RNA, 15 nt, Homo sapiens
ccacuucauccccuc

SEQ ID NO: 809295 - RNA, 21 nt, Homo sapiens
ccacuucuaugcaaaugccuc

SEQ ID NO: 809296 - RNA, 18 nt, Homo sapiens
ccacuucuccaugcugca

SEQ ID NO: 809297 - RNA, 15 nt, Homo sapiens
ccacuugaagcacuu

SEQ ID NO: 809298 - RNA, 14 nt, Homo sapiens
ccacuuguucugua

SEQ ID NO: 809299 - RNA, 17 nt, Homo sapiens
ccacuuucugccagcau

SEQ ID NO: 809300 - RNA, 23 nt, Homo sapiens
ccacuuucugccagcaucugcag

SEQ ID NO: 809301 - RNA, 15 nt, Homo sapiens
ccacuuugcucugaa

SEQ ID NO: 809302 - RNA, 17 nt, Homo sapiens
ccagaaaaccuccagua

SEQ ID NO: 809303 - RNA, 20 nt, Homo sapiens
ccagaaaaccucuccugacc

SEQ ID NO: 809304 - RNA, 16 nt, Homo sapiens
ugaaaagggcacuccc

SEQ ID NO: 809305 - RNA, 17 nt, Homo sapiens
ugaaaaguuacuaccug

SEQ ID NO: 809306 - RNA, 16 nt, Homo sapiens
ugaaaauaauguugua

SEQ ID NO: 809307 - RNA, 21 nt, Homo sapiens
ugaaaauaguguaagaacugu

SEQ ID NO: 809308 - RNA, 17 nt, Homo sapiens
ugaaaauauuuguauca

SEQ ID NO: 809309 - RNA, 23 nt, Homo sapiens
ugaaaauauuuguccaauugagu

SEQ ID NO: 809310 - RNA, 19 nt, Homo sapiens
ugaaaauauuuuguugccu

SEQ ID NO: 809311 - RNA, 14 nt, Homo sapiens
ugaaaaugaaagga

SEQ ID NO: 809312 - RNA, 22 nt, Homo sapiens
ugaaaaugcaucacaugaugaa

SEQ ID NO: 809313 - RNA, 11 nt, Homo sapiens
ugaaaauugca

SEQ ID NO: 809314 - RNA, 14 nt, Homo sapiens
ugaaaauugcaaua

SEQ ID NO: 809315 - RNA, 20 nt, Homo sapiens
ugaaaauugucuucuucugu

SEQ ID NO: 809316 - RNA, 23 nt, Homo sapiens
ugaaaauuuauuuuuagugauaa

SEQ ID NO: 809317 - RNA, 17 nt, Homo sapiens
ugaaacaaauaaucaca

SEQ ID NO: 809318 - RNA, 21 nt, Homo sapiens
ugaaacaagcaacagauggau

SEQ ID NO: 809319 - RNA, 13 nt, Homo sapiens
ugaaacacagcug

SEQ ID NO: 809320 - RNA, 21 nt, Homo sapiens
ugaaacauggcuguguuugca

SEQ ID NO: 809321 - RNA, 15 nt, Homo sapiens
ugaaaccccaucucu

SEQ ID NO: 809322 - RNA, 16 nt, Homo sapiens
ugaaacccuguaucua

SEQ ID NO: 809323 - RNA, 18 nt, Homo sapiens
ugaaaccuacacacuguc

SEQ ID NO: 809324 - RNA, 21 nt, Homo sapiens
ugaaaccuccuauuccaugcg

SEQ ID NO: 809325 - RNA, 21 nt, Homo sapiens
ugaaaccuuauuuuuucccaa

SEQ ID NO: 809326 - RNA, 23 nt, Homo sapiens
ugaaacuaacagauaagcaagag

SEQ ID NO: 809327 - RNA, 11 nt, Homo sapiens
ugaaacuaaga

SEQ ID NO: 809328 - RNA, 20 nt, Homo sapiens
ugaaacuagaagagauuucu

SEQ ID NO: 809329 - RNA, 20 nt, Homo sapiens
ugaaacuauuuuaccugaac

SEQ ID NO: 809330 - RNA, 19 nt, Homo sapiens
ugaaacugaaagcacauga

SEQ ID NO: 809331 - RNA, 18 nt, Homo sapiens
ugaaacuguccaccaaga

SEQ ID NO: 809332 - RNA, 23 nt, Homo sapiens
ugaaacuuguuuauuauguacaa

SEQ ID NO: 809333 - RNA, 23 nt, Homo sapiens
ugaaagaaaaauaccaugucucu

SEQ ID NO: 809334 - RNA, 17 nt, Homo sapiens
ugaaagaaccaaaagag

SEQ ID NO: 809335 - RNA, 14 nt, Homo sapiens
ugaaagaaccagag

SEQ ID NO: 809336 - RNA, 17 nt, Homo sapiens
ugaaagaaucagucuug

SEQ ID NO: 809337 - RNA, 17 nt, Homo sapiens
ugaaagacaucaaugaa

SEQ ID NO: 809338 - RNA, 22 nt, Homo sapiens
ugaaagagcaagugacuuucua

SEQ ID NO: 809339 - RNA, 11 nt, Homo sapiens
ugaaagaucuu

SEQ ID NO: 809340 - RNA, 15 nt, Homo sapiens
ugaaagcacaugaau

SEQ ID NO: 809341 - RNA, 10 nt, Homo sapiens
ugaaagcaga

SEQ ID NO: 809342 - RNA, 21 nt, Homo sapiens
ugaaagcaggaugaauuuucu

SEQ ID NO: 809343 - RNA, 20 nt, Homo sapiens
ugaaagcugauuacugucaa

SEQ ID NO: 809344 - RNA, 21 nt, Homo sapiens
ugaaagcuuuauacaguugaa

SEQ ID NO: 809345 - RNA, 17 nt, Homo sapiens
ugaaaggacccugugag

SEQ ID NO: 809346 - RNA, 17 nt, Homo sapiens
ugaaaggcauucucuga

SEQ ID NO: 809347 - RNA, 16 nt, Homo sapiens
ugaaagggaaacuggg

SEQ ID NO: 809348 - RNA, 16 nt, Homo sapiens
ugaaagguuaauucuc

SEQ ID NO: 809349 - RNA, 15 nt, Homo sapiens
ugaaucugcucacuu

SEQ ID NO: 809350 - RNA, 12 nt, Homo sapiens
ugaaucuucacg

SEQ ID NO: 809351 - RNA, 11 nt, Homo sapiens
ugaaugaauaa

SEQ ID NO: 809352 - RNA, 14 nt, Homo sapiens
ugaaugauaaacuc

SEQ ID NO: 809353 - RNA, 18 nt, Homo sapiens
ugaaugcacacuagccuc

SEQ ID NO: 809354 - RNA, 19 nt, Homo sapiens
ugaaugcagaagcgcucca

SEQ ID NO: 809355 - RNA, 15 nt, Homo sapiens
ugaaugcagggaaug

SEQ ID NO: 809356 - RNA, 18 nt, Homo sapiens
ugaaugcccucacuauug

SEQ ID NO: 809357 - RNA, 19 nt, Homo sapiens
ugaaugccuaugguggauc

SEQ ID NO: 809358 - RNA, 16 nt, Homo sapiens
ugaaugcuccagucaa

SEQ ID NO: 809359 - RNA, 16 nt, Homo sapiens
ugaaugcugccacaac

SEQ ID NO: 809360 - RNA, 16 nt, Homo sapiens
ugaaugguuccaugcc

SEQ ID NO: 809361 - RNA, 19 nt, Homo sapiens
ugaaugugccuaauggaga

SEQ ID NO: 809362 - RNA, 16 nt, Homo sapiens
ugaaugugcuggugaa

SEQ ID NO: 809363 - RNA, 17 nt, Homo sapiens
ugaauguuagacucugg

SEQ ID NO: 809364 - RNA, 14 nt, Homo sapiens
ugaauuaagccauc

SEQ ID NO: 809365 - RNA, 22 nt, Homo sapiens
ugaauuaugauggucugcauua

SEQ ID NO: 809366 - RNA, 17 nt, Homo sapiens
ugaauuauugacacuga

SEQ ID NO: 809367 - RNA, 14 nt, Homo sapiens
ugaauucacuuaag

SEQ ID NO: 809368 - RNA, 15 nt, Homo sapiens
ugaauucauaucgcc

SEQ ID NO: 809369 - RNA, 14 nt, Homo sapiens
ugaauuccauggaa

SEQ ID NO: 809370 - RNA, 13 nt, Homo sapiens
ugaauugccaggg

SEQ ID NO: 809371 - RNA, 23 nt, Homo sapiens
ugaauuguuaauucacagaauag

SEQ ID NO: 809372 - RNA, 21 nt, Homo sapiens
ugaauuuacuuccuugcaugu

SEQ ID NO: 809373 - RNA, 21 nt, Homo sapiens
ugaauuuguauuaaaaagccu

SEQ ID NO: 809374 - RNA, 17 nt, Homo sapiens
ugaauuuucaaguaauu

SEQ ID NO: 809375 - RNA, 14 nt, Homo sapiens
ugaauuuucagaga

SEQ ID NO: 809376 - RNA, 16 nt, Homo sapiens
ugaauuuuuaugauau

SEQ ID NO: 809377 - RNA, 15 nt, Homo sapiens
ugacaaaccauuucc

SEQ ID NO: 809378 - RNA, 15 nt, Homo sapiens
ugacaaaggaugaag

SEQ ID NO: 809379 - RNA, 20 nt, Homo sapiens
ugacaaaugcccugcaccua

SEQ ID NO: 809380 - RNA, 15 nt, Homo sapiens
ugacaauaauuucag

SEQ ID NO: 809381 - RNA, 18 nt, Homo sapiens
ugacaaucaacucuaaua

SEQ ID NO: 809382 - RNA, 23 nt, Homo sapiens
ugacacaguuaucaaaaaguauu

SEQ ID NO: 809383 - RNA, 15 nt, Homo sapiens
ugacacauaugcacc

SEQ ID NO: 809384 - RNA, 24 nt, Homo sapiens
ugacaccauucuccugccucaccc

SEQ ID NO: 809385 - RNA, 14 nt, Homo sapiens
ugacacccagucau

SEQ ID NO: 809386 - RNA, 21 nt, Homo sapiens
ugacacccagucauccagcag

SEQ ID NO: 809387 - RNA, 11 nt, Homo sapiens
ugacacgcagc

SEQ ID NO: 809388 - RNA, 18 nt, Homo sapiens
ugacacgucugccuaccc

SEQ ID NO: 809389 - RNA, 10 nt, Homo sapiens
ugacacugaa

SEQ ID NO: 809390 - RNA, 15 nt, Homo sapiens
ugacacugcucuaac

SEQ ID NO: 809391 - RNA, 12 nt, Homo sapiens
ugacagaacaag

SEQ ID NO: 809392 - RNA, 17 nt, Homo sapiens
ugacagaaggugccacu

SEQ ID NO: 809393 - RNA, 17 nt, Homo sapiens
ugacagaauauguuuca

SEQ ID NO: 809394 - RNA, 19 nt, Homo sapiens
ugacagacaggcucuuagc

SEQ ID NO: 809395 - RNA, 16 nt, Homo sapiens
ugacagagacccagau

SEQ ID NO: 809396 - RNA, 22 nt, Homo sapiens
ugacagagcgagacuccaucuc

SEQ ID NO: 809397 - RNA, 22 nt, Homo sapiens
ugacagagugagacccugucuc

SEQ ID NO: 809398 - RNA, 19 nt, Homo sapiens
ugacagaguucacuauaaa

SEQ ID NO: 809399 - RNA, 12 nt, Homo sapiens
ugacagccagag

SEQ ID NO: 809400 - RNA, 22 nt, Homo sapiens
ugacagcugaccuuugucaucu

SEQ ID NO: 809401 - RNA, 12 nt, Homo sapiens
ugacaguauauu

SEQ ID NO: 809402 - RNA, 17 nt, Homo sapiens
ugacaguccacaggggc

SEQ ID NO: 809403 - RNA, 14 nt, Homo sapiens
ugacagugccucuu

SEQ ID NO: 809404 - RNA, 13 nt, Homo sapiens
ugacauacauauu

SEQ ID NO: 809405 - RNA, 16 nt, Homo sapiens
ugacauacauccaaca

SEQ ID NO: 809406 - RNA, 18 nt, Homo sapiens
ugacauccccacccuugg

SEQ ID NO: 809407 - RNA, 16 nt, Homo sapiens
ugacaucuugcacggu

SEQ ID NO: 809408 - RNA, 16 nt, Homo sapiens
ugacaugagauuuaua

SEQ ID NO: 809409 - RNA, 15 nt, Homo sapiens
ugacauggcaaguca

SEQ ID NO: 809410 - RNA, 18 nt, Homo sapiens
ugacauuagcauuguggu

SEQ ID NO: 809411 - RNA, 17 nt, Homo sapiens
ugacauugcuuuacugu

SEQ ID NO: 809412 - RNA, 11 nt, Homo sapiens
ugacauuuuau

SEQ ID NO: 809413 - RNA, 20 nt, Homo sapiens
ugaccaaaacaaacaaacag

SEQ ID NO: 809414 - RNA, 10 nt, Homo sapiens
ugaccaaaua

SEQ ID NO: 809415 - RNA, 15 nt, Homo sapiens
ugaccaagaacugca

SEQ ID NO: 809416 - RNA, 16 nt, Homo sapiens
ugaccaagaacugcau

SEQ ID NO: 809417 - RNA, 22 nt, Homo sapiens
ugaccaagacagguucagguag

SEQ ID NO: 809418 - RNA, 16 nt, Homo sapiens
ugaccaagcaucuuug

SEQ ID NO: 809419 - RNA, 14 nt, Homo sapiens
uuuucucaugauga

SEQ ID NO: 809420 - RNA, 21 nt, Homo sapiens
uuuucuccugccugugcugug

SEQ ID NO: 809421 - RNA, 15 nt, Homo sapiens
uuuucucugugcuuc

SEQ ID NO: 809422 - RNA, 16 nt, Homo sapiens
uuuucucugugcuuca

SEQ ID NO: 809423 - RNA, 18 nt, Homo sapiens
uuuucucuuguaccauag

SEQ ID NO: 809424 - RNA, 15 nt, Homo sapiens
uuuucugaauucaua

SEQ ID NO: 809425 - RNA, 15 nt, Homo sapiens
uuuucugauaaaaga

SEQ ID NO: 809426 - RNA, 11 nt, Homo sapiens
uuuucugcuaa

SEQ ID NO: 809427 - RNA, 22 nt, Homo sapiens
uuuucugcuaaaaaguccuuga

SEQ ID NO: 809428 - RNA, 20 nt, Homo sapiens
uuuucuguaaauaaccuauu

SEQ ID NO: 809429 - RNA, 14 nt, Homo sapiens
uuuucugugccuga

SEQ ID NO: 809430 - RNA, 15 nt, Homo sapiens
uuuucuugccaauga

SEQ ID NO: 809431 - RNA, 19 nt, Homo sapiens
uuuucuugccuugguuguc

SEQ ID NO: 809432 - RNA, 17 nt, Homo sapiens
uuuucuuugagucuguu

SEQ ID NO: 809433 - RNA, 22 nt, Homo sapiens
uuuucuuuuaagcuauccacag

SEQ ID NO: 809434 - RNA, 17 nt, Homo sapiens
uuuucuuuuuuaucuug

SEQ ID NO: 809435 - RNA, 13 nt, Homo sapiens
uuuugaaaguaau

SEQ ID NO: 809436 - RNA, 15 nt, Homo sapiens
uuuugaacagaacug

SEQ ID NO: 809437 - RNA, 18 nt, Homo sapiens
uuuugacaucagcauuag

SEQ ID NO: 809438 - RNA, 23 nt, Homo sapiens
uuuugaccaaauaaaguaccauu

SEQ ID NO: 809439 - RNA, 21 nt, Homo sapiens
uuuugaccagugaaacuauga

SEQ ID NO: 809440 - RNA, 13 nt, Homo sapiens
uuuugagacagag

SEQ ID NO: 809441 - RNA, 21 nt, Homo sapiens
uuuugaggaauuaucauggga

SEQ ID NO: 809442 - RNA, 14 nt, Homo sapiens
uuuugaggagcugg

SEQ ID NO: 809443 - RNA, 11 nt, Homo sapiens
uuuugauugcc

SEQ ID NO: 809444 - RNA, 12 nt, Homo sapiens
uuuugcauaaaa

SEQ ID NO: 809445 - RNA, 21 nt, Homo sapiens
uuuugccaguauuaugcauau

SEQ ID NO: 809446 - RNA, 17 nt, Homo sapiens
uuuugccauaaugacuc

SEQ ID NO: 809447 - RNA, 18 nt, Homo sapiens
uuuugccucaccuaauag

SEQ ID NO: 809448 - RNA, 15 nt, Homo sapiens
uuuugccugcaagag

SEQ ID NO: 809449 - RNA, 15 nt, Homo sapiens
uuuugcuacauucua

SEQ ID NO: 809450 - RNA, 11 nt, Homo sapiens
uuuugcugcua

SEQ ID NO: 809451 - RNA, 22 nt, Homo sapiens
uuuugcugucuuucucuaaaua

SEQ ID NO: 809452 - RNA, 12 nt, Homo sapiens
uuuuggcuuuau

SEQ ID NO: 809453 - RNA, 22 nt, Homo sapiens
uuuugggcuuucauaguguuca

SEQ ID NO: 809454 - RNA, 18 nt, Homo sapiens
uuuuggucauagcauuca

SEQ ID NO: 809455 - RNA, 16 nt, Homo sapiens
uuuuguacugaaucuc

SEQ ID NO: 809456 - RNA, 11 nt, Homo sapiens
uuuuguacuuu

SEQ ID NO: 809457 - RNA, 20 nt, Homo sapiens
uuuuguauuguuuucugaca

SEQ ID NO: 809458 - RNA, 15 nt, Homo sapiens
uuuugugaagccaug

SEQ ID NO: 809459 - RNA, 17 nt, Homo sapiens
uuuugugaaguauucac

SEQ ID NO: 809460 - RNA, 17 nt, Homo sapiens
uuuugugcaaagccaaa

SEQ ID NO: 809461 - RNA, 12 nt, Homo sapiens
uuuuguguccuc

SEQ ID NO: 809462 - RNA, 17 nt, Homo sapiens
uuuuguucauacauauu

SEQ ID NO: 809463 - RNA, 18 nt, Homo sapiens
uuuuguucuacaugagga

SEQ ID NO: 809464 - RNA, 17 nt, Homo sapiens
uuuuguucucaacuuca

SEQ ID NO: 809465 - RNA, 13 nt, Homo sapiens
uggccuacaguca

SEQ ID NO: 809466 - RNA, 20 nt, Homo sapiens
uggccuaggcuaccucaaga

SEQ ID NO: 809467 - RNA, 13 nt, Homo sapiens
uggccuaugcaca

SEQ ID NO: 809468 - RNA, 18 nt, Homo sapiens
uggccuaugcacauaugg

SEQ ID NO: 809469 - RNA, 13 nt, Homo sapiens
uggccuccaaaau

SEQ ID NO: 809470 - RNA, 19 nt, Homo sapiens
uggccugcugggcucucca

SEQ ID NO: 809471 - RNA, 19 nt, Homo sapiens
uggccugggaucuggcaca

SEQ ID NO: 809472 - RNA, 15 nt, Homo sapiens
uggccuuacacugaa

SEQ ID NO: 809473 - RNA, 14 nt, Homo sapiens
uggccuuguaagac

SEQ ID NO: 809474 - RNA, 18 nt, Homo sapiens
uggcgcauauuaagcacu

SEQ ID NO: 809475 - RNA, 21 nt, Homo sapiens
uggcgcgggaggcaccagcuc

SEQ ID NO: 809476 - RNA, 16 nt, Homo sapiens
uggcgguggaccaaag

SEQ ID NO: 809477 - RNA, 14 nt, Homo sapiens
uggcuaacacguga

SEQ ID NO: 809478 - RNA, 14 nt, Homo sapiens
uggcuaacuggcga

SEQ ID NO: 809479 - RNA, 15 nt, Homo sapiens
uggcuaagauaccaa

SEQ ID NO: 809480 - RNA, 15 nt, Homo sapiens
uggcuaagcauuuau

SEQ ID NO: 809481 - RNA, 18 nt, Homo sapiens
uggcuacacacaaaccag

SEQ ID NO: 809482 - RNA, 21 nt, Homo sapiens
uggcuaccgaaguaaacugau

SEQ ID NO: 809483 - RNA, 18 nt, Homo sapiens
uggcuacuucccuuccuc

SEQ ID NO: 809484 - RNA, 16 nt, Homo sapiens
uggcuagauguuuaca

SEQ ID NO: 809485 - RNA, 15 nt, Homo sapiens
uggcuauaaauauau

SEQ ID NO: 809486 - RNA, 12 nt, Homo sapiens
uggcuauaccug

SEQ ID NO: 809487 - RNA, 16 nt, Homo sapiens
uggcucaacauugugu

SEQ ID NO: 809488 - RNA, 16 nt, Homo sapiens
uggcucacacugagaa

SEQ ID NO: 809489 - RNA, 13 nt, Homo sapiens
uggcucacuacug

SEQ ID NO: 809490 - RNA, 20 nt, Homo sapiens
uggcucacuacugaacacau

SEQ ID NO: 809491 - RNA, 14 nt, Homo sapiens
uggcucaucucuuu

SEQ ID NO: 809492 - RNA, 17 nt, Homo sapiens
uggcucaugucuauaau

SEQ ID NO: 809493 - RNA, 15 nt, Homo sapiens
uggcucccaggacac

SEQ ID NO: 809494 - RNA, 22 nt, Homo sapiens
uggcucccauucacucuuccag

SEQ ID NO: 809495 - RNA, 17 nt, Homo sapiens
uggcuccccaaagggug

SEQ ID NO: 809496 - RNA, 13 nt, Homo sapiens
uggcucucagagg

SEQ ID NO: 809497 - RNA, 13 nt, Homo sapiens
uggcucugggaau

SEQ ID NO: 809498 - RNA, 20 nt, Homo sapiens
uggcucuugaggcauuucca

SEQ ID NO: 809499 - RNA, 22 nt, Homo sapiens
uggcucuugaggcauuuccaga

SEQ ID NO: 809500 - RNA, 17 nt, Homo sapiens
uggcugacuggcaguaa

SEQ ID NO: 809501 - RNA, 19 nt, Homo sapiens
uggcugagccuggcuggag

SEQ ID NO: 809502 - RNA, 13 nt, Homo sapiens
uggcugcccagga

SEQ ID NO: 809503 - RNA, 14 nt, Homo sapiens
uggcugccuuagaa

SEQ ID NO: 809504 - RNA, 12 nt, Homo sapiens
uggcugccuugu

SEQ ID NO: 809505 - RNA, 20 nt, Homo sapiens
uggcugcugucauaacaucc

SEQ ID NO: 809506 - RNA, 21 nt, Homo sapiens
uggcugggaauaagugccagg

SEQ ID NO: 809507 - RNA, 14 nt, Homo sapiens
uggcugggcccagc

SEQ ID NO: 809508 - RNA, 18 nt, Homo sapiens
uggcugggcuggcugaag

SEQ ID NO: 809509 - RNA, 19 nt, Homo sapiens
uggcugguaacaguucaug

SEQ ID NO: 809510 - RNA, 15 nt, Homo sapiens
uggcugugaaauuca

SEQ ID NO: 809511 - RNA, 23 nt, Homo sapiens
uggcugugcccagcaggcccagc

SEQ ID NO: 809512 - RNA, 16 nt, Homo sapiens
uggcuuaaauccaguu

SEQ ID NO: 809513 - RNA, 21 nt, Homo sapiens
uggcuuaauguuuauuccuga

SEQ ID NO: 809514 - RNA, 14 nt, Homo sapiens
uggcuuagugccac

SEQ ID NO: 809515 - RNA, 21 nt, Homo sapiens
uggcuucaccaucaauccuga

SEQ ID NO: 809516 - RNA, 18 nt, Homo sapiens
uggcuucugcuugucauc

SEQ ID NO: 809517 - RNA, 14 nt, Homo sapiens
uggcuucugugaug

SEQ ID NO: 809518 - RNA, 19 nt, Homo sapiens
uggcuuguuugauuucaac

SEQ ID NO: 809519 - RNA, 18 nt, Homo sapiens
uggcuuuagcuaccucac

SEQ ID NO: 809520 - RNA, 20 nt, Homo sapiens
uggcuuuaguggccaucauu

SEQ ID NO: 809521 - RNA, 17 nt, Homo sapiens
uggcuuuaugcaaauac

SEQ ID NO: 809522 - RNA, 22 nt, Homo sapiens
uggcuuuaugcaaauacaauca

SEQ ID NO: 809523 - RNA, 21 nt, Homo sapiens
uggcuuugaaugcggcccaac

SEQ ID NO: 809524 - RNA, 20 nt, Homo sapiens
uggcuuuggugaacuguugg

SEQ ID NO: 809525 - RNA, 22 nt, Homo sapiens
uggcuuuguuuuuugugcuauu

SEQ ID NO: 809526 - RNA, 19 nt, Homo sapiens
ugggaaaugagaacauucc

SEQ ID NO: 809527 - RNA, 18 nt, Homo sapiens
ugggaagaccagcuuugc

SEQ ID NO: 809528 - RNA, 23 nt, Homo sapiens
ugggaauggggacacggugucca

SEQ ID NO: 809529 - RNA, 17 nt, Homo sapiens
uacucuugagagcucag

SEQ ID NO: 809530 - RNA, 20 nt, Homo sapiens
uacucuuucugcuuacaaag

SEQ ID NO: 809531 - RNA, 24 nt, Homo sapiens
uacucuuucugcuuacaaagacaa

SEQ ID NO: 809532 - RNA, 18 nt, Homo sapiens
uacugaaggaaaaacaca

SEQ ID NO: 809533 - RNA, 20 nt, Homo sapiens
uacugaaucugcuaccaaaa

SEQ ID NO: 809534 - RNA, 20 nt, Homo sapiens
uacugacagaggcucacuga

SEQ ID NO: 809535 - RNA, 12 nt, Homo sapiens
uacugacugaga

SEQ ID NO: 809536 - RNA, 14 nt, Homo sapiens
uacugacugagaua

SEQ ID NO: 809537 - RNA, 15 nt, Homo sapiens
uacugacuguagcca

SEQ ID NO: 809538 - RNA, 17 nt, Homo sapiens
uacugaucuuuguauau

SEQ ID NO: 809539 - RNA, 14 nt, Homo sapiens
uacugauucacugc

SEQ ID NO: 809540 - RNA, 22 nt, Homo sapiens
uacugcacccagcagugucacu

SEQ ID NO: 809541 - RNA, 21 nt, Homo sapiens
uacugcacuuucccccuuccc

SEQ ID NO: 809542 - RNA, 16 nt, Homo sapiens
uacugcagcaccucca

SEQ ID NO: 809543 - RNA, 13 nt, Homo sapiens
uacugccauguac

SEQ ID NO: 809544 - RNA, 14 nt, Homo sapiens
uacugcucugagaa

SEQ ID NO: 809545 - RNA, 14 nt, Homo sapiens
uacuggacucagga

SEQ ID NO: 809546 - RNA, 22 nt, Homo sapiens
uacugggacaccauuaccaaaa

SEQ ID NO: 809547 - RNA, 21 nt, Homo sapiens
uacuguacccucgcaugacug

SEQ ID NO: 809548 - RNA, 22 nt, Homo sapiens
uacugucugggauuaagggcaa

SEQ ID NO: 809549 - RNA, 19 nt, Homo sapiens
uacugugagcuuacauuga

SEQ ID NO: 809550 - RNA, 23 nt, Homo sapiens
uacuguggucugggcaccaccuc

SEQ ID NO: 809551 - RNA, 16 nt, Homo sapiens
uacuguucagcuuuua

SEQ ID NO: 809552 - RNA, 23 nt, Homo sapiens
uacuguuuugggccuccaugccc

SEQ ID NO: 809553 - RNA, 19 nt, Homo sapiens
uacuuaaaaauagucuucc

SEQ ID NO: 809554 - RNA, 20 nt, Homo sapiens
uacuuaaaaauagucuucca

SEQ ID NO: 809555 - RNA, 14 nt, Homo sapiens
uacuuaaacuucca

SEQ ID NO: 809556 - RNA, 22 nt, Homo sapiens
uacuuaaguugucgaacaguag

SEQ ID NO: 809557 - RNA, 16 nt, Homo sapiens
uacuuaauacuaggau

SEQ ID NO: 809558 - RNA, 14 nt, Homo sapiens
uacuuaaugcauau

SEQ ID NO: 809559 - RNA, 15 nt, Homo sapiens
uacuuaauucagucu

SEQ ID NO: 809560 - RNA, 18 nt, Homo sapiens
uacuuagcagcuaucucu

SEQ ID NO: 809561 - RNA, 18 nt, Homo sapiens
uacuuagguuauuuugcu

SEQ ID NO: 809562 - RNA, 20 nt, Homo sapiens
uacuuauauguaaaguauua

SEQ ID NO: 809563 - RNA, 21 nt, Homo sapiens
uacuuaucucucaaaacaaua

SEQ ID NO: 809564 - RNA, 20 nt, Homo sapiens
uacuuaugaaaagaauuuga

SEQ ID NO: 809565 - RNA, 15 nt, Homo sapiens
uacuuauguugcaca

SEQ ID NO: 809566 - RNA, 15 nt, Homo sapiens
uacuuccuacuguag

SEQ ID NO: 809567 - RNA, 14 nt, Homo sapiens
uacuuccugauuag

SEQ ID NO: 809568 - RNA, 19 nt, Homo sapiens
uacuuccuguguacucuuu

SEQ ID NO: 809569 - RNA, 19 nt, Homo sapiens
uacuucuaagguagcugca

SEQ ID NO: 809570 - RNA, 17 nt, Homo sapiens
uacuucuuuagcauuuu

SEQ ID NO: 809571 - RNA, 16 nt, Homo sapiens
uacuugaaaaaguaaa

SEQ ID NO: 809572 - RNA, 16 nt, Homo sapiens
uacuugagacucuuga

SEQ ID NO: 809573 - RNA, 21 nt, Homo sapiens
uacuugggaggcugagccagg

SEQ ID NO: 809574 - RNA, 18 nt, Homo sapiens
uacuugugaaacacagcu

SEQ ID NO: 809575 - RNA, 19 nt, Homo sapiens
uacuuguggugugaccaug

SEQ ID NO: 809576 - RNA, 17 nt, Homo sapiens
uacuuuaaaaugccaau

SEQ ID NO: 809577 - RNA, 22 nt, Homo sapiens
uacuuuacaaaccauuaccugu

SEQ ID NO: 809578 - RNA, 18 nt, Homo sapiens
uacuuuacagacaggaaa

SEQ ID NO: 809579 - RNA, 15 nt, Homo sapiens
uacuuuauuguacag

SEQ ID NO: 809580 - RNA, 20 nt, Homo sapiens
uacuuucuguuaaaaugcau

SEQ ID NO: 809581 - RNA, 14 nt, Homo sapiens
uacuuugacagugu

SEQ ID NO: 809582 - RNA, 17 nt, Homo sapiens
uacuuugacuuuuugca

SEQ ID NO: 809583 - RNA, 17 nt, Homo sapiens
uacuuugguaguggaau

SEQ ID NO: 809584 - RNA, 23 nt, Homo sapiens
uacuuuuaaagccuauucacuug

SEQ ID NO: 809585 - RNA, 14 nt, Homo sapiens
uacuuuuaacuaau

SEQ ID NO: 809586 - RNA, 16 nt, Homo sapiens
uacuuuuacucugccu

SEQ ID NO: 809587 - RNA, 17 nt, Homo sapiens
uacuuuucuuuccucag

SEQ ID NO: 809588 - RNA, 17 nt, Homo sapiens
uacuuuuuauacuccau

SEQ ID NO: 809589 - RNA, 22 nt, Homo sapiens
uacuuuuucugguguguuaaca

SEQ ID NO: 809590 - RNA, 14 nt, Homo sapiens
uagaaaaagauucu

SEQ ID NO: 809591 - RNA, 17 nt, Homo sapiens
uagaaaaaucucauucc

SEQ ID NO: 809592 - RNA, 21 nt, Homo sapiens
uagaaaaggcagcuaaaggaa

SEQ ID NO: 809593 - RNA, 15 nt, Homo sapiens
uagaaaagugaauug

SEQ ID NO: 809594 - RNA, 13 nt, Homo sapiens
uagaaaaugagga

SEQ ID NO: 809595 - RNA, 14 nt, Homo sapiens
uagaaaaugcaguc

SEQ ID NO: 809596 - RNA, 15 nt, Homo sapiens
uagaaaaugguccaa

SEQ ID NO: 809597 - RNA, 13 nt, Homo sapiens
uagaaacaauaaa

SEQ ID NO: 809598 - RNA, 13 nt, Homo sapiens
uagaaacaugaca

SEQ ID NO: 809599 - RNA, 17 nt, Homo sapiens
uagaaacaugacacuga

SEQ ID NO: 809600 - RNA, 19 nt, Homo sapiens
uagaaacguaaacuaugac

SEQ ID NO: 809601 - RNA, 20 nt, Homo sapiens
uagaaagcuuugaaugcaga

SEQ ID NO: 809602 - RNA, 20 nt, Homo sapiens
uagaaaggcaguucagguau

SEQ ID NO: 809603 - RNA, 19 nt, Homo sapiens
uagaaaugacugcauuuga

SEQ ID NO: 809604 - RNA, 13 nt, Homo sapiens
uagaaauugaaca

SEQ ID NO: 809605 - RNA, 13 nt, Homo sapiens
uagaaauuuuaca

SEQ ID NO: 809606 - RNA, 18 nt, Homo sapiens
uagaacaacgccugucac

SEQ ID NO: 809607 - RNA, 17 nt, Homo sapiens
uagaacagauaaucagu

SEQ ID NO: 809608 - RNA, 21 nt, Homo sapiens
uagaacccauaaccauacaca

SEQ ID NO: 809609 - RNA, 18 nt, Homo sapiens
uagaacuauuaaaacagc

SEQ ID NO: 809610 - RNA, 17 nt, Homo sapiens
uagaacuccaguuuuca

SEQ ID NO: 809611 - RNA, 20 nt, Homo sapiens
uagaacucuagagagccuua

SEQ ID NO: 809612 - RNA, 21 nt, Homo sapiens
uagaacucuagagagccuuaa

SEQ ID NO: 809613 - RNA, 22 nt, Homo sapiens
uagaacuggaucccaacaccaa

SEQ ID NO: 809614 - RNA, 14 nt, Homo sapiens
uagaacuguacugu

SEQ ID NO: 809615 - RNA, 19 nt, Homo sapiens
uagaacuugcagcugaugu

SEQ ID NO: 809616 - RNA, 15 nt, Homo sapiens
uagaagaagcccaua

SEQ ID NO: 809617 - RNA, 21 nt, Homo sapiens
uagaagaagcccauaucacau

SEQ ID NO: 809618 - RNA, 17 nt, Homo sapiens
uagaagacaacaggcau

SEQ ID NO: 809619 - RNA, 14 nt, Homo sapiens
uagaagacugucag

SEQ ID NO: 809620 - RNA, 17 nt, Homo sapiens
uagaagagaaaugcugc

SEQ ID NO: 809621 - RNA, 19 nt, Homo sapiens
uagaagagauuucuaaaag

SEQ ID NO: 809622 - RNA, 20 nt, Homo sapiens
uagaagauguguaaacaggu

SEQ ID NO: 809623 - RNA, 20 nt, Homo sapiens
uagaagauuuuaugcugcug

SEQ ID NO: 809624 - RNA, 22 nt, Homo sapiens
uagaagcaacuaggaaaaucac

SEQ ID NO: 809625 - RNA, 14 nt, Homo sapiens
uagaagccaaggga

SEQ ID NO: 809626 - RNA, 15 nt, Homo sapiens
uagaagccaaguaaa

SEQ ID NO: 809627 - RNA, 22 nt, Homo sapiens
uagaagccaaguaaagugcuua

SEQ ID NO: 809628 - RNA, 23 nt, Homo sapiens
uagaagccugcagaauccagcua

SEQ ID NO: 809629 - RNA, 21 nt, Homo sapiens
uagaaggcacaauaugggcac

SEQ ID NO: 809630 - RNA, 22 nt, Homo sapiens
uagaagggccaguccugccugg

SEQ ID NO: 809631 - RNA, 23 nt, Homo sapiens
uagaaggggaggacacugguggu

SEQ ID NO: 809632 - RNA, 19 nt, Homo sapiens
uagaaguagcaaaaaguau

SEQ ID NO: 809633 - RNA, 14 nt, Homo sapiens
uagaagucauaugu

SEQ ID NO: 809634 - RNA, 17 nt, Homo sapiens
uagaagucuuagaugua

SEQ ID NO: 809635 - RNA, 12 nt, Homo sapiens
uagaagugcuaa

SEQ ID NO: 809636 - RNA, 18 nt, Homo sapiens
uagaaguugaaacucacu

SEQ ID NO: 809637 - RNA, 23 nt, Homo sapiens
uagaaguugaaacucacuaguaa

SEQ ID NO: 809638 - RNA, 11 nt, Homo sapiens
uagaauaccac

SEQ ID NO: 809639 - RNA, 17 nt, Homo sapiens
uagaauauccaugaccu

SEQ ID NO: 809640 - RNA, 20 nt, Homo sapiens
uagaauauuuauuaccucug

SEQ ID NO: 809641 - RNA, 18 nt, Homo sapiens
uagaaucuagaaauguuc

SEQ ID NO: 809642 - RNA, 14 nt, Homo sapiens
uagaaucucuucau

SEQ ID NO: 809643 - RNA, 18 nt, Homo sapiens
ugggcauucuuguuucaa

SEQ ID NO: 809644 - RNA, 19 nt, Homo sapiens
ugggcauuuuucuuacuuu

SEQ ID NO: 809645 - RNA, 13 nt, Homo sapiens
ugggccaccagag

SEQ ID NO: 809646 - RNA, 20 nt, Homo sapiens
ugggccagugaacaggguaa

SEQ ID NO: 809647 - RNA, 14 nt, Homo sapiens
ugggcccagaucug

SEQ ID NO: 809648 - RNA, 19 nt, Homo sapiens
ugggccccuggcacucuug

SEQ ID NO: 809649 - RNA, 14 nt, Homo sapiens
ugggccuccaugcc

SEQ ID NO: 809650 - RNA, 19 nt, Homo sapiens
ugggccuggagggggagca

SEQ ID NO: 809651 - RNA, 15 nt, Homo sapiens
ugggccugugaauca

SEQ ID NO: 809652 - RNA, 18 nt, Homo sapiens
ugggcgacagagcgagac

SEQ ID NO: 809653 - RNA, 22 nt, Homo sapiens
ugggcgagccccuccuucuccc

SEQ ID NO: 809654 - RNA, 21 nt, Homo sapiens
ugggcgcucucccuaccuugc

SEQ ID NO: 809655 - RNA, 22 nt, Homo sapiens
ugggcgcuguuuucucagcucc

SEQ ID NO: 809656 - RNA, 15 nt, Homo sapiens
ugggcgucugagcug

SEQ ID NO: 809657 - RNA, 21 nt, Homo sapiens
ugggcgugugugacacugaug

SEQ ID NO: 809658 - RNA, 23 nt, Homo sapiens
ugggcuaccaucugcauggggcu

SEQ ID NO: 809659 - RNA, 19 nt, Homo sapiens
ugggcuacccuaaagggag

SEQ ID NO: 809660 - RNA, 21 nt, Homo sapiens
ugggcugguaucucagaaagu

SEQ ID NO: 809661 - RNA, 15 nt, Homo sapiens
ugggcugucagcuuu

SEQ ID NO: 809662 - RNA, 12 nt, Homo sapiens
ugggcugugcua

SEQ ID NO: 809663 - RNA, 18 nt, Homo sapiens
ugggcuucaaucacugua

SEQ ID NO: 809664 - RNA, 16 nt, Homo sapiens
ugggcuugaaacauua

SEQ ID NO: 809665 - RNA, 22 nt, Homo sapiens
ugggcuugacaccugucuugaa

SEQ ID NO: 809666 - RNA, 17 nt, Homo sapiens
uggggaaaaaacugugc

SEQ ID NO: 809667 - RNA, 20 nt, Homo sapiens
uggggaaaauggccaugcag

SEQ ID NO: 809668 - RNA, 14 nt, Homo sapiens
uggggaaaggggac

SEQ ID NO: 809669 - RNA, 16 nt, Homo sapiens
uggggaagaagacaca

SEQ ID NO: 809670 - RNA, 13 nt, Homo sapiens
uggggaagacagu

SEQ ID NO: 809671 - RNA, 15 nt, Homo sapiens
uggggaagacagugg

SEQ ID NO: 809672 - RNA, 14 nt, Homo sapiens
uggggaagacugug

SEQ ID NO: 809673 - RNA, 16 nt, Homo sapiens
uggggaagguggagca

SEQ ID NO: 809674 - RNA, 21 nt, Homo sapiens
uggggaagugucccugugauc

SEQ ID NO: 809675 - RNA, 18 nt, Homo sapiens
uggggaccucaccugcug

SEQ ID NO: 809676 - RNA, 13 nt, Homo sapiens
uggggacggugua

SEQ ID NO: 809677 - RNA, 13 nt, Homo sapiens
uggggacuugaug

SEQ ID NO: 809678 - RNA, 17 nt, Homo sapiens
uggggagcccgucucag

SEQ ID NO: 809679 - RNA, 19 nt, Homo sapiens
uggggaguaggacauacca

SEQ ID NO: 809680 - RNA, 17 nt, Homo sapiens
uggggauguaaccaagc

SEQ ID NO: 809681 - RNA, 15 nt, Homo sapiens
uggggccagauccag

SEQ ID NO: 809682 - RNA, 13 nt, Homo sapiens
uggggccagucag

SEQ ID NO: 809683 - RNA, 15 nt, Homo sapiens
uggggcccagugcau

SEQ ID NO: 809684 - RNA, 18 nt, Homo sapiens
uggggccgcugggguccg

SEQ ID NO: 809685 - RNA, 15 nt, Homo sapiens
uggggcucucucuuc

SEQ ID NO: 809686 - RNA, 15 nt, Homo sapiens
ugggggaacugugaa

SEQ ID NO: 809687 - RNA, 22 nt, Homo sapiens
ugggggaagacuuuaaaccacc

SEQ ID NO: 809688 - RNA, 22 nt, Homo sapiens
ugggggcagggcugugcuugaa

SEQ ID NO: 809689 - RNA, 23 nt, Homo sapiens
ugggggcgcccucucugcuccuu

SEQ ID NO: 809690 - RNA, 16 nt, Homo sapiens
ugggggcugugauauu

SEQ ID NO: 809691 - RNA, 12 nt, Homo sapiens
uggggggaccca

SEQ ID NO: 809692 - RNA, 20 nt, Homo sapiens
ugggggguuuucuugccuug

SEQ ID NO: 809693 - RNA, 18 nt, Homo sapiens
ugggggugccgcucucuc

SEQ ID NO: 809694 - RNA, 23 nt, Homo sapiens
ugggggugccgcucucucugagg

SEQ ID NO: 809695 - RNA, 23 nt, Homo sapiens
ugggggugccgcugucucugagg

SEQ ID NO: 809696 - RNA, 22 nt, Homo sapiens
ugggggugccgcuuucucugag

SEQ ID NO: 809697 - RNA, 18 nt, Homo sapiens
ugggggugcugcucucuc

SEQ ID NO: 809698 - RNA, 16 nt, Homo sapiens
uggggguuggggugcu

SEQ ID NO: 809699 - RNA, 18 nt, Homo sapiens
ugggguaguuguguuuca

SEQ ID NO: 809700 - RNA, 13 nt, Homo sapiens
uggggugagggag

SEQ ID NO: 809701 - RNA, 17 nt, Homo sapiens
ugggguggccaccagua

SEQ ID NO: 809702 - RNA, 19 nt, Homo sapiens
ugggguggcgggaauccua

SEQ ID NO: 809703 - RNA, 19 nt, Homo sapiens
ugggguucgagacuccauc

SEQ ID NO: 809704 - RNA, 15 nt, Homo sapiens
ugggguugggggaca

SEQ ID NO: 809705 - RNA, 16 nt, Homo sapiens
ugggguuucaccaucu

SEQ ID NO: 809706 - RNA, 17 nt, Homo sapiens
ugggguuucaccaucuu

SEQ ID NO: 809707 - RNA, 14 nt, Homo sapiens
uggguacaaaaagu

SEQ ID NO: 809708 - RNA, 13 nt, Homo sapiens
uguaacugucagu

SEQ ID NO: 809709 - RNA, 23 nt, Homo sapiens
uguaacugugccaguucuuucca

SEQ ID NO: 809710 - RNA, 16 nt, Homo sapiens
uguaacuuauauugaa

SEQ ID NO: 809711 - RNA, 16 nt, Homo sapiens
uguaacuuuacaguua

SEQ ID NO: 809712 - RNA, 16 nt, Homo sapiens
uguaagaaagcauaga

SEQ ID NO: 809713 - RNA, 15 nt, Homo sapiens
uguaagaacuguaca

SEQ ID NO: 809714 - RNA, 18 nt, Homo sapiens
uguaagagcaaaagccuc

SEQ ID NO: 809715 - RNA, 19 nt, Homo sapiens
uguaagauaaaccaguuga

SEQ ID NO: 809716 - RNA, 13 nt, Homo sapiens
uguaagauuucau

SEQ ID NO: 809717 - RNA, 17 nt, Homo sapiens
uguaagcaagucacuua

SEQ ID NO: 809718 - RNA, 14 nt, Homo sapiens
uguaaguacuucca

SEQ ID NO: 809719 - RNA, 21 nt, Homo sapiens
uguaagugagagagacaagaa

SEQ ID NO: 809720 - RNA, 15 nt, Homo sapiens
uguaagugggcccac

SEQ ID NO: 809721 - RNA, 23 nt, Homo sapiens
uguaauaaaucuaggaugugaug

SEQ ID NO: 809722 - RNA, 15 nt, Homo sapiens
uguaauaagcaauca

SEQ ID NO: 809723 - RNA, 15 nt, Homo sapiens
uguaauagcauacau

SEQ ID NO: 809724 - RNA, 13 nt, Homo sapiens
uguaauauauuuc

SEQ ID NO: 809725 - RNA, 14 nt, Homo sapiens
uguaauaugcacaa

SEQ ID NO: 809726 - RNA, 19 nt, Homo sapiens
uguaauauuucuucaaaua

SEQ ID NO: 809727 - RNA, 22 nt, Homo sapiens
uguaaucaaggccagugcuaaa

SEQ ID NO: 809728 - RNA, 14 nt, Homo sapiens
uguaaucagcaaua

SEQ ID NO: 809729 - RNA, 13 nt, Homo sapiens
uguaaucccagca

SEQ ID NO: 809730 - RNA, 17 nt, Homo sapiens
uguaaucccagcacuuu

SEQ ID NO: 809731 - RNA, 19 nt, Homo sapiens
uguaaucccagcuacuugg

SEQ ID NO: 809732 - RNA, 21 nt, Homo sapiens
uguaaucgcccuacuauucag

SEQ ID NO: 809733 - RNA, 21 nt, Homo sapiens
uguaaucucucugcagcugcc

SEQ ID NO: 809734 - RNA, 22 nt, Homo sapiens
uguaaugguaucuuaaagugug

SEQ ID NO: 809735 - RNA, 13 nt, Homo sapiens
uguaauuccagcu

SEQ ID NO: 809736 - RNA, 21 nt, Homo sapiens
uguaauuuaaaaagugcuaua

SEQ ID NO: 809737 - RNA, 18 nt, Homo sapiens
uguaauuuaaaauuguga

SEQ ID NO: 809738 - RNA, 15 nt, Homo sapiens
uguaauuuaugcaag

SEQ ID NO: 809739 - RNA, 21 nt, Homo sapiens
uguaauuuauuaacuaaucaa

SEQ ID NO: 809740 - RNA, 17 nt, Homo sapiens
uguacaaaacaguuuga

SEQ ID NO: 809741 - RNA, 18 nt, Homo sapiens
uguacaaaauaacucucc

SEQ ID NO: 809742 - RNA, 19 nt, Homo sapiens
uguacacuaccaaacacuc

SEQ ID NO: 809743 - RNA, 17 nt, Homo sapiens
uguacacugauuccuuu

SEQ ID NO: 809744 - RNA, 11 nt, Homo sapiens
uguacacugug

SEQ ID NO: 809745 - RNA, 12 nt, Homo sapiens
uguacacugugu

SEQ ID NO: 809746 - RNA, 17 nt, Homo sapiens
uguacagacuucuuggu

SEQ ID NO: 809747 - RNA, 17 nt, Homo sapiens
uguacagaugaaugaua

SEQ ID NO: 809748 - RNA, 19 nt, Homo sapiens
uguacaguguguaaagugu

SEQ ID NO: 809749 - RNA, 11 nt, Homo sapiens
uguacauagac

SEQ ID NO: 809750 - RNA, 17 nt, Homo sapiens
uguacauggaauaacau

SEQ ID NO: 809751 - RNA, 14 nt, Homo sapiens
uguacauucuucca

SEQ ID NO: 809752 - RNA, 16 nt, Homo sapiens
uguaccaagugaaauu

SEQ ID NO: 809753 - RNA, 15 nt, Homo sapiens
uguaccacaaacaca

SEQ ID NO: 809754 - RNA, 14 nt, Homo sapiens
uguaccacaucugc

SEQ ID NO: 809755 - RNA, 16 nt, Homo sapiens
uguaccauuugcaugg

SEQ ID NO: 809756 - RNA, 21 nt, Homo sapiens
uucaacugaaaaaaacauauc

SEQ ID NO: 809757 - RNA, 22 nt, Homo sapiens
uucaacugccauguuuugccac

SEQ ID NO: 809758 - RNA, 14 nt, Homo sapiens
uucaacuuccaaag

SEQ ID NO: 809759 - RNA, 18 nt, Homo sapiens
uucaagaagauggcaaaa

SEQ ID NO: 809760 - RNA, 12 nt, Homo sapiens
uucaagcccagg

SEQ ID NO: 809761 - RNA, 16 nt, Homo sapiens
uucaagccuuagauaa

SEQ ID NO: 809762 - RNA, 21 nt, Homo sapiens
uucaaggccccgagcuguuac

SEQ ID NO: 809763 - RNA, 16 nt, Homo sapiens
uucaaguaauugugaa

SEQ ID NO: 809764 - RNA, 20 nt, Homo sapiens
uucaaguauaacaacuuuga

SEQ ID NO: 809765 - RNA, 13 nt, Homo sapiens
uucaagugccaaa

SEQ ID NO: 809766 - RNA, 20 nt, Homo sapiens
uucaagugccuagacuguua

SEQ ID NO: 809767 - RNA, 18 nt, Homo sapiens
uucaagugcuucuccagc

SEQ ID NO: 809768 - RNA, 19 nt, Homo sapiens
uucaaguuuuaaaguucau

SEQ ID NO: 809769 - RNA, 13 nt, Homo sapiens
uucaauacaggcu

SEQ ID NO: 809770 - RNA, 23 nt, Homo sapiens
uucaauauaagaagcaaucuuug

SEQ ID NO: 809771 - RNA, 22 nt, Homo sapiens
uucaauauuuuuguauauacuu

SEQ ID NO: 809772 - RNA, 17 nt, Homo sapiens
uucaaucauuuauucau

SEQ ID NO: 809773 - RNA, 12 nt, Homo sapiens
uucaaucucuug

SEQ ID NO: 809774 - RNA, 12 nt, Homo sapiens
uucaaugcauuu

SEQ ID NO: 809775 - RNA, 15 nt, Homo sapiens
uucaaugcauuuaaa

SEQ ID NO: 809776 - RNA, 21 nt, Homo sapiens
uucaaugugacaccuaacucu

SEQ ID NO: 809777 - RNA, 14 nt, Homo sapiens
uucaauuauacuaa

SEQ ID NO: 809778 - RNA, 20 nt, Homo sapiens
uucaauuauacuaaaccuca

SEQ ID NO: 809779 - RNA, 21 nt, Homo sapiens
uucacaaauauaguugaacaa

SEQ ID NO: 809780 - RNA, 10 nt, Homo sapiens
uucacaagcu

SEQ ID NO: 809781 - RNA, 18 nt, Homo sapiens
uucacacaaagacuccuu

SEQ ID NO: 809782 - RNA, 13 nt, Homo sapiens
uucacaccagcua

SEQ ID NO: 809783 - RNA, 16 nt, Homo sapiens
uucacagaauagcaca

SEQ ID NO: 809784 - RNA, 13 nt, Homo sapiens
uucacagccagac

SEQ ID NO: 809785 - RNA, 19 nt, Homo sapiens
uucacaguaauaugguucc

SEQ ID NO: 809786 - RNA, 12 nt, Homo sapiens
uucacagugaag

SEQ ID NO: 809787 - RNA, 19 nt, Homo sapiens
uucacauauaucaaaguga

SEQ ID NO: 809788 - RNA, 14 nt, Homo sapiens
uucacaucugucac

SEQ ID NO: 809789 - RNA, 15 nt, Homo sapiens
uucacaucugucacg

SEQ ID NO: 809790 - RNA, 17 nt, Homo sapiens
uucaccagagcauuucc

SEQ ID NO: 809791 - RNA, 13 nt, Homo sapiens
uucaccagcagca

SEQ ID NO: 809792 - RNA, 20 nt, Homo sapiens
uucaccauguuggccaggau

SEQ ID NO: 809793 - RNA, 17 nt, Homo sapiens
uucacccacgcauauac

SEQ ID NO: 809794 - RNA, 20 nt, Homo sapiens
uucaccccacucagcucacc

SEQ ID NO: 809795 - RNA, 22 nt, Homo sapiens
uucaccguggcuaccauuguca

SEQ ID NO: 809796 - RNA, 18 nt, Homo sapiens
uucaccuaccgaguucaa

SEQ ID NO: 809797 - RNA, 19 nt, Homo sapiens
uucaccuccaagcauuuca

SEQ ID NO: 809798 - RNA, 16 nt, Homo sapiens
uucaccucuucuuucc

SEQ ID NO: 809799 - RNA, 17 nt, Homo sapiens
uucaccugugacaaagg

SEQ ID NO: 809800 - RNA, 16 nt, Homo sapiens
uucaccuugauaaggu

SEQ ID NO: 809801 - RNA, 22 nt, Homo sapiens
uucacgccuguaaucccagcac

SEQ ID NO: 809802 - RNA, 19 nt, Homo sapiens
uucacgcuguuuguuucau

SEQ ID NO: 809803 - RNA, 23 nt, Homo sapiens
uucacguggccuccgcagugucu

SEQ ID NO: 809804 - RNA, 12 nt, Homo sapiens
uucacuacaggu

SEQ ID NO: 809805 - RNA, 16 nt, Homo sapiens
uucacuaggaggucau

SEQ ID NO: 809806 - RNA, 14 nt, Homo sapiens
uucacugccuuccu

SEQ ID NO: 809807 - RNA, 16 nt, Homo sapiens
uucacugcgaagaccc

SEQ ID NO: 809808 - RNA, 12 nt, Homo sapiens
uucacugcugag

SEQ ID NO: 809809 - RNA, 13 nt, Homo sapiens
uucacuucagagc

SEQ ID NO: 809810 - RNA, 22 nt, Homo sapiens
uucacuuuucugaguucuugaa

SEQ ID NO: 809811 - RNA, 21 nt, Homo sapiens
uucacuuuuuacagugcuauu

SEQ ID NO: 809812 - RNA, 18 nt, Homo sapiens
uucagaaccauccauagu

SEQ ID NO: 809813 - RNA, 20 nt, Homo sapiens
uucagacaacauuaugaucu

SEQ ID NO: 809814 - RNA, 15 nt, Homo sapiens
uucagacaagcugca

SEQ ID NO: 809815 - RNA, 14 nt, Homo sapiens
uucagacacuuugg

SEQ ID NO: 809816 - RNA, 13 nt, Homo sapiens
uucagacuuuaaa

SEQ ID NO: 809817 - RNA, 19 nt, Homo sapiens
uucagaggagcaacccuau

SEQ ID NO: 809818 - RNA, 21 nt, Homo sapiens
uucagaggguaacuuaacaga

SEQ ID NO: 809819 - RNA, 23 nt, Homo sapiens
uucagaguugcuuuaaaguaccu

SEQ ID NO: 809820 - RNA, 23 nt, Homo sapiens
uucagauaauugaauaaguaccu

SEQ ID NO: 809821 - RNA, 19 nt, Homo sapiens
uucagaugcuucugggaga

SEQ ID NO: 809822 - RNA, 18 nt, Homo sapiens
uucagauggugaagcauu

SEQ ID NO: 809823 - RNA, 21 nt, Homo sapiens
uucagauuaagaguugccaaa

SEQ ID NO: 809824 - RNA, 18 nt, Homo sapiens
uucagauuugccauucaa

SEQ ID NO: 809825 - RNA, 14 nt, Homo sapiens
uucagauuugccuu

SEQ ID NO: 809826 - RNA, 12 nt, Homo sapiens
uucagcacacac

SEQ ID NO: 809827 - RNA, 20 nt, Homo sapiens
uucagccuagccgaccucag

SEQ ID NO: 809828 - RNA, 14 nt, Homo sapiens
uucagcuccaggga

SEQ ID NO: 809829 - RNA, 13 nt, Homo sapiens
uucagcucuacag

SEQ ID NO: 809830 - RNA, 22 nt, Homo sapiens
uucagcuguacuucgucuucua

SEQ ID NO: 809831 - RNA, 18 nt, Homo sapiens
uucaggaguuggagacca

SEQ ID NO: 809832 - RNA, 22 nt, Homo sapiens
uuuugaggaauuaucaugggaa

SEQ ID NO: 809833 - RNA, 22 nt, Homo sapiens
uuuugauaacaaugacacuaga

SEQ ID NO: 809834 - RNA, 11 nt, Homo sapiens
uuuugaugaaa

SEQ ID NO: 809835 - RNA, 17 nt, Homo sapiens
uuuugcacaaggaaaua

SEQ ID NO: 809836 - RNA, 22 nt, Homo sapiens
uuuugcacauaacaugcuuuag

SEQ ID NO: 809837 - RNA, 13 nt, Homo sapiens
uuuugcacuguaa

SEQ ID NO: 809838 - RNA, 21 nt, Homo sapiens
uuuugcauguaugacuuaaua

SEQ ID NO: 809839 - RNA, 22 nt, Homo sapiens
uuuugcauguaugacuuaauaa

SEQ ID NO: 809840 - RNA, 22 nt, Homo sapiens
uuuugcauuucucuuccuaaau

SEQ ID NO: 809841 - RNA, 15 nt, Homo sapiens
uuuugccaguauuau

SEQ ID NO: 809842 - RNA, 17 nt, Homo sapiens
uuuugccugcaagagaa

SEQ ID NO: 809843 - RNA, 14 nt, Homo sapiens
uuuuggaaagucag

SEQ ID NO: 809844 - RNA, 16 nt, Homo sapiens
uuuuggaauuaugucu

SEQ ID NO: 809845 - RNA, 19 nt, Homo sapiens
uuuuggcccaaucucugcc

SEQ ID NO: 809846 - RNA, 14 nt, Homo sapiens
uuuugggaggucaa

SEQ ID NO: 809847 - RNA, 15 nt, Homo sapiens
uuuuggggggaacau

SEQ ID NO: 809848 - RNA, 20 nt, Homo sapiens
uuuuggguauugaauguggu

SEQ ID NO: 809849 - RNA, 21 nt, Homo sapiens
uuuugguagaugcaugacuug

SEQ ID NO: 809850 - RNA, 18 nt, Homo sapiens
uuuugguugggaaugagg

SEQ ID NO: 809851 - RNA, 17 nt, Homo sapiens
uuuuguaaauguacugg

SEQ ID NO: 809852 - RNA, 17 nt, Homo sapiens
uuuuguaagaaggcaau

SEQ ID NO: 809853 - RNA, 17 nt, Homo sapiens
uuuuguaucuacaucuu

SEQ ID NO: 809854 - RNA, 17 nt, Homo sapiens
uuuugucagaaaagagc

SEQ ID NO: 809855 - RNA, 22 nt, Homo sapiens
uuuugucagaaaagagccacuu

SEQ ID NO: 809856 - RNA, 13 nt, Homo sapiens
uuuugugcuacag

SEQ ID NO: 809857 - RNA, 22 nt, Homo sapiens
uuuuguuaacugauuugcaaua

SEQ ID NO: 809858 - RNA, 18 nt, Homo sapiens
uuuuguuccacaaguuaa

SEQ ID NO: 809859 - RNA, 21 nt, Homo sapiens
uuuuguugaaauugucaaaga

SEQ ID NO: 809860 - RNA, 17 nt, Homo sapiens
uuuuguuggcauagcuc

SEQ ID NO: 809861 - RNA, 16 nt, Homo sapiens
uuuuuaacauugcuga

SEQ ID NO: 809862 - RNA, 13 nt, Homo sapiens
uuuuuaauggaaa

SEQ ID NO: 809863 - RNA, 22 nt, Homo sapiens
uuuuuaauuaaaugaagccaag

SEQ ID NO: 809864 - RNA, 14 nt, Homo sapiens
uuuuuaauuaacca

SEQ ID NO: 809865 - RNA, 15 nt, Homo sapiens
uuuuuacaucaaaau

SEQ ID NO: 809866 - RNA, 12 nt, Homo sapiens
uuuuuacauuga

SEQ ID NO: 809867 - RNA, 17 nt, Homo sapiens
uuuuuacuaucacacau

SEQ ID NO: 809868 - RNA, 17 nt, Homo sapiens
uuuuuaggagugauuac

SEQ ID NO: 809869 - RNA, 19 nt, Homo sapiens
uuuuuauaccagcuuaaua

SEQ ID NO: 809870 - RNA, 22 nt, Homo sapiens
uuuuucaagagcuccuugaccc

SEQ ID NO: 809871 - RNA, 13 nt, Homo sapiens
uuuuucaagccug

SEQ ID NO: 809872 - RNA, 13 nt, Homo sapiens
uuuuucauuguau

SEQ ID NO: 809873 - RNA, 21 nt, Homo sapiens
uuuuucccaaguacccugaga

SEQ ID NO: 809874 - RNA, 23 nt, Homo sapiens
uuuuuccuacagcuacauugaga

SEQ ID NO: 809875 - RNA, 13 nt, Homo sapiens
uuuuucugaugau

SEQ ID NO: 809876 - RNA, 15 nt, Homo sapiens
uuuuucugccugaga

SEQ ID NO: 809877 - RNA, 11 nt, Homo sapiens
uuuuucugggg

SEQ ID NO: 809878 - RNA, 21 nt, Homo sapiens
uuuuugaucaagaaugcaaua

SEQ ID NO: 809879 - RNA, 11 nt, Homo sapiens
uuuuugcaaua

SEQ ID NO: 809880 - RNA, 15 nt, Homo sapiens
uuuuuggaaagucag

SEQ ID NO: 809881 - RNA, 19 nt, Homo sapiens
uuuuuggagaaaugucaua

SEQ ID NO: 809882 - RNA, 19 nt, Homo sapiens
uuuuuggugguucugcugu

SEQ ID NO: 809883 - RNA, 14 nt, Homo sapiens
uuuuuguacuugga

SEQ ID NO: 809884 - RNA, 20 nt, Homo sapiens
uuuuuucaaaauccaaaaag

SEQ ID NO: 809885 - RNA, 14 nt, Homo sapiens
uuuuuucugccuga

SEQ ID NO: 809886 - RNA, 17 nt, Homo sapiens
uuuuuuguuugccucuu

SEQ ID NO: 809887 - RNA, 19 nt, Homo sapiens
uucucaucuuuuuacuaaa

SEQ ID NO: 809888 - RNA, 13 nt, Homo sapiens
uucucaugaucca

SEQ ID NO: 809889 - RNA, 17 nt, Homo sapiens
uucucauucguggcaug

SEQ ID NO: 809890 - RNA, 17 nt, Homo sapiens
uucucauuuguucucac

SEQ ID NO: 809891 - RNA, 13 nt, Homo sapiens
uucuccaagcauc

SEQ ID NO: 809892 - RNA, 11 nt, Homo sapiens
uucuccacugg

SEQ ID NO: 809893 - RNA, 18 nt, Homo sapiens
uucuccauaucaaaacga

SEQ ID NO: 809894 - RNA, 16 nt, Homo sapiens
uucuccaucacaacca

SEQ ID NO: 809895 - RNA, 19 nt, Homo sapiens
uucuccaucccucuaauga

SEQ ID NO: 809896 - RNA, 20 nt, Homo sapiens
uucuccccugccggugcaca

SEQ ID NO: 809897 - RNA, 19 nt, Homo sapiens
uucucccucacuccugcca

SEQ ID NO: 809898 - RNA, 19 nt, Homo sapiens
uucuccgcaacagccaagu

SEQ ID NO: 809899 - RNA, 15 nt, Homo sapiens
uucuccucacuguau

SEQ ID NO: 809900 - RNA, 14 nt, Homo sapiens
uucuccugccucag

SEQ ID NO: 809901 - RNA, 16 nt, Homo sapiens
uucucggcucagguuu

SEQ ID NO: 809902 - RNA, 18 nt, Homo sapiens
uucucgggguccagugca

SEQ ID NO: 809903 - RNA, 16 nt, Homo sapiens
uucucuaaacauuuca

SEQ ID NO: 809904 - RNA, 16 nt, Homo sapiens
uucucuaacucagaaa

SEQ ID NO: 809905 - RNA, 20 nt, Homo sapiens
uucucuaauguuguaucaua

SEQ ID NO: 809906 - RNA, 20 nt, Homo sapiens
uucucuauuagacuuuagaa

SEQ ID NO: 809907 - RNA, 13 nt, Homo sapiens
uucucucaucucu

SEQ ID NO: 809908 - RNA, 23 nt, Homo sapiens
uucucucaucuuuuagcauguga

SEQ ID NO: 809909 - RNA, 12 nt, Homo sapiens
uucucugccuca

SEQ ID NO: 809910 - RNA, 21 nt, Homo sapiens
uucucuguauuccgauacaaa

SEQ ID NO: 809911 - RNA, 17 nt, Homo sapiens
uucucugugaacuauua

SEQ ID NO: 809912 - RNA, 18 nt, Homo sapiens
uucucugugaacuauuaa

SEQ ID NO: 809913 - RNA, 16 nt, Homo sapiens
uucucugugucuaaga

SEQ ID NO: 809914 - RNA, 17 nt, Homo sapiens
uucucuucgcugugaug

SEQ ID NO: 809915 - RNA, 17 nt, Homo sapiens
uucucuucucucuucaa

SEQ ID NO: 809916 - RNA, 17 nt, Homo sapiens
uucucuugagcuggccu

SEQ ID NO: 809917 - RNA, 22 nt, Homo sapiens
uucucuuuuuuaaaaacaaaca

SEQ ID NO: 809918 - RNA, 13 nt, Homo sapiens
uucugaaaacuga

SEQ ID NO: 809919 - RNA, 22 nt, Homo sapiens
uucugaacuggaacaugggcau

SEQ ID NO: 809920 - RNA, 15 nt, Homo sapiens
uucugagaaggugag

SEQ ID NO: 809921 - RNA, 18 nt, Homo sapiens
uucugagacagcuugucu

SEQ ID NO: 809922 - RNA, 20 nt, Homo sapiens
uucugagcauaaugcuccca

SEQ ID NO: 809923 - RNA, 16 nt, Homo sapiens
uucugauaaugcauua

SEQ ID NO: 809924 - RNA, 18 nt, Homo sapiens
uucugaucauguaugcau

SEQ ID NO: 809925 - RNA, 21 nt, Homo sapiens
uucugauguccauuuguccca

SEQ ID NO: 809926 - RNA, 18 nt, Homo sapiens
uucugauguuucugugaa

SEQ ID NO: 809927 - RNA, 22 nt, Homo sapiens
uucugauuugucccuaugcaua

SEQ ID NO: 809928 - RNA, 14 nt, Homo sapiens
uucugcacugaaaa

SEQ ID NO: 809929 - RNA, 16 nt, Homo sapiens
uucugcacuucauauc

SEQ ID NO: 809930 - RNA, 20 nt, Homo sapiens
uucugcagcaugaccuguga

SEQ ID NO: 809931 - RNA, 23 nt, Homo sapiens
uucugcagggaugauaguggaau

SEQ ID NO: 809932 - RNA, 18 nt, Homo sapiens
uucugcaucaucuguaga

SEQ ID NO: 809933 - RNA, 20 nt, Homo sapiens
uucugccgcccccuccugaa

SEQ ID NO: 809934 - RNA, 14 nt, Homo sapiens
uucugccugugcag

SEQ ID NO: 809935 - RNA, 17 nt, Homo sapiens
uucugccuucucaggaa

SEQ ID NO: 809936 - RNA, 16 nt, Homo sapiens
uucugccuuguuucau

SEQ ID NO: 809937 - RNA, 19 nt, Homo sapiens
uucugcuaccucacugggg

SEQ ID NO: 809938 - RNA, 14 nt, Homo sapiens
uucugcuagcuaua

SEQ ID NO: 809939 - RNA, 16 nt, Homo sapiens
uucugcugaccaaaug

SEQ ID NO: 809940 - RNA, 16 nt, Homo sapiens
uucuggaaaagcaaaa

SEQ ID NO: 809941 - RNA, 14 nt, Homo sapiens
uucuggaauguaau

SEQ ID NO: 809942 - RNA, 16 nt, Homo sapiens
uucuggacagacagau

SEQ ID NO: 809943 - RNA, 21 nt, Homo sapiens
uucuggagaaagguauguuac

SEQ ID NO: 809944 - RNA, 18 nt, Homo sapiens
uucuggauuugcagguga

SEQ ID NO: 809945 - RNA, 14 nt, Homo sapiens
uucuggcauaacua

SEQ ID NO: 809946 - RNA, 15 nt, Homo sapiens
uucuggccucugcug

SEQ ID NO: 809947 - RNA, 15 nt, Homo sapiens
uucugggcggccagu

SEQ ID NO: 809948 - RNA, 18 nt, Homo sapiens
uucugggcggccagugcg

SEQ ID NO: 809949 - RNA, 19 nt, Homo sapiens
uucuggggaaagacacugc

SEQ ID NO: 809950 - RNA, 22 nt, Homo sapiens
uucugguagcauauucaugguu

SEQ ID NO: 809951 - RNA, 15 nt, Homo sapiens
uucugguuacugugg

SEQ ID NO: 809952 - RNA, 13 nt, Homo sapiens
uucuguaccaguu

SEQ ID NO: 809953 - RNA, 16 nt, Homo sapiens
uucuguaguugcagcu

SEQ ID NO: 809954 - RNA, 14 nt, Homo sapiens
uucuguaucauuga

SEQ ID NO: 809955 - RNA, 18 nt, Homo sapiens
uucuguaucauugauuca

SEQ ID NO: 809956 - RNA, 16 nt, Homo sapiens
uucugucaaaugcagu

SEQ ID NO: 809957 - RNA, 14 nt, Homo sapiens
uucugucaauuuca

SEQ ID NO: 809958 - RNA, 18 nt, Homo sapiens
uucuguggaccacugcau

SEQ ID NO: 809959 - RNA, 21 nt, Homo sapiens
uucuguggaccacugcaugag

SEQ ID NO: 809960 - RNA, 13 nt, Homo sapiens
uucuguguacuuu

SEQ ID NO: 809961 - RNA, 18 nt, Homo sapiens
uucuguucucccugggaa

SEQ ID NO: 809962 - RNA, 17 nt, Homo sapiens
uucuguucuuacaaaug

SEQ ID NO: 809963 - RNA, 16 nt, Homo sapiens
uucuguugaaguuuac

SEQ ID NO: 809964 - RNA, 21 nt, Homo sapiens
uucuguugaucccacuucacu

SEQ ID NO: 809965 - RNA, 15 nt, Homo sapiens
uucuguugccaguca

SEQ ID NO: 809966 - RNA, 17 nt, Homo sapiens
uucuguuggggaggggu

SEQ ID NO: 809967 - RNA, 19 nt, Homo sapiens
aaaagucuacaacauagca

SEQ ID NO: 809968 - RNA, 15 nt, Homo sapiens
aaaagucuaccaccg

SEQ ID NO: 809969 - RNA, 18 nt, Homo sapiens
aaaagugucucaaaggag

SEQ ID NO: 809970 - RNA, 13 nt, Homo sapiens
aaaaguuacuuau

SEQ ID NO: 809971 - RNA, 16 nt, Homo sapiens
aaaaguuagucaaucc

SEQ ID NO: 809972 - RNA, 20 nt, Homo sapiens
aaaaguuagucaauccuguc

SEQ ID NO: 809973 - RNA, 19 nt, Homo sapiens
aaaaguucuuuuugcucua

SEQ ID NO: 809974 - RNA, 23 nt, Homo sapiens
aaaauaaccggauauauacauag

SEQ ID NO: 809975 - RNA, 17 nt, Homo sapiens
aaaauaagcuucaucuc

SEQ ID NO: 809976 - RNA, 17 nt, Homo sapiens
aaaauacagauuugaau

SEQ ID NO: 809977 - RNA, 14 nt, Homo sapiens
aaaauaccaugcca

SEQ ID NO: 809978 - RNA, 18 nt, Homo sapiens
aaaauaccuucugaacua

SEQ ID NO: 809979 - RNA, 16 nt, Homo sapiens
aaaauacgaaguggag

SEQ ID NO: 809980 - RNA, 17 nt, Homo sapiens
aaaauacuauugccuca

SEQ ID NO: 809981 - RNA, 14 nt, Homo sapiens
aaaauacuguucuu

SEQ ID NO: 809982 - RNA, 16 nt, Homo sapiens
aaaauagaaacuugcu

SEQ ID NO: 809983 - RNA, 22 nt, Homo sapiens
aaaauagauccaaucaguuuau

SEQ ID NO: 809984 - RNA, 15 nt, Homo sapiens
gcaacuaggccuuca

SEQ ID NO: 809985 - RNA, 20 nt, Homo sapiens
gcaacuagggcuagucuucc

SEQ ID NO: 809986 - RNA, 20 nt, Homo sapiens
gcaacucuuuuaagugccuu

SEQ ID NO: 809987 - RNA, 15 nt, Homo sapiens
gcaacugaggcagac

SEQ ID NO: 809988 - RNA, 22 nt, Homo sapiens
gcaacugaggcagacagcagcu

SEQ ID NO: 809989 - RNA, 16 nt, Homo sapiens
gcaacugcccuuccag

SEQ ID NO: 809990 - RNA, 15 nt, Homo sapiens
gcaacuguaugaaaa

SEQ ID NO: 809991 - RNA, 14 nt, Homo sapiens
gcaacuucaaggga

SEQ ID NO: 809992 - RNA, 18 nt, Homo sapiens
gcaagaagucaaaguaaa

SEQ ID NO: 809993 - RNA, 21 nt, Homo sapiens
gcaagaccaaaaugacaauga

SEQ ID NO: 809994 - RNA, 15 nt, Homo sapiens
gcaagaccagucacu

SEQ ID NO: 809995 - RNA, 17 nt, Homo sapiens
gcaagaccccaucucaa

SEQ ID NO: 809996 - RNA, 13 nt, Homo sapiens
gcaagacugucuc

SEQ ID NO: 809997 - RNA, 17 nt, Homo sapiens
gcaagacuguugcucaa

SEQ ID NO: 809998 - RNA, 18 nt, Homo sapiens
gcaagacuguugcucaaa

SEQ ID NO: 809999 - RNA, 15 nt, Homo sapiens
gcaagaggaggacag

SEQ ID NO: 810000 - RNA, 22 nt, Homo sapiens
gcaagaguuucuuguaagccau

SEQ ID NO: 810001 - RNA, 14 nt, Homo sapiens
gcaaggacaccaua

SEQ ID NO: 810002 - RNA, 17 nt, Homo sapiens
gcaaggacggccuucaa

SEQ ID NO: 810003 - RNA, 21 nt, Homo sapiens
gcaaggacggccuucaacuga

SEQ ID NO: 810004 - RNA, 13 nt, Homo sapiens
gcaaggagaaaaa

SEQ ID NO: 810005 - RNA, 23 nt, Homo sapiens
gcaagggaccuucaugcccuucu

SEQ ID NO: 810006 - RNA, 14 nt, Homo sapiens
gcaagggauaacuc

SEQ ID NO: 810007 - RNA, 12 nt, Homo sapiens
gcaagugauauc

SEQ ID NO: 810008 - RNA, 21 nt, Homo sapiens
gcaagugcaucuuugccucaa

SEQ ID NO: 810009 - RNA, 17 nt, Homo sapiens
gcaagugguagcaagaa

SEQ ID NO: 810010 - RNA, 14 nt, Homo sapiens
gcaaguuagaacua

SEQ ID NO: 810011 - RNA, 20 nt, Homo sapiens
gcaaguugaggacuucuugc

SEQ ID NO: 810012 - RNA, 15 nt, Homo sapiens
gcaaguuucagugaa

SEQ ID NO: 810013 - RNA, 14 nt, Homo sapiens
gcaauaaauauuag

SEQ ID NO: 810014 - RNA, 20 nt, Homo sapiens
gcaauaaccucaaagugacu

SEQ ID NO: 810015 - RNA, 13 nt, Homo sapiens
gcaauacauuuca

SEQ ID NO: 810016 - RNA, 19 nt, Homo sapiens
gcaauacguuugugcagaa

SEQ ID NO: 810017 - RNA, 21 nt, Homo sapiens
gcaauagacacauacauguca

SEQ ID NO: 810018 - RNA, 18 nt, Homo sapiens
gcaauagauuacugaugu

SEQ ID NO: 810019 - RNA, 23 nt, Homo sapiens
gcaaucaaguccuacaagcuaaa

SEQ ID NO: 810020 - RNA, 23 nt, Homo sapiens
gcaauccuucccugcucuugcag

SEQ ID NO: 810021 - RNA, 15 nt, Homo sapiens
gcaaucuacuggaaa

SEQ ID NO: 810022 - RNA, 16 nt, Homo sapiens
gcaaucuacuggaaau

SEQ ID NO: 810023 - RNA, 22 nt, Homo sapiens
gcaaucugggugguaacugcca

SEQ ID NO: 810024 - RNA, 17 nt, Homo sapiens
gcaaucuuugccuuuau

SEQ ID NO: 810025 - RNA, 21 nt, Homo sapiens
gcaaugaaugaugcuuuucug

SEQ ID NO: 810026 - RNA, 23 nt, Homo sapiens
gcaaugaugacccacuaaagagu

SEQ ID NO: 810027 - RNA, 23 nt, Homo sapiens
gcaaugcacugaagcguguuucu

SEQ ID NO: 810028 - RNA, 13 nt, Homo sapiens
gcaaugccauuuc

SEQ ID NO: 810029 - RNA, 20 nt, Homo sapiens
gcaauggaagcccucaaaga

SEQ ID NO: 810030 - RNA, 21 nt, Homo sapiens
gcaauugaauuaaauuaggaa

SEQ ID NO: 810031 - RNA, 18 nt, Homo sapiens
gcaauuuuauuaaaugca

SEQ ID NO: 810032 - RNA, 21 nt, Homo sapiens
gcaauuuuucaagagcuccuu

SEQ ID NO: 810033 - RNA, 18 nt, Homo sapiens
gcacaaggcugaccaaga

SEQ ID NO: 810034 - RNA, 12 nt, Homo sapiens
gcacaaguacuu

SEQ ID NO: 810035 - RNA, 20 nt, Homo sapiens
gcacacacacacgcuuucuu

SEQ ID NO: 810036 - RNA, 15 nt, Homo sapiens
gcacacaccugccug

SEQ ID NO: 810037 - RNA, 14 nt, Homo sapiens
gcacacaguacaca

SEQ ID NO: 810038 - RNA, 22 nt, Homo sapiens
gcacaccccuggggcugagucu

SEQ ID NO: 810039 - RNA, 22 nt, Homo sapiens
gcacacccuccagagacaacag

SEQ ID NO: 810040 - RNA, 21 nt, Homo sapiens
gcacaccucagccccacugac

SEQ ID NO: 810041 - RNA, 20 nt, Homo sapiens
gcacacuagccucuccagga

SEQ ID NO: 810042 - RNA, 17 nt, Homo sapiens
gcacacucaugugcaaa

SEQ ID NO: 810043 - RNA, 11 nt, Homo sapiens
gcacacuuuac

SEQ ID NO: 810044 - RNA, 17 nt, Homo sapiens
gcacagaagguugcuau

SEQ ID NO: 810045 - RNA, 16 nt, Homo sapiens
gcacagaauuugucag

SEQ ID NO: 810046 - RNA, 21 nt, Homo sapiens
gcacagccuuugcccaaaacu

SEQ ID NO: 810047 - RNA, 17 nt, Homo sapiens
gcacagcuccugccagg

SEQ ID NO: 810048 - RNA, 21 nt, Homo sapiens
gcacaggaguguccucuuccc

SEQ ID NO: 810049 - RNA, 22 nt, Homo sapiens
gcacagggagacccguccauuu

SEQ ID NO: 810050 - RNA, 21 nt, Homo sapiens
gcacagggagugcacauaucc

SEQ ID NO: 810051 - RNA, 13 nt, Homo sapiens
gcacaguaggaau

SEQ ID NO: 810052 - RNA, 14 nt, Homo sapiens
gcacagucacccau

SEQ ID NO: 810053 - RNA, 14 nt, Homo sapiens
gcacaguuagcaaa

SEQ ID NO: 810054 - RNA, 12 nt, Homo sapiens
gcacaguuugaa

SEQ ID NO: 810055 - RNA, 14 nt, Homo sapiens
gcacauaccuucau

SEQ ID NO: 810056 - RNA, 18 nt, Homo sapiens
gcacauaccuucaugugg

SEQ ID NO: 810057 - RNA, 23 nt, Homo sapiens
gcacauauccaggcaccaggacu

SEQ ID NO: 810058 - RNA, 12 nt, Homo sapiens
gcacaugcacac

SEQ ID NO: 810059 - RNA, 23 nt, Homo sapiens
gcacaugccgcgggcggccaggc

SEQ ID NO: 810060 - RNA, 19 nt, Homo sapiens
gcacaugcgaccccgagga

SEQ ID NO: 810061 - RNA, 16 nt, Homo sapiens
gcacauggacagacuu

SEQ ID NO: 810062 - RNA, 13 nt, Homo sapiens
gcacauggugugg

SEQ ID NO: 810063 - RNA, 13 nt, Homo sapiens
gcacauguauuga

SEQ ID NO: 810064 - RNA, 20 nt, Homo sapiens
gcacaugugccacacaguga

SEQ ID NO: 810065 - RNA, 22 nt, Homo sapiens
gcacauugaaagagaaccaguu

SEQ ID NO: 810066 - RNA, 20 nt, Homo sapiens
gcacauugccuguucugcuu

SEQ ID NO: 810067 - RNA, 18 nt, Homo sapiens
gcacauuuaaggcgccau

SEQ ID NO: 810068 - RNA, 15 nt, Homo sapiens
gcacauuucuuugca

SEQ ID NO: 810069 - RNA, 17 nt, Homo sapiens
gcaccaacaucuacaag

SEQ ID NO: 810070 - RNA, 21 nt, Homo sapiens
gcaccaaccacagcaucggga

SEQ ID NO: 810071 - RNA, 13 nt, Homo sapiens
gcaccacugcacu

SEQ ID NO: 810072 - RNA, 20 nt, Homo sapiens
gcaccacugcucuccagccu

SEQ ID NO: 810073 - RNA, 23 nt, Homo sapiens
gcaccauacauuauuucuuccca

SEQ ID NO: 810074 - RNA, 19 nt, Homo sapiens
gcaccaucagccuguucca

SEQ ID NO: 810075 - RNA, 17 nt, Homo sapiens
gcacccacacacaaaga

SEQ ID NO: 810076 - RNA, 13 nt, Homo sapiens
gcaccccacugca

SEQ ID NO: 810077 - RNA, 19 nt, Homo sapiens
gcacccuaguucuaccuca

SEQ ID NO: 810078 - RNA, 17 nt, Homo sapiens
gcacccuccacccuguc

SEQ ID NO: 810079 - RNA, 17 nt, Homo sapiens
gcacccugauccucacc

SEQ ID NO: 810080 - RNA, 18 nt, Homo sapiens
gcacccugcccaccaaga

SEQ ID NO: 810081 - RNA, 16 nt, Homo sapiens
aaacauagucagcucu

SEQ ID NO: 810082 - RNA, 18 nt, Homo sapiens
aaacaucagcugaauuca

SEQ ID NO: 810083 - RNA, 16 nt, Homo sapiens
aaacauccuugcaaau

SEQ ID NO: 810084 - RNA, 21 nt, Homo sapiens
aaacaucuaauaaguauauaa

SEQ ID NO: 810085 - RNA, 16 nt, Homo sapiens
aaacaugauuguuuac

SEQ ID NO: 810086 - RNA, 19 nt, Homo sapiens
aaacauguuuaaauagccu

SEQ ID NO: 810087 - RNA, 17 nt, Homo sapiens
aaacauuaauauuuacc

SEQ ID NO: 810088 - RNA, 15 nt, Homo sapiens
aaacauucuaugugu

SEQ ID NO: 810089 - RNA, 18 nt, Homo sapiens
aaacauucugauuuggaa

SEQ ID NO: 810090 - RNA, 18 nt, Homo sapiens
aaacauuucuaaaccaga

SEQ ID NO: 810091 - RNA, 11 nt, Homo sapiens
aaacauuugcu

SEQ ID NO: 810092 - RNA, 13 nt, Homo sapiens
aaacauuuugaca

SEQ ID NO: 810093 - RNA, 12 nt, Homo sapiens
aaaccaacaaaa

SEQ ID NO: 810094 - RNA, 18 nt, Homo sapiens
aaaccaaccgcacaugca

SEQ ID NO: 810095 - RNA, 19 nt, Homo sapiens
aaaccaagccguggcuucc

SEQ ID NO: 810096 - RNA, 16 nt, Homo sapiens
aaaccaauagcuuuaa

SEQ ID NO: 810097 - RNA, 15 nt, Homo sapiens
aaaccacuagaacuc

SEQ ID NO: 810098 - RNA, 13 nt, Homo sapiens
aaaccacuguaua

SEQ ID NO: 810099 - RNA, 15 nt, Homo sapiens
gcacguaagcuccuu

SEQ ID NO: 810100 - RNA, 23 nt, Homo sapiens
gcacguccuugggcgucucuaau

SEQ ID NO: 810101 - RNA, 16 nt, Homo sapiens
gcacgugccugugauc

SEQ ID NO: 810102 - RNA, 12 nt, Homo sapiens
gcacgugucuca

SEQ ID NO: 810103 - RNA, 16 nt, Homo sapiens
gcacuaaugcuuuaag

SEQ ID NO: 810104 - RNA, 22 nt, Homo sapiens
gcacuaccacgccaagcuaauu

SEQ ID NO: 810105 - RNA, 16 nt, Homo sapiens
gcacuagaauauuuaa

SEQ ID NO: 810106 - RNA, 18 nt, Homo sapiens
gcacuaucacgagccuuu

SEQ ID NO: 810107 - RNA, 13 nt, Homo sapiens
gcacuauguauau

SEQ ID NO: 810108 - RNA, 13 nt, Homo sapiens
gcacucacgcccu

SEQ ID NO: 810109 - RNA, 20 nt, Homo sapiens
gcacucacgcccuaagcgca

SEQ ID NO: 810110 - RNA, 21 nt, Homo sapiens
gcacuccagccugagugacag

SEQ ID NO: 810111 - RNA, 22 nt, Homo sapiens
gcacuccagucuggaugacaga

SEQ ID NO: 810112 - RNA, 18 nt, Homo sapiens
gcacucuugaacugggcg

SEQ ID NO: 810113 - RNA, 18 nt, Homo sapiens
gcacugaacuuugcaaag

SEQ ID NO: 810114 - RNA, 20 nt, Homo sapiens
gcacugaggcagcgaccuca

SEQ ID NO: 810115 - RNA, 21 nt, Homo sapiens
gcacugaggcagcgaccucaa

SEQ ID NO: 810116 - RNA, 18 nt, Homo sapiens
gcacugcccuuuucagga

SEQ ID NO: 810117 - RNA, 14 nt, Homo sapiens
gcacuggagcugca

SEQ ID NO: 810118 - RNA, 15 nt, Homo sapiens
gcacugggagccaug

SEQ ID NO: 810119 - RNA, 22 nt, Homo sapiens
gcacuggguugacuuucaggua

SEQ ID NO: 810120 - RNA, 20 nt, Homo sapiens
gcacugugaccgagaacuuu

SEQ ID NO: 810121 - RNA, 16 nt, Homo sapiens
gcacugugagcaccug

SEQ ID NO: 810122 - RNA, 12 nt, Homo sapiens
gcacuguucaca

SEQ ID NO: 810123 - RNA, 15 nt, Homo sapiens
gcacuuagcccaaga

SEQ ID NO: 810124 - RNA, 16 nt, Homo sapiens
gcacuuaugauuucau

SEQ ID NO: 810125 - RNA, 13 nt, Homo sapiens
gcacuucaucuga

SEQ ID NO: 810126 - RNA, 22 nt, Homo sapiens
gcacuugauguguagacauguc

SEQ ID NO: 810127 - RNA, 20 nt, Homo sapiens
gcacuugccuguuggcugcu

SEQ ID NO: 810128 - RNA, 13 nt, Homo sapiens
gcacuugugaucc

SEQ ID NO: 810129 - RNA, 15 nt, Homo sapiens
gcacuuuaaaugaag

SEQ ID NO: 810130 - RNA, 14 nt, Homo sapiens
gcacuuucuucucu

SEQ ID NO: 810131 - RNA, 21 nt, Homo sapiens
gcacuuugaaggggccucacc

SEQ ID NO: 810132 - RNA, 18 nt, Homo sapiens
gcagaaauauagugcaau

SEQ ID NO: 810133 - RNA, 16 nt, Homo sapiens
gcagaauccucaguug

SEQ ID NO: 810134 - RNA, 21 nt, Homo sapiens
gcagaauucaaaagugauuau

SEQ ID NO: 810135 - RNA, 13 nt, Homo sapiens
gcagacaaccuca

SEQ ID NO: 810136 - RNA, 16 nt, Homo sapiens
gcagacaaugacccca

SEQ ID NO: 810137 - RNA, 15 nt, Homo sapiens
gcagacaccagcagc

SEQ ID NO: 810138 - RNA, 17 nt, Homo sapiens
gcagacaggccauguga

SEQ ID NO: 810139 - RNA, 12 nt, Homo sapiens
gcagaccaacag

SEQ ID NO: 810140 - RNA, 14 nt, Homo sapiens
gcagacccugagca

SEQ ID NO: 810141 - RNA, 14 nt, Homo sapiens
gcagaccucaugcc

SEQ ID NO: 810142 - RNA, 13 nt, Homo sapiens
gcagacgggcaca

SEQ ID NO: 810143 - RNA, 12 nt, Homo sapiens
gcagacugcugc

SEQ ID NO: 810144 - RNA, 23 nt, Homo sapiens
gcagacugcugcuagagccagca

SEQ ID NO: 810145 - RNA, 22 nt, Homo sapiens
gcagacuugaccccgacgccac

SEQ ID NO: 810146 - RNA, 20 nt, Homo sapiens
gcagagaaccaaaggggcca

SEQ ID NO: 810147 - RNA, 21 nt, Homo sapiens
gcagagaacuggaaagacaua

SEQ ID NO: 810148 - RNA, 15 nt, Homo sapiens
gcagagagcagcagc

SEQ ID NO: 810149 - RNA, 16 nt, Homo sapiens
gcagagauguacugca

SEQ ID NO: 810150 - RNA, 19 nt, Homo sapiens
gcagagcaugaccugagga

SEQ ID NO: 810151 - RNA, 20 nt, Homo sapiens
gcagagccacagcugugcau

SEQ ID NO: 810152 - RNA, 20 nt, Homo sapiens
gcagagccucguuucugcuu

SEQ ID NO: 810153 - RNA, 16 nt, Homo sapiens
gcagagccugagucac

SEQ ID NO: 810154 - RNA, 21 nt, Homo sapiens
gcagagcugagggcccugugg

SEQ ID NO: 810155 - RNA, 20 nt, Homo sapiens
gcagagcuuguuuuguuuca

SEQ ID NO: 810156 - RNA, 19 nt, Homo sapiens
gcagagggcaggggugcug

SEQ ID NO: 810157 - RNA, 11 nt, Homo sapiens
gcagaggucag

SEQ ID NO: 810158 - RNA, 13 nt, Homo sapiens
gcagaggugcaag

SEQ ID NO: 810159 - RNA, 13 nt, Homo sapiens
gcagagguugcag

SEQ ID NO: 810160 - RNA, 17 nt, Homo sapiens
gcagaguuacaguucug

SEQ ID NO: 810161 - RNA, 23 nt, Homo sapiens
gcagaguuuguguguugucuuga

SEQ ID NO: 810162 - RNA, 12 nt, Homo sapiens
gcagauacuuga

SEQ ID NO: 810163 - RNA, 16 nt, Homo sapiens
gcagauccucugggaa

SEQ ID NO: 810164 - RNA, 18 nt, Homo sapiens
gcagaugcuuuacaguca

SEQ ID NO: 810165 - RNA, 20 nt, Homo sapiens
gcagauuuccagccuucuac

SEQ ID NO: 810166 - RNA, 21 nt, Homo sapiens
gcagcaaaagaccaaaucuca

SEQ ID NO: 810167 - RNA, 15 nt, Homo sapiens
gcagcaaauuuucag

SEQ ID NO: 810168 - RNA, 21 nt, Homo sapiens
gcagcaaggaaagcucacgaa

SEQ ID NO: 810169 - RNA, 19 nt, Homo sapiens
gcagcaagggaccugcuca

SEQ ID NO: 810170 - RNA, 11 nt, Homo sapiens
gcagcacuccc

SEQ ID NO: 810171 - RNA, 12 nt, Homo sapiens
gcagcacucccc

SEQ ID NO: 810172 - RNA, 13 nt, Homo sapiens
gcagcacugugag

SEQ ID NO: 810173 - RNA, 18 nt, Homo sapiens
gcagcauagcaagacaca

SEQ ID NO: 810174 - RNA, 10 nt, Homo sapiens
gcagcauucc

SEQ ID NO: 810175 - RNA, 16 nt, Homo sapiens
gcagcauuucauugca

SEQ ID NO: 810176 - RNA, 14 nt, Homo sapiens
gcagccaaccaaga

SEQ ID NO: 810177 - RNA, 22 nt, Homo sapiens
gcagccaacccggcacugcccu

SEQ ID NO: 810178 - RNA, 13 nt, Homo sapiens
gcagccaggacac

SEQ ID NO: 810179 - RNA, 18 nt, Homo sapiens
gcagcccaacagcacuuu

SEQ ID NO: 810180 - RNA, 16 nt, Homo sapiens
gcagccuccacuuccc

SEQ ID NO: 810181 - RNA, 14 nt, Homo sapiens
gcagccucugccag

SEQ ID NO: 810182 - RNA, 17 nt, Homo sapiens
gcagccuugacuucuca

SEQ ID NO: 810183 - RNA, 21 nt, Homo sapiens
gcagccuuuacguucaucacc

SEQ ID NO: 810184 - RNA, 19 nt, Homo sapiens
gcagcgcugcaguugcuca

SEQ ID NO: 810185 - RNA, 20 nt, Homo sapiens
gcagcuaaaggaagugaauc

SEQ ID NO: 810186 - RNA, 15 nt, Homo sapiens
gcagcuagugccuuu

SEQ ID NO: 810187 - RNA, 18 nt, Homo sapiens
gcagcucaggcacacuuc

SEQ ID NO: 810188 - RNA, 20 nt, Homo sapiens
gcagcuccuuccuagccuug

SEQ ID NO: 810189 - RNA, 14 nt, Homo sapiens
gcagcucuugcccu

SEQ ID NO: 810190 - RNA, 16 nt, Homo sapiens
gcagcuggaggcugcu

SEQ ID NO: 810191 - RNA, 18 nt, Homo sapiens
gcagcuggggcuagggga

SEQ ID NO: 810192 - RNA, 17 nt, Homo sapiens
gcagcugguaaucuugc

SEQ ID NO: 810193 - RNA, 11 nt, Homo sapiens
gcagcugugag

SEQ ID NO: 810194 - RNA, 15 nt, Homo sapiens
gcaggaaaaguugau

SEQ ID NO: 810195 - RNA, 14 nt, Homo sapiens
gcaggaaggaacaa

SEQ ID NO: 810196 - RNA, 14 nt, Homo sapiens
gcaggacuugccac

SEQ ID NO: 810197 - RNA, 14 nt, Homo sapiens
gcauggacauuuag

SEQ ID NO: 810198 - RNA, 17 nt, Homo sapiens
gcauggagagccucuua

SEQ ID NO: 810199 - RNA, 18 nt, Homo sapiens
gcauggauggguccucac

SEQ ID NO: 810200 - RNA, 18 nt, Homo sapiens
gcauggcuaauagggcca

SEQ ID NO: 810201 - RNA, 16 nt, Homo sapiens
gcaugguguguggugc

SEQ ID NO: 810202 - RNA, 22 nt, Homo sapiens
gcauguccaacaugguaauuca

SEQ ID NO: 810203 - RNA, 18 nt, Homo sapiens
gcaugucucaauaguaaa

SEQ ID NO: 810204 - RNA, 16 nt, Homo sapiens
gcauguguauuuccag

SEQ ID NO: 810205 - RNA, 12 nt, Homo sapiens
gcauuacaggug

SEQ ID NO: 810206 - RNA, 21 nt, Homo sapiens
gcauuagcucuuagacccaca

SEQ ID NO: 810207 - RNA, 17 nt, Homo sapiens
gcauuauguccacugug

SEQ ID NO: 810208 - RNA, 20 nt, Homo sapiens
gcauuauguccacuguguau

SEQ ID NO: 810209 - RNA, 20 nt, Homo sapiens
gcauuccagccccucugguc

SEQ ID NO: 810210 - RNA, 15 nt, Homo sapiens
gcauuccugaugacc

SEQ ID NO: 810211 - RNA, 22 nt, Homo sapiens
gcauucggggaagcugcacaug

SEQ ID NO: 810212 - RNA, 22 nt, Homo sapiens
gcauucucguauccaacccaag

SEQ ID NO: 810213 - RNA, 21 nt, Homo sapiens
gcauucugagcaggggaacaa

SEQ ID NO: 810214 - RNA, 12 nt, Homo sapiens
gcauugcacuug

SEQ ID NO: 810215 - RNA, 22 nt, Homo sapiens
aaagagccuucagaaugcuccu

SEQ ID NO: 810216 - RNA, 17 nt, Homo sapiens
aaagagcgucauguccu

SEQ ID NO: 810217 - RNA, 18 nt, Homo sapiens
aaagagcuuugugauaua

SEQ ID NO: 810218 - RNA, 15 nt, Homo sapiens
aaagaggaaccagga

SEQ ID NO: 810219 - RNA, 23 nt, Homo sapiens
aaagaggaacgggcuuggaagaa

SEQ ID NO: 810220 - RNA, 15 nt, Homo sapiens
aaagagggacaagag

SEQ ID NO: 810221 - RNA, 16 nt, Homo sapiens
aaagagggacaggcug

SEQ ID NO: 810222 - RNA, 15 nt, Homo sapiens
aaagaggguaacaau

SEQ ID NO: 810223 - RNA, 15 nt, Homo sapiens
aaagagguuacuuua

SEQ ID NO: 810224 - RNA, 16 nt, Homo sapiens
aaagagugaaugccau

SEQ ID NO: 810225 - RNA, 20 nt, Homo sapiens
aaagauaacaagaucuuuca

SEQ ID NO: 810226 - RNA, 14 nt, Homo sapiens
aaagauacggccca

SEQ ID NO: 810227 - RNA, 20 nt, Homo sapiens
aaagauaggaggaaccacaa

SEQ ID NO: 810228 - RNA, 16 nt, Homo sapiens
aaagauaucagagcuc

SEQ ID NO: 810229 - RNA, 23 nt, Homo sapiens
aaagauauuucagagagcuucuu

SEQ ID NO: 810230 - RNA, 23 nt, Homo sapiens
aaagauccccaaaacaggccagg

SEQ ID NO: 810231 - RNA, 18 nt, Homo sapiens
aaagaugagaucggagac

SEQ ID NO: 810232 - RNA, 20 nt, Homo sapiens
aaagaugaucuacucagaaa

SEQ ID NO: 810233 - RNA, 22 nt, Homo sapiens
aaagaugcaaggaccaggacuc

SEQ ID NO: 810234 - RNA, 23 nt, Homo sapiens
aaagauggccauauuaccccuuu

SEQ ID NO: 810235 - RNA, 13 nt, Homo sapiens
aaagaugguuuau

SEQ ID NO: 810236 - RNA, 22 nt, Homo sapiens
aaagaugguuuaugcauguaua

SEQ ID NO: 810237 - RNA, 19 nt, Homo sapiens
aaagauguuuacaucaaag

SEQ ID NO: 810238 - RNA, 19 nt, Homo sapiens
aaagauguuugucagauau

SEQ ID NO: 810239 - RNA, 19 nt, Homo sapiens
aaagauugauuuguguguu

SEQ ID NO: 810240 - RNA, 17 nt, Homo sapiens
aaagauuguuggaugaa

SEQ ID NO: 810241 - RNA, 11 nt, Homo sapiens
aaagauuuaca

SEQ ID NO: 810242 - RNA, 21 nt, Homo sapiens
aaagcaaaauacaucagcuug

SEQ ID NO: 810243 - RNA, 22 nt, Homo sapiens
aaagcaaacacuuacagaauua

SEQ ID NO: 810244 - RNA, 14 nt, Homo sapiens
aaagcaaguguuca

SEQ ID NO: 810245 - RNA, 18 nt, Homo sapiens
aaagcacauguauugaca

SEQ ID NO: 810246 - RNA, 21 nt, Homo sapiens
aaagcaccagcaggcacguua

SEQ ID NO: 810247 - RNA, 15 nt, Homo sapiens
aaagcacuacaauca

SEQ ID NO: 810248 - RNA, 22 nt, Homo sapiens
aaagcacuccugcuuaaucuuc

SEQ ID NO: 810249 - RNA, 11 nt, Homo sapiens
aaagcacugac

SEQ ID NO: 810250 - RNA, 15 nt, Homo sapiens
aaagcacugacuucu

SEQ ID NO: 810251 - RNA, 13 nt, Homo sapiens
aaagcagacuuuu

SEQ ID NO: 810252 - RNA, 14 nt, Homo sapiens
aaagcagauacuug

SEQ ID NO: 810253 - RNA, 17 nt, Homo sapiens
aaagcagaugagcugug

SEQ ID NO: 810254 - RNA, 12 nt, Homo sapiens
aaagcagcaucu

SEQ ID NO: 810255 - RNA, 15 nt, Homo sapiens
aaagcagccugugaa

SEQ ID NO: 810256 - RNA, 16 nt, Homo sapiens
aaagcagcucaagaac

SEQ ID NO: 810257 - RNA, 17 nt, Homo sapiens
aaagcagcucaagaaca

SEQ ID NO: 810258 - RNA, 21 nt, Homo sapiens
aaagcagcucaagaacacaug

SEQ ID NO: 810259 - RNA, 21 nt, Homo sapiens
aaagcaggauuauuaagugau

SEQ ID NO: 810260 - RNA, 19 nt, Homo sapiens
aaagcaguggacaccagga

SEQ ID NO: 810261 - RNA, 13 nt, Homo sapiens
aaagcaguucaug

SEQ ID NO: 810262 - RNA, 20 nt, Homo sapiens
aaagcaguucaugucugaaa

SEQ ID NO: 810263 - RNA, 23 nt, Homo sapiens
aaagcauaugcagccaaccaaga

SEQ ID NO: 810264 - RNA, 21 nt, Homo sapiens
aaagcauauuggugcuagaaa

SEQ ID NO: 810265 - RNA, 16 nt, Homo sapiens
aaagcaucaccucagg

SEQ ID NO: 810266 - RNA, 18 nt, Homo sapiens
aaagcccugccucugugu

SEQ ID NO: 810267 - RNA, 13 nt, Homo sapiens
aaagccuauucac

SEQ ID NO: 810268 - RNA, 15 nt, Homo sapiens
aaagccuauucacuu

SEQ ID NO: 810269 - RNA, 20 nt, Homo sapiens
aaagccucacguauuucaca

SEQ ID NO: 810270 - RNA, 24 nt, Homo sapiens
aaagccuccaaggguuucgacugg

SEQ ID NO: 810271 - RNA, 16 nt, Homo sapiens
aaagccugcaauuuca

SEQ ID NO: 810272 - RNA, 20 nt, Homo sapiens
aaagcgagaucccaucucua

SEQ ID NO: 810273 - RNA, 20 nt, Homo sapiens
aaagcggggcuucaucugca

SEQ ID NO: 810274 - RNA, 16 nt, Homo sapiens
aaagcguaaaaggaga

SEQ ID NO: 810275 - RNA, 13 nt, Homo sapiens
aaagcguccucuc

SEQ ID NO: 810276 - RNA, 14 nt, Homo sapiens
aaagcguccucuca

SEQ ID NO: 810277 - RNA, 15 nt, Homo sapiens
aaagcguccucucag

SEQ ID NO: 810278 - RNA, 17 nt, Homo sapiens
aaagcguccucucagua

SEQ ID NO: 810279 - RNA, 16 nt, Homo sapiens
aaagcuaauuaaucau

SEQ ID NO: 810280 - RNA, 12 nt, Homo sapiens
aaagcuaccugu

SEQ ID NO: 810281 - RNA, 20 nt, Homo sapiens
aaagcuagcacuaacucgug

SEQ ID NO: 810282 - RNA, 23 nt, Homo sapiens
aaagcuaggaugguucugugacc

SEQ ID NO: 810283 - RNA, 20 nt, Homo sapiens
aaagcucuauuaagauuucc

SEQ ID NO: 810284 - RNA, 17 nt, Homo sapiens
aaagcugaccccaaaga

SEQ ID NO: 810285 - RNA, 12 nt, Homo sapiens
aaagcugccauu

SEQ ID NO: 810286 - RNA, 17 nt, Homo sapiens
aaagcuggacugaccaa

SEQ ID NO: 810287 - RNA, 24 nt, Homo sapiens
aaagcuguuccuugguccuaguaa

SEQ ID NO: 810288 - RNA, 23 nt, Homo sapiens
aaagcuguuuauuuauucacugu

SEQ ID NO: 810289 - RNA, 16 nt, Homo sapiens
aaagcuucacaguacc

SEQ ID NO: 810290 - RNA, 21 nt, Homo sapiens
aaagcuuguggccccuuuuac

SEQ ID NO: 810291 - RNA, 18 nt, Homo sapiens
aaagcuuuacuacugugg

SEQ ID NO: 810292 - RNA, 19 nt, Homo sapiens
aaagcuuuuauugucacag

SEQ ID NO: 810293 - RNA, 20 nt, Homo sapiens
aaaggaaaaucacaucucca

SEQ ID NO: 810294 - RNA, 16 nt, Homo sapiens
aaaggaauacauugca

SEQ ID NO: 810295 - RNA, 17 nt, Homo sapiens
aaaggaauacauugcaa

SEQ ID NO: 810296 - RNA, 14 nt, Homo sapiens
aaaggacccuguga

SEQ ID NO: 810297 - RNA, 21 nt, Homo sapiens
aaaggaugcacagucaggaag

SEQ ID NO: 810298 - RNA, 21 nt, Homo sapiens
aaaggauguuuugucccauuu

SEQ ID NO: 810299 - RNA, 20 nt, Homo sapiens
aaaggauuuuaccaaagcau

SEQ ID NO: 810300 - RNA, 24 nt, Homo sapiens
aaaggcaaaaagcauguguuugca

SEQ ID NO: 810301 - RNA, 21 nt, Homo sapiens
aaaggcaugcgcucacugcuu

SEQ ID NO: 810302 - RNA, 21 nt, Homo sapiens
aaaggccagguugcuaagaaa

SEQ ID NO: 810303 - RNA, 19 nt, Homo sapiens
aaaggcgguacuaguucag

SEQ ID NO: 810304 - RNA, 15 nt, Homo sapiens
aaaggcucagucuca

SEQ ID NO: 810305 - RNA, 16 nt, Homo sapiens
aaaggcucccauguga

SEQ ID NO: 810306 - RNA, 11 nt, Homo sapiens
aaagggagaag

SEQ ID NO: 810307 - RNA, 20 nt, Homo sapiens
aaagggagaauaaaauuccu

SEQ ID NO: 810308 - RNA, 16 nt, Homo sapiens
aaagggauaguccaaa

SEQ ID NO: 810309 - RNA, 18 nt, Homo sapiens
aaagggauaguccaaaga

SEQ ID NO: 810310 - RNA, 14 nt, Homo sapiens
aaagggcaguuuug

SEQ ID NO: 810311 - RNA, 11 nt, Homo sapiens
gaacuccacuc

SEQ ID NO: 810312 - RNA, 18 nt, Homo sapiens
gaacucccagaaccacua

SEQ ID NO: 810313 - RNA, 19 nt, Homo sapiens
gaacucgccucagccugau

SEQ ID NO: 810314 - RNA, 19 nt, Homo sapiens
gaacucuaaccaguguaca

SEQ ID NO: 810315 - RNA, 18 nt, Homo sapiens
gaacucucaagugucuua

SEQ ID NO: 810316 - RNA, 11 nt, Homo sapiens
gaacucuccau

SEQ ID NO: 810317 - RNA, 14 nt, Homo sapiens
gaacucugguggca

SEQ ID NO: 810318 - RNA, 19 nt, Homo sapiens
gaacucugguggcacagga

SEQ ID NO: 810319 - RNA, 13 nt, Homo sapiens
gaacucuguaaaa

SEQ ID NO: 810320 - RNA, 18 nt, Homo sapiens
gaacucuguaaaaccuca

SEQ ID NO: 810321 - RNA, 18 nt, Homo sapiens
gaacugaaggcauaugca

SEQ ID NO: 810322 - RNA, 21 nt, Homo sapiens
gacaccuccauuucucuccag

SEQ ID NO: 810323 - RNA, 19 nt, Homo sapiens
gacaccuguacauucuucc

SEQ ID NO: 810324 - RNA, 18 nt, Homo sapiens
gacacggcuucacugacc

SEQ ID NO: 810325 - RNA, 15 nt, Homo sapiens
gacacuagccugugc

SEQ ID NO: 810326 - RNA, 18 nt, Homo sapiens
gacacuagccugugcacg

SEQ ID NO: 810327 - RNA, 16 nt, Homo sapiens
gacacuauucauuuga

SEQ ID NO: 810328 - RNA, 21 nt, Homo sapiens
gacacugaaaguuuuguaaaa

SEQ ID NO: 810329 - RNA, 20 nt, Homo sapiens
gacacuuugucuaguguauu

SEQ ID NO: 810330 - RNA, 16 nt, Homo sapiens
gacagaaagaucuuca

SEQ ID NO: 810331 - RNA, 17 nt, Homo sapiens
gacagaaggugccacuu

SEQ ID NO: 810332 - RNA, 22 nt, Homo sapiens
gacagaccacagagcugucacu

SEQ ID NO: 810333 - RNA, 21 nt, Homo sapiens
gacagagaggggcagguugac

SEQ ID NO: 810334 - RNA, 22 nt, Homo sapiens
gacagagcaagaccccaucuca

SEQ ID NO: 810335 - RNA, 22 nt, Homo sapiens
gacagagccaggagaagcucag

SEQ ID NO: 810336 - RNA, 18 nt, Homo sapiens
gacagaggguggcuggag

SEQ ID NO: 810337 - RNA, 16 nt, Homo sapiens
gacagauugccuguuu

SEQ ID NO: 810338 - RNA, 20 nt, Homo sapiens
gacagauuuggaugcacuca

SEQ ID NO: 810339 - RNA, 19 nt, Homo sapiens
gacagcaucuuccucccuc

SEQ ID NO: 810340 - RNA, 15 nt, Homo sapiens
gacagccaagcaccu

SEQ ID NO: 810341 - RNA, 15 nt, Homo sapiens
gacagcccuccuuga

SEQ ID NO: 810342 - RNA, 15 nt, Homo sapiens
gacagccugcagcag

SEQ ID NO: 810343 - RNA, 20 nt, Homo sapiens
gacagcgucuccaauuauga

SEQ ID NO: 810344 - RNA, 20 nt, Homo sapiens
gacagcuucaugaaacuguc

SEQ ID NO: 810345 - RNA, 18 nt, Homo sapiens
gacagcuuuccucaaaaa

SEQ ID NO: 810346 - RNA, 16 nt, Homo sapiens
gacaggaauacuuaac

SEQ ID NO: 810347 - RNA, 13 nt, Homo sapiens
gacaggcacucca

SEQ ID NO: 810348 - RNA, 18 nt, Homo sapiens
gacaggcuccucugggga

SEQ ID NO: 810349 - RNA, 13 nt, Homo sapiens
gacaggcucuuag

SEQ ID NO: 810350 - RNA, 15 nt, Homo sapiens
gacagggacaugccc

SEQ ID NO: 810351 - RNA, 20 nt, Homo sapiens
gacagguggcaacaaugccc

SEQ ID NO: 810352 - RNA, 18 nt, Homo sapiens
gacaguaccuagcuguaa

SEQ ID NO: 810353 - RNA, 12 nt, Homo sapiens
gacaguaccuga

SEQ ID NO: 810354 - RNA, 18 nt, Homo sapiens
gacagucguucccagugu

SEQ ID NO: 810355 - RNA, 22 nt, Homo sapiens
gacagugaaauacauccuucaa

SEQ ID NO: 810356 - RNA, 14 nt, Homo sapiens
gacagugaacauuc

SEQ ID NO: 810357 - RNA, 14 nt, Homo sapiens
gacagugccuggga

SEQ ID NO: 810358 - RNA, 21 nt, Homo sapiens
gacagugccugggaauguauu

SEQ ID NO: 810359 - RNA, 16 nt, Homo sapiens
gacaguugcagaauug

SEQ ID NO: 810360 - RNA, 18 nt, Homo sapiens
gacauaauuucacugaau

SEQ ID NO: 810361 - RNA, 19 nt, Homo sapiens
gacauacauuuaugcacau

SEQ ID NO: 810362 - RNA, 21 nt, Homo sapiens
gacauacuagaguugauuaua

SEQ ID NO: 810363 - RNA, 17 nt, Homo sapiens
gacauacuuaaugcaua

SEQ ID NO: 810364 - RNA, 22 nt, Homo sapiens
gacaucacuuacuauccauuuc

SEQ ID NO: 810365 - RNA, 20 nt, Homo sapiens
gacauccugagcagugccag

SEQ ID NO: 810366 - RNA, 18 nt, Homo sapiens
gacaugaaaggacccugu

SEQ ID NO: 810367 - RNA, 18 nt, Homo sapiens
gacaugcccaaggccacg

SEQ ID NO: 810368 - RNA, 15 nt, Homo sapiens
gacaugcccugugug

SEQ ID NO: 810369 - RNA, 21 nt, Homo sapiens
gacauggacccacuacccuuc

SEQ ID NO: 810370 - RNA, 14 nt, Homo sapiens
gacauguaauguug

SEQ ID NO: 810371 - RNA, 15 nt, Homo sapiens
gacauguggggccag

SEQ ID NO: 810372 - RNA, 18 nt, Homo sapiens
gacauuaaaucuaugaag

SEQ ID NO: 810373 - RNA, 17 nt, Homo sapiens
gaccaaagacugcagaa

SEQ ID NO: 810374 - RNA, 17 nt, Homo sapiens
gaccaaagagcccucaa

SEQ ID NO: 810375 - RNA, 13 nt, Homo sapiens
gaccaaaucucag

SEQ ID NO: 810376 - RNA, 21 nt, Homo sapiens
gaccaaauugcuuuacaguuu

SEQ ID NO: 810377 - RNA, 15 nt, Homo sapiens
gaccaacugggccca

SEQ ID NO: 810378 - RNA, 20 nt, Homo sapiens
gaccaagccgagaugcccau

SEQ ID NO: 810379 - RNA, 12 nt, Homo sapiens
gaccaagguaua

SEQ ID NO: 810380 - RNA, 13 nt, Homo sapiens
gaccaauacuacu

SEQ ID NO: 810381 - RNA, 20 nt, Homo sapiens
gaccaauucuaacagcaaau

SEQ ID NO: 810382 - RNA, 23 nt, Homo sapiens
gaccacacugcacacagugacuu

SEQ ID NO: 810383 - RNA, 23 nt, Homo sapiens
gaccaccaccccaacaaaccauc

SEQ ID NO: 810384 - RNA, 16 nt, Homo sapiens
gaccaccuaauaucaa

SEQ ID NO: 810385 - RNA, 16 nt, Homo sapiens
gaccaccuuucacaaa

SEQ ID NO: 810386 - RNA, 14 nt, Homo sapiens
gaccacggacucca

SEQ ID NO: 810387 - RNA, 22 nt, Homo sapiens
gaccacugaagcaccacaggga

SEQ ID NO: 810388 - RNA, 17 nt, Homo sapiens
gaccacugaauucacuc

SEQ ID NO: 810389 - RNA, 18 nt, Homo sapiens
gaccacugcuggaccaag

SEQ ID NO: 810390 - RNA, 13 nt, Homo sapiens
gaccacugucucc

SEQ ID NO: 810391 - RNA, 15 nt, Homo sapiens
gaccacuuccagggg

SEQ ID NO: 810392 - RNA, 17 nt, Homo sapiens
gaccacuuccaggggaa

SEQ ID NO: 810393 - RNA, 22 nt, Homo sapiens
gaccacuuuuuguaauacuuuu

SEQ ID NO: 810394 - RNA, 16 nt, Homo sapiens
gaccagaaauucccuu

SEQ ID NO: 810395 - RNA, 22 nt, Homo sapiens
gaccagcagcugaugccuccuu

SEQ ID NO: 810396 - RNA, 23 nt, Homo sapiens
gaccagccagggcaacacaguga

SEQ ID NO: 810397 - RNA, 14 nt, Homo sapiens
gaccagcucucuuc

SEQ ID NO: 810398 - RNA, 19 nt, Homo sapiens
gaccagcucucuuccuguc

SEQ ID NO: 810399 - RNA, 18 nt, Homo sapiens
gaccagcuuugcagugac

SEQ ID NO: 810400 - RNA, 17 nt, Homo sapiens
gaccagggcuuuuccca

SEQ ID NO: 810401 - RNA, 22 nt, Homo sapiens
gaccagguuugaugccugugaa

SEQ ID NO: 810402 - RNA, 21 nt, Homo sapiens
gaccaguaugcuuggacugaa

SEQ ID NO: 810403 - RNA, 20 nt, Homo sapiens
gaccaguugggagcacugga

SEQ ID NO: 810404 - RNA, 17 nt, Homo sapiens
gaccaucuuugccaaca

SEQ ID NO: 810405 - RNA, 15 nt, Homo sapiens
gaccauuuucugcca

SEQ ID NO: 810406 - RNA, 17 nt, Homo sapiens
gacccaacagcagugau

SEQ ID NO: 810407 - RNA, 17 nt, Homo sapiens
gacccaccccugugcuc

SEQ ID NO: 810408 - RNA, 13 nt, Homo sapiens
gacccaccuucaa

SEQ ID NO: 810409 - RNA, 13 nt, Homo sapiens
gacccacugugcu

SEQ ID NO: 810410 - RNA, 14 nt, Homo sapiens
gacccacugugcug

SEQ ID NO: 810411 - RNA, 14 nt, Homo sapiens
gacccagccuucag

SEQ ID NO: 810412 - RNA, 19 nt, Homo sapiens
gacccagccuucagucaca

SEQ ID NO: 810413 - RNA, 22 nt, Homo sapiens
gacccagcugcagaccaugcca

SEQ ID NO: 810414 - RNA, 12 nt, Homo sapiens
gacccaggaaag

SEQ ID NO: 810415 - RNA, 23 nt, Homo sapiens
gacccaggaaaggcaggauugaa

SEQ ID NO: 810416 - RNA, 16 nt, Homo sapiens
gacccagggaugacau

SEQ ID NO: 810417 - RNA, 18 nt, Homo sapiens
gacccagggaugacaugu

SEQ ID NO: 810418 - RNA, 16 nt, Homo sapiens
gacccaggucauggaa

SEQ ID NO: 810419 - RNA, 14 nt, Homo sapiens
gacccaugugcaag

SEQ ID NO: 810420 - RNA, 19 nt, Homo sapiens
gaccccaaaggaacacuga

SEQ ID NO: 810421 - RNA, 20 nt, Homo sapiens
gaccccaaauuaagaaucua

SEQ ID NO: 810422 - RNA, 16 nt, Homo sapiens
gaccccacccaagcuu

SEQ ID NO: 810423 - RNA, 20 nt, Homo sapiens
gaccccagcugccaaggaaa

SEQ ID NO: 810424 - RNA, 13 nt, Homo sapiens
gaccccaucucuu

SEQ ID NO: 810425 - RNA, 17 nt, Homo sapiens
gaccccaucuuccagcc

SEQ ID NO: 810426 - RNA, 15 nt, Homo sapiens
gacccccagcacuug

SEQ ID NO: 810427 - RNA, 23 nt, Homo sapiens
gacccccagcacuuggggguuca

SEQ ID NO: 810428 - RNA, 16 nt, Homo sapiens
gaccccgccucaccaa

SEQ ID NO: 810429 - RNA, 16 nt, Homo sapiens
gaccccucccaaccuc

SEQ ID NO: 810430 - RNA, 20 nt, Homo sapiens
gacccggaggggccuggcag

SEQ ID NO: 810431 - RNA, 21 nt, Homo sapiens
gacccuacuucuuuugcucuu

SEQ ID NO: 810432 - RNA, 21 nt, Homo sapiens
gacccucauggcccccagggg

SEQ ID NO: 810433 - RNA, 15 nt, Homo sapiens
gaggaggugacaaac

SEQ ID NO: 810434 - RNA, 15 nt, Homo sapiens
gaggagguuucugca

SEQ ID NO: 810435 - RNA, 14 nt, Homo sapiens
gaggaguaauggca

SEQ ID NO: 810436 - RNA, 15 nt, Homo sapiens
gaggaguaccgccag

SEQ ID NO: 810437 - RNA, 19 nt, Homo sapiens
gcacagaaggaaucugugc

SEQ ID NO: 810438 - RNA, 18 nt, Homo sapiens
gcacagaagguugcuaua

SEQ ID NO: 810439 - RNA, 13 nt, Homo sapiens
gcacagauggauu

SEQ ID NO: 810440 - RNA, 15 nt, Homo sapiens
gcacagcuaauucua

SEQ ID NO: 810441 - RNA, 21 nt, Homo sapiens
gcacagcugaguuaugaugua

SEQ ID NO: 810442 - RNA, 22 nt, Homo sapiens
gcacaggaguguccucuucccu

SEQ ID NO: 810443 - RNA, 16 nt, Homo sapiens
gcacagggcaccagag

SEQ ID NO: 810444 - RNA, 17 nt, Homo sapiens
gcacaguaaaaauggaa

SEQ ID NO: 810445 - RNA, 18 nt, Homo sapiens
gcacaguaggaauuggaa

SEQ ID NO: 810446 - RNA, 15 nt, Homo sapiens
gcacagucacugcuc

SEQ ID NO: 810447 - RNA, 21 nt, Homo sapiens
gcacaguucaugguuuccucc

SEQ ID NO: 810448 - RNA, 13 nt, Homo sapiens
gcacauaacaugc

SEQ ID NO: 810449 - RNA, 21 nt, Homo sapiens
gcacauauggacucugcacau

SEQ ID NO: 810450 - RNA, 17 nt, Homo sapiens
gcacaucacaacauuua

SEQ ID NO: 810451 - RNA, 17 nt, Homo sapiens
gcacaugaauaauuuca

SEQ ID NO: 810452 - RNA, 12 nt, Homo sapiens
gcacaugcagau

SEQ ID NO: 810453 - RNA, 20 nt, Homo sapiens
gcacaugucuuguacaugug

SEQ ID NO: 810454 - RNA, 13 nt, Homo sapiens
gcacauugugcag

SEQ ID NO: 810455 - RNA, 21 nt, Homo sapiens
gcacauuuaaggcgccauugc

SEQ ID NO: 810456 - RNA, 18 nt, Homo sapiens
gcacauuugucacugaau

SEQ ID NO: 810457 - RNA, 17 nt, Homo sapiens
gcaccaaagacaucagu

SEQ ID NO: 810458 - RNA, 23 nt, Homo sapiens
gcaccaaagacaucagucuccaa

SEQ ID NO: 810459 - RNA, 16 nt, Homo sapiens
gcaccacugcacucca

SEQ ID NO: 810460 - RNA, 20 nt, Homo sapiens
gcaccacugcacuccagccu

SEQ ID NO: 810461 - RNA, 16 nt, Homo sapiens
gcaccacugcuuccca

SEQ ID NO: 810462 - RNA, 19 nt, Homo sapiens
gcaccacuguguauuuaac

SEQ ID NO: 810463 - RNA, 17 nt, Homo sapiens
gcaccagacacccagga

SEQ ID NO: 810464 - RNA, 19 nt, Homo sapiens
gcaccagcgguccaacgcc

SEQ ID NO: 810465 - RNA, 16 nt, Homo sapiens
gcaccaggagaggaca

SEQ ID NO: 810466 - RNA, 15 nt, Homo sapiens
gcaccauugcgcucu

SEQ ID NO: 810467 - RNA, 22 nt, Homo sapiens
gcacccaccaccaugcccagcu

SEQ ID NO: 810468 - RNA, 17 nt, Homo sapiens
gcaccccaaagcuuucc

SEQ ID NO: 810469 - RNA, 22 nt, Homo sapiens
gcacccgcccuuuccuugccuu

SEQ ID NO: 810470 - RNA, 17 nt, Homo sapiens
gcacccucccacccggc

SEQ ID NO: 810471 - RNA, 22 nt, Homo sapiens
gcacccugcccaccaagaagca

SEQ ID NO: 810472 - RNA, 12 nt, Homo sapiens
gcacccuggauu

SEQ ID NO: 810473 - RNA, 21 nt, Homo sapiens
gcacccuggauugaucggagc

SEQ ID NO: 810474 - RNA, 23 nt, Homo sapiens
gcacccuggggccuggaccugcc

SEQ ID NO: 810475 - RNA, 13 nt, Homo sapiens
gcaccgagaccaa

SEQ ID NO: 810476 - RNA, 19 nt, Homo sapiens
gcaccuacacucaccugca

SEQ ID NO: 810477 - RNA, 13 nt, Homo sapiens
gcaccuaccucac

SEQ ID NO: 810478 - RNA, 21 nt, Homo sapiens
gcaccuaccuuagaaaacaag

SEQ ID NO: 810479 - RNA, 21 nt, Homo sapiens
gcaccucacaggccccaggaa

SEQ ID NO: 810480 - RNA, 20 nt, Homo sapiens
gcaccucggggacaccagag

SEQ ID NO: 810481 - RNA, 21 nt, Homo sapiens
gcaccucuagggccucuccag

SEQ ID NO: 810482 - RNA, 21 nt, Homo sapiens
gcaccugccagaggaugcucu

SEQ ID NO: 810483 - RNA, 13 nt, Homo sapiens
gcaccugcgcaca

SEQ ID NO: 810484 - RNA, 11 nt, Homo sapiens
gcaccuggcau

SEQ ID NO: 810485 - RNA, 12 nt, Homo sapiens
gcaccugugcag

SEQ ID NO: 810486 - RNA, 12 nt, Homo sapiens
gcaccuguggug

SEQ ID NO: 810487 - RNA, 24 nt, Homo sapiens
gcaccuugugucuguacacguguc

SEQ ID NO: 810488 - RNA, 13 nt, Homo sapiens
gcaccuuugcacg

SEQ ID NO: 810489 - RNA, 13 nt, Homo sapiens
gcaccuuuuugca

SEQ ID NO: 810490 - RNA, 13 nt, Homo sapiens
gcacgaucucagu

SEQ ID NO: 810491 - RNA, 21 nt, Homo sapiens
gcacgcccuacuccacugccc

SEQ ID NO: 810492 - RNA, 23 nt, Homo sapiens
gcacggagccgcgggacagccaa

SEQ ID NO: 810493 - RNA, 19 nt, Homo sapiens
gcacgguuuccagauguaa

SEQ ID NO: 810494 - RNA, 16 nt, Homo sapiens
gcacuaaaucagagac

SEQ ID NO: 810495 - RNA, 21 nt, Homo sapiens
gcacuauaauguaagcucuac

SEQ ID NO: 810496 - RNA, 13 nt, Homo sapiens
gcacuauuuccac

SEQ ID NO: 810497 - RNA, 13 nt, Homo sapiens
gcacucagauuua

SEQ ID NO: 810498 - RNA, 19 nt, Homo sapiens
gcacucagauuuaagccuu

SEQ ID NO: 810499 - RNA, 15 nt, Homo sapiens
gcacucauggguaau

SEQ ID NO: 810500 - RNA, 19 nt, Homo sapiens
gcacugaggaagaacgggg

SEQ ID NO: 810501 - RNA, 16 nt, Homo sapiens
gcacugaucacccaau

SEQ ID NO: 810502 - RNA, 20 nt, Homo sapiens
gcacugaugcugccccucau

SEQ ID NO: 810503 - RNA, 20 nt, Homo sapiens
gcacugccugccauguaguu

SEQ ID NO: 810504 - RNA, 17 nt, Homo sapiens
gcacugugagcaccuga

SEQ ID NO: 810505 - RNA, 16 nt, Homo sapiens
gcacuguuagugacag

SEQ ID NO: 810506 - RNA, 20 nt, Homo sapiens
gcacuuacagcucuggccac

SEQ ID NO: 810507 - RNA, 14 nt, Homo sapiens
gcacuucauaucca

SEQ ID NO: 810508 - RNA, 15 nt, Homo sapiens
gcacuuccuggucuu

SEQ ID NO: 810509 - RNA, 11 nt, Homo sapiens
gcacuugccug

SEQ ID NO: 810510 - RNA, 17 nt, Homo sapiens
gcacuugugauccuaaa

SEQ ID NO: 810511 - RNA, 15 nt, Homo sapiens
gcacuuuagaucacu

SEQ ID NO: 810512 - RNA, 22 nt, Homo sapiens
gcacuuugggaggcugaggcag

SEQ ID NO: 810513 - RNA, 15 nt, Homo sapiens
gcagaaaaacucugg

SEQ ID NO: 810514 - RNA, 18 nt, Homo sapiens
gcagaacuuuccagggau

SEQ ID NO: 810515 - RNA, 17 nt, Homo sapiens
gcagaagagaaaagcug

SEQ ID NO: 810516 - RNA, 22 nt, Homo sapiens
gcagaagagaaaggacucagug

SEQ ID NO: 810517 - RNA, 12 nt, Homo sapiens
gcagaagcccug

SEQ ID NO: 810518 - RNA, 15 nt, Homo sapiens
gcagaauacauucaa

SEQ ID NO: 810519 - RNA, 17 nt, Homo sapiens
gcagaauugagagugau

SEQ ID NO: 810520 - RNA, 23 nt, Homo sapiens
gcagaauugagagugauuccuuu

SEQ ID NO: 810521 - RNA, 19 nt, Homo sapiens
gcagaauuguggaguguuu

SEQ ID NO: 810522 - RNA, 20 nt, Homo sapiens
gcagacauagaagagccaag

SEQ ID NO: 810523 - RNA, 16 nt, Homo sapiens
gcagaccccaggcaag

SEQ ID NO: 810524 - RNA, 18 nt, Homo sapiens
gcagacugaaccagucca

SEQ ID NO: 810525 - RNA, 22 nt, Homo sapiens
gcagacuuuuguguaaaaagca

SEQ ID NO: 810526 - RNA, 14 nt, Homo sapiens
gcagagaaccaaag

SEQ ID NO: 810527 - RNA, 23 nt, Homo sapiens
gcagagagguggagaacugggau

SEQ ID NO: 810528 - RNA, 16 nt, Homo sapiens
gcagagcaugaccuga

SEQ ID NO: 810529 - RNA, 21 nt, Homo sapiens
gcagagccugagucacugguc

SEQ ID NO: 810530 - RNA, 16 nt, Homo sapiens
gcagaggcaacacugg

SEQ ID NO: 810531 - RNA, 18 nt, Homo sapiens
gcagaggcaacacuggaa

SEQ ID NO: 810532 - RNA, 14 nt, Homo sapiens
gcagaggccagagg

SEQ ID NO: 810533 - RNA, 21 nt, Homo sapiens
gcagaggcguacuacccagcu

SEQ ID NO: 810534 - RNA, 20 nt, Homo sapiens
gcagaggcuaauucaguguc

SEQ ID NO: 810535 - RNA, 16 nt, Homo sapiens
gcagagguugcaguga

SEQ ID NO: 810536 - RNA, 16 nt, Homo sapiens
gcagaguaaguauuau

SEQ ID NO: 810537 - RNA, 22 nt, Homo sapiens
gcagagucugccccacaugugg

SEQ ID NO: 810538 - RNA, 16 nt, Homo sapiens
gcagagugcacagcug

SEQ ID NO: 810539 - RNA, 16 nt, Homo sapiens
gcagauagcacugggu

SEQ ID NO: 810540 - RNA, 19 nt, Homo sapiens
gcagaucuggacuuggcaa

SEQ ID NO: 810541 - RNA, 21 nt, Homo sapiens
gcagaugagcagucacacugu

SEQ ID NO: 810542 - RNA, 21 nt, Homo sapiens
gcagauugaaaaggacaccuu

SEQ ID NO: 810543 - RNA, 12 nt, Homo sapiens
gcagcacuguga

SEQ ID NO: 810544 - RNA, 21 nt, Homo sapiens
gcagcagcaaggaaagcucac

SEQ ID NO: 810545 - RNA, 17 nt, Homo sapiens
gcagcagggggagcucc

SEQ ID NO: 810546 - RNA, 14 nt, Homo sapiens
gcagcagugucugu

SEQ ID NO: 810547 - RNA, 21 nt, Homo sapiens
gcagcaugagacuuucugcug

SEQ ID NO: 810548 - RNA, 23 nt, Homo sapiens
gcagcauuugauauacaugcuca

SEQ ID NO: 810549 - RNA, 16 nt, Homo sapiens
gcagccaaccaagaug

SEQ ID NO: 810550 - RNA, 16 nt, Homo sapiens
gcagccacaaccaaaa

SEQ ID NO: 810551 - RNA, 13 nt, Homo sapiens
gcagcccagagac

SEQ ID NO: 810552 - RNA, 14 nt, Homo sapiens
gcagcccagggccu

SEQ ID NO: 810553 - RNA, 23 nt, Homo sapiens
gcagcccaugcccaccugcccau

SEQ ID NO: 810554 - RNA, 18 nt, Homo sapiens
gcagcccuguguguguca

SEQ ID NO: 810555 - RNA, 18 nt, Homo sapiens
gcagccgugaucaaggga

SEQ ID NO: 810556 - RNA, 16 nt, Homo sapiens
gcagccuccuccugac

SEQ ID NO: 810557 - RNA, 13 nt, Homo sapiens
gcagccucuguca

SEQ ID NO: 810558 - RNA, 18 nt, Homo sapiens
gcagccugcaccuggugg

SEQ ID NO: 810559 - RNA, 21 nt, Homo sapiens
gcagccuggcucccaggacac

SEQ ID NO: 810560 - RNA, 13 nt, Homo sapiens
gcagccugugaag

SEQ ID NO: 810561 - RNA, 13 nt, Homo sapiens
gcagcgaccucaa

SEQ ID NO: 810562 - RNA, 19 nt, Homo sapiens
gcagcuaucucucagugaa

SEQ ID NO: 810563 - RNA, 19 nt, Homo sapiens
gcagcucacacccuaccuu

SEQ ID NO: 810564 - RNA, 22 nt, Homo sapiens
gcagcucagcucuuuggaucag

SEQ ID NO: 810565 - RNA, 17 nt, Homo sapiens
gcagcugccucugcucc

SEQ ID NO: 810566 - RNA, 15 nt, Homo sapiens
gcaucaaauauuugu

SEQ ID NO: 810567 - RNA, 13 nt, Homo sapiens
gcaucaaggucag

SEQ ID NO: 810568 - RNA, 14 nt, Homo sapiens
gcaucaaguucucc

SEQ ID NO: 810569 - RNA, 18 nt, Homo sapiens
gcaucaauacaaccagcc

SEQ ID NO: 810570 - RNA, 19 nt, Homo sapiens
gcaucaauacaaccagccc

SEQ ID NO: 810571 - RNA, 21 nt, Homo sapiens
gcaucaauuuuucuuauuuca

SEQ ID NO: 810572 - RNA, 17 nt, Homo sapiens
gcaucaccaggguuucu

SEQ ID NO: 810573 - RNA, 23 nt, Homo sapiens
gcaucacggauggugcaugggcu

SEQ ID NO: 810574 - RNA, 19 nt, Homo sapiens
gcaucagagguuugcuucc

SEQ ID NO: 810575 - RNA, 17 nt, Homo sapiens
gcaucaguagauuucug

SEQ ID NO: 810576 - RNA, 15 nt, Homo sapiens
gcaucaucaaaaacu

SEQ ID NO: 810577 - RNA, 18 nt, Homo sapiens
gcaucaucucagcucacu

SEQ ID NO: 810578 - RNA, 15 nt, Homo sapiens
gcaucauuaguacau

SEQ ID NO: 810579 - RNA, 11 nt, Homo sapiens
gcaucauucac

SEQ ID NO: 810580 - RNA, 18 nt, Homo sapiens
gcauccagccuguguguu

SEQ ID NO: 810581 - RNA, 22 nt, Homo sapiens
gcaucccaaaccacgccucuug

SEQ ID NO: 810582 - RNA, 14 nt, Homo sapiens
gcaucccaggggac

SEQ ID NO: 810583 - RNA, 23 nt, Homo sapiens
gcaucccugcuucuggcgcccca

SEQ ID NO: 810584 - RNA, 21 nt, Homo sapiens
uucuaacuagaaaucugccaa

SEQ ID NO: 810585 - RNA, 20 nt, Homo sapiens
uucuaacucauauguuccca

SEQ ID NO: 810586 - RNA, 17 nt, Homo sapiens
uucuaagacuacuauga

SEQ ID NO: 810587 - RNA, 23 nt, Homo sapiens
uucuaagacucaaauguucuaag

SEQ ID NO: 810588 - RNA, 21 nt, Homo sapiens
uucuaagaugugauauucuaa

SEQ ID NO: 810589 - RNA, 19 nt, Homo sapiens
uucuaaguaaaaccacagc

SEQ ID NO: 810590 - RNA, 17 nt, Homo sapiens
uucuacaacugauugca

SEQ ID NO: 810591 - RNA, 20 nt, Homo sapiens
uucuacaacugauugcaaca

SEQ ID NO: 810592 - RNA, 14 nt, Homo sapiens
uucuacagcagaua

SEQ ID NO: 810593 - RNA, 14 nt, Homo sapiens
uucuacaggccagc

SEQ ID NO: 810594 - RNA, 20 nt, Homo sapiens
uucuaccucuuggcugccuu

SEQ ID NO: 810595 - RNA, 15 nt, Homo sapiens
uucuacucugucuua

SEQ ID NO: 810596 - RNA, 22 nt, Homo sapiens
uucuacuguaucgccagugccu

SEQ ID NO: 810597 - RNA, 17 nt, Homo sapiens
uucuaggaaaucagaag

SEQ ID NO: 810598 - RNA, 15 nt, Homo sapiens
uucuaggcaucccag

SEQ ID NO: 810599 - RNA, 18 nt, Homo sapiens
uucuaggcccauuguccu

SEQ ID NO: 810600 - RNA, 16 nt, Homo sapiens
uucuaggcucacugca

SEQ ID NO: 810601 - RNA, 22 nt, Homo sapiens
uucuagucuccuuugcacugag

SEQ ID NO: 810602 - RNA, 16 nt, Homo sapiens
uucuagucuuggccag

SEQ ID NO: 810603 - RNA, 11 nt, Homo sapiens
uucuauacugu

SEQ ID NO: 810604 - RNA, 17 nt, Homo sapiens
uucuauaggaacauaug

SEQ ID NO: 810605 - RNA, 14 nt, Homo sapiens
uucuaugaagccca

SEQ ID NO: 810606 - RNA, 15 nt, Homo sapiens
uucuaugcauuaaga

SEQ ID NO: 810607 - RNA, 22 nt, Homo sapiens
uucuaugguugacauuguauau

SEQ ID NO: 810608 - RNA, 16 nt, Homo sapiens
uucuauguagaacugu

SEQ ID NO: 810609 - RNA, 15 nt, Homo sapiens
uucuauugacuucaa

SEQ ID NO: 810610 - RNA, 23 nt, Homo sapiens
uucucaaaugcacaucucauggc

SEQ ID NO: 810611 - RNA, 21 nt, Homo sapiens
uucucacagugggagccaggg

SEQ ID NO: 810612 - RNA, 14 nt, Homo sapiens
uucucaccccagga

SEQ ID NO: 810613 - RNA, 20 nt, Homo sapiens
uucucacuccuaccugguaa

SEQ ID NO: 810614 - RNA, 17 nt, Homo sapiens
uucucagguguugccaa

SEQ ID NO: 810615 - RNA, 22 nt, Homo sapiens
uucucagucauuuuuaaccucu

SEQ ID NO: 810616 - RNA, 13 nt, Homo sapiens
uucucaucacuca

SEQ ID NO: 810617 - RNA, 18 nt, Homo sapiens
uucucaucauauuguaug

SEQ ID NO: 810618 - RNA, 21 nt, Homo sapiens
uucucaucauauuguauguaa

SEQ ID NO: 810619 - RNA, 14 nt, Homo sapiens
uucucauuucaccc

SEQ ID NO: 810620 - RNA, 14 nt, Homo sapiens
uucuccacugcuug

SEQ ID NO: 810621 - RNA, 21 nt, Homo sapiens
uucuccaucccucuaaugaga

SEQ ID NO: 810622 - RNA, 23 nt, Homo sapiens
uucucccacaugaggccaucuca

SEQ ID NO: 810623 - RNA, 23 nt, Homo sapiens
uucucccaggccaggcuccuucc

SEQ ID NO: 810624 - RNA, 11 nt, Homo sapiens
uucuccugacc

SEQ ID NO: 810625 - RNA, 13 nt, Homo sapiens
uucuccugccuca

SEQ ID NO: 810626 - RNA, 14 nt, Homo sapiens
uucuccugccucac

SEQ ID NO: 810627 - RNA, 17 nt, Homo sapiens
uucuccugucccuccau

SEQ ID NO: 810628 - RNA, 19 nt, Homo sapiens
uucuccuucaaaacacuca

SEQ ID NO: 810629 - RNA, 14 nt, Homo sapiens
uucuccuucagccc

SEQ ID NO: 810630 - RNA, 23 nt, Homo sapiens
uucuccuuuuauucucuguauug

SEQ ID NO: 810631 - RNA, 15 nt, Homo sapiens
uucucuaaugcagcu

SEQ ID NO: 810632 - RNA, 16 nt, Homo sapiens
uucucuauugcugcuc

SEQ ID NO: 810633 - RNA, 12 nt, Homo sapiens
uucucucaauga

SEQ ID NO: 810634 - RNA, 20 nt, Homo sapiens
uucucucacaguguacucua

SEQ ID NO: 810635 - RNA, 13 nt, Homo sapiens
uucucucacugug

SEQ ID NO: 810636 - RNA, 22 nt, Homo sapiens
uucucuccaccuuaguacuuua

SEQ ID NO: 810637 - RNA, 23 nt, Homo sapiens
uucucuccaccuuaguacuuuag

SEQ ID NO: 810638 - RNA, 21 nt, Homo sapiens
uucucucuggcucaggugugg

SEQ ID NO: 810639 - RNA, 13 nt, Homo sapiens
uucucucuguaau

SEQ ID NO: 810640 - RNA, 19 nt, Homo sapiens
uucucugccgcuaccuccc

SEQ ID NO: 810641 - RNA, 13 nt, Homo sapiens
uucucugugcucu

SEQ ID NO: 810642 - RNA, 22 nt, Homo sapiens
uucucuuaugaucaccauguau

SEQ ID NO: 810643 - RNA, 15 nt, Homo sapiens
uucucuucccaguga

SEQ ID NO: 810644 - RNA, 23 nt, Homo sapiens
uucucuuccgucuaaucucucac

SEQ ID NO: 810645 - RNA, 22 nt, Homo sapiens
uucucuugacguuuacauauau

SEQ ID NO: 810646 - RNA, 16 nt, Homo sapiens
uucucuuucucuccuu

SEQ ID NO: 810647 - RNA, 11 nt, Homo sapiens
uucucuuugcu

SEQ ID NO: 810648 - RNA, 18 nt, Homo sapiens
uucugacaucagcagaga

SEQ ID NO: 810649 - RNA, 11 nt, Homo sapiens
uucugacuguu

SEQ ID NO: 810650 - RNA, 17 nt, Homo sapiens
uucugagaaagacuauu

SEQ ID NO: 810651 - RNA, 19 nt, Homo sapiens
uucugagacagcuugucug

SEQ ID NO: 810652 - RNA, 12 nt, Homo sapiens
uucugagcaaac

SEQ ID NO: 810653 - RNA, 23 nt, Homo sapiens
uucugaggcccugcccaaugaga

SEQ ID NO: 810654 - RNA, 16 nt, Homo sapiens
uucugauaaaguuccu

SEQ ID NO: 810655 - RNA, 17 nt, Homo sapiens
uucugauauguauccau

SEQ ID NO: 810656 - RNA, 17 nt, Homo sapiens
uucugaugaaucucaaa

SEQ ID NO: 810657 - RNA, 22 nt, Homo sapiens
uucugcaacaucuuaagaucca

SEQ ID NO: 810658 - RNA, 23 nt, Homo sapiens
uucugcaacaucuuaagauccac

SEQ ID NO: 810659 - RNA, 11 nt, Homo sapiens
uucugcaaugu

SEQ ID NO: 810660 - RNA, 12 nt, Homo sapiens
uucugcacugaa

SEQ ID NO: 810661 - RNA, 21 nt, Homo sapiens
uucugcuaaauaucaccuagc

SEQ ID NO: 810662 - RNA, 18 nt, Homo sapiens
uucugcuggugaauaacu

SEQ ID NO: 810663 - RNA, 17 nt, Homo sapiens
uucuggaaguuucuggu

SEQ ID NO: 810664 - RNA, 21 nt, Homo sapiens
uucuggagauggaagcuuguu

SEQ ID NO: 810665 - RNA, 22 nt, Homo sapiens
uucuggcauauguuucugcuag

SEQ ID NO: 810666 - RNA, 16 nt, Homo sapiens
uucugggaacuuccuc

SEQ ID NO: 810667 - RNA, 14 nt, Homo sapiens
uucugggacugugc

SEQ ID NO: 810668 - RNA, 19 nt, Homo sapiens
uucugggcacccucccacc

SEQ ID NO: 810669 - RNA, 18 nt, Homo sapiens
uucuggguucauauauau

SEQ ID NO: 810670 - RNA, 17 nt, Homo sapiens
uucuggugcuacuccau

SEQ ID NO: 810671 - RNA, 14 nt, Homo sapiens
uucugguuggugua

SEQ ID NO: 810672 - RNA, 19 nt, Homo sapiens
uucugguuuucgaagacua

SEQ ID NO: 810673 - RNA, 11 nt, Homo sapiens
uucuguacaac

SEQ ID NO: 810674 - RNA, 15 nt, Homo sapiens
uucuguagcaccaga

SEQ ID NO: 810675 - RNA, 15 nt, Homo sapiens
uucugucaccaaauu

SEQ ID NO: 810676 - RNA, 19 nt, Homo sapiens
uucugucuagacuggccua

SEQ ID NO: 810677 - RNA, 14 nt, Homo sapiens
uucugucuucccaa

SEQ ID NO: 810678 - RNA, 21 nt, Homo sapiens
cuucccaaucagcacugaaaa

SEQ ID NO: 810679 - RNA, 23 nt, Homo sapiens
cuucccaccuacugcacuuuccc

SEQ ID NO: 810680 - RNA, 14 nt, Homo sapiens
cuucccagugaauu

SEQ ID NO: 810681 - RNA, 14 nt, Homo sapiens
cuuccccaguguca

SEQ ID NO: 810682 - RNA, 21 nt, Homo sapiens
cuuccccucugcggcuuucac

SEQ ID NO: 810683 - RNA, 16 nt, Homo sapiens
cuuccccugggcaaga

SEQ ID NO: 810684 - RNA, 13 nt, Homo sapiens
cuucccgccuucc

SEQ ID NO: 810685 - RNA, 22 nt, Homo sapiens
cuucccggcgucccuaccuccu

SEQ ID NO: 810686 - RNA, 13 nt, Homo sapiens
cuucccuaccuca

SEQ ID NO: 810687 - RNA, 16 nt, Homo sapiens
cuucccucacaccgcg

SEQ ID NO: 810688 - RNA, 23 nt, Homo sapiens
cuucccucccugaggcaggugag

SEQ ID NO: 810689 - RNA, 22 nt, Homo sapiens
cuucccucucugcagacuuccc

SEQ ID NO: 810690 - RNA, 23 nt, Homo sapiens
cuucccugcauuaacugcacaaa

SEQ ID NO: 810691 - RNA, 18 nt, Homo sapiens
cuucccuguauuaccucc

SEQ ID NO: 810692 - RNA, 12 nt, Homo sapiens
cuucccuguuga

SEQ ID NO: 810693 - RNA, 20 nt, Homo sapiens
cuucccuguugaauugguga

SEQ ID NO: 810694 - RNA, 16 nt, Homo sapiens
cuucccuuaacuccaa

SEQ ID NO: 810695 - RNA, 20 nt, Homo sapiens
cuucccuuaacuccaagaac

SEQ ID NO: 810696 - RNA, 15 nt, Homo sapiens
cuucccuuaccucaa

SEQ ID NO: 810697 - RNA, 16 nt, Homo sapiens
cuucccuuaccucaaa

SEQ ID NO: 810698 - RNA, 13 nt, Homo sapiens
uugagaaugguua

SEQ ID NO: 810699 - RNA, 17 nt, Homo sapiens
uugagaaugguuacaaa

SEQ ID NO: 810700 - RNA, 11 nt, Homo sapiens
uugagacagag

SEQ ID NO: 810701 - RNA, 20 nt, Homo sapiens
uugagauaaagucaaaugcc

SEQ ID NO: 810702 - RNA, 14 nt, Homo sapiens
uugagaucagucuu

SEQ ID NO: 810703 - RNA, 17 nt, Homo sapiens
uugagauccagugcagu

SEQ ID NO: 810704 - RNA, 18 nt, Homo sapiens
uugagauguaugaaggcu

SEQ ID NO: 810705 - RNA, 21 nt, Homo sapiens
uugagccuuggcccacacuga

SEQ ID NO: 810706 - RNA, 14 nt, Homo sapiens
uugagcgagcccau

SEQ ID NO: 810707 - RNA, 15 nt, Homo sapiens
uugagcgagcccauu

SEQ ID NO: 810708 - RNA, 14 nt, Homo sapiens
uugagcuacuucaa

SEQ ID NO: 810709 - RNA, 17 nt, Homo sapiens
uugagcugcucugcaag

SEQ ID NO: 810710 - RNA, 11 nt, Homo sapiens
uugaggacaag

SEQ ID NO: 810711 - RNA, 17 nt, Homo sapiens
uugaggagcugcacuga

SEQ ID NO: 810712 - RNA, 15 nt, Homo sapiens
uugaggcugcagauu

SEQ ID NO: 810713 - RNA, 20 nt, Homo sapiens
uugaggcuuaaacaagccaa

SEQ ID NO: 810714 - RNA, 12 nt, Homo sapiens
uugaggcuuuca

SEQ ID NO: 810715 - RNA, 18 nt, Homo sapiens
uugaggggcccuggccag

SEQ ID NO: 810716 - RNA, 21 nt, Homo sapiens
uugagggugggggugcucucu

SEQ ID NO: 810717 - RNA, 22 nt, Homo sapiens
uugagguuuuguaaaacuguua

SEQ ID NO: 810718 - RNA, 21 nt, Homo sapiens
uugaguaccuacugugugcca

SEQ ID NO: 810719 - RNA, 18 nt, Homo sapiens
uugagugacagcuuucug

SEQ ID NO: 810720 - RNA, 22 nt, Homo sapiens
uugagugugauuugaaugauuu

SEQ ID NO: 810721 - RNA, 22 nt, Homo sapiens
uugaguuaaugugcugagcauu

SEQ ID NO: 810722 - RNA, 16 nt, Homo sapiens
uugaguuucucuccac

SEQ ID NO: 810723 - RNA, 21 nt, Homo sapiens
uugaguuugucgcucaugugu

SEQ ID NO: 810724 - RNA, 23 nt, Homo sapiens
uugauaagcuauugucuguaaua

SEQ ID NO: 810725 - RNA, 21 nt, Homo sapiens
uugauagauuucuacacugag

SEQ ID NO: 810726 - RNA, 20 nt, Homo sapiens
uugauaguuaauuauuucaa

SEQ ID NO: 810727 - RNA, 16 nt, Homo sapiens
uugauaguuuggcuau

SEQ ID NO: 810728 - RNA, 20 nt, Homo sapiens
uugauaucucgaacuuucaa

SEQ ID NO: 810729 - RNA, 19 nt, Homo sapiens
uugauauugccacccucca

SEQ ID NO: 810730 - RNA, 18 nt, Homo sapiens
uugauauuuaauuaugaa

SEQ ID NO: 810731 - RNA, 17 nt, Homo sapiens
uugaucaaauauuucaa

SEQ ID NO: 810732 - RNA, 18 nt, Homo sapiens
uugaucaagaaugcaaua

SEQ ID NO: 810733 - RNA, 15 nt, Homo sapiens
uugaucuuuuaguuu

SEQ ID NO: 810734 - RNA, 22 nt, Homo sapiens
uugaucuuuugcuaaugcaauu

SEQ ID NO: 810735 - RNA, 19 nt, Homo sapiens
uugaugauuaauucaccuu

SEQ ID NO: 810736 - RNA, 12 nt, Homo sapiens
uugauggugaua

SEQ ID NO: 810737 - RNA, 23 nt, Homo sapiens
uugauguauauaucuauuauuca

SEQ ID NO: 810738 - RNA, 18 nt, Homo sapiens
uugauguuaacugagcua

SEQ ID NO: 810739 - RNA, 23 nt, Homo sapiens
uugauuauucugauuccacuuuu

SEQ ID NO: 810740 - RNA, 21 nt, Homo sapiens
uugauuccugguuugacucag

SEQ ID NO: 810741 - RNA, 19 nt, Homo sapiens
uugauucgaaggaugaaga

SEQ ID NO: 810742 - RNA, 22 nt, Homo sapiens
uugauugaggagcugcacugau

SEQ ID NO: 810743 - RNA, 19 nt, Homo sapiens
uugauugucagcuacuaau

SEQ ID NO: 810744 - RNA, 15 nt, Homo sapiens
uugauuucauuaaua

SEQ ID NO: 810745 - RNA, 17 nt, Homo sapiens
uugauuuguagcacuga

SEQ ID NO: 810746 - RNA, 14 nt, Homo sapiens
uugcaaagauuucu

SEQ ID NO: 810747 - RNA, 16 nt, Homo sapiens
uugcaaauaaaccacu

SEQ ID NO: 810748 - RNA, 20 nt, Homo sapiens
uugcaaauuauucuagucaa

SEQ ID NO: 810749 - RNA, 21 nt, Homo sapiens
uugcaaauuauucuagucaac

SEQ ID NO: 810750 - RNA, 23 nt, Homo sapiens
uugcaaccucuuugcucaacaga

SEQ ID NO: 810751 - RNA, 21 nt, Homo sapiens
uugcaauaccaauguucuaaa

SEQ ID NO: 810752 - RNA, 18 nt, Homo sapiens
uugcaauggaucagccaa

SEQ ID NO: 810753 - RNA, 22 nt, Homo sapiens
uugcacaaacuugugagcauca

SEQ ID NO: 810754 - RNA, 19 nt, Homo sapiens
uugcacauaacaugcuuua

SEQ ID NO: 810755 - RNA, 14 nt, Homo sapiens
uugcacaugugacc

SEQ ID NO: 810756 - RNA, 18 nt, Homo sapiens
uugcaccaaagacaucag

SEQ ID NO: 810757 - RNA, 15 nt, Homo sapiens
uugcaccucugcuga

SEQ ID NO: 810758 - RNA, 20 nt, Homo sapiens
uugcaccuguccccacccuc

SEQ ID NO: 810759 - RNA, 11 nt, Homo sapiens
uugcacugggg

SEQ ID NO: 810760 - RNA, 15 nt, Homo sapiens
uugcacuucaaaaaa

SEQ ID NO: 810761 - RNA, 20 nt, Homo sapiens
uugcagagaaccucagauca

SEQ ID NO: 810762 - RNA, 22 nt, Homo sapiens
uugcagauaccauuucuguuga

SEQ ID NO: 810763 - RNA, 19 nt, Homo sapiens
uugcagcugagugaaaaau

SEQ ID NO: 810764 - RNA, 20 nt, Homo sapiens
uugcaggauggugucucuuc

SEQ ID NO: 810765 - RNA, 22 nt, Homo sapiens
uugcagggaagccccacuugaa

SEQ ID NO: 810766 - RNA, 18 nt, Homo sapiens
uugcaggugaacagccuc

SEQ ID NO: 810767 - RNA, 21 nt, Homo sapiens
uugcagugaaccuagauugca

SEQ ID NO: 810768 - RNA, 20 nt, Homo sapiens
uugcagugagcugagaucac

SEQ ID NO: 810769 - RNA, 17 nt, Homo sapiens
uugcaguuauuucaaaa

SEQ ID NO: 810770 - RNA, 13 nt, Homo sapiens
uugcaugcugaaa

SEQ ID NO: 810771 - RNA, 14 nt, Homo sapiens
uugcaugcuugcau

SEQ ID NO: 810772 - RNA, 13 nt, Homo sapiens
uugcauuccagaa

SEQ ID NO: 810773 - RNA, 19 nt, Homo sapiens
uugcauuccagaaccaaau

SEQ ID NO: 810774 - RNA, 16 nt, Homo sapiens
uugcauugucuaauga

SEQ ID NO: 810775 - RNA, 18 nt, Homo sapiens
uugcauugucuaaugaca

SEQ ID NO: 810776 - RNA, 10 nt, Homo sapiens
uugcauuugg

SEQ ID NO: 810777 - RNA, 18 nt, Homo sapiens
uugccaaaauaccagagc

SEQ ID NO: 810778 - RNA, 22 nt, Homo sapiens
uugccaagagccugagugacag

SEQ ID NO: 810779 - RNA, 18 nt, Homo sapiens
uugccaagcagugcacau

SEQ ID NO: 810780 - RNA, 23 nt, Homo sapiens
uugccaagcagugcacauuucau

SEQ ID NO: 810781 - RNA, 19 nt, Homo sapiens
uugccaaguggcauuacau

SEQ ID NO: 810782 - RNA, 14 nt, Homo sapiens
uugccacacugugg

SEQ ID NO: 810783 - RNA, 19 nt, Homo sapiens
uugccacugcugugugauu

SEQ ID NO: 810784 - RNA, 18 nt, Homo sapiens
uugccagaugcaauacaa

SEQ ID NO: 810785 - RNA, 20 nt, Homo sapiens
uugccaggcuggagugcagu

SEQ ID NO: 810786 - RNA, 20 nt, Homo sapiens
uugccagguugcagcugcuc

SEQ ID NO: 810787 - RNA, 20 nt, Homo sapiens
uugccauagcugacuacaaa

SEQ ID NO: 810788 - RNA, 13 nt, Homo sapiens
uugcccaccccuc

SEQ ID NO: 810789 - RNA, 18 nt, Homo sapiens
uugcccagacuacagggc

SEQ ID NO: 810790 - RNA, 15 nt, Homo sapiens
uugcccuuggagcug

SEQ ID NO: 810791 - RNA, 14 nt, Homo sapiens
uugccuaaacccua

SEQ ID NO: 810792 - RNA, 22 nt, Homo sapiens
uugccuccuguucugcccacga

SEQ ID NO: 810793 - RNA, 14 nt, Homo sapiens
cuuggcuugccauu

SEQ ID NO: 810794 - RNA, 12 nt, Homo sapiens
cuuggcuuuaug

SEQ ID NO: 810795 - RNA, 15 nt, Homo sapiens
cuuggcuuuaugcaa

SEQ ID NO: 810796 - RNA, 20 nt, Homo sapiens
cuugggaaacuauucaugaa

SEQ ID NO: 810797 - RNA, 17 nt, Homo sapiens
cuugggagaggggcgca

SEQ ID NO: 810798 - RNA, 16 nt, Homo sapiens
cuugggaugaugccuc

SEQ ID NO: 810799 - RNA, 20 nt, Homo sapiens
cuugggcaugggggagccuu

SEQ ID NO: 810800 - RNA, 18 nt, Homo sapiens
cuugggcccugcacagau

SEQ ID NO: 810801 - RNA, 16 nt, Homo sapiens
cuugggcuacuggcag

SEQ ID NO: 810802 - RNA, 17 nt, Homo sapiens
cuuggggcccagugcau

SEQ ID NO: 810803 - RNA, 23 nt, Homo sapiens
cuugggggaaaauaccacaauca

SEQ ID NO: 810804 - RNA, 20 nt, Homo sapiens
cuugggucucagcugcugac

SEQ ID NO: 810805 - RNA, 18 nt, Homo sapiens
cuugguacugaaaaugag

SEQ ID NO: 810806 - RNA, 14 nt, Homo sapiens
cuugguaugcaucu

SEQ ID NO: 810807 - RNA, 15 nt, Homo sapiens
cuugguauuacccuc

SEQ ID NO: 810808 - RNA, 12 nt, Homo sapiens
cuuggugcuauc

SEQ ID NO: 810809 - RNA, 14 nt, Homo sapiens
cuuggugggagaaa

SEQ ID NO: 810810 - RNA, 16 nt, Homo sapiens
cuuguaaagacuguag

SEQ ID NO: 810811 - RNA, 19 nt, Homo sapiens
cuuguaacaguuuugugua

SEQ ID NO: 810812 - RNA, 19 nt, Homo sapiens
uuguauuuuauuguuucuu

SEQ ID NO: 810813 - RNA, 17 nt, Homo sapiens
uugucaaaugaugauua

SEQ ID NO: 810814 - RNA, 22 nt, Homo sapiens
uugucaagaagcguuaugugca

SEQ ID NO: 810815 - RNA, 20 nt, Homo sapiens
uugucagaauuucuuuguca

SEQ ID NO: 810816 - RNA, 19 nt, Homo sapiens
uugucagaguucugcucua

SEQ ID NO: 810817 - RNA, 20 nt, Homo sapiens
uuuuuaccuaaucuccacuu

SEQ ID NO: 810818 - RNA, 22 nt, Homo sapiens
uuuuuacuaaacucagaggcag

SEQ ID NO: 810819 - RNA, 20 nt, Homo sapiens
uuuuuacuaaucuuucugca

SEQ ID NO: 810820 - RNA, 12 nt, Homo sapiens
uuuuuacuguug

SEQ ID NO: 810821 - RNA, 19 nt, Homo sapiens
uuuuuagagcuuccaaaug

SEQ ID NO: 810822 - RNA, 19 nt, Homo sapiens
uuuuuaguagagauggggu

SEQ ID NO: 810823 - RNA, 13 nt, Homo sapiens
uuuuuauaauuca

SEQ ID NO: 810824 - RNA, 18 nt, Homo sapiens
uuuuuauacaauggaaua

SEQ ID NO: 810825 - RNA, 22 nt, Homo sapiens
uuuuuauucaugugaaguguau

SEQ ID NO: 810826 - RNA, 13 nt, Homo sapiens
uuuuucacauauc

SEQ ID NO: 810827 - RNA, 23 nt, Homo sapiens
uuuuuccugcauguucugugacu

SEQ ID NO: 810828 - RNA, 23 nt, Homo sapiens
uuuuuccuuccuuaucacugaca

SEQ ID NO: 810829 - RNA, 13 nt, Homo sapiens
uuuuucuauauuc

SEQ ID NO: 810830 - RNA, 16 nt, Homo sapiens
uuuuucuauuguacuc

SEQ ID NO: 810831 - RNA, 13 nt, Homo sapiens
uuuuucuccagcu

SEQ ID NO: 810832 - RNA, 15 nt, Homo sapiens
uuuuucuguggucuu

SEQ ID NO: 810833 - RNA, 22 nt, Homo sapiens
uuuuucuuugagacugggucuc

SEQ ID NO: 810834 - RNA, 22 nt, Homo sapiens
uuuuugacucccagaucaguca

SEQ ID NO: 810835 - RNA, 16 nt, Homo sapiens
uuuuugagacaaaguc

SEQ ID NO: 810836 - RNA, 20 nt, Homo sapiens
uuuuugaguacuguacuauc

SEQ ID NO: 810837 - RNA, 20 nt, Homo sapiens
uuuuugccuucauuaccuuu

SEQ ID NO: 810838 - RNA, 11 nt, Homo sapiens
uuuuugcucuc

SEQ ID NO: 810839 - RNA, 20 nt, Homo sapiens
uuuuuggaacuaaagcaaau

SEQ ID NO: 810840 - RNA, 14 nt, Homo sapiens
uuuuuggcagggag

SEQ ID NO: 810841 - RNA, 22 nt, Homo sapiens
uuuuugggaccuugcgugaaga

SEQ ID NO: 810842 - RNA, 18 nt, Homo sapiens
uuuuugggggaaggucag

SEQ ID NO: 810843 - RNA, 23 nt, Homo sapiens
uuuuugucugcuaguaguguucu

SEQ ID NO: 810844 - RNA, 12 nt, Homo sapiens
uuuuugugucaa

SEQ ID NO: 810845 - RNA, 21 nt, Homo sapiens
uuuuuucauuuugccaaaaag

SEQ ID NO: 810846 - RNA, 12 nt, Homo sapiens
uuuuuuccacaa

SEQ ID NO: 810847 - RNA, 22 nt, Homo sapiens
uuuuuucucauucugugccauu

SEQ ID NO: 810848 - RNA, 21 nt, Homo sapiens
uuuuuuguauagaccaaagca

SEQ ID NO: 810849 - RNA, 21 nt, Homo sapiens
uuuuuuguuauguuugcacuu

SEQ ID NO: 810850 - RNA, 13 nt, Homo sapiens
uuuuuuugcugcu

SEQ ID NO: 810851 - RNA, 14 nt, Homo sapiens
uuggacaaccucau

SEQ ID NO: 810852 - RNA, 23 nt, Homo sapiens
uuggacaaucaugaaauaugcau

SEQ ID NO: 810853 - RNA, 20 nt, Homo sapiens
uuggacacuuaguuauuuac

SEQ ID NO: 810854 - RNA, 21 nt, Homo sapiens
uuggacagcuacuucugggaa

SEQ ID NO: 810855 - RNA, 21 nt, Homo sapiens
uuggacugauaaucucuuuaa

SEQ ID NO: 810856 - RNA, 16 nt, Homo sapiens
uuggacuucucugaaa

SEQ ID NO: 810857 - RNA, 13 nt, Homo sapiens
uugauaccuguag

SEQ ID NO: 810858 - RNA, 17 nt, Homo sapiens
uugauauuuuccaaaug

SEQ ID NO: 810859 - RNA, 14 nt, Homo sapiens
uugaucacuacaag

SEQ ID NO: 810860 - RNA, 20 nt, Homo sapiens
uugaucccacuucacuguga

SEQ ID NO: 810861 - RNA, 19 nt, Homo sapiens
uugaucuuaacaaagccuu

SEQ ID NO: 810862 - RNA, 17 nt, Homo sapiens
uugaugacccuuuucau

SEQ ID NO: 810863 - RNA, 20 nt, Homo sapiens
uugaaaauaguuaccuucaa

SEQ ID NO: 810864 - RNA, 19 nt, Homo sapiens
uugaaaauauuuuguugcc

SEQ ID NO: 810865 - RNA, 20 nt, Homo sapiens
uugaaaauuuuuaaauauuc

SEQ ID NO: 810866 - RNA, 20 nt, Homo sapiens
uugaaacagauucaggccag

SEQ ID NO: 810867 - RNA, 18 nt, Homo sapiens
uugaaacauagagaucua

SEQ ID NO: 810868 - RNA, 23 nt, Homo sapiens
uugaaacuggaauaaguguuuau

SEQ ID NO: 810869 - RNA, 16 nt, Homo sapiens
uugaaacuuugaaugu

SEQ ID NO: 810870 - RNA, 22 nt, Homo sapiens
uucucucccuuccucucuccuu

SEQ ID NO: 810871 - RNA, 15 nt, Homo sapiens
uucucugccagugac

SEQ ID NO: 810872 - RNA, 16 nt, Homo sapiens
uucucugggcugaaug

SEQ ID NO: 810873 - RNA, 21 nt, Homo sapiens
uucucugugucuaagauucua

SEQ ID NO: 810874 - RNA, 20 nt, Homo sapiens
uucucuuaguuauugcugaa

SEQ ID NO: 810875 - RNA, 21 nt, Homo sapiens
uucucuugaaaaguucaggga

SEQ ID NO: 810876 - RNA, 18 nt, Homo sapiens
uucucuugacguuuacau

SEQ ID NO: 810877 - RNA, 20 nt, Homo sapiens
uucucuugccauuuguagcu

SEQ ID NO: 810878 - RNA, 17 nt, Homo sapiens
uuccucuaacucacugc

SEQ ID NO: 810879 - RNA, 17 nt, Homo sapiens
uuccucuagaagccaag

SEQ ID NO: 810880 - RNA, 22 nt, Homo sapiens
uuccucuaugaaaauuauaucu

SEQ ID NO: 810881 - RNA, 12 nt, Homo sapiens
uuccucucuuaa

SEQ ID NO: 810882 - RNA, 11 nt, Homo sapiens
uuccucugcau

SEQ ID NO: 810883 - RNA, 19 nt, Homo sapiens
uuccugaaaauugcaauac

SEQ ID NO: 810884 - RNA, 23 nt, Homo sapiens
uuccugagugcguggaucugggu

SEQ ID NO: 810885 - RNA, 18 nt, Homo sapiens
uuccugcauucacccaga

SEQ ID NO: 810886 - RNA, 14 nt, Homo sapiens
uuccugcccuugaa

SEQ ID NO: 810887 - RNA, 16 nt, Homo sapiens
uuccugcuuccgagau

SEQ ID NO: 810888 - RNA, 21 nt, Homo sapiens
uuccuggagcccgaggcacca

SEQ ID NO: 810889 - RNA, 15 nt, Homo sapiens
uuccuggguccugcc

SEQ ID NO: 810890 - RNA, 17 nt, Homo sapiens
uuccugguuugacucag

SEQ ID NO: 810891 - RNA, 22 nt, Homo sapiens
uuccugguuugacucaguucca

SEQ ID NO: 810892 - RNA, 21 nt, Homo sapiens
uuccuguaaagaaacauuucc

SEQ ID NO: 810893 - RNA, 20 nt, Homo sapiens
uuccuguacuacugccuugu

SEQ ID NO: 810894 - RNA, 18 nt, Homo sapiens
uuccuguauguuguccaa

SEQ ID NO: 810895 - RNA, 14 nt, Homo sapiens
uuccugucauugcg

SEQ ID NO: 810896 - RNA, 15 nt, Homo sapiens
uuccuguccagcucc

SEQ ID NO: 810897 - RNA, 11 nt, Homo sapiens
uuccugugauc

SEQ ID NO: 810898 - RNA, 14 nt, Homo sapiens
uuccuguuacuuua

SEQ ID NO: 810899 - RNA, 19 nt, Homo sapiens
uuccuguucccuuggaaua

SEQ ID NO: 810900 - RNA, 21 nt, Homo sapiens
uuccuguuuccauccaguucc

SEQ ID NO: 810901 - RNA, 14 nt, Homo sapiens
uuccuuaaagcauu

SEQ ID NO: 810902 - RNA, 22 nt, Homo sapiens
uuccuuagcuuagaccucagcc

SEQ ID NO: 810903 - RNA, 13 nt, Homo sapiens
uuccuuagucuca

SEQ ID NO: 810904 - RNA, 15 nt, Homo sapiens
uuccuuagucucaag

SEQ ID NO: 810905 - RNA, 14 nt, Homo sapiens
uuccuuaugacuca

SEQ ID NO: 810906 - RNA, 14 nt, Homo sapiens
uuccuuccuuccuc

SEQ ID NO: 810907 - RNA, 19 nt, Homo sapiens
uuccuucucaucugugauu

SEQ ID NO: 810908 - RNA, 21 nt, Homo sapiens
uuccuucuggccucugcugaa

SEQ ID NO: 810909 - RNA, 13 nt, Homo sapiens
uuccuugaccagc

SEQ ID NO: 810910 - RNA, 16 nt, Homo sapiens
uuccuugaccagcaga

SEQ ID NO: 810911 - RNA, 11 nt, Homo sapiens
uuccuugagaa

SEQ ID NO: 810912 - RNA, 21 nt, Homo sapiens
uuccuugauggagauauuuac

SEQ ID NO: 810913 - RNA, 15 nt, Homo sapiens
uuccuuggcuuuaug

SEQ ID NO: 810914 - RNA, 16 nt, Homo sapiens
uuccuugggaugaucu

SEQ ID NO: 810915 - RNA, 19 nt, Homo sapiens
uuccuuuauacacagugga

SEQ ID NO: 810916 - RNA, 17 nt, Homo sapiens
uuccuuuaugugaauuu

SEQ ID NO: 810917 - RNA, 18 nt, Homo sapiens
uuccuuucuacaauuuca

SEQ ID NO: 810918 - RNA, 14 nt, Homo sapiens
uuccuuucugccac

SEQ ID NO: 810919 - RNA, 17 nt, Homo sapiens
uuccuuuuugacacuga

SEQ ID NO: 810920 - RNA, 19 nt, Homo sapiens
uuccuuuuugacacugaaa

SEQ ID NO: 810921 - RNA, 12 nt, Homo sapiens
uucgaccaaacu

SEQ ID NO: 810922 - RNA, 16 nt, Homo sapiens
uucgacugguccagcu

SEQ ID NO: 810923 - RNA, 15 nt, Homo sapiens
uucgaggagugccgu

SEQ ID NO: 810924 - RNA, 13 nt, Homo sapiens
uucgagucuugcu

SEQ ID NO: 810925 - RNA, 20 nt, Homo sapiens
uucgcaaccgcaauccggag

SEQ ID NO: 810926 - RNA, 22 nt, Homo sapiens
uucgccagcugaaguugcugag

SEQ ID NO: 810927 - RNA, 14 nt, Homo sapiens
uucgcccugugcac

SEQ ID NO: 810928 - RNA, 17 nt, Homo sapiens
uucgggauucuuugaca

SEQ ID NO: 810929 - RNA, 18 nt, Homo sapiens
uucgguacuuacccggag

SEQ ID NO: 810930 - RNA, 14 nt, Homo sapiens
uucguucugcugac

SEQ ID NO: 810931 - RNA, 18 nt, Homo sapiens
uucguuguuauuauucau

SEQ ID NO: 810932 - RNA, 14 nt, Homo sapiens
uucuaaaaguuuga

SEQ ID NO: 810933 - RNA, 23 nt, Homo sapiens
uucuaaagauggaaaaaccaccc

SEQ ID NO: 810934 - RNA, 15 nt, Homo sapiens
uucuaaaguucuaag

SEQ ID NO: 810935 - RNA, 18 nt, Homo sapiens
uucuaaaguuuugcaaca

SEQ ID NO: 810936 - RNA, 17 nt, Homo sapiens
uucuaaccuccuaagca

SEQ ID NO: 810937 - RNA, 12 nt, Homo sapiens
uucuaagaguuu

SEQ ID NO: 810938 - RNA, 13 nt, Homo sapiens
uucuaagauucua

SEQ ID NO: 810939 - RNA, 21 nt, Homo sapiens
uucuaaggccuaggauucuaa

SEQ ID NO: 810940 - RNA, 18 nt, Homo sapiens
uucuaaguauuuuauucc

SEQ ID NO: 810941 - RNA, 16 nt, Homo sapiens
uucuaaguuucuaaga

SEQ ID NO: 810942 - RNA, 19 nt, Homo sapiens
uucuaauuucaaaaauaua

SEQ ID NO: 810943 - RNA, 22 nt, Homo sapiens
uucuacacaguaaaaacuugua

SEQ ID NO: 810944 - RNA, 19 nt, Homo sapiens
uucuacauacuauggaauu

SEQ ID NO: 810945 - RNA, 12 nt, Homo sapiens
uucuacuggaaa

SEQ ID NO: 810946 - RNA, 18 nt, Homo sapiens
uucuacuuuuaacuaaua

SEQ ID NO: 810947 - RNA, 15 nt, Homo sapiens
uucuagaaacaaaca

SEQ ID NO: 810948 - RNA, 14 nt, Homo sapiens
uucuagauucacug

SEQ ID NO: 810949 - RNA, 12 nt, Homo sapiens
uucuagcuauaa

SEQ ID NO: 810950 - RNA, 14 nt, Homo sapiens
uucuaggauagcua

SEQ ID NO: 810951 - RNA, 11 nt, Homo sapiens
uucuaggcauc

SEQ ID NO: 810952 - RNA, 14 nt, Homo sapiens
uucuagucacuucc

SEQ ID NO: 810953 - RNA, 14 nt, Homo sapiens
uucuagucauauau

SEQ ID NO: 810954 - RNA, 22 nt, Homo sapiens
uucuaguguaacacugcaagaa

SEQ ID NO: 810955 - RNA, 16 nt, Homo sapiens
uucuaguuucucucaa

SEQ ID NO: 810956 - RNA, 16 nt, Homo sapiens
uucuaguuugcauucc

SEQ ID NO: 810957 - RNA, 20 nt, Homo sapiens
uucuauaauuuugccuuuaa

SEQ ID NO: 810958 - RNA, 14 nt, Homo sapiens
uucuauaguucuag

SEQ ID NO: 810959 - RNA, 19 nt, Homo sapiens
uucuaucugggcuguugcu

SEQ ID NO: 810960 - RNA, 16 nt, Homo sapiens
uucuaugcaagccuug

SEQ ID NO: 810961 - RNA, 12 nt, Homo sapiens
uucuaugcagau

SEQ ID NO: 810962 - RNA, 21 nt, Homo sapiens
uucuauggguuggacaaccuc

SEQ ID NO: 810963 - RNA, 17 nt, Homo sapiens
uucuaugguacccugug

SEQ ID NO: 810964 - RNA, 14 nt, Homo sapiens
uucuauuaacuuua

SEQ ID NO: 810965 - RNA, 16 nt, Homo sapiens
uucuauuauagauaua

SEQ ID NO: 810966 - RNA, 15 nt, Homo sapiens
uucuauucuaaguaa

SEQ ID NO: 810967 - RNA, 15 nt, Homo sapiens
uucuauugcugagaa

SEQ ID NO: 810968 - RNA, 12 nt, Homo sapiens
uucuauuuaaca

SEQ ID NO: 810969 - RNA, 16 nt, Homo sapiens
uucucaaaaacaaaga

SEQ ID NO: 810970 - RNA, 23 nt, Homo sapiens
uucucaagcccugcagucacagc

SEQ ID NO: 810971 - RNA, 14 nt, Homo sapiens
uucucaagucccuu

SEQ ID NO: 810972 - RNA, 15 nt, Homo sapiens
uucucaaguucuaag

SEQ ID NO: 810973 - RNA, 13 nt, Homo sapiens
uucucaaucuccu

SEQ ID NO: 810974 - RNA, 19 nt, Homo sapiens
uucucacaaaaaggcaaau

SEQ ID NO: 810975 - RNA, 15 nt, Homo sapiens
uucucacccugugaa

SEQ ID NO: 810976 - RNA, 19 nt, Homo sapiens
uucucagguguugccaaau

SEQ ID NO: 810977 - RNA, 21 nt, Homo sapiens
uucucagguguugccaaauau

SEQ ID NO: 810978 - RNA, 20 nt, Homo sapiens
uucucaguaucaguauuuac

SEQ ID NO: 810979 - RNA, 18 nt, Homo sapiens
uucucauaccuuccccac

SEQ ID NO: 810980 - RNA, 20 nt, Homo sapiens
uucucaucacucaaccuuau

SEQ ID NO: 810981 - RNA, 16 nt, Homo sapiens
uucucaucauauugua

SEQ ID NO: 810982 - RNA, 13 nt, Homo sapiens
uucucaucugcaa

SEQ ID NO: 810983 - RNA, 22 nt, Homo sapiens
uucucauuaaaguuguuuccca

SEQ ID NO: 810984 - RNA, 14 nt, Homo sapiens
uucuccaaaugaga

SEQ ID NO: 810985 - RNA, 20 nt, Homo sapiens
uucuccauacgcacugguau

SEQ ID NO: 810986 - RNA, 15 nt, Homo sapiens
uucuccccaggguag

SEQ ID NO: 810987 - RNA, 20 nt, Homo sapiens
uucuccugccugugcuguga

SEQ ID NO: 810988 - RNA, 18 nt, Homo sapiens
uucuccuuuuacuucacu

SEQ ID NO: 810989 - RNA, 16 nt, Homo sapiens
uucuccuuuugaccaa

SEQ ID NO: 810990 - RNA, 16 nt, Homo sapiens
uucucgaguugcagca

SEQ ID NO: 810991 - RNA, 23 nt, Homo sapiens
uucucuacagaggugaaauucca

SEQ ID NO: 810992 - RNA, 16 nt, Homo sapiens
uucucuaugacaugaa

SEQ ID NO: 810993 - RNA, 15 nt, Homo sapiens
uucucuauugcugcu

SEQ ID NO: 810994 - RNA, 23 nt, Homo sapiens
uucauuccuaacacagcaugugu

SEQ ID NO: 810995 - RNA, 14 nt, Homo sapiens
uucauucucucuca

SEQ ID NO: 810996 - RNA, 19 nt, Homo sapiens
uucauugauggaugucuuc

SEQ ID NO: 810997 - RNA, 16 nt, Homo sapiens
uucauugcacuuugau

SEQ ID NO: 810998 - RNA, 14 nt, Homo sapiens
uucauuggagcauu

SEQ ID NO: 810999 - RNA, 18 nt, Homo sapiens
uucauuguuacauguaau

SEQ ID NO: 811000 - RNA, 18 nt, Homo sapiens
uucauuuaaaaugauuag

SEQ ID NO: 811001 - RNA, 14 nt, Homo sapiens
uucauuuaucuaua

SEQ ID NO: 811002 - RNA, 13 nt, Homo sapiens
uucauuuccagca

SEQ ID NO: 811003 - RNA, 14 nt, Homo sapiens
uucauuuccagcau

SEQ ID NO: 811004 - RNA, 16 nt, Homo sapiens
uucauuuugggccuug

SEQ ID NO: 811005 - RNA, 19 nt, Homo sapiens
uucauuuuuaaucaugaaa

SEQ ID NO: 811006 - RNA, 21 nt, Homo sapiens
uuccaaaauaauuuuaagaaa

SEQ ID NO: 811007 - RNA, 16 nt, Homo sapiens
uuccaaaaugccaaau

SEQ ID NO: 811008 - RNA, 12 nt, Homo sapiens
uuccaaagucac

SEQ ID NO: 811009 - RNA, 14 nt, Homo sapiens
uuccaaauauguau

SEQ ID NO: 811010 - RNA, 17 nt, Homo sapiens
uuccaaaugauccuagu

SEQ ID NO: 811011 - RNA, 14 nt, Homo sapiens
uuccaaauucacaa

SEQ ID NO: 811012 - RNA, 21 nt, Homo sapiens
uuccaaauugcccuaugcugu

SEQ ID NO: 811013 - RNA, 21 nt, Homo sapiens
uuccaacaccacagacacaca

SEQ ID NO: 811014 - RNA, 23 nt, Homo sapiens
uuccaacaccacagacacacaca

SEQ ID NO: 811015 - RNA, 23 nt, Homo sapiens
uuccaacccagccacgacugcca

SEQ ID NO: 811016 - RNA, 16 nt, Homo sapiens
uuccaaccuuuggaag

SEQ ID NO: 811017 - RNA, 16 nt, Homo sapiens
uuccaacguggcccag

SEQ ID NO: 811018 - RNA, 19 nt, Homo sapiens
uuccaaggguacuaaggaa

SEQ ID NO: 811019 - RNA, 22 nt, Homo sapiens
uuccaaugugacuaaugaccac

SEQ ID NO: 811020 - RNA, 20 nt, Homo sapiens
uuccaauuuacauacucugc

SEQ ID NO: 811021 - RNA, 17 nt, Homo sapiens
uuccacaagagugaauu

SEQ ID NO: 811022 - RNA, 17 nt, Homo sapiens
uuccacaaguuaaauaa

SEQ ID NO: 811023 - RNA, 16 nt, Homo sapiens
uuccaccauugcugga

SEQ ID NO: 811024 - RNA, 23 nt, Homo sapiens
uuccacguguuuuauuccuguau

SEQ ID NO: 811025 - RNA, 14 nt, Homo sapiens
uuccacuacugcua

SEQ ID NO: 811026 - RNA, 18 nt, Homo sapiens
uuccacuaucauucccau

SEQ ID NO: 811027 - RNA, 23 nt, Homo sapiens
uuccacuuagaaauugcauuucc

SEQ ID NO: 811028 - RNA, 14 nt, Homo sapiens
uuccagaaaggaua

SEQ ID NO: 811029 - RNA, 22 nt, Homo sapiens
uuccagaagaagagaagcugcu

SEQ ID NO: 811030 - RNA, 16 nt, Homo sapiens
uuccagaaucuugacu

SEQ ID NO: 811031 - RNA, 13 nt, Homo sapiens
uuccagccuucua

SEQ ID NO: 811032 - RNA, 16 nt, Homo sapiens
uuccagcuccuguaac

SEQ ID NO: 811033 - RNA, 19 nt, Homo sapiens
uuccagcugacaucuugca

SEQ ID NO: 811034 - RNA, 12 nt, Homo sapiens
uuccagcugcug

SEQ ID NO: 811035 - RNA, 17 nt, Homo sapiens
uuccaggcugagccaug

SEQ ID NO: 811036 - RNA, 14 nt, Homo sapiens
uuccaggcugguuc

SEQ ID NO: 811037 - RNA, 21 nt, Homo sapiens
uuccagugguuugagacacug

SEQ ID NO: 811038 - RNA, 16 nt, Homo sapiens
uuccaguuauaaauau

SEQ ID NO: 811039 - RNA, 19 nt, Homo sapiens
uuccaguucaucuauggca

SEQ ID NO: 811040 - RNA, 23 nt, Homo sapiens
uuccaguuuaaugaacuaccauc

SEQ ID NO: 811041 - RNA, 16 nt, Homo sapiens
uuccauaagaagucgu

SEQ ID NO: 811042 - RNA, 18 nt, Homo sapiens
uuccauaauacauaacau

SEQ ID NO: 811043 - RNA, 17 nt, Homo sapiens
uuccauauccauaguga

SEQ ID NO: 811044 - RNA, 17 nt, Homo sapiens
uuccauauguuauauca

SEQ ID NO: 811045 - RNA, 17 nt, Homo sapiens
uuccauauuaguuuuac

SEQ ID NO: 811046 - RNA, 16 nt, Homo sapiens
uuccaucaucacugua

SEQ ID NO: 811047 - RNA, 23 nt, Homo sapiens
uuccaugcaacuggaguuccuua

SEQ ID NO: 811048 - RNA, 13 nt, Homo sapiens
uuccaugugccuu

SEQ ID NO: 811049 - RNA, 21 nt, Homo sapiens
uuccauuaaguacaugugcca

SEQ ID NO: 811050 - RNA, 23 nt, Homo sapiens
uuccauugaagccgacucuggcc

SEQ ID NO: 811051 - RNA, 13 nt, Homo sapiens
uuccauugccaua

SEQ ID NO: 811052 - RNA, 16 nt, Homo sapiens
uuccauugguccaaga

SEQ ID NO: 811053 - RNA, 13 nt, Homo sapiens
uuccauuuaguaa

SEQ ID NO: 811054 - RNA, 15 nt, Homo sapiens
uucccaaguguaauu

SEQ ID NO: 811055 - RNA, 21 nt, Homo sapiens
uucccaccaggcugcucaggg

SEQ ID NO: 811056 - RNA, 20 nt, Homo sapiens
uucccagcagugggggucag

SEQ ID NO: 811057 - RNA, 17 nt, Homo sapiens
uucccaggaauauccca

SEQ ID NO: 811058 - RNA, 21 nt, Homo sapiens
uucccaggccagcaagcucuu

SEQ ID NO: 811059 - RNA, 16 nt, Homo sapiens
uucccaggcccacugu

SEQ ID NO: 811060 - RNA, 16 nt, Homo sapiens
uucccaggcuggauac

SEQ ID NO: 811061 - RNA, 16 nt, Homo sapiens
uucccaguucuugacc

SEQ ID NO: 811062 - RNA, 19 nt, Homo sapiens
uucccaucgcugucacagg

SEQ ID NO: 811063 - RNA, 20 nt, Homo sapiens
uucccauucugccccagagu

SEQ ID NO: 811064 - RNA, 20 nt, Homo sapiens
uucccauuguggcuccuauc

SEQ ID NO: 811065 - RNA, 23 nt, Homo sapiens
uuccccaaagacgaccagcauuu

SEQ ID NO: 811066 - RNA, 15 nt, Homo sapiens
uuccccaaccaaaga

SEQ ID NO: 811067 - RNA, 17 nt, Homo sapiens
uuccccacacaugccua

SEQ ID NO: 811068 - RNA, 23 nt, Homo sapiens
uuccccagcgucccagucucugg

SEQ ID NO: 811069 - RNA, 18 nt, Homo sapiens
uucccccaauguuuaaaa

SEQ ID NO: 811070 - RNA, 19 nt, Homo sapiens
uucccccacuacugcagca

SEQ ID NO: 811071 - RNA, 15 nt, Homo sapiens
uucccccaguaccuc

SEQ ID NO: 811072 - RNA, 22 nt, Homo sapiens
uuccccgcccccaaccccagca

SEQ ID NO: 811073 - RNA, 20 nt, Homo sapiens
uuccccuccuuggcuuuaug

SEQ ID NO: 811074 - RNA, 11 nt, Homo sapiens
uuccccugugg

SEQ ID NO: 811075 - RNA, 21 nt, Homo sapiens
uucccgacgacacauauacau

SEQ ID NO: 811076 - RNA, 18 nt, Homo sapiens
uucccguauugacaggaa

SEQ ID NO: 811077 - RNA, 15 nt, Homo sapiens
uucccuaaacuuuag

SEQ ID NO: 811078 - RNA, 23 nt, Homo sapiens
uucccuaggaaacucacacuccc

SEQ ID NO: 811079 - RNA, 20 nt, Homo sapiens
uucccuaucuucucccccac

SEQ ID NO: 811080 - RNA, 16 nt, Homo sapiens
uucccucccuaucuaa

SEQ ID NO: 811081 - RNA, 23 nt, Homo sapiens
uucccugcuuccaggaaacucca

SEQ ID NO: 811082 - RNA, 15 nt, Homo sapiens
uucccuuaacuccaa

SEQ ID NO: 811083 - RNA, 18 nt, Homo sapiens
uucccuucaacaugaaaa

SEQ ID NO: 811084 - RNA, 14 nt, Homo sapiens
uuccgaaucucuuu

SEQ ID NO: 811085 - RNA, 16 nt, Homo sapiens
uuccgauacaaagugu

SEQ ID NO: 811086 - RNA, 18 nt, Homo sapiens
uuccgcuuugaaagaagc

SEQ ID NO: 811087 - RNA, 16 nt, Homo sapiens
uuccguggcacugcau

SEQ ID NO: 811088 - RNA, 14 nt, Homo sapiens
uuccuaaacccaau

SEQ ID NO: 811089 - RNA, 13 nt, Homo sapiens
uuccuaaggcaug

SEQ ID NO: 811090 - RNA, 18 nt, Homo sapiens
uuccuaguaaauuuaauu

SEQ ID NO: 811091 - RNA, 15 nt, Homo sapiens
uuccuauguaacugc

SEQ ID NO: 811092 - RNA, 12 nt, Homo sapiens
uuccucacauuu

SEQ ID NO: 811093 - RNA, 20 nt, Homo sapiens
uuccucacuaugacacugag

SEQ ID NO: 811094 - RNA, 13 nt, Homo sapiens
uuccucagccucc

SEQ ID NO: 811095 - RNA, 14 nt, Homo sapiens
uuccucauuaguaa

SEQ ID NO: 811096 - RNA, 19 nt, Homo sapiens
uuccuccccgagucagggc

SEQ ID NO: 811097 - RNA, 18 nt, Homo sapiens
uuccuccucgcugccaga

SEQ ID NO: 811098 - RNA, 19 nt, Homo sapiens
uuccucgugggccgugugg

SEQ ID NO: 811099 - RNA, 23 nt, Homo sapiens
uuauauuuguaaauuuaugugau

SEQ ID NO: 811100 - RNA, 19 nt, Homo sapiens
uuaucaacuucgcuagaaa

SEQ ID NO: 811101 - RNA, 19 nt, Homo sapiens
uuaucacacuucugugaga

SEQ ID NO: 811102 - RNA, 12 nt, Homo sapiens
uuaucaccucau

SEQ ID NO: 811103 - RNA, 18 nt, Homo sapiens
uuaucaccucauucugaa

SEQ ID NO: 811104 - RNA, 16 nt, Homo sapiens
uuaucacuuaaacuug

SEQ ID NO: 811105 - RNA, 22 nt, Homo sapiens
uuaucagacucuguaauugaau

SEQ ID NO: 811106 - RNA, 22 nt, Homo sapiens
uuaucaggaaauguuuucuuaa

SEQ ID NO: 811107 - RNA, 12 nt, Homo sapiens
uuaucauaugcu

SEQ ID NO: 811108 - RNA, 15 nt, Homo sapiens
uuaucaucaccucaa

SEQ ID NO: 811109 - RNA, 23 nt, Homo sapiens
uuaucauucauucuuagcucuua

SEQ ID NO: 811110 - RNA, 21 nt, Homo sapiens
uuauccaccaagaacauaaga

SEQ ID NO: 811111 - RNA, 17 nt, Homo sapiens
uuaucccaagaaugcaa

SEQ ID NO: 811112 - RNA, 20 nt, Homo sapiens
uuauccuccaccgucuuucu

SEQ ID NO: 811113 - RNA, 21 nt, Homo sapiens
uuaucuagcaagaagauucua

SEQ ID NO: 811114 - RNA, 18 nt, Homo sapiens
uuaucugucacaccugug

SEQ ID NO: 811115 - RNA, 15 nt, Homo sapiens
uuaucuuaucuagca

SEQ ID NO: 811116 - RNA, 20 nt, Homo sapiens
uuaucuugcaccccaaagcu

SEQ ID NO: 811117 - RNA, 15 nt, Homo sapiens
uuaucuugucucugg

SEQ ID NO: 811118 - RNA, 19 nt, Homo sapiens
uuaucuuuuguauaucuaa

SEQ ID NO: 811119 - RNA, 21 nt, Homo sapiens
uuaugaaaacuagcauuacau

SEQ ID NO: 811120 - RNA, 13 nt, Homo sapiens
uuaugaacacuug

SEQ ID NO: 811121 - RNA, 22 nt, Homo sapiens
uuaugaauaaaguugcugugaa

SEQ ID NO: 811122 - RNA, 15 nt, Homo sapiens
uuaugaggcuauuaa

SEQ ID NO: 811123 - RNA, 13 nt, Homo sapiens
uuaugauguaauc

SEQ ID NO: 811124 - RNA, 22 nt, Homo sapiens
uuaugauuacuaucauggcaua

SEQ ID NO: 811125 - RNA, 15 nt, Homo sapiens
uuaugcaaauacaau

SEQ ID NO: 811126 - RNA, 16 nt, Homo sapiens
uuaugcaaauacaauc

SEQ ID NO: 811127 - RNA, 14 nt, Homo sapiens
uuaugccaaagugu

SEQ ID NO: 811128 - RNA, 18 nt, Homo sapiens
uuaugccggaugugcuuu

SEQ ID NO: 811129 - RNA, 17 nt, Homo sapiens
uuaugccuucacuuuac

SEQ ID NO: 811130 - RNA, 12 nt, Homo sapiens
uuaugcugucau

SEQ ID NO: 811131 - RNA, 15 nt, Homo sapiens
uuauggaaaaggggu

SEQ ID NO: 811132 - RNA, 23 nt, Homo sapiens
uuauggcagaagggaauugcuca

SEQ ID NO: 811133 - RNA, 15 nt, Homo sapiens
uuauggcuucacauu

SEQ ID NO: 811134 - RNA, 12 nt, Homo sapiens
uuaugguuuugg

SEQ ID NO: 811135 - RNA, 18 nt, Homo sapiens
uuaugucaugugcaccuu

SEQ ID NO: 811136 - RNA, 20 nt, Homo sapiens
uuaugucccugacuguaaau

SEQ ID NO: 811137 - RNA, 20 nt, Homo sapiens
uuaugucucuugagcaucaa

SEQ ID NO: 811138 - RNA, 20 nt, Homo sapiens
uuaugugagagaaaguguga

SEQ ID NO: 811139 - RNA, 17 nt, Homo sapiens
uuauguuaaaaagaaau

SEQ ID NO: 811140 - RNA, 14 nt, Homo sapiens
uuauguuagcauug

SEQ ID NO: 811141 - RNA, 17 nt, Homo sapiens
uuauguuugcacuuugu

SEQ ID NO: 811142 - RNA, 14 nt, Homo sapiens
uuauuaaaucaaaa

SEQ ID NO: 811143 - RNA, 18 nt, Homo sapiens
uuauuaagcuuuuuggaa

SEQ ID NO: 811144 - RNA, 14 nt, Homo sapiens
uuauuaauuucagu

SEQ ID NO: 811145 - RNA, 16 nt, Homo sapiens
uuauuacaucuuucac

SEQ ID NO: 811146 - RNA, 13 nt, Homo sapiens
uuauuacauguaa

SEQ ID NO: 811147 - RNA, 15 nt, Homo sapiens
uuauuacucuauaca

SEQ ID NO: 811148 - RNA, 11 nt, Homo sapiens
uuauuacugaa

SEQ ID NO: 811149 - RNA, 13 nt, Homo sapiens
uuauuaucuauua

SEQ ID NO: 811150 - RNA, 17 nt, Homo sapiens
uuauuauuucuguucuu

SEQ ID NO: 811151 - RNA, 20 nt, Homo sapiens
uuauuauuucuguucuuaca

SEQ ID NO: 811152 - RNA, 21 nt, Homo sapiens
uuauuauuugacaacaaucca

SEQ ID NO: 811153 - RNA, 22 nt, Homo sapiens
uuauucacauauaucaaaguga

SEQ ID NO: 811154 - RNA, 13 nt, Homo sapiens
uuauucacuguaa

SEQ ID NO: 811155 - RNA, 12 nt, Homo sapiens
uuauucuaguca

SEQ ID NO: 811156 - RNA, 15 nt, Homo sapiens
uuauucucuucacuc

SEQ ID NO: 811157 - RNA, 14 nt, Homo sapiens
uuauucugauucca

SEQ ID NO: 811158 - RNA, 13 nt, Homo sapiens
uuauugacacuga

SEQ ID NO: 811159 - RNA, 20 nt, Homo sapiens
uuauugaccaauuccugaca

SEQ ID NO: 811160 - RNA, 13 nt, Homo sapiens
uuauugacuaaca

SEQ ID NO: 811161 - RNA, 17 nt, Homo sapiens
uuauugauaaguucaua

SEQ ID NO: 811162 - RNA, 19 nt, Homo sapiens
uuauugauaaguucauaca

SEQ ID NO: 811163 - RNA, 12 nt, Homo sapiens
uuauugcauaau

SEQ ID NO: 811164 - RNA, 19 nt, Homo sapiens
uuauuggcugagauaugaa

SEQ ID NO: 811165 - RNA, 18 nt, Homo sapiens
uuauugguguuuacccag

SEQ ID NO: 811166 - RNA, 20 nt, Homo sapiens
uuauugguuguuguauugau

SEQ ID NO: 811167 - RNA, 14 nt, Homo sapiens
uuauuguuaauaca

SEQ ID NO: 811168 - RNA, 13 nt, Homo sapiens
uuauuuccacuua

SEQ ID NO: 811169 - RNA, 17 nt, Homo sapiens
uuauuuccccagccaca

SEQ ID NO: 811170 - RNA, 20 nt, Homo sapiens
uuauuucugaucuauacaaa

SEQ ID NO: 811171 - RNA, 13 nt, Homo sapiens
uuauuucugcucu

SEQ ID NO: 811172 - RNA, 16 nt, Homo sapiens
uuauuuuacagcucau

SEQ ID NO: 811173 - RNA, 15 nt, Homo sapiens
uuauuuuggcuucag

SEQ ID NO: 811174 - RNA, 16 nt, Homo sapiens
uuauuuugguugcagu

SEQ ID NO: 811175 - RNA, 15 nt, Homo sapiens
uuauuuuguucauac

SEQ ID NO: 811176 - RNA, 18 nt, Homo sapiens
uuauuuuuaaaaagaaau

SEQ ID NO: 811177 - RNA, 12 nt, Homo sapiens
uuauuuuugcaa

SEQ ID NO: 811178 - RNA, 21 nt, Homo sapiens
uuauuuuuucgugcacucugc

SEQ ID NO: 811179 - RNA, 19 nt, Homo sapiens
uucaaaaaacucucuccca

SEQ ID NO: 811180 - RNA, 15 nt, Homo sapiens
uucaaaagugauuau

SEQ ID NO: 811181 - RNA, 18 nt, Homo sapiens
uucaaaauauacauucaa

SEQ ID NO: 811182 - RNA, 14 nt, Homo sapiens
uucaaaauccaaaa

SEQ ID NO: 811183 - RNA, 15 nt, Homo sapiens
uucaaacaaccugcc

SEQ ID NO: 811184 - RNA, 19 nt, Homo sapiens
uucaaacagucucaggaaa

SEQ ID NO: 811185 - RNA, 19 nt, Homo sapiens
uucaaaccugaccacagaa

SEQ ID NO: 811186 - RNA, 19 nt, Homo sapiens
uucaaacugcaugauucau

SEQ ID NO: 811187 - RNA, 18 nt, Homo sapiens
uucaaagacagagaagac

SEQ ID NO: 811188 - RNA, 19 nt, Homo sapiens
uucaaagacggaguauucu

SEQ ID NO: 811189 - RNA, 15 nt, Homo sapiens
uucaaagaugcauuu

SEQ ID NO: 811190 - RNA, 20 nt, Homo sapiens
uucaaagauuuuuauuuuga

SEQ ID NO: 811191 - RNA, 12 nt, Homo sapiens
uucaaagcauuu

SEQ ID NO: 811192 - RNA, 12 nt, Homo sapiens
uucaaagcuaaa

SEQ ID NO: 811193 - RNA, 19 nt, Homo sapiens
uucaaagggaaacuuuaau

SEQ ID NO: 811194 - RNA, 12 nt, Homo sapiens
uucaaaguuuag

SEQ ID NO: 811195 - RNA, 20 nt, Homo sapiens
uucaaaguuuuguuguacuu

SEQ ID NO: 811196 - RNA, 12 nt, Homo sapiens
uucaaaugaaac

SEQ ID NO: 811197 - RNA, 12 nt, Homo sapiens
uucaaaugggcu

SEQ ID NO: 811198 - RNA, 12 nt, Homo sapiens
uucaaauuugau

SEQ ID NO: 811199 - RNA, 11 nt, Homo sapiens
uucaacaaagg

SEQ ID NO: 811200 - RNA, 23 nt, Homo sapiens
uucaacagcucaccaacuacaga

SEQ ID NO: 811201 - RNA, 18 nt, Homo sapiens
uucaacaguuuuugcuaa

SEQ ID NO: 811202 - RNA, 19 nt, Homo sapiens
uucaacauuuacauguauu

SEQ ID NO: 811203 - RNA, 16 nt, Homo sapiens
uucaacuugcauccaa

SEQ ID NO: 811204 - RNA, 20 nt, Homo sapiens
ugagagcccgcgugcuggag

SEQ ID NO: 811205 - RNA, 22 nt, Homo sapiens
ugagagcccgcgugcuggagaa

SEQ ID NO: 811206 - RNA, 21 nt, Homo sapiens
ugagagggaaaagauugacug

SEQ ID NO: 811207 - RNA, 12 nt, Homo sapiens
ugagaguauuua

SEQ ID NO: 811208 - RNA, 23 nt, Homo sapiens
ugagauaccacaaacccugcuga

SEQ ID NO: 811209 - RNA, 19 nt, Homo sapiens
ugagauacuuuacuaauaa

SEQ ID NO: 811210 - RNA, 17 nt, Homo sapiens
ugagaucguuguuuaca

SEQ ID NO: 811211 - RNA, 17 nt, Homo sapiens
ugagaugcguuguuaca

SEQ ID NO: 811212 - RNA, 13 nt, Homo sapiens
ugagauggggaca

SEQ ID NO: 811213 - RNA, 10 nt, Homo sapiens
ugagaugugc

SEQ ID NO: 811214 - RNA, 22 nt, Homo sapiens
ugagauguguggacuguggcac

SEQ ID NO: 811215 - RNA, 17 nt, Homo sapiens
ugagauguuauuacugu

SEQ ID NO: 811216 - RNA, 22 nt, Homo sapiens
ugagauguuguguggcaauggg

SEQ ID NO: 811217 - RNA, 16 nt, Homo sapiens
ugagauuacaggcacc

SEQ ID NO: 811218 - RNA, 14 nt, Homo sapiens
ugagcaaaggugau

SEQ ID NO: 811219 - RNA, 13 nt, Homo sapiens
ugagcaacugcga

SEQ ID NO: 811220 - RNA, 22 nt, Homo sapiens
ugagcaagucuuagacaucaua

SEQ ID NO: 811221 - RNA, 14 nt, Homo sapiens
ugagcacacuuuag

SEQ ID NO: 811222 - RNA, 22 nt, Homo sapiens
ugagcacuguuuauacacugug

SEQ ID NO: 811223 - RNA, 17 nt, Homo sapiens
ugagcagaacaccugag

SEQ ID NO: 811224 - RNA, 9 nt, Homo sapiens
ugagcagac

SEQ ID NO: 811225 - RNA, 15 nt, Homo sapiens
ugagcagagacauga

SEQ ID NO: 811226 - RNA, 18 nt, Homo sapiens
ugagcagagauguacugc

SEQ ID NO: 811227 - RNA, 20 nt, Homo sapiens
ugagcagaugauuccccuag

SEQ ID NO: 811228 - RNA, 19 nt, Homo sapiens
ugagcagccuccacugugu

SEQ ID NO: 811229 - RNA, 15 nt, Homo sapiens
ugagcagguguucuu

SEQ ID NO: 811230 - RNA, 21 nt, Homo sapiens
ugagcauggggcgcucccacu

SEQ ID NO: 811231 - RNA, 18 nt, Homo sapiens
ugagcauggucacaagca

SEQ ID NO: 811232 - RNA, 20 nt, Homo sapiens
ugagccaagaucgcaccacu

SEQ ID NO: 811233 - RNA, 17 nt, Homo sapiens
ugagccaaggacagggc

SEQ ID NO: 811234 - RNA, 21 nt, Homo sapiens
ugagccaaggcuuuugcaaag

SEQ ID NO: 811235 - RNA, 16 nt, Homo sapiens
ugagccaguggugcua

SEQ ID NO: 811236 - RNA, 19 nt, Homo sapiens
ugagcccccugaugccacc

SEQ ID NO: 811237 - RNA, 19 nt, Homo sapiens
ugagcccccugcacccacc

SEQ ID NO: 811238 - RNA, 21 nt, Homo sapiens
ugagccccuggaggcacugaa

SEQ ID NO: 811239 - RNA, 13 nt, Homo sapiens
ugagccuuggccc

SEQ ID NO: 811240 - RNA, 20 nt, Homo sapiens
ugagccuuggcccacacuga

SEQ ID NO: 811241 - RNA, 14 nt, Homo sapiens
ugagcgagugucca

SEQ ID NO: 811242 - RNA, 13 nt, Homo sapiens
ugagcuacuucaa

SEQ ID NO: 811243 - RNA, 16 nt, Homo sapiens
ugagcuaugcaaacaa

SEQ ID NO: 811244 - RNA, 20 nt, Homo sapiens
ugagcucaggaguuugagac

SEQ ID NO: 811245 - RNA, 21 nt, Homo sapiens
ugagcugagacagauaagaga

SEQ ID NO: 811246 - RNA, 19 nt, Homo sapiens
ugagcugccuguaacuuga

SEQ ID NO: 811247 - RNA, 21 nt, Homo sapiens
ugagcuggaguucagcaguga

SEQ ID NO: 811248 - RNA, 14 nt, Homo sapiens
ugagcuggggaccu

SEQ ID NO: 811249 - RNA, 20 nt, Homo sapiens
ugagcuggggacucagggac

SEQ ID NO: 811250 - RNA, 20 nt, Homo sapiens
ugagcuggggaugucucuca

SEQ ID NO: 811251 - RNA, 22 nt, Homo sapiens
ugagcuggggaugucucucaug

SEQ ID NO: 811252 - RNA, 17 nt, Homo sapiens
ugagcuggguacugacu

SEQ ID NO: 811253 - RNA, 16 nt, Homo sapiens
ugagcuucuuuagcua

SEQ ID NO: 811254 - RNA, 16 nt, Homo sapiens
ugagcuuucuuugcac

SEQ ID NO: 811255 - RNA, 18 nt, Homo sapiens
ugagcuuucuuugcacuu

SEQ ID NO: 811256 - RNA, 20 nt, Homo sapiens
ugaggaaaacuguagucucu

SEQ ID NO: 811257 - RNA, 16 nt, Homo sapiens
ugaggaagugaacauu

SEQ ID NO: 811258 - RNA, 18 nt, Homo sapiens
ugaggacaagauaccaag

SEQ ID NO: 811259 - RNA, 16 nt, Homo sapiens
ugaggacaccagugaa

SEQ ID NO: 811260 - RNA, 23 nt, Homo sapiens
ugaggacagaaggacuggugcga

SEQ ID NO: 811261 - RNA, 23 nt, Homo sapiens
ugaggaccacuccuguacacuga

SEQ ID NO: 811262 - RNA, 17 nt, Homo sapiens
ugaggacccgaggacag

SEQ ID NO: 811263 - RNA, 15 nt, Homo sapiens
ugaggacuucuugcu

SEQ ID NO: 811264 - RNA, 20 nt, Homo sapiens
ugaggagaagcugauccagu

SEQ ID NO: 811265 - RNA, 21 nt, Homo sapiens
ugaggagaggaguuuucucca

SEQ ID NO: 811266 - RNA, 13 nt, Homo sapiens
ugaggagcccagg

SEQ ID NO: 811267 - RNA, 15 nt, Homo sapiens
ugaggagcucaagaa

SEQ ID NO: 811268 - RNA, 16 nt, Homo sapiens
ugaggagcugcacuga

SEQ ID NO: 811269 - RNA, 20 nt, Homo sapiens
ugaggagggaggaacguggu

SEQ ID NO: 811270 - RNA, 15 nt, Homo sapiens
ugaggaggucccacu

SEQ ID NO: 811271 - RNA, 19 nt, Homo sapiens
ugaggaggucccacuugca

SEQ ID NO: 811272 - RNA, 23 nt, Homo sapiens
ugaggauauggacacuggugcca

SEQ ID NO: 811273 - RNA, 12 nt, Homo sapiens
ugaggauuucaa

SEQ ID NO: 811274 - RNA, 13 nt, Homo sapiens
ugaggcaggagaa

SEQ ID NO: 811275 - RNA, 22 nt, Homo sapiens
ugaggcaggagaauuacuugaa

SEQ ID NO: 811276 - RNA, 13 nt, Homo sapiens
ugaggcaggugag

SEQ ID NO: 811277 - RNA, 20 nt, Homo sapiens
ugaggcauuuccagacuuga

SEQ ID NO: 811278 - RNA, 21 nt, Homo sapiens
ugaggccacccacugacccaa

SEQ ID NO: 811279 - RNA, 17 nt, Homo sapiens
ugaggccuagacucugu

SEQ ID NO: 811280 - RNA, 19 nt, Homo sapiens
ugaggccucacuacucgag

SEQ ID NO: 811281 - RNA, 19 nt, Homo sapiens
ugaggccuccagcuucagg

SEQ ID NO: 811282 - RNA, 14 nt, Homo sapiens
ugaggcugcagauu

SEQ ID NO: 811283 - RNA, 13 nt, Homo sapiens
ugaggcugucagu

SEQ ID NO: 811284 - RNA, 23 nt, Homo sapiens
cccuguguggucuccaugcucac

SEQ ID NO: 811285 - RNA, 22 nt, Homo sapiens
cccuguuuuaauucaacccagc

SEQ ID NO: 811286 - RNA, 21 nt, Homo sapiens
cccuuaacucaaaccaugcaa

SEQ ID NO: 811287 - RNA, 22 nt, Homo sapiens
cccuuacagagcauacaacaga

SEQ ID NO: 811288 - RNA, 20 nt, Homo sapiens
cccuuacccucccaccacuc

SEQ ID NO: 811289 - RNA, 22 nt, Homo sapiens
cccuuauuuguuuuguguuuca

SEQ ID NO: 811290 - RNA, 22 nt, Homo sapiens
cccuucaaccauuccccauggg

SEQ ID NO: 811291 - RNA, 17 nt, Homo sapiens
cccuucacauacccucc

SEQ ID NO: 811292 - RNA, 11 nt, Homo sapiens
cccuucacugu

SEQ ID NO: 811293 - RNA, 16 nt, Homo sapiens
cccuucacugucacca

SEQ ID NO: 811294 - RNA, 20 nt, Homo sapiens
cccuucaguacccucucagc

SEQ ID NO: 811295 - RNA, 14 nt, Homo sapiens
cccuuccagugccc

SEQ ID NO: 811296 - RNA, 14 nt, Homo sapiens
cccuuccuguuuca

SEQ ID NO: 811297 - RNA, 15 nt, Homo sapiens
cccuuccuguuucag

SEQ ID NO: 811298 - RNA, 16 nt, Homo sapiens
cccuucuccuuucuaa

SEQ ID NO: 811299 - RNA, 23 nt, Homo sapiens
cccuucuguguuucuggagugau

SEQ ID NO: 811300 - RNA, 17 nt, Homo sapiens
cccuucuuuacuuccca

SEQ ID NO: 811301 - RNA, 20 nt, Homo sapiens
cccuugauuuaaacacacag

SEQ ID NO: 811302 - RNA, 14 nt, Homo sapiens
cccuugcccggcug

SEQ ID NO: 811303 - RNA, 22 nt, Homo sapiens
cccuugcuguaugcugaucauc

SEQ ID NO: 811304 - RNA, 19 nt, Homo sapiens
cccuuggcaguguggcagu

SEQ ID NO: 811305 - RNA, 22 nt, Homo sapiens
cccuuggcccaucugugcagua

SEQ ID NO: 811306 - RNA, 18 nt, Homo sapiens
cccuuggccuccauuucu

SEQ ID NO: 811307 - RNA, 17 nt, Homo sapiens
cccuuuaacucaugagg

SEQ ID NO: 811308 - RNA, 21 nt, Homo sapiens
cccuuuagcgggacucaguga

SEQ ID NO: 811309 - RNA, 16 nt, Homo sapiens
cccuuucacacuggau

SEQ ID NO: 811310 - RNA, 17 nt, Homo sapiens
cccuuugauucuccagu

SEQ ID NO: 811311 - RNA, 18 nt, Homo sapiens
cccuuugccacacugugg

SEQ ID NO: 811312 - RNA, 13 nt, Homo sapiens
cccuuuuacuuuu

SEQ ID NO: 811313 - RNA, 12 nt, Homo sapiens
cccuuuucauga

SEQ ID NO: 811314 - RNA, 15 nt, Homo sapiens
cccuuuucucaggac

SEQ ID NO: 811315 - RNA, 12 nt, Homo sapiens
ccgaaaccagag

SEQ ID NO: 811316 - RNA, 16 nt, Homo sapiens
ccgaaguaugagggaa

SEQ ID NO: 811317 - RNA, 12 nt, Homo sapiens
ccgacaucacag

SEQ ID NO: 811318 - RNA, 18 nt, Homo sapiens
ugauuuguagcacugagg

SEQ ID NO: 811319 - RNA, 14 nt, Homo sapiens
ugauuuuacaauug

SEQ ID NO: 811320 - RNA, 20 nt, Homo sapiens
ugauuuuuuucauuuugcca

SEQ ID NO: 811321 - RNA, 21 nt, Homo sapiens
ugcaaaaaaaaaaaaagcaau

SEQ ID NO: 811322 - RNA, 13 nt, Homo sapiens
ugcaaaaauaacc

SEQ ID NO: 811323 - RNA, 18 nt, Homo sapiens
ugcaaaauauuugacuau

SEQ ID NO: 811324 - RNA, 21 nt, Homo sapiens
ugcaaaccacuucuccaugcu

SEQ ID NO: 811325 - RNA, 15 nt, Homo sapiens
ugcaaaccucaucuu

SEQ ID NO: 811326 - RNA, 18 nt, Homo sapiens
ugcaaacucaguuccaaa

SEQ ID NO: 811327 - RNA, 19 nt, Homo sapiens
ugcaaacucaguuccaaag

SEQ ID NO: 811328 - RNA, 18 nt, Homo sapiens
ugcaaacugaaagaucug

SEQ ID NO: 811329 - RNA, 17 nt, Homo sapiens
ugcaaagaucuuuucca

SEQ ID NO: 811330 - RNA, 13 nt, Homo sapiens
ugcaaagauuucu

SEQ ID NO: 811331 - RNA, 13 nt, Homo sapiens
ugcaaagcacuga

SEQ ID NO: 811332 - RNA, 21 nt, Homo sapiens
ugcaaagcugaagaccaugga

SEQ ID NO: 811333 - RNA, 19 nt, Homo sapiens
ugcaaagcuuuggcugaga

SEQ ID NO: 811334 - RNA, 23 nt, Homo sapiens
ugcaaagcuuuugccugcaagag

SEQ ID NO: 811335 - RNA, 19 nt, Homo sapiens
ugcaaaggcgucugaaugu

SEQ ID NO: 811336 - RNA, 15 nt, Homo sapiens
ugcaaauacaaucag

SEQ ID NO: 811337 - RNA, 22 nt, Homo sapiens
ugcaaauacaaucagcccagug

SEQ ID NO: 811338 - RNA, 22 nt, Homo sapiens
ugcaaauaggcagaauggaauc

SEQ ID NO: 811339 - RNA, 14 nt, Homo sapiens
ugcaaaugcaugcu

SEQ ID NO: 811340 - RNA, 17 nt, Homo sapiens
ugcaaaugcuauauugc

SEQ ID NO: 811341 - RNA, 19 nt, Homo sapiens
ugcaaauguccccuugaug

SEQ ID NO: 811342 - RNA, 15 nt, Homo sapiens
ugcaaauucauuuca

SEQ ID NO: 811343 - RNA, 20 nt, Homo sapiens
ugcaacaauaaaguacuuua

SEQ ID NO: 811344 - RNA, 12 nt, Homo sapiens
ugcaacagcuac

SEQ ID NO: 811345 - RNA, 22 nt, Homo sapiens
ugcaacagcuacagucuaaaau

SEQ ID NO: 811346 - RNA, 16 nt, Homo sapiens
ugcaacagggggcaaa

SEQ ID NO: 811347 - RNA, 13 nt, Homo sapiens
ugcaaccaggaac

SEQ ID NO: 811348 - RNA, 22 nt, Homo sapiens
ugcaacccagucacacuguggc

SEQ ID NO: 811349 - RNA, 22 nt, Homo sapiens
ugcaacccgguuuaccaguuua

SEQ ID NO: 811350 - RNA, 16 nt, Homo sapiens
ugcaacccuuaccccu

SEQ ID NO: 811351 - RNA, 17 nt, Homo sapiens
ugcaaccuccgccuccc

SEQ ID NO: 811352 - RNA, 21 nt, Homo sapiens
ugcaaccucuuugcucaacag

SEQ ID NO: 811353 - RNA, 22 nt, Homo sapiens
ugcaacugggucugacaugaac

SEQ ID NO: 811354 - RNA, 14 nt, Homo sapiens
ugcaacuucugccu

SEQ ID NO: 811355 - RNA, 21 nt, Homo sapiens
ugcaacuucuuacuucccuaa

SEQ ID NO: 811356 - RNA, 12 nt, Homo sapiens
ugcaagacagaa

SEQ ID NO: 811357 - RNA, 17 nt, Homo sapiens
ugcaagaguggacugaa

SEQ ID NO: 811358 - RNA, 18 nt, Homo sapiens
ugcaagaguggacugaau

SEQ ID NO: 811359 - RNA, 23 nt, Homo sapiens
ugcaagaguuucuuguaagccau

SEQ ID NO: 811360 - RNA, 14 nt, Homo sapiens
ugcaaggcacugac

SEQ ID NO: 811361 - RNA, 20 nt, Homo sapiens
ugcaaguuagggucuaugua

SEQ ID NO: 811362 - RNA, 16 nt, Homo sapiens
ugcaauaauacuucuc

SEQ ID NO: 811363 - RNA, 19 nt, Homo sapiens
ugcaauaauacuucucaaa

SEQ ID NO: 811364 - RNA, 19 nt, Homo sapiens
ugcaauaccaauguucuaa

SEQ ID NO: 811365 - RNA, 16 nt, Homo sapiens
ugcaauagagacugua

SEQ ID NO: 811366 - RNA, 15 nt, Homo sapiens
ugcaaucuucuacuu

SEQ ID NO: 811367 - RNA, 18 nt, Homo sapiens
ugcaaugacacagucuug

SEQ ID NO: 811368 - RNA, 13 nt, Homo sapiens
ugcaauguaguca

SEQ ID NO: 811369 - RNA, 12 nt, Homo sapiens
ugcaauguauua

SEQ ID NO: 811370 - RNA, 12 nt, Homo sapiens
ugcaaugucaca

SEQ ID NO: 811371 - RNA, 14 nt, Homo sapiens
ugcaauugcuccca

SEQ ID NO: 811372 - RNA, 16 nt, Homo sapiens
ugcaauuuccaacaca

SEQ ID NO: 811373 - RNA, 20 nt, Homo sapiens
ugcaauuuuauuaaaugcau

SEQ ID NO: 811374 - RNA, 18 nt, Homo sapiens
ugcaauuuuucaagagcu

SEQ ID NO: 811375 - RNA, 17 nt, Homo sapiens
ugcacaaacuugugagc

SEQ ID NO: 811376 - RNA, 14 nt, Homo sapiens
ugcacaagaaugga

SEQ ID NO: 811377 - RNA, 23 nt, Homo sapiens
ugcacaagaauggaucacaagau

SEQ ID NO: 811378 - RNA, 14 nt, Homo sapiens
ugcacaagccaggg

SEQ ID NO: 811379 - RNA, 20 nt, Homo sapiens
ugcacacaagcucugcgcca

SEQ ID NO: 811380 - RNA, 20 nt, Homo sapiens
ugcacacacacacaucucau

SEQ ID NO: 811381 - RNA, 19 nt, Homo sapiens
ugcacacgggaaagccuua

SEQ ID NO: 811382 - RNA, 16 nt, Homo sapiens
ugcacacucacuugua

SEQ ID NO: 811383 - RNA, 21 nt, Homo sapiens
ugcacacucacuuguaagaaa

SEQ ID NO: 811384 - RNA, 21 nt, Homo sapiens
ugcacacucauacacaugugc

SEQ ID NO: 811385 - RNA, 21 nt, Homo sapiens
ugcacacucaugcacacagau

SEQ ID NO: 811386 - RNA, 19 nt, Homo sapiens
ugcacagaauauguaugua

SEQ ID NO: 811387 - RNA, 23 nt, Homo sapiens
ugcacaggcagauguuugccuca

SEQ ID NO: 811388 - RNA, 23 nt, Homo sapiens
ugcacagggggaggccauaaaga

SEQ ID NO: 811389 - RNA, 17 nt, Homo sapiens
ugcacagucacugcucu

SEQ ID NO: 811390 - RNA, 19 nt, Homo sapiens
ugcacagucacugcucuuc

SEQ ID NO: 811391 - RNA, 15 nt, Homo sapiens
ugcacaucacaacau

SEQ ID NO: 811392 - RNA, 14 nt, Homo sapiens
ugcacaugaaaguu

SEQ ID NO: 811393 - RNA, 18 nt, Homo sapiens
ugcaccaauuaucaucuu

SEQ ID NO: 811394 - RNA, 14 nt, Homo sapiens
ugcaccacugcucu

SEQ ID NO: 811395 - RNA, 15 nt, Homo sapiens
ugcaccauugcacuc

SEQ ID NO: 811396 - RNA, 18 nt, Homo sapiens
ugcaccuacccacaugca

SEQ ID NO: 811397 - RNA, 12 nt, Homo sapiens
ugcaccuaccuu

SEQ ID NO: 811398 - RNA, 15 nt, Homo sapiens
ugcaccuacugcuua

SEQ ID NO: 811399 - RNA, 21 nt, Homo sapiens
ugcaccucuggcuagagccga

SEQ ID NO: 811400 - RNA, 23 nt, Homo sapiens
ccuccugggcccacaacagcgug

SEQ ID NO: 811401 - RNA, 13 nt, Homo sapiens
ccuccuguaaaug

SEQ ID NO: 811402 - RNA, 12 nt, Homo sapiens
ccuccugugcua

SEQ ID NO: 811403 - RNA, 18 nt, Homo sapiens
ccuccuuggccaccagac

SEQ ID NO: 811404 - RNA, 21 nt, Homo sapiens
ccuccuuggcuuuaugcaaau

SEQ ID NO: 811405 - RNA, 14 nt, Homo sapiens
ccuccuugugccuu

SEQ ID NO: 811406 - RNA, 14 nt, Homo sapiens
ccucgcaugacugu

SEQ ID NO: 811407 - RNA, 21 nt, Homo sapiens
ccucgggccgaggcccagcgg

SEQ ID NO: 811408 - RNA, 21 nt, Homo sapiens
ccucgucaagagcaugcacau

SEQ ID NO: 811409 - RNA, 13 nt, Homo sapiens
ccucuaauugcau

SEQ ID NO: 811410 - RNA, 21 nt, Homo sapiens
ccucuacuuuaacuuuuacaa

SEQ ID NO: 811411 - RNA, 17 nt, Homo sapiens
ccucuagguagcacuug

SEQ ID NO: 811412 - RNA, 21 nt, Homo sapiens
ccucuaguaagaugcacugaa

SEQ ID NO: 811413 - RNA, 21 nt, Homo sapiens
ccucuauuuuaauuacugcua

SEQ ID NO: 811414 - RNA, 20 nt, Homo sapiens
ccucucagagugacagucau

SEQ ID NO: 811415 - RNA, 19 nt, Homo sapiens
ccucuccaagggcuucugc

SEQ ID NO: 811416 - RNA, 18 nt, Homo sapiens
ccucucccaaguccacac

SEQ ID NO: 811417 - RNA, 18 nt, Homo sapiens
ccucucccggcaacaucu

SEQ ID NO: 811418 - RNA, 15 nt, Homo sapiens
ccucucccugccaag

SEQ ID NO: 811419 - RNA, 17 nt, Homo sapiens
ccucuccuggaucaaaa

SEQ ID NO: 811420 - RNA, 17 nt, Homo sapiens
ccucuccuuccuuaccc

SEQ ID NO: 811421 - RNA, 21 nt, Homo sapiens
ccucucuaagugggcauugcc

SEQ ID NO: 811422 - RNA, 12 nt, Homo sapiens
ccucucucaaaa

SEQ ID NO: 811423 - RNA, 22 nt, Homo sapiens
ccucucucacauggaacgcuuu

SEQ ID NO: 811424 - RNA, 23 nt, Homo sapiens
ccucucucauggcacccaggcag

SEQ ID NO: 811425 - RNA, 19 nt, Homo sapiens
ccucucucccggagguugg

SEQ ID NO: 811426 - RNA, 20 nt, Homo sapiens
ccucucucuaccagucuauu

SEQ ID NO: 811427 - RNA, 12 nt, Homo sapiens
ccucucucucag

SEQ ID NO: 811428 - RNA, 11 nt, Homo sapiens
ccucucugagu

SEQ ID NO: 811429 - RNA, 12 nt, Homo sapiens
ccucucugaguc

SEQ ID NO: 811430 - RNA, 16 nt, Homo sapiens
ccucugaacuugccuu

SEQ ID NO: 811431 - RNA, 19 nt, Homo sapiens
ccucugacccuagcucuuu

SEQ ID NO: 811432 - RNA, 14 nt, Homo sapiens
uggauccagcacug

SEQ ID NO: 811433 - RNA, 16 nt, Homo sapiens
uggaucccugcccuuc

SEQ ID NO: 811434 - RNA, 16 nt, Homo sapiens
uggauccugggucaaa

SEQ ID NO: 811435 - RNA, 20 nt, Homo sapiens
uggaucuaucaccugucauc

SEQ ID NO: 811436 - RNA, 21 nt, Homo sapiens
uggaucuaucaccugucauca

SEQ ID NO: 811437 - RNA, 18 nt, Homo sapiens
uggaugacuaacuaucaa

SEQ ID NO: 811438 - RNA, 16 nt, Homo sapiens
uggaugcagcuucaag

SEQ ID NO: 811439 - RNA, 14 nt, Homo sapiens
uggaugcaggguuu

SEQ ID NO: 811440 - RNA, 14 nt, Homo sapiens
uggauggaaaggga

SEQ ID NO: 811441 - RNA, 16 nt, Homo sapiens
uggauggcacccugga

SEQ ID NO: 811442 - RNA, 23 nt, Homo sapiens
uggaugggggaacucagauccag

SEQ ID NO: 811443 - RNA, 14 nt, Homo sapiens
uggauguucacugc

SEQ ID NO: 811444 - RNA, 21 nt, Homo sapiens
uggauuacaggcaugugccac

SEQ ID NO: 811445 - RNA, 17 nt, Homo sapiens
uggauuacuauugcaaa

SEQ ID NO: 811446 - RNA, 23 nt, Homo sapiens
uggauuacuauugcaaaagggaa

SEQ ID NO: 811447 - RNA, 14 nt, Homo sapiens
uggauuauucauuu

SEQ ID NO: 811448 - RNA, 19 nt, Homo sapiens
uggauucaacacugugcac

SEQ ID NO: 811449 - RNA, 20 nt, Homo sapiens
uggauucaacacugugcacg

SEQ ID NO: 811450 - RNA, 20 nt, Homo sapiens
uggauucccagggacuucag

SEQ ID NO: 811451 - RNA, 13 nt, Homo sapiens
uggauucuggaug

SEQ ID NO: 811452 - RNA, 16 nt, Homo sapiens
uggauugacucugcau

SEQ ID NO: 811453 - RNA, 14 nt, Homo sapiens
uggauugaggccag

SEQ ID NO: 811454 - RNA, 18 nt, Homo sapiens
uggauugauaauugcauu

SEQ ID NO: 811455 - RNA, 22 nt, Homo sapiens
uggauugcacguggccucuuga

SEQ ID NO: 811456 - RNA, 23 nt, Homo sapiens
uggauuggaaugcagaggucucc

SEQ ID NO: 811457 - RNA, 22 nt, Homo sapiens
uggauuuaaaagccugcucaau

SEQ ID NO: 811458 - RNA, 15 nt, Homo sapiens
uggauuuauagcuau

SEQ ID NO: 811459 - RNA, 17 nt, Homo sapiens
uggauuuucaucagggg

SEQ ID NO: 811460 - RNA, 19 nt, Homo sapiens
uggauuuugaaauuuacug

SEQ ID NO: 811461 - RNA, 18 nt, Homo sapiens
uggcaaaaaggagccuuu

SEQ ID NO: 811462 - RNA, 22 nt, Homo sapiens
uggcaaaaaggagccuuuugcu

SEQ ID NO: 811463 - RNA, 18 nt, Homo sapiens
uggcaaaaucaucuuaca

SEQ ID NO: 811464 - RNA, 22 nt, Homo sapiens
uggcaaaaucuuguuaauguca

SEQ ID NO: 811465 - RNA, 13 nt, Homo sapiens
uggcaaacccucc

SEQ ID NO: 811466 - RNA, 23 nt, Homo sapiens
uggcaaagauuuuuggcacuuug

SEQ ID NO: 811467 - RNA, 23 nt, Homo sapiens
uggcaaagccuucauugccuuaa

SEQ ID NO: 811468 - RNA, 21 nt, Homo sapiens
uggcaaauguaacugugccag

SEQ ID NO: 811469 - RNA, 20 nt, Homo sapiens
uggcaacaaaaaguaaugaa

SEQ ID NO: 811470 - RNA, 19 nt, Homo sapiens
uggcaacagagcaagacuc

SEQ ID NO: 811471 - RNA, 21 nt, Homo sapiens
uggcaacagagcaagacucca

SEQ ID NO: 811472 - RNA, 13 nt, Homo sapiens
uggcaaccuuccu

SEQ ID NO: 811473 - RNA, 19 nt, Homo sapiens
uggcaacggaagaaugaga

SEQ ID NO: 811474 - RNA, 19 nt, Homo sapiens
uggcaauuguccccaggga

SEQ ID NO: 811475 - RNA, 23 nt, Homo sapiens
uggcacaaaaaaauaucagacaa

SEQ ID NO: 811476 - RNA, 19 nt, Homo sapiens
uggcacacaccuguagucc

SEQ ID NO: 811477 - RNA, 16 nt, Homo sapiens
uggcacaugccuguaa

SEQ ID NO: 811478 - RNA, 15 nt, Homo sapiens
uggcaccacugcacu

SEQ ID NO: 811479 - RNA, 15 nt, Homo sapiens
uggcacguauugcug

SEQ ID NO: 811480 - RNA, 19 nt, Homo sapiens
uggcacucagggagcauuu

SEQ ID NO: 811481 - RNA, 16 nt, Homo sapiens
uggcacucuguaguca

SEQ ID NO: 811482 - RNA, 16 nt, Homo sapiens
uggcacuugcuaacaa

SEQ ID NO: 811483 - RNA, 17 nt, Homo sapiens
uggcacuugcuaacaaa

SEQ ID NO: 811484 - RNA, 12 nt, Homo sapiens
uggcacuuguau

SEQ ID NO: 811485 - RNA, 10 nt, Homo sapiens
uggcacuuug

SEQ ID NO: 811486 - RNA, 11 nt, Homo sapiens
uggcacuuuga

SEQ ID NO: 811487 - RNA, 21 nt, Homo sapiens
uggcagaagggaauugcucag

SEQ ID NO: 811488 - RNA, 12 nt, Homo sapiens
uggcagagccag

SEQ ID NO: 811489 - RNA, 12 nt, Homo sapiens
uggcagccagga

SEQ ID NO: 811490 - RNA, 21 nt, Homo sapiens
uggcagcgccucaucuucaac

SEQ ID NO: 811491 - RNA, 17 nt, Homo sapiens
uggcagcgcggggagcc

SEQ ID NO: 811492 - RNA, 19 nt, Homo sapiens
uggcagcugccccuggcac

SEQ ID NO: 811493 - RNA, 20 nt, Homo sapiens
uggcagcuguuucucaugaa

SEQ ID NO: 811494 - RNA, 11 nt, Homo sapiens
uggcagggaua

SEQ ID NO: 811495 - RNA, 19 nt, Homo sapiens
uggcagucugaauuuuuaa

SEQ ID NO: 811496 - RNA, 18 nt, Homo sapiens
uggcagugaccauggcac

SEQ ID NO: 811497 - RNA, 14 nt, Homo sapiens
uggcauaagacaga

SEQ ID NO: 811498 - RNA, 19 nt, Homo sapiens
uggcauacgccuguagucc

SEQ ID NO: 811499 - RNA, 18 nt, Homo sapiens
uggcaucaagggagacac

SEQ ID NO: 811500 - RNA, 15 nt, Homo sapiens
uggcaucacagggca

SEQ ID NO: 811501 - RNA, 16 nt, Homo sapiens
uggcaucaucucagcu

SEQ ID NO: 811502 - RNA, 19 nt, Homo sapiens
uggcaucaucucagcucac

SEQ ID NO: 811503 - RNA, 18 nt, Homo sapiens
uggcaugaggagguccca

SEQ ID NO: 811504 - RNA, 12 nt, Homo sapiens
uggcaugccuuc

SEQ ID NO: 811505 - RNA, 15 nt, Homo sapiens
uggcauuacauugag

SEQ ID NO: 811506 - RNA, 23 nt, Homo sapiens
uggcauuugggugaacuguggac

SEQ ID NO: 811507 - RNA, 17 nt, Homo sapiens
uggccaaauagcaaaga

SEQ ID NO: 811508 - RNA, 16 nt, Homo sapiens
uggccaacaugaugaa

SEQ ID NO: 811509 - RNA, 15 nt, Homo sapiens
uggccaaggugucca

SEQ ID NO: 811510 - RNA, 22 nt, Homo sapiens
uggccaauaacuuuucaccaau

SEQ ID NO: 811511 - RNA, 14 nt, Homo sapiens
uggccacagacuga

SEQ ID NO: 811512 - RNA, 15 nt, Homo sapiens
uggccacagugucac

SEQ ID NO: 811513 - RNA, 19 nt, Homo sapiens
uggccacgcagccaggaca

SEQ ID NO: 811514 - RNA, 20 nt, Homo sapiens
uggccacgggggcaguguga

SEQ ID NO: 811515 - RNA, 19 nt, Homo sapiens
uggccaggacccugaccuc

SEQ ID NO: 811516 - RNA, 22 nt, Homo sapiens
uggccaggagguuggugacuga

SEQ ID NO: 811517 - RNA, 15 nt, Homo sapiens
cuaauaccucugugu

SEQ ID NO: 811518 - RNA, 22 nt, Homo sapiens
cuaauagaauaaaggcaguuuu

SEQ ID NO: 811519 - RNA, 14 nt, Homo sapiens
cuaauagagauuaa

SEQ ID NO: 811520 - RNA, 16 nt, Homo sapiens
cuaauagucuuugcca

SEQ ID NO: 811521 - RNA, 17 nt, Homo sapiens
cuaauagucuuugccag

SEQ ID NO: 811522 - RNA, 12 nt, Homo sapiens
cuaauauucaac

SEQ ID NO: 811523 - RNA, 23 nt, Homo sapiens
cuaaucaagaaaagaauuacaga

SEQ ID NO: 811524 - RNA, 21 nt, Homo sapiens
cuaaucugauguuaaccaaug

SEQ ID NO: 811525 - RNA, 14 nt, Homo sapiens
cuaaucugcagugg

SEQ ID NO: 811526 - RNA, 16 nt, Homo sapiens
cuaaucugcaguggau

SEQ ID NO: 811527 - RNA, 17 nt, Homo sapiens
cuaaugagacugaccau

SEQ ID NO: 811528 - RNA, 11 nt, Homo sapiens
cuaauguauua

SEQ ID NO: 811529 - RNA, 15 nt, Homo sapiens
cuaaugucagaguag

SEQ ID NO: 811530 - RNA, 23 nt, Homo sapiens
cuaauguuugaacaaagcucaaa

SEQ ID NO: 811531 - RNA, 20 nt, Homo sapiens
cuaauuagaucaauuacuua

SEQ ID NO: 811532 - RNA, 12 nt, Homo sapiens
cuaauuccuguu

SEQ ID NO: 811533 - RNA, 17 nt, Homo sapiens
cuaauucggauuugcca

SEQ ID NO: 811534 - RNA, 18 nt, Homo sapiens
cuaauuggccucuuuaag

SEQ ID NO: 811535 - RNA, 11 nt, Homo sapiens
cuaauugugga

SEQ ID NO: 811536 - RNA, 21 nt, Homo sapiens
cuaauuuccucugacauguaa

SEQ ID NO: 811537 - RNA, 23 nt, Homo sapiens
cuaauuugaauggaaaacacaug

SEQ ID NO: 811538 - RNA, 20 nt, Homo sapiens
cuaauuuucuagauuuucua

SEQ ID NO: 811539 - RNA, 14 nt, Homo sapiens
cuacaacagaauuu

SEQ ID NO: 811540 - RNA, 18 nt, Homo sapiens
cuacaaccaauuuacacu

SEQ ID NO: 811541 - RNA, 17 nt, Homo sapiens
cuacaacugauugcaac

SEQ ID NO: 811542 - RNA, 20 nt, Homo sapiens
cuacaacuuuuccuaaggca

SEQ ID NO: 811543 - RNA, 10 nt, Homo sapiens
cuacaaggac

SEQ ID NO: 811544 - RNA, 16 nt, Homo sapiens
cuacaagucagcucca

SEQ ID NO: 811545 - RNA, 14 nt, Homo sapiens
cuacacacaaacca

SEQ ID NO: 811546 - RNA, 14 nt, Homo sapiens
cuacacacaguacg

SEQ ID NO: 811547 - RNA, 16 nt, Homo sapiens
uggugaucagugcaau

SEQ ID NO: 811548 - RNA, 15 nt, Homo sapiens
uggugaugguuucca

SEQ ID NO: 811549 - RNA, 13 nt, Homo sapiens
uggugcacugagc

SEQ ID NO: 811550 - RNA, 19 nt, Homo sapiens
uggugccccagcaccaacc

SEQ ID NO: 811551 - RNA, 15 nt, Homo sapiens
ugguggaaacagugg

SEQ ID NO: 811552 - RNA, 15 nt, Homo sapiens
ugguggagcagagug

SEQ ID NO: 811553 - RNA, 18 nt, Homo sapiens
ugguggcauuguuuacag

SEQ ID NO: 811554 - RNA, 19 nt, Homo sapiens
ugguggcucacgccuguaa

SEQ ID NO: 811555 - RNA, 19 nt, Homo sapiens
uggugggcccccaaugaca

SEQ ID NO: 811556 - RNA, 16 nt, Homo sapiens
uggugggcgccuguaa

SEQ ID NO: 811557 - RNA, 22 nt, Homo sapiens
uggugggggugggcgccuguag

SEQ ID NO: 811558 - RNA, 17 nt, Homo sapiens
uggugggucuauguucc

SEQ ID NO: 811559 - RNA, 16 nt, Homo sapiens
ugguggguucagggga

SEQ ID NO: 811560 - RNA, 21 nt, Homo sapiens
ugguguaguuucuucauuuca

SEQ ID NO: 811561 - RNA, 15 nt, Homo sapiens
ugguguauguaugag

SEQ ID NO: 811562 - RNA, 22 nt, Homo sapiens
uggugucacccuggauaggcaa

SEQ ID NO: 811563 - RNA, 14 nt, Homo sapiens
uggugucaguaucc

SEQ ID NO: 811564 - RNA, 17 nt, Homo sapiens
uggugugaccauguuca

SEQ ID NO: 811565 - RNA, 19 nt, Homo sapiens
ugguguucaaaaaaacacu

SEQ ID NO: 811566 - RNA, 23 nt, Homo sapiens
ugguguucuguuucaauguauaa

SEQ ID NO: 811567 - RNA, 23 nt, Homo sapiens
ugguguuuugcacuucuguaaac

SEQ ID NO: 811568 - RNA, 14 nt, Homo sapiens
ugguuacaguuuga

SEQ ID NO: 811569 - RNA, 14 nt, Homo sapiens
ugguuauauaguca

SEQ ID NO: 811570 - RNA, 16 nt, Homo sapiens
ugguuauuaugaauaa

SEQ ID NO: 811571 - RNA, 17 nt, Homo sapiens
ugguucaacauggaaau

SEQ ID NO: 811572 - RNA, 19 nt, Homo sapiens
ugguucacauccuaccccu

SEQ ID NO: 811573 - RNA, 23 nt, Homo sapiens
ugguucagugccuuccucucucu

SEQ ID NO: 811574 - RNA, 14 nt, Homo sapiens
ugguucaucccuuu

SEQ ID NO: 811575 - RNA, 13 nt, Homo sapiens
ugguuccaaagac

SEQ ID NO: 811576 - RNA, 15 nt, Homo sapiens
ugguuccaaagacac

SEQ ID NO: 811577 - RNA, 16 nt, Homo sapiens
ugguuccaagucuuug

SEQ ID NO: 811578 - RNA, 14 nt, Homo sapiens
ugguuccaugcagc

SEQ ID NO: 811579 - RNA, 19 nt, Homo sapiens
ugguuccaugccugagggu

SEQ ID NO: 811580 - RNA, 15 nt, Homo sapiens
ugguugaaaaccaca

SEQ ID NO: 811581 - RNA, 20 nt, Homo sapiens
ugguugaaaaccacagucag

SEQ ID NO: 811582 - RNA, 15 nt, Homo sapiens
ugguugaaugaauaa

SEQ ID NO: 811583 - RNA, 13 nt, Homo sapiens
ugguuuacuucaa

SEQ ID NO: 811584 - RNA, 16 nt, Homo sapiens
ugguuugaaagaugca

SEQ ID NO: 811585 - RNA, 15 nt, Homo sapiens
ugguuugugucaaaa

SEQ ID NO: 811586 - RNA, 20 nt, Homo sapiens
ugguuuuccagcgaagggaa

SEQ ID NO: 811587 - RNA, 15 nt, Homo sapiens
ugguuuuuacauuca

SEQ ID NO: 811588 - RNA, 16 nt, Homo sapiens
ugguuuuuacauucaa

SEQ ID NO: 811589 - RNA, 22 nt, Homo sapiens
ugguuuuuuuuugauccucuga

SEQ ID NO: 811590 - RNA, 23 nt, Homo sapiens
ugguuuuuuuuuuuuugagacag

SEQ ID NO: 811591 - RNA, 13 nt, Homo sapiens
uguaaaagcacau

SEQ ID NO: 811592 - RNA, 22 nt, Homo sapiens
uguaaaaugugaagugaaugaa

SEQ ID NO: 811593 - RNA, 22 nt, Homo sapiens
uguaaaauguuuuagcaauuua

SEQ ID NO: 811594 - RNA, 17 nt, Homo sapiens
uguaaaauucauagcau

SEQ ID NO: 811595 - RNA, 17 nt, Homo sapiens
uguaaacaaaccacagc

SEQ ID NO: 811596 - RNA, 19 nt, Homo sapiens
uguaaacauaauucuugua

SEQ ID NO: 811597 - RNA, 16 nt, Homo sapiens
uguaaacuacaaagua

SEQ ID NO: 811598 - RNA, 16 nt, Homo sapiens
uguaaagacaaauaaa

SEQ ID NO: 811599 - RNA, 19 nt, Homo sapiens
uguaaagauguuuauuuca

SEQ ID NO: 811600 - RNA, 20 nt, Homo sapiens
uguaaaguaaaagcuauaaa

SEQ ID NO: 811601 - RNA, 21 nt, Homo sapiens
uguaaaguagaauaagccuuc

SEQ ID NO: 811602 - RNA, 14 nt, Homo sapiens
uguaaauaugaauc

SEQ ID NO: 811603 - RNA, 23 nt, Homo sapiens
uguaaauauuuauuuauguguuc

SEQ ID NO: 811604 - RNA, 15 nt, Homo sapiens
uguaaaucugccaca

SEQ ID NO: 811605 - RNA, 17 nt, Homo sapiens
uguaaaugcucguguga

SEQ ID NO: 811606 - RNA, 13 nt, Homo sapiens
uguaaauguacug

SEQ ID NO: 811607 - RNA, 14 nt, Homo sapiens
uguaaauguacugg

SEQ ID NO: 811608 - RNA, 12 nt, Homo sapiens
uguaacaaugua

SEQ ID NO: 811609 - RNA, 21 nt, Homo sapiens
uguaacaauuguguagccuuu

SEQ ID NO: 811610 - RNA, 16 nt, Homo sapiens
uguaacacugcaagaa

SEQ ID NO: 811611 - RNA, 17 nt, Homo sapiens
uguaacacugcaagaag

SEQ ID NO: 811612 - RNA, 20 nt, Homo sapiens
uguaacagauaucagugucu

SEQ ID NO: 811613 - RNA, 15 nt, Homo sapiens
uguaacaucagggac

SEQ ID NO: 811614 - RNA, 14 nt, Homo sapiens
uguaacccgcucau

SEQ ID NO: 811615 - RNA, 16 nt, Homo sapiens
uguaaccugcugugau

SEQ ID NO: 811616 - RNA, 16 nt, Homo sapiens
uguaacguggcacugg

SEQ ID NO: 811617 - RNA, 21 nt, Homo sapiens
uguaacugacugccuugcuaa

SEQ ID NO: 811618 - RNA, 12 nt, Homo sapiens
uguaacugcuga

SEQ ID NO: 811619 - RNA, 19 nt, Homo sapiens
uguaacuguaaaacauuga

SEQ ID NO: 811620 - RNA, 13 nt, Homo sapiens
uguaagaacugua

SEQ ID NO: 811621 - RNA, 18 nt, Homo sapiens
uguaagaaggcaauauua

SEQ ID NO: 811622 - RNA, 17 nt, Homo sapiens
uguaagaaguuucuuaa

SEQ ID NO: 811623 - RNA, 14 nt, Homo sapiens
uguaagacuuacaa

SEQ ID NO: 811624 - RNA, 19 nt, Homo sapiens
uguaagagaaaauauuacu

SEQ ID NO: 811625 - RNA, 18 nt, Homo sapiens
uguaagaguucagacuca

SEQ ID NO: 811626 - RNA, 12 nt, Homo sapiens
uguaagauuuca

SEQ ID NO: 811627 - RNA, 16 nt, Homo sapiens
uguaagcauacuuugu

SEQ ID NO: 811628 - RNA, 19 nt, Homo sapiens
uguaaggaauuaucaauua

SEQ ID NO: 811629 - RNA, 13 nt, Homo sapiens
uguaagucaucua

SEQ ID NO: 811630 - RNA, 18 nt, Homo sapiens
uguaauaauaaaucgucc

SEQ ID NO: 811631 - RNA, 21 nt, Homo sapiens
uguaauaccugauugaucaca

SEQ ID NO: 811632 - RNA, 16 nt, Homo sapiens
uguaaucauuccuucc

SEQ ID NO: 811633 - RNA, 15 nt, Homo sapiens
uguaaucuaccagug

SEQ ID NO: 811634 - RNA, 16 nt, Homo sapiens
uguaaucucagcacuu

SEQ ID NO: 811635 - RNA, 19 nt, Homo sapiens
cucacugagugauacuuua

SEQ ID NO: 811636 - RNA, 21 nt, Homo sapiens
cucacugcugcaaauacugua

SEQ ID NO: 811637 - RNA, 22 nt, Homo sapiens
cucacugcugcaaauacuguau

SEQ ID NO: 811638 - RNA, 22 nt, Homo sapiens
cucacuggccacaauacccacc

SEQ ID NO: 811639 - RNA, 23 nt, Homo sapiens
cucacuggggccuacagcuuuga

SEQ ID NO: 811640 - RNA, 17 nt, Homo sapiens
cucacuguugaauuuuc

SEQ ID NO: 811641 - RNA, 18 nt, Homo sapiens
cucacuugugcaguguug

SEQ ID NO: 811642 - RNA, 22 nt, Homo sapiens
cucagaaauguaguuugcacuu

SEQ ID NO: 811643 - RNA, 21 nt, Homo sapiens
cucagaacucuuugcucuugu

SEQ ID NO: 811644 - RNA, 18 nt, Homo sapiens
cucagaaggaauggugcg

SEQ ID NO: 811645 - RNA, 15 nt, Homo sapiens
cucagaaggcuucau

SEQ ID NO: 811646 - RNA, 23 nt, Homo sapiens
cucagaauauugcuuuggucaua

SEQ ID NO: 811647 - RNA, 17 nt, Homo sapiens
cucagaccaaucaucaa

SEQ ID NO: 811648 - RNA, 17 nt, Homo sapiens
cucagagaccagcacuc

SEQ ID NO: 811649 - RNA, 19 nt, Homo sapiens
cucagagaccgugagcgcc

SEQ ID NO: 811650 - RNA, 13 nt, Homo sapiens
cucagagauauac

SEQ ID NO: 811651 - RNA, 13 nt, Homo sapiens
cucagagcucucu

SEQ ID NO: 811652 - RNA, 14 nt, Homo sapiens
cucagaggccugcu

SEQ ID NO: 811653 - RNA, 22 nt, Homo sapiens
cucagaguguggguccuucaaa

SEQ ID NO: 811654 - RNA, 23 nt, Homo sapiens
cucagaucauuaucagccugugc

SEQ ID NO: 811655 - RNA, 15 nt, Homo sapiens
cucagaucuugacag

SEQ ID NO: 811656 - RNA, 19 nt, Homo sapiens
cucagauugaggagcucaa

SEQ ID NO: 811657 - RNA, 23 nt, Homo sapiens
cucagcacauucgggaccaauau

SEQ ID NO: 811658 - RNA, 20 nt, Homo sapiens
cucagcauagccugccugau

SEQ ID NO: 811659 - RNA, 23 nt, Homo sapiens
cucagcauuucuuuucuggccaa

SEQ ID NO: 811660 - RNA, 22 nt, Homo sapiens
cucagcccccgcccgucaccac

SEQ ID NO: 811661 - RNA, 16 nt, Homo sapiens
uguccauuuauaucau

SEQ ID NO: 811662 - RNA, 19 nt, Homo sapiens
ugucccaccaacucugcac

SEQ ID NO: 811663 - RNA, 21 nt, Homo sapiens
ugucccagaaugccuccugca

SEQ ID NO: 811664 - RNA, 19 nt, Homo sapiens
uguccccacuuacagaucu

SEQ ID NO: 811665 - RNA, 17 nt, Homo sapiens
uguccccagucagagau

SEQ ID NO: 811666 - RNA, 16 nt, Homo sapiens
ugucccgcggugcuga

SEQ ID NO: 811667 - RNA, 14 nt, Homo sapiens
ugucccguggcauu

SEQ ID NO: 811668 - RNA, 22 nt, Homo sapiens
ugucccucauccauagcaccuc

SEQ ID NO: 811669 - RNA, 17 nt, Homo sapiens
ugucccugagcagcuua

SEQ ID NO: 811670 - RNA, 23 nt, Homo sapiens
ugucccugcccaggccucuggcu

SEQ ID NO: 811671 - RNA, 19 nt, Homo sapiens
ugucccugugaucuuggca

SEQ ID NO: 811672 - RNA, 17 nt, Homo sapiens
ugucccuugcuugccug

SEQ ID NO: 811673 - RNA, 18 nt, Homo sapiens
uguccggcccagugccac

SEQ ID NO: 811674 - RNA, 15 nt, Homo sapiens
uguccgggcucagaa

SEQ ID NO: 811675 - RNA, 14 nt, Homo sapiens
uguccguucauccc

SEQ ID NO: 811676 - RNA, 15 nt, Homo sapiens
uguccuaugcgcuca

SEQ ID NO: 811677 - RNA, 18 nt, Homo sapiens
uguccucaaaaggaauaa

SEQ ID NO: 811678 - RNA, 23 nt, Homo sapiens
uguccucaguguaccacuacuua

SEQ ID NO: 811679 - RNA, 16 nt, Homo sapiens
uguccuccaccaugca

SEQ ID NO: 811680 - RNA, 18 nt, Homo sapiens
uguccucucccugccaag

SEQ ID NO: 811681 - RNA, 22 nt, Homo sapiens
uguccucuugccuuuuacuuaa

SEQ ID NO: 811682 - RNA, 16 nt, Homo sapiens
uguccugacaccugcu

SEQ ID NO: 811683 - RNA, 21 nt, Homo sapiens
uguccuggugcucucugccac

SEQ ID NO: 811684 - RNA, 21 nt, Homo sapiens
uguccuguacauugugggaug

SEQ ID NO: 811685 - RNA, 19 nt, Homo sapiens
uguccuguccuuucuugca

SEQ ID NO: 811686 - RNA, 16 nt, Homo sapiens
uguccugugacaacac

SEQ ID NO: 811687 - RNA, 14 nt, Homo sapiens
uguccuuccugacc

SEQ ID NO: 811688 - RNA, 20 nt, Homo sapiens
uguccuucgcccugugcacc

SEQ ID NO: 811689 - RNA, 13 nt, Homo sapiens
uguccuugcacac

SEQ ID NO: 811690 - RNA, 15 nt, Homo sapiens
uguccuugcacacuc

SEQ ID NO: 811691 - RNA, 12 nt, Homo sapiens
uguccuuuauga

SEQ ID NO: 811692 - RNA, 15 nt, Homo sapiens
uguccuuuaugaucc

SEQ ID NO: 811693 - RNA, 21 nt, Homo sapiens
ugucgagagcuggccaaagag

SEQ ID NO: 811694 - RNA, 14 nt, Homo sapiens
ugucgagaucucag

SEQ ID NO: 811695 - RNA, 22 nt, Homo sapiens
ugucgccuggaugcacuuccug

SEQ ID NO: 811696 - RNA, 18 nt, Homo sapiens
ugucuaaugacagauaaa

SEQ ID NO: 811697 - RNA, 16 nt, Homo sapiens
ugucuacucauccaga

SEQ ID NO: 811698 - RNA, 18 nt, Homo sapiens
ugucuauuaucacauuaa

SEQ ID NO: 811699 - RNA, 18 nt, Homo sapiens
ugucucaaaaaauauaua

SEQ ID NO: 811700 - RNA, 20 nt, Homo sapiens
ugucucaaaggagcuuucuc

SEQ ID NO: 811701 - RNA, 16 nt, Homo sapiens
ugucucacugaaacau

SEQ ID NO: 811702 - RNA, 23 nt, Homo sapiens
ugucucaugucaaugaccauuca

SEQ ID NO: 811703 - RNA, 18 nt, Homo sapiens
ugucuccacgauggugga

SEQ ID NO: 811704 - RNA, 18 nt, Homo sapiens
ugucuccacggccugccc

SEQ ID NO: 811705 - RNA, 16 nt, Homo sapiens
ugucucuaaccauuca

SEQ ID NO: 811706 - RNA, 15 nt, Homo sapiens
ugucucuacaaaaaa

SEQ ID NO: 811707 - RNA, 23 nt, Homo sapiens
ugucucuacuuuucccuguacuu

SEQ ID NO: 811708 - RNA, 15 nt, Homo sapiens
ugucucucaugacca

SEQ ID NO: 811709 - RNA, 14 nt, Homo sapiens
ugucucugccaugu

SEQ ID NO: 811710 - RNA, 18 nt, Homo sapiens
ugucucuugagcaucaau

SEQ ID NO: 811711 - RNA, 16 nt, Homo sapiens
ugucugaacauagaaa

SEQ ID NO: 811712 - RNA, 19 nt, Homo sapiens
ugucugagacagaaucuca

SEQ ID NO: 811713 - RNA, 20 nt, Homo sapiens
ugucugagauacgucuguga

SEQ ID NO: 811714 - RNA, 21 nt, Homo sapiens
ugucugauucuaugccuguau

SEQ ID NO: 811715 - RNA, 21 nt, Homo sapiens
ugucuggcccgcaauacugua

SEQ ID NO: 811716 - RNA, 16 nt, Homo sapiens
ugucuggguuccaaaa

SEQ ID NO: 811717 - RNA, 17 nt, Homo sapiens
ugucuggugcacauaau

SEQ ID NO: 811718 - RNA, 14 nt, Homo sapiens
ugucuggugcagaa

SEQ ID NO: 811719 - RNA, 13 nt, Homo sapiens
ugucuguaccucg

SEQ ID NO: 811720 - RNA, 16 nt, Homo sapiens
ugucuguccuuuauga

SEQ ID NO: 811721 - RNA, 16 nt, Homo sapiens
ugucuguggggugguu

SEQ ID NO: 811722 - RNA, 19 nt, Homo sapiens
ugucuguuuguuucaagaa

SEQ ID NO: 811723 - RNA, 21 nt, Homo sapiens
ugucuuaauuaaaagaauauu

SEQ ID NO: 811724 - RNA, 15 nt, Homo sapiens
ugucuuacugugauc

SEQ ID NO: 811725 - RNA, 13 nt, Homo sapiens
ugucuucagagaa

SEQ ID NO: 811726 - RNA, 22 nt, Homo sapiens
ugucuuccacagccgccugaaa

SEQ ID NO: 811727 - RNA, 20 nt, Homo sapiens
ugucuuccugcauucaccca

SEQ ID NO: 811728 - RNA, 13 nt, Homo sapiens
ugucuucucaggc

SEQ ID NO: 811729 - RNA, 13 nt, Homo sapiens
ugucuucugggca

SEQ ID NO: 811730 - RNA, 16 nt, Homo sapiens
ugucuugagcucuaaa

SEQ ID NO: 811731 - RNA, 19 nt, Homo sapiens
ugucuuggacacuguacaa

SEQ ID NO: 811732 - RNA, 22 nt, Homo sapiens
ugucuuguucauuuugaguauu

SEQ ID NO: 811733 - RNA, 22 nt, Homo sapiens
ugucuuuaaaaguauccagaga

SEQ ID NO: 811734 - RNA, 19 nt, Homo sapiens
ugucuuuauaaucuacucc

SEQ ID NO: 811735 - RNA, 16 nt, Homo sapiens
ugucuuuaucaaagga

SEQ ID NO: 811736 - RNA, 23 nt, Homo sapiens
ugucuuugucaccacguggggcu

SEQ ID NO: 811737 - RNA, 18 nt, Homo sapiens
ugucuuuguucugugauu

SEQ ID NO: 811738 - RNA, 15 nt, Homo sapiens
ugucuuuuguucucu

SEQ ID NO: 811739 - RNA, 16 nt, Homo sapiens
ugugaaauucauuugu

SEQ ID NO: 811740 - RNA, 15 nt, Homo sapiens
ugugaacacaucagc

SEQ ID NO: 811741 - RNA, 19 nt, Homo sapiens
ugugaacuauuaaucaucc

SEQ ID NO: 811742 - RNA, 17 nt, Homo sapiens
ugugaacucaccaaaca

SEQ ID NO: 811743 - RNA, 12 nt, Homo sapiens
ugugaagccaaa

SEQ ID NO: 811744 - RNA, 16 nt, Homo sapiens
ugugaaguggaaaugu

SEQ ID NO: 811745 - RNA, 14 nt, Homo sapiens
ugugaaugaucucu

SEQ ID NO: 811746 - RNA, 18 nt, Homo sapiens
ugugacaacaugcaagaa

SEQ ID NO: 811747 - RNA, 19 nt, Homo sapiens
ugugacaacaugcaagaag

SEQ ID NO: 811748 - RNA, 12 nt, Homo sapiens
ugugacauacau

SEQ ID NO: 811749 - RNA, 13 nt, Homo sapiens
ugugacauacaua

SEQ ID NO: 811750 - RNA, 12 nt, Homo sapiens
cuccugcaaaau

SEQ ID NO: 811751 - RNA, 14 nt, Homo sapiens
cuccugccuacuca

SEQ ID NO: 811752 - RNA, 23 nt, Homo sapiens
cuccugcgcccuucauugccaca

SEQ ID NO: 811753 - RNA, 16 nt, Homo sapiens
cuccugcgcugacaag

SEQ ID NO: 811754 - RNA, 12 nt, Homo sapiens
cuccugcugcag

SEQ ID NO: 811755 - RNA, 22 nt, Homo sapiens
cuccugcugggcgugugugaca

SEQ ID NO: 811756 - RNA, 23 nt, Homo sapiens
cuccuggcuggggccuguugaag

SEQ ID NO: 811757 - RNA, 15 nt, Homo sapiens
cuccuggcugugaca

SEQ ID NO: 811758 - RNA, 23 nt, Homo sapiens
cuccugggaaggagggagcugcu

SEQ ID NO: 811759 - RNA, 15 nt, Homo sapiens
cuccugggaaggcca

SEQ ID NO: 811760 - RNA, 14 nt, Homo sapiens
cuccugggcuauau

SEQ ID NO: 811761 - RNA, 16 nt, Homo sapiens
cuccuggggucacuca

SEQ ID NO: 811762 - RNA, 14 nt, Homo sapiens
cuccuguacacuga

SEQ ID NO: 811763 - RNA, 18 nt, Homo sapiens
cuccugucccucauccau

SEQ ID NO: 811764 - RNA, 12 nt, Homo sapiens
cuccugucucag

SEQ ID NO: 811765 - RNA, 17 nt, Homo sapiens
cuccugucucagccucc

SEQ ID NO: 811766 - RNA, 21 nt, Homo sapiens
cuccugucuuaugguccagaa

SEQ ID NO: 811767 - RNA, 12 nt, Homo sapiens
cuccugucuuca

SEQ ID NO: 811768 - RNA, 23 nt, Homo sapiens
cuccugucuucagagcaaaagac

SEQ ID NO: 811769 - RNA, 19 nt, Homo sapiens
cuccugugaccccaccuug

SEQ ID NO: 811770 - RNA, 20 nt, Homo sapiens
cuccuuaacaacuguagcaa

SEQ ID NO: 811771 - RNA, 24 nt, Homo sapiens
cuccuucccccagcccaauaaagg

SEQ ID NO: 811772 - RNA, 13 nt, Homo sapiens
cuccuucccgccg

SEQ ID NO: 811773 - RNA, 17 nt, Homo sapiens
cuccuugacuccaagaa

SEQ ID NO: 811774 - RNA, 13 nt, Homo sapiens
cuccuugcacuuu

SEQ ID NO: 811775 - RNA, 22 nt, Homo sapiens
cuccuuggauguagucaguuag

SEQ ID NO: 811776 - RNA, 14 nt, Homo sapiens
cuggccacgcagcc

SEQ ID NO: 811777 - RNA, 12 nt, Homo sapiens
cuggccagagag

SEQ ID NO: 811778 - RNA, 19 nt, Homo sapiens
cuggccaguccugguccug

SEQ ID NO: 811779 - RNA, 15 nt, Homo sapiens
cuggcccacccaguc

SEQ ID NO: 811780 - RNA, 16 nt, Homo sapiens
cuggcccagaugauau

SEQ ID NO: 811781 - RNA, 18 nt, Homo sapiens
cuggcccagaugauauaa

SEQ ID NO: 811782 - RNA, 22 nt, Homo sapiens
cuggcccaggguguuugcagcu

SEQ ID NO: 811783 - RNA, 12 nt, Homo sapiens
cuggcccugugc

SEQ ID NO: 811784 - RNA, 17 nt, Homo sapiens
cuggcccugugccuugg

SEQ ID NO: 811785 - RNA, 20 nt, Homo sapiens
cuggcccuucagucugcucc

SEQ ID NO: 811786 - RNA, 21 nt, Homo sapiens
cuggcccuugcuuaccucuca

SEQ ID NO: 811787 - RNA, 16 nt, Homo sapiens
cuggcgacugccccug

SEQ ID NO: 811788 - RNA, 15 nt, Homo sapiens
cuggcggcugugcau

SEQ ID NO: 811789 - RNA, 16 nt, Homo sapiens
cuggcuaacacgguga

SEQ ID NO: 811790 - RNA, 14 nt, Homo sapiens
cuggcuaacugaug

SEQ ID NO: 811791 - RNA, 18 nt, Homo sapiens
cuggcuacugucuauuaa

SEQ ID NO: 811792 - RNA, 22 nt, Homo sapiens
cuggcuagaguccucacuccca

SEQ ID NO: 811793 - RNA, 19 nt, Homo sapiens
cuggcucaggugugggugg

SEQ ID NO: 811794 - RNA, 20 nt, Homo sapiens
cuggcuccagagauggucac

SEQ ID NO: 811795 - RNA, 18 nt, Homo sapiens
cuggcucccccacaccuc

SEQ ID NO: 811796 - RNA, 14 nt, Homo sapiens
cuggcucucagaag

SEQ ID NO: 811797 - RNA, 22 nt, Homo sapiens
cuggcucuugaggcauuuccag

SEQ ID NO: 811798 - RNA, 15 nt, Homo sapiens
cuggcugaagaauga

SEQ ID NO: 811799 - RNA, 15 nt, Homo sapiens
cuggcugaugaucca

SEQ ID NO: 811800 - RNA, 17 nt, Homo sapiens
cuggcugcuuuguucaa

SEQ ID NO: 811801 - RNA, 13 nt, Homo sapiens
cuggcugggcaug

SEQ ID NO: 811802 - RNA, 15 nt, Homo sapiens
cuggcuuagugccac

SEQ ID NO: 811803 - RNA, 20 nt, Homo sapiens
cuggcuucucuugagucaca

SEQ ID NO: 811804 - RNA, 15 nt, Homo sapiens
cuggcuuuccagcuu

SEQ ID NO: 811805 - RNA, 22 nt, Homo sapiens
cugggaacaacuucaguccaac

SEQ ID NO: 811806 - RNA, 16 nt, Homo sapiens
cugggaaccacuccca

SEQ ID NO: 811807 - RNA, 19 nt, Homo sapiens
cugggacaucuuaguguuu

SEQ ID NO: 811808 - RNA, 17 nt, Homo sapiens
cugggagaaccucaggc

SEQ ID NO: 811809 - RNA, 16 nt, Homo sapiens
cugggagcagcucugu

SEQ ID NO: 811810 - RNA, 20 nt, Homo sapiens
cugggaggcaucaguugcua

SEQ ID NO: 811811 - RNA, 18 nt, Homo sapiens
cugggagucacacagugu

SEQ ID NO: 811812 - RNA, 15 nt, Homo sapiens
cugggaucuggcaca

SEQ ID NO: 811813 - RNA, 19 nt, Homo sapiens
cugggaugaugcaguuuga

SEQ ID NO: 811814 - RNA, 14 nt, Homo sapiens
cugggauguagaac

SEQ ID NO: 811815 - RNA, 23 nt, Homo sapiens
cugggauuaacagguaugaacca

SEQ ID NO: 811816 - RNA, 15 nt, Homo sapiens
cugggauuacaggca

SEQ ID NO: 811817 - RNA, 22 nt, Homo sapiens
cugggauuacagggaugagcca

SEQ ID NO: 811818 - RNA, 23 nt, Homo sapiens
cugggauuacuggcaugagccac

SEQ ID NO: 811819 - RNA, 14 nt, Homo sapiens
cugggcaacacagc

SEQ ID NO: 811820 - RNA, 13 nt, Homo sapiens
cugggcaaucaga

SEQ ID NO: 811821 - RNA, 15 nt, Homo sapiens
cugggcacaguggac

SEQ ID NO: 811822 - RNA, 14 nt, Homo sapiens
cugggcagaaggcc

SEQ ID NO: 811823 - RNA, 16 nt, Homo sapiens
cugggcagaaggccaa

SEQ ID NO: 811824 - RNA, 22 nt, Homo sapiens
cugggcagcauagcaagacaca

SEQ ID NO: 811825 - RNA, 13 nt, Homo sapiens
cugggcagguggg

SEQ ID NO: 811826 - RNA, 20 nt, Homo sapiens
cugggcagucagaaagccca

SEQ ID NO: 811827 - RNA, 21 nt, Homo sapiens
cugggcauuuggugagaguca

SEQ ID NO: 811828 - RNA, 14 nt, Homo sapiens
cugggccaugucca

SEQ ID NO: 811829 - RNA, 16 nt, Homo sapiens
cugggccauguccaaa

SEQ ID NO: 811830 - RNA, 17 nt, Homo sapiens
cugggccauguccaaag

SEQ ID NO: 811831 - RNA, 18 nt, Homo sapiens
cugggccauguccaaaga

SEQ ID NO: 811832 - RNA, 16 nt, Homo sapiens
cugggcccaagacaga

SEQ ID NO: 811833 - RNA, 22 nt, Homo sapiens
cugggccccaccaccuaggcca

SEQ ID NO: 811834 - RNA, 20 nt, Homo sapiens
cugggcccucucuucucacc

SEQ ID NO: 811835 - RNA, 17 nt, Homo sapiens
cugggcggccucuugcu

SEQ ID NO: 811836 - RNA, 19 nt, Homo sapiens
cugggcuccuccaccagcu

SEQ ID NO: 811837 - RNA, 12 nt, Homo sapiens
cugggcucucca

SEQ ID NO: 811838 - RNA, 22 nt, Homo sapiens
cugggcugcuacccagaaauca

SEQ ID NO: 811839 - RNA, 13 nt, Homo sapiens
cugggcugggaaa

SEQ ID NO: 811840 - RNA, 13 nt, Homo sapiens
cugggcuguaacg

SEQ ID NO: 811841 - RNA, 13 nt, Homo sapiens
cugggcugugcua

SEQ ID NO: 811842 - RNA, 14 nt, Homo sapiens
cugggcuucauucc

SEQ ID NO: 811843 - RNA, 19 nt, Homo sapiens
cugggcuucgucuacuccu

SEQ ID NO: 811844 - RNA, 22 nt, Homo sapiens
cuggggaagagaaaagcccaag

SEQ ID NO: 811845 - RNA, 18 nt, Homo sapiens
cuggggacagcuuccuca

SEQ ID NO: 811846 - RNA, 17 nt, Homo sapiens
cuggggaggcugaggca

SEQ ID NO: 811847 - RNA, 15 nt, Homo sapiens
cuggggcaagaugag

SEQ ID NO: 811848 - RNA, 14 nt, Homo sapiens
cuggggcaauggga

SEQ ID NO: 811849 - RNA, 16 nt, Homo sapiens
cuggggcauccugugc

SEQ ID NO: 811850 - RNA, 19 nt, Homo sapiens
cuggggccuagcgaucucu

SEQ ID NO: 811851 - RNA, 17 nt, Homo sapiens
cuggggccucaccugcu

SEQ ID NO: 811852 - RNA, 15 nt, Homo sapiens
cuggggccuguugaa

SEQ ID NO: 811853 - RNA, 14 nt, Homo sapiens
cuggggcucugugc

SEQ ID NO: 811854 - RNA, 22 nt, Homo sapiens
cugggggaggggacauugaaca

SEQ ID NO: 811855 - RNA, 20 nt, Homo sapiens
cuggggggacccagugcaga

SEQ ID NO: 811856 - RNA, 21 nt, Homo sapiens
cuggggggacccagugcagaa

SEQ ID NO: 811857 - RNA, 23 nt, Homo sapiens
cuggggggcguggagagcccggc

SEQ ID NO: 811858 - RNA, 19 nt, Homo sapiens
cugggguccuccugugcua

SEQ ID NO: 811859 - RNA, 22 nt, Homo sapiens
cuggggucuggcuuuggugaac

SEQ ID NO: 811860 - RNA, 22 nt, Homo sapiens
cuggguaagaagaaagcaaaag

SEQ ID NO: 811861 - RNA, 20 nt, Homo sapiens
cuggguacccugagcccacc

SEQ ID NO: 811862 - RNA, 11 nt, Homo sapiens
cuggguccuug

SEQ ID NO: 811863 - RNA, 23 nt, Homo sapiens
cugggucucgcuuuguugcccag

SEQ ID NO: 811864 - RNA, 15 nt, Homo sapiens
cugggucugaccugg

SEQ ID NO: 811865 - RNA, 15 nt, Homo sapiens
cugggugacagagug

SEQ ID NO: 811866 - RNA, 19 nt, Homo sapiens
cuggguuacagaaucacag

SEQ ID NO: 811867 - RNA, 16 nt, Homo sapiens
cuggguuggugcacag

SEQ ID NO: 811868 - RNA, 22 nt, Homo sapiens
cuggguuuauagaugugagcca

SEQ ID NO: 811869 - RNA, 15 nt, Homo sapiens
uucaccagagcauuu

SEQ ID NO: 811870 - RNA, 15 nt, Homo sapiens
uucaccagauuugcu

SEQ ID NO: 811871 - RNA, 19 nt, Homo sapiens
uucaccauauuggccaguc

SEQ ID NO: 811872 - RNA, 19 nt, Homo sapiens
uucaccuaagucucuguga

SEQ ID NO: 811873 - RNA, 22 nt, Homo sapiens
uucaccuaagucucugugaauu

SEQ ID NO: 811874 - RNA, 16 nt, Homo sapiens
uucaccuacauuaucu

SEQ ID NO: 811875 - RNA, 18 nt, Homo sapiens
uucaccuacauuaucuca

SEQ ID NO: 811876 - RNA, 20 nt, Homo sapiens
uucaccuuccagugucucgg

SEQ ID NO: 811877 - RNA, 13 nt, Homo sapiens
uucacgcaugugu

SEQ ID NO: 811878 - RNA, 20 nt, Homo sapiens
uucacuaaugaucacauucu

SEQ ID NO: 811879 - RNA, 18 nt, Homo sapiens
uucacugaaggugauuca

SEQ ID NO: 811880 - RNA, 22 nt, Homo sapiens
uucacugauaaaugaagaaaag

SEQ ID NO: 811881 - RNA, 16 nt, Homo sapiens
uucacugcaaugucaa

SEQ ID NO: 811882 - RNA, 19 nt, Homo sapiens
uucacuguacugcauguga

SEQ ID NO: 811883 - RNA, 20 nt, Homo sapiens
uucacuguacugcaugugac

SEQ ID NO: 811884 - RNA, 20 nt, Homo sapiens
uucacuguagaaugauuuca

SEQ ID NO: 811885 - RNA, 17 nt, Homo sapiens
uucacugugagugaaaa

SEQ ID NO: 811886 - RNA, 12 nt, Homo sapiens
uucacuuuacaa

SEQ ID NO: 811887 - RNA, 15 nt, Homo sapiens
uucagaaaggggcau

SEQ ID NO: 811888 - RNA, 14 nt, Homo sapiens
uucagaagacacug

SEQ ID NO: 811889 - RNA, 15 nt, Homo sapiens
uucagaagacacugc

SEQ ID NO: 811890 - RNA, 17 nt, Homo sapiens
uucagaagagaugggcu

SEQ ID NO: 811891 - RNA, 16 nt, Homo sapiens
guacuauguaucaaug

SEQ ID NO: 811892 - RNA, 22 nt, Homo sapiens
guacuaugucugaacauagaaa

SEQ ID NO: 811893 - RNA, 14 nt, Homo sapiens
guacuauugcagac

SEQ ID NO: 811894 - RNA, 20 nt, Homo sapiens
guacuccagccugggugaca

SEQ ID NO: 811895 - RNA, 15 nt, Homo sapiens
guacucuugcugaug

SEQ ID NO: 811896 - RNA, 20 nt, Homo sapiens
guacucuuguuuuugcauaa

SEQ ID NO: 811897 - RNA, 15 nt, Homo sapiens
guacugauucaagaa

SEQ ID NO: 811898 - RNA, 20 nt, Homo sapiens
guacugccaauacugccaac

SEQ ID NO: 811899 - RNA, 11 nt, Homo sapiens
guacuguuacu

SEQ ID NO: 811900 - RNA, 22 nt, Homo sapiens
guacuuauaaagaagguuggug

SEQ ID NO: 811901 - RNA, 21 nt, Homo sapiens
guacuuaucccugcucuccca

SEQ ID NO: 811902 - RNA, 21 nt, Homo sapiens
guacuucaaguuaaagugaau

SEQ ID NO: 811903 - RNA, 18 nt, Homo sapiens
guacuuccuguguacucu

SEQ ID NO: 811904 - RNA, 15 nt, Homo sapiens
guacuucuguguuca

SEQ ID NO: 811905 - RNA, 21 nt, Homo sapiens
guacuugaauuuuucuuccuc

SEQ ID NO: 811906 - RNA, 18 nt, Homo sapiens
guacuuuuaaaaacauaa

SEQ ID NO: 811907 - RNA, 23 nt, Homo sapiens
guagaaaaagcaguaacugacaa

SEQ ID NO: 811908 - RNA, 21 nt, Homo sapiens
guagaaaauaaaacugagcua

SEQ ID NO: 811909 - RNA, 22 nt, Homo sapiens
guagaacucacucugggcugua

SEQ ID NO: 811910 - RNA, 17 nt, Homo sapiens
guagaagguaacucuuu

SEQ ID NO: 811911 - RNA, 20 nt, Homo sapiens
guagacagguguuacuuaca

SEQ ID NO: 811912 - RNA, 17 nt, Homo sapiens
guagagaagcaaguaaa

SEQ ID NO: 811913 - RNA, 14 nt, Homo sapiens
guagaguggugcug

SEQ ID NO: 811914 - RNA, 17 nt, Homo sapiens
guagaguggugcugcuu

SEQ ID NO: 811915 - RNA, 12 nt, Homo sapiens
guagaugcauua

SEQ ID NO: 811916 - RNA, 18 nt, Homo sapiens
guagauuuuaaaagauaa

SEQ ID NO: 811917 - RNA, 22 nt, Homo sapiens
guagcaaugugccuugauugau

SEQ ID NO: 811918 - RNA, 22 nt, Homo sapiens
guagcccaggccagagugcagu

SEQ ID NO: 811919 - RNA, 13 nt, Homo sapiens
guagcccauccuu

SEQ ID NO: 811920 - RNA, 23 nt, Homo sapiens
guagccugggcucacugugcugg

SEQ ID NO: 811921 - RNA, 13 nt, Homo sapiens
guagcugaugaaa

SEQ ID NO: 811922 - RNA, 18 nt, Homo sapiens
guagcugggauuacaggc

SEQ ID NO: 811923 - RNA, 19 nt, Homo sapiens
guagcugggauuacaggug

SEQ ID NO: 811924 - RNA, 21 nt, Homo sapiens
guagcugugaaauccauauau

SEQ ID NO: 811925 - RNA, 21 nt, Homo sapiens
guaggaccaagcaucuugggg

SEQ ID NO: 811926 - RNA, 15 nt, Homo sapiens
guaggcauauaucac

SEQ ID NO: 811927 - RNA, 16 nt, Homo sapiens
guaggcuuaguuugug

SEQ ID NO: 811928 - RNA, 14 nt, Homo sapiens
guaggggcaaaaau

SEQ ID NO: 811929 - RNA, 16 nt, Homo sapiens
guaggggcuacuguga

SEQ ID NO: 811930 - RNA, 14 nt, Homo sapiens
guaggguugccaga

SEQ ID NO: 811931 - RNA, 19 nt, Homo sapiens
guaggugguucgugcugug

SEQ ID NO: 811932 - RNA, 16 nt, Homo sapiens
guagguguaagagaaa

SEQ ID NO: 811933 - RNA, 15 nt, Homo sapiens
guaguaccccaagaa

SEQ ID NO: 811934 - RNA, 21 nt, Homo sapiens
guagucauacucccuggugua

SEQ ID NO: 811935 - RNA, 17 nt, Homo sapiens
guaguccagccuuccag

SEQ ID NO: 811936 - RNA, 17 nt, Homo sapiens
guagucccagcuacuca

SEQ ID NO: 811937 - RNA, 21 nt, Homo sapiens
guagucucuccccuggccaca

SEQ ID NO: 811938 - RNA, 15 nt, Homo sapiens
guagugaaauuauac

SEQ ID NO: 811939 - RNA, 17 nt, Homo sapiens
guaguuacuguggucac

SEQ ID NO: 811940 - RNA, 18 nt, Homo sapiens
guaguugcagcugaugcc

SEQ ID NO: 811941 - RNA, 22 nt, Homo sapiens
guaguuuguuuuagaaccagcc

SEQ ID NO: 811942 - RNA, 17 nt, Homo sapiens
guaguuuucaaaacaca

SEQ ID NO: 811943 - RNA, 14 nt, Homo sapiens
guauaaagauugua

SEQ ID NO: 811944 - RNA, 14 nt, Homo sapiens
guauaaauggaccu

SEQ ID NO: 811945 - RNA, 16 nt, Homo sapiens
guauaacaacuuugaa

SEQ ID NO: 811946 - RNA, 14 nt, Homo sapiens
guauaaguauucaa

SEQ ID NO: 811947 - RNA, 16 nt, Homo sapiens
guauaagucaagcaca

SEQ ID NO: 811948 - RNA, 18 nt, Homo sapiens
guauaaugguugacuggg

SEQ ID NO: 811949 - RNA, 14 nt, Homo sapiens
gugucaaaacuggu

SEQ ID NO: 811950 - RNA, 16 nt, Homo sapiens
gugucaaaagccagau

SEQ ID NO: 811951 - RNA, 21 nt, Homo sapiens
gugucacccauuggugaccug

SEQ ID NO: 811952 - RNA, 13 nt, Homo sapiens
gugucacuggcuu

SEQ ID NO: 811953 - RNA, 22 nt, Homo sapiens
gugucauaugacugauuacuca

SEQ ID NO: 811954 - RNA, 14 nt, Homo sapiens
guguccagcacaga

SEQ ID NO: 811955 - RNA, 15 nt, Homo sapiens
gugucccaugaccca

SEQ ID NO: 811956 - RNA, 15 nt, Homo sapiens
guguccccugcccca

SEQ ID NO: 811957 - RNA, 12 nt, Homo sapiens
guguccuuccau

SEQ ID NO: 811958 - RNA, 13 nt, Homo sapiens
gugucucugccau

SEQ ID NO: 811959 - RNA, 17 nt, Homo sapiens
gugucugccaaacacau

SEQ ID NO: 811960 - RNA, 16 nt, Homo sapiens
gugucuguugcuugua

SEQ ID NO: 811961 - RNA, 13 nt, Homo sapiens
gugugaacugcaa

SEQ ID NO: 811962 - RNA, 14 nt, Homo sapiens
gugugagcuaugca

SEQ ID NO: 811963 - RNA, 20 nt, Homo sapiens
gugugaggcggcccugacca

SEQ ID NO: 811964 - RNA, 16 nt, Homo sapiens
gugugccacucagaga

SEQ ID NO: 811965 - RNA, 14 nt, Homo sapiens
gugugccauuuuaa

SEQ ID NO: 811966 - RNA, 10 nt, Homo sapiens
gugugccuuc

SEQ ID NO: 811967 - RNA, 19 nt, Homo sapiens
gugugcgugugcgugcgug

SEQ ID NO: 811968 - RNA, 14 nt, Homo sapiens
guguggagcuguau

SEQ ID NO: 811969 - RNA, 17 nt, Homo sapiens
guguguacacgggacug

SEQ ID NO: 811970 - RNA, 13 nt, Homo sapiens
guguguacugcac

SEQ ID NO: 811971 - RNA, 13 nt, Homo sapiens
guguguaugcuga

SEQ ID NO: 811972 - RNA, 16 nt, Homo sapiens
guguguauuuguguaa

SEQ ID NO: 811973 - RNA, 19 nt, Homo sapiens
guguguccaaaacugccuc

SEQ ID NO: 811974 - RNA, 20 nt, Homo sapiens
gugugucucugcauguguaa

SEQ ID NO: 811975 - RNA, 15 nt, Homo sapiens
gugugugacaauucu

SEQ ID NO: 811976 - RNA, 11 nt, Homo sapiens
gugugugcaag

SEQ ID NO: 811977 - RNA, 14 nt, Homo sapiens
gugugugcacaucc

SEQ ID NO: 811978 - RNA, 22 nt, Homo sapiens
guguguuuucccaaagcacuuu

SEQ ID NO: 811979 - RNA, 18 nt, Homo sapiens
guguuaagcguucaguga

SEQ ID NO: 811980 - RNA, 19 nt, Homo sapiens
guguuacccacugccaugc

SEQ ID NO: 811981 - RNA, 17 nt, Homo sapiens
guguuacugcuuugcaa

SEQ ID NO: 811982 - RNA, 21 nt, Homo sapiens
guguuaucagucauaacuaaa

SEQ ID NO: 811983 - RNA, 14 nt, Homo sapiens
guguuaucuuuuga

SEQ ID NO: 811984 - RNA, 21 nt, Homo sapiens
guguuauuaaugacaaaggca

SEQ ID NO: 811985 - RNA, 13 nt, Homo sapiens
guguucauuuuau

SEQ ID NO: 811986 - RNA, 22 nt, Homo sapiens
guguucccgacauaacauugua

SEQ ID NO: 811987 - RNA, 20 nt, Homo sapiens
guguuccuagaaugcagcug

SEQ ID NO: 811988 - RNA, 14 nt, Homo sapiens
guguucuucauuac

SEQ ID NO: 811989 - RNA, 17 nt, Homo sapiens
guguugagcguuugcac

SEQ ID NO: 811990 - RNA, 14 nt, Homo sapiens
guguugaucccaag

SEQ ID NO: 811991 - RNA, 12 nt, Homo sapiens
guguugcaaauu

SEQ ID NO: 811992 - RNA, 16 nt, Homo sapiens
guguuggcacaugccu

SEQ ID NO: 811993 - RNA, 18 nt, Homo sapiens
guguugugggaugaccgc

SEQ ID NO: 811994 - RNA, 12 nt, Homo sapiens
guguuguucauu

SEQ ID NO: 811995 - RNA, 18 nt, Homo sapiens
guguuugcagcugugaga

SEQ ID NO: 811996 - RNA, 16 nt, Homo sapiens
guguuuggagcucuau

SEQ ID NO: 811997 - RNA, 19 nt, Homo sapiens
guguuuucccaaagcacuu

SEQ ID NO: 811998 - RNA, 23 nt, Homo sapiens
guguuuuuaaagaaaagcauuca

SEQ ID NO: 811999 - RNA, 21 nt, Homo sapiens
guguuuuucuuuuuccacaag

SEQ ID NO: 812000 - RNA, 20 nt, Homo sapiens
guuaaaaaaaagaauaaagg

SEQ ID NO: 812001 - RNA, 20 nt, Homo sapiens
guuaaaauacucagugcuaa

SEQ ID NO: 812002 - RNA, 15 nt, Homo sapiens
guuaaauaugcaucu

SEQ ID NO: 812003 - RNA, 22 nt, Homo sapiens
guuaaauccuuugcuucauucc

SEQ ID NO: 812004 - RNA, 15 nt, Homo sapiens
guuaaauguuuacaa

SEQ ID NO: 812005 - RNA, 14 nt, Homo sapiens
guuaacaggauauu

SEQ ID NO: 812006 - RNA, 16 nt, Homo sapiens
guuaacugauuugcaa

SEQ ID NO: 812007 - RNA, 11 nt, Homo sapiens
uuuaaagacag

SEQ ID NO: 812008 - RNA, 18 nt, Homo sapiens
uuuaaagccacauuucau

SEQ ID NO: 812009 - RNA, 22 nt, Homo sapiens
uuuaaagccuucuggauccaug

SEQ ID NO: 812010 - RNA, 23 nt, Homo sapiens
uuuaaagcuacaaucuguucaau

SEQ ID NO: 812011 - RNA, 10 nt, Homo sapiens
uuuaaagggu

SEQ ID NO: 812012 - RNA, 20 nt, Homo sapiens
uuuaaaguauguuauugcau

SEQ ID NO: 812013 - RNA, 13 nt, Homo sapiens
uuuaaaugauaca

SEQ ID NO: 812014 - RNA, 13 nt, Homo sapiens
uuuaaaugccaua

SEQ ID NO: 812015 - RNA, 21 nt, Homo sapiens
uuuaaaugugugagugcaugu

SEQ ID NO: 812016 - RNA, 13 nt, Homo sapiens
uuuaaauguuacu

SEQ ID NO: 812017 - RNA, 13 nt, Homo sapiens
uuuaaauugugcc

SEQ ID NO: 812018 - RNA, 22 nt, Homo sapiens
uuuaacacuuuguauuacuuag

SEQ ID NO: 812019 - RNA, 17 nt, Homo sapiens
uuuaacagaaacuuuca

SEQ ID NO: 812020 - RNA, 18 nt, Homo sapiens
uuuaacccuaaucuuuca

SEQ ID NO: 812021 - RNA, 19 nt, Homo sapiens
uuuaaccuaauaucacuua

SEQ ID NO: 812022 - RNA, 14 nt, Homo sapiens
uuuaacguuuucau

SEQ ID NO: 812023 - RNA, 20 nt, Homo sapiens
uuuaacucaguuucuaggca

SEQ ID NO: 812024 - RNA, 13 nt, Homo sapiens
uuuaagaaaucaa

SEQ ID NO: 812025 - RNA, 17 nt, Homo sapiens
uuuaagacuaugauuua

SEQ ID NO: 812026 - RNA, 17 nt, Homo sapiens
uuuaagaguuacuuaau

SEQ ID NO: 812027 - RNA, 23 nt, Homo sapiens
uuuaagauccgcaauguggagca

SEQ ID NO: 812028 - RNA, 13 nt, Homo sapiens
uuuaagauuccca

SEQ ID NO: 812029 - RNA, 20 nt, Homo sapiens
uuuaagccugaagagcuuau

SEQ ID NO: 812030 - RNA, 14 nt, Homo sapiens
uuuaagcuaccaau

SEQ ID NO: 812031 - RNA, 17 nt, Homo sapiens
uuuaagcuucaguugcu

SEQ ID NO: 812032 - RNA, 12 nt, Homo sapiens
uuuaaggcuaaa

SEQ ID NO: 812033 - RNA, 19 nt, Homo sapiens
uuuaaggguacaguuugau

SEQ ID NO: 812034 - RNA, 18 nt, Homo sapiens
uuuaaggugaaccaaaga

SEQ ID NO: 812035 - RNA, 14 nt, Homo sapiens
uuuaaguacuugag

SEQ ID NO: 812036 - RNA, 13 nt, Homo sapiens
uuuaaguacuuug

SEQ ID NO: 812037 - RNA, 16 nt, Homo sapiens
uuuaaguuguuugcau

SEQ ID NO: 812038 - RNA, 22 nt, Homo sapiens
uuuaauaaaugguuuauucugc

SEQ ID NO: 812039 - RNA, 14 nt, Homo sapiens
uuuaauaacauacu

SEQ ID NO: 812040 - RNA, 19 nt, Homo sapiens
uuuaauaacauacuccuuu

SEQ ID NO: 812041 - RNA, 15 nt, Homo sapiens
uuuaauacaggguag

SEQ ID NO: 812042 - RNA, 19 nt, Homo sapiens
uuuaauacaggguagauaa

SEQ ID NO: 812043 - RNA, 14 nt, Homo sapiens
uuuaauacagugag

SEQ ID NO: 812044 - RNA, 21 nt, Homo sapiens
uuuaauagggaauauaucucu

SEQ ID NO: 812045 - RNA, 13 nt, Homo sapiens
uuuaauagucauu

SEQ ID NO: 812046 - RNA, 13 nt, Homo sapiens
uuuaaucagugaa

SEQ ID NO: 812047 - RNA, 19 nt, Homo sapiens
uuuaaucauuuugccucuu

SEQ ID NO: 812048 - RNA, 13 nt, Homo sapiens
uuuaaucccagca

SEQ ID NO: 812049 - RNA, 11 nt, Homo sapiens
uuuaaugggaa

SEQ ID NO: 812050 - RNA, 19 nt, Homo sapiens
uuuaauguaauagggaaaa

SEQ ID NO: 812051 - RNA, 14 nt, Homo sapiens
uuuaauuaaaaccu

SEQ ID NO: 812052 - RNA, 16 nt, Homo sapiens
uuuaauugauuauucu

SEQ ID NO: 812053 - RNA, 15 nt, Homo sapiens
uuuaauuuuaguuuc

SEQ ID NO: 812054 - RNA, 14 nt, Homo sapiens
uuuacaaaccauua

SEQ ID NO: 812055 - RNA, 17 nt, Homo sapiens
uuuacaaaguauuugcu

SEQ ID NO: 812056 - RNA, 15 nt, Homo sapiens
uuuacaaggugacaa

SEQ ID NO: 812057 - RNA, 16 nt, Homo sapiens
uuuacaagugcugcaa

SEQ ID NO: 812058 - RNA, 15 nt, Homo sapiens
uuuacaaucugcacu

SEQ ID NO: 812059 - RNA, 20 nt, Homo sapiens
uuuacaauuugacauacaaa

SEQ ID NO: 812060 - RNA, 20 nt, Homo sapiens
uuuacagaaaagacucugac

SEQ ID NO: 812061 - RNA, 14 nt, Homo sapiens
uuuacagaaaucaa

SEQ ID NO: 812062 - RNA, 14 nt, Homo sapiens
uuuacagacuguga

SEQ ID NO: 812063 - RNA, 21 nt, Homo sapiens
uuuacagcuaucgaacuucac

SEQ ID NO: 812064 - RNA, 21 nt, Homo sapiens
uuuacauacugcugucuaugu

SEQ ID NO: 812065 - RNA, 19 nt, Homo sapiens
cacugucuagagcaacuuu

SEQ ID NO: 812066 - RNA, 16 nt, Homo sapiens
cacugucuugccagau

SEQ ID NO: 812067 - RNA, 12 nt, Homo sapiens
cacugugacuua

SEQ ID NO: 812068 - RNA, 22 nt, Homo sapiens
cacugugacuuaagaagccuua

SEQ ID NO: 812069 - RNA, 16 nt, Homo sapiens
cacugugagcaccuga

SEQ ID NO: 812070 - RNA, 20 nt, Homo sapiens
cacuguggcauugucuguaa

SEQ ID NO: 812071 - RNA, 18 nt, Homo sapiens
cacuuaaaaaauguccau

SEQ ID NO: 812072 - RNA, 20 nt, Homo sapiens
cacuuaaaaaauguccauga

SEQ ID NO: 812073 - RNA, 18 nt, Homo sapiens
cacuuaauaauuuuuacc

SEQ ID NO: 812074 - RNA, 14 nt, Homo sapiens
cacuuacagaauua

SEQ ID NO: 812075 - RNA, 20 nt, Homo sapiens
cacuuagaauccgaagggaa

SEQ ID NO: 812076 - RNA, 17 nt, Homo sapiens
cacuuagguuuugucca

SEQ ID NO: 812077 - RNA, 23 nt, Homo sapiens
cacuuauaagaaagaucaaagac

SEQ ID NO: 812078 - RNA, 16 nt, Homo sapiens
cacuuauguuauacaa

SEQ ID NO: 812079 - RNA, 22 nt, Homo sapiens
cacuuauguuauacaauacaga

SEQ ID NO: 812080 - RNA, 17 nt, Homo sapiens
cacuucaaaaaagcuua

SEQ ID NO: 812081 - RNA, 18 nt, Homo sapiens
cacuucaacccccagcua

SEQ ID NO: 812082 - RNA, 13 nt, Homo sapiens
cacuucagccucc

SEQ ID NO: 812083 - RNA, 23 nt, Homo sapiens
cacuucagcuuaauaaguauuua

SEQ ID NO: 812084 - RNA, 18 nt, Homo sapiens
cacuucaguuuaaugucu

SEQ ID NO: 812085 - RNA, 13 nt, Homo sapiens
cacuucauaucca

SEQ ID NO: 812086 - RNA, 12 nt, Homo sapiens
cacuuccagucc

SEQ ID NO: 812087 - RNA, 23 nt, Homo sapiens
cacuuccaugagaagaagcagau

SEQ ID NO: 812088 - RNA, 17 nt, Homo sapiens
cacuucccagagcaucu

SEQ ID NO: 812089 - RNA, 22 nt, Homo sapiens
cacuucccaggaucugcuccaa

SEQ ID NO: 812090 - RNA, 15 nt, Homo sapiens
cacuucgccauucau

SEQ ID NO: 812091 - RNA, 18 nt, Homo sapiens
cacuucuaaaugcauauc

SEQ ID NO: 812092 - RNA, 18 nt, Homo sapiens
cacuucuaugcaaaugcc

SEQ ID NO: 812093 - RNA, 20 nt, Homo sapiens
cacuucucaucauauuguau

SEQ ID NO: 812094 - RNA, 21 nt, Homo sapiens
cacuucucucuccccaucccc

SEQ ID NO: 812095 - RNA, 22 nt, Homo sapiens
cacuucugguauaauuguguag

SEQ ID NO: 812096 - RNA, 12 nt, Homo sapiens
cacuucuuaggg

SEQ ID NO: 812097 - RNA, 21 nt, Homo sapiens
cacuucuuguuccccacugac

SEQ ID NO: 812098 - RNA, 15 nt, Homo sapiens
cacuugaagcacuua

SEQ ID NO: 812099 - RNA, 23 nt, Homo sapiens
cacuugauuuuuuucauuuugcc

SEQ ID NO: 812100 - RNA, 15 nt, Homo sapiens
cacuugcaugaauua

SEQ ID NO: 812101 - RNA, 19 nt, Homo sapiens
cacuugcuuagguugucuu

SEQ ID NO: 812102 - RNA, 15 nt, Homo sapiens
cacuuggcauacaaa

SEQ ID NO: 812103 - RNA, 22 nt, Homo sapiens
cacuugguuuuuggcucuuuca

SEQ ID NO: 812104 - RNA, 22 nt, Homo sapiens
cacuuguaagaaaaugagacaa

SEQ ID NO: 812105 - RNA, 12 nt, Homo sapiens
cacuugugcacc

SEQ ID NO: 812106 - RNA, 21 nt, Homo sapiens
cacuugugcaguguugacagu

SEQ ID NO: 812107 - RNA, 20 nt, Homo sapiens
cacuuuaugccggaugugcu

SEQ ID NO: 812108 - RNA, 18 nt, Homo sapiens
cacuuuggacuucucuga

SEQ ID NO: 812109 - RNA, 16 nt, Homo sapiens
cacuuuguugcaagau

SEQ ID NO: 812110 - RNA, 16 nt, Homo sapiens
cacuuuuaauaaacuu

SEQ ID NO: 812111 - RNA, 19 nt, Homo sapiens
cacuuuuuuuuuuucugcc

SEQ ID NO: 812112 - RNA, 23 nt, Homo sapiens
cacuuuuuuuuuuucugccugag

SEQ ID NO: 812113 - RNA, 18 nt, Homo sapiens
cagaaaaagcuagcacua

SEQ ID NO: 812114 - RNA, 21 nt, Homo sapiens
cagaaaacagggucugggaca

SEQ ID NO: 812115 - RNA, 17 nt, Homo sapiens
cagaaaagcaauacugu

SEQ ID NO: 812116 - RNA, 22 nt, Homo sapiens
cagaaaagcaauacuguuucca

SEQ ID NO: 812117 - RNA, 16 nt, Homo sapiens
cagaaaagcaccugcc

SEQ ID NO: 812118 - RNA, 18 nt, Homo sapiens
cagaaaagcccaaguuca

SEQ ID NO: 812119 - RNA, 22 nt, Homo sapiens
cagaaaauaaaauauucacucu

SEQ ID NO: 812120 - RNA, 22 nt, Homo sapiens
cagaaaauauuauguguuucca

SEQ ID NO: 812121 - RNA, 15 nt, Homo sapiens
cagaaaauugcacaa

SEQ ID NO: 812122 - RNA, 18 nt, Homo sapiens
cagaaacaaaaacacuaa

SEQ ID NO: 812123 - RNA, 14 nt, Homo sapiens
cagaaacacugccu

SEQ ID NO: 812124 - RNA, 20 nt, Homo sapiens
cagaaaccaguuaugugaau

SEQ ID NO: 812125 - RNA, 16 nt, Homo sapiens
cagaaaccuccaucaa

SEQ ID NO: 812126 - RNA, 14 nt, Homo sapiens
cagaaacuacugac

SEQ ID NO: 812127 - RNA, 15 nt, Homo sapiens
cagaaagauuuuccu

SEQ ID NO: 812128 - RNA, 16 nt, Homo sapiens
cagaaagcauccuaaa

SEQ ID NO: 812129 - RNA, 15 nt, Homo sapiens
cagaaagccuuucau

SEQ ID NO: 812130 - RNA, 15 nt, Homo sapiens
cagaaauaaacauug

SEQ ID NO: 812131 - RNA, 16 nt, Homo sapiens
cagaaauacugcucug

SEQ ID NO: 812132 - RNA, 23 nt, Homo sapiens
cagaaauagacuuaauaaagguu

SEQ ID NO: 812133 - RNA, 19 nt, Homo sapiens
cagaaaucaaaaagggaau

SEQ ID NO: 812134 - RNA, 19 nt, Homo sapiens
cagaaaucuagaagacugu

SEQ ID NO: 812135 - RNA, 23 nt, Homo sapiens
cagaaauuagccggucauggugg

SEQ ID NO: 812136 - RNA, 15 nt, Homo sapiens
cagaaauuuaauuca

SEQ ID NO: 812137 - RNA, 22 nt, Homo sapiens
cagaaauuuaucuuucaaagag

SEQ ID NO: 812138 - RNA, 20 nt, Homo sapiens
cagaacaagaccccgucuca

SEQ ID NO: 812139 - RNA, 13 nt, Homo sapiens
cagaacacacaga

SEQ ID NO: 812140 - RNA, 22 nt, Homo sapiens
cagaacaccuaugcaaagauga

SEQ ID NO: 812141 - RNA, 16 nt, Homo sapiens
cagaacauauguugca

SEQ ID NO: 812142 - RNA, 13 nt, Homo sapiens
cagaaccaaaucu

SEQ ID NO: 812143 - RNA, 18 nt, Homo sapiens
cagaaccccuacaugaaa

SEQ ID NO: 812144 - RNA, 19 nt, Homo sapiens
cagaacccuuccugagacc

SEQ ID NO: 812145 - RNA, 20 nt, Homo sapiens
cagaaccucuuccccagaaa

SEQ ID NO: 812146 - RNA, 18 nt, Homo sapiens
cagaacucccauuacaac

SEQ ID NO: 812147 - RNA, 20 nt, Homo sapiens
cagaacuuaaggauggagcc

SEQ ID NO: 812148 - RNA, 21 nt, Homo sapiens
cagaacuugaaugugucaggu

SEQ ID NO: 812149 - RNA, 17 nt, Homo sapiens
cagaagaaagauggaaa

SEQ ID NO: 812150 - RNA, 14 nt, Homo sapiens
cagaagaagcuggu

SEQ ID NO: 812151 - RNA, 14 nt, Homo sapiens
cagaagacacugca

SEQ ID NO: 812152 - RNA, 19 nt, Homo sapiens
cagaagaccccugacucau

SEQ ID NO: 812153 - RNA, 21 nt, Homo sapiens
cagaagagauggauauugaaa

SEQ ID NO: 812154 - RNA, 18 nt, Homo sapiens
cagaagauuuucaagaac

SEQ ID NO: 812155 - RNA, 23 nt, Homo sapiens
cagaagcagguucuugaugucau

SEQ ID NO: 812156 - RNA, 19 nt, Homo sapiens
cagaagcauugccuggacu

SEQ ID NO: 812157 - RNA, 23 nt, Homo sapiens
cagaagcauugccuggacugacc

SEQ ID NO: 812158 - RNA, 12 nt, Homo sapiens
cagaagcccuga

SEQ ID NO: 812159 - RNA, 23 nt, Homo sapiens
cagaaggaaagaagggggcccug

SEQ ID NO: 812160 - RNA, 23 nt, Homo sapiens
cagaaggacacuagccugugcac

SEQ ID NO: 812161 - RNA, 21 nt, Homo sapiens
cagaaggauauuuacuacuuu

SEQ ID NO: 812162 - RNA, 22 nt, Homo sapiens
cagaaggaucuucaucugacua

SEQ ID NO: 812163 - RNA, 15 nt, Homo sapiens
cagaaggccaagagg

SEQ ID NO: 812164 - RNA, 22 nt, Homo sapiens
cagaagggugugggccaccaga

SEQ ID NO: 812165 - RNA, 16 nt, Homo sapiens
cagaagugguuuccca

SEQ ID NO: 812166 - RNA, 19 nt, Homo sapiens
cagaaguuaguuuguauau

SEQ ID NO: 812167 - RNA, 17 nt, Homo sapiens
cagaauaacuaccuccu

SEQ ID NO: 812168 - RNA, 20 nt, Homo sapiens
cagaauaauuggcaugucuc

SEQ ID NO: 812169 - RNA, 13 nt, Homo sapiens
cagaauacauaca

SEQ ID NO: 812170 - RNA, 23 nt, Homo sapiens
cagaauagcuuugaauguggccc

SEQ ID NO: 812171 - RNA, 19 nt, Homo sapiens
cagaauauugcuuugguca

SEQ ID NO: 812172 - RNA, 18 nt, Homo sapiens
cagaaucacagcccucau

SEQ ID NO: 812173 - RNA, 13 nt, Homo sapiens
cagaauccaaaga

SEQ ID NO: 812174 - RNA, 20 nt, Homo sapiens
cagaauccugaugguaucaa

SEQ ID NO: 812175 - RNA, 15 nt, Homo sapiens
cagaaucucaaauaa

SEQ ID NO: 812176 - RNA, 17 nt, Homo sapiens
cagaaucucaaauaacu

SEQ ID NO: 812177 - RNA, 14 nt, Homo sapiens
cagaaucuccaucc

SEQ ID NO: 812178 - RNA, 17 nt, Homo sapiens
cagcccagugucccuga

SEQ ID NO: 812179 - RNA, 14 nt, Homo sapiens
cagcccaugugcac

SEQ ID NO: 812180 - RNA, 20 nt, Homo sapiens
cagcccaugugcaccugccc

SEQ ID NO: 812181 - RNA, 21 nt, Homo sapiens
cagccccaaacacccacccaa

SEQ ID NO: 812182 - RNA, 13 nt, Homo sapiens
cagccccaugugu

SEQ ID NO: 812183 - RNA, 12 nt, Homo sapiens
cagccccggggu

SEQ ID NO: 812184 - RNA, 16 nt, Homo sapiens
cagccccuccaaaggu

SEQ ID NO: 812185 - RNA, 20 nt, Homo sapiens
cagccccuuauuugcacuuc

SEQ ID NO: 812186 - RNA, 19 nt, Homo sapiens
cagcccuagaggcgagcca

SEQ ID NO: 812187 - RNA, 14 nt, Homo sapiens
cagcccuauuucag

SEQ ID NO: 812188 - RNA, 17 nt, Homo sapiens
cagcccuccucugucaa

SEQ ID NO: 812189 - RNA, 20 nt, Homo sapiens
cagcccugaccccaguguac

SEQ ID NO: 812190 - RNA, 19 nt, Homo sapiens
cagcccugaggugaaaggg

SEQ ID NO: 812191 - RNA, 12 nt, Homo sapiens
cagcccuggauu

SEQ ID NO: 812192 - RNA, 18 nt, Homo sapiens
cagcccuguccccugaaa

SEQ ID NO: 812193 - RNA, 17 nt, Homo sapiens
cagcccuuauggccaau

SEQ ID NO: 812194 - RNA, 21 nt, Homo sapiens
cagcccuugaagucacccggc

SEQ ID NO: 812195 - RNA, 16 nt, Homo sapiens
cagccgaaaagcuuuu

SEQ ID NO: 812196 - RNA, 14 nt, Homo sapiens
cagccgauguggua

SEQ ID NO: 812197 - RNA, 18 nt, Homo sapiens
cagccgccuuaagcugau

SEQ ID NO: 812198 - RNA, 16 nt, Homo sapiens
cagccgugagugcaga

SEQ ID NO: 812199 - RNA, 14 nt, Homo sapiens
cagccuacauucac

SEQ ID NO: 812200 - RNA, 20 nt, Homo sapiens
cagccuacuuucacacuaag

SEQ ID NO: 812201 - RNA, 15 nt, Homo sapiens
cagccucagauccag

SEQ ID NO: 812202 - RNA, 19 nt, Homo sapiens
cagccucaguaguagcgaa

SEQ ID NO: 812203 - RNA, 13 nt, Homo sapiens
cagccuccagggc

SEQ ID NO: 812204 - RNA, 23 nt, Homo sapiens
cagccucccaaagugcugagauu

SEQ ID NO: 812205 - RNA, 19 nt, Homo sapiens
cagccucccaaguagcuga

SEQ ID NO: 812206 - RNA, 17 nt, Homo sapiens
cagccuccccgugccaa

SEQ ID NO: 812207 - RNA, 18 nt, Homo sapiens
cagccuccccgugccaaa

SEQ ID NO: 812208 - RNA, 19 nt, Homo sapiens
cagccucccuaguagcugg

SEQ ID NO: 812209 - RNA, 20 nt, Homo sapiens
cagccucccucugaccugca

SEQ ID NO: 812210 - RNA, 17 nt, Homo sapiens
cagccucccugucacuc

SEQ ID NO: 812211 - RNA, 17 nt, Homo sapiens
cagccucccuuugauga

SEQ ID NO: 812212 - RNA, 18 nt, Homo sapiens
cagccucucaaguagcug

SEQ ID NO: 812213 - RNA, 19 nt, Homo sapiens
cagccugaccaacaucgug

SEQ ID NO: 812214 - RNA, 21 nt, Homo sapiens
cagccugaccaacauggugaa

SEQ ID NO: 812215 - RNA, 15 nt, Homo sapiens
cagccugaccccgcc

SEQ ID NO: 812216 - RNA, 20 nt, Homo sapiens
cagccugaucaggcuuccug

SEQ ID NO: 812217 - RNA, 22 nt, Homo sapiens
cagccuggcucccaggacacga

SEQ ID NO: 812218 - RNA, 19 nt, Homo sapiens
cagccugggcaacagagca

SEQ ID NO: 812219 - RNA, 20 nt, Homo sapiens
cagccugggcaacagagcaa

SEQ ID NO: 812220 - RNA, 21 nt, Homo sapiens
cagccuggucaacauggugaa

SEQ ID NO: 812221 - RNA, 13 nt, Homo sapiens
cagccuguaggga

SEQ ID NO: 812222 - RNA, 18 nt, Homo sapiens
cagccuguccuugucacg

SEQ ID NO: 812223 - RNA, 15 nt, Homo sapiens
cagccuucagucaca

SEQ ID NO: 812224 - RNA, 16 nt, Homo sapiens
cagccuucagucacau

SEQ ID NO: 812225 - RNA, 14 nt, Homo sapiens
cagccuugccagag

SEQ ID NO: 812226 - RNA, 20 nt, Homo sapiens
cagccuuucugaggacacca

SEQ ID NO: 812227 - RNA, 21 nt, Homo sapiens
cagcgagcuaugaucgcgcca

SEQ ID NO: 812228 - RNA, 14 nt, Homo sapiens
cagcgcggggagcc

SEQ ID NO: 812229 - RNA, 19 nt, Homo sapiens
cagcggaggagaccagcuc

SEQ ID NO: 812230 - RNA, 20 nt, Homo sapiens
cagcggauugcucuggagca

SEQ ID NO: 812231 - RNA, 17 nt, Homo sapiens
cagcggcuccaacuccu

SEQ ID NO: 812232 - RNA, 21 nt, Homo sapiens
cagcgggaucucguaucuuua

SEQ ID NO: 812233 - RNA, 15 nt, Homo sapiens
cagcgggcacagggc

SEQ ID NO: 812234 - RNA, 14 nt, Homo sapiens
cagcgucaacaucg

SEQ ID NO: 812235 - RNA, 19 nt, Homo sapiens
cagcgucacuccagugcuc

SEQ ID NO: 812236 - RNA, 16 nt, Homo sapiens
cagcgucccagucucu

SEQ ID NO: 812237 - RNA, 21 nt, Homo sapiens
cagcguccggggugguggaca

SEQ ID NO: 812238 - RNA, 13 nt, Homo sapiens
cagcgucuugcuc

SEQ ID NO: 812239 - RNA, 23 nt, Homo sapiens
cagcgugcacaucugcugugguc

SEQ ID NO: 812240 - RNA, 18 nt, Homo sapiens
cagcuaaaguaacagagc

SEQ ID NO: 812241 - RNA, 14 nt, Homo sapiens
cagcuaaugaauug

SEQ ID NO: 812242 - RNA, 22 nt, Homo sapiens
cagcuacacaaggaaggcauuu

SEQ ID NO: 812243 - RNA, 13 nt, Homo sapiens
cagcuacauuccu

SEQ ID NO: 812244 - RNA, 21 nt, Homo sapiens
cagcuaccucuucuauggacu

SEQ ID NO: 812245 - RNA, 22 nt, Homo sapiens
cagcuacucaggaggcugagac

SEQ ID NO: 812246 - RNA, 14 nt, Homo sapiens
cagcuagcuuauuc

SEQ ID NO: 812247 - RNA, 22 nt, Homo sapiens
cagcuagcuuauucuuguguac

SEQ ID NO: 812248 - RNA, 14 nt, Homo sapiens
cagcuagugccuuu

SEQ ID NO: 812249 - RNA, 15 nt, Homo sapiens
cagcuagugccuuua

SEQ ID NO: 812250 - RNA, 15 nt, Homo sapiens
cagcuauauuugauu

SEQ ID NO: 812251 - RNA, 21 nt, Homo sapiens
cagcuaucaggaugucccuga

SEQ ID NO: 812252 - RNA, 20 nt, Homo sapiens
cagcuauuuugugaagccau

SEQ ID NO: 812253 - RNA, 14 nt, Homo sapiens
cagcucaaagacuu

SEQ ID NO: 812254 - RNA, 13 nt, Homo sapiens
cagcucaccaucc

SEQ ID NO: 812255 - RNA, 17 nt, Homo sapiens
cagcucacucaucaaug

SEQ ID NO: 812256 - RNA, 23 nt, Homo sapiens
cagcucacugcugcugccucuga

SEQ ID NO: 812257 - RNA, 14 nt, Homo sapiens
cagcucaguaguau

SEQ ID NO: 812258 - RNA, 21 nt, Homo sapiens
cagcuccacccugagcuuccu

SEQ ID NO: 812259 - RNA, 16 nt, Homo sapiens
cagcuccccuucugaa

SEQ ID NO: 812260 - RNA, 21 nt, Homo sapiens
cagcuccuccucuuggagcug

SEQ ID NO: 812261 - RNA, 15 nt, Homo sapiens
cagcuccugccaggg

SEQ ID NO: 812262 - RNA, 17 nt, Homo sapiens
cagcuccuuacucugag

SEQ ID NO: 812263 - RNA, 15 nt, Homo sapiens
cagcucugaucacau

SEQ ID NO: 812264 - RNA, 13 nt, Homo sapiens
cagcucuggagaa

SEQ ID NO: 812265 - RNA, 17 nt, Homo sapiens
cagcugagcuugagcuc

SEQ ID NO: 812266 - RNA, 15 nt, Homo sapiens
cagcugaguuaugau

SEQ ID NO: 812267 - RNA, 13 nt, Homo sapiens
cagcugaugcuca

SEQ ID NO: 812268 - RNA, 19 nt, Homo sapiens
cagcugaugcucaagucca

SEQ ID NO: 812269 - RNA, 12 nt, Homo sapiens
cagcugcacuga

SEQ ID NO: 812270 - RNA, 19 nt, Homo sapiens
cagcugcagccacuuucug

SEQ ID NO: 812271 - RNA, 22 nt, Homo sapiens
cagcugcagucaacaguucaaa

SEQ ID NO: 812272 - RNA, 16 nt, Homo sapiens
cagcugccaagugcuc

SEQ ID NO: 812273 - RNA, 17 nt, Homo sapiens
cagcugccaagugcucu

SEQ ID NO: 812274 - RNA, 18 nt, Homo sapiens
cagcugcccuggcuguga

SEQ ID NO: 812275 - RNA, 12 nt, Homo sapiens
cagcugcugaaa

SEQ ID NO: 812276 - RNA, 16 nt, Homo sapiens
cagcugcugacccucu

SEQ ID NO: 812277 - RNA, 21 nt, Homo sapiens
cagcuggaagggucaacaucu

SEQ ID NO: 812278 - RNA, 18 nt, Homo sapiens
cagcugggcucugcaauu

SEQ ID NO: 812279 - RNA, 17 nt, Homo sapiens
cagcuggggagcagcug

SEQ ID NO: 812280 - RNA, 18 nt, Homo sapiens
cagcuggggccggagccu

SEQ ID NO: 812281 - RNA, 16 nt, Homo sapiens
cagcugguaaucuugc

SEQ ID NO: 812282 - RNA, 18 nt, Homo sapiens
cagcugguucgugguuuu

SEQ ID NO: 812283 - RNA, 15 nt, Homo sapiens
cagcuguagccaugg

SEQ ID NO: 812284 - RNA, 23 nt, Homo sapiens
cagcugugcugcaccccaugugg

SEQ ID NO: 812285 - RNA, 23 nt, Homo sapiens
cagcuguggccuaggcuaccuca

SEQ ID NO: 812286 - RNA, 23 nt, Homo sapiens
cagcugugugggucauaccgugu

SEQ ID NO: 812287 - RNA, 19 nt, Homo sapiens
cagcuguguggugcuucug

SEQ ID NO: 812288 - RNA, 23 nt, Homo sapiens
cagcuuaauaaguauuuauugca

SEQ ID NO: 812289 - RNA, 20 nt, Homo sapiens
cagcuuagaaugcaucucau

SEQ ID NO: 812290 - RNA, 21 nt, Homo sapiens
cagcuuauuuuuuucuacaua

SEQ ID NO: 812291 - RNA, 19 nt, Homo sapiens
cagcuucaacuuuucucuu

SEQ ID NO: 812292 - RNA, 21 nt, Homo sapiens
caguggcgcgaucucagcuca

SEQ ID NO: 812293 - RNA, 19 nt, Homo sapiens
caguggcuggaucugugag

SEQ ID NO: 812294 - RNA, 16 nt, Homo sapiens
caguggcugugccacc

SEQ ID NO: 812295 - RNA, 16 nt, Homo sapiens
cagugggaucccagac

SEQ ID NO: 812296 - RNA, 17 nt, Homo sapiens
cagugggggcagagcca

SEQ ID NO: 812297 - RNA, 21 nt, Homo sapiens
cagugggugccccccuugcca

SEQ ID NO: 812298 - RNA, 14 nt, Homo sapiens
caguggucaugcuc

SEQ ID NO: 812299 - RNA, 17 nt, Homo sapiens
caguggucaugcucagc

SEQ ID NO: 812300 - RNA, 22 nt, Homo sapiens
caguggucccauuuauaucugc

SEQ ID NO: 812301 - RNA, 16 nt, Homo sapiens
caguggugacauaguc

SEQ ID NO: 812302 - RNA, 22 nt, Homo sapiens
caguggugagaucacaguucau

SEQ ID NO: 812303 - RNA, 19 nt, Homo sapiens
cagugguggucuucaagac

SEQ ID NO: 812304 - RNA, 16 nt, Homo sapiens
caguggugugaucucg

SEQ ID NO: 812305 - RNA, 19 nt, Homo sapiens
cagugguuuuauacugaag

SEQ ID NO: 812306 - RNA, 22 nt, Homo sapiens
caguguaauaauaaaucguccu

SEQ ID NO: 812307 - RNA, 14 nt, Homo sapiens
caguguacccuccu

SEQ ID NO: 812308 - RNA, 12 nt, Homo sapiens
cagugucauuua

SEQ ID NO: 812309 - RNA, 19 nt, Homo sapiens
caguguccucuugcucaaa

SEQ ID NO: 812310 - RNA, 15 nt, Homo sapiens
cagugucuuccauaa

SEQ ID NO: 812311 - RNA, 15 nt, Homo sapiens
cagugugacacugcu

SEQ ID NO: 812312 - RNA, 23 nt, Homo sapiens
cagugugaucccaagugccaguc

SEQ ID NO: 812313 - RNA, 20 nt, Homo sapiens
cagugugcaagggcagugaa

SEQ ID NO: 812314 - RNA, 15 nt, Homo sapiens
caguguggcagugac

SEQ ID NO: 812315 - RNA, 17 nt, Homo sapiens
caguguuauuaaugaca

SEQ ID NO: 812316 - RNA, 22 nt, Homo sapiens
caguguugugccccuucacuca

SEQ ID NO: 812317 - RNA, 11 nt, Homo sapiens
caguguuuaca

SEQ ID NO: 812318 - RNA, 22 nt, Homo sapiens
caguguuuggaugaaaaaagcc

SEQ ID NO: 812319 - RNA, 23 nt, Homo sapiens
caguguuuuagagagagaacuuu

SEQ ID NO: 812320 - RNA, 22 nt, Homo sapiens
caguuaaacugugaagcuauug

SEQ ID NO: 812321 - RNA, 23 nt, Homo sapiens
caguuaaggaagauccugaagca

SEQ ID NO: 812322 - RNA, 18 nt, Homo sapiens
caguuaauacuccagaga

SEQ ID NO: 812323 - RNA, 22 nt, Homo sapiens
caguuacaauuguuacaguacu

SEQ ID NO: 812324 - RNA, 14 nt, Homo sapiens
caguuaggugcuga

SEQ ID NO: 812325 - RNA, 14 nt, Homo sapiens
caguucaagacuua

SEQ ID NO: 812326 - RNA, 15 nt, Homo sapiens
caguucaagacuuag

SEQ ID NO: 812327 - RNA, 12 nt, Homo sapiens
caguucagauaa

SEQ ID NO: 812328 - RNA, 14 nt, Homo sapiens
caguucagugaggu

SEQ ID NO: 812329 - RNA, 18 nt, Homo sapiens
caguucauugcacuuuga

SEQ ID NO: 812330 - RNA, 21 nt, Homo sapiens
caguuccuguagaacugagaa

SEQ ID NO: 812331 - RNA, 14 nt, Homo sapiens
caguuccuguggcu

SEQ ID NO: 812332 - RNA, 22 nt, Homo sapiens
caguucuagaagccacagugcc

SEQ ID NO: 812333 - RNA, 16 nt, Homo sapiens
caguucuaguuugcau

SEQ ID NO: 812334 - RNA, 16 nt, Homo sapiens
caguucucucccuucc

SEQ ID NO: 812335 - RNA, 20 nt, Homo sapiens
caguucucuguggaagcaag

SEQ ID NO: 812336 - RNA, 20 nt, Homo sapiens
caguucugagcaccguguca

SEQ ID NO: 812337 - RNA, 13 nt, Homo sapiens
caguucugugguu

SEQ ID NO: 812338 - RNA, 21 nt, Homo sapiens
caguugaauaaaagugcacac

SEQ ID NO: 812339 - RNA, 14 nt, Homo sapiens
caguugacuuuaag

SEQ ID NO: 812340 - RNA, 13 nt, Homo sapiens
caguugcucugac

SEQ ID NO: 812341 - RNA, 16 nt, Homo sapiens
caguugcugaucccug

SEQ ID NO: 812342 - RNA, 19 nt, Homo sapiens
caguugggacccaaaacac

SEQ ID NO: 812343 - RNA, 16 nt, Homo sapiens
caguugggagcacugg

SEQ ID NO: 812344 - RNA, 18 nt, Homo sapiens
caguuguaccaagugaaa

SEQ ID NO: 812345 - RNA, 14 nt, Homo sapiens
caguuuagaaugga

SEQ ID NO: 812346 - RNA, 15 nt, Homo sapiens
caguuucacauauuu

SEQ ID NO: 812347 - RNA, 15 nt, Homo sapiens
caguuucccuaucuc

SEQ ID NO: 812348 - RNA, 12 nt, Homo sapiens
caguuugcacaa

SEQ ID NO: 812349 - RNA, 14 nt, Homo sapiens
caguuuguggcauc

SEQ ID NO: 812350 - RNA, 14 nt, Homo sapiens
caguuuuaccucuu

SEQ ID NO: 812351 - RNA, 19 nt, Homo sapiens
caguuuuauaaaaagugga

SEQ ID NO: 812352 - RNA, 15 nt, Homo sapiens
caguuuuuaaacuag

SEQ ID NO: 812353 - RNA, 17 nt, Homo sapiens
cauaaaaagcagaauuu

SEQ ID NO: 812354 - RNA, 22 nt, Homo sapiens
cauaaaaagccugcaauuucau

SEQ ID NO: 812355 - RNA, 20 nt, Homo sapiens
cauaaaaauaaaaucuguaa

SEQ ID NO: 812356 - RNA, 18 nt, Homo sapiens
cauaaaaccaaguuuuac

SEQ ID NO: 812357 - RNA, 16 nt, Homo sapiens
cauaaaaucugugaau

SEQ ID NO: 812358 - RNA, 23 nt, Homo sapiens
cauaaacuaagagaaacugugua

SEQ ID NO: 812359 - RNA, 14 nt, Homo sapiens
cauaaacugccaag

SEQ ID NO: 812360 - RNA, 16 nt, Homo sapiens
cauaaacuucagggau

SEQ ID NO: 812361 - RNA, 17 nt, Homo sapiens
cauaaagacaaucacug

SEQ ID NO: 812362 - RNA, 12 nt, Homo sapiens
cauaaagaucaa

SEQ ID NO: 812363 - RNA, 11 nt, Homo sapiens
cauaaagccaa

SEQ ID NO: 812364 - RNA, 12 nt, Homo sapiens
cauaaagugaau

SEQ ID NO: 812365 - RNA, 16 nt, Homo sapiens
cauaaauaaaggugua

SEQ ID NO: 812366 - RNA, 13 nt, Homo sapiens
cauaaaucugucu

SEQ ID NO: 812367 - RNA, 22 nt, Homo sapiens
cauaaaucuuguaaucauguua

SEQ ID NO: 812368 - RNA, 17 nt, Homo sapiens
cauaaaugaagcagcuu

SEQ ID NO: 812369 - RNA, 17 nt, Homo sapiens
cauaaaugaaucaucaa

SEQ ID NO: 812370 - RNA, 17 nt, Homo sapiens
cauaaaugacacuacuu

SEQ ID NO: 812371 - RNA, 21 nt, Homo sapiens
cauaaauuacuguuuugccaa

SEQ ID NO: 812372 - RNA, 15 nt, Homo sapiens
cauaaccugucucac

SEQ ID NO: 812373 - RNA, 23 nt, Homo sapiens
cauaacgguuaagaaagcacuua

SEQ ID NO: 812374 - RNA, 15 nt, Homo sapiens
cauaacuauacuuga

SEQ ID NO: 812375 - RNA, 22 nt, Homo sapiens
cauaacuucauagaugcaggag

SEQ ID NO: 812376 - RNA, 17 nt, Homo sapiens
cauaacuugcugaauuu

SEQ ID NO: 812377 - RNA, 21 nt, Homo sapiens
cauaacuuggccauguucucc

SEQ ID NO: 812378 - RNA, 16 nt, Homo sapiens
cauaagaaaacuaaga

SEQ ID NO: 812379 - RNA, 15 nt, Homo sapiens
cauaagaaaagauua

SEQ ID NO: 812380 - RNA, 20 nt, Homo sapiens
cauaagagagccuugguuca

SEQ ID NO: 812381 - RNA, 16 nt, Homo sapiens
cauaagcauuacuuua

SEQ ID NO: 812382 - RNA, 20 nt, Homo sapiens
cauaagccuccauuuaguuc

SEQ ID NO: 812383 - RNA, 13 nt, Homo sapiens
cauaagugcaaua

SEQ ID NO: 812384 - RNA, 21 nt, Homo sapiens
cauaauaaaaaauuaugacaa

SEQ ID NO: 812385 - RNA, 22 nt, Homo sapiens
cauaauaaauaauuaaccacca

SEQ ID NO: 812386 - RNA, 15 nt, Homo sapiens
cauaauagucaauuu

SEQ ID NO: 812387 - RNA, 13 nt, Homo sapiens
cauaaucacaaau

SEQ ID NO: 812388 - RNA, 18 nt, Homo sapiens
cauaauguuacauuauua

SEQ ID NO: 812389 - RNA, 16 nt, Homo sapiens
cauaauguuccagaca

SEQ ID NO: 812390 - RNA, 21 nt, Homo sapiens
cauaauguuucuggauuucau

SEQ ID NO: 812391 - RNA, 20 nt, Homo sapiens
cauaauucagcacuuaacua

SEQ ID NO: 812392 - RNA, 20 nt, Homo sapiens
cauaauucuaagucuuccac

SEQ ID NO: 812393 - RNA, 21 nt, Homo sapiens
cauaauuuauacaggucauau

SEQ ID NO: 812394 - RNA, 23 nt, Homo sapiens
cauaauuuauacaggucauauua

SEQ ID NO: 812395 - RNA, 19 nt, Homo sapiens
cauaauuuguacauaugua

SEQ ID NO: 812396 - RNA, 22 nt, Homo sapiens
cauaauuuguacauauguaaaa

SEQ ID NO: 812397 - RNA, 21 nt, Homo sapiens
cauaauuuucuucaugcaaug

SEQ ID NO: 812398 - RNA, 14 nt, Homo sapiens
cauacaauguaugu

SEQ ID NO: 812399 - RNA, 23 nt, Homo sapiens
cauacaauuauuuuuacaguucu

SEQ ID NO: 812400 - RNA, 16 nt, Homo sapiens
cauacacuuauuggaa

SEQ ID NO: 812401 - RNA, 19 nt, Homo sapiens
cauacagagacagauauac

SEQ ID NO: 812402 - RNA, 17 nt, Homo sapiens
cauacauauuaucucau

SEQ ID NO: 812403 - RNA, 18 nt, Homo sapiens
cauacaugcauacaaaga

SEQ ID NO: 812404 - RNA, 17 nt, Homo sapiens
cauacaugucacauuua

SEQ ID NO: 812405 - RNA, 21 nt, Homo sapiens
cauacauuuaugcacauucac

SEQ ID NO: 812406 - RNA, 15 nt, Homo sapiens
ccuuuuaacugccaa

SEQ ID NO: 812407 - RNA, 13 nt, Homo sapiens
ccuuuuaugcaaa

SEQ ID NO: 812408 - RNA, 13 nt, Homo sapiens
ccuuuuccacuuu

SEQ ID NO: 812409 - RNA, 15 nt, Homo sapiens
ccuuuuccacuuuaa

SEQ ID NO: 812410 - RNA, 17 nt, Homo sapiens
ccuuuugaacuugucac

SEQ ID NO: 812411 - RNA, 16 nt, Homo sapiens
ccuuuugaccaaauaa

SEQ ID NO: 812412 - RNA, 13 nt, Homo sapiens
ccuuuugccaucc

SEQ ID NO: 812413 - RNA, 21 nt, Homo sapiens
ccuuuuuaaaaagcaccuauu

SEQ ID NO: 812414 - RNA, 16 nt, Homo sapiens
ccuuuuucacuuugaa

SEQ ID NO: 812415 - RNA, 23 nt, Homo sapiens
ccuuuuucuccacacuccacuga

SEQ ID NO: 812416 - RNA, 14 nt, Homo sapiens
ccuuuuugguacuu

SEQ ID NO: 812417 - RNA, 13 nt, Homo sapiens
ccuuuuuguacug

SEQ ID NO: 812418 - RNA, 19 nt, Homo sapiens
ccuuuuuuauacaggaaaa

SEQ ID NO: 812419 - RNA, 16 nt, Homo sapiens
ccuuuuuuguuauuau

SEQ ID NO: 812420 - RNA, 17 nt, Homo sapiens
cgaaauuggauuaugca

SEQ ID NO: 812421 - RNA, 20 nt, Homo sapiens
cgaacaccaaaaaugaugcg

SEQ ID NO: 812422 - RNA, 22 nt, Homo sapiens
cgaagaucgugccauugcacuc

SEQ ID NO: 812423 - RNA, 19 nt, Homo sapiens
cgaagccuuauuucuagaa

SEQ ID NO: 812424 - RNA, 18 nt, Homo sapiens
cgaauuuuaucuguggag

SEQ ID NO: 812425 - RNA, 20 nt, Homo sapiens
cgacaagugcugaacagugg

SEQ ID NO: 812426 - RNA, 17 nt, Homo sapiens
cgacauggagaccaucu

SEQ ID NO: 812427 - RNA, 15 nt, Homo sapiens
cgaccaacugcccua

SEQ ID NO: 812428 - RNA, 14 nt, Homo sapiens
cgaccacaccagcc

SEQ ID NO: 812429 - RNA, 19 nt, Homo sapiens
cgaccaggcuggacacccu

SEQ ID NO: 812430 - RNA, 11 nt, Homo sapiens
cgacccauuca

SEQ ID NO: 812431 - RNA, 22 nt, Homo sapiens
cgaccuaauugucuuuguucug

SEQ ID NO: 812432 - RNA, 16 nt, Homo sapiens
cgaccugcgccaaucc

SEQ ID NO: 812433 - RNA, 18 nt, Homo sapiens
cgacuccacgcuguccuu

SEQ ID NO: 812434 - RNA, 14 nt, Homo sapiens
cgacuggcugugag

SEQ ID NO: 812435 - RNA, 18 nt, Homo sapiens
cgacuuauuuuguugaaa

SEQ ID NO: 812436 - RNA, 20 nt, Homo sapiens
cgacuucaugacaagcauuu

SEQ ID NO: 812437 - RNA, 19 nt, Homo sapiens
cgacuuguuuuugcacaug

SEQ ID NO: 812438 - RNA, 15 nt, Homo sapiens
cgagaagcagcauuu

SEQ ID NO: 812439 - RNA, 14 nt, Homo sapiens
cgagacaccacaag

SEQ ID NO: 812440 - RNA, 13 nt, Homo sapiens
cgagacaccaucc

SEQ ID NO: 812441 - RNA, 17 nt, Homo sapiens
cgagaccccaucuucca

SEQ ID NO: 812442 - RNA, 14 nt, Homo sapiens
cgagaccccggcuu

SEQ ID NO: 812443 - RNA, 19 nt, Homo sapiens
cgagacuccgucucaagga

SEQ ID NO: 812444 - RNA, 23 nt, Homo sapiens
cgagagaaagggagugcaugugc

SEQ ID NO: 812445 - RNA, 23 nt, Homo sapiens
cgagaguggguguuggacagugu

SEQ ID NO: 812446 - RNA, 20 nt, Homo sapiens
cgagaucacgccacugcacu

SEQ ID NO: 812447 - RNA, 21 nt, Homo sapiens
cgagauugcaccauugcgcuc

SEQ ID NO: 812448 - RNA, 14 nt, Homo sapiens
cgagcacugugagc

SEQ ID NO: 812449 - RNA, 17 nt, Homo sapiens
cgagcagaugaugccaa

SEQ ID NO: 812450 - RNA, 17 nt, Homo sapiens
cgagcaggcuacuguca

SEQ ID NO: 812451 - RNA, 15 nt, Homo sapiens
cgagcagggugguga

SEQ ID NO: 812452 - RNA, 19 nt, Homo sapiens
cgagcauaguccaaaaagc

SEQ ID NO: 812453 - RNA, 19 nt, Homo sapiens
cgagcccagcuacauuccu

SEQ ID NO: 812454 - RNA, 13 nt, Homo sapiens
cgagccuucucac

SEQ ID NO: 812455 - RNA, 18 nt, Homo sapiens
cgaggaguaacaauacaa

SEQ ID NO: 812456 - RNA, 18 nt, Homo sapiens
cgaggcaggggcucugcu

SEQ ID NO: 812457 - RNA, 16 nt, Homo sapiens
cgagggcgccaugcag

SEQ ID NO: 812458 - RNA, 21 nt, Homo sapiens
cgaggugcaaauucauuucau

SEQ ID NO: 812459 - RNA, 14 nt, Homo sapiens
cgagucucuucucc

SEQ ID NO: 812460 - RNA, 19 nt, Homo sapiens
cgagucucuucuccacugg

SEQ ID NO: 812461 - RNA, 15 nt, Homo sapiens
cgagugcacugcauu

SEQ ID NO: 812462 - RNA, 15 nt, Homo sapiens
cgagugugauuugaa

SEQ ID NO: 812463 - RNA, 21 nt, Homo sapiens
cgauaguuuacugagaaugau

SEQ ID NO: 812464 - RNA, 21 nt, Homo sapiens
cgauccaugagggacuccucc

SEQ ID NO: 812465 - RNA, 22 nt, Homo sapiens
cgauccauguaaucugacguca

SEQ ID NO: 812466 - RNA, 18 nt, Homo sapiens
cgauccuggggcccucag

SEQ ID NO: 812467 - RNA, 19 nt, Homo sapiens
cgauccuuaauaaaugaau

SEQ ID NO: 812468 - RNA, 13 nt, Homo sapiens
cgaugacaguguu

SEQ ID NO: 812469 - RNA, 17 nt, Homo sapiens
cgaugcagugcuuccaa

SEQ ID NO: 812470 - RNA, 12 nt, Homo sapiens
cgaugcauuuaa

SEQ ID NO: 812471 - RNA, 19 nt, Homo sapiens
cgaugccugcaugcugaaa

SEQ ID NO: 812472 - RNA, 15 nt, Homo sapiens
cgauucaaacugcuc

SEQ ID NO: 812473 - RNA, 20 nt, Homo sapiens
cgauuccuuuauauuugcuc

SEQ ID NO: 812474 - RNA, 13 nt, Homo sapiens
cgauucuuaacaa

SEQ ID NO: 812475 - RNA, 14 nt, Homo sapiens
cgauugaaggugac

SEQ ID NO: 812476 - RNA, 19 nt, Homo sapiens
cgauugcaggagucccugc

SEQ ID NO: 812477 - RNA, 22 nt, Homo sapiens
cgauuucacaguguguuuguga

SEQ ID NO: 812478 - RNA, 14 nt, Homo sapiens
cgcaaaugaguauu

SEQ ID NO: 812479 - RNA, 13 nt, Homo sapiens
cgcaacaguuuuu

SEQ ID NO: 812480 - RNA, 15 nt, Homo sapiens
cgcaauugcucaugc

SEQ ID NO: 812481 - RNA, 12 nt, Homo sapiens
cgcaccacugca

SEQ ID NO: 812482 - RNA, 13 nt, Homo sapiens
cgcaccacugcac

SEQ ID NO: 812483 - RNA, 22 nt, Homo sapiens
cgcaccauuucugucacucaca

SEQ ID NO: 812484 - RNA, 21 nt, Homo sapiens
cgcagaaaacaagaugagauu

SEQ ID NO: 812485 - RNA, 14 nt, Homo sapiens
cgcagacgggcaca

SEQ ID NO: 812486 - RNA, 21 nt, Homo sapiens
cgcagguuaugucagcagcuc

SEQ ID NO: 812487 - RNA, 16 nt, Homo sapiens
cgcauacacacaugcc

SEQ ID NO: 812488 - RNA, 20 nt, Homo sapiens
cgcauacuacaguaacugug

SEQ ID NO: 812489 - RNA, 16 nt, Homo sapiens
cgcauccucuuccauu

SEQ ID NO: 812490 - RNA, 13 nt, Homo sapiens
cgcaucuugccuc

SEQ ID NO: 812491 - RNA, 15 nt, Homo sapiens
cgcaugacuguuaca

SEQ ID NO: 812492 - RNA, 23 nt, Homo sapiens
cgcaugucucccuccaguccucu

SEQ ID NO: 812493 - RNA, 14 nt, Homo sapiens
cgccaaacauuccu

SEQ ID NO: 812494 - RNA, 20 nt, Homo sapiens
cgccaccccuccuuccuuga

SEQ ID NO: 812495 - RNA, 13 nt, Homo sapiens
cgccaccugugac

SEQ ID NO: 812496 - RNA, 18 nt, Homo sapiens
cgccaccugugaccagca

SEQ ID NO: 812497 - RNA, 13 nt, Homo sapiens
cgccagcugggag

SEQ ID NO: 812498 - RNA, 14 nt, Homo sapiens
cgccaggacugugu

SEQ ID NO: 812499 - RNA, 21 nt, Homo sapiens
cgcccacccacgcauacacac

SEQ ID NO: 812500 - RNA, 20 nt, Homo sapiens
cgcccaccucggccucccaa

SEQ ID NO: 812501 - RNA, 19 nt, Homo sapiens
cgcccagcugcaccugcca

SEQ ID NO: 812502 - RNA, 20 nt, Homo sapiens
cgcccaggcuggagugcaau

SEQ ID NO: 812503 - RNA, 21 nt, Homo sapiens
cgcccagguccccgcuuucuu

SEQ ID NO: 812504 - RNA, 22 nt, Homo sapiens
cgcccccugccccaaucuccca

SEQ ID NO: 812505 - RNA, 18 nt, Homo sapiens
cgcccgagggauggugcc

SEQ ID NO: 812506 - RNA, 17 nt, Homo sapiens
cgcccuccucccuguca

SEQ ID NO: 812507 - RNA, 19 nt, Homo sapiens
cgccuacuggacgcugccc

SEQ ID NO: 812508 - RNA, 21 nt, Homo sapiens
cgccuaugaucccagcacuuu

SEQ ID NO: 812509 - RNA, 15 nt, Homo sapiens
cgccugccugccacc

SEQ ID NO: 812510 - RNA, 20 nt, Homo sapiens
cgccuguaaucccagcacuu

SEQ ID NO: 812511 - RNA, 21 nt, Homo sapiens
cgccugugaggggugcagaga

SEQ ID NO: 812512 - RNA, 13 nt, Homo sapiens
cgccuuaaacucu

SEQ ID NO: 812513 - RNA, 15 nt, Homo sapiens
cgccuucucccacau

SEQ ID NO: 812514 - RNA, 21 nt, Homo sapiens
cgccuugccuccucacccacc

SEQ ID NO: 812515 - RNA, 22 nt, Homo sapiens
cgcgagcugcugauacagaaga

SEQ ID NO: 812516 - RNA, 22 nt, Homo sapiens
cgcgccccacgagaccccggcu

SEQ ID NO: 812517 - RNA, 12 nt, Homo sapiens
cgcgcucgccca

SEQ ID NO: 812518 - RNA, 19 nt, Homo sapiens
cgcgcucgcccagcaggag

SEQ ID NO: 812519 - RNA, 16 nt, Homo sapiens
cgcuauccaguugcag

SEQ ID NO: 812520 - RNA, 12 nt, Homo sapiens
cgcucaccugca

SEQ ID NO: 812521 - RNA, 16 nt, Homo sapiens
cuacugcaagagccaa

SEQ ID NO: 812522 - RNA, 23 nt, Homo sapiens
cuacugcaagagccaaguuccaa

SEQ ID NO: 812523 - RNA, 13 nt, Homo sapiens
cuacugugugcca

SEQ ID NO: 812524 - RNA, 23 nt, Homo sapiens
cuacuuacaacccagggugugaa

SEQ ID NO: 812525 - RNA, 19 nt, Homo sapiens
cuacuucggagaggccaag

SEQ ID NO: 812526 - RNA, 19 nt, Homo sapiens
cuacuugggaggcugaggc

SEQ ID NO: 812527 - RNA, 15 nt, Homo sapiens
cuacuuuguggcaau

SEQ ID NO: 812528 - RNA, 15 nt, Homo sapiens
cuacuuuuuauacuc

SEQ ID NO: 812529 - RNA, 16 nt, Homo sapiens
cuacuuuuuauacucc

SEQ ID NO: 812530 - RNA, 16 nt, Homo sapiens
cuagaaagacagaagc

SEQ ID NO: 812531 - RNA, 16 nt, Homo sapiens
cuagaaaucugccaau

SEQ ID NO: 812532 - RNA, 17 nt, Homo sapiens
cuagaaaucuguugcua

SEQ ID NO: 812533 - RNA, 18 nt, Homo sapiens
cuagaacaacgccuguca

SEQ ID NO: 812534 - RNA, 22 nt, Homo sapiens
cuagaacaaugggaggcuguga

SEQ ID NO: 812535 - RNA, 19 nt, Homo sapiens
cuagaacaugcacauuuau

SEQ ID NO: 812536 - RNA, 19 nt, Homo sapiens
cuagaacucuccaucuuau

SEQ ID NO: 812537 - RNA, 23 nt, Homo sapiens
cuagaagaaaagcccauuuucaa

SEQ ID NO: 812538 - RNA, 13 nt, Homo sapiens
cuagaagacuguc

SEQ ID NO: 812539 - RNA, 17 nt, Homo sapiens
cuagaagaugaauacaa

SEQ ID NO: 812540 - RNA, 18 nt, Homo sapiens
cuagaaguuacugaaugc

SEQ ID NO: 812541 - RNA, 12 nt, Homo sapiens
cuagaauuauuc

SEQ ID NO: 812542 - RNA, 17 nt, Homo sapiens
cuagacagcuuuucuca

SEQ ID NO: 812543 - RNA, 12 nt, Homo sapiens
cuagacccguga

SEQ ID NO: 812544 - RNA, 22 nt, Homo sapiens
cuagacuaagaagauuuaguuu

SEQ ID NO: 812545 - RNA, 20 nt, Homo sapiens
cuagacuauuaggugcaauu

SEQ ID NO: 812546 - RNA, 16 nt, Homo sapiens
cuagacucuagacaag

SEQ ID NO: 812547 - RNA, 18 nt, Homo sapiens
cuagagaaggcauuucau

SEQ ID NO: 812548 - RNA, 22 nt, Homo sapiens
cuagagacaggcaaacugcaaa

SEQ ID NO: 812549 - RNA, 14 nt, Homo sapiens
cuagaggcgagcca

SEQ ID NO: 812550 - RNA, 12 nt, Homo sapiens
cuagagggccca

SEQ ID NO: 812551 - RNA, 17 nt, Homo sapiens
cuagaguccucacuccc

SEQ ID NO: 812552 - RNA, 19 nt, Homo sapiens
cuagauacagaauaaugga

SEQ ID NO: 812553 - RNA, 13 nt, Homo sapiens
cuagauacuggaa

SEQ ID NO: 812554 - RNA, 18 nt, Homo sapiens
cuagauacuggaaaccua

SEQ ID NO: 812555 - RNA, 20 nt, Homo sapiens
cuagaucaaggagcccagaa

SEQ ID NO: 812556 - RNA, 20 nt, Homo sapiens
cuagaucucagccauucuaa

SEQ ID NO: 812557 - RNA, 22 nt, Homo sapiens
cuagaugccacugcccauagac

SEQ ID NO: 812558 - RNA, 14 nt, Homo sapiens
cuagauggacccca

SEQ ID NO: 812559 - RNA, 22 nt, Homo sapiens
cuagauggagaaaguaacacaa

SEQ ID NO: 812560 - RNA, 19 nt, Homo sapiens
cuagauguguucuaagcaa

SEQ ID NO: 812561 - RNA, 15 nt, Homo sapiens
cuagauucaaagguu

SEQ ID NO: 812562 - RNA, 18 nt, Homo sapiens
cuagauucaaagguucua

SEQ ID NO: 812563 - RNA, 17 nt, Homo sapiens
cuagauuuaacucaguu

SEQ ID NO: 812564 - RNA, 20 nt, Homo sapiens
cuagcaaauguuaugcauaa

SEQ ID NO: 812565 - RNA, 16 nt, Homo sapiens
cuagcacuuggagcca

SEQ ID NO: 812566 - RNA, 23 nt, Homo sapiens
cuagcagaaaucuagaagacugu

SEQ ID NO: 812567 - RNA, 19 nt, Homo sapiens
cuagcagaggaaaguguaa

SEQ ID NO: 812568 - RNA, 15 nt, Homo sapiens
cuagcagcugcaguc

SEQ ID NO: 812569 - RNA, 16 nt, Homo sapiens
cuagcaggaauauuuc

SEQ ID NO: 812570 - RNA, 17 nt, Homo sapiens
cuagcccugggacauca

SEQ ID NO: 812571 - RNA, 15 nt, Homo sapiens
cuagcgcaagaccag

SEQ ID NO: 812572 - RNA, 19 nt, Homo sapiens
cuagcuagaaauaugauuu

SEQ ID NO: 812573 - RNA, 13 nt, Homo sapiens
cuagcuauaacaa

SEQ ID NO: 812574 - RNA, 14 nt, Homo sapiens
cuagcuuagcuguc

SEQ ID NO: 812575 - RNA, 21 nt, Homo sapiens
cuagcuuagugcuauguguga

SEQ ID NO: 812576 - RNA, 18 nt, Homo sapiens
cuagcuucugcaauguuu

SEQ ID NO: 812577 - RNA, 19 nt, Homo sapiens
cuaggaaaaucacuugcca

SEQ ID NO: 812578 - RNA, 21 nt, Homo sapiens
cuaggaaacucacacuccccu

SEQ ID NO: 812579 - RNA, 13 nt, Homo sapiens
cuaggaaggugaa

SEQ ID NO: 812580 - RNA, 20 nt, Homo sapiens
cuaggaaggugaaucugccc

SEQ ID NO: 812581 - RNA, 22 nt, Homo sapiens
cuaggcaccucagaccaaucau

SEQ ID NO: 812582 - RNA, 12 nt, Homo sapiens
cuaggccccaga

SEQ ID NO: 812583 - RNA, 15 nt, Homo sapiens
cuaggccgcccugag

SEQ ID NO: 812584 - RNA, 14 nt, Homo sapiens
cuaggcuaccucaa

SEQ ID NO: 812585 - RNA, 18 nt, Homo sapiens
cuaggcugcccacucucc

SEQ ID NO: 812586 - RNA, 14 nt, Homo sapiens
cuagggagccauuu

SEQ ID NO: 812587 - RNA, 18 nt, Homo sapiens
cuagggcacuuuaaguca

SEQ ID NO: 812588 - RNA, 21 nt, Homo sapiens
cuagggcacuuuaagucagug

SEQ ID NO: 812589 - RNA, 14 nt, Homo sapiens
cuaggggacacuuc

SEQ ID NO: 812590 - RNA, 18 nt, Homo sapiens
cuaggggagucccugugg

SEQ ID NO: 812591 - RNA, 18 nt, Homo sapiens
cuaggggucaggcuccau

SEQ ID NO: 812592 - RNA, 16 nt, Homo sapiens
cuagggucuugggggu

SEQ ID NO: 812593 - RNA, 16 nt, Homo sapiens
cuaggucacuucucac

SEQ ID NO: 812594 - RNA, 14 nt, Homo sapiens
cuaguaaauuuaau

SEQ ID NO: 812595 - RNA, 14 nt, Homo sapiens
cuaguaacuccucu

SEQ ID NO: 812596 - RNA, 18 nt, Homo sapiens
cuaguaagaugcacugaa

SEQ ID NO: 812597 - RNA, 19 nt, Homo sapiens
cuaguacugccccccauga

SEQ ID NO: 812598 - RNA, 14 nt, Homo sapiens
cuaguagaacugga

SEQ ID NO: 812599 - RNA, 16 nt, Homo sapiens
cuaguagcuaaccauc

SEQ ID NO: 812600 - RNA, 22 nt, Homo sapiens
cuaguauuuauggguggauuua

SEQ ID NO: 812601 - RNA, 13 nt, Homo sapiens
cuagucacaaaga

SEQ ID NO: 812602 - RNA, 19 nt, Homo sapiens
cuagucuccuuugcacuga

SEQ ID NO: 812603 - RNA, 16 nt, Homo sapiens
cuagugacaagcuccu

SEQ ID NO: 812604 - RNA, 12 nt, Homo sapiens
cuagugccuuua

SEQ ID NO: 812605 - RNA, 13 nt, Homo sapiens
cuagugggaguua

SEQ ID NO: 812606 - RNA, 14 nt, Homo sapiens
cuaguguacauuuc

SEQ ID NO: 812607 - RNA, 22 nt, Homo sapiens
cuaguguacauuucuauaaaua

SEQ ID NO: 812608 - RNA, 14 nt, Homo sapiens
cuaguguaccuccu

SEQ ID NO: 812609 - RNA, 16 nt, Homo sapiens
cuagugucuuuugccu

SEQ ID NO: 812610 - RNA, 16 nt, Homo sapiens
cuaguguguccuguga

SEQ ID NO: 812611 - RNA, 18 nt, Homo sapiens
cuaguguucuguuuguua

SEQ ID NO: 812612 - RNA, 15 nt, Homo sapiens
cuaguugaguagcca

SEQ ID NO: 812613 - RNA, 22 nt, Homo sapiens
cuaguugaguagccagaugaaa

SEQ ID NO: 812614 - RNA, 14 nt, Homo sapiens
cuaguuugaccuca

SEQ ID NO: 812615 - RNA, 11 nt, Homo sapiens
cuaguuugcaa

SEQ ID NO: 812616 - RNA, 21 nt, Homo sapiens
cuaguuugcuuugcugaccaa

SEQ ID NO: 812617 - RNA, 20 nt, Homo sapiens
cuaguuuugucaaacuguag

SEQ ID NO: 812618 - RNA, 17 nt, Homo sapiens
cuaguuuuuauacaugu

SEQ ID NO: 812619 - RNA, 16 nt, Homo sapiens
cuauaaaauagauaua

SEQ ID NO: 812620 - RNA, 16 nt, Homo sapiens
cuauaaagaagaacuu

SEQ ID NO: 812621 - RNA, 19 nt, Homo sapiens
cuauaaagaagaacuugca

SEQ ID NO: 812622 - RNA, 20 nt, Homo sapiens
cuauaaagaagaacuugcau

SEQ ID NO: 812623 - RNA, 22 nt, Homo sapiens
cuauaaagaagaacuugcaugg

SEQ ID NO: 812624 - RNA, 24 nt, Homo sapiens
cuauaaaguuuuauuugaaugaac

SEQ ID NO: 812625 - RNA, 20 nt, Homo sapiens
cuauaaauagaugcugugua

SEQ ID NO: 812626 - RNA, 16 nt, Homo sapiens
cuauaacaaucacugg

SEQ ID NO: 812627 - RNA, 20 nt, Homo sapiens
cuauaagaauaaggcuuuuu

SEQ ID NO: 812628 - RNA, 15 nt, Homo sapiens
cuauaauguuucccu

SEQ ID NO: 812629 - RNA, 17 nt, Homo sapiens
cuauaccaauaaaguga

SEQ ID NO: 812630 - RNA, 15 nt, Homo sapiens
cuauaccucacaaua

SEQ ID NO: 812631 - RNA, 19 nt, Homo sapiens
cuauaccuggggacuugau

SEQ ID NO: 812632 - RNA, 12 nt, Homo sapiens
cuauacugcacu

SEQ ID NO: 812633 - RNA, 20 nt, Homo sapiens
cuauagacuguaagcuccau

SEQ ID NO: 812634 - RNA, 22 nt, Homo sapiens
cuauagccuaagcggcuguuua

SEQ ID NO: 812635 - RNA, 23 nt, Homo sapiens
cuauaggugcuacaaaaacacag

SEQ ID NO: 812636 - RNA, 18 nt, Homo sapiens
gaaacuguagucucagga

SEQ ID NO: 812637 - RNA, 17 nt, Homo sapiens
gaaacuguaugugcugu

SEQ ID NO: 812638 - RNA, 21 nt, Homo sapiens
gaaacuuauuucucauaucaa

SEQ ID NO: 812639 - RNA, 16 nt, Homo sapiens
gaaacuucgccagcug

SEQ ID NO: 812640 - RNA, 16 nt, Homo sapiens
gaaacuugcuuaucaa

SEQ ID NO: 812641 - RNA, 19 nt, Homo sapiens
gaaacuuuaauccaaagaa

SEQ ID NO: 812642 - RNA, 19 nt, Homo sapiens
gaaacuuugaguacagaua

SEQ ID NO: 812643 - RNA, 20 nt, Homo sapiens
gaaacuuugcagaugugauu

SEQ ID NO: 812644 - RNA, 16 nt, Homo sapiens
gaaacuuugccucaag

SEQ ID NO: 812645 - RNA, 14 nt, Homo sapiens
gaaagaacuaugaa

SEQ ID NO: 812646 - RNA, 16 nt, Homo sapiens
gaaagaagccacagcu

SEQ ID NO: 812647 - RNA, 18 nt, Homo sapiens
gaaagaaucagucuugca

SEQ ID NO: 812648 - RNA, 17 nt, Homo sapiens
gaaagaaucucuugaga

SEQ ID NO: 812649 - RNA, 16 nt, Homo sapiens
gaaagaccuaugagca

SEQ ID NO: 812650 - RNA, 18 nt, Homo sapiens
gaaagacucuuaaugcag

SEQ ID NO: 812651 - RNA, 18 nt, Homo sapiens
gaaagagacuccgucuca

SEQ ID NO: 812652 - RNA, 22 nt, Homo sapiens
gaaagagauuuucacccaucca

SEQ ID NO: 812653 - RNA, 14 nt, Homo sapiens
gaaagagcaaguga

SEQ ID NO: 812654 - RNA, 18 nt, Homo sapiens
gaaagaggcaccaggaag

SEQ ID NO: 812655 - RNA, 22 nt, Homo sapiens
gaaagaggccagacaugguguc

SEQ ID NO: 812656 - RNA, 14 nt, Homo sapiens
gaaagaucaaagac

SEQ ID NO: 812657 - RNA, 13 nt, Homo sapiens
gaaagaugcagug

SEQ ID NO: 812658 - RNA, 15 nt, Homo sapiens
gaaagcaacaaagau

SEQ ID NO: 812659 - RNA, 14 nt, Homo sapiens
gaaagcaauauuau

SEQ ID NO: 812660 - RNA, 11 nt, Homo sapiens
gaaagcacuac

SEQ ID NO: 812661 - RNA, 18 nt, Homo sapiens
gaaagcauaugcagccaa

SEQ ID NO: 812662 - RNA, 23 nt, Homo sapiens
gaaagcaucauuauuugcagaga

SEQ ID NO: 812663 - RNA, 16 nt, Homo sapiens
gaaagcccucaugugc

SEQ ID NO: 812664 - RNA, 20 nt, Homo sapiens
gaaagcccucaugugcagua

SEQ ID NO: 812665 - RNA, 19 nt, Homo sapiens
gaaagccucugcugccaug

SEQ ID NO: 812666 - RNA, 14 nt, Homo sapiens
gaaagccuuaggga

SEQ ID NO: 812667 - RNA, 16 nt, Homo sapiens
gaaagcugcugugauc

SEQ ID NO: 812668 - RNA, 16 nt, Homo sapiens
gaaagcugcuugccau

SEQ ID NO: 812669 - RNA, 17 nt, Homo sapiens
gaaagcuggugucugau

SEQ ID NO: 812670 - RNA, 23 nt, Homo sapiens
gaaagcuugagucucaagggugg

SEQ ID NO: 812671 - RNA, 17 nt, Homo sapiens
gaaaggacccugugagc

SEQ ID NO: 812672 - RNA, 21 nt, Homo sapiens
gaaaggagaacuauccaaaac

SEQ ID NO: 812673 - RNA, 20 nt, Homo sapiens
gaaaggauuuuaccaaagca

SEQ ID NO: 812674 - RNA, 12 nt, Homo sapiens
gaaaggccuuca

SEQ ID NO: 812675 - RNA, 13 nt, Homo sapiens
gaaaggcucaguc

SEQ ID NO: 812676 - RNA, 14 nt, Homo sapiens
gaaaggcucauuua

SEQ ID NO: 812677 - RNA, 20 nt, Homo sapiens
gaaaggcucauuuaaaacag

SEQ ID NO: 812678 - RNA, 13 nt, Homo sapiens
gaaagggagcuau

SEQ ID NO: 812679 - RNA, 23 nt, Homo sapiens
gaaaggggaagugguccagaaac

SEQ ID NO: 812680 - RNA, 13 nt, Homo sapiens
gaaaggggcccca

SEQ ID NO: 812681 - RNA, 20 nt, Homo sapiens
gaaaggguuuguaauacuuu

SEQ ID NO: 812682 - RNA, 19 nt, Homo sapiens
gaaagguacuauauuugcu

SEQ ID NO: 812683 - RNA, 21 nt, Homo sapiens
gaaagguacuauauuugcuag

SEQ ID NO: 812684 - RNA, 14 nt, Homo sapiens
gaaaggucucugga

SEQ ID NO: 812685 - RNA, 23 nt, Homo sapiens
gaaagguuaauucucuagggcua

SEQ ID NO: 812686 - RNA, 16 nt, Homo sapiens
gaaagguuuuccuuau

SEQ ID NO: 812687 - RNA, 13 nt, Homo sapiens
gaaaguacuuugg

SEQ ID NO: 812688 - RNA, 17 nt, Homo sapiens
gaaaguauaaugcagua

SEQ ID NO: 812689 - RNA, 12 nt, Homo sapiens
gaaagugauauc

SEQ ID NO: 812690 - RNA, 16 nt, Homo sapiens
gaaaguucaacuucca

SEQ ID NO: 812691 - RNA, 14 nt, Homo sapiens
gaaaguucauaucu

SEQ ID NO: 812692 - RNA, 22 nt, Homo sapiens
gaaaguucccccaucaguuccc

SEQ ID NO: 812693 - RNA, 17 nt, Homo sapiens
gaaaguuucagauuugc

SEQ ID NO: 812694 - RNA, 20 nt, Homo sapiens
gaaauaaaaaaugaaaaaca

SEQ ID NO: 812695 - RNA, 16 nt, Homo sapiens
gaaauaaacugugcaa

SEQ ID NO: 812696 - RNA, 15 nt, Homo sapiens
gaaauaaagaucuca

SEQ ID NO: 812697 - RNA, 18 nt, Homo sapiens
gaaauaaagcguccucuc

SEQ ID NO: 812698 - RNA, 21 nt, Homo sapiens
gaaauaaagcguccucucagu

SEQ ID NO: 812699 - RNA, 18 nt, Homo sapiens
gaaauaaaguuggugaca

SEQ ID NO: 812700 - RNA, 13 nt, Homo sapiens
gaaauacuuucag

SEQ ID NO: 812701 - RNA, 22 nt, Homo sapiens
gaaauaguaccuucaauacuua

SEQ ID NO: 812702 - RNA, 14 nt, Homo sapiens
gaaauauagccaaa

SEQ ID NO: 812703 - RNA, 23 nt, Homo sapiens
gaaauauaguaaacacuuggaaa

SEQ ID NO: 812704 - RNA, 22 nt, Homo sapiens
gaaauauauauguguguguaug

SEQ ID NO: 812705 - RNA, 20 nt, Homo sapiens
gaaauaugugguuuccacga

SEQ ID NO: 812706 - RNA, 16 nt, Homo sapiens
gaaauauuuucuagga

SEQ ID NO: 812707 - RNA, 14 nt, Homo sapiens
gaaaucaaugcaag

SEQ ID NO: 812708 - RNA, 15 nt, Homo sapiens
gaaaucaguuucuca

SEQ ID NO: 812709 - RNA, 23 nt, Homo sapiens
gaaaucaguuucucaaacugagc

SEQ ID NO: 812710 - RNA, 15 nt, Homo sapiens
gaaaucauuguagaa

SEQ ID NO: 812711 - RNA, 12 nt, Homo sapiens
gaaaucuacuga

SEQ ID NO: 812712 - RNA, 17 nt, Homo sapiens
gaaaucuagaagacugu

SEQ ID NO: 812713 - RNA, 17 nt, Homo sapiens
gaaaucuuucucccuca

SEQ ID NO: 812714 - RNA, 21 nt, Homo sapiens
gaaaugaauagccaggccuga

SEQ ID NO: 812715 - RNA, 16 nt, Homo sapiens
gaaaugaaugguuuca

SEQ ID NO: 812716 - RNA, 15 nt, Homo sapiens
gaaaugaccaagaca

SEQ ID NO: 812717 - RNA, 16 nt, Homo sapiens
gaaaugagaacauucc

SEQ ID NO: 812718 - RNA, 17 nt, Homo sapiens
gaaaugauaugaccaaa

SEQ ID NO: 812719 - RNA, 18 nt, Homo sapiens
gaaaugauaugaccaaaa

SEQ ID NO: 812720 - RNA, 22 nt, Homo sapiens
gaaaugaugaaaagguugccug

SEQ ID NO: 812721 - RNA, 11 nt, Homo sapiens
gaaaugcaaaa

SEQ ID NO: 812722 - RNA, 12 nt, Homo sapiens
gaaaugcaaaac

SEQ ID NO: 812723 - RNA, 22 nt, Homo sapiens
gaaaugcaaaagauacggccca

SEQ ID NO: 812724 - RNA, 18 nt, Homo sapiens
gaaaugcuaugacuguau

SEQ ID NO: 812725 - RNA, 20 nt, Homo sapiens
gaaaugcugccugccugucu

SEQ ID NO: 812726 - RNA, 15 nt, Homo sapiens
gaaauggagaagcuc

SEQ ID NO: 812727 - RNA, 23 nt, Homo sapiens
gaaaugggaaaugagaacauucc

SEQ ID NO: 812728 - RNA, 15 nt, Homo sapiens
gaaaugguacuucau

SEQ ID NO: 812729 - RNA, 14 nt, Homo sapiens
gaaauguaaaagca

SEQ ID NO: 812730 - RNA, 17 nt, Homo sapiens
gaaauguaugugcucuu

SEQ ID NO: 812731 - RNA, 15 nt, Homo sapiens
gaaauuagauuugug

SEQ ID NO: 812732 - RNA, 14 nt, Homo sapiens
gaaauuauuauuca

SEQ ID NO: 812733 - RNA, 16 nt, Homo sapiens
gaaauuccaaagucuc

SEQ ID NO: 812734 - RNA, 20 nt, Homo sapiens
gaaauuccauacuucucuca

SEQ ID NO: 812735 - RNA, 16 nt, Homo sapiens
gaaauucuccacugug

SEQ ID NO: 812736 - RNA, 15 nt, Homo sapiens
gaaauucucugcgau

SEQ ID NO: 812737 - RNA, 14 nt, Homo sapiens
gaaauucugaugag

SEQ ID NO: 812738 - RNA, 21 nt, Homo sapiens
gaaauuggaagaagcacugau

SEQ ID NO: 812739 - RNA, 17 nt, Homo sapiens
gaaauuuaagacuagau

SEQ ID NO: 812740 - RNA, 14 nt, Homo sapiens
gaaauuuacuacag

SEQ ID NO: 812741 - RNA, 23 nt, Homo sapiens
gaaauuuucaauuugagauucua

SEQ ID NO: 812742 - RNA, 17 nt, Homo sapiens
gaaauuuuguaagaagg

SEQ ID NO: 812743 - RNA, 21 nt, Homo sapiens
gaaauuuuguaagaaggcaau

SEQ ID NO: 812744 - RNA, 18 nt, Homo sapiens
gaacaaaaauugagacau

SEQ ID NO: 812745 - RNA, 21 nt, Homo sapiens
gaacaaacacugcaguuuccu

SEQ ID NO: 812746 - RNA, 21 nt, Homo sapiens
gaacaaagugcuagacuuucu

SEQ ID NO: 812747 - RNA, 14 nt, Homo sapiens
gaacaaaugaauaa

SEQ ID NO: 812748 - RNA, 17 nt, Homo sapiens
gaacaacgccugucaca

SEQ ID NO: 812749 - RNA, 22 nt, Homo sapiens
gaacaacuaggcuucagcauau

SEQ ID NO: 812750 - RNA, 17 nt, Homo sapiens
gaacaacuugcuacuga

SEQ ID NO: 812751 - RNA, 18 nt, Homo sapiens
gaauguuugaaaauuaga

SEQ ID NO: 812752 - RNA, 17 nt, Homo sapiens
gaauuaaaaaagcauac

SEQ ID NO: 812753 - RNA, 22 nt, Homo sapiens
gaauuaaaagucuacagcacua

SEQ ID NO: 812754 - RNA, 18 nt, Homo sapiens
gaauuaagaaauacucau

SEQ ID NO: 812755 - RNA, 22 nt, Homo sapiens
gaauuaccauuaauuacauaca

SEQ ID NO: 812756 - RNA, 17 nt, Homo sapiens
gaauuacuuguguuacu

SEQ ID NO: 812757 - RNA, 23 nt, Homo sapiens
gaauuacuuguguuacuugccaa

SEQ ID NO: 812758 - RNA, 17 nt, Homo sapiens
gaauuauauguucagau

SEQ ID NO: 812759 - RNA, 15 nt, Homo sapiens
gaauuaucuauuuca

SEQ ID NO: 812760 - RNA, 21 nt, Homo sapiens
gaauuauguaauauauuguac

SEQ ID NO: 812761 - RNA, 16 nt, Homo sapiens
gaauuauugacacuga

SEQ ID NO: 812762 - RNA, 20 nt, Homo sapiens
gaauuauuuugaaugucaca

SEQ ID NO: 812763 - RNA, 21 nt, Homo sapiens
gaauuauuuugaaugucacaa

SEQ ID NO: 812764 - RNA, 19 nt, Homo sapiens
gaauuauuuuuguguuucu

SEQ ID NO: 812765 - RNA, 14 nt, Homo sapiens
gaauucaaaaguga

SEQ ID NO: 812766 - RNA, 20 nt, Homo sapiens
gaauucagcaccagugaaag

SEQ ID NO: 812767 - RNA, 11 nt, Homo sapiens
gaauucagugc

SEQ ID NO: 812768 - RNA, 19 nt, Homo sapiens
gaauuccucuuuugcuuaa

SEQ ID NO: 812769 - RNA, 19 nt, Homo sapiens
gaauucuaagcuggugccc

SEQ ID NO: 812770 - RNA, 23 nt, Homo sapiens
gaauucuuacauguuuucuuugc

SEQ ID NO: 812771 - RNA, 18 nt, Homo sapiens
gaauucuuuccccaaaga

SEQ ID NO: 812772 - RNA, 14 nt, Homo sapiens
gaauugaaacugag

SEQ ID NO: 812773 - RNA, 18 nt, Homo sapiens
gaauugaacgacuaccca

SEQ ID NO: 812774 - RNA, 14 nt, Homo sapiens
gaauugaccaaaua

SEQ ID NO: 812775 - RNA, 20 nt, Homo sapiens
gaauuggcuuccagauuuua

SEQ ID NO: 812776 - RNA, 18 nt, Homo sapiens
gaauugugcaaccaucac

SEQ ID NO: 812777 - RNA, 15 nt, Homo sapiens
gaauuuaaggcccaa

SEQ ID NO: 812778 - RNA, 13 nt, Homo sapiens
gaauuuacucagg

SEQ ID NO: 812779 - RNA, 14 nt, Homo sapiens
gaauuuacucaggc

SEQ ID NO: 812780 - RNA, 10 nt, Homo sapiens
gaauuucaca

SEQ ID NO: 812781 - RNA, 15 nt, Homo sapiens
gaauuuccucuauug

SEQ ID NO: 812782 - RNA, 20 nt, Homo sapiens
gaauuucuaaaaaacagagg

SEQ ID NO: 812783 - RNA, 22 nt, Homo sapiens
gaauuucuaagcgccuauuguu

SEQ ID NO: 812784 - RNA, 15 nt, Homo sapiens
gaauuucuuugucau

SEQ ID NO: 812785 - RNA, 18 nt, Homo sapiens
gaauuugaacagcucacc

SEQ ID NO: 812786 - RNA, 16 nt, Homo sapiens
gaauuugaauacugca

SEQ ID NO: 812787 - RNA, 17 nt, Homo sapiens
gaauuuggccugcacua

SEQ ID NO: 812788 - RNA, 22 nt, Homo sapiens
gaauuuguacuucuuauugcaa

SEQ ID NO: 812789 - RNA, 20 nt, Homo sapiens
gaauuuguauuaaaaagccu

SEQ ID NO: 812790 - RNA, 15 nt, Homo sapiens
gaauuuuaagugcuu

SEQ ID NO: 812791 - RNA, 20 nt, Homo sapiens
gaauuuucucuaacuucaag

SEQ ID NO: 812792 - RNA, 23 nt, Homo sapiens
gaauuuugcaauguauuuagcua

SEQ ID NO: 812793 - RNA, 22 nt, Homo sapiens
gaauuuuguucucugggagaaa

SEQ ID NO: 812794 - RNA, 13 nt, Homo sapiens
gaauuuuguugcu

SEQ ID NO: 812795 - RNA, 21 nt, Homo sapiens
gaauuuuuuaaauugacaguu

SEQ ID NO: 812796 - RNA, 22 nt, Homo sapiens
gaauuuuuuuguaauaagcaau

SEQ ID NO: 812797 - RNA, 21 nt, Homo sapiens
gacaaaaagcacuaguauaaa

SEQ ID NO: 812798 - RNA, 22 nt, Homo sapiens
gacaaaaauauuucagcaaacg

SEQ ID NO: 812799 - RNA, 16 nt, Homo sapiens
gacaaaacccacuguu

SEQ ID NO: 812800 - RNA, 20 nt, Homo sapiens
gacaaaauugcagauaccau

SEQ ID NO: 812801 - RNA, 17 nt, Homo sapiens
gacaaaccgagugcaau

SEQ ID NO: 812802 - RNA, 12 nt, Homo sapiens
gacaaagccaaa

SEQ ID NO: 812803 - RNA, 14 nt, Homo sapiens
gacaaaggaaucaa

SEQ ID NO: 812804 - RNA, 13 nt, Homo sapiens
gacaaagucucca

SEQ ID NO: 812805 - RNA, 19 nt, Homo sapiens
gacaaauaucuuuuuugga

SEQ ID NO: 812806 - RNA, 16 nt, Homo sapiens
gacaaccucauuuuaa

SEQ ID NO: 812807 - RNA, 17 nt, Homo sapiens
gacaacugcacaugaaa

SEQ ID NO: 812808 - RNA, 16 nt, Homo sapiens
gacaacugugacugua

SEQ ID NO: 812809 - RNA, 19 nt, Homo sapiens
gacaagaaacacauucuua

SEQ ID NO: 812810 - RNA, 17 nt, Homo sapiens
gacaagaauaauucaau

SEQ ID NO: 812811 - RNA, 16 nt, Homo sapiens
gacaagacacugagga

SEQ ID NO: 812812 - RNA, 20 nt, Homo sapiens
gacaagacccccagcacuug

SEQ ID NO: 812813 - RNA, 22 nt, Homo sapiens
gacaagccaacuuguaaauaca

SEQ ID NO: 812814 - RNA, 11 nt, Homo sapiens
gacaagccauc

SEQ ID NO: 812815 - RNA, 14 nt, Homo sapiens
gacaaggugcuaac

SEQ ID NO: 812816 - RNA, 19 nt, Homo sapiens
gacaaguauuaauaguuca

SEQ ID NO: 812817 - RNA, 21 nt, Homo sapiens
gacaagugacuguaucugugu

SEQ ID NO: 812818 - RNA, 15 nt, Homo sapiens
gacaauaaaauggaa

SEQ ID NO: 812819 - RNA, 20 nt, Homo sapiens
gacaauaaagauauuuccaa

SEQ ID NO: 812820 - RNA, 19 nt, Homo sapiens
gacaauaaauuugaugaau

SEQ ID NO: 812821 - RNA, 13 nt, Homo sapiens
gacaaucacuaca

SEQ ID NO: 812822 - RNA, 18 nt, Homo sapiens
gacaaucacuacaaguca

SEQ ID NO: 812823 - RNA, 23 nt, Homo sapiens
gacaaugaaaguuugcacuguau

SEQ ID NO: 812824 - RNA, 22 nt, Homo sapiens
gacaaugcugagguuaugaaca

SEQ ID NO: 812825 - RNA, 14 nt, Homo sapiens
gacacaauccucaa

SEQ ID NO: 812826 - RNA, 19 nt, Homo sapiens
gacacauagaaaacaauca

SEQ ID NO: 812827 - RNA, 13 nt, Homo sapiens
gacacauaugcac

SEQ ID NO: 812828 - RNA, 21 nt, Homo sapiens
gacacauuaaugauaaacuca

SEQ ID NO: 812829 - RNA, 17 nt, Homo sapiens
gacaccaguggugcguu

SEQ ID NO: 812830 - RNA, 16 nt, Homo sapiens
gacaccuuuagguucu

SEQ ID NO: 812831 - RNA, 15 nt, Homo sapiens
gacacuaucacucau

SEQ ID NO: 812832 - RNA, 20 nt, Homo sapiens
gacacuauuuaucugugcaa

SEQ ID NO: 812833 - RNA, 21 nt, Homo sapiens
gacacuauuuaucugugcaaa

SEQ ID NO: 812834 - RNA, 20 nt, Homo sapiens
gacacugaggagauacugaa

SEQ ID NO: 812835 - RNA, 15 nt, Homo sapiens
gacacugcaaaggcg

SEQ ID NO: 812836 - RNA, 13 nt, Homo sapiens
gacacugcuuuaa

SEQ ID NO: 812837 - RNA, 12 nt, Homo sapiens
gacacugucacu

SEQ ID NO: 812838 - RNA, 23 nt, Homo sapiens
gacacuuaguuauuuaccaaagc

SEQ ID NO: 812839 - RNA, 20 nt, Homo sapiens
gacacuugccuucuucaccc

SEQ ID NO: 812840 - RNA, 17 nt, Homo sapiens
gacacuuuaauuaccaa

SEQ ID NO: 812841 - RNA, 15 nt, Homo sapiens
gacagaaagagacag

SEQ ID NO: 812842 - RNA, 18 nt, Homo sapiens
gacagaaggaacacugcu

SEQ ID NO: 812843 - RNA, 21 nt, Homo sapiens
gacagaaggaacacugcuuga

SEQ ID NO: 812844 - RNA, 23 nt, Homo sapiens
gacagaauaaugaauggacucaa

SEQ ID NO: 812845 - RNA, 16 nt, Homo sapiens
gacagaauauguuuca

SEQ ID NO: 812846 - RNA, 13 nt, Homo sapiens
gacagaauguguu

SEQ ID NO: 812847 - RNA, 20 nt, Homo sapiens
gacagaauuaggaccugguu

SEQ ID NO: 812848 - RNA, 11 nt, Homo sapiens
gacagaauucu

SEQ ID NO: 812849 - RNA, 17 nt, Homo sapiens
gacagacagagaaggca

SEQ ID NO: 812850 - RNA, 17 nt, Homo sapiens
gacagacaggcucuuag

SEQ ID NO: 812851 - RNA, 14 nt, Homo sapiens
gacagacauacauu

SEQ ID NO: 812852 - RNA, 15 nt, Homo sapiens
gacagacccucugcc

SEQ ID NO: 812853 - RNA, 23 nt, Homo sapiens
gacagagcaagaccccaucucaa

SEQ ID NO: 812854 - RNA, 16 nt, Homo sapiens
gacagagcgagacucc

SEQ ID NO: 812855 - RNA, 22 nt, Homo sapiens
gacagagggcucaccucuugcc

SEQ ID NO: 812856 - RNA, 23 nt, Homo sapiens
gacagagugagacccugucucaa

SEQ ID NO: 812857 - RNA, 13 nt, Homo sapiens
gacagagugagug

SEQ ID NO: 812858 - RNA, 17 nt, Homo sapiens
gacagaugaaugccgug

SEQ ID NO: 812859 - RNA, 18 nt, Homo sapiens
gacagauggaaaagggag

SEQ ID NO: 812860 - RNA, 13 nt, Homo sapiens
gacagauuuccau

SEQ ID NO: 812861 - RNA, 12 nt, Homo sapiens
gacagcaaguga

SEQ ID NO: 812862 - RNA, 22 nt, Homo sapiens
gacagccagagccugucuuuca

SEQ ID NO: 812863 - RNA, 14 nt, Homo sapiens
gacagccugaguca

SEQ ID NO: 812864 - RNA, 13 nt, Homo sapiens
gacagccuggcac

SEQ ID NO: 812865 - RNA, 21 nt, Homo sapiens
gcuuaacuccccacugccugu

SEQ ID NO: 812866 - RNA, 17 nt, Homo sapiens
gcuuaagugagcagaac

SEQ ID NO: 812867 - RNA, 17 nt, Homo sapiens
gcuuaaugcuacaugug

SEQ ID NO: 812868 - RNA, 12 nt, Homo sapiens
gcuuacaggaag

SEQ ID NO: 812869 - RNA, 12 nt, Homo sapiens
gcuuacauugaa

SEQ ID NO: 812870 - RNA, 13 nt, Homo sapiens
gcuuaccugacac

SEQ ID NO: 812871 - RNA, 15 nt, Homo sapiens
gcuuaccugaucuca

SEQ ID NO: 812872 - RNA, 20 nt, Homo sapiens
gcuuacuguugcuuuaguca

SEQ ID NO: 812873 - RNA, 20 nt, Homo sapiens
gcuuagacuucgacucagga

SEQ ID NO: 812874 - RNA, 18 nt, Homo sapiens
gcuuaggccucucugccu

SEQ ID NO: 812875 - RNA, 15 nt, Homo sapiens
gcuuaguaacuagug

SEQ ID NO: 812876 - RNA, 16 nt, Homo sapiens
gcuuauauuaagcaaa

SEQ ID NO: 812877 - RNA, 16 nt, Homo sapiens
gcuuauauuucuucgc

SEQ ID NO: 812878 - RNA, 12 nt, Homo sapiens
gcuuaugauuca

SEQ ID NO: 812879 - RNA, 17 nt, Homo sapiens
gcuuaugccugccucuu

SEQ ID NO: 812880 - RNA, 15 nt, Homo sapiens
gcuuauggauucaua

SEQ ID NO: 812881 - RNA, 18 nt, Homo sapiens
gcuuauuuuuuucuacau

SEQ ID NO: 812882 - RNA, 15 nt, Homo sapiens
gcuucaaggcuucca

SEQ ID NO: 812883 - RNA, 14 nt, Homo sapiens
gcuucaaguggcag

SEQ ID NO: 812884 - RNA, 14 nt, Homo sapiens
gcuucaaucacugu

SEQ ID NO: 812885 - RNA, 21 nt, Homo sapiens
gcuucacaguagagccagcuu

SEQ ID NO: 812886 - RNA, 21 nt, Homo sapiens
gcuucaccagagcauuuccaa

SEQ ID NO: 812887 - RNA, 12 nt, Homo sapiens
gcuucaccaguc

SEQ ID NO: 812888 - RNA, 17 nt, Homo sapiens
gcuucaccagucugucu

SEQ ID NO: 812889 - RNA, 19 nt, Homo sapiens
gcuucaccccugcacuuca

SEQ ID NO: 812890 - RNA, 15 nt, Homo sapiens
gcuucagaugaccuc

SEQ ID NO: 812891 - RNA, 13 nt, Homo sapiens
gcuucaguguuuu

SEQ ID NO: 812892 - RNA, 20 nt, Homo sapiens
gcuuccaacaaggacagccc

SEQ ID NO: 812893 - RNA, 18 nt, Homo sapiens
gcuuccacaaaauuagaa

SEQ ID NO: 812894 - RNA, 14 nt, Homo sapiens
gcuuccagcaguau

SEQ ID NO: 812895 - RNA, 11 nt, Homo sapiens
gcuuccaugau

SEQ ID NO: 812896 - RNA, 12 nt, Homo sapiens
gcuuccuaacug

SEQ ID NO: 812897 - RNA, 12 nt, Homo sapiens
gcuuccucaguu

SEQ ID NO: 812898 - RNA, 17 nt, Homo sapiens
gcuuccuggguccugcc

SEQ ID NO: 812899 - RNA, 14 nt, Homo sapiens
gcuucgaaguauuc

SEQ ID NO: 812900 - RNA, 15 nt, Homo sapiens
gcuucgacuacugcu

SEQ ID NO: 812901 - RNA, 14 nt, Homo sapiens
gcuucuaguuugca

SEQ ID NO: 812902 - RNA, 19 nt, Homo sapiens
gcuucuaguuugcaacuuc

SEQ ID NO: 812903 - RNA, 22 nt, Homo sapiens
gcuucuccuucuccuucccauu

SEQ ID NO: 812904 - RNA, 12 nt, Homo sapiens
gcuucucuccac

SEQ ID NO: 812905 - RNA, 18 nt, Homo sapiens
gcuucucugacuucugcc

SEQ ID NO: 812906 - RNA, 21 nt, Homo sapiens
gcuucugcaccaacucaccug

SEQ ID NO: 812907 - RNA, 16 nt, Homo sapiens
gcuucuggagcccuug

SEQ ID NO: 812908 - RNA, 18 nt, Homo sapiens
gcuucugggccacucagg

SEQ ID NO: 812909 - RNA, 19 nt, Homo sapiens
gcuucuguaguacuccuua

SEQ ID NO: 812910 - RNA, 12 nt, Homo sapiens
gcuucugugaug

SEQ ID NO: 812911 - RNA, 13 nt, Homo sapiens
gcuucuuggagcu

SEQ ID NO: 812912 - RNA, 13 nt, Homo sapiens
gcuugaagccaaa

SEQ ID NO: 812913 - RNA, 14 nt, Homo sapiens
gcuugaagccaaag

SEQ ID NO: 812914 - RNA, 14 nt, Homo sapiens
gcuugacaacaucu

SEQ ID NO: 812915 - RNA, 15 nt, Homo sapiens
gcuugacaacaucug

SEQ ID NO: 812916 - RNA, 21 nt, Homo sapiens
gcuugagaauccucuccuuuc

SEQ ID NO: 812917 - RNA, 14 nt, Homo sapiens
gcuugcacagccaa

SEQ ID NO: 812918 - RNA, 21 nt, Homo sapiens
gcuugccccacccaacaagcc

SEQ ID NO: 812919 - RNA, 19 nt, Homo sapiens
gcuugcugguagcacuugc

SEQ ID NO: 812920 - RNA, 13 nt, Homo sapiens
gcuuggaaaggac

SEQ ID NO: 812921 - RNA, 17 nt, Homo sapiens
gcuuggaaaggaccagu

SEQ ID NO: 812922 - RNA, 14 nt, Homo sapiens
gcuugggcauugaa

SEQ ID NO: 812923 - RNA, 19 nt, Homo sapiens
gcuugggcccugcacagau

SEQ ID NO: 812924 - RNA, 16 nt, Homo sapiens
gcuugguggccuggga

SEQ ID NO: 812925 - RNA, 17 nt, Homo sapiens
gcuugguggccugggau

SEQ ID NO: 812926 - RNA, 16 nt, Homo sapiens
gcuuguaucaacacug

SEQ ID NO: 812927 - RNA, 16 nt, Homo sapiens
gcuugucauuccagag

SEQ ID NO: 812928 - RNA, 20 nt, Homo sapiens
gcuuguccugcucucuucag

SEQ ID NO: 812929 - RNA, 21 nt, Homo sapiens
gcuuguuuacagcacuacucu

SEQ ID NO: 812930 - RNA, 17 nt, Homo sapiens
gcuuuaaaugucugcau

SEQ ID NO: 812931 - RNA, 14 nt, Homo sapiens
gcuuuagcauuauu

SEQ ID NO: 812932 - RNA, 11 nt, Homo sapiens
gcuuuaugcaa

SEQ ID NO: 812933 - RNA, 14 nt, Homo sapiens
gcuuuaugcaaaua

SEQ ID NO: 812934 - RNA, 20 nt, Homo sapiens
gcuuuauuuuuuaaguauuu

SEQ ID NO: 812935 - RNA, 15 nt, Homo sapiens
gcuuucagcacucac

SEQ ID NO: 812936 - RNA, 20 nt, Homo sapiens
gcuuuccacauuugucacag

SEQ ID NO: 812937 - RNA, 15 nt, Homo sapiens
gcuuucccacuuccc

SEQ ID NO: 812938 - RNA, 14 nt, Homo sapiens
gcuuuccucaaaaa

SEQ ID NO: 812939 - RNA, 21 nt, Homo sapiens
gcuuuccuggucccucacccc

SEQ ID NO: 812940 - RNA, 18 nt, Homo sapiens
gcuuucuaaaguuaccug

SEQ ID NO: 812941 - RNA, 14 nt, Homo sapiens
gcuuucuuucacaa

SEQ ID NO: 812942 - RNA, 18 nt, Homo sapiens
gcuuugaaagaagcaaga

SEQ ID NO: 812943 - RNA, 14 nt, Homo sapiens
gcuuugaaugcaga

SEQ ID NO: 812944 - RNA, 19 nt, Homo sapiens
gcuuugaaugcggcccaac

SEQ ID NO: 812945 - RNA, 15 nt, Homo sapiens
gcuuugcacuucaaa

SEQ ID NO: 812946 - RNA, 16 nt, Homo sapiens
gcuuugcauguauuag

SEQ ID NO: 812947 - RNA, 16 nt, Homo sapiens
gcuuugcuacaaauuu

SEQ ID NO: 812948 - RNA, 20 nt, Homo sapiens
gcuuuggcugagaccuggga

SEQ ID NO: 812949 - RNA, 21 nt, Homo sapiens
gcuuuguuucuuucauaugaa

SEQ ID NO: 812950 - RNA, 19 nt, Homo sapiens
gcuuuuaagaaacacaggg

SEQ ID NO: 812951 - RNA, 15 nt, Homo sapiens
gcuuuuacuaucugu

SEQ ID NO: 812952 - RNA, 21 nt, Homo sapiens
gcuuuuaugauauauauaugc

SEQ ID NO: 812953 - RNA, 15 nt, Homo sapiens
gcuuuucauuucuca

SEQ ID NO: 812954 - RNA, 13 nt, Homo sapiens
gcuuuucuguauu

SEQ ID NO: 812955 - RNA, 19 nt, Homo sapiens
gcuuuucuuuuuuaauuuc

SEQ ID NO: 812956 - RNA, 19 nt, Homo sapiens
gcuuuugcauuaaucuaag

SEQ ID NO: 812957 - RNA, 19 nt, Homo sapiens
gcuuuuggucucccuggga

SEQ ID NO: 812958 - RNA, 18 nt, Homo sapiens
ggaaaaacaaaugccaua

SEQ ID NO: 812959 - RNA, 19 nt, Homo sapiens
ggaaaaacaaaugccauau

SEQ ID NO: 812960 - RNA, 17 nt, Homo sapiens
ggaaaaacaacaucauu

SEQ ID NO: 812961 - RNA, 22 nt, Homo sapiens
ggaaaaauaaucaaaagcuauu

SEQ ID NO: 812962 - RNA, 13 nt, Homo sapiens
ggaaaacacugcc

SEQ ID NO: 812963 - RNA, 15 nt, Homo sapiens
ggaaaacagaccugu

SEQ ID NO: 812964 - RNA, 22 nt, Homo sapiens
ggaaaacgaagcucauucccaa

SEQ ID NO: 812965 - RNA, 13 nt, Homo sapiens
ggaaaacuacuga

SEQ ID NO: 812966 - RNA, 17 nt, Homo sapiens
ggaaaagaaauugcaug

SEQ ID NO: 812967 - RNA, 21 nt, Homo sapiens
ggaaaagaaauugcaugcagu

SEQ ID NO: 812968 - RNA, 13 nt, Homo sapiens
ggaaaagcaaaac

SEQ ID NO: 812969 - RNA, 19 nt, Homo sapiens
ggaaaagcaaaacuguagg

SEQ ID NO: 812970 - RNA, 13 nt, Homo sapiens
ggaaaagcaagaa

SEQ ID NO: 812971 - RNA, 21 nt, Homo sapiens
ggaaaagcauuuuucaauaua

SEQ ID NO: 812972 - RNA, 17 nt, Homo sapiens
ggaaaaggggcuccuug

SEQ ID NO: 812973 - RNA, 20 nt, Homo sapiens
ggaaaaguugaugguauuca

SEQ ID NO: 812974 - RNA, 18 nt, Homo sapiens
ggaaaaucacuugccaaa

SEQ ID NO: 812975 - RNA, 19 nt, Homo sapiens
ggaaaaugccuccauggca

SEQ ID NO: 812976 - RNA, 19 nt, Homo sapiens
ggaaaauggagccaugaca

SEQ ID NO: 812977 - RNA, 21 nt, Homo sapiens
ggaaaauggagccaugacaag

SEQ ID NO: 812978 - RNA, 14 nt, Homo sapiens
ggaaaauguauuua

SEQ ID NO: 812979 - RNA, 17 nt, Homo sapiens
ggaaaauuucacauuaa

SEQ ID NO: 812980 - RNA, 19 nt, Homo sapiens
ggaaacaaccaugucauuu

SEQ ID NO: 812981 - RNA, 22 nt, Homo sapiens
ggcaggcucacugccaggccag

SEQ ID NO: 812982 - RNA, 19 nt, Homo sapiens
ggcagggagugggagccaa

SEQ ID NO: 812983 - RNA, 15 nt, Homo sapiens
ggcagggcugugcuu

SEQ ID NO: 812984 - RNA, 12 nt, Homo sapiens
ggcagggguccu

SEQ ID NO: 812985 - RNA, 17 nt, Homo sapiens
ggcagggugagaagcua

SEQ ID NO: 812986 - RNA, 23 nt, Homo sapiens
ggcagguaggucggcacuuggac

SEQ ID NO: 812987 - RNA, 21 nt, Homo sapiens
ggcaggugccaugucugggaa

SEQ ID NO: 812988 - RNA, 16 nt, Homo sapiens
ggcaggugucauauga

SEQ ID NO: 812989 - RNA, 23 nt, Homo sapiens
ggcagguguugggaccugcugcu

SEQ ID NO: 812990 - RNA, 19 nt, Homo sapiens
ggcagucucugcccaaaca

SEQ ID NO: 812991 - RNA, 14 nt, Homo sapiens
ggcagugcauguga

SEQ ID NO: 812992 - RNA, 19 nt, Homo sapiens
ggcaguguggcagugacca

SEQ ID NO: 812993 - RNA, 20 nt, Homo sapiens
ggcaguguggcagugaccau

SEQ ID NO: 812994 - RNA, 17 nt, Homo sapiens
ggcaguuuaaagcacaa

SEQ ID NO: 812995 - RNA, 16 nt, Homo sapiens
ggcauaauagucaauu

SEQ ID NO: 812996 - RNA, 16 nt, Homo sapiens
ggcauacagacugggg

SEQ ID NO: 812997 - RNA, 17 nt, Homo sapiens
ggcauagcucuggggug

SEQ ID NO: 812998 - RNA, 24 nt, Homo sapiens
ggcauaggcugacuuuugcagaug

SEQ ID NO: 812999 - RNA, 15 nt, Homo sapiens
ggcauauacagugaa

SEQ ID NO: 813000 - RNA, 11 nt, Homo sapiens
ggcauaugcac

SEQ ID NO: 813001 - RNA, 13 nt, Homo sapiens
ggcauaugcacag

SEQ ID NO: 813002 - RNA, 22 nt, Homo sapiens
ggcaucaagggagacaccagug

SEQ ID NO: 813003 - RNA, 22 nt, Homo sapiens
ggcaucaugcaugucaaacaug

SEQ ID NO: 813004 - RNA, 12 nt, Homo sapiens
ggcaucauggaa

SEQ ID NO: 813005 - RNA, 22 nt, Homo sapiens
ggcauccacccagugcugccau

SEQ ID NO: 813006 - RNA, 16 nt, Homo sapiens
ggcaucuugcuggcua

SEQ ID NO: 813007 - RNA, 19 nt, Homo sapiens
ggcaugaagcugcauauga

SEQ ID NO: 813008 - RNA, 18 nt, Homo sapiens
ggcaugguguguggugcu

SEQ ID NO: 813009 - RNA, 12 nt, Homo sapiens
ggcauguaugca

SEQ ID NO: 813010 - RNA, 15 nt, Homo sapiens
ggcaugucuccucaa

SEQ ID NO: 813011 - RNA, 14 nt, Homo sapiens
ggcaugugcuguga

SEQ ID NO: 813012 - RNA, 21 nt, Homo sapiens
ggcauugugagaauguaacuu

SEQ ID NO: 813013 - RNA, 17 nt, Homo sapiens
ggccaacggcaacagca

SEQ ID NO: 813014 - RNA, 17 nt, Homo sapiens
ggccaacguggaccugc

SEQ ID NO: 813015 - RNA, 20 nt, Homo sapiens
ggccaauaaauaugauguua

SEQ ID NO: 813016 - RNA, 22 nt, Homo sapiens
ggccaaugcuuauacccaguga

SEQ ID NO: 813017 - RNA, 19 nt, Homo sapiens
ggccacaacagggcauuuu

SEQ ID NO: 813018 - RNA, 10 nt, Homo sapiens
ggccacagac

SEQ ID NO: 813019 - RNA, 14 nt, Homo sapiens
ggccaccaggcugg

SEQ ID NO: 813020 - RNA, 20 nt, Homo sapiens
ggccacccgcccacagccag

SEQ ID NO: 813021 - RNA, 17 nt, Homo sapiens
ggccaccucuugcuugg

SEQ ID NO: 813022 - RNA, 15 nt, Homo sapiens
ggccacgcagccagg

SEQ ID NO: 813023 - RNA, 18 nt, Homo sapiens
ggccacggagcaguucag

SEQ ID NO: 813024 - RNA, 20 nt, Homo sapiens
ggccacuugaguuggggcca

SEQ ID NO: 813025 - RNA, 18 nt, Homo sapiens
ggccagaagagcuuguca

SEQ ID NO: 813026 - RNA, 22 nt, Homo sapiens
ggccagacuggaagacacuuca

SEQ ID NO: 813027 - RNA, 19 nt, Homo sapiens
ggccagagccgggguucca

SEQ ID NO: 813028 - RNA, 19 nt, Homo sapiens
ggccagcaagcucuucacu

SEQ ID NO: 813029 - RNA, 16 nt, Homo sapiens
ggccagcaccaucucu

SEQ ID NO: 813030 - RNA, 15 nt, Homo sapiens
ggccagcacuuccau

SEQ ID NO: 813031 - RNA, 12 nt, Homo sapiens
ggccagcccgga

SEQ ID NO: 813032 - RNA, 23 nt, Homo sapiens
ggccagcccugcagcccaaaacc

SEQ ID NO: 813033 - RNA, 15 nt, Homo sapiens
ggccagcgggcacag

SEQ ID NO: 813034 - RNA, 21 nt, Homo sapiens
ggccagcguggcgcaguggcc

SEQ ID NO: 813035 - RNA, 14 nt, Homo sapiens
ggccaggcacugug

SEQ ID NO: 813036 - RNA, 21 nt, Homo sapiens
ggccaggcccgcaccccggcc

SEQ ID NO: 813037 - RNA, 17 nt, Homo sapiens
ggccagggaaagcccgu

SEQ ID NO: 813038 - RNA, 24 nt, Homo sapiens
ggccagggaaagcccgugucaaug

SEQ ID NO: 813039 - RNA, 22 nt, Homo sapiens
ggccagggugggaagagaagaa

SEQ ID NO: 813040 - RNA, 18 nt, Homo sapiens
ggccagucaggcugcaga

SEQ ID NO: 813041 - RNA, 22 nt, Homo sapiens
ggccagugggaccccacagagu

SEQ ID NO: 813042 - RNA, 14 nt, Homo sapiens
ggccauacugccuu

SEQ ID NO: 813043 - RNA, 23 nt, Homo sapiens
ggccaucugacugccaagccaga

SEQ ID NO: 813044 - RNA, 18 nt, Homo sapiens
ggcccaaagaaagagcua

SEQ ID NO: 813045 - RNA, 16 nt, Homo sapiens
ggcccaggguguuugc

SEQ ID NO: 813046 - RNA, 17 nt, Homo sapiens
ggcccagugcauaugca

SEQ ID NO: 813047 - RNA, 13 nt, Homo sapiens
ggcccagugcaug

SEQ ID NO: 813048 - RNA, 12 nt, Homo sapiens
ggcccaugcaau

SEQ ID NO: 813049 - RNA, 22 nt, Homo sapiens
ggcccaugcaauuuuauuaaau

SEQ ID NO: 813050 - RNA, 23 nt, Homo sapiens
ggcccauucagagcuauggugcu

SEQ ID NO: 813051 - RNA, 14 nt, Homo sapiens
ggccccauccucau

SEQ ID NO: 813052 - RNA, 14 nt, Homo sapiens
ggccccaucuggau

SEQ ID NO: 813053 - RNA, 14 nt, Homo sapiens
ggcccccaugcaag

SEQ ID NO: 813054 - RNA, 23 nt, Homo sapiens
ggcccccgucagggagaggucac

SEQ ID NO: 813055 - RNA, 17 nt, Homo sapiens
ggccccggguccaggag

SEQ ID NO: 813056 - RNA, 17 nt, Homo sapiens
ggccccuaggugcccag

SEQ ID NO: 813057 - RNA, 14 nt, Homo sapiens
ggccccuccaucca

SEQ ID NO: 813058 - RNA, 22 nt, Homo sapiens
ggcccucccaucuccccgcuga

SEQ ID NO: 813059 - RNA, 16 nt, Homo sapiens
ggcccugcauuggccu

SEQ ID NO: 813060 - RNA, 16 nt, Homo sapiens
ggcccugcugaagcug

SEQ ID NO: 813061 - RNA, 15 nt, Homo sapiens
ggcccugcugaguca

SEQ ID NO: 813062 - RNA, 20 nt, Homo sapiens
ggcccugguuccugcugucc

SEQ ID NO: 813063 - RNA, 15 nt, Homo sapiens
ggcccugugccuugg

SEQ ID NO: 813064 - RNA, 18 nt, Homo sapiens
ggcccuguuccccaagga

SEQ ID NO: 813065 - RNA, 20 nt, Homo sapiens
ggcccuuaccuuuccugaug

SEQ ID NO: 813066 - RNA, 19 nt, Homo sapiens
ggcccuuuggcuucugauu

SEQ ID NO: 813067 - RNA, 13 nt, Homo sapiens
ggccgagagcaga

SEQ ID NO: 813068 - RNA, 19 nt, Homo sapiens
ggccgccgcugacccuggg

SEQ ID NO: 813069 - RNA, 15 nt, Homo sapiens
ggccgcugggguccg

SEQ ID NO: 813070 - RNA, 12 nt, Homo sapiens
ggccgucugugu

SEQ ID NO: 813071 - RNA, 19 nt, Homo sapiens
ggccuaaauaaaugagcug

SEQ ID NO: 813072 - RNA, 15 nt, Homo sapiens
ggccuagcgaucucu

SEQ ID NO: 813073 - RNA, 14 nt, Homo sapiens
ggccuauuccagga

SEQ ID NO: 813074 - RNA, 13 nt, Homo sapiens
ggccucaagaaca

SEQ ID NO: 813075 - RNA, 15 nt, Homo sapiens
ggccucaccugcugg

SEQ ID NO: 813076 - RNA, 16 nt, Homo sapiens
ggccucaccugcugga

SEQ ID NO: 813077 - RNA, 18 nt, Homo sapiens
ggccucagggcgcucaga

SEQ ID NO: 813078 - RNA, 23 nt, Homo sapiens
ggccucaguuucauuaacuggug

SEQ ID NO: 813079 - RNA, 17 nt, Homo sapiens
ggccucaucuccuuuau

SEQ ID NO: 813080 - RNA, 17 nt, Homo sapiens
ggccuccugucccucau

SEQ ID NO: 813081 - RNA, 19 nt, Homo sapiens
ggccucucugccugggaug

SEQ ID NO: 813082 - RNA, 16 nt, Homo sapiens
ggccugacgcauucuc

SEQ ID NO: 813083 - RNA, 14 nt, Homo sapiens
ggccugacucucag

SEQ ID NO: 813084 - RNA, 16 nt, Homo sapiens
ggccugacugcucaga

SEQ ID NO: 813085 - RNA, 21 nt, Homo sapiens
ggccugagaugcaggugaugc

SEQ ID NO: 813086 - RNA, 22 nt, Homo sapiens
ggccugaggugugugccacuca

SEQ ID NO: 813087 - RNA, 23 nt, Homo sapiens
ggccugccuugaagccacugaag

SEQ ID NO: 813088 - RNA, 19 nt, Homo sapiens
ggccugcugccagugcagc

SEQ ID NO: 813089 - RNA, 23 nt, Homo sapiens
ggccuggaccugcccugggccac

SEQ ID NO: 813090 - RNA, 17 nt, Homo sapiens
ggccuggcaagugggug

SEQ ID NO: 813091 - RNA, 18 nt, Homo sapiens
ggccugggaucuggcaca

SEQ ID NO: 813092 - RNA, 24 nt, Homo sapiens
ggccuguccacccugccaagacuc

SEQ ID NO: 813093 - RNA, 11 nt, Homo sapiens
ggccuguggug

SEQ ID NO: 813094 - RNA, 15 nt, Homo sapiens
ggccugugugugugc

SEQ ID NO: 813095 - RNA, 16 nt, Homo sapiens
guuuuuuauuaugcau

SEQ ID NO: 813096 - RNA, 19 nt, Homo sapiens
guuuuuuauuaugcauuau

SEQ ID NO: 813097 - RNA, 20 nt, Homo sapiens
guuuuuucaucauaacauaa

SEQ ID NO: 813098 - RNA, 17 nt, Homo sapiens
guuuuuuugcagaauua

SEQ ID NO: 813099 - RNA, 23 nt, Homo sapiens
guuuuuuuuuuccacuuagaaau

SEQ ID NO: 813100 - RNA, 23 nt, Homo sapiens
guuuuuuuuuuuuuuaacaugua

SEQ ID NO: 813101 - RNA, 21 nt, Homo sapiens
uaaaaaaaaaacuucauucua

SEQ ID NO: 813102 - RNA, 22 nt, Homo sapiens
uaaaaaaaaaauccauuuuaca

SEQ ID NO: 813103 - RNA, 23 nt, Homo sapiens
uaaaaaaaaugauaaggcucuga

SEQ ID NO: 813104 - RNA, 19 nt, Homo sapiens
uaaaaaaauaaaaaagauc

SEQ ID NO: 813105 - RNA, 19 nt, Homo sapiens
uaaaaaaauacaugcaucu

SEQ ID NO: 813106 - RNA, 21 nt, Homo sapiens
uaaaaaaauuagugaguauaa

SEQ ID NO: 813107 - RNA, 13 nt, Homo sapiens
uaaaaaagcauac

SEQ ID NO: 813108 - RNA, 15 nt, Homo sapiens
uaaaaaagcauauau

SEQ ID NO: 813109 - RNA, 13 nt, Homo sapiens
uaaaaaauacugu

SEQ ID NO: 813110 - RNA, 18 nt, Homo sapiens
uaaaaaauagcagcuuua

SEQ ID NO: 813111 - RNA, 12 nt, Homo sapiens
uaaaaacaaaca

SEQ ID NO: 813112 - RNA, 17 nt, Homo sapiens
uaaaaacacuaccucuu

SEQ ID NO: 813113 - RNA, 14 nt, Homo sapiens
uaaaaacauaacau

SEQ ID NO: 813114 - RNA, 12 nt, Homo sapiens
uaaaaacuaaaa

SEQ ID NO: 813115 - RNA, 22 nt, Homo sapiens
uaaaaacuuccuucaaucuuca

SEQ ID NO: 813116 - RNA, 15 nt, Homo sapiens
uaaaaacuuguacua

SEQ ID NO: 813117 - RNA, 23 nt, Homo sapiens
uaaaaagaaauuuugccugccau

SEQ ID NO: 813118 - RNA, 12 nt, Homo sapiens
uaaaaaggccaa

SEQ ID NO: 813119 - RNA, 13 nt, Homo sapiens
uaaaaagugacac

SEQ ID NO: 813120 - RNA, 18 nt, Homo sapiens
uaaaaagugacacagcag

SEQ ID NO: 813121 - RNA, 19 nt, Homo sapiens
uaaaaagugacacagcagc

SEQ ID NO: 813122 - RNA, 19 nt, Homo sapiens
uaaaaaguuucuaaagugu

SEQ ID NO: 813123 - RNA, 17 nt, Homo sapiens
uaaaaauaaccaaaaaa

SEQ ID NO: 813124 - RNA, 15 nt, Homo sapiens
uaaaaauacaaaaau

SEQ ID NO: 813125 - RNA, 19 nt, Homo sapiens
uaaaaaucauugauuguca

SEQ ID NO: 813126 - RNA, 13 nt, Homo sapiens
uaaaaaucuccau

SEQ ID NO: 813127 - RNA, 16 nt, Homo sapiens
uaaaaaugagugcuua

SEQ ID NO: 813128 - RNA, 14 nt, Homo sapiens
uaaaaaugcugcuc

SEQ ID NO: 813129 - RNA, 11 nt, Homo sapiens
uaaaaauggaa

SEQ ID NO: 813130 - RNA, 23 nt, Homo sapiens
uaaaaauggcaggggguggaauu

SEQ ID NO: 813131 - RNA, 18 nt, Homo sapiens
uaaaaauggccauuugcu

SEQ ID NO: 813132 - RNA, 13 nt, Homo sapiens
uaaaaauguccug

SEQ ID NO: 813133 - RNA, 21 nt, Homo sapiens
uaaaaauuagcaugcugcuuu

SEQ ID NO: 813134 - RNA, 20 nt, Homo sapiens
uaaaaauucauaaccaaaga

SEQ ID NO: 813135 - RNA, 16 nt, Homo sapiens
uaaaaauugacaauga

SEQ ID NO: 813136 - RNA, 23 nt, Homo sapiens
uaaaaauugugaucagaccauaa

SEQ ID NO: 813137 - RNA, 16 nt, Homo sapiens
uaaaacaaaauuugac

SEQ ID NO: 813138 - RNA, 11 nt, Homo sapiens
uaaaacaaaca

SEQ ID NO: 813139 - RNA, 22 nt, Homo sapiens
uaaaacaauaaaugaaugaaua

SEQ ID NO: 813140 - RNA, 12 nt, Homo sapiens
uaaaacaauucu

SEQ ID NO: 813141 - RNA, 19 nt, Homo sapiens
uaaaacacaccuaagagaa

SEQ ID NO: 813142 - RNA, 17 nt, Homo sapiens
uaaaacagcagaagauu

SEQ ID NO: 813143 - RNA, 22 nt, Homo sapiens
uaaaacagguuauaacaguguu

SEQ ID NO: 813144 - RNA, 17 nt, Homo sapiens
uaaaacaugcuggugaa

SEQ ID NO: 813145 - RNA, 23 nt, Homo sapiens
uaaaacauuagucaguugcucau

SEQ ID NO: 813146 - RNA, 18 nt, Homo sapiens
uaaaacauuaugaguuuc

SEQ ID NO: 813147 - RNA, 20 nt, Homo sapiens
uaaaacauugaauuguagua

SEQ ID NO: 813148 - RNA, 15 nt, Homo sapiens
uaaaaccacagcagu

SEQ ID NO: 813149 - RNA, 21 nt, Homo sapiens
uaaaaccccaucucuacuaaa

SEQ ID NO: 813150 - RNA, 17 nt, Homo sapiens
uaaaaccugugugccau

SEQ ID NO: 813151 - RNA, 22 nt, Homo sapiens
uaaaaccuguucucuuuaauca

SEQ ID NO: 813152 - RNA, 20 nt, Homo sapiens
uaaaacuaaauguaauuuau

SEQ ID NO: 813153 - RNA, 15 nt, Homo sapiens
uuuggagagugcuau

SEQ ID NO: 813154 - RNA, 20 nt, Homo sapiens
uuuggagcacaaaauucaaa

SEQ ID NO: 813155 - RNA, 22 nt, Homo sapiens
uuuggaguaaauauauauguca

SEQ ID NO: 813156 - RNA, 19 nt, Homo sapiens
uuuggaguccccucaccuc

SEQ ID NO: 813157 - RNA, 16 nt, Homo sapiens
uuuggaugauugucau

SEQ ID NO: 813158 - RNA, 18 nt, Homo sapiens
uuuggauuacuauugcaa

SEQ ID NO: 813159 - RNA, 17 nt, Homo sapiens
uuuggauugacucugca

SEQ ID NO: 813160 - RNA, 12 nt, Homo sapiens
uuuggcaauuuc

SEQ ID NO: 813161 - RNA, 15 nt, Homo sapiens
uuuggcgaaucucaa

SEQ ID NO: 813162 - RNA, 23 nt, Homo sapiens
uuuggcgaccuccuuucaucaca

SEQ ID NO: 813163 - RNA, 18 nt, Homo sapiens
uuuggcuagguaucauuc

SEQ ID NO: 813164 - RNA, 18 nt, Homo sapiens
uuuggcuggaauuacaaa

SEQ ID NO: 813165 - RNA, 15 nt, Homo sapiens
uuuggcuugugggcu

SEQ ID NO: 813166 - RNA, 18 nt, Homo sapiens
uuuggcuuuaugugcaaa

SEQ ID NO: 813167 - RNA, 21 nt, Homo sapiens
uuugggagcacggacugucag

SEQ ID NO: 813168 - RNA, 15 nt, Homo sapiens
uuugggcaggucuga

SEQ ID NO: 813169 - RNA, 13 nt, Homo sapiens
uuugggccagaca

SEQ ID NO: 813170 - RNA, 17 nt, Homo sapiens
uuuggggacucauuuca

SEQ ID NO: 813171 - RNA, 15 nt, Homo sapiens
uuuggggagcagaga

SEQ ID NO: 813172 - RNA, 19 nt, Homo sapiens
uuugguaaaaaugcugcuc

SEQ ID NO: 813173 - RNA, 13 nt, Homo sapiens
uuugguaauguua

SEQ ID NO: 813174 - RNA, 16 nt, Homo sapiens
uuuggugaacuguugg

SEQ ID NO: 813175 - RNA, 17 nt, Homo sapiens
uuugguuuggaguacaa

SEQ ID NO: 813176 - RNA, 12 nt, Homo sapiens
uuuguaaccaua

SEQ ID NO: 813177 - RNA, 17 nt, Homo sapiens
uuuguaauacuuuacaa

SEQ ID NO: 813178 - RNA, 14 nt, Homo sapiens
uuuguaaugcugca

SEQ ID NO: 813179 - RNA, 15 nt, Homo sapiens
uuuguaaugcugcac

SEQ ID NO: 813180 - RNA, 18 nt, Homo sapiens
uuuguacaauuacuaaau

SEQ ID NO: 813181 - RNA, 20 nt, Homo sapiens
uuuguaccucuaaguacaua

SEQ ID NO: 813182 - RNA, 13 nt, Homo sapiens
uuuguagcacuga

SEQ ID NO: 813183 - RNA, 14 nt, Homo sapiens
uuuguagucuuguc

SEQ ID NO: 813184 - RNA, 19 nt, Homo sapiens
uuuguauaaaauagacaaa

SEQ ID NO: 813185 - RNA, 12 nt, Homo sapiens
uuugucagaaac

SEQ ID NO: 813186 - RNA, 20 nt, Homo sapiens
uuugucagcaucugaccauc

SEQ ID NO: 813187 - RNA, 21 nt, Homo sapiens
uuugucagggauuuagcccau

SEQ ID NO: 813188 - RNA, 21 nt, Homo sapiens
uuugucauauaagauucauau

SEQ ID NO: 813189 - RNA, 17 nt, Homo sapiens
uuuguccccacuuacag

SEQ ID NO: 813190 - RNA, 15 nt, Homo sapiens
uuugucuuauauaua

SEQ ID NO: 813191 - RNA, 13 nt, Homo sapiens
uuugucuugaaug

SEQ ID NO: 813192 - RNA, 22 nt, Homo sapiens
uuugucuuggcuuuucuuuggg

SEQ ID NO: 813193 - RNA, 23 nt, Homo sapiens
uuugugaaaugaaaacauguaau

SEQ ID NO: 813194 - RNA, 18 nt, Homo sapiens
uuuguggcaucuugccaa

SEQ ID NO: 813195 - RNA, 16 nt, Homo sapiens
uuuguuacuuccuuau

SEQ ID NO: 813196 - RNA, 14 nt, Homo sapiens
uuuguucaugaaua

SEQ ID NO: 813197 - RNA, 13 nt, Homo sapiens
uuuguuccaugag

SEQ ID NO: 813198 - RNA, 10 nt, Homo sapiens
uuuguuguuu

SEQ ID NO: 813199 - RNA, 13 nt, Homo sapiens
uuuguuuaacaaa

SEQ ID NO: 813200 - RNA, 18 nt, Homo sapiens
uuuguuucuuucauauga

SEQ ID NO: 813201 - RNA, 17 nt, Homo sapiens
uuuuaaaaacaaacaaa

SEQ ID NO: 813202 - RNA, 20 nt, Homo sapiens
uuuuaaaauaaaaauuuaau

SEQ ID NO: 813203 - RNA, 21 nt, Homo sapiens
uuuuaaagcauauuggugcua

SEQ ID NO: 813204 - RNA, 14 nt, Homo sapiens
uuuuaaaugacuug

SEQ ID NO: 813205 - RNA, 17 nt, Homo sapiens
uuuuaacucaccucuca

SEQ ID NO: 813206 - RNA, 14 nt, Homo sapiens
uuuuaaggagcugg

SEQ ID NO: 813207 - RNA, 13 nt, Homo sapiens
uuuuaaugaucuc

SEQ ID NO: 813208 - RNA, 17 nt, Homo sapiens
uuuuaaugcuauuugaa

SEQ ID NO: 813209 - RNA, 13 nt, Homo sapiens
uuuuaauguacaa

SEQ ID NO: 813210 - RNA, 21 nt, Homo sapiens
uaaauccauccauccaaaggc

SEQ ID NO: 813211 - RNA, 15 nt, Homo sapiens
uaaaucguccuccca

SEQ ID NO: 813212 - RNA, 12 nt, Homo sapiens
uaaaucuaugaa

SEQ ID NO: 813213 - RNA, 13 nt, Homo sapiens
uaaaucugugaug

SEQ ID NO: 813214 - RNA, 17 nt, Homo sapiens
uaaaucuuaagcaauau

SEQ ID NO: 813215 - RNA, 16 nt, Homo sapiens
uaaaucuuuucaauua

SEQ ID NO: 813216 - RNA, 21 nt, Homo sapiens
uaaaucuuuuugcuucuacuu

SEQ ID NO: 813217 - RNA, 11 nt, Homo sapiens
uaaaugaacua

SEQ ID NO: 813218 - RNA, 15 nt, Homo sapiens
uaaaugaacuaauga

SEQ ID NO: 813219 - RNA, 15 nt, Homo sapiens
uaaaugaagcagcuu

SEQ ID NO: 813220 - RNA, 19 nt, Homo sapiens
uaaaugacugucuuaucac

SEQ ID NO: 813221 - RNA, 18 nt, Homo sapiens
uaaaugagggcugcacau

SEQ ID NO: 813222 - RNA, 15 nt, Homo sapiens
uaaaugauacaguau

SEQ ID NO: 813223 - RNA, 15 nt, Homo sapiens
uaaaugaucacucca

SEQ ID NO: 813224 - RNA, 21 nt, Homo sapiens
uaaaugauucuuagugacuuu

SEQ ID NO: 813225 - RNA, 19 nt, Homo sapiens
uaaaugccaggccuggcaa

SEQ ID NO: 813226 - RNA, 24 nt, Homo sapiens
uaaaugcucgugugauuuccuaca

SEQ ID NO: 813227 - RNA, 22 nt, Homo sapiens
uaaaugcucuaacuggacauga

SEQ ID NO: 813228 - RNA, 21 nt, Homo sapiens
uaaaugcugucaacuaugaua

SEQ ID NO: 813229 - RNA, 20 nt, Homo sapiens
uaaauggcauggaguauagu

SEQ ID NO: 813230 - RNA, 19 nt, Homo sapiens
uaaauggcuuuugccacau

SEQ ID NO: 813231 - RNA, 24 nt, Homo sapiens
uaaauggcuuuugccacauacaua

SEQ ID NO: 813232 - RNA, 20 nt, Homo sapiens
uaaaugggucaugacaagau

SEQ ID NO: 813233 - RNA, 21 nt, Homo sapiens
uaaauguagcgacugucaaca

SEQ ID NO: 813234 - RNA, 20 nt, Homo sapiens
uaaauguaucuuauucacau

SEQ ID NO: 813235 - RNA, 22 nt, Homo sapiens
uaaaugucuuguuucccagauu

SEQ ID NO: 813236 - RNA, 16 nt, Homo sapiens
uaaaugugauucaccu

SEQ ID NO: 813237 - RNA, 11 nt, Homo sapiens
uaaaugugcag

SEQ ID NO: 813238 - RNA, 13 nt, Homo sapiens
uaaaugugcuuug

SEQ ID NO: 813239 - RNA, 12 nt, Homo sapiens
uaaauguugcuu

SEQ ID NO: 813240 - RNA, 18 nt, Homo sapiens
uaaauuauaucugugaau

SEQ ID NO: 813241 - RNA, 20 nt, Homo sapiens
uaaauuauuagagauuuucu

SEQ ID NO: 813242 - RNA, 20 nt, Homo sapiens
uaaauuauuaguuuacauca

SEQ ID NO: 813243 - RNA, 23 nt, Homo sapiens
uaaauuauuauuugacaacaauc

SEQ ID NO: 813244 - RNA, 22 nt, Homo sapiens
uaaauuauuuuaaaaacuaaaa

SEQ ID NO: 813245 - RNA, 11 nt, Homo sapiens
uaaauucauuu

SEQ ID NO: 813246 - RNA, 20 nt, Homo sapiens
uaaauuguuuuuacugauga

SEQ ID NO: 813247 - RNA, 18 nt, Homo sapiens
uaaauuuaaaaaucaaua

SEQ ID NO: 813248 - RNA, 16 nt, Homo sapiens
uaaauuuaaugcugcc

SEQ ID NO: 813249 - RNA, 13 nt, Homo sapiens
uaaauuuauuuca

SEQ ID NO: 813250 - RNA, 14 nt, Homo sapiens
uaaauuuguacuau

SEQ ID NO: 813251 - RNA, 20 nt, Homo sapiens
uaaauuuuaaaaaggaauuu

SEQ ID NO: 813252 - RNA, 18 nt, Homo sapiens
uaaauuuuauaucuugua

SEQ ID NO: 813253 - RNA, 21 nt, Homo sapiens
uaaauuuucaugaaugugcug

SEQ ID NO: 813254 - RNA, 17 nt, Homo sapiens
uaaauuuugaguucuac

SEQ ID NO: 813255 - RNA, 15 nt, Homo sapiens
uaacaaaauccucag

SEQ ID NO: 813256 - RNA, 19 nt, Homo sapiens
uaacaaacaagagaagcuu

SEQ ID NO: 813257 - RNA, 15 nt, Homo sapiens
uaacaaagaacaagc

SEQ ID NO: 813258 - RNA, 16 nt, Homo sapiens
uaacaaagaacaagca

SEQ ID NO: 813259 - RNA, 19 nt, Homo sapiens
uaacaaagcccuuauucuc

SEQ ID NO: 813260 - RNA, 21 nt, Homo sapiens
uaacaaagcccuuauucucuu

SEQ ID NO: 813261 - RNA, 20 nt, Homo sapiens
uaacaacaauaacacugucu

SEQ ID NO: 813262 - RNA, 13 nt, Homo sapiens
uaacaacuguggu

SEQ ID NO: 813263 - RNA, 20 nt, Homo sapiens
uaacaagggcugcaaugccc

SEQ ID NO: 813264 - RNA, 14 nt, Homo sapiens
uaacaaguggguga

SEQ ID NO: 813265 - RNA, 11 nt, Homo sapiens
uaacaaugaag

SEQ ID NO: 813266 - RNA, 13 nt, Homo sapiens
uaacaauugugua

SEQ ID NO: 813267 - RNA, 18 nt, Homo sapiens
uaacaauuguguagccuu

SEQ ID NO: 813268 - RNA, 13 nt, Homo sapiens
uaacacacuggcc

SEQ ID NO: 813269 - RNA, 14 nt, Homo sapiens
gccaccaacauaaa

SEQ ID NO: 813270 - RNA, 16 nt, Homo sapiens
gccaccacgucugcca

SEQ ID NO: 813271 - RNA, 18 nt, Homo sapiens
gccaccacucaagcaaca

SEQ ID NO: 813272 - RNA, 18 nt, Homo sapiens
gccaccagaccaugggcc

SEQ ID NO: 813273 - RNA, 10 nt, Homo sapiens
gccaccagag

SEQ ID NO: 813274 - RNA, 17 nt, Homo sapiens
gccaccaucauagcuca

SEQ ID NO: 813275 - RNA, 14 nt, Homo sapiens
gccaccaucuggag

SEQ ID NO: 813276 - RNA, 16 nt, Homo sapiens
gccaccucaccaagga

SEQ ID NO: 813277 - RNA, 13 nt, Homo sapiens
gccaccucagggc

SEQ ID NO: 813278 - RNA, 15 nt, Homo sapiens
gccacgcacugggcc

SEQ ID NO: 813279 - RNA, 17 nt, Homo sapiens
gccacggccuugugucu

SEQ ID NO: 813280 - RNA, 18 nt, Homo sapiens
gccacuacaacagaauuu

SEQ ID NO: 813281 - RNA, 14 nt, Homo sapiens
gccacucaaaggaa

SEQ ID NO: 813282 - RNA, 20 nt, Homo sapiens
gccacuccagaccccuggcu

SEQ ID NO: 813283 - RNA, 21 nt, Homo sapiens
gccacuccuggggucacucag

SEQ ID NO: 813284 - RNA, 14 nt, Homo sapiens
gccacugggcaccu

SEQ ID NO: 813285 - RNA, 16 nt, Homo sapiens
gccacuguggccagag

SEQ ID NO: 813286 - RNA, 14 nt, Homo sapiens
gccacuugacauuc

SEQ ID NO: 813287 - RNA, 16 nt, Homo sapiens
gccacuugacauuccu

SEQ ID NO: 813288 - RNA, 23 nt, Homo sapiens
gccacuugguuuuuggcucuuuc

SEQ ID NO: 813289 - RNA, 23 nt, Homo sapiens
gcuaaggaugguuuuaucuuccc

SEQ ID NO: 813290 - RNA, 19 nt, Homo sapiens
gcuaauaaacuguauuaaa

SEQ ID NO: 813291 - RNA, 14 nt, Homo sapiens
gcuaauaagugcuu

SEQ ID NO: 813292 - RNA, 18 nt, Homo sapiens
gcuaauucagugucacau

SEQ ID NO: 813293 - RNA, 20 nt, Homo sapiens
gcuaauuguacuaaucugag

SEQ ID NO: 813294 - RNA, 21 nt, Homo sapiens
gcuacaaauuuaugcauuuca

SEQ ID NO: 813295 - RNA, 20 nt, Homo sapiens
gcuacagaugguagaacuaa

SEQ ID NO: 813296 - RNA, 17 nt, Homo sapiens
gcuacauuccucagcug

SEQ ID NO: 813297 - RNA, 23 nt, Homo sapiens
gcuacauugacgagcaugagcug

SEQ ID NO: 813298 - RNA, 19 nt, Homo sapiens
gcuaccccauucucuagac

SEQ ID NO: 813299 - RNA, 13 nt, Homo sapiens
gcuaccccuuuga

SEQ ID NO: 813300 - RNA, 19 nt, Homo sapiens
gcuacccugaguucaucca

SEQ ID NO: 813301 - RNA, 14 nt, Homo sapiens
gcuaccucuucuau

SEQ ID NO: 813302 - RNA, 21 nt, Homo sapiens
gcuaccuguucuugggccuca

SEQ ID NO: 813303 - RNA, 22 nt, Homo sapiens
gcuaccuucucuacccaucucc

SEQ ID NO: 813304 - RNA, 21 nt, Homo sapiens
gcuacuaccuagggcacuuua

SEQ ID NO: 813305 - RNA, 22 nt, Homo sapiens
gcuacuacgguugaucuugcaa

SEQ ID NO: 813306 - RNA, 21 nt, Homo sapiens
gcuacucaggaggcugaggca

SEQ ID NO: 813307 - RNA, 20 nt, Homo sapiens
gcuacucuguuccuucacau

SEQ ID NO: 813308 - RNA, 19 nt, Homo sapiens
gcuacugaaaggcaguagu

SEQ ID NO: 813309 - RNA, 14 nt, Homo sapiens
gcuacuggcagcuc

SEQ ID NO: 813310 - RNA, 17 nt, Homo sapiens
gcuacuuaacaaaguaa

SEQ ID NO: 813311 - RNA, 22 nt, Homo sapiens
gcuacuuaacaaaguaaacaaa

SEQ ID NO: 813312 - RNA, 15 nt, Homo sapiens
gcuagaaggacucac

SEQ ID NO: 813313 - RNA, 16 nt, Homo sapiens
gcuagacagaaaccaa

SEQ ID NO: 813314 - RNA, 15 nt, Homo sapiens
gcuagaguaggugca

SEQ ID NO: 813315 - RNA, 14 nt, Homo sapiens
gcuagaguccucac

SEQ ID NO: 813316 - RNA, 15 nt, Homo sapiens
gcuagcaaauuugag

SEQ ID NO: 813317 - RNA, 13 nt, Homo sapiens
gcuagcacuaacu

SEQ ID NO: 813318 - RNA, 15 nt, Homo sapiens
gcuagcagcugugau

SEQ ID NO: 813319 - RNA, 18 nt, Homo sapiens
gcuagcaguaaaagauga

SEQ ID NO: 813320 - RNA, 20 nt, Homo sapiens
gcuaggguggcccuugcagu

SEQ ID NO: 813321 - RNA, 18 nt, Homo sapiens
gcuagucugcccuaugga

SEQ ID NO: 813322 - RNA, 16 nt, Homo sapiens
gcuaguuugaccucau

SEQ ID NO: 813323 - RNA, 13 nt, Homo sapiens
gcuauaagugcuc

SEQ ID NO: 813324 - RNA, 10 nt, Homo sapiens
gcuauauucc

SEQ ID NO: 813325 - RNA, 17 nt, Homo sapiens
gcuauccagcagaucau

SEQ ID NO: 813326 - RNA, 15 nt, Homo sapiens
gcuaucucucaguga

SEQ ID NO: 813327 - RNA, 12 nt, Homo sapiens
gcuaugacugua

SEQ ID NO: 813328 - RNA, 23 nt, Homo sapiens
gcuauggucagguuauacuccuc

SEQ ID NO: 813329 - RNA, 21 nt, Homo sapiens
gcuauguauaaaauacauagu

SEQ ID NO: 813330 - RNA, 16 nt, Homo sapiens
gcuauuaagaaaauca

SEQ ID NO: 813331 - RNA, 19 nt, Homo sapiens
gcuauuaagaaaaucacau

SEQ ID NO: 813332 - RNA, 21 nt, Homo sapiens
gcuauuaggaaauucugauga

SEQ ID NO: 813333 - RNA, 19 nt, Homo sapiens
gcuauuggcccagcuuuua

SEQ ID NO: 813334 - RNA, 16 nt, Homo sapiens
gcuauugucuguaaua

SEQ ID NO: 813335 - RNA, 19 nt, Homo sapiens
gcuauugugaauagugccg

SEQ ID NO: 813336 - RNA, 14 nt, Homo sapiens
gcuauuuaucucaa

SEQ ID NO: 813337 - RNA, 14 nt, Homo sapiens
gcuauuuaugcaag

SEQ ID NO: 813338 - RNA, 19 nt, Homo sapiens
gcuauuucaucugguuucu

SEQ ID NO: 813339 - RNA, 13 nt, Homo sapiens
gcuauuucugggu

SEQ ID NO: 813340 - RNA, 20 nt, Homo sapiens
gcuauuucuucuacugcuau

SEQ ID NO: 813341 - RNA, 20 nt, Homo sapiens
gcuauuuguguguaugcuga

SEQ ID NO: 813342 - RNA, 14 nt, Homo sapiens
gcuauuuucauuua

SEQ ID NO: 813343 - RNA, 12 nt, Homo sapiens
gcucaaagggaa

SEQ ID NO: 813344 - RNA, 13 nt, Homo sapiens
gcucaaagggaac

SEQ ID NO: 813345 - RNA, 18 nt, Homo sapiens
gcucaagaacacaugugc

SEQ ID NO: 813346 - RNA, 21 nt, Homo sapiens
gcucaagucacuuuuauuuga

SEQ ID NO: 813347 - RNA, 23 nt, Homo sapiens
gcucaauauuccugaaugaaaua

SEQ ID NO: 813348 - RNA, 19 nt, Homo sapiens
gcucaauucaagugacaca

SEQ ID NO: 813349 - RNA, 19 nt, Homo sapiens
gcucacaaggcccaggaga

SEQ ID NO: 813350 - RNA, 22 nt, Homo sapiens
gcucacacugagaauguaagaa

SEQ ID NO: 813351 - RNA, 20 nt, Homo sapiens
gcucacccugcggcacgugg

SEQ ID NO: 813352 - RNA, 11 nt, Homo sapiens
gcucaccucag

SEQ ID NO: 813353 - RNA, 23 nt, Homo sapiens
gcucaccuuuuuaugaucugcca

SEQ ID NO: 813354 - RNA, 20 nt, Homo sapiens
gcucacgccuguaauucuag

SEQ ID NO: 813355 - RNA, 19 nt, Homo sapiens
gcucagaaggaauggugcg

SEQ ID NO: 813356 - RNA, 17 nt, Homo sapiens
gcucagaucucauggga

SEQ ID NO: 813357 - RNA, 14 nt, Homo sapiens
gcucagcagccagu

SEQ ID NO: 813358 - RNA, 20 nt, Homo sapiens
gcucagcccugcaccaugcu

SEQ ID NO: 813359 - RNA, 23 nt, Homo sapiens
gcucagcccugcaccaugcugcu

SEQ ID NO: 813360 - RNA, 21 nt, Homo sapiens
gcucaggaaggggugugcuga

SEQ ID NO: 813361 - RNA, 20 nt, Homo sapiens
gcucaggguggucucuucuu

SEQ ID NO: 813362 - RNA, 16 nt, Homo sapiens
gcucaggucaacugac

SEQ ID NO: 813363 - RNA, 17 nt, Homo sapiens
gcucaguaacugugcau

SEQ ID NO: 813364 - RNA, 15 nt, Homo sapiens
gcucagucucaggag

SEQ ID NO: 813365 - RNA, 16 nt, Homo sapiens
gcucauaaacugccaa

SEQ ID NO: 813366 - RNA, 16 nt, Homo sapiens
gcucauagaucagcaa

SEQ ID NO: 813367 - RNA, 17 nt, Homo sapiens
gcucauagaucagcaaa

SEQ ID NO: 813368 - RNA, 14 nt, Homo sapiens
gcucaugacacugu

SEQ ID NO: 813369 - RNA, 12 nt, Homo sapiens
gcucaugccauc

SEQ ID NO: 813370 - RNA, 22 nt, Homo sapiens
gcucauugcuaaccacugucug

SEQ ID NO: 813371 - RNA, 19 nt, Homo sapiens
gcucauugcuguaccacau

SEQ ID NO: 813372 - RNA, 16 nt, Homo sapiens
gcucauuuuugcuguu

SEQ ID NO: 813373 - RNA, 22 nt, Homo sapiens
gcucauuuuuucuucuccuaaa

SEQ ID NO: 813374 - RNA, 13 nt, Homo sapiens
gcuccaccccagg

SEQ ID NO: 813375 - RNA, 11 nt, Homo sapiens
gcuccacugaa

SEQ ID NO: 813376 - RNA, 14 nt, Homo sapiens
gcuccagaaauguc

SEQ ID NO: 813377 - RNA, 19 nt, Homo sapiens
gcuccagagcaagcauuca

SEQ ID NO: 813378 - RNA, 15 nt, Homo sapiens
gcuccaggacucccu

SEQ ID NO: 813379 - RNA, 22 nt, Homo sapiens
gcuccaucccaaccaggcaccu

SEQ ID NO: 813380 - RNA, 14 nt, Homo sapiens
gcuccaugcaccuc

SEQ ID NO: 813381 - RNA, 16 nt, Homo sapiens
gcuccauuaauccagg

SEQ ID NO: 813382 - RNA, 14 nt, Homo sapiens
gcucccaagcugcc

SEQ ID NO: 813383 - RNA, 13 nt, Homo sapiens
gcucccagggugg

SEQ ID NO: 813384 - RNA, 19 nt, Homo sapiens
gcucccaugugagucccug

SEQ ID NO: 813385 - RNA, 21 nt, Homo sapiens
gcuccccugcgccuccauggc

SEQ ID NO: 813386 - RNA, 11 nt, Homo sapiens
gcucccggggc

SEQ ID NO: 813387 - RNA, 18 nt, Homo sapiens
gcuccggaggacucacca

SEQ ID NO: 813388 - RNA, 17 nt, Homo sapiens
gcuccuaguuugaccuc

SEQ ID NO: 813389 - RNA, 18 nt, Homo sapiens
gcuccuaguuugaccuca

SEQ ID NO: 813390 - RNA, 14 nt, Homo sapiens
gcuccuaucugugu

SEQ ID NO: 813391 - RNA, 21 nt, Homo sapiens
gcuccucuccccagcccagag

SEQ ID NO: 813392 - RNA, 16 nt, Homo sapiens
gcuccugagugucaug

SEQ ID NO: 813393 - RNA, 17 nt, Homo sapiens
gcuccugagugucauga

SEQ ID NO: 813394 - RNA, 14 nt, Homo sapiens
gcuccuggaaccaa

SEQ ID NO: 813395 - RNA, 16 nt, Homo sapiens
gcuccugggcagcuug

SEQ ID NO: 813396 - RNA, 15 nt, Homo sapiens
gcuccuggguuucau

SEQ ID NO: 813397 - RNA, 16 nt, Homo sapiens
gcuccuggguuucaug

SEQ ID NO: 813398 - RNA, 13 nt, Homo sapiens
gcuccuguggcag

SEQ ID NO: 813399 - RNA, 15 nt, Homo sapiens
gcuccuguggcagcu

SEQ ID NO: 813400 - RNA, 19 nt, Homo sapiens
gcuccuguguucuagaccu

SEQ ID NO: 813401 - RNA, 20 nt, Homo sapiens
gcuccuguguucuagaccuc

SEQ ID NO: 813402 - RNA, 15 nt, Homo sapiens
ggagacugcaucuca

SEQ ID NO: 813403 - RNA, 16 nt, Homo sapiens
ggagacuugccagagc

SEQ ID NO: 813404 - RNA, 13 nt, Homo sapiens
ggagagaacugaa

SEQ ID NO: 813405 - RNA, 16 nt, Homo sapiens
ggagagagccaagacg

SEQ ID NO: 813406 - RNA, 14 nt, Homo sapiens
ggagagauguuugg

SEQ ID NO: 813407 - RNA, 16 nt, Homo sapiens
ggagaggucaccagcu

SEQ ID NO: 813408 - RNA, 17 nt, Homo sapiens
ggagauaaucuagaaca

SEQ ID NO: 813409 - RNA, 17 nt, Homo sapiens
ggagcaacaggccaagg

SEQ ID NO: 813410 - RNA, 20 nt, Homo sapiens
ggagcacauacuaccuagaa

SEQ ID NO: 813411 - RNA, 18 nt, Homo sapiens
ggagcacgaggucuggcc

SEQ ID NO: 813412 - RNA, 13 nt, Homo sapiens
ggagcacuggguu

SEQ ID NO: 813413 - RNA, 19 nt, Homo sapiens
ggagcagaguguucccuga

SEQ ID NO: 813414 - RNA, 15 nt, Homo sapiens
ggagcagcagccagc

SEQ ID NO: 813415 - RNA, 18 nt, Homo sapiens
ggagcaggggaggcucac

SEQ ID NO: 813416 - RNA, 17 nt, Homo sapiens
ggagcccagaaaaccuc

SEQ ID NO: 813417 - RNA, 20 nt, Homo sapiens
ggagccccacccagaccuga

SEQ ID NO: 813418 - RNA, 23 nt, Homo sapiens
ggagccccuccucccccggcugg

SEQ ID NO: 813419 - RNA, 21 nt, Homo sapiens
ggagccuggcuccguccagga

SEQ ID NO: 813420 - RNA, 23 nt, Homo sapiens
ggagcggacucacuugauguuuc

SEQ ID NO: 813421 - RNA, 13 nt, Homo sapiens
ggagcugcaaauu

SEQ ID NO: 813422 - RNA, 19 nt, Homo sapiens
ggagcugccugcagcacau

SEQ ID NO: 813423 - RNA, 14 nt, Homo sapiens
ggagcugcucagaa

SEQ ID NO: 813424 - RNA, 18 nt, Homo sapiens
ggagcugcugagugacag

SEQ ID NO: 813425 - RNA, 14 nt, Homo sapiens
ggagcuggugagau

SEQ ID NO: 813426 - RNA, 13 nt, Homo sapiens
ggagcuugcagug

SEQ ID NO: 813427 - RNA, 18 nt, Homo sapiens
ggagcuuucucaaugucu

SEQ ID NO: 813428 - RNA, 20 nt, Homo sapiens
ggaggaaccacaauguuucu

SEQ ID NO: 813429 - RNA, 12 nt, Homo sapiens
ggaggagaagua

SEQ ID NO: 813430 - RNA, 17 nt, Homo sapiens
ggaggagcuucucccag

SEQ ID NO: 813431 - RNA, 22 nt, Homo sapiens
ggaggaggcugaggccugugaa

SEQ ID NO: 813432 - RNA, 15 nt, Homo sapiens
ggaggaucaguuuuu

SEQ ID NO: 813433 - RNA, 21 nt, Homo sapiens
ggaggaucauuugagcucaug

SEQ ID NO: 813434 - RNA, 21 nt, Homo sapiens
ggaggccaagaacuugcaaua

SEQ ID NO: 813435 - RNA, 21 nt, Homo sapiens
ggaggcccaaaugauggauca

SEQ ID NO: 813436 - RNA, 14 nt, Homo sapiens
ggaggcugagccag

SEQ ID NO: 813437 - RNA, 18 nt, Homo sapiens
ggagggaaaagagugccu

SEQ ID NO: 813438 - RNA, 21 nt, Homo sapiens
ggagggacuuuuaaucaguga

SEQ ID NO: 813439 - RNA, 12 nt, Homo sapiens
ggaggguggcca

SEQ ID NO: 813440 - RNA, 16 nt, Homo sapiens
ggaggucauacaugca

SEQ ID NO: 813441 - RNA, 17 nt, Homo sapiens
ggaggugauuccaguga

SEQ ID NO: 813442 - RNA, 19 nt, Homo sapiens
ggagguggagauugcagug

SEQ ID NO: 813443 - RNA, 19 nt, Homo sapiens
ggagguggcuggguuuaca

SEQ ID NO: 813444 - RNA, 11 nt, Homo sapiens
ggccagggugg

SEQ ID NO: 813445 - RNA, 23 nt, Homo sapiens
ggccaguaucuauauauguguau

SEQ ID NO: 813446 - RNA, 16 nt, Homo sapiens
ggccagugaacagggu

SEQ ID NO: 813447 - RNA, 15 nt, Homo sapiens
ggccauaaagaucaa

SEQ ID NO: 813448 - RNA, 15 nt, Homo sapiens
ggccaugauggccuu

SEQ ID NO: 813449 - RNA, 16 nt, Homo sapiens
ggccauguccaaagag

SEQ ID NO: 813450 - RNA, 17 nt, Homo sapiens
ggcccacccccaggaag

SEQ ID NO: 813451 - RNA, 20 nt, Homo sapiens
ggcccacugugccucagaga

SEQ ID NO: 813452 - RNA, 15 nt, Homo sapiens
ggcccagagaagcaa

SEQ ID NO: 813453 - RNA, 18 nt, Homo sapiens
ggcccaggaauuagagaa

SEQ ID NO: 813454 - RNA, 13 nt, Homo sapiens
ggcccaguccucu

SEQ ID NO: 813455 - RNA, 15 nt, Homo sapiens
ggcccauacugguug

SEQ ID NO: 813456 - RNA, 16 nt, Homo sapiens
ggccccagaucugccu

SEQ ID NO: 813457 - RNA, 17 nt, Homo sapiens
ggccccagggggucuca

SEQ ID NO: 813458 - RNA, 17 nt, Homo sapiens
ggccccaguccaugcuu

SEQ ID NO: 813459 - RNA, 23 nt, Homo sapiens
ggcccccaaugacacccaugcca

SEQ ID NO: 813460 - RNA, 18 nt, Homo sapiens
ggccccgaaugucacugg

SEQ ID NO: 813461 - RNA, 16 nt, Homo sapiens
ggccccucaccuggua

SEQ ID NO: 813462 - RNA, 17 nt, Homo sapiens
ggccccuccagcacaca

SEQ ID NO: 813463 - RNA, 14 nt, Homo sapiens
ggcccgaacaggga

SEQ ID NO: 813464 - RNA, 19 nt, Homo sapiens
ggcccgacagccuggcaca

SEQ ID NO: 813465 - RNA, 15 nt, Homo sapiens
ggcccgcaccgcugg

SEQ ID NO: 813466 - RNA, 17 nt, Homo sapiens
ggcccuaugucucagga

SEQ ID NO: 813467 - RNA, 18 nt, Homo sapiens
ggcccuccucucccaucc

SEQ ID NO: 813468 - RNA, 17 nt, Homo sapiens
ggcccugacuucuggag

SEQ ID NO: 813469 - RNA, 22 nt, Homo sapiens
ggcccugggucuugccaugugc

SEQ ID NO: 813470 - RNA, 18 nt, Homo sapiens
ggcccuugggccacgcuc

SEQ ID NO: 813471 - RNA, 19 nt, Homo sapiens
ggccgcagcucuugcccuu

SEQ ID NO: 813472 - RNA, 18 nt, Homo sapiens
ggccuaaucucauaccuc

SEQ ID NO: 813473 - RNA, 13 nt, Homo sapiens
ggccuaccugggg

SEQ ID NO: 813474 - RNA, 10 nt, Homo sapiens
ggccucagaa

SEQ ID NO: 813475 - RNA, 21 nt, Homo sapiens
ggccuccagaagcugcuccuu

SEQ ID NO: 813476 - RNA, 19 nt, Homo sapiens
ggccucccaaagugcuagu

SEQ ID NO: 813477 - RNA, 22 nt, Homo sapiens
ggccucccaaagugcugggauu

SEQ ID NO: 813478 - RNA, 23 nt, Homo sapiens
ggccucccucugcuacuccaucc

SEQ ID NO: 813479 - RNA, 19 nt, Homo sapiens
ggccuccugugcaucugua

SEQ ID NO: 813480 - RNA, 22 nt, Homo sapiens
ggccuccuuggcaaugcauuug

SEQ ID NO: 813481 - RNA, 16 nt, Homo sapiens
ggccucucucaaaaga

SEQ ID NO: 813482 - RNA, 19 nt, Homo sapiens
ggccucugagaagcucuga

SEQ ID NO: 813483 - RNA, 21 nt, Homo sapiens
ggccucugccugggacacugc

SEQ ID NO: 813484 - RNA, 16 nt, Homo sapiens
ggccugaccagggggc

SEQ ID NO: 813485 - RNA, 13 nt, Homo sapiens
ggccugaccucaa

SEQ ID NO: 813486 - RNA, 13 nt, Homo sapiens
ggccugagcaaca

SEQ ID NO: 813487 - RNA, 20 nt, Homo sapiens
ggccugcccagucgacccca

SEQ ID NO: 813488 - RNA, 22 nt, Homo sapiens
ggccugcgacccugggggcaca

SEQ ID NO: 813489 - RNA, 22 nt, Homo sapiens
ggcuuucuggagaggagggaug

SEQ ID NO: 813490 - RNA, 19 nt, Homo sapiens
ggcuuugccucuucuuugu

SEQ ID NO: 813491 - RNA, 21 nt, Homo sapiens
ggcuuuguuuuuugugcuauu

SEQ ID NO: 813492 - RNA, 15 nt, Homo sapiens
ggcuuuuccaaugau

SEQ ID NO: 813493 - RNA, 13 nt, Homo sapiens
gggaaaaggagua

SEQ ID NO: 813494 - RNA, 16 nt, Homo sapiens
gggaaaaggggcuccu

SEQ ID NO: 813495 - RNA, 13 nt, Homo sapiens
gggaaacugggaa

SEQ ID NO: 813496 - RNA, 15 nt, Homo sapiens
gggaaaggaggcaug

SEQ ID NO: 813497 - RNA, 14 nt, Homo sapiens
gggaacauguccua

SEQ ID NO: 813498 - RNA, 14 nt, Homo sapiens
gggaaccacuccca

SEQ ID NO: 813499 - RNA, 17 nt, Homo sapiens
gggaacucagauccagg

SEQ ID NO: 813500 - RNA, 14 nt, Homo sapiens
gggaagaagggaua

SEQ ID NO: 813501 - RNA, 11 nt, Homo sapiens
gggaagacagu

SEQ ID NO: 813502 - RNA, 18 nt, Homo sapiens
gggaagagacagcccagg

SEQ ID NO: 813503 - RNA, 21 nt, Homo sapiens
gggaagccugugccagcaccu

SEQ ID NO: 813504 - RNA, 22 nt, Homo sapiens
gggaagcgaugaauuuggagac

SEQ ID NO: 813505 - RNA, 22 nt, Homo sapiens
gggaagugguccagaaacaaaa

SEQ ID NO: 813506 - RNA, 22 nt, Homo sapiens
gggaauccaagccuccacagcg

SEQ ID NO: 813507 - RNA, 21 nt, Homo sapiens
gggaaugagaguuccuucuca

SEQ ID NO: 813508 - RNA, 14 nt, Homo sapiens
gggaaugcaauccu

SEQ ID NO: 813509 - RNA, 12 nt, Homo sapiens
gggaaugcugcc

SEQ ID NO: 813510 - RNA, 17 nt, Homo sapiens
gggaauuuucucuccau

SEQ ID NO: 813511 - RNA, 16 nt, Homo sapiens
gggacaaggaaggaaa

SEQ ID NO: 813512 - RNA, 14 nt, Homo sapiens
gggacaagggauuu

SEQ ID NO: 813513 - RNA, 19 nt, Homo sapiens
gggacagcaagugagcaga

SEQ ID NO: 813514 - RNA, 21 nt, Homo sapiens
gggacagggcugggagaagaa

SEQ ID NO: 813515 - RNA, 22 nt, Homo sapiens
gggacguuucuggaacugucug

SEQ ID NO: 813516 - RNA, 14 nt, Homo sapiens
gggacuaacccaau

SEQ ID NO: 813517 - RNA, 12 nt, Homo sapiens
gggacuaggacc

SEQ ID NO: 813518 - RNA, 19 nt, Homo sapiens
gggacuaucuuugcugcag

SEQ ID NO: 813519 - RNA, 15 nt, Homo sapiens
gggacugaugucauc

SEQ ID NO: 813520 - RNA, 15 nt, Homo sapiens
gggagaagugauaug

SEQ ID NO: 813521 - RNA, 16 nt, Homo sapiens
gggagaaugucaguau

SEQ ID NO: 813522 - RNA, 20 nt, Homo sapiens
gggagauuggcuuugccuuu

SEQ ID NO: 813523 - RNA, 15 nt, Homo sapiens
gggagcaggagccug

SEQ ID NO: 813524 - RNA, 22 nt, Homo sapiens
gggagcccacuguccugggccu

SEQ ID NO: 813525 - RNA, 16 nt, Homo sapiens
gggagcccagugaagc

SEQ ID NO: 813526 - RNA, 14 nt, Homo sapiens
gggagcugggagac

SEQ ID NO: 813527 - RNA, 17 nt, Homo sapiens
gggaggaagcagguuga

SEQ ID NO: 813528 - RNA, 21 nt, Homo sapiens
gggaggaggaaguaguccagc

SEQ ID NO: 813529 - RNA, 20 nt, Homo sapiens
gggaggcagagguugcagug

SEQ ID NO: 813530 - RNA, 22 nt, Homo sapiens
gggaggcagagguugcagugaa

SEQ ID NO: 813531 - RNA, 20 nt, Homo sapiens
gggaggcggagguuccagug

SEQ ID NO: 813532 - RNA, 17 nt, Homo sapiens
gggaggcgggggcugcc

SEQ ID NO: 813533 - RNA, 20 nt, Homo sapiens
gggagguggagauugcagug

SEQ ID NO: 813534 - RNA, 20 nt, Homo sapiens
gggagguggagcuugcagug

SEQ ID NO: 813535 - RNA, 16 nt, Homo sapiens
gggagugugggcugcc

SEQ ID NO: 813536 - RNA, 15 nt, Homo sapiens
gggagugugucugcu

SEQ ID NO: 813537 - RNA, 13 nt, Homo sapiens
gggauagaaagga

SEQ ID NO: 813538 - RNA, 12 nt, Homo sapiens
gggaucauuuga

SEQ ID NO: 813539 - RNA, 15 nt, Homo sapiens
gggaucgacuguaaa

SEQ ID NO: 813540 - RNA, 17 nt, Homo sapiens
gggaucucaggggcugu

SEQ ID NO: 813541 - RNA, 14 nt, Homo sapiens
gggaucugccauug

SEQ ID NO: 813542 - RNA, 13 nt, Homo sapiens
gggaucuucccac

SEQ ID NO: 813543 - RNA, 23 nt, Homo sapiens
gggaucuuccuugggaugaucuu

SEQ ID NO: 813544 - RNA, 17 nt, Homo sapiens
gggaugaagcucacugg

SEQ ID NO: 813545 - RNA, 18 nt, Homo sapiens
gggaugccaauuuccucu

SEQ ID NO: 813546 - RNA, 22 nt, Homo sapiens
gggaugcugccugagucaccca

SEQ ID NO: 813547 - RNA, 15 nt, Homo sapiens
gggauggagaagcac

SEQ ID NO: 813548 - RNA, 17 nt, Homo sapiens
gggauuggggaagacug

SEQ ID NO: 813549 - RNA, 23 nt, Homo sapiens
gggauuuuuggcuacacacaaac

SEQ ID NO: 813550 - RNA, 13 nt, Homo sapiens
gggcaaagaagaa

SEQ ID NO: 813551 - RNA, 13 nt, Homo sapiens
gggcaaucuuugc

SEQ ID NO: 813552 - RNA, 17 nt, Homo sapiens
gggcacuacauaauugc

SEQ ID NO: 813553 - RNA, 14 nt, Homo sapiens
gggcagcaaccccu

SEQ ID NO: 813554 - RNA, 15 nt, Homo sapiens
gggcagcauagcaag

SEQ ID NO: 813555 - RNA, 21 nt, Homo sapiens
ggcaaaaacuguacuguguuu

SEQ ID NO: 813556 - RNA, 20 nt, Homo sapiens
ggcaaaacuuuggcacuggg

SEQ ID NO: 813557 - RNA, 22 nt, Homo sapiens
ggcaaaaucuuguuaaugucau

SEQ ID NO: 813558 - RNA, 23 nt, Homo sapiens
ggcaacaauacaugcugcuaauu

SEQ ID NO: 813559 - RNA, 23 nt, Homo sapiens
ggcaacacuuuagcuugggucca

SEQ ID NO: 813560 - RNA, 18 nt, Homo sapiens
ggcaacagaugaagaccc

SEQ ID NO: 813561 - RNA, 14 nt, Homo sapiens
ggcaacuguaugaa

SEQ ID NO: 813562 - RNA, 12 nt, Homo sapiens
ggcaacugugag

SEQ ID NO: 813563 - RNA, 18 nt, Homo sapiens
ggcaagaguguucuuuuc

SEQ ID NO: 813564 - RNA, 18 nt, Homo sapiens
ggcaagccuggccaucug

SEQ ID NO: 813565 - RNA, 22 nt, Homo sapiens
ggcaaggacggccuucaacuga

SEQ ID NO: 813566 - RNA, 22 nt, Homo sapiens
ggcaagucaccugcagcccaug

SEQ ID NO: 813567 - RNA, 12 nt, Homo sapiens
ggcaagugauau

SEQ ID NO: 813568 - RNA, 20 nt, Homo sapiens
ggcaagugugggggguccuu

SEQ ID NO: 813569 - RNA, 19 nt, Homo sapiens
ggcaauuucaccaccaaau

SEQ ID NO: 813570 - RNA, 21 nt, Homo sapiens
ggcacaauaugggcacuuuaa

SEQ ID NO: 813571 - RNA, 19 nt, Homo sapiens
ggcacagggucugcucuuu

SEQ ID NO: 813572 - RNA, 20 nt, Homo sapiens
ggcacagggucugcucuuuc

SEQ ID NO: 813573 - RNA, 13 nt, Homo sapiens
ggcacaguggcuc

SEQ ID NO: 813574 - RNA, 14 nt, Homo sapiens
ggcacagugggccu

SEQ ID NO: 813575 - RNA, 13 nt, Homo sapiens
ggcaccaacucca

SEQ ID NO: 813576 - RNA, 19 nt, Homo sapiens
ggcacccacacacaaagag

SEQ ID NO: 813577 - RNA, 19 nt, Homo sapiens
ggcacccuggaaccgggaa

SEQ ID NO: 813578 - RNA, 15 nt, Homo sapiens
ggcacgcccuacucc

SEQ ID NO: 813579 - RNA, 18 nt, Homo sapiens
ggcacucagggagcauuu

SEQ ID NO: 813580 - RNA, 16 nt, Homo sapiens
ggcacuggugggccau

SEQ ID NO: 813581 - RNA, 18 nt, Homo sapiens
ggcacugugccugagcuc

SEQ ID NO: 813582 - RNA, 20 nt, Homo sapiens
ggcacugugccugagcucug

SEQ ID NO: 813583 - RNA, 20 nt, Homo sapiens
ggcacuuaagugcacuuuuu

SEQ ID NO: 813584 - RNA, 21 nt, Homo sapiens
ggcacuuuaagucagugacag

SEQ ID NO: 813585 - RNA, 15 nt, Homo sapiens
ggcagaaagcaaaug

SEQ ID NO: 813586 - RNA, 15 nt, Homo sapiens
ggcagaaccaaagcu

SEQ ID NO: 813587 - RNA, 22 nt, Homo sapiens
ggcagaagaauugaacccagga

SEQ ID NO: 813588 - RNA, 19 nt, Homo sapiens
ggcagaccgugaccaucuu

SEQ ID NO: 813589 - RNA, 18 nt, Homo sapiens
ggcagagucagcugcuga

SEQ ID NO: 813590 - RNA, 22 nt, Homo sapiens
ggcagcaaccccugcaugccau

SEQ ID NO: 813591 - RNA, 19 nt, Homo sapiens
ggcagcaagggaccugcuc

SEQ ID NO: 813592 - RNA, 20 nt, Homo sapiens
ggcagcaagguggccacagu

SEQ ID NO: 813593 - RNA, 14 nt, Homo sapiens
ggcagcagaucugu

SEQ ID NO: 813594 - RNA, 23 nt, Homo sapiens
ggcagcagcucccgcagggcuga

SEQ ID NO: 813595 - RNA, 14 nt, Homo sapiens
ggcagcaugacuca

SEQ ID NO: 813596 - RNA, 23 nt, Homo sapiens
ggcagcccagcccuccucuguca

SEQ ID NO: 813597 - RNA, 16 nt, Homo sapiens
ggcagcccuauuucag

SEQ ID NO: 813598 - RNA, 23 nt, Homo sapiens
gguuuguguugagcguuugcacg

SEQ ID NO: 813599 - RNA, 19 nt, Homo sapiens
gguuuguguuugaguuuua

SEQ ID NO: 813600 - RNA, 22 nt, Homo sapiens
gguuuuucugauuagagugcaa

SEQ ID NO: 813601 - RNA, 19 nt, Homo sapiens
gguuuuuuucuucuguauu

SEQ ID NO: 813602 - RNA, 23 nt, Homo sapiens
guaaaaagcccagcacuugaauu

SEQ ID NO: 813603 - RNA, 15 nt, Homo sapiens
guaaaaaugcugcuc

SEQ ID NO: 813604 - RNA, 21 nt, Homo sapiens
guaaaacaaucuguuuuggcu

SEQ ID NO: 813605 - RNA, 14 nt, Homo sapiens
guaaaacaaugcca

SEQ ID NO: 813606 - RNA, 17 nt, Homo sapiens
guaaaacauuuguuucc

SEQ ID NO: 813607 - RNA, 15 nt, Homo sapiens
guaaaacuauauucu

SEQ ID NO: 813608 - RNA, 21 nt, Homo sapiens
guaaaacuauauucucagugu

SEQ ID NO: 813609 - RNA, 18 nt, Homo sapiens
guaaaaggauaguaagca

SEQ ID NO: 813610 - RNA, 15 nt, Homo sapiens
guaaaauaacaucag

SEQ ID NO: 813611 - RNA, 19 nt, Homo sapiens
guaaaauacuuuuacucug

SEQ ID NO: 813612 - RNA, 13 nt, Homo sapiens
guaaaaugaaauu

SEQ ID NO: 813613 - RNA, 17 nt, Homo sapiens
guaaaauggaggccauu

SEQ ID NO: 813614 - RNA, 13 nt, Homo sapiens
guaaaauguucuc

SEQ ID NO: 813615 - RNA, 14 nt, Homo sapiens
guaaaauuauuuca

SEQ ID NO: 813616 - RNA, 23 nt, Homo sapiens
guaaaauugaaaggcauucucug

SEQ ID NO: 813617 - RNA, 16 nt, Homo sapiens
guaaaauuguuccuga

SEQ ID NO: 813618 - RNA, 12 nt, Homo sapiens
guaaacaaugaa

SEQ ID NO: 813619 - RNA, 20 nt, Homo sapiens
guaaacagauggcacuuuga

SEQ ID NO: 813620 - RNA, 13 nt, Homo sapiens
guaaacauaauuc

SEQ ID NO: 813621 - RNA, 15 nt, Homo sapiens
guaaaccaaacccua

SEQ ID NO: 813622 - RNA, 17 nt, Homo sapiens
guaaacgggaacaugcc

SEQ ID NO: 813623 - RNA, 17 nt, Homo sapiens
guaaacugauguacuga

SEQ ID NO: 813624 - RNA, 20 nt, Homo sapiens
guaaacugugcuagugcuga

SEQ ID NO: 813625 - RNA, 12 nt, Homo sapiens
guaaacuuccaa

SEQ ID NO: 813626 - RNA, 20 nt, Homo sapiens
guaaacuucugcaacaagca

SEQ ID NO: 813627 - RNA, 12 nt, Homo sapiens
guaaagacugua

SEQ ID NO: 813628 - RNA, 16 nt, Homo sapiens
guaaagccucauuuga

SEQ ID NO: 813629 - RNA, 13 nt, Homo sapiens
guaaaggcauugu

SEQ ID NO: 813630 - RNA, 18 nt, Homo sapiens
guaaaggcuauacuuguc

SEQ ID NO: 813631 - RNA, 19 nt, Homo sapiens
guaaaggcuauacuugucu

SEQ ID NO: 813632 - RNA, 16 nt, Homo sapiens
guaaauaccugucaau

SEQ ID NO: 813633 - RNA, 16 nt, Homo sapiens
guaaauaguauuugag

SEQ ID NO: 813634 - RNA, 21 nt, Homo sapiens
guaaauauuuguuacuuuuag

SEQ ID NO: 813635 - RNA, 11 nt, Homo sapiens
guaaaugcucg

SEQ ID NO: 813636 - RNA, 21 nt, Homo sapiens
guaaaugcucgugugauuucc

SEQ ID NO: 813637 - RNA, 15 nt, Homo sapiens
guaaauguccauuua

SEQ ID NO: 813638 - RNA, 15 nt, Homo sapiens
guaaauguccugcua

SEQ ID NO: 813639 - RNA, 14 nt, Homo sapiens
guaaauguguugcc

SEQ ID NO: 813640 - RNA, 23 nt, Homo sapiens
guaaauugcaaauaaaccacuuu

SEQ ID NO: 813641 - RNA, 20 nt, Homo sapiens
guaacaauuguguagccuuu

SEQ ID NO: 813642 - RNA, 16 nt, Homo sapiens
guaacaguucauguuu

SEQ ID NO: 813643 - RNA, 21 nt, Homo sapiens
guaacccgcucaucacuggau

SEQ ID NO: 813644 - RNA, 15 nt, Homo sapiens
guaacccucacccac

SEQ ID NO: 813645 - RNA, 15 nt, Homo sapiens
guaaccuagugaauu

SEQ ID NO: 813646 - RNA, 14 nt, Homo sapiens
guaacuaauuugug

SEQ ID NO: 813647 - RNA, 13 nt, Homo sapiens
guaacuccagcuc

SEQ ID NO: 813648 - RNA, 17 nt, Homo sapiens
guaacuccccucaggga

SEQ ID NO: 813649 - RNA, 16 nt, Homo sapiens
guaacucuaugaacuu

SEQ ID NO: 813650 - RNA, 11 nt, Homo sapiens
guaacugcuga

SEQ ID NO: 813651 - RNA, 14 nt, Homo sapiens
guaacuugcugcuu

SEQ ID NO: 813652 - RNA, 18 nt, Homo sapiens
guaacuuucauaccacuu

SEQ ID NO: 813653 - RNA, 16 nt, Homo sapiens
guaagaagaaagcaaa

SEQ ID NO: 813654 - RNA, 14 nt, Homo sapiens
guaagaaggcaaua

SEQ ID NO: 813655 - RNA, 14 nt, Homo sapiens
guaagacauuugua

SEQ ID NO: 813656 - RNA, 20 nt, Homo sapiens
guaagccaguuggcuucuaa

SEQ ID NO: 813657 - RNA, 19 nt, Homo sapiens
guaagcugcucuauuguag

SEQ ID NO: 813658 - RNA, 14 nt, Homo sapiens
uaagugccugagac

SEQ ID NO: 813659 - RNA, 17 nt, Homo sapiens
uaagugcuaagugcuua

SEQ ID NO: 813660 - RNA, 19 nt, Homo sapiens
uaaguggcuucucugugaa

SEQ ID NO: 813661 - RNA, 14 nt, Homo sapiens
uaaguuauuuacuu

SEQ ID NO: 813662 - RNA, 15 nt, Homo sapiens
uaaguugcuuccuaa

SEQ ID NO: 813663 - RNA, 22 nt, Homo sapiens
uaaguugucuaaacaaugcuga

SEQ ID NO: 813664 - RNA, 14 nt, Homo sapiens
uaaguuucugggac

SEQ ID NO: 813665 - RNA, 13 nt, Homo sapiens
uaaguuugcacuc

SEQ ID NO: 813666 - RNA, 13 nt, Homo sapiens
uaaguuuuuccaa

SEQ ID NO: 813667 - RNA, 15 nt, Homo sapiens
uaauaaaccuccuuc

SEQ ID NO: 813668 - RNA, 17 nt, Homo sapiens
uaauaaagcauucuuua

SEQ ID NO: 813669 - RNA, 18 nt, Homo sapiens
uaauaaagcauucuuuaa

SEQ ID NO: 813670 - RNA, 24 nt, Homo sapiens
uaauaaaggucuuugcacauguga

SEQ ID NO: 813671 - RNA, 14 nt, Homo sapiens
uaauaaagguuuaa

SEQ ID NO: 813672 - RNA, 21 nt, Homo sapiens
uaauaaaucuaggaugugaug

SEQ ID NO: 813673 - RNA, 22 nt, Homo sapiens
uaauaaauuuuagugugccuuc

SEQ ID NO: 813674 - RNA, 16 nt, Homo sapiens
uaauaacugcaguguu

SEQ ID NO: 813675 - RNA, 12 nt, Homo sapiens
uaauaacuuauc

SEQ ID NO: 813676 - RNA, 17 nt, Homo sapiens
uaauaagauggcugugg

SEQ ID NO: 813677 - RNA, 19 nt, Homo sapiens
uaauaaguacaacuaccua

SEQ ID NO: 813678 - RNA, 17 nt, Homo sapiens
uaauaauaguaauuccu

SEQ ID NO: 813679 - RNA, 16 nt, Homo sapiens
uaauaaugcuggaugg

SEQ ID NO: 813680 - RNA, 15 nt, Homo sapiens
uaauaauguuuaaua

SEQ ID NO: 813681 - RNA, 22 nt, Homo sapiens
uaauaauuuacagguucuuagg

SEQ ID NO: 813682 - RNA, 14 nt, Homo sapiens
uaauacaucaaaga

SEQ ID NO: 813683 - RNA, 14 nt, Homo sapiens
uaauacuacugugu

SEQ ID NO: 813684 - RNA, 16 nt, Homo sapiens
uaauacuucauucucu

SEQ ID NO: 813685 - RNA, 20 nt, Homo sapiens
uaauagaauagcacagccag

SEQ ID NO: 813686 - RNA, 18 nt, Homo sapiens
uaauagauguuacucaaa

SEQ ID NO: 813687 - RNA, 22 nt, Homo sapiens
uaauagcaaugguggugcacca

SEQ ID NO: 813688 - RNA, 14 nt, Homo sapiens
uaauagcagaaaua

SEQ ID NO: 813689 - RNA, 23 nt, Homo sapiens
uaauagcugccuucaaggacugu

SEQ ID NO: 813690 - RNA, 16 nt, Homo sapiens
uaauaggcaucuccag

SEQ ID NO: 813691 - RNA, 17 nt, Homo sapiens
uaauagucuuugccagu

SEQ ID NO: 813692 - RNA, 17 nt, Homo sapiens
uaauaguucaguguaug

SEQ ID NO: 813693 - RNA, 20 nt, Homo sapiens
uaauauaguuauugcacaag

SEQ ID NO: 813694 - RNA, 14 nt, Homo sapiens
uaauaucacuuaaa

SEQ ID NO: 813695 - RNA, 20 nt, Homo sapiens
uaauaucugugaggugcuga

SEQ ID NO: 813696 - RNA, 22 nt, Homo sapiens
uaauaugaaaaucuccaucuca

SEQ ID NO: 813697 - RNA, 20 nt, Homo sapiens
uaauaugaguaauacaucaa

SEQ ID NO: 813698 - RNA, 13 nt, Homo sapiens
uaauaugcuuuac

SEQ ID NO: 813699 - RNA, 16 nt, Homo sapiens
uaauaugguauuugcu

SEQ ID NO: 813700 - RNA, 16 nt, Homo sapiens
uaauauguacuuugag

SEQ ID NO: 813701 - RNA, 20 nt, Homo sapiens
uaauaugugaucagcuuuca

SEQ ID NO: 813702 - RNA, 15 nt, Homo sapiens
uaauaugugccuuaa

SEQ ID NO: 813703 - RNA, 22 nt, Homo sapiens
uaauauugauaagcuauugucu

SEQ ID NO: 813704 - RNA, 19 nt, Homo sapiens
uaauauuucaagugccuag

SEQ ID NO: 813705 - RNA, 22 nt, Homo sapiens
uaaucaaaacuuucguuguuau

SEQ ID NO: 813706 - RNA, 22 nt, Homo sapiens
uaaucaaaauugucucuucuga

SEQ ID NO: 813707 - RNA, 19 nt, Homo sapiens
uaaucaagaaaagaauuac

SEQ ID NO: 813708 - RNA, 19 nt, Homo sapiens
uaaucaaggccagugcuaa

SEQ ID NO: 813709 - RNA, 20 nt, Homo sapiens
uaaucacacacacacuugcu

SEQ ID NO: 813710 - RNA, 22 nt, Homo sapiens
uaaucacaguuuuuccuggaau

SEQ ID NO: 813711 - RNA, 12 nt, Homo sapiens
uaaucacucuaa

SEQ ID NO: 813712 - RNA, 16 nt, Homo sapiens
uaaucacucuaauuaa

SEQ ID NO: 813713 - RNA, 22 nt, Homo sapiens
uaaucacucuaauuaauuguaa

SEQ ID NO: 813714 - RNA, 16 nt, Homo sapiens
uaaucacugcauuuca

SEQ ID NO: 813715 - RNA, 21 nt, Homo sapiens
uaaucagcaagaauuugaucg

SEQ ID NO: 813716 - RNA, 21 nt, Homo sapiens
uagcucugguauauaauccau

SEQ ID NO: 813717 - RNA, 17 nt, Homo sapiens
uagcucuggugaccuug

SEQ ID NO: 813718 - RNA, 16 nt, Homo sapiens
uagcugacuacaaauu

SEQ ID NO: 813719 - RNA, 15 nt, Homo sapiens
uagcugagaagcaau

SEQ ID NO: 813720 - RNA, 16 nt, Homo sapiens
uagcuggccacauggc

SEQ ID NO: 813721 - RNA, 17 nt, Homo sapiens
uagcugggacuacaggc

SEQ ID NO: 813722 - RNA, 11 nt, Homo sapiens
uagcugucacc

SEQ ID NO: 813723 - RNA, 16 nt, Homo sapiens
uagcuguccucucaga

SEQ ID NO: 813724 - RNA, 15 nt, Homo sapiens
uagcuuaaaccaaca

SEQ ID NO: 813725 - RNA, 22 nt, Homo sapiens
uagcuucugcuuuucugcccug

SEQ ID NO: 813726 - RNA, 22 nt, Homo sapiens
uagcuuuagggcaauauugcca

SEQ ID NO: 813727 - RNA, 17 nt, Homo sapiens
uaggaaaaguacauuua

SEQ ID NO: 813728 - RNA, 14 nt, Homo sapiens
uaggaaaauuucac

SEQ ID NO: 813729 - RNA, 18 nt, Homo sapiens
uaggaaagcauaugcagc

SEQ ID NO: 813730 - RNA, 19 nt, Homo sapiens
uaggaaauguaagauuuca

SEQ ID NO: 813731 - RNA, 15 nt, Homo sapiens
uaggaaauucugaug

SEQ ID NO: 813732 - RNA, 21 nt, Homo sapiens
uaggaacugcugggcuuggca

SEQ ID NO: 813733 - RNA, 14 nt, Homo sapiens
uaggaauaugacca

SEQ ID NO: 813734 - RNA, 19 nt, Homo sapiens
uaggacucaaaguuucaga

SEQ ID NO: 813735 - RNA, 20 nt, Homo sapiens
uaggagacugcgucaagcaa

SEQ ID NO: 813736 - RNA, 22 nt, Homo sapiens
uaggaggaaaaagaaaugcauu

SEQ ID NO: 813737 - RNA, 15 nt, Homo sapiens
uaggaggcuggccaa

SEQ ID NO: 813738 - RNA, 16 nt, Homo sapiens
uaggaguucauagaag

SEQ ID NO: 813739 - RNA, 17 nt, Homo sapiens
uaggaguugaguacagu

SEQ ID NO: 813740 - RNA, 19 nt, Homo sapiens
uaggaugaaucauauucau

SEQ ID NO: 813741 - RNA, 12 nt, Homo sapiens
uaggaugugaug

SEQ ID NO: 813742 - RNA, 15 nt, Homo sapiens
uaggcaaccuucuaa

SEQ ID NO: 813743 - RNA, 17 nt, Homo sapiens
uaggcagccucucugcu

SEQ ID NO: 813744 - RNA, 17 nt, Homo sapiens
uaggcagccugcaggga

SEQ ID NO: 813745 - RNA, 12 nt, Homo sapiens
uaggcauguaaa

SEQ ID NO: 813746 - RNA, 21 nt, Homo sapiens
uaggccagaguugcaaagauc

SEQ ID NO: 813747 - RNA, 17 nt, Homo sapiens
uaggccagcaccaucuc

SEQ ID NO: 813748 - RNA, 15 nt, Homo sapiens
uaggccucucugccu

SEQ ID NO: 813749 - RNA, 17 nt, Homo sapiens
uaggcuaccucaagacu

SEQ ID NO: 813750 - RNA, 17 nt, Homo sapiens
uaggcuauuaaaaaagu

SEQ ID NO: 813751 - RNA, 22 nt, Homo sapiens
uaggcuuaucagggaguuacag

SEQ ID NO: 813752 - RNA, 11 nt, Homo sapiens
uaggcuucuau

SEQ ID NO: 813753 - RNA, 21 nt, Homo sapiens
uagggacugccaggcuguuuc

SEQ ID NO: 813754 - RNA, 23 nt, Homo sapiens
uagggcaacaauacaugcugcua

SEQ ID NO: 813755 - RNA, 13 nt, Homo sapiens
uagggcacuuuaa

SEQ ID NO: 813756 - RNA, 21 nt, Homo sapiens
uagggcacuuuaagucaguga

SEQ ID NO: 813757 - RNA, 17 nt, Homo sapiens
uagggcuuuugauuuau

SEQ ID NO: 813758 - RNA, 14 nt, Homo sapiens
uagggggaagacag

SEQ ID NO: 813759 - RNA, 17 nt, Homo sapiens
uagggggcgauauacua

SEQ ID NO: 813760 - RNA, 22 nt, Homo sapiens
uagggguuaacuuggucagagc

SEQ ID NO: 813761 - RNA, 21 nt, Homo sapiens
uagggucaggcggggugcugu

SEQ ID NO: 813762 - RNA, 16 nt, Homo sapiens
uagguacgucaaagca

SEQ ID NO: 813763 - RNA, 16 nt, Homo sapiens
uagguagcacagcacu

SEQ ID NO: 813764 - RNA, 20 nt, Homo sapiens
uagguaggggcccacuucac

SEQ ID NO: 813765 - RNA, 22 nt, Homo sapiens
uagguaggugguuuuauuucaa

SEQ ID NO: 813766 - RNA, 17 nt, Homo sapiens
uagguccaagggccaua

SEQ ID NO: 813767 - RNA, 15 nt, Homo sapiens
uagguccaccugcua

SEQ ID NO: 813768 - RNA, 19 nt, Homo sapiens
uaggucuccaagaccaccc

SEQ ID NO: 813769 - RNA, 11 nt, Homo sapiens
uaggugccuuu

SEQ ID NO: 813770 - RNA, 23 nt, Homo sapiens
uaggugcugaaugaagcugccau

SEQ ID NO: 813771 - RNA, 19 nt, Homo sapiens
uagguucaggaagaccaca

SEQ ID NO: 813772 - RNA, 12 nt, Homo sapiens
uagguugcugac

SEQ ID NO: 813773 - RNA, 19 nt, Homo sapiens
uaguaaagugauaauuucu

SEQ ID NO: 813774 - RNA, 13 nt, Homo sapiens
uaguaaugcucug

SEQ ID NO: 813775 - RNA, 23 nt, Homo sapiens
uaguacuugggagaccuguaauc

SEQ ID NO: 813776 - RNA, 21 nt, Homo sapiens
uaguacuuugugcucauaaau

SEQ ID NO: 813777 - RNA, 14 nt, Homo sapiens
uaguagucucugug

SEQ ID NO: 813778 - RNA, 15 nt, Homo sapiens
uaguauaauugaccu

SEQ ID NO: 813779 - RNA, 12 nt, Homo sapiens
uaguauugugau

SEQ ID NO: 813780 - RNA, 18 nt, Homo sapiens
uagucaauccugucauau

SEQ ID NO: 813781 - RNA, 21 nt, Homo sapiens
uagucacauggccuaugcaca

SEQ ID NO: 813782 - RNA, 22 nt, Homo sapiens
uagucacauggccuaugcacau

SEQ ID NO: 813783 - RNA, 18 nt, Homo sapiens
uagucacucauccauccc

SEQ ID NO: 813784 - RNA, 13 nt, Homo sapiens
uagucaggagaag

SEQ ID NO: 813785 - RNA, 23 nt, Homo sapiens
uagucauacucccugguguagug

SEQ ID NO: 813786 - RNA, 17 nt, Homo sapiens
uagucauuaauguguaa

SEQ ID NO: 813787 - RNA, 22 nt, Homo sapiens
uagucauucuuacaauugcacu

SEQ ID NO: 813788 - RNA, 19 nt, Homo sapiens
uagucccagcuacuccgga

SEQ ID NO: 813789 - RNA, 21 nt, Homo sapiens
uagucccgauaggguauuuga

SEQ ID NO: 813790 - RNA, 18 nt, Homo sapiens
uagucuccuuugcacuga

SEQ ID NO: 813791 - RNA, 20 nt, Homo sapiens
uagucucucugcaagacaga

SEQ ID NO: 813792 - RNA, 22 nt, Homo sapiens
uagucuuggaagcuguuuggaa

SEQ ID NO: 813793 - RNA, 15 nt, Homo sapiens
uagugaauggucucu

SEQ ID NO: 813794 - RNA, 17 nt, Homo sapiens
uagugacuguaauuaau

SEQ ID NO: 813795 - RNA, 19 nt, Homo sapiens
uagugcaacaucucugaau

SEQ ID NO: 813796 - RNA, 20 nt, Homo sapiens
uagugcacccagugacugac

SEQ ID NO: 813797 - RNA, 22 nt, Homo sapiens
uagugccacccaccuuugccac

SEQ ID NO: 813798 - RNA, 15 nt, Homo sapiens
uagugcuagucucag

SEQ ID NO: 813799 - RNA, 16 nt, Homo sapiens
uagugcuaguggauuu

SEQ ID NO: 813800 - RNA, 14 nt, Homo sapiens
uagugcuggucaga

SEQ ID NO: 813801 - RNA, 21 nt, Homo sapiens
uagugggcaccccacugcaau

SEQ ID NO: 813802 - RNA, 14 nt, Homo sapiens
uaguguaacacugc

SEQ ID NO: 813803 - RNA, 13 nt, Homo sapiens
uaguguaccuccu

SEQ ID NO: 813804 - RNA, 17 nt, Homo sapiens
uagugucucauguggaa

SEQ ID NO: 813805 - RNA, 20 nt, Homo sapiens
uaguguucacaaacugugaa

SEQ ID NO: 813806 - RNA, 16 nt, Homo sapiens
uaguuaauuauuucaa

SEQ ID NO: 813807 - RNA, 13 nt, Homo sapiens
uaguuacuguggu

SEQ ID NO: 813808 - RNA, 20 nt, Homo sapiens
uaguuagaauuauaucacuu

SEQ ID NO: 813809 - RNA, 15 nt, Homo sapiens
uaguuagccaucuaa

SEQ ID NO: 813810 - RNA, 15 nt, Homo sapiens
uaguucaacuguaua

SEQ ID NO: 813811 - RNA, 22 nt, Homo sapiens
uaguucaauauuuguuacuguu

SEQ ID NO: 813812 - RNA, 16 nt, Homo sapiens
uaguucuaucaggaaa

SEQ ID NO: 813813 - RNA, 14 nt, Homo sapiens
uaguugaacaagau

SEQ ID NO: 813814 - RNA, 23 nt, Homo sapiens
uaguugaucuacaaaggccaugg

SEQ ID NO: 813815 - RNA, 15 nt, Homo sapiens
uaguugucuuuccug

SEQ ID NO: 813816 - RNA, 14 nt, Homo sapiens
uaguuuauuucaac

SEQ ID NO: 813817 - RNA, 19 nt, Homo sapiens
uaguuugaggaaauuugca

SEQ ID NO: 813818 - RNA, 16 nt, Homo sapiens
uaguuugcaacuucaa

SEQ ID NO: 813819 - RNA, 19 nt, Homo sapiens
uaguuugcaguuacacuaa

SEQ ID NO: 813820 - RNA, 13 nt, Homo sapiens
uaguuugugcugu

SEQ ID NO: 813821 - RNA, 20 nt, Homo sapiens
uaguuuuauaaaacucaguu

SEQ ID NO: 813822 - RNA, 16 nt, Homo sapiens
uaguuuucaaaacaca

SEQ ID NO: 813823 - RNA, 23 nt, Homo sapiens
uaguuuugauccuaaaucugccu

SEQ ID NO: 813824 - RNA, 22 nt, Homo sapiens
uaguuuuuaccuaccacagugu

SEQ ID NO: 813825 - RNA, 20 nt, Homo sapiens
uauaaaaaagccacuggaau

SEQ ID NO: 813826 - RNA, 14 nt, Homo sapiens
uauaaaacagucau

SEQ ID NO: 813827 - RNA, 21 nt, Homo sapiens
uauaaaacagucauggccuga

SEQ ID NO: 813828 - RNA, 21 nt, Homo sapiens
uauaaaagaauaaaauugcac

SEQ ID NO: 813829 - RNA, 13 nt, Homo sapiens
uauaaaagcaaaa

SEQ ID NO: 813830 - RNA, 21 nt, Homo sapiens
uauaaaauauguacauaauau

SEQ ID NO: 813831 - RNA, 13 nt, Homo sapiens
uacagacaagguu

SEQ ID NO: 813832 - RNA, 17 nt, Homo sapiens
uacagagaagugaauaa

SEQ ID NO: 813833 - RNA, 20 nt, Homo sapiens
uacagagauuacuuugcugc

SEQ ID NO: 813834 - RNA, 19 nt, Homo sapiens
uacagagcacauuugucag

SEQ ID NO: 813835 - RNA, 13 nt, Homo sapiens
uacagagccacag

SEQ ID NO: 813836 - RNA, 22 nt, Homo sapiens
uacagauuuuaccuauccacaa

SEQ ID NO: 813837 - RNA, 16 nt, Homo sapiens
uacagccugcacacac

SEQ ID NO: 813838 - RNA, 17 nt, Homo sapiens
uacaggaaauugacuua

SEQ ID NO: 813839 - RNA, 21 nt, Homo sapiens
uacaggaagcaccccaugcca

SEQ ID NO: 813840 - RNA, 19 nt, Homo sapiens
uacaggaagguagaaauau

SEQ ID NO: 813841 - RNA, 19 nt, Homo sapiens
uacaggccauacuuuacaa

SEQ ID NO: 813842 - RNA, 20 nt, Homo sapiens
uacaggcgugauccaccaca

SEQ ID NO: 813843 - RNA, 15 nt, Homo sapiens
uacagguaugugcca

SEQ ID NO: 813844 - RNA, 19 nt, Homo sapiens
uacaggugaaggcucucac

SEQ ID NO: 813845 - RNA, 20 nt, Homo sapiens
uacagguuuuaaaagccuug

SEQ ID NO: 813846 - RNA, 13 nt, Homo sapiens
uacaguaccuugu

SEQ ID NO: 813847 - RNA, 19 nt, Homo sapiens
uacaguauguuuuacaugu

SEQ ID NO: 813848 - RNA, 22 nt, Homo sapiens
uacaguauuguggcugcacuug

SEQ ID NO: 813849 - RNA, 21 nt, Homo sapiens
uacagucuaaaauugcuucuu

SEQ ID NO: 813850 - RNA, 18 nt, Homo sapiens
uacagugagcucuagcaa

SEQ ID NO: 813851 - RNA, 13 nt, Homo sapiens
uacagugcuauuu

SEQ ID NO: 813852 - RNA, 20 nt, Homo sapiens
uacagugcuguguacccugg

SEQ ID NO: 813853 - RNA, 12 nt, Homo sapiens
uacagugguuuu

SEQ ID NO: 813854 - RNA, 20 nt, Homo sapiens
uacaguguagaguaacacau

SEQ ID NO: 813855 - RNA, 23 nt, Homo sapiens
uacaguguccuaccacucuaauc

SEQ ID NO: 813856 - RNA, 21 nt, Homo sapiens
uacaguuauuaaucuggacau

SEQ ID NO: 813857 - RNA, 20 nt, Homo sapiens
uacaguuugauuuuugacca

SEQ ID NO: 813858 - RNA, 18 nt, Homo sapiens
uacauaaaguacauaaca

SEQ ID NO: 813859 - RNA, 23 nt, Homo sapiens
uacauaacguucaguugggaugg

SEQ ID NO: 813860 - RNA, 14 nt, Homo sapiens
uacauaaggcugga

SEQ ID NO: 813861 - RNA, 13 nt, Homo sapiens
uacauaaguaauu

SEQ ID NO: 813862 - RNA, 16 nt, Homo sapiens
uacauacuauggaauu

SEQ ID NO: 813863 - RNA, 12 nt, Homo sapiens
uacauacugcug

SEQ ID NO: 813864 - RNA, 17 nt, Homo sapiens
uacauauaucucugugu

SEQ ID NO: 813865 - RNA, 12 nt, Homo sapiens
uacauaugcuga

SEQ ID NO: 813866 - RNA, 14 nt, Homo sapiens
uacauauguagaua

SEQ ID NO: 813867 - RNA, 22 nt, Homo sapiens
uacauauguauacaugugccau

SEQ ID NO: 813868 - RNA, 13 nt, Homo sapiens
uacaucaaagagu

SEQ ID NO: 813869 - RNA, 18 nt, Homo sapiens
uacaucaaugguguguua

SEQ ID NO: 813870 - RNA, 19 nt, Homo sapiens
uacaucaaugguguguuaa

SEQ ID NO: 813871 - RNA, 13 nt, Homo sapiens
uacaucuaaguca

SEQ ID NO: 813872 - RNA, 17 nt, Homo sapiens
uacaucucuacuaaaaa

SEQ ID NO: 813873 - RNA, 21 nt, Homo sapiens
uacaucuuaaaucuuuucaau

SEQ ID NO: 813874 - RNA, 12 nt, Homo sapiens
uacaucuuucac

SEQ ID NO: 813875 - RNA, 18 nt, Homo sapiens
uacaugaaacuacucaua

SEQ ID NO: 813876 - RNA, 20 nt, Homo sapiens
uacaugaaauaaugcacuga

SEQ ID NO: 813877 - RNA, 20 nt, Homo sapiens
uacaugaugcccugcugacc

SEQ ID NO: 813878 - RNA, 18 nt, Homo sapiens
uacaugcagcccaugccc

SEQ ID NO: 813879 - RNA, 19 nt, Homo sapiens
uacaugcagcccaugccca

SEQ ID NO: 813880 - RNA, 18 nt, Homo sapiens
uacauggaaaggauuuug

SEQ ID NO: 813881 - RNA, 13 nt, Homo sapiens
uacauguaaucca

SEQ ID NO: 813882 - RNA, 14 nt, Homo sapiens
uacaugucacauuu

SEQ ID NO: 813883 - RNA, 22 nt, Homo sapiens
uacaugucacauuuagcugugc

SEQ ID NO: 813884 - RNA, 18 nt, Homo sapiens
uacaugugagugacgaug

SEQ ID NO: 813885 - RNA, 18 nt, Homo sapiens
uacauuaaaaaaauucca

SEQ ID NO: 813886 - RNA, 13 nt, Homo sapiens
uacauuaaaucac

SEQ ID NO: 813887 - RNA, 17 nt, Homo sapiens
uacauuaacggugcuaa

SEQ ID NO: 813888 - RNA, 10 nt, Homo sapiens
uacauucaau

SEQ ID NO: 813889 - RNA, 12 nt, Homo sapiens
uacauucacuuc

SEQ ID NO: 813890 - RNA, 22 nt, Homo sapiens
uacauucugcaagcacaucugc

SEQ ID NO: 813891 - RNA, 11 nt, Homo sapiens
uacauucuucc

SEQ ID NO: 813892 - RNA, 19 nt, Homo sapiens
uacauucuuuaucuugaca

SEQ ID NO: 813893 - RNA, 16 nt, Homo sapiens
uacauugagcauuuga

SEQ ID NO: 813894 - RNA, 18 nt, Homo sapiens
uacauuggcacaauguau

SEQ ID NO: 813895 - RNA, 17 nt, Homo sapiens
uacauugugacuguguu

SEQ ID NO: 813896 - RNA, 19 nt, Homo sapiens
uacauugugggauguucag

SEQ ID NO: 813897 - RNA, 15 nt, Homo sapiens
uacauuuaauacagc

SEQ ID NO: 813898 - RNA, 19 nt, Homo sapiens
uacauuuaauagacuuaca

SEQ ID NO: 813899 - RNA, 15 nt, Homo sapiens
uacauuuaucacuga

SEQ ID NO: 813900 - RNA, 17 nt, Homo sapiens
uacauuucaccuacuuu

SEQ ID NO: 813901 - RNA, 18 nt, Homo sapiens
uacauuucaccuacuuug

SEQ ID NO: 813902 - RNA, 19 nt, Homo sapiens
uacauuuccaaauucacaa

SEQ ID NO: 813903 - RNA, 20 nt, Homo sapiens
uacauuucugcagaucuucc

SEQ ID NO: 813904 - RNA, 18 nt, Homo sapiens
uacauuucuuagacuaca

SEQ ID NO: 813905 - RNA, 15 nt, Homo sapiens
uacauuuguauuuau

SEQ ID NO: 813906 - RNA, 19 nt, Homo sapiens
uacauuuuuuaacuuucua

SEQ ID NO: 813907 - RNA, 15 nt, Homo sapiens
uaccaaaauguuaau

SEQ ID NO: 813908 - RNA, 18 nt, Homo sapiens
uaccaaagaagaguuuac

SEQ ID NO: 813909 - RNA, 18 nt, Homo sapiens
uaccaaauagcaauacaa

SEQ ID NO: 813910 - RNA, 17 nt, Homo sapiens
uaccaacauaaguguug

SEQ ID NO: 813911 - RNA, 18 nt, Homo sapiens
uaccaaguuuuauuguca

SEQ ID NO: 813912 - RNA, 22 nt, Homo sapiens
uaccaauaucuugccaguuuug

SEQ ID NO: 813913 - RNA, 17 nt, Homo sapiens
uaccacacauauugcac

SEQ ID NO: 813914 - RNA, 20 nt, Homo sapiens
uaccaccaagggaucugcca

SEQ ID NO: 813915 - RNA, 15 nt, Homo sapiens
uaccacucagagaaa

SEQ ID NO: 813916 - RNA, 17 nt, Homo sapiens
uaccagaaggagaugcu

SEQ ID NO: 813917 - RNA, 22 nt, Homo sapiens
uaccagagccuucaagugccaa

SEQ ID NO: 813918 - RNA, 23 nt, Homo sapiens
uaccagauguuuugauguuaucg

SEQ ID NO: 813919 - RNA, 15 nt, Homo sapiens
uaccagcaucuccca

SEQ ID NO: 813920 - RNA, 16 nt, Homo sapiens
uaccaguugguauuuc

SEQ ID NO: 813921 - RNA, 11 nt, Homo sapiens
uaccauagaaa

SEQ ID NO: 813922 - RNA, 17 nt, Homo sapiens
uaccauauucagcauuu

SEQ ID NO: 813923 - RNA, 21 nt, Homo sapiens
uaccauugaaggaaagcuaua

SEQ ID NO: 813924 - RNA, 20 nt, Homo sapiens
uaccauugcuguucuacuuu

SEQ ID NO: 813925 - RNA, 15 nt, Homo sapiens
uaccauuucuguuga

SEQ ID NO: 813926 - RNA, 17 nt, Homo sapiens
uacccaaaggucuucaa

SEQ ID NO: 813927 - RNA, 14 nt, Homo sapiens
uacccaagcugugg

SEQ ID NO: 813928 - RNA, 13 nt, Homo sapiens
uacccacauguac

SEQ ID NO: 813929 - RNA, 14 nt, Homo sapiens
uacccacauguaca

SEQ ID NO: 813930 - RNA, 21 nt, Homo sapiens
uacccacauguacagacauac

SEQ ID NO: 813931 - RNA, 15 nt, Homo sapiens
uacccaccaccuucu

SEQ ID NO: 813932 - RNA, 12 nt, Homo sapiens
uacccacuucca

SEQ ID NO: 813933 - RNA, 17 nt, Homo sapiens
uacccagaaaguuauug

SEQ ID NO: 813934 - RNA, 19 nt, Homo sapiens
uacccaggaccaagccaca

SEQ ID NO: 813935 - RNA, 20 nt, Homo sapiens
uacccaggcuggagugcagu

SEQ ID NO: 813936 - RNA, 19 nt, Homo sapiens
uacccaggcuuuagcauua

SEQ ID NO: 813937 - RNA, 19 nt, Homo sapiens
uacccauagcuuccaugag

SEQ ID NO: 813938 - RNA, 21 nt, Homo sapiens
uacccauuuuuuaaaaaagca

SEQ ID NO: 813939 - RNA, 20 nt, Homo sapiens
uaccccagacuagauguagu

SEQ ID NO: 813940 - RNA, 22 nt, Homo sapiens
uaccccugcuaaggaguucuca

SEQ ID NO: 813941 - RNA, 15 nt, Homo sapiens
uaccccugcucccau

SEQ ID NO: 813942 - RNA, 19 nt, Homo sapiens
uaccccugcucccauuccu

SEQ ID NO: 813943 - RNA, 16 nt, Homo sapiens
uaccccuuugcacuug

SEQ ID NO: 813944 - RNA, 21 nt, Homo sapiens
uacccgggcagggcucccaca

SEQ ID NO: 813945 - RNA, 15 nt, Homo sapiens
uacccuaaagugcaa

SEQ ID NO: 813946 - RNA, 14 nt, Homo sapiens
uaguuuuacuuuua

SEQ ID NO: 813947 - RNA, 15 nt, Homo sapiens
uaguuuucagccuug

SEQ ID NO: 813948 - RNA, 23 nt, Homo sapiens
uaguuuuugaucaagaaugcaau

SEQ ID NO: 813949 - RNA, 14 nt, Homo sapiens
uauaaaaaacacua

SEQ ID NO: 813950 - RNA, 15 nt, Homo sapiens
uauaaaaacaaaaac

SEQ ID NO: 813951 - RNA, 18 nt, Homo sapiens
uauaaaaaugagugcuua

SEQ ID NO: 813952 - RNA, 19 nt, Homo sapiens
uauaaaaaugagugcuuaa

SEQ ID NO: 813953 - RNA, 20 nt, Homo sapiens
uauaaaauagacuuacugca

SEQ ID NO: 813954 - RNA, 18 nt, Homo sapiens
uauaaagaacuuguguag

SEQ ID NO: 813955 - RNA, 15 nt, Homo sapiens
uauaaagacaacaaa

SEQ ID NO: 813956 - RNA, 16 nt, Homo sapiens
uauaaagaccuauaaa

SEQ ID NO: 813957 - RNA, 21 nt, Homo sapiens
uauaaagauacuaaaccagca

SEQ ID NO: 813958 - RNA, 21 nt, Homo sapiens
uauaaagcacagauuugcauu

SEQ ID NO: 813959 - RNA, 23 nt, Homo sapiens
uauaaagcaguauuuuucuugac

SEQ ID NO: 813960 - RNA, 19 nt, Homo sapiens
uauaaaggccagcgccaga

SEQ ID NO: 813961 - RNA, 15 nt, Homo sapiens
uauaaagucuaagca

SEQ ID NO: 813962 - RNA, 22 nt, Homo sapiens
uauaaaguuuuauuugaaugaa

SEQ ID NO: 813963 - RNA, 17 nt, Homo sapiens
uauaaauacaugcacac

SEQ ID NO: 813964 - RNA, 16 nt, Homo sapiens
uauaaaucaaugucac

SEQ ID NO: 813965 - RNA, 17 nt, Homo sapiens
uauaaaucaugaugcua

SEQ ID NO: 813966 - RNA, 15 nt, Homo sapiens
uauaaaugaauuugc

SEQ ID NO: 813967 - RNA, 17 nt, Homo sapiens
uauaaauguaccagaga

SEQ ID NO: 813968 - RNA, 14 nt, Homo sapiens
uauaaauuauaucc

SEQ ID NO: 813969 - RNA, 23 nt, Homo sapiens
uauaaauuuucccaaaacugaua

SEQ ID NO: 813970 - RNA, 18 nt, Homo sapiens
uauaaauuuuuaccuguu

SEQ ID NO: 813971 - RNA, 15 nt, Homo sapiens
uauaacaaucacugg

SEQ ID NO: 813972 - RNA, 14 nt, Homo sapiens
uauaacagaauuaa

SEQ ID NO: 813973 - RNA, 13 nt, Homo sapiens
uauaacaguguuu

SEQ ID NO: 813974 - RNA, 14 nt, Homo sapiens
uauaacaugcaaac

SEQ ID NO: 813975 - RNA, 22 nt, Homo sapiens
uauaacaugucuuucagcauua

SEQ ID NO: 813976 - RNA, 13 nt, Homo sapiens
uauaaccaaaagg

SEQ ID NO: 813977 - RNA, 19 nt, Homo sapiens
uauaaccauaugauacuau

SEQ ID NO: 813978 - RNA, 23 nt, Homo sapiens
uauaacccuaggaauuuagacaa

SEQ ID NO: 813979 - RNA, 12 nt, Homo sapiens
uauaacucugca

SEQ ID NO: 813980 - RNA, 23 nt, Homo sapiens
uauaacuggauugcagacuguuc

SEQ ID NO: 813981 - RNA, 12 nt, Homo sapiens
uauaacuguaaa

SEQ ID NO: 813982 - RNA, 16 nt, Homo sapiens
uauaacuguauuugaa

SEQ ID NO: 813983 - RNA, 12 nt, Homo sapiens
uauaacugucuu

SEQ ID NO: 813984 - RNA, 22 nt, Homo sapiens
uauaagaaaagcagacgcagca

SEQ ID NO: 813985 - RNA, 16 nt, Homo sapiens
uauaagaaagaucaaa

SEQ ID NO: 813986 - RNA, 21 nt, Homo sapiens
uauaagacuauuccaacuggg

SEQ ID NO: 813987 - RNA, 22 nt, Homo sapiens
uauaagagggcauauacaguga

SEQ ID NO: 813988 - RNA, 14 nt, Homo sapiens
uauaagcaacuuca

SEQ ID NO: 813989 - RNA, 20 nt, Homo sapiens
uauaagcagauuuaacaauu

SEQ ID NO: 813990 - RNA, 16 nt, Homo sapiens
uauaagcaucugccau

SEQ ID NO: 813991 - RNA, 14 nt, Homo sapiens
uauaagccaguuca

SEQ ID NO: 813992 - RNA, 22 nt, Homo sapiens
uauaagcccacuguuaauauuc

SEQ ID NO: 813993 - RNA, 17 nt, Homo sapiens
uauaagguaugugcuau

SEQ ID NO: 813994 - RNA, 22 nt, Homo sapiens
uauaaguaauacuucaguaaua

SEQ ID NO: 813995 - RNA, 13 nt, Homo sapiens
uauaaguauucaa

SEQ ID NO: 813996 - RNA, 12 nt, Homo sapiens
uauaagugcuca

SEQ ID NO: 813997 - RNA, 19 nt, Homo sapiens
uauaaucccacccaccuca

SEQ ID NO: 813998 - RNA, 22 nt, Homo sapiens
uauaaugaaugacuuccccaau

SEQ ID NO: 813999 - RNA, 22 nt, Homo sapiens
uauaauguacagaagagcaaaa

SEQ ID NO: 814000 - RNA, 15 nt, Homo sapiens
uauaauguugccagc

SEQ ID NO: 814001 - RNA, 20 nt, Homo sapiens
uauaauuuccauagugugag

SEQ ID NO: 814002 - RNA, 12 nt, Homo sapiens
uauacacugugu

SEQ ID NO: 814003 - RNA, 23 nt, Homo sapiens
uauacacuuacacuuuaugcaca

SEQ ID NO: 814004 - RNA, 13 nt, Homo sapiens
uauacagcuguau

SEQ ID NO: 814005 - RNA, 16 nt, Homo sapiens
uauacaggcauaaaau

SEQ ID NO: 814006 - RNA, 14 nt, Homo sapiens
uauacagugauaua

SEQ ID NO: 814007 - RNA, 21 nt, Homo sapiens
uauacauaaaguauccaugca

SEQ ID NO: 814008 - RNA, 10 nt, Homo sapiens
uauacauaug

SEQ ID NO: 814009 - RNA, 21 nt, Homo sapiens
uauacauaugagaauauaccu

SEQ ID NO: 814010 - RNA, 23 nt, Homo sapiens
uauacauuuuuuaggacaucuua

SEQ ID NO: 814011 - RNA, 13 nt, Homo sapiens
uauaccaaaaggg

SEQ ID NO: 814012 - RNA, 15 nt, Homo sapiens
uauaccucaaugucc

SEQ ID NO: 814013 - RNA, 16 nt, Homo sapiens
uauacgcccuugagcu

SEQ ID NO: 814014 - RNA, 20 nt, Homo sapiens
uauacuagggagccauuuga

SEQ ID NO: 814015 - RNA, 23 nt, Homo sapiens
uauacugcacuuacgcuauccag

SEQ ID NO: 814016 - RNA, 19 nt, Homo sapiens
uauacuguagcugaugaaa

SEQ ID NO: 814017 - RNA, 15 nt, Homo sapiens
uauacuuacuucugg

SEQ ID NO: 814018 - RNA, 15 nt, Homo sapiens
uauacuucagugcuc

SEQ ID NO: 814019 - RNA, 11 nt, Homo sapiens
uauacuuucag

SEQ ID NO: 814020 - RNA, 14 nt, Homo sapiens
uauacuuuugugaa

SEQ ID NO: 814021 - RNA, 14 nt, Homo sapiens
uauagaaguagcaa

SEQ ID NO: 814022 - RNA, 18 nt, Homo sapiens
uauagaauaaaagcuaua

SEQ ID NO: 814023 - RNA, 15 nt, Homo sapiens
uauagacaaauaaua

SEQ ID NO: 814024 - RNA, 17 nt, Homo sapiens
uauagacauucucacau

SEQ ID NO: 814025 - RNA, 14 nt, Homo sapiens
uauagacucuagga

SEQ ID NO: 814026 - RNA, 19 nt, Homo sapiens
uauagagaauaaggcacaa

SEQ ID NO: 814027 - RNA, 18 nt, Homo sapiens
uauagaugaguuuugcca

SEQ ID NO: 814028 - RNA, 16 nt, Homo sapiens
uauagcugcuuggauu

SEQ ID NO: 814029 - RNA, 20 nt, Homo sapiens
uauagcuugcauagucaaua

SEQ ID NO: 814030 - RNA, 15 nt, Homo sapiens
uauaggaacaauucu

SEQ ID NO: 814031 - RNA, 21 nt, Homo sapiens
uauaggcaugagccacugagc

SEQ ID NO: 814032 - RNA, 12 nt, Homo sapiens
uauagggaugag

SEQ ID NO: 814033 - RNA, 15 nt, Homo sapiens
uauaggucacuccug

SEQ ID NO: 814034 - RNA, 19 nt, Homo sapiens
uauaggucucaucucuuca

SEQ ID NO: 814035 - RNA, 14 nt, Homo sapiens
uauaguaaaugccu

SEQ ID NO: 814036 - RNA, 14 nt, Homo sapiens
uauaguacuggcau

SEQ ID NO: 814037 - RNA, 17 nt, Homo sapiens
uauaguauaagcagugu

SEQ ID NO: 814038 - RNA, 20 nt, Homo sapiens
uauaguccagacacuuaacu

SEQ ID NO: 814039 - RNA, 19 nt, Homo sapiens
uauagugucaugcagagua

SEQ ID NO: 814040 - RNA, 22 nt, Homo sapiens
uauaguguucacaaacugugaa

SEQ ID NO: 814041 - RNA, 21 nt, Homo sapiens
uauaguuauugcacaaguuca

SEQ ID NO: 814042 - RNA, 16 nt, Homo sapiens
uauaguuucugaggcu

SEQ ID NO: 814043 - RNA, 16 nt, Homo sapiens
uauauaaagacugccu

SEQ ID NO: 814044 - RNA, 13 nt, Homo sapiens
uauauaaguugcu

SEQ ID NO: 814045 - RNA, 13 nt, Homo sapiens
uauauaaguuuac

SEQ ID NO: 814046 - RNA, 12 nt, Homo sapiens
uauauacauaua

SEQ ID NO: 814047 - RNA, 13 nt, Homo sapiens
uauauaccaagcu

SEQ ID NO: 814048 - RNA, 16 nt, Homo sapiens
uauauagaaugaucua

SEQ ID NO: 814049 - RNA, 15 nt, Homo sapiens
uauauagcagcuuua

SEQ ID NO: 814050 - RNA, 17 nt, Homo sapiens
uauauaguaugaaugca

SEQ ID NO: 814051 - RNA, 14 nt, Homo sapiens
uauauauauaugca

SEQ ID NO: 814052 - RNA, 16 nt, Homo sapiens
uauauauauguguaua

SEQ ID NO: 814053 - RNA, 21 nt, Homo sapiens
uauauauuuaauugauuucug

SEQ ID NO: 814054 - RNA, 13 nt, Homo sapiens
uauauauuuacau

SEQ ID NO: 814055 - RNA, 19 nt, Homo sapiens
uauauauuuauaacucauc

SEQ ID NO: 814056 - RNA, 21 nt, Homo sapiens
uauauauuuuaagguugcaca

SEQ ID NO: 814057 - RNA, 20 nt, Homo sapiens
uauaucauaacuauacuuga

SEQ ID NO: 814058 - RNA, 13 nt, Homo sapiens
uauaucauaugua

SEQ ID NO: 814059 - RNA, 17 nt, Homo sapiens
uauaucauucuaaagau

SEQ ID NO: 814060 - RNA, 13 nt, Homo sapiens
uauauccauaaga

SEQ ID NO: 814061 - RNA, 19 nt, Homo sapiens
ucuugggaagaccagcuuu

SEQ ID NO: 814062 - RNA, 13 nt, Homo sapiens
ucuuggggccacu

SEQ ID NO: 814063 - RNA, 23 nt, Homo sapiens
ucuuggggggguggccgcugagu

SEQ ID NO: 814064 - RNA, 19 nt, Homo sapiens
ucuugggucccccacguga

SEQ ID NO: 814065 - RNA, 11 nt, Homo sapiens
ucuugggucuu

SEQ ID NO: 814066 - RNA, 18 nt, Homo sapiens
ucuuggguucaagugauu

SEQ ID NO: 814067 - RNA, 15 nt, Homo sapiens
ucuugguacuacuag

SEQ ID NO: 814068 - RNA, 17 nt, Homo sapiens
ucuuggugaacacacau

SEQ ID NO: 814069 - RNA, 20 nt, Homo sapiens
ucuuguauaagauccuagau

SEQ ID NO: 814070 - RNA, 17 nt, Homo sapiens
ucuuguuaaagauuuca

SEQ ID NO: 814071 - RNA, 15 nt, Homo sapiens
ucuuguucuacugag

SEQ ID NO: 814072 - RNA, 15 nt, Homo sapiens
ucuuguuuaccaaag

SEQ ID NO: 814073 - RNA, 22 nt, Homo sapiens
ucuuguuucaauuccaccugca

SEQ ID NO: 814074 - RNA, 15 nt, Homo sapiens
ucuuguuucccagau

SEQ ID NO: 814075 - RNA, 18 nt, Homo sapiens
ucuuguuuuaagugccuu

SEQ ID NO: 814076 - RNA, 20 nt, Homo sapiens
ucuuuaaaaguauccagaga

SEQ ID NO: 814077 - RNA, 22 nt, Homo sapiens
ucuuuaaacacucuucagagaa

SEQ ID NO: 814078 - RNA, 20 nt, Homo sapiens
ucuuuaaacugguuguucug

SEQ ID NO: 814079 - RNA, 13 nt, Homo sapiens
ucuuuaacacagc

SEQ ID NO: 814080 - RNA, 18 nt, Homo sapiens
ucuuuaaguuuugauuaa

SEQ ID NO: 814081 - RNA, 20 nt, Homo sapiens
ucuuuaauuuguuaucucaa

SEQ ID NO: 814082 - RNA, 20 nt, Homo sapiens
ucuuuacaaaaaaauacaaa

SEQ ID NO: 814083 - RNA, 12 nt, Homo sapiens
ucuuuaccugag

SEQ ID NO: 814084 - RNA, 15 nt, Homo sapiens
ucuuuagaacaggga

SEQ ID NO: 814085 - RNA, 14 nt, Homo sapiens
ucuuuagugucuga

SEQ ID NO: 814086 - RNA, 18 nt, Homo sapiens
ucuuuauaaucuacuccu

SEQ ID NO: 814087 - RNA, 14 nt, Homo sapiens
ucuuuaugacuguu

SEQ ID NO: 814088 - RNA, 18 nt, Homo sapiens
ucuuuauguccauaagcu

SEQ ID NO: 814089 - RNA, 23 nt, Homo sapiens
ucuuucacacuuccaccagccug

SEQ ID NO: 814090 - RNA, 20 nt, Homo sapiens
ucuuucacauuguuugcugc

SEQ ID NO: 814091 - RNA, 20 nt, Homo sapiens
ucuuucaggacucuaccuca

SEQ ID NO: 814092 - RNA, 21 nt, Homo sapiens
ucuuucaggacucuaccucau

SEQ ID NO: 814093 - RNA, 16 nt, Homo sapiens
ucuuucaucucugcuu

SEQ ID NO: 814094 - RNA, 20 nt, Homo sapiens
ucuuucaugggcaccaaccu

SEQ ID NO: 814095 - RNA, 13 nt, Homo sapiens
ucuuuccaaaaca

SEQ ID NO: 814096 - RNA, 15 nt, Homo sapiens
ucuuuccaggcuucc

SEQ ID NO: 814097 - RNA, 15 nt, Homo sapiens
ucuuuccucccugaa

SEQ ID NO: 814098 - RNA, 22 nt, Homo sapiens
ucuuuccucccugaagcugugc

SEQ ID NO: 814099 - RNA, 21 nt, Homo sapiens
ucuuucuagaggugcuacaua

SEQ ID NO: 814100 - RNA, 22 nt, Homo sapiens
ucuuucucccccaccucuugcg

SEQ ID NO: 814101 - RNA, 19 nt, Homo sapiens
ucuuucucccucaccccca

SEQ ID NO: 814102 - RNA, 14 nt, Homo sapiens
ucuuucugauaaca

SEQ ID NO: 814103 - RNA, 22 nt, Homo sapiens
ucuuucuuugcaccaaagacau

SEQ ID NO: 814104 - RNA, 16 nt, Homo sapiens
ucuuugaacagguuuu

SEQ ID NO: 814105 - RNA, 17 nt, Homo sapiens
ucuuugaagagauuuca

SEQ ID NO: 814106 - RNA, 14 nt, Homo sapiens
ucuuugaggugauu

SEQ ID NO: 814107 - RNA, 17 nt, Homo sapiens
ucuuugcccacaaugcu

SEQ ID NO: 814108 - RNA, 21 nt, Homo sapiens
ucuuugccggaggaaaagcag

SEQ ID NO: 814109 - RNA, 20 nt, Homo sapiens
ucuuugcucccugcaagaaa

SEQ ID NO: 814110 - RNA, 15 nt, Homo sapiens
ucuuugcugcaguca

SEQ ID NO: 814111 - RNA, 12 nt, Homo sapiens
ucuuugcugcug

SEQ ID NO: 814112 - RNA, 16 nt, Homo sapiens
ucuuuggacaaccaug

SEQ ID NO: 814113 - RNA, 22 nt, Homo sapiens
ucuuugggccagacaugccaca

SEQ ID NO: 814114 - RNA, 16 nt, Homo sapiens
ucuuugguucuaagga

SEQ ID NO: 814115 - RNA, 13 nt, Homo sapiens
ucuuugugugaca

SEQ ID NO: 814116 - RNA, 15 nt, Homo sapiens
ucuuugugugacaug

SEQ ID NO: 814117 - RNA, 16 nt, Homo sapiens
ucuuuuaaaaucauga

SEQ ID NO: 814118 - RNA, 16 nt, Homo sapiens
ucuuuuaagcuaucca

SEQ ID NO: 814119 - RNA, 22 nt, Homo sapiens
ucuuuuacccggcacauucccc

SEQ ID NO: 814120 - RNA, 19 nt, Homo sapiens
ucuuuucccuucagucuuc

SEQ ID NO: 814121 - RNA, 23 nt, Homo sapiens
ucuuuucugcaucaucuguagau

SEQ ID NO: 814122 - RNA, 18 nt, Homo sapiens
ucuuuucuucuauggggu

SEQ ID NO: 814123 - RNA, 18 nt, Homo sapiens
ucuuuugaaggacuccuu

SEQ ID NO: 814124 - RNA, 20 nt, Homo sapiens
ucuuuugacauaacuaucuu

SEQ ID NO: 814125 - RNA, 17 nt, Homo sapiens
ucuuuugcacaaggaaa

SEQ ID NO: 814126 - RNA, 14 nt, Homo sapiens
ucuuuuuacuguug

SEQ ID NO: 814127 - RNA, 17 nt, Homo sapiens
ucuuuuuguacuuugga

SEQ ID NO: 814128 - RNA, 22 nt, Homo sapiens
ucuuuuuuuuuaaguucuuaug

SEQ ID NO: 814129 - RNA, 21 nt, Homo sapiens
ugaaaaaaggacaauuucaaa

SEQ ID NO: 814130 - RNA, 19 nt, Homo sapiens
ugaaaaaauauauguauau

SEQ ID NO: 814131 - RNA, 17 nt, Homo sapiens
ugaaaaacagaaagcau

SEQ ID NO: 814132 - RNA, 20 nt, Homo sapiens
ugaaaaaucacauccuggcc

SEQ ID NO: 814133 - RNA, 19 nt, Homo sapiens
ugaaaaauggcaaagaauu

SEQ ID NO: 814134 - RNA, 22 nt, Homo sapiens
ugaaaaaugguaauuguugcua

SEQ ID NO: 814135 - RNA, 18 nt, Homo sapiens
ugaaaacagugucuugag

SEQ ID NO: 814136 - RNA, 21 nt, Homo sapiens
ugaaaacauagcaucucagga

SEQ ID NO: 814137 - RNA, 12 nt, Homo sapiens
ugaaaacucuau

SEQ ID NO: 814138 - RNA, 17 nt, Homo sapiens
ugaaaacuuagccagag

SEQ ID NO: 814139 - RNA, 16 nt, Homo sapiens
ugaaaagaaucagcau

SEQ ID NO: 814140 - RNA, 17 nt, Homo sapiens
ugaaaagacucaguguu

SEQ ID NO: 814141 - RNA, 21 nt, Homo sapiens
ugaaaagcaguucaugucuga

SEQ ID NO: 814142 - RNA, 15 nt, Homo sapiens
ugaaaagguugccug

SEQ ID NO: 814143 - RNA, 13 nt, Homo sapiens
ugaaaagugugua

SEQ ID NO: 814144 - RNA, 19 nt, Homo sapiens
ugaaaaguugaaaugugua

SEQ ID NO: 814145 - RNA, 16 nt, Homo sapiens
ugaaaauaauggaauu

SEQ ID NO: 814146 - RNA, 22 nt, Homo sapiens
ugaaaauacaacuuaaauaaua

SEQ ID NO: 814147 - RNA, 19 nt, Homo sapiens
ugaaaauauagacauucuc

SEQ ID NO: 814148 - RNA, 19 nt, Homo sapiens
ugaaaauauucuacuggcc

SEQ ID NO: 814149 - RNA, 13 nt, Homo sapiens
ugaaaaucaaaua

SEQ ID NO: 814150 - RNA, 16 nt, Homo sapiens
ugaaaauccaucucau

SEQ ID NO: 814151 - RNA, 13 nt, Homo sapiens
ugaaaaucuccau

SEQ ID NO: 814152 - RNA, 17 nt, Homo sapiens
ugaaaaucuccaucuca

SEQ ID NO: 814153 - RNA, 12 nt, Homo sapiens
ugaaaaugcaaa

SEQ ID NO: 814154 - RNA, 18 nt, Homo sapiens
ugaaaaugcaucacauga

SEQ ID NO: 814155 - RNA, 22 nt, Homo sapiens
ugaaaauguauguguaaguauu

SEQ ID NO: 814156 - RNA, 17 nt, Homo sapiens
ugaaaauguccaggaaa

SEQ ID NO: 814157 - RNA, 17 nt, Homo sapiens
ugaaacaauguugucca

SEQ ID NO: 814158 - RNA, 21 nt, Homo sapiens
ugaaacacucaguuguucaau

SEQ ID NO: 814159 - RNA, 16 nt, Homo sapiens
ugaaacagaacuugac

SEQ ID NO: 814160 - RNA, 12 nt, Homo sapiens
ugaaacagagaa

SEQ ID NO: 814161 - RNA, 13 nt, Homo sapiens
ugaaaccaggugg

SEQ ID NO: 814162 - RNA, 15 nt, Homo sapiens
ugaaaccccgucucu

SEQ ID NO: 814163 - RNA, 23 nt, Homo sapiens
ugaaaccuuaguuucaagagucu

SEQ ID NO: 814164 - RNA, 17 nt, Homo sapiens
ugaaacuaggguuugaa

SEQ ID NO: 814165 - RNA, 20 nt, Homo sapiens
ugaaacuccaucucuacuga

SEQ ID NO: 814166 - RNA, 20 nt, Homo sapiens
ugaaacuccaugcaaaccau

SEQ ID NO: 814167 - RNA, 24 nt, Homo sapiens
ugaaacuuuagagauuaacgacaa

SEQ ID NO: 814168 - RNA, 13 nt, Homo sapiens
ugaaagaaaccac

SEQ ID NO: 814169 - RNA, 22 nt, Homo sapiens
ugaaagaagagaugagaaauga

SEQ ID NO: 814170 - RNA, 19 nt, Homo sapiens
ugaaagaagaguuccaugg

SEQ ID NO: 814171 - RNA, 20 nt, Homo sapiens
ugaaagaagaguuccauggu

SEQ ID NO: 814172 - RNA, 16 nt, Homo sapiens
ugaaagacauguaacu

SEQ ID NO: 814173 - RNA, 22 nt, Homo sapiens
ugaaagaggacguguuacccac

SEQ ID NO: 814174 - RNA, 18 nt, Homo sapiens
ugaaagaggcagcuugaa

SEQ ID NO: 814175 - RNA, 15 nt, Homo sapiens
ugacauaccuaccag

SEQ ID NO: 814176 - RNA, 21 nt, Homo sapiens
ugacauaccuaccaguauuau

SEQ ID NO: 814177 - RNA, 18 nt, Homo sapiens
ugacaucucaguucacug

SEQ ID NO: 814178 - RNA, 17 nt, Homo sapiens
ugacaugauauagucag

SEQ ID NO: 814179 - RNA, 15 nt, Homo sapiens
ugacaugcacugacc

SEQ ID NO: 814180 - RNA, 15 nt, Homo sapiens
ugacauguggggcca

SEQ ID NO: 814181 - RNA, 23 nt, Homo sapiens
ugacauucacccuucaacauaaa

SEQ ID NO: 814182 - RNA, 19 nt, Homo sapiens
ugacauucuuagcuguaac

SEQ ID NO: 814183 - RNA, 19 nt, Homo sapiens
ugaccaaauaaaguaccau

SEQ ID NO: 814184 - RNA, 20 nt, Homo sapiens
ugaccaagagagaaagaagu

SEQ ID NO: 814185 - RNA, 15 nt, Homo sapiens
ugaccaauacauuug

SEQ ID NO: 814186 - RNA, 11 nt, Homo sapiens
ugaccaggaac

SEQ ID NO: 814187 - RNA, 22 nt, Homo sapiens
ugaccaggaucccaagccuccu

SEQ ID NO: 814188 - RNA, 14 nt, Homo sapiens
ugaccaucugugac

SEQ ID NO: 814189 - RNA, 15 nt, Homo sapiens
ugaccaucugugacu

SEQ ID NO: 814190 - RNA, 22 nt, Homo sapiens
ugaccauggaggccagugccag

SEQ ID NO: 814191 - RNA, 15 nt, Homo sapiens
ugacccacccagugu

SEQ ID NO: 814192 - RNA, 17 nt, Homo sapiens
ugacccagcaucuccca

SEQ ID NO: 814193 - RNA, 15 nt, Homo sapiens
ugacccagccugaaa

SEQ ID NO: 814194 - RNA, 16 nt, Homo sapiens
ugaccccugaccucac

SEQ ID NO: 814195 - RNA, 21 nt, Homo sapiens
ugacccuaugggucuaggaca

SEQ ID NO: 814196 - RNA, 17 nt, Homo sapiens
ugacccuccccuaguca

SEQ ID NO: 814197 - RNA, 20 nt, Homo sapiens
ugacccucugacccuagcuc

SEQ ID NO: 814198 - RNA, 19 nt, Homo sapiens
ugacccuggucaccagagg

SEQ ID NO: 814199 - RNA, 15 nt, Homo sapiens
ugaccggaucuacac

SEQ ID NO: 814200 - RNA, 11 nt, Homo sapiens
ugaccuacccc

SEQ ID NO: 814201 - RNA, 22 nt, Homo sapiens
ugaccuaccucaaagggcaguu

SEQ ID NO: 814202 - RNA, 14 nt, Homo sapiens
ugaccucacaguga

SEQ ID NO: 814203 - RNA, 15 nt, Homo sapiens
ugaccucaccugguc

SEQ ID NO: 814204 - RNA, 17 nt, Homo sapiens
ugaccucaggugaucca

SEQ ID NO: 814205 - RNA, 17 nt, Homo sapiens
ugaccuccauuucccaa

SEQ ID NO: 814206 - RNA, 15 nt, Homo sapiens
ugaccucccagugac

SEQ ID NO: 814207 - RNA, 17 nt, Homo sapiens
ugaccuccgccauccac

SEQ ID NO: 814208 - RNA, 17 nt, Homo sapiens
ugaccucgugaucugcc

SEQ ID NO: 814209 - RNA, 16 nt, Homo sapiens
ugaccucugccccaga

SEQ ID NO: 814210 - RNA, 18 nt, Homo sapiens
ugaccugagaugugugau

SEQ ID NO: 814211 - RNA, 19 nt, Homo sapiens
ugaccugagaugugugauu

SEQ ID NO: 814212 - RNA, 18 nt, Homo sapiens
ugaccuggaaucagugaa

SEQ ID NO: 814213 - RNA, 22 nt, Homo sapiens
ugaccuggaaucagugaagcca

SEQ ID NO: 814214 - RNA, 19 nt, Homo sapiens
ugaccugucuauaagagaa

SEQ ID NO: 814215 - RNA, 14 nt, Homo sapiens
ugaccugugaccag

SEQ ID NO: 814216 - RNA, 15 nt, Homo sapiens
ugaccuugcaauguu

SEQ ID NO: 814217 - RNA, 15 nt, Homo sapiens
ugacgacaagugcug

SEQ ID NO: 814218 - RNA, 17 nt, Homo sapiens
ugacgauguucuguaca

SEQ ID NO: 814219 - RNA, 23 nt, Homo sapiens
ugacgccugauggugcugcucag

SEQ ID NO: 814220 - RNA, 12 nt, Homo sapiens
ugacgcuggaag

SEQ ID NO: 814221 - RNA, 12 nt, Homo sapiens
ugacgcuucccu

SEQ ID NO: 814222 - RNA, 18 nt, Homo sapiens
ugacgcuugugacagugc

SEQ ID NO: 814223 - RNA, 18 nt, Homo sapiens
ugacggcgcccccagugu

SEQ ID NO: 814224 - RNA, 12 nt, Homo sapiens
ugacuaaacaac

SEQ ID NO: 814225 - RNA, 19 nt, Homo sapiens
ugacuaaagcuauguuaca

SEQ ID NO: 814226 - RNA, 19 nt, Homo sapiens
ugacuaauuaggcaaggcu

SEQ ID NO: 814227 - RNA, 21 nt, Homo sapiens
ugacuacugcccacaccaacg

SEQ ID NO: 814228 - RNA, 17 nt, Homo sapiens
ugacuauggcuaccaaa

SEQ ID NO: 814229 - RNA, 22 nt, Homo sapiens
ugacuaugggagucaacucaac

SEQ ID NO: 814230 - RNA, 21 nt, Homo sapiens
ugacuauucuugauguaaaau

SEQ ID NO: 814231 - RNA, 19 nt, Homo sapiens
ugacucaauuauuugcaua

SEQ ID NO: 814232 - RNA, 16 nt, Homo sapiens
ugacucacuuauccca

SEQ ID NO: 814233 - RNA, 22 nt, Homo sapiens
ugacucagcauagauuguauaa

SEQ ID NO: 814234 - RNA, 22 nt, Homo sapiens
ugacuccauucaaaucuacggu

SEQ ID NO: 814235 - RNA, 18 nt, Homo sapiens
ugacucccaaguuuccau

SEQ ID NO: 814236 - RNA, 23 nt, Homo sapiens
ugacuccuguugccauggauuca

SEQ ID NO: 814237 - RNA, 21 nt, Homo sapiens
ugacucucgugcauuucaacu

SEQ ID NO: 814238 - RNA, 12 nt, Homo sapiens
ugacucuggaag

SEQ ID NO: 814239 - RNA, 14 nt, Homo sapiens
ugacugaagcacag

SEQ ID NO: 814240 - RNA, 19 nt, Homo sapiens
ugacugaagugaacuauga

SEQ ID NO: 814241 - RNA, 16 nt, Homo sapiens
ugacugagauggagug

SEQ ID NO: 814242 - RNA, 21 nt, Homo sapiens
ugacugauagcuuacacugag

SEQ ID NO: 814243 - RNA, 22 nt, Homo sapiens
ugacugauagcuuacacugagg

SEQ ID NO: 814244 - RNA, 14 nt, Homo sapiens
ugacugcaccagcg

SEQ ID NO: 814245 - RNA, 16 nt, Homo sapiens
ugacugccaagccaga

SEQ ID NO: 814246 - RNA, 17 nt, Homo sapiens
ugacugccaagccagau

SEQ ID NO: 814247 - RNA, 20 nt, Homo sapiens
ugacugcucagaacuugcug

SEQ ID NO: 814248 - RNA, 13 nt, Homo sapiens
ugacugcuuuuaa

SEQ ID NO: 814249 - RNA, 22 nt, Homo sapiens
ugacuggaaguuguggauauca

SEQ ID NO: 814250 - RNA, 23 nt, Homo sapiens
ugacuggcagggcuuugggcagu

SEQ ID NO: 814251 - RNA, 15 nt, Homo sapiens
ugacugucucacuua

SEQ ID NO: 814252 - RNA, 16 nt, Homo sapiens
ugacuguguuugcauu

SEQ ID NO: 814253 - RNA, 15 nt, Homo sapiens
ugacuuaaguggcau

SEQ ID NO: 814254 - RNA, 21 nt, Homo sapiens
ugacuucucaacgccaaguca

SEQ ID NO: 814255 - RNA, 16 nt, Homo sapiens
ugacuugaaaugcucu

SEQ ID NO: 814256 - RNA, 17 nt, Homo sapiens
ugacuugaaaugcucuu

SEQ ID NO: 814257 - RNA, 21 nt, Homo sapiens
ugacuugaaaugcucuuuugc

SEQ ID NO: 814258 - RNA, 17 nt, Homo sapiens
ugacuugugucccauga

SEQ ID NO: 814259 - RNA, 21 nt, Homo sapiens
ugagaaaaguucaauacucuu

SEQ ID NO: 814260 - RNA, 22 nt, Homo sapiens
ugagaaaauaucuugcuuucaa

SEQ ID NO: 814261 - RNA, 13 nt, Homo sapiens
ugagaaacagcuc

SEQ ID NO: 814262 - RNA, 17 nt, Homo sapiens
ugagaaauuugccuugu

SEQ ID NO: 814263 - RNA, 21 nt, Homo sapiens
ugagaacucguucaccuccaa

SEQ ID NO: 814264 - RNA, 13 nt, Homo sapiens
ugagaacucugcc

SEQ ID NO: 814265 - RNA, 19 nt, Homo sapiens
ugagaagaucggaacagcu

SEQ ID NO: 814266 - RNA, 20 nt, Homo sapiens
ugagaagaucggaacagcuc

SEQ ID NO: 814267 - RNA, 21 nt, Homo sapiens
ugagaagaucggaacagcucc

SEQ ID NO: 814268 - RNA, 18 nt, Homo sapiens
ugagaagccagcuuuccu

SEQ ID NO: 814269 - RNA, 22 nt, Homo sapiens
ugagaaggcaaaagaaagaacc

SEQ ID NO: 814270 - RNA, 19 nt, Homo sapiens
ugagaagucaaacauuuca

SEQ ID NO: 814271 - RNA, 22 nt, Homo sapiens
ugagaaguucucagaauaacua

SEQ ID NO: 814272 - RNA, 16 nt, Homo sapiens
ugagaaucagacugac

SEQ ID NO: 814273 - RNA, 15 nt, Homo sapiens
ugagaaucaugcacu

SEQ ID NO: 814274 - RNA, 16 nt, Homo sapiens
ugagaauuguauguca

SEQ ID NO: 814275 - RNA, 20 nt, Homo sapiens
ugagacagagucuuacucug

SEQ ID NO: 814276 - RNA, 20 nt, Homo sapiens
ugagacagagucuuccucug

SEQ ID NO: 814277 - RNA, 22 nt, Homo sapiens
ugagacagauugggagguguau

SEQ ID NO: 814278 - RNA, 20 nt, Homo sapiens
ugagaccccuucucaaaaaa

SEQ ID NO: 814279 - RNA, 19 nt, Homo sapiens
ugagacgaggcaggggcuc

SEQ ID NO: 814280 - RNA, 17 nt, Homo sapiens
ugagacggagucuugcu

SEQ ID NO: 814281 - RNA, 22 nt, Homo sapiens
ugagacuacaagugugugccac

SEQ ID NO: 814282 - RNA, 20 nt, Homo sapiens
ugagacucagugcagaugga

SEQ ID NO: 814283 - RNA, 14 nt, Homo sapiens
ugagacuccaccuc

SEQ ID NO: 814284 - RNA, 16 nt, Homo sapiens
ugagacugaacugugu

SEQ ID NO: 814285 - RNA, 16 nt, Homo sapiens
ugagacuggcuugccc

SEQ ID NO: 814286 - RNA, 14 nt, Homo sapiens
ugagagaaaccucu

SEQ ID NO: 814287 - RNA, 15 nt, Homo sapiens
ugagagaaaccucuu

SEQ ID NO: 814288 - RNA, 22 nt, Homo sapiens
ugagagaaagagagaagccagc

SEQ ID NO: 814289 - RNA, 19 nt, Homo sapiens
uuagucuuaauguacacau

SEQ ID NO: 814290 - RNA, 19 nt, Homo sapiens
uuagucuuuuguaauauca

SEQ ID NO: 814291 - RNA, 13 nt, Homo sapiens
uuagugaguauaa

SEQ ID NO: 814292 - RNA, 11 nt, Homo sapiens
uuagugcuugu

SEQ ID NO: 814293 - RNA, 20 nt, Homo sapiens
uuaguggcucaacauugugu

SEQ ID NO: 814294 - RNA, 19 nt, Homo sapiens
uuagugugugugcaugugu

SEQ ID NO: 814295 - RNA, 14 nt, Homo sapiens
uuaguucccaacau

SEQ ID NO: 814296 - RNA, 22 nt, Homo sapiens
uuaguucugguugauucacuca

SEQ ID NO: 814297 - RNA, 22 nt, Homo sapiens
uuaguuuauauuacucucauuc

SEQ ID NO: 814298 - RNA, 21 nt, Homo sapiens
uuaguuucaaauuuaccucag

SEQ ID NO: 814299 - RNA, 24 nt, Homo sapiens
uuaguuuugcauaguucuagugca

SEQ ID NO: 814300 - RNA, 17 nt, Homo sapiens
uuauaaaaaaugguuca

SEQ ID NO: 814301 - RNA, 16 nt, Homo sapiens
uuauaaaaagaaugaa

SEQ ID NO: 814302 - RNA, 21 nt, Homo sapiens
uuauaaauaaacuguugcucg

SEQ ID NO: 814303 - RNA, 13 nt, Homo sapiens
uuauaacaguguu

SEQ ID NO: 814304 - RNA, 13 nt, Homo sapiens
uuauaacuguaaa

SEQ ID NO: 814305 - RNA, 14 nt, Homo sapiens
uuauaagcauguau

SEQ ID NO: 814306 - RNA, 21 nt, Homo sapiens
uuauaagugaagugauacuau

SEQ ID NO: 814307 - RNA, 18 nt, Homo sapiens
uuauaauaugugccuuaa

SEQ ID NO: 814308 - RNA, 21 nt, Homo sapiens
uuauaauucuugaaugaggca

SEQ ID NO: 814309 - RNA, 18 nt, Homo sapiens
uuauaauuggugcauagc

SEQ ID NO: 814310 - RNA, 20 nt, Homo sapiens
uuauacagauagaguuccau

SEQ ID NO: 814311 - RNA, 23 nt, Homo sapiens
uuauacagauagaguuccauaua

SEQ ID NO: 814312 - RNA, 14 nt, Homo sapiens
uuauacaugugaua

SEQ ID NO: 814313 - RNA, 13 nt, Homo sapiens
uuauacauuugau

SEQ ID NO: 814314 - RNA, 22 nt, Homo sapiens
uuauacucaccugcguuuucau

SEQ ID NO: 814315 - RNA, 19 nt, Homo sapiens
uuauacuguagcugaugaa

SEQ ID NO: 814316 - RNA, 11 nt, Homo sapiens
uuauacuguau

SEQ ID NO: 814317 - RNA, 16 nt, Homo sapiens
uuauagaaagauagau

SEQ ID NO: 814318 - RNA, 18 nt, Homo sapiens
uuauagaaagauagauau

SEQ ID NO: 814319 - RNA, 21 nt, Homo sapiens
uuauagaagagaaaugcugcu

SEQ ID NO: 814320 - RNA, 15 nt, Homo sapiens
uuauagaaguagcaa

SEQ ID NO: 814321 - RNA, 20 nt, Homo sapiens
uuauagaaguagcaaaaagu

SEQ ID NO: 814322 - RNA, 19 nt, Homo sapiens
uuauagacagucguuccca

SEQ ID NO: 814323 - RNA, 20 nt, Homo sapiens
uuauagauauauaaauaauc

SEQ ID NO: 814324 - RNA, 13 nt, Homo sapiens
uuauagauucuaa

SEQ ID NO: 814325 - RNA, 12 nt, Homo sapiens
uuauagcuauga

SEQ ID NO: 814326 - RNA, 18 nt, Homo sapiens
uuauaguaacaucaaaga

SEQ ID NO: 814327 - RNA, 16 nt, Homo sapiens
uuauaguccuccugga

SEQ ID NO: 814328 - RNA, 13 nt, Homo sapiens
uuauagucuucca

SEQ ID NO: 814329 - RNA, 15 nt, Homo sapiens
uuauaguuacugugu

SEQ ID NO: 814330 - RNA, 16 nt, Homo sapiens
uuauauaaaauacaua

SEQ ID NO: 814331 - RNA, 22 nt, Homo sapiens
uuauauagaaaaauaacuuuag

SEQ ID NO: 814332 - RNA, 19 nt, Homo sapiens
uuauauauuuauaacucau

SEQ ID NO: 814333 - RNA, 14 nt, Homo sapiens
uuauaucacuucac

SEQ ID NO: 814334 - RNA, 13 nt, Homo sapiens
uuauaucugugaa

SEQ ID NO: 814335 - RNA, 22 nt, Homo sapiens
uuauaugaccauauuuacucuu

SEQ ID NO: 814336 - RNA, 12 nt, Homo sapiens
uuauaugauuca

SEQ ID NO: 814337 - RNA, 12 nt, Homo sapiens
uuauauguugcu

SEQ ID NO: 814338 - RNA, 16 nt, Homo sapiens
uuauauuaaaauaugg

SEQ ID NO: 814339 - RNA, 15 nt, Homo sapiens
uuauauuaaaguaaa

SEQ ID NO: 814340 - RNA, 15 nt, Homo sapiens
uuauauuacucucau

SEQ ID NO: 814341 - RNA, 16 nt, Homo sapiens
uuauauuauugauuca

SEQ ID NO: 814342 - RNA, 17 nt, Homo sapiens
uuauauucagaguaugu

SEQ ID NO: 814343 - RNA, 22 nt, Homo sapiens
uuauauuuccuuuaugugaauu

SEQ ID NO: 814344 - RNA, 19 nt, Homo sapiens
uuauauuuuaugaacauug

SEQ ID NO: 814345 - RNA, 20 nt, Homo sapiens
uuaucaaacuucagcuguac

SEQ ID NO: 814346 - RNA, 13 nt, Homo sapiens
uuaucaaagaagu

SEQ ID NO: 814347 - RNA, 18 nt, Homo sapiens
uuaucaaagggugaaaau

SEQ ID NO: 814348 - RNA, 21 nt, Homo sapiens
uuaucaacauaccuuggccag

SEQ ID NO: 814349 - RNA, 18 nt, Homo sapiens
uuaucaauuaaugacaau

SEQ ID NO: 814350 - RNA, 18 nt, Homo sapiens
uuaucaauuuuucccagu

SEQ ID NO: 814351 - RNA, 20 nt, Homo sapiens
uuaucaccucugauggcuga

SEQ ID NO: 814352 - RNA, 23 nt, Homo sapiens
uuaucaggaaauguuuucuuaag

SEQ ID NO: 814353 - RNA, 14 nt, Homo sapiens
uuaucagucauaac

SEQ ID NO: 814354 - RNA, 19 nt, Homo sapiens
uuaucaugcaaaugcugua

SEQ ID NO: 814355 - RNA, 20 nt, Homo sapiens
uuaucaugcguuuuauaucu

SEQ ID NO: 814356 - RNA, 21 nt, Homo sapiens
uuaucccccgcaaagacauca

SEQ ID NO: 814357 - RNA, 23 nt, Homo sapiens
uuaucccccgcaaagacaucaaa

SEQ ID NO: 814358 - RNA, 17 nt, Homo sapiens
uuauccuguauucuugu

SEQ ID NO: 814359 - RNA, 16 nt, Homo sapiens
uuauccuucuacuugu

SEQ ID NO: 814360 - RNA, 23 nt, Homo sapiens
uuaucgggcuccagccaucucau

SEQ ID NO: 814361 - RNA, 16 nt, Homo sapiens
uuaucuaucaacuaua

SEQ ID NO: 814362 - RNA, 15 nt, Homo sapiens
uuaucucugaggcua

SEQ ID NO: 814363 - RNA, 12 nt, Homo sapiens
uuaucugucaca

SEQ ID NO: 814364 - RNA, 12 nt, Homo sapiens
uuaucugugcaa

SEQ ID NO: 814365 - RNA, 18 nt, Homo sapiens
uuaucuguuuucuaccuc

SEQ ID NO: 814366 - RNA, 15 nt, Homo sapiens
uuaucuugacauuca

SEQ ID NO: 814367 - RNA, 15 nt, Homo sapiens
uuaucuuggacugac

SEQ ID NO: 814368 - RNA, 13 nt, Homo sapiens
uuaucuuuaccaa

SEQ ID NO: 814369 - RNA, 20 nt, Homo sapiens
uuaucuuuguauuauguguc

SEQ ID NO: 814370 - RNA, 21 nt, Homo sapiens
uuaugaaaauauagacauucu

SEQ ID NO: 814371 - RNA, 21 nt, Homo sapiens
uuaugaaaugccacugggaca

SEQ ID NO: 814372 - RNA, 20 nt, Homo sapiens
uuaugaaguuaacagucuca

SEQ ID NO: 814373 - RNA, 16 nt, Homo sapiens
uuaugacagugaacau

SEQ ID NO: 814374 - RNA, 12 nt, Homo sapiens
uuaugacuguuu

SEQ ID NO: 814375 - RNA, 16 nt, Homo sapiens
uuaugauauauuucag

SEQ ID NO: 814376 - RNA, 18 nt, Homo sapiens
uuaugaucugccauuuca

SEQ ID NO: 814377 - RNA, 12 nt, Homo sapiens
uuaugaugcuaa

SEQ ID NO: 814378 - RNA, 14 nt, Homo sapiens
uuaugcaaauggag

SEQ ID NO: 814379 - RNA, 16 nt, Homo sapiens
uuaugcaaauggagau

SEQ ID NO: 814380 - RNA, 23 nt, Homo sapiens
uuaugccauagcaagauugcuua

SEQ ID NO: 814381 - RNA, 14 nt, Homo sapiens
uuaugcuuccacag

SEQ ID NO: 814382 - RNA, 13 nt, Homo sapiens
uuauggacaggau

SEQ ID NO: 814383 - RNA, 23 nt, Homo sapiens
uuauggagcucacacuccagugg

SEQ ID NO: 814384 - RNA, 13 nt, Homo sapiens
uuauggcaaagau

SEQ ID NO: 814385 - RNA, 22 nt, Homo sapiens
uuauggcaagugauaucaccuc

SEQ ID NO: 814386 - RNA, 22 nt, Homo sapiens
uuauggcugcauaguauuccau

SEQ ID NO: 814387 - RNA, 19 nt, Homo sapiens
uuaugggaagacaaaacaa

SEQ ID NO: 814388 - RNA, 20 nt, Homo sapiens
uuauguaugaaaauuauucu

SEQ ID NO: 814389 - RNA, 23 nt, Homo sapiens
uuauguauuugaaaacucacaga

SEQ ID NO: 814390 - RNA, 19 nt, Homo sapiens
uuaugucucuucugagcua

SEQ ID NO: 814391 - RNA, 19 nt, Homo sapiens
uuaugugugaggagcugcu

SEQ ID NO: 814392 - RNA, 20 nt, Homo sapiens
uuauguguuaugaacaucca

SEQ ID NO: 814393 - RNA, 13 nt, Homo sapiens
uuauguucaguca

SEQ ID NO: 814394 - RNA, 21 nt, Homo sapiens
uuauguugaauccacccaaau

SEQ ID NO: 814395 - RNA, 13 nt, Homo sapiens
uuauuaacuacug

SEQ ID NO: 814396 - RNA, 22 nt, Homo sapiens
uuauuaagugccugagacaccc

SEQ ID NO: 814397 - RNA, 23 nt, Homo sapiens
uuauuaaucauacaaacucucac

SEQ ID NO: 814398 - RNA, 15 nt, Homo sapiens
uuauuacaauguauc

SEQ ID NO: 814399 - RNA, 19 nt, Homo sapiens
uuauuacauggggucuaga

SEQ ID NO: 814400 - RNA, 14 nt, Homo sapiens
uuauuacauguaau

SEQ ID NO: 814401 - RNA, 19 nt, Homo sapiens
uuauuacauguaauuugau

SEQ ID NO: 814402 - RNA, 12 nt, Homo sapiens
uuauuauauucc

SEQ ID NO: 814403 - RNA, 16 nt, Homo sapiens
uuauuauuucuaaucc

SEQ ID NO: 814404 - RNA, 21 nt, Homo sapiens
uuccagcauuuuuauaaacua

SEQ ID NO: 814405 - RNA, 19 nt, Homo sapiens
uuccagcccaucuccgggg

SEQ ID NO: 814406 - RNA, 18 nt, Homo sapiens
uuccagcugccaagugcu

SEQ ID NO: 814407 - RNA, 17 nt, Homo sapiens
uuccagcugcugucuuc

SEQ ID NO: 814408 - RNA, 23 nt, Homo sapiens
uuccaggacagggaagggagcag

SEQ ID NO: 814409 - RNA, 20 nt, Homo sapiens
uuccaggccugaucuugccu

SEQ ID NO: 814410 - RNA, 21 nt, Homo sapiens
uuccagguggcgugagaggca

SEQ ID NO: 814411 - RNA, 16 nt, Homo sapiens
uuccagguuccaucca

SEQ ID NO: 814412 - RNA, 16 nt, Homo sapiens
uuccagucuacuugag

SEQ ID NO: 814413 - RNA, 19 nt, Homo sapiens
uuccagugguuugagacac

SEQ ID NO: 814414 - RNA, 12 nt, Homo sapiens
uuccaguguuug

SEQ ID NO: 814415 - RNA, 22 nt, Homo sapiens
uuccaguuccucuuuugugcug

SEQ ID NO: 814416 - RNA, 16 nt, Homo sapiens
uuccauacuucucuca

SEQ ID NO: 814417 - RNA, 23 nt, Homo sapiens
uuccauaugugggugucagucag

SEQ ID NO: 814418 - RNA, 13 nt, Homo sapiens
uuccauauugaug

SEQ ID NO: 814419 - RNA, 16 nt, Homo sapiens
uuccaucucugacuua

SEQ ID NO: 814420 - RNA, 19 nt, Homo sapiens
uuccaugagaagaagcaga

SEQ ID NO: 814421 - RNA, 22 nt, Homo sapiens
uuccauguaucuuuugaacugg

SEQ ID NO: 814422 - RNA, 16 nt, Homo sapiens
uuccauuaugauucuu

SEQ ID NO: 814423 - RNA, 19 nt, Homo sapiens
uuccauuugaagcagugau

SEQ ID NO: 814424 - RNA, 23 nt, Homo sapiens
uuccauuuuuauuucaaaauaua

SEQ ID NO: 814425 - RNA, 20 nt, Homo sapiens
uucccaaaccuaaugaucau

SEQ ID NO: 814426 - RNA, 19 nt, Homo sapiens
uucccaacgugcaaagcca

SEQ ID NO: 814427 - RNA, 16 nt, Homo sapiens
uucccaagcccaugag

SEQ ID NO: 814428 - RNA, 17 nt, Homo sapiens
uucccaaguaugccuua

SEQ ID NO: 814429 - RNA, 14 nt, Homo sapiens
uucccaccauuccc

SEQ ID NO: 814430 - RNA, 17 nt, Homo sapiens
uucccacugcacuccag

SEQ ID NO: 814431 - RNA, 15 nt, Homo sapiens
uucccacugccaggg

SEQ ID NO: 814432 - RNA, 17 nt, Homo sapiens
uucccagagucaucuga

SEQ ID NO: 814433 - RNA, 20 nt, Homo sapiens
uucccaggagaaagaugaaa

SEQ ID NO: 814434 - RNA, 21 nt, Homo sapiens
uucccaggagaaagaugaaac

SEQ ID NO: 814435 - RNA, 21 nt, Homo sapiens
uucccaggguuauagacaguc

SEQ ID NO: 814436 - RNA, 12 nt, Homo sapiens
uucccagugugg

SEQ ID NO: 814437 - RNA, 23 nt, Homo sapiens
uucccaguuaaagauuauuguga

SEQ ID NO: 814438 - RNA, 14 nt, Homo sapiens
uucccaugccuguc

SEQ ID NO: 814439 - RNA, 17 nt, Homo sapiens
uucccauuugugccaga

SEQ ID NO: 814440 - RNA, 17 nt, Homo sapiens
uuccccacugcucucug

SEQ ID NO: 814441 - RNA, 14 nt, Homo sapiens
uucccccacaguuu

SEQ ID NO: 814442 - RNA, 15 nt, Homo sapiens
uuccccccauguugu

SEQ ID NO: 814443 - RNA, 19 nt, Homo sapiens
uuccccucccuggguucag

SEQ ID NO: 814444 - RNA, 23 nt, Homo sapiens
uuccccuccuuggcuuuaugcaa

SEQ ID NO: 814445 - RNA, 15 nt, Homo sapiens
uuccccuggccucag

SEQ ID NO: 814446 - RNA, 17 nt, Homo sapiens
uuccccugugucauccc

SEQ ID NO: 814447 - RNA, 24 nt, Homo sapiens
uucccgacauaacauuguacugua

SEQ ID NO: 814448 - RNA, 18 nt, Homo sapiens
uucccuagaccuuggcau

SEQ ID NO: 814449 - RNA, 18 nt, Homo sapiens
uucccuaggaaacucaca

SEQ ID NO: 814450 - RNA, 21 nt, Homo sapiens
uucccuaucucgaacauggaa

SEQ ID NO: 814451 - RNA, 20 nt, Homo sapiens
uucccuauggguucugugac

SEQ ID NO: 814452 - RNA, 14 nt, Homo sapiens
uucccucacaccgc

SEQ ID NO: 814453 - RNA, 13 nt, Homo sapiens
uucccucccuauc

SEQ ID NO: 814454 - RNA, 20 nt, Homo sapiens
uucccugaaaacccagagag

SEQ ID NO: 814455 - RNA, 19 nt, Homo sapiens
uucccugaaaccguuaaaa

SEQ ID NO: 814456 - RNA, 15 nt, Homo sapiens
uucccugcaccacuc

SEQ ID NO: 814457 - RNA, 18 nt, Homo sapiens
uucccugccuugcugaca

SEQ ID NO: 814458 - RNA, 22 nt, Homo sapiens
uucccugcucuugcaguugcuc

SEQ ID NO: 814459 - RNA, 18 nt, Homo sapiens
uucccuggugccaccagc

SEQ ID NO: 814460 - RNA, 18 nt, Homo sapiens
uucccuucuuugcugcug

SEQ ID NO: 814461 - RNA, 15 nt, Homo sapiens
uucccuugaauuuca

SEQ ID NO: 814462 - RNA, 18 nt, Homo sapiens
uucccuuggauguagucu

SEQ ID NO: 814463 - RNA, 13 nt, Homo sapiens
uucccuuugccac

SEQ ID NO: 814464 - RNA, 19 nt, Homo sapiens
uucccuuuuguauucucuu

SEQ ID NO: 814465 - RNA, 15 nt, Homo sapiens
uuccgauacaaagug

SEQ ID NO: 814466 - RNA, 21 nt, Homo sapiens
uuccggccuccugucccucau

SEQ ID NO: 814467 - RNA, 15 nt, Homo sapiens
uuccguggucagagu

SEQ ID NO: 814468 - RNA, 23 nt, Homo sapiens
uuccguguguguacugauucaag

SEQ ID NO: 814469 - RNA, 11 nt, Homo sapiens
uuccuaaacau

SEQ ID NO: 814470 - RNA, 22 nt, Homo sapiens
uuccuaaggcacccacaaauaa

SEQ ID NO: 814471 - RNA, 15 nt, Homo sapiens
uuccuaauacuguca

SEQ ID NO: 814472 - RNA, 16 nt, Homo sapiens
uuccuaccucugguga

SEQ ID NO: 814473 - RNA, 16 nt, Homo sapiens
uuccuagaaugcagcu

SEQ ID NO: 814474 - RNA, 12 nt, Homo sapiens
uuccuagcugug

SEQ ID NO: 814475 - RNA, 18 nt, Homo sapiens
uuccuauaacacugugaa

SEQ ID NO: 814476 - RNA, 11 nt, Homo sapiens
uuccuaucuca

SEQ ID NO: 814477 - RNA, 20 nt, Homo sapiens
uuccuaugacauuacuguau

SEQ ID NO: 814478 - RNA, 12 nt, Homo sapiens
uuccucacuaug

SEQ ID NO: 814479 - RNA, 13 nt, Homo sapiens
uuccucagaucau

SEQ ID NO: 814480 - RNA, 17 nt, Homo sapiens
uuccucagauggacaag

SEQ ID NO: 814481 - RNA, 16 nt, Homo sapiens
uuccucagcugugugg

SEQ ID NO: 814482 - RNA, 13 nt, Homo sapiens
uuccucauguaac

SEQ ID NO: 814483 - RNA, 17 nt, Homo sapiens
uuccuccccacacucca

SEQ ID NO: 814484 - RNA, 18 nt, Homo sapiens
uuccucgccugacaacca

SEQ ID NO: 814485 - RNA, 19 nt, Homo sapiens
uuccucggugggccagagc

SEQ ID NO: 814486 - RNA, 18 nt, Homo sapiens
uuccucucgcagcuugau

SEQ ID NO: 814487 - RNA, 18 nt, Homo sapiens
uuccucucucuaccaguc

SEQ ID NO: 814488 - RNA, 14 nt, Homo sapiens
uuccucuuacugua

SEQ ID NO: 814489 - RNA, 19 nt, Homo sapiens
uuccucuuugaauucuucc

SEQ ID NO: 814490 - RNA, 17 nt, Homo sapiens
uuccugaauacaagccu

SEQ ID NO: 814491 - RNA, 20 nt, Homo sapiens
uuccugaauguguucuuggu

SEQ ID NO: 814492 - RNA, 16 nt, Homo sapiens
uuccugagaccacaga

SEQ ID NO: 814493 - RNA, 13 nt, Homo sapiens
uuccugagaccuc

SEQ ID NO: 814494 - RNA, 19 nt, Homo sapiens
uuccugaguggugccaaac

SEQ ID NO: 814495 - RNA, 16 nt, Homo sapiens
uuccugauaacauuau

SEQ ID NO: 814496 - RNA, 21 nt, Homo sapiens
uuccugauagcauaugacaaa

SEQ ID NO: 814497 - RNA, 22 nt, Homo sapiens
uuccugaugccccugacaucau

SEQ ID NO: 814498 - RNA, 23 nt, Homo sapiens
uuccugauuaggaauaugaccau

SEQ ID NO: 814499 - RNA, 14 nt, Homo sapiens
uuccugcauguucu

SEQ ID NO: 814500 - RNA, 13 nt, Homo sapiens
uuccugccacugc

SEQ ID NO: 814501 - RNA, 22 nt, Homo sapiens
uuccugcugcuggggccagcga

SEQ ID NO: 814502 - RNA, 20 nt, Homo sapiens
uuccuggaaacagcaugaau

SEQ ID NO: 814503 - RNA, 21 nt, Homo sapiens
uuccuggccugagagucagcu

SEQ ID NO: 814504 - RNA, 19 nt, Homo sapiens
uuccugguguagcacuuaa

SEQ ID NO: 814505 - RNA, 20 nt, Homo sapiens
uuccuguaaugcaggacucc

SEQ ID NO: 814506 - RNA, 19 nt, Homo sapiens
uuccugucccacuacugua

SEQ ID NO: 814507 - RNA, 16 nt, Homo sapiens
uuccugucuuauccuc

SEQ ID NO: 814508 - RNA, 20 nt, Homo sapiens
uuccugucuuauccuccacc

SEQ ID NO: 814509 - RNA, 13 nt, Homo sapiens
uuccugugaucca

SEQ ID NO: 814510 - RNA, 22 nt, Homo sapiens
uuccuguggggggaaguccaug

SEQ ID NO: 814511 - RNA, 21 nt, Homo sapiens
uuccuguguggccugccuuca

SEQ ID NO: 814512 - RNA, 13 nt, Homo sapiens
uuccuguuuccau

SEQ ID NO: 814513 - RNA, 13 nt, Homo sapiens
uuccuuaagccag

SEQ ID NO: 814514 - RNA, 16 nt, Homo sapiens
uuccuuaucacugaca

SEQ ID NO: 814515 - RNA, 15 nt, Homo sapiens
uuccuuaucugucac

SEQ ID NO: 814516 - RNA, 12 nt, Homo sapiens
uuccuucacuca

SEQ ID NO: 814517 - RNA, 14 nt, Homo sapiens
uuccuucacucauc

SEQ ID NO: 814518 - RNA, 15 nt, Homo sapiens
uugaacccaggagau

SEQ ID NO: 814519 - RNA, 22 nt, Homo sapiens
uugaacuucugacuacuuguug

SEQ ID NO: 814520 - RNA, 12 nt, Homo sapiens
uugaacuuggaa

SEQ ID NO: 814521 - RNA, 15 nt, Homo sapiens
uugaagacucccuga

SEQ ID NO: 814522 - RNA, 11 nt, Homo sapiens
uugaagccaaa

SEQ ID NO: 814523 - RNA, 13 nt, Homo sapiens
uugaagccaaaga

SEQ ID NO: 814524 - RNA, 15 nt, Homo sapiens
uugaaguagcucuuu

SEQ ID NO: 814525 - RNA, 15 nt, Homo sapiens
uugaaguccaggacu

SEQ ID NO: 814526 - RNA, 15 nt, Homo sapiens
uugaagucuuuaaua

SEQ ID NO: 814527 - RNA, 14 nt, Homo sapiens
uugaauacugcauu

SEQ ID NO: 814528 - RNA, 14 nt, Homo sapiens
uugaauacugugaa

SEQ ID NO: 814529 - RNA, 20 nt, Homo sapiens
uugaaucuacaaaaaacaac

SEQ ID NO: 814530 - RNA, 12 nt, Homo sapiens
uugaaucucaua

SEQ ID NO: 814531 - RNA, 21 nt, Homo sapiens
uugaaucucauaauuuauaca

SEQ ID NO: 814532 - RNA, 18 nt, Homo sapiens
uugaaucugaaucagcca

SEQ ID NO: 814533 - RNA, 11 nt, Homo sapiens
uugaaugauga

SEQ ID NO: 814534 - RNA, 14 nt, Homo sapiens
uugaaugcugccag

SEQ ID NO: 814535 - RNA, 17 nt, Homo sapiens
uugaauguccuuuuaug

SEQ ID NO: 814536 - RNA, 22 nt, Homo sapiens
uugaauuuuucuuccucuccac

SEQ ID NO: 814537 - RNA, 17 nt, Homo sapiens
uugaauuuuuuuuaaca

SEQ ID NO: 814538 - RNA, 15 nt, Homo sapiens
uugacaaaacccacu

SEQ ID NO: 814539 - RNA, 11 nt, Homo sapiens
uugacaaugau

SEQ ID NO: 814540 - RNA, 20 nt, Homo sapiens
uugacacauaugaacacaga

SEQ ID NO: 814541 - RNA, 17 nt, Homo sapiens
uugacacuuguugucca

SEQ ID NO: 814542 - RNA, 15 nt, Homo sapiens
uugacaggaaccuua

SEQ ID NO: 814543 - RNA, 17 nt, Homo sapiens
uugacaggaauacuuaa

SEQ ID NO: 814544 - RNA, 21 nt, Homo sapiens
uugacauaggcaauaauaagu

SEQ ID NO: 814545 - RNA, 15 nt, Homo sapiens
uugacaucagcauua

SEQ ID NO: 814546 - RNA, 17 nt, Homo sapiens
uugaccaagaacugcau

SEQ ID NO: 814547 - RNA, 21 nt, Homo sapiens
uugaccuuugagagauauaau

SEQ ID NO: 814548 - RNA, 20 nt, Homo sapiens
uugacguuucuucuuucuag

SEQ ID NO: 814549 - RNA, 22 nt, Homo sapiens
uugacuagggauucaggcugcu

SEQ ID NO: 814550 - RNA, 23 nt, Homo sapiens
uugacuauguuuggaguuuaauu

SEQ ID NO: 814551 - RNA, 14 nt, Homo sapiens
uugacucaccugaa

SEQ ID NO: 814552 - RNA, 13 nt, Homo sapiens
uugacucaguucc

SEQ ID NO: 814553 - RNA, 23 nt, Homo sapiens
uugacugucacuguuccuuguca

SEQ ID NO: 814554 - RNA, 16 nt, Homo sapiens
uugacuguucaaugau

SEQ ID NO: 814555 - RNA, 21 nt, Homo sapiens
uugacuuacauagaugauaaa

SEQ ID NO: 814556 - RNA, 20 nt, Homo sapiens
uugacuuagaauaaugaagg

SEQ ID NO: 814557 - RNA, 21 nt, Homo sapiens
uugacuuccccacugcucucu

SEQ ID NO: 814558 - RNA, 17 nt, Homo sapiens
uugacuugaaaugcucu

SEQ ID NO: 814559 - RNA, 13 nt, Homo sapiens
uugagacagaguc

SEQ ID NO: 814560 - RNA, 18 nt, Homo sapiens
uugagacggagucuugcu

SEQ ID NO: 814561 - RNA, 23 nt, Homo sapiens
uugagagcccgcgugcuggagaa

SEQ ID NO: 814562 - RNA, 18 nt, Homo sapiens
uugagaguugcuggugua

SEQ ID NO: 814563 - RNA, 22 nt, Homo sapiens
uugagauaaagucaaaugccaa

SEQ ID NO: 814564 - RNA, 16 nt, Homo sapiens
uugagauauaguucac

SEQ ID NO: 814565 - RNA, 20 nt, Homo sapiens
uugagcaguggcugguccag

SEQ ID NO: 814566 - RNA, 18 nt, Homo sapiens
uugagcaguuagcucauu

SEQ ID NO: 814567 - RNA, 22 nt, Homo sapiens
uugagcgugaaucuguaucuug

SEQ ID NO: 814568 - RNA, 21 nt, Homo sapiens
uugagcgugaccuugcaaugu

SEQ ID NO: 814569 - RNA, 14 nt, Homo sapiens
uugagcguuugcac

SEQ ID NO: 814570 - RNA, 14 nt, Homo sapiens
uugagcuacaguag

SEQ ID NO: 814571 - RNA, 23 nt, Homo sapiens
uugagcuacuucaaaugugguau

SEQ ID NO: 814572 - RNA, 21 nt, Homo sapiens
uugagcuucacugucaucuuu

SEQ ID NO: 814573 - RNA, 14 nt, Homo sapiens
uugaggaacauuca

SEQ ID NO: 814574 - RNA, 18 nt, Homo sapiens
uugaggggcugacuucaa

SEQ ID NO: 814575 - RNA, 23 nt, Homo sapiens
uugaggucaaguaagaagacaug

SEQ ID NO: 814576 - RNA, 15 nt, Homo sapiens
uugaguaccuacugu

SEQ ID NO: 814577 - RNA, 17 nt, Homo sapiens
uugaguagaguugauca

SEQ ID NO: 814578 - RNA, 16 nt, Homo sapiens
uugagucaccaugcca

SEQ ID NO: 814579 - RNA, 23 nt, Homo sapiens
uugagucuauccuagucuucaca

SEQ ID NO: 814580 - RNA, 19 nt, Homo sapiens
uugagugacuugagcccaa

SEQ ID NO: 814581 - RNA, 16 nt, Homo sapiens
uugagugcacuaaaca

SEQ ID NO: 814582 - RNA, 23 nt, Homo sapiens
uugaguuccuauaacacugugaa

SEQ ID NO: 814583 - RNA, 21 nt, Homo sapiens
uugaguuguuuggaugauuaa

SEQ ID NO: 814584 - RNA, 19 nt, Homo sapiens
uugauaaauccaucacuau

SEQ ID NO: 814585 - RNA, 17 nt, Homo sapiens
uugauagauuucuacac

SEQ ID NO: 814586 - RNA, 15 nt, Homo sapiens
uugauaucugaucaa

SEQ ID NO: 814587 - RNA, 20 nt, Homo sapiens
uugauauguaaguacuucca

SEQ ID NO: 814588 - RNA, 19 nt, Homo sapiens
uugauauuuuccaaaugga

SEQ ID NO: 814589 - RNA, 16 nt, Homo sapiens
uugaucaaauauuuca

SEQ ID NO: 814590 - RNA, 22 nt, Homo sapiens
uugaucaugaauaacugauuag

SEQ ID NO: 814591 - RNA, 19 nt, Homo sapiens
uugaugaauaaaaugaagg

SEQ ID NO: 814592 - RNA, 17 nt, Homo sapiens
uugaugacccucugacc

SEQ ID NO: 814593 - RNA, 18 nt, Homo sapiens
uugaugaguuaacuguga

SEQ ID NO: 814594 - RNA, 18 nt, Homo sapiens
uugaugccagagggccag

SEQ ID NO: 814595 - RNA, 22 nt, Homo sapiens
uugauguacauaacuccugucc

SEQ ID NO: 814596 - RNA, 23 nt, Homo sapiens
uugauguuaacugagcuacuaga

SEQ ID NO: 814597 - RNA, 21 nt, Homo sapiens
uugauuaacuccuccugcgau

SEQ ID NO: 814598 - RNA, 16 nt, Homo sapiens
uugauuccacauucca

SEQ ID NO: 814599 - RNA, 20 nt, Homo sapiens
uugauuccugguuugacuca

SEQ ID NO: 814600 - RNA, 22 nt, Homo sapiens
uugauuccugguuugacucagu

SEQ ID NO: 814601 - RNA, 14 nt, Homo sapiens
uugauucugauaau

SEQ ID NO: 814602 - RNA, 21 nt, Homo sapiens
uugauugaggagcugcacuga

SEQ ID NO: 814603 - RNA, 14 nt, Homo sapiens
uugauuggugauua

SEQ ID NO: 814604 - RNA, 17 nt, Homo sapiens
uugauuuuuaauggaaa

SEQ ID NO: 814605 - RNA, 22 nt, Homo sapiens
uugauuuuuauaaauacugcaa

SEQ ID NO: 814606 - RNA, 20 nt, Homo sapiens
uugcaaagaaaaguuucacc

SEQ ID NO: 814607 - RNA, 13 nt, Homo sapiens
uugcaaagauuua

SEQ ID NO: 814608 - RNA, 19 nt, Homo sapiens
uugcaaagguuccaacugu

SEQ ID NO: 814609 - RNA, 18 nt, Homo sapiens
uugcaaauuauucuaguc

SEQ ID NO: 814610 - RNA, 14 nt, Homo sapiens
uugcaacagacugu

SEQ ID NO: 814611 - RNA, 17 nt, Homo sapiens
uugcaauacauuucaau

SEQ ID NO: 814612 - RNA, 19 nt, Homo sapiens
uugcaauuggaauaaucac

SEQ ID NO: 814613 - RNA, 20 nt, Homo sapiens
uugcaauuggaauaaucacu

SEQ ID NO: 814614 - RNA, 12 nt, Homo sapiens
uugcaccaaaga

SEQ ID NO: 814615 - RNA, 12 nt, Homo sapiens
uugcaccacugc

SEQ ID NO: 814616 - RNA, 22 nt, Homo sapiens
uugcaccccaaagcuuuccugc

SEQ ID NO: 814617 - RNA, 18 nt, Homo sapiens
uugcacuguuuucugucg

SEQ ID NO: 814618 - RNA, 14 nt, Homo sapiens
uugcacuucaaaaa

SEQ ID NO: 814619 - RNA, 20 nt, Homo sapiens
uugcagcagugagucucuuc

SEQ ID NO: 814620 - RNA, 15 nt, Homo sapiens
uugcagcucaguagu

SEQ ID NO: 814621 - RNA, 17 nt, Homo sapiens
uugcagcugcucuugca

SEQ ID NO: 814622 - RNA, 18 nt, Homo sapiens
uugcagcuuuauguucau

SEQ ID NO: 814623 - RNA, 18 nt, Homo sapiens
uugcaggcucugggcuca

SEQ ID NO: 814624 - RNA, 20 nt, Homo sapiens
uugcaggggccggaguagga

SEQ ID NO: 814625 - RNA, 16 nt, Homo sapiens
uugcaggguccucuuc

SEQ ID NO: 814626 - RNA, 15 nt, Homo sapiens
uugcagugagccaag

SEQ ID NO: 814627 - RNA, 16 nt, Homo sapiens
uugcagugagccauga

SEQ ID NO: 814628 - RNA, 20 nt, Homo sapiens
uugcagugagccgagaucac

SEQ ID NO: 814629 - RNA, 14 nt, Homo sapiens
uugcagugagcuga

SEQ ID NO: 814630 - RNA, 20 nt, Homo sapiens
uugcaguucaccugcacuua

SEQ ID NO: 814631 - RNA, 13 nt, Homo sapiens
uugcaguucugua

SEQ ID NO: 814632 - RNA, 18 nt, Homo sapiens
uaucaucuuuugaucuuu

SEQ ID NO: 814633 - RNA, 23 nt, Homo sapiens
uaucaugaagcacaucaauuaca

SEQ ID NO: 814634 - RNA, 22 nt, Homo sapiens
uaucaugcaaauuucaugacca

SEQ ID NO: 814635 - RNA, 17 nt, Homo sapiens
uaucauguauggugaua

SEQ ID NO: 814636 - RNA, 22 nt, Homo sapiens
uaucauugcaggagccauauga

SEQ ID NO: 814637 - RNA, 15 nt, Homo sapiens
uauccaggacuguuu

SEQ ID NO: 814638 - RNA, 22 nt, Homo sapiens
uauccauauuuuacugaucucu

SEQ ID NO: 814639 - RNA, 16 nt, Homo sapiens
uaucccaagaaugcaa

SEQ ID NO: 814640 - RNA, 20 nt, Homo sapiens
uaucccaaucaaagaauuac

SEQ ID NO: 814641 - RNA, 15 nt, Homo sapiens
uaucccuacaucuaa

SEQ ID NO: 814642 - RNA, 20 nt, Homo sapiens
uauccgaacuuuaauuucag

SEQ ID NO: 814643 - RNA, 15 nt, Homo sapiens
uauccugauuccaaa

SEQ ID NO: 814644 - RNA, 16 nt, Homo sapiens
uauccugcuagcugua

SEQ ID NO: 814645 - RNA, 14 nt, Homo sapiens
uauccuucuacuug

SEQ ID NO: 814646 - RNA, 15 nt, Homo sapiens
uauccuuucaagaca

SEQ ID NO: 814647 - RNA, 18 nt, Homo sapiens
uauccuuucuaacaaaaa

SEQ ID NO: 814648 - RNA, 19 nt, Homo sapiens
uaucggcucuauucucuaa

SEQ ID NO: 814649 - RNA, 17 nt, Homo sapiens
uaucgggaacaguguuu

SEQ ID NO: 814650 - RNA, 23 nt, Homo sapiens
uaucucaggggccaacuaggcag

SEQ ID NO: 814651 - RNA, 12 nt, Homo sapiens
uaucuccugaca

SEQ ID NO: 814652 - RNA, 20 nt, Homo sapiens
uaucucucagugaacuguga

SEQ ID NO: 814653 - RNA, 20 nt, Homo sapiens
uaucugagggagacugcaaa

SEQ ID NO: 814654 - RNA, 23 nt, Homo sapiens
uaucugagggaggaggccaccuc

SEQ ID NO: 814655 - RNA, 14 nt, Homo sapiens
uaucugauuuccua

SEQ ID NO: 814656 - RNA, 17 nt, Homo sapiens
uaucugccaaauugaga

SEQ ID NO: 814657 - RNA, 14 nt, Homo sapiens
uaucugccauguga

SEQ ID NO: 814658 - RNA, 15 nt, Homo sapiens
uaucugcgugcacuu

SEQ ID NO: 814659 - RNA, 16 nt, Homo sapiens
uaucugcgugcacuuc

SEQ ID NO: 814660 - RNA, 15 nt, Homo sapiens
uaucuggacaagcca

SEQ ID NO: 814661 - RNA, 20 nt, Homo sapiens
uaucuggggaaaucaaaaca

SEQ ID NO: 814662 - RNA, 17 nt, Homo sapiens
uaucugugaggugcuga

SEQ ID NO: 814663 - RNA, 21 nt, Homo sapiens
uaucuguguagacuauuugcu

SEQ ID NO: 814664 - RNA, 19 nt, Homo sapiens
uaucugugucaaaagccag

SEQ ID NO: 814665 - RNA, 18 nt, Homo sapiens
uaucuuaugcuauuauuc

SEQ ID NO: 814666 - RNA, 22 nt, Homo sapiens
uaucuucagcccaggcuuuugc

SEQ ID NO: 814667 - RNA, 18 nt, Homo sapiens
uaucuugaagucagccac

SEQ ID NO: 814668 - RNA, 24 nt, Homo sapiens
uaucuuuaccaaaaaccauguugc

SEQ ID NO: 814669 - RNA, 16 nt, Homo sapiens
uaucuuucuaaaacug

SEQ ID NO: 814670 - RNA, 20 nt, Homo sapiens
uaucuuuuugaaagcaauau

SEQ ID NO: 814671 - RNA, 23 nt, Homo sapiens
uaugaaaauauagacauucucac

SEQ ID NO: 814672 - RNA, 18 nt, Homo sapiens
uaugaaaaucuccaucuc

SEQ ID NO: 814673 - RNA, 20 nt, Homo sapiens
uaugaaaccacugcuggcag

SEQ ID NO: 814674 - RNA, 22 nt, Homo sapiens
uaugaaauaaaauuacacagua

SEQ ID NO: 814675 - RNA, 19 nt, Homo sapiens
uaugaaauuauaaucugug

SEQ ID NO: 814676 - RNA, 21 nt, Homo sapiens
uaugaaauuauauaaguauuc

SEQ ID NO: 814677 - RNA, 21 nt, Homo sapiens
uaugaacagcugugucugcca

SEQ ID NO: 814678 - RNA, 12 nt, Homo sapiens
uaugaacaucca

SEQ ID NO: 814679 - RNA, 14 nt, Homo sapiens
uaugaacuacaaag

SEQ ID NO: 814680 - RNA, 14 nt, Homo sapiens
uaugaaucugcuca

SEQ ID NO: 814681 - RNA, 20 nt, Homo sapiens
uaugaauuaaaagucuacag

SEQ ID NO: 814682 - RNA, 17 nt, Homo sapiens
uccaguauccacuuugc

SEQ ID NO: 814683 - RNA, 19 nt, Homo sapiens
uccagucagaugaggcaaa

SEQ ID NO: 814684 - RNA, 13 nt, Homo sapiens
uccagucuggauc

SEQ ID NO: 814685 - RNA, 17 nt, Homo sapiens
uccagucuggaugacag

SEQ ID NO: 814686 - RNA, 22 nt, Homo sapiens
uccagucuuccugacacuuuaa

SEQ ID NO: 814687 - RNA, 18 nt, Homo sapiens
uccagugaggaacccuga

SEQ ID NO: 814688 - RNA, 23 nt, Homo sapiens
uccagugaugugugagcuaugca

SEQ ID NO: 814689 - RNA, 14 nt, Homo sapiens
uccagugcaguugu

SEQ ID NO: 814690 - RNA, 19 nt, Homo sapiens
uccagugguucugcuucaa

SEQ ID NO: 814691 - RNA, 13 nt, Homo sapiens
uccaguguuuaca

SEQ ID NO: 814692 - RNA, 14 nt, Homo sapiens
uccaguucaucuau

SEQ ID NO: 814693 - RNA, 15 nt, Homo sapiens
uccaguucaugagaa

SEQ ID NO: 814694 - RNA, 16 nt, Homo sapiens
uccaguuugcaccugu

SEQ ID NO: 814695 - RNA, 22 nt, Homo sapiens
uccaguuuuauaaaaaguggag

SEQ ID NO: 814696 - RNA, 18 nt, Homo sapiens
uccauaagauuugcaaag

SEQ ID NO: 814697 - RNA, 22 nt, Homo sapiens
uccauagccuaaucccugggca

SEQ ID NO: 814698 - RNA, 22 nt, Homo sapiens
uccauaggcgcaggugcacagg

SEQ ID NO: 814699 - RNA, 21 nt, Homo sapiens
uccauagggccuccuuagauc

SEQ ID NO: 814700 - RNA, 16 nt, Homo sapiens
uccauagugacuuuuc

SEQ ID NO: 814701 - RNA, 23 nt, Homo sapiens
uccauaucccuuccucucaggcu

SEQ ID NO: 814702 - RNA, 18 nt, Homo sapiens
uccauaucccuuugcagu

SEQ ID NO: 814703 - RNA, 13 nt, Homo sapiens
uccauauguuaua

SEQ ID NO: 814704 - RNA, 23 nt, Homo sapiens
uccauauuggacauccccagaaa

SEQ ID NO: 814705 - RNA, 14 nt, Homo sapiens
uccaucaguauuaa

SEQ ID NO: 814706 - RNA, 20 nt, Homo sapiens
uccauccaucuuuccaucca

SEQ ID NO: 814707 - RNA, 14 nt, Homo sapiens
uccaucccuacccc

SEQ ID NO: 814708 - RNA, 21 nt, Homo sapiens
uccauccgguggccuauucca

SEQ ID NO: 814709 - RNA, 16 nt, Homo sapiens
uccauccuuccaacau

SEQ ID NO: 814710 - RNA, 14 nt, Homo sapiens
uccaucgugugugc

SEQ ID NO: 814711 - RNA, 16 nt, Homo sapiens
uccaucucuucugcaa

SEQ ID NO: 814712 - RNA, 19 nt, Homo sapiens
uccaugagggcaggcacau

SEQ ID NO: 814713 - RNA, 22 nt, Homo sapiens
uccaugauuuuaaauugugauc

SEQ ID NO: 814714 - RNA, 22 nt, Homo sapiens
uccaugcaacuggaguuccuua

SEQ ID NO: 814715 - RNA, 16 nt, Homo sapiens
uccaugccaugaauga

SEQ ID NO: 814716 - RNA, 17 nt, Homo sapiens
uccaugccaugaaugag

SEQ ID NO: 814717 - RNA, 18 nt, Homo sapiens
uccaugcugccagccuuc

SEQ ID NO: 814718 - RNA, 14 nt, Homo sapiens
uccaugggacuuuc

SEQ ID NO: 814719 - RNA, 18 nt, Homo sapiens
uccauguaaauugcaaau

SEQ ID NO: 814720 - RNA, 12 nt, Homo sapiens
uccauguacuug

SEQ ID NO: 814721 - RNA, 16 nt, Homo sapiens
uccauguauucacaca

SEQ ID NO: 814722 - RNA, 13 nt, Homo sapiens
uccaugugccuuu

SEQ ID NO: 814723 - RNA, 15 nt, Homo sapiens
uccauguuauucucu

SEQ ID NO: 814724 - RNA, 15 nt, Homo sapiens
uccauguugcugcca

SEQ ID NO: 814725 - RNA, 15 nt, Homo sapiens
uccauguuugcaccu

SEQ ID NO: 814726 - RNA, 20 nt, Homo sapiens
uccauuccagucaaaucugg

SEQ ID NO: 814727 - RNA, 19 nt, Homo sapiens
uccauucuggaaacaccug

SEQ ID NO: 814728 - RNA, 16 nt, Homo sapiens
uccauugcucuugagu

SEQ ID NO: 814729 - RNA, 19 nt, Homo sapiens
uccauugguuuaccuguga

SEQ ID NO: 814730 - RNA, 21 nt, Homo sapiens
uccauuucucaaucagugcag

SEQ ID NO: 814731 - RNA, 21 nt, Homo sapiens
ucccaggagaccugauucccu

SEQ ID NO: 814732 - RNA, 21 nt, Homo sapiens
ucccaggccaggcuuuguugc

SEQ ID NO: 814733 - RNA, 18 nt, Homo sapiens
ucccagguugacaccauu

SEQ ID NO: 814734 - RNA, 22 nt, Homo sapiens
ucccagugaccccugaccucac

SEQ ID NO: 814735 - RNA, 13 nt, Homo sapiens
ucccagugccuuc

SEQ ID NO: 814736 - RNA, 16 nt, Homo sapiens
ucccaguggagccaua

SEQ ID NO: 814737 - RNA, 17 nt, Homo sapiens
ucccauauccugccuca

SEQ ID NO: 814738 - RNA, 13 nt, Homo sapiens
ucccauccuugau

SEQ ID NO: 814739 - RNA, 18 nt, Homo sapiens
ucccaucuccccgcugaa

SEQ ID NO: 814740 - RNA, 16 nt, Homo sapiens
ucccaucugauuuacu

SEQ ID NO: 814741 - RNA, 12 nt, Homo sapiens
ucccauggaaua

SEQ ID NO: 814742 - RNA, 23 nt, Homo sapiens
ucccaugggcugaguggggagca

SEQ ID NO: 814743 - RNA, 17 nt, Homo sapiens
ucccauggucaaugcag

SEQ ID NO: 814744 - RNA, 15 nt, Homo sapiens
ucccauguaaugugu

SEQ ID NO: 814745 - RNA, 23 nt, Homo sapiens
ucccauuauuauuucuguucuua

SEQ ID NO: 814746 - RNA, 21 nt, Homo sapiens
ucccauucauauuaagacagu

SEQ ID NO: 814747 - RNA, 17 nt, Homo sapiens
ucccauuucaucagcaa

SEQ ID NO: 814748 - RNA, 12 nt, Homo sapiens
uccccaaagggu

SEQ ID NO: 814749 - RNA, 14 nt, Homo sapiens
uccccaacacccca

SEQ ID NO: 814750 - RNA, 17 nt, Homo sapiens
uccccaacugaguucaa

SEQ ID NO: 814751 - RNA, 16 nt, Homo sapiens
uccccaagcacggugu

SEQ ID NO: 814752 - RNA, 21 nt, Homo sapiens
uccccaagcuggccacuauca

SEQ ID NO: 814753 - RNA, 14 nt, Homo sapiens
uccccaaggacucu

SEQ ID NO: 814754 - RNA, 22 nt, Homo sapiens
uccccaaucccggucaugcuuu

SEQ ID NO: 814755 - RNA, 22 nt, Homo sapiens
uccccacaggagcccugcagug

SEQ ID NO: 814756 - RNA, 16 nt, Homo sapiens
uccccacccagucuca

SEQ ID NO: 814757 - RNA, 23 nt, Homo sapiens
uccccacgagggcuggcuggccu

SEQ ID NO: 814758 - RNA, 18 nt, Homo sapiens
uccccacuucugugccac

SEQ ID NO: 814759 - RNA, 15 nt, Homo sapiens
uccccagacuccacc

SEQ ID NO: 814760 - RNA, 23 nt, Homo sapiens
uccccaggaacguuucugaacaa

SEQ ID NO: 814761 - RNA, 16 nt, Homo sapiens
uccccaggcaccucac

SEQ ID NO: 814762 - RNA, 20 nt, Homo sapiens
uccccaguugccgucuagga

SEQ ID NO: 814763 - RNA, 20 nt, Homo sapiens
uccccaucauuacugguaaa

SEQ ID NO: 814764 - RNA, 21 nt, Homo sapiens
uccccaucauuacugguaaag

SEQ ID NO: 814765 - RNA, 23 nt, Homo sapiens
uccccauccaggucuugacucau

SEQ ID NO: 814766 - RNA, 19 nt, Homo sapiens
uccccauuugggacaucaa

SEQ ID NO: 814767 - RNA, 23 nt, Homo sapiens
uccccauuugggacaucaagccu

SEQ ID NO: 814768 - RNA, 18 nt, Homo sapiens
ucccccaaagcaauguga

SEQ ID NO: 814769 - RNA, 15 nt, Homo sapiens
ucccccaaagccgga

SEQ ID NO: 814770 - RNA, 15 nt, Homo sapiens
ucccccacagccacu

SEQ ID NO: 814771 - RNA, 18 nt, Homo sapiens
ucccccaccgguccagcu

SEQ ID NO: 814772 - RNA, 19 nt, Homo sapiens
ucccccaccgguccagcug

SEQ ID NO: 814773 - RNA, 20 nt, Homo sapiens
ucccccaucccccacugcca

SEQ ID NO: 814774 - RNA, 21 nt, Homo sapiens
uccccccugcugcccagugca

SEQ ID NO: 814775 - RNA, 16 nt, Homo sapiens
ucccccgugaucuccc

SEQ ID NO: 814776 - RNA, 17 nt, Homo sapiens
ucccccucucugcccug

SEQ ID NO: 814777 - RNA, 20 nt, Homo sapiens
uccccgggucucucacuguu

SEQ ID NO: 814778 - RNA, 14 nt, Homo sapiens
uccccgugccaaaa

SEQ ID NO: 814779 - RNA, 18 nt, Homo sapiens
uccuaaugucagaacaga

SEQ ID NO: 814780 - RNA, 13 nt, Homo sapiens
uccuaauucaauc

SEQ ID NO: 814781 - RNA, 17 nt, Homo sapiens
uccuaauuuugaccugu

SEQ ID NO: 814782 - RNA, 13 nt, Homo sapiens
uccuacacuugag

SEQ ID NO: 814783 - RNA, 17 nt, Homo sapiens
uccuacagccagcagca

SEQ ID NO: 814784 - RNA, 22 nt, Homo sapiens
uccuacagcccuuuguacuuca

SEQ ID NO: 814785 - RNA, 14 nt, Homo sapiens
uccuaccacucuaa

SEQ ID NO: 814786 - RNA, 17 nt, Homo sapiens
uccuaccccuuugcacu

SEQ ID NO: 814787 - RNA, 14 nt, Homo sapiens
uccuaccugucugc

SEQ ID NO: 814788 - RNA, 11 nt, Homo sapiens
uccuacugaug

SEQ ID NO: 814789 - RNA, 16 nt, Homo sapiens
uccuacugauguuccu

SEQ ID NO: 814790 - RNA, 21 nt, Homo sapiens
uccuagaaccaagcuucagag

SEQ ID NO: 814791 - RNA, 16 nt, Homo sapiens
uccuagcaaguaagaa

SEQ ID NO: 814792 - RNA, 18 nt, Homo sapiens
uccuagcugugugaauac

SEQ ID NO: 814793 - RNA, 19 nt, Homo sapiens
uccuaggccacaccaucuc

SEQ ID NO: 814794 - RNA, 20 nt, Homo sapiens
uccuaggccacaccaucucc

SEQ ID NO: 814795 - RNA, 16 nt, Homo sapiens
uccuaggggugcgcuc

SEQ ID NO: 814796 - RNA, 15 nt, Homo sapiens
uccuaggucaugccu

SEQ ID NO: 814797 - RNA, 22 nt, Homo sapiens
uccuaguuguucagcauggcau

SEQ ID NO: 814798 - RNA, 22 nt, Homo sapiens
uccuaucuccagcggcccuguc

SEQ ID NO: 814799 - RNA, 13 nt, Homo sapiens
uccuaugacauua

SEQ ID NO: 814800 - RNA, 19 nt, Homo sapiens
uccuauuaaaacacagcuu

SEQ ID NO: 814801 - RNA, 22 nt, Homo sapiens
uccuauucugaugaaucucaaa

SEQ ID NO: 814802 - RNA, 22 nt, Homo sapiens
uccuauuuauaagagugccgua

SEQ ID NO: 814803 - RNA, 20 nt, Homo sapiens
uccuauuucuccaaagccuu

SEQ ID NO: 814804 - RNA, 15 nt, Homo sapiens
uccucaaguacucaa

SEQ ID NO: 814805 - RNA, 20 nt, Homo sapiens
uccucaccucuggacuggcu

SEQ ID NO: 814806 - RNA, 21 nt, Homo sapiens
uccucaggguggggggugaca

SEQ ID NO: 814807 - RNA, 21 nt, Homo sapiens
uccucauauggcccaguguca

SEQ ID NO: 814808 - RNA, 17 nt, Homo sapiens
uccucauccccacaauc

SEQ ID NO: 814809 - RNA, 23 nt, Homo sapiens
uccuccaagaauuugacuuggaa

SEQ ID NO: 814810 - RNA, 16 nt, Homo sapiens
uccuccacucacucca

SEQ ID NO: 814811 - RNA, 21 nt, Homo sapiens
uccuccagcccagacccagug

SEQ ID NO: 814812 - RNA, 18 nt, Homo sapiens
uccuccccacacuccacu

SEQ ID NO: 814813 - RNA, 15 nt, Homo sapiens
uccucccuacuucca

SEQ ID NO: 814814 - RNA, 20 nt, Homo sapiens
uccucccuuccucaccucca

SEQ ID NO: 814815 - RNA, 14 nt, Homo sapiens
uccucccuugggaa

SEQ ID NO: 814816 - RNA, 22 nt, Homo sapiens
uccucccuuguggcuuccucag

SEQ ID NO: 814817 - RNA, 12 nt, Homo sapiens
uccuccguccac

SEQ ID NO: 814818 - RNA, 16 nt, Homo sapiens
uccuccguccauauca

SEQ ID NO: 814819 - RNA, 14 nt, Homo sapiens
uccuccugcugcag

SEQ ID NO: 814820 - RNA, 14 nt, Homo sapiens
uccucggacucugc

SEQ ID NO: 814821 - RNA, 22 nt, Homo sapiens
uccucgggccgaggcccagcgg

SEQ ID NO: 814822 - RNA, 16 nt, Homo sapiens
uccucgguacucccau

SEQ ID NO: 814823 - RNA, 13 nt, Homo sapiens
uccucguagccau

SEQ ID NO: 814824 - RNA, 14 nt, Homo sapiens
uccucuaaugaaga

SEQ ID NO: 814825 - RNA, 22 nt, Homo sapiens
uccucuagcaggccuaagacau

SEQ ID NO: 814826 - RNA, 19 nt, Homo sapiens
uccucuagcugugggggug

SEQ ID NO: 814827 - RNA, 19 nt, Homo sapiens
uccucuauuuaagauauau

SEQ ID NO: 814828 - RNA, 16 nt, Homo sapiens
uccucucacucuucag

SEQ ID NO: 814829 - RNA, 18 nt, Homo sapiens
uccucuccacugccuucg

SEQ ID NO: 814830 - RNA, 21 nt, Homo sapiens
uccucuccuacccacuggucu

SEQ ID NO: 814831 - RNA, 19 nt, Homo sapiens
uccucuccuccagcccaga

SEQ ID NO: 814832 - RNA, 15 nt, Homo sapiens
uccucucuuccucuu

SEQ ID NO: 814833 - RNA, 14 nt, Homo sapiens
uccucucuuggcau

SEQ ID NO: 814834 - RNA, 10 nt, Homo sapiens
uccucugcau

SEQ ID NO: 814835 - RNA, 15 nt, Homo sapiens
uccucugccaccucc

SEQ ID NO: 814836 - RNA, 23 nt, Homo sapiens
uccucuguucacaaacuaccucu

SEQ ID NO: 814837 - RNA, 14 nt, Homo sapiens
uccucuucagagga

SEQ ID NO: 814838 - RNA, 17 nt, Homo sapiens
uccucuuccaugcugug

SEQ ID NO: 814839 - RNA, 11 nt, Homo sapiens
uccucuucuau

SEQ ID NO: 814840 - RNA, 13 nt, Homo sapiens
uccucuucugccu

SEQ ID NO: 814841 - RNA, 20 nt, Homo sapiens
uccucuugguggguguggcc

SEQ ID NO: 814842 - RNA, 23 nt, Homo sapiens
uccucuuucaaagguagccauca

SEQ ID NO: 814843 - RNA, 16 nt, Homo sapiens
uccucuuugguggcau

SEQ ID NO: 814844 - RNA, 16 nt, Homo sapiens
uccugaaaauugcaau

SEQ ID NO: 814845 - RNA, 16 nt, Homo sapiens
uccugaaacaacuugg

SEQ ID NO: 814846 - RNA, 15 nt, Homo sapiens
uccuuuuguguacag

SEQ ID NO: 814847 - RNA, 17 nt, Homo sapiens
uccuuuuuaaaugacuu

SEQ ID NO: 814848 - RNA, 14 nt, Homo sapiens
uccuuuuucacuuu

SEQ ID NO: 814849 - RNA, 19 nt, Homo sapiens
uccuuuuuuauacaggaaa

SEQ ID NO: 814850 - RNA, 17 nt, Homo sapiens
ucgaaauacaagccauu

SEQ ID NO: 814851 - RNA, 23 nt, Homo sapiens
ucgaacauggaacucauuccugc

SEQ ID NO: 814852 - RNA, 22 nt, Homo sapiens
ucgaacuccuggccucaaguga

SEQ ID NO: 814853 - RNA, 14 nt, Homo sapiens
ucgaagcuccguga

SEQ ID NO: 814854 - RNA, 18 nt, Homo sapiens
ucgaaugaacaaagucca

SEQ ID NO: 814855 - RNA, 17 nt, Homo sapiens
ucgaaugagucuaagaa

SEQ ID NO: 814856 - RNA, 18 nt, Homo sapiens
ucgacaccauccuggcua

SEQ ID NO: 814857 - RNA, 11 nt, Homo sapiens
ucgagaucuca

SEQ ID NO: 814858 - RNA, 19 nt, Homo sapiens
ucgagcagaugaugccaac

SEQ ID NO: 814859 - RNA, 17 nt, Homo sapiens
ucgagguagguggauca

SEQ ID NO: 814860 - RNA, 19 nt, Homo sapiens
ucgauauuagaagcuauau

SEQ ID NO: 814861 - RNA, 19 nt, Homo sapiens
ucgauccuggggcccucag

SEQ ID NO: 814862 - RNA, 20 nt, Homo sapiens
ucgaucuccugaccucguga

SEQ ID NO: 814863 - RNA, 17 nt, Homo sapiens
ucgcaaggccugugcug

SEQ ID NO: 814864 - RNA, 19 nt, Homo sapiens
ucgcaccacugcacuccag

SEQ ID NO: 814865 - RNA, 14 nt, Homo sapiens
ucgcagguucaagc

SEQ ID NO: 814866 - RNA, 17 nt, Homo sapiens
ucgcauuaagcacacac

SEQ ID NO: 814867 - RNA, 16 nt, Homo sapiens
ucgccaccccuccuuc

SEQ ID NO: 814868 - RNA, 18 nt, Homo sapiens
ucgcccaggagacauccg

SEQ ID NO: 814869 - RNA, 20 nt, Homo sapiens
ucgcccuccucccugucaua

SEQ ID NO: 814870 - RNA, 20 nt, Homo sapiens
ucgccggcuucaaguggcag

SEQ ID NO: 814871 - RNA, 18 nt, Homo sapiens
ucgccuguuggggaccuc

SEQ ID NO: 814872 - RNA, 19 nt, Homo sapiens
ucgcugaugcagacacaga

SEQ ID NO: 814873 - RNA, 13 nt, Homo sapiens
ucgcugggcucaa

SEQ ID NO: 814874 - RNA, 19 nt, Homo sapiens
ucggaaacuauaaguaauu

SEQ ID NO: 814875 - RNA, 19 nt, Homo sapiens
ucggaagggguuccucaaa

SEQ ID NO: 814876 - RNA, 12 nt, Homo sapiens
ucggaaugucau

SEQ ID NO: 814877 - RNA, 22 nt, Homo sapiens
ucggagaagcuggaaaguguga

SEQ ID NO: 814878 - RNA, 16 nt, Homo sapiens
ucggagagcagcagca

SEQ ID NO: 814879 - RNA, 15 nt, Homo sapiens
ucggagccaacaaga

SEQ ID NO: 814880 - RNA, 17 nt, Homo sapiens
ucggagccaaugaacag

SEQ ID NO: 814881 - RNA, 21 nt, Homo sapiens
ucggagcuggcccagggggcc

SEQ ID NO: 814882 - RNA, 20 nt, Homo sapiens
ucggauuugccauagccuug

SEQ ID NO: 814883 - RNA, 14 nt, Homo sapiens
ucggccccagcaca

SEQ ID NO: 814884 - RNA, 15 nt, Homo sapiens
ucggcuagggguccu

SEQ ID NO: 814885 - RNA, 19 nt, Homo sapiens
ucggcuccgggcaaauggc

SEQ ID NO: 814886 - RNA, 14 nt, Homo sapiens
ucgggaacaguguu

SEQ ID NO: 814887 - RNA, 18 nt, Homo sapiens
ucgggcgagucacugccu

SEQ ID NO: 814888 - RNA, 15 nt, Homo sapiens
ucgggggcuguggau

SEQ ID NO: 814889 - RNA, 23 nt, Homo sapiens
ucgguguucugucccagugcggu

SEQ ID NO: 814890 - RNA, 20 nt, Homo sapiens
ucguagguauuagugcuagu

SEQ ID NO: 814891 - RNA, 12 nt, Homo sapiens
ucguaugcacuc

SEQ ID NO: 814892 - RNA, 18 nt, Homo sapiens
ucgucaucaggugcauag

SEQ ID NO: 814893 - RNA, 22 nt, Homo sapiens
ucuauugaaaacagugucuuga

SEQ ID NO: 814894 - RNA, 14 nt, Homo sapiens
ucuauugacuuuuc

SEQ ID NO: 814895 - RNA, 21 nt, Homo sapiens
ucuauugagugaacagaauug

SEQ ID NO: 814896 - RNA, 19 nt, Homo sapiens
ucuauugucgcuaugugac

SEQ ID NO: 814897 - RNA, 20 nt, Homo sapiens
ucuauugucuacuugcgauu

SEQ ID NO: 814898 - RNA, 14 nt, Homo sapiens
ucuauuguuaccuc

SEQ ID NO: 814899 - RNA, 17 nt, Homo sapiens
ucuauuuaagauuccca

SEQ ID NO: 814900 - RNA, 17 nt, Homo sapiens
ucuauuuccacugaaca

SEQ ID NO: 814901 - RNA, 21 nt, Homo sapiens
ucuauuuuaagacugauuuua

SEQ ID NO: 814902 - RNA, 16 nt, Homo sapiens
ucucaaaaacaaagag

SEQ ID NO: 814903 - RNA, 22 nt, Homo sapiens
ucucaaaaauccuuaugcauga

SEQ ID NO: 814904 - RNA, 22 nt, Homo sapiens
ucucaaaacaauauuacuuugu

SEQ ID NO: 814905 - RNA, 21 nt, Homo sapiens
ucucaaaacugcacugucaag

SEQ ID NO: 814906 - RNA, 14 nt, Homo sapiens
ucucaaacuccuga

SEQ ID NO: 814907 - RNA, 12 nt, Homo sapiens
ucucaaacuuca

SEQ ID NO: 814908 - RNA, 16 nt, Homo sapiens
ucucaaagaaggcauu

SEQ ID NO: 814909 - RNA, 14 nt, Homo sapiens
ucucaaagcacugu

SEQ ID NO: 814910 - RNA, 17 nt, Homo sapiens
ucucaaaguuugacagg

SEQ ID NO: 814911 - RNA, 23 nt, Homo sapiens
ucucaagggcuagcaucccugag

SEQ ID NO: 814912 - RNA, 11 nt, Homo sapiens
ucucaaucucc

SEQ ID NO: 814913 - RNA, 17 nt, Homo sapiens
ucucaaugaaccauaaa

SEQ ID NO: 814914 - RNA, 17 nt, Homo sapiens
ucucaaugaagccagcu

SEQ ID NO: 814915 - RNA, 19 nt, Homo sapiens
ucucacaaggaaaaggcca

SEQ ID NO: 814916 - RNA, 12 nt, Homo sapiens
ucucacagagaa

SEQ ID NO: 814917 - RNA, 18 nt, Homo sapiens
ucucacaguguugcccag

SEQ ID NO: 814918 - RNA, 20 nt, Homo sapiens
ucucacauaagcccaguuca

SEQ ID NO: 814919 - RNA, 17 nt, Homo sapiens
ucucaccacgggaaagc

SEQ ID NO: 814920 - RNA, 22 nt, Homo sapiens
ucucaccugcuggggaccucac

SEQ ID NO: 814921 - RNA, 13 nt, Homo sapiens
ucucacuacuuga

SEQ ID NO: 814922 - RNA, 18 nt, Homo sapiens
ucucagaauaacuaccuc

SEQ ID NO: 814923 - RNA, 13 nt, Homo sapiens
ucucagaccccac

SEQ ID NO: 814924 - RNA, 19 nt, Homo sapiens
ucucagagaccagcacuca

SEQ ID NO: 814925 - RNA, 23 nt, Homo sapiens
ucucagauguugaaacuuugaau

SEQ ID NO: 814926 - RNA, 16 nt, Homo sapiens
ucucagcaucgugcug

SEQ ID NO: 814927 - RNA, 18 nt, Homo sapiens
ucucagcccugaccuucu

SEQ ID NO: 814928 - RNA, 12 nt, Homo sapiens
ucucagcucacu

SEQ ID NO: 814929 - RNA, 15 nt, Homo sapiens
ucucagcucacugca

SEQ ID NO: 814930 - RNA, 20 nt, Homo sapiens
ucucagcucacugcaaccuc

SEQ ID NO: 814931 - RNA, 22 nt, Homo sapiens
ucucagcucacugcaaccucug

SEQ ID NO: 814932 - RNA, 14 nt, Homo sapiens
ucucagcuuugaga

SEQ ID NO: 814933 - RNA, 14 nt, Homo sapiens
ucucaggccagcuc

SEQ ID NO: 814934 - RNA, 18 nt, Homo sapiens
ucucaggccugacucuca

SEQ ID NO: 814935 - RNA, 15 nt, Homo sapiens
ucucagguguugcca

SEQ ID NO: 814936 - RNA, 20 nt, Homo sapiens
ucucagucaguaauugccaa

SEQ ID NO: 814937 - RNA, 21 nt, Homo sapiens
ucucagugaaauaacuaccuu

SEQ ID NO: 814938 - RNA, 14 nt, Homo sapiens
ucucagugcuucuu

SEQ ID NO: 814939 - RNA, 13 nt, Homo sapiens
ucucaguggagcc

SEQ ID NO: 814940 - RNA, 21 nt, Homo sapiens
ucucauaaugcuuuguuaaau

SEQ ID NO: 814941 - RNA, 21 nt, Homo sapiens
ucucauaccuuccccacaucu

SEQ ID NO: 814942 - RNA, 12 nt, Homo sapiens
ucucaucacuca

SEQ ID NO: 814943 - RNA, 23 nt, Homo sapiens
ucucaugauccaacuaaugccuu

SEQ ID NO: 814944 - RNA, 19 nt, Homo sapiens
ucucauggguggcacucag

SEQ ID NO: 814945 - RNA, 17 nt, Homo sapiens
ucucauguauaaaacua

SEQ ID NO: 814946 - RNA, 18 nt, Homo sapiens
ucucauuuaaaaugagau

SEQ ID NO: 814947 - RNA, 17 nt, Homo sapiens
ucucauuuggucugcca

SEQ ID NO: 814948 - RNA, 13 nt, Homo sapiens
ucuccaaacauua

SEQ ID NO: 814949 - RNA, 22 nt, Homo sapiens
ucuccaaucaguguuuggugua

SEQ ID NO: 814950 - RNA, 17 nt, Homo sapiens
ucuccacugggugccaa

SEQ ID NO: 814951 - RNA, 17 nt, Homo sapiens
ucuccagacccaccaca

SEQ ID NO: 814952 - RNA, 19 nt, Homo sapiens
ucuccagcggcccugucau

SEQ ID NO: 814953 - RNA, 14 nt, Homo sapiens
ucuccaguggauuc

SEQ ID NO: 814954 - RNA, 23 nt, Homo sapiens
ucuccauaaaugacacuacuuga

SEQ ID NO: 814955 - RNA, 12 nt, Homo sapiens
ucuccaugcugc

SEQ ID NO: 814956 - RNA, 20 nt, Homo sapiens
ucuccauguguuugauuucu

SEQ ID NO: 814957 - RNA, 14 nt, Homo sapiens
ucuccauuugcucu

SEQ ID NO: 814958 - RNA, 22 nt, Homo sapiens
ucucccagcuucaaaugcaaau

SEQ ID NO: 814959 - RNA, 17 nt, Homo sapiens
ucuccccacuaaccaca

SEQ ID NO: 814960 - RNA, 16 nt, Homo sapiens
ucuccccaggccucca

SEQ ID NO: 814961 - RNA, 19 nt, Homo sapiens
ucuccccaguguaugucuu

SEQ ID NO: 814962 - RNA, 21 nt, Homo sapiens
ucuccccggcaggccugagaa

SEQ ID NO: 814963 - RNA, 21 nt, Homo sapiens
ucucccugccaagucucagaa

SEQ ID NO: 814964 - RNA, 16 nt, Homo sapiens
ucucccuuguccugcu

SEQ ID NO: 814965 - RNA, 14 nt, Homo sapiens
ucuccgacucugca

SEQ ID NO: 814966 - RNA, 17 nt, Homo sapiens
ucuccguagaauuuugc

SEQ ID NO: 814967 - RNA, 15 nt, Homo sapiens
ucuccguuaaucucu

SEQ ID NO: 814968 - RNA, 15 nt, Homo sapiens
ucuccuaacaaaaga

SEQ ID NO: 814969 - RNA, 20 nt, Homo sapiens
ucuccuaagcuggagugcag

SEQ ID NO: 814970 - RNA, 18 nt, Homo sapiens
ucuccuaaugcuuuaucc

SEQ ID NO: 814971 - RNA, 18 nt, Homo sapiens
ucuccuacuaugcaauuu

SEQ ID NO: 814972 - RNA, 14 nt, Homo sapiens
ucuccucagaagaa

SEQ ID NO: 814973 - RNA, 14 nt, Homo sapiens
ucuccuccauuccc

SEQ ID NO: 814974 - RNA, 12 nt, Homo sapiens
ucuccucuccau

SEQ ID NO: 814975 - RNA, 18 nt, Homo sapiens
ucuccucuuuuguaccca

SEQ ID NO: 814976 - RNA, 12 nt, Homo sapiens
ucuccugacccc

SEQ ID NO: 814977 - RNA, 14 nt, Homo sapiens
ucuccuggcuuuac

SEQ ID NO: 814978 - RNA, 16 nt, Homo sapiens
ucuccuguccaaccua

SEQ ID NO: 814979 - RNA, 13 nt, Homo sapiens
ucuccugugccca

SEQ ID NO: 814980 - RNA, 13 nt, Homo sapiens
ucuccuugcacuu

SEQ ID NO: 814981 - RNA, 14 nt, Homo sapiens
ucuccuugcacuuu

SEQ ID NO: 814982 - RNA, 16 nt, Homo sapiens
ucuccuuggcugucug

SEQ ID NO: 814983 - RNA, 15 nt, Homo sapiens
ucuccuuuacuaaau

SEQ ID NO: 814984 - RNA, 18 nt, Homo sapiens
ucuccuuugcacugaggg

SEQ ID NO: 814985 - RNA, 13 nt, Homo sapiens
ucuccuuuggcca

SEQ ID NO: 814986 - RNA, 18 nt, Homo sapiens
ucuccuuuggccauucca

SEQ ID NO: 814987 - RNA, 18 nt, Homo sapiens
ucuccuuuugaccaaaua

SEQ ID NO: 814988 - RNA, 20 nt, Homo sapiens
ucucgaacuccugaccccaa

SEQ ID NO: 814989 - RNA, 17 nt, Homo sapiens
ucucgaaugcugagaag

SEQ ID NO: 814990 - RNA, 15 nt, Homo sapiens
ucucgaucuccugac

SEQ ID NO: 814991 - RNA, 13 nt, Homo sapiens
ucucgauggacaa

SEQ ID NO: 814992 - RNA, 12 nt, Homo sapiens
ucucgcaaaaac

SEQ ID NO: 814993 - RNA, 14 nt, Homo sapiens
ucucgguuugccaa

SEQ ID NO: 814994 - RNA, 17 nt, Homo sapiens
ucucuaacauuuccuua

SEQ ID NO: 814995 - RNA, 21 nt, Homo sapiens
ucucuaacguccacuagcuua

SEQ ID NO: 814996 - RNA, 19 nt, Homo sapiens
ucucuaacuccugccauuc

SEQ ID NO: 814997 - RNA, 23 nt, Homo sapiens
ucucuacaaacucccacuuguca

SEQ ID NO: 814998 - RNA, 22 nt, Homo sapiens
ucucuacaaauuuuucuguggu

SEQ ID NO: 814999 - RNA, 15 nt, Homo sapiens
ucucuaccagucuau

SEQ ID NO: 815000 - RNA, 22 nt, Homo sapiens
ucucuagggcuaguagaacugg

SEQ ID NO: 815001 - RNA, 15 nt, Homo sapiens
ucucuauauugcuua

SEQ ID NO: 815002 - RNA, 15 nt, Homo sapiens
ucucuauugcugcuc

SEQ ID NO: 815003 - RNA, 12 nt, Homo sapiens
ucucucaaugaa

SEQ ID NO: 815004 - RNA, 13 nt, Homo sapiens
ucucucaaugaau

SEQ ID NO: 815005 - RNA, 13 nt, Homo sapiens
ucucucacaugga

SEQ ID NO: 815006 - RNA, 21 nt, Homo sapiens
ucucucagugaacugugaggg

SEQ ID NO: 815007 - RNA, 16 nt, Homo sapiens
ucucucaguucuacac

SEQ ID NO: 815008 - RNA, 19 nt, Homo sapiens
ucucucaucucuuagcucc

SEQ ID NO: 815009 - RNA, 13 nt, Homo sapiens
ucucucaugacca

SEQ ID NO: 815010 - RNA, 20 nt, Homo sapiens
ucucuccaccgugacacaau

SEQ ID NO: 815011 - RNA, 14 nt, Homo sapiens
ucucuccagccuga

SEQ ID NO: 815012 - RNA, 17 nt, Homo sapiens
ucucuccagcugacuaa

SEQ ID NO: 815013 - RNA, 22 nt, Homo sapiens
ucucucccaccccggccuccac

SEQ ID NO: 815014 - RNA, 16 nt, Homo sapiens
ucucuccgaggggugg

SEQ ID NO: 815015 - RNA, 20 nt, Homo sapiens
ucucuccugauagucuuuca

SEQ ID NO: 815016 - RNA, 16 nt, Homo sapiens
ucucucgcaagggaag

SEQ ID NO: 815017 - RNA, 16 nt, Homo sapiens
ucucucuaccagucua

SEQ ID NO: 815018 - RNA, 10 nt, Homo sapiens
ucucucucag

SEQ ID NO: 815019 - RNA, 13 nt, Homo sapiens
ucucucucgcugc

SEQ ID NO: 815020 - RNA, 16 nt, Homo sapiens
ucucucuuuguaaaac

SEQ ID NO: 815021 - RNA, 12 nt, Homo sapiens
ucucugagucaa

SEQ ID NO: 815022 - RNA, 18 nt, Homo sapiens
ucucugcaguuuuuccca

SEQ ID NO: 815023 - RNA, 17 nt, Homo sapiens
ucucugcaucuacuccc

SEQ ID NO: 815024 - RNA, 12 nt, Homo sapiens
ucucugccagug

SEQ ID NO: 815025 - RNA, 15 nt, Homo sapiens
ucucugccagugaca

SEQ ID NO: 815026 - RNA, 20 nt, Homo sapiens
ucucuggcuguaaggcucua

SEQ ID NO: 815027 - RNA, 12 nt, Homo sapiens
ucucuguacuuu

SEQ ID NO: 815028 - RNA, 13 nt, Homo sapiens
ucucugucucaaa

SEQ ID NO: 815029 - RNA, 15 nt, Homo sapiens
ucucugucucaaauu

SEQ ID NO: 815030 - RNA, 11 nt, Homo sapiens
ucucugugcau

SEQ ID NO: 815031 - RNA, 20 nt, Homo sapiens
ucucugugugcacacccaug

SEQ ID NO: 815032 - RNA, 18 nt, Homo sapiens
ucucuuacaccugccaug

SEQ ID NO: 815033 - RNA, 20 nt, Homo sapiens
ucucuuaccugggaccucac

SEQ ID NO: 815034 - RNA, 16 nt, Homo sapiens
ucucuuauagaauauu

SEQ ID NO: 815035 - RNA, 14 nt, Homo sapiens
ucucuucaaucucu

SEQ ID NO: 815036 - RNA, 15 nt, Homo sapiens
ucucuucacucccaa

SEQ ID NO: 815037 - RNA, 23 nt, Homo sapiens
ucucuucauuauucucugcuaua

SEQ ID NO: 815038 - RNA, 13 nt, Homo sapiens
ucucuucugccuu

SEQ ID NO: 815039 - RNA, 13 nt, Homo sapiens
ucucuucugggcg

SEQ ID NO: 815040 - RNA, 20 nt, Homo sapiens
ucucuugaaaaguucaggga

SEQ ID NO: 815041 - RNA, 17 nt, Homo sapiens
ucucuugauucugggau

SEQ ID NO: 815042 - RNA, 15 nt, Homo sapiens
ucucuugcauuguga

SEQ ID NO: 815043 - RNA, 15 nt, Homo sapiens
ucucuugguaugcau

SEQ ID NO: 815044 - RNA, 21 nt, Homo sapiens
ucucuuuggcuggaauuacaa

SEQ ID NO: 815045 - RNA, 16 nt, Homo sapiens
ucucuuugguguuaca

SEQ ID NO: 815046 - RNA, 19 nt, Homo sapiens
ucucuuuuaggaggcacaa

SEQ ID NO: 815047 - RNA, 24 nt, Homo sapiens
ucugaaaauauuuuuuucuagcua

SEQ ID NO: 815048 - RNA, 21 nt, Homo sapiens
ucugaaauccauaaacuaaga

SEQ ID NO: 815049 - RNA, 21 nt, Homo sapiens
ucugaaccagaauuacauguu

SEQ ID NO: 815050 - RNA, 14 nt, Homo sapiens
ucugaaccaugugg

SEQ ID NO: 815051 - RNA, 15 nt, Homo sapiens
ucugaagcuuuacca

SEQ ID NO: 815052 - RNA, 20 nt, Homo sapiens
ucugaagucacaucacagga

SEQ ID NO: 815053 - RNA, 15 nt, Homo sapiens
ucugaagucacugca

SEQ ID NO: 815054 - RNA, 20 nt, Homo sapiens
ucugaauaaaguguaacaau

SEQ ID NO: 815055 - RNA, 20 nt, Homo sapiens
ucugaauaaauacccauuga

SEQ ID NO: 815056 - RNA, 13 nt, Homo sapiens
ucugaauccuuuu

SEQ ID NO: 815057 - RNA, 20 nt, Homo sapiens
ucugaaugcugccacaacca

SEQ ID NO: 815058 - RNA, 15 nt, Homo sapiens
ucugaauuaauuaau

SEQ ID NO: 815059 - RNA, 18 nt, Homo sapiens
ucugacaguccuuggggu

SEQ ID NO: 815060 - RNA, 13 nt, Homo sapiens
ucugaccaaaaca

SEQ ID NO: 815061 - RNA, 14 nt, Homo sapiens
ucugaccagcuuuu

SEQ ID NO: 815062 - RNA, 22 nt, Homo sapiens
ucugacccagugcccccacuga

SEQ ID NO: 815063 - RNA, 20 nt, Homo sapiens
ucugacuaagguugacauaa

SEQ ID NO: 815064 - RNA, 21 nt, Homo sapiens
ucugacuaggugucaccauac

SEQ ID NO: 815065 - RNA, 15 nt, Homo sapiens
ucugacuaugacaua

SEQ ID NO: 815066 - RNA, 20 nt, Homo sapiens
ucugagaagacacaagguga

SEQ ID NO: 815067 - RNA, 17 nt, Homo sapiens
ucugagaaggugagaua

SEQ ID NO: 815068 - RNA, 24 nt, Homo sapiens
ucugagacaccugaugaccuguua

SEQ ID NO: 815069 - RNA, 10 nt, Homo sapiens
ucugagacag

SEQ ID NO: 815070 - RNA, 17 nt, Homo sapiens
ucugagacagcuugucu

SEQ ID NO: 815071 - RNA, 14 nt, Homo sapiens
ucugagaccaaagu

SEQ ID NO: 815072 - RNA, 19 nt, Homo sapiens
ucugagacccuuuucucag

SEQ ID NO: 815073 - RNA, 17 nt, Homo sapiens
ucugagagccaggguuu

SEQ ID NO: 815074 - RNA, 19 nt, Homo sapiens
ucugagcacagcugcauua

SEQ ID NO: 815075 - RNA, 21 nt, Homo sapiens
ucugagcacagcugcauuaaa

SEQ ID NO: 815076 - RNA, 20 nt, Homo sapiens
ucugagcacggacucuccca

SEQ ID NO: 815077 - RNA, 15 nt, Homo sapiens
ucugagcuauuucau

SEQ ID NO: 815078 - RNA, 21 nt, Homo sapiens
ucugagggaggaggccaccuc

SEQ ID NO: 815079 - RNA, 17 nt, Homo sapiens
ucugaggggugggggug

SEQ ID NO: 815080 - RNA, 20 nt, Homo sapiens
ucugaguaagaaacagaauc

SEQ ID NO: 815081 - RNA, 14 nt, Homo sapiens
ucugaguaagcccu

SEQ ID NO: 815082 - RNA, 19 nt, Homo sapiens
ucugaguaagcccucagga

SEQ ID NO: 815083 - RNA, 21 nt, Homo sapiens
ucugagucuauguucaaagac

SEQ ID NO: 815084 - RNA, 14 nt, Homo sapiens
ucugagugggccca

SEQ ID NO: 815085 - RNA, 18 nt, Homo sapiens
ucugauaaaagauggcca

SEQ ID NO: 815086 - RNA, 14 nt, Homo sapiens
ucugauaaugcuca

SEQ ID NO: 815087 - RNA, 15 nt, Homo sapiens
ucugauauguaucca

SEQ ID NO: 815088 - RNA, 13 nt, Homo sapiens
ucugaucauguau

SEQ ID NO: 815089 - RNA, 22 nt, Homo sapiens
ucugaucugcaguuuuugccug

SEQ ID NO: 815090 - RNA, 17 nt, Homo sapiens
ucugaugaucauugcug

SEQ ID NO: 815091 - RNA, 20 nt, Homo sapiens
ucugauggcugaagaaugua

SEQ ID NO: 815092 - RNA, 16 nt, Homo sapiens
ucugauuggugauuca

SEQ ID NO: 815093 - RNA, 20 nt, Homo sapiens
ucugauuuuugucccaguag

SEQ ID NO: 815094 - RNA, 21 nt, Homo sapiens
ucugcaaaggcgucugaaugu

SEQ ID NO: 815095 - RNA, 16 nt, Homo sapiens
ucugcaacacuuugag

SEQ ID NO: 815096 - RNA, 16 nt, Homo sapiens
ucugcaacauuugaca

SEQ ID NO: 815097 - RNA, 13 nt, Homo sapiens
ucugcaagcauca

SEQ ID NO: 815098 - RNA, 16 nt, Homo sapiens
ucugcacagacaagca

SEQ ID NO: 815099 - RNA, 17 nt, Homo sapiens
ucugcagacugcugcua

SEQ ID NO: 815100 - RNA, 20 nt, Homo sapiens
ucugcagcugcuuuugcauu

SEQ ID NO: 815101 - RNA, 20 nt, Homo sapiens
ucugcagcuuucaagcucau

SEQ ID NO: 815102 - RNA, 17 nt, Homo sapiens
ucugcaggccacuguga

SEQ ID NO: 815103 - RNA, 22 nt, Homo sapiens
ucugcauggaacagcauuaccc

SEQ ID NO: 815104 - RNA, 22 nt, Homo sapiens
ucugcaugucuacucagcauuu

SEQ ID NO: 815105 - RNA, 19 nt, Homo sapiens
ucugccaauuuuugccuuc

SEQ ID NO: 815106 - RNA, 19 nt, Homo sapiens
ucugccauuaaaacauuac

SEQ ID NO: 815107 - RNA, 14 nt, Homo sapiens
ucugccauucaacu

SEQ ID NO: 815108 - RNA, 15 nt, Homo sapiens
ucugcccacagucuu

SEQ ID NO: 815109 - RNA, 13 nt, Homo sapiens
ucugccccagaua

SEQ ID NO: 815110 - RNA, 16 nt, Homo sapiens
ucugcccuuguucccu

SEQ ID NO: 815111 - RNA, 22 nt, Homo sapiens
ucugccuagaguguagccuaaa

SEQ ID NO: 815112 - RNA, 20 nt, Homo sapiens
ucugccucccagguucaagu

SEQ ID NO: 815113 - RNA, 20 nt, Homo sapiens
ucugccugaaccuuccaucu

SEQ ID NO: 815114 - RNA, 22 nt, Homo sapiens
ucugccugaaggcucacaccuc

SEQ ID NO: 815115 - RNA, 18 nt, Homo sapiens
ucugccuggggugcauuu

SEQ ID NO: 815116 - RNA, 20 nt, Homo sapiens
ucugccuuaaaaccaaagag

SEQ ID NO: 815117 - RNA, 21 nt, Homo sapiens
ucugccuuuggggacuuuucu

SEQ ID NO: 815118 - RNA, 23 nt, Homo sapiens
ucugcgcaccaaggaauggagag

SEQ ID NO: 815119 - RNA, 18 nt, Homo sapiens
ucugcggaucucagcuuu

SEQ ID NO: 815120 - RNA, 22 nt, Homo sapiens
ucugcuccccugugaacccacu

SEQ ID NO: 815121 - RNA, 21 nt, Homo sapiens
ucugcuggcagaaagcaaaug

SEQ ID NO: 815122 - RNA, 19 nt, Homo sapiens
ucugcuggccuggaucucc

SEQ ID NO: 815123 - RNA, 15 nt, Homo sapiens
ucugcuggugaauaa

SEQ ID NO: 815124 - RNA, 13 nt, Homo sapiens
ucugcuguagcuu

SEQ ID NO: 815125 - RNA, 15 nt, Homo sapiens
ucugcuguggucuga

SEQ ID NO: 815126 - RNA, 19 nt, Homo sapiens
ucugcuguggucugaagug

SEQ ID NO: 815127 - RNA, 23 nt, Homo sapiens
ucugcuguuuuuuuugcugcuaa

SEQ ID NO: 815128 - RNA, 14 nt, Homo sapiens
ucugcuuacaaaga

SEQ ID NO: 815129 - RNA, 16 nt, Homo sapiens
ucugcuuaugcaguuu

SEQ ID NO: 815130 - RNA, 22 nt, Homo sapiens
ucugcuuuaguuucacauugca

SEQ ID NO: 815131 - RNA, 19 nt, Homo sapiens
ucugcuuuucccauugcca

SEQ ID NO: 815132 - RNA, 20 nt, Homo sapiens
ucugcuuuucccauugccau

SEQ ID NO: 815133 - RNA, 17 nt, Homo sapiens
ucugcuuuugcacaccu

SEQ ID NO: 815134 - RNA, 18 nt, Homo sapiens
ucuggaacccagacucag

SEQ ID NO: 815135 - RNA, 21 nt, Homo sapiens
ucuggaagucaucucauucca

SEQ ID NO: 815136 - RNA, 16 nt, Homo sapiens
ucuggaauacaugaaa

SEQ ID NO: 815137 - RNA, 11 nt, Homo sapiens
ucuggacaaag

SEQ ID NO: 815138 - RNA, 15 nt, Homo sapiens
ucuggacgugaaaua

SEQ ID NO: 815139 - RNA, 20 nt, Homo sapiens
ucuggaggacggucagucca

SEQ ID NO: 815140 - RNA, 15 nt, Homo sapiens
ucuggaggcaaucaa

SEQ ID NO: 815141 - RNA, 13 nt, Homo sapiens
ucuggagugagcu

SEQ ID NO: 815142 - RNA, 18 nt, Homo sapiens
ucuggauccagccaugcc

SEQ ID NO: 815143 - RNA, 15 nt, Homo sapiens
ucuggauucugaauc

SEQ ID NO: 815144 - RNA, 17 nt, Homo sapiens
ucuggauucugaaucuc

SEQ ID NO: 815145 - RNA, 12 nt, Homo sapiens
ucuggauuucau

SEQ ID NO: 815146 - RNA, 20 nt, Homo sapiens
ucuggauuucauacuguaac

SEQ ID NO: 815147 - RNA, 12 nt, Homo sapiens
ucuggcaaaaag

SEQ ID NO: 815148 - RNA, 21 nt, Homo sapiens
ucuggcagagucagcugcuga

SEQ ID NO: 815149 - RNA, 19 nt, Homo sapiens
ucuggcaggaaucuaucca

SEQ ID NO: 815150 - RNA, 18 nt, Homo sapiens
ucuggcaucuuagaccuc

SEQ ID NO: 815151 - RNA, 23 nt, Homo sapiens
ucuggcccacccccaacaggaau

SEQ ID NO: 815152 - RNA, 20 nt, Homo sapiens
ucuggccugggcgacagagc

SEQ ID NO: 815153 - RNA, 20 nt, Homo sapiens
ucuggcugaacccugugcug

SEQ ID NO: 815154 - RNA, 18 nt, Homo sapiens
ucuggcugaggauuucaa

SEQ ID NO: 815155 - RNA, 17 nt, Homo sapiens
ucuggcuuagugccacc

SEQ ID NO: 815156 - RNA, 15 nt, Homo sapiens
ucugggaggcccuga

SEQ ID NO: 815157 - RNA, 15 nt, Homo sapiens
ucugggagucacaca

SEQ ID NO: 815158 - RNA, 17 nt, Homo sapiens
ucugggagucacacagu

SEQ ID NO: 815159 - RNA, 23 nt, Homo sapiens
ucugggaguuauaggucauggga

SEQ ID NO: 815160 - RNA, 23 nt, Homo sapiens
ucugggauuaagggcaaaucuau

SEQ ID NO: 815161 - RNA, 17 nt, Homo sapiens
ucugggccaaguuccuc

SEQ ID NO: 815162 - RNA, 19 nt, Homo sapiens
ucuggggaaaggggacaag

SEQ ID NO: 815163 - RNA, 17 nt, Homo sapiens
ucuggggggauauuucc

SEQ ID NO: 815164 - RNA, 20 nt, Homo sapiens
ucuggggguccucucugagu

SEQ ID NO: 815165 - RNA, 21 nt, Homo sapiens
ucugggguccauucucugagu

SEQ ID NO: 815166 - RNA, 22 nt, Homo sapiens
ucugggguccauucucugaguc

SEQ ID NO: 815167 - RNA, 23 nt, Homo sapiens
ucugggguccauucucugaguca

SEQ ID NO: 815168 - RNA, 18 nt, Homo sapiens
ucuggguacuucuugaag

SEQ ID NO: 815169 - RNA, 17 nt, Homo sapiens
ucugguaggaaugcuuc

SEQ ID NO: 815170 - RNA, 17 nt, Homo sapiens
ucuggucacauggcugu

SEQ ID NO: 815171 - RNA, 22 nt, Homo sapiens
ucugguccaggcccuguggcag

SEQ ID NO: 815172 - RNA, 17 nt, Homo sapiens
ucugguccgagucucag

SEQ ID NO: 815173 - RNA, 16 nt, Homo sapiens
ucuggucgcuccugcc

SEQ ID NO: 815174 - RNA, 19 nt, Homo sapiens
ucuggucuaguuaaccuag

SEQ ID NO: 815175 - RNA, 18 nt, Homo sapiens
ucuggugccaaaugaaga

SEQ ID NO: 815176 - RNA, 15 nt, Homo sapiens
ucuguaaacuuacua

SEQ ID NO: 815177 - RNA, 13 nt, Homo sapiens
ucuguacagauca

SEQ ID NO: 815178 - RNA, 16 nt, Homo sapiens
ucuguagcgucuguau

SEQ ID NO: 815179 - RNA, 14 nt, Homo sapiens
ucuguagcuauaau

SEQ ID NO: 815180 - RNA, 16 nt, Homo sapiens
ucuguaggaaccgugg

SEQ ID NO: 815181 - RNA, 16 nt, Homo sapiens
ucuguaguuacugugg

SEQ ID NO: 815182 - RNA, 14 nt, Homo sapiens
ucuguauauacuca

SEQ ID NO: 815183 - RNA, 15 nt, Homo sapiens
ucuguaucagucuuu

SEQ ID NO: 815184 - RNA, 21 nt, Homo sapiens
ucuguaucauugauucaucaa

SEQ ID NO: 815185 - RNA, 23 nt, Homo sapiens
ucuguaucccuacaucuaacuca

SEQ ID NO: 815186 - RNA, 20 nt, Homo sapiens
ucuguauugggguacaggaa

SEQ ID NO: 815187 - RNA, 19 nt, Homo sapiens
ucuguauuuuauuuagaca

SEQ ID NO: 815188 - RNA, 14 nt, Homo sapiens
ucugucaacaucaa

SEQ ID NO: 815189 - RNA, 17 nt, Homo sapiens
ucugucaacaucaaaga

SEQ ID NO: 815190 - RNA, 18 nt, Homo sapiens
ucugucaccaacugaagu

SEQ ID NO: 815191 - RNA, 23 nt, Homo sapiens
ucugucaccaacugaaguggcua

SEQ ID NO: 815192 - RNA, 12 nt, Homo sapiens
ugacucuagcaa

SEQ ID NO: 815193 - RNA, 16 nt, Homo sapiens
ugacucucacacugaa

SEQ ID NO: 815194 - RNA, 14 nt, Homo sapiens
ugacugaaacauuc

SEQ ID NO: 815195 - RNA, 15 nt, Homo sapiens
ugacugaaacauuca

SEQ ID NO: 815196 - RNA, 18 nt, Homo sapiens
ugacugaaggcugucagg

SEQ ID NO: 815197 - RNA, 11 nt, Homo sapiens
ugacuggugcu

SEQ ID NO: 815198 - RNA, 15 nt, Homo sapiens
ugacuguaucugugu

SEQ ID NO: 815199 - RNA, 17 nt, Homo sapiens
ugacuguaucuguguag

SEQ ID NO: 815200 - RNA, 17 nt, Homo sapiens
ugacuguccaagugcca

SEQ ID NO: 815201 - RNA, 19 nt, Homo sapiens
ugacuuaacagaacucaac

SEQ ID NO: 815202 - RNA, 18 nt, Homo sapiens
ugacuuaguugcguuaca

SEQ ID NO: 815203 - RNA, 18 nt, Homo sapiens
ugacuucagaauaacagc

SEQ ID NO: 815204 - RNA, 21 nt, Homo sapiens
ugacuuccugaacaaccagcu

SEQ ID NO: 815205 - RNA, 16 nt, Homo sapiens
ugacuuggaguuuuau

SEQ ID NO: 815206 - RNA, 16 nt, Homo sapiens
ugacuugugucccaug

SEQ ID NO: 815207 - RNA, 17 nt, Homo sapiens
ugagaaaacucaaccag

SEQ ID NO: 815208 - RNA, 19 nt, Homo sapiens
ugagaaaaguucaauacuc

SEQ ID NO: 815209 - RNA, 22 nt, Homo sapiens
ugagaaacauuauuagcacuuc

SEQ ID NO: 815210 - RNA, 22 nt, Homo sapiens
ugagaaacucuacauguaacua

SEQ ID NO: 815211 - RNA, 16 nt, Homo sapiens
ugagaaacugauuuau

SEQ ID NO: 815212 - RNA, 18 nt, Homo sapiens
ugagaaagacuauucaaa

SEQ ID NO: 815213 - RNA, 12 nt, Homo sapiens
ugagaaagggau

SEQ ID NO: 815214 - RNA, 17 nt, Homo sapiens
ugagaaagggauugcug

SEQ ID NO: 815215 - RNA, 14 nt, Homo sapiens
ugagaaaguucuca

SEQ ID NO: 815216 - RNA, 15 nt, Homo sapiens
ugagaaauggccaaa

SEQ ID NO: 815217 - RNA, 21 nt, Homo sapiens
ugagaacaagucacagcugca

SEQ ID NO: 815218 - RNA, 13 nt, Homo sapiens
ugagaacagcauu

SEQ ID NO: 815219 - RNA, 15 nt, Homo sapiens
ugagaacagcauuua

SEQ ID NO: 815220 - RNA, 20 nt, Homo sapiens
ugagaacucugcccaggugu

SEQ ID NO: 815221 - RNA, 14 nt, Homo sapiens
ugagaacuugacaa

SEQ ID NO: 815222 - RNA, 22 nt, Homo sapiens
ugagaagaaaacaucuauucuc

SEQ ID NO: 815223 - RNA, 13 nt, Homo sapiens
ugagaagaaugaa

SEQ ID NO: 815224 - RNA, 14 nt, Homo sapiens
ugagaagccaugua

SEQ ID NO: 815225 - RNA, 18 nt, Homo sapiens
ugagaagccuucagcucc

SEQ ID NO: 815226 - RNA, 14 nt, Homo sapiens
ugagaaggacccug

SEQ ID NO: 815227 - RNA, 14 nt, Homo sapiens
ugagaaggcaaaag

SEQ ID NO: 815228 - RNA, 20 nt, Homo sapiens
ugagaagugucuaaaaacac

SEQ ID NO: 815229 - RNA, 15 nt, Homo sapiens
ugagaauguggaaua

SEQ ID NO: 815230 - RNA, 17 nt, Homo sapiens
ugagaauuguaugucau

SEQ ID NO: 815231 - RNA, 15 nt, Homo sapiens
ugagaauugugcuuu

SEQ ID NO: 815232 - RNA, 13 nt, Homo sapiens
ugagacaagcccu

SEQ ID NO: 815233 - RNA, 17 nt, Homo sapiens
ugagacagaaucucagu

SEQ ID NO: 815234 - RNA, 16 nt, Homo sapiens
ugagacccagugcacu

SEQ ID NO: 815235 - RNA, 15 nt, Homo sapiens
ugagaccucaaugaa

SEQ ID NO: 815236 - RNA, 15 nt, Homo sapiens
ugagacucagugcag

SEQ ID NO: 815237 - RNA, 15 nt, Homo sapiens
ugagacuccaccuca

SEQ ID NO: 815238 - RNA, 17 nt, Homo sapiens
ugagacucuagggucca

SEQ ID NO: 815239 - RNA, 17 nt, Homo sapiens
ugagacuuaaaacaugg

SEQ ID NO: 815240 - RNA, 23 nt, Homo sapiens
ugagacuuaaaacauggugccua

SEQ ID NO: 815241 - RNA, 12 nt, Homo sapiens
ugagagccuuuu

SEQ ID NO: 815242 - RNA, 19 nt, Homo sapiens
ugagagggaaucgacugua

SEQ ID NO: 815243 - RNA, 21 nt, Homo sapiens
ugagaucacgccauuguacuc

SEQ ID NO: 815244 - RNA, 18 nt, Homo sapiens
ugagauccgggagacuga

SEQ ID NO: 815245 - RNA, 23 nt, Homo sapiens
ugagaucgugccguuacucucca

SEQ ID NO: 815246 - RNA, 16 nt, Homo sapiens
ugagcaaauggugcug

SEQ ID NO: 815247 - RNA, 16 nt, Homo sapiens
ugagcaagacauacuu

SEQ ID NO: 815248 - RNA, 15 nt, Homo sapiens
ugagcaauaugccuc

SEQ ID NO: 815249 - RNA, 23 nt, Homo sapiens
ugagcaauggaguggcugccaug

SEQ ID NO: 815250 - RNA, 13 nt, Homo sapiens
ugagcaaugucug

SEQ ID NO: 815251 - RNA, 20 nt, Homo sapiens
ugagcacacccgugugcaca

SEQ ID NO: 815252 - RNA, 23 nt, Homo sapiens
ugagcacuuagcaggcaccgcca

SEQ ID NO: 815253 - RNA, 18 nt, Homo sapiens
ugagcagagagcagcagc

SEQ ID NO: 815254 - RNA, 17 nt, Homo sapiens
ugagcagcuuagacagc

SEQ ID NO: 815255 - RNA, 14 nt, Homo sapiens
ugagcagcuuuucu

SEQ ID NO: 815256 - RNA, 19 nt, Homo sapiens
ugagcagggagaagccaga

SEQ ID NO: 815257 - RNA, 23 nt, Homo sapiens
ugagcagguguucuucauuaccu

SEQ ID NO: 815258 - RNA, 22 nt, Homo sapiens
ugagcaguguuggagugaggac

SEQ ID NO: 815259 - RNA, 14 nt, Homo sapiens
ugagcaguucauga

SEQ ID NO: 815260 - RNA, 14 nt, Homo sapiens
ugagcauaaaucaa

SEQ ID NO: 815261 - RNA, 18 nt, Homo sapiens
ugagcaugcacagcugcu

SEQ ID NO: 815262 - RNA, 20 nt, Homo sapiens
ugagcauuacuauucacuga

SEQ ID NO: 815263 - RNA, 15 nt, Homo sapiens
ugagccaagaucgca

SEQ ID NO: 815264 - RNA, 15 nt, Homo sapiens
ugagccaccaugccu

SEQ ID NO: 815265 - RNA, 18 nt, Homo sapiens
ugagccagugagggcagu

SEQ ID NO: 815266 - RNA, 16 nt, Homo sapiens
ugagccaucacuagaa

SEQ ID NO: 815267 - RNA, 20 nt, Homo sapiens
ugagccaugaucgagccacu

SEQ ID NO: 815268 - RNA, 15 nt, Homo sapiens
ugagccccagugcug

SEQ ID NO: 815269 - RNA, 23 nt, Homo sapiens
ugagcccucuaugguguggcaaa

SEQ ID NO: 815270 - RNA, 20 nt, Homo sapiens
ugagcgcuguggacuguccu

SEQ ID NO: 815271 - RNA, 14 nt, Homo sapiens
ugagcuacuucaaa

SEQ ID NO: 815272 - RNA, 23 nt, Homo sapiens
ugagcuagagauaaaacagaauc

SEQ ID NO: 815273 - RNA, 13 nt, Homo sapiens
ugagcucugggaa

SEQ ID NO: 815274 - RNA, 12 nt, Homo sapiens
ugagcugggaag

SEQ ID NO: 815275 - RNA, 16 nt, Homo sapiens
ugagcugggggaagaa

SEQ ID NO: 815276 - RNA, 19 nt, Homo sapiens
ugagcugguaggauguaag

SEQ ID NO: 815277 - RNA, 20 nt, Homo sapiens
ugagcugguuugucaaacaa

SEQ ID NO: 815278 - RNA, 23 nt, Homo sapiens
ugagcuucaauauaagaagcaau

SEQ ID NO: 815279 - RNA, 17 nt, Homo sapiens
ugagcuucacugucauc

SEQ ID NO: 815280 - RNA, 18 nt, Homo sapiens
ugagcuuccccaagcacg

SEQ ID NO: 815281 - RNA, 21 nt, Homo sapiens
ugagcuucuaacucauuguau

SEQ ID NO: 815282 - RNA, 18 nt, Homo sapiens
ugaggaaaaaaugguaua

SEQ ID NO: 815283 - RNA, 18 nt, Homo sapiens
ugaggaaaugccacaaau

SEQ ID NO: 815284 - RNA, 14 nt, Homo sapiens
ugaggaacauucaa

SEQ ID NO: 815285 - RNA, 20 nt, Homo sapiens
ugaggaacucacauacugac

SEQ ID NO: 815286 - RNA, 17 nt, Homo sapiens
ugaggaaggacuugacu

SEQ ID NO: 815287 - RNA, 15 nt, Homo sapiens
ugaggaauccaaaag

SEQ ID NO: 815288 - RNA, 15 nt, Homo sapiens
ugaggacaauuucau

SEQ ID NO: 815289 - RNA, 15 nt, Homo sapiens
ugaggacauguggaa

SEQ ID NO: 815290 - RNA, 23 nt, Homo sapiens
ugaggacgagacccccauccagc

SEQ ID NO: 815291 - RNA, 15 nt, Homo sapiens
ugaggacugauuuca

SEQ ID NO: 815292 - RNA, 12 nt, Homo sapiens
ugaggacugugg

SEQ ID NO: 815293 - RNA, 17 nt, Homo sapiens
ugaggagcccuaagcau

SEQ ID NO: 815294 - RNA, 13 nt, Homo sapiens
ugaggagcccuua

SEQ ID NO: 815295 - RNA, 22 nt, Homo sapiens
ugaggagcggacucacuugaug

SEQ ID NO: 815296 - RNA, 17 nt, Homo sapiens
ugaggagcugcacugau

SEQ ID NO: 815297 - RNA, 17 nt, Homo sapiens
ugaggauguguuuugca

SEQ ID NO: 815298 - RNA, 13 nt, Homo sapiens
ugaggauuucaag

SEQ ID NO: 815299 - RNA, 13 nt, Homo sapiens
ugaggcaggugga

SEQ ID NO: 815300 - RNA, 13 nt, Homo sapiens
ugaggcaugacua

SEQ ID NO: 815301 - RNA, 19 nt, Homo sapiens
ugaggcauuuccagacuug

SEQ ID NO: 815302 - RNA, 15 nt, Homo sapiens
ugaggcccagugcau

SEQ ID NO: 815303 - RNA, 21 nt, Homo sapiens
ugaggcccagugcauaugcaa

SEQ ID NO: 815304 - RNA, 16 nt, Homo sapiens
ugaggccugcuucccc

SEQ ID NO: 815305 - RNA, 22 nt, Homo sapiens
ugaggcuacagggaguguagua

SEQ ID NO: 815306 - RNA, 19 nt, Homo sapiens
ugaggcuauggaggguccu

SEQ ID NO: 815307 - RNA, 14 nt, Homo sapiens
ugaggcucucuagu

SEQ ID NO: 815308 - RNA, 13 nt, Homo sapiens
ugaggcugucaca

SEQ ID NO: 815309 - RNA, 14 nt, Homo sapiens
ugaggcuucucagc

SEQ ID NO: 815310 - RNA, 17 nt, Homo sapiens
ugaggcuucuccuucuc

SEQ ID NO: 815311 - RNA, 17 nt, Homo sapiens
ugagggaucacugccaa

SEQ ID NO: 815312 - RNA, 15 nt, Homo sapiens
ugagggcaguucuga

SEQ ID NO: 815313 - RNA, 17 nt, Homo sapiens
ugagggccagggaccca

SEQ ID NO: 815314 - RNA, 22 nt, Homo sapiens
ugagggcucuguuugugggacu

SEQ ID NO: 815315 - RNA, 22 nt, Homo sapiens
ugaggggcuccuggaaaggcuc

SEQ ID NO: 815316 - RNA, 22 nt, Homo sapiens
ugaggggguaauaaaccuccuu

SEQ ID NO: 815317 - RNA, 14 nt, Homo sapiens
ugagggucugggau

SEQ ID NO: 815318 - RNA, 20 nt, Homo sapiens
ugagggugacuauggagcug

SEQ ID NO: 815319 - RNA, 12 nt, Homo sapiens
ugagggugcuga

SEQ ID NO: 815320 - RNA, 23 nt, Homo sapiens
ugagggugggggugcucucucug

SEQ ID NO: 815321 - RNA, 15 nt, Homo sapiens
ugaggguuaaugaaa

SEQ ID NO: 815322 - RNA, 16 nt, Homo sapiens
ugaggucucuugaggg

SEQ ID NO: 815323 - RNA, 17 nt, Homo sapiens
ugaggugggcuggggcu

SEQ ID NO: 815324 - RNA, 16 nt, Homo sapiens
ugagguucuugggaua

SEQ ID NO: 815325 - RNA, 22 nt, Homo sapiens
ugagguugggguguacuaguua

SEQ ID NO: 815326 - RNA, 18 nt, Homo sapiens
ugaguaacaggugccuuc

SEQ ID NO: 815327 - RNA, 18 nt, Homo sapiens
ugaguaagcccucaggag

SEQ ID NO: 815328 - RNA, 17 nt, Homo sapiens
ugaguaaucauacucaa

SEQ ID NO: 815329 - RNA, 18 nt, Homo sapiens
ugaguaauuguauuguca

SEQ ID NO: 815330 - RNA, 16 nt, Homo sapiens
ugaguaccuacugugu

SEQ ID NO: 815331 - RNA, 16 nt, Homo sapiens
ugaguagccagaugaa

SEQ ID NO: 815332 - RNA, 20 nt, Homo sapiens
ugaguagcucugccuuugcu

SEQ ID NO: 815333 - RNA, 22 nt, Homo sapiens
ugaguagcuggauuacaggcau

SEQ ID NO: 815334 - RNA, 24 nt, Homo sapiens
ugaguauuccaugagcugcucauu

SEQ ID NO: 815335 - RNA, 15 nt, Homo sapiens
ugagucaaagacuua

SEQ ID NO: 815336 - RNA, 15 nt, Homo sapiens
ugagucagacuguca

SEQ ID NO: 815337 - RNA, 13 nt, Homo sapiens
ugagucagugcuc

SEQ ID NO: 815338 - RNA, 14 nt, Homo sapiens
ugagucaugaucuc

SEQ ID NO: 815339 - RNA, 13 nt, Homo sapiens
ugaguccaaagaa

SEQ ID NO: 815340 - RNA, 17 nt, Homo sapiens
ugagucccuccaaaggg

SEQ ID NO: 815341 - RNA, 16 nt, Homo sapiens
ugaguccuaggacuua

SEQ ID NO: 815342 - RNA, 17 nt, Homo sapiens
ugaguccuguucuuccu

SEQ ID NO: 815343 - RNA, 15 nt, Homo sapiens
ugagucggaagcucc

SEQ ID NO: 815344 - RNA, 20 nt, Homo sapiens
ugagucugaguccugucucu

SEQ ID NO: 815345 - RNA, 19 nt, Homo sapiens
ugagucuguugugugucau

SEQ ID NO: 815346 - RNA, 14 nt, Homo sapiens
ugagugaucacugg

SEQ ID NO: 815347 - RNA, 22 nt, Homo sapiens
ugaguggaguugaggugucaga

SEQ ID NO: 815348 - RNA, 13 nt, Homo sapiens
ugaguggccccac

SEQ ID NO: 815349 - RNA, 20 nt, Homo sapiens
ugagugggaauccgggacac

SEQ ID NO: 815350 - RNA, 14 nt, Homo sapiens
ugaguggucuucaa

SEQ ID NO: 815351 - RNA, 15 nt, Homo sapiens
ugaguggugccaaac

SEQ ID NO: 815352 - RNA, 15 nt, Homo sapiens
ugaguguccuugcag

SEQ ID NO: 815353 - RNA, 16 nt, Homo sapiens
ugaguuacaauuugga

SEQ ID NO: 815354 - RNA, 22 nt, Homo sapiens
ugaguuacaauuuggagcauaa

SEQ ID NO: 815355 - RNA, 22 nt, Homo sapiens
ugaguuauuaaaaucauaggaa

SEQ ID NO: 815356 - RNA, 22 nt, Homo sapiens
ugaguucuggaagggacuuuag

SEQ ID NO: 815357 - RNA, 23 nt, Homo sapiens
ugaguugacuucugacaaaggug

SEQ ID NO: 815358 - RNA, 15 nt, Homo sapiens
ugaguuguguuccac

SEQ ID NO: 815359 - RNA, 19 nt, Homo sapiens
ugaguuuaaaucaagauua

SEQ ID NO: 815360 - RNA, 18 nt, Homo sapiens
ugaguuucuuaacccuuu

SEQ ID NO: 815361 - RNA, 13 nt, Homo sapiens
ugauaaaccaaaa

SEQ ID NO: 815362 - RNA, 14 nt, Homo sapiens
ugauaaacuuugcu

SEQ ID NO: 815363 - RNA, 15 nt, Homo sapiens
ugauaaagcacagcu

SEQ ID NO: 815364 - RNA, 16 nt, Homo sapiens
ugauaaguucauacau

SEQ ID NO: 815365 - RNA, 16 nt, Homo sapiens
ugauaauaauugauca

SEQ ID NO: 815366 - RNA, 20 nt, Homo sapiens
ugauaauagcacuaaugcuu

SEQ ID NO: 815367 - RNA, 13 nt, Homo sapiens
ugauaaugcucac

SEQ ID NO: 815368 - RNA, 20 nt, Homo sapiens
ugauaauuguguaccuuaag

SEQ ID NO: 815369 - RNA, 22 nt, Homo sapiens
ugauaccaccuuuacugugcuu

SEQ ID NO: 815370 - RNA, 15 nt, Homo sapiens
ugauaccacugcacu

SEQ ID NO: 815371 - RNA, 22 nt, Homo sapiens
ugauacccaaguuauugggaug

SEQ ID NO: 815372 - RNA, 18 nt, Homo sapiens
ugauacuucaggugcuuu

SEQ ID NO: 815373 - RNA, 12 nt, Homo sapiens
ugauacuuugac

SEQ ID NO: 815374 - RNA, 12 nt, Homo sapiens
ugauagaagauu

SEQ ID NO: 815375 - RNA, 13 nt, Homo sapiens
ugauagaauacaa

SEQ ID NO: 815376 - RNA, 13 nt, Homo sapiens
ugauguccagaag

SEQ ID NO: 815377 - RNA, 16 nt, Homo sapiens
ugaugucuccacuuuc

SEQ ID NO: 815378 - RNA, 16 nt, Homo sapiens
ugauguguccucaggg

SEQ ID NO: 815379 - RNA, 19 nt, Homo sapiens
ugaugugugagcuaugcaa

SEQ ID NO: 815380 - RNA, 19 nt, Homo sapiens
ugauguuccaccugccaca

SEQ ID NO: 815381 - RNA, 15 nt, Homo sapiens
ugauguuuccuggaa

SEQ ID NO: 815382 - RNA, 19 nt, Homo sapiens
ugauguuuggggaucgaug

SEQ ID NO: 815383 - RNA, 19 nt, Homo sapiens
ugauuaaaaaugcuuuuag

SEQ ID NO: 815384 - RNA, 22 nt, Homo sapiens
ugauuaaagcuaaggaccuuaa

SEQ ID NO: 815385 - RNA, 21 nt, Homo sapiens
ugauuaacucuuagaaguguu

SEQ ID NO: 815386 - RNA, 15 nt, Homo sapiens
ugauuacuaugcucu

SEQ ID NO: 815387 - RNA, 21 nt, Homo sapiens
ugauuagaaggcaaguuucua

SEQ ID NO: 815388 - RNA, 15 nt, Homo sapiens
ugauuagacagaaca

SEQ ID NO: 815389 - RNA, 17 nt, Homo sapiens
ugauuagagcugcauaa

SEQ ID NO: 815390 - RNA, 14 nt, Homo sapiens
ugauuaugccacug

SEQ ID NO: 815391 - RNA, 18 nt, Homo sapiens
ugauuauuuguauuuaca

SEQ ID NO: 815392 - RNA, 15 nt, Homo sapiens
ugauucaacagggaa

SEQ ID NO: 815393 - RNA, 20 nt, Homo sapiens
ugauucacauccucucaagu

SEQ ID NO: 815394 - RNA, 13 nt, Homo sapiens
ugauucacugcau

SEQ ID NO: 815395 - RNA, 12 nt, Homo sapiens
ugauuccaugga

SEQ ID NO: 815396 - RNA, 22 nt, Homo sapiens
ugauucccuccugcuacucugu

SEQ ID NO: 815397 - RNA, 23 nt, Homo sapiens
ugauuccguguguguacugauuc

SEQ ID NO: 815398 - RNA, 24 nt, Homo sapiens
ugauuccuuuccuaaaaguguaag

SEQ ID NO: 815399 - RNA, 22 nt, Homo sapiens
ugauucuccugccucagccucc

SEQ ID NO: 815400 - RNA, 19 nt, Homo sapiens
ugauugaaaauaguaaaug

SEQ ID NO: 815401 - RNA, 20 nt, Homo sapiens
ugauugaaucugauuggaca

SEQ ID NO: 815402 - RNA, 21 nt, Homo sapiens
ugauugacacacagcacucuc

SEQ ID NO: 815403 - RNA, 14 nt, Homo sapiens
ugauugcagcuuua

SEQ ID NO: 815404 - RNA, 17 nt, Homo sapiens
ugauugcuuaccuacau

SEQ ID NO: 815405 - RNA, 21 nt, Homo sapiens
ugauuggacauuuucuucaga

SEQ ID NO: 815406 - RNA, 23 nt, Homo sapiens
ugauuggaccaggccauucugcc

SEQ ID NO: 815407 - RNA, 19 nt, Homo sapiens
ugauuuaccuauacauuau

SEQ ID NO: 815408 - RNA, 12 nt, Homo sapiens
ugauuuauugaa

SEQ ID NO: 815409 - RNA, 18 nt, Homo sapiens
ugauuucacaacagauca

SEQ ID NO: 815410 - RNA, 20 nt, Homo sapiens
ugauuucaggagaaccuaac

SEQ ID NO: 815411 - RNA, 14 nt, Homo sapiens
ugauuucauuucaa

SEQ ID NO: 815412 - RNA, 17 nt, Homo sapiens
ugauuuuugagcccuug

SEQ ID NO: 815413 - RNA, 14 nt, Homo sapiens
ugauuuuuuuccac

SEQ ID NO: 815414 - RNA, 18 nt, Homo sapiens
ugauuuuuuuuauugccu

SEQ ID NO: 815415 - RNA, 22 nt, Homo sapiens
ugcaaaaauuaauacacaaaua

SEQ ID NO: 815416 - RNA, 14 nt, Homo sapiens
ugcaaaacacuaaa

SEQ ID NO: 815417 - RNA, 13 nt, Homo sapiens
ugcaaaacuuuag

SEQ ID NO: 815418 - RNA, 20 nt, Homo sapiens
ugcaaaagugaaacauacaa

SEQ ID NO: 815419 - RNA, 13 nt, Homo sapiens
ugcaaaauuucca

SEQ ID NO: 815420 - RNA, 22 nt, Homo sapiens
ugcaaacccgaaaauaaaagac

SEQ ID NO: 815421 - RNA, 19 nt, Homo sapiens
ugcaaacucacugcucaag

SEQ ID NO: 815422 - RNA, 15 nt, Homo sapiens
ugcaaacuuguuaga

SEQ ID NO: 815423 - RNA, 17 nt, Homo sapiens
ugcaaagcugaagacca

SEQ ID NO: 815424 - RNA, 16 nt, Homo sapiens
ugcaaaggagaagcac

SEQ ID NO: 815425 - RNA, 20 nt, Homo sapiens
ugcaaaggagaagcacagcu

SEQ ID NO: 815426 - RNA, 23 nt, Homo sapiens
ugcaaagucaaaacuauagccau

SEQ ID NO: 815427 - RNA, 21 nt, Homo sapiens
ugcaaauccuugauacugcuc

SEQ ID NO: 815428 - RNA, 20 nt, Homo sapiens
ugcaaaugccuccaagccau

SEQ ID NO: 815429 - RNA, 21 nt, Homo sapiens
ugcaacaauaaaguacuuuac

SEQ ID NO: 815430 - RNA, 15 nt, Homo sapiens
ugcaacagacuugaa

SEQ ID NO: 815431 - RNA, 19 nt, Homo sapiens
ugcaacagggggcaaagau

SEQ ID NO: 815432 - RNA, 11 nt, Homo sapiens
ugcaacauucu

SEQ ID NO: 815433 - RNA, 13 nt, Homo sapiens
ugcaaccucugcc

SEQ ID NO: 815434 - RNA, 19 nt, Homo sapiens
ugcaagcacaucugcauuu

SEQ ID NO: 815435 - RNA, 22 nt, Homo sapiens
ugcaagccuucuaaaugaguca

SEQ ID NO: 815436 - RNA, 17 nt, Homo sapiens
ugcaagguauuucucca

SEQ ID NO: 815437 - RNA, 23 nt, Homo sapiens
ugcaaggugcccacaugugucca

SEQ ID NO: 815438 - RNA, 14 nt, Homo sapiens
ugcaaguuacugca

SEQ ID NO: 815439 - RNA, 16 nt, Homo sapiens
ugcaaguuacugcagu

SEQ ID NO: 815440 - RNA, 18 nt, Homo sapiens
ugcaauaaaauaguagca

SEQ ID NO: 815441 - RNA, 13 nt, Homo sapiens
ugcaauaaugaca

SEQ ID NO: 815442 - RNA, 23 nt, Homo sapiens
ugcaauaccaaguauagccuaug

SEQ ID NO: 815443 - RNA, 16 nt, Homo sapiens
ugcaauauaagcauaa

SEQ ID NO: 815444 - RNA, 19 nt, Homo sapiens
ugcaauaucugaagcccuc

SEQ ID NO: 815445 - RNA, 16 nt, Homo sapiens
ugcaauaugaauucaa

SEQ ID NO: 815446 - RNA, 20 nt, Homo sapiens
ugcaauccagccugggcaac

SEQ ID NO: 815447 - RNA, 20 nt, Homo sapiens
ugcaaucgguuuaaacaugg

SEQ ID NO: 815448 - RNA, 13 nt, Homo sapiens
ugcaaugagccau

SEQ ID NO: 815449 - RNA, 20 nt, Homo sapiens
ugcaaugcccucauacccau

SEQ ID NO: 815450 - RNA, 13 nt, Homo sapiens
ugcaaugucacaa

SEQ ID NO: 815451 - RNA, 19 nt, Homo sapiens
ugcaauugacauaggcaau

SEQ ID NO: 815452 - RNA, 15 nt, Homo sapiens
ugcaauuuuucaaga

SEQ ID NO: 815453 - RNA, 17 nt, Homo sapiens
ugcacaagcacuaucac

SEQ ID NO: 815454 - RNA, 20 nt, Homo sapiens
ugcacaaguaacacauuugg

SEQ ID NO: 815455 - RNA, 21 nt, Homo sapiens
ugcacaagucuuuccagagga

SEQ ID NO: 815456 - RNA, 16 nt, Homo sapiens
ugcacaauuccaugac

SEQ ID NO: 815457 - RNA, 12 nt, Homo sapiens
ugcacacaccug

SEQ ID NO: 815458 - RNA, 13 nt, Homo sapiens
ugcacacaggaca

SEQ ID NO: 815459 - RNA, 20 nt, Homo sapiens
ugcacacgggaaagccuuaa

SEQ ID NO: 815460 - RNA, 13 nt, Homo sapiens
ugcacacugccug

SEQ ID NO: 815461 - RNA, 19 nt, Homo sapiens
ugcacagccaacgagacac

SEQ ID NO: 815462 - RNA, 13 nt, Homo sapiens
ugcacagcugcuu

SEQ ID NO: 815463 - RNA, 22 nt, Homo sapiens
ugcacauauggacucugcacau

SEQ ID NO: 815464 - RNA, 13 nt, Homo sapiens
ugcacaugaaucc

SEQ ID NO: 815465 - RNA, 23 nt, Homo sapiens
ugcacaugugagcaugucacuuc

SEQ ID NO: 815466 - RNA, 15 nt, Homo sapiens
ugcacauugugcagg

SEQ ID NO: 815467 - RNA, 11 nt, Homo sapiens
ugcaccaaaga

SEQ ID NO: 815468 - RNA, 12 nt, Homo sapiens
ugcaccaaagac

SEQ ID NO: 815469 - RNA, 18 nt, Homo sapiens
ugcaccaaagacaucagu

SEQ ID NO: 815470 - RNA, 15 nt, Homo sapiens
ugcaccaacgagcug

SEQ ID NO: 815471 - RNA, 18 nt, Homo sapiens
ugcaccaacgagcuguac

SEQ ID NO: 815472 - RNA, 21 nt, Homo sapiens
ugcaccaacgagcuguacaug

SEQ ID NO: 815473 - RNA, 17 nt, Homo sapiens
ugcaccaggagacagac

SEQ ID NO: 815474 - RNA, 13 nt, Homo sapiens
ugcaccaugcugc

SEQ ID NO: 815475 - RNA, 15 nt, Homo sapiens
ugcaccaugcugcug

SEQ ID NO: 815476 - RNA, 14 nt, Homo sapiens
ugcaccauggagac

SEQ ID NO: 815477 - RNA, 19 nt, Homo sapiens
ugcaccccaccagcaauac

SEQ ID NO: 815478 - RNA, 21 nt, Homo sapiens
ugcaccuacccacaugcacuc

SEQ ID NO: 815479 - RNA, 19 nt, Homo sapiens
ugcaccuacugcuuacugu

SEQ ID NO: 815480 - RNA, 21 nt, Homo sapiens
ugcaccuugugucuguacacg

SEQ ID NO: 815481 - RNA, 22 nt, Homo sapiens
ugcaccuugugucuguacacgu

SEQ ID NO: 815482 - RNA, 14 nt, Homo sapiens
ugcacgaucucagu

SEQ ID NO: 815483 - RNA, 13 nt, Homo sapiens
ugcacgguacaaa

SEQ ID NO: 815484 - RNA, 17 nt, Homo sapiens
ugcacguggccucuuga

SEQ ID NO: 815485 - RNA, 16 nt, Homo sapiens
ugcacguggggcccac

SEQ ID NO: 815486 - RNA, 23 nt, Homo sapiens
ugcacuaaaucagagacaaaaua

SEQ ID NO: 815487 - RNA, 21 nt, Homo sapiens
ugcacuaccauugcuguucua

SEQ ID NO: 815488 - RNA, 23 nt, Homo sapiens
ugcacuacucccucaaagcacac

SEQ ID NO: 815489 - RNA, 13 nt, Homo sapiens
ugcacuacuccuc

SEQ ID NO: 815490 - RNA, 23 nt, Homo sapiens
ugcacuacuccucugcagugccu

SEQ ID NO: 815491 - RNA, 18 nt, Homo sapiens
ugcacuagccugugauua

SEQ ID NO: 815492 - RNA, 20 nt, Homo sapiens
ugcacuccagccugggcaac

SEQ ID NO: 815493 - RNA, 20 nt, Homo sapiens
ugcacuccagcuugggcaac

SEQ ID NO: 815494 - RNA, 18 nt, Homo sapiens
ugcacuccggucccaaau

SEQ ID NO: 815495 - RNA, 19 nt, Homo sapiens
ugcacucuagccuggcaac

SEQ ID NO: 815496 - RNA, 15 nt, Homo sapiens
ugcacugagggccac

SEQ ID NO: 815497 - RNA, 13 nt, Homo sapiens
ugcacugcauucc

SEQ ID NO: 815498 - RNA, 22 nt, Homo sapiens
ugcacuggggagcccgucucag

SEQ ID NO: 815499 - RNA, 14 nt, Homo sapiens
ugcacuggggccac

SEQ ID NO: 815500 - RNA, 22 nt, Homo sapiens
ugcacuuauaagaaagaucaaa

SEQ ID NO: 815501 - RNA, 23 nt, Homo sapiens
ugcagaaaacagggucugggaca

SEQ ID NO: 815502 - RNA, 19 nt, Homo sapiens
ugcagaagcaaacaagcuu

SEQ ID NO: 815503 - RNA, 21 nt, Homo sapiens
ugcagacaaccucaucagcug

SEQ ID NO: 815504 - RNA, 18 nt, Homo sapiens
ugcagaccccuuggccag

SEQ ID NO: 815505 - RNA, 20 nt, Homo sapiens
ugcagacuguucuuacugua

SEQ ID NO: 815506 - RNA, 16 nt, Homo sapiens
ugcagaggcaccucaa

SEQ ID NO: 815507 - RNA, 22 nt, Homo sapiens
ugcagaggggaaagacuuccau

SEQ ID NO: 815508 - RNA, 15 nt, Homo sapiens
ugcagaguaaguauu

SEQ ID NO: 815509 - RNA, 17 nt, Homo sapiens
ugcagagugcccagaac

SEQ ID NO: 815510 - RNA, 16 nt, Homo sapiens
ugcagcaaacacucca

SEQ ID NO: 815511 - RNA, 21 nt, Homo sapiens
ugcagcaccgaggggccuuug

SEQ ID NO: 815512 - RNA, 22 nt, Homo sapiens
ugcagcagugagucucuucaga

SEQ ID NO: 815513 - RNA, 13 nt, Homo sapiens
ugcagccacuuuc

SEQ ID NO: 815514 - RNA, 21 nt, Homo sapiens
ugcagcccuugugaugugauu

SEQ ID NO: 815515 - RNA, 19 nt, Homo sapiens
ugcagccgugaucaaggga

SEQ ID NO: 815516 - RNA, 20 nt, Homo sapiens
ugcagccucacuucuaccug

SEQ ID NO: 815517 - RNA, 17 nt, Homo sapiens
ugcagccuuugccuccc

SEQ ID NO: 815518 - RNA, 20 nt, Homo sapiens
ugcagcggcaggaccgccau

SEQ ID NO: 815519 - RNA, 19 nt, Homo sapiens
ugcagcugcuuuugcauuu

SEQ ID NO: 815520 - RNA, 23 nt, Homo sapiens
ugcaggaagugucuagaggaaua

SEQ ID NO: 815521 - RNA, 21 nt, Homo sapiens
ugcaggagcuaguucucagcu

SEQ ID NO: 815522 - RNA, 21 nt, Homo sapiens
ugcaggagucccugccaucau

SEQ ID NO: 815523 - RNA, 17 nt, Homo sapiens
ugcaggauguucaggga

SEQ ID NO: 815524 - RNA, 18 nt, Homo sapiens
ugcaggauguucagggag

SEQ ID NO: 815525 - RNA, 19 nt, Homo sapiens
ugcaggccacugugagcgc

SEQ ID NO: 815526 - RNA, 15 nt, Homo sapiens
ugcaggccccagcaa

SEQ ID NO: 815527 - RNA, 17 nt, Homo sapiens
ugcagggacuccaugcu

SEQ ID NO: 815528 - RNA, 13 nt, Homo sapiens
ugcagggcacugu

SEQ ID NO: 815529 - RNA, 12 nt, Homo sapiens
ugcagggcuccc

SEQ ID NO: 815530 - RNA, 15 nt, Homo sapiens
ugcaggggaagacca

SEQ ID NO: 815531 - RNA, 21 nt, Homo sapiens
ugcagggggugugucugcuca

SEQ ID NO: 815532 - RNA, 19 nt, Homo sapiens
ugcagggguccccccucaa

SEQ ID NO: 815533 - RNA, 20 nt, Homo sapiens
ugcagguggugggacacugg

SEQ ID NO: 815534 - RNA, 22 nt, Homo sapiens
ugcagguuccuuaucugucaca

SEQ ID NO: 815535 - RNA, 21 nt, Homo sapiens
ugcaguacuuaauguuuguaa

SEQ ID NO: 815536 - RNA, 22 nt, Homo sapiens
ugcaguagagucaucuccauca

SEQ ID NO: 815537 - RNA, 11 nt, Homo sapiens
ugcaguagcac

SEQ ID NO: 815538 - RNA, 21 nt, Homo sapiens
ugcaguaggggcuacugugac

SEQ ID NO: 815539 - RNA, 19 nt, Homo sapiens
ugcaguaugaacuauugcc

SEQ ID NO: 815540 - RNA, 17 nt, Homo sapiens
ugcaguaugggaucuga

SEQ ID NO: 815541 - RNA, 15 nt, Homo sapiens
ugcaguauguugcca

SEQ ID NO: 815542 - RNA, 20 nt, Homo sapiens
ugcagucaacaguucaaaga

SEQ ID NO: 815543 - RNA, 14 nt, Homo sapiens
ugcagucacuggag

SEQ ID NO: 815544 - RNA, 19 nt, Homo sapiens
ugcagucagcgccagcacu

SEQ ID NO: 815545 - RNA, 14 nt, Homo sapiens
ugcagucaucuccc

SEQ ID NO: 815546 - RNA, 20 nt, Homo sapiens
ugcaguccgcagucuggccu

SEQ ID NO: 815547 - RNA, 17 nt, Homo sapiens
ugcagugagcccagauc

SEQ ID NO: 815548 - RNA, 15 nt, Homo sapiens
ugcagugagcuauua

SEQ ID NO: 815549 - RNA, 19 nt, Homo sapiens
ugcaguggcaucaucucag

SEQ ID NO: 815550 - RNA, 20 nt, Homo sapiens
ugcaguggcccccacagaaa

SEQ ID NO: 815551 - RNA, 18 nt, Homo sapiens
ugcaguggcgccaucuca

SEQ ID NO: 815552 - RNA, 18 nt, Homo sapiens
ugcaguggcgugaucuca

SEQ ID NO: 815553 - RNA, 17 nt, Homo sapiens
ugcaguggcgugaucuu

SEQ ID NO: 815554 - RNA, 21 nt, Homo sapiens
ugcaguggcgugaucuuggcu

SEQ ID NO: 815555 - RNA, 17 nt, Homo sapiens
ugcaguggugugaucuc

SEQ ID NO: 815556 - RNA, 14 nt, Homo sapiens
uuuccucaagcaau

SEQ ID NO: 815557 - RNA, 16 nt, Homo sapiens
uuuccucagugcauuu

SEQ ID NO: 815558 - RNA, 15 nt, Homo sapiens
uuuccuccucaggca

SEQ ID NO: 815559 - RNA, 22 nt, Homo sapiens
uuuccuccucccagugccuucu

SEQ ID NO: 815560 - RNA, 14 nt, Homo sapiens
uuuccucuauugau

SEQ ID NO: 815561 - RNA, 21 nt, Homo sapiens
uuuccugcugccauccucacc

SEQ ID NO: 815562 - RNA, 19 nt, Homo sapiens
uuuccuuaacgcuagagau

SEQ ID NO: 815563 - RNA, 15 nt, Homo sapiens
uuuccuucagguuuu

SEQ ID NO: 815564 - RNA, 11 nt, Homo sapiens
uuuccuuccau

SEQ ID NO: 815565 - RNA, 19 nt, Homo sapiens
uuuccuucuaacacuugua

SEQ ID NO: 815566 - RNA, 15 nt, Homo sapiens
uuuccuuucugccac

SEQ ID NO: 815567 - RNA, 17 nt, Homo sapiens
uuucgugcacucugcua

SEQ ID NO: 815568 - RNA, 21 nt, Homo sapiens
uuucuaaccuugaaugcugcc

SEQ ID NO: 815569 - RNA, 13 nt, Homo sapiens
uuucuaagagaag

SEQ ID NO: 815570 - RNA, 19 nt, Homo sapiens
uuucuaccuccuccuuugu

SEQ ID NO: 815571 - RNA, 24 nt, Homo sapiens
uuucuaccuuguuguguuucuauc

SEQ ID NO: 815572 - RNA, 14 nt, Homo sapiens
uuucuauacuuuac

SEQ ID NO: 815573 - RNA, 23 nt, Homo sapiens
uuucucaaaggcccucagugaga

SEQ ID NO: 815574 - RNA, 19 nt, Homo sapiens
uuucucaacuggguccaga

SEQ ID NO: 815575 - RNA, 17 nt, Homo sapiens
uuucuccuuuuacuuca

SEQ ID NO: 815576 - RNA, 20 nt, Homo sapiens
uuucucuaacuccugccauu

SEQ ID NO: 815577 - RNA, 17 nt, Homo sapiens
uuucucucuggcuucuc

SEQ ID NO: 815578 - RNA, 21 nt, Homo sapiens
uuucucugagcagucagggug

SEQ ID NO: 815579 - RNA, 15 nt, Homo sapiens
uuucucugccaguga

SEQ ID NO: 815580 - RNA, 14 nt, Homo sapiens
uuucucuuccuaaa

SEQ ID NO: 815581 - RNA, 14 nt, Homo sapiens
uuucugagaaagac

SEQ ID NO: 815582 - RNA, 18 nt, Homo sapiens
uuucugagacagcuuguc

SEQ ID NO: 815583 - RNA, 12 nt, Homo sapiens
uuucugagcuuu

SEQ ID NO: 815584 - RNA, 21 nt, Homo sapiens
uuucugauaaaagauggccau

SEQ ID NO: 815585 - RNA, 16 nt, Homo sapiens
uuucugauacugcuga

SEQ ID NO: 815586 - RNA, 18 nt, Homo sapiens
uuucugauuacuguccag

SEQ ID NO: 815587 - RNA, 23 nt, Homo sapiens
uuucuggacaguaccugauugua

SEQ ID NO: 815588 - RNA, 21 nt, Homo sapiens
uuucuggggaaagacacugcc

SEQ ID NO: 815589 - RNA, 22 nt, Homo sapiens
uuucuggggaugucccagggug

SEQ ID NO: 815590 - RNA, 19 nt, Homo sapiens
uuucugggguccauucucu

SEQ ID NO: 815591 - RNA, 20 nt, Homo sapiens
uuucuggguguguccagggg

SEQ ID NO: 815592 - RNA, 16 nt, Homo sapiens
uuucuguauauacuca

SEQ ID NO: 815593 - RNA, 17 nt, Homo sapiens
uuucuguggcuaaacag

SEQ ID NO: 815594 - RNA, 17 nt, Homo sapiens
uuucuguugccacaacc

SEQ ID NO: 815595 - RNA, 16 nt, Homo sapiens
uuucuuaaaaaacaua

SEQ ID NO: 815596 - RNA, 16 nt, Homo sapiens
uuucuuagugugccaa

SEQ ID NO: 815597 - RNA, 20 nt, Homo sapiens
uuucuucaagaacauucuac

SEQ ID NO: 815598 - RNA, 18 nt, Homo sapiens
uuucuucaguccagagaa

SEQ ID NO: 815599 - RNA, 21 nt, Homo sapiens
uuucuuccaaagcacauugaa

SEQ ID NO: 815600 - RNA, 23 nt, Homo sapiens
uuucuuccagaaggcaaaaagac

SEQ ID NO: 815601 - RNA, 13 nt, Homo sapiens
uuucuuccaugau

SEQ ID NO: 815602 - RNA, 16 nt, Homo sapiens
uuucuucucccaaaug

SEQ ID NO: 815603 - RNA, 21 nt, Homo sapiens
uuucuugacaaaaccuaacuu

SEQ ID NO: 815604 - RNA, 23 nt, Homo sapiens
uuucuugaggaaaauauugcugu

SEQ ID NO: 815605 - RNA, 20 nt, Homo sapiens
uuucuugccuuaaccagucu

SEQ ID NO: 815606 - RNA, 13 nt, Homo sapiens
uuucuugcuuuca

SEQ ID NO: 815607 - RNA, 22 nt, Homo sapiens
uuucuuuaauaguuuugauccu

SEQ ID NO: 815608 - RNA, 19 nt, Homo sapiens
uuucuuuaccugagaccag

SEQ ID NO: 815609 - RNA, 15 nt, Homo sapiens
uuucuuuuaagcuau

SEQ ID NO: 815610 - RNA, 23 nt, Homo sapiens
uuugaaaaugggcucaaccagaa

SEQ ID NO: 815611 - RNA, 19 nt, Homo sapiens
uuugaaaauuagagaucau

SEQ ID NO: 815612 - RNA, 18 nt, Homo sapiens
uuugaaacaaaguacucu

SEQ ID NO: 815613 - RNA, 24 nt, Homo sapiens
uuugaaauaauaaaucugguagaa

SEQ ID NO: 815614 - RNA, 17 nt, Homo sapiens
uuugaaauaaugacaua

SEQ ID NO: 815615 - RNA, 23 nt, Homo sapiens
uuugaagaauauuuguaguuauc

SEQ ID NO: 815616 - RNA, 19 nt, Homo sapiens
uuugaagacguggacuccu

SEQ ID NO: 815617 - RNA, 13 nt, Homo sapiens
uuugaagagacca

SEQ ID NO: 815618 - RNA, 18 nt, Homo sapiens
uuugaagcaucacauaaa

SEQ ID NO: 815619 - RNA, 23 nt, Homo sapiens
uuugaaugaugagccuucgugcc

SEQ ID NO: 815620 - RNA, 15 nt, Homo sapiens
uuugaauucugugau

SEQ ID NO: 815621 - RNA, 14 nt, Homo sapiens
uuugacacugcucu

SEQ ID NO: 815622 - RNA, 20 nt, Homo sapiens
uuugacacuucccaguggaa

SEQ ID NO: 815623 - RNA, 12 nt, Homo sapiens
uuugaccaaaua

SEQ ID NO: 815624 - RNA, 17 nt, Homo sapiens
uuugaccaaauaaagua

SEQ ID NO: 815625 - RNA, 13 nt, Homo sapiens
uuugaccagugaa

SEQ ID NO: 815626 - RNA, 17 nt, Homo sapiens
uuugaccggaucuacac

SEQ ID NO: 815627 - RNA, 19 nt, Homo sapiens
uuugaccucauuuguaaaa

SEQ ID NO: 815628 - RNA, 14 nt, Homo sapiens
uuugacuugaauau

SEQ ID NO: 815629 - RNA, 19 nt, Homo sapiens
uuugacuuugcccaggcau

SEQ ID NO: 815630 - RNA, 17 nt, Homo sapiens
uuugagacaaagucuca

SEQ ID NO: 815631 - RNA, 10 nt, Homo sapiens
uuugagacag

SEQ ID NO: 815632 - RNA, 13 nt, Homo sapiens
uuugagacagagu

SEQ ID NO: 815633 - RNA, 22 nt, Homo sapiens
uuugagauaaagucaaaugcca

SEQ ID NO: 815634 - RNA, 20 nt, Homo sapiens
uuugagcugcugacugccaa

SEQ ID NO: 815635 - RNA, 16 nt, Homo sapiens
uuugaggggcugacuu

SEQ ID NO: 815636 - RNA, 17 nt, Homo sapiens
uuugaggugaggguugg

SEQ ID NO: 815637 - RNA, 23 nt, Homo sapiens
uuugagugugugugugcaugugu

SEQ ID NO: 815638 - RNA, 19 nt, Homo sapiens
uuugauagggaacugggga

SEQ ID NO: 815639 - RNA, 16 nt, Homo sapiens
uuugauauacauugug

SEQ ID NO: 815640 - RNA, 18 nt, Homo sapiens
uuugaugaaacucaugaa

SEQ ID NO: 815641 - RNA, 15 nt, Homo sapiens
uuugauucagcaaaa

SEQ ID NO: 815642 - RNA, 22 nt, Homo sapiens
uuugauugaggagcugcacuga

SEQ ID NO: 815643 - RNA, 13 nt, Homo sapiens
uuugauugcacau

SEQ ID NO: 815644 - RNA, 16 nt, Homo sapiens
uuugauuuugauuuua

SEQ ID NO: 815645 - RNA, 20 nt, Homo sapiens
uuugcaaauaacugaucuca

SEQ ID NO: 815646 - RNA, 14 nt, Homo sapiens
uuugcaaugucaca

SEQ ID NO: 815647 - RNA, 14 nt, Homo sapiens
uuugcaauuggaau

SEQ ID NO: 815648 - RNA, 12 nt, Homo sapiens
uuugcacugagg

SEQ ID NO: 815649 - RNA, 12 nt, Homo sapiens
uuugcacuuugu

SEQ ID NO: 815650 - RNA, 24 nt, Homo sapiens
uuugcaggcccagaggagccaagu

SEQ ID NO: 815651 - RNA, 16 nt, Homo sapiens
uuugcagucaguucau

SEQ ID NO: 815652 - RNA, 12 nt, Homo sapiens
uuugccaaaaac

SEQ ID NO: 815653 - RNA, 14 nt, Homo sapiens
uuugccaagggagg

SEQ ID NO: 815654 - RNA, 18 nt, Homo sapiens
uuugccaggacaugcaau

SEQ ID NO: 815655 - RNA, 14 nt, Homo sapiens
uuugccaguauuau

SEQ ID NO: 815656 - RNA, 13 nt, Homo sapiens
uuugccaguucaa

SEQ ID NO: 815657 - RNA, 20 nt, Homo sapiens
uuugccaguucaagaauuua

SEQ ID NO: 815658 - RNA, 17 nt, Homo sapiens
uuugccauuaugcaaau

SEQ ID NO: 815659 - RNA, 13 nt, Homo sapiens
uuugccauucaag

SEQ ID NO: 815660 - RNA, 23 nt, Homo sapiens
uuugcccccauucacuuugucag

SEQ ID NO: 815661 - RNA, 15 nt, Homo sapiens
uuugccucauaauag

SEQ ID NO: 815662 - RNA, 22 nt, Homo sapiens
uuugccugauccuccaacagcu

SEQ ID NO: 815663 - RNA, 15 nt, Homo sapiens
uuugccuucacccau

SEQ ID NO: 815664 - RNA, 14 nt, Homo sapiens
uuugcguacacaga

SEQ ID NO: 815665 - RNA, 13 nt, Homo sapiens
uuugcguacuugu

SEQ ID NO: 815666 - RNA, 19 nt, Homo sapiens
uuugcuauuagagcauuga

SEQ ID NO: 815667 - RNA, 17 nt, Homo sapiens
uuugcucaacagaacau

SEQ ID NO: 815668 - RNA, 22 nt, Homo sapiens
uuugcucauugcuguaccacau

SEQ ID NO: 815669 - RNA, 22 nt, Homo sapiens
uuugcucuuagcugucugcuca

SEQ ID NO: 815670 - RNA, 14 nt, Homo sapiens
uuugcucuucagau

SEQ ID NO: 815671 - RNA, 12 nt, Homo sapiens
uuugcugcacaa

SEQ ID NO: 815672 - RNA, 19 nt, Homo sapiens
uuugcugcacaaacaugaa

SEQ ID NO: 815673 - RNA, 19 nt, Homo sapiens
uuugcuuuuuuaaacuuga

SEQ ID NO: 815674 - RNA, 15 nt, Homo sapiens
uuuggaaaccacagu

SEQ ID NO: 815675 - RNA, 18 nt, Homo sapiens
uuuggaaaccacagucag

SEQ ID NO: 815676 - RNA, 20 nt, Homo sapiens
uuuggacugucuauaucaua

SEQ ID NO: 815677 - RNA, 20 nt, Homo sapiens
uuuggagaaaugucauaaau

SEQ ID NO: 815678 - RNA, 14 nt, Homo sapiens
uuuggcaaugcuaa

SEQ ID NO: 815679 - RNA, 19 nt, Homo sapiens
uuuggcaggcuuuuuucca

SEQ ID NO: 815680 - RNA, 17 nt, Homo sapiens
uuuggccccacuuugaa

SEQ ID NO: 815681 - RNA, 19 nt, Homo sapiens
uuuggcuagguaucauuca

SEQ ID NO: 815682 - RNA, 18 nt, Homo sapiens
uuuggcuauaagugcuca

SEQ ID NO: 815683 - RNA, 16 nt, Homo sapiens
uuugggcagacccuga

SEQ ID NO: 815684 - RNA, 17 nt, Homo sapiens
uuuggggacaugugauu

SEQ ID NO: 815685 - RNA, 19 nt, Homo sapiens
uuuggggacuuguagggau

SEQ ID NO: 815686 - RNA, 17 nt, Homo sapiens
uuuggggaggaguugau

SEQ ID NO: 815687 - RNA, 15 nt, Homo sapiens
uuuggggccucaaga

SEQ ID NO: 815688 - RNA, 21 nt, Homo sapiens
uuuggggcuuucccaggagaa

SEQ ID NO: 815689 - RNA, 11 nt, Homo sapiens
uuugggguccc

SEQ ID NO: 815690 - RNA, 15 nt, Homo sapiens
uuuggguaacuucaa

SEQ ID NO: 815691 - RNA, 12 nt, Homo sapiens
uuuggguauuaa

SEQ ID NO: 815692 - RNA, 18 nt, Homo sapiens
uuuggucgaggaguaaca

SEQ ID NO: 815693 - RNA, 16 nt, Homo sapiens
uuugguuaaacccaug

SEQ ID NO: 815694 - RNA, 14 nt, Homo sapiens
uuugguucuaugcu

SEQ ID NO: 815695 - RNA, 18 nt, Homo sapiens
uuugguuuaccuggggau

SEQ ID NO: 815696 - RNA, 23 nt, Homo sapiens
uuuguaaaacaaugccaugaaca

SEQ ID NO: 815697 - RNA, 17 nt, Homo sapiens
uuuguaaaauguucucu

SEQ ID NO: 815698 - RNA, 13 nt, Homo sapiens
uuuguaacuuuag

SEQ ID NO: 815699 - RNA, 18 nt, Homo sapiens
uuuguaagagugagcucu

SEQ ID NO: 815700 - RNA, 13 nt, Homo sapiens
uuuguaaugcugc

SEQ ID NO: 815701 - RNA, 14 nt, Homo sapiens
uuuguaauugcuua

SEQ ID NO: 815702 - RNA, 14 nt, Homo sapiens
uuuguacugauaua

SEQ ID NO: 815703 - RNA, 17 nt, Homo sapiens
uuuguagcacugacaga

SEQ ID NO: 815704 - RNA, 14 nt, Homo sapiens
uuuguagcacugag

SEQ ID NO: 815705 - RNA, 16 nt, Homo sapiens
uuuguagccagguacu

SEQ ID NO: 815706 - RNA, 19 nt, Homo sapiens
uuuguagccuuccuccaca

SEQ ID NO: 815707 - RNA, 22 nt, Homo sapiens
uuuguauauaggcuucucacgg

SEQ ID NO: 815708 - RNA, 22 nt, Homo sapiens
uuuguauauuuguaaacuacaa

SEQ ID NO: 815709 - RNA, 23 nt, Homo sapiens
uuuguauucauguucaugugauu

SEQ ID NO: 815710 - RNA, 22 nt, Homo sapiens
uuuguauucucuuccucaucca

SEQ ID NO: 815711 - RNA, 12 nt, Homo sapiens
uuugucacugaa

SEQ ID NO: 815712 - RNA, 13 nt, Homo sapiens
uuugucauaccuu

SEQ ID NO: 815713 - RNA, 18 nt, Homo sapiens
uuugucauucaagccugu

SEQ ID NO: 815714 - RNA, 19 nt, Homo sapiens
uuugucccagccuggggcu

SEQ ID NO: 815715 - RNA, 22 nt, Homo sapiens
uuugucccggggcuccacugaa

SEQ ID NO: 815716 - RNA, 14 nt, Homo sapiens
uuugucucgcuaua

SEQ ID NO: 815717 - RNA, 14 nt, Homo sapiens
uuugucuucaugaa

SEQ ID NO: 815718 - RNA, 23 nt, Homo sapiens
uuugugacccugagaaggcaaaa

SEQ ID NO: 815719 - RNA, 23 nt, Homo sapiens
uuuguggaagcacaggcaagagu

SEQ ID NO: 815720 - RNA, 11 nt, Homo sapiens
uuuguggcauc

SEQ ID NO: 815721 - RNA, 20 nt, Homo sapiens
uuugugggauuuuaguaaga

SEQ ID NO: 815722 - RNA, 22 nt, Homo sapiens
uuuguucaaugcuagaacaacg

SEQ ID NO: 815723 - RNA, 13 nt, Homo sapiens
uuuguucagagag

SEQ ID NO: 815724 - RNA, 21 nt, Homo sapiens
uuuguuccacuuguuugcacu

SEQ ID NO: 815725 - RNA, 15 nt, Homo sapiens
uuuguugccaugugc

SEQ ID NO: 815726 - RNA, 22 nt, Homo sapiens
uuuguuguuugauucagcaaaa

SEQ ID NO: 815727 - RNA, 22 nt, Homo sapiens
uuuguuuugauguuuguggccu

SEQ ID NO: 815728 - RNA, 22 nt, Homo sapiens
uuuuaaaaaaaggagacugugu

SEQ ID NO: 815729 - RNA, 16 nt, Homo sapiens
uuuuaaaaauugucau

SEQ ID NO: 815730 - RNA, 16 nt, Homo sapiens
uuuuaaaaccauuuaa

SEQ ID NO: 815731 - RNA, 21 nt, Homo sapiens
uuuuaaaagaauuucauagau

SEQ ID NO: 815732 - RNA, 22 nt, Homo sapiens
uuuuaaaguauguuauugcaua

SEQ ID NO: 815733 - RNA, 19 nt, Homo sapiens
uuuuaaauaaaagcacaag

SEQ ID NO: 815734 - RNA, 18 nt, Homo sapiens
uuuuaaauaauugcauca

SEQ ID NO: 815735 - RNA, 22 nt, Homo sapiens
uuuuaaaugaggauucacugac

SEQ ID NO: 815736 - RNA, 13 nt, Homo sapiens
uuuuaaauuguca

SEQ ID NO: 815737 - RNA, 15 nt, Homo sapiens
uuuuaacaauuccca

SEQ ID NO: 815738 - RNA, 14 nt, Homo sapiens
uuuuaacaugucaa

SEQ ID NO: 815739 - RNA, 22 nt, Homo sapiens
uuuuaaccuaauaucacuuaaa

SEQ ID NO: 815740 - RNA, 16 nt, Homo sapiens
uuuuaacuuauugaca

SEQ ID NO: 815741 - RNA, 13 nt, Homo sapiens
uuuuaacuuucua

SEQ ID NO: 815742 - RNA, 20 nt, Homo sapiens
uuuuaaguuucucugcagaa

SEQ ID NO: 815743 - RNA, 22 nt, Homo sapiens
uuuuaaucaaaugcuuuggacu

SEQ ID NO: 815744 - RNA, 17 nt, Homo sapiens
uuuuacauuucauacaa

SEQ ID NO: 815745 - RNA, 23 nt, Homo sapiens
uuuuaccaaagugucuuuugaca

SEQ ID NO: 815746 - RNA, 15 nt, Homo sapiens
uuuuacccacaugac

SEQ ID NO: 815747 - RNA, 22 nt, Homo sapiens
uuuuacucauuguccugguuuc

SEQ ID NO: 815748 - RNA, 11 nt, Homo sapiens
uuuuacuucca

SEQ ID NO: 815749 - RNA, 17 nt, Homo sapiens
uuuuacuucucuauaca

SEQ ID NO: 815750 - RNA, 18 nt, Homo sapiens
uuuuacuucucuauacaa

SEQ ID NO: 815751 - RNA, 20 nt, Homo sapiens
uuuuauacaaaccuaccaaa

SEQ ID NO: 815752 - RNA, 20 nt, Homo sapiens
uuuuauacagugauauacuu

SEQ ID NO: 815753 - RNA, 22 nt, Homo sapiens
uuuuauacugcacaguggcaca

SEQ ID NO: 815754 - RNA, 19 nt, Homo sapiens
uuuuauauucuaagccagu

SEQ ID NO: 815755 - RNA, 18 nt, Homo sapiens
uuuuauauuuauugugcu

SEQ ID NO: 815756 - RNA, 11 nt, Homo sapiens
uuuuaugcugg

SEQ ID NO: 815757 - RNA, 20 nt, Homo sapiens
uuuuauggaggcuuugcaua

SEQ ID NO: 815758 - RNA, 17 nt, Homo sapiens
uuuuauggcucuaucuu

SEQ ID NO: 815759 - RNA, 14 nt, Homo sapiens
uuuuauucuauauu

SEQ ID NO: 815760 - RNA, 16 nt, Homo sapiens
uuuuauucuugaucag

SEQ ID NO: 815761 - RNA, 13 nt, Homo sapiens
uuuuauuguugua

SEQ ID NO: 815762 - RNA, 18 nt, Homo sapiens
uuuuauuucugacucuua

SEQ ID NO: 815763 - RNA, 12 nt, Homo sapiens
uuuucaaaaagu

SEQ ID NO: 815764 - RNA, 17 nt, Homo sapiens
uuuucaaaauccaaaaa

SEQ ID NO: 815765 - RNA, 18 nt, Homo sapiens
uuuucaaaauccaaaaag

SEQ ID NO: 815766 - RNA, 19 nt, Homo sapiens
uuuucaaaauccaaaaaga

SEQ ID NO: 815767 - RNA, 21 nt, Homo sapiens
uuuucaaagauguguugcuau

SEQ ID NO: 815768 - RNA, 15 nt, Homo sapiens
uuuucaagagcuccu

SEQ ID NO: 815769 - RNA, 21 nt, Homo sapiens
uuuucaaucauaauaccugcu

SEQ ID NO: 815770 - RNA, 16 nt, Homo sapiens
uuuucacaaucuuggg

SEQ ID NO: 815771 - RNA, 17 nt, Homo sapiens
uuuucacagucacugau

SEQ ID NO: 815772 - RNA, 20 nt, Homo sapiens
uuuucaccaggggugcucac

SEQ ID NO: 815773 - RNA, 21 nt, Homo sapiens
uuuucacguaucuuccaagua

SEQ ID NO: 815774 - RNA, 10 nt, Homo sapiens
uuuucacugc

SEQ ID NO: 815775 - RNA, 12 nt, Homo sapiens
uuuucacuugua

SEQ ID NO: 815776 - RNA, 14 nt, Homo sapiens
uuuucagagcuuau

SEQ ID NO: 815777 - RNA, 17 nt, Homo sapiens
uuuucaguauacugugu

SEQ ID NO: 815778 - RNA, 19 nt, Homo sapiens
uuuucauguagaacucagc

SEQ ID NO: 815779 - RNA, 14 nt, Homo sapiens
uuuucauuaucuca

SEQ ID NO: 815780 - RNA, 14 nt, Homo sapiens
uuuucauuuguaca

SEQ ID NO: 815781 - RNA, 22 nt, Homo sapiens
uuuuccaagacagagucuugcu

SEQ ID NO: 815782 - RNA, 22 nt, Homo sapiens
uuuuccacaagauucccagaga

SEQ ID NO: 815783 - RNA, 16 nt, Homo sapiens
uuuucccaaagcacuu

SEQ ID NO: 815784 - RNA, 14 nt, Homo sapiens
uuuucccaguauuu

SEQ ID NO: 815785 - RNA, 16 nt, Homo sapiens
uuuuccucuucuagau

SEQ ID NO: 815786 - RNA, 22 nt, Homo sapiens
ucaauacuuuuguguauucugu

SEQ ID NO: 815787 - RNA, 15 nt, Homo sapiens
ucaauaguguugcuu

SEQ ID NO: 815788 - RNA, 18 nt, Homo sapiens
ucaauauagcaagaccac

SEQ ID NO: 815789 - RNA, 16 nt, Homo sapiens
ucaaucaacuuuacug

SEQ ID NO: 815790 - RNA, 18 nt, Homo sapiens
ucaaucauaauaccugcu

SEQ ID NO: 815791 - RNA, 21 nt, Homo sapiens
ucaaucauaauaccugcugug

SEQ ID NO: 815792 - RNA, 17 nt, Homo sapiens
ucaauccugucauauaa

SEQ ID NO: 815793 - RNA, 23 nt, Homo sapiens
ucaaucuguccguucacaugugu

SEQ ID NO: 815794 - RNA, 14 nt, Homo sapiens
ucaaucuuugccua

SEQ ID NO: 815795 - RNA, 14 nt, Homo sapiens
ucaaugaacuucca

SEQ ID NO: 815796 - RNA, 24 nt, Homo sapiens
ucaaugaagccagcucacagugcu

SEQ ID NO: 815797 - RNA, 13 nt, Homo sapiens
ucaaugaccugua

SEQ ID NO: 815798 - RNA, 11 nt, Homo sapiens
ucaaugcauuu

SEQ ID NO: 815799 - RNA, 15 nt, Homo sapiens
ucaaugccaacuuuu

SEQ ID NO: 815800 - RNA, 12 nt, Homo sapiens
ucaaugccagua

SEQ ID NO: 815801 - RNA, 16 nt, Homo sapiens
ucaauggaaagcugcu

SEQ ID NO: 815802 - RNA, 17 nt, Homo sapiens
ucaauggaagaaaccac

SEQ ID NO: 815803 - RNA, 18 nt, Homo sapiens
ucaaugggcucuuccaac

SEQ ID NO: 815804 - RNA, 13 nt, Homo sapiens
ucaaugguaucau

SEQ ID NO: 815805 - RNA, 20 nt, Homo sapiens
ucaaugucuuaggucaggag

SEQ ID NO: 815806 - RNA, 21 nt, Homo sapiens
ucaauguuuugagucagugca

SEQ ID NO: 815807 - RNA, 15 nt, Homo sapiens
cuguugcauuuacuu

SEQ ID NO: 815808 - RNA, 22 nt, Homo sapiens
cuguugcuuuaauaugagcuuc

SEQ ID NO: 815809 - RNA, 20 nt, Homo sapiens
cuguugugugucaugccagu

SEQ ID NO: 815810 - RNA, 20 nt, Homo sapiens
cuguuguuccauuuuaugca

SEQ ID NO: 815811 - RNA, 15 nt, Homo sapiens
cuguuguucccguga

SEQ ID NO: 815812 - RNA, 14 nt, Homo sapiens
cuguuuaacauuuc

SEQ ID NO: 815813 - RNA, 14 nt, Homo sapiens
cuguuuacagugug

SEQ ID NO: 815814 - RNA, 15 nt, Homo sapiens
cuguuuccauccagu

SEQ ID NO: 815815 - RNA, 16 nt, Homo sapiens
cuguuucuucuuguga

SEQ ID NO: 815816 - RNA, 20 nt, Homo sapiens
cuguuugcccccauucacuu

SEQ ID NO: 815817 - RNA, 17 nt, Homo sapiens
cuguuuggcuuaacaca

SEQ ID NO: 815818 - RNA, 13 nt, Homo sapiens
cuguuuguuaaaa

SEQ ID NO: 815819 - RNA, 21 nt, Homo sapiens
cuguuuuauaaugaacccauc

SEQ ID NO: 815820 - RNA, 18 nt, Homo sapiens
cuguuuuaucucugugaa

SEQ ID NO: 815821 - RNA, 13 nt, Homo sapiens
cuguuuugcauau

SEQ ID NO: 815822 - RNA, 14 nt, Homo sapiens
cuguuuugccuuca

SEQ ID NO: 815823 - RNA, 15 nt, Homo sapiens
cuguuuugccuucac

SEQ ID NO: 815824 - RNA, 20 nt, Homo sapiens
cuguuuuggggcuuucccag

SEQ ID NO: 815825 - RNA, 21 nt, Homo sapiens
cuguuuuuucagucugugaaa

SEQ ID NO: 815826 - RNA, 21 nt, Homo sapiens
cuguuuuuuggugguucugcu

SEQ ID NO: 815827 - RNA, 17 nt, Homo sapiens
cuguuuuuuuugcugcu

SEQ ID NO: 815828 - RNA, 23 nt, Homo sapiens
aaaauuuaauuuguccuuccuaa

SEQ ID NO: 815829 - RNA, 13 nt, Homo sapiens
aaaauuuuacuuc

SEQ ID NO: 815830 - RNA, 22 nt, Homo sapiens
aaaauuuuggucauagcauuca

SEQ ID NO: 815831 - RNA, 21 nt, Homo sapiens
aaaauuuuuuuuguaacugga

SEQ ID NO: 815832 - RNA, 21 nt, Homo sapiens
aaacaaaaagccccauugggc

SEQ ID NO: 815833 - RNA, 18 nt, Homo sapiens
aaacaaaaaucuguguaa

SEQ ID NO: 815834 - RNA, 18 nt, Homo sapiens
aaacaaaauccaagauuc

SEQ ID NO: 815835 - RNA, 16 nt, Homo sapiens
aaacaaagaguaucau

SEQ ID NO: 815836 - RNA, 21 nt, Homo sapiens
aaacaaauaaucacauugacu

SEQ ID NO: 815837 - RNA, 17 nt, Homo sapiens
aaacaacaucauuccaa

SEQ ID NO: 815838 - RNA, 20 nt, Homo sapiens
aaacaagaaaucugacaaua

SEQ ID NO: 815839 - RNA, 14 nt, Homo sapiens
aaacaaggaagcca

SEQ ID NO: 815840 - RNA, 16 nt, Homo sapiens
aaacaaggaagccaaa

SEQ ID NO: 815841 - RNA, 22 nt, Homo sapiens
aaacaaucuguuuuggcuuuau

SEQ ID NO: 815842 - RNA, 15 nt, Homo sapiens
aaacaaugccaugaa

SEQ ID NO: 815843 - RNA, 19 nt, Homo sapiens
aaacacaaaugcagggauu

SEQ ID NO: 815844 - RNA, 15 nt, Homo sapiens
aaacacauauucaaa

SEQ ID NO: 815845 - RNA, 17 nt, Homo sapiens
aaacaccaaaaagggau

SEQ ID NO: 815846 - RNA, 22 nt, Homo sapiens
aaacaccaaacucauaacaguc

SEQ ID NO: 815847 - RNA, 12 nt, Homo sapiens
aaacaccaaaga

SEQ ID NO: 815848 - RNA, 17 nt, Homo sapiens
aaacaccgcuucugccu

SEQ ID NO: 815849 - RNA, 21 nt, Homo sapiens
aaacaccggcagaaaacggag

SEQ ID NO: 815850 - RNA, 14 nt, Homo sapiens
aaacacgugucuau

SEQ ID NO: 815851 - RNA, 12 nt, Homo sapiens
aaacacuccacc

SEQ ID NO: 815852 - RNA, 17 nt, Homo sapiens
aaacacuuacagaauua

SEQ ID NO: 815853 - RNA, 21 nt, Homo sapiens
aaacacuucugcuuucacuua

SEQ ID NO: 815854 - RNA, 15 nt, Homo sapiens
aaacagagaugugau

SEQ ID NO: 815855 - RNA, 21 nt, Homo sapiens
aaacagauaacaccaaaccaa

SEQ ID NO: 815856 - RNA, 10 nt, Homo sapiens
aaacagccac

SEQ ID NO: 815857 - RNA, 22 nt, Homo sapiens
aaacagccucuuuuugauacug

SEQ ID NO: 815858 - RNA, 16 nt, Homo sapiens
aaacaggaccacaaaa

SEQ ID NO: 815859 - RNA, 21 nt, Homo sapiens
aaacaggcaccacugcuuuaa

SEQ ID NO: 815860 - RNA, 12 nt, Homo sapiens
aaacaggccagg

SEQ ID NO: 815861 - RNA, 15 nt, Homo sapiens
aaacaggcgcuguuu

SEQ ID NO: 815862 - RNA, 19 nt, Homo sapiens
aaacaggcuguaauuccau

SEQ ID NO: 815863 - RNA, 18 nt, Homo sapiens
aaacagguauauacuuug

SEQ ID NO: 815864 - RNA, 18 nt, Homo sapiens
aaacaggugcuaauuugu

SEQ ID NO: 815865 - RNA, 19 nt, Homo sapiens
aaacauaaagagaacucug

SEQ ID NO: 815866 - RNA, 17 nt, Homo sapiens
aaacauacgugugcaug

SEQ ID NO: 815867 - RNA, 14 nt, Homo sapiens
aaacauagcaucuc

SEQ ID NO: 815868 - RNA, 22 nt, Homo sapiens
aaacauauccuuucaagacaga

SEQ ID NO: 815869 - RNA, 22 nt, Homo sapiens
aaacaucagcugaauucacuua

SEQ ID NO: 815870 - RNA, 14 nt, Homo sapiens
aaacaucuauucuc

SEQ ID NO: 815871 - RNA, 19 nt, Homo sapiens
aaacauggaggaacaguau

SEQ ID NO: 815872 - RNA, 18 nt, Homo sapiens
aaacauguaauauaaaga

SEQ ID NO: 815873 - RNA, 9 nt, Homo sapiens
aaacauguu

SEQ ID NO: 815874 - RNA, 22 nt, Homo sapiens
aaacauguuuaaauagccuaaa

SEQ ID NO: 815875 - RNA, 15 nt, Homo sapiens
aaacauuaaugcaau

SEQ ID NO: 815876 - RNA, 23 nt, Homo sapiens
aaacauucacacagggcucuuug

SEQ ID NO: 815877 - RNA, 21 nt, Homo sapiens
aaacauugaaguaaugaauuu

SEQ ID NO: 815878 - RNA, 23 nt, Homo sapiens
aaacauugcaauaaauggcuuga

SEQ ID NO: 815879 - RNA, 20 nt, Homo sapiens
aaacauuggauuuuuccuua

SEQ ID NO: 815880 - RNA, 14 nt, Homo sapiens
aaacauuucuggac

SEQ ID NO: 815881 - RNA, 15 nt, Homo sapiens
aaaccaacaaaaaga

SEQ ID NO: 815882 - RNA, 17 nt, Homo sapiens
aaaccaaggacugagca

SEQ ID NO: 815883 - RNA, 16 nt, Homo sapiens
aaagggagugcaugug

SEQ ID NO: 815884 - RNA, 13 nt, Homo sapiens
aaaggggcccaag

SEQ ID NO: 815885 - RNA, 20 nt, Homo sapiens
aaaggggcccaagccccauc

SEQ ID NO: 815886 - RNA, 16 nt, Homo sapiens
aaagggucuuaugaaa

SEQ ID NO: 815887 - RNA, 16 nt, Homo sapiens
aaagguauauugugaa

SEQ ID NO: 815888 - RNA, 19 nt, Homo sapiens
aaaggugccucauagcaua

SEQ ID NO: 815889 - RNA, 21 nt, Homo sapiens
aaaggugguccuuccuaccuc

SEQ ID NO: 815890 - RNA, 22 nt, Homo sapiens
aaagguugacaauaaaugugcu

SEQ ID NO: 815891 - RNA, 13 nt, Homo sapiens
aaagguuguguag

SEQ ID NO: 815892 - RNA, 18 nt, Homo sapiens
aaagguuucauguucacu

SEQ ID NO: 815893 - RNA, 14 nt, Homo sapiens
aaagguuuuccuua

SEQ ID NO: 815894 - RNA, 19 nt, Homo sapiens
aaagguuuucuucauucau

SEQ ID NO: 815895 - RNA, 15 nt, Homo sapiens
aaaguaacacaaaca

SEQ ID NO: 815896 - RNA, 18 nt, Homo sapiens
aaaguaaccugaacuaau

SEQ ID NO: 815897 - RNA, 13 nt, Homo sapiens
aaaguaaugacuu

SEQ ID NO: 815898 - RNA, 16 nt, Homo sapiens
aaaguaaugcuucaau

SEQ ID NO: 815899 - RNA, 13 nt, Homo sapiens
aaaguaccacaca

SEQ ID NO: 815900 - RNA, 14 nt, Homo sapiens
aaaguaccacacau

SEQ ID NO: 815901 - RNA, 17 nt, Homo sapiens
aaaguagaaaaagauuc

SEQ ID NO: 815902 - RNA, 20 nt, Homo sapiens
aaaguagaggaauccaugua

SEQ ID NO: 815903 - RNA, 14 nt, Homo sapiens
aaaguagcaauuuc

SEQ ID NO: 815904 - RNA, 12 nt, Homo sapiens
aaaguagggaug

SEQ ID NO: 815905 - RNA, 15 nt, Homo sapiens
aaaguauucuagugu

SEQ ID NO: 815906 - RNA, 16 nt, Homo sapiens
aaagucaaaaggugcc

SEQ ID NO: 815907 - RNA, 15 nt, Homo sapiens
aaagucaaaugccaa

SEQ ID NO: 815908 - RNA, 17 nt, Homo sapiens
aaagucaaaugccaaac

SEQ ID NO: 815909 - RNA, 17 nt, Homo sapiens
aaagucagaucuggucu

SEQ ID NO: 815910 - RNA, 18 nt, Homo sapiens
aaaguccagguuagcaca

SEQ ID NO: 815911 - RNA, 20 nt, Homo sapiens
aaagugccagaaaguguuua

SEQ ID NO: 815912 - RNA, 14 nt, Homo sapiens
aaagugcugagauu

SEQ ID NO: 815913 - RNA, 21 nt, Homo sapiens
aaagugcugggaugacaggca

SEQ ID NO: 815914 - RNA, 18 nt, Homo sapiens
aaaguggacaaggagugu

SEQ ID NO: 815915 - RNA, 23 nt, Homo sapiens
aaaguguaacaauuguguagccu

SEQ ID NO: 815916 - RNA, 19 nt, Homo sapiens
aaaguguaauagcauacau

SEQ ID NO: 815917 - RNA, 17 nt, Homo sapiens
aaaguguaccaacauaa

SEQ ID NO: 815918 - RNA, 21 nt, Homo sapiens
aaagugucauauuuacugguc

SEQ ID NO: 815919 - RNA, 16 nt, Homo sapiens
aaagugucuacaugug

SEQ ID NO: 815920 - RNA, 19 nt, Homo sapiens
aaagugugagcucuucccu

SEQ ID NO: 815921 - RNA, 14 nt, Homo sapiens
aaagugugggagac

SEQ ID NO: 815922 - RNA, 19 nt, Homo sapiens
aaaguguguuucuauguga

SEQ ID NO: 815923 - RNA, 18 nt, Homo sapiens
aaaguuacuauucuguau

SEQ ID NO: 815924 - RNA, 15 nt, Homo sapiens
aaaguuaguauuaaa

SEQ ID NO: 815925 - RNA, 20 nt, Homo sapiens
aaaguuagucaauccuguca

SEQ ID NO: 815926 - RNA, 21 nt, Homo sapiens
aaaguuauugauaaguucaua

SEQ ID NO: 815927 - RNA, 16 nt, Homo sapiens
aaaguucucauugaau

SEQ ID NO: 815928 - RNA, 12 nt, Homo sapiens
aaaguucuggaa

SEQ ID NO: 815929 - RNA, 18 nt, Homo sapiens
aaaguucuuuuugcucua

SEQ ID NO: 815930 - RNA, 16 nt, Homo sapiens
aaaguuguagcuccag

SEQ ID NO: 815931 - RNA, 21 nt, Homo sapiens
aaaguuucaccuguauugaau

SEQ ID NO: 815932 - RNA, 21 nt, Homo sapiens
aaaguuuuaggguacaguuug

SEQ ID NO: 815933 - RNA, 20 nt, Homo sapiens
aaaguuuuauuugaaugaac

SEQ ID NO: 815934 - RNA, 15 nt, Homo sapiens
aaauaaaauguguac

SEQ ID NO: 815935 - RNA, 14 nt, Homo sapiens
aaauaaacuaguuu

SEQ ID NO: 815936 - RNA, 15 nt, Homo sapiens
aaauaacacugugaa

SEQ ID NO: 815937 - RNA, 12 nt, Homo sapiens
aaauaacuaccu

SEQ ID NO: 815938 - RNA, 15 nt, Homo sapiens
aaauaacugaucuca

SEQ ID NO: 815939 - RNA, 14 nt, Homo sapiens
aaauaagagauuug

SEQ ID NO: 815940 - RNA, 18 nt, Homo sapiens
aaauaagcauguuuucac

SEQ ID NO: 815941 - RNA, 16 nt, Homo sapiens
aaauaauaaaucuggu

SEQ ID NO: 815942 - RNA, 12 nt, Homo sapiens
aaauaaugagga

SEQ ID NO: 815943 - RNA, 20 nt, Homo sapiens
aaauaauuauauaacuguau

SEQ ID NO: 815944 - RNA, 12 nt, Homo sapiens
aaauaauuugaa

SEQ ID NO: 815945 - RNA, 14 nt, Homo sapiens
aaauacaaucagcc

SEQ ID NO: 815946 - RNA, 21 nt, Homo sapiens
aaauacacaugaaaacaagaa

SEQ ID NO: 815947 - RNA, 15 nt, Homo sapiens
aaauacacauuugcu

SEQ ID NO: 815948 - RNA, 13 nt, Homo sapiens
aaauacaucagcu

SEQ ID NO: 815949 - RNA, 17 nt, Homo sapiens
aaauacccacuaacaaa

SEQ ID NO: 815950 - RNA, 21 nt, Homo sapiens
aaauaccuuuucucacaaaaa

SEQ ID NO: 815951 - RNA, 18 nt, Homo sapiens
aaauacggcuuuuccaau

SEQ ID NO: 815952 - RNA, 17 nt, Homo sapiens
aaauacucaugugcaau

SEQ ID NO: 815953 - RNA, 16 nt, Homo sapiens
aaauacuggacucagg

SEQ ID NO: 815954 - RNA, 15 nt, Homo sapiens
aaauacuuuuacucu

SEQ ID NO: 815955 - RNA, 15 nt, Homo sapiens
aaauagaaacuugcu

SEQ ID NO: 815956 - RNA, 15 nt, Homo sapiens
aaauagacaaaaagu

SEQ ID NO: 815957 - RNA, 22 nt, Homo sapiens
aaauagaugugucuuaacauaa

SEQ ID NO: 815958 - RNA, 19 nt, Homo sapiens
aaauagcacacuuuuccac

SEQ ID NO: 815959 - RNA, 21 nt, Homo sapiens
aaauaguaccuucaauacuua

SEQ ID NO: 815960 - RNA, 13 nt, Homo sapiens
aaauagucacuca

SEQ ID NO: 815961 - RNA, 16 nt, Homo sapiens
aaauagucuuccacaa

SEQ ID NO: 815962 - RNA, 22 nt, Homo sapiens
aaauagugacaagugaagaaca

SEQ ID NO: 815963 - RNA, 20 nt, Homo sapiens
aaauaguguaagaacuguac

SEQ ID NO: 815964 - RNA, 22 nt, Homo sapiens
aaauauauacccccccaugcag

SEQ ID NO: 815965 - RNA, 17 nt, Homo sapiens
aaauauauagaaugauc

SEQ ID NO: 815966 - RNA, 16 nt, Homo sapiens
aaauauauucuuucaa

SEQ ID NO: 815967 - RNA, 20 nt, Homo sapiens
aaauaugauuuuauuugaca

SEQ ID NO: 815968 - RNA, 17 nt, Homo sapiens
aaauaugccuaguaaca

SEQ ID NO: 815969 - RNA, 19 nt, Homo sapiens
aaauaugcuauauauuagg

SEQ ID NO: 815970 - RNA, 16 nt, Homo sapiens
aaauauguauaugaca

SEQ ID NO: 815971 - RNA, 23 nt, Homo sapiens
aaauauguauuaacacuacucaa

SEQ ID NO: 815972 - RNA, 18 nt, Homo sapiens
aaauauguauuuuccuaa

SEQ ID NO: 815973 - RNA, 13 nt, Homo sapiens
aaauaugucccag

SEQ ID NO: 815974 - RNA, 14 nt, Homo sapiens
aaauauguccuggg

SEQ ID NO: 815975 - RNA, 20 nt, Homo sapiens
aaauauguuaagggcuuuaa

SEQ ID NO: 815976 - RNA, 12 nt, Homo sapiens
aaauauucacuc

SEQ ID NO: 815977 - RNA, 13 nt, Homo sapiens
aaauauucacucu

SEQ ID NO: 815978 - RNA, 15 nt, Homo sapiens
aaauauucacucucc

SEQ ID NO: 815979 - RNA, 22 nt, Homo sapiens
aaauauucacucuccauuagaa

SEQ ID NO: 815980 - RNA, 21 nt, Homo sapiens
aaauauucuacuggccuguaa

SEQ ID NO: 815981 - RNA, 16 nt, Homo sapiens
aaauauucuccauggg

SEQ ID NO: 815982 - RNA, 13 nt, Homo sapiens
aaauauucucucu

SEQ ID NO: 815983 - RNA, 23 nt, Homo sapiens
aaauauuguugacaacugugacu

SEQ ID NO: 815984 - RNA, 20 nt, Homo sapiens
aaauauuuccuuaaacugug

SEQ ID NO: 815985 - RNA, 13 nt, Homo sapiens
aaauauuucucaa

SEQ ID NO: 815986 - RNA, 19 nt, Homo sapiens
aaauauuucucaacugagg

SEQ ID NO: 815987 - RNA, 21 nt, Homo sapiens
aaauauuuucauacagcauua

SEQ ID NO: 815988 - RNA, 20 nt, Homo sapiens
aaauauuuuguaaugcugca

SEQ ID NO: 815989 - RNA, 22 nt, Homo sapiens
aaaucaaaaagggaaugcauua

SEQ ID NO: 815990 - RNA, 21 nt, Homo sapiens
aaaucaaagauaagguuauag

SEQ ID NO: 815991 - RNA, 19 nt, Homo sapiens
aaaucaaauaugcaaagca

SEQ ID NO: 815992 - RNA, 16 nt, Homo sapiens
aaaucaaugucacuua

SEQ ID NO: 815993 - RNA, 15 nt, Homo sapiens
aaaucaauucuaguc

SEQ ID NO: 815994 - RNA, 16 nt, Homo sapiens
aaaucacgcagaccca

SEQ ID NO: 815995 - RNA, 11 nt, Homo sapiens
aaaucacuuga

SEQ ID NO: 815996 - RNA, 13 nt, Homo sapiens
aaaucacuugcca

SEQ ID NO: 815997 - RNA, 13 nt, Homo sapiens
aaaucacuuugag

SEQ ID NO: 815998 - RNA, 17 nt, Homo sapiens
aaaucagaaauaugaca

SEQ ID NO: 815999 - RNA, 18 nt, Homo sapiens
aaagaccaaauuccuugg

SEQ ID NO: 816000 - RNA, 18 nt, Homo sapiens
aaagaccagccuggucaa

SEQ ID NO: 816001 - RNA, 13 nt, Homo sapiens
aaagacucugacc

SEQ ID NO: 816002 - RNA, 21 nt, Homo sapiens
aaagacuguagaagaaagagc

SEQ ID NO: 816003 - RNA, 18 nt, Homo sapiens
aaagacugugaacagcuu

SEQ ID NO: 816004 - RNA, 11 nt, Homo sapiens
aaagacuucca

SEQ ID NO: 816005 - RNA, 22 nt, Homo sapiens
aaagacuuuuuuuuaacacuuu

SEQ ID NO: 816006 - RNA, 15 nt, Homo sapiens
aaagagaacaccucc

SEQ ID NO: 816007 - RNA, 22 nt, Homo sapiens
aaagagaacaccuccagcuuuu

SEQ ID NO: 816008 - RNA, 19 nt, Homo sapiens
aaagagacauauacuaaga

SEQ ID NO: 816009 - RNA, 16 nt, Homo sapiens
aaagagagaagccagc

SEQ ID NO: 816010 - RNA, 23 nt, Homo sapiens
aaagagagaucuugauccacaga

SEQ ID NO: 816011 - RNA, 16 nt, Homo sapiens
aaagagcucagacauu

SEQ ID NO: 816012 - RNA, 20 nt, Homo sapiens
aaagagcuccaaauugaauc

SEQ ID NO: 816013 - RNA, 14 nt, Homo sapiens
aaagaggaagcaaa

SEQ ID NO: 816014 - RNA, 20 nt, Homo sapiens
aaagaggcugccccucucac

SEQ ID NO: 816015 - RNA, 17 nt, Homo sapiens
aaagauauaaggggaaa

SEQ ID NO: 816016 - RNA, 16 nt, Homo sapiens
aaagaugaaaaguaua

SEQ ID NO: 816017 - RNA, 21 nt, Homo sapiens
aaagaugaucuacucagaaau

SEQ ID NO: 816018 - RNA, 13 nt, Homo sapiens
aaagaugcagugg

SEQ ID NO: 816019 - RNA, 12 nt, Homo sapiens
aaagaugcauuu

SEQ ID NO: 816020 - RNA, 16 nt, Homo sapiens
aaagauggaguuucua

SEQ ID NO: 816021 - RNA, 15 nt, Homo sapiens
aaagauggaugugcu

SEQ ID NO: 816022 - RNA, 16 nt, Homo sapiens
aaagauguuccaguga

SEQ ID NO: 816023 - RNA, 21 nt, Homo sapiens
aaagauuauagaaguagcaaa

SEQ ID NO: 816024 - RNA, 20 nt, Homo sapiens
aaagauuauugugacuucac

SEQ ID NO: 816025 - RNA, 18 nt, Homo sapiens
aaagauucuauaguucua

SEQ ID NO: 816026 - RNA, 15 nt, Homo sapiens
aaagauuucucagua

SEQ ID NO: 816027 - RNA, 20 nt, Homo sapiens
aaagauuucuugaguuuugu

SEQ ID NO: 816028 - RNA, 15 nt, Homo sapiens
aaagauuuucagaaa

SEQ ID NO: 816029 - RNA, 16 nt, Homo sapiens
aaagcaaaaaacaaaa

SEQ ID NO: 816030 - RNA, 23 nt, Homo sapiens
aaagcaacaucuucauagaugaa

SEQ ID NO: 816031 - RNA, 15 nt, Homo sapiens
aaagcacaguuugaa

SEQ ID NO: 816032 - RNA, 19 nt, Homo sapiens
aaagcacauguauugacaa

SEQ ID NO: 816033 - RNA, 12 nt, Homo sapiens
aaagcaccugcc

SEQ ID NO: 816034 - RNA, 13 nt, Homo sapiens
aaagcacuacaau

SEQ ID NO: 816035 - RNA, 21 nt, Homo sapiens
aaagcagaaaguucaacuucc

SEQ ID NO: 816036 - RNA, 24 nt, Homo sapiens
aaagcagaauuuuaaugugaagac

SEQ ID NO: 816037 - RNA, 15 nt, Homo sapiens
aaagcagacaggugu

SEQ ID NO: 816038 - RNA, 22 nt, Homo sapiens
aaagcagaguggacugcauuua

SEQ ID NO: 816039 - RNA, 20 nt, Homo sapiens
aaagcagaugagcuguggac

SEQ ID NO: 816040 - RNA, 13 nt, Homo sapiens
aaagcagcugauu

SEQ ID NO: 816041 - RNA, 20 nt, Homo sapiens
aaagcaguaaauuugcuagc

SEQ ID NO: 816042 - RNA, 13 nt, Homo sapiens
aaagcaguagcau

SEQ ID NO: 816043 - RNA, 13 nt, Homo sapiens
aaagcaguauuug

SEQ ID NO: 816044 - RNA, 19 nt, Homo sapiens
aaagcaguuacuaauaugc

SEQ ID NO: 816045 - RNA, 22 nt, Homo sapiens
aaagcaguuacuaauaugccua

SEQ ID NO: 816046 - RNA, 13 nt, Homo sapiens
aaagcauaaagcu

SEQ ID NO: 816047 - RNA, 20 nt, Homo sapiens
aaagcauggacuaaccccaa

SEQ ID NO: 816048 - RNA, 18 nt, Homo sapiens
aaagcauguuuugcaugu

SEQ ID NO: 816049 - RNA, 11 nt, Homo sapiens
aaagcauuuac

SEQ ID NO: 816050 - RNA, 10 nt, Homo sapiens
aaagcauuuc

SEQ ID NO: 816051 - RNA, 18 nt, Homo sapiens
aaagcauuugcaacagcu

SEQ ID NO: 816052 - RNA, 14 nt, Homo sapiens
aaguaugccuuaag

SEQ ID NO: 816053 - RNA, 21 nt, Homo sapiens
aaguaugggaugauaguugaa

SEQ ID NO: 816054 - RNA, 15 nt, Homo sapiens
aaguauuauuuuaca

SEQ ID NO: 816055 - RNA, 16 nt, Homo sapiens
aaguauuauuuuacaa

SEQ ID NO: 816056 - RNA, 15 nt, Homo sapiens
aaguauuuauugcau

SEQ ID NO: 816057 - RNA, 17 nt, Homo sapiens
aaguauuugaucaguaa

SEQ ID NO: 816058 - RNA, 13 nt, Homo sapiens
aagucaaaugcca

SEQ ID NO: 816059 - RNA, 14 nt, Homo sapiens
aagucaacaguaaa

SEQ ID NO: 816060 - RNA, 14 nt, Homo sapiens
aagucaaccugcuu

SEQ ID NO: 816061 - RNA, 21 nt, Homo sapiens
aagucacacgcuuuugaauua

SEQ ID NO: 816062 - RNA, 21 nt, Homo sapiens
aagucacaggaagaaagcaga

SEQ ID NO: 816063 - RNA, 23 nt, Homo sapiens
aagucacaggaagaaagcagaaa

SEQ ID NO: 816064 - RNA, 12 nt, Homo sapiens
aagucacaucca

SEQ ID NO: 816065 - RNA, 23 nt, Homo sapiens
aagucaccaaauagugugaaaua

SEQ ID NO: 816066 - RNA, 18 nt, Homo sapiens
aagucaccggagcuuuca

SEQ ID NO: 816067 - RNA, 21 nt, Homo sapiens
aagucacggcugcgcacugug

SEQ ID NO: 816068 - RNA, 22 nt, Homo sapiens
aagucacggcugcgcacugugu

SEQ ID NO: 816069 - RNA, 13 nt, Homo sapiens
aagucacugcaca

SEQ ID NO: 816070 - RNA, 17 nt, Homo sapiens
aagucacuuaacuauaa

SEQ ID NO: 816071 - RNA, 22 nt, Homo sapiens
aagucagaggagauguggucaa

SEQ ID NO: 816072 - RNA, 16 nt, Homo sapiens
aagucagguccaauuu

SEQ ID NO: 816073 - RNA, 13 nt, Homo sapiens
aagucaguaucau

SEQ ID NO: 816074 - RNA, 18 nt, Homo sapiens
aagucagucuuauagcaa

SEQ ID NO: 816075 - RNA, 13 nt, Homo sapiens
aagucauagccau

SEQ ID NO: 816076 - RNA, 19 nt, Homo sapiens
aagucaucaugaacuggcu

SEQ ID NO: 816077 - RNA, 22 nt, Homo sapiens
aagucaucucauuccacuguug

SEQ ID NO: 816078 - RNA, 20 nt, Homo sapiens
aagucaugaagcccaaguga

SEQ ID NO: 816079 - RNA, 17 nt, Homo sapiens
aagucauuaaaauggaa

SEQ ID NO: 816080 - RNA, 18 nt, Homo sapiens
aaguccaagcauaccaac

SEQ ID NO: 816081 - RNA, 12 nt, Homo sapiens
aaguccacuuua

SEQ ID NO: 816082 - RNA, 16 nt, Homo sapiens
aaguccaucugacaaa

SEQ ID NO: 816083 - RNA, 22 nt, Homo sapiens
aaguccauguuauucucucaca

SEQ ID NO: 816084 - RNA, 14 nt, Homo sapiens
aagucccagcauug

SEQ ID NO: 816085 - RNA, 20 nt, Homo sapiens
aagucccugacucucuguga

SEQ ID NO: 816086 - RNA, 20 nt, Homo sapiens
aaguccuaguuguucagcau

SEQ ID NO: 816087 - RNA, 22 nt, Homo sapiens
aaguccugaaguagaugguuga

SEQ ID NO: 816088 - RNA, 23 nt, Homo sapiens
aaguccugacacuauucauuuga

SEQ ID NO: 816089 - RNA, 20 nt, Homo sapiens
aagucgccagucacugcugc

SEQ ID NO: 816090 - RNA, 16 nt, Homo sapiens
aagucggaucuagucc

SEQ ID NO: 816091 - RNA, 19 nt, Homo sapiens
aagucuaacgcugaacuga

SEQ ID NO: 816092 - RNA, 13 nt, Homo sapiens
aagucuaugcuua

SEQ ID NO: 816093 - RNA, 14 nt, Homo sapiens
aagucuccaugaag

SEQ ID NO: 816094 - RNA, 18 nt, Homo sapiens
aagucucugugaauugaa

SEQ ID NO: 816095 - RNA, 15 nt, Homo sapiens
aagucugcuacccuc

SEQ ID NO: 816096 - RNA, 20 nt, Homo sapiens
aagucugucugucugaugau

SEQ ID NO: 816097 - RNA, 13 nt, Homo sapiens
aagugaaagcaag

SEQ ID NO: 816098 - RNA, 21 nt, Homo sapiens
aagugaagaacacuacugcua

SEQ ID NO: 816099 - RNA, 24 nt, Homo sapiens
aagugacuucuggagaaagcucau

SEQ ID NO: 816100 - RNA, 19 nt, Homo sapiens
aagugagaaaaguucaaua

SEQ ID NO: 816101 - RNA, 19 nt, Homo sapiens
aagugagaaaaugccucaa

SEQ ID NO: 816102 - RNA, 23 nt, Homo sapiens
aagugagcagagauguacugcaa

SEQ ID NO: 816103 - RNA, 11 nt, Homo sapiens
aagugagcuuu

SEQ ID NO: 816104 - RNA, 21 nt, Homo sapiens
aagugaguuaaucuuguauga

SEQ ID NO: 816105 - RNA, 22 nt, Homo sapiens
aagugauaucccccagccucaa

SEQ ID NO: 816106 - RNA, 21 nt, Homo sapiens
aagugauccuuccaccucagu

SEQ ID NO: 816107 - RNA, 13 nt, Homo sapiens
aagugauuaucuc

SEQ ID NO: 816108 - RNA, 18 nt, Homo sapiens
aagugcuauuucuugcau

SEQ ID NO: 816109 - RNA, 20 nt, Homo sapiens
aagugcugggauuacaggca

SEQ ID NO: 816110 - RNA, 21 nt, Homo sapiens
aagugcugggauuacaggugu

SEQ ID NO: 816111 - RNA, 13 nt, Homo sapiens
aagugcuguggcu

SEQ ID NO: 816112 - RNA, 17 nt, Homo sapiens
aagugcuucuccagccu

SEQ ID NO: 816113 - RNA, 17 nt, Homo sapiens
aaguggaaaaaggagag

SEQ ID NO: 816114 - RNA, 15 nt, Homo sapiens
aaguggcaagaccaa

SEQ ID NO: 816115 - RNA, 19 nt, Homo sapiens
aaguggccaagaagcagug

SEQ ID NO: 816116 - RNA, 15 nt, Homo sapiens
aagugggacauucaa

SEQ ID NO: 816117 - RNA, 18 nt, Homo sapiens
aaguggguggaucacuug

SEQ ID NO: 816118 - RNA, 18 nt, Homo sapiens
aagugguaaauacuguga

SEQ ID NO: 816119 - RNA, 14 nt, Homo sapiens
aagugguacaggaa

SEQ ID NO: 816120 - RNA, 21 nt, Homo sapiens
aagugguccagaaacaaaaag

SEQ ID NO: 816121 - RNA, 11 nt, Homo sapiens
aagugugagua

SEQ ID NO: 816122 - RNA, 20 nt, Homo sapiens
aagugugauauacaaagugu

SEQ ID NO: 816123 - RNA, 16 nt, Homo sapiens
aagugugggagaccga

SEQ ID NO: 816124 - RNA, 18 nt, Homo sapiens
aaguguguaugauaauga

SEQ ID NO: 816125 - RNA, 23 nt, Homo sapiens
aaguguucuuagguuuacuguga

SEQ ID NO: 816126 - RNA, 16 nt, Homo sapiens
aaguguucuucagugu

SEQ ID NO: 816127 - RNA, 18 nt, Homo sapiens
aaguguugcucuuggaaa

SEQ ID NO: 816128 - RNA, 18 nt, Homo sapiens
aaguguuugauggugcca

SEQ ID NO: 816129 - RNA, 20 nt, Homo sapiens
aaguuaaaauaaaaccaagg

SEQ ID NO: 816130 - RNA, 20 nt, Homo sapiens
aaguuaaccccauguccuca

SEQ ID NO: 816131 - RNA, 14 nt, Homo sapiens
aaguuacuugaauu

SEQ ID NO: 816132 - RNA, 12 nt, Homo sapiens
aaguuagucaau

SEQ ID NO: 816133 - RNA, 14 nt, Homo sapiens
aaguuagucaaucc

SEQ ID NO: 816134 - RNA, 13 nt, Homo sapiens
aagcacaguuuga

SEQ ID NO: 816135 - RNA, 14 nt, Homo sapiens
aagcacaucaauua

SEQ ID NO: 816136 - RNA, 13 nt, Homo sapiens
aagcacauguaau

SEQ ID NO: 816137 - RNA, 14 nt, Homo sapiens
aagcacauuccaaa

SEQ ID NO: 816138 - RNA, 22 nt, Homo sapiens
aagcacuauuaauacucugcag

SEQ ID NO: 816139 - RNA, 23 nt, Homo sapiens
aagcacucuggaugauggauucc

SEQ ID NO: 816140 - RNA, 21 nt, Homo sapiens
aagcagaaaguucaacuucca

SEQ ID NO: 816141 - RNA, 22 nt, Homo sapiens
aagcagacaggugugcagauuu

SEQ ID NO: 816142 - RNA, 19 nt, Homo sapiens
aagcagagcaaaaugcucu

SEQ ID NO: 816143 - RNA, 15 nt, Homo sapiens
aagcagauacuugag

SEQ ID NO: 816144 - RNA, 14 nt, Homo sapiens
aagcagcaagacaa

SEQ ID NO: 816145 - RNA, 15 nt, Homo sapiens
aagcagcacugugag

SEQ ID NO: 816146 - RNA, 12 nt, Homo sapiens
aagcagcauuug

SEQ ID NO: 816147 - RNA, 13 nt, Homo sapiens
aagcaggacagag

SEQ ID NO: 816148 - RNA, 11 nt, Homo sapiens
aagcagggaaa

SEQ ID NO: 816149 - RNA, 14 nt, Homo sapiens
aagcagguucuuga

SEQ ID NO: 816150 - RNA, 22 nt, Homo sapiens
aagcaguagcauuugcuuccuc

SEQ ID NO: 816151 - RNA, 14 nt, Homo sapiens
aagcagucgugccu

SEQ ID NO: 816152 - RNA, 19 nt, Homo sapiens
aagcagucuugcucuguua

SEQ ID NO: 816153 - RNA, 15 nt, Homo sapiens
aagcagugcacauuu

SEQ ID NO: 816154 - RNA, 18 nt, Homo sapiens
aagcagugccuuccauaa

SEQ ID NO: 816155 - RNA, 23 nt, Homo sapiens
aagcaguuauugaaaugauuaac

SEQ ID NO: 816156 - RNA, 21 nt, Homo sapiens
aagcaguuguaccaagugaaa

SEQ ID NO: 816157 - RNA, 18 nt, Homo sapiens
aagcauacaaagcaguuu

SEQ ID NO: 816158 - RNA, 17 nt, Homo sapiens
aagcauauauaacuauu

SEQ ID NO: 816159 - RNA, 22 nt, Homo sapiens
aagcauaugcagccaaccaaga

SEQ ID NO: 816160 - RNA, 20 nt, Homo sapiens
aagcaucauuauuugcagag

SEQ ID NO: 816161 - RNA, 24 nt, Homo sapiens
aagcaucucagccuaccaugagaa

SEQ ID NO: 816162 - RNA, 16 nt, Homo sapiens
aagcauggacuaaccc

SEQ ID NO: 816163 - RNA, 20 nt, Homo sapiens
aagcauggccuggacugacu

SEQ ID NO: 816164 - RNA, 23 nt, Homo sapiens
aagcaugucucaauaguaaaaga

SEQ ID NO: 816165 - RNA, 18 nt, Homo sapiens
aagcauguuuucacuaau

SEQ ID NO: 816166 - RNA, 18 nt, Homo sapiens
aagcauuccuucuuucac

SEQ ID NO: 816167 - RNA, 10 nt, Homo sapiens
aagcauucuu

SEQ ID NO: 816168 - RNA, 15 nt, Homo sapiens
aaggcaguagaacuc

SEQ ID NO: 816169 - RNA, 16 nt, Homo sapiens
aaggcauccaggccag

SEQ ID NO: 816170 - RNA, 15 nt, Homo sapiens
aaggcaucgucaugc

SEQ ID NO: 816171 - RNA, 12 nt, Homo sapiens
aaggcaucucag

SEQ ID NO: 816172 - RNA, 20 nt, Homo sapiens
aaggcaugcuuguggaugac

SEQ ID NO: 816173 - RNA, 22 nt, Homo sapiens
aaggcauguggccuuuaucuca

SEQ ID NO: 816174 - RNA, 16 nt, Homo sapiens
aaggcauuguccaaag

SEQ ID NO: 816175 - RNA, 17 nt, Homo sapiens
aaggcauuuauugccau

SEQ ID NO: 816176 - RNA, 15 nt, Homo sapiens
aaggcauuucuauca

SEQ ID NO: 816177 - RNA, 20 nt, Homo sapiens
aaggccacggccuugugucu

SEQ ID NO: 816178 - RNA, 14 nt, Homo sapiens
aaggccacuugagu

SEQ ID NO: 816179 - RNA, 18 nt, Homo sapiens
aaggccagaaacuccuuu

SEQ ID NO: 816180 - RNA, 18 nt, Homo sapiens
aaggcccauaucugugaa

SEQ ID NO: 816181 - RNA, 16 nt, Homo sapiens
aaggccccugcaaugu

SEQ ID NO: 816182 - RNA, 22 nt, Homo sapiens
aaggccgagaccccaucuucca

SEQ ID NO: 816183 - RNA, 21 nt, Homo sapiens
aaggccugacuucugcuggca

SEQ ID NO: 816184 - RNA, 16 nt, Homo sapiens
aaggccugguguuucu

SEQ ID NO: 816185 - RNA, 14 nt, Homo sapiens
aaggcggugcucag

SEQ ID NO: 816186 - RNA, 12 nt, Homo sapiens
aaggcugaccaa

SEQ ID NO: 816187 - RNA, 20 nt, Homo sapiens
aaggcuucucuccacagugu

SEQ ID NO: 816188 - RNA, 21 nt, Homo sapiens
aaggcuucucuccacaguguu

SEQ ID NO: 816189 - RNA, 15 nt, Homo sapiens
aaggcuugaagcugu

SEQ ID NO: 816190 - RNA, 17 nt, Homo sapiens
aaggcuuuaucucaggg

SEQ ID NO: 816191 - RNA, 14 nt, Homo sapiens
aaggcuuugaguua

SEQ ID NO: 816192 - RNA, 20 nt, Homo sapiens
aaggcuuugguuuccaaguc

SEQ ID NO: 816193 - RNA, 17 nt, Homo sapiens
aagggaauacugugcau

SEQ ID NO: 816194 - RNA, 19 nt, Homo sapiens
aagggaauguaacugcuga

SEQ ID NO: 816195 - RNA, 18 nt, Homo sapiens
aagggaauugcucagaga

SEQ ID NO: 816196 - RNA, 12 nt, Homo sapiens
aagggaauuugg

SEQ ID NO: 816197 - RNA, 21 nt, Homo sapiens
aagggaguggggcuggggaaa

SEQ ID NO: 816198 - RNA, 21 nt, Homo sapiens
aagggauaaucaucucuguca

SEQ ID NO: 816199 - RNA, 16 nt, Homo sapiens
aagggauaguccaaag

SEQ ID NO: 816200 - RNA, 18 nt, Homo sapiens
aagggauccguacauuca

SEQ ID NO: 816201 - RNA, 19 nt, Homo sapiens
aagggauggaaaaggaaga

SEQ ID NO: 816202 - RNA, 17 nt, Homo sapiens
aagggauggacuuguga

SEQ ID NO: 816203 - RNA, 20 nt, Homo sapiens
aagggauuguuguguaguca

SEQ ID NO: 816204 - RNA, 19 nt, Homo sapiens
aagggcaaggaguuuauua

SEQ ID NO: 816205 - RNA, 19 nt, Homo sapiens
aagggcacucccaacccug

SEQ ID NO: 816206 - RNA, 12 nt, Homo sapiens
aagggcagagaa

SEQ ID NO: 816207 - RNA, 9 nt, Homo sapiens
aagggccag

SEQ ID NO: 816208 - RNA, 18 nt, Homo sapiens
aagggccagauuucauuc

SEQ ID NO: 816209 - RNA, 21 nt, Homo sapiens
aagggccagauuucauucuca

SEQ ID NO: 816210 - RNA, 16 nt, Homo sapiens
aagggccgacuaagag

SEQ ID NO: 816211 - RNA, 17 nt, Homo sapiens
aagggcugaguguccag

SEQ ID NO: 816212 - RNA, 19 nt, Homo sapiens
aaggggaaauaacugccuu

SEQ ID NO: 816213 - RNA, 17 nt, Homo sapiens
aaggggaaggaagagag

SEQ ID NO: 816214 - RNA, 18 nt, Homo sapiens
aaggggaaucagaacuca

SEQ ID NO: 816215 - RNA, 20 nt, Homo sapiens
aaggggagccaaaaucucaa

SEQ ID NO: 816216 - RNA, 16 nt, Homo sapiens
aaggggauauuuacug

SEQ ID NO: 816217 - RNA, 18 nt, Homo sapiens
aaggggcccaaauucuuu

SEQ ID NO: 816218 - RNA, 23 nt, Homo sapiens
aaggggccucaccgagugggggc

SEQ ID NO: 816219 - RNA, 14 nt, Homo sapiens
aaggggcugaggac

SEQ ID NO: 816220 - RNA, 14 nt, Homo sapiens
aaggggugggccac

SEQ ID NO: 816221 - RNA, 21 nt, Homo sapiens
aaggguacagauuagguuugu

SEQ ID NO: 816222 - RNA, 13 nt, Homo sapiens
aaggguacugaaa

SEQ ID NO: 816223 - RNA, 18 nt, Homo sapiens
aagggucguuaccagaga

SEQ ID NO: 816224 - RNA, 23 nt, Homo sapiens
aaggguuauagacugccaugcua

SEQ ID NO: 816225 - RNA, 16 nt, Homo sapiens
aaggguucaacaaagg

SEQ ID NO: 816226 - RNA, 16 nt, Homo sapiens
aaggguuuacuugaca

SEQ ID NO: 816227 - RNA, 16 nt, Homo sapiens
aaggguuucucuauua

SEQ ID NO: 816228 - RNA, 13 nt, Homo sapiens
aagguacacuggu

SEQ ID NO: 816229 - RNA, 15 nt, Homo sapiens
aagguacuuaaagcu

SEQ ID NO: 816230 - RNA, 22 nt, Homo sapiens
aagguagccaucccaugaacac

SEQ ID NO: 816231 - RNA, 17 nt, Homo sapiens
aagguagcccagcacug

SEQ ID NO: 816232 - RNA, 20 nt, Homo sapiens
aagguagcccagcacuguga

SEQ ID NO: 816233 - RNA, 21 nt, Homo sapiens
aagguagcuuaccugacacaa

SEQ ID NO: 816234 - RNA, 17 nt, Homo sapiens
aagguaguaacuuucca

SEQ ID NO: 816235 - RNA, 18 nt, Homo sapiens
aagguauuagcaaagcaa

SEQ ID NO: 816236 - RNA, 15 nt, Homo sapiens
aagguauuucuccag

SEQ ID NO: 816237 - RNA, 18 nt, Homo sapiens
aaggucaauaaauuauua

SEQ ID NO: 816238 - RNA, 17 nt, Homo sapiens
aaggucccaugcuccac

SEQ ID NO: 816239 - RNA, 12 nt, Homo sapiens
aaggugaccucu

SEQ ID NO: 816240 - RNA, 13 nt, Homo sapiens
aaggugagcagaa

SEQ ID NO: 816241 - RNA, 12 nt, Homo sapiens
aaggugccacuu

SEQ ID NO: 816242 - RNA, 15 nt, Homo sapiens
aaggugccucaagaa

SEQ ID NO: 816243 - RNA, 18 nt, Homo sapiens
aaggugcuggaaagggag

SEQ ID NO: 816244 - RNA, 22 nt, Homo sapiens
aagguggccacagugucacugg

SEQ ID NO: 816245 - RNA, 13 nt, Homo sapiens
aagguggccucug

SEQ ID NO: 816246 - RNA, 15 nt, Homo sapiens
aaggugggcagauca

SEQ ID NO: 816247 - RNA, 18 nt, Homo sapiens
aagguuaugcacugccug

SEQ ID NO: 816248 - RNA, 16 nt, Homo sapiens
aagguuccaacuguau

SEQ ID NO: 816249 - RNA, 17 nt, Homo sapiens
aagguuccaacuguaua

SEQ ID NO: 816250 - RNA, 15 nt, Homo sapiens
aacagacaacagaag

SEQ ID NO: 816251 - RNA, 20 nt, Homo sapiens
aacagacaagugacuguauc

SEQ ID NO: 816252 - RNA, 19 nt, Homo sapiens
aacagagcaagacuccauc

SEQ ID NO: 816253 - RNA, 16 nt, Homo sapiens
aacagagggaguuuaa

SEQ ID NO: 816254 - RNA, 22 nt, Homo sapiens
aacagagggaguuuaauacagg

SEQ ID NO: 816255 - RNA, 14 nt, Homo sapiens
aacagagugcaacc

SEQ ID NO: 816256 - RNA, 22 nt, Homo sapiens
aacagagugcaacccagucaca

SEQ ID NO: 816257 - RNA, 14 nt, Homo sapiens
aacagauaacacca

SEQ ID NO: 816258 - RNA, 15 nt, Homo sapiens
aacagauaagcaaga

SEQ ID NO: 816259 - RNA, 13 nt, Homo sapiens
aacagaucuggaa

SEQ ID NO: 816260 - RNA, 23 nt, Homo sapiens
aacagauggggucugugacugga

SEQ ID NO: 816261 - RNA, 20 nt, Homo sapiens
aacagauucaggccagccca

SEQ ID NO: 816262 - RNA, 17 nt, Homo sapiens
aacagcaauggugucag

SEQ ID NO: 816263 - RNA, 14 nt, Homo sapiens
aacagcaucuuuca

SEQ ID NO: 816264 - RNA, 21 nt, Homo sapiens
aacagcaugggccucaccucc

SEQ ID NO: 816265 - RNA, 23 nt, Homo sapiens
aacagccaaaacuccacagucaa

SEQ ID NO: 816266 - RNA, 20 nt, Homo sapiens
aacagccacgucagcuuuuc

SEQ ID NO: 816267 - RNA, 21 nt, Homo sapiens
aacagcguguaaacacauguu

SEQ ID NO: 816268 - RNA, 20 nt, Homo sapiens
aacaggaucucaaacuugau

SEQ ID NO: 816269 - RNA, 23 nt, Homo sapiens
aacaggcaaaguuuuacagagag

SEQ ID NO: 816270 - RNA, 19 nt, Homo sapiens
aacaggcucagaucucaug

SEQ ID NO: 816271 - RNA, 22 nt, Homo sapiens
aacagggagaaguagcuaguag

SEQ ID NO: 816272 - RNA, 21 nt, Homo sapiens
aacagggcugccuucuggccu

SEQ ID NO: 816273 - RNA, 16 nt, Homo sapiens
aacaggguaccucaag

SEQ ID NO: 816274 - RNA, 18 nt, Homo sapiens
aacagguaaaacagggcc

SEQ ID NO: 816275 - RNA, 15 nt, Homo sapiens
aacagguauauacuu

SEQ ID NO: 816276 - RNA, 21 nt, Homo sapiens
aacaguaaaagccuuauucua

SEQ ID NO: 816277 - RNA, 19 nt, Homo sapiens
aacaguaaagaaagcagaa

SEQ ID NO: 816278 - RNA, 15 nt, Homo sapiens
aacaguaacugccau

SEQ ID NO: 816279 - RNA, 14 nt, Homo sapiens
aacaguaugcacaa

SEQ ID NO: 816280 - RNA, 16 nt, Homo sapiens
aacaguauuacagugu

SEQ ID NO: 816281 - RNA, 17 nt, Homo sapiens
aacaguauuacaguguc

SEQ ID NO: 816282 - RNA, 22 nt, Homo sapiens
aacagucuaguguaauggauca

SEQ ID NO: 816283 - RNA, 16 nt, Homo sapiens
aacagugagaaaccau

SEQ ID NO: 816284 - RNA, 23 nt, Homo sapiens
aacagugggcguugggagccuag

SEQ ID NO: 816285 - RNA, 11 nt, Homo sapiens
aacaguucaaa

SEQ ID NO: 816286 - RNA, 20 nt, Homo sapiens
aacaguucauguuugcuuca

SEQ ID NO: 816287 - RNA, 14 nt, Homo sapiens
aacaguuguauguu

SEQ ID NO: 816288 - RNA, 22 nt, Homo sapiens
aacaguuuuuuaugcuaaucag

SEQ ID NO: 816289 - RNA, 20 nt, Homo sapiens
aacauaaaaucugugaauua

SEQ ID NO: 816290 - RNA, 11 nt, Homo sapiens
cagcucacuca

SEQ ID NO: 816291 - RNA, 15 nt, Homo sapiens
cagcucagaggccca

SEQ ID NO: 816292 - RNA, 16 nt, Homo sapiens
cagcucaugacacugu

SEQ ID NO: 816293 - RNA, 15 nt, Homo sapiens
cagcuccagggccag

SEQ ID NO: 816294 - RNA, 19 nt, Homo sapiens
cagcuccccuucugaauca

SEQ ID NO: 816295 - RNA, 16 nt, Homo sapiens
cagcucccgcuguggc

SEQ ID NO: 816296 - RNA, 18 nt, Homo sapiens
cagcuccugccaggguga

SEQ ID NO: 816297 - RNA, 14 nt, Homo sapiens
cagcuccuguaaca

SEQ ID NO: 816298 - RNA, 21 nt, Homo sapiens
cagcuccuguaacauacuggc

SEQ ID NO: 816299 - RNA, 19 nt, Homo sapiens
cagcucuccccaggcauuu

SEQ ID NO: 816300 - RNA, 23 nt, Homo sapiens
cagcucuggaugaaggcaaaaac

SEQ ID NO: 816301 - RNA, 21 nt, Homo sapiens
cagcucuguaucugccaugug

SEQ ID NO: 816302 - RNA, 17 nt, Homo sapiens
cagcugaagaacaucug

SEQ ID NO: 816303 - RNA, 17 nt, Homo sapiens
cagcugaauucacuuaa

SEQ ID NO: 816304 - RNA, 13 nt, Homo sapiens
cagcugacuaaac

SEQ ID NO: 816305 - RNA, 22 nt, Homo sapiens
cagcugacucucgugcauuuca

SEQ ID NO: 816306 - RNA, 13 nt, Homo sapiens
cagcugagucuau

SEQ ID NO: 816307 - RNA, 14 nt, Homo sapiens
cagcugaugcucaa

SEQ ID NO: 816308 - RNA, 13 nt, Homo sapiens
cagcugcaccugc

SEQ ID NO: 816309 - RNA, 17 nt, Homo sapiens
cagcugcagcugaucca

SEQ ID NO: 816310 - RNA, 22 nt, Homo sapiens
cagcugcauuaaaacaaaggaa

SEQ ID NO: 816311 - RNA, 23 nt, Homo sapiens
cagcugcauuucacaugccuugc

SEQ ID NO: 816312 - RNA, 16 nt, Homo sapiens
cagcugccucugcucc

SEQ ID NO: 816313 - RNA, 13 nt, Homo sapiens
cagcuggacaggu

SEQ ID NO: 816314 - RNA, 17 nt, Homo sapiens
cagcugguucgugguuu

SEQ ID NO: 816315 - RNA, 22 nt, Homo sapiens
cagcuguaagaagagacuggga

SEQ ID NO: 816316 - RNA, 22 nt, Homo sapiens
cagcugucagaacacuccaagc

SEQ ID NO: 816317 - RNA, 16 nt, Homo sapiens
cagcuguccugcagca

SEQ ID NO: 816318 - RNA, 11 nt, Homo sapiens
cagcugugaga

SEQ ID NO: 816319 - RNA, 14 nt, Homo sapiens
cagcugugcacuuu

SEQ ID NO: 816320 - RNA, 13 nt, Homo sapiens
cagcugugcugca

SEQ ID NO: 816321 - RNA, 20 nt, Homo sapiens
cagcuguggcagaguuacag

SEQ ID NO: 816322 - RNA, 15 nt, Homo sapiens
cagcuguguggugcu

SEQ ID NO: 816323 - RNA, 13 nt, Homo sapiens
cagcuuaaaccca

SEQ ID NO: 816324 - RNA, 19 nt, Homo sapiens
cagcuuagaaugcaucuca

SEQ ID NO: 816325 - RNA, 19 nt, Homo sapiens
cagcuucaccagagcauuu

SEQ ID NO: 816326 - RNA, 14 nt, Homo sapiens
cagcuuccaaacau

SEQ ID NO: 816327 - RNA, 20 nt, Homo sapiens
cagcuucccgaguaacugag

SEQ ID NO: 816328 - RNA, 19 nt, Homo sapiens
cagcuucccgaguagcugg

SEQ ID NO: 816329 - RNA, 18 nt, Homo sapiens
cagcuucucaaaguacug

SEQ ID NO: 816330 - RNA, 20 nt, Homo sapiens
cagcuugaguggguucucug

SEQ ID NO: 816331 - RNA, 16 nt, Homo sapiens
cagcuuucugugcaga

SEQ ID NO: 816332 - RNA, 18 nt, Homo sapiens
cagcuuucugugcagaga

SEQ ID NO: 816333 - RNA, 13 nt, Homo sapiens
cagcuuuuccuca

SEQ ID NO: 816334 - RNA, 18 nt, Homo sapiens
caggaaaaaaaauucugu

SEQ ID NO: 816335 - RNA, 18 nt, Homo sapiens
caggaaaaagacuaagcc

SEQ ID NO: 816336 - RNA, 21 nt, Homo sapiens
caggaaacuccacaucugccu

SEQ ID NO: 816337 - RNA, 18 nt, Homo sapiens
caggaaagggagggaaua

SEQ ID NO: 816338 - RNA, 14 nt, Homo sapiens
caggaaauagucac

SEQ ID NO: 816339 - RNA, 14 nt, Homo sapiens
caggaaaucaaaua

SEQ ID NO: 816340 - RNA, 19 nt, Homo sapiens
caggaaaucaaauaugcaa

SEQ ID NO: 816341 - RNA, 13 nt, Homo sapiens
caggaacaaacag

SEQ ID NO: 816342 - RNA, 19 nt, Homo sapiens
caggaacacccgacuccuc

SEQ ID NO: 816343 - RNA, 20 nt, Homo sapiens
caggaacagcaaaugcaaaa

SEQ ID NO: 816344 - RNA, 14 nt, Homo sapiens
caggaagaggccca

SEQ ID NO: 816345 - RNA, 18 nt, Homo sapiens
caggaagaguucuauccc

SEQ ID NO: 816346 - RNA, 16 nt, Homo sapiens
caggaagccaggugag

SEQ ID NO: 816347 - RNA, 17 nt, Homo sapiens
caggaagcucugaugca

SEQ ID NO: 816348 - RNA, 17 nt, Homo sapiens
caggaagggagaacuug

SEQ ID NO: 816349 - RNA, 19 nt, Homo sapiens
caggaagggagaacuugaa

SEQ ID NO: 816350 - RNA, 16 nt, Homo sapiens
caggaaggggugugcu

SEQ ID NO: 816351 - RNA, 16 nt, Homo sapiens
caggaaggucuucaau

SEQ ID NO: 816352 - RNA, 15 nt, Homo sapiens
caggaaguacuucca

SEQ ID NO: 816353 - RNA, 15 nt, Homo sapiens
caggaaucucagaga

SEQ ID NO: 816354 - RNA, 16 nt, Homo sapiens
caggaaucucagagac

SEQ ID NO: 816355 - RNA, 21 nt, Homo sapiens
caggaauuccucuuuugcuua

SEQ ID NO: 816356 - RNA, 18 nt, Homo sapiens
caggacauuaaggaccaa

SEQ ID NO: 816357 - RNA, 21 nt, Homo sapiens
caggaccacucaguuaaggaa

SEQ ID NO: 816358 - RNA, 20 nt, Homo sapiens
caggacucacccucauacca

SEQ ID NO: 816359 - RNA, 20 nt, Homo sapiens
caggacuuccauuugcuuug

SEQ ID NO: 816360 - RNA, 20 nt, Homo sapiens
caggacuugcuaaagcacuu

SEQ ID NO: 816361 - RNA, 17 nt, Homo sapiens
caggagaaccacuacau

SEQ ID NO: 816362 - RNA, 18 nt, Homo sapiens
caggagacagaccacuug

SEQ ID NO: 816363 - RNA, 14 nt, Homo sapiens
caggagacaguuca

SEQ ID NO: 816364 - RNA, 14 nt, Homo sapiens
caggagaccugcuc

SEQ ID NO: 816365 - RNA, 13 nt, Homo sapiens
caggagacugggc

SEQ ID NO: 816366 - RNA, 16 nt, Homo sapiens
caggagagcagcgcag

SEQ ID NO: 816367 - RNA, 17 nt, Homo sapiens
caggagaucgagaccau

SEQ ID NO: 816368 - RNA, 17 nt, Homo sapiens
caggagcacccaggcau

SEQ ID NO: 816369 - RNA, 19 nt, Homo sapiens
caggagccaguccgugcag

SEQ ID NO: 816370 - RNA, 21 nt, Homo sapiens
caggagcugaggauaaagggc

SEQ ID NO: 816371 - RNA, 12 nt, Homo sapiens
caggaggaucau

SEQ ID NO: 816372 - RNA, 22 nt, Homo sapiens
caggaggaucauuugagcucau

SEQ ID NO: 816373 - RNA, 22 nt, Homo sapiens
caggaggcagacaaugacccca

SEQ ID NO: 816374 - RNA, 21 nt, Homo sapiens
caggaggcccugguccuggcc

SEQ ID NO: 816375 - RNA, 20 nt, Homo sapiens
caggagggugacgcccagcu

SEQ ID NO: 816376 - RNA, 24 nt, Homo sapiens
caggaggucugguccgagucucag

SEQ ID NO: 816377 - RNA, 18 nt, Homo sapiens
caggagguuggugacuga

SEQ ID NO: 816378 - RNA, 15 nt, Homo sapiens
caggagguuguggau

SEQ ID NO: 816379 - RNA, 16 nt, Homo sapiens
caggaguaaaacuccc

SEQ ID NO: 816380 - RNA, 23 nt, Homo sapiens
caggaguaaaagagucaagugac

SEQ ID NO: 816381 - RNA, 18 nt, Homo sapiens
cagugaccccugaccuca

SEQ ID NO: 816382 - RNA, 19 nt, Homo sapiens
cagugaccccugaccucac

SEQ ID NO: 816383 - RNA, 17 nt, Homo sapiens
cagugacgugcaccugu

SEQ ID NO: 816384 - RNA, 13 nt, Homo sapiens
cagugagcacuag

SEQ ID NO: 816385 - RNA, 14 nt, Homo sapiens
cagugagccaagau

SEQ ID NO: 816386 - RNA, 17 nt, Homo sapiens
cagugagccaugaucau

SEQ ID NO: 816387 - RNA, 16 nt, Homo sapiens
cagugagcugagauca

SEQ ID NO: 816388 - RNA, 20 nt, Homo sapiens
cagugagcugauaucaugcc

SEQ ID NO: 816389 - RNA, 20 nt, Homo sapiens
cagugagcuguguucuugcc

SEQ ID NO: 816390 - RNA, 23 nt, Homo sapiens
cagugaggaacccugaucucuca

SEQ ID NO: 816391 - RNA, 20 nt, Homo sapiens
cagugaguaaucaauacaga

SEQ ID NO: 816392 - RNA, 13 nt, Homo sapiens
cagugaucuccau

SEQ ID NO: 816393 - RNA, 17 nt, Homo sapiens
cagugaugcugugcuau

SEQ ID NO: 816394 - RNA, 18 nt, Homo sapiens
cagugcaaaccacuucuc

SEQ ID NO: 816395 - RNA, 23 nt, Homo sapiens
cagugcaccuacugcuuacuguu

SEQ ID NO: 816396 - RNA, 20 nt, Homo sapiens
cagugcagggaaccgugaua

SEQ ID NO: 816397 - RNA, 22 nt, Homo sapiens
cagugcauuuuguuucuguaua

SEQ ID NO: 816398 - RNA, 15 nt, Homo sapiens
cagugccaagcacag

SEQ ID NO: 816399 - RNA, 19 nt, Homo sapiens
cagugccacccaugcagcu

SEQ ID NO: 816400 - RNA, 15 nt, Homo sapiens
cagugccagcaccug

SEQ ID NO: 816401 - RNA, 16 nt, Homo sapiens
cagugccagcaccugc

SEQ ID NO: 816402 - RNA, 18 nt, Homo sapiens
cagugccagcaccugccc

SEQ ID NO: 816403 - RNA, 21 nt, Homo sapiens
cagugcccaccaacaucccau

SEQ ID NO: 816404 - RNA, 13 nt, Homo sapiens
cagugcccaugca

SEQ ID NO: 816405 - RNA, 18 nt, Homo sapiens
cagugcccaugcaauggc

SEQ ID NO: 816406 - RNA, 16 nt, Homo sapiens
cagugcccccacugac

SEQ ID NO: 816407 - RNA, 13 nt, Homo sapiens
cagugcccuaggc

SEQ ID NO: 816408 - RNA, 14 nt, Homo sapiens
cagugcccucacag

SEQ ID NO: 816409 - RNA, 16 nt, Homo sapiens
ccagacuggcacaguu

SEQ ID NO: 816410 - RNA, 12 nt, Homo sapiens
ccagacuugaau

SEQ ID NO: 816411 - RNA, 13 nt, Homo sapiens
ccagagaagccaa

SEQ ID NO: 816412 - RNA, 14 nt, Homo sapiens
ccagagagcagcuu

SEQ ID NO: 816413 - RNA, 22 nt, Homo sapiens
ccagagagcagcuucagugaca

SEQ ID NO: 816414 - RNA, 15 nt, Homo sapiens
ccagagcauuuccaa

SEQ ID NO: 816415 - RNA, 21 nt, Homo sapiens
ccagagcauuuccaacaccac

SEQ ID NO: 816416 - RNA, 23 nt, Homo sapiens
ccagagccaaccuggacuuccug

SEQ ID NO: 816417 - RNA, 19 nt, Homo sapiens
ccagagcccuucacugcca

SEQ ID NO: 816418 - RNA, 22 nt, Homo sapiens
ccagagccugucuuucagcauu

SEQ ID NO: 816419 - RNA, 18 nt, Homo sapiens
ccagagcuggaaggcagg

SEQ ID NO: 816420 - RNA, 12 nt, Homo sapiens
ccagagcugugc

SEQ ID NO: 816421 - RNA, 23 nt, Homo sapiens
ccagaggcagagguugcagugag

SEQ ID NO: 816422 - RNA, 20 nt, Homo sapiens
ccagaggggcucaggucaca

SEQ ID NO: 816423 - RNA, 22 nt, Homo sapiens
ccagaggugcccgcucuucccu

SEQ ID NO: 816424 - RNA, 19 nt, Homo sapiens
ccagagguggauguuauga

SEQ ID NO: 816425 - RNA, 17 nt, Homo sapiens
ccagagguuaucugccu

SEQ ID NO: 816426 - RNA, 11 nt, Homo sapiens
ccagagucaga

SEQ ID NO: 816427 - RNA, 14 nt, Homo sapiens
ccagaguggcccaa

SEQ ID NO: 816428 - RNA, 16 nt, Homo sapiens
ccagaguuggacccga

SEQ ID NO: 816429 - RNA, 21 nt, Homo sapiens
ccagauacacuaaaguuacaa

SEQ ID NO: 816430 - RNA, 15 nt, Homo sapiens
ccagaucacugccac

SEQ ID NO: 816431 - RNA, 23 nt, Homo sapiens
ccagaucagauucuucucuuaau

SEQ ID NO: 816432 - RNA, 18 nt, Homo sapiens
ccagaucgauccuggauu

SEQ ID NO: 816433 - RNA, 17 nt, Homo sapiens
ccagaucgcaccacugc

SEQ ID NO: 816434 - RNA, 12 nt, Homo sapiens
ccagaucugccu

SEQ ID NO: 816435 - RNA, 18 nt, Homo sapiens
ccagauggcucuuucuau

SEQ ID NO: 816436 - RNA, 20 nt, Homo sapiens
ccagaugugaaaacaucuca

SEQ ID NO: 816437 - RNA, 20 nt, Homo sapiens
ccagauguuuacagacugug

SEQ ID NO: 816438 - RNA, 22 nt, Homo sapiens
ccagauugacgacaagugcuga

SEQ ID NO: 816439 - RNA, 23 nt, Homo sapiens
ccagauugacgacaagugcugaa

SEQ ID NO: 816440 - RNA, 21 nt, Homo sapiens
ccagauuggcucacacugaga

SEQ ID NO: 816441 - RNA, 20 nt, Homo sapiens
ccagauuuaaaaaaagaaca

SEQ ID NO: 816442 - RNA, 16 nt, Homo sapiens
ccagcaagcucuucac

SEQ ID NO: 816443 - RNA, 15 nt, Homo sapiens
ccaacccccaucucc

SEQ ID NO: 816444 - RNA, 22 nt, Homo sapiens
ccaacccgucuggcccaccagg

SEQ ID NO: 816445 - RNA, 14 nt, Homo sapiens
ccaaccuccugacc

SEQ ID NO: 816446 - RNA, 18 nt, Homo sapiens
ccaaccuggggggcagug

SEQ ID NO: 816447 - RNA, 18 nt, Homo sapiens
ccaaccuuccaaguguaa

SEQ ID NO: 816448 - RNA, 20 nt, Homo sapiens
ccaacgagacacauugccuu

SEQ ID NO: 816449 - RNA, 16 nt, Homo sapiens
ccaacgcacaggaaaa

SEQ ID NO: 816450 - RNA, 15 nt, Homo sapiens
ccaacggcaacagca

SEQ ID NO: 816451 - RNA, 15 nt, Homo sapiens
ccaacuaaucucauu

SEQ ID NO: 816452 - RNA, 15 nt, Homo sapiens
ccaacuagaagccua

SEQ ID NO: 816453 - RNA, 12 nt, Homo sapiens
ccaacuaggcag

SEQ ID NO: 816454 - RNA, 14 nt, Homo sapiens
ccaacucuugcaca

SEQ ID NO: 816455 - RNA, 18 nt, Homo sapiens
ccaacugauguccauuag

SEQ ID NO: 816456 - RNA, 19 nt, Homo sapiens
ccaacugcaaaaaaagccu

SEQ ID NO: 816457 - RNA, 17 nt, Homo sapiens
ccaacuucaauuuacuu

SEQ ID NO: 816458 - RNA, 22 nt, Homo sapiens
ccaacuugguucugcuucaaua

SEQ ID NO: 816459 - RNA, 23 nt, Homo sapiens
ccaacuuuuaaugggauuucaug

SEQ ID NO: 816460 - RNA, 17 nt, Homo sapiens
ccaagaaaugaacuugg

SEQ ID NO: 816461 - RNA, 16 nt, Homo sapiens
ccaagaagugggugcc

SEQ ID NO: 816462 - RNA, 14 nt, Homo sapiens
ccaagaaugagcuu

SEQ ID NO: 816463 - RNA, 13 nt, Homo sapiens
ccaagaauguuau

SEQ ID NO: 816464 - RNA, 15 nt, Homo sapiens
ccaagacaugacauu

SEQ ID NO: 816465 - RNA, 14 nt, Homo sapiens
ccaagacccaacag

SEQ ID NO: 816466 - RNA, 13 nt, Homo sapiens
ccaagacccugug

SEQ ID NO: 816467 - RNA, 16 nt, Homo sapiens
ccaagacucuuuauga

SEQ ID NO: 816468 - RNA, 22 nt, Homo sapiens
ccaagagcagcugggaacugac

SEQ ID NO: 816469 - RNA, 19 nt, Homo sapiens
ccaagaggacugagacugg

SEQ ID NO: 816470 - RNA, 16 nt, Homo sapiens
ccaagagucuaaagau

SEQ ID NO: 816471 - RNA, 18 nt, Homo sapiens
ccaagaguuaaagaccag

SEQ ID NO: 816472 - RNA, 16 nt, Homo sapiens
ccaagauacucuuugu

SEQ ID NO: 816473 - RNA, 17 nt, Homo sapiens
ccaagauugcaccacug

SEQ ID NO: 816474 - RNA, 17 nt, Homo sapiens
ccaagauuuuuuauuug

SEQ ID NO: 816475 - RNA, 19 nt, Homo sapiens
aaaguacaucucuacuaaa

SEQ ID NO: 816476 - RNA, 20 nt, Homo sapiens
aaaguaccacacauauugca

SEQ ID NO: 816477 - RNA, 18 nt, Homo sapiens
aaaguagaauaagccuuc

SEQ ID NO: 816478 - RNA, 22 nt, Homo sapiens
aaaguagucucuccccuggcca

SEQ ID NO: 816479 - RNA, 14 nt, Homo sapiens
aaaguauaugugca

SEQ ID NO: 816480 - RNA, 18 nt, Homo sapiens
aaaguauuuuugauuaac

SEQ ID NO: 816481 - RNA, 13 nt, Homo sapiens
aaagucacccaaa

SEQ ID NO: 816482 - RNA, 15 nt, Homo sapiens
aaagucacccaaaca

SEQ ID NO: 816483 - RNA, 16 nt, Homo sapiens
aaagucacccaaacac

SEQ ID NO: 816484 - RNA, 12 nt, Homo sapiens
aaagucagucuu

SEQ ID NO: 816485 - RNA, 15 nt, Homo sapiens
aaaguccacaguuua

SEQ ID NO: 816486 - RNA, 17 nt, Homo sapiens
aaaguccucugcuccag

SEQ ID NO: 816487 - RNA, 21 nt, Homo sapiens
aaagucuaccccugcuaagga

SEQ ID NO: 816488 - RNA, 14 nt, Homo sapiens
aaagugaaaucaga

SEQ ID NO: 816489 - RNA, 14 nt, Homo sapiens
aaagugacuauuca

SEQ ID NO: 816490 - RNA, 21 nt, Homo sapiens
aaagugacucacuuaucccaa

SEQ ID NO: 816491 - RNA, 23 nt, Homo sapiens
aaagugacucacuuaucccaaga

SEQ ID NO: 816492 - RNA, 20 nt, Homo sapiens
aaagugcugcuggaaguaga

SEQ ID NO: 816493 - RNA, 14 nt, Homo sapiens
aaaguggccaugcc

SEQ ID NO: 816494 - RNA, 14 nt, Homo sapiens
aaaguguaacaauu

SEQ ID NO: 816495 - RNA, 15 nt, Homo sapiens
aaaguuaaacauuga

SEQ ID NO: 816496 - RNA, 15 nt, Homo sapiens
aaaguuacaaacaga

SEQ ID NO: 816497 - RNA, 20 nt, Homo sapiens
aaaguuacugauucacugca

SEQ ID NO: 816498 - RNA, 21 nt, Homo sapiens
aaaguuacugauucacugcau

SEQ ID NO: 816499 - RNA, 12 nt, Homo sapiens
aaaguuacugua

SEQ ID NO: 816500 - RNA, 19 nt, Homo sapiens
aaaguuacuugaauuucaa

SEQ ID NO: 816501 - RNA, 21 nt, Homo sapiens
aaaguuagucaauccugucau

SEQ ID NO: 816502 - RNA, 13 nt, Homo sapiens
aaaguuauugaua

SEQ ID NO: 816503 - RNA, 15 nt, Homo sapiens
aaaguucaauacucu

SEQ ID NO: 816504 - RNA, 22 nt, Homo sapiens
aaaguucagggaccguccaggg

SEQ ID NO: 816505 - RNA, 14 nt, Homo sapiens
aaaguugcugugaa

SEQ ID NO: 816506 - RNA, 20 nt, Homo sapiens
aaaguuggugcaucuagaaa

SEQ ID NO: 816507 - RNA, 23 nt, Homo sapiens
aaaguuuuauaacuuguguuauu

SEQ ID NO: 816508 - RNA, 19 nt, Homo sapiens
aaaguuuugcaacaauaaa

SEQ ID NO: 816509 - RNA, 16 nt, Homo sapiens
aaaguuuugucagaaa

SEQ ID NO: 816510 - RNA, 14 nt, Homo sapiens
aaauaaaaacccaa

SEQ ID NO: 816511 - RNA, 13 nt, Homo sapiens
aaauaaaaagaga

SEQ ID NO: 816512 - RNA, 22 nt, Homo sapiens
aaauaaaaagugacacagcagc

SEQ ID NO: 816513 - RNA, 20 nt, Homo sapiens
aaauaaaaaucucuuuucca

SEQ ID NO: 816514 - RNA, 17 nt, Homo sapiens
aaauaaaacaucaccua

SEQ ID NO: 816515 - RNA, 17 nt, Homo sapiens
aaauaaaaggacuguga

SEQ ID NO: 816516 - RNA, 16 nt, Homo sapiens
aaauaaaauauucacu

SEQ ID NO: 816517 - RNA, 13 nt, Homo sapiens
aaauaaacauguu

SEQ ID NO: 816518 - RNA, 22 nt, Homo sapiens
aaauaaagcguccucucaguaa

SEQ ID NO: 816519 - RNA, 17 nt, Homo sapiens
aaauaaagucaucagca

SEQ ID NO: 816520 - RNA, 19 nt, Homo sapiens
aaauaaauucugacuuaug

SEQ ID NO: 816521 - RNA, 15 nt, Homo sapiens
aaauaacaggcauuu

SEQ ID NO: 816522 - RNA, 13 nt, Homo sapiens
aaauaacuggaaa

SEQ ID NO: 816523 - RNA, 17 nt, Homo sapiens
aaauaagcauguuuuca

SEQ ID NO: 816524 - RNA, 18 nt, Homo sapiens
aaauaagcucuccccaaa

SEQ ID NO: 816525 - RNA, 19 nt, Homo sapiens
aaauaaguggaaaccgugu

SEQ ID NO: 816526 - RNA, 14 nt, Homo sapiens
aaauaaguguuuua

SEQ ID NO: 816527 - RNA, 19 nt, Homo sapiens
aaauaauaaacaguggaau

SEQ ID NO: 816528 - RNA, 14 nt, Homo sapiens
aaauaauaacaauc

SEQ ID NO: 816529 - RNA, 19 nt, Homo sapiens
aaauaauaacaaucacaaa

SEQ ID NO: 816530 - RNA, 12 nt, Homo sapiens
aaauaauaugca

SEQ ID NO: 816531 - RNA, 13 nt, Homo sapiens
aaauaaucugaca

SEQ ID NO: 816532 - RNA, 14 nt, Homo sapiens
aaauaaugaauaca

SEQ ID NO: 816533 - RNA, 21 nt, Homo sapiens
aaauaauugcuccuauacuau

SEQ ID NO: 816534 - RNA, 15 nt, Homo sapiens
aaauacaaaaagcaa

SEQ ID NO: 816535 - RNA, 18 nt, Homo sapiens
aaauacaacacugauacu

SEQ ID NO: 816536 - RNA, 11 nt, Homo sapiens
aaauacaauaa

SEQ ID NO: 816537 - RNA, 12 nt, Homo sapiens
aaauacaaucag

SEQ ID NO: 816538 - RNA, 22 nt, Homo sapiens
aaauacaaucagcccagugcaa

SEQ ID NO: 816539 - RNA, 14 nt, Homo sapiens
aaauacacaacaca

SEQ ID NO: 816540 - RNA, 14 nt, Homo sapiens
aaauacacauagca

SEQ ID NO: 816541 - RNA, 12 nt, Homo sapiens
aaauacagauuu

SEQ ID NO: 816542 - RNA, 19 nt, Homo sapiens
aaauacagcugcacugagg

SEQ ID NO: 816543 - RNA, 13 nt, Homo sapiens
aaauacaugcaca

SEQ ID NO: 816544 - RNA, 17 nt, Homo sapiens
aaauaccacaagccuga

SEQ ID NO: 816545 - RNA, 18 nt, Homo sapiens
aaauaccagagccuucaa

SEQ ID NO: 816546 - RNA, 19 nt, Homo sapiens
aaauacccacuaacaaaga

SEQ ID NO: 816547 - RNA, 18 nt, Homo sapiens
aaauaccuuggcugaugu

SEQ ID NO: 816548 - RNA, 22 nt, Homo sapiens
aaauacgaaguggagauuuaca

SEQ ID NO: 816549 - RNA, 20 nt, Homo sapiens
aaauacgguaaggauacuuu

SEQ ID NO: 816550 - RNA, 14 nt, Homo sapiens
aaauacucugcuau

SEQ ID NO: 816551 - RNA, 17 nt, Homo sapiens
aaauacuggacucagga

SEQ ID NO: 816552 - RNA, 12 nt, Homo sapiens
aaauacugucaa

SEQ ID NO: 816553 - RNA, 19 nt, Homo sapiens
aaauacuucuugaagccga

SEQ ID NO: 816554 - RNA, 20 nt, Homo sapiens
aaauagaaaauaugaccaga

SEQ ID NO: 816555 - RNA, 18 nt, Homo sapiens
aaauagaaaccauuuuca

SEQ ID NO: 816556 - RNA, 14 nt, Homo sapiens
aaauagaccucuca

SEQ ID NO: 816557 - RNA, 15 nt, Homo sapiens
aaauagaggcuaaau

SEQ ID NO: 816558 - RNA, 20 nt, Homo sapiens
aaauagaguaaauacaggua

SEQ ID NO: 816559 - RNA, 14 nt, Homo sapiens
aaauagcagcuuua

SEQ ID NO: 816560 - RNA, 11 nt, Homo sapiens
aaauagcagua

SEQ ID NO: 816561 - RNA, 12 nt, Homo sapiens
aaauagccacaa

SEQ ID NO: 816562 - RNA, 14 nt, Homo sapiens
aaauagccccagac

SEQ ID NO: 816563 - RNA, 19 nt, Homo sapiens
aaauagggaagauggagac

SEQ ID NO: 816564 - RNA, 21 nt, Homo sapiens
aaauaguauacauugucuuga

SEQ ID NO: 816565 - RNA, 13 nt, Homo sapiens
aaauagucuucca

SEQ ID NO: 816566 - RNA, 17 nt, Homo sapiens
aaauagucuuccacaaa

SEQ ID NO: 816567 - RNA, 21 nt, Homo sapiens
aaauaguguaagaacuguaca

SEQ ID NO: 816568 - RNA, 16 nt, Homo sapiens
aaauaguguacacaga

SEQ ID NO: 816569 - RNA, 16 nt, Homo sapiens
aaauaguuaccuucaa

SEQ ID NO: 816570 - RNA, 16 nt, Homo sapiens
aaauaguugcauagca

SEQ ID NO: 816571 - RNA, 15 nt, Homo sapiens
aaauauaauaugcac

SEQ ID NO: 816572 - RNA, 13 nt, Homo sapiens
aaauauagccaaa

SEQ ID NO: 816573 - RNA, 14 nt, Homo sapiens
aaauauauauguca

SEQ ID NO: 816574 - RNA, 16 nt, Homo sapiens
aaauauauaugucaau

SEQ ID NO: 816575 - RNA, 14 nt, Homo sapiens
aaauauauaugugu

SEQ ID NO: 816576 - RNA, 18 nt, Homo sapiens
aaauauauuuuggaaaac

SEQ ID NO: 816577 - RNA, 19 nt, Homo sapiens
aaauaucaguauucugaca

SEQ ID NO: 816578 - RNA, 16 nt, Homo sapiens
aaauaucauuuacucu

SEQ ID NO: 816579 - RNA, 22 nt, Homo sapiens
aaauauccaagauuuaaaugcc

SEQ ID NO: 816580 - RNA, 16 nt, Homo sapiens
aaauaucugaaaugug

SEQ ID NO: 816581 - RNA, 22 nt, Homo sapiens
aaauaugagaugcguuguuaca

SEQ ID NO: 816582 - RNA, 21 nt, Homo sapiens
aaauaugauuuuauuugacaa

SEQ ID NO: 816583 - RNA, 19 nt, Homo sapiens
aaauauguugaguguucau

SEQ ID NO: 816584 - RNA, 19 nt, Homo sapiens
aaauauuagaagccugcag

SEQ ID NO: 816585 - RNA, 16 nt, Homo sapiens
aaauauuauugguguu

SEQ ID NO: 816586 - RNA, 16 nt, Homo sapiens
aaauauucacucucca

SEQ ID NO: 816587 - RNA, 15 nt, Homo sapiens
aaauauugacucaaa

SEQ ID NO: 816588 - RNA, 18 nt, Homo sapiens
aaauauugcugugucuuc

SEQ ID NO: 816589 - RNA, 20 nt, Homo sapiens
aaauauugcugugucuucau

SEQ ID NO: 816590 - RNA, 15 nt, Homo sapiens
aaauauuuaugagaa

SEQ ID NO: 816591 - RNA, 21 nt, Homo sapiens
aaaaugcuaaacaacugggua

SEQ ID NO: 816592 - RNA, 14 nt, Homo sapiens
aaaaugcuacuuaa

SEQ ID NO: 816593 - RNA, 15 nt, Homo sapiens
aaaaugcucuugucc

SEQ ID NO: 816594 - RNA, 14 nt, Homo sapiens
aaaauggagccaug

SEQ ID NO: 816595 - RNA, 19 nt, Homo sapiens
aaaauggaggccauugugu

SEQ ID NO: 816596 - RNA, 21 nt, Homo sapiens
aaaauggcaaagaauucaaac

SEQ ID NO: 816597 - RNA, 22 nt, Homo sapiens
aaaauggucauccaaacucaaa

SEQ ID NO: 816598 - RNA, 22 nt, Homo sapiens
aaaauguacccgagcacauaga

SEQ ID NO: 816599 - RNA, 16 nt, Homo sapiens
aaaauguccugccuuu

SEQ ID NO: 816600 - RNA, 23 nt, Homo sapiens
aaaaugucuaagauaguaacaau

SEQ ID NO: 816601 - RNA, 16 nt, Homo sapiens
aaaaugucuguuucaa

SEQ ID NO: 816602 - RNA, 20 nt, Homo sapiens
aaaauguuugguuucaggua

SEQ ID NO: 816603 - RNA, 16 nt, Homo sapiens
aaaauuaaaaccaauu

SEQ ID NO: 816604 - RNA, 19 nt, Homo sapiens
aaaauuagagaucaugaau

SEQ ID NO: 816605 - RNA, 13 nt, Homo sapiens
aaaauuagugagu

SEQ ID NO: 816606 - RNA, 17 nt, Homo sapiens
aaaauuaucaauaucua

SEQ ID NO: 816607 - RNA, 13 nt, Homo sapiens
aaaauuauuugcu

SEQ ID NO: 816608 - RNA, 13 nt, Homo sapiens
aaaauucaaagca

SEQ ID NO: 816609 - RNA, 17 nt, Homo sapiens
aaaauucagagaguuag

SEQ ID NO: 816610 - RNA, 18 nt, Homo sapiens
aaaauucauaaccaaaga

SEQ ID NO: 816611 - RNA, 18 nt, Homo sapiens
aaaauucauuucuaauua

SEQ ID NO: 816612 - RNA, 20 nt, Homo sapiens
aaaauucuauguuaauuaca

SEQ ID NO: 816613 - RNA, 15 nt, Homo sapiens
aaaauugacaaugau

SEQ ID NO: 816614 - RNA, 20 nt, Homo sapiens
aaaauuggaacucuacucaa

SEQ ID NO: 816615 - RNA, 17 nt, Homo sapiens
aaaauugugaucagacc

SEQ ID NO: 816616 - RNA, 19 nt, Homo sapiens
aaaauuguuuagugauauu

SEQ ID NO: 816617 - RNA, 21 nt, Homo sapiens
aaaauuuaggaccaauaccuc

SEQ ID NO: 816618 - RNA, 18 nt, Homo sapiens
aaaauuucguuguccaau

SEQ ID NO: 816619 - RNA, 18 nt, Homo sapiens
aaaauuugaaauuuagcu

SEQ ID NO: 816620 - RNA, 18 nt, Homo sapiens
aaaauuuguuuugacgga

SEQ ID NO: 816621 - RNA, 19 nt, Homo sapiens
aaaauuuuaaugcauuguu

SEQ ID NO: 816622 - RNA, 23 nt, Homo sapiens
aaaauuuuggucauagcauucac

SEQ ID NO: 816623 - RNA, 17 nt, Homo sapiens
aaaauuuuuaaauauuc

SEQ ID NO: 816624 - RNA, 16 nt, Homo sapiens
aaaauuuuuacauuca

SEQ ID NO: 816625 - RNA, 16 nt, Homo sapiens
aaacaaaaaggaaaug

SEQ ID NO: 816626 - RNA, 21 nt, Homo sapiens
aaacaaaacccucagcacugu

SEQ ID NO: 816627 - RNA, 18 nt, Homo sapiens
aaacaaaagcaaagaugc

SEQ ID NO: 816628 - RNA, 20 nt, Homo sapiens
aaacaaaauggguuacuuga

SEQ ID NO: 816629 - RNA, 12 nt, Homo sapiens
aaacaaaccauc

SEQ ID NO: 816630 - RNA, 13 nt, Homo sapiens
aaacaaauaugca

SEQ ID NO: 816631 - RNA, 14 nt, Homo sapiens
aaacaaauaugcaa

SEQ ID NO: 816632 - RNA, 15 nt, Homo sapiens
aaacaacuaccuccu

SEQ ID NO: 816633 - RNA, 21 nt, Homo sapiens
aaacaacuuauuuuuguucau

SEQ ID NO: 816634 - RNA, 20 nt, Homo sapiens
aaacaacuucaauauccaaa

SEQ ID NO: 816635 - RNA, 13 nt, Homo sapiens
aaacaacuuugua

SEQ ID NO: 816636 - RNA, 19 nt, Homo sapiens
aaacaagaggacuguguug

SEQ ID NO: 816637 - RNA, 19 nt, Homo sapiens
aaacaagcagguguuuaua

SEQ ID NO: 816638 - RNA, 15 nt, Homo sapiens
aaacaaggaagccaa

SEQ ID NO: 816639 - RNA, 17 nt, Homo sapiens
aaacaauauguuugcaa

SEQ ID NO: 816640 - RNA, 11 nt, Homo sapiens
aaacaaugcca

SEQ ID NO: 816641 - RNA, 15 nt, Homo sapiens
aaacaauucugugac

SEQ ID NO: 816642 - RNA, 19 nt, Homo sapiens
aaacaauuggcaaacuuug

SEQ ID NO: 816643 - RNA, 15 nt, Homo sapiens
aaacacaaaccacaa

SEQ ID NO: 816644 - RNA, 21 nt, Homo sapiens
aaacacacgagcaaacccaga

SEQ ID NO: 816645 - RNA, 22 nt, Homo sapiens
aaacacauacaggaagguagaa

SEQ ID NO: 816646 - RNA, 20 nt, Homo sapiens
aaacacauguuuuuauacaa

SEQ ID NO: 816647 - RNA, 16 nt, Homo sapiens
aaacacccaugcuauc

SEQ ID NO: 816648 - RNA, 22 nt, Homo sapiens
aaacaccuagcuuuauucuuca

SEQ ID NO: 816649 - RNA, 13 nt, Homo sapiens
aaacacuagcucu

SEQ ID NO: 816650 - RNA, 22 nt, Homo sapiens
aaacacuauuuccaaaagcaca

SEQ ID NO: 816651 - RNA, 12 nt, Homo sapiens
aaacacugccau

SEQ ID NO: 816652 - RNA, 15 nt, Homo sapiens
aaagaaaaaugccug

SEQ ID NO: 816653 - RNA, 15 nt, Homo sapiens
aaagaaagaaggaag

SEQ ID NO: 816654 - RNA, 16 nt, Homo sapiens
aaagaaagcugagaag

SEQ ID NO: 816655 - RNA, 18 nt, Homo sapiens
aaagaaauacaguacugu

SEQ ID NO: 816656 - RNA, 12 nt, Homo sapiens
aaagaaaugcau

SEQ ID NO: 816657 - RNA, 16 nt, Homo sapiens
aaagaaaugcccaucu

SEQ ID NO: 816658 - RNA, 16 nt, Homo sapiens
aaagaaauuuugccug

SEQ ID NO: 816659 - RNA, 23 nt, Homo sapiens
aaagaagagaugagaaaugauga

SEQ ID NO: 816660 - RNA, 13 nt, Homo sapiens
aaagaagccacag

SEQ ID NO: 816661 - RNA, 12 nt, Homo sapiens
aaagaagccagc

SEQ ID NO: 816662 - RNA, 22 nt, Homo sapiens
aaagaagcugcuguucuuagca

SEQ ID NO: 816663 - RNA, 22 nt, Homo sapiens
aaagaaggaauucuaggcaucc

SEQ ID NO: 816664 - RNA, 23 nt, Homo sapiens
aaagaaggcauuugcaggguccu

SEQ ID NO: 816665 - RNA, 15 nt, Homo sapiens
aaagaaguacuuuau

SEQ ID NO: 816666 - RNA, 20 nt, Homo sapiens
aaagaaguacuuuauugcaa

SEQ ID NO: 816667 - RNA, 19 nt, Homo sapiens
aaagaagucauggcccaaa

SEQ ID NO: 816668 - RNA, 24 nt, Homo sapiens
aaagaaguugcuaagugugcuuag

SEQ ID NO: 816669 - RNA, 17 nt, Homo sapiens
aaagaauaaaguccaaa

SEQ ID NO: 816670 - RNA, 22 nt, Homo sapiens
aaagaauaauaugcugccaaau

SEQ ID NO: 816671 - RNA, 14 nt, Homo sapiens
aaagaaucacagua

SEQ ID NO: 816672 - RNA, 20 nt, Homo sapiens
aaagaaucacaguacuuucc

SEQ ID NO: 816673 - RNA, 19 nt, Homo sapiens
aaagaaucucuugagacau

SEQ ID NO: 816674 - RNA, 22 nt, Homo sapiens
aaagaauuggccaggcauggug

SEQ ID NO: 816675 - RNA, 13 nt, Homo sapiens
aaagaauuugcac

SEQ ID NO: 816676 - RNA, 17 nt, Homo sapiens
aaagacacaaaaaaaga

SEQ ID NO: 816677 - RNA, 16 nt, Homo sapiens
aaagacagaagcuuaa

SEQ ID NO: 816678 - RNA, 13 nt, Homo sapiens
aaagacaucaaac

SEQ ID NO: 816679 - RNA, 12 nt, Homo sapiens
aaagacaucaau

SEQ ID NO: 816680 - RNA, 11 nt, Homo sapiens
aaagacaucag

SEQ ID NO: 816681 - RNA, 12 nt, Homo sapiens
aaagacaucagu

SEQ ID NO: 816682 - RNA, 17 nt, Homo sapiens
aaagacauucuuccaaa

SEQ ID NO: 816683 - RNA, 20 nt, Homo sapiens
aaagaccagggcuuuuccca

SEQ ID NO: 816684 - RNA, 14 nt, Homo sapiens
aaagaccuugcuua

SEQ ID NO: 816685 - RNA, 15 nt, Homo sapiens
aaagacguucccuuu

SEQ ID NO: 816686 - RNA, 21 nt, Homo sapiens
aaagacguucuuuugcauaaa

SEQ ID NO: 816687 - RNA, 14 nt, Homo sapiens
aaagacuccaaaga

SEQ ID NO: 816688 - RNA, 14 nt, Homo sapiens
aaagacucugacca

SEQ ID NO: 816689 - RNA, 20 nt, Homo sapiens
aaagacucuuaaugcagacu

SEQ ID NO: 816690 - RNA, 23 nt, Homo sapiens
aaagacugaaucuaccugcccua

SEQ ID NO: 816691 - RNA, 19 nt, Homo sapiens
aaagacuguacaaaguaga

SEQ ID NO: 816692 - RNA, 11 nt, Homo sapiens
aaagacuguag

SEQ ID NO: 816693 - RNA, 17 nt, Homo sapiens
aaagagacuccgucuca

SEQ ID NO: 816694 - RNA, 21 nt, Homo sapiens
aaagagcaacaauccaucucu

SEQ ID NO: 816695 - RNA, 20 nt, Homo sapiens
aaagagcgucauguccuugg

SEQ ID NO: 816696 - RNA, 15 nt, Homo sapiens
aaagaggcugccccu

SEQ ID NO: 816697 - RNA, 22 nt, Homo sapiens
aaagaggcugccccucucacca

SEQ ID NO: 816698 - RNA, 14 nt, Homo sapiens
aaagagggcuuccu

SEQ ID NO: 816699 - RNA, 18 nt, Homo sapiens
aaagaguauauguucccu

SEQ ID NO: 816700 - RNA, 17 nt, Homo sapiens
aaagauacagacauuca

SEQ ID NO: 816701 - RNA, 20 nt, Homo sapiens
aaagauauaugaauaugaca

SEQ ID NO: 816702 - RNA, 21 nt, Homo sapiens
aaagaucuuucaggacucuac

SEQ ID NO: 816703 - RNA, 21 nt, Homo sapiens
aaagaugcagaguaaguauua

SEQ ID NO: 816704 - RNA, 16 nt, Homo sapiens
aaagaugcauuuucac

SEQ ID NO: 816705 - RNA, 12 nt, Homo sapiens
aaagaugguuua

SEQ ID NO: 816706 - RNA, 15 nt, Homo sapiens
aaagauguauuugaa

SEQ ID NO: 816707 - RNA, 22 nt, Homo sapiens
cagcaaagggaggaggugcaca

SEQ ID NO: 816708 - RNA, 18 nt, Homo sapiens
cagcaacaggaaucucag

SEQ ID NO: 816709 - RNA, 16 nt, Homo sapiens
cagcaaccccugcaug

SEQ ID NO: 816710 - RNA, 20 nt, Homo sapiens
cagcaacugcccuuccaggu

SEQ ID NO: 816711 - RNA, 17 nt, Homo sapiens
cagcaagcacugugguc

SEQ ID NO: 816712 - RNA, 21 nt, Homo sapiens
cagcaaggccuugguggagca

SEQ ID NO: 816713 - RNA, 21 nt, Homo sapiens
cagcaagggaccugcucauca

SEQ ID NO: 816714 - RNA, 21 nt, Homo sapiens
cagcaagguggccacaguguc

SEQ ID NO: 816715 - RNA, 17 nt, Homo sapiens
cagcaauuucagaacca

SEQ ID NO: 816716 - RNA, 21 nt, Homo sapiens
cagcacacacaguggauucca

SEQ ID NO: 816717 - RNA, 22 nt, Homo sapiens
cagcacaguggcggcaacauug

SEQ ID NO: 816718 - RNA, 15 nt, Homo sapiens
cagcacaguuuuuaa

SEQ ID NO: 816719 - RNA, 16 nt, Homo sapiens
cagcaccaaccacagc

SEQ ID NO: 816720 - RNA, 13 nt, Homo sapiens
cagcaccagugaa

SEQ ID NO: 816721 - RNA, 21 nt, Homo sapiens
cagcaccaucucuuuaccucc

SEQ ID NO: 816722 - RNA, 17 nt, Homo sapiens
cagcaccuccuccaugc

SEQ ID NO: 816723 - RNA, 14 nt, Homo sapiens
cagcacggcccuga

SEQ ID NO: 816724 - RNA, 10 nt, Homo sapiens
cagcacuaac

SEQ ID NO: 816725 - RNA, 22 nt, Homo sapiens
cagcacuguuacaagaggccau

SEQ ID NO: 816726 - RNA, 16 nt, Homo sapiens
cagcacuuguguuguc

SEQ ID NO: 816727 - RNA, 18 nt, Homo sapiens
cagcacuuguguugucug

SEQ ID NO: 816728 - RNA, 13 nt, Homo sapiens
cagaaacuacuga

SEQ ID NO: 816729 - RNA, 12 nt, Homo sapiens
cagaaagaucuu

SEQ ID NO: 816730 - RNA, 14 nt, Homo sapiens
cagaaagauuuucc

SEQ ID NO: 816731 - RNA, 16 nt, Homo sapiens
cagaaagcaucccuca

SEQ ID NO: 816732 - RNA, 17 nt, Homo sapiens
cagaaagcauccuaaau

SEQ ID NO: 816733 - RNA, 20 nt, Homo sapiens
cagaaagcuccuuccagacc

SEQ ID NO: 816734 - RNA, 20 nt, Homo sapiens
cagaaagugauaagugcagg

SEQ ID NO: 816735 - RNA, 18 nt, Homo sapiens
cagaaaguucaacuucca

SEQ ID NO: 816736 - RNA, 16 nt, Homo sapiens
cagaaauccugcaaug

SEQ ID NO: 816737 - RNA, 19 nt, Homo sapiens
cagaaauccugcaaugaaa

SEQ ID NO: 816738 - RNA, 14 nt, Homo sapiens
cagaaauuguauau

SEQ ID NO: 816739 - RNA, 18 nt, Homo sapiens
cagaaauugugugugcaa

SEQ ID NO: 816740 - RNA, 22 nt, Homo sapiens
cagaacaccugaggacaggagu

SEQ ID NO: 816741 - RNA, 17 nt, Homo sapiens
cagaacacuuauguuau

SEQ ID NO: 816742 - RNA, 19 nt, Homo sapiens
cagaacacuuauguuauac

SEQ ID NO: 816743 - RNA, 20 nt, Homo sapiens
cagaacacuuauguuauaca

SEQ ID NO: 816744 - RNA, 22 nt, Homo sapiens
cagaacaguggcucguauccca

SEQ ID NO: 816745 - RNA, 16 nt, Homo sapiens
cagaaccaaagcucaa

SEQ ID NO: 816746 - RNA, 11 nt, Homo sapiens
cagaaccacua

SEQ ID NO: 816747 - RNA, 16 nt, Homo sapiens
cagaacccagauuucc

SEQ ID NO: 816748 - RNA, 18 nt, Homo sapiens
cagaacucaaaugagccc

SEQ ID NO: 816749 - RNA, 18 nt, Homo sapiens
cagaacuggacucaggau

SEQ ID NO: 816750 - RNA, 17 nt, Homo sapiens
cagaacuguuggcugcu

SEQ ID NO: 816751 - RNA, 23 nt, Homo sapiens
cagaacuucacagugacacugga

SEQ ID NO: 816752 - RNA, 18 nt, Homo sapiens
cagaacuucaggugugac

SEQ ID NO: 816753 - RNA, 15 nt, Homo sapiens
cagaacuuccaaaga

SEQ ID NO: 816754 - RNA, 14 nt, Homo sapiens
cagaacuugaaugu

SEQ ID NO: 816755 - RNA, 14 nt, Homo sapiens
cagaagacaaaaag

SEQ ID NO: 816756 - RNA, 19 nt, Homo sapiens
cagaagagaaaggacucag

SEQ ID NO: 816757 - RNA, 23 nt, Homo sapiens
cagaagagguugggcuuccaugc

SEQ ID NO: 816758 - RNA, 19 nt, Homo sapiens
cagaagaugccagcuucuc

SEQ ID NO: 816759 - RNA, 15 nt, Homo sapiens
cagaagcagaccuca

SEQ ID NO: 816760 - RNA, 17 nt, Homo sapiens
cagaagcagguucuuga

SEQ ID NO: 816761 - RNA, 21 nt, Homo sapiens
cagaagcagguucuugauguc

SEQ ID NO: 816762 - RNA, 16 nt, Homo sapiens
cagaagccuuugauau

SEQ ID NO: 816763 - RNA, 15 nt, Homo sapiens
cagaagcugcuccuu

SEQ ID NO: 816764 - RNA, 21 nt, Homo sapiens
cagaagcuuccugagcuucaa

SEQ ID NO: 816765 - RNA, 20 nt, Homo sapiens
cagaaggagaugcugcugag

SEQ ID NO: 816766 - RNA, 15 nt, Homo sapiens
cagaaggaucuucau

SEQ ID NO: 816767 - RNA, 20 nt, Homo sapiens
cagaaggauuaccugaggca

SEQ ID NO: 816768 - RNA, 16 nt, Homo sapiens
cagaagggaauugcuc

SEQ ID NO: 816769 - RNA, 15 nt, Homo sapiens
cagaaggggguggug

SEQ ID NO: 816770 - RNA, 14 nt, Homo sapiens
cagaagguauuccu

SEQ ID NO: 816771 - RNA, 22 nt, Homo sapiens
cagaaggugccacuuuacccac

SEQ ID NO: 816772 - RNA, 15 nt, Homo sapiens
cagaagguugcucua

SEQ ID NO: 816773 - RNA, 12 nt, Homo sapiens
cagaagugcucu

SEQ ID NO: 816774 - RNA, 19 nt, Homo sapiens
cagaauacaguaagcugcu

SEQ ID NO: 816775 - RNA, 22 nt, Homo sapiens
cagaauacgggucccucuaacc

SEQ ID NO: 816776 - RNA, 11 nt, Homo sapiens
cagaauacugg

SEQ ID NO: 816777 - RNA, 14 nt, Homo sapiens
cagaauagcacaaa

SEQ ID NO: 816778 - RNA, 22 nt, Homo sapiens
cagaauaggaaaacauugcaau

SEQ ID NO: 816779 - RNA, 18 nt, Homo sapiens
cagaauauacccauccau

SEQ ID NO: 816780 - RNA, 21 nt, Homo sapiens
cagaauccauaaauguguucc

SEQ ID NO: 816781 - RNA, 19 nt, Homo sapiens
cagaauguuguacuugaaa

SEQ ID NO: 816782 - RNA, 13 nt, Homo sapiens
cagaauucuucag

SEQ ID NO: 816783 - RNA, 16 nt, Homo sapiens
cagaauugagagugau

SEQ ID NO: 816784 - RNA, 19 nt, Homo sapiens
cagacaacauuaugaucua

SEQ ID NO: 816785 - RNA, 17 nt, Homo sapiens
cagacaauaaaauggaa

SEQ ID NO: 816786 - RNA, 15 nt, Homo sapiens
cagacacaacccaau

SEQ ID NO: 816787 - RNA, 22 nt, Homo sapiens
cagacacacacacgcacgcaca

SEQ ID NO: 816788 - RNA, 14 nt, Homo sapiens
cagacacacccaca

SEQ ID NO: 816789 - RNA, 18 nt, Homo sapiens
cagacacaugcuauguuc

SEQ ID NO: 816790 - RNA, 22 nt, Homo sapiens
cagacacccagaauguagcauc

SEQ ID NO: 816791 - RNA, 21 nt, Homo sapiens
cagacacuggcguuacugcuu

SEQ ID NO: 816792 - RNA, 15 nt, Homo sapiens
cagacauucaaugaa

SEQ ID NO: 816793 - RNA, 20 nt, Homo sapiens
cagacauucauugucccuga

SEQ ID NO: 816794 - RNA, 14 nt, Homo sapiens
cagaccacuugcca

SEQ ID NO: 816795 - RNA, 23 nt, Homo sapiens
cagacccacugaaaugaccaaga

SEQ ID NO: 816796 - RNA, 23 nt, Homo sapiens
cagacccagcuuagaguucuucu

SEQ ID NO: 816797 - RNA, 22 nt, Homo sapiens
cagacccaguggacucuuccac

SEQ ID NO: 816798 - RNA, 23 nt, Homo sapiens
cagacccccccauuucccgcaca

SEQ ID NO: 816799 - RNA, 17 nt, Homo sapiens
cagaccugaaugcuucu

SEQ ID NO: 816800 - RNA, 23 nt, Homo sapiens
cagaccuugggggaagacuuuaa

SEQ ID NO: 816801 - RNA, 15 nt, Homo sapiens
cagacgagcagugac

SEQ ID NO: 816802 - RNA, 16 nt, Homo sapiens
cagacgggcacacaga

SEQ ID NO: 816803 - RNA, 16 nt, Homo sapiens
cagacggugugcacca

SEQ ID NO: 816804 - RNA, 12 nt, Homo sapiens
cagacgugugac

SEQ ID NO: 816805 - RNA, 19 nt, Homo sapiens
cagacuaucguaaccuggu

SEQ ID NO: 816806 - RNA, 16 nt, Homo sapiens
cagacucaguuuguca

SEQ ID NO: 816807 - RNA, 16 nt, Homo sapiens
cagacuccagccugaa

SEQ ID NO: 816808 - RNA, 15 nt, Homo sapiens
cagacuccugugcaa

SEQ ID NO: 816809 - RNA, 15 nt, Homo sapiens
cagacucgggaccaa

SEQ ID NO: 816810 - RNA, 13 nt, Homo sapiens
cagacucuuggcu

SEQ ID NO: 816811 - RNA, 15 nt, Homo sapiens
cagacugcugcuaga

SEQ ID NO: 816812 - RNA, 21 nt, Homo sapiens
cagacugugucuuauucuccc

SEQ ID NO: 816813 - RNA, 13 nt, Homo sapiens
cagacuuaaauca

SEQ ID NO: 816814 - RNA, 19 nt, Homo sapiens
cagacuucaagaccauccu

SEQ ID NO: 816815 - RNA, 17 nt, Homo sapiens
cagacuucacacugcaa

SEQ ID NO: 816816 - RNA, 15 nt, Homo sapiens
cagacuucaucuuca

SEQ ID NO: 816817 - RNA, 14 nt, Homo sapiens
cagacuucccugaa

SEQ ID NO: 816818 - RNA, 14 nt, Homo sapiens
cagacuugaauaca

SEQ ID NO: 816819 - RNA, 15 nt, Homo sapiens
cagacuugcacugaa

SEQ ID NO: 816820 - RNA, 18 nt, Homo sapiens
cagacuuuaaaauucuaa

SEQ ID NO: 816821 - RNA, 20 nt, Homo sapiens
cagacuuuuguguaaaaagc

SEQ ID NO: 816822 - RNA, 21 nt, Homo sapiens
cagagaaaauaauuaauuuca

SEQ ID NO: 816823 - RNA, 23 nt, Homo sapiens
cagagaaaggggagcccacuguc

SEQ ID NO: 816824 - RNA, 16 nt, Homo sapiens
cagagaaauacuuuca

SEQ ID NO: 816825 - RNA, 15 nt, Homo sapiens
cagagaaaucugcau

SEQ ID NO: 816826 - RNA, 15 nt, Homo sapiens
cagagaaccaaaggg

SEQ ID NO: 816827 - RNA, 20 nt, Homo sapiens
cagagaacuggaaagacaua

SEQ ID NO: 816828 - RNA, 22 nt, Homo sapiens
cagagaagauaauguucuuuaa

SEQ ID NO: 816829 - RNA, 21 nt, Homo sapiens
cagagaaggaaaagacugaau

SEQ ID NO: 816830 - RNA, 20 nt, Homo sapiens
cagagaaggccuuacagaaa

SEQ ID NO: 816831 - RNA, 16 nt, Homo sapiens
cagagaaugcaccucu

SEQ ID NO: 816832 - RNA, 19 nt, Homo sapiens
cagagacaggcccaagaga

SEQ ID NO: 816833 - RNA, 13 nt, Homo sapiens
cagagacauacuu

SEQ ID NO: 816834 - RNA, 19 nt, Homo sapiens
cagagaccacaccacuaac

SEQ ID NO: 816835 - RNA, 15 nt, Homo sapiens
cagagaccagcacuc

SEQ ID NO: 816836 - RNA, 22 nt, Homo sapiens
cagagaccagcacucagccuca

SEQ ID NO: 816837 - RNA, 14 nt, Homo sapiens
cagagacccaacag

SEQ ID NO: 816838 - RNA, 21 nt, Homo sapiens
cagagacccagaucucaugga

SEQ ID NO: 816839 - RNA, 14 nt, Homo sapiens
cagagaccuaugua

SEQ ID NO: 816840 - RNA, 16 nt, Homo sapiens
cagagacugaauagau

SEQ ID NO: 816841 - RNA, 16 nt, Homo sapiens
cagagacugucccuga

SEQ ID NO: 816842 - RNA, 20 nt, Homo sapiens
cagagagagagaaggcagca

SEQ ID NO: 816843 - RNA, 21 nt, Homo sapiens
cagagagcugcccuucagcga

SEQ ID NO: 816844 - RNA, 19 nt, Homo sapiens
cagagaggggcagguugac

SEQ ID NO: 816845 - RNA, 15 nt, Homo sapiens
cagagauccaaaaga

SEQ ID NO: 816846 - RNA, 20 nt, Homo sapiens
cagagaucguguauugagau

SEQ ID NO: 816847 - RNA, 20 nt, Homo sapiens
cagagaugcaaugauaguua

SEQ ID NO: 816848 - RNA, 16 nt, Homo sapiens
cagagauguacugcaa

SEQ ID NO: 816849 - RNA, 20 nt, Homo sapiens
cagagcaagaccccaucuca

SEQ ID NO: 816850 - RNA, 20 nt, Homo sapiens
cagagcaagacuccaucuca

SEQ ID NO: 816851 - RNA, 14 nt, Homo sapiens
cagagcaagacugu

SEQ ID NO: 816852 - RNA, 12 nt, Homo sapiens
cagagcacagau

SEQ ID NO: 816853 - RNA, 17 nt, Homo sapiens
cagagcacauuugucag

SEQ ID NO: 816854 - RNA, 17 nt, Homo sapiens
cagagcacccccugcuc

SEQ ID NO: 816855 - RNA, 17 nt, Homo sapiens
cagagcagaugaggaaa

SEQ ID NO: 816856 - RNA, 13 nt, Homo sapiens
cagagcagcucac

SEQ ID NO: 816857 - RNA, 15 nt, Homo sapiens
cagagcaucuugcau

SEQ ID NO: 816858 - RNA, 23 nt, Homo sapiens
cagagcauugcuauuuaucucaa

SEQ ID NO: 816859 - RNA, 20 nt, Homo sapiens
cagagccccuuaaagcugcu

SEQ ID NO: 816860 - RNA, 20 nt, Homo sapiens
cagagccuagccaccuccca

SEQ ID NO: 816861 - RNA, 19 nt, Homo sapiens
caaaaaaaccucuaugcaa

SEQ ID NO: 816862 - RNA, 16 nt, Homo sapiens
caaaaaacuacuucuu

SEQ ID NO: 816863 - RNA, 18 nt, Homo sapiens
caaaaaaucauguuuauu

SEQ ID NO: 816864 - RNA, 11 nt, Homo sapiens
caaaaaaucug

SEQ ID NO: 816865 - RNA, 14 nt, Homo sapiens
caaaaaaucugacc

SEQ ID NO: 816866 - RNA, 19 nt, Homo sapiens
caaaaaaugugagcuauaa

SEQ ID NO: 816867 - RNA, 17 nt, Homo sapiens
caaaaaauuagccagau

SEQ ID NO: 816868 - RNA, 19 nt, Homo sapiens
caaaaacaaagaguaucau

SEQ ID NO: 816869 - RNA, 21 nt, Homo sapiens
caaaaacaagcaaaaccaaag

SEQ ID NO: 816870 - RNA, 16 nt, Homo sapiens
caaaaacguaucuccu

SEQ ID NO: 816871 - RNA, 15 nt, Homo sapiens
caaaaacuacacaua

SEQ ID NO: 816872 - RNA, 21 nt, Homo sapiens
caaaaacuugaucacaugcuu

SEQ ID NO: 816873 - RNA, 13 nt, Homo sapiens
caaaaagacauua

SEQ ID NO: 816874 - RNA, 12 nt, Homo sapiens
caaaaaggcaaa

SEQ ID NO: 816875 - RNA, 12 nt, Homo sapiens
caaaaagucaag

SEQ ID NO: 816876 - RNA, 17 nt, Homo sapiens
caaaaagucacaguuaa

SEQ ID NO: 816877 - RNA, 17 nt, Homo sapiens
caaaaauaaacgaacuc

SEQ ID NO: 816878 - RNA, 22 nt, Homo sapiens
caaaaauagaaauuagauuugu

SEQ ID NO: 816879 - RNA, 23 nt, Homo sapiens
caaaaaugaaagcaugucucaau

SEQ ID NO: 816880 - RNA, 15 nt, Homo sapiens
caaaaaugaaaucca

SEQ ID NO: 816881 - RNA, 15 nt, Homo sapiens
caaaaaugcacccaa

SEQ ID NO: 816882 - RNA, 21 nt, Homo sapiens
caaaaauggauauuauuagaa

SEQ ID NO: 816883 - RNA, 19 nt, Homo sapiens
caaaaauguaaugaucaua

SEQ ID NO: 816884 - RNA, 15 nt, Homo sapiens
caaaaauuagcugug

SEQ ID NO: 816885 - RNA, 13 nt, Homo sapiens
caaaaauuugcau

SEQ ID NO: 816886 - RNA, 23 nt, Homo sapiens
caaaacaaaacccucagcacugu

SEQ ID NO: 816887 - RNA, 18 nt, Homo sapiens
caaaacaauauuacuuug

SEQ ID NO: 816888 - RNA, 15 nt, Homo sapiens
caaaacaaucucuca

SEQ ID NO: 816889 - RNA, 11 nt, Homo sapiens
caaaacacagg

SEQ ID NO: 816890 - RNA, 12 nt, Homo sapiens
caaaaccagcug

SEQ ID NO: 816891 - RNA, 13 nt, Homo sapiens
caaaaccagugaa

SEQ ID NO: 816892 - RNA, 20 nt, Homo sapiens
caaaacccucugcuucuccu

SEQ ID NO: 816893 - RNA, 16 nt, Homo sapiens
caaaacuccaucucaa

SEQ ID NO: 816894 - RNA, 15 nt, Homo sapiens
caaaacuccgucuca

SEQ ID NO: 816895 - RNA, 17 nt, Homo sapiens
caaaacugcacugucaa

SEQ ID NO: 816896 - RNA, 12 nt, Homo sapiens
caaaacugccuc

SEQ ID NO: 816897 - RNA, 13 nt, Homo sapiens
caaaacugucauc

SEQ ID NO: 816898 - RNA, 14 nt, Homo sapiens
caaaacuuaggcau

SEQ ID NO: 816899 - RNA, 14 nt, Homo sapiens
caaaacuuuggcac

SEQ ID NO: 816900 - RNA, 13 nt, Homo sapiens
caaaagaagacaa

SEQ ID NO: 816901 - RNA, 19 nt, Homo sapiens
caaaagcagauacuugagg

SEQ ID NO: 816902 - RNA, 20 nt, Homo sapiens
caaaagcaguaaauuugcua

SEQ ID NO: 816903 - RNA, 21 nt, Homo sapiens
caaaagcguccagaaaggaga

SEQ ID NO: 816904 - RNA, 20 nt, Homo sapiens
caaaagcuuauucaucuguu

SEQ ID NO: 816905 - RNA, 23 nt, Homo sapiens
caaaagcuuugaauacugugaaa

SEQ ID NO: 816906 - RNA, 17 nt, Homo sapiens
caaaagggccauguuuc

SEQ ID NO: 816907 - RNA, 15 nt, Homo sapiens
caaaagucagucuua

SEQ ID NO: 816908 - RNA, 18 nt, Homo sapiens
caaaaguuucuuacucaa

SEQ ID NO: 816909 - RNA, 21 nt, Homo sapiens
caaaaguuucuuacucaagga

SEQ ID NO: 816910 - RNA, 16 nt, Homo sapiens
caaaauaaaggcgcua

SEQ ID NO: 816911 - RNA, 13 nt, Homo sapiens
caaaauaaguguu

SEQ ID NO: 816912 - RNA, 13 nt, Homo sapiens
caaaauaaugagg

SEQ ID NO: 816913 - RNA, 19 nt, Homo sapiens
caaaauaccaugccauuua

SEQ ID NO: 816914 - RNA, 12 nt, Homo sapiens
caaaauaccuuc

SEQ ID NO: 816915 - RNA, 23 nt, Homo sapiens
caaaauaccuucugaacuacacu

SEQ ID NO: 816916 - RNA, 18 nt, Homo sapiens
caaaauagacaauuugca

SEQ ID NO: 816917 - RNA, 19 nt, Homo sapiens
caaaauauuuaagugaagg

SEQ ID NO: 816918 - RNA, 16 nt, Homo sapiens
caaaaucaucuuacau

SEQ ID NO: 816919 - RNA, 22 nt, Homo sapiens
caaaaugaaggcgggccugcaa

SEQ ID NO: 816920 - RNA, 17 nt, Homo sapiens
caaaaugcuucugcaca

SEQ ID NO: 816921 - RNA, 17 nt, Homo sapiens
caaaauguucuauuuaa

SEQ ID NO: 816922 - RNA, 20 nt, Homo sapiens
caaaauguucuauuuaacaa

SEQ ID NO: 816923 - RNA, 18 nt, Homo sapiens
caaaauucuuaaguaugu

SEQ ID NO: 816924 - RNA, 13 nt, Homo sapiens
caaaauugaugug

SEQ ID NO: 816925 - RNA, 17 nt, Homo sapiens
caaacacaguuacacuu

SEQ ID NO: 816926 - RNA, 14 nt, Homo sapiens
caaacaccagucac

SEQ ID NO: 816927 - RNA, 15 nt, Homo sapiens
caaacacuagcucug

SEQ ID NO: 816928 - RNA, 20 nt, Homo sapiens
caaacacuagcucuguauua

SEQ ID NO: 816929 - RNA, 17 nt, Homo sapiens
caaacacuccacccucc

SEQ ID NO: 816930 - RNA, 13 nt, Homo sapiens
caaacagcaagaa

SEQ ID NO: 816931 - RNA, 12 nt, Homo sapiens
caaacauauaac

SEQ ID NO: 816932 - RNA, 22 nt, Homo sapiens
caaacauggagaaaucuacuga

SEQ ID NO: 816933 - RNA, 13 nt, Homo sapiens
caaacaugguuua

SEQ ID NO: 816934 - RNA, 12 nt, Homo sapiens
caaacauuugaa

SEQ ID NO: 816935 - RNA, 23 nt, Homo sapiens
caaaccaaccgcacaugcagaug

SEQ ID NO: 816936 - RNA, 16 nt, Homo sapiens
caaaccaagcaaagga

SEQ ID NO: 816937 - RNA, 15 nt, Homo sapiens
caaaccacaacugac

SEQ ID NO: 816938 - RNA, 16 nt, Homo sapiens
caaaccacaacugaca

SEQ ID NO: 816939 - RNA, 20 nt, Homo sapiens
caaaccaugagaauuugcaa

SEQ ID NO: 816940 - RNA, 14 nt, Homo sapiens
caaacccaaaaaag

SEQ ID NO: 816941 - RNA, 13 nt, Homo sapiens
caaacccauuccc

SEQ ID NO: 816942 - RNA, 21 nt, Homo sapiens
caaaccuaaaaauuuugugac

SEQ ID NO: 816943 - RNA, 14 nt, Homo sapiens
caaaccucaaauau

SEQ ID NO: 816944 - RNA, 14 nt, Homo sapiens
caaaccucaucuuu

SEQ ID NO: 816945 - RNA, 19 nt, Homo sapiens
caaacuacaauuaaaacua

SEQ ID NO: 816946 - RNA, 14 nt, Homo sapiens
caaacuaugaucac

SEQ ID NO: 816947 - RNA, 17 nt, Homo sapiens
caaacucaaacuugaga

SEQ ID NO: 816948 - RNA, 18 nt, Homo sapiens
caaacucacugcucaaga

SEQ ID NO: 816949 - RNA, 19 nt, Homo sapiens
caaacucaguuccaaaguc

SEQ ID NO: 816950 - RNA, 18 nt, Homo sapiens
caaacucauccucuuuua

SEQ ID NO: 816951 - RNA, 18 nt, Homo sapiens
caaacucuaaaauuauaa

SEQ ID NO: 816952 - RNA, 16 nt, Homo sapiens
caaacugaaagaucug

SEQ ID NO: 816953 - RNA, 23 nt, Homo sapiens
caaacuggggccuccagaacuca

SEQ ID NO: 816954 - RNA, 21 nt, Homo sapiens
caaacuggggccucccugguc

SEQ ID NO: 816955 - RNA, 19 nt, Homo sapiens
caaacugugaagcauuuac

SEQ ID NO: 816956 - RNA, 21 nt, Homo sapiens
caaacuuaagaaacacugacu

SEQ ID NO: 816957 - RNA, 14 nt, Homo sapiens
caaacuugcuuuau

SEQ ID NO: 816958 - RNA, 12 nt, Homo sapiens
caaagaaaaagg

SEQ ID NO: 816959 - RNA, 14 nt, Homo sapiens
caaagaaaguguau

SEQ ID NO: 816960 - RNA, 19 nt, Homo sapiens
caaagaagaguuaagaaga

SEQ ID NO: 816961 - RNA, 20 nt, Homo sapiens
caaagaagcuuccacaaaau

SEQ ID NO: 816962 - RNA, 20 nt, Homo sapiens
caaagaaggaauucuaggca

SEQ ID NO: 816963 - RNA, 15 nt, Homo sapiens
caaagaaguacuuua

SEQ ID NO: 816964 - RNA, 21 nt, Homo sapiens
caaagaauuucuucaguccag

SEQ ID NO: 816965 - RNA, 16 nt, Homo sapiens
caagacuauaccuuau

SEQ ID NO: 816966 - RNA, 17 nt, Homo sapiens
caagacuauaccuuauc

SEQ ID NO: 816967 - RNA, 19 nt, Homo sapiens
caagacuccaucucaaaaa

SEQ ID NO: 816968 - RNA, 21 nt, Homo sapiens
caagacuccaucucaaaaaag

SEQ ID NO: 816969 - RNA, 12 nt, Homo sapiens
caagacuccuca

SEQ ID NO: 816970 - RNA, 21 nt, Homo sapiens
caagacuuuugucugaucaag

SEQ ID NO: 816971 - RNA, 21 nt, Homo sapiens
caagagcaaaacuccgucuca

SEQ ID NO: 816972 - RNA, 23 nt, Homo sapiens
caagagcagcugggaacugacau

SEQ ID NO: 816973 - RNA, 13 nt, Homo sapiens
caagagcaugcac

SEQ ID NO: 816974 - RNA, 16 nt, Homo sapiens
caagagcugagaaaca

SEQ ID NO: 816975 - RNA, 16 nt, Homo sapiens
caagaggagacuuuaa

SEQ ID NO: 816976 - RNA, 16 nt, Homo sapiens
caagaggcuguuccca

SEQ ID NO: 816977 - RNA, 17 nt, Homo sapiens
caagagugagacuccac

SEQ ID NO: 816978 - RNA, 22 nt, Homo sapiens
auuccugcuggccccuucuggg

SEQ ID NO: 816979 - RNA, 19 nt, Homo sapiens
auuccuggagcccgaggca

SEQ ID NO: 816980 - RNA, 21 nt, Homo sapiens
auuccugguguagcacuuaac

SEQ ID NO: 816981 - RNA, 17 nt, Homo sapiens
auuccugguuugacuca

SEQ ID NO: 816982 - RNA, 16 nt, Homo sapiens
auuccuguugauggga

SEQ ID NO: 816983 - RNA, 20 nt, Homo sapiens
auuccuguugcugucuucag

SEQ ID NO: 816984 - RNA, 13 nt, Homo sapiens
auuccuucacuca

SEQ ID NO: 816985 - RNA, 15 nt, Homo sapiens
auuccuucauucacu

SEQ ID NO: 816986 - RNA, 22 nt, Homo sapiens
auuccuucuggccucugcugaa

SEQ ID NO: 816987 - RNA, 19 nt, Homo sapiens
auuccuuggcaugccuucc

SEQ ID NO: 816988 - RNA, 21 nt, Homo sapiens
auuccuuggcaugccuuccag

SEQ ID NO: 816989 - RNA, 22 nt, Homo sapiens
auucgcccuccucccugucaua

SEQ ID NO: 816990 - RNA, 19 nt, Homo sapiens
auucgcuguccccucagcg

SEQ ID NO: 816991 - RNA, 14 nt, Homo sapiens
auucggacggccaa

SEQ ID NO: 816992 - RNA, 18 nt, Homo sapiens
auucggugugcugccaac

SEQ ID NO: 816993 - RNA, 17 nt, Homo sapiens
auucguaugccagcuca

SEQ ID NO: 816994 - RNA, 19 nt, Homo sapiens
auucuaaaaaugguuauca

SEQ ID NO: 816995 - RNA, 14 nt, Homo sapiens
auucuaaaacauuc

SEQ ID NO: 816996 - RNA, 16 nt, Homo sapiens
auucuaaaggcuugau

SEQ ID NO: 816997 - RNA, 23 nt, Homo sapiens
auucuaacccaagacaugacauu

SEQ ID NO: 816998 - RNA, 18 nt, Homo sapiens
auucuaagagaaggccuu

SEQ ID NO: 816999 - RNA, 21 nt, Homo sapiens
auucuaagagaaggccuuuaa

SEQ ID NO: 817000 - RNA, 21 nt, Homo sapiens
auucuaaguuauuuacuuuua

SEQ ID NO: 817001 - RNA, 14 nt, Homo sapiens
auucuaauuugcau

SEQ ID NO: 817002 - RNA, 17 nt, Homo sapiens
auucuacaaaaaaccag

SEQ ID NO: 817003 - RNA, 13 nt, Homo sapiens
auucuacagugau

SEQ ID NO: 817004 - RNA, 14 nt, Homo sapiens
auucuacagugaug

SEQ ID NO: 817005 - RNA, 18 nt, Homo sapiens
auucuaccugaggccagg

SEQ ID NO: 817006 - RNA, 19 nt, Homo sapiens
auucuacuaugcauuaaau

SEQ ID NO: 817007 - RNA, 13 nt, Homo sapiens
auucuacuggaaa

SEQ ID NO: 817008 - RNA, 17 nt, Homo sapiens
auucuacuggccuguaa

SEQ ID NO: 817009 - RNA, 15 nt, Homo sapiens
auucuagagccagcu

SEQ ID NO: 817010 - RNA, 14 nt, Homo sapiens
auucuagugcugcu

SEQ ID NO: 817011 - RNA, 17 nt, Homo sapiens
auucuaguguaacacug

SEQ ID NO: 817012 - RNA, 16 nt, Homo sapiens
auucuaguuuugucaa

SEQ ID NO: 817013 - RNA, 16 nt, Homo sapiens
auucuauccaucuccu

SEQ ID NO: 817014 - RNA, 23 nt, Homo sapiens
auucucagugagggcucuggauu

SEQ ID NO: 817015 - RNA, 19 nt, Homo sapiens
auucucaguguagggcaga

SEQ ID NO: 817016 - RNA, 15 nt, Homo sapiens
auucucaucacucaa

SEQ ID NO: 817017 - RNA, 15 nt, Homo sapiens
auucucaugccucag

SEQ ID NO: 817018 - RNA, 14 nt, Homo sapiens
auucuccacugugc

SEQ ID NO: 817019 - RNA, 22 nt, Homo sapiens
auucucccagcguuaacacaaa

SEQ ID NO: 817020 - RNA, 19 nt, Homo sapiens
auucucggggcccugugua

SEQ ID NO: 817021 - RNA, 15 nt, Homo sapiens
auucucugcaauuug

SEQ ID NO: 817022 - RNA, 16 nt, Homo sapiens
auucugaaucucaaga

SEQ ID NO: 817023 - RNA, 21 nt, Homo sapiens
auucugagccugauauugaua

SEQ ID NO: 817024 - RNA, 19 nt, Homo sapiens
auucugauauguauccauc

SEQ ID NO: 817025 - RNA, 21 nt, Homo sapiens
auucugauuauugaguuccag

SEQ ID NO: 817026 - RNA, 20 nt, Homo sapiens
auucugcuacuucacuguca

SEQ ID NO: 817027 - RNA, 14 nt, Homo sapiens
auucugcuuaccuu

SEQ ID NO: 817028 - RNA, 22 nt, Homo sapiens
auucuggaaaagcaaaacugua

SEQ ID NO: 817029 - RNA, 23 nt, Homo sapiens
auucuggaggggagagcuuugug

SEQ ID NO: 817030 - RNA, 21 nt, Homo sapiens
auucugggcuccuggaaccaa

SEQ ID NO: 817031 - RNA, 22 nt, Homo sapiens
auucugugagacaccaggcauc

SEQ ID NO: 817032 - RNA, 14 nt, Homo sapiens
auucuguggaacaa

SEQ ID NO: 817033 - RNA, 18 nt, Homo sapiens
auucuguuuauucuucca

SEQ ID NO: 817034 - RNA, 17 nt, Homo sapiens
auucuuaauucucugca

SEQ ID NO: 817035 - RNA, 15 nt, Homo sapiens
auucuuagugacuuu

SEQ ID NO: 817036 - RNA, 22 nt, Homo sapiens
auucuuauuauuuuugagacag

SEQ ID NO: 817037 - RNA, 14 nt, Homo sapiens
auucuucacuugcu

SEQ ID NO: 817038 - RNA, 19 nt, Homo sapiens
auucuuccagaaugcugaa

SEQ ID NO: 817039 - RNA, 13 nt, Homo sapiens
auucuucuaccac

SEQ ID NO: 817040 - RNA, 17 nt, Homo sapiens
auucuuguagaugcauu

SEQ ID NO: 817041 - RNA, 18 nt, Homo sapiens
auucuuguagaugcauua

SEQ ID NO: 817042 - RNA, 14 nt, Homo sapiens
auucuuguucagau

SEQ ID NO: 817043 - RNA, 13 nt, Homo sapiens
auucuuuaccuca

SEQ ID NO: 817044 - RNA, 18 nt, Homo sapiens
auucuuuuccaagcuccu

SEQ ID NO: 817045 - RNA, 15 nt, Homo sapiens
auucuuuuguaauau

SEQ ID NO: 817046 - RNA, 12 nt, Homo sapiens
auugaaaacacu

SEQ ID NO: 817047 - RNA, 13 nt, Homo sapiens
auugaaaaugcau

SEQ ID NO: 817048 - RNA, 18 nt, Homo sapiens
auugaaauguuugcauaa

SEQ ID NO: 817049 - RNA, 19 nt, Homo sapiens
auugaaauguuugcauaaa

SEQ ID NO: 817050 - RNA, 15 nt, Homo sapiens
auugaaguuguuuau

SEQ ID NO: 817051 - RNA, 14 nt, Homo sapiens
auugaauaggauca

SEQ ID NO: 817052 - RNA, 19 nt, Homo sapiens
auugaaucugauuggacau

SEQ ID NO: 817053 - RNA, 16 nt, Homo sapiens
auugacaacugcacau

SEQ ID NO: 817054 - RNA, 20 nt, Homo sapiens
auugacaacugcacaugaaa

SEQ ID NO: 817055 - RNA, 22 nt, Homo sapiens
auugacgaacuggcuacaguac

SEQ ID NO: 817056 - RNA, 17 nt, Homo sapiens
auugacucaaaccauau

SEQ ID NO: 817057 - RNA, 21 nt, Homo sapiens
auugacucaaucuuugccuaa

SEQ ID NO: 817058 - RNA, 17 nt, Homo sapiens
auugacucugcauuuga

SEQ ID NO: 817059 - RNA, 21 nt, Homo sapiens
auugagaagccauguacucaa

SEQ ID NO: 817060 - RNA, 13 nt, Homo sapiens
auugagaccugag

SEQ ID NO: 817061 - RNA, 14 nt, Homo sapiens
auugagagugauuc

SEQ ID NO: 817062 - RNA, 22 nt, Homo sapiens
auugagcgugaccuugcaaugu

SEQ ID NO: 817063 - RNA, 14 nt, Homo sapiens
auugagcugcagaa

SEQ ID NO: 817064 - RNA, 17 nt, Homo sapiens
auugaggagcucaagaa

SEQ ID NO: 817065 - RNA, 18 nt, Homo sapiens
auugagugcacuaaacaa

SEQ ID NO: 817066 - RNA, 18 nt, Homo sapiens
auugauagaguguuauca

SEQ ID NO: 817067 - RNA, 23 nt, Homo sapiens
auugauauacacggaugacuuaa

SEQ ID NO: 817068 - RNA, 17 nt, Homo sapiens
auugauaugcuuauaca

SEQ ID NO: 817069 - RNA, 19 nt, Homo sapiens
auugaucaaauauuucaac

SEQ ID NO: 817070 - RNA, 17 nt, Homo sapiens
auugaucaaugcauguu

SEQ ID NO: 817071 - RNA, 17 nt, Homo sapiens
auugauggaugucuucu

SEQ ID NO: 817072 - RNA, 21 nt, Homo sapiens
auugaugugguauaaaugccc

SEQ ID NO: 817073 - RNA, 15 nt, Homo sapiens
auugauuacuaucau

SEQ ID NO: 817074 - RNA, 14 nt, Homo sapiens
auugauuauucuga

SEQ ID NO: 817075 - RNA, 20 nt, Homo sapiens
auugauucacuuacugacuu

SEQ ID NO: 817076 - RNA, 13 nt, Homo sapiens
auugauuccacau

SEQ ID NO: 817077 - RNA, 22 nt, Homo sapiens
auugauuguauuguugaaaaag

SEQ ID NO: 817078 - RNA, 16 nt, Homo sapiens
auugauuucugacucu

SEQ ID NO: 817079 - RNA, 18 nt, Homo sapiens
auugcaaagauguuuaca

SEQ ID NO: 817080 - RNA, 15 nt, Homo sapiens
auugcaacagacugu

SEQ ID NO: 817081 - RNA, 21 nt, Homo sapiens
auugcaccauacuccuugcuu

SEQ ID NO: 817082 - RNA, 13 nt, Homo sapiens
auugcaccugcag

SEQ ID NO: 817083 - RNA, 17 nt, Homo sapiens
auugcagaccugucacc

SEQ ID NO: 817084 - RNA, 16 nt, Homo sapiens
auugcaggagucccug

SEQ ID NO: 817085 - RNA, 22 nt, Homo sapiens
auuuggucacacucucaccuag

SEQ ID NO: 817086 - RNA, 17 nt, Homo sapiens
auuuguaaagcuauuua

SEQ ID NO: 817087 - RNA, 15 nt, Homo sapiens
auuuguaaaucugcc

SEQ ID NO: 817088 - RNA, 17 nt, Homo sapiens
auuuguaaaucugccac

SEQ ID NO: 817089 - RNA, 22 nt, Homo sapiens
auuuguaaaucugccacaaaaa

SEQ ID NO: 817090 - RNA, 15 nt, Homo sapiens
auuuguagcaauuua

SEQ ID NO: 817091 - RNA, 15 nt, Homo sapiens
auuuguagcacugag

SEQ ID NO: 817092 - RNA, 20 nt, Homo sapiens
auuuguagcucuggaccugu

SEQ ID NO: 817093 - RNA, 22 nt, Homo sapiens
auuuguagguaauguuccugaa

SEQ ID NO: 817094 - RNA, 20 nt, Homo sapiens
aucucugccauaucagugaa

SEQ ID NO: 817095 - RNA, 22 nt, Homo sapiens
aucucuguucuguuuggcacuu

SEQ ID NO: 817096 - RNA, 19 nt, Homo sapiens
aucucuucaugcuugacau

SEQ ID NO: 817097 - RNA, 21 nt, Homo sapiens
aucucuuguuuacgauuucac

SEQ ID NO: 817098 - RNA, 14 nt, Homo sapiens
aucucuuuaccucc

SEQ ID NO: 817099 - RNA, 17 nt, Homo sapiens
aucucuuugaucuacuu

SEQ ID NO: 817100 - RNA, 17 nt, Homo sapiens
aucugaaaugugauaag

SEQ ID NO: 817101 - RNA, 13 nt, Homo sapiens
aucugaacauucu

SEQ ID NO: 817102 - RNA, 19 nt, Homo sapiens
aucugaauaaaguguaaca

SEQ ID NO: 817103 - RNA, 19 nt, Homo sapiens
aucugaauuuugcaaugua

SEQ ID NO: 817104 - RNA, 12 nt, Homo sapiens
aucugaccaucu

SEQ ID NO: 817105 - RNA, 12 nt, Homo sapiens
aucugacuauga

SEQ ID NO: 817106 - RNA, 22 nt, Homo sapiens
aucugagagccgggaaggggaa

SEQ ID NO: 817107 - RNA, 13 nt, Homo sapiens
aucugauguuaac

SEQ ID NO: 817108 - RNA, 15 nt, Homo sapiens
aucugcaguuuaaca

SEQ ID NO: 817109 - RNA, 22 nt, Homo sapiens
aucugccaagggccgacuaaga

SEQ ID NO: 817110 - RNA, 13 nt, Homo sapiens
aucugcccuagcc

SEQ ID NO: 817111 - RNA, 14 nt, Homo sapiens
aucugcgugcacuu

SEQ ID NO: 817112 - RNA, 15 nt, Homo sapiens
aucugcugcaccuug

SEQ ID NO: 817113 - RNA, 13 nt, Homo sapiens
aucuggacuuccu

SEQ ID NO: 817114 - RNA, 17 nt, Homo sapiens
aucuggagaaccucauc

SEQ ID NO: 817115 - RNA, 23 nt, Homo sapiens
aucuggcccuugcuuaccucuca

SEQ ID NO: 817116 - RNA, 15 nt, Homo sapiens
aucuggcgaagcuca

SEQ ID NO: 817117 - RNA, 17 nt, Homo sapiens
aucuggcuuagugccac

SEQ ID NO: 817118 - RNA, 22 nt, Homo sapiens
aucuggcuuagugccacccacc

SEQ ID NO: 817119 - RNA, 16 nt, Homo sapiens
aucuggguaagaagaa

SEQ ID NO: 817120 - RNA, 13 nt, Homo sapiens
aucuguaacucua

SEQ ID NO: 817121 - RNA, 20 nt, Homo sapiens
aucuguacucauguccuuca

SEQ ID NO: 817122 - RNA, 14 nt, Homo sapiens
aucuguaucccuac

SEQ ID NO: 817123 - RNA, 22 nt, Homo sapiens
aucugucauaagcauuacuuua

SEQ ID NO: 817124 - RNA, 14 nt, Homo sapiens
aucuguccacaucc

SEQ ID NO: 817125 - RNA, 16 nt, Homo sapiens
aucuguccacaucccc

SEQ ID NO: 817126 - RNA, 20 nt, Homo sapiens
aucuguggaaugauucacau

SEQ ID NO: 817127 - RNA, 21 nt, Homo sapiens
aucugugggucugggagucac

SEQ ID NO: 817128 - RNA, 20 nt, Homo sapiens
aucugugucaaaagccagau

SEQ ID NO: 817129 - RNA, 16 nt, Homo sapiens
aucuguuauccugcua

SEQ ID NO: 817130 - RNA, 18 nt, Homo sapiens
aucuguugauaaauccau

SEQ ID NO: 817131 - RNA, 19 nt, Homo sapiens
aucuguugauaaauccauc

SEQ ID NO: 817132 - RNA, 21 nt, Homo sapiens
aucuguuugaucccuguuacc

SEQ ID NO: 817133 - RNA, 16 nt, Homo sapiens
aucuuaaaacaaauuc

SEQ ID NO: 817134 - RNA, 13 nt, Homo sapiens
aucuuaaacaaug

SEQ ID NO: 817135 - RNA, 14 nt, Homo sapiens
aucuuaaaugccag

SEQ ID NO: 817136 - RNA, 17 nt, Homo sapiens
aucuuaacaaagccuuu

SEQ ID NO: 817137 - RNA, 14 nt, Homo sapiens
aucuuaagauccac

SEQ ID NO: 817138 - RNA, 20 nt, Homo sapiens
aucuuacaagguugcaagag

SEQ ID NO: 817139 - RNA, 12 nt, Homo sapiens
aucuuacuguac

SEQ ID NO: 817140 - RNA, 19 nt, Homo sapiens
aucuuagaagcacuacacc

SEQ ID NO: 817141 - RNA, 22 nt, Homo sapiens
aucuucaaacauguacaaaauc

SEQ ID NO: 817142 - RNA, 19 nt, Homo sapiens
aucuucaaacuuucacuuu

SEQ ID NO: 817143 - RNA, 21 nt, Homo sapiens
aucuucaauuuauuacugaaa

SEQ ID NO: 817144 - RNA, 19 nt, Homo sapiens
aucuucacgacaauguuga

SEQ ID NO: 817145 - RNA, 18 nt, Homo sapiens
aucuucauagaugaauga

SEQ ID NO: 817146 - RNA, 18 nt, Homo sapiens
aucuuccaaaugcaauuu

SEQ ID NO: 817147 - RNA, 13 nt, Homo sapiens
aucuuccaagggu

SEQ ID NO: 817148 - RNA, 18 nt, Homo sapiens
aucuuccaaggguacuaa

SEQ ID NO: 817149 - RNA, 19 nt, Homo sapiens
aucuuccagccaccuaguc

SEQ ID NO: 817150 - RNA, 22 nt, Homo sapiens
aucuucccaauguuugggauau

SEQ ID NO: 817151 - RNA, 23 nt, Homo sapiens
aucuucccuuuauuacaagaagg

SEQ ID NO: 817152 - RNA, 16 nt, Homo sapiens
aucuuccuccuuguga

SEQ ID NO: 817153 - RNA, 14 nt, Homo sapiens
aucuuccugugucc

SEQ ID NO: 817154 - RNA, 13 nt, Homo sapiens
aucuuccuuccuc

SEQ ID NO: 817155 - RNA, 23 nt, Homo sapiens
aucuuccuuuguugcacaaauag

SEQ ID NO: 817156 - RNA, 13 nt, Homo sapiens
aucuucuacugua

SEQ ID NO: 817157 - RNA, 12 nt, Homo sapiens
aucuucuacuuu

SEQ ID NO: 817158 - RNA, 20 nt, Homo sapiens
aucuucucccuuguccugcu

SEQ ID NO: 817159 - RNA, 15 nt, Homo sapiens
aucuucuuaugcaau

SEQ ID NO: 817160 - RNA, 17 nt, Homo sapiens
aucuugagggcagacag

SEQ ID NO: 817161 - RNA, 22 nt, Homo sapiens
aucuugauaucucgaacuuuca

SEQ ID NO: 817162 - RNA, 14 nt, Homo sapiens
aucuugcaccccaa

SEQ ID NO: 817163 - RNA, 22 nt, Homo sapiens
aucuugcauccaaaccuguaac

SEQ ID NO: 817164 - RNA, 23 nt, Homo sapiens
aucuugcauccaaaccuguaacc

SEQ ID NO: 817165 - RNA, 13 nt, Homo sapiens
aucuugcuggcua

SEQ ID NO: 817166 - RNA, 18 nt, Homo sapiens
aucuuggagggaccaagg

SEQ ID NO: 817167 - RNA, 18 nt, Homo sapiens
aucuuggcuuugccacac

SEQ ID NO: 817168 - RNA, 14 nt, Homo sapiens
aucuuguagcuuua

SEQ ID NO: 817169 - RNA, 16 nt, Homo sapiens
aucuuguuacugcuga

SEQ ID NO: 817170 - RNA, 12 nt, Homo sapiens
aucuuguuucau

SEQ ID NO: 817171 - RNA, 22 nt, Homo sapiens
aucuuguuuugaaaauaaccua

SEQ ID NO: 817172 - RNA, 24 nt, Homo sapiens
aucuuguuuuuccacuacugcuac

SEQ ID NO: 817173 - RNA, 21 nt, Homo sapiens
aucuuuaaaauacacacucaa

SEQ ID NO: 817174 - RNA, 15 nt, Homo sapiens
aucuuuacucaggca

SEQ ID NO: 817175 - RNA, 13 nt, Homo sapiens
aucuuuagggaau

SEQ ID NO: 817176 - RNA, 15 nt, Homo sapiens
aucuuuagggaauga

SEQ ID NO: 817177 - RNA, 17 nt, Homo sapiens
aucuuucauccuugacu

SEQ ID NO: 817178 - RNA, 19 nt, Homo sapiens
aucuuucauccuugacuaa

SEQ ID NO: 817179 - RNA, 13 nt, Homo sapiens
aucuuucuaggag

SEQ ID NO: 817180 - RNA, 23 nt, Homo sapiens
aucuuucuugaaugaaugaaaga

SEQ ID NO: 817181 - RNA, 17 nt, Homo sapiens
aucuuucuuuccaaaac

SEQ ID NO: 817182 - RNA, 18 nt, Homo sapiens
aucuuugauucuccuuca

SEQ ID NO: 817183 - RNA, 15 nt, Homo sapiens
aucuuuggauuugau

SEQ ID NO: 817184 - RNA, 15 nt, Homo sapiens
aucuuuguaccaaaa

SEQ ID NO: 817185 - RNA, 19 nt, Homo sapiens
aucuuuuauagacgcucuu

SEQ ID NO: 817186 - RNA, 13 nt, Homo sapiens
aucuuuucauuaa

SEQ ID NO: 817187 - RNA, 20 nt, Homo sapiens
aucuuuucuaaucacagugu

SEQ ID NO: 817188 - RNA, 20 nt, Homo sapiens
aucuuuuucuauauucucau

SEQ ID NO: 817189 - RNA, 23 nt, Homo sapiens
augaaaaauauugcugaacuacu

SEQ ID NO: 817190 - RNA, 12 nt, Homo sapiens
augaaacuaaga

SEQ ID NO: 817191 - RNA, 20 nt, Homo sapiens
augaaacuguccaccaagau

SEQ ID NO: 817192 - RNA, 15 nt, Homo sapiens
augaaacuuguuuca

SEQ ID NO: 817193 - RNA, 23 nt, Homo sapiens
augaaagguacuauauuugcuag

SEQ ID NO: 817194 - RNA, 13 nt, Homo sapiens
augaaauaugcau

SEQ ID NO: 817195 - RNA, 15 nt, Homo sapiens
augaaaugcuuccaa

SEQ ID NO: 817196 - RNA, 20 nt, Homo sapiens
augaaaugucuggucugucc

SEQ ID NO: 817197 - RNA, 21 nt, Homo sapiens
augaaaugucuggucugucca

SEQ ID NO: 817198 - RNA, 14 nt, Homo sapiens
augaaauuacuuau

SEQ ID NO: 817199 - RNA, 16 nt, Homo sapiens
augaaauugcugaaag

SEQ ID NO: 817200 - RNA, 13 nt, Homo sapiens
augaacaaauucu

SEQ ID NO: 817201 - RNA, 11 nt, Homo sapiens
augaacacuug

SEQ ID NO: 817202 - RNA, 11 nt, Homo sapiens
augaacaucuc

SEQ ID NO: 817203 - RNA, 21 nt, Homo sapiens
augaacaucuuuagugucuga

SEQ ID NO: 817204 - RNA, 22 nt, Homo sapiens
augaacccauccgguuugccau

SEQ ID NO: 817205 - RNA, 23 nt, Homo sapiens
augaacuguuagguucugaugac

SEQ ID NO: 817206 - RNA, 21 nt, Homo sapiens
augaagaugucuaauaguuau

SEQ ID NO: 817207 - RNA, 13 nt, Homo sapiens
augaagcagauuu

SEQ ID NO: 817208 - RNA, 15 nt, Homo sapiens
aggguggcacuggga

SEQ ID NO: 817209 - RNA, 18 nt, Homo sapiens
aggguggcccuugcaguu

SEQ ID NO: 817210 - RNA, 14 nt, Homo sapiens
aggguggccuguuc

SEQ ID NO: 817211 - RNA, 16 nt, Homo sapiens
aggguguaggggccac

SEQ ID NO: 817212 - RNA, 17 nt, Homo sapiens
aggguguguacugcaca

SEQ ID NO: 817213 - RNA, 15 nt, Homo sapiens
aggguguuugcagcu

SEQ ID NO: 817214 - RNA, 16 nt, Homo sapiens
aggguuaaggccugaa

SEQ ID NO: 817215 - RNA, 14 nt, Homo sapiens
aggguuccaaaggg

SEQ ID NO: 817216 - RNA, 20 nt, Homo sapiens
aggguugggcccagaucugg

SEQ ID NO: 817217 - RNA, 19 nt, Homo sapiens
agguaauccggagugagca

SEQ ID NO: 817218 - RNA, 23 nt, Homo sapiens
agguaauccuauuaaaacacagc

SEQ ID NO: 817219 - RNA, 21 nt, Homo sapiens
agguaccagcugcgcuugcuu

SEQ ID NO: 817220 - RNA, 14 nt, Homo sapiens
agguagacuuugcu

SEQ ID NO: 817221 - RNA, 20 nt, Homo sapiens
agguagacuuuuaauaucac

SEQ ID NO: 817222 - RNA, 16 nt, Homo sapiens
agguagccaucccaug

SEQ ID NO: 817223 - RNA, 20 nt, Homo sapiens
agguagcccagcacugugaa

SEQ ID NO: 817224 - RNA, 23 nt, Homo sapiens
agguagcugcagauaaguggccu

SEQ ID NO: 817225 - RNA, 23 nt, Homo sapiens
agucaucuugcuaccaguauuua

SEQ ID NO: 817226 - RNA, 22 nt, Homo sapiens
agucauggaggccaagaacuug

SEQ ID NO: 817227 - RNA, 12 nt, Homo sapiens
aguccaaaaagc

SEQ ID NO: 817228 - RNA, 17 nt, Homo sapiens
aguccaaaauacuguuc

SEQ ID NO: 817229 - RNA, 16 nt, Homo sapiens
aguccaaaugugauca

SEQ ID NO: 817230 - RNA, 21 nt, Homo sapiens
aguccaagggguagucugccu

SEQ ID NO: 817231 - RNA, 20 nt, Homo sapiens
aguccagagggacagucagu

SEQ ID NO: 817232 - RNA, 23 nt, Homo sapiens
aguccagguggugaauuuuccaa

SEQ ID NO: 817233 - RNA, 14 nt, Homo sapiens
aguccaugcuccag

SEQ ID NO: 817234 - RNA, 15 nt, Homo sapiens
agucccagcuacuca

SEQ ID NO: 817235 - RNA, 12 nt, Homo sapiens
agucccauucau

SEQ ID NO: 817236 - RNA, 21 nt, Homo sapiens
aguccccaaggccucucucug

SEQ ID NO: 817237 - RNA, 14 nt, Homo sapiens
agucccccaaaggg

SEQ ID NO: 817238 - RNA, 15 nt, Homo sapiens
aguccccucucucug

SEQ ID NO: 817239 - RNA, 16 nt, Homo sapiens
aguccccuuaagccaa

SEQ ID NO: 817240 - RNA, 15 nt, Homo sapiens
agucccuccaaaggg

SEQ ID NO: 817241 - RNA, 13 nt, Homo sapiens
agucccugacucu

SEQ ID NO: 817242 - RNA, 23 nt, Homo sapiens
agucccugacucucugugaccug

SEQ ID NO: 817243 - RNA, 15 nt, Homo sapiens
aguccuaaggccuua

SEQ ID NO: 817244 - RNA, 17 nt, Homo sapiens
aguccuacaagcuaaaa

SEQ ID NO: 817245 - RNA, 18 nt, Homo sapiens
aguccuccacucgaccca

SEQ ID NO: 817246 - RNA, 18 nt, Homo sapiens
aguccugacacuauucau

SEQ ID NO: 817247 - RNA, 20 nt, Homo sapiens
aguccuggaagccagcuuuc

SEQ ID NO: 817248 - RNA, 16 nt, Homo sapiens
aguccuggacgcacaa

SEQ ID NO: 817249 - RNA, 12 nt, Homo sapiens
aguccugggauu

SEQ ID NO: 817250 - RNA, 22 nt, Homo sapiens
aguccugguccuggcugcacuc

SEQ ID NO: 817251 - RNA, 23 nt, Homo sapiens
aguccugguccuggcugcacucu

SEQ ID NO: 817252 - RNA, 17 nt, Homo sapiens
aguccuguuugcaggga

SEQ ID NO: 817253 - RNA, 22 nt, Homo sapiens
aguccuugucuuguaauugugg

SEQ ID NO: 817254 - RNA, 13 nt, Homo sapiens
aguccuuuaguca

SEQ ID NO: 817255 - RNA, 12 nt, Homo sapiens
aguccuuuccaa

SEQ ID NO: 817256 - RNA, 17 nt, Homo sapiens
agucgccagucacugcu

SEQ ID NO: 817257 - RNA, 20 nt, Homo sapiens
agucgccagucacugcugca

SEQ ID NO: 817258 - RNA, 16 nt, Homo sapiens
agucggccccaucucu

SEQ ID NO: 817259 - RNA, 23 nt, Homo sapiens
agucuacucuuucugcuuacaaa

SEQ ID NO: 817260 - RNA, 15 nt, Homo sapiens
agucuagcaccucua

SEQ ID NO: 817261 - RNA, 19 nt, Homo sapiens
agucuaggcuaagcacuuu

SEQ ID NO: 817262 - RNA, 13 nt, Homo sapiens
agucuauuuccac

SEQ ID NO: 817263 - RNA, 23 nt, Homo sapiens
agucuauuuccacugaacaaaac

SEQ ID NO: 817264 - RNA, 13 nt, Homo sapiens
agucucaccuuca

SEQ ID NO: 817265 - RNA, 16 nt, Homo sapiens
agucucaggaaaucaa

SEQ ID NO: 817266 - RNA, 14 nt, Homo sapiens
agucucaggaccua

SEQ ID NO: 817267 - RNA, 14 nt, Homo sapiens
agucucagucugau

SEQ ID NO: 817268 - RNA, 14 nt, Homo sapiens
agucuccaugaaga

SEQ ID NO: 817269 - RNA, 16 nt, Homo sapiens
agucucuauaccaaua

SEQ ID NO: 817270 - RNA, 17 nt, Homo sapiens
agucucuauaccaauaa

SEQ ID NO: 817271 - RNA, 16 nt, Homo sapiens
agucucucacccucau

SEQ ID NO: 817272 - RNA, 13 nt, Homo sapiens
agucugaaacugg

SEQ ID NO: 817273 - RNA, 14 nt, Homo sapiens
agucugaaacuggc

SEQ ID NO: 817274 - RNA, 22 nt, Homo sapiens
agucugagacuccucauaccuc

SEQ ID NO: 817275 - RNA, 18 nt, Homo sapiens
agucugaggccugaguga

SEQ ID NO: 817276 - RNA, 15 nt, Homo sapiens
agucugauaaacuga

SEQ ID NO: 817277 - RNA, 21 nt, Homo sapiens
agucugcccuauggauuugaa

SEQ ID NO: 817278 - RNA, 22 nt, Homo sapiens
agucugcuacccucauuucuca

SEQ ID NO: 817279 - RNA, 15 nt, Homo sapiens
agucugcuucagugc

SEQ ID NO: 817280 - RNA, 11 nt, Homo sapiens
agucugugaaa

SEQ ID NO: 817281 - RNA, 16 nt, Homo sapiens
agucuucacuaaccuu

SEQ ID NO: 817282 - RNA, 20 nt, Homo sapiens
agucuuccaguuuaaugaac

SEQ ID NO: 817283 - RNA, 19 nt, Homo sapiens
agucuuccugacacuuuaa

SEQ ID NO: 817284 - RNA, 18 nt, Homo sapiens
agucuucuccuccaugaa

SEQ ID NO: 817285 - RNA, 17 nt, Homo sapiens
agucuugaaacaagcaa

SEQ ID NO: 817286 - RNA, 18 nt, Homo sapiens
agucuugcucuguugccc

SEQ ID NO: 817287 - RNA, 19 nt, Homo sapiens
agucuugcucuguugccca

SEQ ID NO: 817288 - RNA, 15 nt, Homo sapiens
agucuuggugcuauc

SEQ ID NO: 817289 - RNA, 21 nt, Homo sapiens
agucuuguagaaaucucagaa

SEQ ID NO: 817290 - RNA, 13 nt, Homo sapiens
agucuuugccagu

SEQ ID NO: 817291 - RNA, 14 nt, Homo sapiens
agucuuugcucagu

SEQ ID NO: 817292 - RNA, 19 nt, Homo sapiens
agucuuuucuggcaaauaa

SEQ ID NO: 817293 - RNA, 22 nt, Homo sapiens
agugaaaaaucuguggaaugua

SEQ ID NO: 817294 - RNA, 20 nt, Homo sapiens
agugaagaugccagugaaac

SEQ ID NO: 817295 - RNA, 18 nt, Homo sapiens
agugaaggugguggggcu

SEQ ID NO: 817296 - RNA, 22 nt, Homo sapiens
agugaaguagccucuuguguaa

SEQ ID NO: 817297 - RNA, 14 nt, Homo sapiens
agugaaguugugca

SEQ ID NO: 817298 - RNA, 18 nt, Homo sapiens
agugaauaaccacuuaaa

SEQ ID NO: 817299 - RNA, 22 nt, Homo sapiens
agugaauacauuaacggugcua

SEQ ID NO: 817300 - RNA, 13 nt, Homo sapiens
agugaaucugauu

SEQ ID NO: 817301 - RNA, 13 nt, Homo sapiens
agugaaucuguau

SEQ ID NO: 817302 - RNA, 16 nt, Homo sapiens
agugaaugaacaaaug

SEQ ID NO: 817303 - RNA, 23 nt, Homo sapiens
agugacaaaauagacaauuugca

SEQ ID NO: 817304 - RNA, 14 nt, Homo sapiens
agugacacagcagc

SEQ ID NO: 817305 - RNA, 15 nt, Homo sapiens
agugacacagcagcu

SEQ ID NO: 817306 - RNA, 12 nt, Homo sapiens
agugacacccag

SEQ ID NO: 817307 - RNA, 20 nt, Homo sapiens
agugacagagcgagacucca

SEQ ID NO: 817308 - RNA, 14 nt, Homo sapiens
agugacagcuugag

SEQ ID NO: 817309 - RNA, 19 nt, Homo sapiens
agugacauaauauauucua

SEQ ID NO: 817310 - RNA, 15 nt, Homo sapiens
agugacauguuuaca

SEQ ID NO: 817311 - RNA, 13 nt, Homo sapiens
agugaccaaaggu

SEQ ID NO: 817312 - RNA, 21 nt, Homo sapiens
agugaccaaaggugugcccug

SEQ ID NO: 817313 - RNA, 20 nt, Homo sapiens
agugaccccugaccucacug

SEQ ID NO: 817314 - RNA, 21 nt, Homo sapiens
agugaccuggaaucagugaag

SEQ ID NO: 817315 - RNA, 23 nt, Homo sapiens
agugacgggugcccguaauccca

SEQ ID NO: 817316 - RNA, 13 nt, Homo sapiens
agugagacccugu

SEQ ID NO: 817317 - RNA, 13 nt, Homo sapiens
agugagagcuucc

SEQ ID NO: 817318 - RNA, 14 nt, Homo sapiens
agugagagcuuccu

SEQ ID NO: 817319 - RNA, 16 nt, Homo sapiens
agugagaggcaaacca

SEQ ID NO: 817320 - RNA, 13 nt, Homo sapiens
agugagagggcau

SEQ ID NO: 817321 - RNA, 19 nt, Homo sapiens
agugagcaagggggcccaa

SEQ ID NO: 817322 - RNA, 23 nt, Homo sapiens
agugagcacacccgugugcacac

SEQ ID NO: 817323 - RNA, 12 nt, Homo sapiens
agugagcacuag

SEQ ID NO: 817324 - RNA, 16 nt, Homo sapiens
agugagcaugagcuca

SEQ ID NO: 817325 - RNA, 22 nt, Homo sapiens
agugagccugaauuuuguugcu

SEQ ID NO: 817326 - RNA, 18 nt, Homo sapiens
auauuccauccauauacu

SEQ ID NO: 817327 - RNA, 20 nt, Homo sapiens
auauucuaagccaguuuuca

SEQ ID NO: 817328 - RNA, 16 nt, Homo sapiens
auauucuacuaugcau

SEQ ID NO: 817329 - RNA, 16 nt, Homo sapiens
auauucuuauuucacu

SEQ ID NO: 817330 - RNA, 17 nt, Homo sapiens
auauucuuugguuguga

SEQ ID NO: 817331 - RNA, 19 nt, Homo sapiens
auauugaaaaaaguuccac

SEQ ID NO: 817332 - RNA, 14 nt, Homo sapiens
auauugaagacauu

SEQ ID NO: 817333 - RNA, 15 nt, Homo sapiens
auauugaauguuaaa

SEQ ID NO: 817334 - RNA, 20 nt, Homo sapiens
auauugagaucagcauucaa

SEQ ID NO: 817335 - RNA, 18 nt, Homo sapiens
auauugcaguaguauuua

SEQ ID NO: 817336 - RNA, 16 nt, Homo sapiens
auauugcccaggcugu

SEQ ID NO: 817337 - RNA, 11 nt, Homo sapiens
auauugccuua

SEQ ID NO: 817338 - RNA, 15 nt, Homo sapiens
auauuggacugauaa

SEQ ID NO: 817339 - RNA, 16 nt, Homo sapiens
auauuguaaagcccau

SEQ ID NO: 817340 - RNA, 16 nt, Homo sapiens
auauuguaaauacugg

SEQ ID NO: 817341 - RNA, 14 nt, Homo sapiens
auauuguaagcauu

SEQ ID NO: 817342 - RNA, 15 nt, Homo sapiens
auauuuaaaacauca

SEQ ID NO: 817343 - RNA, 16 nt, Homo sapiens
auauuuaaauaaagga

SEQ ID NO: 817344 - RNA, 12 nt, Homo sapiens
auauuuacuacu

SEQ ID NO: 817345 - RNA, 15 nt, Homo sapiens
auauuuacuguuaga

SEQ ID NO: 817346 - RNA, 15 nt, Homo sapiens
auauuuauagcaauc

SEQ ID NO: 817347 - RNA, 16 nt, Homo sapiens
auauuucaagugccua

SEQ ID NO: 817348 - RNA, 13 nt, Homo sapiens
auauuucagcaaa

SEQ ID NO: 817349 - RNA, 14 nt, Homo sapiens
auauuucugauacu

SEQ ID NO: 817350 - RNA, 18 nt, Homo sapiens
auauuugaagcaucacau

SEQ ID NO: 817351 - RNA, 21 nt, Homo sapiens
auauuugaauuuuaaaucuaa

SEQ ID NO: 817352 - RNA, 22 nt, Homo sapiens
auauuugcauuccagaaccaaa

SEQ ID NO: 817353 - RNA, 11 nt, Homo sapiens
auauuugccac

SEQ ID NO: 817354 - RNA, 20 nt, Homo sapiens
auauuugccaccaagugaaa

SEQ ID NO: 817355 - RNA, 17 nt, Homo sapiens
auauuugcuagauuucu

SEQ ID NO: 817356 - RNA, 14 nt, Homo sapiens
auauuuuauuuccu

SEQ ID NO: 817357 - RNA, 11 nt, Homo sapiens
auauuuugcua

SEQ ID NO: 817358 - RNA, 19 nt, Homo sapiens
auauuuuugguugucaaua

SEQ ID NO: 817359 - RNA, 12 nt, Homo sapiens
aucaaaaagccu

SEQ ID NO: 817360 - RNA, 14 nt, Homo sapiens
aucaaaaaguauua

SEQ ID NO: 817361 - RNA, 19 nt, Homo sapiens
aucaaaaaugaaucacuuc

SEQ ID NO: 817362 - RNA, 20 nt, Homo sapiens
aucaaaacuaaccaucugaa

SEQ ID NO: 817363 - RNA, 14 nt, Homo sapiens
aucaaaacucuccu

SEQ ID NO: 817364 - RNA, 13 nt, Homo sapiens
aucaaaaggccca

SEQ ID NO: 817365 - RNA, 19 nt, Homo sapiens
aucaaacauuuucuggcca

SEQ ID NO: 817366 - RNA, 21 nt, Homo sapiens
aucaaacuagcugucacuuuu

SEQ ID NO: 817367 - RNA, 15 nt, Homo sapiens
aucaaagagcacauu

SEQ ID NO: 817368 - RNA, 18 nt, Homo sapiens
aucaacauuuguuccaug

SEQ ID NO: 817369 - RNA, 15 nt, Homo sapiens
aucaacuaaugauuu

SEQ ID NO: 817370 - RNA, 19 nt, Homo sapiens
aucaacuuauuauaugacu

SEQ ID NO: 817371 - RNA, 15 nt, Homo sapiens
aucaagaagcuguga

SEQ ID NO: 817372 - RNA, 18 nt, Homo sapiens
aucaagaagggcugcaug

SEQ ID NO: 817373 - RNA, 14 nt, Homo sapiens
aucaagagggauaa

SEQ ID NO: 817374 - RNA, 14 nt, Homo sapiens
aucaagccaauacc

SEQ ID NO: 817375 - RNA, 16 nt, Homo sapiens
aucaagccugauucaa

SEQ ID NO: 817376 - RNA, 20 nt, Homo sapiens
aucaaguuccaguaacccaa

SEQ ID NO: 817377 - RNA, 23 nt, Homo sapiens
aucaauaggaaagcauaugcagc

SEQ ID NO: 817378 - RNA, 13 nt, Homo sapiens
aucaaugcaagag

SEQ ID NO: 817379 - RNA, 16 nt, Homo sapiens
aucaaugcaagaguga

SEQ ID NO: 817380 - RNA, 16 nt, Homo sapiens
aucaaugucacuuaaa

SEQ ID NO: 817381 - RNA, 15 nt, Homo sapiens
aucacaccuaaucuu

SEQ ID NO: 817382 - RNA, 17 nt, Homo sapiens
aucacaccucaguggga

SEQ ID NO: 817383 - RNA, 19 nt, Homo sapiens
aucacauaugcuuacucuu

SEQ ID NO: 817384 - RNA, 18 nt, Homo sapiens
aucacauuaucaucugaa

SEQ ID NO: 817385 - RNA, 19 nt, Homo sapiens
aucaccaccgccucuggcc

SEQ ID NO: 817386 - RNA, 22 nt, Homo sapiens
aucaccucuuaugcacaccucc

SEQ ID NO: 817387 - RNA, 18 nt, Homo sapiens
aucacgaggucaggagau

SEQ ID NO: 817388 - RNA, 23 nt, Homo sapiens
aucacgucacugcacuccagcuu

SEQ ID NO: 817389 - RNA, 19 nt, Homo sapiens
aucacuaagggauggggca

SEQ ID NO: 817390 - RNA, 23 nt, Homo sapiens
aucacuagccaugauaacugcaa

SEQ ID NO: 817391 - RNA, 21 nt, Homo sapiens
aucacuaucuuucugauaaca

SEQ ID NO: 817392 - RNA, 15 nt, Homo sapiens
aucacucaaccuuau

SEQ ID NO: 817393 - RNA, 23 nt, Homo sapiens
aucacugaucuaagcaguggcau

SEQ ID NO: 817394 - RNA, 14 nt, Homo sapiens
aucacugcauuuca

SEQ ID NO: 817395 - RNA, 12 nt, Homo sapiens
aucacugccaaa

SEQ ID NO: 817396 - RNA, 19 nt, Homo sapiens
aucacugccacacucucca

SEQ ID NO: 817397 - RNA, 15 nt, Homo sapiens
aucacugguccaggu

SEQ ID NO: 817398 - RNA, 16 nt, Homo sapiens
aucacuggucuaaaag

SEQ ID NO: 817399 - RNA, 21 nt, Homo sapiens
aucacuguauagacaugcuac

SEQ ID NO: 817400 - RNA, 17 nt, Homo sapiens
aucacuuaaacuugcau

SEQ ID NO: 817401 - RNA, 20 nt, Homo sapiens
aucacuucugaagucccugc

SEQ ID NO: 817402 - RNA, 11 nt, Homo sapiens
aucacuuugac

SEQ ID NO: 817403 - RNA, 20 nt, Homo sapiens
aucacuuuggacagaauuag

SEQ ID NO: 817404 - RNA, 16 nt, Homo sapiens
aucagaaacuugugaa

SEQ ID NO: 817405 - RNA, 17 nt, Homo sapiens
aucagaacugugccaca

SEQ ID NO: 817406 - RNA, 17 nt, Homo sapiens
aucagaaggacauggug

SEQ ID NO: 817407 - RNA, 13 nt, Homo sapiens
aucagaccugguu

SEQ ID NO: 817408 - RNA, 18 nt, Homo sapiens
aucagacuccugugcaac

SEQ ID NO: 817409 - RNA, 15 nt, Homo sapiens
aucagagacuaugua

SEQ ID NO: 817410 - RNA, 15 nt, Homo sapiens
aucagagaguguaca

SEQ ID NO: 817411 - RNA, 22 nt, Homo sapiens
aucagaggucuauuuuuaccua

SEQ ID NO: 817412 - RNA, 19 nt, Homo sapiens
aucagaguuccuccuacuu

SEQ ID NO: 817413 - RNA, 20 nt, Homo sapiens
aucagaguuccuccuacuua

SEQ ID NO: 817414 - RNA, 12 nt, Homo sapiens
aucagaguugcu

SEQ ID NO: 817415 - RNA, 18 nt, Homo sapiens
aucagaugacucucucca

SEQ ID NO: 817416 - RNA, 19 nt, Homo sapiens
aucagaugacucucuccaa

SEQ ID NO: 817417 - RNA, 22 nt, Homo sapiens
aucagauguguguucucaguga

SEQ ID NO: 817418 - RNA, 12 nt, Homo sapiens
aucagauuuauu

SEQ ID NO: 817419 - RNA, 18 nt, Homo sapiens
aucagcagagaacuggaa

SEQ ID NO: 817420 - RNA, 15 nt, Homo sapiens
aucagcauuuuacua

SEQ ID NO: 817421 - RNA, 17 nt, Homo sapiens
aucagcauuuuacuacu

SEQ ID NO: 817422 - RNA, 14 nt, Homo sapiens
aucagccagucuca

SEQ ID NO: 817423 - RNA, 22 nt, Homo sapiens
aucagccauaagaaagcacuau

SEQ ID NO: 817424 - RNA, 13 nt, Homo sapiens
aucagccuucaag

SEQ ID NO: 817425 - RNA, 15 nt, Homo sapiens
aucagccuugcuaaa

SEQ ID NO: 817426 - RNA, 18 nt, Homo sapiens
aucagcuagggacuacuu

SEQ ID NO: 817427 - RNA, 21 nt, Homo sapiens
aucagcuagggacuacuuaau

SEQ ID NO: 817428 - RNA, 20 nt, Homo sapiens
aucagcugaauucacuuaag

SEQ ID NO: 817429 - RNA, 14 nt, Homo sapiens
aucagcugcuacua

SEQ ID NO: 817430 - RNA, 13 nt, Homo sapiens
aucagcuuucaaa

SEQ ID NO: 817431 - RNA, 20 nt, Homo sapiens
aucaggaaaacaaaucacug

SEQ ID NO: 817432 - RNA, 18 nt, Homo sapiens
aucaggaauauuuuccaa

SEQ ID NO: 817433 - RNA, 13 nt, Homo sapiens
aucaggacgagaa

SEQ ID NO: 817434 - RNA, 22 nt, Homo sapiens
aucaggguagcugaaggaaauc

SEQ ID NO: 817435 - RNA, 17 nt, Homo sapiens
aucagguagacuuuuaa

SEQ ID NO: 817436 - RNA, 18 nt, Homo sapiens
aucaggugaggugugcuc

SEQ ID NO: 817437 - RNA, 17 nt, Homo sapiens
aucaguaagucacaguu

SEQ ID NO: 817438 - RNA, 14 nt, Homo sapiens
aucaguagauuucu

SEQ ID NO: 817439 - RNA, 18 nt, Homo sapiens
aucaguagauuucuggca

SEQ ID NO: 817440 - RNA, 18 nt, Homo sapiens
aucaguauaauucuguac

SEQ ID NO: 817441 - RNA, 14 nt, Homo sapiens
aucaguauugugaa

SEQ ID NO: 817442 - RNA, 22 nt, Homo sapiens
auaguuuaggagaaaccagcuu

SEQ ID NO: 817443 - RNA, 22 nt, Homo sapiens
auaguuuggcuauaagugcuca

SEQ ID NO: 817444 - RNA, 23 nt, Homo sapiens
auaguuuucuccuuuuacuucac

SEQ ID NO: 817445 - RNA, 21 nt, Homo sapiens
auauaaaaaagccacuggaau

SEQ ID NO: 817446 - RNA, 15 nt, Homo sapiens
auauaaaaaaucaug

SEQ ID NO: 817447 - RNA, 19 nt, Homo sapiens
auauaaaaauggguguuau

SEQ ID NO: 817448 - RNA, 20 nt, Homo sapiens
auauaacaagugggugaaug

SEQ ID NO: 817449 - RNA, 20 nt, Homo sapiens
auauaacuaagacauaugca

SEQ ID NO: 817450 - RNA, 18 nt, Homo sapiens
auauaaggaaagcaauaa

SEQ ID NO: 817451 - RNA, 18 nt, Homo sapiens
auauaaucucaccugcuu

SEQ ID NO: 817452 - RNA, 19 nt, Homo sapiens
auauaauucccaagcuuuu

SEQ ID NO: 817453 - RNA, 14 nt, Homo sapiens
auauaauuuauuga

SEQ ID NO: 817454 - RNA, 12 nt, Homo sapiens
auauaccaaauu

SEQ ID NO: 817455 - RNA, 12 nt, Homo sapiens
auauaccaucuc

SEQ ID NO: 817456 - RNA, 21 nt, Homo sapiens
auauaccuggcuuuuacuuua

SEQ ID NO: 817457 - RNA, 19 nt, Homo sapiens
auauaccuuuuugugucaa

SEQ ID NO: 817458 - RNA, 13 nt, Homo sapiens
auauagacaccaa

SEQ ID NO: 817459 - RNA, 20 nt, Homo sapiens
auauagagaauaaggcacaa

SEQ ID NO: 817460 - RNA, 15 nt, Homo sapiens
auauagagacaggac

SEQ ID NO: 817461 - RNA, 14 nt, Homo sapiens
auauagcaauacuu

SEQ ID NO: 817462 - RNA, 15 nt, Homo sapiens
auauaggccagaguu

SEQ ID NO: 817463 - RNA, 20 nt, Homo sapiens
auauaguaacuacuuuuuau

SEQ ID NO: 817464 - RNA, 17 nt, Homo sapiens
auauaguaugaaugcag

SEQ ID NO: 817465 - RNA, 13 nt, Homo sapiens
auauauacauggg

SEQ ID NO: 817466 - RNA, 15 nt, Homo sapiens
auauauauauaguaa

SEQ ID NO: 817467 - RNA, 12 nt, Homo sapiens
auauauaugcac

SEQ ID NO: 817468 - RNA, 14 nt, Homo sapiens
auauauauuacaag

SEQ ID NO: 817469 - RNA, 20 nt, Homo sapiens
auauauguguuuuucacauu

SEQ ID NO: 817470 - RNA, 19 nt, Homo sapiens
auauauuauuuuacugcuu

SEQ ID NO: 817471 - RNA, 14 nt, Homo sapiens
auauauuuaauuga

SEQ ID NO: 817472 - RNA, 13 nt, Homo sapiens
auauauuuauuga

SEQ ID NO: 817473 - RNA, 17 nt, Homo sapiens
auauauuuuuaccaucu

SEQ ID NO: 817474 - RNA, 14 nt, Homo sapiens
auaucaaaagcaaa

SEQ ID NO: 817475 - RNA, 14 nt, Homo sapiens
auaucaaaauucua

SEQ ID NO: 817476 - RNA, 14 nt, Homo sapiens
auaucaacucugaa

SEQ ID NO: 817477 - RNA, 13 nt, Homo sapiens
auaucagaacugu

SEQ ID NO: 817478 - RNA, 19 nt, Homo sapiens
auaucagacaagcacuauu

SEQ ID NO: 817479 - RNA, 22 nt, Homo sapiens
auaucaguauucugacauguaa

SEQ ID NO: 817480 - RNA, 18 nt, Homo sapiens
auaucaguccucuuucaa

SEQ ID NO: 817481 - RNA, 19 nt, Homo sapiens
auaucauaacuauacuuga

SEQ ID NO: 817482 - RNA, 15 nt, Homo sapiens
auaucaugcaaauuu

SEQ ID NO: 817483 - RNA, 23 nt, Homo sapiens
auaucaugccccuguacuccagc

SEQ ID NO: 817484 - RNA, 19 nt, Homo sapiens
auaucauuuauccuuacau

SEQ ID NO: 817485 - RNA, 15 nt, Homo sapiens
auauccacuuaccug

SEQ ID NO: 817486 - RNA, 19 nt, Homo sapiens
auauccauaagauuugcaa

SEQ ID NO: 817487 - RNA, 17 nt, Homo sapiens
auauccuugauguacag

SEQ ID NO: 817488 - RNA, 17 nt, Homo sapiens
auauccuuucaagacag

SEQ ID NO: 817489 - RNA, 19 nt, Homo sapiens
auauccuuucuaacaaaaa

SEQ ID NO: 817490 - RNA, 17 nt, Homo sapiens
auauccuuuuacugcag

SEQ ID NO: 817491 - RNA, 14 nt, Homo sapiens
auaucgaucucuua

SEQ ID NO: 817492 - RNA, 13 nt, Homo sapiens
auaucuaccccag

SEQ ID NO: 817493 - RNA, 20 nt, Homo sapiens
auaucugaagagcuauuaua

SEQ ID NO: 817494 - RNA, 14 nt, Homo sapiens
auaucuggcacugu

SEQ ID NO: 817495 - RNA, 19 nt, Homo sapiens
auaucuuaaagaaacagcu

SEQ ID NO: 817496 - RNA, 15 nt, Homo sapiens
auaucuugaaacaua

SEQ ID NO: 817497 - RNA, 18 nt, Homo sapiens
auaucuuguagcuuuauc

SEQ ID NO: 817498 - RNA, 20 nt, Homo sapiens
auaugaaaaucuccaucuca

SEQ ID NO: 817499 - RNA, 18 nt, Homo sapiens
auaugaaacuaggguuug

SEQ ID NO: 817500 - RNA, 19 nt, Homo sapiens
auaugaagaagacaccucu

SEQ ID NO: 817501 - RNA, 17 nt, Homo sapiens
auaugaaggauuacucu

SEQ ID NO: 817502 - RNA, 19 nt, Homo sapiens
auaugaaucugcucacuuu

SEQ ID NO: 817503 - RNA, 15 nt, Homo sapiens
auaugaauucaagaa

SEQ ID NO: 817504 - RNA, 13 nt, Homo sapiens
auaugaccaaaau

SEQ ID NO: 817505 - RNA, 22 nt, Homo sapiens
auaugagcuuccuucugugaaa

SEQ ID NO: 817506 - RNA, 17 nt, Homo sapiens
auaugaggcuugauaau

SEQ ID NO: 817507 - RNA, 14 nt, Homo sapiens
auaugauaaaacac

SEQ ID NO: 817508 - RNA, 14 nt, Homo sapiens
auaugauacucuca

SEQ ID NO: 817509 - RNA, 19 nt, Homo sapiens
auaugauacucucagauuu

SEQ ID NO: 817510 - RNA, 13 nt, Homo sapiens
auaugauucugcu

SEQ ID NO: 817511 - RNA, 20 nt, Homo sapiens
auaugauuuaaaacauguaa

SEQ ID NO: 817512 - RNA, 20 nt, Homo sapiens
auaugcaauguauagugucu

SEQ ID NO: 817513 - RNA, 18 nt, Homo sapiens
auaugcagccaaccaaga

SEQ ID NO: 817514 - RNA, 15 nt, Homo sapiens
auaugcagugauaua

SEQ ID NO: 817515 - RNA, 13 nt, Homo sapiens
auaugcgcuuaaa

SEQ ID NO: 817516 - RNA, 14 nt, Homo sapiens
auaugcuccugccu

SEQ ID NO: 817517 - RNA, 22 nt, Homo sapiens
auaugcuuagcauagauuugca

SEQ ID NO: 817518 - RNA, 20 nt, Homo sapiens
auaugcuuauacacuuacac

SEQ ID NO: 817519 - RNA, 16 nt, Homo sapiens
auaugcuuuacaaucu

SEQ ID NO: 817520 - RNA, 16 nt, Homo sapiens
auauggacucugcaca

SEQ ID NO: 817521 - RNA, 23 nt, Homo sapiens
auauggaugauucagaaauugga

SEQ ID NO: 817522 - RNA, 16 nt, Homo sapiens
auaugggcucaaguca

SEQ ID NO: 817523 - RNA, 18 nt, Homo sapiens
auauggggaaaaaacugu

SEQ ID NO: 817524 - RNA, 24 nt, Homo sapiens
auauggugaagggaaguggggagu

SEQ ID NO: 817525 - RNA, 15 nt, Homo sapiens
auauguaaagcacau

SEQ ID NO: 817526 - RNA, 18 nt, Homo sapiens
auauguaaguacuuccac

SEQ ID NO: 817527 - RNA, 22 nt, Homo sapiens
auauguaauuucaaaauacauu

SEQ ID NO: 817528 - RNA, 14 nt, Homo sapiens
auauguagcucauc

SEQ ID NO: 817529 - RNA, 14 nt, Homo sapiens
auauguaguauaau

SEQ ID NO: 817530 - RNA, 18 nt, Homo sapiens
auauguaugccugcaaua

SEQ ID NO: 817531 - RNA, 14 nt, Homo sapiens
auauguauggaucu

SEQ ID NO: 817532 - RNA, 12 nt, Homo sapiens
auauguaugggu

SEQ ID NO: 817533 - RNA, 19 nt, Homo sapiens
auaugugauuuacauuuca

SEQ ID NO: 817534 - RNA, 16 nt, Homo sapiens
auaugugcagucuugc

SEQ ID NO: 817535 - RNA, 19 nt, Homo sapiens
auauguguauauauauaug

SEQ ID NO: 817536 - RNA, 17 nt, Homo sapiens
auauguguauguacguu

SEQ ID NO: 817537 - RNA, 23 nt, Homo sapiens
auauguuagaaucaaauacucau

SEQ ID NO: 817538 - RNA, 17 nt, Homo sapiens
auauguugaaacuuuaa

SEQ ID NO: 817539 - RNA, 19 nt, Homo sapiens
auauguuuuaaaauacucu

SEQ ID NO: 817540 - RNA, 21 nt, Homo sapiens
auauuaacaacaauaacacug

SEQ ID NO: 817541 - RNA, 13 nt, Homo sapiens
auauuaacacgcu

SEQ ID NO: 817542 - RNA, 12 nt, Homo sapiens
auauuaacauuc

SEQ ID NO: 817543 - RNA, 21 nt, Homo sapiens
auauuaagaaagacuaucuaa

SEQ ID NO: 817544 - RNA, 16 nt, Homo sapiens
auauuaagaagcaaua

SEQ ID NO: 817545 - RNA, 16 nt, Homo sapiens
auauuaaggaaaaaag

SEQ ID NO: 817546 - RNA, 13 nt, Homo sapiens
auauuacagugaa

SEQ ID NO: 817547 - RNA, 21 nt, Homo sapiens
auauuauauaggauauugcua

SEQ ID NO: 817548 - RNA, 22 nt, Homo sapiens
auauucaaugaacuuccauuug

SEQ ID NO: 817549 - RNA, 17 nt, Homo sapiens
auauucaaugcauuuaa

SEQ ID NO: 817550 - RNA, 17 nt, Homo sapiens
auauucagccagcuuaa

SEQ ID NO: 817551 - RNA, 21 nt, Homo sapiens
auauucaggcuacucauucag

SEQ ID NO: 817552 - RNA, 22 nt, Homo sapiens
auauucaggcuacucauucagu

SEQ ID NO: 817553 - RNA, 22 nt, Homo sapiens
auaccuccucccuaaugcucac

SEQ ID NO: 817554 - RNA, 23 nt, Homo sapiens
auaccuuauuuauuuuuguguag

SEQ ID NO: 817555 - RNA, 15 nt, Homo sapiens
auaccuuccuucccu

SEQ ID NO: 817556 - RNA, 21 nt, Homo sapiens
auaccuuggcugauguugcag

SEQ ID NO: 817557 - RNA, 16 nt, Homo sapiens
auaccuuuuuguguca

SEQ ID NO: 817558 - RNA, 16 nt, Homo sapiens
auacgaaaucaguuuc

SEQ ID NO: 817559 - RNA, 16 nt, Homo sapiens
auacgagccuucucac

SEQ ID NO: 817560 - RNA, 18 nt, Homo sapiens
auacggaagagcagguga

SEQ ID NO: 817561 - RNA, 22 nt, Homo sapiens
auacuacaguaacugugacuga

SEQ ID NO: 817562 - RNA, 22 nt, Homo sapiens
auacuacauucgugugugucug

SEQ ID NO: 817563 - RNA, 21 nt, Homo sapiens
auacuacuccuguaauuccua

SEQ ID NO: 817564 - RNA, 15 nt, Homo sapiens
auacuagauguuaag

SEQ ID NO: 817565 - RNA, 16 nt, Homo sapiens
auacuaguagucauac

SEQ ID NO: 817566 - RNA, 15 nt, Homo sapiens
auacuauuauuugcu

SEQ ID NO: 817567 - RNA, 15 nt, Homo sapiens
auacuauugccucau

SEQ ID NO: 817568 - RNA, 23 nt, Homo sapiens
auacuccacucccagcagcucaa

SEQ ID NO: 817569 - RNA, 18 nt, Homo sapiens
auacuccauacauaacuu

SEQ ID NO: 817570 - RNA, 19 nt, Homo sapiens
auacucuugaaauguagaa

SEQ ID NO: 817571 - RNA, 21 nt, Homo sapiens
auacucuuuuuacaauccaua

SEQ ID NO: 817572 - RNA, 21 nt, Homo sapiens
auacugcucaucauuccuuga

SEQ ID NO: 817573 - RNA, 17 nt, Homo sapiens
auacuggucucaggcca

SEQ ID NO: 817574 - RNA, 18 nt, Homo sapiens
auacugguuauaguugau

SEQ ID NO: 817575 - RNA, 21 nt, Homo sapiens
auacuguagaagaagcccaua

SEQ ID NO: 817576 - RNA, 16 nt, Homo sapiens
auacuguauuuuuacc

SEQ ID NO: 817577 - RNA, 20 nt, Homo sapiens
auacugugagcuuacauuga

SEQ ID NO: 817578 - RNA, 13 nt, Homo sapiens
auacuguuuccau

SEQ ID NO: 817579 - RNA, 14 nt, Homo sapiens
auacuucauucucu

SEQ ID NO: 817580 - RNA, 18 nt, Homo sapiens
auacuucauucucucuca

SEQ ID NO: 817581 - RNA, 18 nt, Homo sapiens
auacuugccuucugauag

SEQ ID NO: 817582 - RNA, 20 nt, Homo sapiens
auacuugccuucugauagua

SEQ ID NO: 817583 - RNA, 19 nt, Homo sapiens
auacuuggaugcagcucuu

SEQ ID NO: 817584 - RNA, 15 nt, Homo sapiens
auacuuuacaaacca

SEQ ID NO: 817585 - RNA, 13 nt, Homo sapiens
auacuuugcauau

SEQ ID NO: 817586 - RNA, 24 nt, Homo sapiens
auacuuugguuggcagcauuccau

SEQ ID NO: 817587 - RNA, 20 nt, Homo sapiens
auacuuuuaaagccuauuca

SEQ ID NO: 817588 - RNA, 12 nt, Homo sapiens
auacuuuuggcu

SEQ ID NO: 817589 - RNA, 21 nt, Homo sapiens
auacuuuugugaacaaaaauu

SEQ ID NO: 817590 - RNA, 17 nt, Homo sapiens
auagaaacaugacacug

SEQ ID NO: 817591 - RNA, 18 nt, Homo sapiens
auagaaacaugacacuga

SEQ ID NO: 817592 - RNA, 19 nt, Homo sapiens
auagaaacguaaacuauga

SEQ ID NO: 817593 - RNA, 15 nt, Homo sapiens
auagaaacuugcuua

SEQ ID NO: 817594 - RNA, 17 nt, Homo sapiens
auagaaacuugcuuauc

SEQ ID NO: 817595 - RNA, 16 nt, Homo sapiens
auagaaagcuguuuau

SEQ ID NO: 817596 - RNA, 19 nt, Homo sapiens
auagaaagugccagaaagu

SEQ ID NO: 817597 - RNA, 23 nt, Homo sapiens
auagaaauuguaaaucagagguu

SEQ ID NO: 817598 - RNA, 14 nt, Homo sapiens
auagaacauccaga

SEQ ID NO: 817599 - RNA, 12 nt, Homo sapiens
auagaacugucc

SEQ ID NO: 817600 - RNA, 13 nt, Homo sapiens
auagaagaagcua

SEQ ID NO: 817601 - RNA, 15 nt, Homo sapiens
auagaaguagcaaaa

SEQ ID NO: 817602 - RNA, 17 nt, Homo sapiens
auagaauaaaagcuaua

SEQ ID NO: 817603 - RNA, 15 nt, Homo sapiens
auagaauacauguaa

SEQ ID NO: 817604 - RNA, 20 nt, Homo sapiens
auagacaaaagaauaagaca

SEQ ID NO: 817605 - RNA, 18 nt, Homo sapiens
auagacacugaucuggcu

SEQ ID NO: 817606 - RNA, 19 nt, Homo sapiens
auagacuggauggaaagac

SEQ ID NO: 817607 - RNA, 18 nt, Homo sapiens
auagacuguaagcuccau

SEQ ID NO: 817608 - RNA, 15 nt, Homo sapiens
auagacuuaauacau

SEQ ID NO: 817609 - RNA, 19 nt, Homo sapiens
auagacuuaauacaugcaa

SEQ ID NO: 817610 - RNA, 14 nt, Homo sapiens
auagacuuacugca

SEQ ID NO: 817611 - RNA, 23 nt, Homo sapiens
auagagacggagauccuaagguc

SEQ ID NO: 817612 - RNA, 13 nt, Homo sapiens
auagaguacugca

SEQ ID NO: 817613 - RNA, 20 nt, Homo sapiens
auagauauuuuauauguaug

SEQ ID NO: 817614 - RNA, 23 nt, Homo sapiens
auagaucagcaaaccggggccua

SEQ ID NO: 817615 - RNA, 20 nt, Homo sapiens
auagauccccccacugagcu

SEQ ID NO: 817616 - RNA, 23 nt, Homo sapiens
auagaugcuggcccagggcccag

SEQ ID NO: 817617 - RNA, 20 nt, Homo sapiens
auagauggcugaacaucagg

SEQ ID NO: 817618 - RNA, 14 nt, Homo sapiens
auagaugugagcca

SEQ ID NO: 817619 - RNA, 15 nt, Homo sapiens
auagaugugagccag

SEQ ID NO: 817620 - RNA, 14 nt, Homo sapiens
auagauguguuauu

SEQ ID NO: 817621 - RNA, 16 nt, Homo sapiens
auagauuaauggcacu

SEQ ID NO: 817622 - RNA, 19 nt, Homo sapiens
auagauuaauggcacugau

SEQ ID NO: 817623 - RNA, 19 nt, Homo sapiens
auagauuacugaugugaua

SEQ ID NO: 817624 - RNA, 17 nt, Homo sapiens
auagauuucuacacuga

SEQ ID NO: 817625 - RNA, 12 nt, Homo sapiens
auagcaagugaa

SEQ ID NO: 817626 - RNA, 15 nt, Homo sapiens
auagcaagugaaagc

SEQ ID NO: 817627 - RNA, 23 nt, Homo sapiens
auagcacacuuuuccacauucca

SEQ ID NO: 817628 - RNA, 18 nt, Homo sapiens
auagcaccuccacauacc

SEQ ID NO: 817629 - RNA, 12 nt, Homo sapiens
auagcacugggc

SEQ ID NO: 817630 - RNA, 13 nt, Homo sapiens
auagcaucucagg

SEQ ID NO: 817631 - RNA, 21 nt, Homo sapiens
auagcauggggccccuggccc

SEQ ID NO: 817632 - RNA, 12 nt, Homo sapiens
auagccaaaaau

SEQ ID NO: 817633 - RNA, 14 nt, Homo sapiens
auagccaacugcug

SEQ ID NO: 817634 - RNA, 13 nt, Homo sapiens
auagcuucaggag

SEQ ID NO: 817635 - RNA, 19 nt, Homo sapiens
auagcuugcauagucaaua

SEQ ID NO: 817636 - RNA, 14 nt, Homo sapiens
auaggaaaacauug

SEQ ID NO: 817637 - RNA, 14 nt, Homo sapiens
auaggaauauucaa

SEQ ID NO: 817638 - RNA, 17 nt, Homo sapiens
auaggacauugugucag

SEQ ID NO: 817639 - RNA, 14 nt, Homo sapiens
auaggaccugcauc

SEQ ID NO: 817640 - RNA, 18 nt, Homo sapiens
auaggagccgauggaucu

SEQ ID NO: 817641 - RNA, 15 nt, Homo sapiens
auaggcaugagccac

SEQ ID NO: 817642 - RNA, 19 nt, Homo sapiens
auaggccaucaauaucaca

SEQ ID NO: 817643 - RNA, 16 nt, Homo sapiens
auaggccugucccuug

SEQ ID NO: 817644 - RNA, 20 nt, Homo sapiens
auagggggaagacagauaug

SEQ ID NO: 817645 - RNA, 19 nt, Homo sapiens
auaggugcuacaaaaacac

SEQ ID NO: 817646 - RNA, 12 nt, Homo sapiens
auaggugcuuau

SEQ ID NO: 817647 - RNA, 16 nt, Homo sapiens
auaguaacaucaaaga

SEQ ID NO: 817648 - RNA, 17 nt, Homo sapiens
auaguaacaucaaagau

SEQ ID NO: 817649 - RNA, 19 nt, Homo sapiens
auaguaccuucaauacuua

SEQ ID NO: 817650 - RNA, 11 nt, Homo sapiens
auaguacuggc

SEQ ID NO: 817651 - RNA, 13 nt, Homo sapiens
auaguacuggcau

SEQ ID NO: 817652 - RNA, 20 nt, Homo sapiens
auaguauucaggugagcaau

SEQ ID NO: 817653 - RNA, 16 nt, Homo sapiens
auaguauuccauggug

SEQ ID NO: 817654 - RNA, 15 nt, Homo sapiens
auagucacauggccu

SEQ ID NO: 817655 - RNA, 13 nt, Homo sapiens
auaguccaaaaag

SEQ ID NO: 817656 - RNA, 21 nt, Homo sapiens
auaguccaccucccauuacuu

SEQ ID NO: 817657 - RNA, 22 nt, Homo sapiens
auagucccauuuuucucuugcc

SEQ ID NO: 817658 - RNA, 22 nt, Homo sapiens
auaguggguacaucaaguccau

SEQ ID NO: 817659 - RNA, 21 nt, Homo sapiens
auaguuaauaacuggaaaaag

SEQ ID NO: 817660 - RNA, 17 nt, Homo sapiens
auaguuaauuauuucaa

SEQ ID NO: 817661 - RNA, 13 nt, Homo sapiens
auaguuacuguaa

SEQ ID NO: 817662 - RNA, 21 nt, Homo sapiens
aucagucuuucuugagcagau

SEQ ID NO: 817663 - RNA, 21 nt, Homo sapiens
aucaguucuacggaucaucaa

SEQ ID NO: 817664 - RNA, 16 nt, Homo sapiens
aucaguugaggccagg

SEQ ID NO: 817665 - RNA, 16 nt, Homo sapiens
aucauaaaacuugaug

SEQ ID NO: 817666 - RNA, 13 nt, Homo sapiens
aucauaaagucag

SEQ ID NO: 817667 - RNA, 15 nt, Homo sapiens
aucauaaccauguga

SEQ ID NO: 817668 - RNA, 16 nt, Homo sapiens
aucauaagaauagcug

SEQ ID NO: 817669 - RNA, 16 nt, Homo sapiens
aucauaagggcacuga

SEQ ID NO: 817670 - RNA, 16 nt, Homo sapiens
aucauaauuacauucc

SEQ ID NO: 817671 - RNA, 18 nt, Homo sapiens
aucauagcaagaccucau

SEQ ID NO: 817672 - RNA, 17 nt, Homo sapiens
aucauagcucacugcag

SEQ ID NO: 817673 - RNA, 10 nt, Homo sapiens
aucauauuca

SEQ ID NO: 817674 - RNA, 19 nt, Homo sapiens
aucaucaaaaacuuuggag

SEQ ID NO: 817675 - RNA, 18 nt, Homo sapiens
aucaucaaaaagaacaac

SEQ ID NO: 817676 - RNA, 19 nt, Homo sapiens
aucaucaacaagauuuccu

SEQ ID NO: 817677 - RNA, 20 nt, Homo sapiens
aucaucaggaagccuguggu

SEQ ID NO: 817678 - RNA, 19 nt, Homo sapiens
aucauccagaaguuccuca

SEQ ID NO: 817679 - RNA, 22 nt, Homo sapiens
aucaucuauaaagaagaacuug

SEQ ID NO: 817680 - RNA, 11 nt, Homo sapiens
aucaucucagc

SEQ ID NO: 817681 - RNA, 13 nt, Homo sapiens
aucaucuguagau

SEQ ID NO: 817682 - RNA, 14 nt, Homo sapiens
aucaugagacauua

SEQ ID NO: 817683 - RNA, 20 nt, Homo sapiens
aucaugccccuguacuccag

SEQ ID NO: 817684 - RNA, 22 nt, Homo sapiens
aucaugguacauuuaucacuga

SEQ ID NO: 817685 - RNA, 19 nt, Homo sapiens
aucaugguagucacuaaca

SEQ ID NO: 817686 - RNA, 17 nt, Homo sapiens
aucauguaccucagauc

SEQ ID NO: 817687 - RNA, 15 nt, Homo sapiens
aucauguaugcaucc

SEQ ID NO: 817688 - RNA, 13 nt, Homo sapiens
aucaugucuguau

SEQ ID NO: 817689 - RNA, 18 nt, Homo sapiens
aucauguugaaacaaacc

SEQ ID NO: 817690 - RNA, 20 nt, Homo sapiens
aucauuacugccaucuuuau

SEQ ID NO: 817691 - RNA, 12 nt, Homo sapiens
aucauuagaaca

SEQ ID NO: 817692 - RNA, 15 nt, Homo sapiens
aucauucaacucucc

SEQ ID NO: 817693 - RNA, 16 nt, Homo sapiens
aucauucaacucucca

SEQ ID NO: 817694 - RNA, 19 nt, Homo sapiens
aucauucagcaucuacucu

SEQ ID NO: 817695 - RNA, 15 nt, Homo sapiens
aucauuguuggacau

SEQ ID NO: 817696 - RNA, 16 nt, Homo sapiens
aucauuugagcucaug

SEQ ID NO: 817697 - RNA, 13 nt, Homo sapiens
auccaacacugga

SEQ ID NO: 817698 - RNA, 14 nt, Homo sapiens
auccaacauccaga

SEQ ID NO: 817699 - RNA, 13 nt, Homo sapiens
auccaacguguaa

SEQ ID NO: 817700 - RNA, 13 nt, Homo sapiens
auccaacuccagc

SEQ ID NO: 817701 - RNA, 16 nt, Homo sapiens
auccaagaaucaguga

SEQ ID NO: 817702 - RNA, 23 nt, Homo sapiens
auccaagacuuagagcugggaau

SEQ ID NO: 817703 - RNA, 21 nt, Homo sapiens
auccaagauuuaaaugccaua

SEQ ID NO: 817704 - RNA, 16 nt, Homo sapiens
auccaagccagaguuu

SEQ ID NO: 817705 - RNA, 23 nt, Homo sapiens
auccaagcgaggucaacagagaa

SEQ ID NO: 817706 - RNA, 18 nt, Homo sapiens
auccaauggguuuuuccc

SEQ ID NO: 817707 - RNA, 20 nt, Homo sapiens
auccacaaaugaagggauau

SEQ ID NO: 817708 - RNA, 16 nt, Homo sapiens
auccacaaaugcaguu

SEQ ID NO: 817709 - RNA, 21 nt, Homo sapiens
auccacaccguacaucugcaa

SEQ ID NO: 817710 - RNA, 16 nt, Homo sapiens
auccacccaacccuau

SEQ ID NO: 817711 - RNA, 15 nt, Homo sapiens
auccaccccauccaa

SEQ ID NO: 817712 - RNA, 18 nt, Homo sapiens
auccaccccguugcucaa

SEQ ID NO: 817713 - RNA, 21 nt, Homo sapiens
auccaccccguugcucaagcc

SEQ ID NO: 817714 - RNA, 23 nt, Homo sapiens
auccaccgccacugggccuguca

SEQ ID NO: 817715 - RNA, 14 nt, Homo sapiens
auccacuuugacuc

SEQ ID NO: 817716 - RNA, 11 nt, Homo sapiens
auccacuuugc

SEQ ID NO: 817717 - RNA, 15 nt, Homo sapiens
auccacuuugcucug

SEQ ID NO: 817718 - RNA, 18 nt, Homo sapiens
auccacuuugcucugaau

SEQ ID NO: 817719 - RNA, 19 nt, Homo sapiens
auccacuuugcucugaaug

SEQ ID NO: 817720 - RNA, 14 nt, Homo sapiens
auccagaacagugg

SEQ ID NO: 817721 - RNA, 17 nt, Homo sapiens
auccagaccccaugccu

SEQ ID NO: 817722 - RNA, 14 nt, Homo sapiens
auccagcacuggug

SEQ ID NO: 817723 - RNA, 18 nt, Homo sapiens
auccagccuccugcuaac

SEQ ID NO: 817724 - RNA, 14 nt, Homo sapiens
auccagcuaugaau

SEQ ID NO: 817725 - RNA, 22 nt, Homo sapiens
auccagcuccccuucugaauca

SEQ ID NO: 817726 - RNA, 20 nt, Homo sapiens
auccaggaucaugagacauu

SEQ ID NO: 817727 - RNA, 15 nt, Homo sapiens
auccaggcagaucca

SEQ ID NO: 817728 - RNA, 16 nt, Homo sapiens
auccaggcagauccag

SEQ ID NO: 817729 - RNA, 19 nt, Homo sapiens
auccaggcgugguggcaca

SEQ ID NO: 817730 - RNA, 16 nt, Homo sapiens
auccaggcuuaccaaa

SEQ ID NO: 817731 - RNA, 21 nt, Homo sapiens
auccagugaccucucucucug

SEQ ID NO: 817732 - RNA, 16 nt, Homo sapiens
auccagugguggguaa

SEQ ID NO: 817733 - RNA, 23 nt, Homo sapiens
auccauagugacuuuucaaguau

SEQ ID NO: 817734 - RNA, 14 nt, Homo sapiens
auccauccauccaa

SEQ ID NO: 817735 - RNA, 14 nt, Homo sapiens
auccauccuuccaa

SEQ ID NO: 817736 - RNA, 24 nt, Homo sapiens
auccaucuuugaacuucugacuac

SEQ ID NO: 817737 - RNA, 18 nt, Homo sapiens
auccaugcaccuaccuua

SEQ ID NO: 817738 - RNA, 18 nt, Homo sapiens
auccaugcgucaguuuuu

SEQ ID NO: 817739 - RNA, 20 nt, Homo sapiens
auccaugcuuggguguaaca

SEQ ID NO: 817740 - RNA, 19 nt, Homo sapiens
auccauggggcugauugua

SEQ ID NO: 817741 - RNA, 18 nt, Homo sapiens
auccauuaccuccaucca

SEQ ID NO: 817742 - RNA, 20 nt, Homo sapiens
auccauuaccuccauccauc

SEQ ID NO: 817743 - RNA, 15 nt, Homo sapiens
auccauugaacuaaa

SEQ ID NO: 817744 - RNA, 13 nt, Homo sapiens
auccauuuuacac

SEQ ID NO: 817745 - RNA, 21 nt, Homo sapiens
aucccaaaucugucagcaucu

SEQ ID NO: 817746 - RNA, 15 nt, Homo sapiens
aucccaagaaaugga

SEQ ID NO: 817747 - RNA, 15 nt, Homo sapiens
aucccaagaaugcaa

SEQ ID NO: 817748 - RNA, 15 nt, Homo sapiens
aucccaagucauuuc

SEQ ID NO: 817749 - RNA, 15 nt, Homo sapiens
aucccacauccaacu

SEQ ID NO: 817750 - RNA, 15 nt, Homo sapiens
aucccaccacugcac

SEQ ID NO: 817751 - RNA, 22 nt, Homo sapiens
aucccagauaugguugcacaaa

SEQ ID NO: 817752 - RNA, 13 nt, Homo sapiens
aucccagcacuuu

SEQ ID NO: 817753 - RNA, 12 nt, Homo sapiens
aucccagcauuu

SEQ ID NO: 817754 - RNA, 17 nt, Homo sapiens
aucccagcuacucaaga

SEQ ID NO: 817755 - RNA, 15 nt, Homo sapiens
aucccagcuacucag

SEQ ID NO: 817756 - RNA, 21 nt, Homo sapiens
aucccaggggaccacaccucc

SEQ ID NO: 817757 - RNA, 21 nt, Homo sapiens
aucccagucacuccucucuag

SEQ ID NO: 817758 - RNA, 17 nt, Homo sapiens
aucccaugaacacacug

SEQ ID NO: 817759 - RNA, 16 nt, Homo sapiens
aucccauggaaccacu

SEQ ID NO: 817760 - RNA, 17 nt, Homo sapiens
auccccacccagucuca

SEQ ID NO: 817761 - RNA, 16 nt, Homo sapiens
auccccaggcaccuca

SEQ ID NO: 817762 - RNA, 16 nt, Homo sapiens
auccccccacugagcu

SEQ ID NO: 817763 - RNA, 20 nt, Homo sapiens
auccccggggcggcaggaag

SEQ ID NO: 817764 - RNA, 17 nt, Homo sapiens
aucccgaaaaucucucg

SEQ ID NO: 817765 - RNA, 17 nt, Homo sapiens
aucccguaucacagugu

SEQ ID NO: 817766 - RNA, 16 nt, Homo sapiens
aucccguguugccaug

SEQ ID NO: 817767 - RNA, 13 nt, Homo sapiens
aucccucccugac

SEQ ID NO: 817768 - RNA, 15 nt, Homo sapiens
aucccucucuucccc

SEQ ID NO: 817769 - RNA, 22 nt, Homo sapiens
aucccugacaucuggaaucugg

SEQ ID NO: 817770 - RNA, 16 nt, Homo sapiens
aucccugccuguuaag

SEQ ID NO: 817771 - RNA, 15 nt, Homo sapiens
aucccuggaugugga

SEQ ID NO: 817772 - RNA, 19 nt, Homo sapiens
aucccugucauuuuuaaca

SEQ ID NO: 817773 - RNA, 16 nt, Homo sapiens
aucccuucggagccaa

SEQ ID NO: 817774 - RNA, 13 nt, Homo sapiens
auccgaaguauga

SEQ ID NO: 817775 - RNA, 12 nt, Homo sapiens
auccgacuugaa

SEQ ID NO: 817776 - RNA, 15 nt, Homo sapiens
agggacaagggauuc

SEQ ID NO: 817777 - RNA, 21 nt, Homo sapiens
agggacagagccccacgcugu

SEQ ID NO: 817778 - RNA, 15 nt, Homo sapiens
agggacagucaguuu

SEQ ID NO: 817779 - RNA, 22 nt, Homo sapiens
agggacccagccuucagucaca

SEQ ID NO: 817780 - RNA, 14 nt, Homo sapiens
agggagaacgggaa

SEQ ID NO: 817781 - RNA, 20 nt, Homo sapiens
agggagaauaaaauuccuau

SEQ ID NO: 817782 - RNA, 21 nt, Homo sapiens
agggagacccccaucuuuaca

SEQ ID NO: 817783 - RNA, 16 nt, Homo sapiens
agggagagagugcuau

SEQ ID NO: 817784 - RNA, 15 nt, Homo sapiens
agggagagccaucac

SEQ ID NO: 817785 - RNA, 14 nt, Homo sapiens
agggagauucagac

SEQ ID NO: 817786 - RNA, 20 nt, Homo sapiens
agggagcccccagaggacuu

SEQ ID NO: 817787 - RNA, 16 nt, Homo sapiens
agggagccgagaucac

SEQ ID NO: 817788 - RNA, 19 nt, Homo sapiens
agggagccgcaccuuguca

SEQ ID NO: 817789 - RNA, 21 nt, Homo sapiens
agggagcuaucaggaacagcu

SEQ ID NO: 817790 - RNA, 18 nt, Homo sapiens
agggagcucugaugagca

SEQ ID NO: 817791 - RNA, 14 nt, Homo sapiens
agggagcucugggg

SEQ ID NO: 817792 - RNA, 14 nt, Homo sapiens
agggagcugaguaa

SEQ ID NO: 817793 - RNA, 20 nt, Homo sapiens
agggagcugaguaacaccau

SEQ ID NO: 817794 - RNA, 22 nt, Homo sapiens
ugugcuccuccuacccuuccag

SEQ ID NO: 817795 - RNA, 18 nt, Homo sapiens
ugugcucuggcaccauca

SEQ ID NO: 817796 - RNA, 23 nt, Homo sapiens
ugugcugaaauaauuacugguaa

SEQ ID NO: 817797 - RNA, 19 nt, Homo sapiens
ugugcugcaccuggucaua

SEQ ID NO: 817798 - RNA, 21 nt, Homo sapiens
ugugcugcagcucccauuuca

SEQ ID NO: 817799 - RNA, 15 nt, Homo sapiens
ugugcugcugcuuca

SEQ ID NO: 817800 - RNA, 21 nt, Homo sapiens
ugugcuggaaagcguugaugg

SEQ ID NO: 817801 - RNA, 16 nt, Homo sapiens
ugugcuggucauggaa

SEQ ID NO: 817802 - RNA, 11 nt, Homo sapiens
ugugcugugac

SEQ ID NO: 817803 - RNA, 18 nt, Homo sapiens
ugugcuuagaauugcugg

SEQ ID NO: 817804 - RNA, 16 nt, Homo sapiens
uguggaagagcauuag

SEQ ID NO: 817805 - RNA, 19 nt, Homo sapiens
uguggaaggcaagccaggc

SEQ ID NO: 817806 - RNA, 16 nt, Homo sapiens
uguggagcagagcucu

SEQ ID NO: 817807 - RNA, 17 nt, Homo sapiens
uguggagccccagcaua

SEQ ID NO: 817808 - RNA, 18 nt, Homo sapiens
uguggaguggguaaucca

SEQ ID NO: 817809 - RNA, 14 nt, Homo sapiens
uguggaugauguug

SEQ ID NO: 817810 - RNA, 15 nt, Homo sapiens
uguggauucuauauu

SEQ ID NO: 817811 - RNA, 21 nt, Homo sapiens
uguggcacucagggagcauuu

SEQ ID NO: 817812 - RNA, 15 nt, Homo sapiens
uguggcagcucuccc

SEQ ID NO: 817813 - RNA, 13 nt, Homo sapiens
uguggcagugguu

SEQ ID NO: 817814 - RNA, 15 nt, Homo sapiens
uguggcagugguuuu

SEQ ID NO: 817815 - RNA, 22 nt, Homo sapiens
uguggcauaaauugcaucacug

SEQ ID NO: 817816 - RNA, 18 nt, Homo sapiens
uguggcaucaccaggguu

SEQ ID NO: 817817 - RNA, 19 nt, Homo sapiens
uguggcccagggaagccaa

SEQ ID NO: 817818 - RNA, 23 nt, Homo sapiens
uguggcccagggaagccaaaaga

SEQ ID NO: 817819 - RNA, 15 nt, Homo sapiens
uguggccccuuuuac

SEQ ID NO: 817820 - RNA, 16 nt, Homo sapiens
uguggccugccuucac

SEQ ID NO: 817821 - RNA, 23 nt, Homo sapiens
uguggccuugcccgccagccuca

SEQ ID NO: 817822 - RNA, 18 nt, Homo sapiens
uguggcuuauggauucau

SEQ ID NO: 817823 - RNA, 14 nt, Homo sapiens
uguggcuuccucag

SEQ ID NO: 817824 - RNA, 18 nt, Homo sapiens
uguggcuuuuaugcuuuc

SEQ ID NO: 817825 - RNA, 17 nt, Homo sapiens
ugugggagccugcaaac

SEQ ID NO: 817826 - RNA, 17 nt, Homo sapiens
ugugggccaccagagaa

SEQ ID NO: 817827 - RNA, 17 nt, Homo sapiens
uguggggaagaggggcu

SEQ ID NO: 817828 - RNA, 21 nt, Homo sapiens
uguggggagggauuuggggcu

SEQ ID NO: 817829 - RNA, 19 nt, Homo sapiens
ugugggugucagucaggga

SEQ ID NO: 817830 - RNA, 13 nt, Homo sapiens
uguggguguccug

SEQ ID NO: 817831 - RNA, 15 nt, Homo sapiens
uguggguuauacaca

SEQ ID NO: 817832 - RNA, 20 nt, Homo sapiens
uguggucaauccgaaguaug

SEQ ID NO: 817833 - RNA, 21 nt, Homo sapiens
uguggucaauccgaaguauga

SEQ ID NO: 817834 - RNA, 21 nt, Homo sapiens
uguggugaccugauguaaaca

SEQ ID NO: 817835 - RNA, 22 nt, Homo sapiens
uguggugagcagaaguggagcu

SEQ ID NO: 817836 - RNA, 14 nt, Homo sapiens
ugugguuacaagaa

SEQ ID NO: 817837 - RNA, 14 nt, Homo sapiens
ugugguuacuuccu

SEQ ID NO: 817838 - RNA, 16 nt, Homo sapiens
ugugguugaaaaccac

SEQ ID NO: 817839 - RNA, 13 nt, Homo sapiens
ugugguuuacuag

SEQ ID NO: 817840 - RNA, 19 nt, Homo sapiens
ugugguuucagaugugcaa

SEQ ID NO: 817841 - RNA, 13 nt, Homo sapiens
uguguaauaugca

SEQ ID NO: 817842 - RNA, 18 nt, Homo sapiens
uguguacagucuuugcag

SEQ ID NO: 817843 - RNA, 21 nt, Homo sapiens
uguguacaguugguucauccc

SEQ ID NO: 817844 - RNA, 12 nt, Homo sapiens
uguguaccucua

SEQ ID NO: 817845 - RNA, 16 nt, Homo sapiens
uguguaccugugacua

SEQ ID NO: 817846 - RNA, 15 nt, Homo sapiens
uguguagccugugca

SEQ ID NO: 817847 - RNA, 13 nt, Homo sapiens
uguguagcuccca

SEQ ID NO: 817848 - RNA, 18 nt, Homo sapiens
uguguagucaagucacca

SEQ ID NO: 817849 - RNA, 14 nt, Homo sapiens
uguguauacuugua

SEQ ID NO: 817850 - RNA, 22 nt, Homo sapiens
uguguauauaaauacaugcaca

SEQ ID NO: 817851 - RNA, 16 nt, Homo sapiens
uguguauauaguauga

SEQ ID NO: 817852 - RNA, 23 nt, Homo sapiens
uguguauccaugcaccuaccuua

SEQ ID NO: 817853 - RNA, 9 nt, Homo sapiens
uguguauga

SEQ ID NO: 817854 - RNA, 16 nt, Homo sapiens
uguguauguuugcaca

SEQ ID NO: 817855 - RNA, 21 nt, Homo sapiens
uguguauucuguggauucuau

SEQ ID NO: 817856 - RNA, 17 nt, Homo sapiens
uguguauuuaacugccu

SEQ ID NO: 817857 - RNA, 24 nt, Homo sapiens
uguguauuuccagugcaauuguag

SEQ ID NO: 817858 - RNA, 22 nt, Homo sapiens
uguguauuuguauuaauaaagc

SEQ ID NO: 817859 - RNA, 19 nt, Homo sapiens
ugugucaaugccugucuua

SEQ ID NO: 817860 - RNA, 23 nt, Homo sapiens
ugugucagaaaaaggaaaccaca

SEQ ID NO: 817861 - RNA, 13 nt, Homo sapiens
ugugucauguaua

SEQ ID NO: 817862 - RNA, 21 nt, Homo sapiens
ugugucccgaauccacagucg

SEQ ID NO: 817863 - RNA, 16 nt, Homo sapiens
ugugucuguacacgug

SEQ ID NO: 817864 - RNA, 13 nt, Homo sapiens
ugugucugucagc

SEQ ID NO: 817865 - RNA, 21 nt, Homo sapiens
ugugugaaacaauguugucca

SEQ ID NO: 817866 - RNA, 18 nt, Homo sapiens
ugugugaacuaacaugca

SEQ ID NO: 817867 - RNA, 22 nt, Homo sapiens
ugugugacuuacagaaacugca

SEQ ID NO: 817868 - RNA, 18 nt, Homo sapiens
ugugugagcuaugcaaac

SEQ ID NO: 817869 - RNA, 12 nt, Homo sapiens
ugugugauuucc

SEQ ID NO: 817870 - RNA, 10 nt, Homo sapiens
ugugugcaca

SEQ ID NO: 817871 - RNA, 11 nt, Homo sapiens
ugugugcacau

SEQ ID NO: 817872 - RNA, 16 nt, Homo sapiens
ugugugcgugcgcauc

SEQ ID NO: 817873 - RNA, 20 nt, Homo sapiens
uguguggcaaugggauuugg

SEQ ID NO: 817874 - RNA, 13 nt, Homo sapiens
uguguggugcuac

SEQ ID NO: 817875 - RNA, 14 nt, Homo sapiens
ugugugguggagcc

SEQ ID NO: 817876 - RNA, 11 nt, Homo sapiens
ugugugguggg

SEQ ID NO: 817877 - RNA, 14 nt, Homo sapiens
uguguguaccugug

SEQ ID NO: 817878 - RNA, 11 nt, Homo sapiens
uguguguauau

SEQ ID NO: 817879 - RNA, 15 nt, Homo sapiens
ugugugugugcacau

SEQ ID NO: 817880 - RNA, 13 nt, Homo sapiens
ugugugugugcgu

SEQ ID NO: 817881 - RNA, 22 nt, Homo sapiens
uguguguuagcagucaaaucua

SEQ ID NO: 817882 - RNA, 22 nt, Homo sapiens
uguguuacugcuuugcaaagac

SEQ ID NO: 817883 - RNA, 20 nt, Homo sapiens
uguguuauuauuuugcacug

SEQ ID NO: 817884 - RNA, 22 nt, Homo sapiens
uguguuauuauuuugcacuguu

SEQ ID NO: 817885 - RNA, 15 nt, Homo sapiens
uguguucaccuucaa

SEQ ID NO: 817886 - RNA, 13 nt, Homo sapiens
uguguucugucac

SEQ ID NO: 817887 - RNA, 17 nt, Homo sapiens
uguguugagauccagug

SEQ ID NO: 817888 - RNA, 18 nt, Homo sapiens
uguguuucuauugacuuc

SEQ ID NO: 817889 - RNA, 19 nt, Homo sapiens
uguguuuguagucuugucu

SEQ ID NO: 817890 - RNA, 14 nt, Homo sapiens
uguguuuuuaauaa

SEQ ID NO: 817891 - RNA, 21 nt, Homo sapiens
uguguuuuuaauaaagacagg

SEQ ID NO: 817892 - RNA, 18 nt, Homo sapiens
uguuaaaaaaaaugauaa

SEQ ID NO: 817893 - RNA, 17 nt, Homo sapiens
uguuaaaauacucagug

SEQ ID NO: 817894 - RNA, 14 nt, Homo sapiens
ugguguagcacuua

SEQ ID NO: 817895 - RNA, 13 nt, Homo sapiens
uggugucaggcag

SEQ ID NO: 817896 - RNA, 17 nt, Homo sapiens
uggugucuccuuuacua

SEQ ID NO: 817897 - RNA, 14 nt, Homo sapiens
ugguguggcugcuc

SEQ ID NO: 817898 - RNA, 16 nt, Homo sapiens
ugguguggguguccug

SEQ ID NO: 817899 - RNA, 21 nt, Homo sapiens
ugguguucaaaaaaacacuag

SEQ ID NO: 817900 - RNA, 16 nt, Homo sapiens
ugguguugacauacau

SEQ ID NO: 817901 - RNA, 17 nt, Homo sapiens
ugguuaaacauuaauau

SEQ ID NO: 817902 - RNA, 14 nt, Homo sapiens
ugguuaacaucuca

SEQ ID NO: 817903 - RNA, 15 nt, Homo sapiens
ugguuaacaucucag

SEQ ID NO: 817904 - RNA, 17 nt, Homo sapiens
ugguuauucaaguauuc

SEQ ID NO: 817905 - RNA, 19 nt, Homo sapiens
ugguucaggaaaacuacug

SEQ ID NO: 817906 - RNA, 15 nt, Homo sapiens
ugguucagugccuuc

SEQ ID NO: 817907 - RNA, 23 nt, Homo sapiens
ugguucauauuuauacuuugcaa

SEQ ID NO: 817908 - RNA, 18 nt, Homo sapiens
ugguuccaugcagccuug

SEQ ID NO: 817909 - RNA, 12 nt, Homo sapiens
ugguucucucca

SEQ ID NO: 817910 - RNA, 14 nt, Homo sapiens
ugguugaaaaccac

SEQ ID NO: 817911 - RNA, 14 nt, Homo sapiens
ugguugacauugua

SEQ ID NO: 817912 - RNA, 22 nt, Homo sapiens
ugguuggccgugguccagcucu

SEQ ID NO: 817913 - RNA, 18 nt, Homo sapiens
ugguugggggaggggccu

SEQ ID NO: 817914 - RNA, 15 nt, Homo sapiens
ugguuggguccucac

SEQ ID NO: 817915 - RNA, 21 nt, Homo sapiens
ugguugugccuucccuucucu

SEQ ID NO: 817916 - RNA, 14 nt, Homo sapiens
ugguuuaaagcaaa

SEQ ID NO: 817917 - RNA, 18 nt, Homo sapiens
ugguuuaaauaugaauga

SEQ ID NO: 817918 - RNA, 15 nt, Homo sapiens
ugguuuccacauuua

SEQ ID NO: 817919 - RNA, 17 nt, Homo sapiens
ugguuucccaucuccau

SEQ ID NO: 817920 - RNA, 15 nt, Homo sapiens
ugguuuccuauuucc

SEQ ID NO: 817921 - RNA, 13 nt, Homo sapiens
ugguuugagacac

SEQ ID NO: 817922 - RNA, 15 nt, Homo sapiens
ugguuugugugauca

SEQ ID NO: 817923 - RNA, 12 nt, Homo sapiens
ugguuuuuacug

SEQ ID NO: 817924 - RNA, 19 nt, Homo sapiens
ugguuuuuggcucuuucag

SEQ ID NO: 817925 - RNA, 14 nt, Homo sapiens
uguaaaaaauggag

SEQ ID NO: 817926 - RNA, 12 nt, Homo sapiens
uguaaaaagccc

SEQ ID NO: 817927 - RNA, 18 nt, Homo sapiens
uguaaaacuauauucuca

SEQ ID NO: 817928 - RNA, 13 nt, Homo sapiens
uguaaaacuguua

SEQ ID NO: 817929 - RNA, 20 nt, Homo sapiens
uguaaaacuuuggugcauug

SEQ ID NO: 817930 - RNA, 23 nt, Homo sapiens
uguaaaacuuuggugcauuguua

SEQ ID NO: 817931 - RNA, 18 nt, Homo sapiens
uguaaaagagucaucugg

SEQ ID NO: 817932 - RNA, 14 nt, Homo sapiens
uguaaaagcacaug

SEQ ID NO: 817933 - RNA, 21 nt, Homo sapiens
uguaaaauauuuaugagaaag

SEQ ID NO: 817934 - RNA, 19 nt, Homo sapiens
uguaaaaucccaucugcua

SEQ ID NO: 817935 - RNA, 12 nt, Homo sapiens
uguaaaaugcaa

SEQ ID NO: 817936 - RNA, 20 nt, Homo sapiens
uguaaaaugugaagugaaug

SEQ ID NO: 817937 - RNA, 15 nt, Homo sapiens
uguaaaauuauuuca

SEQ ID NO: 817938 - RNA, 18 nt, Homo sapiens
uguaaacaaaccacagca

SEQ ID NO: 817939 - RNA, 16 nt, Homo sapiens
uguaaacccucaaggg

SEQ ID NO: 817940 - RNA, 21 nt, Homo sapiens
uguaaaccuagaguuuuauca

SEQ ID NO: 817941 - RNA, 13 nt, Homo sapiens
uguaaacuuuauc

SEQ ID NO: 817942 - RNA, 17 nt, Homo sapiens
uguaaacuuuaucacuu

SEQ ID NO: 817943 - RNA, 17 nt, Homo sapiens
uguaaaguagaauaagc

SEQ ID NO: 817944 - RNA, 23 nt, Homo sapiens
uguaaagugugggagaccgagga

SEQ ID NO: 817945 - RNA, 23 nt, Homo sapiens
uguaaaucugccacaaaaacagg

SEQ ID NO: 817946 - RNA, 13 nt, Homo sapiens
uguaaaugcauau

SEQ ID NO: 817947 - RNA, 19 nt, Homo sapiens
uguaaauguugugcuguua

SEQ ID NO: 817948 - RNA, 15 nt, Homo sapiens
uguaaauuucucaaa

SEQ ID NO: 817949 - RNA, 16 nt, Homo sapiens
uguaaauuuguacuau

SEQ ID NO: 817950 - RNA, 11 nt, Homo sapiens
uguaacacauu

SEQ ID NO: 817951 - RNA, 13 nt, Homo sapiens
uguaacacuuguc

SEQ ID NO: 817952 - RNA, 17 nt, Homo sapiens
uguaacagucaaauauc

SEQ ID NO: 817953 - RNA, 14 nt, Homo sapiens
uguaacaucaggga

SEQ ID NO: 817954 - RNA, 21 nt, Homo sapiens
uguaacugagagaaagauucu

SEQ ID NO: 817955 - RNA, 13 nt, Homo sapiens
uguaacugcugaa

SEQ ID NO: 817956 - RNA, 15 nt, Homo sapiens
uguaacuuccugcug

SEQ ID NO: 817957 - RNA, 12 nt, Homo sapiens
uguaacuuucau

SEQ ID NO: 817958 - RNA, 14 nt, Homo sapiens
uguaacuuucauac

SEQ ID NO: 817959 - RNA, 15 nt, Homo sapiens
uguaagaaaauguua

SEQ ID NO: 817960 - RNA, 23 nt, Homo sapiens
uguaagaaauaacacugugaaug

SEQ ID NO: 817961 - RNA, 12 nt, Homo sapiens
uguaagaacaac

SEQ ID NO: 817962 - RNA, 19 nt, Homo sapiens
uguaagacauuuguauauu

SEQ ID NO: 817963 - RNA, 16 nt, Homo sapiens
uguaagagaaauggaa

SEQ ID NO: 817964 - RNA, 14 nt, Homo sapiens
uguaagagugauuu

SEQ ID NO: 817965 - RNA, 23 nt, Homo sapiens
uguaagaucguucucugccucac

SEQ ID NO: 817966 - RNA, 18 nt, Homo sapiens
uguaagauuucauucuga

SEQ ID NO: 817967 - RNA, 14 nt, Homo sapiens
uguaagauuuucca

SEQ ID NO: 817968 - RNA, 22 nt, Homo sapiens
uguaagcucuacugaggugcua

SEQ ID NO: 817969 - RNA, 15 nt, Homo sapiens
uguaaggcucuagau

SEQ ID NO: 817970 - RNA, 21 nt, Homo sapiens
uguaagggauggcuggcugga

SEQ ID NO: 817971 - RNA, 18 nt, Homo sapiens
uguaagugagagagacaa

SEQ ID NO: 817972 - RNA, 15 nt, Homo sapiens
uguaauacuuuacaa

SEQ ID NO: 817973 - RNA, 16 nt, Homo sapiens
uguaauagugacauau

SEQ ID NO: 817974 - RNA, 14 nt, Homo sapiens
uguaauauacaguu

SEQ ID NO: 817975 - RNA, 19 nt, Homo sapiens
uguaaucccagcacuuugg

SEQ ID NO: 817976 - RNA, 20 nt, Homo sapiens
uguaaucccagcacuuuggc

SEQ ID NO: 817977 - RNA, 18 nt, Homo sapiens
uguaaugaaaaugaauau

SEQ ID NO: 817978 - RNA, 21 nt, Homo sapiens
uguaaugaucagaugaacuca

SEQ ID NO: 817979 - RNA, 17 nt, Homo sapiens
uguaaugucaccaccuu

SEQ ID NO: 817980 - RNA, 20 nt, Homo sapiens
uguaauuaaaagcaaaucau

SEQ ID NO: 817981 - RNA, 23 nt, Homo sapiens
uguaauuggaaucuucaccucag

SEQ ID NO: 817982 - RNA, 23 nt, Homo sapiens
uguaauuuuaaauaaaagugauc

SEQ ID NO: 817983 - RNA, 16 nt, Homo sapiens
uguacaaaacaguuug

SEQ ID NO: 817984 - RNA, 13 nt, Homo sapiens
uguacaacugcac

SEQ ID NO: 817985 - RNA, 12 nt, Homo sapiens
uguacaauguga

SEQ ID NO: 817986 - RNA, 15 nt, Homo sapiens
uguacacaacaaucc

SEQ ID NO: 817987 - RNA, 17 nt, Homo sapiens
uguacagauucuuucag

SEQ ID NO: 817988 - RNA, 20 nt, Homo sapiens
uguacaguagauuuuccaaa

SEQ ID NO: 817989 - RNA, 13 nt, Homo sapiens
uguacauuucacc

SEQ ID NO: 817990 - RNA, 22 nt, Homo sapiens
uguacccuccuccccacacaga

SEQ ID NO: 817991 - RNA, 19 nt, Homo sapiens
uguacgcacuggagcugca

SEQ ID NO: 817992 - RNA, 19 nt, Homo sapiens
uguacgcugcugcaggaca

SEQ ID NO: 817993 - RNA, 17 nt, Homo sapiens
uguacgcuuugcucaaa

SEQ ID NO: 817994 - RNA, 18 nt, Homo sapiens
uguacguuuugcacauuu

SEQ ID NO: 817995 - RNA, 23 nt, Homo sapiens
uguacuaaaccaccucagaaagg

SEQ ID NO: 817996 - RNA, 21 nt, Homo sapiens
uguacuacagcuauauuugau

SEQ ID NO: 817997 - RNA, 15 nt, Homo sapiens
uggccuuuaucucaa

SEQ ID NO: 817998 - RNA, 13 nt, Homo sapiens
uggcgaagcucag

SEQ ID NO: 817999 - RNA, 18 nt, Homo sapiens
uggcgcaggugccaugcc

SEQ ID NO: 818000 - RNA, 16 nt, Homo sapiens
uggcgcaucauaugca

SEQ ID NO: 818001 - RNA, 15 nt, Homo sapiens
uggcgcgaucucagc

SEQ ID NO: 818002 - RNA, 16 nt, Homo sapiens
uggcgcgaucucagcu

SEQ ID NO: 818003 - RNA, 18 nt, Homo sapiens
uggcgcgaucucagcuca

SEQ ID NO: 818004 - RNA, 19 nt, Homo sapiens
uggcgcgaucucagcucac

SEQ ID NO: 818005 - RNA, 21 nt, Homo sapiens
uggcgcuuagagaggacaaua

SEQ ID NO: 818006 - RNA, 20 nt, Homo sapiens
uggcggcccuucugacuguu

SEQ ID NO: 818007 - RNA, 13 nt, Homo sapiens
uggcggccuuccg

SEQ ID NO: 818008 - RNA, 19 nt, Homo sapiens
uggcgugaucucagcucac

SEQ ID NO: 818009 - RNA, 19 nt, Homo sapiens
uggcgugcucagacccaac

SEQ ID NO: 818010 - RNA, 14 nt, Homo sapiens
uggcguuacugcuu

SEQ ID NO: 818011 - RNA, 15 nt, Homo sapiens
uggcguuacugcuug

SEQ ID NO: 818012 - RNA, 22 nt, Homo sapiens
uggcguuacugcuugaccaaag

SEQ ID NO: 818013 - RNA, 18 nt, Homo sapiens
ugggcuggggcugcuccc

SEQ ID NO: 818014 - RNA, 20 nt, Homo sapiens
ugggcuuucaaaaaccauau

SEQ ID NO: 818015 - RNA, 15 nt, Homo sapiens
uggggaaaaaacugu

SEQ ID NO: 818016 - RNA, 12 nt, Homo sapiens
uggggaaagggg

SEQ ID NO: 818017 - RNA, 15 nt, Homo sapiens
uggggaacacagcua

SEQ ID NO: 818018 - RNA, 18 nt, Homo sapiens
uggggaacagagcaagac

SEQ ID NO: 818019 - RNA, 15 nt, Homo sapiens
uggggaagcugugaa

SEQ ID NO: 818020 - RNA, 16 nt, Homo sapiens
uggggaagcugugaaa

SEQ ID NO: 818021 - RNA, 16 nt, Homo sapiens
uggggagcacuugucc

SEQ ID NO: 818022 - RNA, 20 nt, Homo sapiens
uggggauagaggaaagggau

SEQ ID NO: 818023 - RNA, 17 nt, Homo sapiens
uggggaucucaggggcu

SEQ ID NO: 818024 - RNA, 14 nt, Homo sapiens
uggggcaagaugag

SEQ ID NO: 818025 - RNA, 24 nt, Homo sapiens
uggggcaggcugggccauguccaa

SEQ ID NO: 818026 - RNA, 12 nt, Homo sapiens
uggggccaccaa

SEQ ID NO: 818027 - RNA, 22 nt, Homo sapiens
uggggccaccaaagcugcccac

SEQ ID NO: 818028 - RNA, 14 nt, Homo sapiens
uggggccagaucca

SEQ ID NO: 818029 - RNA, 18 nt, Homo sapiens
uggggccaggaccauggc

SEQ ID NO: 818030 - RNA, 13 nt, Homo sapiens
uggggccauugcu

SEQ ID NO: 818031 - RNA, 15 nt, Homo sapiens
uggggccucaccugc

SEQ ID NO: 818032 - RNA, 17 nt, Homo sapiens
uggggccucaccugcug

SEQ ID NO: 818033 - RNA, 18 nt, Homo sapiens
uggggccuccagaacuca

SEQ ID NO: 818034 - RNA, 22 nt, Homo sapiens
uggggccucuccuacuaugcaa

SEQ ID NO: 818035 - RNA, 10 nt, Homo sapiens
uggggcuccu

SEQ ID NO: 818036 - RNA, 18 nt, Homo sapiens
uggggcuccuuucuccag

SEQ ID NO: 818037 - RNA, 15 nt, Homo sapiens
uggggcugauuguau

SEQ ID NO: 818038 - RNA, 21 nt, Homo sapiens
uggggcuggaugucuccaucu

SEQ ID NO: 818039 - RNA, 15 nt, Homo sapiens
uggggcuguccugcu

SEQ ID NO: 818040 - RNA, 16 nt, Homo sapiens
uggggcuguccugcug

SEQ ID NO: 818041 - RNA, 23 nt, Homo sapiens
ugggggaaaguguugaccacaga

SEQ ID NO: 818042 - RNA, 15 nt, Homo sapiens
ugggggaagacuuua

SEQ ID NO: 818043 - RNA, 19 nt, Homo sapiens
uggggggacccagugcaga

SEQ ID NO: 818044 - RNA, 20 nt, Homo sapiens
ugggggugccgcucucucug

SEQ ID NO: 818045 - RNA, 21 nt, Homo sapiens
ugggggugccgcucucucuga

SEQ ID NO: 818046 - RNA, 18 nt, Homo sapiens
ugggggugccgcugucuc

SEQ ID NO: 818047 - RNA, 23 nt, Homo sapiens
ugggggugccgcuuucucugagg

SEQ ID NO: 818048 - RNA, 12 nt, Homo sapiens
uggggguguuca

SEQ ID NO: 818049 - RNA, 18 nt, Homo sapiens
ugggguuucuggggucca

SEQ ID NO: 818050 - RNA, 16 nt, Homo sapiens
uggguacaaaaaguca

SEQ ID NO: 818051 - RNA, 19 nt, Homo sapiens
uggguacugaaagccuuag

SEQ ID NO: 818052 - RNA, 21 nt, Homo sapiens
uggguacugaaagccuuaggg

SEQ ID NO: 818053 - RNA, 22 nt, Homo sapiens
uggguauaaaggcuaaaaggga

SEQ ID NO: 818054 - RNA, 17 nt, Homo sapiens
ugggucaaaccaagaag

SEQ ID NO: 818055 - RNA, 18 nt, Homo sapiens
ugggucacagagugagac

SEQ ID NO: 818056 - RNA, 13 nt, Homo sapiens
ugggucaugugca

SEQ ID NO: 818057 - RNA, 14 nt, Homo sapiens
uggguccuuuucag

SEQ ID NO: 818058 - RNA, 14 nt, Homo sapiens
ugggucuauguucc

SEQ ID NO: 818059 - RNA, 15 nt, Homo sapiens
ugggucuucccugua

SEQ ID NO: 818060 - RNA, 18 nt, Homo sapiens
ugggugcgugguauacau

SEQ ID NO: 818061 - RNA, 14 nt, Homo sapiens
uggguggaaagugc

SEQ ID NO: 818062 - RNA, 16 nt, Homo sapiens
uggguggagaagggag

SEQ ID NO: 818063 - RNA, 16 nt, Homo sapiens
ugggugggugggauga

SEQ ID NO: 818064 - RNA, 18 nt, Homo sapiens
ugggugucagucagggac

SEQ ID NO: 818065 - RNA, 16 nt, Homo sapiens
uggguuaagagcucac

SEQ ID NO: 818066 - RNA, 17 nt, Homo sapiens
uggguuauuuuuauuaa

SEQ ID NO: 818067 - RNA, 14 nt, Homo sapiens
uggguuugguuaga

SEQ ID NO: 818068 - RNA, 12 nt, Homo sapiens
uggguuuuacca

SEQ ID NO: 818069 - RNA, 14 nt, Homo sapiens
ugguaaaaagaucc

SEQ ID NO: 818070 - RNA, 19 nt, Homo sapiens
ugguaaagccucauuugaa

SEQ ID NO: 818071 - RNA, 20 nt, Homo sapiens
ugguaaccagccacaguaca

SEQ ID NO: 818072 - RNA, 23 nt, Homo sapiens
ugguaacugauuaccugccaauu

SEQ ID NO: 818073 - RNA, 13 nt, Homo sapiens
ugguaaguaacug

SEQ ID NO: 818074 - RNA, 18 nt, Homo sapiens
ugguacuuuauucuugcu

SEQ ID NO: 818075 - RNA, 12 nt, Homo sapiens
ugguagcacuug

SEQ ID NO: 818076 - RNA, 17 nt, Homo sapiens
ugguaggauaucuuggc

SEQ ID NO: 818077 - RNA, 14 nt, Homo sapiens
ugguagguguuuga

SEQ ID NO: 818078 - RNA, 19 nt, Homo sapiens
ugguaguuguggcuuuuau

SEQ ID NO: 818079 - RNA, 22 nt, Homo sapiens
ugguauccugugacauguaaca

SEQ ID NO: 818080 - RNA, 21 nt, Homo sapiens
ugguauggacaaaauugcaga

SEQ ID NO: 818081 - RNA, 19 nt, Homo sapiens
ugguaugggggauuucaaa

SEQ ID NO: 818082 - RNA, 18 nt, Homo sapiens
ugguauuauauaauucaa

SEQ ID NO: 818083 - RNA, 12 nt, Homo sapiens
ugguauucauua

SEQ ID NO: 818084 - RNA, 15 nt, Homo sapiens
ugguauugcagagaa

SEQ ID NO: 818085 - RNA, 23 nt, Homo sapiens
uggucaagggcugucauugcaca

SEQ ID NO: 818086 - RNA, 18 nt, Homo sapiens
uggucaauauagcaagac

SEQ ID NO: 818087 - RNA, 19 nt, Homo sapiens
uggucaauccgaaguauga

SEQ ID NO: 818088 - RNA, 20 nt, Homo sapiens
uggucaauccgaaguaugag

SEQ ID NO: 818089 - RNA, 14 nt, Homo sapiens
uggucacauacaau

SEQ ID NO: 818090 - RNA, 20 nt, Homo sapiens
uggucacccuucaacgcucc

SEQ ID NO: 818091 - RNA, 14 nt, Homo sapiens
uggucagagugcca

SEQ ID NO: 818092 - RNA, 20 nt, Homo sapiens
uggucauagaaacaauaaau

SEQ ID NO: 818093 - RNA, 15 nt, Homo sapiens
uggucauccaaacuc

SEQ ID NO: 818094 - RNA, 20 nt, Homo sapiens
uggucccggggccagcacuu

SEQ ID NO: 818095 - RNA, 16 nt, Homo sapiens
ugguccuggcugcacu

SEQ ID NO: 818096 - RNA, 18 nt, Homo sapiens
ugguccuggcugcacucu

SEQ ID NO: 818097 - RNA, 14 nt, Homo sapiens
uggucgagugacac

SEQ ID NO: 818098 - RNA, 20 nt, Homo sapiens
uggucuaagguucagccuga

SEQ ID NO: 818099 - RNA, 19 nt, Homo sapiens
uggucuaauuauuuacuca

SEQ ID NO: 818100 - RNA, 16 nt, Homo sapiens
uggucucacuacuuga

SEQ ID NO: 818101 - RNA, 19 nt, Homo sapiens
uggucugcauuagucucau

SEQ ID NO: 818102 - RNA, 21 nt, Homo sapiens
uggucuucaagacgacagcuc

SEQ ID NO: 818103 - RNA, 21 nt, Homo sapiens
uggucuuucugaauugcacau

SEQ ID NO: 818104 - RNA, 13 nt, Homo sapiens
uggucuuugcucc

SEQ ID NO: 818105 - RNA, 23 nt, Homo sapiens
uggugaaaccccaucucuaugaa

SEQ ID NO: 818106 - RNA, 19 nt, Homo sapiens
uggugaaacccccaucucu

SEQ ID NO: 818107 - RNA, 20 nt, Homo sapiens
uggugaaaccccgucucuac

SEQ ID NO: 818108 - RNA, 20 nt, Homo sapiens
uggugaacugagcugggcag

SEQ ID NO: 818109 - RNA, 18 nt, Homo sapiens
uggugaauaacuaugcca

SEQ ID NO: 818110 - RNA, 17 nt, Homo sapiens
uggugacaccagccuuu

SEQ ID NO: 818111 - RNA, 16 nt, Homo sapiens
uggugaccuuucacga

SEQ ID NO: 818112 - RNA, 20 nt, Homo sapiens
uggugagcucugggaagugu

SEQ ID NO: 818113 - RNA, 14 nt, Homo sapiens
uggugaucagugca

SEQ ID NO: 818114 - RNA, 15 nt, Homo sapiens
cuuuaaauggcuuua

SEQ ID NO: 818115 - RNA, 12 nt, Homo sapiens
cuuuaagaaugu

SEQ ID NO: 818116 - RNA, 15 nt, Homo sapiens
cuuuaagcaacacag

SEQ ID NO: 818117 - RNA, 15 nt, Homo sapiens
cuuuaagccaaagaa

SEQ ID NO: 818118 - RNA, 14 nt, Homo sapiens
cuuuaagccugcau

SEQ ID NO: 818119 - RNA, 13 nt, Homo sapiens
cuuuaauacaaaa

SEQ ID NO: 818120 - RNA, 17 nt, Homo sapiens
cuuuaauacaaaaagca

SEQ ID NO: 818121 - RNA, 22 nt, Homo sapiens
cuuuaauaguuuugauccuaaa

SEQ ID NO: 818122 - RNA, 19 nt, Homo sapiens
cuuuaaucuucaguuuuau

SEQ ID NO: 818123 - RNA, 21 nt, Homo sapiens
cuuuaauucauaaaucacaaa

SEQ ID NO: 818124 - RNA, 15 nt, Homo sapiens
cuuuacacucaggcu

SEQ ID NO: 818125 - RNA, 13 nt, Homo sapiens
cuuuacaguuaca

SEQ ID NO: 818126 - RNA, 17 nt, Homo sapiens
cuuuacccaccuagaac

SEQ ID NO: 818127 - RNA, 11 nt, Homo sapiens
cuuuaccucag

SEQ ID NO: 818128 - RNA, 12 nt, Homo sapiens
cuuuaccucagg

SEQ ID NO: 818129 - RNA, 22 nt, Homo sapiens
cuuuaccugcaggcuccaugca

SEQ ID NO: 818130 - RNA, 17 nt, Homo sapiens
cuuuaccugcugggacc

SEQ ID NO: 818131 - RNA, 20 nt, Homo sapiens
cuuuacuucauggacuucca

SEQ ID NO: 818132 - RNA, 13 nt, Homo sapiens
cuuuacuucccag

SEQ ID NO: 818133 - RNA, 11 nt, Homo sapiens
cuuuacuugac

SEQ ID NO: 818134 - RNA, 13 nt, Homo sapiens
cuuuagaaugaga

SEQ ID NO: 818135 - RNA, 14 nt, Homo sapiens
cuuccuguguccau

SEQ ID NO: 818136 - RNA, 14 nt, Homo sapiens
cuuccuguguccug

SEQ ID NO: 818137 - RNA, 22 nt, Homo sapiens
cuuccuguguguccaaaacugc

SEQ ID NO: 818138 - RNA, 15 nt, Homo sapiens
cuuccuuacccaaac

SEQ ID NO: 818139 - RNA, 22 nt, Homo sapiens
cuuccuuuugaaguuucauugg

SEQ ID NO: 818140 - RNA, 15 nt, Homo sapiens
cuucgaggcccagcg

SEQ ID NO: 818141 - RNA, 14 nt, Homo sapiens
cuucgcaaccgcaa

SEQ ID NO: 818142 - RNA, 13 nt, Homo sapiens
cuucgcacucaau

SEQ ID NO: 818143 - RNA, 16 nt, Homo sapiens
cuucguaagaaggaau

SEQ ID NO: 818144 - RNA, 16 nt, Homo sapiens
cuucuaaaaguacugc

SEQ ID NO: 818145 - RNA, 19 nt, Homo sapiens
cuucuaaucccagcacuuu

SEQ ID NO: 818146 - RNA, 22 nt, Homo sapiens
cuucuaauugcuguguguccca

SEQ ID NO: 818147 - RNA, 18 nt, Homo sapiens
cuucuacagcagcacugu

SEQ ID NO: 818148 - RNA, 19 nt, Homo sapiens
cuucuaccuuaaaauguaa

SEQ ID NO: 818149 - RNA, 12 nt, Homo sapiens
cuucuacugcua

SEQ ID NO: 818150 - RNA, 23 nt, Homo sapiens
cuucuagaaucucguuucuccuc

SEQ ID NO: 818151 - RNA, 20 nt, Homo sapiens
cuucuagcuuagugcuaugu

SEQ ID NO: 818152 - RNA, 20 nt, Homo sapiens
cuucuaguuucccacaauau

SEQ ID NO: 818153 - RNA, 14 nt, Homo sapiens
cuucuaugcugcuu

SEQ ID NO: 818154 - RNA, 15 nt, Homo sapiens
cuucuauggggucua

SEQ ID NO: 818155 - RNA, 22 nt, Homo sapiens
cuucuauuccauggcuaacugg

SEQ ID NO: 818156 - RNA, 14 nt, Homo sapiens
cuucucaaagcacu

SEQ ID NO: 818157 - RNA, 16 nt, Homo sapiens
cugugacuagaaccau

SEQ ID NO: 818158 - RNA, 22 nt, Homo sapiens
cugugacuauaaagcuguuauu

SEQ ID NO: 818159 - RNA, 21 nt, Homo sapiens
cugugacucccccucuuucac

SEQ ID NO: 818160 - RNA, 23 nt, Homo sapiens
cugugacugaagaagaugagccu

SEQ ID NO: 818161 - RNA, 21 nt, Homo sapiens
cugugacuuaagaagccuuac

SEQ ID NO: 818162 - RNA, 18 nt, Homo sapiens
cugugacuuaucuaccau

SEQ ID NO: 818163 - RNA, 23 nt, Homo sapiens
cugugagacgaggcaggggcucu

SEQ ID NO: 818164 - RNA, 18 nt, Homo sapiens
cugugagcuuacauugaa

SEQ ID NO: 818165 - RNA, 16 nt, Homo sapiens
cugugaguauugcuua

SEQ ID NO: 818166 - RNA, 18 nt, Homo sapiens
cugugauacgaugcuuca

SEQ ID NO: 818167 - RNA, 22 nt, Homo sapiens
cugugauauuuucacacuggua

SEQ ID NO: 818168 - RNA, 22 nt, Homo sapiens
cugugaugacuugccauuaaaa

SEQ ID NO: 818169 - RNA, 17 nt, Homo sapiens
cugugauuagaucacau

SEQ ID NO: 818170 - RNA, 21 nt, Homo sapiens
cugugauucccuccugcuacu

SEQ ID NO: 818171 - RNA, 18 nt, Homo sapiens
cugugcaaauccuugaua

SEQ ID NO: 818172 - RNA, 18 nt, Homo sapiens
cugugcaggauauuugca

SEQ ID NO: 818173 - RNA, 21 nt, Homo sapiens
cugugcaggcauggucccuua

SEQ ID NO: 818174 - RNA, 14 nt, Homo sapiens
cugugcaucaacca

SEQ ID NO: 818175 - RNA, 16 nt, Homo sapiens
cugugcaucaguggga

SEQ ID NO: 818176 - RNA, 10 nt, Homo sapiens
cugugccaac

SEQ ID NO: 818177 - RNA, 23 nt, Homo sapiens
cugugccaacuacuacuggugau

SEQ ID NO: 818178 - RNA, 21 nt, Homo sapiens
cugugccagacauugcucuca

SEQ ID NO: 818179 - RNA, 23 nt, Homo sapiens
cugugcccagcacagugccugac

SEQ ID NO: 818180 - RNA, 15 nt, Homo sapiens
cugugcccagcaugc

SEQ ID NO: 818181 - RNA, 20 nt, Homo sapiens
cugugcccggggaaaggcaa

SEQ ID NO: 818182 - RNA, 14 nt, Homo sapiens
cugcugaaugcagg

SEQ ID NO: 818183 - RNA, 16 nt, Homo sapiens
cugcugacauucccau

SEQ ID NO: 818184 - RNA, 22 nt, Homo sapiens
cugcugaccaauugugcugcca

SEQ ID NO: 818185 - RNA, 22 nt, Homo sapiens
cugcugaccucccagugacccc

SEQ ID NO: 818186 - RNA, 20 nt, Homo sapiens
cugcugauaucaacagcuuc

SEQ ID NO: 818187 - RNA, 14 nt, Homo sapiens
cugcugcaaggugg

SEQ ID NO: 818188 - RNA, 17 nt, Homo sapiens
cugcugcauagcucuau

SEQ ID NO: 818189 - RNA, 15 nt, Homo sapiens
cugcugcccagugca

SEQ ID NO: 818190 - RNA, 21 nt, Homo sapiens
cugcugcccagugcaaaccac

SEQ ID NO: 818191 - RNA, 15 nt, Homo sapiens
cugcugcugcugcug

SEQ ID NO: 818192 - RNA, 20 nt, Homo sapiens
cugcuggagaggaacccaga

SEQ ID NO: 818193 - RNA, 17 nt, Homo sapiens
cugcuggggaccuuggc

SEQ ID NO: 818194 - RNA, 15 nt, Homo sapiens
cugcugguaccugcc

SEQ ID NO: 818195 - RNA, 16 nt, Homo sapiens
cugcugucauaacauc

SEQ ID NO: 818196 - RNA, 21 nt, Homo sapiens
cugcuguccacaugaccucca

SEQ ID NO: 818197 - RNA, 14 nt, Homo sapiens
cugcuguccugcaa

SEQ ID NO: 818198 - RNA, 21 nt, Homo sapiens
cugcugucuacaaaaugccaa

SEQ ID NO: 818199 - RNA, 14 nt, Homo sapiens
cugcugucuuguug

SEQ ID NO: 818200 - RNA, 16 nt, Homo sapiens
cugcuguggggaccac

SEQ ID NO: 818201 - RNA, 21 nt, Homo sapiens
cugcuguuuggcuuaacacau

SEQ ID NO: 818202 - RNA, 20 nt, Homo sapiens
cugcuuaaauuucuccagug

SEQ ID NO: 818203 - RNA, 15 nt, Homo sapiens
cugcuuacuugguga

SEQ ID NO: 818204 - RNA, 19 nt, Homo sapiens
cugcuucacaaaccuugcu

SEQ ID NO: 818205 - RNA, 16 nt, Homo sapiens
cugcuucccuguugaa

SEQ ID NO: 818206 - RNA, 14 nt, Homo sapiens
cugcuucucggggu

SEQ ID NO: 818207 - RNA, 15 nt, Homo sapiens
cugcuucugaacuca

SEQ ID NO: 818208 - RNA, 16 nt, Homo sapiens
cugcuucugauaugca

SEQ ID NO: 818209 - RNA, 22 nt, Homo sapiens
cugcuucuguguguggugagca

SEQ ID NO: 818210 - RNA, 23 nt, Homo sapiens
cugcuucuuggagcuuuggaaua

SEQ ID NO: 818211 - RNA, 14 nt, Homo sapiens
cugcuugaccaaag

SEQ ID NO: 818212 - RNA, 15 nt, Homo sapiens
cugcuugcugcucau

SEQ ID NO: 818213 - RNA, 22 nt, Homo sapiens
cugcuuggauaugaaacuguag

SEQ ID NO: 818214 - RNA, 13 nt, Homo sapiens
cugcuuugccaag

SEQ ID NO: 818215 - RNA, 19 nt, Homo sapiens
cugcuuuuaaaugaccaaa

SEQ ID NO: 818216 - RNA, 23 nt, Homo sapiens
cuggaaaacagaaaccauucuag

SEQ ID NO: 818217 - RNA, 16 nt, Homo sapiens
cuggaaaacagaacac

SEQ ID NO: 818218 - RNA, 18 nt, Homo sapiens
cuggaaauguagcacuua

SEQ ID NO: 818219 - RNA, 15 nt, Homo sapiens
cuggaacauuccaaa

SEQ ID NO: 818220 - RNA, 16 nt, Homo sapiens
cuggaacuugaguuau

SEQ ID NO: 818221 - RNA, 17 nt, Homo sapiens
cuggaagacacuucaga

SEQ ID NO: 818222 - RNA, 13 nt, Homo sapiens
cuggaagagccaa

SEQ ID NO: 818223 - RNA, 14 nt, Homo sapiens
cuggaagagccaaa

SEQ ID NO: 818224 - RNA, 17 nt, Homo sapiens
cuggaaucuggagacca

SEQ ID NO: 818225 - RNA, 16 nt, Homo sapiens
cuggaaugcagugaca

SEQ ID NO: 818226 - RNA, 14 nt, Homo sapiens
cuggaauugccagc

SEQ ID NO: 818227 - RNA, 13 nt, Homo sapiens
cuggacaagccaa

SEQ ID NO: 818228 - RNA, 22 nt, Homo sapiens
cuggacaggcucugcuucucca

SEQ ID NO: 818229 - RNA, 19 nt, Homo sapiens
cuggacucccacucuuuga

SEQ ID NO: 818230 - RNA, 17 nt, Homo sapiens
cuggacugugugcaacg

SEQ ID NO: 818231 - RNA, 15 nt, Homo sapiens
cuggagaaccucauc

SEQ ID NO: 818232 - RNA, 20 nt, Homo sapiens
cuggagauaugaaggauuac

SEQ ID NO: 818233 - RNA, 22 nt, Homo sapiens
cuggagaugcagcuacuggaau

SEQ ID NO: 818234 - RNA, 15 nt, Homo sapiens
cuggagcagaacuuu

SEQ ID NO: 818235 - RNA, 21 nt, Homo sapiens
cuggagccaucucuuccucau

SEQ ID NO: 818236 - RNA, 21 nt, Homo sapiens
cuggagcccuaaccccuucca

SEQ ID NO: 818237 - RNA, 19 nt, Homo sapiens
cuggagccuccacugccuc

SEQ ID NO: 818238 - RNA, 17 nt, Homo sapiens
cuggaggaguuccuuga

SEQ ID NO: 818239 - RNA, 20 nt, Homo sapiens
cuggaggccggaaucucagc

SEQ ID NO: 818240 - RNA, 13 nt, Homo sapiens
cuggaggcucugu

SEQ ID NO: 818241 - RNA, 21 nt, Homo sapiens
cuggaggcugcaccuacugag

SEQ ID NO: 818242 - RNA, 19 nt, Homo sapiens
cuggagggggagcaccagc

SEQ ID NO: 818243 - RNA, 17 nt, Homo sapiens
cuggagguugaagccaa

SEQ ID NO: 818244 - RNA, 15 nt, Homo sapiens
cuggagucucagagc

SEQ ID NO: 818245 - RNA, 12 nt, Homo sapiens
cuggagugcagu

SEQ ID NO: 818246 - RNA, 20 nt, Homo sapiens
cuggagugcaguggcgcaau

SEQ ID NO: 818247 - RNA, 20 nt, Homo sapiens
cuggagugcaguggcgugau

SEQ ID NO: 818248 - RNA, 21 nt, Homo sapiens
cuggagugcaguggugugauc

SEQ ID NO: 818249 - RNA, 17 nt, Homo sapiens
cuggauacuaagcacaa

SEQ ID NO: 818250 - RNA, 19 nt, Homo sapiens
cuggauagaaccaccauag

SEQ ID NO: 818251 - RNA, 15 nt, Homo sapiens
cuggauauuuaguuc

SEQ ID NO: 818252 - RNA, 21 nt, Homo sapiens
cuggaucuugccuaaauccca

SEQ ID NO: 818253 - RNA, 16 nt, Homo sapiens
cuggauggcaccucag

SEQ ID NO: 818254 - RNA, 14 nt, Homo sapiens
cuggaugucuccau

SEQ ID NO: 818255 - RNA, 15 nt, Homo sapiens
cuggauucacucacu

SEQ ID NO: 818256 - RNA, 17 nt, Homo sapiens
cuggauuucauacugua

SEQ ID NO: 818257 - RNA, 19 nt, Homo sapiens
cuggauuugcaggugaaca

SEQ ID NO: 818258 - RNA, 20 nt, Homo sapiens
cuggauuugggagcucugcu

SEQ ID NO: 818259 - RNA, 22 nt, Homo sapiens
cuggcaacagagcgagauucca

SEQ ID NO: 818260 - RNA, 14 nt, Homo sapiens
cuggcaacaucuuu

SEQ ID NO: 818261 - RNA, 14 nt, Homo sapiens
cuggcaacugcuaa

SEQ ID NO: 818262 - RNA, 17 nt, Homo sapiens
cuggcaagucaccugca

SEQ ID NO: 818263 - RNA, 21 nt, Homo sapiens
cuggcaaugaaaaauucucag

SEQ ID NO: 818264 - RNA, 15 nt, Homo sapiens
cuggcacaguuuucu

SEQ ID NO: 818265 - RNA, 20 nt, Homo sapiens
cuggcacauuggaaagcaca

SEQ ID NO: 818266 - RNA, 21 nt, Homo sapiens
cugguugcuucagaccugaca

SEQ ID NO: 818267 - RNA, 19 nt, Homo sapiens
cugguugucauuuuugcag

SEQ ID NO: 818268 - RNA, 18 nt, Homo sapiens
cugguuguuaugugauca

SEQ ID NO: 818269 - RNA, 21 nt, Homo sapiens
cugguuuaauuucauguguau

SEQ ID NO: 818270 - RNA, 20 nt, Homo sapiens
cugguuucuguucuguugau

SEQ ID NO: 818271 - RNA, 20 nt, Homo sapiens
cugguuugaaagaugcagug

SEQ ID NO: 818272 - RNA, 18 nt, Homo sapiens
cugguuugucaaacaaca

SEQ ID NO: 818273 - RNA, 21 nt, Homo sapiens
cuguaaagauguuuauuucag

SEQ ID NO: 818274 - RNA, 18 nt, Homo sapiens
cuguaaauugcagaauuc

SEQ ID NO: 818275 - RNA, 20 nt, Homo sapiens
cuguaacacauaguggcuuc

SEQ ID NO: 818276 - RNA, 16 nt, Homo sapiens
cuguaacagacuaauu

SEQ ID NO: 818277 - RNA, 12 nt, Homo sapiens
cuguaacuacuu

SEQ ID NO: 818278 - RNA, 23 nt, Homo sapiens
cuguaacucacauucucuuccca

SEQ ID NO: 818279 - RNA, 17 nt, Homo sapiens
cuguaacugguaguguu

SEQ ID NO: 818280 - RNA, 16 nt, Homo sapiens
cuguaaggcauuuuca

SEQ ID NO: 818281 - RNA, 21 nt, Homo sapiens
cuguaauauuguaaauacugg

SEQ ID NO: 818282 - RNA, 19 nt, Homo sapiens
cuguaaucccaacacuuug

SEQ ID NO: 818283 - RNA, 17 nt, Homo sapiens
cuguaaucccagcacuu

SEQ ID NO: 818284 - RNA, 18 nt, Homo sapiens
cuguaaucccagcacuuu

SEQ ID NO: 818285 - RNA, 18 nt, Homo sapiens
cuguaaucucagcacuuu

SEQ ID NO: 818286 - RNA, 19 nt, Homo sapiens
cuguaaucucagcacuuug

SEQ ID NO: 818287 - RNA, 12 nt, Homo sapiens
cuguaaugacaa

SEQ ID NO: 818288 - RNA, 22 nt, Homo sapiens
cuguaaugaucagaugaacuca

SEQ ID NO: 818289 - RNA, 23 nt, Homo sapiens
cuguacaaaguagaagucuuaga

SEQ ID NO: 818290 - RNA, 18 nt, Homo sapiens
cuguacauugugagcucu

SEQ ID NO: 818291 - RNA, 21 nt, Homo sapiens
cuguaccacguggguccucuu

SEQ ID NO: 818292 - RNA, 22 nt, Homo sapiens
cuguaccauauucagcauuuga

SEQ ID NO: 818293 - RNA, 21 nt, Homo sapiens
cuccccacaccucccuacucc

SEQ ID NO: 818294 - RNA, 20 nt, Homo sapiens
cuccccagacuccaccguca

SEQ ID NO: 818295 - RNA, 17 nt, Homo sapiens
cuccccagcccagagac

SEQ ID NO: 818296 - RNA, 13 nt, Homo sapiens
cuccccaggggag

SEQ ID NO: 818297 - RNA, 11 nt, Homo sapiens
cuccccagugc

SEQ ID NO: 818298 - RNA, 23 nt, Homo sapiens
cuccccaguucauugcacuuuga

SEQ ID NO: 818299 - RNA, 12 nt, Homo sapiens
cuccccauggag

SEQ ID NO: 818300 - RNA, 21 nt, Homo sapiens
cuccccauuugggacaucaag

SEQ ID NO: 818301 - RNA, 19 nt, Homo sapiens
cuccccguguaaaaagccu

SEQ ID NO: 818302 - RNA, 16 nt, Homo sapiens
cuccccuaacaggugc

SEQ ID NO: 818303 - RNA, 12 nt, Homo sapiens
cuccccuaucca

SEQ ID NO: 818304 - RNA, 18 nt, Homo sapiens
cuccccuccggacuggug

SEQ ID NO: 818305 - RNA, 18 nt, Homo sapiens
cuccccugcccuggucca

SEQ ID NO: 818306 - RNA, 14 nt, Homo sapiens
cuccccugcuccca

SEQ ID NO: 818307 - RNA, 15 nt, Homo sapiens
cuccccuguaccuuu

SEQ ID NO: 818308 - RNA, 16 nt, Homo sapiens
cuccccuuucacaggu

SEQ ID NO: 818309 - RNA, 20 nt, Homo sapiens
cucccgaguagcugggauua

SEQ ID NO: 818310 - RNA, 17 nt, Homo sapiens
cucccggguucaaguga

SEQ ID NO: 818311 - RNA, 19 nt, Homo sapiens
cucccggguucaagugauu

SEQ ID NO: 818312 - RNA, 13 nt, Homo sapiens
cucccuaccuugc

SEQ ID NO: 818313 - RNA, 16 nt, Homo sapiens
cucccuaccuugccuc

SEQ ID NO: 818314 - RNA, 21 nt, Homo sapiens
cucccuaggcugcccacucuc

SEQ ID NO: 818315 - RNA, 19 nt, Homo sapiens
cucccuaguuagcauccag

SEQ ID NO: 818316 - RNA, 18 nt, Homo sapiens
cucccuccagacaaugcc

SEQ ID NO: 818317 - RNA, 18 nt, Homo sapiens
cucccucggaaugcuaag

SEQ ID NO: 818318 - RNA, 16 nt, Homo sapiens
cucccucucaguggag

SEQ ID NO: 818319 - RNA, 16 nt, Homo sapiens
cucccucugaccugca

SEQ ID NO: 818320 - RNA, 19 nt, Homo sapiens
cucccucugcuguguuccc

SEQ ID NO: 818321 - RNA, 18 nt, Homo sapiens
cucccugaagaccaaaau

SEQ ID NO: 818322 - RNA, 22 nt, Homo sapiens
cucccugcaagaaaucagccau

SEQ ID NO: 818323 - RNA, 15 nt, Homo sapiens
cucccugccaccagg

SEQ ID NO: 818324 - RNA, 17 nt, Homo sapiens
cucccugggcagugcuc

SEQ ID NO: 818325 - RNA, 14 nt, Homo sapiens
cucccuguccuccu

SEQ ID NO: 818326 - RNA, 13 nt, Homo sapiens
cucccuguugcug

SEQ ID NO: 818327 - RNA, 23 nt, Homo sapiens
cucccuugggaagggcagggaau

SEQ ID NO: 818328 - RNA, 15 nt, Homo sapiens
cucccuuuaguggag

SEQ ID NO: 818329 - RNA, 15 nt, Homo sapiens
cucccuuucucucuc

SEQ ID NO: 818330 - RNA, 18 nt, Homo sapiens
cucccuuugccagugccu

SEQ ID NO: 818331 - RNA, 21 nt, Homo sapiens
cuccgaccacuuccaggggaa

SEQ ID NO: 818332 - RNA, 15 nt, Homo sapiens
cuccgcaacagccaa

SEQ ID NO: 818333 - RNA, 24 nt, Homo sapiens
cuccggucccaaauguagcaggug

SEQ ID NO: 818334 - RNA, 17 nt, Homo sapiens
cuccgugcuuaaccaaa

SEQ ID NO: 818335 - RNA, 22 nt, Homo sapiens
cuccuaagcaacuaggccuuca

SEQ ID NO: 818336 - RNA, 19 nt, Homo sapiens
cuccuaagcuggagugcag

SEQ ID NO: 818337 - RNA, 20 nt, Homo sapiens
cuccuacauaucccuuccag

SEQ ID NO: 818338 - RNA, 15 nt, Homo sapiens
cuccuacuaugcaau

SEQ ID NO: 818339 - RNA, 13 nt, Homo sapiens
cuccuacugagga

SEQ ID NO: 818340 - RNA, 19 nt, Homo sapiens
cuccuacuuacaacccagg

SEQ ID NO: 818341 - RNA, 22 nt, Homo sapiens
cuccuagaagaaccaaauaccu

SEQ ID NO: 818342 - RNA, 20 nt, Homo sapiens
cuccuaucuugauuucacug

SEQ ID NO: 818343 - RNA, 21 nt, Homo sapiens
cuccucacuggaggagcagcu

SEQ ID NO: 818344 - RNA, 18 nt, Homo sapiens
cuccucacuuggcugucu

SEQ ID NO: 818345 - RNA, 21 nt, Homo sapiens
cuccucagaucugaacacagu

SEQ ID NO: 818346 - RNA, 16 nt, Homo sapiens
cuccucaggcacacag

SEQ ID NO: 818347 - RNA, 22 nt, Homo sapiens
cuccucagugacaucaaagccu

SEQ ID NO: 818348 - RNA, 20 nt, Homo sapiens
cuccuccagggccacgugcc

SEQ ID NO: 818349 - RNA, 14 nt, Homo sapiens
cuccuccccuuuca

SEQ ID NO: 818350 - RNA, 20 nt, Homo sapiens
cuccuccguguggacugugc

SEQ ID NO: 818351 - RNA, 16 nt, Homo sapiens
cuccucgcugccagau

SEQ ID NO: 818352 - RNA, 18 nt, Homo sapiens
cuccucgggaaacacaca

SEQ ID NO: 818353 - RNA, 12 nt, Homo sapiens
cuccucuacucu

SEQ ID NO: 818354 - RNA, 19 nt, Homo sapiens
cuccucucccauccuugau

SEQ ID NO: 818355 - RNA, 12 nt, Homo sapiens
cuccucugaccu

SEQ ID NO: 818356 - RNA, 21 nt, Homo sapiens
cuccucuguuaaaaaaaauga

SEQ ID NO: 818357 - RNA, 22 nt, Homo sapiens
cuccugaccauaauccuagccc

SEQ ID NO: 818358 - RNA, 16 nt, Homo sapiens
cuccugaccucaggug

SEQ ID NO: 818359 - RNA, 18 nt, Homo sapiens
cuccugauggagugugca

SEQ ID NO: 818360 - RNA, 13 nt, Homo sapiens
cuccugauggcca

SEQ ID NO: 818361 - RNA, 15 nt, Homo sapiens
cuccugccaggguga

SEQ ID NO: 818362 - RNA, 15 nt, Homo sapiens
cuccugccauagucu

SEQ ID NO: 818363 - RNA, 11 nt, Homo sapiens
cuccugccauu

SEQ ID NO: 818364 - RNA, 19 nt, Homo sapiens
cuccugcucauauugugau

SEQ ID NO: 818365 - RNA, 21 nt, Homo sapiens
cuccuggaccuugacagagca

SEQ ID NO: 818366 - RNA, 20 nt, Homo sapiens
cuccuggcuuuacagacaaa

SEQ ID NO: 818367 - RNA, 18 nt, Homo sapiens
cuccugggcccaagugau

SEQ ID NO: 818368 - RNA, 19 nt, Homo sapiens
cuccugggcccaagugauc

SEQ ID NO: 818369 - RNA, 16 nt, Homo sapiens
cuccuggucuugagau

SEQ ID NO: 818370 - RNA, 14 nt, Homo sapiens
cuccugucaccuag

SEQ ID NO: 818371 - RNA, 19 nt, Homo sapiens
cuccugucccuugaccuua

SEQ ID NO: 818372 - RNA, 20 nt, Homo sapiens
cuccugugcuagaugugcaa

SEQ ID NO: 818373 - RNA, 13 nt, Homo sapiens
cuccugugcuauu

SEQ ID NO: 818374 - RNA, 15 nt, Homo sapiens
cuccuucagacaccc

SEQ ID NO: 818375 - RNA, 15 nt, Homo sapiens
cuccuucccauuucu

SEQ ID NO: 818376 - RNA, 18 nt, Homo sapiens
cuccuucccuucuuugcu

SEQ ID NO: 818377 - RNA, 23 nt, Homo sapiens
cuccuuccuggagcccagaggag

SEQ ID NO: 818378 - RNA, 13 nt, Homo sapiens
cuccuugaaguuc

SEQ ID NO: 818379 - RNA, 12 nt, Homo sapiens
cuccuugcacuu

SEQ ID NO: 818380 - RNA, 14 nt, Homo sapiens
cuccuugcacuuuc

SEQ ID NO: 818381 - RNA, 17 nt, Homo sapiens
cuccuugcuuccugucu

SEQ ID NO: 818382 - RNA, 16 nt, Homo sapiens
cuccuuggccacagac

SEQ ID NO: 818383 - RNA, 20 nt, Homo sapiens
cuccuuggcugucugugggc

SEQ ID NO: 818384 - RNA, 14 nt, Homo sapiens
cuccuuggcuuuau

SEQ ID NO: 818385 - RNA, 19 nt, Homo sapiens
cuccuuggcuuuaugcaaa

SEQ ID NO: 818386 - RNA, 17 nt, Homo sapiens
cuccuugucccccguga

SEQ ID NO: 818387 - RNA, 23 nt, Homo sapiens
cuccuuuaccccucauccaaagu

SEQ ID NO: 818388 - RNA, 15 nt, Homo sapiens
cuccuuuaccuuuca

SEQ ID NO: 818389 - RNA, 13 nt, Homo sapiens
cuccuuuacuaaa

SEQ ID NO: 818390 - RNA, 14 nt, Homo sapiens
cuccuuucucuuau

SEQ ID NO: 818391 - RNA, 14 nt, Homo sapiens
cuccuuugcacuga

SEQ ID NO: 818392 - RNA, 22 nt, Homo sapiens
cuccuuugugugugugucagcu

SEQ ID NO: 818393 - RNA, 19 nt, Homo sapiens
cucgaaaaagaaucugcuu

SEQ ID NO: 818394 - RNA, 12 nt, Homo sapiens
cucgagugaauu

SEQ ID NO: 818395 - RNA, 22 nt, Homo sapiens
cucgaucuuccagaagcuguac

SEQ ID NO: 818396 - RNA, 16 nt, Homo sapiens
cucgaugaagcccaau

SEQ ID NO: 818397 - RNA, 13 nt, Homo sapiens
cucgaugccugau

SEQ ID NO: 818398 - RNA, 13 nt, Homo sapiens
cucgcucucucuc

SEQ ID NO: 818399 - RNA, 20 nt, Homo sapiens
cucgggaaacacacaagcaa

SEQ ID NO: 818400 - RNA, 21 nt, Homo sapiens
cucgggaaacuuagaucauca

SEQ ID NO: 818401 - RNA, 14 nt, Homo sapiens
cucgggagccaugu

SEQ ID NO: 818402 - RNA, 18 nt, Homo sapiens
cucgggcuugagugagaa

SEQ ID NO: 818403 - RNA, 14 nt, Homo sapiens
cucgggguaaaaag

SEQ ID NO: 818404 - RNA, 20 nt, Homo sapiens
cucgguauuaauccaaagcu

SEQ ID NO: 818405 - RNA, 13 nt, Homo sapiens
cucguuagccuuc

SEQ ID NO: 818406 - RNA, 16 nt, Homo sapiens
cucguuagccuuccuc

SEQ ID NO: 818407 - RNA, 18 nt, Homo sapiens
cucuaaaacccuguguuc

SEQ ID NO: 818408 - RNA, 22 nt, Homo sapiens
cucauagccacuuuuauguuac

SEQ ID NO: 818409 - RNA, 21 nt, Homo sapiens
cucaucaacugaaugagguca

SEQ ID NO: 818410 - RNA, 14 nt, Homo sapiens
cucaucacuggacu

SEQ ID NO: 818411 - RNA, 18 nt, Homo sapiens
cucaucagacucugagua

SEQ ID NO: 818412 - RNA, 15 nt, Homo sapiens
cucaucagcuuuauu

SEQ ID NO: 818413 - RNA, 23 nt, Homo sapiens
cucaucaguguccucuugcucaa

SEQ ID NO: 818414 - RNA, 23 nt, Homo sapiens
cucaucauagcaauaacauuccc

SEQ ID NO: 818415 - RNA, 22 nt, Homo sapiens
cucauccagaccccaugccugu

SEQ ID NO: 818416 - RNA, 16 nt, Homo sapiens
cucauccccacaaucu

SEQ ID NO: 818417 - RNA, 21 nt, Homo sapiens
cucauccgcuacuacaucaag

SEQ ID NO: 818418 - RNA, 16 nt, Homo sapiens
cucauccuuuacauuu

SEQ ID NO: 818419 - RNA, 19 nt, Homo sapiens
cucaucuguacauacuguu

SEQ ID NO: 818420 - RNA, 15 nt, Homo sapiens
cucaucuuacuguac

SEQ ID NO: 818421 - RNA, 18 nt, Homo sapiens
cucaugccccuaauccca

SEQ ID NO: 818422 - RNA, 22 nt, Homo sapiens
cucaugcuguugcugcuacugu

SEQ ID NO: 818423 - RNA, 16 nt, Homo sapiens
cucaugcuucacuuag

SEQ ID NO: 818424 - RNA, 15 nt, Homo sapiens
cucauggcacccagg

SEQ ID NO: 818425 - RNA, 17 nt, Homo sapiens
cucaugguccuuggagg

SEQ ID NO: 818426 - RNA, 15 nt, Homo sapiens
cucaugucuuucuca

SEQ ID NO: 818427 - RNA, 15 nt, Homo sapiens
cucauuccagaggaa

SEQ ID NO: 818428 - RNA, 18 nt, Homo sapiens
cucauucccaacgugcaa

SEQ ID NO: 818429 - RNA, 16 nt, Homo sapiens
cucauuccuucacuca

SEQ ID NO: 818430 - RNA, 22 nt, Homo sapiens
cucauucuuuauucuauuuuag

SEQ ID NO: 818431 - RNA, 16 nt, Homo sapiens
cucauugcuaaccacu

SEQ ID NO: 818432 - RNA, 16 nt, Homo sapiens
cucauugcuuaauucu

SEQ ID NO: 818433 - RNA, 22 nt, Homo sapiens
cucauuguuuauuaacaaauua

SEQ ID NO: 818434 - RNA, 18 nt, Homo sapiens
cucauuuaaaacaggcaa

SEQ ID NO: 818435 - RNA, 17 nt, Homo sapiens
cucauuuagaacuugca

SEQ ID NO: 818436 - RNA, 21 nt, Homo sapiens
cucauuugagauaaagucaaa

SEQ ID NO: 818437 - RNA, 23 nt, Homo sapiens
cucauuuuuguuuucauuaucuc

SEQ ID NO: 818438 - RNA, 13 nt, Homo sapiens
cuccaaaauauua

SEQ ID NO: 818439 - RNA, 16 nt, Homo sapiens
cuccaaaccugucuug

SEQ ID NO: 818440 - RNA, 13 nt, Homo sapiens
cuccaaacugaag

SEQ ID NO: 818441 - RNA, 16 nt, Homo sapiens
cuccaaagagaccagc

SEQ ID NO: 818442 - RNA, 10 nt, Homo sapiens
cuccaaaggc

SEQ ID NO: 818443 - RNA, 13 nt, Homo sapiens
cuccaaaugagau

SEQ ID NO: 818444 - RNA, 18 nt, Homo sapiens
cuccaaauuuuuuuuacu

SEQ ID NO: 818445 - RNA, 15 nt, Homo sapiens
cuccaacucaacuca

SEQ ID NO: 818446 - RNA, 22 nt, Homo sapiens
cuccaacuccuuucagccacau

SEQ ID NO: 818447 - RNA, 12 nt, Homo sapiens
cuccaagaccac

SEQ ID NO: 818448 - RNA, 17 nt, Homo sapiens
cuccaagacccuguguu

SEQ ID NO: 818449 - RNA, 14 nt, Homo sapiens
cuccaagcauuuca

SEQ ID NO: 818450 - RNA, 23 nt, Homo sapiens
cuccaaggguuucgacuggucca

SEQ ID NO: 818451 - RNA, 20 nt, Homo sapiens
cuccaagguagaauuugcaa

SEQ ID NO: 818452 - RNA, 14 nt, Homo sapiens
cuccacacuccacu

SEQ ID NO: 818453 - RNA, 17 nt, Homo sapiens
cuccacagucaauauua

SEQ ID NO: 818454 - RNA, 11 nt, Homo sapiens
cuccacaugcu

SEQ ID NO: 818455 - RNA, 12 nt, Homo sapiens
cuccacauuucc

SEQ ID NO: 818456 - RNA, 14 nt, Homo sapiens
cuccaccacauccu

SEQ ID NO: 818457 - RNA, 19 nt, Homo sapiens
cuccaccacccaacccaaa

SEQ ID NO: 818458 - RNA, 14 nt, Homo sapiens
cuccaccucuggug

SEQ ID NO: 818459 - RNA, 21 nt, Homo sapiens
cuccaccucugguggcuccuc

SEQ ID NO: 818460 - RNA, 17 nt, Homo sapiens
cuccacucaguugcaac

SEQ ID NO: 818461 - RNA, 19 nt, Homo sapiens
cuccacuggccuccuggca

SEQ ID NO: 818462 - RNA, 18 nt, Homo sapiens
cuccagaagcugcuccuu

SEQ ID NO: 818463 - RNA, 17 nt, Homo sapiens
cuccagaguuguucucu

SEQ ID NO: 818464 - RNA, 22 nt, Homo sapiens
cuccagccagcaaugaugucca

SEQ ID NO: 818465 - RNA, 20 nt, Homo sapiens
cuccagcccagacccagugg

SEQ ID NO: 818466 - RNA, 21 nt, Homo sapiens
cuccagccugacuuggggaga

SEQ ID NO: 818467 - RNA, 21 nt, Homo sapiens
cuccagccuggggaccccacu

SEQ ID NO: 818468 - RNA, 21 nt, Homo sapiens
cuccagccugggggacagaaa

SEQ ID NO: 818469 - RNA, 17 nt, Homo sapiens
cuccagcgguccaaagu

SEQ ID NO: 818470 - RNA, 16 nt, Homo sapiens
cuccaggaauacugaa

SEQ ID NO: 818471 - RNA, 19 nt, Homo sapiens
cuccaggacucagugaucc

SEQ ID NO: 818472 - RNA, 18 nt, Homo sapiens
cuccaggcccaaggcucc

SEQ ID NO: 818473 - RNA, 23 nt, Homo sapiens
cuccagggaauccaagccuccac

SEQ ID NO: 818474 - RNA, 13 nt, Homo sapiens
cuccagggcuuug

SEQ ID NO: 818475 - RNA, 22 nt, Homo sapiens
cuccagguggcucugaggugcc

SEQ ID NO: 818476 - RNA, 23 nt, Homo sapiens
cuccaggugugcacguggcaugu

SEQ ID NO: 818477 - RNA, 19 nt, Homo sapiens
cuccaguaccuugcuucuu

SEQ ID NO: 818478 - RNA, 23 nt, Homo sapiens
cuccaguuagaaugcaccaugga

SEQ ID NO: 818479 - RNA, 17 nt, Homo sapiens
cuccaguuugcauuugg

SEQ ID NO: 818480 - RNA, 18 nt, Homo sapiens
cuccauacguucagaggu

SEQ ID NO: 818481 - RNA, 17 nt, Homo sapiens
cuccauagcgacacccu

SEQ ID NO: 818482 - RNA, 23 nt, Homo sapiens
cuccauauuggacauccccagaa

SEQ ID NO: 818483 - RNA, 18 nt, Homo sapiens
cuccaucccaaccaggca

SEQ ID NO: 818484 - RNA, 11 nt, Homo sapiens
cuccaucccag

SEQ ID NO: 818485 - RNA, 20 nt, Homo sapiens
cuccauccugaaagccaaga

SEQ ID NO: 818486 - RNA, 15 nt, Homo sapiens
cuccaucucaaaaag

SEQ ID NO: 818487 - RNA, 10 nt, Homo sapiens
cuccaucucc

SEQ ID NO: 818488 - RNA, 18 nt, Homo sapiens
cuccaucucuucugcaag

SEQ ID NO: 818489 - RNA, 22 nt, Homo sapiens
cuccaucuuuauagaaggaauu

SEQ ID NO: 818490 - RNA, 15 nt, Homo sapiens
cuccaugacuggcug

SEQ ID NO: 818491 - RNA, 21 nt, Homo sapiens
cuccaugcuccucaccugucu

SEQ ID NO: 818492 - RNA, 19 nt, Homo sapiens
cuccauguauauauucuuc

SEQ ID NO: 818493 - RNA, 14 nt, Homo sapiens
cuccauguuugaug

SEQ ID NO: 818494 - RNA, 20 nt, Homo sapiens
cuccauuaaauggucuaaaa

SEQ ID NO: 818495 - RNA, 16 nt, Homo sapiens
cuccauuacugugauu

SEQ ID NO: 818496 - RNA, 23 nt, Homo sapiens
cuccauuccuggagcccgaggca

SEQ ID NO: 818497 - RNA, 14 nt, Homo sapiens
cuccauucugacca

SEQ ID NO: 818498 - RNA, 15 nt, Homo sapiens
cuccauugugccuaa

SEQ ID NO: 818499 - RNA, 12 nt, Homo sapiens
cuccauuuucaa

SEQ ID NO: 818500 - RNA, 19 nt, Homo sapiens
cucccaaaaaacuacuucu

SEQ ID NO: 818501 - RNA, 21 nt, Homo sapiens
cucccaaaaaacuacuucuuu

SEQ ID NO: 818502 - RNA, 11 nt, Homo sapiens
cucccaaagug

SEQ ID NO: 818503 - RNA, 19 nt, Homo sapiens
cucccaaagugcugggaug

SEQ ID NO: 818504 - RNA, 23 nt, Homo sapiens
cucccaacaacaugaaacugccu

SEQ ID NO: 818505 - RNA, 16 nt, Homo sapiens
cucccaacacugucac

SEQ ID NO: 818506 - RNA, 16 nt, Homo sapiens
cucccaacccauucac

SEQ ID NO: 818507 - RNA, 19 nt, Homo sapiens
cucccaagcaccugggauu

SEQ ID NO: 818508 - RNA, 23 nt, Homo sapiens
cucccaagguccucucaguucuc

SEQ ID NO: 818509 - RNA, 14 nt, Homo sapiens
cucccaaucagcuu

SEQ ID NO: 818510 - RNA, 15 nt, Homo sapiens
cucccacauugucac

SEQ ID NO: 818511 - RNA, 14 nt, Homo sapiens
cucccaccaccagu

SEQ ID NO: 818512 - RNA, 13 nt, Homo sapiens
cucccaccucccu

SEQ ID NO: 818513 - RNA, 16 nt, Homo sapiens
cucccaccuccuggug

SEQ ID NO: 818514 - RNA, 13 nt, Homo sapiens
cucccaccugcau

SEQ ID NO: 818515 - RNA, 20 nt, Homo sapiens
cucccagcuaauugagacca

SEQ ID NO: 818516 - RNA, 16 nt, Homo sapiens
cucccaggccaggcuc

SEQ ID NO: 818517 - RNA, 21 nt, Homo sapiens
cucccaggucgggcaguggag

SEQ ID NO: 818518 - RNA, 23 nt, Homo sapiens
cucccaugugagucccugugaug

SEQ ID NO: 818519 - RNA, 16 nt, Homo sapiens
cucccauuacuuugau

SEQ ID NO: 818520 - RNA, 23 nt, Homo sapiens
cucccauuacuuugauaucugau

SEQ ID NO: 818521 - RNA, 11 nt, Homo sapiens
cucccauuuca

SEQ ID NO: 818522 - RNA, 20 nt, Homo sapiens
cuccccaacaccccacugag

SEQ ID NO: 818523 - RNA, 19 nt, Homo sapiens
cuaguuuuuauacaugugu

SEQ ID NO: 818524 - RNA, 17 nt, Homo sapiens
cuauaaaaacaaaaacu

SEQ ID NO: 818525 - RNA, 17 nt, Homo sapiens
cuauaaaaugacagauc

SEQ ID NO: 818526 - RNA, 14 nt, Homo sapiens
cuauaacaaucacu

SEQ ID NO: 818527 - RNA, 14 nt, Homo sapiens
cuauaacacuguga

SEQ ID NO: 818528 - RNA, 20 nt, Homo sapiens
cuauaagcaaauugcuuuuu

SEQ ID NO: 818529 - RNA, 17 nt, Homo sapiens
cuauaauaaaacuaaac

SEQ ID NO: 818530 - RNA, 19 nt, Homo sapiens
cuauaaucccagcacuuug

SEQ ID NO: 818531 - RNA, 15 nt, Homo sapiens
cuauaaugagcaugu

SEQ ID NO: 818532 - RNA, 17 nt, Homo sapiens
cuauaauuuugccuuua

SEQ ID NO: 818533 - RNA, 21 nt, Homo sapiens
cuauaauuuugccuuuaacag

SEQ ID NO: 818534 - RNA, 13 nt, Homo sapiens
cuauacacacaca

SEQ ID NO: 818535 - RNA, 17 nt, Homo sapiens
cuauaccugagccucaa

SEQ ID NO: 818536 - RNA, 15 nt, Homo sapiens
cuauaccugcuucag

SEQ ID NO: 818537 - RNA, 19 nt, Homo sapiens
cuauaccugcuucagugaa

SEQ ID NO: 818538 - RNA, 17 nt, Homo sapiens
cuauaccuuauccauag

SEQ ID NO: 818539 - RNA, 17 nt, Homo sapiens
cuauacuuuguucuguu

SEQ ID NO: 818540 - RNA, 15 nt, Homo sapiens
cuauaggucagagau

SEQ ID NO: 818541 - RNA, 21 nt, Homo sapiens
cuauagucccagcuacucaga

SEQ ID NO: 818542 - RNA, 21 nt, Homo sapiens
cuauagugaacucccaucuau

SEQ ID NO: 818543 - RNA, 17 nt, Homo sapiens
cuauauacuauaugauu

SEQ ID NO: 818544 - RNA, 20 nt, Homo sapiens
cuauauaguuccuugccuua

SEQ ID NO: 818545 - RNA, 21 nt, Homo sapiens
cuauauaguuccuugccuuaa

SEQ ID NO: 818546 - RNA, 17 nt, Homo sapiens
cuauaucaaaaaaccuu

SEQ ID NO: 818547 - RNA, 15 nt, Homo sapiens
cuauaucuauuugag

SEQ ID NO: 818548 - RNA, 18 nt, Homo sapiens
cuauauugcuuaccugau

SEQ ID NO: 818549 - RNA, 14 nt, Homo sapiens
cuauauuugcuaga

SEQ ID NO: 818550 - RNA, 13 nt, Homo sapiens
cuaucaacaaaga

SEQ ID NO: 818551 - RNA, 21 nt, Homo sapiens
cuaucaaccuaagcaacagaa

SEQ ID NO: 818552 - RNA, 12 nt, Homo sapiens
cuaucacugucu

SEQ ID NO: 818553 - RNA, 20 nt, Homo sapiens
cuaucauaauucagcacuua

SEQ ID NO: 818554 - RNA, 21 nt, Homo sapiens
cuaucauacuacugaaacaga

SEQ ID NO: 818555 - RNA, 18 nt, Homo sapiens
cuaucauuggccuccaaa

SEQ ID NO: 818556 - RNA, 15 nt, Homo sapiens
cuauccuauguuaaa

SEQ ID NO: 818557 - RNA, 14 nt, Homo sapiens
cuaucgcaccacug

SEQ ID NO: 818558 - RNA, 15 nt, Homo sapiens
cuaucgcaccacugu

SEQ ID NO: 818559 - RNA, 18 nt, Homo sapiens
cuaucuaucuuccaaaug

SEQ ID NO: 818560 - RNA, 13 nt, Homo sapiens
cuaucugaccaaa

SEQ ID NO: 818561 - RNA, 16 nt, Homo sapiens
cuaucugccaaauuga

SEQ ID NO: 818562 - RNA, 19 nt, Homo sapiens
cuaucugggcugugggcaa

SEQ ID NO: 818563 - RNA, 14 nt, Homo sapiens
cuaugaagcccacc

SEQ ID NO: 818564 - RNA, 14 nt, Homo sapiens
cucacuaugcugcu

SEQ ID NO: 818565 - RNA, 15 nt, Homo sapiens
cucacucaccaucug

SEQ ID NO: 818566 - RNA, 15 nt, Homo sapiens
cucacuccaccaccc

SEQ ID NO: 818567 - RNA, 16 nt, Homo sapiens
cucacucccuguuuua

SEQ ID NO: 818568 - RNA, 14 nt, Homo sapiens
cucacuccuguuac

SEQ ID NO: 818569 - RNA, 17 nt, Homo sapiens
cucacucguucuguuac

SEQ ID NO: 818570 - RNA, 22 nt, Homo sapiens
cucacucugggcuguaacgugg

SEQ ID NO: 818571 - RNA, 18 nt, Homo sapiens
cucacugcagggcacugu

SEQ ID NO: 818572 - RNA, 16 nt, Homo sapiens
cucacugcagugcuga

SEQ ID NO: 818573 - RNA, 13 nt, Homo sapiens
cucacugccuagg

SEQ ID NO: 818574 - RNA, 23 nt, Homo sapiens
cucacugcugcaaauacuguaua

SEQ ID NO: 818575 - RNA, 21 nt, Homo sapiens
cucacuguagcuuuuaggaau

SEQ ID NO: 818576 - RNA, 14 nt, Homo sapiens
cucacuguauccag

SEQ ID NO: 818577 - RNA, 15 nt, Homo sapiens
cucacuguugcagug

SEQ ID NO: 818578 - RNA, 15 nt, Homo sapiens
cucacuugauguuuc

SEQ ID NO: 818579 - RNA, 11 nt, Homo sapiens
cucacuuuaaa

SEQ ID NO: 818580 - RNA, 19 nt, Homo sapiens
cucacuuucccuuguguca

SEQ ID NO: 818581 - RNA, 16 nt, Homo sapiens
cucacuuugacaccca

SEQ ID NO: 818582 - RNA, 13 nt, Homo sapiens
cucagaaagggau

SEQ ID NO: 818583 - RNA, 17 nt, Homo sapiens
cucagaauaacuaccuc

SEQ ID NO: 818584 - RNA, 23 nt, Homo sapiens
cucagaauauacccauccaugca

SEQ ID NO: 818585 - RNA, 22 nt, Homo sapiens
cucagagcagggccaaagcaca

SEQ ID NO: 818586 - RNA, 22 nt, Homo sapiens
cucagaguguuuaauuguacuc

SEQ ID NO: 818587 - RNA, 16 nt, Homo sapiens
cucagauuauuuuucc

SEQ ID NO: 818588 - RNA, 17 nt, Homo sapiens
cucagcaacaguggaau

SEQ ID NO: 818589 - RNA, 12 nt, Homo sapiens
cucagcacuguu

SEQ ID NO: 818590 - RNA, 21 nt, Homo sapiens
cucagcagcugguaaucuugc

SEQ ID NO: 818591 - RNA, 20 nt, Homo sapiens
cucagcaguccacaaagcau

SEQ ID NO: 818592 - RNA, 23 nt, Homo sapiens
cucagcauagggucacuuugcca

SEQ ID NO: 818593 - RNA, 23 nt, Homo sapiens
cucagccacacccaggcacuuaa

SEQ ID NO: 818594 - RNA, 23 nt, Homo sapiens
cucagcccugggccccaccaccu

SEQ ID NO: 818595 - RNA, 23 nt, Homo sapiens
cucagccuacuuucacacuaaga

SEQ ID NO: 818596 - RNA, 18 nt, Homo sapiens
cucagccucauccugaga

SEQ ID NO: 818597 - RNA, 16 nt, Homo sapiens
cucagccugagccucu

SEQ ID NO: 818598 - RNA, 21 nt, Homo sapiens
cucagccuugccagagaucca

SEQ ID NO: 818599 - RNA, 17 nt, Homo sapiens
cucagcgcuaagccaaa

SEQ ID NO: 818600 - RNA, 16 nt, Homo sapiens
cucagcuaagcucacg

SEQ ID NO: 818601 - RNA, 22 nt, Homo sapiens
cucagcuaagcucacguccuga

SEQ ID NO: 818602 - RNA, 11 nt, Homo sapiens
cucagcucacu

SEQ ID NO: 818603 - RNA, 22 nt, Homo sapiens
cucagcucugguccaggcccug

SEQ ID NO: 818604 - RNA, 15 nt, Homo sapiens
cucagcugcacauuc

SEQ ID NO: 818605 - RNA, 13 nt, Homo sapiens
cucagcuuaucuc

SEQ ID NO: 818606 - RNA, 21 nt, Homo sapiens
cucagcuuuuucguauuucaa

SEQ ID NO: 818607 - RNA, 17 nt, Homo sapiens
cucaggagucugaggca

SEQ ID NO: 818608 - RNA, 15 nt, Homo sapiens
cucaggcccaugcua

SEQ ID NO: 818609 - RNA, 15 nt, Homo sapiens
cucaggccucugcag

SEQ ID NO: 818610 - RNA, 15 nt, Homo sapiens
cucaggcucuugacu

SEQ ID NO: 818611 - RNA, 17 nt, Homo sapiens
cucaggcuuccuuggca

SEQ ID NO: 818612 - RNA, 22 nt, Homo sapiens
cucagggagcagggaaggccug

SEQ ID NO: 818613 - RNA, 16 nt, Homo sapiens
cucaggggucauucau

SEQ ID NO: 818614 - RNA, 20 nt, Homo sapiens
cucagggguuaagagcucag

SEQ ID NO: 818615 - RNA, 22 nt, Homo sapiens
cucaggugaaaauccaucucau

SEQ ID NO: 818616 - RNA, 17 nt, Homo sapiens
cucagguguugccaaau

SEQ ID NO: 818617 - RNA, 22 nt, Homo sapiens
cucagguuuguuuugugaauuu

SEQ ID NO: 818618 - RNA, 15 nt, Homo sapiens
cucaguaaaaguaaa

SEQ ID NO: 818619 - RNA, 14 nt, Homo sapiens
cucaguaguauaug

SEQ ID NO: 818620 - RNA, 15 nt, Homo sapiens
cucagugaacuguga

SEQ ID NO: 818621 - RNA, 13 nt, Homo sapiens
cucagugcaucuu

SEQ ID NO: 818622 - RNA, 22 nt, Homo sapiens
cucagugccacuugacauuccu

SEQ ID NO: 818623 - RNA, 15 nt, Homo sapiens
cucaguggaucacac

SEQ ID NO: 818624 - RNA, 22 nt, Homo sapiens
cucaguggaucacacacaugga

SEQ ID NO: 818625 - RNA, 20 nt, Homo sapiens
cucagugggggcagagccac

SEQ ID NO: 818626 - RNA, 20 nt, Homo sapiens
cucaguguaccacuacuuag

SEQ ID NO: 818627 - RNA, 16 nt, Homo sapiens
cucaguuaaacuguga

SEQ ID NO: 818628 - RNA, 16 nt, Homo sapiens
cucaguuccaaaguca

SEQ ID NO: 818629 - RNA, 22 nt, Homo sapiens
cucaguuccaaagucacaggaa

SEQ ID NO: 818630 - RNA, 17 nt, Homo sapiens
cucaguucccucuugcu

SEQ ID NO: 818631 - RNA, 21 nt, Homo sapiens
cucauaaguaaguuuggcaag

SEQ ID NO: 818632 - RNA, 19 nt, Homo sapiens
cucauaauuuauacagguc

SEQ ID NO: 818633 - RNA, 17 nt, Homo sapiens
cucauacacaugugcac

SEQ ID NO: 818634 - RNA, 17 nt, Homo sapiens
cucauacaucaagccaa

SEQ ID NO: 818635 - RNA, 21 nt, Homo sapiens
cucauaccagcauacgcucac

SEQ ID NO: 818636 - RNA, 19 nt, Homo sapiens
cucauacugucugggauua

SEQ ID NO: 818637 - RNA, 18 nt, Homo sapiens
cucauagauuauuaucua

SEQ ID NO: 818638 - RNA, 17 nt, Homo sapiens
ucugccauaucagugaa

SEQ ID NO: 818639 - RNA, 21 nt, Homo sapiens
ucugccauaucagugaaccuu

SEQ ID NO: 818640 - RNA, 14 nt, Homo sapiens
ucugcccagaauuc

SEQ ID NO: 818641 - RNA, 20 nt, Homo sapiens
ucugccccagcucuggcuuc

SEQ ID NO: 818642 - RNA, 21 nt, Homo sapiens
ucugcccuaaccugacagagg

SEQ ID NO: 818643 - RNA, 14 nt, Homo sapiens
ucugcccucauaga

SEQ ID NO: 818644 - RNA, 18 nt, Homo sapiens
ucugcccugcccuagcuc

SEQ ID NO: 818645 - RNA, 18 nt, Homo sapiens
ucugcccugccugaggag

SEQ ID NO: 818646 - RNA, 20 nt, Homo sapiens
ucugcccuuauggagcucac

SEQ ID NO: 818647 - RNA, 14 nt, Homo sapiens
ucugccgcuaccuc

SEQ ID NO: 818648 - RNA, 15 nt, Homo sapiens
ucugccgguccccca

SEQ ID NO: 818649 - RNA, 18 nt, Homo sapiens
ucugccggucccccaugc

SEQ ID NO: 818650 - RNA, 13 nt, Homo sapiens
ucugccugagauu

SEQ ID NO: 818651 - RNA, 20 nt, Homo sapiens
ucugccuguggaguagccau

SEQ ID NO: 818652 - RNA, 21 nt, Homo sapiens
ucugcgcaccaaggaauggag

SEQ ID NO: 818653 - RNA, 23 nt, Homo sapiens
ucugcgcuuggucuuucugugcu

SEQ ID NO: 818654 - RNA, 20 nt, Homo sapiens
ucugcggcuuucacugcuga

SEQ ID NO: 818655 - RNA, 15 nt, Homo sapiens
ucugcuaaauuucaa

SEQ ID NO: 818656 - RNA, 22 nt, Homo sapiens
ucugcuaauucgagucauggcu

SEQ ID NO: 818657 - RNA, 19 nt, Homo sapiens
ucugcuagacuccucagga

SEQ ID NO: 818658 - RNA, 12 nt, Homo sapiens
ucugcuagggaa

SEQ ID NO: 818659 - RNA, 14 nt, Homo sapiens
ucugcucacuuuaa

SEQ ID NO: 818660 - RNA, 17 nt, Homo sapiens
ucugcuccugaagcccu

SEQ ID NO: 818661 - RNA, 21 nt, Homo sapiens
ucugcucuagggaaucuggau

SEQ ID NO: 818662 - RNA, 23 nt, Homo sapiens
ucugcucuuucucugccagugac

SEQ ID NO: 818663 - RNA, 20 nt, Homo sapiens
ucugcugaaggcagucauau

SEQ ID NO: 818664 - RNA, 18 nt, Homo sapiens
ucugcugaaugcagggaa

SEQ ID NO: 818665 - RNA, 22 nt, Homo sapiens
ucugcuguuuuuuuugcugcua

SEQ ID NO: 818666 - RNA, 17 nt, Homo sapiens
ucugcuucagugcagug

SEQ ID NO: 818667 - RNA, 18 nt, Homo sapiens
ucugcuucuccuucaaaa

SEQ ID NO: 818668 - RNA, 15 nt, Homo sapiens
ucugcuucucggggu

SEQ ID NO: 818669 - RNA, 22 nt, Homo sapiens
ucugcuugccgacuggcuguga

SEQ ID NO: 818670 - RNA, 23 nt, Homo sapiens
ucugcuuuuuaaagaaugcucuu

SEQ ID NO: 818671 - RNA, 14 nt, Homo sapiens
ucuggaaaagcaaa

SEQ ID NO: 818672 - RNA, 16 nt, Homo sapiens
ucuggaagccuggacu

SEQ ID NO: 818673 - RNA, 18 nt, Homo sapiens
ucuggaauacauauucca

SEQ ID NO: 818674 - RNA, 18 nt, Homo sapiens
ucuggaaucuggagacca

SEQ ID NO: 818675 - RNA, 14 nt, Homo sapiens
ucuggaauugcuca

SEQ ID NO: 818676 - RNA, 13 nt, Homo sapiens
ucuggacacugag

SEQ ID NO: 818677 - RNA, 15 nt, Homo sapiens
ucuggacacugagag

SEQ ID NO: 818678 - RNA, 21 nt, Homo sapiens
ucuggaccauauaccaucucc

SEQ ID NO: 818679 - RNA, 18 nt, Homo sapiens
ucuggagaaccucaucca

SEQ ID NO: 818680 - RNA, 15 nt, Homo sapiens
ucuggagaacuauac

SEQ ID NO: 818681 - RNA, 18 nt, Homo sapiens
ucuggagaguaaucuggg

SEQ ID NO: 818682 - RNA, 22 nt, Homo sapiens
ucuggagcaaccuacugucuaa

SEQ ID NO: 818683 - RNA, 23 nt, Homo sapiens
ucuggagggguguggcuccuucc

SEQ ID NO: 818684 - RNA, 12 nt, Homo sapiens
ucuggaggucau

SEQ ID NO: 818685 - RNA, 17 nt, Homo sapiens
ucuggaggucaucuggc

SEQ ID NO: 818686 - RNA, 14 nt, Homo sapiens
ucuggaugaaggca

SEQ ID NO: 818687 - RNA, 23 nt, Homo sapiens
ucuggcaacagagcaagacucca

SEQ ID NO: 818688 - RNA, 13 nt, Homo sapiens
ucuggcacacucc

SEQ ID NO: 818689 - RNA, 13 nt, Homo sapiens
ucuggcaucucuu

SEQ ID NO: 818690 - RNA, 22 nt, Homo sapiens
ucuggcaucucuuucugcaaag

SEQ ID NO: 818691 - RNA, 16 nt, Homo sapiens
ucuggccaggcauggc

SEQ ID NO: 818692 - RNA, 20 nt, Homo sapiens
ucuggcccgcaauacuguag

SEQ ID NO: 818693 - RNA, 16 nt, Homo sapiens
ucuggcccuucuugcc

SEQ ID NO: 818694 - RNA, 15 nt, Homo sapiens
ucuggcgaagcucag

SEQ ID NO: 818695 - RNA, 21 nt, Homo sapiens
ucuggcucagggucaaagaca

SEQ ID NO: 818696 - RNA, 18 nt, Homo sapiens
ucuggcucuaauucacag

SEQ ID NO: 818697 - RNA, 19 nt, Homo sapiens
ucuggcucuugaggcauuu

SEQ ID NO: 818698 - RNA, 16 nt, Homo sapiens
ucugggaaacaagaag

SEQ ID NO: 818699 - RNA, 13 nt, Homo sapiens
ucugggaggccau

SEQ ID NO: 818700 - RNA, 19 nt, Homo sapiens
ucugggauauggcugccca

SEQ ID NO: 818701 - RNA, 20 nt, Homo sapiens
ucugggauuaagggcaaauc

SEQ ID NO: 818702 - RNA, 17 nt, Homo sapiens
ucugggggauaagggag

SEQ ID NO: 818703 - RNA, 18 nt, Homo sapiens
ucugggggauaagggagu

SEQ ID NO: 818704 - RNA, 20 nt, Homo sapiens
ucuggggggacccagugcag

SEQ ID NO: 818705 - RNA, 12 nt, Homo sapiens
ucugguacaaag

SEQ ID NO: 818706 - RNA, 20 nt, Homo sapiens
ucugguaguuguggcuuuua

SEQ ID NO: 818707 - RNA, 21 nt, Homo sapiens
ucugguaguuguggcuuuuau

SEQ ID NO: 818708 - RNA, 20 nt, Homo sapiens
ucuggucacauggcugucga

SEQ ID NO: 818709 - RNA, 12 nt, Homo sapiens
ucuggucugucc

SEQ ID NO: 818710 - RNA, 14 nt, Homo sapiens
ucuggucuguccac

SEQ ID NO: 818711 - RNA, 15 nt, Homo sapiens
ucuggugacaccagc

SEQ ID NO: 818712 - RNA, 13 nt, Homo sapiens
ucuggugccauuu

SEQ ID NO: 818713 - RNA, 21 nt, Homo sapiens
ucugguggggcuguccugcug

SEQ ID NO: 818714 - RNA, 16 nt, Homo sapiens
ucugguuuacuucaaa

SEQ ID NO: 818715 - RNA, 18 nt, Homo sapiens
accgagucuugcucuguu

SEQ ID NO: 818716 - RNA, 14 nt, Homo sapiens
accgaugguccuca

SEQ ID NO: 818717 - RNA, 13 nt, Homo sapiens
accgccacugggc

SEQ ID NO: 818718 - RNA, 15 nt, Homo sapiens
accgccauggugcug

SEQ ID NO: 818719 - RNA, 18 nt, Homo sapiens
accgcugauaagcauuga

SEQ ID NO: 818720 - RNA, 18 nt, Homo sapiens
accggcucucaccuggcc

SEQ ID NO: 818721 - RNA, 20 nt, Homo sapiens
accguccucagcaguccaca

SEQ ID NO: 818722 - RNA, 14 nt, Homo sapiens
accgugaccaucuu

SEQ ID NO: 818723 - RNA, 23 nt, Homo sapiens
accgugcucauugcuaaccacug

SEQ ID NO: 818724 - RNA, 20 nt, Homo sapiens
accguggacaggcccagcgc

SEQ ID NO: 818725 - RNA, 22 nt, Homo sapiens
accguggaggaggaaggcaaga

SEQ ID NO: 818726 - RNA, 18 nt, Homo sapiens
accguguaccucaguucc

SEQ ID NO: 818727 - RNA, 15 nt, Homo sapiens
accgugucaccuacg

SEQ ID NO: 818728 - RNA, 12 nt, Homo sapiens
accuaagcaaca

SEQ ID NO: 818729 - RNA, 16 nt, Homo sapiens
accuaauaucacuuaa

SEQ ID NO: 818730 - RNA, 15 nt, Homo sapiens
accuaccacaguguc

SEQ ID NO: 818731 - RNA, 17 nt, Homo sapiens
accuacccuccacaggc

SEQ ID NO: 818732 - RNA, 21 nt, Homo sapiens
accuacuuugacuuuuugcau

SEQ ID NO: 818733 - RNA, 16 nt, Homo sapiens
accuagaacacuaacu

SEQ ID NO: 818734 - RNA, 16 nt, Homo sapiens
accuagaauagucuca

SEQ ID NO: 818735 - RNA, 23 nt, Homo sapiens
accuagauugcaccauugcacuc

SEQ ID NO: 818736 - RNA, 16 nt, Homo sapiens
accuaggccucagcug

SEQ ID NO: 818737 - RNA, 16 nt, Homo sapiens
accuagugccccagac

SEQ ID NO: 818738 - RNA, 21 nt, Homo sapiens
accuauuuuugaaggcauaaa

SEQ ID NO: 818739 - RNA, 16 nt, Homo sapiens
accucaaaaugucuaa

SEQ ID NO: 818740 - RNA, 22 nt, Homo sapiens
accucaagcaaccaugaacuca

SEQ ID NO: 818741 - RNA, 13 nt, Homo sapiens
accucaaggucau

SEQ ID NO: 818742 - RNA, 15 nt, Homo sapiens
accucacacgcuggg

SEQ ID NO: 818743 - RNA, 18 nt, Homo sapiens
accucacacgcugggcuu

SEQ ID NO: 818744 - RNA, 17 nt, Homo sapiens
accucacuguccuguga

SEQ ID NO: 818745 - RNA, 12 nt, Homo sapiens
accucacuguga

SEQ ID NO: 818746 - RNA, 17 nt, Homo sapiens
accucagaggaguuuaa

SEQ ID NO: 818747 - RNA, 15 nt, Homo sapiens
guucaauaaagcacu

SEQ ID NO: 818748 - RNA, 16 nt, Homo sapiens
guucaccuugggauga

SEQ ID NO: 818749 - RNA, 11 nt, Homo sapiens
guucacuccca

SEQ ID NO: 818750 - RNA, 16 nt, Homo sapiens
guucagaggugcagcu

SEQ ID NO: 818751 - RNA, 21 nt, Homo sapiens
guucagauuuuacugucuaug

SEQ ID NO: 818752 - RNA, 24 nt, Homo sapiens
guucagcacugucccuugccucaa

SEQ ID NO: 818753 - RNA, 12 nt, Homo sapiens
guucagcagaac

SEQ ID NO: 818754 - RNA, 14 nt, Homo sapiens
guucauacauauuu

SEQ ID NO: 818755 - RNA, 16 nt, Homo sapiens
guucauauuaugucau

SEQ ID NO: 818756 - RNA, 20 nt, Homo sapiens
guucauauuuauacuuugca

SEQ ID NO: 818757 - RNA, 18 nt, Homo sapiens
guuccacuuguuugcacu

SEQ ID NO: 818758 - RNA, 17 nt, Homo sapiens
guuccagauagcagggc

SEQ ID NO: 818759 - RNA, 15 nt, Homo sapiens
guuccagauguggau

SEQ ID NO: 818760 - RNA, 16 nt, Homo sapiens
guuccauccaccaccu

SEQ ID NO: 818761 - RNA, 13 nt, Homo sapiens
guuccaugcagcc

SEQ ID NO: 818762 - RNA, 23 nt, Homo sapiens
guucccacaccccaacacuucca

SEQ ID NO: 818763 - RNA, 13 nt, Homo sapiens
guucccaccauuc

SEQ ID NO: 818764 - RNA, 19 nt, Homo sapiens
guucccaccauucccugcc

SEQ ID NO: 818765 - RNA, 23 nt, Homo sapiens
guucccaccauucccugccuugc

SEQ ID NO: 818766 - RNA, 17 nt, Homo sapiens
guuccccacacagggca

SEQ ID NO: 818767 - RNA, 14 nt, Homo sapiens
guuccccacugaca

SEQ ID NO: 818768 - RNA, 16 nt, Homo sapiens
guucccccaguaccuc

SEQ ID NO: 818769 - RNA, 23 nt, Homo sapiens
guucccgugacgaggcucaaaaa

SEQ ID NO: 818770 - RNA, 22 nt, Homo sapiens
guucccuuggccucagaauuca

SEQ ID NO: 818771 - RNA, 23 nt, Homo sapiens
guuccugaauacaagccuaugcg

SEQ ID NO: 818772 - RNA, 17 nt, Homo sapiens
guuccugaugacccagg

SEQ ID NO: 818773 - RNA, 16 nt, Homo sapiens
guuccuggcugaugau

SEQ ID NO: 818774 - RNA, 16 nt, Homo sapiens
guuccuuacugcagaa

SEQ ID NO: 818775 - RNA, 20 nt, Homo sapiens
guuccuuuauuuuauguaaa

SEQ ID NO: 818776 - RNA, 12 nt, Homo sapiens
guucgaccaaac

SEQ ID NO: 818777 - RNA, 19 nt, Homo sapiens
guucuaacaaaacaaguug

SEQ ID NO: 818778 - RNA, 15 nt, Homo sapiens
guucuaaguucaugu

SEQ ID NO: 818779 - RNA, 18 nt, Homo sapiens
guucuacauaaguaauuc

SEQ ID NO: 818780 - RNA, 18 nt, Homo sapiens
guucuaccaagaacugaa

SEQ ID NO: 818781 - RNA, 14 nt, Homo sapiens
guucuaguuugcau

SEQ ID NO: 818782 - RNA, 23 nt, Homo sapiens
guucucacaccaacagugugaag

SEQ ID NO: 818783 - RNA, 13 nt, Homo sapiens
guucucacuggga

SEQ ID NO: 818784 - RNA, 19 nt, Homo sapiens
guucucagguguugccaaa

SEQ ID NO: 818785 - RNA, 20 nt, Homo sapiens
guucucauuuggucugccag

SEQ ID NO: 818786 - RNA, 18 nt, Homo sapiens
guucuccugccaccaaga

SEQ ID NO: 818787 - RNA, 17 nt, Homo sapiens
guucucuauugcugcuc

SEQ ID NO: 818788 - RNA, 21 nt, Homo sapiens
guucucuucuuuaaagggaug

SEQ ID NO: 818789 - RNA, 15 nt, Homo sapiens
guucugaaagugacu

SEQ ID NO: 818790 - RNA, 11 nt, Homo sapiens
guucugcagcc

SEQ ID NO: 818791 - RNA, 21 nt, Homo sapiens
guucugcugaaucaaaucucu

SEQ ID NO: 818792 - RNA, 18 nt, Homo sapiens
guucugggaaacugaaac

SEQ ID NO: 818793 - RNA, 23 nt, Homo sapiens
guucuggggggacccagugcaga

SEQ ID NO: 818794 - RNA, 19 nt, Homo sapiens
guucuguaaaauauacuua

SEQ ID NO: 818795 - RNA, 18 nt, Homo sapiens
guucuguugaccugugca

SEQ ID NO: 818796 - RNA, 16 nt, Homo sapiens
guucuguuucaaugua

SEQ ID NO: 818797 - RNA, 16 nt, Homo sapiens
guucuuagugucacuu

SEQ ID NO: 818798 - RNA, 18 nt, Homo sapiens
guucuucaccuccugcca

SEQ ID NO: 818799 - RNA, 22 nt, Homo sapiens
guucuucuuucucuguauuccg

SEQ ID NO: 818800 - RNA, 17 nt, Homo sapiens
guucuuguccuggaguc

SEQ ID NO: 818801 - RNA, 22 nt, Homo sapiens
guucuuguuuuauauaccuggc

SEQ ID NO: 818802 - RNA, 18 nt, Homo sapiens
guucuuuaaaggcaucua

SEQ ID NO: 818803 - RNA, 21 nt, Homo sapiens
guucuuuaauguuguccagga

SEQ ID NO: 818804 - RNA, 16 nt, Homo sapiens
guucuuugggccagac

SEQ ID NO: 818805 - RNA, 14 nt, Homo sapiens
guucuuuuugccag

SEQ ID NO: 818806 - RNA, 19 nt, Homo sapiens
guugaaaaccacagucagu

SEQ ID NO: 818807 - RNA, 22 nt, Homo sapiens
guugaaaaccacagucagugga

SEQ ID NO: 818808 - RNA, 14 nt, Homo sapiens
guugaaacuguuau

SEQ ID NO: 818809 - RNA, 19 nt, Homo sapiens
guugaaagacaucaaugaa

SEQ ID NO: 818810 - RNA, 17 nt, Homo sapiens
guugaaaggccucaaga

SEQ ID NO: 818811 - RNA, 19 nt, Homo sapiens
guugaacacaauugauacu

SEQ ID NO: 818812 - RNA, 15 nt, Homo sapiens
guugacaacugugac

SEQ ID NO: 818813 - RNA, 22 nt, Homo sapiens
guugacacauaugaacacagac

SEQ ID NO: 818814 - RNA, 23 nt, Homo sapiens
guugacgccuaacugaauuugaa

SEQ ID NO: 818815 - RNA, 22 nt, Homo sapiens
guugagcuucauauaccagcaa

SEQ ID NO: 818816 - RNA, 19 nt, Homo sapiens
guugaggccaggaguuuaa

SEQ ID NO: 818817 - RNA, 19 nt, Homo sapiens
guugaucuggaacccagac

SEQ ID NO: 818818 - RNA, 22 nt, Homo sapiens
guugaucuggaacccagacuca

SEQ ID NO: 818819 - RNA, 19 nt, Homo sapiens
guugcaaacucaguuccaa

SEQ ID NO: 818820 - RNA, 23 nt, Homo sapiens
guugcagcccuugugaugugauu

SEQ ID NO: 818821 - RNA, 15 nt, Homo sapiens
guugcauuccuuugu

SEQ ID NO: 818822 - RNA, 20 nt, Homo sapiens
guugccaggcuggagugcag

SEQ ID NO: 818823 - RNA, 18 nt, Homo sapiens
guugccagguugcagcug

SEQ ID NO: 818824 - RNA, 17 nt, Homo sapiens
guugccauggauucacc

SEQ ID NO: 818825 - RNA, 22 nt, Homo sapiens
guugccugggggcuuuugccac

SEQ ID NO: 818826 - RNA, 18 nt, Homo sapiens
guugcucaaaucuauuca

SEQ ID NO: 818827 - RNA, 16 nt, Homo sapiens
guugcuggacugucau

SEQ ID NO: 818828 - RNA, 19 nt, Homo sapiens
guugcuuccuaacauccuu

SEQ ID NO: 818829 - RNA, 17 nt, Homo sapiens
guugcuuuagucacuaa

SEQ ID NO: 818830 - RNA, 18 nt, Homo sapiens
guugcuuuugugaacuuu

SEQ ID NO: 818831 - RNA, 16 nt, Homo sapiens
guuggaaaguaacugu

SEQ ID NO: 818832 - RNA, 19 nt, Homo sapiens
guuggaaccguguccagca

SEQ ID NO: 818833 - RNA, 23 nt, Homo sapiens
guuggaaccguguccagcacaga

SEQ ID NO: 818834 - RNA, 22 nt, Homo sapiens
guuggaacuuacauacaugggg

SEQ ID NO: 818835 - RNA, 20 nt, Homo sapiens
guuggacuucagucuugccu

SEQ ID NO: 818836 - RNA, 14 nt, Homo sapiens
guuggagugcagug

SEQ ID NO: 818837 - RNA, 15 nt, Homo sapiens
guuggcgacugucau

SEQ ID NO: 818838 - RNA, 17 nt, Homo sapiens
guuggcggggggcugca

SEQ ID NO: 818839 - RNA, 13 nt, Homo sapiens
guugggcuuccau

SEQ ID NO: 818840 - RNA, 17 nt, Homo sapiens
guuggguucacuugcca

SEQ ID NO: 818841 - RNA, 20 nt, Homo sapiens
guuggugaauuucacaagcu

SEQ ID NO: 818842 - RNA, 20 nt, Homo sapiens
guuggugacugaaacauuca

SEQ ID NO: 818843 - RNA, 19 nt, Homo sapiens
guugguuccaagucuuugc

SEQ ID NO: 818844 - RNA, 18 nt, Homo sapiens
guugucaccauugcacaa

SEQ ID NO: 818845 - RNA, 20 nt, Homo sapiens
guugucagcugcagccacuu

SEQ ID NO: 818846 - RNA, 20 nt, Homo sapiens
guugucuacauuaaaucacu

SEQ ID NO: 818847 - RNA, 22 nt, Homo sapiens
guugucuacauuaaaucacuug

SEQ ID NO: 818848 - RNA, 21 nt, Homo sapiens
guugucugaagucacugcaca

SEQ ID NO: 818849 - RNA, 13 nt, Homo sapiens
guugugagacuuc

SEQ ID NO: 818850 - RNA, 17 nt, Homo sapiens
guugugccccuuuccaa

SEQ ID NO: 818851 - RNA, 12 nt, Homo sapiens
guuguguaguca

SEQ ID NO: 818852 - RNA, 12 nt, Homo sapiens
guugugucuuaa

SEQ ID NO: 818853 - RNA, 19 nt, Homo sapiens
guuguuaaugaaaauguca

SEQ ID NO: 818854 - RNA, 17 nt, Homo sapiens
guuguuaauguacaaaa

SEQ ID NO: 818855 - RNA, 13 nt, Homo sapiens
guuguuuuguaca

SEQ ID NO: 818856 - RNA, 17 nt, Homo sapiens
guuuaaaaacaaaggaa

SEQ ID NO: 818857 - RNA, 22 nt, Homo sapiens
guuuaaaaaggcaguuugcaaa

SEQ ID NO: 818858 - RNA, 19 nt, Homo sapiens
guuuaaagaagcucuccag

SEQ ID NO: 818859 - RNA, 13 nt, Homo sapiens
guuuaaagucuca

SEQ ID NO: 818860 - RNA, 14 nt, Homo sapiens
guuuaaucagcgau

SEQ ID NO: 818861 - RNA, 19 nt, Homo sapiens
accucagccucccaaagug

SEQ ID NO: 818862 - RNA, 19 nt, Homo sapiens
accucagcugcacauuccu

SEQ ID NO: 818863 - RNA, 18 nt, Homo sapiens
accucagucucccagcua

SEQ ID NO: 818864 - RNA, 17 nt, Homo sapiens
accucagugucauuuau

SEQ ID NO: 818865 - RNA, 22 nt, Homo sapiens
accucagugucauuuaugaaaa

SEQ ID NO: 818866 - RNA, 22 nt, Homo sapiens
accucaguuuuaucauuuucaa

SEQ ID NO: 818867 - RNA, 22 nt, Homo sapiens
accucauaucaguuugcuagca

SEQ ID NO: 818868 - RNA, 18 nt, Homo sapiens
accucaucagcugccuaa

SEQ ID NO: 818869 - RNA, 15 nt, Homo sapiens
accuccacauaccug

SEQ ID NO: 818870 - RNA, 23 nt, Homo sapiens
accuccaggcuuucccacuuccc

SEQ ID NO: 818871 - RNA, 16 nt, Homo sapiens
accucccauuacuuug

SEQ ID NO: 818872 - RNA, 21 nt, Homo sapiens
accucccauuacuuugauauc

SEQ ID NO: 818873 - RNA, 14 nt, Homo sapiens
accuccccacugcc

SEQ ID NO: 818874 - RNA, 21 nt, Homo sapiens
accucccccuuucacacugga

SEQ ID NO: 818875 - RNA, 18 nt, Homo sapiens
accucccuccccgucuca

SEQ ID NO: 818876 - RNA, 21 nt, Homo sapiens
accucccugacccgucuaaua

SEQ ID NO: 818877 - RNA, 23 nt, Homo sapiens
accuccuaauuccacacccucac

SEQ ID NO: 818878 - RNA, 13 nt, Homo sapiens
accuccucauggc

SEQ ID NO: 818879 - RNA, 14 nt, Homo sapiens
accuccuccaugca

SEQ ID NO: 818880 - RNA, 20 nt, Homo sapiens
accuccucccuaaugcucac

SEQ ID NO: 818881 - RNA, 15 nt, Homo sapiens
accuccuuagcccug

SEQ ID NO: 818882 - RNA, 22 nt, Homo sapiens
accucgccuguuggggaccuca

SEQ ID NO: 818883 - RNA, 15 nt, Homo sapiens
accucggagggaugg

SEQ ID NO: 818884 - RNA, 20 nt, Homo sapiens
accucggccucccaaagugc

SEQ ID NO: 818885 - RNA, 22 nt, Homo sapiens
accucgggaaacuuagaucauc

SEQ ID NO: 818886 - RNA, 13 nt, Homo sapiens
accucgugaucca

SEQ ID NO: 818887 - RNA, 22 nt, Homo sapiens
accucuccuucaugacagccuc

SEQ ID NO: 818888 - RNA, 18 nt, Homo sapiens
accucugagaagacacaa

SEQ ID NO: 818889 - RNA, 19 nt, Homo sapiens
accucugagaagacacaag

SEQ ID NO: 818890 - RNA, 11 nt, Homo sapiens
accucugccac

SEQ ID NO: 818891 - RNA, 21 nt, Homo sapiens
accucugccucuaguccccaa

SEQ ID NO: 818892 - RNA, 22 nt, Homo sapiens
accucuggcaugaauauuucau

SEQ ID NO: 818893 - RNA, 17 nt, Homo sapiens
accucuguggaugaugu

SEQ ID NO: 818894 - RNA, 14 nt, Homo sapiens
accucuguggugug

SEQ ID NO: 818895 - RNA, 15 nt, Homo sapiens
accucuuaugcacac

SEQ ID NO: 818896 - RNA, 12 nt, Homo sapiens
accucuucacuc

SEQ ID NO: 818897 - RNA, 11 nt, Homo sapiens
accucuuccac

SEQ ID NO: 818898 - RNA, 14 nt, Homo sapiens
accucuuccuugau

SEQ ID NO: 818899 - RNA, 20 nt, Homo sapiens
accucuucugggaacuuccu

SEQ ID NO: 818900 - RNA, 17 nt, Homo sapiens
accucuucuuucccucc

SEQ ID NO: 818901 - RNA, 10 nt, Homo sapiens
accucuugcg

SEQ ID NO: 818902 - RNA, 17 nt, Homo sapiens
accucuuggcugccuug

SEQ ID NO: 818903 - RNA, 21 nt, Homo sapiens
accucuuuuaaacaggcaaaa

SEQ ID NO: 818904 - RNA, 16 nt, Homo sapiens
accucuuuuaaaucua

SEQ ID NO: 818905 - RNA, 22 nt, Homo sapiens
accugaaauuccaaagucucua

SEQ ID NO: 818906 - RNA, 14 nt, Homo sapiens
accugacacaagag

SEQ ID NO: 818907 - RNA, 13 nt, Homo sapiens
accugacucuugc

SEQ ID NO: 818908 - RNA, 18 nt, Homo sapiens
accugagaaauggccaaa

SEQ ID NO: 818909 - RNA, 18 nt, Homo sapiens
accugauauucaggcuac

SEQ ID NO: 818910 - RNA, 21 nt, Homo sapiens
accugauugaucacacagugu

SEQ ID NO: 818911 - RNA, 16 nt, Homo sapiens
accugauuuauugaaa

SEQ ID NO: 818912 - RNA, 15 nt, Homo sapiens
accugauuugaugau

SEQ ID NO: 818913 - RNA, 22 nt, Homo sapiens
accugcaaagaucuguccucag

SEQ ID NO: 818914 - RNA, 17 nt, Homo sapiens
accugcagcccauggug

SEQ ID NO: 818915 - RNA, 21 nt, Homo sapiens
accugcaggcuuagguccuca

SEQ ID NO: 818916 - RNA, 19 nt, Homo sapiens
accugcagggacuccaugc

SEQ ID NO: 818917 - RNA, 21 nt, Homo sapiens
accugcagggacuccaugcug

SEQ ID NO: 818918 - RNA, 18 nt, Homo sapiens
accugcaguuaacaggau

SEQ ID NO: 818919 - RNA, 14 nt, Homo sapiens
accugccuggugca

SEQ ID NO: 818920 - RNA, 15 nt, Homo sapiens
accugccugugugcu

SEQ ID NO: 818921 - RNA, 17 nt, Homo sapiens
accugcgcacagguggg

SEQ ID NO: 818922 - RNA, 22 nt, Homo sapiens
accugcuaaucacauccacaaa

SEQ ID NO: 818923 - RNA, 23 nt, Homo sapiens
accugcucuuguucuacugagaa

SEQ ID NO: 818924 - RNA, 14 nt, Homo sapiens
accugcugggaccu

SEQ ID NO: 818925 - RNA, 23 nt, Homo sapiens
accugcuggggaccucaccugcu

SEQ ID NO: 818926 - RNA, 18 nt, Homo sapiens
accugcugguuguugcca

SEQ ID NO: 818927 - RNA, 14 nt, Homo sapiens
accugcugugauac

SEQ ID NO: 818928 - RNA, 18 nt, Homo sapiens
accugcuucagagcucaa

SEQ ID NO: 818929 - RNA, 22 nt, Homo sapiens
accuggacgaagagcaggccag

SEQ ID NO: 818930 - RNA, 21 nt, Homo sapiens
accuggagauugugcucugca

SEQ ID NO: 818931 - RNA, 18 nt, Homo sapiens
accuggcccugugccuug

SEQ ID NO: 818932 - RNA, 19 nt, Homo sapiens
accuggcccugugccuugg

SEQ ID NO: 818933 - RNA, 16 nt, Homo sapiens
accuggcccuugcaau

SEQ ID NO: 818934 - RNA, 16 nt, Homo sapiens
accuggcgugcucaga

SEQ ID NO: 818935 - RNA, 11 nt, Homo sapiens
accugggaccu

SEQ ID NO: 818936 - RNA, 19 nt, Homo sapiens
accugggcagggaugaugg

SEQ ID NO: 818937 - RNA, 13 nt, Homo sapiens
accuggugcacuu

SEQ ID NO: 818938 - RNA, 15 nt, Homo sapiens
accuguaaucccagc

SEQ ID NO: 818939 - RNA, 15 nt, Homo sapiens
accuguacuaaacca

SEQ ID NO: 818940 - RNA, 20 nt, Homo sapiens
accuguagugagaaacugau

SEQ ID NO: 818941 - RNA, 18 nt, Homo sapiens
accuguauacagugcaga

SEQ ID NO: 818942 - RNA, 18 nt, Homo sapiens
accugucauuuugcacug

SEQ ID NO: 818943 - RNA, 20 nt, Homo sapiens
guuuugauuuguagcacuga

SEQ ID NO: 818944 - RNA, 12 nt, Homo sapiens
guuuugcaacaa

SEQ ID NO: 818945 - RNA, 16 nt, Homo sapiens
guuuugccaguucaag

SEQ ID NO: 818946 - RNA, 17 nt, Homo sapiens
guuuuggaagcucugaa

SEQ ID NO: 818947 - RNA, 22 nt, Homo sapiens
guuuuuaaaaaggucauauauu

SEQ ID NO: 818948 - RNA, 17 nt, Homo sapiens
guuuuuaaaaaucuguu

SEQ ID NO: 818949 - RNA, 22 nt, Homo sapiens
guuuuuaaauagaguuugcuau

SEQ ID NO: 818950 - RNA, 15 nt, Homo sapiens
guuuuuaacauguca

SEQ ID NO: 818951 - RNA, 17 nt, Homo sapiens
guuuuuaaguuugcacu

SEQ ID NO: 818952 - RNA, 16 nt, Homo sapiens
guuuuuacaguggaau

SEQ ID NO: 818953 - RNA, 13 nt, Homo sapiens
guuuuuacuguga

SEQ ID NO: 818954 - RNA, 18 nt, Homo sapiens
guuuuuauaccagcuuaa

SEQ ID NO: 818955 - RNA, 18 nt, Homo sapiens
guuuuuccacuacugcua

SEQ ID NO: 818956 - RNA, 19 nt, Homo sapiens
guuuuuccacuacugcuac

SEQ ID NO: 818957 - RNA, 21 nt, Homo sapiens
guuuuuggcucuuucagagag

SEQ ID NO: 818958 - RNA, 22 nt, Homo sapiens
guuuuugggggguuuucuugcc

SEQ ID NO: 818959 - RNA, 19 nt, Homo sapiens
guuuuuucagucugugaaa

SEQ ID NO: 818960 - RNA, 20 nt, Homo sapiens
guuuuuuccuuuauaagguu

SEQ ID NO: 818961 - RNA, 16 nt, Homo sapiens
guuuuuuguucuugcg

SEQ ID NO: 818962 - RNA, 13 nt, Homo sapiens
guuuuuuucccag

SEQ ID NO: 818963 - RNA, 16 nt, Homo sapiens
guuuuuuuugcugcua

SEQ ID NO: 818964 - RNA, 22 nt, Homo sapiens
uaaaaaaaaaaacaaagcaaca

SEQ ID NO: 818965 - RNA, 19 nt, Homo sapiens
uaaaaaaaaaaggaugaaa

SEQ ID NO: 818966 - RNA, 23 nt, Homo sapiens
uaaaaaaaaauuguaucucauua

SEQ ID NO: 818967 - RNA, 17 nt, Homo sapiens
uaaaaaaagaacauaaa

SEQ ID NO: 818968 - RNA, 17 nt, Homo sapiens
uaaaaaauaacugugca

SEQ ID NO: 818969 - RNA, 15 nt, Homo sapiens
uaaaaaauacuguug

SEQ ID NO: 818970 - RNA, 21 nt, Homo sapiens
uaaaaaaugaaaaacauuauu

SEQ ID NO: 818971 - RNA, 13 nt, Homo sapiens
uaaaaaauggaac

SEQ ID NO: 818972 - RNA, 19 nt, Homo sapiens
uaaaaaauuaugacaaugu

SEQ ID NO: 818973 - RNA, 16 nt, Homo sapiens
uaaaaacaaggucugc

SEQ ID NO: 818974 - RNA, 23 nt, Homo sapiens
uaaaaacccuguauggcacuuau

SEQ ID NO: 818975 - RNA, 18 nt, Homo sapiens
accuugggggaagacuuu

SEQ ID NO: 818976 - RNA, 19 nt, Homo sapiens
accuugggggaagacuuua

SEQ ID NO: 818977 - RNA, 22 nt, Homo sapiens
accuugguguuucucucuguaa

SEQ ID NO: 818978 - RNA, 13 nt, Homo sapiens
accuugucugcua

SEQ ID NO: 818979 - RNA, 14 nt, Homo sapiens
accuuguugcagau

SEQ ID NO: 818980 - RNA, 15 nt, Homo sapiens
accuuuaucuuucca

SEQ ID NO: 818981 - RNA, 15 nt, Homo sapiens
accuuuccugaggaa

SEQ ID NO: 818982 - RNA, 14 nt, Homo sapiens
accuuuggaaguca

SEQ ID NO: 818983 - RNA, 13 nt, Homo sapiens
accuuuguuccca

SEQ ID NO: 818984 - RNA, 16 nt, Homo sapiens
accuuuuacauuguga

SEQ ID NO: 818985 - RNA, 14 nt, Homo sapiens
accuuuucaugguc

SEQ ID NO: 818986 - RNA, 19 nt, Homo sapiens
accuuuuccccaggagcag

SEQ ID NO: 818987 - RNA, 23 nt, Homo sapiens
accuuuucccugcaccacucucu

SEQ ID NO: 818988 - RNA, 15 nt, Homo sapiens
acgaaacacaaacca

SEQ ID NO: 818989 - RNA, 18 nt, Homo sapiens
acgaaacacaaaccacaa

SEQ ID NO: 818990 - RNA, 23 nt, Homo sapiens
acgaaacacaaaccacaacugac

SEQ ID NO: 818991 - RNA, 19 nt, Homo sapiens
acgaacuuuagcugcaucc

SEQ ID NO: 818992 - RNA, 13 nt, Homo sapiens
acgaaggggcccc

SEQ ID NO: 818993 - RNA, 13 nt, Homo sapiens
acgaauugagaua

SEQ ID NO: 818994 - RNA, 22 nt, Homo sapiens
acgacaaagccaaacucugcca

SEQ ID NO: 818995 - RNA, 20 nt, Homo sapiens
acgacgggggcaggugcaag

SEQ ID NO: 818996 - RNA, 13 nt, Homo sapiens
acgacuucagggc

SEQ ID NO: 818997 - RNA, 21 nt, Homo sapiens
acgagcuagcuucugcaaugu

SEQ ID NO: 818998 - RNA, 14 nt, Homo sapiens
acgagcuggaaccc

SEQ ID NO: 818999 - RNA, 21 nt, Homo sapiens
acgagggguggugcuagaaga

SEQ ID NO: 819000 - RNA, 23 nt, Homo sapiens
acgaggucuugugauauugccca

SEQ ID NO: 819001 - RNA, 17 nt, Homo sapiens
acgagguggcagucgca

SEQ ID NO: 819002 - RNA, 19 nt, Homo sapiens
acgaguuuucccucaguga

SEQ ID NO: 819003 - RNA, 15 nt, Homo sapiens
acgcagccaggacac

SEQ ID NO: 819004 - RNA, 18 nt, Homo sapiens
acgcaucagacagaugga

SEQ ID NO: 819005 - RNA, 16 nt, Homo sapiens
acgcauccagcaagaa

SEQ ID NO: 819006 - RNA, 15 nt, Homo sapiens
acgcaugcaguguug

SEQ ID NO: 819007 - RNA, 20 nt, Homo sapiens
acgcccuauuucuaugucau

SEQ ID NO: 819008 - RNA, 22 nt, Homo sapiens
acgccucgguggcauacagacu

SEQ ID NO: 819009 - RNA, 23 nt, Homo sapiens
acgccuggugccccagcaccaac

SEQ ID NO: 819010 - RNA, 17 nt, Homo sapiens
acgcgguggcaugcaug

SEQ ID NO: 819011 - RNA, 21 nt, Homo sapiens
acgcugcugucacaaccaaga

SEQ ID NO: 819012 - RNA, 16 nt, Homo sapiens
acgcuggcaacacaga

SEQ ID NO: 819013 - RNA, 16 nt, Homo sapiens
acgcuguuuguuucau

SEQ ID NO: 819014 - RNA, 20 nt, Homo sapiens
acgcuuguagaacucacucu

SEQ ID NO: 819015 - RNA, 22 nt, Homo sapiens
acggaauauuuaaacaguagcu

SEQ ID NO: 819016 - RNA, 12 nt, Homo sapiens
acggaccaaagc

SEQ ID NO: 819017 - RNA, 21 nt, Homo sapiens
acggaguauucuuuaccucag

SEQ ID NO: 819018 - RNA, 22 nt, Homo sapiens
acggaguccuguguuugugagu

SEQ ID NO: 819019 - RNA, 15 nt, Homo sapiens
acggauaguagacag

SEQ ID NO: 819020 - RNA, 23 nt, Homo sapiens
acggaugauuggauuauucauuu

SEQ ID NO: 819021 - RNA, 13 nt, Homo sapiens
acggcccaugcaa

SEQ ID NO: 819022 - RNA, 15 nt, Homo sapiens
acggcccaugcaauu

SEQ ID NO: 819023 - RNA, 19 nt, Homo sapiens
acggcucacugcagccuca

SEQ ID NO: 819024 - RNA, 19 nt, Homo sapiens
acggcugcgcacugugucc

SEQ ID NO: 819025 - RNA, 20 nt, Homo sapiens
acggcugcgcacuguguccu

SEQ ID NO: 819026 - RNA, 22 nt, Homo sapiens
acgggaagugagagauguugcc

SEQ ID NO: 819027 - RNA, 15 nt, Homo sapiens
acggggcucuucuca

SEQ ID NO: 819028 - RNA, 19 nt, Homo sapiens
acgggguuggcuguuccag

SEQ ID NO: 819029 - RNA, 20 nt, Homo sapiens
acgggguugucgagaucuca

SEQ ID NO: 819030 - RNA, 19 nt, Homo sapiens
acgguacaaacccaaaaaa

SEQ ID NO: 819031 - RNA, 17 nt, Homo sapiens
acggucaggaaaacugu

SEQ ID NO: 819032 - RNA, 12 nt, Homo sapiens
acgguccaugaa

SEQ ID NO: 819033 - RNA, 18 nt, Homo sapiens
acggucuccugacuggug

SEQ ID NO: 819034 - RNA, 12 nt, Homo sapiens
acggugccaagg

SEQ ID NO: 819035 - RNA, 20 nt, Homo sapiens
acggugcuaaaaaugaaaau

SEQ ID NO: 819036 - RNA, 19 nt, Homo sapiens
acggugcucacucccaagg

SEQ ID NO: 819037 - RNA, 23 nt, Homo sapiens
acgguggcaguaggggaaccuag

SEQ ID NO: 819038 - RNA, 20 nt, Homo sapiens
acgguggcucaugccuguaa

SEQ ID NO: 819039 - RNA, 16 nt, Homo sapiens
acggugugcaccaaca

SEQ ID NO: 819040 - RNA, 21 nt, Homo sapiens
acguacaaaauccagcuauga

SEQ ID NO: 819041 - RNA, 23 nt, Homo sapiens
acguacaaaauccagcuaugaau

SEQ ID NO: 819042 - RNA, 22 nt, Homo sapiens
acguaccgugcaucugagauaa

SEQ ID NO: 819043 - RNA, 14 nt, Homo sapiens
acguaccuucaugu

SEQ ID NO: 819044 - RNA, 12 nt, Homo sapiens
acgucacacuug

SEQ ID NO: 819045 - RNA, 13 nt, Homo sapiens
acgucaucucagg

SEQ ID NO: 819046 - RNA, 19 nt, Homo sapiens
acguccuccguccauauca

SEQ ID NO: 819047 - RNA, 21 nt, Homo sapiens
acgucuggcuaaucuuuuuau

SEQ ID NO: 819048 - RNA, 21 nt, Homo sapiens
acgucuguccuccuuucuuau

SEQ ID NO: 819049 - RNA, 13 nt, Homo sapiens
acgucuugcuauu

SEQ ID NO: 819050 - RNA, 17 nt, Homo sapiens
acgucuuuauuuaggag

SEQ ID NO: 819051 - RNA, 15 nt, Homo sapiens
acgugaaacagagug

SEQ ID NO: 819052 - RNA, 20 nt, Homo sapiens
acgugacuguggcacacgcc

SEQ ID NO: 819053 - RNA, 19 nt, Homo sapiens
acgugcagccacacacaga

SEQ ID NO: 819054 - RNA, 18 nt, Homo sapiens
acgugcaggacagcucuu

SEQ ID NO: 819055 - RNA, 17 nt, Homo sapiens
acgugccugugauccca

SEQ ID NO: 819056 - RNA, 22 nt, Homo sapiens
acguggcccagagaagccaaaa

SEQ ID NO: 819057 - RNA, 14 nt, Homo sapiens
uaaaaugagcauug

SEQ ID NO: 819058 - RNA, 19 nt, Homo sapiens
uaaaaugcuacuuaacaaa

SEQ ID NO: 819059 - RNA, 16 nt, Homo sapiens
uaaaaugggaagacug

SEQ ID NO: 819060 - RNA, 13 nt, Homo sapiens
uaaaauguucucu

SEQ ID NO: 819061 - RNA, 14 nt, Homo sapiens
uaaaauuacauucu

SEQ ID NO: 819062 - RNA, 15 nt, Homo sapiens
uaaaauuaccaaaug

SEQ ID NO: 819063 - RNA, 18 nt, Homo sapiens
uaaaauuaucaauaucua

SEQ ID NO: 819064 - RNA, 15 nt, Homo sapiens
uaaaauuaugccaua

SEQ ID NO: 819065 - RNA, 23 nt, Homo sapiens
uaaaauuauuacuaaugaugcuu

SEQ ID NO: 819066 - RNA, 15 nt, Homo sapiens
uaaaauuauuauaua

SEQ ID NO: 819067 - RNA, 17 nt, Homo sapiens
uaaaauucagaugcugu

SEQ ID NO: 819068 - RNA, 16 nt, Homo sapiens
uaaaauucauagcauc

SEQ ID NO: 819069 - RNA, 21 nt, Homo sapiens
uaaaauugauuuuucucuuca

SEQ ID NO: 819070 - RNA, 12 nt, Homo sapiens
uaaaauugcuau

SEQ ID NO: 819071 - RNA, 16 nt, Homo sapiens
uaaaauugcugugcuu

SEQ ID NO: 819072 - RNA, 20 nt, Homo sapiens
uaaaauuuaacuuuugagca

SEQ ID NO: 819073 - RNA, 15 nt, Homo sapiens
uaaaauuuacauuua

SEQ ID NO: 819074 - RNA, 14 nt, Homo sapiens
uaaacaaauaacaa

SEQ ID NO: 819075 - RNA, 17 nt, Homo sapiens
uaaacaaauaacaaugu

SEQ ID NO: 819076 - RNA, 14 nt, Homo sapiens
uaaacaacuaccuc

SEQ ID NO: 819077 - RNA, 20 nt, Homo sapiens
uaaacaacucaagggcacau

SEQ ID NO: 819078 - RNA, 14 nt, Homo sapiens
uaaacaagaaaucu

SEQ ID NO: 819079 - RNA, 19 nt, Homo sapiens
uaaacaagaaaucugacaa

SEQ ID NO: 819080 - RNA, 18 nt, Homo sapiens
uaaacaagggucaauuca

SEQ ID NO: 819081 - RNA, 20 nt, Homo sapiens
uaaacacaaagcuguugaaa

SEQ ID NO: 819082 - RNA, 22 nt, Homo sapiens
uaaacacauguucugugccugc

SEQ ID NO: 819083 - RNA, 16 nt, Homo sapiens
uaaacaccauuauuca

SEQ ID NO: 819084 - RNA, 15 nt, Homo sapiens
uaaacaccuccucau

SEQ ID NO: 819085 - RNA, 21 nt, Homo sapiens
uaaacagaagcagcaaaugaa

SEQ ID NO: 819086 - RNA, 17 nt, Homo sapiens
uaaacagcuucaugccu

SEQ ID NO: 819087 - RNA, 20 nt, Homo sapiens
uaaacaguaaaccuuaacag

SEQ ID NO: 819088 - RNA, 23 nt, Homo sapiens
uaaacauauuuuuauacuuuauu

SEQ ID NO: 819089 - RNA, 16 nt, Homo sapiens
acuaaggaaucuuucu

SEQ ID NO: 819090 - RNA, 16 nt, Homo sapiens
acuaauacuacugugu

SEQ ID NO: 819091 - RNA, 12 nt, Homo sapiens
acuaaugaagug

SEQ ID NO: 819092 - RNA, 13 nt, Homo sapiens
acuaaugaccaca

SEQ ID NO: 819093 - RNA, 14 nt, Homo sapiens
acuaaugacuuugu

SEQ ID NO: 819094 - RNA, 22 nt, Homo sapiens
acuaaugaucacauucuuucca

SEQ ID NO: 819095 - RNA, 14 nt, Homo sapiens
acuaauuaggcaag

SEQ ID NO: 819096 - RNA, 20 nt, Homo sapiens
acuaauuuaaguacuugaga

SEQ ID NO: 819097 - RNA, 15 nt, Homo sapiens
acuaauuugugguaa

SEQ ID NO: 819098 - RNA, 21 nt, Homo sapiens
acuaauuuuaguauucauucu

SEQ ID NO: 819099 - RNA, 15 nt, Homo sapiens
acuacaacagaauuu

SEQ ID NO: 819100 - RNA, 21 nt, Homo sapiens
acuacaccuggcugagguucc

SEQ ID NO: 819101 - RNA, 17 nt, Homo sapiens
acuacagcuauaccuca

SEQ ID NO: 819102 - RNA, 20 nt, Homo sapiens
acuacaggcgccugccagca

SEQ ID NO: 819103 - RNA, 22 nt, Homo sapiens
acuacagggagaaaauccaggu

SEQ ID NO: 819104 - RNA, 22 nt, Homo sapiens
acuacaguaacugugacugaug

SEQ ID NO: 819105 - RNA, 22 nt, Homo sapiens
acuacaugaaauaaugcacuga

SEQ ID NO: 819106 - RNA, 23 nt, Homo sapiens
acuacaugugacuggcaguauua

SEQ ID NO: 819107 - RNA, 18 nt, Homo sapiens
acuaccauugcuguucua

SEQ ID NO: 819108 - RNA, 21 nt, Homo sapiens
acuaccauugcuguucuacuu

SEQ ID NO: 819109 - RNA, 22 nt, Homo sapiens
acuacccgagcccagcuacauu

SEQ ID NO: 819110 - RNA, 23 nt, Homo sapiens
acuaccuaugccacccugcaaua

SEQ ID NO: 819111 - RNA, 19 nt, Homo sapiens
acuacgugacuguggcaca

SEQ ID NO: 819112 - RNA, 14 nt, Homo sapiens
acuacuauauugau

SEQ ID NO: 819113 - RNA, 12 nt, Homo sapiens
acuacuccugua

SEQ ID NO: 819114 - RNA, 15 nt, Homo sapiens
acuacucugugccag

SEQ ID NO: 819115 - RNA, 21 nt, Homo sapiens
acuacugcuggaaaaagcccu

SEQ ID NO: 819116 - RNA, 22 nt, Homo sapiens
acuacuuagagauauguaucau

SEQ ID NO: 819117 - RNA, 21 nt, Homo sapiens
acuacuuggaacuaggcucuu

SEQ ID NO: 819118 - RNA, 20 nt, Homo sapiens
acuagaaagaaggacccaga

SEQ ID NO: 819119 - RNA, 14 nt, Homo sapiens
acuagaacucucca

SEQ ID NO: 819120 - RNA, 16 nt, Homo sapiens
acuagaagagauuucu

SEQ ID NO: 819121 - RNA, 18 nt, Homo sapiens
acuagaccuguaacuuuu

SEQ ID NO: 819122 - RNA, 22 nt, Homo sapiens
acuagacucaggaaagcuguua

SEQ ID NO: 819123 - RNA, 17 nt, Homo sapiens
acuagcagcugcaguca

SEQ ID NO: 819124 - RNA, 18 nt, Homo sapiens
acuagccaaaccaggacc

SEQ ID NO: 819125 - RNA, 21 nt, Homo sapiens
acuagccaggaaguacuucca

SEQ ID NO: 819126 - RNA, 23 nt, Homo sapiens
acuaggaaaaaauugcuuuugag

SEQ ID NO: 819127 - RNA, 13 nt, Homo sapiens
acuaggacacucc

SEQ ID NO: 819128 - RNA, 15 nt, Homo sapiens
acuaggacucugagg

SEQ ID NO: 819129 - RNA, 20 nt, Homo sapiens
acuaggcaauguacucuucc

SEQ ID NO: 819130 - RNA, 20 nt, Homo sapiens
acuaggcccccacuugccuc

SEQ ID NO: 819131 - RNA, 23 nt, Homo sapiens
acuaggcucuuaugugugccuuu

SEQ ID NO: 819132 - RNA, 15 nt, Homo sapiens
acuagggaagcucag

SEQ ID NO: 819133 - RNA, 13 nt, Homo sapiens
acuaggugccuuu

SEQ ID NO: 819134 - RNA, 13 nt, Homo sapiens
acuaguagucaua

SEQ ID NO: 819135 - RNA, 16 nt, Homo sapiens
acuagucucaccagcc

SEQ ID NO: 819136 - RNA, 22 nt, Homo sapiens
acuaguguguguguguauauau

SEQ ID NO: 819137 - RNA, 20 nt, Homo sapiens
acuauaaacuuaagggcaag

SEQ ID NO: 819138 - RNA, 17 nt, Homo sapiens
acuauaagcccacuguu

SEQ ID NO: 819139 - RNA, 13 nt, Homo sapiens
acuauaccuuauc

SEQ ID NO: 819140 - RNA, 13 nt, Homo sapiens
acuauaucuguau

SEQ ID NO: 819141 - RNA, 15 nt, Homo sapiens
acuauauuugcuaga

SEQ ID NO: 819142 - RNA, 18 nt, Homo sapiens
acuauccaacuuaacaug

SEQ ID NO: 819143 - RNA, 16 nt, Homo sapiens
acuaucugauuuccua

SEQ ID NO: 819144 - RNA, 17 nt, Homo sapiens
acuaugaaccuucuuaa

SEQ ID NO: 819145 - RNA, 19 nt, Homo sapiens
acuaugaagguaaagggag

SEQ ID NO: 819146 - RNA, 19 nt, Homo sapiens
acuaugaaguaagcaacaa

SEQ ID NO: 819147 - RNA, 16 nt, Homo sapiens
acuaugacacugagca

SEQ ID NO: 819148 - RNA, 19 nt, Homo sapiens
acuaugaggacugccuuau

SEQ ID NO: 819149 - RNA, 15 nt, Homo sapiens
acuaugaucacagug

SEQ ID NO: 819150 - RNA, 16 nt, Homo sapiens
acuaugaucacaguga

SEQ ID NO: 819151 - RNA, 13 nt, Homo sapiens
acuaugaucucag

SEQ ID NO: 819152 - RNA, 21 nt, Homo sapiens
acuaugauuuaccuauacauu

SEQ ID NO: 819153 - RNA, 14 nt, Homo sapiens
acuaugcacugcug

SEQ ID NO: 819154 - RNA, 14 nt, Homo sapiens
acuauguggcugaa

SEQ ID NO: 819155 - RNA, 23 nt, Homo sapiens
acuauguggcugaaaaugcaaag

SEQ ID NO: 819156 - RNA, 18 nt, Homo sapiens
acuauguuuggaguuuaa

SEQ ID NO: 819157 - RNA, 15 nt, Homo sapiens
acuauuaccaugaga

SEQ ID NO: 819158 - RNA, 22 nt, Homo sapiens
acuauucuaaugaaaacauuaa

SEQ ID NO: 819159 - RNA, 22 nt, Homo sapiens
acuauugugcacaagucuuucc

SEQ ID NO: 819160 - RNA, 21 nt, Homo sapiens
acuauuuaaagccuccucauc

SEQ ID NO: 819161 - RNA, 21 nt, Homo sapiens
acuauuuaaaggaaaaucaca

SEQ ID NO: 819162 - RNA, 22 nt, Homo sapiens
acuauuuagauauaacacuaug

SEQ ID NO: 819163 - RNA, 19 nt, Homo sapiens
acuauuuaguggaaccuug

SEQ ID NO: 819164 - RNA, 17 nt, Homo sapiens
acuauuuaugaaggcaa

SEQ ID NO: 819165 - RNA, 18 nt, Homo sapiens
acuauuuccaaaagcaca

SEQ ID NO: 819166 - RNA, 22 nt, Homo sapiens
acuauuucugggucuuuugcua

SEQ ID NO: 819167 - RNA, 17 nt, Homo sapiens
acucaaacgaugugcaa

SEQ ID NO: 819168 - RNA, 13 nt, Homo sapiens
acucaaacugccu

SEQ ID NO: 819169 - RNA, 13 nt, Homo sapiens
acucaaacuugag

SEQ ID NO: 819170 - RNA, 18 nt, Homo sapiens
acucaaauacacauuugc

SEQ ID NO: 819171 - RNA, 11 nt, Homo sapiens
agaaaugaugg

SEQ ID NO: 819172 - RNA, 22 nt, Homo sapiens
agaaaugauucaaauugcugcu

SEQ ID NO: 819173 - RNA, 13 nt, Homo sapiens
agaaaugcaaaac

SEQ ID NO: 819174 - RNA, 13 nt, Homo sapiens
agaaaugcugcug

SEQ ID NO: 819175 - RNA, 19 nt, Homo sapiens
agaaauggauguaagccug

SEQ ID NO: 819176 - RNA, 20 nt, Homo sapiens
agaaaugguuuccucuggau

SEQ ID NO: 819177 - RNA, 20 nt, Homo sapiens
agaaauuaacaaaugugcug

SEQ ID NO: 819178 - RNA, 23 nt, Homo sapiens
agaaauuaacaaaugugcugcuu

SEQ ID NO: 819179 - RNA, 17 nt, Homo sapiens
agaaauuauacuuacuu

SEQ ID NO: 819180 - RNA, 22 nt, Homo sapiens
agaaauuccauacuucucucag

SEQ ID NO: 819181 - RNA, 13 nt, Homo sapiens
agaacaacauauc

SEQ ID NO: 819182 - RNA, 20 nt, Homo sapiens
agaacaagaccccgucucaa

SEQ ID NO: 819183 - RNA, 10 nt, Homo sapiens
agaacacagg

SEQ ID NO: 819184 - RNA, 20 nt, Homo sapiens
agaacaccugaggacaggag

SEQ ID NO: 819185 - RNA, 16 nt, Homo sapiens
agaacacuacugcuaa

SEQ ID NO: 819186 - RNA, 15 nt, Homo sapiens
agaacagagugcaac

SEQ ID NO: 819187 - RNA, 15 nt, Homo sapiens
agaacagaucaggaa

SEQ ID NO: 819188 - RNA, 17 nt, Homo sapiens
agaacaguaacugccau

SEQ ID NO: 819189 - RNA, 20 nt, Homo sapiens
agaacauaaaaaauaaagua

SEQ ID NO: 819190 - RNA, 15 nt, Homo sapiens
agaacauacacugug

SEQ ID NO: 819191 - RNA, 10 nt, Homo sapiens
agaaccaaaa

SEQ ID NO: 819192 - RNA, 16 nt, Homo sapiens
agaaccaaaacuucca

SEQ ID NO: 819193 - RNA, 12 nt, Homo sapiens
agaaccaaaggg

SEQ ID NO: 819194 - RNA, 21 nt, Homo sapiens
agaaccaagcuucagagccua

SEQ ID NO: 819195 - RNA, 15 nt, Homo sapiens
agaaccacuacaucu

SEQ ID NO: 819196 - RNA, 13 nt, Homo sapiens
agaaccacugucu

SEQ ID NO: 819197 - RNA, 14 nt, Homo sapiens
agaaccauuuacuu

SEQ ID NO: 819198 - RNA, 15 nt, Homo sapiens
agaaccauuuacuua

SEQ ID NO: 819199 - RNA, 18 nt, Homo sapiens
agaacccaccaaccagaa

SEQ ID NO: 819200 - RNA, 15 nt, Homo sapiens
agaacccagauuucc

SEQ ID NO: 819201 - RNA, 17 nt, Homo sapiens
agaacccagauuuccua

SEQ ID NO: 819202 - RNA, 17 nt, Homo sapiens
agaacccauaaccauac

SEQ ID NO: 819203 - RNA, 15 nt, Homo sapiens
agaacccugcuguuu

SEQ ID NO: 819204 - RNA, 13 nt, Homo sapiens
agaaccucuuccc

SEQ ID NO: 819205 - RNA, 13 nt, Homo sapiens
uacauuaucucac

SEQ ID NO: 819206 - RNA, 12 nt, Homo sapiens
uacauucacuuu

SEQ ID NO: 819207 - RNA, 14 nt, Homo sapiens
uacauuccauuuca

SEQ ID NO: 819208 - RNA, 15 nt, Homo sapiens
uacauuccucagcug

SEQ ID NO: 819209 - RNA, 17 nt, Homo sapiens
uacauuccucagcugcc

SEQ ID NO: 819210 - RNA, 19 nt, Homo sapiens
uacauucuuaaagugucga

SEQ ID NO: 819211 - RNA, 14 nt, Homo sapiens
uacauuguaaauag

SEQ ID NO: 819212 - RNA, 21 nt, Homo sapiens
uacauuguacaaggaaugaaa

SEQ ID NO: 819213 - RNA, 15 nt, Homo sapiens
uacauugugcugcac

SEQ ID NO: 819214 - RNA, 22 nt, Homo sapiens
uacauuguucuuauucuggcau

SEQ ID NO: 819215 - RNA, 21 nt, Homo sapiens
uacauuuaaaaauacuucucu

SEQ ID NO: 819216 - RNA, 17 nt, Homo sapiens
uacauuuaauaaaacug

SEQ ID NO: 819217 - RNA, 18 nt, Homo sapiens
uacauuuacuggacccug

SEQ ID NO: 819218 - RNA, 14 nt, Homo sapiens
uacauuucauacaa

SEQ ID NO: 819219 - RNA, 16 nt, Homo sapiens
uacauuuccaaauuca

SEQ ID NO: 819220 - RNA, 18 nt, Homo sapiens
uacauuuccaaauucaca

SEQ ID NO: 819221 - RNA, 20 nt, Homo sapiens
uacauuuguauuuugugaug

SEQ ID NO: 819222 - RNA, 18 nt, Homo sapiens
uacauuuuucagacuuca

SEQ ID NO: 819223 - RNA, 19 nt, Homo sapiens
uacauuuuuuucucuuucc

SEQ ID NO: 819224 - RNA, 15 nt, Homo sapiens
uaccaaaagggccau

SEQ ID NO: 819225 - RNA, 14 nt, Homo sapiens
uaccaaacaaggaa

SEQ ID NO: 819226 - RNA, 14 nt, Homo sapiens
uaccaaagcaucaa

SEQ ID NO: 819227 - RNA, 18 nt, Homo sapiens
uaccaaaguaacugaauu

SEQ ID NO: 819228 - RNA, 15 nt, Homo sapiens
uaccaaaugcuucua

SEQ ID NO: 819229 - RNA, 20 nt, Homo sapiens
uaccaagaacugaaggcaua

SEQ ID NO: 819230 - RNA, 14 nt, Homo sapiens
uaccaauaaaguga

SEQ ID NO: 819231 - RNA, 20 nt, Homo sapiens
uaccaauaaagugacccugu

SEQ ID NO: 819232 - RNA, 14 nt, Homo sapiens
uaccaaucauuuua

SEQ ID NO: 819233 - RNA, 18 nt, Homo sapiens
uaccacaaacccugcuga

SEQ ID NO: 819234 - RNA, 17 nt, Homo sapiens
uaccacaagccugagaa

SEQ ID NO: 819235 - RNA, 18 nt, Homo sapiens
uaccacaagccugagaac

SEQ ID NO: 819236 - RNA, 15 nt, Homo sapiens
uaccacacauauugc

SEQ ID NO: 819237 - RNA, 18 nt, Homo sapiens
uaccacacccagggcuau

SEQ ID NO: 819238 - RNA, 16 nt, Homo sapiens
uaccacaguggaugua

SEQ ID NO: 819239 - RNA, 18 nt, Homo sapiens
uaccacagugucuguauc

SEQ ID NO: 819240 - RNA, 21 nt, Homo sapiens
uaccaccaagggaucugccau

SEQ ID NO: 819241 - RNA, 22 nt, Homo sapiens
uaccaccaagggaucugccauu

SEQ ID NO: 819242 - RNA, 23 nt, Homo sapiens
uaccaccaagggaucugccauug

SEQ ID NO: 819243 - RNA, 18 nt, Homo sapiens
uaccaccuaauguuuaua

SEQ ID NO: 819244 - RNA, 19 nt, Homo sapiens
uaccacugauuuggagaua

SEQ ID NO: 819245 - RNA, 18 nt, Homo sapiens
uaccagaaagcucuacau

SEQ ID NO: 819246 - RNA, 14 nt, Homo sapiens
uaccagagauuuac

SEQ ID NO: 819247 - RNA, 21 nt, Homo sapiens
uaccagagccuucaagugcca

SEQ ID NO: 819248 - RNA, 22 nt, Homo sapiens
uaccagcauacgcucaccuuac

SEQ ID NO: 819249 - RNA, 18 nt, Homo sapiens
uaccaguauagcuugcau

SEQ ID NO: 819250 - RNA, 15 nt, Homo sapiens
uaccagucuauuucc

SEQ ID NO: 819251 - RNA, 21 nt, Homo sapiens
uaccagucuauuuccacugaa

SEQ ID NO: 819252 - RNA, 20 nt, Homo sapiens
uaccaguuguuagaucugua

SEQ ID NO: 819253 - RNA, 13 nt, Homo sapiens
uaccaugcugcuu

SEQ ID NO: 819254 - RNA, 19 nt, Homo sapiens
uaccauuauuaucaaguag

SEQ ID NO: 819255 - RNA, 18 nt, Homo sapiens
uaccauuuaguaagaaua

SEQ ID NO: 819256 - RNA, 22 nt, Homo sapiens
uaccauuuguaauaaaguauau

SEQ ID NO: 819257 - RNA, 23 nt, Homo sapiens
uaccauuuuuuaaggaaacaaua

SEQ ID NO: 819258 - RNA, 22 nt, Homo sapiens
uacccaaaacccugaagccauu

SEQ ID NO: 819259 - RNA, 14 nt, Homo sapiens
uacccaacccugcc

SEQ ID NO: 819260 - RNA, 17 nt, Homo sapiens
uacccaagcuguggcag

SEQ ID NO: 819261 - RNA, 19 nt, Homo sapiens
uacccaccuagaacacuaa

SEQ ID NO: 819262 - RNA, 11 nt, Homo sapiens
uacccacuucc

SEQ ID NO: 819263 - RNA, 23 nt, Homo sapiens
uacccagagaauauauacauucu

SEQ ID NO: 819264 - RNA, 12 nt, Homo sapiens
uacccagcgcua

SEQ ID NO: 819265 - RNA, 15 nt, Homo sapiens
uacccaugcuuuguu

SEQ ID NO: 819266 - RNA, 22 nt, Homo sapiens
uacccaugcuuuguuuuucaca

SEQ ID NO: 819267 - RNA, 16 nt, Homo sapiens
uaccccacugggccag

SEQ ID NO: 819268 - RNA, 19 nt, Homo sapiens
uaccccagguucuagucau

SEQ ID NO: 819269 - RNA, 22 nt, Homo sapiens
uaccccuuggaaaugucugcug

SEQ ID NO: 819270 - RNA, 14 nt, Homo sapiens
uacccuaaagggag

SEQ ID NO: 819271 - RNA, 16 nt, Homo sapiens
uacccuauacauccac

SEQ ID NO: 819272 - RNA, 15 nt, Homo sapiens
uacccugaucuggac

SEQ ID NO: 819273 - RNA, 19 nt, Homo sapiens
uacccuuuaagauauccau

SEQ ID NO: 819274 - RNA, 18 nt, Homo sapiens
uacccuuuagacuguagc

SEQ ID NO: 819275 - RNA, 22 nt, Homo sapiens
uacccuuuggccccacuuugaa

SEQ ID NO: 819276 - RNA, 18 nt, Homo sapiens
uacccuuuuucuccagcu

SEQ ID NO: 819277 - RNA, 18 nt, Homo sapiens
uaccgcuggcccugccgu

SEQ ID NO: 819278 - RNA, 13 nt, Homo sapiens
uaccggauucucu

SEQ ID NO: 819279 - RNA, 13 nt, Homo sapiens
uaccuaaggacaa

SEQ ID NO: 819280 - RNA, 17 nt, Homo sapiens
uaccucaaagggcaguu

SEQ ID NO: 819281 - RNA, 11 nt, Homo sapiens
uaccucaaggg

SEQ ID NO: 819282 - RNA, 19 nt, Homo sapiens
uaccucacagagugcauug

SEQ ID NO: 819283 - RNA, 14 nt, Homo sapiens
uaccucacuggggu

SEQ ID NO: 819284 - RNA, 13 nt, Homo sapiens
uaccucagccuag

SEQ ID NO: 819285 - RNA, 14 nt, Homo sapiens
uaccuccauccauc

SEQ ID NO: 819286 - RNA, 21 nt, Homo sapiens
agaauaaaaaagaaauccaua

SEQ ID NO: 819287 - RNA, 21 nt, Homo sapiens
agaauaaaauuccuaucucau

SEQ ID NO: 819288 - RNA, 13 nt, Homo sapiens
agaauacauucaa

SEQ ID NO: 819289 - RNA, 19 nt, Homo sapiens
agaauaccacaucaaauaa

SEQ ID NO: 819290 - RNA, 18 nt, Homo sapiens
agaauagcagagagccaa

SEQ ID NO: 819291 - RNA, 17 nt, Homo sapiens
agaauagucucacuguc

SEQ ID NO: 819292 - RNA, 19 nt, Homo sapiens
agaauauacaaauagcaaa

SEQ ID NO: 819293 - RNA, 13 nt, Homo sapiens
agaauauaccuua

SEQ ID NO: 819294 - RNA, 19 nt, Homo sapiens
agaauauuauguuccucaa

SEQ ID NO: 819295 - RNA, 19 nt, Homo sapiens
agaauauuuauuaccucug

SEQ ID NO: 819296 - RNA, 21 nt, Homo sapiens
agaauauuuuaagaauuucac

SEQ ID NO: 819297 - RNA, 15 nt, Homo sapiens
agaaucaaauacuca

SEQ ID NO: 819298 - RNA, 17 nt, Homo sapiens
agaaucagaucauuuca

SEQ ID NO: 819299 - RNA, 23 nt, Homo sapiens
agaaucagcauuuagucuugcca

SEQ ID NO: 819300 - RNA, 11 nt, Homo sapiens
agaaucaucuu

SEQ ID NO: 819301 - RNA, 22 nt, Homo sapiens
agaaucaucuuuugaagcuuuc

SEQ ID NO: 819302 - RNA, 20 nt, Homo sapiens
agaaucccuuugcaccugag

SEQ ID NO: 819303 - RNA, 19 nt, Homo sapiens
agaaucgcuugaacccagg

SEQ ID NO: 819304 - RNA, 15 nt, Homo sapiens
agaaucuaaagccag

SEQ ID NO: 819305 - RNA, 14 nt, Homo sapiens
agaaucucaaauaa

SEQ ID NO: 819306 - RNA, 16 nt, Homo sapiens
agaaucucaacauguc

SEQ ID NO: 819307 - RNA, 13 nt, Homo sapiens
agaaucucugagc

SEQ ID NO: 819308 - RNA, 21 nt, Homo sapiens
agaaucucuucaugcuugaca

SEQ ID NO: 819309 - RNA, 18 nt, Homo sapiens
agaaucucuugaaccugg

SEQ ID NO: 819310 - RNA, 22 nt, Homo sapiens
agaaugaaagacugaaucuucc

SEQ ID NO: 819311 - RNA, 16 nt, Homo sapiens
agaaugaaauguaugu

SEQ ID NO: 819312 - RNA, 18 nt, Homo sapiens
agaaugaaauguaugugc

SEQ ID NO: 819313 - RNA, 20 nt, Homo sapiens
agaaugaaauguaugugcuc

SEQ ID NO: 819314 - RNA, 18 nt, Homo sapiens
agaaugagcuuacaaagu

SEQ ID NO: 819315 - RNA, 12 nt, Homo sapiens
agaaugcagcug

SEQ ID NO: 819316 - RNA, 17 nt, Homo sapiens
agaaugcagcugaagac

SEQ ID NO: 819317 - RNA, 13 nt, Homo sapiens
agaaugcaucuca

SEQ ID NO: 819318 - RNA, 21 nt, Homo sapiens
agaaugcaucucaucaacuua

SEQ ID NO: 819319 - RNA, 20 nt, Homo sapiens
agaaugccgguuaaauucca

SEQ ID NO: 819320 - RNA, 13 nt, Homo sapiens
uacuagcacuuug

SEQ ID NO: 819321 - RNA, 16 nt, Homo sapiens
uacuagcaggaauauu

SEQ ID NO: 819322 - RNA, 14 nt, Homo sapiens
uacuagcaguguuu

SEQ ID NO: 819323 - RNA, 16 nt, Homo sapiens
uacuagggagccauuu

SEQ ID NO: 819324 - RNA, 23 nt, Homo sapiens
uacuaguguguguguguauauau

SEQ ID NO: 819325 - RNA, 14 nt, Homo sapiens
uacuaguuuucaau

SEQ ID NO: 819326 - RNA, 12 nt, Homo sapiens
uacuauaugauu

SEQ ID NO: 819327 - RNA, 16 nt, Homo sapiens
uacuaucauggcauau

SEQ ID NO: 819328 - RNA, 12 nt, Homo sapiens
uacucaaaagag

SEQ ID NO: 819329 - RNA, 16 nt, Homo sapiens
uacucacuuuuuccaa

SEQ ID NO: 819330 - RNA, 13 nt, Homo sapiens
uacucagcauuug

SEQ ID NO: 819331 - RNA, 14 nt, Homo sapiens
uacucagcauuuga

SEQ ID NO: 819332 - RNA, 20 nt, Homo sapiens
uacucaggaggcugaggcag

SEQ ID NO: 819333 - RNA, 22 nt, Homo sapiens
uacucauccagaccccaugccu

SEQ ID NO: 819334 - RNA, 16 nt, Homo sapiens
uacucaugugcaauag

SEQ ID NO: 819335 - RNA, 20 nt, Homo sapiens
uacucauuaaaaauaauaga

SEQ ID NO: 819336 - RNA, 15 nt, Homo sapiens
uacuccaucauggcu

SEQ ID NO: 819337 - RNA, 15 nt, Homo sapiens
uacucccucuucacu

SEQ ID NO: 819338 - RNA, 15 nt, Homo sapiens
uacuccuaccucagc

SEQ ID NO: 819339 - RNA, 21 nt, Homo sapiens
uacuccuagaagaaccaaaua

SEQ ID NO: 819340 - RNA, 18 nt, Homo sapiens
uacuccuuuuaagcagug

SEQ ID NO: 819341 - RNA, 15 nt, Homo sapiens
uacucgauguaaggg

SEQ ID NO: 819342 - RNA, 22 nt, Homo sapiens
uacucucaaaaucuuuguauaa

SEQ ID NO: 819343 - RNA, 13 nt, Homo sapiens
uacucugcugcaa

SEQ ID NO: 819344 - RNA, 18 nt, Homo sapiens
uacucuguuccuucacau

SEQ ID NO: 819345 - RNA, 21 nt, Homo sapiens
uacucuuagauggauucucca

SEQ ID NO: 819346 - RNA, 16 nt, Homo sapiens
uacucuugaauacaag

SEQ ID NO: 819347 - RNA, 15 nt, Homo sapiens
uacucuuuguagcaa

SEQ ID NO: 819348 - RNA, 21 nt, Homo sapiens
uacugaaaaggaggggucugg

SEQ ID NO: 819349 - RNA, 17 nt, Homo sapiens
uacugaaccacucuccc

SEQ ID NO: 819350 - RNA, 13 nt, Homo sapiens
uacugaaugcacc

SEQ ID NO: 819351 - RNA, 19 nt, Homo sapiens
uacugaauguguuugaaca

SEQ ID NO: 819352 - RNA, 20 nt, Homo sapiens
uacugaauuggcuuccagau

SEQ ID NO: 819353 - RNA, 13 nt, Homo sapiens
uacugaccagcaa

SEQ ID NO: 819354 - RNA, 19 nt, Homo sapiens
uacugacggaguccugugu

SEQ ID NO: 819355 - RNA, 22 nt, Homo sapiens
uacugacuuucugauuacuguc

SEQ ID NO: 819356 - RNA, 18 nt, Homo sapiens
uacugaggauauggacac

SEQ ID NO: 819357 - RNA, 22 nt, Homo sapiens
uacugaggugcuauguucuuag

SEQ ID NO: 819358 - RNA, 18 nt, Homo sapiens
uacugaguuacauuguca

SEQ ID NO: 819359 - RNA, 16 nt, Homo sapiens
uacugauaauuuugcu

SEQ ID NO: 819360 - RNA, 14 nt, Homo sapiens
uacugaucucuuua

SEQ ID NO: 819361 - RNA, 17 nt, Homo sapiens
uacugaugauguagaua

SEQ ID NO: 819362 - RNA, 13 nt, Homo sapiens
uacugaugugaua

SEQ ID NO: 819363 - RNA, 13 nt, Homo sapiens
uacugcaaaucag

SEQ ID NO: 819364 - RNA, 23 nt, Homo sapiens
uacugcaaaugcuauauugcacu

SEQ ID NO: 819365 - RNA, 18 nt, Homo sapiens
uacugcacccagcagugu

SEQ ID NO: 819366 - RNA, 17 nt, Homo sapiens
uacugcagaucaagaaa

SEQ ID NO: 819367 - RNA, 16 nt, Homo sapiens
uacugccaaccagagc

SEQ ID NO: 819368 - RNA, 18 nt, Homo sapiens
uacugcccaaggauaggu

SEQ ID NO: 819369 - RNA, 13 nt, Homo sapiens
uacugccuagaaa

SEQ ID NO: 819370 - RNA, 13 nt, Homo sapiens
uacugccuugaaa

SEQ ID NO: 819371 - RNA, 19 nt, Homo sapiens
uacugcuaucuacuacaaa

SEQ ID NO: 819372 - RNA, 16 nt, Homo sapiens
uacugcucuccuccac

SEQ ID NO: 819373 - RNA, 16 nt, Homo sapiens
uacugcuuacuguugc

SEQ ID NO: 819374 - RNA, 13 nt, Homo sapiens
uacugcuucccau

SEQ ID NO: 819375 - RNA, 19 nt, Homo sapiens
uacugcuucuuuucacuuc

SEQ ID NO: 819376 - RNA, 14 nt, Homo sapiens
uacuggaaaccuaa

SEQ ID NO: 819377 - RNA, 12 nt, Homo sapiens
uacuggacucag

SEQ ID NO: 819378 - RNA, 18 nt, Homo sapiens
uacugggaaucaagacaa

SEQ ID NO: 819379 - RNA, 19 nt, Homo sapiens
uacugggagauacagccau

SEQ ID NO: 819380 - RNA, 14 nt, Homo sapiens
uacuggugcaguca

SEQ ID NO: 819381 - RNA, 22 nt, Homo sapiens
uacuguaaauauuuuucacaua

SEQ ID NO: 819382 - RNA, 11 nt, Homo sapiens
uacuguacuuu

SEQ ID NO: 819383 - RNA, 17 nt, Homo sapiens
uacuguagcugaugaaa

SEQ ID NO: 819384 - RNA, 17 nt, Homo sapiens
uacuguaguucacugua

SEQ ID NO: 819385 - RNA, 16 nt, Homo sapiens
uacugucuaagcaguu

SEQ ID NO: 819386 - RNA, 17 nt, Homo sapiens
uacuguggucacuugua

SEQ ID NO: 819387 - RNA, 15 nt, Homo sapiens
uacuguggugaucug

SEQ ID NO: 819388 - RNA, 18 nt, Homo sapiens
uacuguucuaaagcucug

SEQ ID NO: 819389 - RNA, 15 nt, Homo sapiens
uacuguugcacugau

SEQ ID NO: 819390 - RNA, 20 nt, Homo sapiens
uacuguuugauauaccaaau

SEQ ID NO: 819391 - RNA, 15 nt, Homo sapiens
uacuguuuuaauugu

SEQ ID NO: 819392 - RNA, 15 nt, Homo sapiens
uacuuaaagcuucua

SEQ ID NO: 819393 - RNA, 19 nt, Homo sapiens
uacuuaacuauucaggaga

SEQ ID NO: 819394 - RNA, 19 nt, Homo sapiens
uacuuaagagugcugugua

SEQ ID NO: 819395 - RNA, 23 nt, Homo sapiens
uacuuaagcaaaagucagucuua

SEQ ID NO: 819396 - RNA, 14 nt, Homo sapiens
uacuuacuccccac

SEQ ID NO: 819397 - RNA, 19 nt, Homo sapiens
uacuuacuccccacugaug

SEQ ID NO: 819398 - RNA, 14 nt, Homo sapiens
uacuuacuucuggc

SEQ ID NO: 819399 - RNA, 13 nt, Homo sapiens
uacuuagugguau

SEQ ID NO: 819400 - RNA, 22 nt, Homo sapiens
uacuuagugguaugucucuuua

SEQ ID NO: 819401 - RNA, 21 nt, Homo sapiens
agaccugcugagggaccagcc

SEQ ID NO: 819402 - RNA, 14 nt, Homo sapiens
agaccuggcucuca

SEQ ID NO: 819403 - RNA, 12 nt, Homo sapiens
agaccugggauu

SEQ ID NO: 819404 - RNA, 19 nt, Homo sapiens
agaccuguaaucauauaau

SEQ ID NO: 819405 - RNA, 14 nt, Homo sapiens
agaccugugcuagu

SEQ ID NO: 819406 - RNA, 16 nt, Homo sapiens
agaccugugugaacua

SEQ ID NO: 819407 - RNA, 18 nt, Homo sapiens
agaccuguguuacuaaaa

SEQ ID NO: 819408 - RNA, 19 nt, Homo sapiens
agaccuuccauaaugcuac

SEQ ID NO: 819409 - RNA, 19 nt, Homo sapiens
agaccuugggggaagacuu

SEQ ID NO: 819410 - RNA, 20 nt, Homo sapiens
agacggagucucucacuguc

SEQ ID NO: 819411 - RNA, 20 nt, Homo sapiens
agacggagucuugcucugua

SEQ ID NO: 819412 - RNA, 15 nt, Homo sapiens
agacgggcacagaca

SEQ ID NO: 819413 - RNA, 18 nt, Homo sapiens
agacgugcgcgaugugac

SEQ ID NO: 819414 - RNA, 19 nt, Homo sapiens
agacgugcgcgaugugaca

SEQ ID NO: 819415 - RNA, 20 nt, Homo sapiens
agacguggugggacuccagc

SEQ ID NO: 819416 - RNA, 24 nt, Homo sapiens
agacuaagcccugucgagacacuu

SEQ ID NO: 819417 - RNA, 18 nt, Homo sapiens
agacuaauucuaaugugg

SEQ ID NO: 819418 - RNA, 18 nt, Homo sapiens
agacuacacaagaggaaa

SEQ ID NO: 819419 - RNA, 17 nt, Homo sapiens
agacuacuaaugacuuu

SEQ ID NO: 819420 - RNA, 15 nt, Homo sapiens
agacuagauugccuu

SEQ ID NO: 819421 - RNA, 17 nt, Homo sapiens
agacuauuuaguggaac

SEQ ID NO: 819422 - RNA, 18 nt, Homo sapiens
agacucaagagaauuuau

SEQ ID NO: 819423 - RNA, 13 nt, Homo sapiens
agacucagugcag

SEQ ID NO: 819424 - RNA, 15 nt, Homo sapiens
agacucagugcagau

SEQ ID NO: 819425 - RNA, 17 nt, Homo sapiens
agacuccaauggggcca

SEQ ID NO: 819426 - RNA, 16 nt, Homo sapiens
agacuccaucucuucu

SEQ ID NO: 819427 - RNA, 17 nt, Homo sapiens
agacuccgucucaagga

SEQ ID NO: 819428 - RNA, 16 nt, Homo sapiens
agacucgacucugugc

SEQ ID NO: 819429 - RNA, 15 nt, Homo sapiens
agacucuagagucca

SEQ ID NO: 819430 - RNA, 18 nt, Homo sapiens
agacucuauuuaagauuc

SEQ ID NO: 819431 - RNA, 16 nt, Homo sapiens
agacucugccauuaaa

SEQ ID NO: 819432 - RNA, 20 nt, Homo sapiens
agacucugccauuaaaacau

SEQ ID NO: 819433 - RNA, 15 nt, Homo sapiens
agacucugguguucu

SEQ ID NO: 819434 - RNA, 17 nt, Homo sapiens
agacucugucuaccugg

SEQ ID NO: 819435 - RNA, 16 nt, Homo sapiens
agacucuuuaugaucu

SEQ ID NO: 819436 - RNA, 18 nt, Homo sapiens
agacugaaagcagcagcu

SEQ ID NO: 819437 - RNA, 11 nt, Homo sapiens
uagaaaguaaa

SEQ ID NO: 819438 - RNA, 13 nt, Homo sapiens
uagaaaguagcca

SEQ ID NO: 819439 - RNA, 15 nt, Homo sapiens
uagaaauauagccaa

SEQ ID NO: 819440 - RNA, 19 nt, Homo sapiens
uagaaauauagccaaaaau

SEQ ID NO: 819441 - RNA, 18 nt, Homo sapiens
uagaaauauugacucaaa

SEQ ID NO: 819442 - RNA, 14 nt, Homo sapiens
uagaaaugagccag

SEQ ID NO: 819443 - RNA, 12 nt, Homo sapiens
uagaaauggauu

SEQ ID NO: 819444 - RNA, 22 nt, Homo sapiens
uagaaauuaacaaaugugcugc

SEQ ID NO: 819445 - RNA, 15 nt, Homo sapiens
uagaacacaguuugu

SEQ ID NO: 819446 - RNA, 23 nt, Homo sapiens
uagaacacugccaacugaucugu

SEQ ID NO: 819447 - RNA, 22 nt, Homo sapiens
uagaacauaaagcaaauagaca

SEQ ID NO: 819448 - RNA, 11 nt, Homo sapiens
uagaaccagcc

SEQ ID NO: 819449 - RNA, 19 nt, Homo sapiens
uagaaccuuaaagaaccau

SEQ ID NO: 819450 - RNA, 17 nt, Homo sapiens
uagaacguaaccacgga

SEQ ID NO: 819451 - RNA, 18 nt, Homo sapiens
uagaacucuccaucuuau

SEQ ID NO: 819452 - RNA, 20 nt, Homo sapiens
uagaacuucaagaaguaaga

SEQ ID NO: 819453 - RNA, 19 nt, Homo sapiens
uagaacuuuaccuauggaa

SEQ ID NO: 819454 - RNA, 22 nt, Homo sapiens
uagaagaaaagcccauuuucaa

SEQ ID NO: 819455 - RNA, 22 nt, Homo sapiens
uagaagacagacaucuguggaa

SEQ ID NO: 819456 - RNA, 18 nt, Homo sapiens
uagaagauuuuaugcugc

SEQ ID NO: 819457 - RNA, 18 nt, Homo sapiens
uagaagcuguaacagaau

SEQ ID NO: 819458 - RNA, 21 nt, Homo sapiens
uagaaggcuucuuagcgcagu

SEQ ID NO: 819459 - RNA, 15 nt, Homo sapiens
uagaagugugguggu

SEQ ID NO: 819460 - RNA, 14 nt, Homo sapiens
uagaaguuacugaa

SEQ ID NO: 819461 - RNA, 13 nt, Homo sapiens
uagaauaagccuu

SEQ ID NO: 819462 - RNA, 14 nt, Homo sapiens
uagaauaaucuauu

SEQ ID NO: 819463 - RNA, 15 nt, Homo sapiens
uagaauacuuuuuaa

SEQ ID NO: 819464 - RNA, 20 nt, Homo sapiens
uagaauauuauguuccucaa

SEQ ID NO: 819465 - RNA, 17 nt, Homo sapiens
uagaauauuuauuaccu

SEQ ID NO: 819466 - RNA, 23 nt, Homo sapiens
uagaauauuuauuaccucugaua

SEQ ID NO: 819467 - RNA, 13 nt, Homo sapiens
uagaaucuucuua

SEQ ID NO: 819468 - RNA, 15 nt, Homo sapiens
uagaaugaaagacug

SEQ ID NO: 819469 - RNA, 13 nt, Homo sapiens
uagaaugcaggag

SEQ ID NO: 819470 - RNA, 15 nt, Homo sapiens
uagaaugcaucucau

SEQ ID NO: 819471 - RNA, 16 nt, Homo sapiens
uagaauugaccaaaua

SEQ ID NO: 819472 - RNA, 17 nt, Homo sapiens
uagaauuggagaguaaa

SEQ ID NO: 819473 - RNA, 19 nt, Homo sapiens
uagaauuuugaguauucca

SEQ ID NO: 819474 - RNA, 16 nt, Homo sapiens
uagacaagcuugucca

SEQ ID NO: 819475 - RNA, 13 nt, Homo sapiens
uagacaauuugca

SEQ ID NO: 819476 - RNA, 17 nt, Homo sapiens
uagacacauacauguca

SEQ ID NO: 819477 - RNA, 12 nt, Homo sapiens
uagacacaugaa

SEQ ID NO: 819478 - RNA, 13 nt, Homo sapiens
uagacagccaggu

SEQ ID NO: 819479 - RNA, 17 nt, Homo sapiens
uagacagguguuacuua

SEQ ID NO: 819480 - RNA, 14 nt, Homo sapiens
uagacagguguuua

SEQ ID NO: 819481 - RNA, 18 nt, Homo sapiens
uagaccaccuaauaucaa

SEQ ID NO: 819482 - RNA, 19 nt, Homo sapiens
uagaccaccuaauaucaau

SEQ ID NO: 819483 - RNA, 17 nt, Homo sapiens
uagaccuaggccucagc

SEQ ID NO: 819484 - RNA, 18 nt, Homo sapiens
uagacgccuuccagguca

SEQ ID NO: 819485 - RNA, 14 nt, Homo sapiens
uagacuaauugugu

SEQ ID NO: 819486 - RNA, 22 nt, Homo sapiens
uagacuaucuagaacuugagaa

SEQ ID NO: 819487 - RNA, 15 nt, Homo sapiens
uagacuauuugcuua

SEQ ID NO: 819488 - RNA, 14 nt, Homo sapiens
uagacucaggaaag

SEQ ID NO: 819489 - RNA, 15 nt, Homo sapiens
uagacuccucaggag

SEQ ID NO: 819490 - RNA, 19 nt, Homo sapiens
uagacucuggucauagaaa

SEQ ID NO: 819491 - RNA, 14 nt, Homo sapiens
uagacugagucaga

SEQ ID NO: 819492 - RNA, 19 nt, Homo sapiens
uagacuuaucugcauauug

SEQ ID NO: 819493 - RNA, 14 nt, Homo sapiens
uagacuuggagcug

SEQ ID NO: 819494 - RNA, 19 nt, Homo sapiens
uagacuuucuuaucacuua

SEQ ID NO: 819495 - RNA, 18 nt, Homo sapiens
uagagaaagaacuaugaa

SEQ ID NO: 819496 - RNA, 20 nt, Homo sapiens
uagagaaauuagaacccaua

SEQ ID NO: 819497 - RNA, 12 nt, Homo sapiens
uagagacaguga

SEQ ID NO: 819498 - RNA, 16 nt, Homo sapiens
uagagacgggauuucc

SEQ ID NO: 819499 - RNA, 14 nt, Homo sapiens
uagagacuguagau

SEQ ID NO: 819500 - RNA, 15 nt, Homo sapiens
uagagacuguagauu

SEQ ID NO: 819501 - RNA, 12 nt, Homo sapiens
uagagauugcau

SEQ ID NO: 819502 - RNA, 14 nt, Homo sapiens
uagagcacacugua

SEQ ID NO: 819503 - RNA, 21 nt, Homo sapiens
uagagccagcccauggcuuua

SEQ ID NO: 819504 - RNA, 17 nt, Homo sapiens
uagaggcuagcuucugc

SEQ ID NO: 819505 - RNA, 18 nt, Homo sapiens
uagaggcugggggcucca

SEQ ID NO: 819506 - RNA, 21 nt, Homo sapiens
uagaggggcucugggagacuu

SEQ ID NO: 819507 - RNA, 21 nt, Homo sapiens
uagagguagguaggaucaucc

SEQ ID NO: 819508 - RNA, 21 nt, Homo sapiens
uagagguuuuaaagugauuaa

SEQ ID NO: 819509 - RNA, 16 nt, Homo sapiens
uagaguaacacauaac

SEQ ID NO: 819510 - RNA, 22 nt, Homo sapiens
uagaguaacacauaacauugua

SEQ ID NO: 819511 - RNA, 15 nt, Homo sapiens
uagaguaggugcaga

SEQ ID NO: 819512 - RNA, 14 nt, Homo sapiens
uagaguauaugcac

SEQ ID NO: 819513 - RNA, 21 nt, Homo sapiens
uagagucacugauacacagaa

SEQ ID NO: 819514 - RNA, 15 nt, Homo sapiens
uagagucuagacaga

SEQ ID NO: 819515 - RNA, 18 nt, Homo sapiens
uagagucugaacagcugu

SEQ ID NO: 819516 - RNA, 19 nt, Homo sapiens
agagcaagacucugucuca

SEQ ID NO: 819517 - RNA, 18 nt, Homo sapiens
agagcaagacugucucaa

SEQ ID NO: 819518 - RNA, 14 nt, Homo sapiens
agagcaagccagga

SEQ ID NO: 819519 - RNA, 15 nt, Homo sapiens
agagcacacuguagc

SEQ ID NO: 819520 - RNA, 20 nt, Homo sapiens
agagcagcuccuuccuagcc

SEQ ID NO: 819521 - RNA, 13 nt, Homo sapiens
agagcagggauua

SEQ ID NO: 819522 - RNA, 15 nt, Homo sapiens
agagcaguuggccaa

SEQ ID NO: 819523 - RNA, 21 nt, Homo sapiens
agagcauggaaaaauacugcc

SEQ ID NO: 819524 - RNA, 21 nt, Homo sapiens
agagcauugcuauuuaucuca

SEQ ID NO: 819525 - RNA, 22 nt, Homo sapiens
agagcauuuccaacaccacaga

SEQ ID NO: 819526 - RNA, 20 nt, Homo sapiens
agagccaaagaauauuccau

SEQ ID NO: 819527 - RNA, 20 nt, Homo sapiens
agagccagccggcuaugaaa

SEQ ID NO: 819528 - RNA, 17 nt, Homo sapiens
agagccaggaugcccag

SEQ ID NO: 819529 - RNA, 23 nt, Homo sapiens
agagccaggggggugaggagcug

SEQ ID NO: 819530 - RNA, 20 nt, Homo sapiens
agagccagucucaccuucaa

SEQ ID NO: 819531 - RNA, 18 nt, Homo sapiens
agagccagugaaggagcc

SEQ ID NO: 819532 - RNA, 14 nt, Homo sapiens
agagcccaugcuca

SEQ ID NO: 819533 - RNA, 18 nt, Homo sapiens
agagccccuacagcauug

SEQ ID NO: 819534 - RNA, 19 nt, Homo sapiens
agagccccuuaaagcugcu

SEQ ID NO: 819535 - RNA, 21 nt, Homo sapiens
agagcccggcgccccugccac

SEQ ID NO: 819536 - RNA, 11 nt, Homo sapiens
agagcccucca

SEQ ID NO: 819537 - RNA, 20 nt, Homo sapiens
agagcccuucacugccauga

SEQ ID NO: 819538 - RNA, 19 nt, Homo sapiens
agagcccuugccuccccau

SEQ ID NO: 819539 - RNA, 19 nt, Homo sapiens
agagccucuggcaucucuu

SEQ ID NO: 819540 - RNA, 18 nt, Homo sapiens
agagccuucaagugccaa

SEQ ID NO: 819541 - RNA, 22 nt, Homo sapiens
agagcggaaggagggagcucug

SEQ ID NO: 819542 - RNA, 21 nt, Homo sapiens
agagcgggguccccucugugc

SEQ ID NO: 819543 - RNA, 16 nt, Homo sapiens
agagcucacagcugga

SEQ ID NO: 819544 - RNA, 17 nt, Homo sapiens
agagcugaacuauuaga

SEQ ID NO: 819545 - RNA, 12 nt, Homo sapiens
agagcugucacu

SEQ ID NO: 819546 - RNA, 13 nt, Homo sapiens
agagcuguuccag

SEQ ID NO: 819547 - RNA, 18 nt, Homo sapiens
agagcuugucagcaagag

SEQ ID NO: 819548 - RNA, 16 nt, Homo sapiens
agagcuuuccuacuug

SEQ ID NO: 819549 - RNA, 20 nt, Homo sapiens
agagcuuuuaaaaauguccu

SEQ ID NO: 819550 - RNA, 22 nt, Homo sapiens
agaggaaaccaguuuggugaua

SEQ ID NO: 819551 - RNA, 16 nt, Homo sapiens
agaggaacagcacugg

SEQ ID NO: 819552 - RNA, 19 nt, Homo sapiens
agaggaagagcugcaacgg

SEQ ID NO: 819553 - RNA, 20 nt, Homo sapiens
uagcagcccacccugcugcu

SEQ ID NO: 819554 - RNA, 22 nt, Homo sapiens
uagcagccuggggugaccucua

SEQ ID NO: 819555 - RNA, 12 nt, Homo sapiens
uagcagcuauau

SEQ ID NO: 819556 - RNA, 14 nt, Homo sapiens
uagcagcugugaug

SEQ ID NO: 819557 - RNA, 14 nt, Homo sapiens
uagcagcuuuagcc

SEQ ID NO: 819558 - RNA, 23 nt, Homo sapiens
uagcagcuuuagccaagugcagg

SEQ ID NO: 819559 - RNA, 16 nt, Homo sapiens
uagcaggcacaggaca

SEQ ID NO: 819560 - RNA, 22 nt, Homo sapiens
uagcaggcuaugaaguugcaau

SEQ ID NO: 819561 - RNA, 22 nt, Homo sapiens
uagcauacuggcuucaccauca

SEQ ID NO: 819562 - RNA, 18 nt, Homo sapiens
uagcaucaguagauuucu

SEQ ID NO: 819563 - RNA, 13 nt, Homo sapiens
uagcaucucagga

SEQ ID NO: 819564 - RNA, 16 nt, Homo sapiens
uagcaugacguguggu

SEQ ID NO: 819565 - RNA, 12 nt, Homo sapiens
uagcaugcugcu

SEQ ID NO: 819566 - RNA, 22 nt, Homo sapiens
uagcauggcauauuuuucacau

SEQ ID NO: 819567 - RNA, 15 nt, Homo sapiens
uagcauguaugaaug

SEQ ID NO: 819568 - RNA, 12 nt, Homo sapiens
uagcauucugug

SEQ ID NO: 819569 - RNA, 12 nt, Homo sapiens
uagcauugcacu

SEQ ID NO: 819570 - RNA, 19 nt, Homo sapiens
uagccaggcaugguggcac

SEQ ID NO: 819571 - RNA, 19 nt, Homo sapiens
uagccaugauaacugcaau

SEQ ID NO: 819572 - RNA, 17 nt, Homo sapiens
uagccaugauuuguccc

SEQ ID NO: 819573 - RNA, 22 nt, Homo sapiens
uagccauguaaucagauuuauu

SEQ ID NO: 819574 - RNA, 19 nt, Homo sapiens
uagcccacucccugccuac

SEQ ID NO: 819575 - RNA, 21 nt, Homo sapiens
uagcccaggccagagugcagu

SEQ ID NO: 819576 - RNA, 19 nt, Homo sapiens
uagccccgagacaccaucc

SEQ ID NO: 819577 - RNA, 16 nt, Homo sapiens
uagcccgcuagcauua

SEQ ID NO: 819578 - RNA, 20 nt, Homo sapiens
uagcccguuuucacacugcu

SEQ ID NO: 819579 - RNA, 20 nt, Homo sapiens
uagccuaaaugauggugcuu

SEQ ID NO: 819580 - RNA, 15 nt, Homo sapiens
uagccucaccaaggu

SEQ ID NO: 819581 - RNA, 16 nt, Homo sapiens
uagccucuccaggaau

SEQ ID NO: 819582 - RNA, 16 nt, Homo sapiens
uagccuuccucugauu

SEQ ID NO: 819583 - RNA, 18 nt, Homo sapiens
uagcgaguuuucugacca

SEQ ID NO: 819584 - RNA, 13 nt, Homo sapiens
uagcggucaauuu

SEQ ID NO: 819585 - RNA, 17 nt, Homo sapiens
uagcgucaagacauuug

SEQ ID NO: 819586 - RNA, 18 nt, Homo sapiens
uagcuaccucacuaugcu

SEQ ID NO: 819587 - RNA, 21 nt, Homo sapiens
uagcuaccucacuaugcugcu

SEQ ID NO: 819588 - RNA, 22 nt, Homo sapiens
uagcuaccucacuaugcugcuu

SEQ ID NO: 819589 - RNA, 14 nt, Homo sapiens
uagcuaguaucuuc

SEQ ID NO: 819590 - RNA, 14 nt, Homo sapiens
uagcucauccuuua

SEQ ID NO: 819591 - RNA, 14 nt, Homo sapiens
uagcucaucuuaga

SEQ ID NO: 819592 - RNA, 23 nt, Homo sapiens
uagcucauuugagauaaagucaa

SEQ ID NO: 819593 - RNA, 14 nt, Homo sapiens
uagcuccuguuguc

SEQ ID NO: 819594 - RNA, 20 nt, Homo sapiens
uagcucuuaauuguucauuu

SEQ ID NO: 819595 - RNA, 22 nt, Homo sapiens
uagcugacggcuggguguuuca

SEQ ID NO: 819596 - RNA, 20 nt, Homo sapiens
uagcugagaagcaauggguc

SEQ ID NO: 819597 - RNA, 17 nt, Homo sapiens
uagcuggaugugguggu

SEQ ID NO: 819598 - RNA, 17 nt, Homo sapiens
uagcugggaagaccaau

SEQ ID NO: 819599 - RNA, 15 nt, Homo sapiens
uagcugggacuacag

SEQ ID NO: 819600 - RNA, 21 nt, Homo sapiens
uagcuguauuuuuuguaugcu

SEQ ID NO: 819601 - RNA, 19 nt, Homo sapiens
uagcugugaucagugauuu

SEQ ID NO: 819602 - RNA, 11 nt, Homo sapiens
uagcuguucug

SEQ ID NO: 819603 - RNA, 14 nt, Homo sapiens
uagcuuaacuaauu

SEQ ID NO: 819604 - RNA, 19 nt, Homo sapiens
uagcuuacaggaagcuuuu

SEQ ID NO: 819605 - RNA, 13 nt, Homo sapiens
uagcuuaccugac

SEQ ID NO: 819606 - RNA, 15 nt, Homo sapiens
uagcuuagaccucag

SEQ ID NO: 819607 - RNA, 21 nt, Homo sapiens
uagcuuagcuaugucagccaa

SEQ ID NO: 819608 - RNA, 16 nt, Homo sapiens
uagcuugcaccuuguc

SEQ ID NO: 819609 - RNA, 23 nt, Homo sapiens
uagcuuuaaaaccugugugccau

SEQ ID NO: 819610 - RNA, 13 nt, Homo sapiens
uagcuuuacaaau

SEQ ID NO: 819611 - RNA, 23 nt, Homo sapiens
uagcuuuagggcaauauugccau

SEQ ID NO: 819612 - RNA, 22 nt, Homo sapiens
uagcuuuccacauuugucacag

SEQ ID NO: 819613 - RNA, 22 nt, Homo sapiens
uagcuuugaaacuccaugcaaa

SEQ ID NO: 819614 - RNA, 11 nt, Homo sapiens
uagcuuuucau

SEQ ID NO: 819615 - RNA, 15 nt, Homo sapiens
uagcuuuucauuucu

SEQ ID NO: 819616 - RNA, 21 nt, Homo sapiens
uaggaaaauauggguugcauu

SEQ ID NO: 819617 - RNA, 15 nt, Homo sapiens
uaggaaaaucacuug

SEQ ID NO: 819618 - RNA, 18 nt, Homo sapiens
uaggaaacucacacuccc

SEQ ID NO: 819619 - RNA, 14 nt, Homo sapiens
uaggaaauuccuuc

SEQ ID NO: 819620 - RNA, 15 nt, Homo sapiens
uaggaaccuaugaaa

SEQ ID NO: 819621 - RNA, 13 nt, Homo sapiens
uaggaaccuugca

SEQ ID NO: 819622 - RNA, 14 nt, Homo sapiens
uaggaagagacaca

SEQ ID NO: 819623 - RNA, 19 nt, Homo sapiens
uaggaaggugaaucugccc

SEQ ID NO: 819624 - RNA, 24 nt, Homo sapiens
uaggaaucccagaggugggauccu

SEQ ID NO: 819625 - RNA, 18 nt, Homo sapiens
uaggaauguccaccauga

SEQ ID NO: 819626 - RNA, 20 nt, Homo sapiens
uaggacauaaacccuugcca

SEQ ID NO: 819627 - RNA, 20 nt, Homo sapiens
uaggagaaacuuagaggaaa

SEQ ID NO: 819628 - RNA, 18 nt, Homo sapiens
uaggagaagggucucaug

SEQ ID NO: 819629 - RNA, 21 nt, Homo sapiens
uaggagcuaaggcucuaugag

SEQ ID NO: 819630 - RNA, 21 nt, Homo sapiens
agauaauuuauuaaagguggu

SEQ ID NO: 819631 - RNA, 13 nt, Homo sapiens
agauacaaacugc

SEQ ID NO: 819632 - RNA, 15 nt, Homo sapiens
agauacaaaugucua

SEQ ID NO: 819633 - RNA, 12 nt, Homo sapiens
agauacaaugua

SEQ ID NO: 819634 - RNA, 20 nt, Homo sapiens
agauacaggggaucauguua

SEQ ID NO: 819635 - RNA, 14 nt, Homo sapiens
agauacuucccaaa

SEQ ID NO: 819636 - RNA, 20 nt, Homo sapiens
agauagaaccuggagccacu

SEQ ID NO: 819637 - RNA, 15 nt, Homo sapiens
agauagagaccaucu

SEQ ID NO: 819638 - RNA, 15 nt, Homo sapiens
agauagcuacagugu

SEQ ID NO: 819639 - RNA, 12 nt, Homo sapiens
agauagggaaaa

SEQ ID NO: 819640 - RNA, 21 nt, Homo sapiens
agauagggggaagacagauau

SEQ ID NO: 819641 - RNA, 23 nt, Homo sapiens
agauagucuauguauguguaaaa

SEQ ID NO: 819642 - RNA, 17 nt, Homo sapiens
agauaguguaacuugcu

SEQ ID NO: 819643 - RNA, 17 nt, Homo sapiens
agauauacugggagaaa

SEQ ID NO: 819644 - RNA, 15 nt, Homo sapiens
agauauagaaacucu

SEQ ID NO: 819645 - RNA, 11 nt, Homo sapiens
agauaugauau

SEQ ID NO: 819646 - RNA, 11 nt, Homo sapiens
agauaugcaaa

SEQ ID NO: 819647 - RNA, 13 nt, Homo sapiens
agauaugugaaga

SEQ ID NO: 819648 - RNA, 19 nt, Homo sapiens
agauauuagguccauucau

SEQ ID NO: 819649 - RNA, 18 nt, Homo sapiens
agauauucagaaguauau

SEQ ID NO: 819650 - RNA, 18 nt, Homo sapiens
agauauucuuauuucacu

SEQ ID NO: 819651 - RNA, 14 nt, Homo sapiens
agauauugauuacu

SEQ ID NO: 819652 - RNA, 22 nt, Homo sapiens
agauauuguugaaauaauugaa

SEQ ID NO: 819653 - RNA, 21 nt, Homo sapiens
agauauuuguauuuauuucca

SEQ ID NO: 819654 - RNA, 14 nt, Homo sapiens
agaucaagcauuac

SEQ ID NO: 819655 - RNA, 17 nt, Homo sapiens
agaucacgccacugcac

SEQ ID NO: 819656 - RNA, 21 nt, Homo sapiens
agaucacgccauuguacucca

SEQ ID NO: 819657 - RNA, 17 nt, Homo sapiens
agaucacgucacugcac

SEQ ID NO: 819658 - RNA, 15 nt, Homo sapiens
agaucacugccacac

SEQ ID NO: 819659 - RNA, 18 nt, Homo sapiens
agaucagaacauucagcu

SEQ ID NO: 819660 - RNA, 24 nt, Homo sapiens
agaucagcauucaaaauaguucua

SEQ ID NO: 819661 - RNA, 22 nt, Homo sapiens
agaucagccugaccaacauggu

SEQ ID NO: 819662 - RNA, 11 nt, Homo sapiens
agaucagucag

SEQ ID NO: 819663 - RNA, 15 nt, Homo sapiens
agaucaucagucacc

SEQ ID NO: 819664 - RNA, 11 nt, Homo sapiens
agaucaugaca

SEQ ID NO: 819665 - RNA, 19 nt, Homo sapiens
agaucaugggucaagagau

SEQ ID NO: 819666 - RNA, 11 nt, Homo sapiens
agauccagugc

SEQ ID NO: 819667 - RNA, 14 nt, Homo sapiens
agaucccagcucac

SEQ ID NO: 819668 - RNA, 18 nt, Homo sapiens
agaucccagcucacguca

SEQ ID NO: 819669 - RNA, 13 nt, Homo sapiens
uaggucggcacuu

SEQ ID NO: 819670 - RNA, 18 nt, Homo sapiens
uaggucucaucucuucag

SEQ ID NO: 819671 - RNA, 15 nt, Homo sapiens
uaggucuccaagacc

SEQ ID NO: 819672 - RNA, 19 nt, Homo sapiens
uaggugagguuuauagaaa

SEQ ID NO: 819673 - RNA, 16 nt, Homo sapiens
uagguggugccagugg

SEQ ID NO: 819674 - RNA, 16 nt, Homo sapiens
uagguguggcugugaa

SEQ ID NO: 819675 - RNA, 18 nt, Homo sapiens
uagguuaaaaaaaaaagu

SEQ ID NO: 819676 - RNA, 13 nt, Homo sapiens
uagguuauaggua

SEQ ID NO: 819677 - RNA, 21 nt, Homo sapiens
uagguucuaaaguucuaagau

SEQ ID NO: 819678 - RNA, 14 nt, Homo sapiens
uagguuuacauuca

SEQ ID NO: 819679 - RNA, 24 nt, Homo sapiens
uagguuucagcaacaagacugcca

SEQ ID NO: 819680 - RNA, 15 nt, Homo sapiens
uaguaaaagugcuuu

SEQ ID NO: 819681 - RNA, 13 nt, Homo sapiens
uaguaaagcuuuu

SEQ ID NO: 819682 - RNA, 15 nt, Homo sapiens
uaguaacaucaaaga

SEQ ID NO: 819683 - RNA, 21 nt, Homo sapiens
uaguaacuacuuuuuauacuc

SEQ ID NO: 819684 - RNA, 16 nt, Homo sapiens
uaguaaguauuuccau

SEQ ID NO: 819685 - RNA, 20 nt, Homo sapiens
uaguaaucuacaaaggaaau

SEQ ID NO: 819686 - RNA, 21 nt, Homo sapiens
uaguaauguuuuauacuguuu

SEQ ID NO: 819687 - RNA, 23 nt, Homo sapiens
uaguaauuuauugucugucuaca

SEQ ID NO: 819688 - RNA, 14 nt, Homo sapiens
uaguacaauucuua

SEQ ID NO: 819689 - RNA, 23 nt, Homo sapiens
uaguacucaauguuucuggacau

SEQ ID NO: 819690 - RNA, 15 nt, Homo sapiens
uaguauuucucagga

SEQ ID NO: 819691 - RNA, 22 nt, Homo sapiens
uagucaacaugccauaucucau

SEQ ID NO: 819692 - RNA, 21 nt, Homo sapiens
uagucaauauuugguauuuca

SEQ ID NO: 819693 - RNA, 15 nt, Homo sapiens
uagucaauccuguca

SEQ ID NO: 819694 - RNA, 16 nt, Homo sapiens
uagucaauccugucau

SEQ ID NO: 819695 - RNA, 20 nt, Homo sapiens
uagucaauuucuacuucugg

SEQ ID NO: 819696 - RNA, 19 nt, Homo sapiens
uagucacauggccuaugca

SEQ ID NO: 819697 - RNA, 15 nt, Homo sapiens
uagucaccuucauga

SEQ ID NO: 819698 - RNA, 12 nt, Homo sapiens
uagucauacucc

SEQ ID NO: 819699 - RNA, 16 nt, Homo sapiens
uaguccaaagacuuaa

SEQ ID NO: 819700 - RNA, 20 nt, Homo sapiens
uaguccaccucccauuacuu

SEQ ID NO: 819701 - RNA, 15 nt, Homo sapiens
uaguccagccuucca

SEQ ID NO: 819702 - RNA, 15 nt, Homo sapiens
uagucccagcuacuu

SEQ ID NO: 819703 - RNA, 20 nt, Homo sapiens
uagucccagcuacuugagag

SEQ ID NO: 819704 - RNA, 18 nt, Homo sapiens
uaguccuauucuauugca

SEQ ID NO: 819705 - RNA, 22 nt, Homo sapiens
uaguccucacuucuagaucuca

SEQ ID NO: 819706 - RNA, 19 nt, Homo sapiens
uaguccuugggcaguucuc

SEQ ID NO: 819707 - RNA, 15 nt, Homo sapiens
uagucucuccccugg

SEQ ID NO: 819708 - RNA, 13 nt, Homo sapiens
uagucucugugag

SEQ ID NO: 819709 - RNA, 13 nt, Homo sapiens
uagucucuuuaaa

SEQ ID NO: 819710 - RNA, 16 nt, Homo sapiens
uagucuguacuucauc

SEQ ID NO: 819711 - RNA, 15 nt, Homo sapiens
uagucuguuugcaaa

SEQ ID NO: 819712 - RNA, 13 nt, Homo sapiens
uagucuuugccag

SEQ ID NO: 819713 - RNA, 19 nt, Homo sapiens
uagucuuuuguaauaucaa

SEQ ID NO: 819714 - RNA, 16 nt, Homo sapiens
uagugaagcuaauuaa

SEQ ID NO: 819715 - RNA, 22 nt, Homo sapiens
uagugaagcuaauuaaacacau

SEQ ID NO: 819716 - RNA, 11 nt, Homo sapiens
uagugaguaua

SEQ ID NO: 819717 - RNA, 17 nt, Homo sapiens
uagugagucagcaccuu

SEQ ID NO: 819718 - RNA, 17 nt, Homo sapiens
uagugcacaagcacuau

SEQ ID NO: 819719 - RNA, 23 nt, Homo sapiens
uagugccaggaaacuaauuuccu

SEQ ID NO: 819720 - RNA, 21 nt, Homo sapiens
uagugcuguaauauuguaaau

SEQ ID NO: 819721 - RNA, 13 nt, Homo sapiens
uaguggagccagg

SEQ ID NO: 819722 - RNA, 17 nt, Homo sapiens
uaguggccaucauuucu

SEQ ID NO: 819723 - RNA, 20 nt, Homo sapiens
uagugggcaccccacugcaa

SEQ ID NO: 819724 - RNA, 19 nt, Homo sapiens
uaguggguacaucaagucc

SEQ ID NO: 819725 - RNA, 20 nt, Homo sapiens
uaguguaccuccucucagug

SEQ ID NO: 819726 - RNA, 14 nt, Homo sapiens
uaguguacuuggag

SEQ ID NO: 819727 - RNA, 18 nt, Homo sapiens
uagugucuauuaucacau

SEQ ID NO: 819728 - RNA, 21 nt, Homo sapiens
uagugugaaauauauuacuua

SEQ ID NO: 819729 - RNA, 16 nt, Homo sapiens
uagugugaauauuaau

SEQ ID NO: 819730 - RNA, 23 nt, Homo sapiens
uaguguggaggggagauauagau

SEQ ID NO: 819731 - RNA, 16 nt, Homo sapiens
uagugugugugcaugu

SEQ ID NO: 819732 - RNA, 13 nt, Homo sapiens
uaguuaaaguaau

SEQ ID NO: 819733 - RNA, 21 nt, Homo sapiens
uaguuaccacauuacucugcc

SEQ ID NO: 819734 - RNA, 18 nt, Homo sapiens
uaguuacuguaaaaugca

SEQ ID NO: 819735 - RNA, 13 nt, Homo sapiens
uaguuccaguuuc

SEQ ID NO: 819736 - RNA, 13 nt, Homo sapiens
uaguuccugauga

SEQ ID NO: 819737 - RNA, 13 nt, Homo sapiens
uaguucuaccuca

SEQ ID NO: 819738 - RNA, 11 nt, Homo sapiens
uaguucuagau

SEQ ID NO: 819739 - RNA, 14 nt, Homo sapiens
uaguucuauuucua

SEQ ID NO: 819740 - RNA, 12 nt, Homo sapiens
uaguucugugac

SEQ ID NO: 819741 - RNA, 19 nt, Homo sapiens
uaguugaauggggucucaa

SEQ ID NO: 819742 - RNA, 19 nt, Homo sapiens
uaguugcccucuaccugac

SEQ ID NO: 819743 - RNA, 12 nt, Homo sapiens
uaguugccuuaa

SEQ ID NO: 819744 - RNA, 15 nt, Homo sapiens
uaguuggaaacaaau

SEQ ID NO: 819745 - RNA, 18 nt, Homo sapiens
uaguuggcaggagcuccu

SEQ ID NO: 819746 - RNA, 19 nt, Homo sapiens
agauguuucaacugugcuc

SEQ ID NO: 819747 - RNA, 15 nt, Homo sapiens
agauguuugccucau

SEQ ID NO: 819748 - RNA, 16 nt, Homo sapiens
agauuaaaaagcacag

SEQ ID NO: 819749 - RNA, 14 nt, Homo sapiens
agauuaauuacucu

SEQ ID NO: 819750 - RNA, 18 nt, Homo sapiens
agauuaccgacacuguca

SEQ ID NO: 819751 - RNA, 16 nt, Homo sapiens
agauuacugaugugau

SEQ ID NO: 819752 - RNA, 17 nt, Homo sapiens
agauuacugaugugaua

SEQ ID NO: 819753 - RNA, 17 nt, Homo sapiens
agauuagagccuguaaa

SEQ ID NO: 819754 - RNA, 22 nt, Homo sapiens
agauuaggcacacagauccccu

SEQ ID NO: 819755 - RNA, 13 nt, Homo sapiens
agauuaguauuag

SEQ ID NO: 819756 - RNA, 22 nt, Homo sapiens
agauuauuaucuauuaucucaa

SEQ ID NO: 819757 - RNA, 22 nt, Homo sapiens
agauuauugugacuucacugua

SEQ ID NO: 819758 - RNA, 22 nt, Homo sapiens
agauucagacuuggacuaugau

SEQ ID NO: 819759 - RNA, 14 nt, Homo sapiens
agauucauaaauac

SEQ ID NO: 819760 - RNA, 12 nt, Homo sapiens
agauucauccau

SEQ ID NO: 819761 - RNA, 19 nt, Homo sapiens
agauuccauuuuauaucca

SEQ ID NO: 819762 - RNA, 21 nt, Homo sapiens
agauucucuuguauaagaucc

SEQ ID NO: 819763 - RNA, 13 nt, Homo sapiens
agauucuguggaa

SEQ ID NO: 819764 - RNA, 14 nt, Homo sapiens
agauucuguuaacu

SEQ ID NO: 819765 - RNA, 17 nt, Homo sapiens
agauucuucagcuugau

SEQ ID NO: 819766 - RNA, 14 nt, Homo sapiens
agauucuucugugu

SEQ ID NO: 819767 - RNA, 11 nt, Homo sapiens
agauugaauau

SEQ ID NO: 819768 - RNA, 16 nt, Homo sapiens
agauugagcucucugc

SEQ ID NO: 819769 - RNA, 14 nt, Homo sapiens
agauugcacuauug

SEQ ID NO: 819770 - RNA, 16 nt, Homo sapiens
agauugcgccacugca

SEQ ID NO: 819771 - RNA, 17 nt, Homo sapiens
agauugcgccauugcac

SEQ ID NO: 819772 - RNA, 19 nt, Homo sapiens
agauuggcucacacugaga

SEQ ID NO: 819773 - RNA, 22 nt, Homo sapiens
agauuuaaaaaaagaacauaaa

SEQ ID NO: 819774 - RNA, 16 nt, Homo sapiens
agauuuaagaauaccu

SEQ ID NO: 819775 - RNA, 17 nt, Homo sapiens
agauuuaagccuuacaa

SEQ ID NO: 819776 - RNA, 21 nt, Homo sapiens
agauuuaagugaauacauuaa

SEQ ID NO: 819777 - RNA, 16 nt, Homo sapiens
agauuuagcuauuuau

SEQ ID NO: 819778 - RNA, 12 nt, Homo sapiens
agauuuauuagu

SEQ ID NO: 819779 - RNA, 19 nt, Homo sapiens
agauuuggaggcuaccuca

SEQ ID NO: 819780 - RNA, 23 nt, Homo sapiens
agauuugggguauaggucucauc

SEQ ID NO: 819781 - RNA, 14 nt, Homo sapiens
agauuuuaccuauc

SEQ ID NO: 819782 - RNA, 14 nt, Homo sapiens
agauuuuacugucu

SEQ ID NO: 819783 - RNA, 17 nt, Homo sapiens
agauuuucaugcaaaag

SEQ ID NO: 819784 - RNA, 13 nt, Homo sapiens
agauuuuccauug

SEQ ID NO: 819785 - RNA, 15 nt, Homo sapiens
uauaagacuacuaua

SEQ ID NO: 819786 - RNA, 19 nt, Homo sapiens
uauaagauucauauuuacu

SEQ ID NO: 819787 - RNA, 18 nt, Homo sapiens
uauaagcauguauauucu

SEQ ID NO: 819788 - RNA, 15 nt, Homo sapiens
uauaagcugccauau

SEQ ID NO: 819789 - RNA, 15 nt, Homo sapiens
uauaagucaagcaca

SEQ ID NO: 819790 - RNA, 20 nt, Homo sapiens
uauaauaggaacaaucuuug

SEQ ID NO: 819791 - RNA, 20 nt, Homo sapiens
uauaauccacuuugcucuga

SEQ ID NO: 819792 - RNA, 16 nt, Homo sapiens
uauaaucccacccacc

SEQ ID NO: 819793 - RNA, 17 nt, Homo sapiens
uauaaucccagcacuuu

SEQ ID NO: 819794 - RNA, 17 nt, Homo sapiens
uauaaucuccauuucaa

SEQ ID NO: 819795 - RNA, 16 nt, Homo sapiens
uauaaugcuugcaccu

SEQ ID NO: 819796 - RNA, 16 nt, Homo sapiens
uauaauguaagcucua

SEQ ID NO: 819797 - RNA, 17 nt, Homo sapiens
uauaauguugcccagug

SEQ ID NO: 819798 - RNA, 22 nt, Homo sapiens
uauaauguuguauuuaauuuua

SEQ ID NO: 819799 - RNA, 21 nt, Homo sapiens
uauaauucagaaggaucuuca

SEQ ID NO: 819800 - RNA, 15 nt, Homo sapiens
uauaauuucuguuca

SEQ ID NO: 819801 - RNA, 13 nt, Homo sapiens
uauacacauauau

SEQ ID NO: 819802 - RNA, 14 nt, Homo sapiens
uauacaggucauau

SEQ ID NO: 819803 - RNA, 16 nt, Homo sapiens
uauacaguguacaugu

SEQ ID NO: 819804 - RNA, 14 nt, Homo sapiens
uauacaucugugua

SEQ ID NO: 819805 - RNA, 17 nt, Homo sapiens
uauaccaucuccagcua

SEQ ID NO: 819806 - RNA, 20 nt, Homo sapiens
uauacccacauguacagaca

SEQ ID NO: 819807 - RNA, 15 nt, Homo sapiens
uauacguauaaauau

SEQ ID NO: 819808 - RNA, 16 nt, Homo sapiens
uauacuagauguuaag

SEQ ID NO: 819809 - RNA, 19 nt, Homo sapiens
uauacuguaugugccaaag

SEQ ID NO: 819810 - RNA, 14 nt, Homo sapiens
uauacuguuuacug

SEQ ID NO: 819811 - RNA, 17 nt, Homo sapiens
uauacuuuaguagacau

SEQ ID NO: 819812 - RNA, 21 nt, Homo sapiens
uauacuuuaguagacauuuau

SEQ ID NO: 819813 - RNA, 13 nt, Homo sapiens
uauacuuugcaau

SEQ ID NO: 819814 - RNA, 19 nt, Homo sapiens
uauacuuuuaaagccuauu

SEQ ID NO: 819815 - RNA, 21 nt, Homo sapiens
uauacuuuuaaagccuauuca

SEQ ID NO: 819816 - RNA, 21 nt, Homo sapiens
uauagaaggguaccuugaaca

SEQ ID NO: 819817 - RNA, 16 nt, Homo sapiens
uauagaugugagccag

SEQ ID NO: 819818 - RNA, 12 nt, Homo sapiens
uauagauucuaa

SEQ ID NO: 819819 - RNA, 14 nt, Homo sapiens
uauagcaagaccac

SEQ ID NO: 819820 - RNA, 14 nt, Homo sapiens
uauaggauauugcu

SEQ ID NO: 819821 - RNA, 22 nt, Homo sapiens
uauaggaucauuuguuggaaug

SEQ ID NO: 819822 - RNA, 22 nt, Homo sapiens
uauaggcuucucacggcgacca

SEQ ID NO: 819823 - RNA, 14 nt, Homo sapiens
uauaggucauggga

SEQ ID NO: 819824 - RNA, 20 nt, Homo sapiens
uauaggugauguuugcucuu

SEQ ID NO: 819825 - RNA, 17 nt, Homo sapiens
uauaguacugacagaua

SEQ ID NO: 819826 - RNA, 16 nt, Homo sapiens
uauaguauauuaacaa

SEQ ID NO: 819827 - RNA, 17 nt, Homo sapiens
uauaguaugaaugcagu

SEQ ID NO: 819828 - RNA, 14 nt, Homo sapiens
uauagucacaagag

SEQ ID NO: 819829 - RNA, 13 nt, Homo sapiens
uauagucuuccag

SEQ ID NO: 819830 - RNA, 18 nt, Homo sapiens
uauagugcaauagugcaa

SEQ ID NO: 819831 - RNA, 12 nt, Homo sapiens
uauagugucaug

SEQ ID NO: 819832 - RNA, 21 nt, Homo sapiens
uauaguguucacaaacuguga

SEQ ID NO: 819833 - RNA, 14 nt, Homo sapiens
uauaguugcuugcc

SEQ ID NO: 819834 - RNA, 23 nt, Homo sapiens
uauaguuguuuuauauguugcua

SEQ ID NO: 819835 - RNA, 16 nt, Homo sapiens
uauaguuuauugacaa

SEQ ID NO: 819836 - RNA, 16 nt, Homo sapiens
uauauaagacuauucc

SEQ ID NO: 819837 - RNA, 17 nt, Homo sapiens
uauauaagguaugugcu

SEQ ID NO: 819838 - RNA, 13 nt, Homo sapiens
uauauacaaggug

SEQ ID NO: 819839 - RNA, 22 nt, Homo sapiens
uauauaccuggcuuuuacuuua

SEQ ID NO: 819840 - RNA, 18 nt, Homo sapiens
uauauacugcuauuuaca

SEQ ID NO: 819841 - RNA, 17 nt, Homo sapiens
uauauaggcaugagcca

SEQ ID NO: 819842 - RNA, 11 nt, Homo sapiens
uauauauagua

SEQ ID NO: 819843 - RNA, 13 nt, Homo sapiens
uauauauauagua

SEQ ID NO: 819844 - RNA, 22 nt, Homo sapiens
uauauaugcuuggcuaacuaua

SEQ ID NO: 819845 - RNA, 16 nt, Homo sapiens
uauauaugugugugua

SEQ ID NO: 819846 - RNA, 18 nt, Homo sapiens
uauauauguguguguaua

SEQ ID NO: 819847 - RNA, 13 nt, Homo sapiens
uauauauucccaa

SEQ ID NO: 819848 - RNA, 15 nt, Homo sapiens
uauaucaagaagucu

SEQ ID NO: 819849 - RNA, 19 nt, Homo sapiens
uauaucaguccucuuucaa

SEQ ID NO: 819850 - RNA, 21 nt, Homo sapiens
uauaucauaacuauacuugau

SEQ ID NO: 819851 - RNA, 17 nt, Homo sapiens
uauaucgcuuaaucuua

SEQ ID NO: 819852 - RNA, 14 nt, Homo sapiens
uauaucuaccccag

SEQ ID NO: 819853 - RNA, 15 nt, Homo sapiens
uauaugacauuguua

SEQ ID NO: 819854 - RNA, 16 nt, Homo sapiens
uauaugcacuauguau

SEQ ID NO: 819855 - RNA, 17 nt, Homo sapiens
uauaugcuuuuucucag

SEQ ID NO: 819856 - RNA, 18 nt, Homo sapiens
uauauguauauacauaua

SEQ ID NO: 819857 - RNA, 17 nt, Homo sapiens
uauaugugaacauuuau

SEQ ID NO: 819858 - RNA, 15 nt, Homo sapiens
uauaugugugccuau

SEQ ID NO: 819859 - RNA, 21 nt, Homo sapiens
uauauguguguggcgugugua

SEQ ID NO: 819860 - RNA, 18 nt, Homo sapiens
uauauguguuuuucacau

SEQ ID NO: 819861 - RNA, 14 nt, Homo sapiens
uauauguugcuaua

SEQ ID NO: 819862 - RNA, 18 nt, Homo sapiens
uaugaguaauacaucaaa

SEQ ID NO: 819863 - RNA, 17 nt, Homo sapiens
uaugaguaguguggaau

SEQ ID NO: 819864 - RNA, 21 nt, Homo sapiens
uaugaguggcuucugggagau

SEQ ID NO: 819865 - RNA, 17 nt, Homo sapiens
uaugaguuucuuuuugc

SEQ ID NO: 819866 - RNA, 17 nt, Homo sapiens
uaugauaaaacacugcc

SEQ ID NO: 819867 - RNA, 19 nt, Homo sapiens
uaugauaaaacacugcccu

SEQ ID NO: 819868 - RNA, 12 nt, Homo sapiens
uaugaucugcca

SEQ ID NO: 819869 - RNA, 23 nt, Homo sapiens
uaugaugagaggccagcacauua

SEQ ID NO: 819870 - RNA, 13 nt, Homo sapiens
uaugaugcacuua

SEQ ID NO: 819871 - RNA, 11 nt, Homo sapiens
uaugaugcuaa

SEQ ID NO: 819872 - RNA, 15 nt, Homo sapiens
uaugaugggggaaaa

SEQ ID NO: 819873 - RNA, 17 nt, Homo sapiens
uaugauggucugcauua

SEQ ID NO: 819874 - RNA, 21 nt, Homo sapiens
uaugauuauuaacgaugucca

SEQ ID NO: 819875 - RNA, 20 nt, Homo sapiens
uaugauuuaagguacuuaaa

SEQ ID NO: 819876 - RNA, 15 nt, Homo sapiens
uaugcaaaagguuua

SEQ ID NO: 819877 - RNA, 13 nt, Homo sapiens
uaugcaaaccuca

SEQ ID NO: 819878 - RNA, 21 nt, Homo sapiens
uaugcaaaccucaucuuucuc

SEQ ID NO: 819879 - RNA, 19 nt, Homo sapiens
uaugcaaccaguuuaucca

SEQ ID NO: 819880 - RNA, 19 nt, Homo sapiens
uaugcaacugcaguucauc

SEQ ID NO: 819881 - RNA, 15 nt, Homo sapiens
uaugcaaguuagggu

SEQ ID NO: 819882 - RNA, 13 nt, Homo sapiens
uaugcaaucugag

SEQ ID NO: 819883 - RNA, 21 nt, Homo sapiens
uaugcagaauuugauucguau

SEQ ID NO: 819884 - RNA, 18 nt, Homo sapiens
uaugcagccaaccaagau

SEQ ID NO: 819885 - RNA, 15 nt, Homo sapiens
uaugcagccauauau

SEQ ID NO: 819886 - RNA, 23 nt, Homo sapiens
uaugcauagcuuugcacuucaaa

SEQ ID NO: 819887 - RNA, 17 nt, Homo sapiens
uaugcauguauaugcca

SEQ ID NO: 819888 - RNA, 23 nt, Homo sapiens
uaugcauuaagaguaaaauuccu

SEQ ID NO: 819889 - RNA, 18 nt, Homo sapiens
uaugcauuugcauuugcu

SEQ ID NO: 819890 - RNA, 15 nt, Homo sapiens
uaugccucugagcag

SEQ ID NO: 819891 - RNA, 15 nt, Homo sapiens
uaugcucauugaacu

SEQ ID NO: 819892 - RNA, 18 nt, Homo sapiens
uaugcucauugaacuuua

SEQ ID NO: 819893 - RNA, 21 nt, Homo sapiens
uaugcugaacgcagaagaaag

SEQ ID NO: 819894 - RNA, 16 nt, Homo sapiens
uaugcugcuguuuaca

SEQ ID NO: 819895 - RNA, 22 nt, Homo sapiens
uaugcuggagauggacaacuca

SEQ ID NO: 819896 - RNA, 18 nt, Homo sapiens
uaugcugguagaugcuga

SEQ ID NO: 819897 - RNA, 17 nt, Homo sapiens
uaugcuuacucuugcuu

SEQ ID NO: 819898 - RNA, 14 nt, Homo sapiens
uauggaauuuugca

SEQ ID NO: 819899 - RNA, 22 nt, Homo sapiens
uauggacacuggugccauguca

SEQ ID NO: 819900 - RNA, 23 nt, Homo sapiens
uauggacgugugugaaugguugu

SEQ ID NO: 819901 - RNA, 14 nt, Homo sapiens
agcaggcaauuuca

SEQ ID NO: 819902 - RNA, 20 nt, Homo sapiens
agcaggcccagcaugcaggu

SEQ ID NO: 819903 - RNA, 23 nt, Homo sapiens
agcaggcccagcaugcagguggu

SEQ ID NO: 819904 - RNA, 17 nt, Homo sapiens
agcaggggcagcuucau

SEQ ID NO: 819905 - RNA, 17 nt, Homo sapiens
agcaggggggcugugcc

SEQ ID NO: 819906 - RNA, 16 nt, Homo sapiens
agcagggguuggucaa

SEQ ID NO: 819907 - RNA, 14 nt, Homo sapiens
agcaggucaccuag

SEQ ID NO: 819908 - RNA, 21 nt, Homo sapiens
agcaggugcuacaacauguga

SEQ ID NO: 819909 - RNA, 16 nt, Homo sapiens
agcaggugcugggcug

SEQ ID NO: 819910 - RNA, 12 nt, Homo sapiens
agcaggugcugu

SEQ ID NO: 819911 - RNA, 16 nt, Homo sapiens
agcaguaaauuugcua

SEQ ID NO: 819912 - RNA, 19 nt, Homo sapiens
agcaguaaauuugcuagca

SEQ ID NO: 819913 - RNA, 13 nt, Homo sapiens
agcaguaagcuau

SEQ ID NO: 819914 - RNA, 22 nt, Homo sapiens
agcagucacugacaguuaauaa

SEQ ID NO: 819915 - RNA, 22 nt, Homo sapiens
agcaguccacaaagcauuuuca

SEQ ID NO: 819916 - RNA, 15 nt, Homo sapiens
agcagucgugccugu

SEQ ID NO: 819917 - RNA, 13 nt, Homo sapiens
agcagucuugcuc

SEQ ID NO: 819918 - RNA, 15 nt, Homo sapiens
agcagugaaguauaa

SEQ ID NO: 819919 - RNA, 15 nt, Homo sapiens
agcagugaucucagg

SEQ ID NO: 819920 - RNA, 13 nt, Homo sapiens
agcagugccagcu

SEQ ID NO: 819921 - RNA, 17 nt, Homo sapiens
agcagugccagcuuucu

SEQ ID NO: 819922 - RNA, 16 nt, Homo sapiens
agcagugccuuccaua

SEQ ID NO: 819923 - RNA, 11 nt, Homo sapiens
agcaguggcau

SEQ ID NO: 819924 - RNA, 16 nt, Homo sapiens
agcaguggcuccauug

SEQ ID NO: 819925 - RNA, 16 nt, Homo sapiens
agcagugucuuccaua

SEQ ID NO: 819926 - RNA, 14 nt, Homo sapiens
agcaguuagcucau

SEQ ID NO: 819927 - RNA, 20 nt, Homo sapiens
agcaguucaugacccaggau

SEQ ID NO: 819928 - RNA, 19 nt, Homo sapiens
agcaguuggccaagcagaa

SEQ ID NO: 819929 - RNA, 17 nt, Homo sapiens
agcaguugggaaguuac

SEQ ID NO: 819930 - RNA, 21 nt, Homo sapiens
agcaguuguaccaagugaaau

SEQ ID NO: 819931 - RNA, 13 nt, Homo sapiens
agcauaaugcucc

SEQ ID NO: 819932 - RNA, 20 nt, Homo sapiens
agcauaaugcucccaucucc

SEQ ID NO: 819933 - RNA, 21 nt, Homo sapiens
agcauaaugcucccaucuccu

SEQ ID NO: 819934 - RNA, 21 nt, Homo sapiens
agcauagccugccugaucccu

SEQ ID NO: 819935 - RNA, 12 nt, Homo sapiens
agcauaugcagc

SEQ ID NO: 819936 - RNA, 13 nt, Homo sapiens
agcauauggugcu

SEQ ID NO: 819937 - RNA, 20 nt, Homo sapiens
agcauauuuaaaacaaagaa

SEQ ID NO: 819938 - RNA, 24 nt, Homo sapiens
agcaucaaucuuguuacugcugau

SEQ ID NO: 819939 - RNA, 19 nt, Homo sapiens
agcaucagagaguguacau

SEQ ID NO: 819940 - RNA, 15 nt, Homo sapiens
agcaucaguacuugu

SEQ ID NO: 819941 - RNA, 15 nt, Homo sapiens
agcaucccccaaagu

SEQ ID NO: 819942 - RNA, 15 nt, Homo sapiens
agcaucccucaccca

SEQ ID NO: 819943 - RNA, 20 nt, Homo sapiens
agcauccucucucacaugga

SEQ ID NO: 819944 - RNA, 22 nt, Homo sapiens
agcaucgggagcacccagagca

SEQ ID NO: 819945 - RNA, 14 nt, Homo sapiens
agcaucgugcuguu

SEQ ID NO: 819946 - RNA, 20 nt, Homo sapiens
agcaucgugcuguuugccuu

SEQ ID NO: 819947 - RNA, 15 nt, Homo sapiens
agcaucucaggagau

SEQ ID NO: 819948 - RNA, 18 nt, Homo sapiens
agcaucucccagcaagac

SEQ ID NO: 819949 - RNA, 13 nt, Homo sapiens
agcaucuugcauc

SEQ ID NO: 819950 - RNA, 18 nt, Homo sapiens
agcaucuugcauccaaac

SEQ ID NO: 819951 - RNA, 20 nt, Homo sapiens
agcaugaaaguggacaagga

SEQ ID NO: 819952 - RNA, 20 nt, Homo sapiens
agcaugaccugugaccagca

SEQ ID NO: 819953 - RNA, 13 nt, Homo sapiens
agcaugagacuuu

SEQ ID NO: 819954 - RNA, 15 nt, Homo sapiens
agcaugaugagaguu

SEQ ID NO: 819955 - RNA, 19 nt, Homo sapiens
agcaugaugggaauaggga

SEQ ID NO: 819956 - RNA, 15 nt, Homo sapiens
agcaugcagguggug

SEQ ID NO: 819957 - RNA, 17 nt, Homo sapiens
agcaugcugcuuugcca

SEQ ID NO: 819958 - RNA, 11 nt, Homo sapiens
agcauggaaaa

SEQ ID NO: 819959 - RNA, 13 nt, Homo sapiens
agcauguuuucac

SEQ ID NO: 819960 - RNA, 20 nt, Homo sapiens
agcauguuuuguugcucagu

SEQ ID NO: 819961 - RNA, 16 nt, Homo sapiens
agcauuaagaacacuu

SEQ ID NO: 819962 - RNA, 18 nt, Homo sapiens
agcauuacauuauuaaac

SEQ ID NO: 819963 - RNA, 15 nt, Homo sapiens
agcauuacccuccuc

SEQ ID NO: 819964 - RNA, 17 nt, Homo sapiens
agcauuacuuuauagcu

SEQ ID NO: 819965 - RNA, 20 nt, Homo sapiens
agcauuagcuggcgcauauu

SEQ ID NO: 819966 - RNA, 18 nt, Homo sapiens
agcauuagucacuuugaa

SEQ ID NO: 819967 - RNA, 14 nt, Homo sapiens
agcauucagaaagu

SEQ ID NO: 819968 - RNA, 23 nt, Homo sapiens
agcauucuggaggggagagcuuu

SEQ ID NO: 819969 - RNA, 14 nt, Homo sapiens
agcauucuuuaaca

SEQ ID NO: 819970 - RNA, 14 nt, Homo sapiens
agcauugagcauaa

SEQ ID NO: 819971 - RNA, 13 nt, Homo sapiens
agcauugcacuug

SEQ ID NO: 819972 - RNA, 20 nt, Homo sapiens
agcauugccuggacugacca

SEQ ID NO: 819973 - RNA, 14 nt, Homo sapiens
agcauugcuuucug

SEQ ID NO: 819974 - RNA, 21 nt, Homo sapiens
agcauuguaaaauuauuucau

SEQ ID NO: 819975 - RNA, 13 nt, Homo sapiens
agcauuucuugau

SEQ ID NO: 819976 - RNA, 18 nt, Homo sapiens
agcauuuucaaugauguu

SEQ ID NO: 819977 - RNA, 14 nt, Homo sapiens
uauucagacaagca

SEQ ID NO: 819978 - RNA, 21 nt, Homo sapiens
uauucauuggcagcucaaaga

SEQ ID NO: 819979 - RNA, 17 nt, Homo sapiens
uauuccaccauucacau

SEQ ID NO: 819980 - RNA, 12 nt, Homo sapiens
uauucccaugag

SEQ ID NO: 819981 - RNA, 20 nt, Homo sapiens
uauuccgauacaaaguguug

SEQ ID NO: 819982 - RNA, 17 nt, Homo sapiens
uauuccuauagcauuua

SEQ ID NO: 819983 - RNA, 14 nt, Homo sapiens
uauuccuguuucca

SEQ ID NO: 819984 - RNA, 15 nt, Homo sapiens
uauucuagccugcau

SEQ ID NO: 819985 - RNA, 23 nt, Homo sapiens
uauucuaguuuugucaaacugua

SEQ ID NO: 819986 - RNA, 17 nt, Homo sapiens
uauucucacuccaccac

SEQ ID NO: 819987 - RNA, 17 nt, Homo sapiens
uauucucauucuuccca

SEQ ID NO: 819988 - RNA, 19 nt, Homo sapiens
uauucucuuuucaagaagu

SEQ ID NO: 819989 - RNA, 15 nt, Homo sapiens
uauucugauuccacu

SEQ ID NO: 819990 - RNA, 17 nt, Homo sapiens
uauucugauuccacuuu

SEQ ID NO: 819991 - RNA, 17 nt, Homo sapiens
uauucugguuacugugg

SEQ ID NO: 819992 - RNA, 17 nt, Homo sapiens
uauucuguauccgugaa

SEQ ID NO: 819993 - RNA, 19 nt, Homo sapiens
uauucuguuugcguacuug

SEQ ID NO: 819994 - RNA, 14 nt, Homo sapiens
uauucuuugcacuu

SEQ ID NO: 819995 - RNA, 20 nt, Homo sapiens
uauugaaaggggacaccugu

SEQ ID NO: 819996 - RNA, 14 nt, Homo sapiens
uauugaaauucuau

SEQ ID NO: 819997 - RNA, 13 nt, Homo sapiens
uauugaagacaau

SEQ ID NO: 819998 - RNA, 14 nt, Homo sapiens
uauugaauguuaaa

SEQ ID NO: 819999 - RNA, 19 nt, Homo sapiens
uauugacacugaacuuaau

SEQ ID NO: 820000 - RNA, 17 nt, Homo sapiens
uauugacucaaaccaua

SEQ ID NO: 820001 - RNA, 19 nt, Homo sapiens
uauugacuuuauguuguau

SEQ ID NO: 820002 - RNA, 21 nt, Homo sapiens
uauugagauaauuuauuuaau

SEQ ID NO: 820003 - RNA, 14 nt, Homo sapiens
uauugagugugauu

SEQ ID NO: 820004 - RNA, 16 nt, Homo sapiens
uauugccucuacuuug

SEQ ID NO: 820005 - RNA, 14 nt, Homo sapiens
uauugcgauggcgu

SEQ ID NO: 820006 - RNA, 14 nt, Homo sapiens
uauugcuucaccau

SEQ ID NO: 820007 - RNA, 22 nt, Homo sapiens
uauuggacauccccagaaaaga

SEQ ID NO: 820008 - RNA, 19 nt, Homo sapiens
uauuggacugauaaucucu

SEQ ID NO: 820009 - RNA, 21 nt, Homo sapiens
uauuggagccccaggggacaa

SEQ ID NO: 820010 - RNA, 13 nt, Homo sapiens
uauuggugcuaga

SEQ ID NO: 820011 - RNA, 17 nt, Homo sapiens
uauugguguuuacccag

SEQ ID NO: 820012 - RNA, 12 nt, Homo sapiens
uauuguacauaa

SEQ ID NO: 820013 - RNA, 16 nt, Homo sapiens
uauuguauaaagcauu

SEQ ID NO: 820014 - RNA, 21 nt, Homo sapiens
uauugucgguuaccucugcau

SEQ ID NO: 820015 - RNA, 23 nt, Homo sapiens
uauugugaccacugaauucacuc

SEQ ID NO: 820016 - RNA, 13 nt, Homo sapiens
agccagcccggcc

SEQ ID NO: 820017 - RNA, 18 nt, Homo sapiens
agccagcugugcacuuuc

SEQ ID NO: 820018 - RNA, 18 nt, Homo sapiens
agccagcuuaaacccaua

SEQ ID NO: 820019 - RNA, 18 nt, Homo sapiens
agccaggagaccugcucu

SEQ ID NO: 820020 - RNA, 18 nt, Homo sapiens
agccaggaguaagacaag

SEQ ID NO: 820021 - RNA, 16 nt, Homo sapiens
agccaggccugaccuc

SEQ ID NO: 820022 - RNA, 18 nt, Homo sapiens
agccaggcugcacagcau

SEQ ID NO: 820023 - RNA, 18 nt, Homo sapiens
agccagggcagaggaaug

SEQ ID NO: 820024 - RNA, 22 nt, Homo sapiens
agccagggggaugccacuccuc

SEQ ID NO: 820025 - RNA, 21 nt, Homo sapiens
agccaggguggucuugaucuc

SEQ ID NO: 820026 - RNA, 18 nt, Homo sapiens
agccagguuagccuuugc

SEQ ID NO: 820027 - RNA, 22 nt, Homo sapiens
agccagucuaguuccugaugac

SEQ ID NO: 820028 - RNA, 13 nt, Homo sapiens
agccagucucaga

SEQ ID NO: 820029 - RNA, 17 nt, Homo sapiens
agccaguggggaugagg

SEQ ID NO: 820030 - RNA, 13 nt, Homo sapiens
agccaguggugcu

SEQ ID NO: 820031 - RNA, 14 nt, Homo sapiens
agccaguggugcua

SEQ ID NO: 820032 - RNA, 23 nt, Homo sapiens
agccauaagaaagcacuauuaau

SEQ ID NO: 820033 - RNA, 22 nt, Homo sapiens
agccauaguggagagaacugaa

SEQ ID NO: 820034 - RNA, 20 nt, Homo sapiens
agccauaguggaucacucac

SEQ ID NO: 820035 - RNA, 23 nt, Homo sapiens
agccaucaaauagugaauggucu

SEQ ID NO: 820036 - RNA, 16 nt, Homo sapiens
agccaucaagcacuuc

SEQ ID NO: 820037 - RNA, 23 nt, Homo sapiens
agccaugacaagaacaaagccac

SEQ ID NO: 820038 - RNA, 13 nt, Homo sapiens
agccaugaucaug

SEQ ID NO: 820039 - RNA, 16 nt, Homo sapiens
agccaugaucaugcca

SEQ ID NO: 820040 - RNA, 15 nt, Homo sapiens
agccauggggagcaa

SEQ ID NO: 820041 - RNA, 21 nt, Homo sapiens
agccauguaucaauauucacu

SEQ ID NO: 820042 - RNA, 18 nt, Homo sapiens
agccauuauuaugauguu

SEQ ID NO: 820043 - RNA, 21 nt, Homo sapiens
agccauucugugugugacucu

SEQ ID NO: 820044 - RNA, 15 nt, Homo sapiens
agcccaacagcacuu

SEQ ID NO: 820045 - RNA, 14 nt, Homo sapiens
agcccaagccuugu

SEQ ID NO: 820046 - RNA, 17 nt, Homo sapiens
agcccaauguaaugcau

SEQ ID NO: 820047 - RNA, 13 nt, Homo sapiens
agcccacauauuc

SEQ ID NO: 820048 - RNA, 22 nt, Homo sapiens
agcccacccugcugcuggugca

SEQ ID NO: 820049 - RNA, 22 nt, Homo sapiens
agcccacgagcacgagcuggaa

SEQ ID NO: 820050 - RNA, 22 nt, Homo sapiens
agcccacguucucucugccugu

SEQ ID NO: 820051 - RNA, 17 nt, Homo sapiens
agcccacucccugccua

SEQ ID NO: 820052 - RNA, 18 nt, Homo sapiens
agcccacucccugccuac

SEQ ID NO: 820053 - RNA, 17 nt, Homo sapiens
agcccagaaaaccucca

SEQ ID NO: 820054 - RNA, 20 nt, Homo sapiens
agcccagaaaaccuccagua

SEQ ID NO: 820055 - RNA, 21 nt, Homo sapiens
agcccagacgauggcacaaac

SEQ ID NO: 820056 - RNA, 11 nt, Homo sapiens
agcccagagac

SEQ ID NO: 820057 - RNA, 20 nt, Homo sapiens
agcccagaucgcaccacugc

SEQ ID NO: 820058 - RNA, 17 nt, Homo sapiens
agcccagcuacauuccu

SEQ ID NO: 820059 - RNA, 18 nt, Homo sapiens
agcccagcuugccaaugg

SEQ ID NO: 820060 - RNA, 19 nt, Homo sapiens
agcccaggauacuggcaca

SEQ ID NO: 820061 - RNA, 20 nt, Homo sapiens
agcccaggccagagugcagu

SEQ ID NO: 820062 - RNA, 14 nt, Homo sapiens
agcccagugcaaac

SEQ ID NO: 820063 - RNA, 17 nt, Homo sapiens
agcccauagcacugggc

SEQ ID NO: 820064 - RNA, 12 nt, Homo sapiens
agcccauaucac

SEQ ID NO: 820065 - RNA, 21 nt, Homo sapiens
agcccaugacguguuucuuga

SEQ ID NO: 820066 - RNA, 24 nt, Homo sapiens
agcccauggcccccaauaaaggca

SEQ ID NO: 820067 - RNA, 19 nt, Homo sapiens
agcccaugugcaccugccc

SEQ ID NO: 820068 - RNA, 18 nt, Homo sapiens
agcccauugcugccaagg

SEQ ID NO: 820069 - RNA, 20 nt, Homo sapiens
agcccauuucuccauacgca

SEQ ID NO: 820070 - RNA, 12 nt, Homo sapiens
agccccacugac

SEQ ID NO: 820071 - RNA, 12 nt, Homo sapiens
agccccagcuga

SEQ ID NO: 820072 - RNA, 15 nt, Homo sapiens
agccccagugccaag

SEQ ID NO: 820073 - RNA, 16 nt, Homo sapiens
agccccauccaacacu

SEQ ID NO: 820074 - RNA, 23 nt, Homo sapiens
agccccaugugugacccuuguca

SEQ ID NO: 820075 - RNA, 18 nt, Homo sapiens
agcccccaguaucucuuc

SEQ ID NO: 820076 - RNA, 17 nt, Homo sapiens
agcccccugcacccacc

SEQ ID NO: 820077 - RNA, 13 nt, Homo sapiens
agccccgacuucc

SEQ ID NO: 820078 - RNA, 18 nt, Homo sapiens
agccccgccccguuguga

SEQ ID NO: 820079 - RNA, 16 nt, Homo sapiens
agccccuccagcacca

SEQ ID NO: 820080 - RNA, 23 nt, Homo sapiens
agccccugaccccugucuguccc

SEQ ID NO: 820081 - RNA, 17 nt, Homo sapiens
agccccugggguggcca

SEQ ID NO: 820082 - RNA, 20 nt, Homo sapiens
agccccuuacuaugaucuca

SEQ ID NO: 820083 - RNA, 15 nt, Homo sapiens
agcccgaacaccauu

SEQ ID NO: 820084 - RNA, 15 nt, Homo sapiens
agcccgacagugcca

SEQ ID NO: 820085 - RNA, 14 nt, Homo sapiens
agcccgcccacugg

SEQ ID NO: 820086 - RNA, 23 nt, Homo sapiens
agcccgggucaucuguaccucug

SEQ ID NO: 820087 - RNA, 23 nt, Homo sapiens
agcccuagaggcgagccaggcaa

SEQ ID NO: 820088 - RNA, 15 nt, Homo sapiens
agcccucaugaucau

SEQ ID NO: 820089 - RNA, 20 nt, Homo sapiens
agcccuccgccauucucaag

SEQ ID NO: 820090 - RNA, 19 nt, Homo sapiens
agcccuccucugcacuccc

SEQ ID NO: 820091 - RNA, 23 nt, Homo sapiens
ucaguugagagggugcaguccag

SEQ ID NO: 820092 - RNA, 21 nt, Homo sapiens
ucaguugccaaggaucccuga

SEQ ID NO: 820093 - RNA, 15 nt, Homo sapiens
ucaguuucacauauu

SEQ ID NO: 820094 - RNA, 19 nt, Homo sapiens
ucaguuucacauauuugua

SEQ ID NO: 820095 - RNA, 16 nt, Homo sapiens
ucaguuucacuuucac

SEQ ID NO: 820096 - RNA, 16 nt, Homo sapiens
ucaguuucccuaucuc

SEQ ID NO: 820097 - RNA, 17 nt, Homo sapiens
ucaguuucuaggcaccu

SEQ ID NO: 820098 - RNA, 18 nt, Homo sapiens
ucaguuucucaaacugag

SEQ ID NO: 820099 - RNA, 22 nt, Homo sapiens
ucaguuugcuagcagaaaucua

SEQ ID NO: 820100 - RNA, 16 nt, Homo sapiens
ucaguuuuacucugcu

SEQ ID NO: 820101 - RNA, 16 nt, Homo sapiens
ucauaaauuacuguuu

SEQ ID NO: 820102 - RNA, 14 nt, Homo sapiens
ucauaacagucuua

SEQ ID NO: 820103 - RNA, 13 nt, Homo sapiens
ucauaaccaaaga

SEQ ID NO: 820104 - RNA, 16 nt, Homo sapiens
ucauaacuauacuuga

SEQ ID NO: 820105 - RNA, 15 nt, Homo sapiens
ucauaaggugcuauc

SEQ ID NO: 820106 - RNA, 18 nt, Homo sapiens
ucauaaguuaugccucug

SEQ ID NO: 820107 - RNA, 21 nt, Homo sapiens
ucauaaucacucuaauuaauu

SEQ ID NO: 820108 - RNA, 14 nt, Homo sapiens
ucauaaugugcaaa

SEQ ID NO: 820109 - RNA, 16 nt, Homo sapiens
ucauaauucagcacuu

SEQ ID NO: 820110 - RNA, 18 nt, Homo sapiens
ucauacaaucgucuuaag

SEQ ID NO: 820111 - RNA, 18 nt, Homo sapiens
ucauacacaugugcacac

SEQ ID NO: 820112 - RNA, 17 nt, Homo sapiens
ucauacagcauuacaaa

SEQ ID NO: 820113 - RNA, 13 nt, Homo sapiens
ucauacaugcaua

SEQ ID NO: 820114 - RNA, 14 nt, Homo sapiens
ucauacaugcauac

SEQ ID NO: 820115 - RNA, 20 nt, Homo sapiens
ucauaccagcauacgcucac

SEQ ID NO: 820116 - RNA, 17 nt, Homo sapiens
ucauaccaguuguucau

SEQ ID NO: 820117 - RNA, 14 nt, Homo sapiens
ucauacccaugcac

SEQ ID NO: 820118 - RNA, 19 nt, Homo sapiens
ucauaccucagaauguaaa

SEQ ID NO: 820119 - RNA, 20 nt, Homo sapiens
ucauaccucugaccaacagg

SEQ ID NO: 820120 - RNA, 18 nt, Homo sapiens
ucauacuaaacuucaccu

SEQ ID NO: 820121 - RNA, 23 nt, Homo sapiens
ucauacucuguguaaucucugau

SEQ ID NO: 820122 - RNA, 15 nt, Homo sapiens
ucauacugucuggga

SEQ ID NO: 820123 - RNA, 20 nt, Homo sapiens
ucauaggaaaaguacauuua

SEQ ID NO: 820124 - RNA, 15 nt, Homo sapiens
ucauaguuuugcacu

SEQ ID NO: 820125 - RNA, 14 nt, Homo sapiens
ucauauaccagcaa

SEQ ID NO: 820126 - RNA, 19 nt, Homo sapiens
ucauaucaugguagucacu

SEQ ID NO: 820127 - RNA, 14 nt, Homo sapiens
ucauauguacuugu

SEQ ID NO: 820128 - RNA, 14 nt, Homo sapiens
ucauauuggacuga

SEQ ID NO: 820129 - RNA, 12 nt, Homo sapiens
ucaucaaaaaga

SEQ ID NO: 820130 - RNA, 14 nt, Homo sapiens
ucaucaaaaccaag

SEQ ID NO: 820131 - RNA, 21 nt, Homo sapiens
ucaucaaagcucacaccaaau

SEQ ID NO: 820132 - RNA, 15 nt, Homo sapiens
aggcaggaguggcgu

SEQ ID NO: 820133 - RNA, 14 nt, Homo sapiens
aggcaggcauuccu

SEQ ID NO: 820134 - RNA, 15 nt, Homo sapiens
aggcagggaagcucu

SEQ ID NO: 820135 - RNA, 21 nt, Homo sapiens
aggcagggaagcucuaccgca

SEQ ID NO: 820136 - RNA, 15 nt, Homo sapiens
aggcaggucugcaag

SEQ ID NO: 820137 - RNA, 14 nt, Homo sapiens
aggcaguaaccaug

SEQ ID NO: 820138 - RNA, 23 nt, Homo sapiens
aggcaguauuuuguguccuccag

SEQ ID NO: 820139 - RNA, 12 nt, Homo sapiens
aggcaguggccu

SEQ ID NO: 820140 - RNA, 19 nt, Homo sapiens
aggcauaagaaaacuaaga

SEQ ID NO: 820141 - RNA, 19 nt, Homo sapiens
aggcauaugcacagucaag

SEQ ID NO: 820142 - RNA, 13 nt, Homo sapiens
aggcauggcagaa

SEQ ID NO: 820143 - RNA, 19 nt, Homo sapiens
aggcaugguguguggugcu

SEQ ID NO: 820144 - RNA, 21 nt, Homo sapiens
aggcauguagcuacaggacau

SEQ ID NO: 820145 - RNA, 21 nt, Homo sapiens
aggcauguggccuuuaucuca

SEQ ID NO: 820146 - RNA, 16 nt, Homo sapiens
aggcauuaacacaaag

SEQ ID NO: 820147 - RNA, 20 nt, Homo sapiens
aggcauuaauguuucuaucu

SEQ ID NO: 820148 - RNA, 14 nt, Homo sapiens
aggcauucuggagu

SEQ ID NO: 820149 - RNA, 19 nt, Homo sapiens
aggcauugccuucucugcc

SEQ ID NO: 820150 - RNA, 16 nt, Homo sapiens
aggcauuuauugccau

SEQ ID NO: 820151 - RNA, 18 nt, Homo sapiens
aggcauuugcaggguccu

SEQ ID NO: 820152 - RNA, 13 nt, Homo sapiens
aggccaacagcac

SEQ ID NO: 820153 - RNA, 13 nt, Homo sapiens
aggccaaggcagg

SEQ ID NO: 820154 - RNA, 15 nt, Homo sapiens
aggccacucuuagcc

SEQ ID NO: 820155 - RNA, 15 nt, Homo sapiens
aggccagacauggug

SEQ ID NO: 820156 - RNA, 22 nt, Homo sapiens
aggccagggaaagcccguguca

SEQ ID NO: 820157 - RNA, 14 nt, Homo sapiens
aggccagggacuca

SEQ ID NO: 820158 - RNA, 15 nt, Homo sapiens
aggccauugucccug

SEQ ID NO: 820159 - RNA, 12 nt, Homo sapiens
aggcccaccauc

SEQ ID NO: 820160 - RNA, 17 nt, Homo sapiens
aggcccagcugcucagu

SEQ ID NO: 820161 - RNA, 12 nt, Homo sapiens
aggcccaugccc

SEQ ID NO: 820162 - RNA, 13 nt, Homo sapiens
aggcccauguaua

SEQ ID NO: 820163 - RNA, 15 nt, Homo sapiens
aggccccaguggcug

SEQ ID NO: 820164 - RNA, 16 nt, Homo sapiens
aggcccuccaugggcu

SEQ ID NO: 820165 - RNA, 20 nt, Homo sapiens
aggcccucugccugcacucc

SEQ ID NO: 820166 - RNA, 17 nt, Homo sapiens
aggcccugcccaaugag

SEQ ID NO: 820167 - RNA, 21 nt, Homo sapiens
aggcccugggucuugccaugu

SEQ ID NO: 820168 - RNA, 19 nt, Homo sapiens
aggcccuuauuuucaagaa

SEQ ID NO: 820169 - RNA, 22 nt, Homo sapiens
aggccgagagcagacaccagca

SEQ ID NO: 820170 - RNA, 16 nt, Homo sapiens
aggccgaggugggcag

SEQ ID NO: 820171 - RNA, 21 nt, Homo sapiens
aggccgcccaugcugagcuca

SEQ ID NO: 820172 - RNA, 21 nt, Homo sapiens
aggccucccuagccagcacuu

SEQ ID NO: 820173 - RNA, 19 nt, Homo sapiens
aggccucuccaguuugcac

SEQ ID NO: 820174 - RNA, 22 nt, Homo sapiens
aggccucucggugcuccaucuc

SEQ ID NO: 820175 - RNA, 22 nt, Homo sapiens
aggccucuuguugagugccagc

SEQ ID NO: 820176 - RNA, 13 nt, Homo sapiens
aggccugaagcca

SEQ ID NO: 820177 - RNA, 12 nt, Homo sapiens
aggccugaauca

SEQ ID NO: 820178 - RNA, 21 nt, Homo sapiens
aggccugccucccacuucacu

SEQ ID NO: 820179 - RNA, 20 nt, Homo sapiens
aggccuggacuuuccugcaa

SEQ ID NO: 820180 - RNA, 15 nt, Homo sapiens
aggccuggauaauau

SEQ ID NO: 820181 - RNA, 18 nt, Homo sapiens
aggccugggccgcugcca

SEQ ID NO: 820182 - RNA, 20 nt, Homo sapiens
aggcgauucuccugccucag

SEQ ID NO: 820183 - RNA, 16 nt, Homo sapiens
aggcgcaggugcacag

SEQ ID NO: 820184 - RNA, 17 nt, Homo sapiens
aggcgcggggucucagg

SEQ ID NO: 820185 - RNA, 15 nt, Homo sapiens
aggcggaucaucuaa

SEQ ID NO: 820186 - RNA, 16 nt, Homo sapiens
aggcgggagaacugaa

SEQ ID NO: 820187 - RNA, 14 nt, Homo sapiens
aggcgggccugcaa

SEQ ID NO: 820188 - RNA, 18 nt, Homo sapiens
aggcggucaugugugcau

SEQ ID NO: 820189 - RNA, 21 nt, Homo sapiens
aggcguacuacccagcucugu

SEQ ID NO: 820190 - RNA, 23 nt, Homo sapiens
aggcguccgcgcgccagcacaga

SEQ ID NO: 820191 - RNA, 23 nt, Homo sapiens
aggcgugcugguccccuccucag

SEQ ID NO: 820192 - RNA, 21 nt, Homo sapiens
aggcguuucugaagugcucuu

SEQ ID NO: 820193 - RNA, 18 nt, Homo sapiens
aggcuaaaugagauacac

SEQ ID NO: 820194 - RNA, 21 nt, Homo sapiens
aggcuaagaugagauuugcca

SEQ ID NO: 820195 - RNA, 20 nt, Homo sapiens
aggcuagaacacuacagggg

SEQ ID NO: 820196 - RNA, 16 nt, Homo sapiens
aggcuaucaacaaaga

SEQ ID NO: 820197 - RNA, 16 nt, Homo sapiens
aggcuaucaacauguu

SEQ ID NO: 820198 - RNA, 19 nt, Homo sapiens
aggcuauuauuuauuguau

SEQ ID NO: 820199 - RNA, 17 nt, Homo sapiens
aggcucaauauuccuga

SEQ ID NO: 820200 - RNA, 16 nt, Homo sapiens
aggcucacaguuacag

SEQ ID NO: 820201 - RNA, 18 nt, Homo sapiens
aggcucacucacagaguc

SEQ ID NO: 820202 - RNA, 18 nt, Homo sapiens
aggcucugccagcccugg

SEQ ID NO: 820203 - RNA, 17 nt, Homo sapiens
aggcucugcuucuccaa

SEQ ID NO: 820204 - RNA, 23 nt, Homo sapiens
aggcucuuaagcagcauggaaaa

SEQ ID NO: 820205 - RNA, 20 nt, Homo sapiens
aggcucuuagcagcuuccag

SEQ ID NO: 820206 - RNA, 20 nt, Homo sapiens
aggggcuccccgggucucuc

SEQ ID NO: 820207 - RNA, 15 nt, Homo sapiens
aggggcucucucaug

SEQ ID NO: 820208 - RNA, 21 nt, Homo sapiens
aggggcugaaagaacauggac

SEQ ID NO: 820209 - RNA, 21 nt, Homo sapiens
aggggcuguggccgucuccuc

SEQ ID NO: 820210 - RNA, 14 nt, Homo sapiens
agggggaagacaga

SEQ ID NO: 820211 - RNA, 16 nt, Homo sapiens
agggggugacuggaag

SEQ ID NO: 820212 - RNA, 13 nt, Homo sapiens
agggguacauucu

SEQ ID NO: 820213 - RNA, 16 nt, Homo sapiens
agggguaugucuuuau

SEQ ID NO: 820214 - RNA, 13 nt, Homo sapiens
agggguauguucc

SEQ ID NO: 820215 - RNA, 13 nt, Homo sapiens
aggggucauucau

SEQ ID NO: 820216 - RNA, 14 nt, Homo sapiens
agggguccagccuc

SEQ ID NO: 820217 - RNA, 22 nt, Homo sapiens
agggguggggguggaggcuucc

SEQ ID NO: 820218 - RNA, 15 nt, Homo sapiens
agggguuaagagcuc

SEQ ID NO: 820219 - RNA, 17 nt, Homo sapiens
agggguucuugagccag

SEQ ID NO: 820220 - RNA, 18 nt, Homo sapiens
agggguuggauugcaaua

SEQ ID NO: 820221 - RNA, 18 nt, Homo sapiens
aggguaagacaauaugaa

SEQ ID NO: 820222 - RNA, 13 nt, Homo sapiens
aggguacaugugc

SEQ ID NO: 820223 - RNA, 16 nt, Homo sapiens
aggguaccuugaacac

SEQ ID NO: 820224 - RNA, 23 nt, Homo sapiens
aggguagucugguuucuagacuu

SEQ ID NO: 820225 - RNA, 14 nt, Homo sapiens
agggucaagccucu

SEQ ID NO: 820226 - RNA, 19 nt, Homo sapiens
agggucacugaaccacugc

SEQ ID NO: 820227 - RNA, 19 nt, Homo sapiens
agggucaggcggggugcug

SEQ ID NO: 820228 - RNA, 22 nt, Homo sapiens
aggguccaaccagaccuggaag

SEQ ID NO: 820229 - RNA, 18 nt, Homo sapiens
aggguccacgccucugcu

SEQ ID NO: 820230 - RNA, 16 nt, Homo sapiens
agggucccucugugua

SEQ ID NO: 820231 - RNA, 16 nt, Homo sapiens
agggucuuugguguuu

SEQ ID NO: 820232 - RNA, 23 nt, Homo sapiens
agggugaaaauuauuuuguucau

SEQ ID NO: 820233 - RNA, 16 nt, Homo sapiens
agggugaccacaccuu

SEQ ID NO: 820234 - RNA, 11 nt, Homo sapiens
agggugacugu

SEQ ID NO: 820235 - RNA, 17 nt, Homo sapiens
aggguggaugaucucaa

SEQ ID NO: 820236 - RNA, 22 nt, Homo sapiens
aggguggcacucaacucugagc

SEQ ID NO: 820237 - RNA, 18 nt, Homo sapiens
agggugggggugcucucu

SEQ ID NO: 820238 - RNA, 17 nt, Homo sapiens
aggguggucuugaucuc

SEQ ID NO: 820239 - RNA, 19 nt, Homo sapiens
aggguguaucuagcucuag

SEQ ID NO: 820240 - RNA, 23 nt, Homo sapiens
aggguguaucuagcucuaguuca

SEQ ID NO: 820241 - RNA, 20 nt, Homo sapiens
agggugugggccaccagaga

SEQ ID NO: 820242 - RNA, 14 nt, Homo sapiens
aggguguguguuca

SEQ ID NO: 820243 - RNA, 16 nt, Homo sapiens
aggguguuugcagcug

SEQ ID NO: 820244 - RNA, 13 nt, Homo sapiens
aggguuacuaugc

SEQ ID NO: 820245 - RNA, 15 nt, Homo sapiens
aggguuccaaagggc

SEQ ID NO: 820246 - RNA, 16 nt, Homo sapiens
aggguuugcacuccac

SEQ ID NO: 820247 - RNA, 23 nt, Homo sapiens
aggguuuugccccaaguccucau

SEQ ID NO: 820248 - RNA, 20 nt, Homo sapiens
uccaaagaagguguuuuccu

SEQ ID NO: 820249 - RNA, 16 nt, Homo sapiens
uccaaagagccuucag

SEQ ID NO: 820250 - RNA, 17 nt, Homo sapiens
uccaaaggaaucuccag

SEQ ID NO: 820251 - RNA, 21 nt, Homo sapiens
uccaaaguugccacagaugau

SEQ ID NO: 820252 - RNA, 14 nt, Homo sapiens
uccaaaucuguccu

SEQ ID NO: 820253 - RNA, 15 nt, Homo sapiens
uccaaaugagccaua

SEQ ID NO: 820254 - RNA, 13 nt, Homo sapiens
uccaaaugccaac

SEQ ID NO: 820255 - RNA, 14 nt, Homo sapiens
uccaaaugcuuuca

SEQ ID NO: 820256 - RNA, 15 nt, Homo sapiens
uccaaauggacauaa

SEQ ID NO: 820257 - RNA, 13 nt, Homo sapiens
uccaaauucacaa

SEQ ID NO: 820258 - RNA, 17 nt, Homo sapiens
uccaacaaacuuacugu

SEQ ID NO: 820259 - RNA, 18 nt, Homo sapiens
uccaacaagaaugcauuc

SEQ ID NO: 820260 - RNA, 14 nt, Homo sapiens
uccaacaccacaga

SEQ ID NO: 820261 - RNA, 21 nt, Homo sapiens
uccaacagauaaaagaaggaa

SEQ ID NO: 820262 - RNA, 11 nt, Homo sapiens
uccaaccacug

SEQ ID NO: 820263 - RNA, 16 nt, Homo sapiens
uccaaccagaccugga

SEQ ID NO: 820264 - RNA, 13 nt, Homo sapiens
uccaacccacugg

SEQ ID NO: 820265 - RNA, 23 nt, Homo sapiens
uccaaccccccagcacugaggaa

SEQ ID NO: 820266 - RNA, 16 nt, Homo sapiens
uccaaccuaaccccuu

SEQ ID NO: 820267 - RNA, 20 nt, Homo sapiens
uccaacuccuuucagccaca

SEQ ID NO: 820268 - RNA, 21 nt, Homo sapiens
uccaacuccuuucagccacau

SEQ ID NO: 820269 - RNA, 19 nt, Homo sapiens
uccaacugggcauuucaau

SEQ ID NO: 820270 - RNA, 17 nt, Homo sapiens
uccaacuguacuuuuaa

SEQ ID NO: 820271 - RNA, 22 nt, Homo sapiens
uccaagcauaccaacacgagca

SEQ ID NO: 820272 - RNA, 18 nt, Homo sapiens
uccaagcauuucaugaaa

SEQ ID NO: 820273 - RNA, 21 nt, Homo sapiens
uccaagccuuauuuugaguaa

SEQ ID NO: 820274 - RNA, 20 nt, Homo sapiens
uccaaggaggggcuguaaaa

SEQ ID NO: 820275 - RNA, 20 nt, Homo sapiens
uccaagggcuuagagaugaa

SEQ ID NO: 820276 - RNA, 22 nt, Homo sapiens
uccaagggguagucugccuucc

SEQ ID NO: 820277 - RNA, 14 nt, Homo sapiens
uccaaggguacuaa

SEQ ID NO: 820278 - RNA, 13 nt, Homo sapiens
uccaagugccaau

SEQ ID NO: 820279 - RNA, 17 nt, Homo sapiens
uccaaguugagauuuua

SEQ ID NO: 820280 - RNA, 16 nt, Homo sapiens
uccaauauuuugccuu

SEQ ID NO: 820281 - RNA, 17 nt, Homo sapiens
uccaauauuuugccuuu

SEQ ID NO: 820282 - RNA, 23 nt, Homo sapiens
uccaaugaugaaauauaaucaga

SEQ ID NO: 820283 - RNA, 19 nt, Homo sapiens
uccaauggaauacugaaaa

SEQ ID NO: 820284 - RNA, 12 nt, Homo sapiens
uccaauguagcu

SEQ ID NO: 820285 - RNA, 21 nt, Homo sapiens
uccacaccagcugcugcugga

SEQ ID NO: 820286 - RNA, 17 nt, Homo sapiens
uccacaccugggcauuu

SEQ ID NO: 820287 - RNA, 23 nt, Homo sapiens
uccacagcugcccuggcugugau

SEQ ID NO: 820288 - RNA, 20 nt, Homo sapiens
uccacauccuuucuaaacaa

SEQ ID NO: 820289 - RNA, 14 nt, Homo sapiens
uccaccaugaacuu

SEQ ID NO: 820290 - RNA, 16 nt, Homo sapiens
uccacccagugcugaa

SEQ ID NO: 820291 - RNA, 13 nt, Homo sapiens
uccacccuuccau

SEQ ID NO: 820292 - RNA, 21 nt, Homo sapiens
uccacccuuggccugucucau

SEQ ID NO: 820293 - RNA, 17 nt, Homo sapiens
uccaccuccuaccccau

SEQ ID NO: 820294 - RNA, 14 nt, Homo sapiens
uccaccugaggaac

SEQ ID NO: 820295 - RNA, 17 nt, Homo sapiens
uccaccugcuaaucaca

SEQ ID NO: 820296 - RNA, 13 nt, Homo sapiens
uccaccugucuca

SEQ ID NO: 820297 - RNA, 20 nt, Homo sapiens
uccacggaaaaugcuaucca

SEQ ID NO: 820298 - RNA, 14 nt, Homo sapiens
uccacuaaaugagc

SEQ ID NO: 820299 - RNA, 13 nt, Homo sapiens
uccacuacugcua

SEQ ID NO: 820300 - RNA, 13 nt, Homo sapiens
uccacucacucca

SEQ ID NO: 820301 - RNA, 20 nt, Homo sapiens
uccacucuugaucucucuug

SEQ ID NO: 820302 - RNA, 21 nt, Homo sapiens
uccacugaaguagugugcagu

SEQ ID NO: 820303 - RNA, 15 nt, Homo sapiens
uccacugucaagaaa

SEQ ID NO: 820304 - RNA, 15 nt, Homo sapiens
uccacugucaggguu

SEQ ID NO: 820305 - RNA, 17 nt, Homo sapiens
uccacugugcacaccca

SEQ ID NO: 820306 - RNA, 22 nt, Homo sapiens
uccacuucugguauaauugugu

SEQ ID NO: 820307 - RNA, 17 nt, Homo sapiens
uccacuuguuugcacug

SEQ ID NO: 820308 - RNA, 13 nt, Homo sapiens
uccacuuugacua

SEQ ID NO: 820309 - RNA, 19 nt, Homo sapiens
uccacuuugcucugaaugu

SEQ ID NO: 820310 - RNA, 21 nt, Homo sapiens
uccagaaacuuuaagaacaaa

SEQ ID NO: 820311 - RNA, 21 nt, Homo sapiens
uccagaagaagagaagcugcu

SEQ ID NO: 820312 - RNA, 13 nt, Homo sapiens
uccagaagcugcu

SEQ ID NO: 820313 - RNA, 23 nt, Homo sapiens
uccagaauugguaaaaacagcag

SEQ ID NO: 820314 - RNA, 20 nt, Homo sapiens
uccagaccagccugggcaac

SEQ ID NO: 820315 - RNA, 22 nt, Homo sapiens
uccagacuugggaaacuauuca

SEQ ID NO: 820316 - RNA, 15 nt, Homo sapiens
uccagagaguggcuc

SEQ ID NO: 820317 - RNA, 15 nt, Homo sapiens
uccagagauggucac

SEQ ID NO: 820318 - RNA, 22 nt, Homo sapiens
uccagagguauuccucucuuaa

SEQ ID NO: 820319 - RNA, 17 nt, Homo sapiens
uccagagguccuccgua

SEQ ID NO: 820320 - RNA, 17 nt, Homo sapiens
uccagauagcagggcau

SEQ ID NO: 820321 - RNA, 13 nt, Homo sapiens
agguuaaggcaua

SEQ ID NO: 820322 - RNA, 18 nt, Homo sapiens
agguuauugcaauaaagu

SEQ ID NO: 820323 - RNA, 16 nt, Homo sapiens
agguucaguauuaugu

SEQ ID NO: 820324 - RNA, 16 nt, Homo sapiens
agguucccgacaccag

SEQ ID NO: 820325 - RNA, 20 nt, Homo sapiens
agguucucagguguugccaa

SEQ ID NO: 820326 - RNA, 19 nt, Homo sapiens
agguucuuagugucacuua

SEQ ID NO: 820327 - RNA, 13 nt, Homo sapiens
agguugcagugag

SEQ ID NO: 820328 - RNA, 15 nt, Homo sapiens
agguuggagugcagu

SEQ ID NO: 820329 - RNA, 13 nt, Homo sapiens
agguuggauuugc

SEQ ID NO: 820330 - RNA, 17 nt, Homo sapiens
agguuggcgacugucau

SEQ ID NO: 820331 - RNA, 19 nt, Homo sapiens
agguugucuccaggccaug

SEQ ID NO: 820332 - RNA, 23 nt, Homo sapiens
agguugucugaagucacugcaca

SEQ ID NO: 820333 - RNA, 15 nt, Homo sapiens
agguuuaaagcugaa

SEQ ID NO: 820334 - RNA, 22 nt, Homo sapiens
agguuuacacugcggaagccaa

SEQ ID NO: 820335 - RNA, 20 nt, Homo sapiens
agguuuccucuuagguguua

SEQ ID NO: 820336 - RNA, 16 nt, Homo sapiens
agguuugucccaguca

SEQ ID NO: 820337 - RNA, 22 nt, Homo sapiens
agguuuguccuggucaugcaca

SEQ ID NO: 820338 - RNA, 16 nt, Homo sapiens
agguuuuaaagugauu

SEQ ID NO: 820339 - RNA, 21 nt, Homo sapiens
agguuuuaaccgcacaugcac

SEQ ID NO: 820340 - RNA, 22 nt, Homo sapiens
aguaaaaagguccucacaggug

SEQ ID NO: 820341 - RNA, 20 nt, Homo sapiens
aguaaaacauaauguaucau

SEQ ID NO: 820342 - RNA, 15 nt, Homo sapiens
aguaaaagugcuuuc

SEQ ID NO: 820343 - RNA, 13 nt, Homo sapiens
aguaaacaaugaa

SEQ ID NO: 820344 - RNA, 19 nt, Homo sapiens
aguaaacgggaacaugccc

SEQ ID NO: 820345 - RNA, 23 nt, Homo sapiens
aguaaaugcuagguuaauuccaa

SEQ ID NO: 820346 - RNA, 14 nt, Homo sapiens
aguaacaucaaaga

SEQ ID NO: 820347 - RNA, 21 nt, Homo sapiens
aguaacauuugcuguuuuaaa

SEQ ID NO: 820348 - RNA, 14 nt, Homo sapiens
aguaaccccuccug

SEQ ID NO: 820349 - RNA, 16 nt, Homo sapiens
aguaacuaaagcuuua

SEQ ID NO: 820350 - RNA, 18 nt, Homo sapiens
aguaacuagguguaaaaa

SEQ ID NO: 820351 - RNA, 15 nt, Homo sapiens
aguaacugaaccauu

SEQ ID NO: 820352 - RNA, 16 nt, Homo sapiens
aguaacugaaccauuc

SEQ ID NO: 820353 - RNA, 17 nt, Homo sapiens
aguaagaaccuugccug

SEQ ID NO: 820354 - RNA, 15 nt, Homo sapiens
aguaagaagacauga

SEQ ID NO: 820355 - RNA, 16 nt, Homo sapiens
aguaagaauaccacau

SEQ ID NO: 820356 - RNA, 15 nt, Homo sapiens
aguaagaugcacuga

SEQ ID NO: 820357 - RNA, 17 nt, Homo sapiens
aguaagaugcacugaaa

SEQ ID NO: 820358 - RNA, 13 nt, Homo sapiens
aguaaguacgugu

SEQ ID NO: 820359 - RNA, 12 nt, Homo sapiens
aguaagugcuuu

SEQ ID NO: 820360 - RNA, 22 nt, Homo sapiens
aguaaguuugauuucauuaaua

SEQ ID NO: 820361 - RNA, 17 nt, Homo sapiens
aguaauacaucaaagag

SEQ ID NO: 820362 - RNA, 17 nt, Homo sapiens
aguaauacauuccauug

SEQ ID NO: 820363 - RNA, 17 nt, Homo sapiens
aguaaucaucuaaguca

SEQ ID NO: 820364 - RNA, 23 nt, Homo sapiens
uccaguuuuauaaaaaguggaga

SEQ ID NO: 820365 - RNA, 14 nt, Homo sapiens
uccauaaacuaaga

SEQ ID NO: 820366 - RNA, 20 nt, Homo sapiens
uccauaaauuuggacugucu

SEQ ID NO: 820367 - RNA, 17 nt, Homo sapiens
uccauaaugcuacuguc

SEQ ID NO: 820368 - RNA, 19 nt, Homo sapiens
uccauaaugcuacugucuc

SEQ ID NO: 820369 - RNA, 23 nt, Homo sapiens
uccauacguucagaggugcagcu

SEQ ID NO: 820370 - RNA, 24 nt, Homo sapiens
uccauacguucagaggugcagcug

SEQ ID NO: 820371 - RNA, 20 nt, Homo sapiens
uccauagauccccccacuga

SEQ ID NO: 820372 - RNA, 19 nt, Homo sapiens
uccauaguaguaugaugau

SEQ ID NO: 820373 - RNA, 14 nt, Homo sapiens
uccauauagcaaua

SEQ ID NO: 820374 - RNA, 17 nt, Homo sapiens
uccauaucccuuugcag

SEQ ID NO: 820375 - RNA, 15 nt, Homo sapiens
uccauauuguugaau

SEQ ID NO: 820376 - RNA, 12 nt, Homo sapiens
uccauauuuccg

SEQ ID NO: 820377 - RNA, 17 nt, Homo sapiens
uccaucagcuguaagaa

SEQ ID NO: 820378 - RNA, 22 nt, Homo sapiens
uccaucagguuccaucccgaaa

SEQ ID NO: 820379 - RNA, 16 nt, Homo sapiens
uccaucaucacuguaa

SEQ ID NO: 820380 - RNA, 16 nt, Homo sapiens
uccauccauccuucca

SEQ ID NO: 820381 - RNA, 20 nt, Homo sapiens
uccauccauggggcugauug

SEQ ID NO: 820382 - RNA, 12 nt, Homo sapiens
uccaucccgaaa

SEQ ID NO: 820383 - RNA, 15 nt, Homo sapiens
uccaucccgaaaauc

SEQ ID NO: 820384 - RNA, 17 nt, Homo sapiens
uccaucccuccauucau

SEQ ID NO: 820385 - RNA, 18 nt, Homo sapiens
uccaucuagucacaaaga

SEQ ID NO: 820386 - RNA, 15 nt, Homo sapiens
uccaucucaaaaaau

SEQ ID NO: 820387 - RNA, 13 nt, Homo sapiens
uccaucuuucuac

SEQ ID NO: 820388 - RNA, 17 nt, Homo sapiens
uccaucuuucuacagag

SEQ ID NO: 820389 - RNA, 14 nt, Homo sapiens
uccaugaauguauc

SEQ ID NO: 820390 - RNA, 18 nt, Homo sapiens
uccaugaauuaguucucc

SEQ ID NO: 820391 - RNA, 19 nt, Homo sapiens
uccaugaccuaguuuucca

SEQ ID NO: 820392 - RNA, 13 nt, Homo sapiens
uccaugagcugcu

SEQ ID NO: 820393 - RNA, 15 nt, Homo sapiens
uccaugcaaaccaug

SEQ ID NO: 820394 - RNA, 23 nt, Homo sapiens
uccaugcaacuggaguuccuuau

SEQ ID NO: 820395 - RNA, 17 nt, Homo sapiens
uccaugcucaccaagga

SEQ ID NO: 820396 - RNA, 14 nt, Homo sapiens
uccaugcuccucac

SEQ ID NO: 820397 - RNA, 19 nt, Homo sapiens
uccaugcugcaaaggagaa

SEQ ID NO: 820398 - RNA, 14 nt, Homo sapiens
uccauggacucaga

SEQ ID NO: 820399 - RNA, 20 nt, Homo sapiens
uccauggcuaagaccacaga

SEQ ID NO: 820400 - RNA, 21 nt, Homo sapiens
uccauggggggagaagugaua

SEQ ID NO: 820401 - RNA, 20 nt, Homo sapiens
uccaugguguauaugugcca

SEQ ID NO: 820402 - RNA, 15 nt, Homo sapiens
uccauguauauauuc

SEQ ID NO: 820403 - RNA, 14 nt, Homo sapiens
uccaugugaucuca

SEQ ID NO: 820404 - RNA, 22 nt, Homo sapiens
uccaugugccuuucuuugccuc

SEQ ID NO: 820405 - RNA, 12 nt, Homo sapiens
uccaugugcuag

SEQ ID NO: 820406 - RNA, 20 nt, Homo sapiens
uccaugugcuagucacuggc

SEQ ID NO: 820407 - RNA, 21 nt, Homo sapiens
uccaugugcuagucacuggca

SEQ ID NO: 820408 - RNA, 16 nt, Homo sapiens
uccauguugcugccaa

SEQ ID NO: 820409 - RNA, 14 nt, Homo sapiens
uccauuaaccagug

SEQ ID NO: 820410 - RNA, 15 nt, Homo sapiens
uccauuacugugauu

SEQ ID NO: 820411 - RNA, 16 nt, Homo sapiens
uccauucaacugaaaa

SEQ ID NO: 820412 - RNA, 14 nt, Homo sapiens
uccauucacaccag

SEQ ID NO: 820413 - RNA, 15 nt, Homo sapiens
uccauucacaccagc

SEQ ID NO: 820414 - RNA, 16 nt, Homo sapiens
uccauucacaccagcu

SEQ ID NO: 820415 - RNA, 18 nt, Homo sapiens
uccauuccccacuucucu

SEQ ID NO: 820416 - RNA, 13 nt, Homo sapiens
uccauucuugcuu

SEQ ID NO: 820417 - RNA, 22 nt, Homo sapiens
ucccaaaauuguuuugagcuuu

SEQ ID NO: 820418 - RNA, 14 nt, Homo sapiens
ucccaaacuccucu

SEQ ID NO: 820419 - RNA, 13 nt, Homo sapiens
ucccaaagcacuu

SEQ ID NO: 820420 - RNA, 13 nt, Homo sapiens
ucccaaagccaga

SEQ ID NO: 820421 - RNA, 15 nt, Homo sapiens
ucccaaagccagaac

SEQ ID NO: 820422 - RNA, 14 nt, Homo sapiens
ucccaaagcucaga

SEQ ID NO: 820423 - RNA, 17 nt, Homo sapiens
ucccaaaguccugggau

SEQ ID NO: 820424 - RNA, 22 nt, Homo sapiens
ucccaaaugucuauuuucuuga

SEQ ID NO: 820425 - RNA, 16 nt, Homo sapiens
ucccaacacuuugaga

SEQ ID NO: 820426 - RNA, 15 nt, Homo sapiens
ucccaacagccaaga

SEQ ID NO: 820427 - RNA, 14 nt, Homo sapiens
ucccaacccauuca

SEQ ID NO: 820428 - RNA, 15 nt, Homo sapiens
ucccaaccccaggaa

SEQ ID NO: 820429 - RNA, 16 nt, Homo sapiens
ucccaaccccagugga

SEQ ID NO: 820430 - RNA, 14 nt, Homo sapiens
ucccaacguuuuac

SEQ ID NO: 820431 - RNA, 17 nt, Homo sapiens
ucccaacguuuuacaua

SEQ ID NO: 820432 - RNA, 21 nt, Homo sapiens
ucccaacucuugcacagucac

SEQ ID NO: 820433 - RNA, 14 nt, Homo sapiens
ucccaacuugccuu

SEQ ID NO: 820434 - RNA, 17 nt, Homo sapiens
ucccaagaaauggaauc

SEQ ID NO: 820435 - RNA, 15 nt, Homo sapiens
ucccaagaaugcaag

SEQ ID NO: 820436 - RNA, 21 nt, Homo sapiens
aaagguaauucugaaccagaa

SEQ ID NO: 820437 - RNA, 19 nt, Homo sapiens
aaagguagcuuaccugaca

SEQ ID NO: 820438 - RNA, 18 nt, Homo sapiens
aaagguauuauacaugug

SEQ ID NO: 820439 - RNA, 20 nt, Homo sapiens
aaagguauuuugaauaccau

SEQ ID NO: 820440 - RNA, 16 nt, Homo sapiens
aaaggugaccaaugau

SEQ ID NO: 820441 - RNA, 16 nt, Homo sapiens
aaagguugagauguaa

SEQ ID NO: 820442 - RNA, 14 nt, Homo sapiens
aaagguugcagugc

SEQ ID NO: 820443 - RNA, 14 nt, Homo sapiens
aaagguugccugaa

SEQ ID NO: 820444 - RNA, 22 nt, Homo sapiens
aaagguuucauguucacuguga

SEQ ID NO: 820445 - RNA, 15 nt, Homo sapiens
aaaguaaagacugua

SEQ ID NO: 820446 - RNA, 20 nt, Homo sapiens
aaaguaaaggccucaucucc

SEQ ID NO: 820447 - RNA, 17 nt, Homo sapiens
aaaguaaauucauguaa

SEQ ID NO: 820448 - RNA, 13 nt, Homo sapiens
aaaguaacugaau

SEQ ID NO: 820449 - RNA, 23 nt, Homo sapiens
aaaguaaggugcuuggaguuuac

SEQ ID NO: 820450 - RNA, 18 nt, Homo sapiens
aaaguacccugugcucaa

SEQ ID NO: 820451 - RNA, 12 nt, Homo sapiens
aaaguagcaauu

SEQ ID NO: 820452 - RNA, 13 nt, Homo sapiens
aaaguagccacgu

SEQ ID NO: 820453 - RNA, 17 nt, Homo sapiens
aaaguagggaccucaga

SEQ ID NO: 820454 - RNA, 14 nt, Homo sapiens
gcauugcagucaua

SEQ ID NO: 820455 - RNA, 14 nt, Homo sapiens
gcauugccuggacu

SEQ ID NO: 820456 - RNA, 17 nt, Homo sapiens
gcauugcuucagaauga

SEQ ID NO: 820457 - RNA, 16 nt, Homo sapiens
gcauuggccucuguac

SEQ ID NO: 820458 - RNA, 17 nt, Homo sapiens
gcauuguaaaugugcuu

SEQ ID NO: 820459 - RNA, 21 nt, Homo sapiens
gcauuuaaaaggacugcugau

SEQ ID NO: 820460 - RNA, 19 nt, Homo sapiens
gcauuuaaacucauuugag

SEQ ID NO: 820461 - RNA, 18 nt, Homo sapiens
gcauuuagucuugccagg

SEQ ID NO: 820462 - RNA, 18 nt, Homo sapiens
gcauuuccuggucagugg

SEQ ID NO: 820463 - RNA, 13 nt, Homo sapiens
gcauuuggaacaa

SEQ ID NO: 820464 - RNA, 13 nt, Homo sapiens
gcauuuguucacu

SEQ ID NO: 820465 - RNA, 20 nt, Homo sapiens
gcauuuuccuaaacccagug

SEQ ID NO: 820466 - RNA, 15 nt, Homo sapiens
gcauuuuuaaauaca

SEQ ID NO: 820467 - RNA, 19 nt, Homo sapiens
gcauuuuucuaaugggcua

SEQ ID NO: 820468 - RNA, 15 nt, Homo sapiens
gcauuuuucugggag

SEQ ID NO: 820469 - RNA, 10 nt, Homo sapiens
gccaaaaagg

SEQ ID NO: 820470 - RNA, 17 nt, Homo sapiens
gccaaacacuagcucug

SEQ ID NO: 820471 - RNA, 17 nt, Homo sapiens
gccaaacccaugaggca

SEQ ID NO: 820472 - RNA, 15 nt, Homo sapiens
gccaaauaaaaucua

SEQ ID NO: 820473 - RNA, 13 nt, Homo sapiens
gccaaauguaauu

SEQ ID NO: 820474 - RNA, 13 nt, Homo sapiens
gccaaauuuccag

SEQ ID NO: 820475 - RNA, 14 nt, Homo sapiens
gccaaauuuuggcc

SEQ ID NO: 820476 - RNA, 20 nt, Homo sapiens
gccaacaaagaacacuaacu

SEQ ID NO: 820477 - RNA, 18 nt, Homo sapiens
gccaaccaagaugcaaau

SEQ ID NO: 820478 - RNA, 13 nt, Homo sapiens
gccaaccuggacu

SEQ ID NO: 820479 - RNA, 14 nt, Homo sapiens
gccaacugcaaaaa

SEQ ID NO: 820480 - RNA, 14 nt, Homo sapiens
gccaagaacgcagg

SEQ ID NO: 820481 - RNA, 17 nt, Homo sapiens
gccaagaacuugcaaua

SEQ ID NO: 820482 - RNA, 14 nt, Homo sapiens
gccaagaagcagug

SEQ ID NO: 820483 - RNA, 16 nt, Homo sapiens
gccaagacagugaagu

SEQ ID NO: 820484 - RNA, 18 nt, Homo sapiens
gccaagaggcuguuccca

SEQ ID NO: 820485 - RNA, 21 nt, Homo sapiens
gccaagaguccaggaggcccu

SEQ ID NO: 820486 - RNA, 21 nt, Homo sapiens
gccaaggaaacccccagugua

SEQ ID NO: 820487 - RNA, 21 nt, Homo sapiens
gccaaggcagcgaccccagga

SEQ ID NO: 820488 - RNA, 20 nt, Homo sapiens
gccaagggaaaggggugcuu

SEQ ID NO: 820489 - RNA, 17 nt, Homo sapiens
gccaagggggugacugg

SEQ ID NO: 820490 - RNA, 20 nt, Homo sapiens
gccaaggggugggccuguga

SEQ ID NO: 820491 - RNA, 22 nt, Homo sapiens
gccaaggggugggccugugaau

SEQ ID NO: 820492 - RNA, 20 nt, Homo sapiens
gccaagguaggcagaucacc

SEQ ID NO: 820493 - RNA, 14 nt, Homo sapiens
gccaagguguccag

SEQ ID NO: 820494 - RNA, 21 nt, Homo sapiens
gccaaguggcauuacauugag

SEQ ID NO: 820495 - RNA, 16 nt, Homo sapiens
gccaaguuccaaaaua

SEQ ID NO: 820496 - RNA, 18 nt, Homo sapiens
gccaauaaaaaugucuca

SEQ ID NO: 820497 - RNA, 23 nt, Homo sapiens
gccaauaacuuuucaccaaugag

SEQ ID NO: 820498 - RNA, 19 nt, Homo sapiens
gccaaucccgccaugcuca

SEQ ID NO: 820499 - RNA, 17 nt, Homo sapiens
gccaaugaacagcuccu

SEQ ID NO: 820500 - RNA, 18 nt, Homo sapiens
gccacaaggacgcuggcu

SEQ ID NO: 820501 - RNA, 19 nt, Homo sapiens
gccacacccuccccauuca

SEQ ID NO: 820502 - RNA, 14 nt, Homo sapiens
gccacacucuccau

SEQ ID NO: 820503 - RNA, 13 nt, Homo sapiens
gccacacugggcc

SEQ ID NO: 820504 - RNA, 12 nt, Homo sapiens
gccacacugugg

SEQ ID NO: 820505 - RNA, 22 nt, Homo sapiens
gccacacugugggacucuucuu

SEQ ID NO: 820506 - RNA, 15 nt, Homo sapiens
gccacagucacugga

SEQ ID NO: 820507 - RNA, 20 nt, Homo sapiens
gccaccaacauaaaacaaaa

SEQ ID NO: 820508 - RNA, 15 nt, Homo sapiens
gccaccccuccuucc

SEQ ID NO: 820509 - RNA, 13 nt, Homo sapiens
gccacccuaccug

SEQ ID NO: 820510 - RNA, 20 nt, Homo sapiens
gccaccggaggucacuccac

SEQ ID NO: 820511 - RNA, 24 nt, Homo sapiens
gccaccgggacagaccuggacacu

SEQ ID NO: 820512 - RNA, 12 nt, Homo sapiens
gccaccuagucc

SEQ ID NO: 820513 - RNA, 13 nt, Homo sapiens
gccaccucaccaa

SEQ ID NO: 820514 - RNA, 17 nt, Homo sapiens
gccaccucugccucuag

SEQ ID NO: 820515 - RNA, 15 nt, Homo sapiens
gccacgcagggccau

SEQ ID NO: 820516 - RNA, 16 nt, Homo sapiens
gccacggccuggcugg

SEQ ID NO: 820517 - RNA, 15 nt, Homo sapiens
gccacucaaagucaa

SEQ ID NO: 820518 - RNA, 21 nt, Homo sapiens
gccacucaggaggcugaggca

SEQ ID NO: 820519 - RNA, 22 nt, Homo sapiens
gccacucccagauggcucuuuc

SEQ ID NO: 820520 - RNA, 21 nt, Homo sapiens
gccacucuuagcuaaaucccu

SEQ ID NO: 820521 - RNA, 19 nt, Homo sapiens
gccacugacugagauggag

SEQ ID NO: 820522 - RNA, 17 nt, Homo sapiens
gccacuguguacugugg

SEQ ID NO: 820523 - RNA, 20 nt, Homo sapiens
gccacuguuuugaaucucau

SEQ ID NO: 820524 - RNA, 12 nt, Homo sapiens
gccacuucucac

SEQ ID NO: 820525 - RNA, 23 nt, Homo sapiens
gccacuugacauuccuugucacc

SEQ ID NO: 820526 - RNA, 16 nt, Homo sapiens
gccacuuuacccaccu

SEQ ID NO: 820527 - RNA, 11 nt, Homo sapiens
gccacuuucaa

SEQ ID NO: 820528 - RNA, 20 nt, Homo sapiens
gccacuuucuacaggccagc

SEQ ID NO: 820529 - RNA, 13 nt, Homo sapiens
gccacuuucugcc

SEQ ID NO: 820530 - RNA, 18 nt, Homo sapiens
gccagaaagcacuacaau

SEQ ID NO: 820531 - RNA, 13 nt, Homo sapiens
gccagaauacugg

SEQ ID NO: 820532 - RNA, 17 nt, Homo sapiens
gccagacaaaauuugag

SEQ ID NO: 820533 - RNA, 15 nt, Homo sapiens
gccagacaugccaca

SEQ ID NO: 820534 - RNA, 12 nt, Homo sapiens
gccagaccucaa

SEQ ID NO: 820535 - RNA, 17 nt, Homo sapiens
gccagagauccaaaaga

SEQ ID NO: 820536 - RNA, 21 nt, Homo sapiens
gccagaggaauccuggcagcc

SEQ ID NO: 820537 - RNA, 13 nt, Homo sapiens
gccagagggcagu

SEQ ID NO: 820538 - RNA, 16 nt, Homo sapiens
gccagaggugcuucac

SEQ ID NO: 820539 - RNA, 15 nt, Homo sapiens
gccagagguuugaga

SEQ ID NO: 820540 - RNA, 19 nt, Homo sapiens
gccagaugugaaaacaucu

SEQ ID NO: 820541 - RNA, 20 nt, Homo sapiens
gccagauguuguuccuggcu

SEQ ID NO: 820542 - RNA, 20 nt, Homo sapiens
gccagcacaggggccccaga

SEQ ID NO: 820543 - RNA, 20 nt, Homo sapiens
gccagcacuaguaaaggagg

SEQ ID NO: 820544 - RNA, 17 nt, Homo sapiens
gccagcauauacugaag

SEQ ID NO: 820545 - RNA, 15 nt, Homo sapiens
gccagcauuuuugca

SEQ ID NO: 820546 - RNA, 15 nt, Homo sapiens
gccagccccaagcug

SEQ ID NO: 820547 - RNA, 16 nt, Homo sapiens
gccagccccaagcugg

SEQ ID NO: 820548 - RNA, 23 nt, Homo sapiens
gccagcccucccuggcugugagc

SEQ ID NO: 820549 - RNA, 17 nt, Homo sapiens
gccagccggcuaugaaa

SEQ ID NO: 820550 - RNA, 18 nt, Homo sapiens
gccagccgugagugcaga

SEQ ID NO: 820551 - RNA, 22 nt, Homo sapiens
gccccacccaccccacaccugc

SEQ ID NO: 820552 - RNA, 19 nt, Homo sapiens
gccccaccuugucugcuaa

SEQ ID NO: 820553 - RNA, 14 nt, Homo sapiens
gccccacuccuucc

SEQ ID NO: 820554 - RNA, 20 nt, Homo sapiens
gccccacuucacccccaacu

SEQ ID NO: 820555 - RNA, 16 nt, Homo sapiens
gccccagcacauggaa

SEQ ID NO: 820556 - RNA, 23 nt, Homo sapiens
gccccagcucgcgggacccgacc

SEQ ID NO: 820557 - RNA, 15 nt, Homo sapiens
gccccaggaccagcu

SEQ ID NO: 820558 - RNA, 13 nt, Homo sapiens
gccccagggcuau

SEQ ID NO: 820559 - RNA, 17 nt, Homo sapiens
gccccaucauugcaccu

SEQ ID NO: 820560 - RNA, 16 nt, Homo sapiens
gccccauccuguguua

SEQ ID NO: 820561 - RNA, 15 nt, Homo sapiens
gcccccagcccagag

SEQ ID NO: 820562 - RNA, 13 nt, Homo sapiens
gcccccauuucac

SEQ ID NO: 820563 - RNA, 22 nt, Homo sapiens
gccccccagccuucacugacag

SEQ ID NO: 820564 - RNA, 23 nt, Homo sapiens
gcccccuauagucaugggguccc

SEQ ID NO: 820565 - RNA, 14 nt, Homo sapiens
gccccgccacagcc

SEQ ID NO: 820566 - RNA, 20 nt, Homo sapiens
gccccgcccccaccccuaca

SEQ ID NO: 820567 - RNA, 16 nt, Homo sapiens
gccccuacugcuguga

SEQ ID NO: 820568 - RNA, 19 nt, Homo sapiens
gccccucugaccugcacug

SEQ ID NO: 820569 - RNA, 17 nt, Homo sapiens
gccccucugcccagcuu

SEQ ID NO: 820570 - RNA, 15 nt, Homo sapiens
gccccuggcccagag

SEQ ID NO: 820571 - RNA, 20 nt, Homo sapiens
aaaucauaccaguuguucau

SEQ ID NO: 820572 - RNA, 20 nt, Homo sapiens
aaaucauccaagacaguuau

SEQ ID NO: 820573 - RNA, 17 nt, Homo sapiens
aaaucauccucaugucc

SEQ ID NO: 820574 - RNA, 16 nt, Homo sapiens
aaaucaugaaaagagg

SEQ ID NO: 820575 - RNA, 13 nt, Homo sapiens
aaaucauguguug

SEQ ID NO: 820576 - RNA, 23 nt, Homo sapiens
aaaucauguguugcagcuuuaua

SEQ ID NO: 820577 - RNA, 14 nt, Homo sapiens
aaaucauuucugca

SEQ ID NO: 820578 - RNA, 17 nt, Homo sapiens
aaaucccaccacugcac

SEQ ID NO: 820579 - RNA, 17 nt, Homo sapiens
aaauccgugaagucaca

SEQ ID NO: 820580 - RNA, 16 nt, Homo sapiens
aaauccucaggugauu

SEQ ID NO: 820581 - RNA, 21 nt, Homo sapiens
aaaucguccucccaggccagg

SEQ ID NO: 820582 - RNA, 19 nt, Homo sapiens
aaaucuaaucucuuauucu

SEQ ID NO: 820583 - RNA, 14 nt, Homo sapiens
aaaucuauuacuuu

SEQ ID NO: 820584 - RNA, 22 nt, Homo sapiens
aaaucucaaugaagccagcuca

SEQ ID NO: 820585 - RNA, 14 nt, Homo sapiens
aaaucuccaucuca

SEQ ID NO: 820586 - RNA, 15 nt, Homo sapiens
aaaucuccaucucaa

SEQ ID NO: 820587 - RNA, 19 nt, Homo sapiens
aaaucucuacugcuuugga

SEQ ID NO: 820588 - RNA, 23 nt, Homo sapiens
aaaucucuacugcuuuggauccu

SEQ ID NO: 820589 - RNA, 15 nt, Homo sapiens
aaaucucuuccacau

SEQ ID NO: 820590 - RNA, 19 nt, Homo sapiens
aaaucugacaagacugaaa

SEQ ID NO: 820591 - RNA, 22 nt, Homo sapiens
aaaucugccacaaaaacaggua

SEQ ID NO: 820592 - RNA, 18 nt, Homo sapiens
aaaucugccaugagcaca

SEQ ID NO: 820593 - RNA, 19 nt, Homo sapiens
aaaucuggguaucuuucca

SEQ ID NO: 820594 - RNA, 20 nt, Homo sapiens
aaaucugucauaagcauuac

SEQ ID NO: 820595 - RNA, 18 nt, Homo sapiens
aaaucuguuuauaugaca

SEQ ID NO: 820596 - RNA, 22 nt, Homo sapiens
aaaucuuaaaagcccuaaguga

SEQ ID NO: 820597 - RNA, 19 nt, Homo sapiens
aaaucuuuuaaaaauucaa

SEQ ID NO: 820598 - RNA, 16 nt, Homo sapiens
aaaugaagggauauaa

SEQ ID NO: 820599 - RNA, 21 nt, Homo sapiens
aaaugaagguuaggauuuaac

SEQ ID NO: 820600 - RNA, 13 nt, Homo sapiens
aaaugaaugaaua

SEQ ID NO: 820601 - RNA, 17 nt, Homo sapiens
aaaugacagauguugaa

SEQ ID NO: 820602 - RNA, 14 nt, Homo sapiens
aaaugaccaaagau

SEQ ID NO: 820603 - RNA, 14 nt, Homo sapiens
aaaugaccaagaca

SEQ ID NO: 820604 - RNA, 12 nt, Homo sapiens
aaaugagacaaa

SEQ ID NO: 820605 - RNA, 20 nt, Homo sapiens
aaaugagccauccccagggc

SEQ ID NO: 820606 - RNA, 20 nt, Homo sapiens
aaaugaggaaaugccacaaa

SEQ ID NO: 820607 - RNA, 13 nt, Homo sapiens
aaaugagugcuua

SEQ ID NO: 820608 - RNA, 14 nt, Homo sapiens
aaaugauacaguau

SEQ ID NO: 820609 - RNA, 23 nt, Homo sapiens
aaaugaugacgugucuccucacu

SEQ ID NO: 820610 - RNA, 16 nt, Homo sapiens
aaaugaugccacuucc

SEQ ID NO: 820611 - RNA, 18 nt, Homo sapiens
aaaugauuuccacaaaca

SEQ ID NO: 820612 - RNA, 16 nt, Homo sapiens
aaaugauuuucauuga

SEQ ID NO: 820613 - RNA, 14 nt, Homo sapiens
aaaugcagugaauu

SEQ ID NO: 820614 - RNA, 18 nt, Homo sapiens
aaaugcauccauuccuca

SEQ ID NO: 820615 - RNA, 20 nt, Homo sapiens
aaaugccaagggggugacug

SEQ ID NO: 820616 - RNA, 18 nt, Homo sapiens
aaaugccugucucuagcu

SEQ ID NO: 820617 - RNA, 21 nt, Homo sapiens
aaaugcgcgugugcacgugug

SEQ ID NO: 820618 - RNA, 21 nt, Homo sapiens
aaaugcuagguuaauuccaau

SEQ ID NO: 820619 - RNA, 17 nt, Homo sapiens
aaaugcuucugcacaca

SEQ ID NO: 820620 - RNA, 10 nt, Homo sapiens
aaaugcuuuu

SEQ ID NO: 820621 - RNA, 14 nt, Homo sapiens
aaauggacuuucag

SEQ ID NO: 820622 - RNA, 18 nt, Homo sapiens
aaauggagauaaaagcaa

SEQ ID NO: 820623 - RNA, 15 nt, Homo sapiens
aaauggaggccuguc

SEQ ID NO: 820624 - RNA, 20 nt, Homo sapiens
aaauggaggccuguccugac

SEQ ID NO: 820625 - RNA, 17 nt, Homo sapiens
aaaugggagacagccuc

SEQ ID NO: 820626 - RNA, 21 nt, Homo sapiens
aaaugggggaaaaguuaguca

SEQ ID NO: 820627 - RNA, 15 nt, Homo sapiens
aaaugggugcccgua

SEQ ID NO: 820628 - RNA, 12 nt, Homo sapiens
aaauggucccaa

SEQ ID NO: 820629 - RNA, 18 nt, Homo sapiens
aaauggugagauguaugu

SEQ ID NO: 820630 - RNA, 13 nt, Homo sapiens
aaaugguugucac

SEQ ID NO: 820631 - RNA, 18 nt, Homo sapiens
aaauguaaaagcacauga

SEQ ID NO: 820632 - RNA, 18 nt, Homo sapiens
aaauguaacugugccagu

SEQ ID NO: 820633 - RNA, 13 nt, Homo sapiens
aaauguaacuuga

SEQ ID NO: 820634 - RNA, 16 nt, Homo sapiens
aaauguaagauuucau

SEQ ID NO: 820635 - RNA, 15 nt, Homo sapiens
aaauguaauagccaa

SEQ ID NO: 820636 - RNA, 13 nt, Homo sapiens
aaauguacacugg

SEQ ID NO: 820637 - RNA, 22 nt, Homo sapiens
aaauguacacuggauauguugu

SEQ ID NO: 820638 - RNA, 13 nt, Homo sapiens
aaauguacauguu

SEQ ID NO: 820639 - RNA, 16 nt, Homo sapiens
aaauguacauuaauua

SEQ ID NO: 820640 - RNA, 18 nt, Homo sapiens
aaauguauaaauauacag

SEQ ID NO: 820641 - RNA, 17 nt, Homo sapiens
aaauguaugugcucuua

SEQ ID NO: 820642 - RNA, 22 nt, Homo sapiens
aaauguauugauucaacaggga

SEQ ID NO: 820643 - RNA, 14 nt, Homo sapiens
aaaugucaggccuu

SEQ ID NO: 820644 - RNA, 20 nt, Homo sapiens
aaaugucaggccuuccccac

SEQ ID NO: 820645 - RNA, 13 nt, Homo sapiens
aaaugucaucuca

SEQ ID NO: 820646 - RNA, 19 nt, Homo sapiens
aaauguccauuuauaucau

SEQ ID NO: 820647 - RNA, 16 nt, Homo sapiens
aaauguccguguaaaa

SEQ ID NO: 820648 - RNA, 13 nt, Homo sapiens
aaaugucuaucaa

SEQ ID NO: 820649 - RNA, 21 nt, Homo sapiens
aaaugucuguuucaaugaccu

SEQ ID NO: 820650 - RNA, 14 nt, Homo sapiens
aaaugugcuuaugu

SEQ ID NO: 820651 - RNA, 23 nt, Homo sapiens
aaauguggagaaacuguagucuc

SEQ ID NO: 820652 - RNA, 19 nt, Homo sapiens
aaaugugguuacacacuuu

SEQ ID NO: 820653 - RNA, 18 nt, Homo sapiens
aaaugugguugcuuaauu

SEQ ID NO: 820654 - RNA, 23 nt, Homo sapiens
aaauguguauuuuucaaggcauu

SEQ ID NO: 820655 - RNA, 22 nt, Homo sapiens
aaauguuaacacucaugaagca

SEQ ID NO: 820656 - RNA, 14 nt, Homo sapiens
aaauguuaggacau

SEQ ID NO: 820657 - RNA, 16 nt, Homo sapiens
aaauguucaagucaug

SEQ ID NO: 820658 - RNA, 23 nt, Homo sapiens
aaauguuccauauguggguguca

SEQ ID NO: 820659 - RNA, 17 nt, Homo sapiens
aaauguucuauuuaaca

SEQ ID NO: 820660 - RNA, 14 nt, Homo sapiens
aaauguuuacugua

SEQ ID NO: 820661 - RNA, 15 nt, Homo sapiens
aaauguuuucugggg

SEQ ID NO: 820662 - RNA, 23 nt, Homo sapiens
aaauuaaagcccauaaggccaga

SEQ ID NO: 820663 - RNA, 20 nt, Homo sapiens
aaauuagaaaguagccacgu

SEQ ID NO: 820664 - RNA, 15 nt, Homo sapiens
aaauuagccggucau

SEQ ID NO: 820665 - RNA, 15 nt, Homo sapiens
aaauuagcugggcau

SEQ ID NO: 820666 - RNA, 14 nt, Homo sapiens
aacacuaaacauuc

SEQ ID NO: 820667 - RNA, 14 nt, Homo sapiens
aacacuaacuuaau

SEQ ID NO: 820668 - RNA, 16 nt, Homo sapiens
aacacuaagcucucug

SEQ ID NO: 820669 - RNA, 22 nt, Homo sapiens
aacacuauuuccaaaagcacau

SEQ ID NO: 820670 - RNA, 17 nt, Homo sapiens
aacacucaguuguucaa

SEQ ID NO: 820671 - RNA, 21 nt, Homo sapiens
aacacucaucuccucuguaau

SEQ ID NO: 820672 - RNA, 16 nt, Homo sapiens
aacacugaaacuguau

SEQ ID NO: 820673 - RNA, 19 nt, Homo sapiens
aacacugaagccauuugcc

SEQ ID NO: 820674 - RNA, 18 nt, Homo sapiens
aacacugacuccugugga

SEQ ID NO: 820675 - RNA, 22 nt, Homo sapiens
aacacugcaagaagucuugaga

SEQ ID NO: 820676 - RNA, 14 nt, Homo sapiens
aacacugcccucuu

SEQ ID NO: 820677 - RNA, 19 nt, Homo sapiens
aacacugucacuagucuca

SEQ ID NO: 820678 - RNA, 20 nt, Homo sapiens
aacacugucacuagucucac

SEQ ID NO: 820679 - RNA, 22 nt, Homo sapiens
aacacuuauguuauacaauaca

SEQ ID NO: 820680 - RNA, 14 nt, Homo sapiens
aacacuucucauca

SEQ ID NO: 820681 - RNA, 18 nt, Homo sapiens
aacagaaagcauccuaaa

SEQ ID NO: 820682 - RNA, 14 nt, Homo sapiens
aacagaaauuguau

SEQ ID NO: 820683 - RNA, 18 nt, Homo sapiens
aacagaaauuguauauug

SEQ ID NO: 820684 - RNA, 21 nt, Homo sapiens
aacagaaauuguauauuguaa

SEQ ID NO: 820685 - RNA, 18 nt, Homo sapiens
aacagaacaucauuagaa

SEQ ID NO: 820686 - RNA, 19 nt, Homo sapiens
gccucuuuucucugugcuu

SEQ ID NO: 820687 - RNA, 23 nt, Homo sapiens
gccugaaaaggacuucuggcuau

SEQ ID NO: 820688 - RNA, 13 nt, Homo sapiens
gccugaaccuggg

SEQ ID NO: 820689 - RNA, 15 nt, Homo sapiens
gccugaaccuuccau

SEQ ID NO: 820690 - RNA, 17 nt, Homo sapiens
gccugaagaacaguaac

SEQ ID NO: 820691 - RNA, 13 nt, Homo sapiens
gccugacaaccac

SEQ ID NO: 820692 - RNA, 13 nt, Homo sapiens
gccugaccaacau

SEQ ID NO: 820693 - RNA, 15 nt, Homo sapiens
gccugacuccugggu

SEQ ID NO: 820694 - RNA, 22 nt, Homo sapiens
gccugacuuggggagauggagu

SEQ ID NO: 820695 - RNA, 13 nt, Homo sapiens
gccugagacaccc

SEQ ID NO: 820696 - RNA, 20 nt, Homo sapiens
gccugagaggcaggcauaga

SEQ ID NO: 820697 - RNA, 20 nt, Homo sapiens
gccugaggaugagcuggaag

SEQ ID NO: 820698 - RNA, 13 nt, Homo sapiens
gccugaggcaauu

SEQ ID NO: 820699 - RNA, 19 nt, Homo sapiens
gccugagucacccaugaag

SEQ ID NO: 820700 - RNA, 16 nt, Homo sapiens
gccugauccagccuuu

SEQ ID NO: 820701 - RNA, 21 nt, Homo sapiens
gccugcaauuucauaugcugu

SEQ ID NO: 820702 - RNA, 15 nt, Homo sapiens
gccugcaucugugaa

SEQ ID NO: 820703 - RNA, 21 nt, Homo sapiens
gccugccaagagguacuguaa

SEQ ID NO: 820704 - RNA, 11 nt, Homo sapiens
gccugccauuu

SEQ ID NO: 820705 - RNA, 16 nt, Homo sapiens
gccugcccgcacccug

SEQ ID NO: 820706 - RNA, 14 nt, Homo sapiens
gccugccuaugaaa

SEQ ID NO: 820707 - RNA, 23 nt, Homo sapiens
gccugccuguccccccgcacuuu

SEQ ID NO: 820708 - RNA, 14 nt, Homo sapiens
gccugcucccugua

SEQ ID NO: 820709 - RNA, 13 nt, Homo sapiens
gccugcuccucac

SEQ ID NO: 820710 - RNA, 15 nt, Homo sapiens
gccugcuuugcuuua

SEQ ID NO: 820711 - RNA, 15 nt, Homo sapiens
gccuggacaguaucc

SEQ ID NO: 820712 - RNA, 24 nt, Homo sapiens
gccuggacugaccacaccaaccag

SEQ ID NO: 820713 - RNA, 13 nt, Homo sapiens
gccuggacugcua

SEQ ID NO: 820714 - RNA, 22 nt, Homo sapiens
gccuggagggggagcaccagcg

SEQ ID NO: 820715 - RNA, 19 nt, Homo sapiens
gccuggaucccugcccuuc

SEQ ID NO: 820716 - RNA, 15 nt, Homo sapiens
gccuggauuccagca

SEQ ID NO: 820717 - RNA, 18 nt, Homo sapiens
gccuggccaacaugguga

SEQ ID NO: 820718 - RNA, 20 nt, Homo sapiens
gccuggccaggagcucuuca

SEQ ID NO: 820719 - RNA, 13 nt, Homo sapiens
gccuggccagucc

SEQ ID NO: 820720 - RNA, 15 nt, Homo sapiens
gccugggagcccaga

SEQ ID NO: 820721 - RNA, 21 nt, Homo sapiens
gccugggcuguuggcacucac

SEQ ID NO: 820722 - RNA, 16 nt, Homo sapiens
gccugggggauguacc

SEQ ID NO: 820723 - RNA, 15 nt, Homo sapiens
gccuggggucuggag

SEQ ID NO: 820724 - RNA, 23 nt, Homo sapiens
gccugggucccacucaggugaaa

SEQ ID NO: 820725 - RNA, 15 nt, Homo sapiens
gccugggugacagug

SEQ ID NO: 820726 - RNA, 15 nt, Homo sapiens
gccugguugugugca

SEQ ID NO: 820727 - RNA, 20 nt, Homo sapiens
gccuguaaucccagaacuuu

SEQ ID NO: 820728 - RNA, 20 nt, Homo sapiens
gccuguaaucccagcacuuu

SEQ ID NO: 820729 - RNA, 20 nt, Homo sapiens
gccuguaaucucagcacuuu

SEQ ID NO: 820730 - RNA, 22 nt, Homo sapiens
gccuguaaucucagcacuuugg

SEQ ID NO: 820731 - RNA, 14 nt, Homo sapiens
gccugucuccuuug

SEQ ID NO: 820732 - RNA, 20 nt, Homo sapiens
gccugucugccccagcccag

SEQ ID NO: 820733 - RNA, 17 nt, Homo sapiens
gccugugaagcagucag

SEQ ID NO: 820734 - RNA, 19 nt, Homo sapiens
gccugugaucccagcuacu

SEQ ID NO: 820735 - RNA, 23 nt, Homo sapiens
gccugugauuaacuugcuuagua

SEQ ID NO: 820736 - RNA, 19 nt, Homo sapiens
gccugugccagcaccuuug

SEQ ID NO: 820737 - RNA, 10 nt, Homo sapiens
gccuguggug

SEQ ID NO: 820738 - RNA, 19 nt, Homo sapiens
gccugugguuaacaucuca

SEQ ID NO: 820739 - RNA, 20 nt, Homo sapiens
gccuguugaagaugcuugua

SEQ ID NO: 820740 - RNA, 20 nt, Homo sapiens
gccuuaaacacacauugcag

SEQ ID NO: 820741 - RNA, 21 nt, Homo sapiens
gccuuagccgcccaugcacug

SEQ ID NO: 820742 - RNA, 16 nt, Homo sapiens
gccuuagggcacuggg

SEQ ID NO: 820743 - RNA, 13 nt, Homo sapiens
gccuuagguugcu

SEQ ID NO: 820744 - RNA, 18 nt, Homo sapiens
gccuuagucucaguuugu

SEQ ID NO: 820745 - RNA, 10 nt, Homo sapiens
gccuuauauu

SEQ ID NO: 820746 - RNA, 14 nt, Homo sapiens
gccuuaucuugcac

SEQ ID NO: 820747 - RNA, 21 nt, Homo sapiens
gccuucacuccggugugccug

SEQ ID NO: 820748 - RNA, 14 nt, Homo sapiens
gccuucauucugca

SEQ ID NO: 820749 - RNA, 18 nt, Homo sapiens
gccuucuacugcucuccu

SEQ ID NO: 820750 - RNA, 15 nt, Homo sapiens
gccuucuucacccag

SEQ ID NO: 820751 - RNA, 12 nt, Homo sapiens
gccuugaccucc

SEQ ID NO: 820752 - RNA, 13 nt, Homo sapiens
gccuugaguagaa

SEQ ID NO: 820753 - RNA, 16 nt, Homo sapiens
gccuugaguuccaguu

SEQ ID NO: 820754 - RNA, 23 nt, Homo sapiens
gccuugccuaaauuuaaugcugc

SEQ ID NO: 820755 - RNA, 18 nt, Homo sapiens
gccuugccuccucaccca

SEQ ID NO: 820756 - RNA, 15 nt, Homo sapiens
gccuuggcuucaggg

SEQ ID NO: 820757 - RNA, 18 nt, Homo sapiens
gccuugggcuccugauga

SEQ ID NO: 820758 - RNA, 21 nt, Homo sapiens
gccuugucuucuuagcuguca

SEQ ID NO: 820759 - RNA, 16 nt, Homo sapiens
gccuuuaaaucuguga

SEQ ID NO: 820760 - RNA, 23 nt, Homo sapiens
gccuuucucccaggccaggcucc

SEQ ID NO: 820761 - RNA, 22 nt, Homo sapiens
gccuuugcccaaaacugucauc

SEQ ID NO: 820762 - RNA, 15 nt, Homo sapiens
gccuuuguuucccau

SEQ ID NO: 820763 - RNA, 20 nt, Homo sapiens
gccuuuuaaaaguucuuuaa

SEQ ID NO: 820764 - RNA, 19 nt, Homo sapiens
gccuuuugugcaaagccaa

SEQ ID NO: 820765 - RNA, 18 nt, Homo sapiens
gcgaaaaccuuccucagc

SEQ ID NO: 820766 - RNA, 20 nt, Homo sapiens
gcgaaaccccaucucuacua

SEQ ID NO: 820767 - RNA, 18 nt, Homo sapiens
gcgaaggggcccuggucc

SEQ ID NO: 820768 - RNA, 13 nt, Homo sapiens
gcgacccaagacc

SEQ ID NO: 820769 - RNA, 13 nt, Homo sapiens
gcgagacuccauc

SEQ ID NO: 820770 - RNA, 15 nt, Homo sapiens
gcgagacuccaucuc

SEQ ID NO: 820771 - RNA, 13 nt, Homo sapiens
gcgagcacuguga

SEQ ID NO: 820772 - RNA, 12 nt, Homo sapiens
gcgauauacuaa

SEQ ID NO: 820773 - RNA, 16 nt, Homo sapiens
gcgauuaagagacaga

SEQ ID NO: 820774 - RNA, 20 nt, Homo sapiens
gcgcaauugcucaugcauag

SEQ ID NO: 820775 - RNA, 12 nt, Homo sapiens
gcgcaccuguag

SEQ ID NO: 820776 - RNA, 13 nt, Homo sapiens
gcgcacugcauuc

SEQ ID NO: 820777 - RNA, 20 nt, Homo sapiens
gcgcaggccugcgugcgcug

SEQ ID NO: 820778 - RNA, 16 nt, Homo sapiens
gcgcagugcuguccaa

SEQ ID NO: 820779 - RNA, 14 nt, Homo sapiens
gcgcaguggcucac

SEQ ID NO: 820780 - RNA, 14 nt, Homo sapiens
gcgcaucaggccug

SEQ ID NO: 820781 - RNA, 18 nt, Homo sapiens
aagcugcacaugugccac

SEQ ID NO: 820782 - RNA, 16 nt, Homo sapiens
aagcugcccacuguuu

SEQ ID NO: 820783 - RNA, 17 nt, Homo sapiens
aagcugcgggcacccau

SEQ ID NO: 820784 - RNA, 14 nt, Homo sapiens
aagcugcugucacu

SEQ ID NO: 820785 - RNA, 18 nt, Homo sapiens
aagcuggaagacugugca

SEQ ID NO: 820786 - RNA, 14 nt, Homo sapiens
aagcuggagugcag

SEQ ID NO: 820787 - RNA, 15 nt, Homo sapiens
aagcuggagugcagu

SEQ ID NO: 820788 - RNA, 21 nt, Homo sapiens
aagcugggauaaucacauuau

SEQ ID NO: 820789 - RNA, 18 nt, Homo sapiens
aagcuggugcccuuccuc

SEQ ID NO: 820790 - RNA, 23 nt, Homo sapiens
aagcuggugucugauuuuggcca

SEQ ID NO: 820791 - RNA, 21 nt, Homo sapiens
aagcuguacucagagcagagc

SEQ ID NO: 820792 - RNA, 22 nt, Homo sapiens
aagcuguguccuugcaccugca

SEQ ID NO: 820793 - RNA, 14 nt, Homo sapiens
aagcuguugcuauu

SEQ ID NO: 820794 - RNA, 15 nt, Homo sapiens
aagcuuaaauugcuu

SEQ ID NO: 820795 - RNA, 14 nt, Homo sapiens
aagcuuaaugauuc

SEQ ID NO: 820796 - RNA, 19 nt, Homo sapiens
aagcuuaauggauuguuaa

SEQ ID NO: 820797 - RNA, 16 nt, Homo sapiens
aagcuuccauaguggu

SEQ ID NO: 820798 - RNA, 18 nt, Homo sapiens
aagcuuucaaauccuccc

SEQ ID NO: 820799 - RNA, 18 nt, Homo sapiens
aagcuuucuguugauguu

SEQ ID NO: 820800 - RNA, 19 nt, Homo sapiens
aagcuuugaauacugugaa

SEQ ID NO: 820801 - RNA, 19 nt, Homo sapiens
aagcuuuuuacucaaagag

SEQ ID NO: 820802 - RNA, 23 nt, Homo sapiens
aaggaaaaaacuuugacuuugcc

SEQ ID NO: 820803 - RNA, 15 nt, Homo sapiens
aaggaaaaaagcaag

SEQ ID NO: 820804 - RNA, 23 nt, Homo sapiens
ggagaagucucagcuaagcucac

SEQ ID NO: 820805 - RNA, 22 nt, Homo sapiens
ggagaaucgcuugaacccagga

SEQ ID NO: 820806 - RNA, 19 nt, Homo sapiens
ggagaaugaagacuguuaa

SEQ ID NO: 820807 - RNA, 13 nt, Homo sapiens
ggagaauggugcu

SEQ ID NO: 820808 - RNA, 13 nt, Homo sapiens
ggagaauugagaa

SEQ ID NO: 820809 - RNA, 23 nt, Homo sapiens
ggagacacaacuauuuuuccaaa

SEQ ID NO: 820810 - RNA, 19 nt, Homo sapiens
ggagacacuggccccucaa

SEQ ID NO: 820811 - RNA, 17 nt, Homo sapiens
ggagaccagcucagagg

SEQ ID NO: 820812 - RNA, 15 nt, Homo sapiens
ggagaccugugcuag

SEQ ID NO: 820813 - RNA, 20 nt, Homo sapiens
ggagacuccuggucugugaa

SEQ ID NO: 820814 - RNA, 14 nt, Homo sapiens
ggagagaaaaaaga

SEQ ID NO: 820815 - RNA, 14 nt, Homo sapiens
ggagagaacugaau

SEQ ID NO: 820816 - RNA, 14 nt, Homo sapiens
ggagagacagugac

SEQ ID NO: 820817 - RNA, 14 nt, Homo sapiens
ggagagagccaaga

SEQ ID NO: 820818 - RNA, 23 nt, Homo sapiens
ggagagcuguuccagaacacaga

SEQ ID NO: 820819 - RNA, 16 nt, Homo sapiens
ggagauggacaacuca

SEQ ID NO: 820820 - RNA, 21 nt, Homo sapiens
ggagauuucuuguugcucaaa

SEQ ID NO: 820821 - RNA, 20 nt, Homo sapiens
ggagcaaaaucgaugcagug

SEQ ID NO: 820822 - RNA, 19 nt, Homo sapiens
ggagcaagugugcucuccu

SEQ ID NO: 820823 - RNA, 15 nt, Homo sapiens
ggagcacuguucaca

SEQ ID NO: 820824 - RNA, 19 nt, Homo sapiens
ggagcacuguucacaucau

SEQ ID NO: 820825 - RNA, 16 nt, Homo sapiens
ggagcagcagccacug

SEQ ID NO: 820826 - RNA, 18 nt, Homo sapiens
ggagcaggaccuacuagg

SEQ ID NO: 820827 - RNA, 21 nt, Homo sapiens
ggagcaggagccugagccuug

SEQ ID NO: 820828 - RNA, 15 nt, Homo sapiens
ggagcauaacuggag

SEQ ID NO: 820829 - RNA, 13 nt, Homo sapiens
ggagccaccagca

SEQ ID NO: 820830 - RNA, 13 nt, Homo sapiens
ggagcccagugaa

SEQ ID NO: 820831 - RNA, 19 nt, Homo sapiens
ggagccccagcuuccugug

SEQ ID NO: 820832 - RNA, 19 nt, Homo sapiens
ggagccccauccuguguua

SEQ ID NO: 820833 - RNA, 18 nt, Homo sapiens
ggagccccgccacagccu

SEQ ID NO: 820834 - RNA, 14 nt, Homo sapiens
ggagcccgcacugu

SEQ ID NO: 820835 - RNA, 21 nt, Homo sapiens
ggagcccugaggaccucucag

SEQ ID NO: 820836 - RNA, 21 nt, Homo sapiens
ggagccgagggcgucagagag

SEQ ID NO: 820837 - RNA, 16 nt, Homo sapiens
ggagcgaagcagagag

SEQ ID NO: 820838 - RNA, 13 nt, Homo sapiens
ggagcgcaccugc

SEQ ID NO: 820839 - RNA, 14 nt, Homo sapiens
ggagcuacugacau

SEQ ID NO: 820840 - RNA, 17 nt, Homo sapiens
ggagcucacacuccagu

SEQ ID NO: 820841 - RNA, 19 nt, Homo sapiens
ggagcuccuggaagcacag

SEQ ID NO: 820842 - RNA, 14 nt, Homo sapiens
ggagcugauggcag

SEQ ID NO: 820843 - RNA, 18 nt, Homo sapiens
ggagcugcucucucauga

SEQ ID NO: 820844 - RNA, 14 nt, Homo sapiens
ggagcuggggcaag

SEQ ID NO: 820845 - RNA, 22 nt, Homo sapiens
ggaggaaaaggccccugcaaug

SEQ ID NO: 820846 - RNA, 23 nt, Homo sapiens
ggaggaacuuuucaagcugcuga

SEQ ID NO: 820847 - RNA, 19 nt, Homo sapiens
ggaggacacuggugguucu

SEQ ID NO: 820848 - RNA, 22 nt, Homo sapiens
ggaggacagaauucucccagcg

SEQ ID NO: 820849 - RNA, 19 nt, Homo sapiens
ggaggaucgccugagccca

SEQ ID NO: 820850 - RNA, 18 nt, Homo sapiens
ggaggauucgagcaucag

SEQ ID NO: 820851 - RNA, 23 nt, Homo sapiens
ggaggcaccagcucuguggccug

SEQ ID NO: 820852 - RNA, 22 nt, Homo sapiens
ggaggcagagguugcagugagc

SEQ ID NO: 820853 - RNA, 16 nt, Homo sapiens
ggaggcaugccucuga

SEQ ID NO: 820854 - RNA, 15 nt, Homo sapiens
ggaggccaaccagcc

SEQ ID NO: 820855 - RNA, 20 nt, Homo sapiens
ggaggccagugccagcaccu

SEQ ID NO: 820856 - RNA, 14 nt, Homo sapiens
ggaggccauugugu

SEQ ID NO: 820857 - RNA, 20 nt, Homo sapiens
ggaggcgcugcugguguucu

SEQ ID NO: 820858 - RNA, 16 nt, Homo sapiens
ggaggcucaggugauc

SEQ ID NO: 820859 - RNA, 12 nt, Homo sapiens
ggaggcugagac

SEQ ID NO: 820860 - RNA, 15 nt, Homo sapiens
ggaggcugaggcaag

SEQ ID NO: 820861 - RNA, 17 nt, Homo sapiens
ggaggcugcgugccagu

SEQ ID NO: 820862 - RNA, 18 nt, Homo sapiens
ggaggcugucuucucagg

SEQ ID NO: 820863 - RNA, 19 nt, Homo sapiens
ggaggcugucuucucaggc

SEQ ID NO: 820864 - RNA, 21 nt, Homo sapiens
ggaggcuugccccacccaaca

SEQ ID NO: 820865 - RNA, 15 nt, Homo sapiens
ggagggagguggucc

SEQ ID NO: 820866 - RNA, 21 nt, Homo sapiens
ggagggcccuccgaccacuuc

SEQ ID NO: 820867 - RNA, 22 nt, Homo sapiens
ggagggcgugacucacccaagc

SEQ ID NO: 820868 - RNA, 18 nt, Homo sapiens
ggagggguauuuuugccc

SEQ ID NO: 820869 - RNA, 23 nt, Homo sapiens
ggagggguuuuggugauacccaa

SEQ ID NO: 820870 - RNA, 19 nt, Homo sapiens
ggagguagagguugcacug

SEQ ID NO: 820871 - RNA, 20 nt, Homo sapiens
ggaggucaaggcuucaguga

SEQ ID NO: 820872 - RNA, 19 nt, Homo sapiens
ggagguggagcuugcagug

SEQ ID NO: 820873 - RNA, 20 nt, Homo sapiens
ggagguggagcuugcaguga

SEQ ID NO: 820874 - RNA, 20 nt, Homo sapiens
ggagguggagguugcaguga

SEQ ID NO: 820875 - RNA, 19 nt, Homo sapiens
ggaggugggguacauuucu

SEQ ID NO: 820876 - RNA, 23 nt, Homo sapiens
ggaggugguccuccuaucucccu

SEQ ID NO: 820877 - RNA, 21 nt, Homo sapiens
ggagguuacagugagccaaga

SEQ ID NO: 820878 - RNA, 20 nt, Homo sapiens
ggagguugcagugagccaaa

SEQ ID NO: 820879 - RNA, 13 nt, Homo sapiens
ggaguaaaauuca

SEQ ID NO: 820880 - RNA, 22 nt, Homo sapiens
ggaguaaucaggcagccuucau

SEQ ID NO: 820881 - RNA, 22 nt, Homo sapiens
ggaguacaaaacaaucucucaa

SEQ ID NO: 820882 - RNA, 17 nt, Homo sapiens
ggaguaccauguggcaa

SEQ ID NO: 820883 - RNA, 21 nt, Homo sapiens
ggaguaccuggaccuguccau

SEQ ID NO: 820884 - RNA, 18 nt, Homo sapiens
ggaguagaaaaaucucau

SEQ ID NO: 820885 - RNA, 16 nt, Homo sapiens
ggaguaggacauacca

SEQ ID NO: 820886 - RNA, 14 nt, Homo sapiens
ggagucacacagug

SEQ ID NO: 820887 - RNA, 18 nt, Homo sapiens
ggagucugccacuuguca

SEQ ID NO: 820888 - RNA, 22 nt, Homo sapiens
ggagugaccaaaggugugcccu

SEQ ID NO: 820889 - RNA, 21 nt, Homo sapiens
ggagugagugaucacugguau

SEQ ID NO: 820890 - RNA, 16 nt, Homo sapiens
ggagugggcgcagugg

SEQ ID NO: 820891 - RNA, 18 nt, Homo sapiens
ggagugucggauccugug

SEQ ID NO: 820892 - RNA, 17 nt, Homo sapiens
ggaguguggcuccugug

SEQ ID NO: 820893 - RNA, 18 nt, Homo sapiens
ggaguuaggcuauucaca

SEQ ID NO: 820894 - RNA, 18 nt, Homo sapiens
ggaguugaaacugcuaua

SEQ ID NO: 820895 - RNA, 18 nt, Homo sapiens
ggcaggcccauucagagc

SEQ ID NO: 820896 - RNA, 16 nt, Homo sapiens
ggcaggcuccaggccu

SEQ ID NO: 820897 - RNA, 15 nt, Homo sapiens
ggcaggcugggccau

SEQ ID NO: 820898 - RNA, 21 nt, Homo sapiens
ggcagggaauggggacggugu

SEQ ID NO: 820899 - RNA, 14 nt, Homo sapiens
ggcagggagugucu

SEQ ID NO: 820900 - RNA, 17 nt, Homo sapiens
ggcaggggugcugugga

SEQ ID NO: 820901 - RNA, 18 nt, Homo sapiens
ggcagggugagaagcuag

SEQ ID NO: 820902 - RNA, 19 nt, Homo sapiens
ggcaggguucuccaagggc

SEQ ID NO: 820903 - RNA, 19 nt, Homo sapiens
ggcaggugagaacccagag

SEQ ID NO: 820904 - RNA, 13 nt, Homo sapiens
ggcaggugccuug

SEQ ID NO: 820905 - RNA, 19 nt, Homo sapiens
ggcagguguguauuuacuu

SEQ ID NO: 820906 - RNA, 15 nt, Homo sapiens
ggcaguauuaagugu

SEQ ID NO: 820907 - RNA, 17 nt, Homo sapiens
ggcaguccagccagcuc

SEQ ID NO: 820908 - RNA, 22 nt, Homo sapiens
ggcagucugaacccuugugcuu

SEQ ID NO: 820909 - RNA, 17 nt, Homo sapiens
ggcauacagacugggga

SEQ ID NO: 820910 - RNA, 22 nt, Homo sapiens
ggcaucacacuuauauuuuaug

SEQ ID NO: 820911 - RNA, 21 nt, Homo sapiens
ggcaucaugcagaguugacau

SEQ ID NO: 820912 - RNA, 16 nt, Homo sapiens
ggcauccacccagugc

SEQ ID NO: 820913 - RNA, 20 nt, Homo sapiens
ggcaucucacuuuaugauag

SEQ ID NO: 820914 - RNA, 19 nt, Homo sapiens
ggcaucuccuguccugggc

SEQ ID NO: 820915 - RNA, 16 nt, Homo sapiens
ggcaucuggaaagggg

SEQ ID NO: 820916 - RNA, 12 nt, Homo sapiens
ggcaucuugcca

SEQ ID NO: 820917 - RNA, 22 nt, Homo sapiens
ggcaucuuugccuugggcugcu

SEQ ID NO: 820918 - RNA, 18 nt, Homo sapiens
aagguuaaaaaguucaua

SEQ ID NO: 820919 - RNA, 14 nt, Homo sapiens
aagguuaacaaaga

SEQ ID NO: 820920 - RNA, 13 nt, Homo sapiens
aagguuacuggga

SEQ ID NO: 820921 - RNA, 14 nt, Homo sapiens
aagguuaugcacug

SEQ ID NO: 820922 - RNA, 20 nt, Homo sapiens
aagguucucagguguugcca

SEQ ID NO: 820923 - RNA, 22 nt, Homo sapiens
aagguucucagguguugccaaa

SEQ ID NO: 820924 - RNA, 14 nt, Homo sapiens
aagguucucugugc

SEQ ID NO: 820925 - RNA, 16 nt, Homo sapiens
aagguuggagauguca

SEQ ID NO: 820926 - RNA, 18 nt, Homo sapiens
aagguuggcgacugucau

SEQ ID NO: 820927 - RNA, 22 nt, Homo sapiens
aagguugucagcugcagccacu

SEQ ID NO: 820928 - RNA, 20 nt, Homo sapiens
aagguuucauguucacugug

SEQ ID NO: 820929 - RNA, 16 nt, Homo sapiens
aagguuugcaaauuaa

SEQ ID NO: 820930 - RNA, 21 nt, Homo sapiens
aagguuuuaaccgcacaugca

SEQ ID NO: 820931 - RNA, 22 nt, Homo sapiens
aagguuuucucuaacuucucaa

SEQ ID NO: 820932 - RNA, 18 nt, Homo sapiens
aagguuuucuucauucau

SEQ ID NO: 820933 - RNA, 23 nt, Homo sapiens
aaguaaacaacucaagggcacau

SEQ ID NO: 820934 - RNA, 19 nt, Homo sapiens
aaguaaaggccucaucucc

SEQ ID NO: 820935 - RNA, 21 nt, Homo sapiens
aaguaacugugagaacccagu

SEQ ID NO: 820936 - RNA, 19 nt, Homo sapiens
aaguaacugugguuuacua

SEQ ID NO: 820937 - RNA, 17 nt, Homo sapiens
aaguaaguuugauuuca

SEQ ID NO: 820938 - RNA, 13 nt, Homo sapiens
aaguaaugauuaa

SEQ ID NO: 820939 - RNA, 23 nt, Homo sapiens
aaguaauuaucgggaacaguguu

SEQ ID NO: 820940 - RNA, 22 nt, Homo sapiens
aaguacaaagguugcagugcug

SEQ ID NO: 820941 - RNA, 14 nt, Homo sapiens
aaguacacugagag

SEQ ID NO: 820942 - RNA, 11 nt, Homo sapiens
aaguaccacac

SEQ ID NO: 820943 - RNA, 17 nt, Homo sapiens
aaguaccacacauauug

SEQ ID NO: 820944 - RNA, 19 nt, Homo sapiens
aaguaccacacauauugca

SEQ ID NO: 820945 - RNA, 16 nt, Homo sapiens
aaguacccugugcuca

SEQ ID NO: 820946 - RNA, 14 nt, Homo sapiens
aaguagaauccuaa

SEQ ID NO: 820947 - RNA, 19 nt, Homo sapiens
aaguagaggaauccaugua

SEQ ID NO: 820948 - RNA, 18 nt, Homo sapiens
aaguagaucuuuucuuga

SEQ ID NO: 820949 - RNA, 21 nt, Homo sapiens
aaguagcaugaucaguguaug

SEQ ID NO: 820950 - RNA, 17 nt, Homo sapiens
aaguagccgcucugguu

SEQ ID NO: 820951 - RNA, 21 nt, Homo sapiens
aaguagcuaguagcaaugugc

SEQ ID NO: 820952 - RNA, 22 nt, Homo sapiens
aaguagcuuuccacauuuguca

SEQ ID NO: 820953 - RNA, 14 nt, Homo sapiens
aaguagggacuucu

SEQ ID NO: 820954 - RNA, 21 nt, Homo sapiens
aaguaggugugacuugaacua

SEQ ID NO: 820955 - RNA, 15 nt, Homo sapiens
aaguagugugcaguu

SEQ ID NO: 820956 - RNA, 21 nt, Homo sapiens
aaguaguugauucagcccuca

SEQ ID NO: 820957 - RNA, 13 nt, Homo sapiens
aaguauaaaugaa

SEQ ID NO: 820958 - RNA, 19 nt, Homo sapiens
aaguauauaauccugugaa

SEQ ID NO: 820959 - RNA, 20 nt, Homo sapiens
aaguauauaaugcuugcacc

SEQ ID NO: 820960 - RNA, 13 nt, Homo sapiens
aaguaugccuuaa

SEQ ID NO: 820961 - RNA, 18 nt, Homo sapiens
aaguauuauuuauuugaa

SEQ ID NO: 820962 - RNA, 17 nt, Homo sapiens
aaguauuuuugauuaac

SEQ ID NO: 820963 - RNA, 19 nt, Homo sapiens
aagucacaggaagaaagca

SEQ ID NO: 820964 - RNA, 13 nt, Homo sapiens
aagucacauucca

SEQ ID NO: 820965 - RNA, 20 nt, Homo sapiens
aagucacuggccaguggcug

SEQ ID NO: 820966 - RNA, 17 nt, Homo sapiens
aagucagaauugcucaa

SEQ ID NO: 820967 - RNA, 22 nt, Homo sapiens
aagucagaucuggucuaguuaa

SEQ ID NO: 820968 - RNA, 17 nt, Homo sapiens
aagucagccacacuggg

SEQ ID NO: 820969 - RNA, 20 nt, Homo sapiens
aagucauccucccaccucag

SEQ ID NO: 820970 - RNA, 17 nt, Homo sapiens
aagucaugugcauuucc

SEQ ID NO: 820971 - RNA, 14 nt, Homo sapiens
aaguccaucugaca

SEQ ID NO: 820972 - RNA, 16 nt, Homo sapiens
aaguccccucuacuuu

SEQ ID NO: 820973 - RNA, 18 nt, Homo sapiens
aagucccuuuaugcagag

SEQ ID NO: 820974 - RNA, 17 nt, Homo sapiens
aaguccucugcuccagc

SEQ ID NO: 820975 - RNA, 14 nt, Homo sapiens
aagucgccagucac

SEQ ID NO: 820976 - RNA, 18 nt, Homo sapiens
aagucgucacuaauacac

SEQ ID NO: 820977 - RNA, 23 nt, Homo sapiens
aagucuaaauaaaugaaguauuu

SEQ ID NO: 820978 - RNA, 19 nt, Homo sapiens
aagucucacagauugcugc

SEQ ID NO: 820979 - RNA, 13 nt, Homo sapiens
aagucucugugaa

SEQ ID NO: 820980 - RNA, 16 nt, Homo sapiens
aagucugcuacccuca

SEQ ID NO: 820981 - RNA, 18 nt, Homo sapiens
aagucugggauguagaac

SEQ ID NO: 820982 - RNA, 14 nt, Homo sapiens
aagucugucugucu

SEQ ID NO: 820983 - RNA, 17 nt, Homo sapiens
aagucuuauuuccucaa

SEQ ID NO: 820984 - RNA, 11 nt, Homo sapiens
aagucuuucau

SEQ ID NO: 820985 - RNA, 19 nt, Homo sapiens
aagugaagaaucuaaugaa

SEQ ID NO: 820986 - RNA, 18 nt, Homo sapiens
aagugaagagauccuucu

SEQ ID NO: 820987 - RNA, 21 nt, Homo sapiens
aagugaagagggagaagggau

SEQ ID NO: 820988 - RNA, 15 nt, Homo sapiens
aagugacuauagaau

SEQ ID NO: 820989 - RNA, 20 nt, Homo sapiens
aagugagagauguugcccau

SEQ ID NO: 820990 - RNA, 15 nt, Homo sapiens
aagugagggcucacu

SEQ ID NO: 820991 - RNA, 17 nt, Homo sapiens
aagugagggcucacuca

SEQ ID NO: 820992 - RNA, 23 nt, Homo sapiens
aagugauagaaaaguguggcuug

SEQ ID NO: 820993 - RNA, 16 nt, Homo sapiens
aagugauaucaccucu

SEQ ID NO: 820994 - RNA, 19 nt, Homo sapiens
aagugaucaaacuacauau

SEQ ID NO: 820995 - RNA, 16 nt, Homo sapiens
aagugauuugccugua

SEQ ID NO: 820996 - RNA, 17 nt, Homo sapiens
aagugcacaggagccaa

SEQ ID NO: 820997 - RNA, 17 nt, Homo sapiens
aagugcauauuuaucca

SEQ ID NO: 820998 - RNA, 11 nt, Homo sapiens
aagugccaaac

SEQ ID NO: 820999 - RNA, 18 nt, Homo sapiens
aagugcuggcaaccacua

SEQ ID NO: 821000 - RNA, 20 nt, Homo sapiens
aagugcuucuccagccucag

SEQ ID NO: 821001 - RNA, 19 nt, Homo sapiens
aaguggaguugacucugga

SEQ ID NO: 821002 - RNA, 14 nt, Homo sapiens
aaguggccaugcca

SEQ ID NO: 821003 - RNA, 15 nt, Homo sapiens
aaguggccuuuccag

SEQ ID NO: 821004 - RNA, 17 nt, Homo sapiens
aaguggcugaugggaac

SEQ ID NO: 821005 - RNA, 18 nt, Homo sapiens
aagugggcccacccggug

SEQ ID NO: 821006 - RNA, 19 nt, Homo sapiens
aaguggggaaguguuccag

SEQ ID NO: 821007 - RNA, 17 nt, Homo sapiens
aaguguaacagauauca

SEQ ID NO: 821008 - RNA, 15 nt, Homo sapiens
aaguguacacuauug

SEQ ID NO: 821009 - RNA, 13 nt, Homo sapiens
ggcuucuccugac

SEQ ID NO: 821010 - RNA, 22 nt, Homo sapiens
ggcuucucuugcuaccugugag

SEQ ID NO: 821011 - RNA, 13 nt, Homo sapiens
ggcuucugugaug

SEQ ID NO: 821012 - RNA, 11 nt, Homo sapiens
ggcuucuuauu

SEQ ID NO: 821013 - RNA, 13 nt, Homo sapiens
ggcuugaagccaa

SEQ ID NO: 821014 - RNA, 14 nt, Homo sapiens
ggcuugaagccaaa

SEQ ID NO: 821015 - RNA, 15 nt, Homo sapiens
ggcuugacucaggau

SEQ ID NO: 821016 - RNA, 14 nt, Homo sapiens
ggcuugcagugcgc

SEQ ID NO: 821017 - RNA, 16 nt, Homo sapiens
ggcuuggaguggccaa

SEQ ID NO: 821018 - RNA, 23 nt, Homo sapiens
ggcuuuaugcaaauacaaucagc

SEQ ID NO: 821019 - RNA, 20 nt, Homo sapiens
ggcuuuaugcuaguuugacc

SEQ ID NO: 821020 - RNA, 22 nt, Homo sapiens
ggcuuuccuucuguauucauaa

SEQ ID NO: 821021 - RNA, 19 nt, Homo sapiens
ggcuuuuaagaaacacagg

SEQ ID NO: 821022 - RNA, 21 nt, Homo sapiens
ggcuuuuccaaugaugaaaua

SEQ ID NO: 821023 - RNA, 19 nt, Homo sapiens
gggaaaauacguugaggga

SEQ ID NO: 821024 - RNA, 21 nt, Homo sapiens
gggaaaccccccagagcucuu

SEQ ID NO: 821025 - RNA, 14 nt, Homo sapiens
gggaaacgggguga

SEQ ID NO: 821026 - RNA, 21 nt, Homo sapiens
gggaaaggauauuuucuucca

SEQ ID NO: 821027 - RNA, 16 nt, Homo sapiens
gggaaauaacugccuu

SEQ ID NO: 821028 - RNA, 14 nt, Homo sapiens
gggaaauugcugcu

SEQ ID NO: 821029 - RNA, 12 nt, Homo sapiens
gggaacaugccc

SEQ ID NO: 821030 - RNA, 14 nt, Homo sapiens
gggaagacaguggc

SEQ ID NO: 821031 - RNA, 21 nt, Homo sapiens
gggaagaccagcuuugcagug

SEQ ID NO: 821032 - RNA, 14 nt, Homo sapiens
aauagacacauaca

SEQ ID NO: 821033 - RNA, 21 nt, Homo sapiens
aauagauggauuuguaucaau

SEQ ID NO: 821034 - RNA, 13 nt, Homo sapiens
aauagaugucuca

SEQ ID NO: 821035 - RNA, 16 nt, Homo sapiens
aauagauuacugaugu

SEQ ID NO: 821036 - RNA, 15 nt, Homo sapiens
aauagauuucucaag

SEQ ID NO: 821037 - RNA, 15 nt, Homo sapiens
aauagcacaggugac

SEQ ID NO: 821038 - RNA, 19 nt, Homo sapiens
aauagcagccuuucucucu

SEQ ID NO: 821039 - RNA, 14 nt, Homo sapiens
aauaggaauaagcu

SEQ ID NO: 821040 - RNA, 21 nt, Homo sapiens
aauaggaaucuucacuagaag

SEQ ID NO: 821041 - RNA, 14 nt, Homo sapiens
aauaggcaucucca

SEQ ID NO: 821042 - RNA, 12 nt, Homo sapiens
aauaggugaaua

SEQ ID NO: 821043 - RNA, 19 nt, Homo sapiens
aauaggugcuuauucucaa

SEQ ID NO: 821044 - RNA, 15 nt, Homo sapiens
aauaguauacauugu

SEQ ID NO: 821045 - RNA, 9 nt, Homo sapiens
aauagucau

SEQ ID NO: 821046 - RNA, 23 nt, Homo sapiens
aauaguccaccucccauuacuuu

SEQ ID NO: 821047 - RNA, 15 nt, Homo sapiens
aauagugaaaugcca

SEQ ID NO: 821048 - RNA, 15 nt, Homo sapiens
aauagugacaaguga

SEQ ID NO: 821049 - RNA, 16 nt, Homo sapiens
aauaguucuguauaua

SEQ ID NO: 821050 - RNA, 18 nt, Homo sapiens
aauaguuuugauccuaaa

SEQ ID NO: 821051 - RNA, 19 nt, Homo sapiens
aauaguuuugauccuaaau

SEQ ID NO: 821052 - RNA, 23 nt, Homo sapiens
aauauaaaacuguacuucacugu

SEQ ID NO: 821053 - RNA, 14 nt, Homo sapiens
aauauaagaucuga

SEQ ID NO: 821054 - RNA, 18 nt, Homo sapiens
aauauaagcugccauaua

SEQ ID NO: 821055 - RNA, 20 nt, Homo sapiens
aauauaauaggacaaucauc

SEQ ID NO: 821056 - RNA, 20 nt, Homo sapiens
aauauaauccacuuugcucu

SEQ ID NO: 821057 - RNA, 16 nt, Homo sapiens
aauauaauuugaucuu

SEQ ID NO: 821058 - RNA, 12 nt, Homo sapiens
aauauacauuca

SEQ ID NO: 821059 - RNA, 14 nt, Homo sapiens
aauauacccaucca

SEQ ID NO: 821060 - RNA, 16 nt, Homo sapiens
aauauacugcauaucc

SEQ ID NO: 821061 - RNA, 12 nt, Homo sapiens
aauauacuucca

SEQ ID NO: 821062 - RNA, 13 nt, Homo sapiens
aauauauaauuga

SEQ ID NO: 821063 - RNA, 21 nt, Homo sapiens
aauauauaguccagacacuua

SEQ ID NO: 821064 - RNA, 15 nt, Homo sapiens
aauauauucaguaau

SEQ ID NO: 821065 - RNA, 18 nt, Homo sapiens
aauauauuucagacauuu

SEQ ID NO: 821066 - RNA, 23 nt, Homo sapiens
aauauauuuuaaguaucagaggu

SEQ ID NO: 821067 - RNA, 15 nt, Homo sapiens
aauauauuuugccau

SEQ ID NO: 821068 - RNA, 15 nt, Homo sapiens
aauaucaguuacuca

SEQ ID NO: 821069 - RNA, 17 nt, Homo sapiens
aauaucauaaagcauuu

SEQ ID NO: 821070 - RNA, 12 nt, Homo sapiens
aauaucauguua

SEQ ID NO: 821071 - RNA, 14 nt, Homo sapiens
aauauccaagacuu

SEQ ID NO: 821072 - RNA, 22 nt, Homo sapiens
aauauccagccucccacaagaa

SEQ ID NO: 821073 - RNA, 12 nt, Homo sapiens
aauauccauuua

SEQ ID NO: 821074 - RNA, 17 nt, Homo sapiens
aauauccuccaaugugu

SEQ ID NO: 821075 - RNA, 22 nt, Homo sapiens
aauaucugaggaugaccagaaa

SEQ ID NO: 821076 - RNA, 17 nt, Homo sapiens
aauaugaagaccaaaug

SEQ ID NO: 821077 - RNA, 21 nt, Homo sapiens
aauaugaguaauacaucaaag

SEQ ID NO: 821078 - RNA, 17 nt, Homo sapiens
aauaugaguuacugaag

SEQ ID NO: 821079 - RNA, 17 nt, Homo sapiens
aauaugauacucucaga

SEQ ID NO: 821080 - RNA, 18 nt, Homo sapiens
aauauggguugcauuugg

SEQ ID NO: 821081 - RNA, 17 nt, Homo sapiens
aauauguagcucauccu

SEQ ID NO: 821082 - RNA, 22 nt, Homo sapiens
aauauuaaggaaaaaagcaagu

SEQ ID NO: 821083 - RNA, 13 nt, Homo sapiens
aauauuacucuca

SEQ ID NO: 821084 - RNA, 18 nt, Homo sapiens
aauauuagaagccugcag

SEQ ID NO: 821085 - RNA, 22 nt, Homo sapiens
aauauuagugauucugauuuca

SEQ ID NO: 821086 - RNA, 18 nt, Homo sapiens
aauauuauuuauuuaacu

SEQ ID NO: 821087 - RNA, 17 nt, Homo sapiens
aauauucaaugaacuuc

SEQ ID NO: 821088 - RNA, 19 nt, Homo sapiens
aauauucaaugaacuucca

SEQ ID NO: 821089 - RNA, 15 nt, Homo sapiens
aauauuccuaacuua

SEQ ID NO: 821090 - RNA, 14 nt, Homo sapiens
aauauucuacacau

SEQ ID NO: 821091 - RNA, 19 nt, Homo sapiens
aauauucuauaugaauuua

SEQ ID NO: 821092 - RNA, 20 nt, Homo sapiens
aauauugaaguuguuuauca

SEQ ID NO: 821093 - RNA, 23 nt, Homo sapiens
aauauuguucuauuuguauauau

SEQ ID NO: 821094 - RNA, 13 nt, Homo sapiens
aauauuguugaca

SEQ ID NO: 821095 - RNA, 14 nt, Homo sapiens
aauauuuaagugaa

SEQ ID NO: 821096 - RNA, 19 nt, Homo sapiens
aauauuucugauacugcug

SEQ ID NO: 821097 - RNA, 22 nt, Homo sapiens
aauauuucugauacugcugagu

SEQ ID NO: 821098 - RNA, 17 nt, Homo sapiens
aauauuuuacaguuuuu

SEQ ID NO: 821099 - RNA, 23 nt, Homo sapiens
aauauuuucauacagcauuacaa

SEQ ID NO: 821100 - RNA, 17 nt, Homo sapiens
aauauuuugcacaguua

SEQ ID NO: 821101 - RNA, 22 nt, Homo sapiens
aauauuuuuauauuuccuuuau

SEQ ID NO: 821102 - RNA, 18 nt, Homo sapiens
aauauuuuucaugcuauc

SEQ ID NO: 821103 - RNA, 18 nt, Homo sapiens
aauauuuuuccacuuaaa

SEQ ID NO: 821104 - RNA, 19 nt, Homo sapiens
aauauuuuuguauauacuu

SEQ ID NO: 821105 - RNA, 23 nt, Homo sapiens
aauauuuuuguauuucucuauuu

SEQ ID NO: 821106 - RNA, 20 nt, Homo sapiens
aauauuuuuuauucaguaaa

SEQ ID NO: 821107 - RNA, 21 nt, Homo sapiens
aauauuuuuuucuagcuauaa

SEQ ID NO: 821108 - RNA, 21 nt, Homo sapiens
aaucaaaauugucucuucuga

SEQ ID NO: 821109 - RNA, 15 nt, Homo sapiens
aaucaaagaauuaca

SEQ ID NO: 821110 - RNA, 22 nt, Homo sapiens
aaucaacaaaauggucauccaa

SEQ ID NO: 821111 - RNA, 17 nt, Homo sapiens
aaucaacagcaugucua

SEQ ID NO: 821112 - RNA, 14 nt, Homo sapiens
aaucaagccugauu

SEQ ID NO: 821113 - RNA, 16 nt, Homo sapiens
aaucaagccugauuca

SEQ ID NO: 821114 - RNA, 13 nt, Homo sapiens
aaucaagucucac

SEQ ID NO: 821115 - RNA, 14 nt, Homo sapiens
aaucaaguuccagu

SEQ ID NO: 821116 - RNA, 19 nt, Homo sapiens
aaucaaucauuucuauuaa

SEQ ID NO: 821117 - RNA, 12 nt, Homo sapiens
aaucaaucugca

SEQ ID NO: 821118 - RNA, 20 nt, Homo sapiens
aaucacaaggcaacugugag

SEQ ID NO: 821119 - RNA, 21 nt, Homo sapiens
aaucacagcccucaugaucau

SEQ ID NO: 821120 - RNA, 23 nt, Homo sapiens
aaucacaggacauuaaggaccaa

SEQ ID NO: 821121 - RNA, 14 nt, Homo sapiens
aaucacaucuccag

SEQ ID NO: 821122 - RNA, 21 nt, Homo sapiens
aaucacuaucuuucugauaac

SEQ ID NO: 821123 - RNA, 22 nt, Homo sapiens
aaucacuggauuauaaguucua

SEQ ID NO: 821124 - RNA, 12 nt, Homo sapiens
aaugaccaaaga

SEQ ID NO: 821125 - RNA, 20 nt, Homo sapiens
aaugacuuugaaaaccuggc

SEQ ID NO: 821126 - RNA, 17 nt, Homo sapiens
aaugagaccaaagucca

SEQ ID NO: 821127 - RNA, 23 nt, Homo sapiens
aaugagacccucguggccuuccc

SEQ ID NO: 821128 - RNA, 14 nt, Homo sapiens
aaugagacugacca

SEQ ID NO: 821129 - RNA, 20 nt, Homo sapiens
aaugagaucguuguuuacag

SEQ ID NO: 821130 - RNA, 13 nt, Homo sapiens
aaugagcauguuu

SEQ ID NO: 821131 - RNA, 20 nt, Homo sapiens
aaugaguuuaaugccauaaa

SEQ ID NO: 821132 - RNA, 17 nt, Homo sapiens
aaugauaugaccaaaau

SEQ ID NO: 821133 - RNA, 14 nt, Homo sapiens
aaugaucacauucu

SEQ ID NO: 821134 - RNA, 19 nt, Homo sapiens
aaugaucagaugaacucau

SEQ ID NO: 821135 - RNA, 22 nt, Homo sapiens
aaugauccucccaccucagccu

SEQ ID NO: 821136 - RNA, 19 nt, Homo sapiens
aaugaucucggaugaccaa

SEQ ID NO: 821137 - RNA, 17 nt, Homo sapiens
aaugaugcacacugagg

SEQ ID NO: 821138 - RNA, 16 nt, Homo sapiens
aaugaugccacuuccc

SEQ ID NO: 821139 - RNA, 15 nt, Homo sapiens
aaugaugggacaaua

SEQ ID NO: 821140 - RNA, 18 nt, Homo sapiens
aaugauguuagccugauu

SEQ ID NO: 821141 - RNA, 15 nt, Homo sapiens
aaugauuaaucaaag

SEQ ID NO: 821142 - RNA, 11 nt, Homo sapiens
aaugauuagaa

SEQ ID NO: 821143 - RNA, 14 nt, Homo sapiens
aaugauuauauuca

SEQ ID NO: 821144 - RNA, 22 nt, Homo sapiens
aaugauuuagguacgucaaagc

SEQ ID NO: 821145 - RNA, 15 nt, Homo sapiens
aaugauuugggaaaa

SEQ ID NO: 821146 - RNA, 9 nt, Homo sapiens
aaugcaaaa

SEQ ID NO: 821147 - RNA, 22 nt, Homo sapiens
aaugcaaaagauacggcccaug

SEQ ID NO: 821148 - RNA, 16 nt, Homo sapiens
gggcugagcccuggca

SEQ ID NO: 821149 - RNA, 15 nt, Homo sapiens
gggcugaucucaggg

SEQ ID NO: 821150 - RNA, 19 nt, Homo sapiens
gggcugauuguauuuaccu

SEQ ID NO: 821151 - RNA, 22 nt, Homo sapiens
gggcugcugagggucugggauc

SEQ ID NO: 821152 - RNA, 15 nt, Homo sapiens
gggcuuaccagguga

SEQ ID NO: 821153 - RNA, 22 nt, Homo sapiens
gggcuuaccaggugagaaguga

SEQ ID NO: 821154 - RNA, 21 nt, Homo sapiens
gggcuuaugacugcaccaaca

SEQ ID NO: 821155 - RNA, 20 nt, Homo sapiens
gggcuuuucaaaaucauuua

SEQ ID NO: 821156 - RNA, 13 nt, Homo sapiens
gggcuuuugccac

SEQ ID NO: 821157 - RNA, 22 nt, Homo sapiens
ggggaaauaauaaagaugcucu

SEQ ID NO: 821158 - RNA, 20 nt, Homo sapiens
ggggaagcggcccuaaggga

SEQ ID NO: 821159 - RNA, 15 nt, Homo sapiens
ggggacacggugucc

SEQ ID NO: 821160 - RNA, 22 nt, Homo sapiens
ggggacagcuuccucacacccc

SEQ ID NO: 821161 - RNA, 22 nt, Homo sapiens
ggggaccuuaagugauuugccu

SEQ ID NO: 821162 - RNA, 14 nt, Homo sapiens
ggggacuaacccaa

SEQ ID NO: 821163 - RNA, 17 nt, Homo sapiens
ggggacuaacccaaugc

SEQ ID NO: 821164 - RNA, 17 nt, Homo sapiens
ggggagugggcgcagug

SEQ ID NO: 821165 - RNA, 14 nt, Homo sapiens
ggggaucccucccc

SEQ ID NO: 821166 - RNA, 13 nt, Homo sapiens
ggggaugucccag

SEQ ID NO: 821167 - RNA, 15 nt, Homo sapiens
ggggaugucucucau

SEQ ID NO: 821168 - RNA, 22 nt, Homo sapiens
ggggauuugaagaagaguuucu

SEQ ID NO: 821169 - RNA, 22 nt, Homo sapiens
ggggccagcauacuccgugagg

SEQ ID NO: 821170 - RNA, 20 nt, Homo sapiens
ggggcccaagccccaucuca

SEQ ID NO: 821171 - RNA, 20 nt, Homo sapiens
ggggcccugcaccugugcag

SEQ ID NO: 821172 - RNA, 13 nt, Homo sapiens
ggggccuccagaa

SEQ ID NO: 821173 - RNA, 16 nt, Homo sapiens
ggggcgagcacuguga

SEQ ID NO: 821174 - RNA, 17 nt, Homo sapiens
ggggcgagcacugugag

SEQ ID NO: 821175 - RNA, 13 nt, Homo sapiens
ggggcucucucau

SEQ ID NO: 821176 - RNA, 10 nt, Homo sapiens
ggggcuuccu

SEQ ID NO: 821177 - RNA, 14 nt, Homo sapiens
ggggcuuuugccac

SEQ ID NO: 821178 - RNA, 12 nt, Homo sapiens
gggggaaggugg

SEQ ID NO: 821179 - RNA, 12 nt, Homo sapiens
gggggaccuggg

SEQ ID NO: 821180 - RNA, 17 nt, Homo sapiens
gggggcaggcucugcca

SEQ ID NO: 821181 - RNA, 20 nt, Homo sapiens
gggggcugcagcauguugcu

SEQ ID NO: 821182 - RNA, 23 nt, Homo sapiens
gggguaccuuaagagacacucca

SEQ ID NO: 821183 - RNA, 13 nt, Homo sapiens
ggggugagggagu

SEQ ID NO: 821184 - RNA, 17 nt, Homo sapiens
ggggugccgcuuucucu

SEQ ID NO: 821185 - RNA, 15 nt, Homo sapiens
gggguggaggggugu

SEQ ID NO: 821186 - RNA, 14 nt, Homo sapiens
gggguuaccaugua

SEQ ID NO: 821187 - RNA, 12 nt, Homo sapiens
gggguuccucaa

SEQ ID NO: 821188 - RNA, 19 nt, Homo sapiens
ggguaaccaaauguuggcc

SEQ ID NO: 821189 - RNA, 22 nt, Homo sapiens
ggguaccuuaagagacacucca

SEQ ID NO: 821190 - RNA, 22 nt, Homo sapiens
ggguacuucuugaaggugcuga

SEQ ID NO: 821191 - RNA, 20 nt, Homo sapiens
ggguagaaugauuaaucaaa

SEQ ID NO: 821192 - RNA, 22 nt, Homo sapiens
ggguaggaaagaggaagcaaau

SEQ ID NO: 821193 - RNA, 20 nt, Homo sapiens
gggucaaagugguacaggaa

SEQ ID NO: 821194 - RNA, 16 nt, Homo sapiens
gggucagccauuuuua

SEQ ID NO: 821195 - RNA, 18 nt, Homo sapiens
gggucagcccagcaccug

SEQ ID NO: 821196 - RNA, 14 nt, Homo sapiens
gggucaguaaggaa

SEQ ID NO: 821197 - RNA, 17 nt, Homo sapiens
ggguccacacaucuccc

SEQ ID NO: 821198 - RNA, 13 nt, Homo sapiens
ggguccacagcug

SEQ ID NO: 821199 - RNA, 20 nt, Homo sapiens
ggguccucuagcccacuccc

SEQ ID NO: 821200 - RNA, 20 nt, Homo sapiens
gggucucgcucuguugccca

SEQ ID NO: 821201 - RNA, 21 nt, Homo sapiens
gggucucgcuuuguugcccag

SEQ ID NO: 821202 - RNA, 21 nt, Homo sapiens
gggucucucacuguugcagug

SEQ ID NO: 821203 - RNA, 15 nt, Homo sapiens
gggugaccagccacu

SEQ ID NO: 821204 - RNA, 11 nt, Homo sapiens
gggugagccag

SEQ ID NO: 821205 - RNA, 18 nt, Homo sapiens
gggugagggaucacugcc

SEQ ID NO: 821206 - RNA, 17 nt, Homo sapiens
gggugcagagagaucau

SEQ ID NO: 821207 - RNA, 11 nt, Homo sapiens
gggugcuccug

SEQ ID NO: 821208 - RNA, 17 nt, Homo sapiens
ggguggagcaugggccu

SEQ ID NO: 821209 - RNA, 16 nt, Homo sapiens
ggguggaucaccugag

SEQ ID NO: 821210 - RNA, 21 nt, Homo sapiens
ggguggggaagaagacacaga

SEQ ID NO: 821211 - RNA, 18 nt, Homo sapiens
ggguggggggugacagug

SEQ ID NO: 821212 - RNA, 13 nt, Homo sapiens
gggugggggugga

SEQ ID NO: 821213 - RNA, 15 nt, Homo sapiens
gggugguguccugaa

SEQ ID NO: 821214 - RNA, 17 nt, Homo sapiens
gggugugaacauguucu

SEQ ID NO: 821215 - RNA, 11 nt, Homo sapiens
gggugugcuau

SEQ ID NO: 821216 - RNA, 14 nt, Homo sapiens
gggugugucugcuc

SEQ ID NO: 821217 - RNA, 16 nt, Homo sapiens
ggguuaaaucaaagau

SEQ ID NO: 821218 - RNA, 21 nt, Homo sapiens
ggguuccccaaccaaagacgg

SEQ ID NO: 821219 - RNA, 13 nt, Homo sapiens
ggguuuacuugac

SEQ ID NO: 821220 - RNA, 18 nt, Homo sapiens
ggguuucaccauguuggc

SEQ ID NO: 821221 - RNA, 14 nt, Homo sapiens
ggguuuugcuacau

SEQ ID NO: 821222 - RNA, 17 nt, Homo sapiens
gguaaaaaguggcugcg

SEQ ID NO: 821223 - RNA, 15 nt, Homo sapiens
gguaaaaguuacuua

SEQ ID NO: 821224 - RNA, 22 nt, Homo sapiens
gguaaaaguucuuuuugcucua

SEQ ID NO: 821225 - RNA, 14 nt, Homo sapiens
gguaaauguuaccu

SEQ ID NO: 821226 - RNA, 13 nt, Homo sapiens
gguaaauguuucu

SEQ ID NO: 821227 - RNA, 16 nt, Homo sapiens
gguaacaguggcugcu

SEQ ID NO: 821228 - RNA, 15 nt, Homo sapiens
gguaaggaaagggcu

SEQ ID NO: 821229 - RNA, 12 nt, Homo sapiens
gguaauauaccu

SEQ ID NO: 821230 - RNA, 21 nt, Homo sapiens
gguaauugccuaaaucuccag

SEQ ID NO: 821231 - RNA, 14 nt, Homo sapiens
gguaauuguugcua

SEQ ID NO: 821232 - RNA, 14 nt, Homo sapiens
gguacaaacccaaa

SEQ ID NO: 821233 - RNA, 14 nt, Homo sapiens
gguacaauuguaaa

SEQ ID NO: 821234 - RNA, 21 nt, Homo sapiens
gguacagacacucccacuugg

SEQ ID NO: 821235 - RNA, 18 nt, Homo sapiens
gguacauuuaucacugaa

SEQ ID NO: 821236 - RNA, 16 nt, Homo sapiens
gguacccagccaucug

SEQ ID NO: 821237 - RNA, 20 nt, Homo sapiens
gguaccuucaggcagccagu

SEQ ID NO: 821238 - RNA, 16 nt, Homo sapiens
gguacgaugacagugu

SEQ ID NO: 821239 - RNA, 16 nt, Homo sapiens
gguacugaaagccuua

SEQ ID NO: 821240 - RNA, 22 nt, Homo sapiens
aaugucucaugucaaugaccau

SEQ ID NO: 821241 - RNA, 17 nt, Homo sapiens
aaugucuggucugucca

SEQ ID NO: 821242 - RNA, 17 nt, Homo sapiens
aaugucuuacugugauc

SEQ ID NO: 821243 - RNA, 20 nt, Homo sapiens
aaugugaaacggaagcucau

SEQ ID NO: 821244 - RNA, 23 nt, Homo sapiens
aaugugauuacugcucuauucca

SEQ ID NO: 821245 - RNA, 22 nt, Homo sapiens
aaugugcagggauauugccuua

SEQ ID NO: 821246 - RNA, 15 nt, Homo sapiens
aaugugcucaugcau

SEQ ID NO: 821247 - RNA, 20 nt, Homo sapiens
aauguggccgaggacuuuga

SEQ ID NO: 821248 - RNA, 18 nt, Homo sapiens
aauguggccguguucaaa

SEQ ID NO: 821249 - RNA, 19 nt, Homo sapiens
aaugugguaguacccaggg

SEQ ID NO: 821250 - RNA, 18 nt, Homo sapiens
aaugugguuacuuccuac

SEQ ID NO: 821251 - RNA, 23 nt, Homo sapiens
aauguguauggguuaaaucaaag

SEQ ID NO: 821252 - RNA, 18 nt, Homo sapiens
aaugugugaaguaugcac

SEQ ID NO: 821253 - RNA, 19 nt, Homo sapiens
aaugugugaaguaugcacu

SEQ ID NO: 821254 - RNA, 14 nt, Homo sapiens
aaugugugugccaa

SEQ ID NO: 821255 - RNA, 15 nt, Homo sapiens
aauguguucuuaacu

SEQ ID NO: 821256 - RNA, 18 nt, Homo sapiens
aauguguuucaaaaccau

SEQ ID NO: 821257 - RNA, 15 nt, Homo sapiens
aauguuacauuauua

SEQ ID NO: 821258 - RNA, 13 nt, Homo sapiens
aauguuaccucua

SEQ ID NO: 821259 - RNA, 22 nt, Homo sapiens
aauguuaucggcucuauucucu

SEQ ID NO: 821260 - RNA, 14 nt, Homo sapiens
aauguuauucuguu

SEQ ID NO: 821261 - RNA, 22 nt, Homo sapiens
aauguuauuuuuuaauuauuau

SEQ ID NO: 821262 - RNA, 15 nt, Homo sapiens
aauguucauggacua

SEQ ID NO: 821263 - RNA, 20 nt, Homo sapiens
aauguucccaaguaggcauu

SEQ ID NO: 821264 - RNA, 15 nt, Homo sapiens
ggucauagcauucac

SEQ ID NO: 821265 - RNA, 17 nt, Homo sapiens
ggucauccaaacucaaa

SEQ ID NO: 821266 - RNA, 19 nt, Homo sapiens
ggucaugacaagaugggac

SEQ ID NO: 821267 - RNA, 21 nt, Homo sapiens
ggucaugcccgucgauguuuu

SEQ ID NO: 821268 - RNA, 12 nt, Homo sapiens
ggucaugugcau

SEQ ID NO: 821269 - RNA, 11 nt, Homo sapiens
gguccacagag

SEQ ID NO: 821270 - RNA, 15 nt, Homo sapiens
gguccacagcuggaa

SEQ ID NO: 821271 - RNA, 12 nt, Homo sapiens
gguccauaacag

SEQ ID NO: 821272 - RNA, 19 nt, Homo sapiens
ggucccaggcagagaauca

SEQ ID NO: 821273 - RNA, 21 nt, Homo sapiens
ggucccauggguuaagagcuc

SEQ ID NO: 821274 - RNA, 14 nt, Homo sapiens
ggucccccaugcca

SEQ ID NO: 821275 - RNA, 13 nt, Homo sapiens
ggucccugagcuc

SEQ ID NO: 821276 - RNA, 17 nt, Homo sapiens
ggucccuuggucaggag

SEQ ID NO: 821277 - RNA, 22 nt, Homo sapiens
gguccucccucccaaggagcca

SEQ ID NO: 821278 - RNA, 16 nt, Homo sapiens
gguccuccugugcuau

SEQ ID NO: 821279 - RNA, 18 nt, Homo sapiens
gguccucuagcccacucc

SEQ ID NO: 821280 - RNA, 16 nt, Homo sapiens
gguccuggugggucag

SEQ ID NO: 821281 - RNA, 23 nt, Homo sapiens
gguccuugaugccagagggccag

SEQ ID NO: 821282 - RNA, 15 nt, Homo sapiens
gguccuuuucagagu

SEQ ID NO: 821283 - RNA, 22 nt, Homo sapiens
ggucgcccuuucuuaccaucug

SEQ ID NO: 821284 - RNA, 16 nt, Homo sapiens
ggucuacucuagaaga

SEQ ID NO: 821285 - RNA, 21 nt, Homo sapiens
ggucuagucacgcaugcagug

SEQ ID NO: 821286 - RNA, 19 nt, Homo sapiens
ggucuccaagggagggugc

SEQ ID NO: 821287 - RNA, 17 nt, Homo sapiens
ggucuccggggaggcag

SEQ ID NO: 821288 - RNA, 16 nt, Homo sapiens
ggucuccuugcacuuu

SEQ ID NO: 821289 - RNA, 21 nt, Homo sapiens
ggucuccuuggcugucugugg

SEQ ID NO: 821290 - RNA, 14 nt, Homo sapiens
ggucucucgcugug

SEQ ID NO: 821291 - RNA, 19 nt, Homo sapiens
ggucucugggcacaguggg

SEQ ID NO: 821292 - RNA, 22 nt, Homo sapiens
ggucugacaccaaaacaugccg

SEQ ID NO: 821293 - RNA, 19 nt, Homo sapiens
ggucugggcaccaccucug

SEQ ID NO: 821294 - RNA, 15 nt, Homo sapiens
ggucuggugcugagg

SEQ ID NO: 821295 - RNA, 18 nt, Homo sapiens
ggucugguuguugcacca

SEQ ID NO: 821296 - RNA, 13 nt, Homo sapiens
ggucuugacucau

SEQ ID NO: 821297 - RNA, 18 nt, Homo sapiens
ggugaaaccucaucucua

SEQ ID NO: 821298 - RNA, 15 nt, Homo sapiens
ggugaacacugugac

SEQ ID NO: 821299 - RNA, 13 nt, Homo sapiens
ggugaaccaaaga

SEQ ID NO: 821300 - RNA, 19 nt, Homo sapiens
ggugaagggagagccagcu

SEQ ID NO: 821301 - RNA, 16 nt, Homo sapiens
ggugacauuguggacu

SEQ ID NO: 821302 - RNA, 14 nt, Homo sapiens
ggugaccacaccuu

SEQ ID NO: 821303 - RNA, 16 nt, Homo sapiens
ggugaccagccacuca

SEQ ID NO: 821304 - RNA, 22 nt, Homo sapiens
ggugagaaauuugccuuguuca

SEQ ID NO: 821305 - RNA, 14 nt, Homo sapiens
ggugaggcaauaaa

SEQ ID NO: 821306 - RNA, 18 nt, Homo sapiens
ggugcaaauccuacugaa

SEQ ID NO: 821307 - RNA, 10 nt, Homo sapiens
ggugcacagc

SEQ ID NO: 821308 - RNA, 17 nt, Homo sapiens
ggugcacagccacuccc

SEQ ID NO: 821309 - RNA, 18 nt, Homo sapiens
ggugcagaccuuggggga

SEQ ID NO: 821310 - RNA, 12 nt, Homo sapiens
ggugcauauacg

SEQ ID NO: 821311 - RNA, 19 nt, Homo sapiens
ggugcaugggcucgccgug

SEQ ID NO: 821312 - RNA, 14 nt, Homo sapiens
ggugcccaccugug

SEQ ID NO: 821313 - RNA, 18 nt, Homo sapiens
ggugcccucuccaaaggc

SEQ ID NO: 821314 - RNA, 18 nt, Homo sapiens
ggugccgcugucucugag

SEQ ID NO: 821315 - RNA, 16 nt, Homo sapiens
ggugccucugugcaca

SEQ ID NO: 821316 - RNA, 12 nt, Homo sapiens
ggugcucacucc

SEQ ID NO: 821317 - RNA, 14 nt, Homo sapiens
ggugcuucucacca

SEQ ID NO: 821318 - RNA, 12 nt, Homo sapiens
gguggagccaag

SEQ ID NO: 821319 - RNA, 13 nt, Homo sapiens
gguggagggcaca

SEQ ID NO: 821320 - RNA, 19 nt, Homo sapiens
gguggagggcacagcccuc

SEQ ID NO: 821321 - RNA, 14 nt, Homo sapiens
gguggaugaucuca

SEQ ID NO: 821322 - RNA, 12 nt, Homo sapiens
gguggcacgugc

SEQ ID NO: 821323 - RNA, 22 nt, Homo sapiens
gguggcccuaaaggacucucca

SEQ ID NO: 821324 - RNA, 19 nt, Homo sapiens
gguggcccuugcaguucag

SEQ ID NO: 821325 - RNA, 15 nt, Homo sapiens
gguggcgggcaccug

SEQ ID NO: 821326 - RNA, 22 nt, Homo sapiens
ggugggcccucugaacuugccu

SEQ ID NO: 821327 - RNA, 19 nt, Homo sapiens
ggugggcugucacugcuug

SEQ ID NO: 821328 - RNA, 13 nt, Homo sapiens
gguggggggucca

SEQ ID NO: 821329 - RNA, 23 nt, Homo sapiens
ggugggggugccgcugucucuga

SEQ ID NO: 821330 - RNA, 11 nt, Homo sapiens
ggugggguccu

SEQ ID NO: 821331 - RNA, 15 nt, Homo sapiens
gguggggugcacucg

SEQ ID NO: 821332 - RNA, 14 nt, Homo sapiens
gguggguguggcca

SEQ ID NO: 821333 - RNA, 19 nt, Homo sapiens
gguggguguggccagcaca

SEQ ID NO: 821334 - RNA, 15 nt, Homo sapiens
ggugggugugggaca

SEQ ID NO: 821335 - RNA, 24 nt, Homo sapiens
gguguagaugggggaacugugaau

SEQ ID NO: 821336 - RNA, 17 nt, Homo sapiens
ggugucagucagggaca

SEQ ID NO: 821337 - RNA, 19 nt, Homo sapiens
ggugucuuggcacuguuag

SEQ ID NO: 821338 - RNA, 17 nt, Homo sapiens
ggugugcccuguacaca

SEQ ID NO: 821339 - RNA, 21 nt, Homo sapiens
gguguuccuagaaugcagcug

SEQ ID NO: 821340 - RNA, 15 nt, Homo sapiens
gguguuugucugugu

SEQ ID NO: 821341 - RNA, 14 nt, Homo sapiens
gguuaaaaaggcca

SEQ ID NO: 821342 - RNA, 15 nt, Homo sapiens
gguuaaaucaaagau

SEQ ID NO: 821343 - RNA, 24 nt, Homo sapiens
gguuaacaaaugagccauccccag

SEQ ID NO: 821344 - RNA, 16 nt, Homo sapiens
gguuaacuuggucaga

SEQ ID NO: 821345 - RNA, 17 nt, Homo sapiens
gguuaagaaagcacuua

SEQ ID NO: 821346 - RNA, 19 nt, Homo sapiens
gguuaaguuucucuucacc

SEQ ID NO: 821347 - RNA, 13 nt, Homo sapiens
gguuaauguaaua

SEQ ID NO: 821348 - RNA, 17 nt, Homo sapiens
gguuaauuucugucaaa

SEQ ID NO: 821349 - RNA, 18 nt, Homo sapiens
gguuaccaccagccuuuc

SEQ ID NO: 821350 - RNA, 18 nt, Homo sapiens
gguuaucaaaaauuucau

SEQ ID NO: 821351 - RNA, 14 nt, Homo sapiens
gguuauuucaauuc

SEQ ID NO: 821352 - RNA, 22 nt, Homo sapiens
gguuauuucagcccccaucacc

SEQ ID NO: 821353 - RNA, 13 nt, Homo sapiens
gguucaagugcuu

SEQ ID NO: 821354 - RNA, 11 nt, Homo sapiens
gguucacacag

SEQ ID NO: 821355 - RNA, 18 nt, Homo sapiens
gugaagugguacaaucug

SEQ ID NO: 821356 - RNA, 16 nt, Homo sapiens
gugaaguugugcaacg

SEQ ID NO: 821357 - RNA, 19 nt, Homo sapiens
gugaaguuuaauugucuca

SEQ ID NO: 821358 - RNA, 16 nt, Homo sapiens
gugaaguuuugcaaau

SEQ ID NO: 821359 - RNA, 17 nt, Homo sapiens
gugaauaacuaugccag

SEQ ID NO: 821360 - RNA, 22 nt, Homo sapiens
gugaauacugcuacagcaauuu

SEQ ID NO: 821361 - RNA, 22 nt, Homo sapiens
gugaauacuuacuauaauuuga

SEQ ID NO: 821362 - RNA, 20 nt, Homo sapiens
gugaauacuugaacucuguu

SEQ ID NO: 821363 - RNA, 14 nt, Homo sapiens
gugaauccugugca

SEQ ID NO: 821364 - RNA, 15 nt, Homo sapiens
gugaaugaaucucaa

SEQ ID NO: 821365 - RNA, 13 nt, Homo sapiens
gugaaugaucucu

SEQ ID NO: 821366 - RNA, 13 nt, Homo sapiens
gugaaugccauuu

SEQ ID NO: 821367 - RNA, 17 nt, Homo sapiens
gugaauguuuaccauga

SEQ ID NO: 821368 - RNA, 21 nt, Homo sapiens
gugaauuaggcuguaacuacu

SEQ ID NO: 821369 - RNA, 22 nt, Homo sapiens
gugaauuuuccaagaacauagu

SEQ ID NO: 821370 - RNA, 15 nt, Homo sapiens
gugacaaacuggcag

SEQ ID NO: 821371 - RNA, 23 nt, Homo sapiens
gugacaagaauaauuuuggaaua

SEQ ID NO: 821372 - RNA, 18 nt, Homo sapiens
gugacagcuuucugggau

SEQ ID NO: 821373 - RNA, 23 nt, Homo sapiens
gugacagcuuucugggaugucac

SEQ ID NO: 821374 - RNA, 14 nt, Homo sapiens
gugacagugccugg

SEQ ID NO: 821375 - RNA, 16 nt, Homo sapiens
gugaccaauacauuug

SEQ ID NO: 821376 - RNA, 11 nt, Homo sapiens
gugaccagcac

SEQ ID NO: 821377 - RNA, 19 nt, Homo sapiens
gugacccugagaaggcaaa

SEQ ID NO: 821378 - RNA, 20 nt, Homo sapiens
gugacccuucagggccagaa

SEQ ID NO: 821379 - RNA, 14 nt, Homo sapiens
gugaccuccacagc

SEQ ID NO: 821380 - RNA, 16 nt, Homo sapiens
gugaccucucucucug

SEQ ID NO: 821381 - RNA, 19 nt, Homo sapiens
gugaccuggaaucagugaa

SEQ ID NO: 821382 - RNA, 15 nt, Homo sapiens
gugaccuugcaaugu

SEQ ID NO: 821383 - RNA, 12 nt, Homo sapiens
gugacugcaaua

SEQ ID NO: 821384 - RNA, 16 nt, Homo sapiens
acagucguucccagug

SEQ ID NO: 821385 - RNA, 21 nt, Homo sapiens
acagucuacauugagcauuug

SEQ ID NO: 821386 - RNA, 18 nt, Homo sapiens
acagucugagacuccuca

SEQ ID NO: 821387 - RNA, 19 nt, Homo sapiens
acagucuggagaagguauu

SEQ ID NO: 821388 - RNA, 18 nt, Homo sapiens
acagugaagcagcacugu

SEQ ID NO: 821389 - RNA, 14 nt, Homo sapiens
acagugacacugga

SEQ ID NO: 821390 - RNA, 15 nt, Homo sapiens
acagugacacuggac

SEQ ID NO: 821391 - RNA, 16 nt, Homo sapiens
acagugagaaaccaua

SEQ ID NO: 821392 - RNA, 17 nt, Homo sapiens
acagugaugaauguacu

SEQ ID NO: 821393 - RNA, 16 nt, Homo sapiens
acagugaugauugaau

SEQ ID NO: 821394 - RNA, 21 nt, Homo sapiens
acagugaugcugugcuaugaa

SEQ ID NO: 821395 - RNA, 13 nt, Homo sapiens
acagugcagacag

SEQ ID NO: 821396 - RNA, 21 nt, Homo sapiens
acagugccauccccaccuuca

SEQ ID NO: 821397 - RNA, 18 nt, Homo sapiens
acagugccgacagcucuc

SEQ ID NO: 821398 - RNA, 20 nt, Homo sapiens
acagugccgacagcucucca

SEQ ID NO: 821399 - RNA, 11 nt, Homo sapiens
acaguggaauc

SEQ ID NO: 821400 - RNA, 18 nt, Homo sapiens
acaguggacucagcagug

SEQ ID NO: 821401 - RNA, 22 nt, Homo sapiens
acaguggaggaagagggacaga

SEQ ID NO: 821402 - RNA, 13 nt, Homo sapiens
acagugucacugg

SEQ ID NO: 821403 - RNA, 19 nt, Homo sapiens
acaguguugaaaauguuca

SEQ ID NO: 821404 - RNA, 14 nt, Homo sapiens
acaguuacagagug

SEQ ID NO: 821405 - RNA, 16 nt, Homo sapiens
acaguuaucacacuuu

SEQ ID NO: 821406 - RNA, 21 nt, Homo sapiens
acaguuauugcaagaguuuaa

SEQ ID NO: 821407 - RNA, 20 nt, Homo sapiens
acaguucagaccaaugcuca

SEQ ID NO: 821408 - RNA, 14 nt, Homo sapiens
acaguucugaagaa

SEQ ID NO: 821409 - RNA, 16 nt, Homo sapiens
acaguugcagcccuug

SEQ ID NO: 821410 - RNA, 20 nt, Homo sapiens
acaguuuagugcuuuacaug

SEQ ID NO: 821411 - RNA, 23 nt, Homo sapiens
acaguuuauuuuuauacuuucag

SEQ ID NO: 821412 - RNA, 21 nt, Homo sapiens
acaguuuccaaauugcccuau

SEQ ID NO: 821413 - RNA, 18 nt, Homo sapiens
acaguuuuaacuguggau

SEQ ID NO: 821414 - RNA, 23 nt, Homo sapiens
acauaaaaaauaaaguaccacac

SEQ ID NO: 821415 - RNA, 17 nt, Homo sapiens
acauaaaauaagagauc

SEQ ID NO: 821416 - RNA, 15 nt, Homo sapiens
acauaacaugcuuua

SEQ ID NO: 821417 - RNA, 13 nt, Homo sapiens
acauaagaaggca

SEQ ID NO: 821418 - RNA, 18 nt, Homo sapiens
acauaagcagcauuucau

SEQ ID NO: 821419 - RNA, 13 nt, Homo sapiens
acauaauguauca

SEQ ID NO: 821420 - RNA, 13 nt, Homo sapiens
acauaauugugac

SEQ ID NO: 821421 - RNA, 13 nt, Homo sapiens
acauacaaaauaa

SEQ ID NO: 821422 - RNA, 15 nt, Homo sapiens
acauacaucuaaguc

SEQ ID NO: 821423 - RNA, 16 nt, Homo sapiens
acauaccuucaugugg

SEQ ID NO: 821424 - RNA, 14 nt, Homo sapiens
acauacgugcacag

SEQ ID NO: 821425 - RNA, 17 nt, Homo sapiens
acauacgugcacagggu

SEQ ID NO: 821426 - RNA, 14 nt, Homo sapiens
acauacuccaacug

SEQ ID NO: 821427 - RNA, 19 nt, Homo sapiens
acauacuccuuccaucaaa

SEQ ID NO: 821428 - RNA, 15 nt, Homo sapiens
acauacuuaaugcau

SEQ ID NO: 821429 - RNA, 17 nt, Homo sapiens
acauacuucuuacuugu

SEQ ID NO: 821430 - RNA, 23 nt, Homo sapiens
acauagaaauggaaauuuugcua

SEQ ID NO: 821431 - RNA, 15 nt, Homo sapiens
acauagaagagccaa

SEQ ID NO: 821432 - RNA, 13 nt, Homo sapiens
acauagagaucua

SEQ ID NO: 821433 - RNA, 13 nt, Homo sapiens
acauagcaucuca

SEQ ID NO: 821434 - RNA, 13 nt, Homo sapiens
acauagccaacuc

SEQ ID NO: 821435 - RNA, 15 nt, Homo sapiens
acauagccucaccaa

SEQ ID NO: 821436 - RNA, 16 nt, Homo sapiens
acauaggaagggaucu

SEQ ID NO: 821437 - RNA, 19 nt, Homo sapiens
acauauagcagaccaaucu

SEQ ID NO: 821438 - RNA, 16 nt, Homo sapiens
acauauauaugucagg

SEQ ID NO: 821439 - RNA, 22 nt, Homo sapiens
acauauccuuucaagacagaaa

SEQ ID NO: 821440 - RNA, 12 nt, Homo sapiens
acauaugcauuu

SEQ ID NO: 821441 - RNA, 16 nt, Homo sapiens
acauauggacucugca

SEQ ID NO: 821442 - RNA, 18 nt, Homo sapiens
acauauguauacaugugc

SEQ ID NO: 821443 - RNA, 14 nt, Homo sapiens
acauauuacuguug

SEQ ID NO: 821444 - RNA, 20 nt, Homo sapiens
acauauuacuguugcauuua

SEQ ID NO: 821445 - RNA, 17 nt, Homo sapiens
acauauuaggaaaauau

SEQ ID NO: 821446 - RNA, 22 nt, Homo sapiens
acauauuaggaaaauauggguu

SEQ ID NO: 821447 - RNA, 14 nt, Homo sapiens
acauauuaucucau

SEQ ID NO: 821448 - RNA, 12 nt, Homo sapiens
acauauuuuaga

SEQ ID NO: 821449 - RNA, 15 nt, Homo sapiens
acauauuuuuauacu

SEQ ID NO: 821450 - RNA, 20 nt, Homo sapiens
acaucaaaacuaaccaucug

SEQ ID NO: 821451 - RNA, 17 nt, Homo sapiens
acaucaaagagcacauu

SEQ ID NO: 821452 - RNA, 19 nt, Homo sapiens
acaucacugucuugccaga

SEQ ID NO: 821453 - RNA, 15 nt, Homo sapiens
acaucauaacccaug

SEQ ID NO: 821454 - RNA, 17 nt, Homo sapiens
acaucauaauuacauuc

SEQ ID NO: 821455 - RNA, 21 nt, Homo sapiens
acaucauuacuuaugaugaug

SEQ ID NO: 821456 - RNA, 21 nt, Homo sapiens
acauccaaccccccaccugcc

SEQ ID NO: 821457 - RNA, 22 nt, Homo sapiens
acauccaaccccccaccugcca

SEQ ID NO: 821458 - RNA, 16 nt, Homo sapiens
acauccaacuccagca

SEQ ID NO: 821459 - RNA, 15 nt, Homo sapiens
acauccaagccagag

SEQ ID NO: 821460 - RNA, 18 nt, Homo sapiens
acauccagcagauuucca

SEQ ID NO: 821461 - RNA, 22 nt, Homo sapiens
acauccccagagcccagcucuu

SEQ ID NO: 821462 - RNA, 16 nt, Homo sapiens
acaucccggcacuguu

SEQ ID NO: 821463 - RNA, 21 nt, Homo sapiens
acauccguugugcuugccugc

SEQ ID NO: 821464 - RNA, 17 nt, Homo sapiens
acauccuuaagucaaaa

SEQ ID NO: 821465 - RNA, 13 nt, Homo sapiens
acaucuaacucau

SEQ ID NO: 821466 - RNA, 18 nt, Homo sapiens
acaucuaguaggugcuug

SEQ ID NO: 821467 - RNA, 20 nt, Homo sapiens
acaucuauugcagagacuca

SEQ ID NO: 821468 - RNA, 12 nt, Homo sapiens
acaucucagaaa

SEQ ID NO: 821469 - RNA, 19 nt, Homo sapiens
acaucucagaaaacucugg

SEQ ID NO: 821470 - RNA, 18 nt, Homo sapiens
guguccuccccucaagga

SEQ ID NO: 821471 - RNA, 19 nt, Homo sapiens
guguccugaagcugcugga

SEQ ID NO: 821472 - RNA, 21 nt, Homo sapiens
guguccuguccuuucuugcag

SEQ ID NO: 821473 - RNA, 15 nt, Homo sapiens
gugucucugccaugu

SEQ ID NO: 821474 - RNA, 17 nt, Homo sapiens
gugucugggauaaccuc

SEQ ID NO: 821475 - RNA, 13 nt, Homo sapiens
gugucugggguga

SEQ ID NO: 821476 - RNA, 15 nt, Homo sapiens
gugucuuaauuauua

SEQ ID NO: 821477 - RNA, 18 nt, Homo sapiens
gugucuuucacagcuccu

SEQ ID NO: 821478 - RNA, 16 nt, Homo sapiens
gugucuuuggugggga

SEQ ID NO: 821479 - RNA, 13 nt, Homo sapiens
gugucuuuugaca

SEQ ID NO: 821480 - RNA, 21 nt, Homo sapiens
gugugaacucaccaaacacaa

SEQ ID NO: 821481 - RNA, 17 nt, Homo sapiens
gugugacagacuccgaa

SEQ ID NO: 821482 - RNA, 18 nt, Homo sapiens
gugugauuuccuacagaa

SEQ ID NO: 821483 - RNA, 21 nt, Homo sapiens
gugugcaacagacaagugacu

SEQ ID NO: 821484 - RNA, 16 nt, Homo sapiens
gugugcauguguguaa

SEQ ID NO: 821485 - RNA, 23 nt, Homo sapiens
gugugcuuauuuuaaauguuacu

SEQ ID NO: 821486 - RNA, 22 nt, Homo sapiens
guguggacuguggcacuugccu

SEQ ID NO: 821487 - RNA, 12 nt, Homo sapiens
guguggcccaag

SEQ ID NO: 821488 - RNA, 19 nt, Homo sapiens
gugugggcugugaguguaa

SEQ ID NO: 821489 - RNA, 14 nt, Homo sapiens
gugugguugcucac

SEQ ID NO: 821490 - RNA, 22 nt, Homo sapiens
guguguauauaaauacaugcac

SEQ ID NO: 821491 - RNA, 21 nt, Homo sapiens
guguguauauaguaugaaugc

SEQ ID NO: 821492 - RNA, 17 nt, Homo sapiens
guguguauuuguauuaa

SEQ ID NO: 821493 - RNA, 21 nt, Homo sapiens
gugugucaggcccucugccug

SEQ ID NO: 821494 - RNA, 18 nt, Homo sapiens
gugugucgcgcacacagc

SEQ ID NO: 821495 - RNA, 17 nt, Homo sapiens
gugugugacacugauga

SEQ ID NO: 821496 - RNA, 19 nt, Homo sapiens
gugugugggaguguguaau

SEQ ID NO: 821497 - RNA, 13 nt, Homo sapiens
gugugugugauau

SEQ ID NO: 821498 - RNA, 14 nt, Homo sapiens
gugugugugcacau

SEQ ID NO: 821499 - RNA, 13 nt, Homo sapiens
guguguguguaug

SEQ ID NO: 821500 - RNA, 15 nt, Homo sapiens
guguguucucaguga

SEQ ID NO: 821501 - RNA, 13 nt, Homo sapiens
guguguuguuaca

SEQ ID NO: 821502 - RNA, 13 nt, Homo sapiens
accacagugucug

SEQ ID NO: 821503 - RNA, 15 nt, Homo sapiens
accacagugucugua

SEQ ID NO: 821504 - RNA, 21 nt, Homo sapiens
accacauccuaccuagggaca

SEQ ID NO: 821505 - RNA, 10 nt, Homo sapiens
accacccacc

SEQ ID NO: 821506 - RNA, 19 nt, Homo sapiens
accaccgaaucccuagucc

SEQ ID NO: 821507 - RNA, 13 nt, Homo sapiens
accaccucagaaa

SEQ ID NO: 821508 - RNA, 16 nt, Homo sapiens
accaccucugugggca

SEQ ID NO: 821509 - RNA, 17 nt, Homo sapiens
accaccuucuucuccua

SEQ ID NO: 821510 - RNA, 23 nt, Homo sapiens
accacuacaugcagcccaugccc

SEQ ID NO: 821511 - RNA, 16 nt, Homo sapiens
accacuaccagccagc

SEQ ID NO: 821512 - RNA, 23 nt, Homo sapiens
accacuagaaagugggcuuaaug

SEQ ID NO: 821513 - RNA, 18 nt, Homo sapiens
accacuagaacucuccau

SEQ ID NO: 821514 - RNA, 21 nt, Homo sapiens
accacucaggccaacaagcca

SEQ ID NO: 821515 - RNA, 23 nt, Homo sapiens
accacucaggccaacaagccaac

SEQ ID NO: 821516 - RNA, 13 nt, Homo sapiens
accacucaguuaa

SEQ ID NO: 821517 - RNA, 15 nt, Homo sapiens
accacuccacuggcc

SEQ ID NO: 821518 - RNA, 17 nt, Homo sapiens
accacugaaaaaauaua

SEQ ID NO: 821519 - RNA, 16 nt, Homo sapiens
accacugaauucacuc

SEQ ID NO: 821520 - RNA, 11 nt, Homo sapiens
accacugccug

SEQ ID NO: 821521 - RNA, 19 nt, Homo sapiens
accacuggccaccaggcug

SEQ ID NO: 821522 - RNA, 23 nt, Homo sapiens
accacugguuaaaauaaagccua

SEQ ID NO: 821523 - RNA, 13 nt, Homo sapiens
accacugucucca

SEQ ID NO: 821524 - RNA, 15 nt, Homo sapiens
accacuucuccaugc

SEQ ID NO: 821525 - RNA, 15 nt, Homo sapiens
accagacacccagga

SEQ ID NO: 821526 - RNA, 16 nt, Homo sapiens
accagacacguacaaa

SEQ ID NO: 821527 - RNA, 21 nt, Homo sapiens
accagagccuucaagugccaa

SEQ ID NO: 821528 - RNA, 13 nt, Homo sapiens
accagagcugccg

SEQ ID NO: 821529 - RNA, 17 nt, Homo sapiens
accagaggaaacuugca

SEQ ID NO: 821530 - RNA, 20 nt, Homo sapiens
accagaugaaauaauguucu

SEQ ID NO: 821531 - RNA, 12 nt, Homo sapiens
accagauuuacu

SEQ ID NO: 821532 - RNA, 12 nt, Homo sapiens
accagauuugcu

SEQ ID NO: 821533 - RNA, 20 nt, Homo sapiens
accagcaggauggcaggggc

SEQ ID NO: 821534 - RNA, 16 nt, Homo sapiens
accagcauacccuuac

SEQ ID NO: 821535 - RNA, 17 nt, Homo sapiens
accagccguauuuuaca

SEQ ID NO: 821536 - RNA, 17 nt, Homo sapiens
accagccuaagaagcuc

SEQ ID NO: 821537 - RNA, 17 nt, Homo sapiens
accagccugcacuacuc

SEQ ID NO: 821538 - RNA, 16 nt, Homo sapiens
accagcggcugcucaa

SEQ ID NO: 821539 - RNA, 21 nt, Homo sapiens
accagcuucugauaaacacaa

SEQ ID NO: 821540 - RNA, 22 nt, Homo sapiens
accaggaaggaagcuguugcuu

SEQ ID NO: 821541 - RNA, 20 nt, Homo sapiens
accaggaccaguucacuugc

SEQ ID NO: 821542 - RNA, 16 nt, Homo sapiens
accaggagacagacag

SEQ ID NO: 821543 - RNA, 17 nt, Homo sapiens
accaggagcuagcccag

SEQ ID NO: 821544 - RNA, 22 nt, Homo sapiens
accaggcaccucuuccuugaug

SEQ ID NO: 821545 - RNA, 14 nt, Homo sapiens
accaggccacuugc

SEQ ID NO: 821546 - RNA, 14 nt, Homo sapiens
accaggcuuggccu

SEQ ID NO: 821547 - RNA, 17 nt, Homo sapiens
accagggagcaguugcc

SEQ ID NO: 821548 - RNA, 23 nt, Homo sapiens
accaggggaggccugaggcuuca

SEQ ID NO: 821549 - RNA, 21 nt, Homo sapiens
accaggucuuguuucucucuc

SEQ ID NO: 821550 - RNA, 13 nt, Homo sapiens
accaguaugacag

SEQ ID NO: 821551 - RNA, 22 nt, Homo sapiens
accaguccuguuugcagggaag

SEQ ID NO: 821552 - RNA, 22 nt, Homo sapiens
accagucuauuuccacugaaca

SEQ ID NO: 821553 - RNA, 19 nt, Homo sapiens
accagugguuuccagucau

SEQ ID NO: 821554 - RNA, 21 nt, Homo sapiens
accauaagugacaccaauaaa

SEQ ID NO: 821555 - RNA, 13 nt, Homo sapiens
accauaauguuac

SEQ ID NO: 821556 - RNA, 20 nt, Homo sapiens
accauauaccaucuccagcu

SEQ ID NO: 821557 - RNA, 20 nt, Homo sapiens
accauauuuacucuuucuaa

SEQ ID NO: 821558 - RNA, 14 nt, Homo sapiens
accaucauagcuca

SEQ ID NO: 821559 - RNA, 13 nt, Homo sapiens
accaucucuaguu

SEQ ID NO: 821560 - RNA, 20 nt, Homo sapiens
accaucugaagaaacuuccc

SEQ ID NO: 821561 - RNA, 11 nt, Homo sapiens
accaucugcau

SEQ ID NO: 821562 - RNA, 11 nt, Homo sapiens
accaucugucu

SEQ ID NO: 821563 - RNA, 16 nt, Homo sapiens
accaucugucuugcca

SEQ ID NO: 821564 - RNA, 13 nt, Homo sapiens
accaucuuggcca

SEQ ID NO: 821565 - RNA, 21 nt, Homo sapiens
accaugcugcuggggaagaca

SEQ ID NO: 821566 - RNA, 14 nt, Homo sapiens
accauggcacuuaa

SEQ ID NO: 821567 - RNA, 18 nt, Homo sapiens
accaugugccaucuguac

SEQ ID NO: 821568 - RNA, 19 nt, Homo sapiens
accauguggcagaagggau

SEQ ID NO: 821569 - RNA, 19 nt, Homo sapiens
accaugugguucacguaca

SEQ ID NO: 821570 - RNA, 20 nt, Homo sapiens
accauguucauuauaaucuc

SEQ ID NO: 821571 - RNA, 13 nt, Homo sapiens
accauucaaauga

SEQ ID NO: 821572 - RNA, 19 nt, Homo sapiens
accauucagaucacugaau

SEQ ID NO: 821573 - RNA, 21 nt, Homo sapiens
accauucuaccugaggccagg

SEQ ID NO: 821574 - RNA, 17 nt, Homo sapiens
accauugaccucagcug

SEQ ID NO: 821575 - RNA, 14 nt, Homo sapiens
accauuucucagca

SEQ ID NO: 821576 - RNA, 17 nt, Homo sapiens
accauuugacuguucaa

SEQ ID NO: 821577 - RNA, 23 nt, Homo sapiens
accauuugauagggaacugggga

SEQ ID NO: 821578 - RNA, 23 nt, Homo sapiens
accauuuguguuuugaaagccca

SEQ ID NO: 821579 - RNA, 21 nt, Homo sapiens
accauuuuguuauugacuaac

SEQ ID NO: 821580 - RNA, 21 nt, Homo sapiens
accauuuuuuaauuuacuugu

SEQ ID NO: 821581 - RNA, 13 nt, Homo sapiens
acccaaacacuuc

SEQ ID NO: 821582 - RNA, 23 nt, Homo sapiens
acccaacagcagugaucucaggg

SEQ ID NO: 821583 - RNA, 22 nt, Homo sapiens
acccacagacugguuuugcaac

SEQ ID NO: 821584 - RNA, 21 nt, Homo sapiens
acccacaugugacacauaugc

SEQ ID NO: 821585 - RNA, 23 nt, Homo sapiens
ucucccuguuggucgguggguug

SEQ ID NO: 821586 - RNA, 16 nt, Homo sapiens
ucuccgacuuccccug

SEQ ID NO: 821587 - RNA, 16 nt, Homo sapiens
ucuccgagccauguga

SEQ ID NO: 821588 - RNA, 22 nt, Homo sapiens
ucuccuaaaacuuuaaaacuug

SEQ ID NO: 821589 - RNA, 16 nt, Homo sapiens
ucuccuaaagcuuuua

SEQ ID NO: 821590 - RNA, 22 nt, Homo sapiens
ucuccuaacaaaagaacuaaga

SEQ ID NO: 821591 - RNA, 13 nt, Homo sapiens
ucuccuacugagg

SEQ ID NO: 821592 - RNA, 14 nt, Homo sapiens
ucuccuaucuugau

SEQ ID NO: 821593 - RNA, 13 nt, Homo sapiens
ucuccuccagugu

SEQ ID NO: 821594 - RNA, 23 nt, Homo sapiens
ucuccugcgcccuucauugccac

SEQ ID NO: 821595 - RNA, 16 nt, Homo sapiens
ucuccuuaaaaacugg

SEQ ID NO: 821596 - RNA, 18 nt, Homo sapiens
ucuccuuggccacagacu

SEQ ID NO: 821597 - RNA, 17 nt, Homo sapiens
ucuccuuugcacugagg

SEQ ID NO: 821598 - RNA, 20 nt, Homo sapiens
ucuccuuugcucuugccaaa

SEQ ID NO: 821599 - RNA, 14 nt, Homo sapiens
ucuccuuuugacca

SEQ ID NO: 821600 - RNA, 17 nt, Homo sapiens
ucuccuuuugaccaaau

SEQ ID NO: 821601 - RNA, 21 nt, Homo sapiens
ucucgcagcuugaugagcccc

SEQ ID NO: 821602 - RNA, 12 nt, Homo sapiens
ucucgcuuuguu

SEQ ID NO: 821603 - RNA, 14 nt, Homo sapiens
ucucggcacuccca

SEQ ID NO: 821604 - RNA, 13 nt, Homo sapiens
ucucggccuucac

SEQ ID NO: 821605 - RNA, 15 nt, Homo sapiens
ucucgguagcugugc

SEQ ID NO: 821606 - RNA, 15 nt, Homo sapiens
ucucgguuugccaaa

SEQ ID NO: 821607 - RNA, 16 nt, Homo sapiens
ucucguaguccaucac

SEQ ID NO: 821608 - RNA, 15 nt, Homo sapiens
ucucuaaaagcuuua

SEQ ID NO: 821609 - RNA, 16 nt, Homo sapiens
ucucuaaccauucaaa

SEQ ID NO: 821610 - RNA, 16 nt, Homo sapiens
ucucuaacucagaaac

SEQ ID NO: 821611 - RNA, 18 nt, Homo sapiens
ucucuaacuccugccauu

SEQ ID NO: 821612 - RNA, 12 nt, Homo sapiens
ucucuacaagag

SEQ ID NO: 821613 - RNA, 18 nt, Homo sapiens
ucucuacugaaaguacaa

SEQ ID NO: 821614 - RNA, 13 nt, Homo sapiens
ucucuagcacaau

SEQ ID NO: 821615 - RNA, 22 nt, Homo sapiens
ucucuagcacaauuugcacuaa

SEQ ID NO: 821616 - RNA, 22 nt, Homo sapiens
ucucuaggagggagccuuguga

SEQ ID NO: 821617 - RNA, 13 nt, Homo sapiens
ucucuauaccaau

SEQ ID NO: 821618 - RNA, 23 nt, Homo sapiens
ucucuauuugagaaguucucaga

SEQ ID NO: 821619 - RNA, 15 nt, Homo sapiens
ucucucaaaacaaua

SEQ ID NO: 821620 - RNA, 13 nt, Homo sapiens
ucucucaucucuu

SEQ ID NO: 821621 - RNA, 17 nt, Homo sapiens
ucucuccaaaaaugcac

SEQ ID NO: 821622 - RNA, 18 nt, Homo sapiens
ucucucuacagagaggaa

SEQ ID NO: 821623 - RNA, 15 nt, Homo sapiens
ucucucuacugcugg

SEQ ID NO: 821624 - RNA, 16 nt, Homo sapiens
ucucucucucuacaaa

SEQ ID NO: 821625 - RNA, 18 nt, Homo sapiens
ucucucugcaagacagaa

SEQ ID NO: 821626 - RNA, 13 nt, Homo sapiens
ucucucuggcuuc

SEQ ID NO: 821627 - RNA, 16 nt, Homo sapiens
ucucucuucucuccag

SEQ ID NO: 821628 - RNA, 14 nt, Homo sapiens
ucucugaggggugg

SEQ ID NO: 821629 - RNA, 20 nt, Homo sapiens
ucucugaguccuuugcuaau

SEQ ID NO: 821630 - RNA, 19 nt, Homo sapiens
ucucugaguuuaucugugg

SEQ ID NO: 821631 - RNA, 18 nt, Homo sapiens
ucucugcauguguaaaag

SEQ ID NO: 821632 - RNA, 12 nt, Homo sapiens
ucucugcuugcu

SEQ ID NO: 821633 - RNA, 16 nt, Homo sapiens
ucucuggagggacaaa

SEQ ID NO: 821634 - RNA, 22 nt, Homo sapiens
ucucugggggacagcagucucu

SEQ ID NO: 821635 - RNA, 10 nt, Homo sapiens
ucucuguccu

SEQ ID NO: 821636 - RNA, 12 nt, Homo sapiens
ucucugugaauu

SEQ ID NO: 821637 - RNA, 12 nt, Homo sapiens
ucucugugcucu

SEQ ID NO: 821638 - RNA, 14 nt, Homo sapiens
ucucuuaccuguua

SEQ ID NO: 821639 - RNA, 16 nt, Homo sapiens
ucucuuagcaacucag

SEQ ID NO: 821640 - RNA, 17 nt, Homo sapiens
ucucuucagucucuaua

SEQ ID NO: 821641 - RNA, 21 nt, Homo sapiens
ucucuuccgucuaaucucuca

SEQ ID NO: 821642 - RNA, 16 nt, Homo sapiens
ucucuucuaagcaaaa

SEQ ID NO: 821643 - RNA, 14 nt, Homo sapiens
ucucuucugagcua

SEQ ID NO: 821644 - RNA, 16 nt, Homo sapiens
ucucuuggaugcagcu

SEQ ID NO: 821645 - RNA, 21 nt, Homo sapiens
ucucuuucuagaggugcuaca

SEQ ID NO: 821646 - RNA, 12 nt, Homo sapiens
ucucuuuggucu

SEQ ID NO: 821647 - RNA, 20 nt, Homo sapiens
ucugaaaaaguauccugcuu

SEQ ID NO: 821648 - RNA, 18 nt, Homo sapiens
ucugaaaauauucuacug

SEQ ID NO: 821649 - RNA, 14 nt, Homo sapiens
ucugaaaauuccag

SEQ ID NO: 821650 - RNA, 13 nt, Homo sapiens
ucugaaacagaga

SEQ ID NO: 821651 - RNA, 14 nt, Homo sapiens
ucugaaagcuuuau

SEQ ID NO: 821652 - RNA, 15 nt, Homo sapiens
ucugaaaggagacau

SEQ ID NO: 821653 - RNA, 15 nt, Homo sapiens
ucugaaauggaauau

SEQ ID NO: 821654 - RNA, 15 nt, Homo sapiens
ucugaacauucuccu

SEQ ID NO: 821655 - RNA, 18 nt, Homo sapiens
ucugaacucugacagauu

SEQ ID NO: 821656 - RNA, 22 nt, Homo sapiens
ucugaaguagccugaucuuucu

SEQ ID NO: 821657 - RNA, 13 nt, Homo sapiens
ucugaagucacau

SEQ ID NO: 821658 - RNA, 17 nt, Homo sapiens
ucugaagucacugcaca

SEQ ID NO: 821659 - RNA, 13 nt, Homo sapiens
ucugaagugcucu

SEQ ID NO: 821660 - RNA, 14 nt, Homo sapiens
ucugaagugguuug

SEQ ID NO: 821661 - RNA, 19 nt, Homo sapiens
ucugaauccucaugaggcu

SEQ ID NO: 821662 - RNA, 19 nt, Homo sapiens
ucugaauccuuuuaaucua

SEQ ID NO: 821663 - RNA, 19 nt, Homo sapiens
ucugacgcuugugacagug

SEQ ID NO: 821664 - RNA, 20 nt, Homo sapiens
ucuagguuucagcaacaaga

SEQ ID NO: 821665 - RNA, 18 nt, Homo sapiens
ucuaguaagaugcacuga

SEQ ID NO: 821666 - RNA, 19 nt, Homo sapiens
ucuaguaagaugcacugaa

SEQ ID NO: 821667 - RNA, 21 nt, Homo sapiens
ucuagucuccuuugcacugag

SEQ ID NO: 821668 - RNA, 21 nt, Homo sapiens
ucuagugaaugaaucucaaga

SEQ ID NO: 821669 - RNA, 20 nt, Homo sapiens
ucuaguuucuugugggcuaa

SEQ ID NO: 821670 - RNA, 15 nt, Homo sapiens
ucuauaaacuucaga

SEQ ID NO: 821671 - RNA, 20 nt, Homo sapiens
ucuauaccaaccaaaccaau

SEQ ID NO: 821672 - RNA, 14 nt, Homo sapiens
ucuauaccaauaaa

SEQ ID NO: 821673 - RNA, 16 nt, Homo sapiens
ucuauacuuuguucug

SEQ ID NO: 821674 - RNA, 14 nt, Homo sapiens
ucuauaggcagcuu

SEQ ID NO: 821675 - RNA, 13 nt, Homo sapiens
ucuauaucaaaaa

SEQ ID NO: 821676 - RNA, 11 nt, Homo sapiens
ucuauaucuca

SEQ ID NO: 821677 - RNA, 17 nt, Homo sapiens
ucuauauggaauugcuu

SEQ ID NO: 821678 - RNA, 14 nt, Homo sapiens
ucuaucaccuguca

SEQ ID NO: 821679 - RNA, 13 nt, Homo sapiens
ucuaucuugucaa

SEQ ID NO: 821680 - RNA, 11 nt, Homo sapiens
ucuaugaagcc

SEQ ID NO: 821681 - RNA, 19 nt, Homo sapiens
ucuaugaucuggacuuccu

SEQ ID NO: 821682 - RNA, 17 nt, Homo sapiens
ucuaugaucuugagggc

SEQ ID NO: 821683 - RNA, 19 nt, Homo sapiens
ucuauggauuuaauaccau

SEQ ID NO: 821684 - RNA, 22 nt, Homo sapiens
ucuaugggguucguuaugccaa

SEQ ID NO: 821685 - RNA, 19 nt, Homo sapiens
ucuauggguuggacaaccu

SEQ ID NO: 821686 - RNA, 14 nt, Homo sapiens
ucuauguauauucu

SEQ ID NO: 821687 - RNA, 15 nt, Homo sapiens
ucuauguucaaagac

SEQ ID NO: 821688 - RNA, 12 nt, Homo sapiens
ucuauguucccc

SEQ ID NO: 821689 - RNA, 19 nt, Homo sapiens
ucuauguuuacaaauggac

SEQ ID NO: 821690 - RNA, 17 nt, Homo sapiens
ucuauguuuggcuucag

SEQ ID NO: 821691 - RNA, 23 nt, Homo sapiens
ucuauuauuuggagccugccaag

SEQ ID NO: 821692 - RNA, 15 nt, Homo sapiens
ucuauucaagcacuu

SEQ ID NO: 821693 - RNA, 20 nt, Homo sapiens
ucuauugagugaacagaauu

SEQ ID NO: 821694 - RNA, 14 nt, Homo sapiens
ucuauugauguaca

SEQ ID NO: 821695 - RNA, 16 nt, Homo sapiens
ucuauuuaaauaaagu

SEQ ID NO: 821696 - RNA, 20 nt, Homo sapiens
ucuauuuaacugagucacac

SEQ ID NO: 821697 - RNA, 17 nt, Homo sapiens
ucuauuuggaacccaag

SEQ ID NO: 821698 - RNA, 20 nt, Homo sapiens
ucuauuuuaauuacugcuau

SEQ ID NO: 821699 - RNA, 14 nt, Homo sapiens
ucuauuuucucagu

SEQ ID NO: 821700 - RNA, 20 nt, Homo sapiens
ucucaaaacaauauuacuuu

SEQ ID NO: 821701 - RNA, 19 nt, Homo sapiens
ucucaaaguuugacaggaa

SEQ ID NO: 821702 - RNA, 13 nt, Homo sapiens
ucucaaaucugcu

SEQ ID NO: 821703 - RNA, 18 nt, Homo sapiens
ucucaaaugcacaucuca

SEQ ID NO: 821704 - RNA, 15 nt, Homo sapiens
ucucaaauuagaaag

SEQ ID NO: 821705 - RNA, 12 nt, Homo sapiens
ucucaacugagg

SEQ ID NO: 821706 - RNA, 21 nt, Homo sapiens
ucucaagacggagaugcaugg

SEQ ID NO: 821707 - RNA, 12 nt, Homo sapiens
ucucaagagcca

SEQ ID NO: 821708 - RNA, 12 nt, Homo sapiens
ucucaagauauu

SEQ ID NO: 821709 - RNA, 16 nt, Homo sapiens
ucucaagcuagccaga

SEQ ID NO: 821710 - RNA, 22 nt, Homo sapiens
ucucaaguauaugucauuuacu

SEQ ID NO: 821711 - RNA, 14 nt, Homo sapiens
ucucaauauauuca

SEQ ID NO: 821712 - RNA, 16 nt, Homo sapiens
ucucaauauauucagu

SEQ ID NO: 821713 - RNA, 16 nt, Homo sapiens
ucucaaucagugcagu

SEQ ID NO: 821714 - RNA, 14 nt, Homo sapiens
ucucaauuugcagu

SEQ ID NO: 821715 - RNA, 13 nt, Homo sapiens
ucucacacacaua

SEQ ID NO: 821716 - RNA, 20 nt, Homo sapiens
ucucacccucaucacuagga

SEQ ID NO: 821717 - RNA, 21 nt, Homo sapiens
ucucaccugcuggggaccuca

SEQ ID NO: 821718 - RNA, 15 nt, Homo sapiens
ucucacuguguuacu

SEQ ID NO: 821719 - RNA, 21 nt, Homo sapiens
ucucagaaagugccugacaca

SEQ ID NO: 821720 - RNA, 23 nt, Homo sapiens
ucucagaacccaucgguaggcaa

SEQ ID NO: 821721 - RNA, 14 nt, Homo sapiens
ucucagaacuccug

SEQ ID NO: 821722 - RNA, 15 nt, Homo sapiens
ucucagaagcacaga

SEQ ID NO: 821723 - RNA, 23 nt, Homo sapiens
ucucagaauucggugugcugcca

SEQ ID NO: 821724 - RNA, 19 nt, Homo sapiens
ucucagacugcauguacca

SEQ ID NO: 821725 - RNA, 12 nt, Homo sapiens
ucucagcacuuu

SEQ ID NO: 821726 - RNA, 15 nt, Homo sapiens
ucucagccagccucc

SEQ ID NO: 821727 - RNA, 16 nt, Homo sapiens
ucucagccuaccauga

SEQ ID NO: 821728 - RNA, 12 nt, Homo sapiens
ucucagccucug

SEQ ID NO: 821729 - RNA, 23 nt, Homo sapiens
ucucaggaaaucaaauaugcaaa

SEQ ID NO: 821730 - RNA, 17 nt, Homo sapiens
ucucaggaccucuguag

SEQ ID NO: 821731 - RNA, 20 nt, Homo sapiens
ucucaggagcuugcaagaag

SEQ ID NO: 821732 - RNA, 21 nt, Homo sapiens
ucucaggccccgggcuucccu

SEQ ID NO: 821733 - RNA, 17 nt, Homo sapiens
ucucagggaagcccagc

SEQ ID NO: 821734 - RNA, 21 nt, Homo sapiens
ucucagguagaagguugacac

SEQ ID NO: 821735 - RNA, 16 nt, Homo sapiens
ucucagguguugccaa

SEQ ID NO: 821736 - RNA, 21 nt, Homo sapiens
ucucagucauuuuuaaccucu

SEQ ID NO: 821737 - RNA, 15 nt, Homo sapiens
ucucagucugcagua

SEQ ID NO: 821738 - RNA, 19 nt, Homo sapiens
ucucaguuauguaguuucu

SEQ ID NO: 821739 - RNA, 14 nt, Homo sapiens
ucucaguucagagu

SEQ ID NO: 821740 - RNA, 17 nt, Homo sapiens
ucucauaaugcuuuguu

SEQ ID NO: 821741 - RNA, 21 nt, Homo sapiens
ucucauaucaacuuagucaau

SEQ ID NO: 821742 - RNA, 23 nt, Homo sapiens
ucucauaucaugguagucacuaa

SEQ ID NO: 821743 - RNA, 14 nt, Homo sapiens
ucucaucaguccau

SEQ ID NO: 821744 - RNA, 16 nt, Homo sapiens
uccugguuugacucag

SEQ ID NO: 821745 - RNA, 12 nt, Homo sapiens
uccuguaggggg

SEQ ID NO: 821746 - RNA, 14 nt, Homo sapiens
uccuguauucuaca

SEQ ID NO: 821747 - RNA, 13 nt, Homo sapiens
uccugucauugcg

SEQ ID NO: 821748 - RNA, 13 nt, Homo sapiens
uccugucccucau

SEQ ID NO: 821749 - RNA, 16 nt, Homo sapiens
uccugucccucaucca

SEQ ID NO: 821750 - RNA, 19 nt, Homo sapiens
uccugucccucauccauag

SEQ ID NO: 821751 - RNA, 19 nt, Homo sapiens
uccugucccuguagcucag

SEQ ID NO: 821752 - RNA, 20 nt, Homo sapiens
uccuguccuuuuaacaccuu

SEQ ID NO: 821753 - RNA, 18 nt, Homo sapiens
uccugugacauguaacag

SEQ ID NO: 821754 - RNA, 18 nt, Homo sapiens
uccugugggagaucuuca

SEQ ID NO: 821755 - RNA, 15 nt, Homo sapiens
uccuguguaacacuu

SEQ ID NO: 821756 - RNA, 16 nt, Homo sapiens
uccuguguccauguga

SEQ ID NO: 821757 - RNA, 14 nt, Homo sapiens
uccuguguccugaa

SEQ ID NO: 821758 - RNA, 18 nt, Homo sapiens
uccuguguguggaaggca

SEQ ID NO: 821759 - RNA, 15 nt, Homo sapiens
uccuguugaugggaa

SEQ ID NO: 821760 - RNA, 21 nt, Homo sapiens
uccuguuuuucacauuuuccu

SEQ ID NO: 821761 - RNA, 14 nt, Homo sapiens
uccuuaaaaacugg

SEQ ID NO: 821762 - RNA, 18 nt, Homo sapiens
uccuuaacgcuagagauu

SEQ ID NO: 821763 - RNA, 18 nt, Homo sapiens
uccuuagcuuagaccuca

SEQ ID NO: 821764 - RNA, 20 nt, Homo sapiens
uccuuagcuuagaccucagc

SEQ ID NO: 821765 - RNA, 14 nt, Homo sapiens
uccuuaggccucug

SEQ ID NO: 821766 - RNA, 17 nt, Homo sapiens
uccuuaggccucugaga

SEQ ID NO: 821767 - RNA, 18 nt, Homo sapiens
uccuuauugggacuuuuc

SEQ ID NO: 821768 - RNA, 16 nt, Homo sapiens
uccuuccaauuuggaa

SEQ ID NO: 821769 - RNA, 18 nt, Homo sapiens
uccuuccagaccuuauca

SEQ ID NO: 821770 - RNA, 15 nt, Homo sapiens
uccuuccauccaucu

SEQ ID NO: 821771 - RNA, 15 nt, Homo sapiens
uccuucccugggaag

SEQ ID NO: 821772 - RNA, 12 nt, Homo sapiens
uccuuccugacc

SEQ ID NO: 821773 - RNA, 20 nt, Homo sapiens
uccuuccuuaucacugacac

SEQ ID NO: 821774 - RNA, 15 nt, Homo sapiens
uccuuccuucagggu

SEQ ID NO: 821775 - RNA, 19 nt, Homo sapiens
uccuucuacuguccuggcu

SEQ ID NO: 821776 - RNA, 18 nt, Homo sapiens
uccuucuauucuagccug

SEQ ID NO: 821777 - RNA, 16 nt, Homo sapiens
uccuucucaucuguga

SEQ ID NO: 821778 - RNA, 19 nt, Homo sapiens
uccuucucucacuguguua

SEQ ID NO: 821779 - RNA, 14 nt, Homo sapiens
uccuugaccagcag

SEQ ID NO: 821780 - RNA, 23 nt, Homo sapiens
uccuugaccagcagaucccagcu

SEQ ID NO: 821781 - RNA, 20 nt, Homo sapiens
uccuugacccugcuuuuugc

SEQ ID NO: 821782 - RNA, 20 nt, Homo sapiens
uccuugauguacagauuuua

SEQ ID NO: 821783 - RNA, 12 nt, Homo sapiens
uccuugcacacu

SEQ ID NO: 821784 - RNA, 20 nt, Homo sapiens
uccuugcccagacuacaggg

SEQ ID NO: 821785 - RNA, 20 nt, Homo sapiens
uccuugccuaaggugucuga

SEQ ID NO: 821786 - RNA, 15 nt, Homo sapiens
uccuugccugugacu

SEQ ID NO: 821787 - RNA, 15 nt, Homo sapiens
uccuugcuuccuguc

SEQ ID NO: 821788 - RNA, 21 nt, Homo sapiens
uccuuggaagagaaugucuga

SEQ ID NO: 821789 - RNA, 17 nt, Homo sapiens
uccuuggcuugccauuu

SEQ ID NO: 821790 - RNA, 13 nt, Homo sapiens
uccuuggcuuuau

SEQ ID NO: 821791 - RNA, 17 nt, Homo sapiens
uccuuggggagcacuug

SEQ ID NO: 821792 - RNA, 15 nt, Homo sapiens
uccuuguaaguuauu

SEQ ID NO: 821793 - RNA, 21 nt, Homo sapiens
uccuugugccuucuuuguaua

SEQ ID NO: 821794 - RNA, 23 nt, Homo sapiens
uccuugugguugaaaaccacagu

SEQ ID NO: 821795 - RNA, 14 nt, Homo sapiens
uccuuuaccagaug

SEQ ID NO: 821796 - RNA, 13 nt, Homo sapiens
uccuuuaugaucc

SEQ ID NO: 821797 - RNA, 17 nt, Homo sapiens
uccuuuccccucccuca

SEQ ID NO: 821798 - RNA, 20 nt, Homo sapiens
uccuuucuuuuaaugaugcc

SEQ ID NO: 821799 - RNA, 19 nt, Homo sapiens
uccuuugagaaugugauuc

SEQ ID NO: 821800 - RNA, 17 nt, Homo sapiens
uccuuugcucuugccaa

SEQ ID NO: 821801 - RNA, 21 nt, Homo sapiens
uccuuuguauucugucuucau

SEQ ID NO: 821802 - RNA, 20 nt, Homo sapiens
uccuuuuaaaaaccuagguc

SEQ ID NO: 821803 - RNA, 16 nt, Homo sapiens
uccuuuuaagcaguga

SEQ ID NO: 821804 - RNA, 17 nt, Homo sapiens
uccuuuuaagcagugag

SEQ ID NO: 821805 - RNA, 16 nt, Homo sapiens
uccuuuuacugcagau

SEQ ID NO: 821806 - RNA, 16 nt, Homo sapiens
uccuuuucccaaagca

SEQ ID NO: 821807 - RNA, 22 nt, Homo sapiens
uccuuuucccaaagcaucccuc

SEQ ID NO: 821808 - RNA, 14 nt, Homo sapiens
uccuuuucuucacc

SEQ ID NO: 821809 - RNA, 13 nt, Homo sapiens
uccuuuugaccaa

SEQ ID NO: 821810 - RNA, 14 nt, Homo sapiens
uccuuuugaccaaa

SEQ ID NO: 821811 - RNA, 15 nt, Homo sapiens
uccuuuugaccaaau

SEQ ID NO: 821812 - RNA, 17 nt, Homo sapiens
uccuuuuucacuuugaa

SEQ ID NO: 821813 - RNA, 17 nt, Homo sapiens
ucgaacauggaacucau

SEQ ID NO: 821814 - RNA, 20 nt, Homo sapiens
ucgaagaaacccuugcugcu

SEQ ID NO: 821815 - RNA, 16 nt, Homo sapiens
ucgaagccaugugcug

SEQ ID NO: 821816 - RNA, 19 nt, Homo sapiens
ucgaagcuccgugagugaa

SEQ ID NO: 821817 - RNA, 15 nt, Homo sapiens
ucgaaguugaugcaa

SEQ ID NO: 821818 - RNA, 17 nt, Homo sapiens
ucgaaucucugugccuu

SEQ ID NO: 821819 - RNA, 18 nt, Homo sapiens
ucgaauuuuucagaugau

SEQ ID NO: 821820 - RNA, 19 nt, Homo sapiens
ucgacuguauucgugcauu

SEQ ID NO: 821821 - RNA, 14 nt, Homo sapiens
ucgagacacaguga

SEQ ID NO: 821822 - RNA, 16 nt, Homo sapiens
ucgagaccaaccugac

SEQ ID NO: 821823 - RNA, 18 nt, Homo sapiens
ucgagaccauccuggcua

SEQ ID NO: 821824 - RNA, 19 nt, Homo sapiens
ucgagaucaucacuuccuu

SEQ ID NO: 821825 - RNA, 15 nt, Homo sapiens
ucgagcaacugcugu

SEQ ID NO: 821826 - RNA, 14 nt, Homo sapiens
ucgagcaucaggcu

SEQ ID NO: 821827 - RNA, 20 nt, Homo sapiens
ucgauccuggauucacucac

SEQ ID NO: 821828 - RNA, 18 nt, Homo sapiens
uccguccauccauucaga

SEQ ID NO: 821829 - RNA, 14 nt, Homo sapiens
uccguccaugccau

SEQ ID NO: 821830 - RNA, 20 nt, Homo sapiens
uccguggucagagugccacu

SEQ ID NO: 821831 - RNA, 20 nt, Homo sapiens
uccgugguuugaacacgaaa

SEQ ID NO: 821832 - RNA, 12 nt, Homo sapiens
uccguguaaaau

SEQ ID NO: 821833 - RNA, 19 nt, Homo sapiens
uccguuaugccaccuggag

SEQ ID NO: 821834 - RNA, 16 nt, Homo sapiens
uccguucaauaagcau

SEQ ID NO: 821835 - RNA, 20 nt, Homo sapiens
uccguucacaugugugguac

SEQ ID NO: 821836 - RNA, 15 nt, Homo sapiens
uccuaaacccaauga

SEQ ID NO: 821837 - RNA, 22 nt, Homo sapiens
uccuaaacccaaugacuucccu

SEQ ID NO: 821838 - RNA, 23 nt, Homo sapiens
uccuaaagaaaaauaucuuggcc

SEQ ID NO: 821839 - RNA, 15 nt, Homo sapiens
uccuaaagcuuuuau

SEQ ID NO: 821840 - RNA, 16 nt, Homo sapiens
uccuaaaugcagugaa

SEQ ID NO: 821841 - RNA, 14 nt, Homo sapiens
uccuaacaaaagaa

SEQ ID NO: 821842 - RNA, 21 nt, Homo sapiens
uccuaacugaaagaugaucau

SEQ ID NO: 821843 - RNA, 18 nt, Homo sapiens
uccuaagcuggagugcag

SEQ ID NO: 821844 - RNA, 20 nt, Homo sapiens
uccuaagcuggagugcagug

SEQ ID NO: 821845 - RNA, 12 nt, Homo sapiens
uccuaaggcaug

SEQ ID NO: 821846 - RNA, 20 nt, Homo sapiens
uccuacagcuacauugagau

SEQ ID NO: 821847 - RNA, 16 nt, Homo sapiens
uccuacagggccacaa

SEQ ID NO: 821848 - RNA, 23 nt, Homo sapiens
uccuacauaucccuuccagaugg

SEQ ID NO: 821849 - RNA, 19 nt, Homo sapiens
uccuaccuuugcugaugcc

SEQ ID NO: 821850 - RNA, 14 nt, Homo sapiens
uccuacuugcacuc

SEQ ID NO: 821851 - RNA, 16 nt, Homo sapiens
uccuagaaugcagcug

SEQ ID NO: 821852 - RNA, 13 nt, Homo sapiens
uccuagauguguu

SEQ ID NO: 821853 - RNA, 17 nt, Homo sapiens
uccuagcugugugaaua

SEQ ID NO: 821854 - RNA, 17 nt, Homo sapiens
uccuauacuauugaagu

SEQ ID NO: 821855 - RNA, 22 nt, Homo sapiens
uccuauacuauugaaguaugua

SEQ ID NO: 821856 - RNA, 14 nt, Homo sapiens
uccuauauccugug

SEQ ID NO: 821857 - RNA, 19 nt, Homo sapiens
uccuaucucccuggcucac

SEQ ID NO: 821858 - RNA, 12 nt, Homo sapiens
uccuaucugugu

SEQ ID NO: 821859 - RNA, 21 nt, Homo sapiens
uccuaugcgcucaugagcguc

SEQ ID NO: 821860 - RNA, 16 nt, Homo sapiens
uccuaugggaacaauu

SEQ ID NO: 821861 - RNA, 18 nt, Homo sapiens
uccuauuguucacuuuau

SEQ ID NO: 821862 - RNA, 22 nt, Homo sapiens
uccucaaauuuuuugacuuuuu

SEQ ID NO: 821863 - RNA, 19 nt, Homo sapiens
uccucaagggccaggacuu

SEQ ID NO: 821864 - RNA, 12 nt, Homo sapiens
uccucacccacc

SEQ ID NO: 821865 - RNA, 22 nt, Homo sapiens
uccucacgcagacacacccaca

SEQ ID NO: 821866 - RNA, 15 nt, Homo sapiens
uccucacuucuagau

SEQ ID NO: 821867 - RNA, 17 nt, Homo sapiens
uccucacuuuauggaag

SEQ ID NO: 821868 - RNA, 15 nt, Homo sapiens
uccucagaaagugua

SEQ ID NO: 821869 - RNA, 22 nt, Homo sapiens
uccucagagaauuucuaccauu

SEQ ID NO: 821870 - RNA, 17 nt, Homo sapiens
uccucagaucauuauca

SEQ ID NO: 821871 - RNA, 15 nt, Homo sapiens
uccucagauggggca

SEQ ID NO: 821872 - RNA, 15 nt, Homo sapiens
uccucagcuuaucuc

SEQ ID NO: 821873 - RNA, 22 nt, Homo sapiens
uccucaggcacacagcuacucu

SEQ ID NO: 821874 - RNA, 16 nt, Homo sapiens
uccucaguaacauuuc

SEQ ID NO: 821875 - RNA, 16 nt, Homo sapiens
uccucaugaauguaaa

SEQ ID NO: 821876 - RNA, 17 nt, Homo sapiens
uccuccaccgucuuucu

SEQ ID NO: 821877 - RNA, 20 nt, Homo sapiens
uccuccagaagccucuggcu

SEQ ID NO: 821878 - RNA, 22 nt, Homo sapiens
uccuccauaaauuauggcauuu

SEQ ID NO: 821879 - RNA, 16 nt, Homo sapiens
uccuccccacacucca

SEQ ID NO: 821880 - RNA, 16 nt, Homo sapiens
uccucccuucccagga

SEQ ID NO: 821881 - RNA, 19 nt, Homo sapiens
uccucccuuccucaccucc

SEQ ID NO: 821882 - RNA, 17 nt, Homo sapiens
uccuccguccauaucag

SEQ ID NO: 821883 - RNA, 19 nt, Homo sapiens
uccuccguguggacugugc

SEQ ID NO: 821884 - RNA, 23 nt, Homo sapiens
uccuccuuaugacuccauucaaa

SEQ ID NO: 821885 - RNA, 14 nt, Homo sapiens
uccuccuugcccag

SEQ ID NO: 821886 - RNA, 19 nt, Homo sapiens
uccuccuuugcucuuggga

SEQ ID NO: 821887 - RNA, 18 nt, Homo sapiens
uccucgagcaacugcugu

SEQ ID NO: 821888 - RNA, 14 nt, Homo sapiens
uccucgcugccaga

SEQ ID NO: 821889 - RNA, 23 nt, Homo sapiens
uccucgggaaacacacaagcaac

SEQ ID NO: 821890 - RNA, 19 nt, Homo sapiens
uccucuaacucacugccua

SEQ ID NO: 821891 - RNA, 17 nt, Homo sapiens
uccucuaaugaagaauu

SEQ ID NO: 821892 - RNA, 19 nt, Homo sapiens
uccucuagcccacucccug

SEQ ID NO: 821893 - RNA, 15 nt, Homo sapiens
uccucucauuugcag

SEQ ID NO: 821894 - RNA, 16 nt, Homo sapiens
uccucuccacugccuu

SEQ ID NO: 821895 - RNA, 14 nt, Homo sapiens
uccucuccuaccca

SEQ ID NO: 821896 - RNA, 22 nt, Homo sapiens
uccucuccuacccacuggucug

SEQ ID NO: 821897 - RNA, 17 nt, Homo sapiens
uccucucuuaaaugcaa

SEQ ID NO: 821898 - RNA, 14 nt, Homo sapiens
uccucuugauuccu

SEQ ID NO: 821899 - RNA, 16 nt, Homo sapiens
uccucuuggugucaua

SEQ ID NO: 821900 - RNA, 18 nt, Homo sapiens
uccucuuugaauucuucc

SEQ ID NO: 821901 - RNA, 16 nt, Homo sapiens
uccugaaacacuaaag

SEQ ID NO: 821902 - RNA, 13 nt, Homo sapiens
uccugaaagccaa

SEQ ID NO: 821903 - RNA, 18 nt, Homo sapiens
uccugaaccgcacagcuc

SEQ ID NO: 821904 - RNA, 16 nt, Homo sapiens
uccugaacucagcuga

SEQ ID NO: 821905 - RNA, 13 nt, Homo sapiens
uccugaagcugcu

SEQ ID NO: 821906 - RNA, 14 nt, Homo sapiens
uccugaauccuuuu

SEQ ID NO: 821907 - RNA, 13 nt, Homo sapiens
uccugacacuuga

SEQ ID NO: 821908 - RNA, 19 nt, Homo sapiens
uccugacagaaggugccac

SEQ ID NO: 821909 - RNA, 13 nt, Homo sapiens
uccugacuucccu

SEQ ID NO: 821910 - RNA, 23 nt, Homo sapiens
uccugagaaaaucccucccugac

SEQ ID NO: 821911 - RNA, 20 nt, Homo sapiens
uccugaguagcugggauuac

SEQ ID NO: 821912 - RNA, 21 nt, Homo sapiens
uccugauaaacauuaaacacu

SEQ ID NO: 821913 - RNA, 13 nt, Homo sapiens
uccugcaacucaa

SEQ ID NO: 821914 - RNA, 11 nt, Homo sapiens
uccugcauguu

SEQ ID NO: 821915 - RNA, 21 nt, Homo sapiens
uccugccaacugauuuaaaag

SEQ ID NO: 821916 - RNA, 17 nt, Homo sapiens
uccugccauagucuuaa

SEQ ID NO: 821917 - RNA, 14 nt, Homo sapiens
uccugccauguuua

SEQ ID NO: 821918 - RNA, 20 nt, Homo sapiens
uccugcccccagucuggguu

SEQ ID NO: 821919 - RNA, 17 nt, Homo sapiens
uccugccgcaacaguuu

SEQ ID NO: 821920 - RNA, 19 nt, Homo sapiens
uccugccugugcugugacu

SEQ ID NO: 821921 - RNA, 21 nt, Homo sapiens
uccugcuccagcagcacaccu

SEQ ID NO: 821922 - RNA, 13 nt, Homo sapiens
uccugcucucuuc

SEQ ID NO: 821923 - RNA, 19 nt, Homo sapiens
uccugcugaacguuucccc

SEQ ID NO: 821924 - RNA, 15 nt, Homo sapiens
uccugcugaccucac

SEQ ID NO: 821925 - RNA, 21 nt, Homo sapiens
uccugcugccuuuucuggagu

SEQ ID NO: 821926 - RNA, 21 nt, Homo sapiens
uccugcugcuguaacugcuga

SEQ ID NO: 821927 - RNA, 18 nt, Homo sapiens
uccugcuuaaucuucaaa

SEQ ID NO: 821928 - RNA, 15 nt, Homo sapiens
uccugcuuccucaga

SEQ ID NO: 821929 - RNA, 15 nt, Homo sapiens
uccugcuucugauau

SEQ ID NO: 821930 - RNA, 20 nt, Homo sapiens
uccuggaagcaggugcuaca

SEQ ID NO: 821931 - RNA, 20 nt, Homo sapiens
uccuggccuugugucacugg

SEQ ID NO: 821932 - RNA, 14 nt, Homo sapiens
uccuggcugagaga

SEQ ID NO: 821933 - RNA, 23 nt, Homo sapiens
uccugggaaggccaccucccacu

SEQ ID NO: 821934 - RNA, 18 nt, Homo sapiens
uccugggagaaccucagg

SEQ ID NO: 821935 - RNA, 16 nt, Homo sapiens
uccugggccugcagaa

SEQ ID NO: 821936 - RNA, 15 nt, Homo sapiens
uccugggcuauauuc

SEQ ID NO: 821937 - RNA, 15 nt, Homo sapiens
uccuggggucacuca

SEQ ID NO: 821938 - RNA, 22 nt, Homo sapiens
uccuggguacugaaagccuuag

SEQ ID NO: 821939 - RNA, 14 nt, Homo sapiens
uccugggucuacca

SEQ ID NO: 821940 - RNA, 18 nt, Homo sapiens
uccuggguggacuuuuga

SEQ ID NO: 821941 - RNA, 17 nt, Homo sapiens
uccugguggauacugua

SEQ ID NO: 821942 - RNA, 23 nt, Homo sapiens
uccugguuaaauuugaauuucag

SEQ ID NO: 821943 - RNA, 14 nt, Homo sapiens
ucagcaccagugaa

SEQ ID NO: 821944 - RNA, 14 nt, Homo sapiens
ucagcacuguuaca

SEQ ID NO: 821945 - RNA, 15 nt, Homo sapiens
ucagcagcccuccuc

SEQ ID NO: 821946 - RNA, 14 nt, Homo sapiens
ucagcaucugacca

SEQ ID NO: 821947 - RNA, 23 nt, Homo sapiens
ucagcaucugaccaucugugacu

SEQ ID NO: 821948 - RNA, 23 nt, Homo sapiens
ucagcauuuucuucucugcacuu

SEQ ID NO: 821949 - RNA, 22 nt, Homo sapiens
ucagccacuacaacagaauuuu

SEQ ID NO: 821950 - RNA, 16 nt, Homo sapiens
ucagccagccuccagc

SEQ ID NO: 821951 - RNA, 21 nt, Homo sapiens
ucagccaggaccauaccgggu

SEQ ID NO: 821952 - RNA, 14 nt, Homo sapiens
ucagcccagugcaa

SEQ ID NO: 821953 - RNA, 16 nt, Homo sapiens
ucagcccagugcaaac

SEQ ID NO: 821954 - RNA, 13 nt, Homo sapiens
ucagcccuggauu

SEQ ID NO: 821955 - RNA, 20 nt, Homo sapiens
ucagccuaagagacugguga

SEQ ID NO: 821956 - RNA, 20 nt, Homo sapiens
ucagccucugccagcgccaa

SEQ ID NO: 821957 - RNA, 18 nt, Homo sapiens
ucagccugaccaacaugg

SEQ ID NO: 821958 - RNA, 14 nt, Homo sapiens
ucagccugagucuc

SEQ ID NO: 821959 - RNA, 13 nt, Homo sapiens
ucagccugcacag

SEQ ID NO: 821960 - RNA, 21 nt, Homo sapiens
ucagccuugccagagauccaa

SEQ ID NO: 821961 - RNA, 19 nt, Homo sapiens
ucagcucuggagaacagug

SEQ ID NO: 821962 - RNA, 21 nt, Homo sapiens
ucagcucuuuggaucagucuu

SEQ ID NO: 821963 - RNA, 18 nt, Homo sapiens
ucagcugaauucacuuaa

SEQ ID NO: 821964 - RNA, 19 nt, Homo sapiens
ucagcugaauucacuuaag

SEQ ID NO: 821965 - RNA, 16 nt, Homo sapiens
ucagcugcacauuccu

SEQ ID NO: 821966 - RNA, 14 nt, Homo sapiens
ucaccgacaacaug

SEQ ID NO: 821967 - RNA, 19 nt, Homo sapiens
ucaccuaagucucugugaa

SEQ ID NO: 821968 - RNA, 17 nt, Homo sapiens
ucaccuacauuaucuca

SEQ ID NO: 821969 - RNA, 21 nt, Homo sapiens
ucaccucucccuccaccuccu

SEQ ID NO: 821970 - RNA, 17 nt, Homo sapiens
ucaccugaggucaggag

SEQ ID NO: 821971 - RNA, 13 nt, Homo sapiens
ucaccugcuggag

SEQ ID NO: 821972 - RNA, 17 nt, Homo sapiens
ucaccugcuggggaccu

SEQ ID NO: 821973 - RNA, 19 nt, Homo sapiens
ucaccugcuggggaccuca

SEQ ID NO: 821974 - RNA, 20 nt, Homo sapiens
ucaccugcuggggaccucac

SEQ ID NO: 821975 - RNA, 18 nt, Homo sapiens
ucaccugcuggggaccuu

SEQ ID NO: 821976 - RNA, 16 nt, Homo sapiens
ucaccuguaaaccuga

SEQ ID NO: 821977 - RNA, 21 nt, Homo sapiens
ucaccuugaaagcaguagcau

SEQ ID NO: 821978 - RNA, 19 nt, Homo sapiens
ucaccuuggcaccagacac

SEQ ID NO: 821979 - RNA, 22 nt, Homo sapiens
ucaccuuggcaccagacaccca

SEQ ID NO: 821980 - RNA, 19 nt, Homo sapiens
ucacgaaguuuguucauca

SEQ ID NO: 821981 - RNA, 14 nt, Homo sapiens
ucacgagccuuugu

SEQ ID NO: 821982 - RNA, 21 nt, Homo sapiens
ucacgccauuguacuccagcc

SEQ ID NO: 821983 - RNA, 14 nt, Homo sapiens
ucacgccuacuuaa

SEQ ID NO: 821984 - RNA, 17 nt, Homo sapiens
ucacggcugcgcacugu

SEQ ID NO: 821985 - RNA, 20 nt, Homo sapiens
ucacggcugcgcacuguguc

SEQ ID NO: 821986 - RNA, 17 nt, Homo sapiens
ucacuaaaauuaaucug

SEQ ID NO: 821987 - RNA, 12 nt, Homo sapiens
ucacuacaggug

SEQ ID NO: 821988 - RNA, 20 nt, Homo sapiens
uaguguucauugaugcugcu

SEQ ID NO: 821989 - RNA, 14 nt, Homo sapiens
uaguuaaaguaaug

SEQ ID NO: 821990 - RNA, 17 nt, Homo sapiens
uaguuaauuauuucaac

SEQ ID NO: 821991 - RNA, 18 nt, Homo sapiens
uaguuaccuuauaguuac

SEQ ID NO: 821992 - RNA, 12 nt, Homo sapiens
uaguuacugugg

SEQ ID NO: 821993 - RNA, 15 nt, Homo sapiens
uaguuagcuauuucu

SEQ ID NO: 821994 - RNA, 16 nt, Homo sapiens
uaguucagugaccugu

SEQ ID NO: 821995 - RNA, 15 nt, Homo sapiens
uaguucauccaaucc

SEQ ID NO: 821996 - RNA, 22 nt, Homo sapiens
uaguucccugaaaacccagaga

SEQ ID NO: 821997 - RNA, 20 nt, Homo sapiens
uaguucuccccgauggggca

SEQ ID NO: 821998 - RNA, 22 nt, Homo sapiens
uaguucuguauauagggcacaa

SEQ ID NO: 821999 - RNA, 21 nt, Homo sapiens
uaguugaucuacaaaggccau

SEQ ID NO: 822000 - RNA, 19 nt, Homo sapiens
uaguugcguggacucugca

SEQ ID NO: 822001 - RNA, 17 nt, Homo sapiens
uaguuggggcaccauac

SEQ ID NO: 822002 - RNA, 19 nt, Homo sapiens
uaguuguucuagcagugaa

SEQ ID NO: 822003 - RNA, 15 nt, Homo sapiens
uaguuuaaaaugcag

SEQ ID NO: 822004 - RNA, 13 nt, Homo sapiens
uaguuuauuucaa

SEQ ID NO: 822005 - RNA, 15 nt, Homo sapiens
uaguuucaugagucu

SEQ ID NO: 822006 - RNA, 21 nt, Homo sapiens
uaguuucuucauuucaggaag

SEQ ID NO: 822007 - RNA, 22 nt, Homo sapiens
uaguuugcauuccugauaugau

SEQ ID NO: 822008 - RNA, 22 nt, Homo sapiens
uaguuuguaugccaagugagaa

SEQ ID NO: 822009 - RNA, 15 nt, Homo sapiens
uaguuuuacuuuuaa

SEQ ID NO: 822010 - RNA, 21 nt, Homo sapiens
uaguuuucuccuuuuacuuca

SEQ ID NO: 822011 - RNA, 23 nt, Homo sapiens
uaguuuuuucuuucccauguauu

SEQ ID NO: 822012 - RNA, 12 nt, Homo sapiens
uauaaaauacug

SEQ ID NO: 822013 - RNA, 18 nt, Homo sapiens
uauaaaauauaaacaaag

SEQ ID NO: 822014 - RNA, 15 nt, Homo sapiens
uauaaacuaccaaau

SEQ ID NO: 822015 - RNA, 15 nt, Homo sapiens
uauaaagauuguacu

SEQ ID NO: 822016 - RNA, 16 nt, Homo sapiens
uauaaagauuguacuu

SEQ ID NO: 822017 - RNA, 14 nt, Homo sapiens
uauaaagauuuucu

SEQ ID NO: 822018 - RNA, 15 nt, Homo sapiens
uauaaagcacaucuc

SEQ ID NO: 822019 - RNA, 12 nt, Homo sapiens
uauaaagcagua

SEQ ID NO: 822020 - RNA, 20 nt, Homo sapiens
uauaaagccuguauucucaa

SEQ ID NO: 822021 - RNA, 22 nt, Homo sapiens
uauaaauacagcauacuucaaa

SEQ ID NO: 822022 - RNA, 19 nt, Homo sapiens
uauaaauagaugcugugua

SEQ ID NO: 822023 - RNA, 19 nt, Homo sapiens
uauaaauggaauuacacaa

SEQ ID NO: 822024 - RNA, 18 nt, Homo sapiens
uauaaauuuguguucuca

SEQ ID NO: 822025 - RNA, 21 nt, Homo sapiens
uauaaauuuuauaacagaauu

SEQ ID NO: 822026 - RNA, 12 nt, Homo sapiens
uauaacaguguu

SEQ ID NO: 822027 - RNA, 15 nt, Homo sapiens
uauaacaguuauauu

SEQ ID NO: 822028 - RNA, 12 nt, Homo sapiens
uauaacauauau

SEQ ID NO: 822029 - RNA, 14 nt, Homo sapiens
uauaacuaacaugu

SEQ ID NO: 822030 - RNA, 17 nt, Homo sapiens
uauaacuggauugcaga

SEQ ID NO: 822031 - RNA, 21 nt, Homo sapiens
uauaacuuaggccuagccucu

SEQ ID NO: 822032 - RNA, 18 nt, Homo sapiens
uauaagaaagaucaaaga

SEQ ID NO: 822033 - RNA, 16 nt, Homo sapiens
uauaagcagcaagaca

SEQ ID NO: 822034 - RNA, 23 nt, Homo sapiens
uauaagugaagugauacuaucca

SEQ ID NO: 822035 - RNA, 19 nt, Homo sapiens
uauaauaaagaaguguucu

SEQ ID NO: 822036 - RNA, 19 nt, Homo sapiens
uauaauaaauacucaguga

SEQ ID NO: 822037 - RNA, 21 nt, Homo sapiens
uauaauaguagauuugaacag

SEQ ID NO: 822038 - RNA, 22 nt, Homo sapiens
uauaaucuuccauacuucuuca

SEQ ID NO: 822039 - RNA, 14 nt, Homo sapiens
uauaaugguugacu

SEQ ID NO: 822040 - RNA, 16 nt, Homo sapiens
uauaauuaauugucau

SEQ ID NO: 822041 - RNA, 18 nt, Homo sapiens
uauaauuggugcauagca

SEQ ID NO: 822042 - RNA, 22 nt, Homo sapiens
uauaauuucaaaccacacauua

SEQ ID NO: 822043 - RNA, 12 nt, Homo sapiens
uauacaaagugu

SEQ ID NO: 822044 - RNA, 15 nt, Homo sapiens
uauacaauacagauc

SEQ ID NO: 822045 - RNA, 15 nt, Homo sapiens
uauacaggcauaaaa

SEQ ID NO: 822046 - RNA, 16 nt, Homo sapiens
uauacagugaagagua

SEQ ID NO: 822047 - RNA, 22 nt, Homo sapiens
uauacaucuuccccuaaugccu

SEQ ID NO: 822048 - RNA, 16 nt, Homo sapiens
uauacaugaccuuaau

SEQ ID NO: 822049 - RNA, 18 nt, Homo sapiens
uauacaugggugaauuau

SEQ ID NO: 822050 - RNA, 21 nt, Homo sapiens
uauaccaaccaaaccaauuca

SEQ ID NO: 822051 - RNA, 23 nt, Homo sapiens
uauaccuccuauauguccauuua

SEQ ID NO: 822052 - RNA, 15 nt, Homo sapiens
uauacgcaucuauaa

SEQ ID NO: 822053 - RNA, 19 nt, Homo sapiens
uauacgcuggcaacacaga

SEQ ID NO: 822054 - RNA, 12 nt, Homo sapiens
uauacuaugaaa

SEQ ID NO: 822055 - RNA, 18 nt, Homo sapiens
uauacucagguaccucuu

SEQ ID NO: 822056 - RNA, 22 nt, Homo sapiens
uauacugaaggaaaaacacaag

SEQ ID NO: 822057 - RNA, 20 nt, Homo sapiens
uauacugguucacauccuac

SEQ ID NO: 822058 - RNA, 21 nt, Homo sapiens
uauacuguaugugccaaagcu

SEQ ID NO: 822059 - RNA, 15 nt, Homo sapiens
uauacuuagcuauau

SEQ ID NO: 822060 - RNA, 16 nt, Homo sapiens
uauacuuaucacauuu

SEQ ID NO: 822061 - RNA, 16 nt, Homo sapiens
uauagaaugagugcag

SEQ ID NO: 822062 - RNA, 19 nt, Homo sapiens
uauagaaugaucuauugcu

SEQ ID NO: 822063 - RNA, 21 nt, Homo sapiens
uauagagggcuuaugauucag

SEQ ID NO: 822064 - RNA, 14 nt, Homo sapiens
uauagaguggaauc

SEQ ID NO: 822065 - RNA, 15 nt, Homo sapiens
uauagauauuacugg

SEQ ID NO: 822066 - RNA, 15 nt, Homo sapiens
uauagauguuuacua

SEQ ID NO: 822067 - RNA, 22 nt, Homo sapiens
uauagcaacuuuaagaaguaau

SEQ ID NO: 822068 - RNA, 22 nt, Homo sapiens
uauagcaauacuucagugagau

SEQ ID NO: 822069 - RNA, 17 nt, Homo sapiens
uauagcagauuguguaa

SEQ ID NO: 822070 - RNA, 20 nt, Homo sapiens
uauaggaaacauaauuuuga

SEQ ID NO: 822071 - RNA, 14 nt, Homo sapiens
uauaggacucucag

SEQ ID NO: 822072 - RNA, 21 nt, Homo sapiens
uauaggugcuacaaaaacaca

SEQ ID NO: 822073 - RNA, 19 nt, Homo sapiens
uauaguaugaaugcagugg

SEQ ID NO: 822074 - RNA, 11 nt, Homo sapiens
uauagugcaau

SEQ ID NO: 822075 - RNA, 18 nt, Homo sapiens
uauaguuccuugccuuaa

SEQ ID NO: 822076 - RNA, 23 nt, Homo sapiens
uauauaaacaauaaaaacaacuu

SEQ ID NO: 822077 - RNA, 20 nt, Homo sapiens
uauauaaagacaacaaaaga

SEQ ID NO: 822078 - RNA, 21 nt, Homo sapiens
uauauaaagacaacaaaagaa

SEQ ID NO: 822079 - RNA, 12 nt, Homo sapiens
uauauaaccaau

SEQ ID NO: 822080 - RNA, 13 nt, Homo sapiens
uauauaacuauuu

SEQ ID NO: 822081 - RNA, 13 nt, Homo sapiens
uauauaagccagu

SEQ ID NO: 822082 - RNA, 18 nt, Homo sapiens
uauauaaguuuacaccuu

SEQ ID NO: 822083 - RNA, 21 nt, Homo sapiens
uauauaauaaauacucaguga

SEQ ID NO: 822084 - RNA, 14 nt, Homo sapiens
uauauaaucaauca

SEQ ID NO: 822085 - RNA, 18 nt, Homo sapiens
uauauaauccauuccucu

SEQ ID NO: 822086 - RNA, 20 nt, Homo sapiens
uauauacaguaacuuuaugu

SEQ ID NO: 822087 - RNA, 22 nt, Homo sapiens
uaaauugggcuucaaucacugu

SEQ ID NO: 822088 - RNA, 16 nt, Homo sapiens
uaaauuuaacugcaua

SEQ ID NO: 822089 - RNA, 20 nt, Homo sapiens
uaaauuuaauauacugcaua

SEQ ID NO: 822090 - RNA, 21 nt, Homo sapiens
uaaauuuaugguucucaggcc

SEQ ID NO: 822091 - RNA, 18 nt, Homo sapiens
uaaauuucuuaugugaca

SEQ ID NO: 822092 - RNA, 17 nt, Homo sapiens
uaaauuuguguucucaa

SEQ ID NO: 822093 - RNA, 20 nt, Homo sapiens
uaaauuuguguucucaaaua

SEQ ID NO: 822094 - RNA, 21 nt, Homo sapiens
uaaauuuuaaguacuuugcug

SEQ ID NO: 822095 - RNA, 19 nt, Homo sapiens
uaaauuuuagugugccuuc

SEQ ID NO: 822096 - RNA, 21 nt, Homo sapiens
uaaauuuuauaacagaauuaa

SEQ ID NO: 822097 - RNA, 15 nt, Homo sapiens
uaaauuuuaugucau

SEQ ID NO: 822098 - RNA, 17 nt, Homo sapiens
uaaauuuuuaagagaaa

SEQ ID NO: 822099 - RNA, 20 nt, Homo sapiens
uaaauuuuuuauaaaagugu

SEQ ID NO: 822100 - RNA, 22 nt, Homo sapiens
uaaauuuuuuugauaauagaga

SEQ ID NO: 822101 - RNA, 19 nt, Homo sapiens
uaacaaacuacauguaauc

SEQ ID NO: 822102 - RNA, 18 nt, Homo sapiens
uaacaacaauaacacugu

SEQ ID NO: 822103 - RNA, 14 nt, Homo sapiens
uaacaacugcccag

SEQ ID NO: 822104 - RNA, 13 nt, Homo sapiens
uaacaacuuugaa

SEQ ID NO: 822105 - RNA, 20 nt, Homo sapiens
uaacaagaguuuuaacacuu

SEQ ID NO: 822106 - RNA, 17 nt, Homo sapiens
uaacaaucacaaaggaa

SEQ ID NO: 822107 - RNA, 19 nt, Homo sapiens
uaacaauucccaguacuau

SEQ ID NO: 822108 - RNA, 15 nt, Homo sapiens
uaacacacuggccau

SEQ ID NO: 822109 - RNA, 16 nt, Homo sapiens
uaacacagcugaacua

SEQ ID NO: 822110 - RNA, 23 nt, Homo sapiens
uaacacauuaucgggagcagugu

SEQ ID NO: 822111 - RNA, 21 nt, Homo sapiens
uaacacauuuuuuugcaugca

SEQ ID NO: 822112 - RNA, 14 nt, Homo sapiens
uaacacggugcuca

SEQ ID NO: 822113 - RNA, 11 nt, Homo sapiens
uaacacuuugg

SEQ ID NO: 822114 - RNA, 10 nt, Homo sapiens
uaacagaauu

SEQ ID NO: 822115 - RNA, 19 nt, Homo sapiens
uaacagaauuaaaguagau

SEQ ID NO: 822116 - RNA, 13 nt, Homo sapiens
uaacagccaagaa

SEQ ID NO: 822117 - RNA, 14 nt, Homo sapiens
uaacaggcauuugu

SEQ ID NO: 822118 - RNA, 22 nt, Homo sapiens
uaacaggcucaauauuccugaa

SEQ ID NO: 822119 - RNA, 20 nt, Homo sapiens
uaacagggagaaguagcuag

SEQ ID NO: 822120 - RNA, 15 nt, Homo sapiens
uaacagucauuuaaa

SEQ ID NO: 822121 - RNA, 13 nt, Homo sapiens
uaacagugcaaaa

SEQ ID NO: 822122 - RNA, 20 nt, Homo sapiens
uaacaguugugaugacuaug

SEQ ID NO: 822123 - RNA, 14 nt, Homo sapiens
uaacauagauuuaa

SEQ ID NO: 822124 - RNA, 21 nt, Homo sapiens
uaacaucacugucuugccaga

SEQ ID NO: 822125 - RNA, 13 nt, Homo sapiens
uaacaucauugca

SEQ ID NO: 822126 - RNA, 22 nt, Homo sapiens
uaacaucgugggucacuacagg

SEQ ID NO: 822127 - RNA, 12 nt, Homo sapiens
uaacaugcuuua

SEQ ID NO: 822128 - RNA, 20 nt, Homo sapiens
uaacauguaauuaaguacua

SEQ ID NO: 822129 - RNA, 21 nt, Homo sapiens
uaacauguaauuaaguacuau

SEQ ID NO: 822130 - RNA, 17 nt, Homo sapiens
uaacauuucuguucuca

SEQ ID NO: 822131 - RNA, 14 nt, Homo sapiens
uaaccauuugcacu

SEQ ID NO: 822132 - RNA, 20 nt, Homo sapiens
uaaccccaacgcacaggaaa

SEQ ID NO: 822133 - RNA, 21 nt, Homo sapiens
uaacccccaguucaagacuua

SEQ ID NO: 822134 - RNA, 23 nt, Homo sapiens
uaaccccuuccagaucacugcca

SEQ ID NO: 822135 - RNA, 16 nt, Homo sapiens
uaacccucacccacag

SEQ ID NO: 822136 - RNA, 20 nt, Homo sapiens
uaaccgcuugguuugcaacc

SEQ ID NO: 822137 - RNA, 17 nt, Homo sapiens
uaaccuaauaucacuua

SEQ ID NO: 822138 - RNA, 15 nt, Homo sapiens
uaaccuagugaauuu

SEQ ID NO: 822139 - RNA, 17 nt, Homo sapiens
uaaccucggcuguuuac

SEQ ID NO: 822140 - RNA, 16 nt, Homo sapiens
uaaccucucugugcca

SEQ ID NO: 822141 - RNA, 14 nt, Homo sapiens
uaaccucugcacua

SEQ ID NO: 822142 - RNA, 17 nt, Homo sapiens
uaaccuugaaugcugcc

SEQ ID NO: 822143 - RNA, 14 nt, Homo sapiens
uaacgcgucuuccu

SEQ ID NO: 822144 - RNA, 11 nt, Homo sapiens
uaacgcugaac

SEQ ID NO: 822145 - RNA, 14 nt, Homo sapiens
uaacggaccaaagc

SEQ ID NO: 822146 - RNA, 17 nt, Homo sapiens
uaacguucugcugcuug

SEQ ID NO: 822147 - RNA, 13 nt, Homo sapiens
uaacuaauuugug

SEQ ID NO: 822148 - RNA, 15 nt, Homo sapiens
uaacuacuuccugau

SEQ ID NO: 822149 - RNA, 18 nt, Homo sapiens
uaacuagaaaucugccaa

SEQ ID NO: 822150 - RNA, 22 nt, Homo sapiens
uaacuagacaccaaaguucuaa

SEQ ID NO: 822151 - RNA, 16 nt, Homo sapiens
uaacuauaaggugccu

SEQ ID NO: 822152 - RNA, 14 nt, Homo sapiens
uaacuauacuugau

SEQ ID NO: 822153 - RNA, 15 nt, Homo sapiens
uaacuauauuugcuu

SEQ ID NO: 822154 - RNA, 22 nt, Homo sapiens
uaacucaccagccccacugcca

SEQ ID NO: 822155 - RNA, 13 nt, Homo sapiens
uaacucccaguga

SEQ ID NO: 822156 - RNA, 20 nt, Homo sapiens
uaacucccuccaccagccug

SEQ ID NO: 822157 - RNA, 23 nt, Homo sapiens
uaacucugggaggggcucgagag

SEQ ID NO: 822158 - RNA, 16 nt, Homo sapiens
uaacugacaacuugaa

SEQ ID NO: 822159 - RNA, 13 nt, Homo sapiens
uaacugacagcuu

SEQ ID NO: 822160 - RNA, 14 nt, Homo sapiens
uaacugaugaagga

SEQ ID NO: 822161 - RNA, 21 nt, Homo sapiens
uaacugcauugagaacugcau

SEQ ID NO: 822162 - RNA, 15 nt, Homo sapiens
uaacuguagugccuc

SEQ ID NO: 822163 - RNA, 20 nt, Homo sapiens
uaacugugaaauaccacaag

SEQ ID NO: 822164 - RNA, 18 nt, Homo sapiens
uaacugugccaguucuuu

SEQ ID NO: 822165 - RNA, 13 nt, Homo sapiens
uaacuuacuguau

SEQ ID NO: 822166 - RNA, 19 nt, Homo sapiens
uaacuuauauugaagacaa

SEQ ID NO: 822167 - RNA, 21 nt, Homo sapiens
uaacuuauauugaagacaauu

SEQ ID NO: 822168 - RNA, 14 nt, Homo sapiens
uaacuucucuguga

SEQ ID NO: 822169 - RNA, 18 nt, Homo sapiens
uaacuucuuucacugaua

SEQ ID NO: 822170 - RNA, 18 nt, Homo sapiens
uaacuuggcugcauuugc

SEQ ID NO: 822171 - RNA, 20 nt, Homo sapiens
uaacuuuauaaauccaguga

SEQ ID NO: 822172 - RNA, 20 nt, Homo sapiens
uaacuuucauaccacuugaa

SEQ ID NO: 822173 - RNA, 15 nt, Homo sapiens
uaacuuuucaccaau

SEQ ID NO: 822174 - RNA, 17 nt, Homo sapiens
uaagaaacuagcagauu

SEQ ID NO: 822175 - RNA, 14 nt, Homo sapiens
uaagaaagcacuau

SEQ ID NO: 822176 - RNA, 15 nt, Homo sapiens
uaagaaauaagcaug

SEQ ID NO: 822177 - RNA, 19 nt, Homo sapiens
uaagaaauacucaugugca

SEQ ID NO: 822178 - RNA, 15 nt, Homo sapiens
uaagaaaugaucuuu

SEQ ID NO: 822179 - RNA, 22 nt, Homo sapiens
uaagaacaauagguaaagcuau

SEQ ID NO: 822180 - RNA, 19 nt, Homo sapiens
uaagaacuguacauuguga

SEQ ID NO: 822181 - RNA, 15 nt, Homo sapiens
uaagaagagugcugu

SEQ ID NO: 822182 - RNA, 24 nt, Homo sapiens
uaagaagauuaguuaccauugaaa

SEQ ID NO: 822183 - RNA, 21 nt, Homo sapiens
uaagaagccuuaauuugcaca

SEQ ID NO: 822184 - RNA, 14 nt, Homo sapiens
uaagaaugcugguu

SEQ ID NO: 822185 - RNA, 19 nt, Homo sapiens
uaagaauucaaacuggggc

SEQ ID NO: 822186 - RNA, 12 nt, Homo sapiens
uaagaauuucac

SEQ ID NO: 822187 - RNA, 15 nt, Homo sapiens
uaagacaaacacugc

SEQ ID NO: 822188 - RNA, 12 nt, Homo sapiens
uaagacauguga

SEQ ID NO: 822189 - RNA, 12 nt, Homo sapiens
uaagacuaugau

SEQ ID NO: 822190 - RNA, 12 nt, Homo sapiens
uaagacugauaa

SEQ ID NO: 822191 - RNA, 14 nt, Homo sapiens
uaagagaaggccuu

SEQ ID NO: 822192 - RNA, 14 nt, Homo sapiens
uaagagacacucca

SEQ ID NO: 822193 - RNA, 15 nt, Homo sapiens
uaagagacacuccaa

SEQ ID NO: 822194 - RNA, 13 nt, Homo sapiens
uaagagagccuug

SEQ ID NO: 822195 - RNA, 21 nt, Homo sapiens
uaagagggcauauacagugaa

SEQ ID NO: 822196 - RNA, 19 nt, Homo sapiens
uaaucccacccaccucacc

SEQ ID NO: 822197 - RNA, 14 nt, Homo sapiens
uaaucccagcacuu

SEQ ID NO: 822198 - RNA, 20 nt, Homo sapiens
uaaucccagcuacuugggag

SEQ ID NO: 822199 - RNA, 22 nt, Homo sapiens
uaauccccaucauuacugguaa

SEQ ID NO: 822200 - RNA, 19 nt, Homo sapiens
uaauccugaauguaaacaa

SEQ ID NO: 822201 - RNA, 16 nt, Homo sapiens
uaaucuaccuugcagu

SEQ ID NO: 822202 - RNA, 16 nt, Homo sapiens
uaaaacagcaugaguc

SEQ ID NO: 822203 - RNA, 20 nt, Homo sapiens
uaaaacaugcuggugaacca

SEQ ID NO: 822204 - RNA, 13 nt, Homo sapiens
uaaaacauuauga

SEQ ID NO: 822205 - RNA, 21 nt, Homo sapiens
uaaaacauuuaauauuauaua

SEQ ID NO: 822206 - RNA, 21 nt, Homo sapiens
guuucacuguacugcauguga

SEQ ID NO: 822207 - RNA, 20 nt, Homo sapiens
guuucagaauuuuguauauu

SEQ ID NO: 822208 - RNA, 20 nt, Homo sapiens
guuuccacaggaacaacagc

SEQ ID NO: 822209 - RNA, 21 nt, Homo sapiens
uaugcagggagcacuguucac

SEQ ID NO: 822210 - RNA, 12 nt, Homo sapiens
uaugcaguaugc

SEQ ID NO: 822211 - RNA, 14 nt, Homo sapiens
uaugcaguaugcuu

SEQ ID NO: 822212 - RNA, 14 nt, Homo sapiens
uaugcaguccuuua

SEQ ID NO: 822213 - RNA, 15 nt, Homo sapiens
uaugcauuauaucaa

SEQ ID NO: 822214 - RNA, 20 nt, Homo sapiens
uaugcauuugcauuugcucu

SEQ ID NO: 822215 - RNA, 16 nt, Homo sapiens
uaugccaagagugcac

SEQ ID NO: 822216 - RNA, 23 nt, Homo sapiens
uaugccacaccuggccuuaaaga

SEQ ID NO: 822217 - RNA, 20 nt, Homo sapiens
uaugccaccaacacugcuca

SEQ ID NO: 822218 - RNA, 12 nt, Homo sapiens
uaugccauagca

SEQ ID NO: 822219 - RNA, 13 nt, Homo sapiens
uaugccuucuuau

SEQ ID NO: 822220 - RNA, 19 nt, Homo sapiens
uaugccuuuauauacuuag

SEQ ID NO: 822221 - RNA, 18 nt, Homo sapiens
uaugcucagggucaauuu

SEQ ID NO: 822222 - RNA, 19 nt, Homo sapiens
uaugcucauugaacuuuaa

SEQ ID NO: 822223 - RNA, 21 nt, Homo sapiens
uaugcugaucuuuuaaaauca

SEQ ID NO: 822224 - RNA, 22 nt, Homo sapiens
uaugcuggacucuggaccauau

SEQ ID NO: 822225 - RNA, 19 nt, Homo sapiens
uaugcuugggcccugcauu

SEQ ID NO: 822226 - RNA, 15 nt, Homo sapiens
uauggaaaaaaccaa

SEQ ID NO: 822227 - RNA, 14 nt, Homo sapiens
uauggccaauaacu

SEQ ID NO: 822228 - RNA, 20 nt, Homo sapiens
uauggccaauaacuuuucac

SEQ ID NO: 822229 - RNA, 17 nt, Homo sapiens
uauggcugccugcaucu

SEQ ID NO: 822230 - RNA, 19 nt, Homo sapiens
uauggcuucacauucauug

SEQ ID NO: 822231 - RNA, 16 nt, Homo sapiens
uaugggaucugauaag

SEQ ID NO: 822232 - RNA, 20 nt, Homo sapiens
uauggguuggacaaccucau

SEQ ID NO: 822233 - RNA, 20 nt, Homo sapiens
uaugguaaaaguuacuuauu

SEQ ID NO: 822234 - RNA, 14 nt, Homo sapiens
uaugguaaucuuua

SEQ ID NO: 822235 - RNA, 20 nt, Homo sapiens
uaugguauauauacauauau

SEQ ID NO: 822236 - RNA, 20 nt, Homo sapiens
uaugguuauuuaugcacugu

SEQ ID NO: 822237 - RNA, 21 nt, Homo sapiens
uaugguucaagauuguugaua

SEQ ID NO: 822238 - RNA, 17 nt, Homo sapiens
uaugguucucucgcaag

SEQ ID NO: 822239 - RNA, 23 nt, Homo sapiens
uauguaaaguagaauaagccuuc

SEQ ID NO: 822240 - RNA, 15 nt, Homo sapiens
uauguaauauauugu

SEQ ID NO: 822241 - RNA, 17 nt, Homo sapiens
uauguacuuguuugcua

SEQ ID NO: 822242 - RNA, 22 nt, Homo sapiens
uauguaugaguggcuucuggga

SEQ ID NO: 822243 - RNA, 21 nt, Homo sapiens
uaugucugccuucgaccacag

SEQ ID NO: 822244 - RNA, 19 nt, Homo sapiens
uaugucuuggacacuguac

SEQ ID NO: 822245 - RNA, 23 nt, Homo sapiens
uaugugagagaaagugugagcaa

SEQ ID NO: 822246 - RNA, 18 nt, Homo sapiens
uaugugaucagcuuucaa

SEQ ID NO: 822247 - RNA, 14 nt, Homo sapiens
uaugugcaaguuua

SEQ ID NO: 822248 - RNA, 23 nt, Homo sapiens
uauguggaagugugggucugugu

SEQ ID NO: 822249 - RNA, 15 nt, Homo sapiens
uaugugggauauuga

SEQ ID NO: 822250 - RNA, 17 nt, Homo sapiens
uaugugggggucugugu

SEQ ID NO: 822251 - RNA, 18 nt, Homo sapiens
uaugugugaggagcugcu

SEQ ID NO: 822252 - RNA, 18 nt, Homo sapiens
uauguuaauaacuugucc

SEQ ID NO: 822253 - RNA, 17 nt, Homo sapiens
uauguuauacaaggcaa

SEQ ID NO: 822254 - RNA, 19 nt, Homo sapiens
uauguucaggaaaugaaag

SEQ ID NO: 822255 - RNA, 12 nt, Homo sapiens
uauguugcaaga

SEQ ID NO: 822256 - RNA, 14 nt, Homo sapiens
uauguuuaaaaagu

SEQ ID NO: 822257 - RNA, 12 nt, Homo sapiens
uauguuugcaaa

SEQ ID NO: 822258 - RNA, 17 nt, Homo sapiens
uauguuuggaauaaagu

SEQ ID NO: 822259 - RNA, 19 nt, Homo sapiens
uauguuuggaauaaaguca

SEQ ID NO: 822260 - RNA, 18 nt, Homo sapiens
uauuaaaaaaaaagaagg

SEQ ID NO: 822261 - RNA, 16 nt, Homo sapiens
uauuaaacuugucaga

SEQ ID NO: 822262 - RNA, 18 nt, Homo sapiens
uauuaacauaagaaaaga

SEQ ID NO: 822263 - RNA, 20 nt, Homo sapiens
uauuaaggccuuuuccacac

SEQ ID NO: 822264 - RNA, 15 nt, Homo sapiens
uauuaauaaagcauu

SEQ ID NO: 822265 - RNA, 16 nt, Homo sapiens
uauuaauaaagcauuc

SEQ ID NO: 822266 - RNA, 15 nt, Homo sapiens
uauuaaucauacaaa

SEQ ID NO: 822267 - RNA, 23 nt, Homo sapiens
uauuaauuuuuaaggauguugcc

SEQ ID NO: 822268 - RNA, 24 nt, Homo sapiens
uauuaauuuuuaaggauguugcca

SEQ ID NO: 822269 - RNA, 22 nt, Homo sapiens
uauuacacaaagaacuugcugc

SEQ ID NO: 822270 - RNA, 12 nt, Homo sapiens
uauuaccagcaa

SEQ ID NO: 822271 - RNA, 12 nt, Homo sapiens
uauuacuguugc

SEQ ID NO: 822272 - RNA, 18 nt, Homo sapiens
uauuacuguugcauuuac

SEQ ID NO: 822273 - RNA, 18 nt, Homo sapiens
uauuagagcugccugugc

SEQ ID NO: 822274 - RNA, 18 nt, Homo sapiens
uauuagguccauucauua

SEQ ID NO: 822275 - RNA, 20 nt, Homo sapiens
uauuaggucgguacuaagaa

SEQ ID NO: 822276 - RNA, 21 nt, Homo sapiens
uauuaggucgguacuaagaaa

SEQ ID NO: 822277 - RNA, 17 nt, Homo sapiens
uauuagugcuagucuca

SEQ ID NO: 822278 - RNA, 18 nt, Homo sapiens
uauuagugcuagucucag

SEQ ID NO: 822279 - RNA, 17 nt, Homo sapiens
uauuauacgcuggcaac

SEQ ID NO: 822280 - RNA, 19 nt, Homo sapiens
uauuaucugucagcugcaa

SEQ ID NO: 822281 - RNA, 19 nt, Homo sapiens
uauuauugauucacuuacu

SEQ ID NO: 822282 - RNA, 22 nt, Homo sapiens
uauuauugcuguuugguuuguu

SEQ ID NO: 822283 - RNA, 22 nt, Homo sapiens
uauuauugguuguuguauugau

SEQ ID NO: 822284 - RNA, 20 nt, Homo sapiens
uauucaacagcucaccaacu

SEQ ID NO: 822285 - RNA, 21 nt, Homo sapiens
uauucaacagcucaccaacua

SEQ ID NO: 822286 - RNA, 22 nt, Homo sapiens
uauucaauaccgcucaguauuu

SEQ ID NO: 822287 - RNA, 14 nt, Homo sapiens
uauucaaugaacuu

SEQ ID NO: 822288 - RNA, 19 nt, Homo sapiens
uauucaauggaaagcugcu

SEQ ID NO: 822289 - RNA, 23 nt, Homo sapiens
uauucacauauaucaaagugaga

SEQ ID NO: 822290 - RNA, 13 nt, Homo sapiens
uauucacugaugc

SEQ ID NO: 822291 - RNA, 18 nt, Homo sapiens
uauucaguaauaacucua

SEQ ID NO: 822292 - RNA, 16 nt, Homo sapiens
uauucaguaaugaaga

SEQ ID NO: 822293 - RNA, 16 nt, Homo sapiens
uauuccacuuaggaag

SEQ ID NO: 822294 - RNA, 22 nt, Homo sapiens
uauuccauggcuaacuggcgag

SEQ ID NO: 822295 - RNA, 21 nt, Homo sapiens
uauucccaaaaauuacuuugg

SEQ ID NO: 822296 - RNA, 13 nt, Homo sapiens
uauucccauuaga

SEQ ID NO: 822297 - RNA, 18 nt, Homo sapiens
uauucccauuagaccaag

SEQ ID NO: 822298 - RNA, 21 nt, Homo sapiens
uauucgugcauuuuuggauca

SEQ ID NO: 822299 - RNA, 15 nt, Homo sapiens
uauucuaaaaccauu

SEQ ID NO: 822300 - RNA, 20 nt, Homo sapiens
uauucuauaaaacucugcau

SEQ ID NO: 822301 - RNA, 23 nt, Homo sapiens
uauucucaguguagggcagagag

SEQ ID NO: 822302 - RNA, 15 nt, Homo sapiens
uauucucaugccuca

SEQ ID NO: 822303 - RNA, 20 nt, Homo sapiens
uauucucccacugacagaaa

SEQ ID NO: 822304 - RNA, 19 nt, Homo sapiens
uauucucuaaaagcuuuaa

SEQ ID NO: 822305 - RNA, 21 nt, Homo sapiens
gggcgccaccgccacccgcag

SEQ ID NO: 822306 - RNA, 20 nt, Homo sapiens
gggcgcccucucugcuccuu

SEQ ID NO: 822307 - RNA, 17 nt, Homo sapiens
gggcggcccacacccag

SEQ ID NO: 822308 - RNA, 14 nt, Homo sapiens
gggcggggcuguca

SEQ ID NO: 822309 - RNA, 20 nt, Homo sapiens
gggcgguaccuugugcccag

SEQ ID NO: 822310 - RNA, 21 nt, Homo sapiens
gggcuaagguuuccagucaga

SEQ ID NO: 822311 - RNA, 17 nt, Homo sapiens
gggcuacugugaccaug

SEQ ID NO: 822312 - RNA, 22 nt, Homo sapiens
gggcuagucuucccuuaccuca

SEQ ID NO: 822313 - RNA, 23 nt, Homo sapiens
gggcuauuuuuucccccacaaac

SEQ ID NO: 822314 - RNA, 17 nt, Homo sapiens
gggcuccaaaucugccu

SEQ ID NO: 822315 - RNA, 16 nt, Homo sapiens
gggcucuacgucccag

SEQ ID NO: 822316 - RNA, 22 nt, Homo sapiens
ggccucccacagugcugggauu

SEQ ID NO: 822317 - RNA, 20 nt, Homo sapiens
ggccucccacccgaugcugc

SEQ ID NO: 822318 - RNA, 20 nt, Homo sapiens
ggccuccucucucaguuuuu

SEQ ID NO: 822319 - RNA, 17 nt, Homo sapiens
ggccucucucauggcac

SEQ ID NO: 822320 - RNA, 21 nt, Homo sapiens
ggccugaagucccagcauuga

SEQ ID NO: 822321 - RNA, 15 nt, Homo sapiens
ggccugaccaaacag

SEQ ID NO: 822322 - RNA, 15 nt, Homo sapiens
ggccugagagucagc

SEQ ID NO: 822323 - RNA, 15 nt, Homo sapiens
ggccugcacuggugu

SEQ ID NO: 822324 - RNA, 23 nt, Homo sapiens
ggccugcgacccugggggcacag

SEQ ID NO: 822325 - RNA, 12 nt, Homo sapiens
ggccuggcacau

SEQ ID NO: 822326 - RNA, 16 nt, Homo sapiens
ggccuggccaccucuc

SEQ ID NO: 822327 - RNA, 18 nt, Homo sapiens
ggccuggcccucacucaa

SEQ ID NO: 822328 - RNA, 21 nt, Homo sapiens
ggccuggggcgagcacuguga

SEQ ID NO: 822329 - RNA, 16 nt, Homo sapiens
ggccugucgugccagu

SEQ ID NO: 822330 - RNA, 19 nt, Homo sapiens
ggccuuaacacacuggcca

SEQ ID NO: 822331 - RNA, 15 nt, Homo sapiens
ggccuucaccaagca

SEQ ID NO: 822332 - RNA, 20 nt, Homo sapiens
ggccuugguggagcagccag

SEQ ID NO: 822333 - RNA, 13 nt, Homo sapiens
ggccuuuucugug

SEQ ID NO: 822334 - RNA, 20 nt, Homo sapiens
ggccuuuucugugccagaca

SEQ ID NO: 822335 - RNA, 22 nt, Homo sapiens
ggccuuuugcccguugagguag

SEQ ID NO: 822336 - RNA, 17 nt, Homo sapiens
ggcgaaaccccaucucu

SEQ ID NO: 822337 - RNA, 19 nt, Homo sapiens
ggcgacagagcgagacucc

SEQ ID NO: 822338 - RNA, 13 nt, Homo sapiens
ggcgacaguuuuc

SEQ ID NO: 822339 - RNA, 14 nt, Homo sapiens
ggcgagcacuguga

SEQ ID NO: 822340 - RNA, 14 nt, Homo sapiens
ggcgcaguggcuca

SEQ ID NO: 822341 - RNA, 17 nt, Homo sapiens
ggcgccaucgccaagua

SEQ ID NO: 822342 - RNA, 15 nt, Homo sapiens
ggcgcccacccuggg

SEQ ID NO: 822343 - RNA, 20 nt, Homo sapiens
ggcgcccacccugggcucca

SEQ ID NO: 822344 - RNA, 20 nt, Homo sapiens
ggcgccccugccaccucccu

SEQ ID NO: 822345 - RNA, 22 nt, Homo sapiens
ggcgccccugccaccucccuga

SEQ ID NO: 822346 - RNA, 13 nt, Homo sapiens
ggcgccuguaauu

SEQ ID NO: 822347 - RNA, 14 nt, Homo sapiens
ggcgcucccacuca

SEQ ID NO: 822348 - RNA, 20 nt, Homo sapiens
ggcggagguugcaaugagcc

SEQ ID NO: 822349 - RNA, 15 nt, Homo sapiens
ggcggccaggcacag

SEQ ID NO: 822350 - RNA, 16 nt, Homo sapiens
ggcggcccugaccaau

SEQ ID NO: 822351 - RNA, 14 nt, Homo sapiens
ggcggccucuugcu

SEQ ID NO: 822352 - RNA, 14 nt, Homo sapiens
ggcgggcauggcgu

SEQ ID NO: 822353 - RNA, 20 nt, Homo sapiens
ggcggguggaucacgagguc

SEQ ID NO: 822354 - RNA, 22 nt, Homo sapiens
ggcguauuuauacucacugagu

SEQ ID NO: 822355 - RNA, 12 nt, Homo sapiens
ggcuaaaguaaa

SEQ ID NO: 822356 - RNA, 13 nt, Homo sapiens
ggcuaaauacaau

SEQ ID NO: 822357 - RNA, 14 nt, Homo sapiens
ggcuaacaucccac

SEQ ID NO: 822358 - RNA, 21 nt, Homo sapiens
ggcuaacuauauuugcuuuuu

SEQ ID NO: 822359 - RNA, 21 nt, Homo sapiens
ggcuaagaugagauuugccag

SEQ ID NO: 822360 - RNA, 15 nt, Homo sapiens
ggcuaagcacuuuau

SEQ ID NO: 822361 - RNA, 16 nt, Homo sapiens
ggcuaauucaguguca

SEQ ID NO: 822362 - RNA, 17 nt, Homo sapiens
ggcuaauucagugucac

SEQ ID NO: 822363 - RNA, 23 nt, Homo sapiens
ggcuacaaagcguuucuuuacuu

SEQ ID NO: 822364 - RNA, 21 nt, Homo sapiens
ggcuacuaccuagggcacuuu

SEQ ID NO: 822365 - RNA, 21 nt, Homo sapiens
ggcuaggcgugguggugcaug

SEQ ID NO: 822366 - RNA, 17 nt, Homo sapiens
ggcuaguagaacuggau

SEQ ID NO: 822367 - RNA, 21 nt, Homo sapiens
ggcuaugaagggacagcugcu

SEQ ID NO: 822368 - RNA, 13 nt, Homo sapiens
ggcuaugcaaggg

SEQ ID NO: 822369 - RNA, 14 nt, Homo sapiens
ggcuauguaaacaa

SEQ ID NO: 822370 - RNA, 20 nt, Homo sapiens
ggcucaaaugauccucccac

SEQ ID NO: 822371 - RNA, 21 nt, Homo sapiens
ggcucaaggaaaggggguccc

SEQ ID NO: 822372 - RNA, 15 nt, Homo sapiens
ggcucacaccuguaa

SEQ ID NO: 822373 - RNA, 17 nt, Homo sapiens
ggcucacaccuguaauc

SEQ ID NO: 822374 - RNA, 14 nt, Homo sapiens
ggcucacauuucau

SEQ ID NO: 822375 - RNA, 15 nt, Homo sapiens
ggcucacgccuguaa

SEQ ID NO: 822376 - RNA, 17 nt, Homo sapiens
ggcucacgccuguaauu

SEQ ID NO: 822377 - RNA, 21 nt, Homo sapiens
ggcucagguuuugagaagcca

SEQ ID NO: 822378 - RNA, 16 nt, Homo sapiens
ggcucaugaccuggaa

SEQ ID NO: 822379 - RNA, 15 nt, Homo sapiens
ggcuccaaaucugcc

SEQ ID NO: 822380 - RNA, 22 nt, Homo sapiens
ggcuccaccccauccaguucau

SEQ ID NO: 822381 - RNA, 20 nt, Homo sapiens
ggcuccaggccccaccuccu

SEQ ID NO: 822382 - RNA, 16 nt, Homo sapiens
ggcucccacagagaca

SEQ ID NO: 822383 - RNA, 14 nt, Homo sapiens
ggcucccaggacac

SEQ ID NO: 822384 - RNA, 18 nt, Homo sapiens
ggcucccggggcagggca

SEQ ID NO: 822385 - RNA, 19 nt, Homo sapiens
ggcuccggaggacucacca

SEQ ID NO: 822386 - RNA, 21 nt, Homo sapiens
ggcuccugaauaucagucacu

SEQ ID NO: 822387 - RNA, 21 nt, Homo sapiens
ggcucgagagggcugguccuu

SEQ ID NO: 822388 - RNA, 15 nt, Homo sapiens
ggcucuaucuuccuc

SEQ ID NO: 822389 - RNA, 17 nt, Homo sapiens
ggcucucuguaggcaca

SEQ ID NO: 822390 - RNA, 19 nt, Homo sapiens
ggcucugcuucuccaagga

SEQ ID NO: 822391 - RNA, 14 nt, Homo sapiens
ggcucugugccuug

SEQ ID NO: 822392 - RNA, 20 nt, Homo sapiens
ggcucuuaugugugccuuug

SEQ ID NO: 822393 - RNA, 12 nt, Homo sapiens
ggcucuucucau

SEQ ID NO: 822394 - RNA, 15 nt, Homo sapiens
ggcucuucugugauu

SEQ ID NO: 822395 - RNA, 16 nt, Homo sapiens
ggcugaaaaugcaaag

SEQ ID NO: 822396 - RNA, 22 nt, Homo sapiens
ggcugaagaaugaagaccacug

SEQ ID NO: 822397 - RNA, 18 nt, Homo sapiens
ggcugacaugaagcuguu

SEQ ID NO: 822398 - RNA, 19 nt, Homo sapiens
ggcugacaugcucacacau

SEQ ID NO: 822399 - RNA, 16 nt, Homo sapiens
ggcugcacauugccug

SEQ ID NO: 822400 - RNA, 22 nt, Homo sapiens
ggcugcagcgcccggugcucug

SEQ ID NO: 822401 - RNA, 21 nt, Homo sapiens
ggcugccuaccaggggccuuc

SEQ ID NO: 822402 - RNA, 19 nt, Homo sapiens
ggcugccugcaucuauucu

SEQ ID NO: 822403 - RNA, 13 nt, Homo sapiens
ggcugcugugaac

SEQ ID NO: 822404 - RNA, 18 nt, Homo sapiens
ggcugcuguggggaccac

SEQ ID NO: 822405 - RNA, 18 nt, Homo sapiens
ggcugcuuccugugacag

SEQ ID NO: 822406 - RNA, 20 nt, Homo sapiens
ggcugcuuggagcagccuaa

SEQ ID NO: 822407 - RNA, 18 nt, Homo sapiens
ggcuggaagaaccacugu

SEQ ID NO: 822408 - RNA, 15 nt, Homo sapiens
ggcuggagacuggac

SEQ ID NO: 822409 - RNA, 20 nt, Homo sapiens
ggcuggagugcaaugacaca

SEQ ID NO: 822410 - RNA, 20 nt, Homo sapiens
ggcuggagugcaguggcgca

SEQ ID NO: 822411 - RNA, 19 nt, Homo sapiens
ggcuggaguggaguggcgu

SEQ ID NO: 822412 - RNA, 16 nt, Homo sapiens
ggcuggcaguagugcu

SEQ ID NO: 822413 - RNA, 17 nt, Homo sapiens
ggcuggccaaggugucc

SEQ ID NO: 822414 - RNA, 17 nt, Homo sapiens
ggcuggggcuugcccuu

SEQ ID NO: 822415 - RNA, 15 nt, Homo sapiens
ggcuggucucaccca

SEQ ID NO: 822416 - RNA, 18 nt, Homo sapiens
ggcuguauuuaauggcau

SEQ ID NO: 822417 - RNA, 19 nt, Homo sapiens
gcucuggugacaccagccu

SEQ ID NO: 822418 - RNA, 14 nt, Homo sapiens
gcucuggugcugca

SEQ ID NO: 822419 - RNA, 13 nt, Homo sapiens
gcucuggugcuuu

SEQ ID NO: 822420 - RNA, 16 nt, Homo sapiens
gcucuguggaugccag

SEQ ID NO: 822421 - RNA, 16 nt, Homo sapiens
gcucuucucagugucu

SEQ ID NO: 822422 - RNA, 15 nt, Homo sapiens
gcucuucucauuuca

SEQ ID NO: 822423 - RNA, 16 nt, Homo sapiens
gcucuucucauuucac

SEQ ID NO: 822424 - RNA, 20 nt, Homo sapiens
gcucuucucuccaguguuuc

SEQ ID NO: 822425 - RNA, 16 nt, Homo sapiens
gcucuuggaagagcuc

SEQ ID NO: 822426 - RNA, 12 nt, Homo sapiens
gcucuuguuauu

SEQ ID NO: 822427 - RNA, 18 nt, Homo sapiens
gcucuuucucugccagug

SEQ ID NO: 822428 - RNA, 15 nt, Homo sapiens
gcucuuuugugauga

SEQ ID NO: 822429 - RNA, 16 nt, Homo sapiens
gcucuuuugugaugaa

SEQ ID NO: 822430 - RNA, 22 nt, Homo sapiens
gcugaaaaaucacauccuggcc

SEQ ID NO: 822431 - RNA, 17 nt, Homo sapiens
gcugaaagaacauggac

SEQ ID NO: 822432 - RNA, 20 nt, Homo sapiens
gcugaaauugaaaaguuauu

SEQ ID NO: 822433 - RNA, 22 nt, Homo sapiens
gcugaacgcguguguacacggg

SEQ ID NO: 822434 - RNA, 16 nt, Homo sapiens
gcugaacugacaauga

SEQ ID NO: 822435 - RNA, 19 nt, Homo sapiens
gcugaagacauguuucaag

SEQ ID NO: 822436 - RNA, 16 nt, Homo sapiens
gcugaagaguuuacug

SEQ ID NO: 822437 - RNA, 18 nt, Homo sapiens
gcugaaggcuuacuucag

SEQ ID NO: 822438 - RNA, 18 nt, Homo sapiens
gcugacagagcucugggu

SEQ ID NO: 822439 - RNA, 19 nt, Homo sapiens
gcugacccagaguggaguc

SEQ ID NO: 822440 - RNA, 18 nt, Homo sapiens
gcugaccucaccuggucc

SEQ ID NO: 822441 - RNA, 17 nt, Homo sapiens
gcugagaggaagcaaga

SEQ ID NO: 822442 - RNA, 14 nt, Homo sapiens
gcugagaucgugcu

SEQ ID NO: 822443 - RNA, 20 nt, Homo sapiens
gcugagauugugccacugua

SEQ ID NO: 822444 - RNA, 16 nt, Homo sapiens
gcugagcaaucugacc

SEQ ID NO: 822445 - RNA, 20 nt, Homo sapiens
gcugagcaaucugacccuau

SEQ ID NO: 822446 - RNA, 22 nt, Homo sapiens
gcugaggccucucauuccagag

SEQ ID NO: 822447 - RNA, 22 nt, Homo sapiens
gcugaggccuuaucauucauuc

SEQ ID NO: 822448 - RNA, 23 nt, Homo sapiens
gcugaggcggguggaucaccuga

SEQ ID NO: 822449 - RNA, 16 nt, Homo sapiens
gcugagggaccagcca

SEQ ID NO: 822450 - RNA, 18 nt, Homo sapiens
gcugagggccugcuggag

SEQ ID NO: 822451 - RNA, 18 nt, Homo sapiens
gcugagguuccucugccu

SEQ ID NO: 822452 - RNA, 13 nt, Homo sapiens
gcugaguccagag

SEQ ID NO: 822453 - RNA, 19 nt, Homo sapiens
gcugagugcaccacuucaa

SEQ ID NO: 822454 - RNA, 18 nt, Homo sapiens
gcugaguggucugacacc

SEQ ID NO: 822455 - RNA, 15 nt, Homo sapiens
gcugauccugcugac

SEQ ID NO: 822456 - RNA, 20 nt, Homo sapiens
gcugauuuccaggccccuga

SEQ ID NO: 822457 - RNA, 20 nt, Homo sapiens
gcugauuuccccucuucccu

SEQ ID NO: 822458 - RNA, 15 nt, Homo sapiens
gcugcaaaccaggcc

SEQ ID NO: 822459 - RNA, 16 nt, Homo sapiens
gcugcaagguacucug

SEQ ID NO: 822460 - RNA, 21 nt, Homo sapiens
gcugcacaucacaacauuuac

SEQ ID NO: 822461 - RNA, 15 nt, Homo sapiens
gcugcaccacuucca

SEQ ID NO: 822462 - RNA, 16 nt, Homo sapiens
gcugcaccugauuagu

SEQ ID NO: 822463 - RNA, 13 nt, Homo sapiens
gcugcaccugguc

SEQ ID NO: 822464 - RNA, 18 nt, Homo sapiens
gcugcacugaucacccaa

SEQ ID NO: 822465 - RNA, 21 nt, Homo sapiens
gcugcacugaucacccaaugc

SEQ ID NO: 822466 - RNA, 17 nt, Homo sapiens
gcugcacugaugcugcc

SEQ ID NO: 822467 - RNA, 22 nt, Homo sapiens
gcugcaggccgugugucuguca

SEQ ID NO: 822468 - RNA, 19 nt, Homo sapiens
gcugcagguguuugaccuc

SEQ ID NO: 822469 - RNA, 14 nt, Homo sapiens
gcugcagucaucua

SEQ ID NO: 822470 - RNA, 16 nt, Homo sapiens
gcugccaagcacucga

SEQ ID NO: 822471 - RNA, 16 nt, Homo sapiens
gcugccagccacuuca

SEQ ID NO: 822472 - RNA, 23 nt, Homo sapiens
gcugccaggcacuguucaucuca

SEQ ID NO: 822473 - RNA, 20 nt, Homo sapiens
gcugccagguuccuguacua

SEQ ID NO: 822474 - RNA, 18 nt, Homo sapiens
gcugcccagacacauggg

SEQ ID NO: 822475 - RNA, 13 nt, Homo sapiens
gcugcccaucagg

SEQ ID NO: 822476 - RNA, 20 nt, Homo sapiens
gcugccccaaccugcugaag

SEQ ID NO: 822477 - RNA, 15 nt, Homo sapiens
gcugccccaccugcc

SEQ ID NO: 822478 - RNA, 19 nt, Homo sapiens
gcugccccugcaguuggca

SEQ ID NO: 822479 - RNA, 15 nt, Homo sapiens
gcugccucacuuccu

SEQ ID NO: 822480 - RNA, 20 nt, Homo sapiens
gcugccucugggccaugcca

SEQ ID NO: 822481 - RNA, 20 nt, Homo sapiens
gcugccugcuuggcccggcc

SEQ ID NO: 822482 - RNA, 19 nt, Homo sapiens
gcugccuggaacaccagca

SEQ ID NO: 822483 - RNA, 18 nt, Homo sapiens
gcugcgagagaaagggag

SEQ ID NO: 822484 - RNA, 13 nt, Homo sapiens
gcugcuagcacuu

SEQ ID NO: 822485 - RNA, 18 nt, Homo sapiens
gcugcuauuucaucuggu

SEQ ID NO: 822486 - RNA, 21 nt, Homo sapiens
gcugcucagccucauccugag

SEQ ID NO: 822487 - RNA, 12 nt, Homo sapiens
gcugcuccaugg

SEQ ID NO: 822488 - RNA, 14 nt, Homo sapiens
gcugcucuauugua

SEQ ID NO: 822489 - RNA, 15 nt, Homo sapiens
gcugcugacccucuc

SEQ ID NO: 822490 - RNA, 16 nt, Homo sapiens
gcugcugagugacagc

SEQ ID NO: 822491 - RNA, 12 nt, Homo sapiens
gcugcugcugau

SEQ ID NO: 822492 - RNA, 18 nt, Homo sapiens
gcugcugggcugagugac

SEQ ID NO: 822493 - RNA, 15 nt, Homo sapiens
gcugcuggugcacag

SEQ ID NO: 822494 - RNA, 19 nt, Homo sapiens
gcugcuuccuccuggaaau

SEQ ID NO: 822495 - RNA, 22 nt, Homo sapiens
gcugcuuccuggcugggaacaa

SEQ ID NO: 822496 - RNA, 19 nt, Homo sapiens
gcugcuuccugucugagua

SEQ ID NO: 822497 - RNA, 18 nt, Homo sapiens
gcugcuugaccuagcucu

SEQ ID NO: 822498 - RNA, 15 nt, Homo sapiens
gcugcuugcugcuca

SEQ ID NO: 822499 - RNA, 15 nt, Homo sapiens
gcugcuuguccugcu

SEQ ID NO: 822500 - RNA, 23 nt, Homo sapiens
gcuggaaaaccuccuuuaccaga

SEQ ID NO: 822501 - RNA, 17 nt, Homo sapiens
gcuggaagacugugcag

SEQ ID NO: 822502 - RNA, 19 nt, Homo sapiens
gcuggaagauauuccugag

SEQ ID NO: 822503 - RNA, 15 nt, Homo sapiens
gcuggaagcaaagua

SEQ ID NO: 822504 - RNA, 14 nt, Homo sapiens
gcuggaaugcagug

SEQ ID NO: 822505 - RNA, 15 nt, Homo sapiens
gcuggacgugcgcga

SEQ ID NO: 822506 - RNA, 13 nt, Homo sapiens
gcuggacugacca

SEQ ID NO: 822507 - RNA, 16 nt, Homo sapiens
gcuggacugaccaaag

SEQ ID NO: 822508 - RNA, 22 nt, Homo sapiens
gcuggacugaccaaagacugca

SEQ ID NO: 822509 - RNA, 19 nt, Homo sapiens
gcuggagugcaaugcacga

SEQ ID NO: 822510 - RNA, 15 nt, Homo sapiens
cagauguuugccuca

SEQ ID NO: 822511 - RNA, 20 nt, Homo sapiens
cagauuaagaguugccaaaa

SEQ ID NO: 822512 - RNA, 22 nt, Homo sapiens
cagauucagacuuggacuauga

SEQ ID NO: 822513 - RNA, 18 nt, Homo sapiens
cagauuggcucacacuga

SEQ ID NO: 822514 - RNA, 16 nt, Homo sapiens
cagauuuaaaaaaaga

SEQ ID NO: 822515 - RNA, 20 nt, Homo sapiens
cagauuuaaaaaaagaacau

SEQ ID NO: 822516 - RNA, 23 nt, Homo sapiens
cagauuuaaaaaaagaacauaaa

SEQ ID NO: 822517 - RNA, 15 nt, Homo sapiens
cagauuugcauuuca

SEQ ID NO: 822518 - RNA, 16 nt, Homo sapiens
cagauuugcauuucag

SEQ ID NO: 822519 - RNA, 17 nt, Homo sapiens
cagauuugccauucaag

SEQ ID NO: 822520 - RNA, 18 nt, Homo sapiens
cagauuuggaugcacuca

SEQ ID NO: 822521 - RNA, 23 nt, Homo sapiens
cagauuuguaugguuccaaagac

SEQ ID NO: 822522 - RNA, 16 nt, Homo sapiens
cagcaaaagaagacaa

SEQ ID NO: 822523 - RNA, 14 nt, Homo sapiens
cagcaacacagccu

SEQ ID NO: 822524 - RNA, 13 nt, Homo sapiens
cagcaacaggaau

SEQ ID NO: 822525 - RNA, 20 nt, Homo sapiens
cagcaacuucuucuccaucc

SEQ ID NO: 822526 - RNA, 17 nt, Homo sapiens
cagcaagggaccugcuc

SEQ ID NO: 822527 - RNA, 23 nt, Homo sapiens
cagcaauacuaagggaagaaaca

SEQ ID NO: 822528 - RNA, 14 nt, Homo sapiens
cagcaauuccaugc

SEQ ID NO: 822529 - RNA, 20 nt, Homo sapiens
cagcaauucuccugccucag

SEQ ID NO: 822530 - RNA, 22 nt, Homo sapiens
cagcaauucuccugccucagcc

SEQ ID NO: 822531 - RNA, 23 nt, Homo sapiens
cagcacaccucagccccacugac

SEQ ID NO: 822532 - RNA, 20 nt, Homo sapiens
cagcacaccuguguccaaga

SEQ ID NO: 822533 - RNA, 20 nt, Homo sapiens
cagcacacgaguuccagacc

SEQ ID NO: 822534 - RNA, 16 nt, Homo sapiens
cagcacagucacccau

SEQ ID NO: 822535 - RNA, 16 nt, Homo sapiens
cagcacagugccugac

SEQ ID NO: 822536 - RNA, 11 nt, Homo sapiens
cagcacccaca

SEQ ID NO: 822537 - RNA, 15 nt, Homo sapiens
cagcacccugcaaaa

SEQ ID NO: 822538 - RNA, 23 nt, Homo sapiens
cagcacguguggccuguucuucu

SEQ ID NO: 822539 - RNA, 15 nt, Homo sapiens
gccuucaagugccaa

SEQ ID NO: 822540 - RNA, 17 nt, Homo sapiens
gccuucaagugccaaac

SEQ ID NO: 822541 - RNA, 10 nt, Homo sapiens
gccuucacag

SEQ ID NO: 822542 - RNA, 13 nt, Homo sapiens
gccuucaccaagc

SEQ ID NO: 822543 - RNA, 19 nt, Homo sapiens
gccuucacgugucuguucc

SEQ ID NO: 822544 - RNA, 15 nt, Homo sapiens
gccuucacuuuacaa

SEQ ID NO: 822545 - RNA, 13 nt, Homo sapiens
gccuucaguuuau

SEQ ID NO: 822546 - RNA, 19 nt, Homo sapiens
gccuucaguuuauuuccac

SEQ ID NO: 822547 - RNA, 14 nt, Homo sapiens
gccuucaucuucac

SEQ ID NO: 822548 - RNA, 19 nt, Homo sapiens
gccuuccaaaaccugcuuc

SEQ ID NO: 822549 - RNA, 15 nt, Homo sapiens
gccuuccacaauuca

SEQ ID NO: 822550 - RNA, 20 nt, Homo sapiens
gccuuccacagugaaugugu

SEQ ID NO: 822551 - RNA, 20 nt, Homo sapiens
gccuuccagcugcugucuuc

SEQ ID NO: 822552 - RNA, 20 nt, Homo sapiens
gccuuccauaauuaugacag

SEQ ID NO: 822553 - RNA, 19 nt, Homo sapiens
gccuucuagcacacuuuuu

SEQ ID NO: 822554 - RNA, 13 nt, Homo sapiens
gccuucucaggaa

SEQ ID NO: 822555 - RNA, 19 nt, Homo sapiens
gccuucugauaguauuccu

SEQ ID NO: 822556 - RNA, 18 nt, Homo sapiens
gccuucuguggccucuug

SEQ ID NO: 822557 - RNA, 16 nt, Homo sapiens
gccuugagagacccag

SEQ ID NO: 822558 - RNA, 20 nt, Homo sapiens
gccuugagucaucuauucaa

SEQ ID NO: 822559 - RNA, 15 nt, Homo sapiens
gccuugccuccucac

SEQ ID NO: 822560 - RNA, 15 nt, Homo sapiens
gccuuggccuugcag

SEQ ID NO: 822561 - RNA, 17 nt, Homo sapiens
gccuuggccuugcagcu

SEQ ID NO: 822562 - RNA, 20 nt, Homo sapiens
gccuugugugaacucaccaa

SEQ ID NO: 822563 - RNA, 21 nt, Homo sapiens
gccuuuaguuuuaacaguuca

SEQ ID NO: 822564 - RNA, 13 nt, Homo sapiens
gccuuuaucucaa

SEQ ID NO: 822565 - RNA, 19 nt, Homo sapiens
gccuuuccccccagagggc

SEQ ID NO: 822566 - RNA, 21 nt, Homo sapiens
gccuuucuaguccuauucuau

SEQ ID NO: 822567 - RNA, 12 nt, Homo sapiens
gccuuucuuugc

SEQ ID NO: 822568 - RNA, 20 nt, Homo sapiens
gccuuuuccacacgcauuaa

SEQ ID NO: 822569 - RNA, 18 nt, Homo sapiens
gccuuuucugugccagac

SEQ ID NO: 822570 - RNA, 24 nt, Homo sapiens
gcgaccauuucucagcaucgugcu

SEQ ID NO: 822571 - RNA, 17 nt, Homo sapiens
gcgacccauucagagac

SEQ ID NO: 822572 - RNA, 19 nt, Homo sapiens
gcgacggcuuccaucugcc

SEQ ID NO: 822573 - RNA, 21 nt, Homo sapiens
gcgagaagaaaggaagagaaa

SEQ ID NO: 822574 - RNA, 15 nt, Homo sapiens
gcgagacuccgucuc

SEQ ID NO: 822575 - RNA, 16 nt, Homo sapiens
gcgagagaaagggagu

SEQ ID NO: 822576 - RNA, 22 nt, Homo sapiens
gcgagaggcagcaagguggcca

SEQ ID NO: 822577 - RNA, 20 nt, Homo sapiens
gcgagcacugugagcaccug

SEQ ID NO: 822578 - RNA, 13 nt, Homo sapiens
gcgaucucagcuc

SEQ ID NO: 822579 - RNA, 17 nt, Homo sapiens
gcgcaaaggugccucau

SEQ ID NO: 822580 - RNA, 22 nt, Homo sapiens
gcgcaagccuguaaucccagcu

SEQ ID NO: 822581 - RNA, 21 nt, Homo sapiens
gcgcaaucucggcucacugca

SEQ ID NO: 822582 - RNA, 21 nt, Homo sapiens
gcgcaggccugcgugcgcugg

SEQ ID NO: 822583 - RNA, 13 nt, Homo sapiens
gcgcagugcuguc

SEQ ID NO: 822584 - RNA, 19 nt, Homo sapiens
gcgcccagccuacauucac

SEQ ID NO: 822585 - RNA, 21 nt, Homo sapiens
gcgcccauccuagugggcacu

SEQ ID NO: 822586 - RNA, 21 nt, Homo sapiens
gcgccugccaucaugccugac

SEQ ID NO: 822587 - RNA, 21 nt, Homo sapiens
gcgcuaauuuugaaugcccuc

SEQ ID NO: 822588 - RNA, 19 nt, Homo sapiens
gcgcuauugcacuccaguc

SEQ ID NO: 822589 - RNA, 13 nt, Homo sapiens
gcgcucaccucag

SEQ ID NO: 822590 - RNA, 14 nt, Homo sapiens
gcgcucagggccau

SEQ ID NO: 822591 - RNA, 14 nt, Homo sapiens
gcgcuguggcucac

SEQ ID NO: 822592 - RNA, 19 nt, Homo sapiens
gcgcuucaguucagcuuua

SEQ ID NO: 822593 - RNA, 21 nt, Homo sapiens
gcggaaggagggagcucugau

SEQ ID NO: 822594 - RNA, 19 nt, Homo sapiens
gcggagucuguccugugac

SEQ ID NO: 822595 - RNA, 13 nt, Homo sapiens
gcggaucaucuaa

SEQ ID NO: 822596 - RNA, 22 nt, Homo sapiens
gcggaucaucuaauucucugug

SEQ ID NO: 822597 - RNA, 13 nt, Homo sapiens
gcggcacguggug

SEQ ID NO: 822598 - RNA, 19 nt, Homo sapiens
gcggcaggaagggggccga

SEQ ID NO: 822599 - RNA, 16 nt, Homo sapiens
gcgggacccgaccccc

SEQ ID NO: 822600 - RNA, 16 nt, Homo sapiens
gcgggaggcaccagcu

SEQ ID NO: 822601 - RNA, 17 nt, Homo sapiens
gcgggucaacauuucca

SEQ ID NO: 822602 - RNA, 12 nt, Homo sapiens
gcgguggcucac

SEQ ID NO: 822603 - RNA, 23 nt, Homo sapiens
gcgguuccucaucugagaggcuc

SEQ ID NO: 822604 - RNA, 14 nt, Homo sapiens
gcguacagaucucu

SEQ ID NO: 822605 - RNA, 20 nt, Homo sapiens
gcguaucaccauacccagcu

SEQ ID NO: 822606 - RNA, 15 nt, Homo sapiens
gcguccccacucccu

SEQ ID NO: 822607 - RNA, 12 nt, Homo sapiens
gcguccugguca

SEQ ID NO: 822608 - RNA, 12 nt, Homo sapiens
gcgucugagcug

SEQ ID NO: 822609 - RNA, 19 nt, Homo sapiens
gcgugaaucuguaucuugc

SEQ ID NO: 822610 - RNA, 14 nt, Homo sapiens
gcgugaccuugcaa

SEQ ID NO: 822611 - RNA, 15 nt, Homo sapiens
gcgugcacaucugcu

SEQ ID NO: 822612 - RNA, 16 nt, Homo sapiens
gcgugcgagcacacac

SEQ ID NO: 822613 - RNA, 15 nt, Homo sapiens
gcgugguagugcaag

SEQ ID NO: 822614 - RNA, 13 nt, Homo sapiens
gcgugguggcaca

SEQ ID NO: 822615 - RNA, 19 nt, Homo sapiens
gcgugguggcgggcaccua

SEQ ID NO: 822616 - RNA, 20 nt, Homo sapiens
gcgugucucugccauguggc

SEQ ID NO: 822617 - RNA, 16 nt, Homo sapiens
gcguguguacacggga

SEQ ID NO: 822618 - RNA, 22 nt, Homo sapiens
gcguguuucugacucugagcua

SEQ ID NO: 822619 - RNA, 15 nt, Homo sapiens
gcguuguuacaggaa

SEQ ID NO: 822620 - RNA, 20 nt, Homo sapiens
gcguuugugcauaucugccu

SEQ ID NO: 822621 - RNA, 13 nt, Homo sapiens
gcuaaaagggaaa

SEQ ID NO: 822622 - RNA, 16 nt, Homo sapiens
gcuaaaggaagugaau

SEQ ID NO: 822623 - RNA, 20 nt, Homo sapiens
gcuaaauaggaaaguuuuga

SEQ ID NO: 822624 - RNA, 22 nt, Homo sapiens
gcuaaauccucauguuacucag

SEQ ID NO: 822625 - RNA, 13 nt, Homo sapiens
gcuaacacgguga

SEQ ID NO: 822626 - RNA, 20 nt, Homo sapiens
gcuaacuuaguaagugcuuu

SEQ ID NO: 822627 - RNA, 17 nt, Homo sapiens
gcuaagauaccaaaacc

SEQ ID NO: 822628 - RNA, 22 nt, Homo sapiens
gcuaagauacugaugacagugu

SEQ ID NO: 822629 - RNA, 21 nt, Homo sapiens
gcuaagauagaggggcucugg

SEQ ID NO: 822630 - RNA, 22 nt, Homo sapiens
cagagaagcuccugcuacuucc

SEQ ID NO: 822631 - RNA, 16 nt, Homo sapiens
cagagaaggccuuaca

SEQ ID NO: 822632 - RNA, 17 nt, Homo sapiens
cagagaaguuuguagcc

SEQ ID NO: 822633 - RNA, 20 nt, Homo sapiens
cagagaaucauacuuagcaa

SEQ ID NO: 822634 - RNA, 14 nt, Homo sapiens
cagagacaccugca

SEQ ID NO: 822635 - RNA, 18 nt, Homo sapiens
cagagacaggcccaagag

SEQ ID NO: 822636 - RNA, 14 nt, Homo sapiens
cagagacagggaaa

SEQ ID NO: 822637 - RNA, 17 nt, Homo sapiens
cagagacauacuugaag

SEQ ID NO: 822638 - RNA, 21 nt, Homo sapiens
cagagacccaacagcagugau

SEQ ID NO: 822639 - RNA, 17 nt, Homo sapiens
cagagacccagaucuca

SEQ ID NO: 822640 - RNA, 13 nt, Homo sapiens
cagagacuaugua

SEQ ID NO: 822641 - RNA, 17 nt, Homo sapiens
cagagagacagacuuga

SEQ ID NO: 822642 - RNA, 15 nt, Homo sapiens
cagagagaggcauuu

SEQ ID NO: 822643 - RNA, 22 nt, Homo sapiens
cagagagaggggagaagccugg

SEQ ID NO: 822644 - RNA, 15 nt, Homo sapiens
cagagagcagcuuca

SEQ ID NO: 822645 - RNA, 20 nt, Homo sapiens
cagagaggccuuuuguuuaa

SEQ ID NO: 822646 - RNA, 13 nt, Homo sapiens
cagagagggccca

SEQ ID NO: 822647 - RNA, 14 nt, Homo sapiens
cagagauaacaucc

SEQ ID NO: 822648 - RNA, 18 nt, Homo sapiens
cagagaugaacaucuaac

SEQ ID NO: 822649 - RNA, 23 nt, Homo sapiens
cagagaugcaccaccaagccaag

SEQ ID NO: 822650 - RNA, 22 nt, Homo sapiens
cagagaugcauuuggaacagug

SEQ ID NO: 822651 - RNA, 17 nt, Homo sapiens
cagagcaaaagacuuga

SEQ ID NO: 822652 - RNA, 20 nt, Homo sapiens
cagagcaagacucugucuca

SEQ ID NO: 822653 - RNA, 24 nt, Homo sapiens
cagagcaagagauaagucuuucau

SEQ ID NO: 822654 - RNA, 22 nt, Homo sapiens
cagagcaaguuccugagugcgu

SEQ ID NO: 822655 - RNA, 16 nt, Homo sapiens
cagagcagagucugaa

SEQ ID NO: 822656 - RNA, 17 nt, Homo sapiens
cagagcagugacccauc

SEQ ID NO: 822657 - RNA, 16 nt, Homo sapiens
cagagcauacaacaga

SEQ ID NO: 822658 - RNA, 22 nt, Homo sapiens
cagagcaucucggaguucagac

SEQ ID NO: 822659 - RNA, 22 nt, Homo sapiens
cagagcauugcuauuuaucuca

SEQ ID NO: 822660 - RNA, 15 nt, Homo sapiens
cagagccagaugcag

SEQ ID NO: 822661 - RNA, 16 nt, Homo sapiens
cagagcccagcuccaa

SEQ ID NO: 822662 - RNA, 12 nt, Homo sapiens
cagagcccggug

SEQ ID NO: 822663 - RNA, 22 nt, Homo sapiens
cagagccucggcccuagcauug

SEQ ID NO: 822664 - RNA, 22 nt, Homo sapiens
cagagccucguuucugcuuuca

SEQ ID NO: 822665 - RNA, 17 nt, Homo sapiens
cagagcugucugaacuc

SEQ ID NO: 822666 - RNA, 17 nt, Homo sapiens
cagagcugugccugcuc

SEQ ID NO: 822667 - RNA, 17 nt, Homo sapiens
cagaggaacuccagaga

SEQ ID NO: 822668 - RNA, 22 nt, Homo sapiens
cagaggaauaacaucaccacug

SEQ ID NO: 822669 - RNA, 19 nt, Homo sapiens
cagaggaguuucuuaauga

SEQ ID NO: 822670 - RNA, 22 nt, Homo sapiens
cagaggcagcgaguuguggaaa

SEQ ID NO: 822671 - RNA, 23 nt, Homo sapiens
cagaggcccuggaggucuccagg

SEQ ID NO: 822672 - RNA, 14 nt, Homo sapiens
cagaggcugauguc

SEQ ID NO: 822673 - RNA, 14 nt, Homo sapiens
cagaggggaaacca

SEQ ID NO: 822674 - RNA, 13 nt, Homo sapiens
cagagguauuccu

SEQ ID NO: 822675 - RNA, 20 nt, Homo sapiens
cagaggucguuugauuucaa

SEQ ID NO: 822676 - RNA, 13 nt, Homo sapiens
cagaggucuccca

SEQ ID NO: 822677 - RNA, 21 nt, Homo sapiens
cagagguuaucugucugcauu

SEQ ID NO: 822678 - RNA, 20 nt, Homo sapiens
cagagguugcagugagccga

SEQ ID NO: 822679 - RNA, 18 nt, Homo sapiens
cagaguauuaucacugcu

SEQ ID NO: 822680 - RNA, 23 nt, Homo sapiens
cagagucuaggcuaagcacuuua

SEQ ID NO: 822681 - RNA, 20 nt, Homo sapiens
cagagucucgcucuguugcc

SEQ ID NO: 822682 - RNA, 20 nt, Homo sapiens
cagagucuugcucuguugcc

SEQ ID NO: 822683 - RNA, 14 nt, Homo sapiens
cagagugaacacuc

SEQ ID NO: 822684 - RNA, 14 nt, Homo sapiens
cagagugacaguca

SEQ ID NO: 822685 - RNA, 20 nt, Homo sapiens
cagagugagacuccaucuca

SEQ ID NO: 822686 - RNA, 23 nt, Homo sapiens
cagagugagccagugagggcagu

SEQ ID NO: 822687 - RNA, 11 nt, Homo sapiens
cagagugccac

SEQ ID NO: 822688 - RNA, 22 nt, Homo sapiens
cagaguggaguugaaacugcua

SEQ ID NO: 822689 - RNA, 17 nt, Homo sapiens
cagaguggcccaagacu

SEQ ID NO: 822690 - RNA, 15 nt, Homo sapiens
cagaguggggagcuc

SEQ ID NO: 822691 - RNA, 15 nt, Homo sapiens
cagaguguucccuga

SEQ ID NO: 822692 - RNA, 16 nt, Homo sapiens
cagaguguucccugac

SEQ ID NO: 822693 - RNA, 23 nt, Homo sapiens
cagaguuaaaauguuuacuguaa

SEQ ID NO: 822694 - RNA, 21 nt, Homo sapiens
cagaguuccugcggagugaag

SEQ ID NO: 822695 - RNA, 15 nt, Homo sapiens
cagaguucugcucua

SEQ ID NO: 822696 - RNA, 15 nt, Homo sapiens
cagaguugcaaagau

SEQ ID NO: 822697 - RNA, 23 nt, Homo sapiens
cagaguugcaaagaucuuuucca

SEQ ID NO: 822698 - RNA, 14 nt, Homo sapiens
cagaguuguugcuu

SEQ ID NO: 822699 - RNA, 12 nt, Homo sapiens
cagaguuugugu

SEQ ID NO: 822700 - RNA, 18 nt, Homo sapiens
cagaguuuuuaaagccuu

SEQ ID NO: 822701 - RNA, 15 nt, Homo sapiens
cagauaaacaacaaa

SEQ ID NO: 822702 - RNA, 14 nt, Homo sapiens
cagauaacucuccu

SEQ ID NO: 822703 - RNA, 17 nt, Homo sapiens
cagauaaguguucuuca

SEQ ID NO: 822704 - RNA, 14 nt, Homo sapiens
cagauacugugagc

SEQ ID NO: 822705 - RNA, 21 nt, Homo sapiens
cagauacuucccauuuuggaa

SEQ ID NO: 822706 - RNA, 17 nt, Homo sapiens
cagauagauauaugcuc

SEQ ID NO: 822707 - RNA, 21 nt, Homo sapiens
cagauagcacugggugugaga

SEQ ID NO: 822708 - RNA, 16 nt, Homo sapiens
cagauaucugcaugug

SEQ ID NO: 822709 - RNA, 18 nt, Homo sapiens
cagauauuguaagcauuc

SEQ ID NO: 822710 - RNA, 22 nt, Homo sapiens
cagaucaagaaaaaaagggaga

SEQ ID NO: 822711 - RNA, 17 nt, Homo sapiens
cagaucaagaaaucccu

SEQ ID NO: 822712 - RNA, 15 nt, Homo sapiens
cagaucaauuuguaa

SEQ ID NO: 822713 - RNA, 16 nt, Homo sapiens
cagaucacagcuucag

SEQ ID NO: 822714 - RNA, 17 nt, Homo sapiens
cagaucgaaauuggacu

SEQ ID NO: 822715 - RNA, 16 nt, Homo sapiens
cagaucgcaccacugc

SEQ ID NO: 822716 - RNA, 20 nt, Homo sapiens
cagaucgcaccacugcacuc

SEQ ID NO: 822717 - RNA, 23 nt, Homo sapiens
cagaucuaucuugucaaucccaa

SEQ ID NO: 822718 - RNA, 16 nt, Homo sapiens
cagaucugaacacagu

SEQ ID NO: 822719 - RNA, 23 nt, Homo sapiens
cagaucuggucuaguuaaccuag

SEQ ID NO: 822720 - RNA, 23 nt, Homo sapiens
cagaucuguuucgugcauuggaa

SEQ ID NO: 822721 - RNA, 15 nt, Homo sapiens
cagaugaaaugcauc

SEQ ID NO: 822722 - RNA, 19 nt, Homo sapiens
cagaugaagacaucaggaa

SEQ ID NO: 822723 - RNA, 16 nt, Homo sapiens
cagaugauuguucaaa

SEQ ID NO: 822724 - RNA, 12 nt, Homo sapiens
cagaugcaauug

SEQ ID NO: 822725 - RNA, 21 nt, Homo sapiens
cagaugccauggccugugcug

SEQ ID NO: 822726 - RNA, 18 nt, Homo sapiens
cagaugccauuuuguaca

SEQ ID NO: 822727 - RNA, 21 nt, Homo sapiens
cagaugccucagccuacuuuc

SEQ ID NO: 822728 - RNA, 17 nt, Homo sapiens
cagaugcuccaagauuc

SEQ ID NO: 822729 - RNA, 16 nt, Homo sapiens
cagaugcuuuacaguc

SEQ ID NO: 822730 - RNA, 17 nt, Homo sapiens
cagauggaaaaacugag

SEQ ID NO: 822731 - RNA, 19 nt, Homo sapiens
cagauggaaaaacugaggc

SEQ ID NO: 822732 - RNA, 17 nt, Homo sapiens
cagauggaaaagggaga

SEQ ID NO: 822733 - RNA, 16 nt, Homo sapiens
cagauggcacuuugaa

SEQ ID NO: 822734 - RNA, 14 nt, Homo sapiens
cagauggggcacca

SEQ ID NO: 822735 - RNA, 19 nt, Homo sapiens
cagauggggucugugacug

SEQ ID NO: 822736 - RNA, 20 nt, Homo sapiens
cagauggggucugugacugg

SEQ ID NO: 822737 - RNA, 15 nt, Homo sapiens
cagaugggucugaua

SEQ ID NO: 822738 - RNA, 18 nt, Homo sapiens
cagauguaaauuaacuca

SEQ ID NO: 822739 - RNA, 21 nt, Homo sapiens
cagauguccgucucucuugcu

SEQ ID NO: 822740 - RNA, 21 nt, Homo sapiens
cagaugugaaaacaucucaau

SEQ ID NO: 822741 - RNA, 16 nt, Homo sapiens
cagauguguguucuca

SEQ ID NO: 822742 - RNA, 20 nt, Homo sapiens
cagauguguguucucaguga

SEQ ID NO: 822743 - RNA, 15 nt, Homo sapiens
cagauguucaaauau

SEQ ID NO: 822744 - RNA, 23 nt, Homo sapiens
cagaacagccucccgaaugaagc

SEQ ID NO: 822745 - RNA, 16 nt, Homo sapiens
cagaaccaccccggcc

SEQ ID NO: 822746 - RNA, 23 nt, Homo sapiens
cagaaccauccauaguaguauga

SEQ ID NO: 822747 - RNA, 17 nt, Homo sapiens
cagaaccccuacaugaa

SEQ ID NO: 822748 - RNA, 22 nt, Homo sapiens
cagaaccuguccuugcacacuc

SEQ ID NO: 822749 - RNA, 19 nt, Homo sapiens
cagaaccuucaacccagug

SEQ ID NO: 822750 - RNA, 20 nt, Homo sapiens
cagaacguggugaccuuuca

SEQ ID NO: 822751 - RNA, 14 nt, Homo sapiens
cagaacuacuucuu

SEQ ID NO: 822752 - RNA, 17 nt, Homo sapiens
cagaacucaaaugagcc

SEQ ID NO: 822753 - RNA, 13 nt, Homo sapiens
cagaacugaaccg

SEQ ID NO: 822754 - RNA, 16 nt, Homo sapiens
cagaacugaucucagg

SEQ ID NO: 822755 - RNA, 21 nt, Homo sapiens
cagaacuuuccagggauccag

SEQ ID NO: 822756 - RNA, 18 nt, Homo sapiens
cagaacuuucuaguugcc

SEQ ID NO: 822757 - RNA, 13 nt, Homo sapiens
cagaagaaagggc

SEQ ID NO: 822758 - RNA, 15 nt, Homo sapiens
cagaagaaugggaau

SEQ ID NO: 822759 - RNA, 20 nt, Homo sapiens
cagaagaccccugacucauc

SEQ ID NO: 822760 - RNA, 22 nt, Homo sapiens
cagaagacuugccugcuaggga

SEQ ID NO: 822761 - RNA, 23 nt, Homo sapiens
cagaagccuaggggagucccugu

SEQ ID NO: 822762 - RNA, 15 nt, Homo sapiens
cagaagccuccaagc

SEQ ID NO: 822763 - RNA, 14 nt, Homo sapiens
cagaagccucugcc

SEQ ID NO: 822764 - RNA, 12 nt, Homo sapiens
cagaagcucucg

SEQ ID NO: 822765 - RNA, 13 nt, Homo sapiens
cagaagcuuaaaa

SEQ ID NO: 822766 - RNA, 15 nt, Homo sapiens
cagaaggagagugag

SEQ ID NO: 822767 - RNA, 19 nt, Homo sapiens
cagaaggaggaaguggaag

SEQ ID NO: 822768 - RNA, 19 nt, Homo sapiens
cagaaggaucuucaucuga

SEQ ID NO: 822769 - RNA, 16 nt, Homo sapiens
cagaaggcaaaaagac

SEQ ID NO: 822770 - RNA, 19 nt, Homo sapiens
cagaaggcaaaaagacauu

SEQ ID NO: 822771 - RNA, 17 nt, Homo sapiens
cagaaggccccagagag

SEQ ID NO: 822772 - RNA, 14 nt, Homo sapiens
cagaaggugccacu

SEQ ID NO: 822773 - RNA, 20 nt, Homo sapiens
cagaagugagcuuugcugcu

SEQ ID NO: 822774 - RNA, 14 nt, Homo sapiens
cagaaguuccucaa

SEQ ID NO: 822775 - RNA, 21 nt, Homo sapiens
cagaauaacugguacacuuca

SEQ ID NO: 822776 - RNA, 21 nt, Homo sapiens
cagaauaggaaaacauugcaa

SEQ ID NO: 822777 - RNA, 17 nt, Homo sapiens
cagaauauaauucccaa

SEQ ID NO: 822778 - RNA, 23 nt, Homo sapiens
cagaauauguuucaaacuuugga

SEQ ID NO: 822779 - RNA, 12 nt, Homo sapiens
cagaauccagcu

SEQ ID NO: 822780 - RNA, 21 nt, Homo sapiens
cagaaucccuuaacaguugua

SEQ ID NO: 822781 - RNA, 13 nt, Homo sapiens
cagaauccugaug

SEQ ID NO: 822782 - RNA, 16 nt, Homo sapiens
cagaauccugauggua

SEQ ID NO: 822783 - RNA, 18 nt, Homo sapiens
cagaaugaaaacuguaaa

SEQ ID NO: 822784 - RNA, 21 nt, Homo sapiens
cagaaugcucagggucacuga

SEQ ID NO: 822785 - RNA, 20 nt, Homo sapiens
cagaauguagcaucugagaa

SEQ ID NO: 822786 - RNA, 12 nt, Homo sapiens
cagaauuaugaa

SEQ ID NO: 822787 - RNA, 22 nt, Homo sapiens
cagaauucaaaagugauuaucu

SEQ ID NO: 822788 - RNA, 20 nt, Homo sapiens
cagaauucucagaaucucaa

SEQ ID NO: 822789 - RNA, 13 nt, Homo sapiens
cagaauugcucaa

SEQ ID NO: 822790 - RNA, 22 nt, Homo sapiens
cagaauuugauucguaugauca

SEQ ID NO: 822791 - RNA, 18 nt, Homo sapiens
cagaauuuggguugacuc

SEQ ID NO: 822792 - RNA, 12 nt, Homo sapiens
cagacaaaugga

SEQ ID NO: 822793 - RNA, 12 nt, Homo sapiens
cagacaacagaa

SEQ ID NO: 822794 - RNA, 13 nt, Homo sapiens
cagacacaacagc

SEQ ID NO: 822795 - RNA, 19 nt, Homo sapiens
cagacacacacacacacaa

SEQ ID NO: 822796 - RNA, 18 nt, Homo sapiens
cagacacacccacagaag

SEQ ID NO: 822797 - RNA, 23 nt, Homo sapiens
cagacacaugcuauguucugucu

SEQ ID NO: 822798 - RNA, 23 nt, Homo sapiens
cagacacugaccauccacucuac

SEQ ID NO: 822799 - RNA, 20 nt, Homo sapiens
cagacacuggcauggauaua

SEQ ID NO: 822800 - RNA, 16 nt, Homo sapiens
cagacagaaggugcua

SEQ ID NO: 822801 - RNA, 21 nt, Homo sapiens
cagacaggcggggcccagcgc

SEQ ID NO: 822802 - RNA, 16 nt, Homo sapiens
cagaccaaccuuccau

SEQ ID NO: 822803 - RNA, 18 nt, Homo sapiens
cagaccacagagcuguca

SEQ ID NO: 822804 - RNA, 22 nt, Homo sapiens
cagaccaguuucagagaaauac

SEQ ID NO: 822805 - RNA, 17 nt, Homo sapiens
cagaccaugaaguaaau

SEQ ID NO: 822806 - RNA, 22 nt, Homo sapiens
cagacccacugaaaugaccaag

SEQ ID NO: 822807 - RNA, 20 nt, Homo sapiens
cagaccccgggucuccuugg

SEQ ID NO: 822808 - RNA, 17 nt, Homo sapiens
cagacccuucaauggaa

SEQ ID NO: 822809 - RNA, 17 nt, Homo sapiens
cagacgggucugagacu

SEQ ID NO: 822810 - RNA, 13 nt, Homo sapiens
cagacgugugacc

SEQ ID NO: 822811 - RNA, 16 nt, Homo sapiens
cagacuagaguacagu

SEQ ID NO: 822812 - RNA, 19 nt, Homo sapiens
cagacucagacuccauuug

SEQ ID NO: 822813 - RNA, 21 nt, Homo sapiens
cagacuccagccugaauguua

SEQ ID NO: 822814 - RNA, 12 nt, Homo sapiens
cagacuccaugg

SEQ ID NO: 822815 - RNA, 18 nt, Homo sapiens
cagacucgggaccaauac

SEQ ID NO: 822816 - RNA, 19 nt, Homo sapiens
cagacucuguaauugaaua

SEQ ID NO: 822817 - RNA, 19 nt, Homo sapiens
cagacugacaguuuacaga

SEQ ID NO: 822818 - RNA, 21 nt, Homo sapiens
cagacuguuagaaaauggaca

SEQ ID NO: 822819 - RNA, 19 nt, Homo sapiens
cagacuguucuuacuguaa

SEQ ID NO: 822820 - RNA, 14 nt, Homo sapiens
cagacuucuccaga

SEQ ID NO: 822821 - RNA, 21 nt, Homo sapiens
cagacuugaaugcuaguuaua

SEQ ID NO: 822822 - RNA, 17 nt, Homo sapiens
cagacuugcuuccugca

SEQ ID NO: 822823 - RNA, 19 nt, Homo sapiens
cagacuuuguguucauuuc

SEQ ID NO: 822824 - RNA, 17 nt, Homo sapiens
cagagaaaaaugcuccc

SEQ ID NO: 822825 - RNA, 18 nt, Homo sapiens
cagagaaacuuaagcaaa

SEQ ID NO: 822826 - RNA, 17 nt, Homo sapiens
cagagaaauacuuucag

SEQ ID NO: 822827 - RNA, 16 nt, Homo sapiens
caauauuaaugaagua

SEQ ID NO: 822828 - RNA, 19 nt, Homo sapiens
caauauugccaugguuuua

SEQ ID NO: 822829 - RNA, 15 nt, Homo sapiens
caauauuuugccuuu

SEQ ID NO: 822830 - RNA, 20 nt, Homo sapiens
caaucaacuuuacuguaaua

SEQ ID NO: 822831 - RNA, 10 nt, Homo sapiens
caaucacaaa

SEQ ID NO: 822832 - RNA, 16 nt, Homo sapiens
caaucagcccagugca

SEQ ID NO: 822833 - RNA, 17 nt, Homo sapiens
caaucaugaaauaugca

SEQ ID NO: 822834 - RNA, 14 nt, Homo sapiens
caauccaacaucca

SEQ ID NO: 822835 - RNA, 20 nt, Homo sapiens
caauccagaggaacaagcau

SEQ ID NO: 822836 - RNA, 20 nt, Homo sapiens
caaucccaacguuuuacaua

SEQ ID NO: 822837 - RNA, 16 nt, Homo sapiens
caauccuaguugucua

SEQ ID NO: 822838 - RNA, 17 nt, Homo sapiens
caaucggguccagagac

SEQ ID NO: 822839 - RNA, 22 nt, Homo sapiens
caaucuauuuuugugugcugug

SEQ ID NO: 822840 - RNA, 18 nt, Homo sapiens
caaucuggcuuagugcca

SEQ ID NO: 822841 - RNA, 16 nt, Homo sapiens
caaucuucuacuuuaa

SEQ ID NO: 822842 - RNA, 14 nt, Homo sapiens
caaucuugaacuca

SEQ ID NO: 822843 - RNA, 18 nt, Homo sapiens
caaucuuguuacugcuga

SEQ ID NO: 822844 - RNA, 14 nt, Homo sapiens
caaucuuugacaau

SEQ ID NO: 822845 - RNA, 22 nt, Homo sapiens
caaugaaaacauguacuacagc

SEQ ID NO: 822846 - RNA, 15 nt, Homo sapiens
caaugacacagucuu

SEQ ID NO: 822847 - RNA, 13 nt, Homo sapiens
caaugagccuuag

SEQ ID NO: 822848 - RNA, 15 nt, Homo sapiens
caaugagcucuucca

SEQ ID NO: 822849 - RNA, 15 nt, Homo sapiens
caaugaugacccacu

SEQ ID NO: 822850 - RNA, 15 nt, Homo sapiens
caaugauuauuugua

SEQ ID NO: 822851 - RNA, 11 nt, Homo sapiens
caaugccagua

SEQ ID NO: 822852 - RNA, 20 nt, Homo sapiens
caaugcccugugcaugccau

SEQ ID NO: 822853 - RNA, 16 nt, Homo sapiens
caaugcuccaucccaa

SEQ ID NO: 822854 - RNA, 12 nt, Homo sapiens
caaugcugaggu

SEQ ID NO: 822855 - RNA, 16 nt, Homo sapiens
caaugggaggcuguga

SEQ ID NO: 822856 - RNA, 16 nt, Homo sapiens
caaugggcucuuccaa

SEQ ID NO: 822857 - RNA, 22 nt, Homo sapiens
caaugguuugugucaaaacugg

SEQ ID NO: 822858 - RNA, 14 nt, Homo sapiens
caauguaagcauac

SEQ ID NO: 822859 - RNA, 13 nt, Homo sapiens
caauguacaauua

SEQ ID NO: 822860 - RNA, 19 nt, Homo sapiens
caauguacauagacccucu

SEQ ID NO: 822861 - RNA, 14 nt, Homo sapiens
caauguauacuuca

SEQ ID NO: 822862 - RNA, 22 nt, Homo sapiens
caauguauacuucagugcucac

SEQ ID NO: 822863 - RNA, 21 nt, Homo sapiens
caauguauuuuaauaacauau

SEQ ID NO: 822864 - RNA, 14 nt, Homo sapiens
caauguguucuuaa

SEQ ID NO: 822865 - RNA, 19 nt, Homo sapiens
caauguuaaagaugcacag

SEQ ID NO: 822866 - RNA, 13 nt, Homo sapiens
caauguucuauua

SEQ ID NO: 822867 - RNA, 21 nt, Homo sapiens
caauguucuuugucucaaaau

SEQ ID NO: 822868 - RNA, 22 nt, Homo sapiens
caauguugcuuaggaugugugc

SEQ ID NO: 822869 - RNA, 19 nt, Homo sapiens
caauuaaaccgcaugugau

SEQ ID NO: 822870 - RNA, 12 nt, Homo sapiens
caauuaaugaca

SEQ ID NO: 822871 - RNA, 18 nt, Homo sapiens
caauuauacuaaaccuca

SEQ ID NO: 822872 - RNA, 22 nt, Homo sapiens
caauuauacuaaaccucacaaa

SEQ ID NO: 822873 - RNA, 20 nt, Homo sapiens
caauuauagugucaugcaga

SEQ ID NO: 822874 - RNA, 17 nt, Homo sapiens
caauuaucaucuuuuga

SEQ ID NO: 822875 - RNA, 15 nt, Homo sapiens
caauuaucuguguca

SEQ ID NO: 822876 - RNA, 17 nt, Homo sapiens
caauucaccaacacagu

SEQ ID NO: 822877 - RNA, 20 nt, Homo sapiens
caauucuaaauccgacuuga

SEQ ID NO: 822878 - RNA, 19 nt, Homo sapiens
caauugcuaccgagaaggu

SEQ ID NO: 822879 - RNA, 12 nt, Homo sapiens
caauugucugcc

SEQ ID NO: 822880 - RNA, 13 nt, Homo sapiens
caauugugcugcc

SEQ ID NO: 822881 - RNA, 15 nt, Homo sapiens
caauugugcugccau

SEQ ID NO: 822882 - RNA, 11 nt, Homo sapiens
caauuguguag

SEQ ID NO: 822883 - RNA, 22 nt, Homo sapiens
caauuguugacaguucugaaga

SEQ ID NO: 822884 - RNA, 14 nt, Homo sapiens
caauuuaugcugcu

SEQ ID NO: 822885 - RNA, 10 nt, Homo sapiens
caauuucacu

SEQ ID NO: 822886 - RNA, 15 nt, Homo sapiens
caauuucagacuccc

SEQ ID NO: 822887 - RNA, 16 nt, Homo sapiens
caauuucauccauguc

SEQ ID NO: 822888 - RNA, 14 nt, Homo sapiens
caauuucuaccuuu

SEQ ID NO: 822889 - RNA, 14 nt, Homo sapiens
caauuucuugguau

SEQ ID NO: 822890 - RNA, 19 nt, Homo sapiens
caauuucuuuuauguuaac

SEQ ID NO: 822891 - RNA, 17 nt, Homo sapiens
caauuuuagauaucaug

SEQ ID NO: 822892 - RNA, 20 nt, Homo sapiens
caauuuucacacacgugaga

SEQ ID NO: 822893 - RNA, 22 nt, Homo sapiens
caauuuugucuuaaguguuucu

SEQ ID NO: 822894 - RNA, 22 nt, Homo sapiens
caauuuuucaagagcuccuuga

SEQ ID NO: 822895 - RNA, 19 nt, Homo sapiens
cacaaaaagugucucugcc

SEQ ID NO: 822896 - RNA, 14 nt, Homo sapiens
cacaaaacuugaaa

SEQ ID NO: 822897 - RNA, 20 nt, Homo sapiens
cacaaaagcagauacuugag

SEQ ID NO: 822898 - RNA, 19 nt, Homo sapiens
cacaaacaauauguuugca

SEQ ID NO: 822899 - RNA, 12 nt, Homo sapiens
cacaaacaugaa

SEQ ID NO: 822900 - RNA, 14 nt, Homo sapiens
cacaaacauucaaa

SEQ ID NO: 822901 - RNA, 19 nt, Homo sapiens
cacaaaccacaacugacac

SEQ ID NO: 822902 - RNA, 20 nt, Homo sapiens
cacaaaccacaacugacaca

SEQ ID NO: 822903 - RNA, 14 nt, Homo sapiens
cacaaacggagccc

SEQ ID NO: 822904 - RNA, 19 nt, Homo sapiens
cacaaaguagaggaaucca

SEQ ID NO: 822905 - RNA, 15 nt, Homo sapiens
cacaaauaaaagcca

SEQ ID NO: 822906 - RNA, 14 nt, Homo sapiens
cacaaauagaguuu

SEQ ID NO: 822907 - RNA, 17 nt, Homo sapiens
caagcccaguaacugca

SEQ ID NO: 822908 - RNA, 13 nt, Homo sapiens
caagccugaucca

SEQ ID NO: 822909 - RNA, 17 nt, Homo sapiens
caagccugucuucagag

SEQ ID NO: 822910 - RNA, 12 nt, Homo sapiens
caagcuauucaa

SEQ ID NO: 822911 - RNA, 19 nt, Homo sapiens
caagcuccuggucuugaga

SEQ ID NO: 822912 - RNA, 22 nt, Homo sapiens
caagcugcucugagccacagug

SEQ ID NO: 822913 - RNA, 12 nt, Homo sapiens
caagcuucacau

SEQ ID NO: 822914 - RNA, 21 nt, Homo sapiens
caagcuugucaaugauuucaa

SEQ ID NO: 822915 - RNA, 19 nt, Homo sapiens
caaggaaacgcuaccucuc

SEQ ID NO: 822916 - RNA, 15 nt, Homo sapiens
caaggaacagccaca

SEQ ID NO: 822917 - RNA, 19 nt, Homo sapiens
caaggaaggcauuuggacc

SEQ ID NO: 822918 - RNA, 15 nt, Homo sapiens
caaggaauaaaugag

SEQ ID NO: 822919 - RNA, 18 nt, Homo sapiens
caaggaaugccugugcca

SEQ ID NO: 822920 - RNA, 20 nt, Homo sapiens
caaggacuaaggccuccagc

SEQ ID NO: 822921 - RNA, 16 nt, Homo sapiens
caaggacuccauugga

SEQ ID NO: 822922 - RNA, 19 nt, Homo sapiens
caaggagagagugagugca

SEQ ID NO: 822923 - RNA, 17 nt, Homo sapiens
caaggagcacaagccac

SEQ ID NO: 822924 - RNA, 18 nt, Homo sapiens
caaggagcacaagccaca

SEQ ID NO: 822925 - RNA, 18 nt, Homo sapiens
caaggauuuuguaagaag

SEQ ID NO: 822926 - RNA, 18 nt, Homo sapiens
caaggcacugacugagca

SEQ ID NO: 822927 - RNA, 19 nt, Homo sapiens
caaggcagcccugucugaa

SEQ ID NO: 822928 - RNA, 16 nt, Homo sapiens
caaggcaggugccucc

SEQ ID NO: 822929 - RNA, 17 nt, Homo sapiens
caaggcaggugccucca

SEQ ID NO: 822930 - RNA, 14 nt, Homo sapiens
caaggccuugccug

SEQ ID NO: 822931 - RNA, 22 nt, Homo sapiens
caaggcgaguggauaauuccaa

SEQ ID NO: 822932 - RNA, 23 nt, Homo sapiens
caaggcgggagggccugcaguga

SEQ ID NO: 822933 - RNA, 13 nt, Homo sapiens
caagggaaaaccc

SEQ ID NO: 822934 - RNA, 14 nt, Homo sapiens
caagggaaaggcaa

SEQ ID NO: 822935 - RNA, 14 nt, Homo sapiens
caagggagggugca

SEQ ID NO: 822936 - RNA, 15 nt, Homo sapiens
caagggaucugccau

SEQ ID NO: 822937 - RNA, 22 nt, Homo sapiens
caaggggcugaaaagaucugaa

SEQ ID NO: 822938 - RNA, 17 nt, Homo sapiens
caagggggugacuggaa

SEQ ID NO: 822939 - RNA, 18 nt, Homo sapiens
caaggggugggccuguga

SEQ ID NO: 822940 - RNA, 20 nt, Homo sapiens
caaggggugggccugugaau

SEQ ID NO: 822941 - RNA, 21 nt, Homo sapiens
caagggucaauuguaacuaau

SEQ ID NO: 822942 - RNA, 18 nt, Homo sapiens
caagggucucacugcuca

SEQ ID NO: 822943 - RNA, 19 nt, Homo sapiens
caaggguggcaggucacug

SEQ ID NO: 822944 - RNA, 22 nt, Homo sapiens
caagguccucucaguucucucc

SEQ ID NO: 822945 - RNA, 19 nt, Homo sapiens
caaggugacacauuacaaa

SEQ ID NO: 822946 - RNA, 21 nt, Homo sapiens
caaggugauuucagacugcag

SEQ ID NO: 822947 - RNA, 22 nt, Homo sapiens
caagguggccacagugucacug

SEQ ID NO: 822948 - RNA, 19 nt, Homo sapiens
caaggugggccuugcuacc

SEQ ID NO: 822949 - RNA, 14 nt, Homo sapiens
caagguguuuccau

SEQ ID NO: 822950 - RNA, 17 nt, Homo sapiens
caaguaacugggauuac

SEQ ID NO: 822951 - RNA, 14 nt, Homo sapiens
caaguacacugaga

SEQ ID NO: 822952 - RNA, 14 nt, Homo sapiens
caaguaugccuuaa

SEQ ID NO: 822953 - RNA, 19 nt, Homo sapiens
caaguauguugagaguugc

SEQ ID NO: 822954 - RNA, 15 nt, Homo sapiens
caagucaccaugcug

SEQ ID NO: 822955 - RNA, 21 nt, Homo sapiens
caagucaggcccuuauuuuca

SEQ ID NO: 822956 - RNA, 14 nt, Homo sapiens
caagucaugccuga

SEQ ID NO: 822957 - RNA, 13 nt, Homo sapiens
caagucccuguca

SEQ ID NO: 822958 - RNA, 21 nt, Homo sapiens
caagucgagagggcuguugga

SEQ ID NO: 822959 - RNA, 19 nt, Homo sapiens
caagucuucccugaucaag

SEQ ID NO: 822960 - RNA, 18 nt, Homo sapiens
caagugaaaaacauccag

SEQ ID NO: 822961 - RNA, 16 nt, Homo sapiens
caagugaaaucaaagg

SEQ ID NO: 822962 - RNA, 23 nt, Homo sapiens
caagugaagaaucuaaugaaugu

SEQ ID NO: 822963 - RNA, 16 nt, Homo sapiens
caagugagacaaaaag

SEQ ID NO: 822964 - RNA, 22 nt, Homo sapiens
caagugagcagagauguacugc

SEQ ID NO: 822965 - RNA, 23 nt, Homo sapiens
caagugagcagagauguacugca

SEQ ID NO: 822966 - RNA, 17 nt, Homo sapiens
caagugauaucaccucu

SEQ ID NO: 822967 - RNA, 19 nt, Homo sapiens
caagugauccuuccaccuc

SEQ ID NO: 822968 - RNA, 19 nt, Homo sapiens
caagugauucuccugccuc

SEQ ID NO: 822969 - RNA, 17 nt, Homo sapiens
caagugccacaugccua

SEQ ID NO: 822970 - RNA, 22 nt, Homo sapiens
caagugccucuuguugcagaga

SEQ ID NO: 822971 - RNA, 18 nt, Homo sapiens
caagugcugcacaaaagc

SEQ ID NO: 822972 - RNA, 22 nt, Homo sapiens
caaguggcugggugcccucuca

SEQ ID NO: 822973 - RNA, 23 nt, Homo sapiens
caagugggauuugcauaaaguga

SEQ ID NO: 822974 - RNA, 14 nt, Homo sapiens
caagugggugaaug

SEQ ID NO: 822975 - RNA, 19 nt, Homo sapiens
caaguguccugaaagcuua

SEQ ID NO: 822976 - RNA, 23 nt, Homo sapiens
caaguuaaagugaauaaccacuu

SEQ ID NO: 822977 - RNA, 17 nt, Homo sapiens
caaguuacagugaugcu

SEQ ID NO: 822978 - RNA, 22 nt, Homo sapiens
caaguucauaggucuccaagac

SEQ ID NO: 822979 - RNA, 23 nt, Homo sapiens
caaguucauugaugacccucuga

SEQ ID NO: 822980 - RNA, 16 nt, Homo sapiens
caaguugcaucagaaa

SEQ ID NO: 822981 - RNA, 20 nt, Homo sapiens
caaguugcaucagaaagcuu

SEQ ID NO: 822982 - RNA, 17 nt, Homo sapiens
caaguuguguuugauau

SEQ ID NO: 822983 - RNA, 18 nt, Homo sapiens
caaguuguugacugugau

SEQ ID NO: 822984 - RNA, 20 nt, Homo sapiens
caaaacugauacccuuugaa

SEQ ID NO: 822985 - RNA, 13 nt, Homo sapiens
caaaacuuaggca

SEQ ID NO: 822986 - RNA, 15 nt, Homo sapiens
caaaacuugcaucua

SEQ ID NO: 822987 - RNA, 22 nt, Homo sapiens
caaaagaagacaacauuucuca

SEQ ID NO: 822988 - RNA, 17 nt, Homo sapiens
caaaagaauaagacaag

SEQ ID NO: 822989 - RNA, 19 nt, Homo sapiens
caaaagagaaauacauaaa

SEQ ID NO: 822990 - RNA, 21 nt, Homo sapiens
caaaagauacggcccaugcaa

SEQ ID NO: 822991 - RNA, 22 nt, Homo sapiens
caaaagauacggcccaugcaau

SEQ ID NO: 822992 - RNA, 12 nt, Homo sapiens
caaaagauguau

SEQ ID NO: 822993 - RNA, 22 nt, Homo sapiens
caaaagcaagggaccuucaugc

SEQ ID NO: 822994 - RNA, 15 nt, Homo sapiens
caaaagcuauuuaaa

SEQ ID NO: 822995 - RNA, 14 nt, Homo sapiens
caaaaggaccccaa

SEQ ID NO: 822996 - RNA, 20 nt, Homo sapiens
caaaagggguuaauguuacu

SEQ ID NO: 822997 - RNA, 19 nt, Homo sapiens
caaaaguuacccaaagggc

SEQ ID NO: 822998 - RNA, 22 nt, Homo sapiens
caaaaguuucuuacucaaggaa

SEQ ID NO: 822999 - RNA, 14 nt, Homo sapiens
caaaauaaugaagu

SEQ ID NO: 823000 - RNA, 15 nt, Homo sapiens
caaaauaaugaaguu

SEQ ID NO: 823001 - RNA, 22 nt, Homo sapiens
caaaauacagauuugaauagca

SEQ ID NO: 823002 - RNA, 19 nt, Homo sapiens
caaaauagagaaucccacu

SEQ ID NO: 823003 - RNA, 21 nt, Homo sapiens
caaaauauauuuuguuuacaa

SEQ ID NO: 823004 - RNA, 20 nt, Homo sapiens
caaaauauuuaagugaagga

SEQ ID NO: 823005 - RNA, 13 nt, Homo sapiens
caaaaucaauuaa

SEQ ID NO: 823006 - RNA, 18 nt, Homo sapiens
caaaaugacaaugaugau

SEQ ID NO: 823007 - RNA, 23 nt, Homo sapiens
caaaaugccaagggggugacugg

SEQ ID NO: 823008 - RNA, 16 nt, Homo sapiens
caaaaugcucuugucc

SEQ ID NO: 823009 - RNA, 23 nt, Homo sapiens
caaaaugcuucugcacacaaaac

SEQ ID NO: 823010 - RNA, 22 nt, Homo sapiens
caaaauggaaauuuaaaugaca

SEQ ID NO: 823011 - RNA, 13 nt, Homo sapiens
caaaaugucucuu

SEQ ID NO: 823012 - RNA, 21 nt, Homo sapiens
caaaauuaagcaaauguuaaa

SEQ ID NO: 823013 - RNA, 20 nt, Homo sapiens
caaaauucacuaaucuugaa

SEQ ID NO: 823014 - RNA, 14 nt, Homo sapiens
caaacaaaauuucu

SEQ ID NO: 823015 - RNA, 19 nt, Homo sapiens
caaacaagaggacuguguu

SEQ ID NO: 823016 - RNA, 13 nt, Homo sapiens
caaacaccaguca

SEQ ID NO: 823017 - RNA, 13 nt, Homo sapiens
caaacaccuucca

SEQ ID NO: 823018 - RNA, 19 nt, Homo sapiens
caaacacucaguccacugu

SEQ ID NO: 823019 - RNA, 18 nt, Homo sapiens
caaacacugcaguuuccu

SEQ ID NO: 823020 - RNA, 22 nt, Homo sapiens
caaacacuugaagugagaagau

SEQ ID NO: 823021 - RNA, 19 nt, Homo sapiens
caaacaggcuguaauucca

SEQ ID NO: 823022 - RNA, 20 nt, Homo sapiens
caaacauguuguacauuuca

SEQ ID NO: 823023 - RNA, 22 nt, Homo sapiens
caaaccacuucuccaugcugca

SEQ ID NO: 823024 - RNA, 19 nt, Homo sapiens
caaaccauuucagccaaac

SEQ ID NO: 823025 - RNA, 14 nt, Homo sapiens
caaaccauuuccaa

SEQ ID NO: 823026 - RNA, 16 nt, Homo sapiens
caaaccgagugcaaug

SEQ ID NO: 823027 - RNA, 19 nt, Homo sapiens
caaaccuaaugaucaucug

SEQ ID NO: 823028 - RNA, 14 nt, Homo sapiens
caaaccuaccaaaa

SEQ ID NO: 823029 - RNA, 15 nt, Homo sapiens
caaaccuacugccca

SEQ ID NO: 823030 - RNA, 20 nt, Homo sapiens
caaaccuacugcccacauuu

SEQ ID NO: 823031 - RNA, 14 nt, Homo sapiens
caaaccuacuguau

SEQ ID NO: 823032 - RNA, 22 nt, Homo sapiens
caaaccuucugccuuugauguu

SEQ ID NO: 823033 - RNA, 19 nt, Homo sapiens
caaacguuuugaacuaaua

SEQ ID NO: 823034 - RNA, 19 nt, Homo sapiens
caaacuaugaucacaguga

SEQ ID NO: 823035 - RNA, 23 nt, Homo sapiens
caaacucaguucaaaccauuuca

SEQ ID NO: 823036 - RNA, 14 nt, Homo sapiens
caaacucaguucga

SEQ ID NO: 823037 - RNA, 13 nt, Homo sapiens
caaacuccugacc

SEQ ID NO: 823038 - RNA, 19 nt, Homo sapiens
caaacucuucccucucuca

SEQ ID NO: 823039 - RNA, 23 nt, Homo sapiens
caaacucuuuuuuaaaaauuacu

SEQ ID NO: 823040 - RNA, 23 nt, Homo sapiens
caaacugcuuuuuccaacucaga

SEQ ID NO: 823041 - RNA, 11 nt, Homo sapiens
caaacugugaa

SEQ ID NO: 823042 - RNA, 18 nt, Homo sapiens
caaacugugaagcauuua

SEQ ID NO: 823043 - RNA, 14 nt, Homo sapiens
caaacuuccaguca

SEQ ID NO: 823044 - RNA, 17 nt, Homo sapiens
caaacuuuguuugucac

SEQ ID NO: 823045 - RNA, 20 nt, Homo sapiens
caaagaaaaaaaaaaaagcc

SEQ ID NO: 823046 - RNA, 22 nt, Homo sapiens
caaagaagacucaguaugcuuu

SEQ ID NO: 823047 - RNA, 13 nt, Homo sapiens
caaagaagguguu

SEQ ID NO: 823048 - RNA, 15 nt, Homo sapiens
caaagaauauuccau

SEQ ID NO: 823049 - RNA, 20 nt, Homo sapiens
caaagaauuacaguacacau

SEQ ID NO: 823050 - RNA, 12 nt, Homo sapiens
caaagacaucaa

SEQ ID NO: 823051 - RNA, 13 nt, Homo sapiens
caaagacugugaa

SEQ ID NO: 823052 - RNA, 19 nt, Homo sapiens
caaagagcaauauuccagu

SEQ ID NO: 823053 - RNA, 13 nt, Homo sapiens
caaagaggcugcc

SEQ ID NO: 823054 - RNA, 20 nt, Homo sapiens
caaagaggcugccccucuca

SEQ ID NO: 823055 - RNA, 15 nt, Homo sapiens
caaagauuacaacuu

SEQ ID NO: 823056 - RNA, 13 nt, Homo sapiens
caaagauuucuca

SEQ ID NO: 823057 - RNA, 21 nt, Homo sapiens
caaagauuuuuggcacuuugu

SEQ ID NO: 823058 - RNA, 14 nt, Homo sapiens
auuuggagugaugg

SEQ ID NO: 823059 - RNA, 20 nt, Homo sapiens
auuugggagcugaaccaaag

SEQ ID NO: 823060 - RNA, 17 nt, Homo sapiens
auuugggccugcuccag

SEQ ID NO: 823061 - RNA, 20 nt, Homo sapiens
auuugggccugcuccagacc

SEQ ID NO: 823062 - RNA, 20 nt, Homo sapiens
auuuggguucugccugccag

SEQ ID NO: 823063 - RNA, 17 nt, Homo sapiens
auuuggucugccagaau

SEQ ID NO: 823064 - RNA, 16 nt, Homo sapiens
auuuggugacugugua

SEQ ID NO: 823065 - RNA, 23 nt, Homo sapiens
auuuggugacuguguaacuuucu

SEQ ID NO: 823066 - RNA, 14 nt, Homo sapiens
auuuguaacuuuag

SEQ ID NO: 823067 - RNA, 18 nt, Homo sapiens
auuuguaaguaacacagu

SEQ ID NO: 823068 - RNA, 20 nt, Homo sapiens
auuuguaauugaacuuaucc

SEQ ID NO: 823069 - RNA, 16 nt, Homo sapiens
auuuguagcaauuuaa

SEQ ID NO: 823070 - RNA, 16 nt, Homo sapiens
auuuguagcacugagg

SEQ ID NO: 823071 - RNA, 21 nt, Homo sapiens
auuuguaugguuccaaagaca

SEQ ID NO: 823072 - RNA, 15 nt, Homo sapiens
auuuguauuaugcug

SEQ ID NO: 823073 - RNA, 17 nt, Homo sapiens
auuuguauuuugugaug

SEQ ID NO: 823074 - RNA, 14 nt, Homo sapiens
auuugucuucauga

SEQ ID NO: 823075 - RNA, 15 nt, Homo sapiens
auuugugccacuuua

SEQ ID NO: 823076 - RNA, 20 nt, Homo sapiens
auuugugcuaccccuuugau

SEQ ID NO: 823077 - RNA, 23 nt, Homo sapiens
auuugugugugugauauaugcau

SEQ ID NO: 823078 - RNA, 14 nt, Homo sapiens
auuuguuaucucaa

SEQ ID NO: 823079 - RNA, 14 nt, Homo sapiens
auuuguucagagag

SEQ ID NO: 823080 - RNA, 17 nt, Homo sapiens
auuuguuccuggaguuu

SEQ ID NO: 823081 - RNA, 16 nt, Homo sapiens
auuuguuuaaagaaua

SEQ ID NO: 823082 - RNA, 16 nt, Homo sapiens
auuuguuugcaauuuu

SEQ ID NO: 823083 - RNA, 24 nt, Homo sapiens
auuuuaaaaacugacuuaaugcuc

SEQ ID NO: 823084 - RNA, 18 nt, Homo sapiens
auuuuaaagacucaaggu

SEQ ID NO: 823085 - RNA, 13 nt, Homo sapiens
auuuuaaauaucc

SEQ ID NO: 823086 - RNA, 18 nt, Homo sapiens
auuuuaaaucauuaggaa

SEQ ID NO: 823087 - RNA, 16 nt, Homo sapiens
auuuuaaggauaugau

SEQ ID NO: 823088 - RNA, 20 nt, Homo sapiens
auuuuaagguugcacacagu

SEQ ID NO: 823089 - RNA, 14 nt, Homo sapiens
auuuuaaguaggaa

SEQ ID NO: 823090 - RNA, 16 nt, Homo sapiens
auuuuaauaacauauc

SEQ ID NO: 823091 - RNA, 13 nt, Homo sapiens
auuuuaauuaucu

SEQ ID NO: 823092 - RNA, 15 nt, Homo sapiens
auuuuaauucuguga

SEQ ID NO: 823093 - RNA, 23 nt, Homo sapiens
auuuuacaauuuuuuaucaugca

SEQ ID NO: 823094 - RNA, 22 nt, Homo sapiens
auuuuacacguaucucuuggua

SEQ ID NO: 823095 - RNA, 13 nt, Homo sapiens
auuuuaccaaagc

SEQ ID NO: 823096 - RNA, 14 nt, Homo sapiens
auuuuagacacuuc

SEQ ID NO: 823097 - RNA, 18 nt, Homo sapiens
auuuuagauaauucuuaa

SEQ ID NO: 823098 - RNA, 18 nt, Homo sapiens
auuuuauacccaaaaccc

SEQ ID NO: 823099 - RNA, 22 nt, Homo sapiens
auuuuauaugcuuacugauaua

SEQ ID NO: 823100 - RNA, 15 nt, Homo sapiens
auuuuaucuguggag

SEQ ID NO: 823101 - RNA, 13 nt, Homo sapiens
auuuuaugaacau

SEQ ID NO: 823102 - RNA, 17 nt, Homo sapiens
auuuuaugccaguuguu

SEQ ID NO: 823103 - RNA, 13 nt, Homo sapiens
auuuuaugcugcu

SEQ ID NO: 823104 - RNA, 21 nt, Homo sapiens
auuuuaugcuggacucuggac

SEQ ID NO: 823105 - RNA, 23 nt, Homo sapiens
auuuuauguuuaaaaaguauguu

SEQ ID NO: 823106 - RNA, 15 nt, Homo sapiens
auuuuauuaaacaca

SEQ ID NO: 823107 - RNA, 16 nt, Homo sapiens
auuuuauuuuacuauu

SEQ ID NO: 823108 - RNA, 14 nt, Homo sapiens
auuuucaaggccuu

SEQ ID NO: 823109 - RNA, 14 nt, Homo sapiens
auuuucagcauuaa

SEQ ID NO: 823110 - RNA, 15 nt, Homo sapiens
auuuucagccuacag

SEQ ID NO: 823111 - RNA, 16 nt, Homo sapiens
auuuucaguuauaugu

SEQ ID NO: 823112 - RNA, 22 nt, Homo sapiens
auuuucauugauucguaugcca

SEQ ID NO: 823113 - RNA, 19 nt, Homo sapiens
auuuuccugagaccucaau

SEQ ID NO: 823114 - RNA, 18 nt, Homo sapiens
auuuuccuguucagugag

SEQ ID NO: 823115 - RNA, 16 nt, Homo sapiens
auuuucuauuuaugua

SEQ ID NO: 823116 - RNA, 19 nt, Homo sapiens
auuuucucuuaacaagacu

SEQ ID NO: 823117 - RNA, 19 nt, Homo sapiens
auuuucuggaauacaugaa

SEQ ID NO: 823118 - RNA, 20 nt, Homo sapiens
auuuucuguggaucauuucc

SEQ ID NO: 823119 - RNA, 18 nt, Homo sapiens
auuuucuguucagauuaa

SEQ ID NO: 823120 - RNA, 16 nt, Homo sapiens
auuuucuucucugcac

SEQ ID NO: 823121 - RNA, 16 nt, Homo sapiens
auuuucuuuuuuuaac

SEQ ID NO: 823122 - RNA, 16 nt, Homo sapiens
auuuugaaaaaugaga

SEQ ID NO: 823123 - RNA, 20 nt, Homo sapiens
auuuugaacagaacugcuau

SEQ ID NO: 823124 - RNA, 15 nt, Homo sapiens
auuuugaagugcugu

SEQ ID NO: 823125 - RNA, 15 nt, Homo sapiens
auuuugagaucaguc

SEQ ID NO: 823126 - RNA, 18 nt, Homo sapiens
auuuugagaucagucuuu

SEQ ID NO: 823127 - RNA, 21 nt, Homo sapiens
auuuugauugcuuaccuacau

SEQ ID NO: 823128 - RNA, 13 nt, Homo sapiens
auuuugcacugua

SEQ ID NO: 823129 - RNA, 14 nt, Homo sapiens
auuuugcacuguaa

SEQ ID NO: 823130 - RNA, 20 nt, Homo sapiens
auuuugcuaacuggguuaaa

SEQ ID NO: 823131 - RNA, 19 nt, Homo sapiens
auuuugcuaacugguuaaa

SEQ ID NO: 823132 - RNA, 18 nt, Homo sapiens
auuuugcuugcugaagga

SEQ ID NO: 823133 - RNA, 16 nt, Homo sapiens
auuuuggcgaaucuca

SEQ ID NO: 823134 - RNA, 21 nt, Homo sapiens
auuuugggagaguaaagcuaa

SEQ ID NO: 823135 - RNA, 17 nt, Homo sapiens
auuuugggccuguuccu

SEQ ID NO: 823136 - RNA, 22 nt, Homo sapiens
auuuugguuucuuccuuuccuc

SEQ ID NO: 823137 - RNA, 19 nt, Homo sapiens
auuuuguaacgaagacaca

SEQ ID NO: 823138 - RNA, 17 nt, Homo sapiens
auuuuguaagaaguuuc

SEQ ID NO: 823139 - RNA, 15 nt, Homo sapiens
auuuuguacauguau

SEQ ID NO: 823140 - RNA, 21 nt, Homo sapiens
auuuugucuguacucauguca

SEQ ID NO: 823141 - RNA, 23 nt, Homo sapiens
auuuugugaccccuuucacuuac

SEQ ID NO: 823142 - RNA, 16 nt, Homo sapiens
auuuuguggucauuaa

SEQ ID NO: 823143 - RNA, 21 nt, Homo sapiens
auuuuguguguaccugugacu

SEQ ID NO: 823144 - RNA, 14 nt, Homo sapiens
auuuuguucauaca

SEQ ID NO: 823145 - RNA, 21 nt, Homo sapiens
auuuuguugccuucaucuuca

SEQ ID NO: 823146 - RNA, 22 nt, Homo sapiens
auuuuuaccuaaucuccacuuu

SEQ ID NO: 823147 - RNA, 17 nt, Homo sapiens
auuuuuagacucaucaa

SEQ ID NO: 823148 - RNA, 16 nt, Homo sapiens
auuuuuauaaccuggc

SEQ ID NO: 823149 - RNA, 19 nt, Homo sapiens
auuuuuaucuauccuaugu

SEQ ID NO: 823150 - RNA, 14 nt, Homo sapiens
auuuuucaagagau

SEQ ID NO: 823151 - RNA, 15 nt, Homo sapiens
auuuuucaaggcauu

SEQ ID NO: 823152 - RNA, 13 nt, Homo sapiens
auuuuucacauau

SEQ ID NO: 823153 - RNA, 16 nt, Homo sapiens
auuuuucaucaaacau

SEQ ID NO: 823154 - RNA, 14 nt, Homo sapiens
auuuuuccacuuaa

SEQ ID NO: 823155 - RNA, 18 nt, Homo sapiens
auuuuuccucuguucaca

SEQ ID NO: 823156 - RNA, 17 nt, Homo sapiens
auuuuucuuacuggaaa

SEQ ID NO: 823157 - RNA, 18 nt, Homo sapiens
auuuuugaagcaaagaag

SEQ ID NO: 823158 - RNA, 15 nt, Homo sapiens
auuuuugaaggcaua

SEQ ID NO: 823159 - RNA, 15 nt, Homo sapiens
auuuuuggugcaagu

SEQ ID NO: 823160 - RNA, 15 nt, Homo sapiens
auuuuuguagcacug

SEQ ID NO: 823161 - RNA, 20 nt, Homo sapiens
auuuuuguaguuagacaaua

SEQ ID NO: 823162 - RNA, 15 nt, Homo sapiens
auuuuuguguaggug

SEQ ID NO: 823163 - RNA, 16 nt, Homo sapiens
auuuuuuauacuguau

SEQ ID NO: 823164 - RNA, 19 nt, Homo sapiens
auuuuuucgugcacucugc

SEQ ID NO: 823165 - RNA, 16 nt, Homo sapiens
auuuuuuguaugcuua

SEQ ID NO: 823166 - RNA, 14 nt, Homo sapiens
auuuuuugugauca

SEQ ID NO: 823167 - RNA, 20 nt, Homo sapiens
auuuuuuguuauguuugcac

SEQ ID NO: 823168 - RNA, 16 nt, Homo sapiens
auuuuuuucuacauaa

SEQ ID NO: 823169 - RNA, 16 nt, Homo sapiens
auuuuuuuuugaagca

SEQ ID NO: 823170 - RNA, 20 nt, Homo sapiens
auuuuuuuuuuuccaagaca

SEQ ID NO: 823171 - RNA, 14 nt, Homo sapiens
caaaaaaaaaagca

SEQ ID NO: 823172 - RNA, 20 nt, Homo sapiens
caaaaaaaaccuucagugaa

SEQ ID NO: 823173 - RNA, 23 nt, Homo sapiens
cuguaaacuguguauuccaagac

SEQ ID NO: 823174 - RNA, 21 nt, Homo sapiens
cuguaaacuuuaucacuuaaa

SEQ ID NO: 823175 - RNA, 22 nt, Homo sapiens
cuguaaauaugaaucugcucac

SEQ ID NO: 823176 - RNA, 13 nt, Homo sapiens
cuguaacacuccu

SEQ ID NO: 823177 - RNA, 18 nt, Homo sapiens
cuguaacccucacccaca

SEQ ID NO: 823178 - RNA, 13 nt, Homo sapiens
cuguaacuacuuc

SEQ ID NO: 823179 - RNA, 20 nt, Homo sapiens
cuguaaggcaggcccauuca

SEQ ID NO: 823180 - RNA, 12 nt, Homo sapiens
cuguaagggcag

SEQ ID NO: 823181 - RNA, 21 nt, Homo sapiens
cuguaauaguucaguagaauu

SEQ ID NO: 823182 - RNA, 15 nt, Homo sapiens
cuguaaucccaacac

SEQ ID NO: 823183 - RNA, 18 nt, Homo sapiens
cuguaaucccagcuacuu

SEQ ID NO: 823184 - RNA, 21 nt, Homo sapiens
cuguaaucccagcuacuuggg

SEQ ID NO: 823185 - RNA, 19 nt, Homo sapiens
cuguaaucuaccaguggug

SEQ ID NO: 823186 - RNA, 17 nt, Homo sapiens
cuguaaucucagcacuu

SEQ ID NO: 823187 - RNA, 21 nt, Homo sapiens
cuguaaucucagcacuuuggg

SEQ ID NO: 823188 - RNA, 15 nt, Homo sapiens
cuguaaugacaaaua

SEQ ID NO: 823189 - RNA, 19 nt, Homo sapiens
cuguaauuccagcuacuca

SEQ ID NO: 823190 - RNA, 17 nt, Homo sapiens
cuguaauucuagcacuu

SEQ ID NO: 823191 - RNA, 20 nt, Homo sapiens
cuguacaaaauaacucucca

SEQ ID NO: 823192 - RNA, 17 nt, Homo sapiens
cuguacaaaguagaagu

SEQ ID NO: 823193 - RNA, 16 nt, Homo sapiens
cuguaccgacuuugau

SEQ ID NO: 823194 - RNA, 22 nt, Homo sapiens
cuguacuccagccugggugaca

SEQ ID NO: 823195 - RNA, 22 nt, Homo sapiens
cuguacuguuacugggcccuga

SEQ ID NO: 823196 - RNA, 20 nt, Homo sapiens
cuguacuguucugugucuuu

SEQ ID NO: 823197 - RNA, 23 nt, Homo sapiens
cuguagaagaagcccauaucaca

SEQ ID NO: 823198 - RNA, 18 nt, Homo sapiens
cuguagcauuacaguggg

SEQ ID NO: 823199 - RNA, 22 nt, Homo sapiens
cuguaggaacaagcaugaucuu

SEQ ID NO: 823200 - RNA, 16 nt, Homo sapiens
cuguaggggcaaaaau

SEQ ID NO: 823201 - RNA, 21 nt, Homo sapiens
cuguagucccagcuacucggg

SEQ ID NO: 823202 - RNA, 20 nt, Homo sapiens
cuguaguuuaugaugcaaau

SEQ ID NO: 823203 - RNA, 22 nt, Homo sapiens
cuguauaaguuauuuuuguaca

SEQ ID NO: 823204 - RNA, 16 nt, Homo sapiens
cuguauauacaauaac

SEQ ID NO: 823205 - RNA, 13 nt, Homo sapiens
cuguauauguugu

SEQ ID NO: 823206 - RNA, 14 nt, Homo sapiens
cuguaucagucuuu

SEQ ID NO: 823207 - RNA, 18 nt, Homo sapiens
gaaaugguggugcuuuaa

SEQ ID NO: 823208 - RNA, 16 nt, Homo sapiens
gaaauguaagauuuca

SEQ ID NO: 823209 - RNA, 21 nt, Homo sapiens
gaaauuaguuucaaauuuacc

SEQ ID NO: 823210 - RNA, 16 nt, Homo sapiens
gaaauuauacuuacuu

SEQ ID NO: 823211 - RNA, 16 nt, Homo sapiens
gaaauucaaagcauaa

SEQ ID NO: 823212 - RNA, 19 nt, Homo sapiens
gaaauugcauuuccugaca

SEQ ID NO: 823213 - RNA, 13 nt, Homo sapiens
gaaauugcuauuu

SEQ ID NO: 823214 - RNA, 15 nt, Homo sapiens
gaaauugguuuucca

SEQ ID NO: 823215 - RNA, 20 nt, Homo sapiens
gaaauugucaaagacuguau

SEQ ID NO: 823216 - RNA, 17 nt, Homo sapiens
gaaauugugugugcaag

SEQ ID NO: 823217 - RNA, 18 nt, Homo sapiens
gaaauuuugccugccauu

SEQ ID NO: 823218 - RNA, 16 nt, Homo sapiens
gaacaaaaauguuucc

SEQ ID NO: 823219 - RNA, 14 nt, Homo sapiens
gaacaaacucugaa

SEQ ID NO: 823220 - RNA, 17 nt, Homo sapiens
gaacaaagacuacuaau

SEQ ID NO: 823221 - RNA, 18 nt, Homo sapiens
gaacaaagccacugacug

SEQ ID NO: 823222 - RNA, 19 nt, Homo sapiens
gaacaaaguccacaguuua

SEQ ID NO: 823223 - RNA, 15 nt, Homo sapiens
gaacaaagugcuaga

SEQ ID NO: 823224 - RNA, 11 nt, Homo sapiens
gaacaaaucag

SEQ ID NO: 823225 - RNA, 12 nt, Homo sapiens
gaacaaaucagc

SEQ ID NO: 823226 - RNA, 15 nt, Homo sapiens
gaacaacagcaucuu

SEQ ID NO: 823227 - RNA, 14 nt, Homo sapiens
gaacaacauaucuc

SEQ ID NO: 823228 - RNA, 20 nt, Homo sapiens
gaacaacuuguagcagcuau

SEQ ID NO: 823229 - RNA, 16 nt, Homo sapiens
gaacaagcaugaucuu

SEQ ID NO: 823230 - RNA, 19 nt, Homo sapiens
gaacaaguuguuucauuga

SEQ ID NO: 823231 - RNA, 16 nt, Homo sapiens
gaacaauucacaguau

SEQ ID NO: 823232 - RNA, 21 nt, Homo sapiens
gaacacacagacuuucuguga

SEQ ID NO: 823233 - RNA, 15 nt, Homo sapiens
gaacacacauuauua

SEQ ID NO: 823234 - RNA, 15 nt, Homo sapiens
gaacacagcaugugc

SEQ ID NO: 823235 - RNA, 18 nt, Homo sapiens
gaacacagugucuguuca

SEQ ID NO: 823236 - RNA, 14 nt, Homo sapiens
gaacacaucagcuu

SEQ ID NO: 823237 - RNA, 19 nt, Homo sapiens
gaacacaugugcagucacu

SEQ ID NO: 823238 - RNA, 16 nt, Homo sapiens
gaacaccauugaggga

SEQ ID NO: 823239 - RNA, 23 nt, Homo sapiens
gaacacuaacuaugcauggugcc

SEQ ID NO: 823240 - RNA, 22 nt, Homo sapiens
gaacacuaacucaccagcccca

SEQ ID NO: 823241 - RNA, 17 nt, Homo sapiens
gaacacugaaacuguau

SEQ ID NO: 823242 - RNA, 13 nt, Homo sapiens
gaacacugcuuga

SEQ ID NO: 823243 - RNA, 11 nt, Homo sapiens
gaacacuggcc

SEQ ID NO: 823244 - RNA, 15 nt, Homo sapiens
gaacacuguucuacc

SEQ ID NO: 823245 - RNA, 13 nt, Homo sapiens
gaacagaaauauu

SEQ ID NO: 823246 - RNA, 13 nt, Homo sapiens
gaacagaaggaug

SEQ ID NO: 823247 - RNA, 12 nt, Homo sapiens
gaacagagcaag

SEQ ID NO: 823248 - RNA, 13 nt, Homo sapiens
gaacagagugcaa

SEQ ID NO: 823249 - RNA, 22 nt, Homo sapiens
gaacagcgggagaccugugcua

SEQ ID NO: 823250 - RNA, 17 nt, Homo sapiens
gaacagcuguaaucuau

SEQ ID NO: 823251 - RNA, 23 nt, Homo sapiens
gaacaggcucagaucucauggga

SEQ ID NO: 823252 - RNA, 18 nt, Homo sapiens
gaacagguaguauuacac

SEQ ID NO: 823253 - RNA, 22 nt, Homo sapiens
gaacagguuuuguguuuuguca

SEQ ID NO: 823254 - RNA, 21 nt, Homo sapiens
gaacaguaaagaaagcagaau

SEQ ID NO: 823255 - RNA, 18 nt, Homo sapiens
gaacaguauuacaguguc

SEQ ID NO: 823256 - RNA, 10 nt, Homo sapiens
gaacauaaaa

SEQ ID NO: 823257 - RNA, 11 nt, Homo sapiens
gaacauaaaaa

SEQ ID NO: 823258 - RNA, 22 nt, Homo sapiens
gaacauaaaaaauaaaguacca

SEQ ID NO: 823259 - RNA, 13 nt, Homo sapiens
gaacauacacugu

SEQ ID NO: 823260 - RNA, 20 nt, Homo sapiens
gaacaugcccccugcagaca

SEQ ID NO: 823261 - RNA, 17 nt, Homo sapiens
gaacauguuuaaugggu

SEQ ID NO: 823262 - RNA, 18 nt, Homo sapiens
gaacauugcagagcuaag

SEQ ID NO: 823263 - RNA, 17 nt, Homo sapiens
gaaccaaucccgugaaa

SEQ ID NO: 823264 - RNA, 18 nt, Homo sapiens
gaaccacuacaucuggcu

SEQ ID NO: 823265 - RNA, 21 nt, Homo sapiens
gaaccacucccaccacaggca

SEQ ID NO: 823266 - RNA, 21 nt, Homo sapiens
gaaccagaauuacauguuaau

SEQ ID NO: 823267 - RNA, 23 nt, Homo sapiens
gaaccagccguauuuuacaugaa

SEQ ID NO: 823268 - RNA, 15 nt, Homo sapiens
gaaccaggaggacaa

SEQ ID NO: 823269 - RNA, 13 nt, Homo sapiens
gaaccauuuacuu

SEQ ID NO: 823270 - RNA, 19 nt, Homo sapiens
gaaccauuugggauggaga

SEQ ID NO: 823271 - RNA, 19 nt, Homo sapiens
gaacccacauaaaagcccc

SEQ ID NO: 823272 - RNA, 15 nt, Homo sapiens
gaacccagaaggcag

SEQ ID NO: 823273 - RNA, 14 nt, Homo sapiens
gaaccccuucugac

SEQ ID NO: 823274 - RNA, 17 nt, Homo sapiens
gaacccuuccugagacc

SEQ ID NO: 823275 - RNA, 22 nt, Homo sapiens
gaaccgacgcaugaaguggaaa

SEQ ID NO: 823276 - RNA, 18 nt, Homo sapiens
auccagugagcacuagaa

SEQ ID NO: 823277 - RNA, 16 nt, Homo sapiens
auccagugauccuuac

SEQ ID NO: 823278 - RNA, 20 nt, Homo sapiens
auccagugcaguugugauuu

SEQ ID NO: 823279 - RNA, 23 nt, Homo sapiens
auccauaaagacaaucacugcca

SEQ ID NO: 823280 - RNA, 22 nt, Homo sapiens
auccauagcaccuccacauacc

SEQ ID NO: 823281 - RNA, 22 nt, Homo sapiens
auccaucacuagccaugauaac

SEQ ID NO: 823282 - RNA, 19 nt, Homo sapiens
auccaucccuccauucauc

SEQ ID NO: 823283 - RNA, 17 nt, Homo sapiens
auccaugcaccuaccuu

SEQ ID NO: 823284 - RNA, 16 nt, Homo sapiens
auccaugcuucucauc

SEQ ID NO: 823285 - RNA, 17 nt, Homo sapiens
auccaugggcaguauga

SEQ ID NO: 823286 - RNA, 17 nt, Homo sapiens
auccauuaucuauuuaa

SEQ ID NO: 823287 - RNA, 18 nt, Homo sapiens
auccauugaacuaaaaua

SEQ ID NO: 823288 - RNA, 16 nt, Homo sapiens
auccauuuuacacagc

SEQ ID NO: 823289 - RNA, 21 nt, Homo sapiens
aucccaacaccaaacucuuaa

SEQ ID NO: 823290 - RNA, 17 nt, Homo sapiens
aucccaagaaauggaau

SEQ ID NO: 823291 - RNA, 18 nt, Homo sapiens
aucccaagaaauggaauc

SEQ ID NO: 823292 - RNA, 18 nt, Homo sapiens
aucccaagcaucauauca

SEQ ID NO: 823293 - RNA, 16 nt, Homo sapiens
aucccaagugcacuuu

SEQ ID NO: 823294 - RNA, 18 nt, Homo sapiens
aucccacauuagcuuguu

SEQ ID NO: 823295 - RNA, 13 nt, Homo sapiens
aucccacuguaug

SEQ ID NO: 823296 - RNA, 12 nt, Homo sapiens
aucccagcacuu

SEQ ID NO: 823297 - RNA, 14 nt, Homo sapiens
aucccagcacuuug

SEQ ID NO: 823298 - RNA, 15 nt, Homo sapiens
aucccagcagcagag

SEQ ID NO: 823299 - RNA, 15 nt, Homo sapiens
aucccagcuacucaa

SEQ ID NO: 823300 - RNA, 22 nt, Homo sapiens
aucccaggggcuuaucucuuca

SEQ ID NO: 823301 - RNA, 22 nt, Homo sapiens
aucccaucgucucggccuucac

SEQ ID NO: 823302 - RNA, 17 nt, Homo sapiens
aucccauggaaccacua

SEQ ID NO: 823303 - RNA, 11 nt, Homo sapiens
aucccauucca

SEQ ID NO: 823304 - RNA, 22 nt, Homo sapiens
auccccaacugcgacugugacc

SEQ ID NO: 823305 - RNA, 23 nt, Homo sapiens
auccccacagcuggcucugacaa

SEQ ID NO: 823306 - RNA, 12 nt, Homo sapiens
auccccaucucc

SEQ ID NO: 823307 - RNA, 18 nt, Homo sapiens
aucccccaaaaugcauuu

SEQ ID NO: 823308 - RNA, 21 nt, Homo sapiens
aucccccacagccacuacuga

SEQ ID NO: 823309 - RNA, 19 nt, Homo sapiens
aucccccagccucaagucu

SEQ ID NO: 823310 - RNA, 20 nt, Homo sapiens
auccccuguguggucuccau

SEQ ID NO: 823311 - RNA, 18 nt, Homo sapiens
aucccgagguauggcaga

SEQ ID NO: 823312 - RNA, 14 nt, Homo sapiens
aucccguguugcca

SEQ ID NO: 823313 - RNA, 14 nt, Homo sapiens
aucccuacaaaaaa

SEQ ID NO: 823314 - RNA, 19 nt, Homo sapiens
aucccucuccaacugccua

SEQ ID NO: 823315 - RNA, 23 nt, Homo sapiens
aucccugaaccccuggccagcuc

SEQ ID NO: 823316 - RNA, 18 nt, Homo sapiens
aucccuguacucugaccc

SEQ ID NO: 823317 - RNA, 17 nt, Homo sapiens
aucccuuaacaguugua

SEQ ID NO: 823318 - RNA, 22 nt, Homo sapiens
aucccuuccagauggucaucca

SEQ ID NO: 823319 - RNA, 13 nt, Homo sapiens
aucccuuccccag

SEQ ID NO: 823320 - RNA, 16 nt, Homo sapiens
aucccuuuuuuuacau

SEQ ID NO: 823321 - RNA, 20 nt, Homo sapiens
aucccuuuuuuuacauuuca

SEQ ID NO: 823322 - RNA, 19 nt, Homo sapiens
auccgaaguaugagggaaa

SEQ ID NO: 823323 - RNA, 15 nt, Homo sapiens
auccgccuaccucag

SEQ ID NO: 823324 - RNA, 16 nt, Homo sapiens
auccgugaagucacau

SEQ ID NO: 823325 - RNA, 16 nt, Homo sapiens
auccuaagucucuuac

SEQ ID NO: 823326 - RNA, 18 nt, Homo sapiens
auccuagaucaccacugg

SEQ ID NO: 823327 - RNA, 22 nt, Homo sapiens
auccuagccccgagacaccauc

SEQ ID NO: 823328 - RNA, 17 nt, Homo sapiens
auccuaguaugccaaaa

SEQ ID NO: 823329 - RNA, 14 nt, Homo sapiens
auccuagucuucac

SEQ ID NO: 823330 - RNA, 16 nt, Homo sapiens
auccuagugggcacuu

SEQ ID NO: 823331 - RNA, 13 nt, Homo sapiens
auccucaaggaaa

SEQ ID NO: 823332 - RNA, 23 nt, Homo sapiens
auccucaauucaauguggugaug

SEQ ID NO: 823333 - RNA, 17 nt, Homo sapiens
auccucaccauccacag

SEQ ID NO: 823334 - RNA, 20 nt, Homo sapiens
auccucacccagcacccaca

SEQ ID NO: 823335 - RNA, 20 nt, Homo sapiens
auccucauccgcuacuacau

SEQ ID NO: 823336 - RNA, 23 nt, Homo sapiens
auccucauccgcuacuacaucaa

SEQ ID NO: 823337 - RNA, 14 nt, Homo sapiens
auccuccauugcuc

SEQ ID NO: 823338 - RNA, 12 nt, Homo sapiens
auccucucucuc

SEQ ID NO: 823339 - RNA, 16 nt, Homo sapiens
auccucugaguuaaau

SEQ ID NO: 823340 - RNA, 21 nt, Homo sapiens
auccugauuccaaauauguau

SEQ ID NO: 823341 - RNA, 18 nt, Homo sapiens
auccugcagggcuucucc

SEQ ID NO: 823342 - RNA, 22 nt, Homo sapiens
auccugcccucacaucuuccac

SEQ ID NO: 823343 - RNA, 19 nt, Homo sapiens
auccugcucuuuugugaug

SEQ ID NO: 823344 - RNA, 22 nt, Homo sapiens
auccuggaaggacacagugaug

SEQ ID NO: 823345 - RNA, 14 nt, Homo sapiens
auccuggaugauuu

SEQ ID NO: 823346 - RNA, 18 nt, Homo sapiens
auccuggaugauuucauc

SEQ ID NO: 823347 - RNA, 16 nt, Homo sapiens
auccuggccuggcaca

SEQ ID NO: 823348 - RNA, 17 nt, Homo sapiens
auccuggggaaggugga

SEQ ID NO: 823349 - RNA, 22 nt, Homo sapiens
auccuggguacugaaagccuua

SEQ ID NO: 823350 - RNA, 17 nt, Homo sapiens
auccugugacugucuca

SEQ ID NO: 823351 - RNA, 12 nt, Homo sapiens
auccugugcaau

SEQ ID NO: 823352 - RNA, 20 nt, Homo sapiens
auccuguguagcauacuggc

SEQ ID NO: 823353 - RNA, 19 nt, Homo sapiens
auccuuaacauuucucucc

SEQ ID NO: 823354 - RNA, 18 nt, Homo sapiens
auccuuaaugcagagcua

SEQ ID NO: 823355 - RNA, 15 nt, Homo sapiens
auccuucaccagagc

SEQ ID NO: 823356 - RNA, 14 nt, Homo sapiens
auccuuccaccuca

SEQ ID NO: 823357 - RNA, 15 nt, Homo sapiens
auccuuccaccucag

SEQ ID NO: 823358 - RNA, 14 nt, Homo sapiens
auccuuccauucca

SEQ ID NO: 823359 - RNA, 15 nt, Homo sapiens
auccuuccauuccac

SEQ ID NO: 823360 - RNA, 13 nt, Homo sapiens
auccuuccccaac

SEQ ID NO: 823361 - RNA, 21 nt, Homo sapiens
auccuucugagcuccaccucu

SEQ ID NO: 823362 - RNA, 12 nt, Homo sapiens
augaaugcagug

SEQ ID NO: 823363 - RNA, 23 nt, Homo sapiens
augaaugcccaggagcugaggau

SEQ ID NO: 823364 - RNA, 18 nt, Homo sapiens
augaaugguuucaacaaa

SEQ ID NO: 823365 - RNA, 14 nt, Homo sapiens
augaauguaaauuu

SEQ ID NO: 823366 - RNA, 18 nt, Homo sapiens
augaauucaagaaaggaa

SEQ ID NO: 823367 - RNA, 15 nt, Homo sapiens
augaauuuggccaga

SEQ ID NO: 823368 - RNA, 19 nt, Homo sapiens
augaauuuuuuucaucuuc

SEQ ID NO: 823369 - RNA, 15 nt, Homo sapiens
augacaacaaucuca

SEQ ID NO: 823370 - RNA, 22 nt, Homo sapiens
augacaagaacaaagccacuga

SEQ ID NO: 823371 - RNA, 17 nt, Homo sapiens
augacaaucaccuucag

SEQ ID NO: 823372 - RNA, 18 nt, Homo sapiens
augacaaugaugaugaua

SEQ ID NO: 823373 - RNA, 19 nt, Homo sapiens
augacaaugaugaugauaa

SEQ ID NO: 823374 - RNA, 22 nt, Homo sapiens
augacacacaaaucccauuaaa

SEQ ID NO: 823375 - RNA, 16 nt, Homo sapiens
augacacuacuugaua

SEQ ID NO: 823376 - RNA, 12 nt, Homo sapiens
augacacugacc

SEQ ID NO: 823377 - RNA, 13 nt, Homo sapiens
augacacugaccu

SEQ ID NO: 823378 - RNA, 12 nt, Homo sapiens
augacacugagc

SEQ ID NO: 823379 - RNA, 16 nt, Homo sapiens
augacagagagagacc

SEQ ID NO: 823380 - RNA, 15 nt, Homo sapiens
augacaggcuguuca

SEQ ID NO: 823381 - RNA, 21 nt, Homo sapiens
augacaguauuauacgcuggc

SEQ ID NO: 823382 - RNA, 22 nt, Homo sapiens
augacagucacagacucgccuc

SEQ ID NO: 823383 - RNA, 13 nt, Homo sapiens
augacaucacuug

SEQ ID NO: 823384 - RNA, 20 nt, Homo sapiens
augacaucacuuguacaaaa

SEQ ID NO: 823385 - RNA, 12 nt, Homo sapiens
augaccaaagau

SEQ ID NO: 823386 - RNA, 14 nt, Homo sapiens
augacccacacugc

SEQ ID NO: 823387 - RNA, 14 nt, Homo sapiens
augacccacccagu

SEQ ID NO: 823388 - RNA, 17 nt, Homo sapiens
augacccaccccugugc

SEQ ID NO: 823389 - RNA, 19 nt, Homo sapiens
augacccaggccuggccag

SEQ ID NO: 823390 - RNA, 14 nt, Homo sapiens
augaccuacagugc

SEQ ID NO: 823391 - RNA, 20 nt, Homo sapiens
augaccuacagugcugugua

SEQ ID NO: 823392 - RNA, 18 nt, Homo sapiens
augaccuuauaguguuaa

SEQ ID NO: 823393 - RNA, 23 nt, Homo sapiens
cugugugcuccggagaugaauau

SEQ ID NO: 823394 - RNA, 14 nt, Homo sapiens
cuguguguccaaaa

SEQ ID NO: 823395 - RNA, 23 nt, Homo sapiens
cuguguuacugcuuugcaaagac

SEQ ID NO: 823396 - RNA, 17 nt, Homo sapiens
cuguguuaucugugguu

SEQ ID NO: 823397 - RNA, 21 nt, Homo sapiens
cuguguuauucuuugcgugua

SEQ ID NO: 823398 - RNA, 21 nt, Homo sapiens
cuguguugccaagcuccaagc

SEQ ID NO: 823399 - RNA, 15 nt, Homo sapiens
cuguguuuccaucuc

SEQ ID NO: 823400 - RNA, 20 nt, Homo sapiens
cuguguuuuuccuccauaaa

SEQ ID NO: 823401 - RNA, 22 nt, Homo sapiens
cuguuaaaauguacacuggaua

SEQ ID NO: 823402 - RNA, 21 nt, Homo sapiens
cuguuaacgucaucucagggu

SEQ ID NO: 823403 - RNA, 15 nt, Homo sapiens
cuguuaauauucuau

SEQ ID NO: 823404 - RNA, 14 nt, Homo sapiens
cuguuacacugggc

SEQ ID NO: 823405 - RNA, 15 nt, Homo sapiens
cuguuaccauucuga

SEQ ID NO: 823406 - RNA, 14 nt, Homo sapiens
cuguuacccagaga

SEQ ID NO: 823407 - RNA, 19 nt, Homo sapiens
cuguuacugaaauugguau

SEQ ID NO: 823408 - RNA, 18 nt, Homo sapiens
cuguuaggcucacaguua

SEQ ID NO: 823409 - RNA, 19 nt, Homo sapiens
cuguuagggcugaaucuuc

SEQ ID NO: 823410 - RNA, 18 nt, Homo sapiens
cuguuagugacagagccc

SEQ ID NO: 823411 - RNA, 14 nt, Homo sapiens
cuguuaugcauagc

SEQ ID NO: 823412 - RNA, 16 nt, Homo sapiens
cuguucaaagcugccu

SEQ ID NO: 823413 - RNA, 21 nt, Homo sapiens
cuguucaaugauuauuuguau

SEQ ID NO: 823414 - RNA, 13 nt, Homo sapiens
cuguucagcuuuu

SEQ ID NO: 823415 - RNA, 14 nt, Homo sapiens
cuguuccuucacau

SEQ ID NO: 823416 - RNA, 18 nt, Homo sapiens
cuguuccuucacauccug

SEQ ID NO: 823417 - RNA, 22 nt, Homo sapiens
cuguucgucacucaaaugaauu

SEQ ID NO: 823418 - RNA, 21 nt, Homo sapiens
cuguucuaccaagaacugaag

SEQ ID NO: 823419 - RNA, 19 nt, Homo sapiens
cuguucuagacacagugua

SEQ ID NO: 823420 - RNA, 13 nt, Homo sapiens
cuguucugcugaa

SEQ ID NO: 823421 - RNA, 22 nt, Homo sapiens
cuguucuguuuggcacuuguau

SEQ ID NO: 823422 - RNA, 21 nt, Homo sapiens
cuguucuuccuauuucuuuca

SEQ ID NO: 823423 - RNA, 16 nt, Homo sapiens
cuguucuuuuguccca

SEQ ID NO: 823424 - RNA, 13 nt, Homo sapiens
cuguugaagcucu

SEQ ID NO: 823425 - RNA, 21 nt, Homo sapiens
cuguugaagcucuggugacac

SEQ ID NO: 823426 - RNA, 18 nt, Homo sapiens
cuguugaucccacuucac

SEQ ID NO: 823427 - RNA, 14 nt, Homo sapiens
cuguugaugccguu

SEQ ID NO: 823428 - RNA, 21 nt, Homo sapiens
cuguugcaaacucaguuccaa

SEQ ID NO: 823429 - RNA, 22 nt, Homo sapiens
cuguugcaaacucaguuccaaa

SEQ ID NO: 823430 - RNA, 11 nt, Homo sapiens
cuguugcacug

SEQ ID NO: 823431 - RNA, 15 nt, Homo sapiens
cuguugcacugaugu

SEQ ID NO: 823432 - RNA, 21 nt, Homo sapiens
cuguugccagugcuuugcaca

SEQ ID NO: 823433 - RNA, 11 nt, Homo sapiens
cuguugcccaa

SEQ ID NO: 823434 - RNA, 21 nt, Homo sapiens
cuguugcugaaaccauacagc

SEQ ID NO: 823435 - RNA, 18 nt, Homo sapiens
cuguugcuuuacaguuac

SEQ ID NO: 823436 - RNA, 20 nt, Homo sapiens
cuguuggauaaagaccuucc

SEQ ID NO: 823437 - RNA, 14 nt, Homo sapiens
cuguuggauaauua

SEQ ID NO: 823438 - RNA, 20 nt, Homo sapiens
cuguugggagaaagcaauac

SEQ ID NO: 823439 - RNA, 12 nt, Homo sapiens
cuguuggucugu

SEQ ID NO: 823440 - RNA, 17 nt, Homo sapiens
cuguuguagaagacaaa

SEQ ID NO: 823441 - RNA, 14 nt, Homo sapiens
cuguuuaaauugcu

SEQ ID NO: 823442 - RNA, 16 nt, Homo sapiens
cuguuuaaauugcuca

SEQ ID NO: 823443 - RNA, 19 nt, Homo sapiens
cuguuuccauagggugaca

SEQ ID NO: 823444 - RNA, 21 nt, Homo sapiens
cuguuucccuuugauucucca

SEQ ID NO: 823445 - RNA, 18 nt, Homo sapiens
cuguuucgguugacccag

SEQ ID NO: 823446 - RNA, 21 nt, Homo sapiens
cuguuugagaaccauuuacuu

SEQ ID NO: 823447 - RNA, 17 nt, Homo sapiens
cuguuugcguacuugua

SEQ ID NO: 823448 - RNA, 21 nt, Homo sapiens
cuguuugcugugcguggaaug

SEQ ID NO: 823449 - RNA, 21 nt, Homo sapiens
cuguuuucggccuucuguggc

SEQ ID NO: 823450 - RNA, 14 nt, Homo sapiens
cuguuuucuaccuc

SEQ ID NO: 823451 - RNA, 14 nt, Homo sapiens
cuguuuucuggaag

SEQ ID NO: 823452 - RNA, 20 nt, Homo sapiens
cuguuuucugggccagugag

SEQ ID NO: 823453 - RNA, 14 nt, Homo sapiens
cuguuuugugagaa

SEQ ID NO: 823454 - RNA, 20 nt, Homo sapiens
cuguuuuuagagcuuccaaa

SEQ ID NO: 823455 - RNA, 15 nt, Homo sapiens
cuguuuuucagggag

SEQ ID NO: 823456 - RNA, 20 nt, Homo sapiens
cuguuuuuuucccagguguu

SEQ ID NO: 823457 - RNA, 16 nt, Homo sapiens
cuuaaaaaauguccau

SEQ ID NO: 823458 - RNA, 17 nt, Homo sapiens
cuuaaaaugggaucuca

SEQ ID NO: 823459 - RNA, 19 nt, Homo sapiens
cuuaaaauguaagauuaua

SEQ ID NO: 823460 - RNA, 13 nt, Homo sapiens
cuuaaacaguauu

SEQ ID NO: 823461 - RNA, 20 nt, Homo sapiens
cuuaaacccauacaauguau

SEQ ID NO: 823462 - RNA, 20 nt, Homo sapiens
cuuaaaccuuaagauacuaa

SEQ ID NO: 823463 - RNA, 19 nt, Homo sapiens
cuuaaacucuggacacucu

SEQ ID NO: 823464 - RNA, 16 nt, Homo sapiens
cuuaaagcauuugcaa

SEQ ID NO: 823465 - RNA, 22 nt, Homo sapiens
cuuaaagggucuuaugaaacaa

SEQ ID NO: 823466 - RNA, 19 nt, Homo sapiens
cuuaaauaaacucaaugag

SEQ ID NO: 823467 - RNA, 16 nt, Homo sapiens
cuuaaauaauuugggu

SEQ ID NO: 823468 - RNA, 17 nt, Homo sapiens
cuuaaaugagaccaaag

SEQ ID NO: 823469 - RNA, 14 nt, Homo sapiens
cuuaacacacuggc

SEQ ID NO: 823470 - RNA, 14 nt, Homo sapiens
cuucagacauguaa

SEQ ID NO: 823471 - RNA, 15 nt, Homo sapiens
cuucagaccugacac

SEQ ID NO: 823472 - RNA, 17 nt, Homo sapiens
cuucagacuggcccuua

SEQ ID NO: 823473 - RNA, 23 nt, Homo sapiens
cuucagagacuucguaauuaaag

SEQ ID NO: 823474 - RNA, 16 nt, Homo sapiens
cuucagagcucaagau

SEQ ID NO: 823475 - RNA, 20 nt, Homo sapiens
cuucagaggauaaauaucaa

SEQ ID NO: 823476 - RNA, 22 nt, Homo sapiens
cuucagaggccuggcaucuucu

SEQ ID NO: 823477 - RNA, 14 nt, Homo sapiens
cuucagagugaaga

SEQ ID NO: 823478 - RNA, 14 nt, Homo sapiens
cuucagauagaaaa

SEQ ID NO: 823479 - RNA, 24 nt, Homo sapiens
cuucagauggugaagcauucuccc

SEQ ID NO: 823480 - RNA, 16 nt, Homo sapiens
cuucagcacaggaauu

SEQ ID NO: 823481 - RNA, 17 nt, Homo sapiens
cuucagcccaccacccu

SEQ ID NO: 823482 - RNA, 13 nt, Homo sapiens
cuucagccuucaa

SEQ ID NO: 823483 - RNA, 21 nt, Homo sapiens
cuucagcuucccgaguagcug

SEQ ID NO: 823484 - RNA, 13 nt, Homo sapiens
cuucaggugcuuu

SEQ ID NO: 823485 - RNA, 22 nt, Homo sapiens
cuucagguucuuucugaaaucg

SEQ ID NO: 823486 - RNA, 17 nt, Homo sapiens
cuucaguccuucuacug

SEQ ID NO: 823487 - RNA, 15 nt, Homo sapiens
cuucagucucuauac

SEQ ID NO: 823488 - RNA, 18 nt, Homo sapiens
cuucagucucuauaccaa

SEQ ID NO: 823489 - RNA, 21 nt, Homo sapiens
cuucagucucuauaccaauaa

SEQ ID NO: 823490 - RNA, 15 nt, Homo sapiens
cuucagucuucuuca

SEQ ID NO: 823491 - RNA, 22 nt, Homo sapiens
cuucagucuugaauuucuaaaa

SEQ ID NO: 823492 - RNA, 16 nt, Homo sapiens
cuucagugagccauga

SEQ ID NO: 823493 - RNA, 17 nt, Homo sapiens
cuucagugagccaugau

SEQ ID NO: 823494 - RNA, 23 nt, Homo sapiens
cuucagugcaccuacugcuuacu

SEQ ID NO: 823495 - RNA, 14 nt, Homo sapiens
cuucaguuaugauu

SEQ ID NO: 823496 - RNA, 16 nt, Homo sapiens
cuucauagaaaccucu

SEQ ID NO: 823497 - RNA, 17 nt, Homo sapiens
cuucauagaaaccucuc

SEQ ID NO: 823498 - RNA, 22 nt, Homo sapiens
cuucauagaugaaugaaacccu

SEQ ID NO: 823499 - RNA, 19 nt, Homo sapiens
cuucauauaccagcaauau

SEQ ID NO: 823500 - RNA, 21 nt, Homo sapiens
cuucauauucagcuugcacau

SEQ ID NO: 823501 - RNA, 21 nt, Homo sapiens
cuucauccaaugcaggcuguu

SEQ ID NO: 823502 - RNA, 19 nt, Homo sapiens
cuucaucccauuccaggca

SEQ ID NO: 823503 - RNA, 21 nt, Homo sapiens
cuucauccucugagugugacc

SEQ ID NO: 823504 - RNA, 16 nt, Homo sapiens
cuucaugaagcagauu

SEQ ID NO: 823505 - RNA, 14 nt, Homo sapiens
cuucaugaugugug

SEQ ID NO: 823506 - RNA, 20 nt, Homo sapiens
cuucaugcuugacauaccua

SEQ ID NO: 823507 - RNA, 15 nt, Homo sapiens
cuucauggacuucca

SEQ ID NO: 823508 - RNA, 17 nt, Homo sapiens
cuucauggaggggguca

SEQ ID NO: 823509 - RNA, 19 nt, Homo sapiens
cuucaugguguccauuuua

SEQ ID NO: 823510 - RNA, 22 nt, Homo sapiens
cuucauguggcucagugccuuc

SEQ ID NO: 823511 - RNA, 17 nt, Homo sapiens
cuucauuaccucaguga

SEQ ID NO: 823512 - RNA, 15 nt, Homo sapiens
cuucauuccaaucua

SEQ ID NO: 823513 - RNA, 23 nt, Homo sapiens
cuucauuccaaucuauugcuuca

SEQ ID NO: 823514 - RNA, 21 nt, Homo sapiens
cuucauucuuuacugcacuca

SEQ ID NO: 823515 - RNA, 13 nt, Homo sapiens
cuucauugccuua

SEQ ID NO: 823516 - RNA, 12 nt, Homo sapiens
cuucauuucagg

SEQ ID NO: 823517 - RNA, 22 nt, Homo sapiens
cuucauuucaggaagacugaca

SEQ ID NO: 823518 - RNA, 14 nt, Homo sapiens
cuucauuucucugc

SEQ ID NO: 823519 - RNA, 18 nt, Homo sapiens
cuucauuugaugcuaaau

SEQ ID NO: 823520 - RNA, 16 nt, Homo sapiens
cuuccaaaaccugcuu

SEQ ID NO: 823521 - RNA, 20 nt, Homo sapiens
cuuccaaacauuaaugcaau

SEQ ID NO: 823522 - RNA, 14 nt, Homo sapiens
cuuccaaaccugac

SEQ ID NO: 823523 - RNA, 14 nt, Homo sapiens
cuuccaaacucuuc

SEQ ID NO: 823524 - RNA, 16 nt, Homo sapiens
cuuccaacguggccca

SEQ ID NO: 823525 - RNA, 21 nt, Homo sapiens
cuuccaauuuacauacucugc

SEQ ID NO: 823526 - RNA, 20 nt, Homo sapiens
cuuccacaugggugcauuug

SEQ ID NO: 823527 - RNA, 20 nt, Homo sapiens
cuuccacccccaccauccag

SEQ ID NO: 823528 - RNA, 13 nt, Homo sapiens
cuuccaccugucc

SEQ ID NO: 823529 - RNA, 14 nt, Homo sapiens
cuuccacucuggaa

SEQ ID NO: 823530 - RNA, 17 nt, Homo sapiens
cuuccacuucuaugcaa

SEQ ID NO: 823531 - RNA, 18 nt, Homo sapiens
cuuccagaucacugccac

SEQ ID NO: 823532 - RNA, 13 nt, Homo sapiens
cuuccagauccug

SEQ ID NO: 823533 - RNA, 23 nt, Homo sapiens
cuuccagcauuuagcuggccaca

SEQ ID NO: 823534 - RNA, 20 nt, Homo sapiens
cuuccaggauggauguuggg

SEQ ID NO: 823535 - RNA, 18 nt, Homo sapiens
cuuccaguuugcuugaua

SEQ ID NO: 823536 - RNA, 21 nt, Homo sapiens
cuuccaucagcgggucuccuc

SEQ ID NO: 823537 - RNA, 11 nt, Homo sapiens
cuuccauuugc

SEQ ID NO: 823538 - RNA, 12 nt, Homo sapiens
cuuccauuugcu

SEQ ID NO: 823539 - RNA, 20 nt, Homo sapiens
cuucccaaaguccugggauu

SEQ ID NO: 823540 - RNA, 21 nt, Homo sapiens
cuucccaccuacugcacuuuc

SEQ ID NO: 823541 - RNA, 18 nt, Homo sapiens
cuucccaccucacaguga

SEQ ID NO: 823542 - RNA, 18 nt, Homo sapiens
cuucccagaaucucugag

SEQ ID NO: 823543 - RNA, 13 nt, Homo sapiens
cuucccaugcauu

SEQ ID NO: 823544 - RNA, 23 nt, Homo sapiens
cuucccauuguggcuccuaucug

SEQ ID NO: 823545 - RNA, 18 nt, Homo sapiens
cuucccauuucucuacac

SEQ ID NO: 823546 - RNA, 22 nt, Homo sapiens
cuuccccaauuggcucuaguca

SEQ ID NO: 823547 - RNA, 13 nt, Homo sapiens
cuuccccacagaa

SEQ ID NO: 823548 - RNA, 20 nt, Homo sapiens
cuuccccaggcccaccauca

SEQ ID NO: 823549 - RNA, 22 nt, Homo sapiens
cuucccccaagauugagcucuc

SEQ ID NO: 823550 - RNA, 15 nt, Homo sapiens
cuucccccacuuccc

SEQ ID NO: 823551 - RNA, 13 nt, Homo sapiens
cuuccccuaccca

SEQ ID NO: 823552 - RNA, 15 nt, Homo sapiens
cuucccgccuuccaa

SEQ ID NO: 823553 - RNA, 22 nt, Homo sapiens
cuucccgccuuccaaaaccugc

SEQ ID NO: 823554 - RNA, 15 nt, Homo sapiens
cuucccuacauggag

SEQ ID NO: 823555 - RNA, 19 nt, Homo sapiens
cuucccucgcaugucuccc

SEQ ID NO: 823556 - RNA, 13 nt, Homo sapiens
cuucccugaucaa

SEQ ID NO: 823557 - RNA, 12 nt, Homo sapiens
cuucccugcuau

SEQ ID NO: 823558 - RNA, 21 nt, Homo sapiens
cuucccuggcuuguaacucca

SEQ ID NO: 823559 - RNA, 15 nt, Homo sapiens
cuucccuuaacucca

SEQ ID NO: 823560 - RNA, 22 nt, Homo sapiens
cuuccgcugaggggucucggau

SEQ ID NO: 823561 - RNA, 23 nt, Homo sapiens
cuuccgcuuugaaagaagcaaga

SEQ ID NO: 823562 - RNA, 23 nt, Homo sapiens
cuuccuacacguuagauuugccg

SEQ ID NO: 823563 - RNA, 13 nt, Homo sapiens
cuuccuacuguag

SEQ ID NO: 823564 - RNA, 15 nt, Homo sapiens
cuuccucacaccccu

SEQ ID NO: 823565 - RNA, 14 nt, Homo sapiens
cuuccuccugaugg

SEQ ID NO: 823566 - RNA, 17 nt, Homo sapiens
cuuccucugauuuacau

SEQ ID NO: 823567 - RNA, 13 nt, Homo sapiens
cuuccucuuggcu

SEQ ID NO: 823568 - RNA, 15 nt, Homo sapiens
cuuccugagcuuucu

SEQ ID NO: 823569 - RNA, 15 nt, Homo sapiens
cuuccugcuugccaa

SEQ ID NO: 823570 - RNA, 14 nt, Homo sapiens
cuuccuggguccug

SEQ ID NO: 823571 - RNA, 21 nt, Homo sapiens
cuuccugucccacuacuguag

SEQ ID NO: 823572 - RNA, 20 nt, Homo sapiens
cuuccuguguaccucuagaa

SEQ ID NO: 823573 - RNA, 15 nt, Homo sapiens
cuuccuguguccuga

SEQ ID NO: 823574 - RNA, 16 nt, Homo sapiens
cuuccuuaaaugacuu

SEQ ID NO: 823575 - RNA, 20 nt, Homo sapiens
cuuccuuaauucacucccac

SEQ ID NO: 823576 - RNA, 17 nt, Homo sapiens
cuuccuuaccugaaagg

SEQ ID NO: 823577 - RNA, 22 nt, Homo sapiens
cuuccuuccacucccuuugcca

SEQ ID NO: 823578 - RNA, 13 nt, Homo sapiens
cuuccuuccagac

SEQ ID NO: 823579 - RNA, 19 nt, Homo sapiens
cuuccuugaagaacugcag

SEQ ID NO: 823580 - RNA, 15 nt, Homo sapiens
cuuccuugaccagca

SEQ ID NO: 823581 - RNA, 20 nt, Homo sapiens
cuuccuugggaugaucuuga

SEQ ID NO: 823582 - RNA, 20 nt, Homo sapiens
cuuccuuucccaagccuucg

SEQ ID NO: 823583 - RNA, 13 nt, Homo sapiens
cuucgacuacugc

SEQ ID NO: 823584 - RNA, 13 nt, Homo sapiens
auaaauacuguca

SEQ ID NO: 823585 - RNA, 15 nt, Homo sapiens
auaaaucaaauauuc

SEQ ID NO: 823586 - RNA, 19 nt, Homo sapiens
auaaaucagccuaaauguc

SEQ ID NO: 823587 - RNA, 15 nt, Homo sapiens
auaaauccaucacua

SEQ ID NO: 823588 - RNA, 16 nt, Homo sapiens
auaaauccuugaauca

SEQ ID NO: 823589 - RNA, 19 nt, Homo sapiens
auaaaugacaagugagaca

SEQ ID NO: 823590 - RNA, 22 nt, Homo sapiens
auaaaugagggcugcacauugc

SEQ ID NO: 823591 - RNA, 20 nt, Homo sapiens
auaaaugauuaaaaaaucag

SEQ ID NO: 823592 - RNA, 21 nt, Homo sapiens
auaaauguaccccucucaguc

SEQ ID NO: 823593 - RNA, 12 nt, Homo sapiens
auaaauguaucu

SEQ ID NO: 823594 - RNA, 14 nt, Homo sapiens
auaaauuauggcau

SEQ ID NO: 823595 - RNA, 17 nt, Homo sapiens
auaaauucagauauauu

SEQ ID NO: 823596 - RNA, 22 nt, Homo sapiens
auaaauugaacuaaauccaaac

SEQ ID NO: 823597 - RNA, 15 nt, Homo sapiens
auaaauuucccaguu

SEQ ID NO: 823598 - RNA, 21 nt, Homo sapiens
auaaauuuuaaaaaggaauuu

SEQ ID NO: 823599 - RNA, 20 nt, Homo sapiens
auaaauuuuagugugccuuc

SEQ ID NO: 823600 - RNA, 20 nt, Homo sapiens
auaaauuuuuugugaucagu

SEQ ID NO: 823601 - RNA, 14 nt, Homo sapiens
auaacaaagcccuu

SEQ ID NO: 823602 - RNA, 18 nt, Homo sapiens
auaacaagccaaacauuc

SEQ ID NO: 823603 - RNA, 17 nt, Homo sapiens
auaacaaggagauuucu

SEQ ID NO: 823604 - RNA, 18 nt, Homo sapiens
auaacauauagcagacca

SEQ ID NO: 823605 - RNA, 19 nt, Homo sapiens
auaacauauagcagaccaa

SEQ ID NO: 823606 - RNA, 15 nt, Homo sapiens
auaaccaaaaggagc

SEQ ID NO: 823607 - RNA, 14 nt, Homo sapiens
auaaccacauuuaa

SEQ ID NO: 823608 - RNA, 17 nt, Homo sapiens
auaaccauaugauacua

SEQ ID NO: 823609 - RNA, 21 nt, Homo sapiens
auaacccuaggaauuuagaca

SEQ ID NO: 823610 - RNA, 22 nt, Homo sapiens
auaaccucaaagugacuauuca

SEQ ID NO: 823611 - RNA, 18 nt, Homo sapiens
auaaccucucugugccau

SEQ ID NO: 823612 - RNA, 22 nt, Homo sapiens
auaacgguuaagaaagcacuua

SEQ ID NO: 823613 - RNA, 22 nt, Homo sapiens
auaacuaggaaauccauucaca

SEQ ID NO: 823614 - RNA, 14 nt, Homo sapiens
auaacuauacuuga

SEQ ID NO: 823615 - RNA, 14 nt, Homo sapiens
auaacugcaguguu

SEQ ID NO: 823616 - RNA, 11 nt, Homo sapiens
auaacugccuu

SEQ ID NO: 823617 - RNA, 14 nt, Homo sapiens
auaacugcuuugca

SEQ ID NO: 823618 - RNA, 22 nt, Homo sapiens
auaacuggaaaacagaacacuu

SEQ ID NO: 823619 - RNA, 22 nt, Homo sapiens
auaacuguauuugaaauaagaa

SEQ ID NO: 823620 - RNA, 19 nt, Homo sapiens
auaacuucucugugaacua

SEQ ID NO: 823621 - RNA, 14 nt, Homo sapiens
auaacuugcaucua

SEQ ID NO: 823622 - RNA, 19 nt, Homo sapiens
auaacuuggccauguucuc

SEQ ID NO: 823623 - RNA, 22 nt, Homo sapiens
auaacuuggccauguucuccau

SEQ ID NO: 823624 - RNA, 18 nt, Homo sapiens
auaacuuguccuauguca

SEQ ID NO: 823625 - RNA, 18 nt, Homo sapiens
auaacuuuucaccaauga

SEQ ID NO: 823626 - RNA, 21 nt, Homo sapiens
auaagaaaauauauucuuuca

SEQ ID NO: 823627 - RNA, 17 nt, Homo sapiens
auaagaaagcacuauua

SEQ ID NO: 823628 - RNA, 18 nt, Homo sapiens
auaagaaagcacuauuaa

SEQ ID NO: 823629 - RNA, 16 nt, Homo sapiens
auaagaaaguauaaag

SEQ ID NO: 823630 - RNA, 16 nt, Homo sapiens
auaagagaagucucau

SEQ ID NO: 823631 - RNA, 14 nt, Homo sapiens
auaagagauccuuu

SEQ ID NO: 823632 - RNA, 15 nt, Homo sapiens
auaagaucugagauu

SEQ ID NO: 823633 - RNA, 19 nt, Homo sapiens
auaagaucuguuuuuggac

SEQ ID NO: 823634 - RNA, 14 nt, Homo sapiens
auaagcaaacuuau

SEQ ID NO: 823635 - RNA, 18 nt, Homo sapiens
auaagcaacuucacagaa

SEQ ID NO: 823636 - RNA, 14 nt, Homo sapiens
auaagcaagagaca

SEQ ID NO: 823637 - RNA, 23 nt, Homo sapiens
auaagcagucauccucagaucau

SEQ ID NO: 823638 - RNA, 23 nt, Homo sapiens
auaagcucaguaacugugcaucu

SEQ ID NO: 823639 - RNA, 12 nt, Homo sapiens
auaagcuccuau

SEQ ID NO: 823640 - RNA, 17 nt, Homo sapiens
auaagcucgagugaauu

SEQ ID NO: 823641 - RNA, 17 nt, Homo sapiens
auaaggcugcaacugga

SEQ ID NO: 823642 - RNA, 21 nt, Homo sapiens
auaagggaggaauauagaaug

SEQ ID NO: 823643 - RNA, 19 nt, Homo sapiens
auaagucaauuccuagaag

SEQ ID NO: 823644 - RNA, 20 nt, Homo sapiens
auaagugcucaauagcuuga

SEQ ID NO: 823645 - RNA, 16 nt, Homo sapiens
auaagugcuuuccuua

SEQ ID NO: 823646 - RNA, 16 nt, Homo sapiens
auaaguuugcaguugg

SEQ ID NO: 823647 - RNA, 15 nt, Homo sapiens
auaauaaacuacaca

SEQ ID NO: 823648 - RNA, 17 nt, Homo sapiens
auaauaaagaugcucuu

SEQ ID NO: 823649 - RNA, 19 nt, Homo sapiens
auaauaacucggauuccag

SEQ ID NO: 823650 - RNA, 13 nt, Homo sapiens
auaauacaaauaa

SEQ ID NO: 823651 - RNA, 13 nt, Homo sapiens
auaauacauauua

SEQ ID NO: 823652 - RNA, 18 nt, Homo sapiens
auaauacugugcagauuu

SEQ ID NO: 823653 - RNA, 13 nt, Homo sapiens
auaauaggccagg

SEQ ID NO: 823654 - RNA, 16 nt, Homo sapiens
auaauaugagaaucag

SEQ ID NO: 823655 - RNA, 20 nt, Homo sapiens
auaauaugcacacagugcuu

SEQ ID NO: 823656 - RNA, 21 nt, Homo sapiens
auaauaugugaucagcuuuca

SEQ ID NO: 823657 - RNA, 20 nt, Homo sapiens
auaauauuagugauucugau

SEQ ID NO: 823658 - RNA, 18 nt, Homo sapiens
auaauauuuacuguuaga

SEQ ID NO: 823659 - RNA, 17 nt, Homo sapiens
auaauauuuuucuuaga

SEQ ID NO: 823660 - RNA, 16 nt, Homo sapiens
auaaucacacacacac

SEQ ID NO: 823661 - RNA, 15 nt, Homo sapiens
auaaucacauuauca

SEQ ID NO: 823662 - RNA, 21 nt, Homo sapiens
auaaucacauuaucaucugaa

SEQ ID NO: 823663 - RNA, 18 nt, Homo sapiens
auaaucaucucugucaca

SEQ ID NO: 823664 - RNA, 15 nt, Homo sapiens
auaauccacuuugcu

SEQ ID NO: 823665 - RNA, 20 nt, Homo sapiens
auaaucuuuggguaacuuca

SEQ ID NO: 823666 - RNA, 16 nt, Homo sapiens
auaaugaggaguuuau

SEQ ID NO: 823667 - RNA, 18 nt, Homo sapiens
auaaugcacugaguaugc

SEQ ID NO: 823668 - RNA, 15 nt, Homo sapiens
auaaugcuacugucu

SEQ ID NO: 823669 - RNA, 22 nt, Homo sapiens
auaaugcuuucacaacauuugc

SEQ ID NO: 823670 - RNA, 19 nt, Homo sapiens
auaauguuaacauggacau

SEQ ID NO: 823671 - RNA, 17 nt, Homo sapiens
auaauguugcccagugu

SEQ ID NO: 823672 - RNA, 21 nt, Homo sapiens
auaauuaaaaaaaaaacuuca

SEQ ID NO: 823673 - RNA, 16 nt, Homo sapiens
auaauucuguacugau

SEQ ID NO: 823674 - RNA, 14 nt, Homo sapiens
aguuuaaugucucc

SEQ ID NO: 823675 - RNA, 21 nt, Homo sapiens
aguuuaauuuuugaaaacugg

SEQ ID NO: 823676 - RNA, 16 nt, Homo sapiens
aguuuacaaucagcca

SEQ ID NO: 823677 - RNA, 20 nt, Homo sapiens
aguuuauauggaaaugcaaa

SEQ ID NO: 823678 - RNA, 16 nt, Homo sapiens
aguuuaucaguaaaua

SEQ ID NO: 823679 - RNA, 22 nt, Homo sapiens
aguuuaugaugcaaaucugcca

SEQ ID NO: 823680 - RNA, 22 nt, Homo sapiens
aguuuauggauaugcugcuuua

SEQ ID NO: 823681 - RNA, 16 nt, Homo sapiens
aguuuauuacaaugua

SEQ ID NO: 823682 - RNA, 19 nt, Homo sapiens
aguuuauuggaaguguuca

SEQ ID NO: 823683 - RNA, 18 nt, Homo sapiens
aguuucaaaugaguuuaa

SEQ ID NO: 823684 - RNA, 12 nt, Homo sapiens
aguuucacauau

SEQ ID NO: 823685 - RNA, 20 nt, Homo sapiens
aguuucagagaccauugcaa

SEQ ID NO: 823686 - RNA, 23 nt, Homo sapiens
aguuucagccuaagagacuggug

SEQ ID NO: 823687 - RNA, 20 nt, Homo sapiens
aguuucauuaacuggugaau

SEQ ID NO: 823688 - RNA, 14 nt, Homo sapiens
aguuucccuaucuc

SEQ ID NO: 823689 - RNA, 16 nt, Homo sapiens
aguuucguaugcacuc

SEQ ID NO: 823690 - RNA, 17 nt, Homo sapiens
aguuucuauucugucag

SEQ ID NO: 823691 - RNA, 18 nt, Homo sapiens
aguuucugauaccacugc

SEQ ID NO: 823692 - RNA, 15 nt, Homo sapiens
aguuucuggugccau

SEQ ID NO: 823693 - RNA, 14 nt, Homo sapiens
aguuucuuccugua

SEQ ID NO: 823694 - RNA, 14 nt, Homo sapiens
aguuugaccucaca

SEQ ID NO: 823695 - RNA, 13 nt, Homo sapiens
aguuugauuucau

SEQ ID NO: 823696 - RNA, 17 nt, Homo sapiens
aguuugcaaugucacaa

SEQ ID NO: 823697 - RNA, 20 nt, Homo sapiens
aguuugcuuugcugaccaaa

SEQ ID NO: 823698 - RNA, 17 nt, Homo sapiens
aguuugcuuuguaugca

SEQ ID NO: 823699 - RNA, 19 nt, Homo sapiens
aguuuggaaugaagaaauu

SEQ ID NO: 823700 - RNA, 16 nt, Homo sapiens
aguuugggccagugaa

SEQ ID NO: 823701 - RNA, 13 nt, Homo sapiens
aguuuguagcuca

SEQ ID NO: 823702 - RNA, 16 nt, Homo sapiens
aguuuguauauauuau

SEQ ID NO: 823703 - RNA, 17 nt, Homo sapiens
aguuugucagacuuuaa

SEQ ID NO: 823704 - RNA, 23 nt, Homo sapiens
aguuugucuuccucuuguuuacg

SEQ ID NO: 823705 - RNA, 19 nt, Homo sapiens
aguuuguggcaucuugcca

SEQ ID NO: 823706 - RNA, 18 nt, Homo sapiens
aguuuguuauagauuuag

SEQ ID NO: 823707 - RNA, 15 nt, Homo sapiens
aguuuuaaauaagcu

SEQ ID NO: 823708 - RNA, 14 nt, Homo sapiens
aguuuuaacugugg

SEQ ID NO: 823709 - RNA, 20 nt, Homo sapiens
aguuuuaauaagaacagauc

SEQ ID NO: 823710 - RNA, 15 nt, Homo sapiens
aguuuuacagcaagg

SEQ ID NO: 823711 - RNA, 17 nt, Homo sapiens
aguuuuagaaaugagau

SEQ ID NO: 823712 - RNA, 13 nt, Homo sapiens
aguuuuaguugca

SEQ ID NO: 823713 - RNA, 20 nt, Homo sapiens
aguuuuauuuugggccuguu

SEQ ID NO: 823714 - RNA, 23 nt, Homo sapiens
aguuuuauuuuuucgugcacucu

SEQ ID NO: 823715 - RNA, 15 nt, Homo sapiens
aguuuucaaaacaca

SEQ ID NO: 823716 - RNA, 18 nt, Homo sapiens
aguuuuccccuggccuca

SEQ ID NO: 823717 - RNA, 13 nt, Homo sapiens
aguuuugaugaaa

SEQ ID NO: 823718 - RNA, 11 nt, Homo sapiens
aguuuugcacu

SEQ ID NO: 823719 - RNA, 17 nt, Homo sapiens
aguuuugccaguucaag

SEQ ID NO: 823720 - RNA, 21 nt, Homo sapiens
aguuuuguaaauguacuggua

SEQ ID NO: 823721 - RNA, 19 nt, Homo sapiens
aguuuuuaaaagaauuuca

SEQ ID NO: 823722 - RNA, 13 nt, Homo sapiens
aguuuuucccaag

SEQ ID NO: 823723 - RNA, 21 nt, Homo sapiens
aguuuuuuauuaugcauuaua

SEQ ID NO: 823724 - RNA, 23 nt, Homo sapiens
auaaaaaaugguucagaauuaaa

SEQ ID NO: 823725 - RNA, 17 nt, Homo sapiens
auaaaaaccauggaacu

SEQ ID NO: 823726 - RNA, 13 nt, Homo sapiens
auaaaaacccugu

SEQ ID NO: 823727 - RNA, 14 nt, Homo sapiens
auaaaaagaaauuu

SEQ ID NO: 823728 - RNA, 17 nt, Homo sapiens
auaaaaagaggagcuuu

SEQ ID NO: 823729 - RNA, 21 nt, Homo sapiens
auaaaacaaaauguuuuggag

SEQ ID NO: 823730 - RNA, 19 nt, Homo sapiens
auaaaacaugggaaucucc

SEQ ID NO: 823731 - RNA, 20 nt, Homo sapiens
auaaaaccaagggauaucuu

SEQ ID NO: 823732 - RNA, 18 nt, Homo sapiens
auaaaacuaugcuauuaa

SEQ ID NO: 823733 - RNA, 18 nt, Homo sapiens
auaaaacucugcauguag

SEQ ID NO: 823734 - RNA, 13 nt, Homo sapiens
auaaaacuuuccu

SEQ ID NO: 823735 - RNA, 20 nt, Homo sapiens
auaaaacuuuucugcugaua

SEQ ID NO: 823736 - RNA, 12 nt, Homo sapiens
auaaaagacuuu

SEQ ID NO: 823737 - RNA, 13 nt, Homo sapiens
auaaaagacuuuu

SEQ ID NO: 823738 - RNA, 19 nt, Homo sapiens
auaaaagauuuacauucca

SEQ ID NO: 823739 - RNA, 20 nt, Homo sapiens
auaaaagcuagauacuggaa

SEQ ID NO: 823740 - RNA, 23 nt, Homo sapiens
auaaaaggggaaauaacugccuu

SEQ ID NO: 823741 - RNA, 20 nt, Homo sapiens
auaaaauaaguggauuuugu

SEQ ID NO: 823742 - RNA, 16 nt, Homo sapiens
auaaaauuagcuugag

SEQ ID NO: 823743 - RNA, 18 nt, Homo sapiens
auaaaauuccuaucucau

SEQ ID NO: 823744 - RNA, 23 nt, Homo sapiens
auaaaauuuaacuuuugagcaua

SEQ ID NO: 823745 - RNA, 21 nt, Homo sapiens
auaaacaacuuaauguucuga

SEQ ID NO: 823746 - RNA, 14 nt, Homo sapiens
auaaacagcuucau

SEQ ID NO: 823747 - RNA, 22 nt, Homo sapiens
auaaacaggaaaaugccagagc

SEQ ID NO: 823748 - RNA, 18 nt, Homo sapiens
auaaacauuccuguugau

SEQ ID NO: 823749 - RNA, 15 nt, Homo sapiens
auaaaccacuuucua

SEQ ID NO: 823750 - RNA, 18 nt, Homo sapiens
auaaaccaguugaaucau

SEQ ID NO: 823751 - RNA, 21 nt, Homo sapiens
auaaaccaguugaaucauuga

SEQ ID NO: 823752 - RNA, 13 nt, Homo sapiens
auaaaccauucca

SEQ ID NO: 823753 - RNA, 15 nt, Homo sapiens
auaaaccugaccucc

SEQ ID NO: 823754 - RNA, 18 nt, Homo sapiens
auaaacgaccaaacucag

SEQ ID NO: 823755 - RNA, 21 nt, Homo sapiens
auaaacuaagagaaacugugu

SEQ ID NO: 823756 - RNA, 13 nt, Homo sapiens
auaaacuacacaa

SEQ ID NO: 823757 - RNA, 22 nt, Homo sapiens
auaaacuagauauuagguccau

SEQ ID NO: 823758 - RNA, 15 nt, Homo sapiens
auaaacuaguuucca

SEQ ID NO: 823759 - RNA, 16 nt, Homo sapiens
auaaacucaaugagcu

SEQ ID NO: 823760 - RNA, 20 nt, Homo sapiens
auaaacugacuaaacuuaca

SEQ ID NO: 823761 - RNA, 18 nt, Homo sapiens
auaaacuuugcuguguac

SEQ ID NO: 823762 - RNA, 17 nt, Homo sapiens
auaaagaagaaaauaac

SEQ ID NO: 823763 - RNA, 17 nt, Homo sapiens
auaaagacaacaaaaga

SEQ ID NO: 823764 - RNA, 20 nt, Homo sapiens
auaaagacaaucacugccaa

SEQ ID NO: 823765 - RNA, 16 nt, Homo sapiens
aguguagccuugcccg

SEQ ID NO: 823766 - RNA, 18 nt, Homo sapiens
aguguagggcaacaauac

SEQ ID NO: 823767 - RNA, 16 nt, Homo sapiens
aguguaguuggaucuc

SEQ ID NO: 823768 - RNA, 17 nt, Homo sapiens
aguguaugacugcacau

SEQ ID NO: 823769 - RNA, 15 nt, Homo sapiens
agugucccugagcag

SEQ ID NO: 823770 - RNA, 17 nt, Homo sapiens
aguguccucuugcucaa

SEQ ID NO: 823771 - RNA, 22 nt, Homo sapiens
aguguccuggcugugaaugcca

SEQ ID NO: 823772 - RNA, 17 nt, Homo sapiens
aguguccuucuugcucc

SEQ ID NO: 823773 - RNA, 19 nt, Homo sapiens
aguguccuuuccagagcaa

SEQ ID NO: 823774 - RNA, 22 nt, Homo sapiens
agugucguuuucauaacuugcu

SEQ ID NO: 823775 - RNA, 21 nt, Homo sapiens
agugucucugccuugagucau

SEQ ID NO: 823776 - RNA, 19 nt, Homo sapiens
agugucuuaggguagaaag

SEQ ID NO: 823777 - RNA, 15 nt, Homo sapiens
agugugaaugcugaa

SEQ ID NO: 823778 - RNA, 12 nt, Homo sapiens
aguguggcccag

SEQ ID NO: 823779 - RNA, 11 nt, Homo sapiens
aguguggcucc

SEQ ID NO: 823780 - RNA, 16 nt, Homo sapiens
aguguggcugaggcca

SEQ ID NO: 823781 - RNA, 21 nt, Homo sapiens
aguguggcugaggccacccag

SEQ ID NO: 823782 - RNA, 23 nt, Homo sapiens
agugugggcgcucucccuaccuu

SEQ ID NO: 823783 - RNA, 17 nt, Homo sapiens
agugugggcuugaccag

SEQ ID NO: 823784 - RNA, 16 nt, Homo sapiens
aguguguaugccaaga

SEQ ID NO: 823785 - RNA, 14 nt, Homo sapiens
agugugugucuuuc

SEQ ID NO: 823786 - RNA, 13 nt, Homo sapiens
aguguucaagaaa

SEQ ID NO: 823787 - RNA, 19 nt, Homo sapiens
aguguucacaaacugugaa

SEQ ID NO: 823788 - RNA, 22 nt, Homo sapiens
aguguucaguaaaagcaaaaug

SEQ ID NO: 823789 - RNA, 18 nt, Homo sapiens
aguguucauugaugcugc

SEQ ID NO: 823790 - RNA, 13 nt, Homo sapiens
aguguucccugac

SEQ ID NO: 823791 - RNA, 12 nt, Homo sapiens
aguguugcuugg

SEQ ID NO: 823792 - RNA, 22 nt, Homo sapiens
aguguugugccccuucacucau

SEQ ID NO: 823793 - RNA, 15 nt, Homo sapiens
aguguuuacccugaa

SEQ ID NO: 823794 - RNA, 15 nt, Homo sapiens
aguguuuuuuauuca

SEQ ID NO: 823795 - RNA, 16 nt, Homo sapiens
aguuaaaagacugcag

SEQ ID NO: 823796 - RNA, 21 nt, Homo sapiens
aguuaaaagacugcagcugcu

SEQ ID NO: 823797 - RNA, 23 nt, Homo sapiens
aguuaaagugaauaaccacuuaa

SEQ ID NO: 823798 - RNA, 18 nt, Homo sapiens
aguuaacucacugagggu

SEQ ID NO: 823799 - RNA, 23 nt, Homo sapiens
aguuaacugugaaauaccacaag

SEQ ID NO: 823800 - RNA, 16 nt, Homo sapiens
aguuacaaacagacca

SEQ ID NO: 823801 - RNA, 15 nt, Homo sapiens
aguuacaaccugaag

SEQ ID NO: 823802 - RNA, 16 nt, Homo sapiens
aguuacacagaaaugc

SEQ ID NO: 823803 - RNA, 21 nt, Homo sapiens
aguuacacagaaaugcugcug

SEQ ID NO: 823804 - RNA, 22 nt, Homo sapiens
aguuacauauguauacaugugc

SEQ ID NO: 823805 - RNA, 18 nt, Homo sapiens
aguuaccaaacauuacaa

SEQ ID NO: 823806 - RNA, 19 nt, Homo sapiens
aguuaccugguagaucaag

SEQ ID NO: 823807 - RNA, 12 nt, Homo sapiens
aguuacuaccug

SEQ ID NO: 823808 - RNA, 17 nt, Homo sapiens
aguuacugccgguuuga

SEQ ID NO: 823809 - RNA, 13 nt, Homo sapiens
aguuacugugguc

SEQ ID NO: 823810 - RNA, 19 nt, Homo sapiens
aguuacuguggucacuugu

SEQ ID NO: 823811 - RNA, 11 nt, Homo sapiens
aguuacuugaa

SEQ ID NO: 823812 - RNA, 24 nt, Homo sapiens
aguuacuuuugacccaugugcaag

SEQ ID NO: 823813 - RNA, 22 nt, Homo sapiens
aguuagguagcuuuagggcaau

SEQ ID NO: 823814 - RNA, 12 nt, Homo sapiens
aguuagucaauc

SEQ ID NO: 823815 - RNA, 23 nt, Homo sapiens
aguuaguguuuugccucaccuaa

SEQ ID NO: 823816 - RNA, 22 nt, Homo sapiens
aguuauaaaucaaugucacuua

SEQ ID NO: 823817 - RNA, 23 nt, Homo sapiens
aguuauagaagagaaaugcugcu

SEQ ID NO: 823818 - RNA, 16 nt, Homo sapiens
aguuauguucagucac

SEQ ID NO: 823819 - RNA, 16 nt, Homo sapiens
aguuauuaaucuggac

SEQ ID NO: 823820 - RNA, 13 nt, Homo sapiens
aguuauucuugca

SEQ ID NO: 823821 - RNA, 18 nt, Homo sapiens
aguuauugcuggugcaaa

SEQ ID NO: 823822 - RNA, 15 nt, Homo sapiens
aguucaacuguauag

SEQ ID NO: 823823 - RNA, 18 nt, Homo sapiens
aguucaagcccaggacca

SEQ ID NO: 823824 - RNA, 20 nt, Homo sapiens
aguucaaucucccgcugcug

SEQ ID NO: 823825 - RNA, 15 nt, Homo sapiens
aguucacuguagaaa

SEQ ID NO: 823826 - RNA, 14 nt, Homo sapiens
aguucagacuguua

SEQ ID NO: 823827 - RNA, 21 nt, Homo sapiens
aguucagggaccguccagggg

SEQ ID NO: 823828 - RNA, 16 nt, Homo sapiens
aguucauaauguggug

SEQ ID NO: 823829 - RNA, 21 nt, Homo sapiens
aguucauaggucuccaagacc

SEQ ID NO: 823830 - RNA, 20 nt, Homo sapiens
aguucauaucuggagccuga

SEQ ID NO: 823831 - RNA, 18 nt, Homo sapiens
aguucauauguaccaugu

SEQ ID NO: 823832 - RNA, 14 nt, Homo sapiens
aguucaucaccauu

SEQ ID NO: 823833 - RNA, 17 nt, Homo sapiens
aguucaucaccauuucc

SEQ ID NO: 823834 - RNA, 12 nt, Homo sapiens
aguucauugugg

SEQ ID NO: 823835 - RNA, 19 nt, Homo sapiens
aguuccaaaauaaagcaua

SEQ ID NO: 823836 - RNA, 19 nt, Homo sapiens
aguuccagaaaaccucucc

SEQ ID NO: 823837 - RNA, 19 nt, Homo sapiens
aguuccaggagaauaaaag

SEQ ID NO: 823838 - RNA, 23 nt, Homo sapiens
aguuccaggccugaucuugccug

SEQ ID NO: 823839 - RNA, 20 nt, Homo sapiens
aguucccuaaacaaaagcaa

SEQ ID NO: 823840 - RNA, 14 nt, Homo sapiens
aguuccucuggguu

SEQ ID NO: 823841 - RNA, 22 nt, Homo sapiens
aguucggaaaccguccugugua

SEQ ID NO: 823842 - RNA, 15 nt, Homo sapiens
aguucuaagauucua

SEQ ID NO: 823843 - RNA, 14 nt, Homo sapiens
aguucuaggcauag

SEQ ID NO: 823844 - RNA, 15 nt, Homo sapiens
aguucugguugauuc

SEQ ID NO: 823845 - RNA, 20 nt, Homo sapiens
aguucuuaaacucagaauau

SEQ ID NO: 823846 - RNA, 20 nt, Homo sapiens
aguucuuugauucuguaaua

SEQ ID NO: 823847 - RNA, 17 nt, Homo sapiens
aguucuuugggccagac

SEQ ID NO: 823848 - RNA, 19 nt, Homo sapiens
aguucuuugggccagacau

SEQ ID NO: 823849 - RNA, 12 nt, Homo sapiens
aguugaacaugg

SEQ ID NO: 823850 - RNA, 20 nt, Homo sapiens
aguugaagcugacucaaaaa

SEQ ID NO: 823851 - RNA, 22 nt, Homo sapiens
aguugacuucugacaaaggugg

SEQ ID NO: 823852 - RNA, 22 nt, Homo sapiens
aguugagagggugcaguccaga

SEQ ID NO: 823853 - RNA, 17 nt, Homo sapiens
aguugagauuuuaauuc

SEQ ID NO: 823854 - RNA, 14 nt, Homo sapiens
aguugaggacuucu

SEQ ID NO: 823855 - RNA, 23 nt, Homo sapiens
aguugaggagacauuacaaugug

SEQ ID NO: 823856 - RNA, 22 nt, Homo sapiens
aguugagucuccucucugagac

SEQ ID NO: 823857 - RNA, 13 nt, Homo sapiens
agugaccauggca

SEQ ID NO: 823858 - RNA, 15 nt, Homo sapiens
agugacccacccuag

SEQ ID NO: 823859 - RNA, 16 nt, Homo sapiens
agugaccccugaccuc

SEQ ID NO: 823860 - RNA, 22 nt, Homo sapiens
agugaccccugaccucacugug

SEQ ID NO: 823861 - RNA, 24 nt, Homo sapiens
agugacuucuggagaaagcucaug

SEQ ID NO: 823862 - RNA, 18 nt, Homo sapiens
agugagaaaaugccucaa

SEQ ID NO: 823863 - RNA, 19 nt, Homo sapiens
agugagaaaccauauuucc

SEQ ID NO: 823864 - RNA, 16 nt, Homo sapiens
agugagaacagcauuu

SEQ ID NO: 823865 - RNA, 18 nt, Homo sapiens
agugagacccugucucaa

SEQ ID NO: 823866 - RNA, 17 nt, Homo sapiens
agugagacuccaucuca

SEQ ID NO: 823867 - RNA, 18 nt, Homo sapiens
agugagacuccaucucaa

SEQ ID NO: 823868 - RNA, 14 nt, Homo sapiens
agugagcucuggug

SEQ ID NO: 823869 - RNA, 23 nt, Homo sapiens
agugaggaacccugaucucucag

SEQ ID NO: 823870 - RNA, 21 nt, Homo sapiens
agugaggaagccuauuugaac

SEQ ID NO: 823871 - RNA, 18 nt, Homo sapiens
agugaguacaugcacacu

SEQ ID NO: 823872 - RNA, 17 nt, Homo sapiens
agugaguaccugcaaaa

SEQ ID NO: 823873 - RNA, 19 nt, Homo sapiens
agugagugaucacugguau

SEQ ID NO: 823874 - RNA, 18 nt, Homo sapiens
agugaguucguuuuggag

SEQ ID NO: 823875 - RNA, 22 nt, Homo sapiens
agugauaucaccucucuucagc

SEQ ID NO: 823876 - RNA, 20 nt, Homo sapiens
agugaucuuucccaagagaa

SEQ ID NO: 823877 - RNA, 12 nt, Homo sapiens
agugaugguugu

SEQ ID NO: 823878 - RNA, 12 nt, Homo sapiens
agugaugucagg

SEQ ID NO: 823879 - RNA, 21 nt, Homo sapiens
agugaugugugagcuaugcaa

SEQ ID NO: 823880 - RNA, 16 nt, Homo sapiens
agugauucuccugccu

SEQ ID NO: 823881 - RNA, 17 nt, Homo sapiens
agugauugauagagugu

SEQ ID NO: 823882 - RNA, 16 nt, Homo sapiens
agugcaaaagugagaa

SEQ ID NO: 823883 - RNA, 15 nt, Homo sapiens
agugcaacaucucug

SEQ ID NO: 823884 - RNA, 20 nt, Homo sapiens
agugcaaugcacgaucucag

SEQ ID NO: 823885 - RNA, 19 nt, Homo sapiens
agugcaauggcacaaucuu

SEQ ID NO: 823886 - RNA, 14 nt, Homo sapiens
agugcacagcuguc

SEQ ID NO: 823887 - RNA, 15 nt, Homo sapiens
agugcacagcugucc

SEQ ID NO: 823888 - RNA, 16 nt, Homo sapiens
agugcacagcugucca

SEQ ID NO: 823889 - RNA, 13 nt, Homo sapiens
agugcaccugccu

SEQ ID NO: 823890 - RNA, 17 nt, Homo sapiens
agugcagaucugugcuc

SEQ ID NO: 823891 - RNA, 18 nt, Homo sapiens
agugcagggaaccgugau

SEQ ID NO: 823892 - RNA, 23 nt, Homo sapiens
agugcagggaggaaaagugcaag

SEQ ID NO: 823893 - RNA, 21 nt, Homo sapiens
agugcaguggcaucaucucag

SEQ ID NO: 823894 - RNA, 20 nt, Homo sapiens
agugcaguggcaugauguca

SEQ ID NO: 823895 - RNA, 21 nt, Homo sapiens
agugcaguggcgcgaucucag

SEQ ID NO: 823896 - RNA, 19 nt, Homo sapiens
agugcaguggcgugaucuc

SEQ ID NO: 823897 - RNA, 20 nt, Homo sapiens
agugcaguggcgugaucuca

SEQ ID NO: 823898 - RNA, 23 nt, Homo sapiens
agugcaguggcgugaucucagcu

SEQ ID NO: 823899 - RNA, 22 nt, Homo sapiens
agugcaucuuugccucaacucc

SEQ ID NO: 823900 - RNA, 14 nt, Homo sapiens
agugcaugguggcc

SEQ ID NO: 823901 - RNA, 16 nt, Homo sapiens
agugcauuugugcuag

SEQ ID NO: 823902 - RNA, 20 nt, Homo sapiens
agugccaauauuucugauau

SEQ ID NO: 823903 - RNA, 18 nt, Homo sapiens
agugccacccaugcagcu

SEQ ID NO: 823904 - RNA, 20 nt, Homo sapiens
agugccacuugacauuccuu

SEQ ID NO: 823905 - RNA, 16 nt, Homo sapiens
agugcccacauuugau

SEQ ID NO: 823906 - RNA, 13 nt, Homo sapiens
agugcccuaggcc

SEQ ID NO: 823907 - RNA, 23 nt, Homo sapiens
agugcccuggggcugaucucagg

SEQ ID NO: 823908 - RNA, 16 nt, Homo sapiens
agugccuagacuguua

SEQ ID NO: 823909 - RNA, 13 nt, Homo sapiens
agugccugcugaa

SEQ ID NO: 823910 - RNA, 14 nt, Homo sapiens
agugccuuaccucc

SEQ ID NO: 823911 - RNA, 21 nt, Homo sapiens
agugccuuccucucucuacca

SEQ ID NO: 823912 - RNA, 20 nt, Homo sapiens
agugccuucugcccucccug

SEQ ID NO: 823913 - RNA, 13 nt, Homo sapiens
agugcgguuuacu

SEQ ID NO: 823914 - RNA, 14 nt, Homo sapiens
agugcuaguauuau

SEQ ID NO: 823915 - RNA, 14 nt, Homo sapiens
agugcuagucucag

SEQ ID NO: 823916 - RNA, 15 nt, Homo sapiens
agugcuauuguagag

SEQ ID NO: 823917 - RNA, 13 nt, Homo sapiens
agugcucucacug

SEQ ID NO: 823918 - RNA, 18 nt, Homo sapiens
agugcugcccaugagcaa

SEQ ID NO: 823919 - RNA, 20 nt, Homo sapiens
agugcugcuggaaguagaau

SEQ ID NO: 823920 - RNA, 17 nt, Homo sapiens
agugcugggaccagagc

SEQ ID NO: 823921 - RNA, 17 nt, Homo sapiens
agugcugggauuacaau

SEQ ID NO: 823922 - RNA, 19 nt, Homo sapiens
agugcugggauuacaggug

SEQ ID NO: 823923 - RNA, 14 nt, Homo sapiens
agugcuggucagag

SEQ ID NO: 823924 - RNA, 15 nt, Homo sapiens
agugcuuccacuucu

SEQ ID NO: 823925 - RNA, 13 nt, Homo sapiens
agugcuugauaug

SEQ ID NO: 823926 - RNA, 14 nt, Homo sapiens
agugcuuguuuacu

SEQ ID NO: 823927 - RNA, 20 nt, Homo sapiens
agugcuuguuuacuaagcau

SEQ ID NO: 823928 - RNA, 18 nt, Homo sapiens
aguggaaaaaggagagca

SEQ ID NO: 823929 - RNA, 14 nt, Homo sapiens
aguggaaggcauca

SEQ ID NO: 823930 - RNA, 14 nt, Homo sapiens
aguggagacagacu

SEQ ID NO: 823931 - RNA, 20 nt, Homo sapiens
aguggagaugggguuucacc

SEQ ID NO: 823932 - RNA, 15 nt, Homo sapiens
aguggaucacacaca

SEQ ID NO: 823933 - RNA, 16 nt, Homo sapiens
aguggauugcauuucu

SEQ ID NO: 823934 - RNA, 23 nt, Homo sapiens
aguggcaaccuugucucuaugcc

SEQ ID NO: 823935 - RNA, 15 nt, Homo sapiens
aguggcagugucauu

SEQ ID NO: 823936 - RNA, 15 nt, Homo sapiens
aguggcaucaucuca

SEQ ID NO: 823937 - RNA, 17 nt, Homo sapiens
aguggcaucaucucagc

SEQ ID NO: 823938 - RNA, 18 nt, Homo sapiens
aguggcaucaucucagcu

SEQ ID NO: 823939 - RNA, 18 nt, Homo sapiens
aguggcauuuccugguca

SEQ ID NO: 823940 - RNA, 16 nt, Homo sapiens
aguggcccccacagaa

SEQ ID NO: 823941 - RNA, 23 nt, Homo sapiens
aguggcgcaugccuguaauccca

SEQ ID NO: 823942 - RNA, 23 nt, Homo sapiens
aguggcggggggguuuugccuaa

SEQ ID NO: 823943 - RNA, 23 nt, Homo sapiens
aguggcucacgccuaugauccca

SEQ ID NO: 823944 - RNA, 23 nt, Homo sapiens
aguggcucacgccuguaauccca

SEQ ID NO: 823945 - RNA, 20 nt, Homo sapiens
aguggcugaguagcucugcc

SEQ ID NO: 823946 - RNA, 21 nt, Homo sapiens
aguggcugaguagcucugccu

SEQ ID NO: 823947 - RNA, 15 nt, Homo sapiens
aguggcuggucucac

SEQ ID NO: 823948 - RNA, 17 nt, Homo sapiens
aguggcuucugggagau

SEQ ID NO: 823949 - RNA, 17 nt, Homo sapiens
agugggaacucugacaa

SEQ ID NO: 823950 - RNA, 14 nt, Homo sapiens
agggugacuaugga

SEQ ID NO: 823951 - RNA, 18 nt, Homo sapiens
aggguggacuucagugug

SEQ ID NO: 823952 - RNA, 15 nt, Homo sapiens
aggguggaugacagg

SEQ ID NO: 823953 - RNA, 23 nt, Homo sapiens
agggugggguaaccaaauguugg

SEQ ID NO: 823954 - RNA, 17 nt, Homo sapiens
aggguggugaguagagc

SEQ ID NO: 823955 - RNA, 22 nt, Homo sapiens
agggugguggcgugcauaugua

SEQ ID NO: 823956 - RNA, 15 nt, Homo sapiens
aggguguaucuagcu

SEQ ID NO: 823957 - RNA, 15 nt, Homo sapiens
aggguguguguucac

SEQ ID NO: 823958 - RNA, 23 nt, Homo sapiens
aggguuaacccuucaucuuccug

SEQ ID NO: 823959 - RNA, 15 nt, Homo sapiens
aggguucaacaaagg

SEQ ID NO: 823960 - RNA, 19 nt, Homo sapiens
aggguuccccuggccuuaa

SEQ ID NO: 823961 - RNA, 16 nt, Homo sapiens
aggguucuaaguggga

SEQ ID NO: 823962 - RNA, 13 nt, Homo sapiens
aggguugccugua

SEQ ID NO: 823963 - RNA, 20 nt, Homo sapiens
aggguuuuccaaugugacua

SEQ ID NO: 823964 - RNA, 13 nt, Homo sapiens
aggguuuugcccc

SEQ ID NO: 823965 - RNA, 13 nt, Homo sapiens
agguaaaccaaac

SEQ ID NO: 823966 - RNA, 12 nt, Homo sapiens
agguaacauguu

SEQ ID NO: 823967 - RNA, 19 nt, Homo sapiens
agguaacucuuugcacaua

SEQ ID NO: 823968 - RNA, 14 nt, Homo sapiens
agguaaugugaaua

SEQ ID NO: 823969 - RNA, 22 nt, Homo sapiens
agguacagcaacaggaaucuca

SEQ ID NO: 823970 - RNA, 20 nt, Homo sapiens
agguacgauuauacuugaga

SEQ ID NO: 823971 - RNA, 19 nt, Homo sapiens
agguagaaauaucugaaaa

SEQ ID NO: 823972 - RNA, 19 nt, Homo sapiens
agguagcccagcacuguga

SEQ ID NO: 823973 - RNA, 21 nt, Homo sapiens
agguauaccuguugagacuga

SEQ ID NO: 823974 - RNA, 21 nt, Homo sapiens
agguaucaguugcaauaauac

SEQ ID NO: 823975 - RNA, 22 nt, Homo sapiens
agguaugaauuaaaagucuaca

SEQ ID NO: 823976 - RNA, 18 nt, Homo sapiens
agguaugcaaucaaaucu

SEQ ID NO: 823977 - RNA, 16 nt, Homo sapiens
agguaugccaccaaca

SEQ ID NO: 823978 - RNA, 20 nt, Homo sapiens
agguauggcagaggugcaag

SEQ ID NO: 823979 - RNA, 21 nt, Homo sapiens
agguauguuacuguaguaauu

SEQ ID NO: 823980 - RNA, 13 nt, Homo sapiens
agguauguugccu

SEQ ID NO: 823981 - RNA, 16 nt, Homo sapiens
agguauuggggaacag

SEQ ID NO: 823982 - RNA, 12 nt, Homo sapiens
aggucacuggaa

SEQ ID NO: 823983 - RNA, 21 nt, Homo sapiens
aggucagcccagccccuccaa

SEQ ID NO: 823984 - RNA, 13 nt, Homo sapiens
aggucagccugga

SEQ ID NO: 823985 - RNA, 17 nt, Homo sapiens
aggucaggaguucaaga

SEQ ID NO: 823986 - RNA, 12 nt, Homo sapiens
aggucagugcuu

SEQ ID NO: 823987 - RNA, 22 nt, Homo sapiens
aggucauauauuuuuugcuacu

SEQ ID NO: 823988 - RNA, 16 nt, Homo sapiens
agguccaaguucaagc

SEQ ID NO: 823989 - RNA, 23 nt, Homo sapiens
agguccaccgagccccugacccc

SEQ ID NO: 823990 - RNA, 13 nt, Homo sapiens
agguccaccugcu

SEQ ID NO: 823991 - RNA, 15 nt, Homo sapiens
agguccaccugcuaa

SEQ ID NO: 823992 - RNA, 20 nt, Homo sapiens
aggucccggccagcucugga

SEQ ID NO: 823993 - RNA, 16 nt, Homo sapiens
agguccgguguucuaa

SEQ ID NO: 823994 - RNA, 18 nt, Homo sapiens
agguccgguguucuaaga

SEQ ID NO: 823995 - RNA, 20 nt, Homo sapiens
agguccucuacuuaaugaga

SEQ ID NO: 823996 - RNA, 19 nt, Homo sapiens
agguccugcuccgcugccu

SEQ ID NO: 823997 - RNA, 23 nt, Homo sapiens
agguccugcuccgcugccuggaa

SEQ ID NO: 823998 - RNA, 21 nt, Homo sapiens
agguccuuauguccugucaua

SEQ ID NO: 823999 - RNA, 20 nt, Homo sapiens
agguccuuguuguuucuugc

SEQ ID NO: 824000 - RNA, 12 nt, Homo sapiens
aggucggcacuu

SEQ ID NO: 824001 - RNA, 14 nt, Homo sapiens
aggucuaccccugg

SEQ ID NO: 824002 - RNA, 15 nt, Homo sapiens
aggucuaguguuccu

SEQ ID NO: 824003 - RNA, 12 nt, Homo sapiens
aggucucaugga

SEQ ID NO: 824004 - RNA, 16 nt, Homo sapiens
aggucuccaagacaau

SEQ ID NO: 824005 - RNA, 23 nt, Homo sapiens
aggucuccaagacaauaauuaca

SEQ ID NO: 824006 - RNA, 16 nt, Homo sapiens
aggucugacacgucug

SEQ ID NO: 824007 - RNA, 20 nt, Homo sapiens
aggucugguccgagucucag

SEQ ID NO: 824008 - RNA, 19 nt, Homo sapiens
aggugaaaauccaucucau

SEQ ID NO: 824009 - RNA, 13 nt, Homo sapiens
aggugaaccaaag

SEQ ID NO: 824010 - RNA, 14 nt, Homo sapiens
aggugaaccaaaga

SEQ ID NO: 824011 - RNA, 19 nt, Homo sapiens
aggugaagucgggucaaaa

SEQ ID NO: 824012 - RNA, 12 nt, Homo sapiens
aggugaauaauu

SEQ ID NO: 824013 - RNA, 18 nt, Homo sapiens
aggugacaaaccauuucc

SEQ ID NO: 824014 - RNA, 16 nt, Homo sapiens
aggugaggcucuucac

SEQ ID NO: 824015 - RNA, 18 nt, Homo sapiens
aggugaggcucuucacau

SEQ ID NO: 824016 - RNA, 15 nt, Homo sapiens
aggugaucuaccugc

SEQ ID NO: 824017 - RNA, 20 nt, Homo sapiens
aggugaucuaccugccucag

SEQ ID NO: 824018 - RNA, 14 nt, Homo sapiens
aggugaugccauua

SEQ ID NO: 824019 - RNA, 16 nt, Homo sapiens
aggugcagacuucuua

SEQ ID NO: 824020 - RNA, 19 nt, Homo sapiens
aggugccaucucaggagaa

SEQ ID NO: 824021 - RNA, 17 nt, Homo sapiens
aggugcccagaauuuac

SEQ ID NO: 824022 - RNA, 11 nt, Homo sapiens
aggugccucau

SEQ ID NO: 824023 - RNA, 19 nt, Homo sapiens
aggugccucauagcauagc

SEQ ID NO: 824024 - RNA, 17 nt, Homo sapiens
aggugcuacaaaaacac

SEQ ID NO: 824025 - RNA, 20 nt, Homo sapiens
aggugcuacaaaaacacagc

SEQ ID NO: 824026 - RNA, 17 nt, Homo sapiens
aggugcuacaacaugug

SEQ ID NO: 824027 - RNA, 19 nt, Homo sapiens
aggugcuacaacaugugag

SEQ ID NO: 824028 - RNA, 19 nt, Homo sapiens
aggugcuaucgcaccacug

SEQ ID NO: 824029 - RNA, 13 nt, Homo sapiens
aggugcugaugag

SEQ ID NO: 824030 - RNA, 15 nt, Homo sapiens
agguggaccuggcag

SEQ ID NO: 824031 - RNA, 16 nt, Homo sapiens
agguggagaacuggga

SEQ ID NO: 824032 - RNA, 17 nt, Homo sapiens
agguggcaacaaugccc

SEQ ID NO: 824033 - RNA, 20 nt, Homo sapiens
agguggccacagugucacug

SEQ ID NO: 824034 - RNA, 16 nt, Homo sapiens
agguggcccuaaagga

SEQ ID NO: 824035 - RNA, 23 nt, Homo sapiens
agguggguccaggaaggcagcug

SEQ ID NO: 824036 - RNA, 20 nt, Homo sapiens
agguggguuuguaccuuccu

SEQ ID NO: 824037 - RNA, 19 nt, Homo sapiens
aggugguccuuccuaccuc

SEQ ID NO: 824038 - RNA, 15 nt, Homo sapiens
agguggugaggcaau

SEQ ID NO: 824039 - RNA, 13 nt, Homo sapiens
agguggugccagu

SEQ ID NO: 824040 - RNA, 14 nt, Homo sapiens
agguguaaccguaa

SEQ ID NO: 824041 - RNA, 15 nt, Homo sapiens
aggugucugccuuca

SEQ ID NO: 824042 - RNA, 16 nt, Homo sapiens
agguguucaagaccag

SEQ ID NO: 824043 - RNA, 22 nt, Homo sapiens
agguguucaagaccagccugac

SEQ ID NO: 824044 - RNA, 16 nt, Homo sapiens
agguguugccaaauau

SEQ ID NO: 824045 - RNA, 16 nt, Homo sapiens
agccaccaguucucau

SEQ ID NO: 824046 - RNA, 22 nt, Homo sapiens
agccacccugaguugcuuuuca

SEQ ID NO: 824047 - RNA, 13 nt, Homo sapiens
agccaccuagucc

SEQ ID NO: 824048 - RNA, 14 nt, Homo sapiens
agccaccucaccaa

SEQ ID NO: 824049 - RNA, 16 nt, Homo sapiens
agccacuuucugccag

SEQ ID NO: 824050 - RNA, 22 nt, Homo sapiens
agccacuuucugccagcaucug

SEQ ID NO: 824051 - RNA, 24 nt, Homo sapiens
agccacuuucugccagcaucugca

SEQ ID NO: 824052 - RNA, 23 nt, Homo sapiens
agccagaagacugacaaagucau

SEQ ID NO: 824053 - RNA, 12 nt, Homo sapiens
agccagacacuc

SEQ ID NO: 824054 - RNA, 14 nt, Homo sapiens
agccagacuggcac

SEQ ID NO: 824055 - RNA, 18 nt, Homo sapiens
agccagagagcaucuuuc

SEQ ID NO: 824056 - RNA, 14 nt, Homo sapiens
agccagaggcaucu

SEQ ID NO: 824057 - RNA, 16 nt, Homo sapiens
agucaccgaagguccu

SEQ ID NO: 824058 - RNA, 14 nt, Homo sapiens
agucaccgggauga

SEQ ID NO: 824059 - RNA, 23 nt, Homo sapiens
agucacugcacagugcaucucag

SEQ ID NO: 824060 - RNA, 17 nt, Homo sapiens
agucacugccaagucau

SEQ ID NO: 824061 - RNA, 20 nt, Homo sapiens
agucacugcucuucagccau

SEQ ID NO: 824062 - RNA, 17 nt, Homo sapiens
agucacuggcaucucac

SEQ ID NO: 824063 - RNA, 20 nt, Homo sapiens
agucacuguucgucacucaa

SEQ ID NO: 824064 - RNA, 14 nt, Homo sapiens
agucagaugaggca

SEQ ID NO: 824065 - RNA, 14 nt, Homo sapiens
agucagaugcccag

SEQ ID NO: 824066 - RNA, 14 nt, Homo sapiens
agucagccacuggg

SEQ ID NO: 824067 - RNA, 12 nt, Homo sapiens
agucagcugcug

SEQ ID NO: 824068 - RNA, 21 nt, Homo sapiens
agucaggaauggcugcaccuu

SEQ ID NO: 824069 - RNA, 14 nt, Homo sapiens
agucaguugcauuc

SEQ ID NO: 824070 - RNA, 17 nt, Homo sapiens
agucaguuuuaggguug

SEQ ID NO: 824071 - RNA, 15 nt, Homo sapiens
agucauacuaguagu

SEQ ID NO: 824072 - RNA, 17 nt, Homo sapiens
agucauaucaaagggua

SEQ ID NO: 824073 - RNA, 18 nt, Homo sapiens
agucauccagucuauuca

SEQ ID NO: 824074 - RNA, 16 nt, Homo sapiens
agucauccucagauca

SEQ ID NO: 824075 - RNA, 14 nt, Homo sapiens
agucauccugccaa

SEQ ID NO: 824076 - RNA, 18 nt, Homo sapiens
agucaucuccaucagcug

SEQ ID NO: 824077 - RNA, 11 nt, Homo sapiens
agucaucuccc

SEQ ID NO: 824078 - RNA, 20 nt, Homo sapiens
agucaugaagcccaagugaa

SEQ ID NO: 824079 - RNA, 22 nt, Homo sapiens
agucauggagaaucugcugcau

SEQ ID NO: 824080 - RNA, 17 nt, Homo sapiens
agucauggcaccaaagc

SEQ ID NO: 824081 - RNA, 20 nt, Homo sapiens
agucauggcccaaauccagu

SEQ ID NO: 824082 - RNA, 17 nt, Homo sapiens
agucauggggucccugc

SEQ ID NO: 824083 - RNA, 23 nt, Homo sapiens
agucauucagcagcaaauuuuca

SEQ ID NO: 824084 - RNA, 22 nt, Homo sapiens
agucauuugauagaaagaugag

SEQ ID NO: 824085 - RNA, 21 nt, Homo sapiens
agucauuugcugagcauguac

SEQ ID NO: 824086 - RNA, 15 nt, Homo sapiens
aguccaacaauguug

SEQ ID NO: 824087 - RNA, 15 nt, Homo sapiens
aguccaccugaggaa

SEQ ID NO: 824088 - RNA, 22 nt, Homo sapiens
aguccacuuguucuguacuugu

SEQ ID NO: 824089 - RNA, 17 nt, Homo sapiens
aguccagacagcuugac

SEQ ID NO: 824090 - RNA, 19 nt, Homo sapiens
aguccagagggacagucag

SEQ ID NO: 824091 - RNA, 21 nt, Homo sapiens
aguccaggguggaugaucuca

SEQ ID NO: 824092 - RNA, 18 nt, Homo sapiens
aguccaucuaacaucaua

SEQ ID NO: 824093 - RNA, 13 nt, Homo sapiens
aguccaugcuucu

SEQ ID NO: 824094 - RNA, 12 nt, Homo sapiens
aguccauuuuaa

SEQ ID NO: 824095 - RNA, 18 nt, Homo sapiens
agucccagcuacucagga

SEQ ID NO: 824096 - RNA, 16 nt, Homo sapiens
agucccagcuacuuga

SEQ ID NO: 824097 - RNA, 20 nt, Homo sapiens
agucccaggggcagccacac

SEQ ID NO: 824098 - RNA, 20 nt, Homo sapiens
aguccccucaccuccucuaa

SEQ ID NO: 824099 - RNA, 17 nt, Homo sapiens
aguccccuucuguguuu

SEQ ID NO: 824100 - RNA, 22 nt, Homo sapiens
agucccgggucucaacuuuaag

SEQ ID NO: 824101 - RNA, 16 nt, Homo sapiens
agucccuccaaagggc

SEQ ID NO: 824102 - RNA, 17 nt, Homo sapiens
aguccgcagaagcccug

SEQ ID NO: 824103 - RNA, 17 nt, Homo sapiens
aguccuagccacucagg

SEQ ID NO: 824104 - RNA, 17 nt, Homo sapiens
aguccuauucuauugca

SEQ ID NO: 824105 - RNA, 19 nt, Homo sapiens
aguccucguagccaucucu

SEQ ID NO: 824106 - RNA, 12 nt, Homo sapiens
aguccucuagca

SEQ ID NO: 824107 - RNA, 20 nt, Homo sapiens
aguccucuuugucauaccuu

SEQ ID NO: 824108 - RNA, 17 nt, Homo sapiens
aguccugacacuauuca

SEQ ID NO: 824109 - RNA, 22 nt, Homo sapiens
aguccugcuaccucccuugccu

SEQ ID NO: 824110 - RNA, 16 nt, Homo sapiens
aguccuggaaucacau

SEQ ID NO: 824111 - RNA, 19 nt, Homo sapiens
aguccuguuugcagggaag

SEQ ID NO: 824112 - RNA, 21 nt, Homo sapiens
aguccuuaaaaaucacacugu

SEQ ID NO: 824113 - RNA, 23 nt, Homo sapiens
aguccuugauuucaaaguuuugu

SEQ ID NO: 824114 - RNA, 16 nt, Homo sapiens
agucggaucuagucca

SEQ ID NO: 824115 - RNA, 17 nt, Homo sapiens
agucguucccagugugg

SEQ ID NO: 824116 - RNA, 21 nt, Homo sapiens
agucuaaagauggaguuucua

SEQ ID NO: 824117 - RNA, 20 nt, Homo sapiens
agucuaagaaaaugaucuua

SEQ ID NO: 824118 - RNA, 18 nt, Homo sapiens
agucuaaugaagagaaaa

SEQ ID NO: 824119 - RNA, 17 nt, Homo sapiens
agucuaggagcugggag

SEQ ID NO: 824120 - RNA, 17 nt, Homo sapiens
agucuauguauguguaa

SEQ ID NO: 824121 - RNA, 17 nt, Homo sapiens
agucucagagaccagca

SEQ ID NO: 824122 - RNA, 23 nt, Homo sapiens
agucucagagaccagcacucagc

SEQ ID NO: 824123 - RNA, 17 nt, Homo sapiens
agucuccuuugcacuga

SEQ ID NO: 824124 - RNA, 14 nt, Homo sapiens
agucucuauaccaa

SEQ ID NO: 824125 - RNA, 15 nt, Homo sapiens
agucucuauaccaau

SEQ ID NO: 824126 - RNA, 18 nt, Homo sapiens
agucucugcccaaacaua

SEQ ID NO: 824127 - RNA, 17 nt, Homo sapiens
agucucuucugcuggca

SEQ ID NO: 824128 - RNA, 22 nt, Homo sapiens
agucucuuuaaucuucaguuuu

SEQ ID NO: 824129 - RNA, 14 nt, Homo sapiens
agucugaugacaca

SEQ ID NO: 824130 - RNA, 19 nt, Homo sapiens
agucugccacuugucaaag

SEQ ID NO: 824131 - RNA, 21 nt, Homo sapiens
agucugcuacccucauuucuc

SEQ ID NO: 824132 - RNA, 21 nt, Homo sapiens
agucuggaaaacagaaaccau

SEQ ID NO: 824133 - RNA, 21 nt, Homo sapiens
agucugggauguagaacuuca

SEQ ID NO: 824134 - RNA, 14 nt, Homo sapiens
agucugucuacugu

SEQ ID NO: 824135 - RNA, 16 nt, Homo sapiens
agucuuagacaucaua

SEQ ID NO: 824136 - RNA, 21 nt, Homo sapiens
agucuuagcuccuguguuaca

SEQ ID NO: 824137 - RNA, 17 nt, Homo sapiens
agucuuauuuccucaac

SEQ ID NO: 824138 - RNA, 23 nt, Homo sapiens
agucuuccaguuuaaugaacuac

SEQ ID NO: 824139 - RNA, 17 nt, Homo sapiens
agucuucucucuggcuc

SEQ ID NO: 824140 - RNA, 19 nt, Homo sapiens
agucuuguagaaaucucag

SEQ ID NO: 824141 - RNA, 19 nt, Homo sapiens
agucuugucauugccagcu

SEQ ID NO: 824142 - RNA, 10 nt, Homo sapiens
agucuugucu

SEQ ID NO: 824143 - RNA, 16 nt, Homo sapiens
agucuuuccuaccuug

SEQ ID NO: 824144 - RNA, 16 nt, Homo sapiens
agucuuucuugagcag

SEQ ID NO: 824145 - RNA, 20 nt, Homo sapiens
agucuuugagcgagcccauu

SEQ ID NO: 824146 - RNA, 16 nt, Homo sapiens
agucuuugcuauugug

SEQ ID NO: 824147 - RNA, 12 nt, Homo sapiens
agucuuugcuca

SEQ ID NO: 824148 - RNA, 15 nt, Homo sapiens
agugaaaaacaucca

SEQ ID NO: 824149 - RNA, 22 nt, Homo sapiens
agugaaaauuguuuagugauau

SEQ ID NO: 824150 - RNA, 18 nt, Homo sapiens
agccucccuguaacucca

SEQ ID NO: 824151 - RNA, 18 nt, Homo sapiens
agccuccgccucccgggu

SEQ ID NO: 824152 - RNA, 22 nt, Homo sapiens
agccucggcccuagcauugcac

SEQ ID NO: 824153 - RNA, 20 nt, Homo sapiens
agccucguuucugcuuucag

SEQ ID NO: 824154 - RNA, 14 nt, Homo sapiens
agccucuccuccau

SEQ ID NO: 824155 - RNA, 20 nt, Homo sapiens
agccucuggccgucacacgu

SEQ ID NO: 824156 - RNA, 13 nt, Homo sapiens
agccucuggcuag

SEQ ID NO: 824157 - RNA, 16 nt, Homo sapiens
agccugaaacugaguu

SEQ ID NO: 824158 - RNA, 17 nt, Homo sapiens
agccugaacagaagcuc

SEQ ID NO: 824159 - RNA, 23 nt, Homo sapiens
agccugaaugucuuacugugauc

SEQ ID NO: 824160 - RNA, 19 nt, Homo sapiens
agccugaauuuuguugcug

SEQ ID NO: 824161 - RNA, 21 nt, Homo sapiens
agccugagcagagacaugacu

SEQ ID NO: 824162 - RNA, 18 nt, Homo sapiens
agccugcaaacucacugc

SEQ ID NO: 824163 - RNA, 23 nt, Homo sapiens
agccugcaaacucacugcucaag

SEQ ID NO: 824164 - RNA, 19 nt, Homo sapiens
agccugcacacaccugccu

SEQ ID NO: 824165 - RNA, 12 nt, Homo sapiens
agccugcauuga

SEQ ID NO: 824166 - RNA, 12 nt, Homo sapiens
agccugccuccc

SEQ ID NO: 824167 - RNA, 18 nt, Homo sapiens
agccugcuggcacccacc

SEQ ID NO: 824168 - RNA, 20 nt, Homo sapiens
agccugcuuugcuuuacugc

SEQ ID NO: 824169 - RNA, 17 nt, Homo sapiens
agccuggauuccagcag

SEQ ID NO: 824170 - RNA, 16 nt, Homo sapiens
agccuggccaacaugg

SEQ ID NO: 824171 - RNA, 13 nt, Homo sapiens
agccuggccuaau

SEQ ID NO: 824172 - RNA, 20 nt, Homo sapiens
agccuggcucuaucuuccuc

SEQ ID NO: 824173 - RNA, 21 nt, Homo sapiens
agccuggcugcccaucaugug

SEQ ID NO: 824174 - RNA, 14 nt, Homo sapiens
agccugggcaacau

SEQ ID NO: 824175 - RNA, 22 nt, Homo sapiens
agccugggcguacagagcacau

SEQ ID NO: 824176 - RNA, 17 nt, Homo sapiens
agccuggggcucccucu

SEQ ID NO: 824177 - RNA, 14 nt, Homo sapiens
agccugggggacag

SEQ ID NO: 824178 - RNA, 15 nt, Homo sapiens
agccuggggugaccu

SEQ ID NO: 824179 - RNA, 14 nt, Homo sapiens
agccugugaagucc

SEQ ID NO: 824180 - RNA, 16 nt, Homo sapiens
agccugugaaguccua

SEQ ID NO: 824181 - RNA, 20 nt, Homo sapiens
agccugugaauaaaaacccu

SEQ ID NO: 824182 - RNA, 14 nt, Homo sapiens
agccugugauuaac

SEQ ID NO: 824183 - RNA, 22 nt, Homo sapiens
agccugugcauguaugucuugg

SEQ ID NO: 824184 - RNA, 23 nt, Homo sapiens
agccuguggcaucuuugccuugg

SEQ ID NO: 824185 - RNA, 14 nt, Homo sapiens
agccuguuauauuc

SEQ ID NO: 824186 - RNA, 12 nt, Homo sapiens
agccuuacaaag

SEQ ID NO: 824187 - RNA, 14 nt, Homo sapiens
agccuucauugccu

SEQ ID NO: 824188 - RNA, 20 nt, Homo sapiens
agccuuccacagugaaugug

SEQ ID NO: 824189 - RNA, 15 nt, Homo sapiens
agccuugcagauauc

SEQ ID NO: 824190 - RNA, 21 nt, Homo sapiens
agccuugugugaacucaccaa

SEQ ID NO: 824191 - RNA, 19 nt, Homo sapiens
agccuuuacuguuugauau

SEQ ID NO: 824192 - RNA, 15 nt, Homo sapiens
agccuuuccaaguca

SEQ ID NO: 824193 - RNA, 16 nt, Homo sapiens
agccuuugcccuguca

SEQ ID NO: 824194 - RNA, 14 nt, Homo sapiens
agccuuugccuccc

SEQ ID NO: 824195 - RNA, 13 nt, Homo sapiens
agcgaacugcacu

SEQ ID NO: 824196 - RNA, 17 nt, Homo sapiens
agcgaacuuguauacuu

SEQ ID NO: 824197 - RNA, 13 nt, Homo sapiens
agcgaaucucugc

SEQ ID NO: 824198 - RNA, 22 nt, Homo sapiens
agcgaccgcccccuccucuagc

SEQ ID NO: 824199 - RNA, 22 nt, Homo sapiens
agcgacguuuauuucaucucuu

SEQ ID NO: 824200 - RNA, 15 nt, Homo sapiens
agcgagacuccgucu

SEQ ID NO: 824201 - RNA, 17 nt, Homo sapiens
agcgagagucugucuca

SEQ ID NO: 824202 - RNA, 23 nt, Homo sapiens
agcgcaugugugcaugugcugug

SEQ ID NO: 824203 - RNA, 13 nt, Homo sapiens
agcgcgucucagc

SEQ ID NO: 824204 - RNA, 20 nt, Homo sapiens
agcgcuucugcugaaaguuc

SEQ ID NO: 824205 - RNA, 22 nt, Homo sapiens
agcgcuuuaaaagcgaccucuc

SEQ ID NO: 824206 - RNA, 18 nt, Homo sapiens
agcggagagagccaagac

SEQ ID NO: 824207 - RNA, 13 nt, Homo sapiens
agcggcugcucaa

SEQ ID NO: 824208 - RNA, 17 nt, Homo sapiens
agcgggggccuugaaga

SEQ ID NO: 824209 - RNA, 23 nt, Homo sapiens
agcgguccaacgccgccuuggcc

SEQ ID NO: 824210 - RNA, 20 nt, Homo sapiens
agcggugguuuguaauuccu

SEQ ID NO: 824211 - RNA, 12 nt, Homo sapiens
agcguacuugaa

SEQ ID NO: 824212 - RNA, 16 nt, Homo sapiens
agcgucaagacauuug

SEQ ID NO: 824213 - RNA, 16 nt, Homo sapiens
agcgucccuagcagug

SEQ ID NO: 824214 - RNA, 15 nt, Homo sapiens
agcgucuugcucugu

SEQ ID NO: 824215 - RNA, 15 nt, Homo sapiens
agcgugaaagcagau

SEQ ID NO: 824216 - RNA, 16 nt, Homo sapiens
agcgugggacccuuca

SEQ ID NO: 824217 - RNA, 16 nt, Homo sapiens
agcguuaugugcagua

SEQ ID NO: 824218 - RNA, 23 nt, Homo sapiens
agcguuguaguaaaugcgugcuu

SEQ ID NO: 824219 - RNA, 20 nt, Homo sapiens
agcguuucuuuacuucucac

SEQ ID NO: 824220 - RNA, 11 nt, Homo sapiens
agcguuugcac

SEQ ID NO: 824221 - RNA, 23 nt, Homo sapiens
agcuaacccucacaagcaugaag

SEQ ID NO: 824222 - RNA, 14 nt, Homo sapiens
agcuaagaaccugg

SEQ ID NO: 824223 - RNA, 14 nt, Homo sapiens
agcuaagauuaucu

SEQ ID NO: 824224 - RNA, 13 nt, Homo sapiens
agcuaagccacau

SEQ ID NO: 824225 - RNA, 12 nt, Homo sapiens
agcuaagugaaa

SEQ ID NO: 824226 - RNA, 19 nt, Homo sapiens
agcuaagugaaaaggucau

SEQ ID NO: 824227 - RNA, 22 nt, Homo sapiens
agcuaauggcgaucaucuuugc

SEQ ID NO: 824228 - RNA, 13 nt, Homo sapiens
agcuacaggacau

SEQ ID NO: 824229 - RNA, 15 nt, Homo sapiens
agcuacaggacauuu

SEQ ID NO: 824230 - RNA, 22 nt, Homo sapiens
agcuacagggcugauacauccu

SEQ ID NO: 824231 - RNA, 11 nt, Homo sapiens
agcuacagugu

SEQ ID NO: 824232 - RNA, 17 nt, Homo sapiens
agcuacaugguggagca

SEQ ID NO: 824233 - RNA, 14 nt, Homo sapiens
agcuacauguucuu

SEQ ID NO: 824234 - RNA, 13 nt, Homo sapiens
agcuacauuccuc

SEQ ID NO: 824235 - RNA, 16 nt, Homo sapiens
agcuaccucaaacuuc

SEQ ID NO: 824236 - RNA, 21 nt, Homo sapiens
agcuaccucacuaugcugcuu

SEQ ID NO: 824237 - RNA, 15 nt, Homo sapiens
agcuacugacauucc

SEQ ID NO: 824238 - RNA, 17 nt, Homo sapiens
agcuagaauaccaccua

SEQ ID NO: 824239 - RNA, 23 nt, Homo sapiens
agcuagagcuucauagguagugc

SEQ ID NO: 824240 - RNA, 19 nt, Homo sapiens
agcuagaggacuucuggca

SEQ ID NO: 824241 - RNA, 15 nt, Homo sapiens
agcuagauacuggaa

SEQ ID NO: 824242 - RNA, 16 nt, Homo sapiens
agcuagaugccacugc

SEQ ID NO: 824243 - RNA, 12 nt, Homo sapiens
agcuagccagag

SEQ ID NO: 824244 - RNA, 18 nt, Homo sapiens
agcuagcuucugcaaugu

SEQ ID NO: 824245 - RNA, 15 nt, Homo sapiens
agcuaggaugguucu

SEQ ID NO: 824246 - RNA, 17 nt, Homo sapiens
agcuaguuaggagccca

SEQ ID NO: 824247 - RNA, 12 nt, Homo sapiens
agcuaucacugu

SEQ ID NO: 824248 - RNA, 19 nt, Homo sapiens
agcuaucaggaugucccug

SEQ ID NO: 824249 - RNA, 23 nt, Homo sapiens
agcuaugaaaacagcuaucucac

SEQ ID NO: 824250 - RNA, 15 nt, Homo sapiens
agcuaugaaaccacu

SEQ ID NO: 824251 - RNA, 20 nt, Homo sapiens
agcuaugaagaaaacacaaa

SEQ ID NO: 824252 - RNA, 19 nt, Homo sapiens
agauugcaccauugcgcuc

SEQ ID NO: 824253 - RNA, 19 nt, Homo sapiens
agauugcgccauugcacuc

SEQ ID NO: 824254 - RNA, 20 nt, Homo sapiens
agauuggaccagacccugaa

SEQ ID NO: 824255 - RNA, 18 nt, Homo sapiens
agauuggcauggcuuuau

SEQ ID NO: 824256 - RNA, 22 nt, Homo sapiens
agauuguuaggagugguucuca

SEQ ID NO: 824257 - RNA, 18 nt, Homo sapiens
agauuuaaaaaaagaaca

SEQ ID NO: 824258 - RNA, 17 nt, Homo sapiens
agauuuacugggccuga

SEQ ID NO: 824259 - RNA, 13 nt, Homo sapiens
agauuucaaauaa

SEQ ID NO: 824260 - RNA, 16 nt, Homo sapiens
agauuucaugccuggu

SEQ ID NO: 824261 - RNA, 15 nt, Homo sapiens
agauuucauucucag

SEQ ID NO: 824262 - RNA, 21 nt, Homo sapiens
agauuuccaacuuuuauuuca

SEQ ID NO: 824263 - RNA, 20 nt, Homo sapiens
acucuaggguccaguggaug

SEQ ID NO: 824264 - RNA, 20 nt, Homo sapiens
acucuaucauuggccuccaa

SEQ ID NO: 824265 - RNA, 15 nt, Homo sapiens
acucuauuguuaccu

SEQ ID NO: 824266 - RNA, 14 nt, Homo sapiens
acucucacacugaa

SEQ ID NO: 824267 - RNA, 15 nt, Homo sapiens
acucucacacugaau

SEQ ID NO: 824268 - RNA, 16 nt, Homo sapiens
acucuccaauguucua

SEQ ID NO: 824269 - RNA, 20 nt, Homo sapiens
acucuccaauguucuauuaa

SEQ ID NO: 824270 - RNA, 20 nt, Homo sapiens
acucuccuccccucccucag

SEQ ID NO: 824271 - RNA, 13 nt, Homo sapiens
acucucugcucua

SEQ ID NO: 824272 - RNA, 20 nt, Homo sapiens
acucucugguuuacuucaaa

SEQ ID NO: 824273 - RNA, 22 nt, Homo sapiens
acucugaaaaacauuccaggaa

SEQ ID NO: 824274 - RNA, 16 nt, Homo sapiens
acucugaauccucaug

SEQ ID NO: 824275 - RNA, 14 nt, Homo sapiens
acucugaccuguac

SEQ ID NO: 824276 - RNA, 23 nt, Homo sapiens
acucugacguugaucccagagag

SEQ ID NO: 824277 - RNA, 14 nt, Homo sapiens
acucugagcccaua

SEQ ID NO: 824278 - RNA, 16 nt, Homo sapiens
acucugcacuacuccu

SEQ ID NO: 824279 - RNA, 19 nt, Homo sapiens
acucugccagccacaucca

SEQ ID NO: 824280 - RNA, 15 nt, Homo sapiens
acucugcccaggugu

SEQ ID NO: 824281 - RNA, 19 nt, Homo sapiens
acucugccucugccugcau

SEQ ID NO: 824282 - RNA, 19 nt, Homo sapiens
acucugcugcaaaaugaag

SEQ ID NO: 824283 - RNA, 18 nt, Homo sapiens
acucuggaccauauacca

SEQ ID NO: 824284 - RNA, 21 nt, Homo sapiens
acucuggagguuuguuuagaa

SEQ ID NO: 824285 - RNA, 19 nt, Homo sapiens
acucuggcugcucccugac

SEQ ID NO: 824286 - RNA, 23 nt, Homo sapiens
acucuggcuguugcguuuuccag

SEQ ID NO: 824287 - RNA, 19 nt, Homo sapiens
acucugguuggaaaugcca

SEQ ID NO: 824288 - RNA, 18 nt, Homo sapiens
acucuguaguuacugugg

SEQ ID NO: 824289 - RNA, 21 nt, Homo sapiens
acucuguauaaguugaaggaa

SEQ ID NO: 824290 - RNA, 13 nt, Homo sapiens
acucuguccuucg

SEQ ID NO: 824291 - RNA, 20 nt, Homo sapiens
acucuguguaaucucugauu

SEQ ID NO: 824292 - RNA, 18 nt, Homo sapiens
acucuguuuccuggucag

SEQ ID NO: 824293 - RNA, 20 nt, Homo sapiens
acucuuagcuaaaucccucc

SEQ ID NO: 824294 - RNA, 14 nt, Homo sapiens
acucuuaucuacau

SEQ ID NO: 824295 - RNA, 21 nt, Homo sapiens
acucuuauucccaaacuacag

SEQ ID NO: 824296 - RNA, 17 nt, Homo sapiens
acucuuccaccucccaa

SEQ ID NO: 824297 - RNA, 16 nt, Homo sapiens
acucuucccucucuca

SEQ ID NO: 824298 - RNA, 21 nt, Homo sapiens
acucuucccucucucacuccc

SEQ ID NO: 824299 - RNA, 16 nt, Homo sapiens
acucuucuaacacaaa

SEQ ID NO: 824300 - RNA, 14 nt, Homo sapiens
acucuugaucucuc

SEQ ID NO: 824301 - RNA, 16 nt, Homo sapiens
acucuugaucucucuu

SEQ ID NO: 824302 - RNA, 22 nt, Homo sapiens
acugaaaaugauuccuggacau

SEQ ID NO: 824303 - RNA, 14 nt, Homo sapiens
acugaaacauuuaa

SEQ ID NO: 824304 - RNA, 15 nt, Homo sapiens
acugaaagaagacau

SEQ ID NO: 824305 - RNA, 16 nt, Homo sapiens
acugaaagaugaucau

SEQ ID NO: 824306 - RNA, 20 nt, Homo sapiens
acugaaauauuuucuaggaa

SEQ ID NO: 824307 - RNA, 17 nt, Homo sapiens
acugaaccacucuccca

SEQ ID NO: 824308 - RNA, 19 nt, Homo sapiens
acugaaggagaaggugccc

SEQ ID NO: 824309 - RNA, 16 nt, Homo sapiens
acugaaggugauucac

SEQ ID NO: 824310 - RNA, 19 nt, Homo sapiens
acugaagucuuuucuguca

SEQ ID NO: 824311 - RNA, 14 nt, Homo sapiens
acugaauaauauca

SEQ ID NO: 824312 - RNA, 15 nt, Homo sapiens
acugaaucacuuaaa

SEQ ID NO: 824313 - RNA, 16 nt, Homo sapiens
acugaaucucaccugc

SEQ ID NO: 824314 - RNA, 17 nt, Homo sapiens
acugaaucucaccugcu

SEQ ID NO: 824315 - RNA, 14 nt, Homo sapiens
acugacacccagug

SEQ ID NO: 824316 - RNA, 16 nt, Homo sapiens
acugacagauuuccau

SEQ ID NO: 824317 - RNA, 15 nt, Homo sapiens
acugacagggagcag

SEQ ID NO: 824318 - RNA, 13 nt, Homo sapiens
acugacaguuuac

SEQ ID NO: 824319 - RNA, 19 nt, Homo sapiens
acugaccaaagacugcaga

SEQ ID NO: 824320 - RNA, 17 nt, Homo sapiens
acugaccauauugugcu

SEQ ID NO: 824321 - RNA, 12 nt, Homo sapiens
acugacccagga

SEQ ID NO: 824322 - RNA, 16 nt, Homo sapiens
acugacccuaacugca

SEQ ID NO: 824323 - RNA, 20 nt, Homo sapiens
acugacccugauacaggcau

SEQ ID NO: 824324 - RNA, 16 nt, Homo sapiens
acugacuccuguggag

SEQ ID NO: 824325 - RNA, 12 nt, Homo sapiens
acugacuccuua

SEQ ID NO: 824326 - RNA, 13 nt, Homo sapiens
acugacugagaua

SEQ ID NO: 824327 - RNA, 17 nt, Homo sapiens
acugacuucagugggac

SEQ ID NO: 824328 - RNA, 21 nt, Homo sapiens
acugacuuguuugucuuccau

SEQ ID NO: 824329 - RNA, 16 nt, Homo sapiens
acugagacuuaaggga

SEQ ID NO: 824330 - RNA, 19 nt, Homo sapiens
acugagauaagaaaagccu

SEQ ID NO: 824331 - RNA, 19 nt, Homo sapiens
acugagaugugaacacauc

SEQ ID NO: 824332 - RNA, 18 nt, Homo sapiens
acugagcuacuagagaua

SEQ ID NO: 824333 - RNA, 21 nt, Homo sapiens
acugaggacuguuugcaauug

SEQ ID NO: 824334 - RNA, 23 nt, Homo sapiens
acugaguccucguagccaucucu

SEQ ID NO: 824335 - RNA, 13 nt, Homo sapiens
acugauaaucucu

SEQ ID NO: 824336 - RNA, 16 nt, Homo sapiens
acugauacacuugaag

SEQ ID NO: 824337 - RNA, 13 nt, Homo sapiens
acugauacuuuca

SEQ ID NO: 824338 - RNA, 13 nt, Homo sapiens
acugaucacccaa

SEQ ID NO: 824339 - RNA, 20 nt, Homo sapiens
acugauccaguauaagacua

SEQ ID NO: 824340 - RNA, 20 nt, Homo sapiens
acugaucuaagcaguggcau

SEQ ID NO: 824341 - RNA, 11 nt, Homo sapiens
acugaucucag

SEQ ID NO: 824342 - RNA, 16 nt, Homo sapiens
acugaugaaaucugcu

SEQ ID NO: 824343 - RNA, 17 nt, Homo sapiens
acugaugaaaucugcua

SEQ ID NO: 824344 - RNA, 12 nt, Homo sapiens
acugaugacuuu

SEQ ID NO: 824345 - RNA, 12 nt, Homo sapiens
acugaugcugcc

SEQ ID NO: 824346 - RNA, 16 nt, Homo sapiens
acugauguacaauuaa

SEQ ID NO: 824347 - RNA, 14 nt, Homo sapiens
acugauucaagaac

SEQ ID NO: 824348 - RNA, 22 nt, Homo sapiens
acugauuuaugaucacuuggaa

SEQ ID NO: 824349 - RNA, 19 nt, Homo sapiens
acugauuucacaacagauc

SEQ ID NO: 824350 - RNA, 20 nt, Homo sapiens
acugauuucacaacagauca

SEQ ID NO: 824351 - RNA, 17 nt, Homo sapiens
acugauuuuuagcuuua

SEQ ID NO: 824352 - RNA, 13 nt, Homo sapiens
acugcaaaugcua

SEQ ID NO: 824353 - RNA, 20 nt, Homo sapiens
acugcacacacagcuccucu

SEQ ID NO: 824354 - RNA, 15 nt, Homo sapiens
acugcacacugccug

SEQ ID NO: 824355 - RNA, 20 nt, Homo sapiens
acugcacacugccuggccca

SEQ ID NO: 824356 - RNA, 16 nt, Homo sapiens
acugcaccaagucuca

SEQ ID NO: 824357 - RNA, 21 nt, Homo sapiens
acugcacgguacaaacccaaa

SEQ ID NO: 824358 - RNA, 16 nt, Homo sapiens
acugcagaucaagaaa

SEQ ID NO: 824359 - RNA, 16 nt, Homo sapiens
acugcagcaccuccag

SEQ ID NO: 824360 - RNA, 13 nt, Homo sapiens
acugcagcugcug

SEQ ID NO: 824361 - RNA, 17 nt, Homo sapiens
acugcauaauagccuaa

SEQ ID NO: 824362 - RNA, 15 nt, Homo sapiens
acugcaucucaaaaa

SEQ ID NO: 824363 - RNA, 16 nt, Homo sapiens
acugcauggcuucuga

SEQ ID NO: 824364 - RNA, 19 nt, Homo sapiens
acugcauuccacagguggg

SEQ ID NO: 824365 - RNA, 20 nt, Homo sapiens
acugccaacugaucuguuau

SEQ ID NO: 824366 - RNA, 17 nt, Homo sapiens
acugccaggcuguuuca

SEQ ID NO: 824367 - RNA, 13 nt, Homo sapiens
acugccaucuuag

SEQ ID NO: 824368 - RNA, 21 nt, Homo sapiens
acugcccaggccuaucuggaa

SEQ ID NO: 824369 - RNA, 21 nt, Homo sapiens
acugccccccgaggcugcuag

SEQ ID NO: 824370 - RNA, 22 nt, Homo sapiens
acugcccccugcugccaugugg

SEQ ID NO: 824371 - RNA, 12 nt, Homo sapiens
acugcccuggca

SEQ ID NO: 824372 - RNA, 14 nt, Homo sapiens
acugccuaagcccu

SEQ ID NO: 824373 - RNA, 20 nt, Homo sapiens
acugccugugaaguggaugg

SEQ ID NO: 824374 - RNA, 18 nt, Homo sapiens
acugccuuccucucucua

SEQ ID NO: 824375 - RNA, 13 nt, Homo sapiens
agauauugguuua

SEQ ID NO: 824376 - RNA, 16 nt, Homo sapiens
agauauuuccauuucu

SEQ ID NO: 824377 - RNA, 19 nt, Homo sapiens
agaucaaaauccuacagau

SEQ ID NO: 824378 - RNA, 20 nt, Homo sapiens
agaucaaacaugcauggaug

SEQ ID NO: 824379 - RNA, 14 nt, Homo sapiens
agaucaacuggaau

SEQ ID NO: 824380 - RNA, 20 nt, Homo sapiens
agaucaagaaaaaaagggag

SEQ ID NO: 824381 - RNA, 12 nt, Homo sapiens
agaucacugcca

SEQ ID NO: 824382 - RNA, 13 nt, Homo sapiens
agaucagcaaagg

SEQ ID NO: 824383 - RNA, 19 nt, Homo sapiens
agaucagcgacccugagga

SEQ ID NO: 824384 - RNA, 19 nt, Homo sapiens
agaucaucuuggaacugca

SEQ ID NO: 824385 - RNA, 14 nt, Homo sapiens
acuauauuugcuag

SEQ ID NO: 824386 - RNA, 23 nt, Homo sapiens
acuaucaauaauacaaagcaaau

SEQ ID NO: 824387 - RNA, 22 nt, Homo sapiens
acuaucccaaucaaagaauuac

SEQ ID NO: 824388 - RNA, 19 nt, Homo sapiens
acuaucgguucaaguugau

SEQ ID NO: 824389 - RNA, 13 nt, Homo sapiens
acuaugacacuga

SEQ ID NO: 824390 - RNA, 14 nt, Homo sapiens
acuaugauuauuaa

SEQ ID NO: 824391 - RNA, 11 nt, Homo sapiens
acuaugcacaa

SEQ ID NO: 824392 - RNA, 22 nt, Homo sapiens
acuaugcauggugccccaggac

SEQ ID NO: 824393 - RNA, 14 nt, Homo sapiens
acuaugcuuuagaa

SEQ ID NO: 824394 - RNA, 19 nt, Homo sapiens
acuauggagccuggcacag

SEQ ID NO: 824395 - RNA, 11 nt, Homo sapiens
acuauggugcu

SEQ ID NO: 824396 - RNA, 22 nt, Homo sapiens
acuaugguguguuguaucuuug

SEQ ID NO: 824397 - RNA, 17 nt, Homo sapiens
acuaugugccaguuccu

SEQ ID NO: 824398 - RNA, 15 nt, Homo sapiens
acuauguuucuauuc

SEQ ID NO: 824399 - RNA, 16 nt, Homo sapiens
acuauuaaaacagcca

SEQ ID NO: 824400 - RNA, 15 nt, Homo sapiens
acuauuaagcaguaa

SEQ ID NO: 824401 - RNA, 17 nt, Homo sapiens
acuauucacugaugcag

SEQ ID NO: 824402 - RNA, 21 nt, Homo sapiens
acuauucacugaugcagaaag

SEQ ID NO: 824403 - RNA, 18 nt, Homo sapiens
acuauugaaguugcagau

SEQ ID NO: 824404 - RNA, 20 nt, Homo sapiens
acuauugcagaccugucacc

SEQ ID NO: 824405 - RNA, 17 nt, Homo sapiens
acuauuuaucugugcaa

SEQ ID NO: 824406 - RNA, 23 nt, Homo sapiens
acuauuuauuaaaaacaugacca

SEQ ID NO: 824407 - RNA, 13 nt, Homo sapiens
acuauuuccacau

SEQ ID NO: 824408 - RNA, 16 nt, Homo sapiens
acuauuuguuccacau

SEQ ID NO: 824409 - RNA, 17 nt, Homo sapiens
acuauuuuaaauaucca

SEQ ID NO: 824410 - RNA, 15 nt, Homo sapiens
acuauuuuaccugaa

SEQ ID NO: 824411 - RNA, 15 nt, Homo sapiens
acuauuuugugcucc

SEQ ID NO: 824412 - RNA, 14 nt, Homo sapiens
acuauuuuuccaaa

SEQ ID NO: 824413 - RNA, 23 nt, Homo sapiens
acucaaacgccgcugacugccac

SEQ ID NO: 824414 - RNA, 14 nt, Homo sapiens
acucaaacugccuu

SEQ ID NO: 824415 - RNA, 12 nt, Homo sapiens
acucaacauguu

SEQ ID NO: 824416 - RNA, 23 nt, Homo sapiens
acucaacauguuacugaccagca

SEQ ID NO: 824417 - RNA, 13 nt, Homo sapiens
acucaacccauug

SEQ ID NO: 824418 - RNA, 19 nt, Homo sapiens
acucaacucugagcccaua

SEQ ID NO: 824419 - RNA, 16 nt, Homo sapiens
acucaagaguucagug

SEQ ID NO: 824420 - RNA, 17 nt, Homo sapiens
acucaaggaauuugcau

SEQ ID NO: 824421 - RNA, 16 nt, Homo sapiens
acucaaggcuugaguc

SEQ ID NO: 824422 - RNA, 20 nt, Homo sapiens
acucaaguaccaccaaggga

SEQ ID NO: 824423 - RNA, 22 nt, Homo sapiens
acucaaugccaacuuuuuguua

SEQ ID NO: 824424 - RNA, 12 nt, Homo sapiens
acucacacuccc

SEQ ID NO: 824425 - RNA, 18 nt, Homo sapiens
acucacagagucaaggcc

SEQ ID NO: 824426 - RNA, 18 nt, Homo sapiens
acucacauucucuuccca

SEQ ID NO: 824427 - RNA, 14 nt, Homo sapiens
acucaccaccuuag

SEQ ID NO: 824428 - RNA, 20 nt, Homo sapiens
acucaccagccccacugcca

SEQ ID NO: 824429 - RNA, 12 nt, Homo sapiens
acucaccaucug

SEQ ID NO: 824430 - RNA, 17 nt, Homo sapiens
acucaccucugccucaa

SEQ ID NO: 824431 - RNA, 21 nt, Homo sapiens
acucacucaguaaaacauaau

SEQ ID NO: 824432 - RNA, 17 nt, Homo sapiens
acucacucauuccuuca

SEQ ID NO: 824433 - RNA, 21 nt, Homo sapiens
acucacuccagcccaacagaa

SEQ ID NO: 824434 - RNA, 14 nt, Homo sapiens
acucacugccuagg

SEQ ID NO: 824435 - RNA, 21 nt, Homo sapiens
acucagacugcaugacaguca

SEQ ID NO: 824436 - RNA, 21 nt, Homo sapiens
acucagaggagcugcaaauug

SEQ ID NO: 824437 - RNA, 13 nt, Homo sapiens
acucagcacucca

SEQ ID NO: 824438 - RNA, 19 nt, Homo sapiens
acucagggccccagcacua

SEQ ID NO: 824439 - RNA, 14 nt, Homo sapiens
acucaggggucauu

SEQ ID NO: 824440 - RNA, 16 nt, Homo sapiens
acucaggggucauuca

SEQ ID NO: 824441 - RNA, 14 nt, Homo sapiens
acucagugcagaug

SEQ ID NO: 824442 - RNA, 16 nt, Homo sapiens
acucaguugcaacuug

SEQ ID NO: 824443 - RNA, 16 nt, Homo sapiens
acucaguuucuaggca

SEQ ID NO: 824444 - RNA, 21 nt, Homo sapiens
acucauccagaccccaugccu

SEQ ID NO: 824445 - RNA, 23 nt, Homo sapiens
acucaucuccucuguaaugauca

SEQ ID NO: 824446 - RNA, 17 nt, Homo sapiens
acucaucugacucauuc

SEQ ID NO: 824447 - RNA, 23 nt, Homo sapiens
acucauggccuugucuaacuuuu

SEQ ID NO: 824448 - RNA, 22 nt, Homo sapiens
acucauuguauuccuccugaga

SEQ ID NO: 824449 - RNA, 15 nt, Homo sapiens
acucauuuaucuccu

SEQ ID NO: 824450 - RNA, 12 nt, Homo sapiens
acuccaacugaa

SEQ ID NO: 824451 - RNA, 14 nt, Homo sapiens
acuccacaccuuuu

SEQ ID NO: 824452 - RNA, 23 nt, Homo sapiens
acuccacccuccaccuuccauuu

SEQ ID NO: 824453 - RNA, 19 nt, Homo sapiens
acuccacccuccuacaggu

SEQ ID NO: 824454 - RNA, 20 nt, Homo sapiens
acuccaccgaccaacugccc

SEQ ID NO: 824455 - RNA, 19 nt, Homo sapiens
acuccacuugaagcacuua

SEQ ID NO: 824456 - RNA, 16 nt, Homo sapiens
acuccagagacaggga

SEQ ID NO: 824457 - RNA, 22 nt, Homo sapiens
acuccagcccuguccccugaaa

SEQ ID NO: 824458 - RNA, 22 nt, Homo sapiens
acuccagccugagugacagagc

SEQ ID NO: 824459 - RNA, 22 nt, Homo sapiens
acuccagcuugggcaacagagc

SEQ ID NO: 824460 - RNA, 22 nt, Homo sapiens
acuccaggggcccccguguuca

SEQ ID NO: 824461 - RNA, 13 nt, Homo sapiens
acuccaucucuac

SEQ ID NO: 824462 - RNA, 17 nt, Homo sapiens
acuccaucucuacugaa

SEQ ID NO: 824463 - RNA, 13 nt, Homo sapiens
acuccaugcaaac

SEQ ID NO: 824464 - RNA, 23 nt, Homo sapiens
acuccauggcuaagaccacagac

SEQ ID NO: 824465 - RNA, 18 nt, Homo sapiens
acucccaccacaggcaua

SEQ ID NO: 824466 - RNA, 15 nt, Homo sapiens
acucccacuuggcau

SEQ ID NO: 824467 - RNA, 12 nt, Homo sapiens
acucccagacau

SEQ ID NO: 824468 - RNA, 20 nt, Homo sapiens
acuccccagagcugugccag

SEQ ID NO: 824469 - RNA, 16 nt, Homo sapiens
acucccuccaccagcc

SEQ ID NO: 824470 - RNA, 13 nt, Homo sapiens
acucccugccuac

SEQ ID NO: 824471 - RNA, 13 nt, Homo sapiens
acucccuuuccaa

SEQ ID NO: 824472 - RNA, 21 nt, Homo sapiens
acucccuuuccaaccucacuu

SEQ ID NO: 824473 - RNA, 20 nt, Homo sapiens
acuccggccugggugacaga

SEQ ID NO: 824474 - RNA, 13 nt, Homo sapiens
acuccggggagcg

SEQ ID NO: 824475 - RNA, 14 nt, Homo sapiens
acuccucucuaggg

SEQ ID NO: 824476 - RNA, 14 nt, Homo sapiens
acuccucuuuacac

SEQ ID NO: 824477 - RNA, 23 nt, Homo sapiens
acuccugacgucugaagcuugac

SEQ ID NO: 824478 - RNA, 22 nt, Homo sapiens
acuccuggccucaagugaucug

SEQ ID NO: 824479 - RNA, 16 nt, Homo sapiens
acuccuguguguggaa

SEQ ID NO: 824480 - RNA, 15 nt, Homo sapiens
acuccuguugccaug

SEQ ID NO: 824481 - RNA, 15 nt, Homo sapiens
acuccuuguggacug

SEQ ID NO: 824482 - RNA, 17 nt, Homo sapiens
acuccuuucagccacau

SEQ ID NO: 824483 - RNA, 23 nt, Homo sapiens
acuccuuucucuaaaacugccuu

SEQ ID NO: 824484 - RNA, 19 nt, Homo sapiens
acuccuuuuccacuuuaaa

SEQ ID NO: 824485 - RNA, 19 nt, Homo sapiens
acuccuuuuuugcaugugc

SEQ ID NO: 824486 - RNA, 12 nt, Homo sapiens
acucgacccaga

SEQ ID NO: 824487 - RNA, 15 nt, Homo sapiens
acucgagaacuuuca

SEQ ID NO: 824488 - RNA, 15 nt, Homo sapiens
acucggaaacuauaa

SEQ ID NO: 824489 - RNA, 15 nt, Homo sapiens
acucggcgugcuccu

SEQ ID NO: 824490 - RNA, 13 nt, Homo sapiens
acucgugugcaac

SEQ ID NO: 824491 - RNA, 21 nt, Homo sapiens
acucuaaccaguguacagguc

SEQ ID NO: 824492 - RNA, 22 nt, Homo sapiens
acucuaaccaguguacagguca

SEQ ID NO: 824493 - RNA, 16 nt, Homo sapiens
acucuaauagugcuua

SEQ ID NO: 824494 - RNA, 13 nt, Homo sapiens
acucuacccuaua

SEQ ID NO: 824495 - RNA, 14 nt, Homo sapiens
acucuacuaaugcc

SEQ ID NO: 824496 - RNA, 23 nt, Homo sapiens
acucuacuucagucaauagccau

SEQ ID NO: 824497 - RNA, 18 nt, Homo sapiens
acucuagaagaccaaaug

SEQ ID NO: 824498 - RNA, 20 nt, Homo sapiens
cugcauuggccuggccucca

SEQ ID NO: 824499 - RNA, 22 nt, Homo sapiens
cugcauuuuaauuuuaaccaaa

SEQ ID NO: 824500 - RNA, 11 nt, Homo sapiens
cugccaagagu

SEQ ID NO: 824501 - RNA, 13 nt, Homo sapiens
cugccacauucua

SEQ ID NO: 824502 - RNA, 19 nt, Homo sapiens
cugccaccacgucugccag

SEQ ID NO: 824503 - RNA, 22 nt, Homo sapiens
cugccacccccuucccugggag

SEQ ID NO: 824504 - RNA, 13 nt, Homo sapiens
cugccaccccuuc

SEQ ID NO: 824505 - RNA, 16 nt, Homo sapiens
cugccaccucccugac

SEQ ID NO: 824506 - RNA, 12 nt, Homo sapiens
cugccacuccau

SEQ ID NO: 824507 - RNA, 19 nt, Homo sapiens
cugccacuguguacugugg

SEQ ID NO: 824508 - RNA, 16 nt, Homo sapiens
cugccagaggaugcuc

SEQ ID NO: 824509 - RNA, 13 nt, Homo sapiens
cugccagcaucug

SEQ ID NO: 824510 - RNA, 16 nt, Homo sapiens
cugccagccacaucca

SEQ ID NO: 824511 - RNA, 12 nt, Homo sapiens
cugccagccuug

SEQ ID NO: 824512 - RNA, 20 nt, Homo sapiens
cugccaggcuguuucagcca

SEQ ID NO: 824513 - RNA, 18 nt, Homo sapiens
cugccaucgcugugaugc

SEQ ID NO: 824514 - RNA, 16 nt, Homo sapiens
cugccaugauagcugg

SEQ ID NO: 824515 - RNA, 12 nt, Homo sapiens
cugccauggaag

SEQ ID NO: 824516 - RNA, 18 nt, Homo sapiens
cugccauguuucaaagac

SEQ ID NO: 824517 - RNA, 22 nt, Homo sapiens
cugccauucacuucauaaucca

SEQ ID NO: 824518 - RNA, 17 nt, Homo sapiens
cugcccacauacgugag

SEQ ID NO: 824519 - RNA, 20 nt, Homo sapiens
cugcccacuguuucucuuga

SEQ ID NO: 824520 - RNA, 19 nt, Homo sapiens
cugcccaggccuaucugga

SEQ ID NO: 824521 - RNA, 19 nt, Homo sapiens
cugcccauucaccaaaauu

SEQ ID NO: 824522 - RNA, 14 nt, Homo sapiens
cugccccaccugcc

SEQ ID NO: 824523 - RNA, 19 nt, Homo sapiens
cugccccaggccugaaaga

SEQ ID NO: 824524 - RNA, 15 nt, Homo sapiens
cugccccccaugagg

SEQ ID NO: 824525 - RNA, 21 nt, Homo sapiens
cugcccccguuccagcugaca

SEQ ID NO: 824526 - RNA, 15 nt, Homo sapiens
cugccccucucacca

SEQ ID NO: 824527 - RNA, 17 nt, Homo sapiens
cugccccucucaccaaa

SEQ ID NO: 824528 - RNA, 16 nt, Homo sapiens
cugccccuuaaacaca

SEQ ID NO: 824529 - RNA, 15 nt, Homo sapiens
cugcccucuauuuau

SEQ ID NO: 824530 - RNA, 14 nt, Homo sapiens
cugcccugccugag

SEQ ID NO: 824531 - RNA, 21 nt, Homo sapiens
cugcccugggauguccacaga

SEQ ID NO: 824532 - RNA, 18 nt, Homo sapiens
cugcccuuccucuuugaa

SEQ ID NO: 824533 - RNA, 23 nt, Homo sapiens
cugccgccucagcuucucaaagu

SEQ ID NO: 824534 - RNA, 19 nt, Homo sapiens
cugccgggcugagggccug

SEQ ID NO: 824535 - RNA, 18 nt, Homo sapiens
cugccuaaguggcugcug

SEQ ID NO: 824536 - RNA, 20 nt, Homo sapiens
cugccucagccaguggcaca

SEQ ID NO: 824537 - RNA, 14 nt, Homo sapiens
cugccucagccucc

SEQ ID NO: 824538 - RNA, 16 nt, Homo sapiens
cugccucggacuccau

SEQ ID NO: 824539 - RNA, 18 nt, Homo sapiens
cugccucuuucccuagga

SEQ ID NO: 824540 - RNA, 23 nt, Homo sapiens
cugccugaaggcucacaccucau

SEQ ID NO: 824541 - RNA, 12 nt, Homo sapiens
cugccugagauu

SEQ ID NO: 824542 - RNA, 14 nt, Homo sapiens
cugccugagcccag

SEQ ID NO: 824543 - RNA, 15 nt, Homo sapiens
cugccugcuguguua

SEQ ID NO: 824544 - RNA, 18 nt, Homo sapiens
cugccuggaacaccagca

SEQ ID NO: 824545 - RNA, 22 nt, Homo sapiens
cugccuggggccucaccugcug

SEQ ID NO: 824546 - RNA, 17 nt, Homo sapiens
cugccugucccagagag

SEQ ID NO: 824547 - RNA, 20 nt, Homo sapiens
cugccugugugggacugaga

SEQ ID NO: 824548 - RNA, 19 nt, Homo sapiens
cugccuguuauaacucugc

SEQ ID NO: 824549 - RNA, 16 nt, Homo sapiens
cugccuuaaaaccaaa

SEQ ID NO: 824550 - RNA, 14 nt, Homo sapiens
cugccuucucagga

SEQ ID NO: 824551 - RNA, 18 nt, Homo sapiens
cugccuucucaugaucca

SEQ ID NO: 824552 - RNA, 16 nt, Homo sapiens
cugccuuggacugugu

SEQ ID NO: 824553 - RNA, 19 nt, Homo sapiens
cugccuuuagccuggacca

SEQ ID NO: 824554 - RNA, 17 nt, Homo sapiens
cugcgagagaaagggag

SEQ ID NO: 824555 - RNA, 22 nt, Homo sapiens
cugcgcugguugaaaaauggca

SEQ ID NO: 824556 - RNA, 20 nt, Homo sapiens
cugcgcuguguacaauguga

SEQ ID NO: 824557 - RNA, 15 nt, Homo sapiens
cugcggcgucugucu

SEQ ID NO: 824558 - RNA, 18 nt, Homo sapiens
cugcguccccacucccuu

SEQ ID NO: 824559 - RNA, 21 nt, Homo sapiens
cugcguccuccucaccucaug

SEQ ID NO: 824560 - RNA, 18 nt, Homo sapiens
cugcuaaauaaacaugug

SEQ ID NO: 824561 - RNA, 15 nt, Homo sapiens
cugcuacuuccccag

SEQ ID NO: 824562 - RNA, 17 nt, Homo sapiens
cugcuagggaccucgcc

SEQ ID NO: 824563 - RNA, 16 nt, Homo sapiens
cugcucagcagagccu

SEQ ID NO: 824564 - RNA, 21 nt, Homo sapiens
cugcucagccucauccugaga

SEQ ID NO: 824565 - RNA, 14 nt, Homo sapiens
cugcucauccaaag

SEQ ID NO: 824566 - RNA, 15 nt, Homo sapiens
cugcuccagaccuga

SEQ ID NO: 824567 - RNA, 15 nt, Homo sapiens
cugcucccaccacca

SEQ ID NO: 824568 - RNA, 14 nt, Homo sapiens
cugcuccugugguc

SEQ ID NO: 824569 - RNA, 13 nt, Homo sapiens
cugcucucugagu

SEQ ID NO: 824570 - RNA, 23 nt, Homo sapiens
cugcucugaauauuuuguaauaa

SEQ ID NO: 824571 - RNA, 12 nt, Homo sapiens
cugcucugcaag

SEQ ID NO: 824572 - RNA, 17 nt, Homo sapiens
cugcucugccuguggag

SEQ ID NO: 824573 - RNA, 21 nt, Homo sapiens
cugcucugucuucuuugccca

SEQ ID NO: 824574 - RNA, 15 nt, Homo sapiens
cugcucuuaggugcu

SEQ ID NO: 824575 - RNA, 22 nt, Homo sapiens
cugcucuugcaguugcucugac

SEQ ID NO: 824576 - RNA, 14 nt, Homo sapiens
cugcucuuguucua

SEQ ID NO: 824577 - RNA, 15 nt, Homo sapiens
cugcucuuucucugc

SEQ ID NO: 824578 - RNA, 17 nt, Homo sapiens
cugcucuuuugugauga

SEQ ID NO: 824579 - RNA, 22 nt, Homo sapiens
cugcugaaaacuagcucgugau

SEQ ID NO: 824580 - RNA, 16 nt, Homo sapiens
cugcugaacacagugu

SEQ ID NO: 824581 - RNA, 23 nt, Homo sapiens
cugcugaaggcagucauaucaaa

SEQ ID NO: 824582 - RNA, 12 nt, Homo sapiens
cugcugaccaaa

SEQ ID NO: 824583 - RNA, 14 nt, Homo sapiens
cugcugacugccaa

SEQ ID NO: 824584 - RNA, 22 nt, Homo sapiens
cugcugacugccaauaacauuc

SEQ ID NO: 824585 - RNA, 20 nt, Homo sapiens
cugcugagucagacugucag

SEQ ID NO: 824586 - RNA, 15 nt, Homo sapiens
cugcugcaggacauu

SEQ ID NO: 824587 - RNA, 17 nt, Homo sapiens
cugcugcaggacauuaa

SEQ ID NO: 824588 - RNA, 21 nt, Homo sapiens
cugcugcccccaccccgggga

SEQ ID NO: 824589 - RNA, 21 nt, Homo sapiens
cugcugccucuuucccuagga

SEQ ID NO: 824590 - RNA, 17 nt, Homo sapiens
cugcugcugcuacugcu

SEQ ID NO: 824591 - RNA, 22 nt, Homo sapiens
cugcuggaggaauuuugucaac

SEQ ID NO: 824592 - RNA, 16 nt, Homo sapiens
cugcuggcuaagcauu

SEQ ID NO: 824593 - RNA, 17 nt, Homo sapiens
cugcuggcuaagcauuu

SEQ ID NO: 824594 - RNA, 20 nt, Homo sapiens
cugcugggcucugccuuaaa

SEQ ID NO: 824595 - RNA, 19 nt, Homo sapiens
cugcuggggaagacagugg

SEQ ID NO: 824596 - RNA, 15 nt, Homo sapiens
cugcuggggaccuug

SEQ ID NO: 824597 - RNA, 18 nt, Homo sapiens
cugcugucacaaccaaga

SEQ ID NO: 824598 - RNA, 15 nt, Homo sapiens
cugcugucauaacau

SEQ ID NO: 824599 - RNA, 16 nt, Homo sapiens
cugcuguuaaagacau

SEQ ID NO: 824600 - RNA, 19 nt, Homo sapiens
cugcuguucauguuacuca

SEQ ID NO: 824601 - RNA, 12 nt, Homo sapiens
cugcuguugcca

SEQ ID NO: 824602 - RNA, 16 nt, Homo sapiens
cugcuguuuuauguca

SEQ ID NO: 824603 - RNA, 16 nt, Homo sapiens
cugcuucaaauauuuc

SEQ ID NO: 824604 - RNA, 13 nt, Homo sapiens
cugcuucccuuac

SEQ ID NO: 824605 - RNA, 19 nt, Homo sapiens
cugcuuccgagauccccag

SEQ ID NO: 824606 - RNA, 13 nt, Homo sapiens
cugcuuccugucu

SEQ ID NO: 824607 - RNA, 16 nt, Homo sapiens
cugcuucugcacuuca

SEQ ID NO: 824608 - RNA, 14 nt, Homo sapiens
cugcuugaacccag

SEQ ID NO: 824609 - RNA, 15 nt, Homo sapiens
cugcuugaccaaaga

SEQ ID NO: 824610 - RNA, 19 nt, Homo sapiens
cugcuuuccccugugggga

SEQ ID NO: 824611 - RNA, 16 nt, Homo sapiens
cugcuuugcaaauuca

SEQ ID NO: 824612 - RNA, 13 nt, Homo sapiens
cugcuuuguucaa

SEQ ID NO: 824613 - RNA, 21 nt, Homo sapiens
cucccugucacucagcugaga

SEQ ID NO: 824614 - RNA, 23 nt, Homo sapiens
cucccugucugugucccagccac

SEQ ID NO: 824615 - RNA, 17 nt, Homo sapiens
cucccuguuccccagag

SEQ ID NO: 824616 - RNA, 19 nt, Homo sapiens
cucccuuguggcuuccuca

SEQ ID NO: 824617 - RNA, 15 nt, Homo sapiens
cucuccgaggggugg

SEQ ID NO: 824618 - RNA, 19 nt, Homo sapiens
cucuccuuccuuacccaaa

SEQ ID NO: 824619 - RNA, 17 nt, Homo sapiens
cucuccuuggccacaga

SEQ ID NO: 824620 - RNA, 16 nt, Homo sapiens
cugaaacucacaguaa

SEQ ID NO: 824621 - RNA, 15 nt, Homo sapiens
cugaaagaauaaaaa

SEQ ID NO: 824622 - RNA, 16 nt, Homo sapiens
cugaaagcacaugaau

SEQ ID NO: 824623 - RNA, 12 nt, Homo sapiens
cugaaagccagg

SEQ ID NO: 824624 - RNA, 16 nt, Homo sapiens
cugaaaggaacacugg

SEQ ID NO: 824625 - RNA, 22 nt, Homo sapiens
cugaaaggauguggaagagcau

SEQ ID NO: 824626 - RNA, 13 nt, Homo sapiens
cugaaaguacaaa

SEQ ID NO: 824627 - RNA, 15 nt, Homo sapiens
cugaaaugaccaaga

SEQ ID NO: 824628 - RNA, 21 nt, Homo sapiens
cugaaauuguuuuaccagcuc

SEQ ID NO: 824629 - RNA, 22 nt, Homo sapiens
cugaaauuuaagauaaugaguu

SEQ ID NO: 824630 - RNA, 17 nt, Homo sapiens
cugaaauuuauucacau

SEQ ID NO: 824631 - RNA, 14 nt, Homo sapiens
cugaacacauuucu

SEQ ID NO: 824632 - RNA, 17 nt, Homo sapiens
cugaacaggaauccuua

SEQ ID NO: 824633 - RNA, 20 nt, Homo sapiens
cugaacauuggagaaucuca

SEQ ID NO: 824634 - RNA, 13 nt, Homo sapiens
cugaaccccaugg

SEQ ID NO: 824635 - RNA, 21 nt, Homo sapiens
cugaagaaacuucccaagugu

SEQ ID NO: 824636 - RNA, 15 nt, Homo sapiens
cugaagaacaguaac

SEQ ID NO: 824637 - RNA, 20 nt, Homo sapiens
cugaagaacaguaacugcca

SEQ ID NO: 824638 - RNA, 22 nt, Homo sapiens
cugaagaacaguaacugccauc

SEQ ID NO: 824639 - RNA, 19 nt, Homo sapiens
cugaagaugggagccuuua

SEQ ID NO: 824640 - RNA, 13 nt, Homo sapiens
cugaagcaguuca

SEQ ID NO: 824641 - RNA, 17 nt, Homo sapiens
cugaagccuggauucca

SEQ ID NO: 824642 - RNA, 21 nt, Homo sapiens
cugaagcguuuuucucaaagg

SEQ ID NO: 824643 - RNA, 23 nt, Homo sapiens
cugaaggcaguggcaggggagca

SEQ ID NO: 824644 - RNA, 18 nt, Homo sapiens
cugaaggcugaguguccg

SEQ ID NO: 824645 - RNA, 20 nt, Homo sapiens
cugaaggugauucaccaaaa

SEQ ID NO: 824646 - RNA, 21 nt, Homo sapiens
cugaaguacuuaaacuuccac

SEQ ID NO: 824647 - RNA, 13 nt, Homo sapiens
cugaagucccugc

SEQ ID NO: 824648 - RNA, 13 nt, Homo sapiens
cugaagugcuuag

SEQ ID NO: 824649 - RNA, 13 nt, Homo sapiens
cugaauacauucu

SEQ ID NO: 824650 - RNA, 12 nt, Homo sapiens
cugaaucuaccu

SEQ ID NO: 824651 - RNA, 16 nt, Homo sapiens
cugaaucucaccugcu

SEQ ID NO: 824652 - RNA, 16 nt, Homo sapiens
cugaaucugcuaccaa

SEQ ID NO: 824653 - RNA, 18 nt, Homo sapiens
cugaaugauuuccaaaga

SEQ ID NO: 824654 - RNA, 19 nt, Homo sapiens
cugaaugggacccuguuga

SEQ ID NO: 824655 - RNA, 21 nt, Homo sapiens
cugaaugucaagaaaaggagu

SEQ ID NO: 824656 - RNA, 18 nt, Homo sapiens
cugaaugucuuacuguga

SEQ ID NO: 824657 - RNA, 16 nt, Homo sapiens
cugaauuaagcagcuc

SEQ ID NO: 824658 - RNA, 15 nt, Homo sapiens
cugaauucagcacca

SEQ ID NO: 824659 - RNA, 20 nt, Homo sapiens
cugaauucuuuccccaaaga

SEQ ID NO: 824660 - RNA, 13 nt, Homo sapiens
cugaauugcacau

SEQ ID NO: 824661 - RNA, 14 nt, Homo sapiens
cugaauuggcagga

SEQ ID NO: 824662 - RNA, 21 nt, Homo sapiens
cugaauuuaucuuugauaaca

SEQ ID NO: 824663 - RNA, 18 nt, Homo sapiens
cugaauuucccucucuca

SEQ ID NO: 824664 - RNA, 19 nt, Homo sapiens
cugaauuuggccugcacua

SEQ ID NO: 824665 - RNA, 17 nt, Homo sapiens
cugaauuuugcaaugua

SEQ ID NO: 824666 - RNA, 15 nt, Homo sapiens
cugacaaaaguucca

SEQ ID NO: 824667 - RNA, 22 nt, Homo sapiens
cugacaagggacuagugaguca

SEQ ID NO: 824668 - RNA, 19 nt, Homo sapiens
cugacacaccaggcgcuaa

SEQ ID NO: 824669 - RNA, 12 nt, Homo sapiens
cugacacaggaa

SEQ ID NO: 824670 - RNA, 11 nt, Homo sapiens
cugacagcuuc

SEQ ID NO: 824671 - RNA, 17 nt, Homo sapiens
cugacagcuucaugaaa

SEQ ID NO: 824672 - RNA, 23 nt, Homo sapiens
cugacaguuaauaaaccuuugca

SEQ ID NO: 824673 - RNA, 21 nt, Homo sapiens
cugacaguuguuuugcuucuu

SEQ ID NO: 824674 - RNA, 16 nt, Homo sapiens
cugacaguuuguggca

SEQ ID NO: 824675 - RNA, 21 nt, Homo sapiens
cugacauuaugugguuuuaga

SEQ ID NO: 824676 - RNA, 11 nt, Homo sapiens
cugaccaaaac

SEQ ID NO: 824677 - RNA, 12 nt, Homo sapiens
cugaccaagaga

SEQ ID NO: 824678 - RNA, 12 nt, Homo sapiens
cugaccacagcc

SEQ ID NO: 824679 - RNA, 18 nt, Homo sapiens
cugacccaggaccauccu

SEQ ID NO: 824680 - RNA, 16 nt, Homo sapiens
cugaccccagugguau

SEQ ID NO: 824681 - RNA, 19 nt, Homo sapiens
cugacccuggucaccagag

SEQ ID NO: 824682 - RNA, 17 nt, Homo sapiens
cugaccucgugauccac

SEQ ID NO: 824683 - RNA, 20 nt, Homo sapiens
cugaccuggaaagaaaaagc

SEQ ID NO: 824684 - RNA, 13 nt, Homo sapiens
cugaccugucuca

SEQ ID NO: 824685 - RNA, 17 nt, Homo sapiens
cugaccuugugauccac

SEQ ID NO: 824686 - RNA, 17 nt, Homo sapiens
cugacgugcagccacac

SEQ ID NO: 824687 - RNA, 20 nt, Homo sapiens
cugacuaggugucaccauac

SEQ ID NO: 824688 - RNA, 21 nt, Homo sapiens
cugacugaaggaaaagcaaga

SEQ ID NO: 824689 - RNA, 20 nt, Homo sapiens
cugacugcagccagccacag

SEQ ID NO: 824690 - RNA, 17 nt, Homo sapiens
cugacugccaagccaga

SEQ ID NO: 824691 - RNA, 18 nt, Homo sapiens
cugacugccaauaacauu

SEQ ID NO: 824692 - RNA, 15 nt, Homo sapiens
cugacuuuuaaccca

SEQ ID NO: 824693 - RNA, 23 nt, Homo sapiens
cugagaaaaaaagugagagaccu

SEQ ID NO: 824694 - RNA, 14 nt, Homo sapiens
cugagaaaugaugg

SEQ ID NO: 824695 - RNA, 16 nt, Homo sapiens
cugagaaauggccaaa

SEQ ID NO: 824696 - RNA, 17 nt, Homo sapiens
cugagaaggcaaaagaa

SEQ ID NO: 824697 - RNA, 16 nt, Homo sapiens
cugagaauguggaaua

SEQ ID NO: 824698 - RNA, 12 nt, Homo sapiens
cugagaccucaa

SEQ ID NO: 824699 - RNA, 13 nt, Homo sapiens
cugagaccucaau

SEQ ID NO: 824700 - RNA, 22 nt, Homo sapiens
cugagacuuaagggaacugaau

SEQ ID NO: 824701 - RNA, 22 nt, Homo sapiens
cugagagacccaaggaggaaaa

SEQ ID NO: 824702 - RNA, 13 nt, Homo sapiens
cugagagaugaca

SEQ ID NO: 824703 - RNA, 20 nt, Homo sapiens
cugagauaagaaaagccuga

SEQ ID NO: 824704 - RNA, 14 nt, Homo sapiens
cugagaucgugcua

SEQ ID NO: 824705 - RNA, 17 nt, Homo sapiens
cugagauugugccacug

SEQ ID NO: 824706 - RNA, 22 nt, Homo sapiens
cugagcaaacuauuugcgacuc

SEQ ID NO: 824707 - RNA, 18 nt, Homo sapiens
cugagcacuguuuauaca

SEQ ID NO: 824708 - RNA, 17 nt, Homo sapiens
cugagcagagagcagca

SEQ ID NO: 824709 - RNA, 21 nt, Homo sapiens
cugagcagugccagcuuucuu

SEQ ID NO: 824710 - RNA, 15 nt, Homo sapiens
cugagccagucccag

SEQ ID NO: 824711 - RNA, 20 nt, Homo sapiens
cugagcccccacugcuucua

SEQ ID NO: 824712 - RNA, 20 nt, Homo sapiens
cugagcccccugcacccacc

SEQ ID NO: 824713 - RNA, 15 nt, Homo sapiens
cugagccccuacccc

SEQ ID NO: 824714 - RNA, 13 nt, Homo sapiens
cugagcccuggca

SEQ ID NO: 824715 - RNA, 13 nt, Homo sapiens
cugagccuagcua

SEQ ID NO: 824716 - RNA, 19 nt, Homo sapiens
cugagccuggcccauagaa

SEQ ID NO: 824717 - RNA, 22 nt, Homo sapiens
cugagcucuccaggccaggugg

SEQ ID NO: 824718 - RNA, 23 nt, Homo sapiens
cugagcuuaaauaacaaaacugu

SEQ ID NO: 824719 - RNA, 17 nt, Homo sapiens
cugagcuuccucuucgg

SEQ ID NO: 824720 - RNA, 16 nt, Homo sapiens
cugaggacaccaguga

SEQ ID NO: 824721 - RNA, 21 nt, Homo sapiens
cugaggagcuguuacugaaua

SEQ ID NO: 824722 - RNA, 13 nt, Homo sapiens
cugaggauuucaa

SEQ ID NO: 824723 - RNA, 14 nt, Homo sapiens
cugaggcaagagaa

SEQ ID NO: 824724 - RNA, 18 nt, Homo sapiens
cugaggcagaaggauuac

SEQ ID NO: 824725 - RNA, 20 nt, Homo sapiens
cugaggcaggagaauggugu

SEQ ID NO: 824726 - RNA, 18 nt, Homo sapiens
cugaggcaggaggauugc

SEQ ID NO: 824727 - RNA, 19 nt, Homo sapiens
cugaggccacccacugacc

SEQ ID NO: 824728 - RNA, 17 nt, Homo sapiens
cugagggagacugcaaa

SEQ ID NO: 824729 - RNA, 17 nt, Homo sapiens
cugagggcagugcccuu

SEQ ID NO: 824730 - RNA, 15 nt, Homo sapiens
cugaggggugggggu

SEQ ID NO: 824731 - RNA, 17 nt, Homo sapiens
cugaggguaucugacaa

SEQ ID NO: 824732 - RNA, 17 nt, Homo sapiens
cugaggguggcacucaa

SEQ ID NO: 824733 - RNA, 21 nt, Homo sapiens
cgcccagacaccaugugcaau

SEQ ID NO: 824734 - RNA, 20 nt, Homo sapiens
cgcccgcucccuuccugcca

SEQ ID NO: 824735 - RNA, 13 nt, Homo sapiens
cgcccuuccucag

SEQ ID NO: 824736 - RNA, 13 nt, Homo sapiens
cgccuaacugaau

SEQ ID NO: 824737 - RNA, 15 nt, Homo sapiens
cgccuaugaucccag

SEQ ID NO: 824738 - RNA, 18 nt, Homo sapiens
cgccucacugaaacaugg

SEQ ID NO: 824739 - RNA, 17 nt, Homo sapiens
cgccuccccaccuccag

SEQ ID NO: 824740 - RNA, 12 nt, Homo sapiens
cgccugcuccuc

SEQ ID NO: 824741 - RNA, 21 nt, Homo sapiens
cgccugugggcgcauacuaca

SEQ ID NO: 824742 - RNA, 19 nt, Homo sapiens
cgccuuggccuugcagcug

SEQ ID NO: 824743 - RNA, 11 nt, Homo sapiens
cgcgaucucag

SEQ ID NO: 824744 - RNA, 20 nt, Homo sapiens
ccuaaauauacaucugugua

SEQ ID NO: 824745 - RNA, 14 nt, Homo sapiens
ccuaaaucccaaga

SEQ ID NO: 824746 - RNA, 16 nt, Homo sapiens
ccuaaaucuccagugg

SEQ ID NO: 824747 - RNA, 22 nt, Homo sapiens
ccuaaaucugccuuuucaucua

SEQ ID NO: 824748 - RNA, 11 nt, Homo sapiens
ccuaacacagu

SEQ ID NO: 824749 - RNA, 16 nt, Homo sapiens
ccuaacacggugcuca

SEQ ID NO: 824750 - RNA, 19 nt, Homo sapiens
ccuaacacggugcucauuu

SEQ ID NO: 824751 - RNA, 22 nt, Homo sapiens
ccuaacauccuuggacugagaa

SEQ ID NO: 824752 - RNA, 23 nt, Homo sapiens
ccuaaccucuuuucugcaucauc

SEQ ID NO: 824753 - RNA, 14 nt, Homo sapiens
ccuaacugcaaugu

SEQ ID NO: 824754 - RNA, 20 nt, Homo sapiens
ccuaacuuuucuacguauaa

SEQ ID NO: 824755 - RNA, 18 nt, Homo sapiens
ccuaagaaugcuuugcca

SEQ ID NO: 824756 - RNA, 17 nt, Homo sapiens
ccuaagcauguguccca

SEQ ID NO: 824757 - RNA, 20 nt, Homo sapiens
ccuaaggacaagacacugag

SEQ ID NO: 824758 - RNA, 15 nt, Homo sapiens
ccuaaggaucucuca

SEQ ID NO: 824759 - RNA, 15 nt, Homo sapiens
ccuaagggagugucu

SEQ ID NO: 824760 - RNA, 17 nt, Homo sapiens
ccuaagucucugugaau

SEQ ID NO: 824761 - RNA, 22 nt, Homo sapiens
ccuaauaaacauccuucaagaa

SEQ ID NO: 824762 - RNA, 20 nt, Homo sapiens
ccuaauacugucauccucaa

SEQ ID NO: 824763 - RNA, 19 nt, Homo sapiens
ccuaauagucauacuagua

SEQ ID NO: 824764 - RNA, 15 nt, Homo sapiens
ccuaauaucacuuaa

SEQ ID NO: 824765 - RNA, 16 nt, Homo sapiens
ccuaauaugcuuuaca

SEQ ID NO: 824766 - RNA, 20 nt, Homo sapiens
ccuaauucaauccuacuuuu

SEQ ID NO: 824767 - RNA, 17 nt, Homo sapiens
ccuaauuccacacccuc

SEQ ID NO: 824768 - RNA, 13 nt, Homo sapiens
ccuaauucucuuc

SEQ ID NO: 824769 - RNA, 20 nt, Homo sapiens
ccuaauucuuguagaugcau

SEQ ID NO: 824770 - RNA, 21 nt, Homo sapiens
ccuacaaaggauaugaacuca

SEQ ID NO: 824771 - RNA, 16 nt, Homo sapiens
ccuacaccucuugaaa

SEQ ID NO: 824772 - RNA, 18 nt, Homo sapiens
ccuacaccucuugaaaau

SEQ ID NO: 824773 - RNA, 15 nt, Homo sapiens
ccuacagggccacaa

SEQ ID NO: 824774 - RNA, 22 nt, Homo sapiens
ccuacaggugcuguucagugcc

SEQ ID NO: 824775 - RNA, 23 nt, Homo sapiens
ccuacagucaucugccaccacac

SEQ ID NO: 824776 - RNA, 15 nt, Homo sapiens
ccuacaucuaacuca

SEQ ID NO: 824777 - RNA, 17 nt, Homo sapiens
ccuacaucuaacucauc

SEQ ID NO: 824778 - RNA, 13 nt, Homo sapiens
ccuacauuaucuc

SEQ ID NO: 824779 - RNA, 20 nt, Homo sapiens
ccuacauuaucucacuuagu

SEQ ID NO: 824780 - RNA, 15 nt, Homo sapiens
ccuacccuaaccaag

SEQ ID NO: 824781 - RNA, 13 nt, Homo sapiens
ccuacccuuccag

SEQ ID NO: 824782 - RNA, 15 nt, Homo sapiens
ccuacccuucccgcc

SEQ ID NO: 824783 - RNA, 11 nt, Homo sapiens
ccuaccucagc

SEQ ID NO: 824784 - RNA, 19 nt, Homo sapiens
ccuaccuuccccagacuug

SEQ ID NO: 824785 - RNA, 13 nt, Homo sapiens
ccuacgugccacu

SEQ ID NO: 824786 - RNA, 17 nt, Homo sapiens
ccuacuccgcucacuga

SEQ ID NO: 824787 - RNA, 15 nt, Homo sapiens
ccuacugcuuacugu

SEQ ID NO: 824788 - RNA, 13 nt, Homo sapiens
ccuacuugcacuc

SEQ ID NO: 824789 - RNA, 19 nt, Homo sapiens
ccuacuuuucuuuccucag

SEQ ID NO: 824790 - RNA, 12 nt, Homo sapiens
ccuagaacuucc

SEQ ID NO: 824791 - RNA, 18 nt, Homo sapiens
ccuagaagucucccugca

SEQ ID NO: 824792 - RNA, 21 nt, Homo sapiens
ccuagaaguuacugaaugcac

SEQ ID NO: 824793 - RNA, 15 nt, Homo sapiens
ccuagaaugcagcug

SEQ ID NO: 824794 - RNA, 15 nt, Homo sapiens
ccuagacccaggugg

SEQ ID NO: 824795 - RNA, 16 nt, Homo sapiens
ccuagaccugggcucc

SEQ ID NO: 824796 - RNA, 20 nt, Homo sapiens
ccuagacucugucuaccugg

SEQ ID NO: 824797 - RNA, 20 nt, Homo sapiens
ccuagauguuuaacaaaucu

SEQ ID NO: 824798 - RNA, 20 nt, Homo sapiens
ccuagcagaggaaaguguaa

SEQ ID NO: 824799 - RNA, 23 nt, Homo sapiens
ccuagcaggcacaggacaccugg

SEQ ID NO: 824800 - RNA, 15 nt, Homo sapiens
ccuagcauugcacuu

SEQ ID NO: 824801 - RNA, 12 nt, Homo sapiens
ccuagcuaccuu

SEQ ID NO: 824802 - RNA, 17 nt, Homo sapiens
ccuagcucuuacacaua

SEQ ID NO: 824803 - RNA, 18 nt, Homo sapiens
ccuaggccaaaugcacaa

SEQ ID NO: 824804 - RNA, 21 nt, Homo sapiens
ccuaggccgcccugagcaucc

SEQ ID NO: 824805 - RNA, 20 nt, Homo sapiens
ccuagggaucugaaauccau

SEQ ID NO: 824806 - RNA, 18 nt, Homo sapiens
ccuaguccuugcugcauu

SEQ ID NO: 824807 - RNA, 21 nt, Homo sapiens
ccuagucuucacaacuuugac

SEQ ID NO: 824808 - RNA, 15 nt, Homo sapiens
ccuauaacacuguga

SEQ ID NO: 824809 - RNA, 22 nt, Homo sapiens
ccuauaugaauaugagaucuga

SEQ ID NO: 824810 - RNA, 22 nt, Homo sapiens
ccuauaugcuggagauggacaa

SEQ ID NO: 824811 - RNA, 19 nt, Homo sapiens
ccuauauguaguauaaaga

SEQ ID NO: 824812 - RNA, 18 nt, Homo sapiens
ccuaucaguuauuaauuu

SEQ ID NO: 824813 - RNA, 14 nt, Homo sapiens
ccuauccacccucu

SEQ ID NO: 824814 - RNA, 23 nt, Homo sapiens
ccuaucuaacccucccauggcac

SEQ ID NO: 824815 - RNA, 10 nt, Homo sapiens
ccuaucucau

SEQ ID NO: 824816 - RNA, 19 nt, Homo sapiens
ccuaucuccugacagaagg

SEQ ID NO: 824817 - RNA, 16 nt, Homo sapiens
ccuaucuuccuuccuc

SEQ ID NO: 824818 - RNA, 11 nt, Homo sapiens
ccuaugcaagu

SEQ ID NO: 824819 - RNA, 16 nt, Homo sapiens
ccuaugcacauaugga

SEQ ID NO: 824820 - RNA, 19 nt, Homo sapiens
ccuaugccacccugcaaua

SEQ ID NO: 824821 - RNA, 15 nt, Homo sapiens
ccuauggacaacuua

SEQ ID NO: 824822 - RNA, 15 nt, Homo sapiens
ccuaugggaaguagu

SEQ ID NO: 824823 - RNA, 15 nt, Homo sapiens
ccuauguccuaagga

SEQ ID NO: 824824 - RNA, 16 nt, Homo sapiens
ccuauuaaaacacagc

SEQ ID NO: 824825 - RNA, 12 nt, Homo sapiens
ccuauuaauucu

SEQ ID NO: 824826 - RNA, 13 nt, Homo sapiens
ccuauuuccccac

SEQ ID NO: 824827 - RNA, 18 nt, Homo sapiens
ccuauuuucauuuguaca

SEQ ID NO: 824828 - RNA, 22 nt, Homo sapiens
ccucaaaacgggucaguauuaa

SEQ ID NO: 824829 - RNA, 11 nt, Homo sapiens
ccucaaaagac

SEQ ID NO: 824830 - RNA, 23 nt, Homo sapiens
ccucaaagaagucggaaugucau

SEQ ID NO: 824831 - RNA, 13 nt, Homo sapiens
ccucaaagcacac

SEQ ID NO: 824832 - RNA, 13 nt, Homo sapiens
ccucaaagcauuu

SEQ ID NO: 824833 - RNA, 22 nt, Homo sapiens
ccucaaaguuggggcaggcugg

SEQ ID NO: 824834 - RNA, 18 nt, Homo sapiens
ccucaacuccaggauuua

SEQ ID NO: 824835 - RNA, 17 nt, Homo sapiens
ccucaacugagggccag

SEQ ID NO: 824836 - RNA, 21 nt, Homo sapiens
ccucaagccccauuuccucac

SEQ ID NO: 824837 - RNA, 15 nt, Homo sapiens
ccucaauguccccaa

SEQ ID NO: 824838 - RNA, 15 nt, Homo sapiens
ccucaauucacauag

SEQ ID NO: 824839 - RNA, 11 nt, Homo sapiens
ccucacaucuu

SEQ ID NO: 824840 - RNA, 14 nt, Homo sapiens
ccucacaucuuuca

SEQ ID NO: 824841 - RNA, 21 nt, Homo sapiens
ccuuucaucucucuaccucca

SEQ ID NO: 824842 - RNA, 20 nt, Homo sapiens
ccuuuccaaccucacuuccc

SEQ ID NO: 824843 - RNA, 23 nt, Homo sapiens
ccuuuccagaguccuccuuugcc

SEQ ID NO: 824844 - RNA, 15 nt, Homo sapiens
ccuuuccagccauag

SEQ ID NO: 824845 - RNA, 16 nt, Homo sapiens
ccuuucccaccauucc

SEQ ID NO: 824846 - RNA, 19 nt, Homo sapiens
ccuuucccccuucucuuag

SEQ ID NO: 824847 - RNA, 17 nt, Homo sapiens
ccuuuccccucccucag

SEQ ID NO: 824848 - RNA, 11 nt, Homo sapiens
ccuuuccuguc

SEQ ID NO: 824849 - RNA, 13 nt, Homo sapiens
ccuuucgagcucu

SEQ ID NO: 824850 - RNA, 15 nt, Homo sapiens
ccuuucuaaacaaga

SEQ ID NO: 824851 - RNA, 19 nt, Homo sapiens
ccuuucucuaaaacugccu

SEQ ID NO: 824852 - RNA, 18 nt, Homo sapiens
ccuuucugcagggaugau

SEQ ID NO: 824853 - RNA, 18 nt, Homo sapiens
ccuuucuuauuaauuuca

SEQ ID NO: 824854 - RNA, 22 nt, Homo sapiens
ccucugcauggaacagcauuac

SEQ ID NO: 824855 - RNA, 24 nt, Homo sapiens
ccucugcccuccgaggccgugcag

SEQ ID NO: 824856 - RNA, 23 nt, Homo sapiens
ccucugccggucccccaugccac

SEQ ID NO: 824857 - RNA, 12 nt, Homo sapiens
ccucugccucaa

SEQ ID NO: 824858 - RNA, 13 nt, Homo sapiens
ccucuggacaaag

SEQ ID NO: 824859 - RNA, 13 nt, Homo sapiens
ccucuggacaguu

SEQ ID NO: 824860 - RNA, 14 nt, Homo sapiens
ccucuggacuggcc

SEQ ID NO: 824861 - RNA, 23 nt, Homo sapiens
ccucuggauccagccaugccuga

SEQ ID NO: 824862 - RNA, 21 nt, Homo sapiens
ccucuggcuggcuaacuggaa

SEQ ID NO: 824863 - RNA, 20 nt, Homo sapiens
ccucugucaacaucaaagag

SEQ ID NO: 824864 - RNA, 22 nt, Homo sapiens
ccucugucuaggacugcagugu

SEQ ID NO: 824865 - RNA, 14 nt, Homo sapiens
ccucuguggaugau

SEQ ID NO: 824866 - RNA, 21 nt, Homo sapiens
ccucuguggcucacauuucau

SEQ ID NO: 824867 - RNA, 14 nt, Homo sapiens
ccucuuacuuugcu

SEQ ID NO: 824868 - RNA, 13 nt, Homo sapiens
ccucuucauuccg

SEQ ID NO: 824869 - RNA, 20 nt, Homo sapiens
ccugcuggccccuucugggg

SEQ ID NO: 824870 - RNA, 17 nt, Homo sapiens
ccugcugggaaugcucc

SEQ ID NO: 824871 - RNA, 19 nt, Homo sapiens
ccugcugggaaugcuccca

SEQ ID NO: 824872 - RNA, 17 nt, Homo sapiens
ccugcuggggaccucac

SEQ ID NO: 824873 - RNA, 22 nt, Homo sapiens
ccugcugugaugacuugccauu

SEQ ID NO: 824874 - RNA, 17 nt, Homo sapiens
ccugcuucccuguugaa

SEQ ID NO: 824875 - RNA, 18 nt, Homo sapiens
ccugcuuccugcuugcca

SEQ ID NO: 824876 - RNA, 22 nt, Homo sapiens
ccugcuuuuuucuguuuuuaca

SEQ ID NO: 824877 - RNA, 14 nt, Homo sapiens
ccuggaacaccagc

SEQ ID NO: 824878 - RNA, 22 nt, Homo sapiens
ccuggacaguaucccacaucca

SEQ ID NO: 824879 - RNA, 14 nt, Homo sapiens
ccuggacugaccac

SEQ ID NO: 824880 - RNA, 22 nt, Homo sapiens
ccuggagaugcagcuacuggaa

SEQ ID NO: 824881 - RNA, 23 nt, Homo sapiens
ccuggagaugcagcuacuggaau

SEQ ID NO: 824882 - RNA, 17 nt, Homo sapiens
ccuggagauugugcucu

SEQ ID NO: 824883 - RNA, 19 nt, Homo sapiens
ccuggagauugugcucugc

SEQ ID NO: 824884 - RNA, 13 nt, Homo sapiens
ccuggagcagcug

SEQ ID NO: 824885 - RNA, 19 nt, Homo sapiens
ccuggagcauggacagugu

SEQ ID NO: 824886 - RNA, 16 nt, Homo sapiens
ccuggagccagggcag

SEQ ID NO: 824887 - RNA, 19 nt, Homo sapiens
ccuggaggggcaccaggug

SEQ ID NO: 824888 - RNA, 21 nt, Homo sapiens
ccuggagugucggauccugug

SEQ ID NO: 824889 - RNA, 21 nt, Homo sapiens
ccuggcacacccagucguccu

SEQ ID NO: 824890 - RNA, 20 nt, Homo sapiens
ccuggcacccccacaagcug

SEQ ID NO: 824891 - RNA, 20 nt, Homo sapiens
ccuggccaacaugaugaaac

SEQ ID NO: 824892 - RNA, 14 nt, Homo sapiens
ccuggccaggagcu

SEQ ID NO: 824893 - RNA, 18 nt, Homo sapiens
ccuggcccauaaugugaa

SEQ ID NO: 824894 - RNA, 15 nt, Homo sapiens
ccuggcccucacuca

SEQ ID NO: 824895 - RNA, 17 nt, Homo sapiens
ccuggccgccuccagga

SEQ ID NO: 824896 - RNA, 23 nt, Homo sapiens
ccuggccggcuccaguuucccca

SEQ ID NO: 824897 - RNA, 15 nt, Homo sapiens
ccuggccucaaguga

SEQ ID NO: 824898 - RNA, 19 nt, Homo sapiens
ccuggccucaagugaucug

SEQ ID NO: 824899 - RNA, 19 nt, Homo sapiens
ccuggcuaagaucaugucu

SEQ ID NO: 824900 - RNA, 14 nt, Homo sapiens
ccuggcucaucucu

SEQ ID NO: 824901 - RNA, 16 nt, Homo sapiens
ccuggcucugcuucca

SEQ ID NO: 824902 - RNA, 14 nt, Homo sapiens
ccuggcuggcacag

SEQ ID NO: 824903 - RNA, 14 nt, Homo sapiens
ccuggcuuugccuc

SEQ ID NO: 824904 - RNA, 16 nt, Homo sapiens
ccuggcuuuuacuuua

SEQ ID NO: 824905 - RNA, 21 nt, Homo sapiens
ccugggaaggcuaaguucagu

SEQ ID NO: 824906 - RNA, 13 nt, Homo sapiens
ccugggacacugc

SEQ ID NO: 824907 - RNA, 13 nt, Homo sapiens
ccugggacaucag

SEQ ID NO: 824908 - RNA, 19 nt, Homo sapiens
ccugggagaaccucaggcu

SEQ ID NO: 824909 - RNA, 16 nt, Homo sapiens
ccugggaucuggcaca

SEQ ID NO: 824910 - RNA, 17 nt, Homo sapiens
ccugggcaauuccgcau

SEQ ID NO: 824911 - RNA, 18 nt, Homo sapiens
ccugggccccaccaccua

SEQ ID NO: 824912 - RNA, 18 nt, Homo sapiens
ccugggcugaccccggug

SEQ ID NO: 824913 - RNA, 16 nt, Homo sapiens
ccugggcugauggaag

SEQ ID NO: 824914 - RNA, 23 nt, Homo sapiens
ccugggcuuggccugcugugauu

SEQ ID NO: 824915 - RNA, 21 nt, Homo sapiens
ccugggggcagugacuggcag

SEQ ID NO: 824916 - RNA, 17 nt, Homo sapiens
ccugggggcuuuugcca

SEQ ID NO: 824917 - RNA, 14 nt, Homo sapiens
ccuggggugcaucu

SEQ ID NO: 824918 - RNA, 19 nt, Homo sapiens
ccuggguauccccugccuc

SEQ ID NO: 824919 - RNA, 16 nt, Homo sapiens
ccugggugacagagug

SEQ ID NO: 824920 - RNA, 16 nt, Homo sapiens
ccugguauauccaaaa

SEQ ID NO: 824921 - RNA, 19 nt, Homo sapiens
ccuggucccuuggagacaa

SEQ ID NO: 824922 - RNA, 20 nt, Homo sapiens
ccuggugcacgcaggcacag

SEQ ID NO: 824923 - RNA, 15 nt, Homo sapiens
ccuggugcauugcug

SEQ ID NO: 824924 - RNA, 18 nt, Homo sapiens
ccuggugcauugcugugu

SEQ ID NO: 824925 - RNA, 11 nt, Homo sapiens
ccuggugggag

SEQ ID NO: 824926 - RNA, 22 nt, Homo sapiens
ccuggugggccuccucugucca

SEQ ID NO: 824927 - RNA, 15 nt, Homo sapiens
ccugguggucaggga

SEQ ID NO: 824928 - RNA, 16 nt, Homo sapiens
ccugguucccaccauu

SEQ ID NO: 824929 - RNA, 17 nt, Homo sapiens
ccugguuggccgugguc

SEQ ID NO: 824930 - RNA, 20 nt, Homo sapiens
ccugguuugacucaguucca

SEQ ID NO: 824931 - RNA, 21 nt, Homo sapiens
ccuguaaggcaggcccauuca

SEQ ID NO: 824932 - RNA, 20 nt, Homo sapiens
ccuguaaucccaacacuuug

SEQ ID NO: 824933 - RNA, 19 nt, Homo sapiens
ccuguaaucccagaacuuu

SEQ ID NO: 824934 - RNA, 19 nt, Homo sapiens
ccuguaaucccagcacuuu

SEQ ID NO: 824935 - RNA, 23 nt, Homo sapiens
ccuguaaucccagcacuuuggga

SEQ ID NO: 824936 - RNA, 19 nt, Homo sapiens
ccuguaaucucagcacuuu

SEQ ID NO: 824937 - RNA, 23 nt, Homo sapiens
ccuguaccacaaacacauuacau

SEQ ID NO: 824938 - RNA, 17 nt, Homo sapiens
ccuguacuaaaccaccu

SEQ ID NO: 824939 - RNA, 21 nt, Homo sapiens
ccuguacuuuucccauuugua

SEQ ID NO: 824940 - RNA, 16 nt, Homo sapiens
ccuguagccacuggca

SEQ ID NO: 824941 - RNA, 22 nt, Homo sapiens
ccuguagucccagcuacuugag

SEQ ID NO: 824942 - RNA, 22 nt, Homo sapiens
ccuguaucuacuaaaaauacaa

SEQ ID NO: 824943 - RNA, 20 nt, Homo sapiens
ccuguauucuacagcagaua

SEQ ID NO: 824944 - RNA, 21 nt, Homo sapiens
ccugucaccagagcuucucug

SEQ ID NO: 824945 - RNA, 21 nt, Homo sapiens
ccugucaguaguggacauugu

SEQ ID NO: 824946 - RNA, 15 nt, Homo sapiens
ccugucauauaauaa

SEQ ID NO: 824947 - RNA, 16 nt, Homo sapiens
ccuguccccacccucc

SEQ ID NO: 824948 - RNA, 15 nt, Homo sapiens
ccuguccuaucacuc

SEQ ID NO: 824949 - RNA, 14 nt, Homo sapiens
ccugucgugccagu

SEQ ID NO: 824950 - RNA, 16 nt, Homo sapiens
ccugucgugccagucc

SEQ ID NO: 824951 - RNA, 22 nt, Homo sapiens
ccugucuaggucuccucagggu

SEQ ID NO: 824952 - RNA, 14 nt, Homo sapiens
ccugucucccccaa

SEQ ID NO: 824953 - RNA, 17 nt, Homo sapiens
ccugugaagggacacag

SEQ ID NO: 824954 - RNA, 14 nt, Homo sapiens
ccugugaaugccac

SEQ ID NO: 824955 - RNA, 12 nt, Homo sapiens
ccugugacaugg

SEQ ID NO: 824956 - RNA, 14 nt, Homo sapiens
ccugugaccagcac

SEQ ID NO: 824957 - RNA, 16 nt, Homo sapiens
ccugugacugucucac

SEQ ID NO: 824958 - RNA, 18 nt, Homo sapiens
ccugugcaacuuucccaa

SEQ ID NO: 824959 - RNA, 16 nt, Homo sapiens
ccugugccagaccuca

SEQ ID NO: 824960 - RNA, 22 nt, Homo sapiens
ccugugcuucuauuucuuggaa

SEQ ID NO: 824961 - RNA, 20 nt, Homo sapiens
ccuguggcggccuuccgggu

SEQ ID NO: 824962 - RNA, 21 nt, Homo sapiens
ccuguggggcaggagugccag

SEQ ID NO: 824963 - RNA, 17 nt, Homo sapiens
ccugugggugaaacaga

SEQ ID NO: 824964 - RNA, 17 nt, Homo sapiens
ccuguguauucuaguga

SEQ ID NO: 824965 - RNA, 13 nt, Homo sapiens
ccuguguccucca

SEQ ID NO: 824966 - RNA, 18 nt, Homo sapiens
ccuguguuaucugugguu

SEQ ID NO: 824967 - RNA, 19 nt, Homo sapiens
ccuguguuaucugugguuu

SEQ ID NO: 824968 - RNA, 21 nt, Homo sapiens
ccuguguugucucuagagcag

SEQ ID NO: 824969 - RNA, 19 nt, Homo sapiens
aaagcuggacugaccaaag

SEQ ID NO: 824970 - RNA, 11 nt, Homo sapiens
aaagcuuaaug

SEQ ID NO: 824971 - RNA, 20 nt, Homo sapiens
aaagcuuaaugauucugaua

SEQ ID NO: 824972 - RNA, 20 nt, Homo sapiens
aaagcuuaauuaaguacaac

SEQ ID NO: 824973 - RNA, 23 nt, Homo sapiens
aaagcuucaaauuaaaacagcug

SEQ ID NO: 824974 - RNA, 21 nt, Homo sapiens
aaagcuucccucucagcugcu

SEQ ID NO: 824975 - RNA, 19 nt, Homo sapiens
aaagcuugagcugcucugc

SEQ ID NO: 824976 - RNA, 18 nt, Homo sapiens
aaagcuuuaaaugucugc

SEQ ID NO: 824977 - RNA, 18 nt, Homo sapiens
aaagcuuuauacaguuga

SEQ ID NO: 824978 - RNA, 21 nt, Homo sapiens
aaagcuuuuuacucaaagagu

SEQ ID NO: 824979 - RNA, 15 nt, Homo sapiens
aaaggaaaccaagug

SEQ ID NO: 824980 - RNA, 14 nt, Homo sapiens
aaaggaaacuugaa

SEQ ID NO: 824981 - RNA, 21 nt, Homo sapiens
aaaggaacucuagaagaccaa

SEQ ID NO: 824982 - RNA, 20 nt, Homo sapiens
aaaggaagagaaaugcaacg

SEQ ID NO: 824983 - RNA, 14 nt, Homo sapiens
aaaggaaguucucc

SEQ ID NO: 824984 - RNA, 14 nt, Homo sapiens
aaaggaaugauaua

SEQ ID NO: 824985 - RNA, 19 nt, Homo sapiens
aaaggacagaguaugaaca

SEQ ID NO: 824986 - RNA, 13 nt, Homo sapiens
aaaggacccugug

SEQ ID NO: 824987 - RNA, 15 nt, Homo sapiens
aaaggacccugugag

SEQ ID NO: 824988 - RNA, 13 nt, Homo sapiens
aaaggacugugau

SEQ ID NO: 824989 - RNA, 14 nt, Homo sapiens
aaaggacugugauu

SEQ ID NO: 824990 - RNA, 16 nt, Homo sapiens
aaaggagaacuaucca

SEQ ID NO: 824991 - RNA, 17 nt, Homo sapiens
aaaggagacauugcucu

SEQ ID NO: 824992 - RNA, 13 nt, Homo sapiens
aaaggagauuuac

SEQ ID NO: 824993 - RNA, 16 nt, Homo sapiens
aaaggaggcaugccuc

SEQ ID NO: 824994 - RNA, 22 nt, Homo sapiens
aaaggauaugaacucaucauuu

SEQ ID NO: 824995 - RNA, 13 nt, Homo sapiens
aaaggcagguggg

SEQ ID NO: 824996 - RNA, 15 nt, Homo sapiens
aaaggccagguugcu

SEQ ID NO: 824997 - RNA, 22 nt, Homo sapiens
aaaggccauuaaagcucaaggu

SEQ ID NO: 824998 - RNA, 15 nt, Homo sapiens
aaaggcccucaguga

SEQ ID NO: 824999 - RNA, 22 nt, Homo sapiens
aaaggcuagaacacuacagggg

SEQ ID NO: 825000 - RNA, 21 nt, Homo sapiens
aaaggcuagguacacagcucu

SEQ ID NO: 825001 - RNA, 13 nt, Homo sapiens
aaaggcugagaag

SEQ ID NO: 825002 - RNA, 15 nt, Homo sapiens
aaaggcugguggcaa

SEQ ID NO: 825003 - RNA, 17 nt, Homo sapiens
aaagggaaacugggaaa

SEQ ID NO: 825004 - RNA, 17 nt, Homo sapiens
aaagggaagccauuccg

SEQ ID NO: 825005 - RNA, 17 nt, Homo sapiens
aaagggagcacuggguu

SEQ ID NO: 825006 - RNA, 9 nt, Homo sapiens
aaagggaug

SEQ ID NO: 825007 - RNA, 10 nt, Homo sapiens
aaagggaugg

SEQ ID NO: 825008 - RNA, 22 nt, Homo sapiens
aaagggauguuauuauccuugg

SEQ ID NO: 825009 - RNA, 22 nt, Homo sapiens
aaagggccaauaaauaugaugu

SEQ ID NO: 825010 - RNA, 16 nt, Homo sapiens
aaagggccauguuuca

SEQ ID NO: 825011 - RNA, 21 nt, Homo sapiens
aaaggguguaggggccaccuc

SEQ ID NO: 825012 - RNA, 23 nt, Homo sapiens
aaagguaaaacaugcuggugaac

SEQ ID NO: 825013 - RNA, 13 nt, Homo sapiens
aaagguacuauau

SEQ ID NO: 825014 - RNA, 15 nt, Homo sapiens
aaaggugccaucuca

SEQ ID NO: 825015 - RNA, 21 nt, Homo sapiens
aaagguuaauuucugucaaau

SEQ ID NO: 825016 - RNA, 14 nt, Homo sapiens
aaagguucuagguu

SEQ ID NO: 825017 - RNA, 15 nt, Homo sapiens
aaagguucucaggug

SEQ ID NO: 825018 - RNA, 13 nt, Homo sapiens
aaagguucuucau

SEQ ID NO: 825019 - RNA, 18 nt, Homo sapiens
aaagguucuucaucccuu

SEQ ID NO: 825020 - RNA, 23 nt, Homo sapiens
aaagguuucauguucacugugag

SEQ ID NO: 825021 - RNA, 21 nt, Homo sapiens
aaaguaaaggccucaucuccu

SEQ ID NO: 825022 - RNA, 14 nt, Homo sapiens
aaaguaacagagca

SEQ ID NO: 825023 - RNA, 15 nt, Homo sapiens
aaaguaaucuaccuc

SEQ ID NO: 825024 - RNA, 14 nt, Homo sapiens
aaaguacaaaaauu

SEQ ID NO: 825025 - RNA, 13 nt, Homo sapiens
aaaguacaauuca

SEQ ID NO: 825026 - RNA, 22 nt, Homo sapiens
ccaguguggaguggguaaucca

SEQ ID NO: 825027 - RNA, 18 nt, Homo sapiens
ccagugugggcuugacca

SEQ ID NO: 825028 - RNA, 18 nt, Homo sapiens
ccaguguuguuuguaaau

SEQ ID NO: 825029 - RNA, 18 nt, Homo sapiens
ccaguucaucuauggcag

SEQ ID NO: 825030 - RNA, 22 nt, Homo sapiens
ccaguuccuguagaacugagaa

SEQ ID NO: 825031 - RNA, 15 nt, Homo sapiens
ccaguugcagguaau

SEQ ID NO: 825032 - RNA, 19 nt, Homo sapiens
ccaguuguuaaaaugagca

SEQ ID NO: 825033 - RNA, 21 nt, Homo sapiens
ccaguuuauggauaugcugcu

SEQ ID NO: 825034 - RNA, 15 nt, Homo sapiens
ccauaagaggugauc

SEQ ID NO: 825035 - RNA, 14 nt, Homo sapiens
ccauaauguuacau

SEQ ID NO: 825036 - RNA, 15 nt, Homo sapiens
ccauaauuauuauuu

SEQ ID NO: 825037 - RNA, 14 nt, Homo sapiens
ccauacgagcaccu

SEQ ID NO: 825038 - RNA, 22 nt, Homo sapiens
ccauacguucagaggugcagcu

SEQ ID NO: 825039 - RNA, 23 nt, Homo sapiens
ccauacguucagaggugcagcug

SEQ ID NO: 825040 - RNA, 19 nt, Homo sapiens
ccauacuuugucugaaaaa

SEQ ID NO: 825041 - RNA, 22 nt, Homo sapiens
ccauagaaacaugacacugacc

SEQ ID NO: 825042 - RNA, 19 nt, Homo sapiens
ccauagcaagauugcuuaa

SEQ ID NO: 825043 - RNA, 20 nt, Homo sapiens
ccauagcaagauugcuuaaa

SEQ ID NO: 825044 - RNA, 12 nt, Homo sapiens
ccauagcacugg

SEQ ID NO: 825045 - RNA, 16 nt, Homo sapiens
ccauagcuuccaugag

SEQ ID NO: 825046 - RNA, 16 nt, Homo sapiens
ccauagucacauggcc

SEQ ID NO: 825047 - RNA, 16 nt, Homo sapiens
ccauagugaccaacau

SEQ ID NO: 825048 - RNA, 23 nt, Homo sapiens
ccauaguggagagaacugaauaa

SEQ ID NO: 825049 - RNA, 15 nt, Homo sapiens
ccauauagacaccaa

SEQ ID NO: 825050 - RNA, 19 nt, Homo sapiens
ccauaucccuuccucucag

SEQ ID NO: 825051 - RNA, 23 nt, Homo sapiens
ccauaucuacaguacuuccagau

SEQ ID NO: 825052 - RNA, 23 nt, Homo sapiens
ccauauucagcauuugauuucca

SEQ ID NO: 825053 - RNA, 22 nt, Homo sapiens
ccauauugugcuucacaguaga

SEQ ID NO: 825054 - RNA, 15 nt, Homo sapiens
ccauauuuacucuuu

SEQ ID NO: 825055 - RNA, 13 nt, Homo sapiens
ccaucaaagaguc

SEQ ID NO: 825056 - RNA, 14 nt, Homo sapiens
ccaucaacaagucu

SEQ ID NO: 825057 - RNA, 12 nt, Homo sapiens
ccaucaccaccg

SEQ ID NO: 825058 - RNA, 21 nt, Homo sapiens
ccaucaggcaguguuaccugu

SEQ ID NO: 825059 - RNA, 16 nt, Homo sapiens
ccaucauuacugguaa

SEQ ID NO: 825060 - RNA, 15 nt, Homo sapiens
ccauccaacacugga

SEQ ID NO: 825061 - RNA, 22 nt, Homo sapiens
ccauccacacggcugaccucau

SEQ ID NO: 825062 - RNA, 22 nt, Homo sapiens
ccauccagccgcugcacaucac

SEQ ID NO: 825063 - RNA, 13 nt, Homo sapiens
ccauccaguggag

SEQ ID NO: 825064 - RNA, 12 nt, Homo sapiens
ccauccauucag

SEQ ID NO: 825065 - RNA, 17 nt, Homo sapiens
ccaucccucggacccac

SEQ ID NO: 825066 - RNA, 17 nt, Homo sapiens
ccaucccuuuuuuuaca

SEQ ID NO: 825067 - RNA, 21 nt, Homo sapiens
ccaucggguaagaugcuccug

SEQ ID NO: 825068 - RNA, 22 nt, Homo sapiens
ccaucguccuuccucucaagcu

SEQ ID NO: 825069 - RNA, 21 nt, Homo sapiens
ccaucuaaugcuuguuuauga

SEQ ID NO: 825070 - RNA, 14 nt, Homo sapiens
ccaucuagucacaa

SEQ ID NO: 825071 - RNA, 12 nt, Homo sapiens
ccaucucaaaaa

SEQ ID NO: 825072 - RNA, 15 nt, Homo sapiens
ccaucucgggcacag

SEQ ID NO: 825073 - RNA, 22 nt, Homo sapiens
ccaucucgggcacaggcccacc

SEQ ID NO: 825074 - RNA, 16 nt, Homo sapiens
ccaucucugauuuuca

SEQ ID NO: 825075 - RNA, 23 nt, Homo sapiens
ccaucugggcuuauauguacuuu

SEQ ID NO: 825076 - RNA, 14 nt, Homo sapiens
ccaucugugacuau

SEQ ID NO: 825077 - RNA, 13 nt, Homo sapiens
ccaucugugcagu

SEQ ID NO: 825078 - RNA, 16 nt, Homo sapiens
ccaucugugugcagca

SEQ ID NO: 825079 - RNA, 16 nt, Homo sapiens
ccaucuugagugguca

SEQ ID NO: 825080 - RNA, 11 nt, Homo sapiens
ccaucuuuaca

SEQ ID NO: 825081 - RNA, 10 nt, Homo sapiens
ccaugaauua

SEQ ID NO: 825082 - RNA, 15 nt, Homo sapiens
ccaugagcugcucca

SEQ ID NO: 825083 - RNA, 22 nt, Homo sapiens
ccaugagcugcuccaucaccug

SEQ ID NO: 825084 - RNA, 19 nt, Homo sapiens
ccaugaggaaggaacagca

SEQ ID NO: 825085 - RNA, 20 nt, Homo sapiens
ccaugaggcaaugucaggaa

SEQ ID NO: 825086 - RNA, 19 nt, Homo sapiens
ccaugaguuaucaugaauu

SEQ ID NO: 825087 - RNA, 21 nt, Homo sapiens
ccaugaugugaagaguuucac

SEQ ID NO: 825088 - RNA, 21 nt, Homo sapiens
ccaugcagccgcaccagagag

SEQ ID NO: 825089 - RNA, 17 nt, Homo sapiens
ccaugcauggugcauca

SEQ ID NO: 825090 - RNA, 21 nt, Homo sapiens
ccaugcauggugcaucagcag

SEQ ID NO: 825091 - RNA, 15 nt, Homo sapiens
ccaugcaugugcaua

SEQ ID NO: 825092 - RNA, 14 nt, Homo sapiens
ccaugccaccaccc

SEQ ID NO: 825093 - RNA, 15 nt, Homo sapiens
ccaugccaugaauga

SEQ ID NO: 825094 - RNA, 16 nt, Homo sapiens
ccaugcuagacaagcu

SEQ ID NO: 825095 - RNA, 15 nt, Homo sapiens
ccaugcucaaccacu

SEQ ID NO: 825096 - RNA, 16 nt, Homo sapiens
ccaugcugugcugugu

SEQ ID NO: 825097 - RNA, 19 nt, Homo sapiens
ccaugcuucucaucugcaa

SEQ ID NO: 825098 - RNA, 22 nt, Homo sapiens
ccauggaaggaagaaaagcugc

SEQ ID NO: 825099 - RNA, 19 nt, Homo sapiens
ccauggaaguuuauuucca

SEQ ID NO: 825100 - RNA, 19 nt, Homo sapiens
ccauggcaccuucagacuu

SEQ ID NO: 825101 - RNA, 16 nt, Homo sapiens
ccauggcccccaauaa

SEQ ID NO: 825102 - RNA, 16 nt, Homo sapiens
ccauggcucagggugg

SEQ ID NO: 825103 - RNA, 17 nt, Homo sapiens
ccaugggccugggccug

SEQ ID NO: 825104 - RNA, 19 nt, Homo sapiens
ccauggguuaagagcucac

SEQ ID NO: 825105 - RNA, 23 nt, Homo sapiens
ccauggugggagagacugugagg

SEQ ID NO: 825106 - RNA, 16 nt, Homo sapiens
ccauguaagguugugc

SEQ ID NO: 825107 - RNA, 18 nt, Homo sapiens
ccauguaaucagauuuau

SEQ ID NO: 825108 - RNA, 19 nt, Homo sapiens
ccauguggcagaagggaua

SEQ ID NO: 825109 - RNA, 15 nt, Homo sapiens
ccauguuauucucuc

SEQ ID NO: 825110 - RNA, 15 nt, Homo sapiens
ccauguucuccauga

SEQ ID NO: 825111 - RNA, 13 nt, Homo sapiens
ccauguugaucuu

SEQ ID NO: 825112 - RNA, 18 nt, Homo sapiens
ccauguuguaaugcugca

SEQ ID NO: 825113 - RNA, 16 nt, Homo sapiens
ccauuaaaaacuacca

SEQ ID NO: 825114 - RNA, 15 nt, Homo sapiens
ccauuaaaacugcuu

SEQ ID NO: 825115 - RNA, 15 nt, Homo sapiens
ccauuaauccaggga

SEQ ID NO: 825116 - RNA, 14 nt, Homo sapiens
ccauuagccggacu

SEQ ID NO: 825117 - RNA, 14 nt, Homo sapiens
gaccucaagugucc

SEQ ID NO: 825118 - RNA, 15 nt, Homo sapiens
gaccucaccugcugg

SEQ ID NO: 825119 - RNA, 13 nt, Homo sapiens
gaccucacugucc

SEQ ID NO: 825120 - RNA, 22 nt, Homo sapiens
cugcuugaggaaaacaagcauu

SEQ ID NO: 825121 - RNA, 22 nt, Homo sapiens
cugcuuucgaauaaagugaaua

SEQ ID NO: 825122 - RNA, 18 nt, Homo sapiens
cuggaccagccucuccac

SEQ ID NO: 825123 - RNA, 13 nt, Homo sapiens
cuggcuuugcaag

SEQ ID NO: 825124 - RNA, 22 nt, Homo sapiens
cugggcccucucugcucugcgu

SEQ ID NO: 825125 - RNA, 22 nt, Homo sapiens
cuguagaaaagggaacugaaca

SEQ ID NO: 825126 - RNA, 12 nt, Homo sapiens
cugugcagugac

SEQ ID NO: 825127 - RNA, 23 nt, Homo sapiens
cuguggugugucccccucugucc

SEQ ID NO: 825128 - RNA, 13 nt, Homo sapiens
cuuaguugcugua

SEQ ID NO: 825129 - RNA, 18 nt, Homo sapiens
cuucauuucucuugcuca

SEQ ID NO: 825130 - RNA, 14 nt, Homo sapiens
cuuccaaacaggcu

SEQ ID NO: 825131 - RNA, 14 nt, Homo sapiens
cuuccacugagggc

SEQ ID NO: 825132 - RNA, 11 nt, Homo sapiens
cuuccauuugc

SEQ ID NO: 825133 - RNA, 19 nt, Homo sapiens
cuuccuuagccuugcucag

SEQ ID NO: 825134 - RNA, 16 nt, Homo sapiens
cuucuucaccauuugg

SEQ ID NO: 825135 - RNA, 19 nt, Homo sapiens
cuugggaguguugucacac

SEQ ID NO: 825136 - RNA, 21 nt, Homo sapiens
cuugucacgccagacuuccca

SEQ ID NO: 825137 - RNA, 16 nt, Homo sapiens
cuuucaaccucaguga

SEQ ID NO: 825138 - RNA, 16 nt, Homo sapiens
cuuuccaaccggcuuu

SEQ ID NO: 825139 - RNA, 18 nt, Homo sapiens
cuuucgaauaaagugaau

SEQ ID NO: 825140 - RNA, 15 nt, Homo sapiens
cuuuuauuacugggg

SEQ ID NO: 825141 - RNA, 18 nt, Homo sapiens
gaaaaaaaauaauagaaa

SEQ ID NO: 825142 - RNA, 15 nt, Homo sapiens
gaaaacauaugcauu

SEQ ID NO: 825143 - RNA, 16 nt, Homo sapiens
gaaaacaugacuuuau

SEQ ID NO: 825144 - RNA, 22 nt, Homo sapiens
gaaaaccucauuuaccauaaaa

SEQ ID NO: 825145 - RNA, 15 nt, Homo sapiens
gaaaauuaugagucu

SEQ ID NO: 825146 - RNA, 23 nt, Homo sapiens
gaaacaacaauuucuacuuugaa

SEQ ID NO: 825147 - RNA, 14 nt, Homo sapiens
gaaauagagugaau

SEQ ID NO: 825148 - RNA, 14 nt, Homo sapiens
gaacaaugaaugcu

SEQ ID NO: 825149 - RNA, 17 nt, Homo sapiens
gaacauggauuccacug

SEQ ID NO: 825150 - RNA, 20 nt, Homo sapiens
gaacauggauuccacugaaa

SEQ ID NO: 825151 - RNA, 20 nt, Homo sapiens
gaacguuuuuccuguucuua

SEQ ID NO: 825152 - RNA, 19 nt, Homo sapiens
gaacuccaguacucaccca

SEQ ID NO: 825153 - RNA, 15 nt, Homo sapiens
gaacugaacauucca

SEQ ID NO: 825154 - RNA, 20 nt, Homo sapiens
gaagccacuauuacugggac

SEQ ID NO: 825155 - RNA, 17 nt, Homo sapiens
gaagcguuguccucagc

SEQ ID NO: 825156 - RNA, 12 nt, Homo sapiens
gaaggaucccau

SEQ ID NO: 825157 - RNA, 13 nt, Homo sapiens
gaagguugcaccu

SEQ ID NO: 825158 - RNA, 16 nt, Homo sapiens
gaaguuuaauugacuu

SEQ ID NO: 825159 - RNA, 16 nt, Homo sapiens
gaaucaaaugcaauuu

SEQ ID NO: 825160 - RNA, 17 nt, Homo sapiens
gaauggagcuggcccuc

SEQ ID NO: 825161 - RNA, 16 nt, Homo sapiens
gacaccuaggcuaggg

SEQ ID NO: 825162 - RNA, 14 nt, Homo sapiens
gaccguugcacaaa

SEQ ID NO: 825163 - RNA, 17 nt, Homo sapiens
gaccuggugcugccucu

SEQ ID NO: 825164 - RNA, 17 nt, Homo sapiens
gacgugauuuugcugua

SEQ ID NO: 825165 - RNA, 19 nt, Homo sapiens
gacgugauuuugcuguaga

SEQ ID NO: 825166 - RNA, 20 nt, Homo sapiens
gacgugauuuugcuguagaa

SEQ ID NO: 825167 - RNA, 16 nt, Homo sapiens
gagaacaaugugcuau

SEQ ID NO: 825168 - RNA, 11 nt, Homo sapiens
gagaucccaac

SEQ ID NO: 825169 - RNA, 13 nt, Homo sapiens
gagccauaugaau

SEQ ID NO: 825170 - RNA, 17 nt, Homo sapiens
gaggccauucuuuccca

SEQ ID NO: 825171 - RNA, 11 nt, Homo sapiens
gagugaccuca

SEQ ID NO: 825172 - RNA, 21 nt, Homo sapiens
gaguguguuugugugcaugaa

SEQ ID NO: 825173 - RNA, 21 nt, Homo sapiens
gaguguuccccuuccacugag

SEQ ID NO: 825174 - RNA, 22 nt, Homo sapiens
gaguguuccccuuccacugagg

SEQ ID NO: 825175 - RNA, 13 nt, Homo sapiens
gaguuuucagugg

SEQ ID NO: 825176 - RNA, 15 nt, Homo sapiens
gauauaaaagacuga

SEQ ID NO: 825177 - RNA, 16 nt, Homo sapiens
gaucccaacacugcca

SEQ ID NO: 825178 - RNA, 17 nt, Homo sapiens
gauguuuuguacuuaca

SEQ ID NO: 825179 - RNA, 14 nt, Homo sapiens
gauucaguguuaaa

SEQ ID NO: 825180 - RNA, 17 nt, Homo sapiens
gauucuuucccaauuca

SEQ ID NO: 825181 - RNA, 23 nt, Homo sapiens
gauugccucugaagccuauguau

SEQ ID NO: 825182 - RNA, 17 nt, Homo sapiens
gauugcgagaauuuuca

SEQ ID NO: 825183 - RNA, 21 nt, Homo sapiens
gauuuauuaauuaaaccagac

SEQ ID NO: 825184 - RNA, 19 nt, Homo sapiens
gauuuuuaugccaccugaa

SEQ ID NO: 825185 - RNA, 18 nt, Homo sapiens
gcacaaaguaagccucac

SEQ ID NO: 825186 - RNA, 15 nt, Homo sapiens
gcacaaauuguacau

SEQ ID NO: 825187 - RNA, 13 nt, Homo sapiens
gcacggcuuccca

SEQ ID NO: 825188 - RNA, 20 nt, Homo sapiens
gcaugaaagagaaagacuga

SEQ ID NO: 825189 - RNA, 20 nt, Homo sapiens
gcauuuagacccugcauuua

SEQ ID NO: 825190 - RNA, 16 nt, Homo sapiens
gcccagcuaaagcaau

SEQ ID NO: 825191 - RNA, 22 nt, Homo sapiens
gccgugcucgcccacaaacuga

SEQ ID NO: 825192 - RNA, 14 nt, Homo sapiens
gccucuguggcacu

SEQ ID NO: 825193 - RNA, 17 nt, Homo sapiens
gccugagguuugccagc

SEQ ID NO: 825194 - RNA, 22 nt, Homo sapiens
gccuggcuguggccuaaccugc

SEQ ID NO: 825195 - RNA, 15 nt, Homo sapiens
gccuugccaugucuu

SEQ ID NO: 825196 - RNA, 23 nt, Homo sapiens
gcguggaacucgugucuggcaca

SEQ ID NO: 825197 - RNA, 13 nt, Homo sapiens
gcucaccaagaag

SEQ ID NO: 825198 - RNA, 19 nt, Homo sapiens
gcugccucuaccugacacu

SEQ ID NO: 825199 - RNA, 22 nt, Homo sapiens
gcuguugauauuaaaaacaaac

SEQ ID NO: 825200 - RNA, 11 nt, Homo sapiens
gcuugccauau

SEQ ID NO: 825201 - RNA, 20 nt, Homo sapiens
gcuuucauguaaacugugca

SEQ ID NO: 825202 - RNA, 19 nt, Homo sapiens
ggaaaguuugggaagggau

SEQ ID NO: 825203 - RNA, 21 nt, Homo sapiens
ggcacagccuggcuguggccu

SEQ ID NO: 825204 - RNA, 21 nt, Homo sapiens
ggcuccucgagaucccaacac

SEQ ID NO: 825205 - RNA, 12 nt, Homo sapiens
gggagucugggc

SEQ ID NO: 825206 - RNA, 14 nt, Homo sapiens
gggcagucauuauc

SEQ ID NO: 825207 - RNA, 22 nt, Homo sapiens
ggugcgaucuuggcucacugca

SEQ ID NO: 825208 - RNA, 16 nt, Homo sapiens
guaacaaaaguauagu

SEQ ID NO: 825209 - RNA, 17 nt, Homo sapiens
guacauaaaaugucauu

SEQ ID NO: 825210 - RNA, 17 nt, Homo sapiens
guacauguuaaacuuac

SEQ ID NO: 825211 - RNA, 18 nt, Homo sapiens
guaccugcccccaaucca

SEQ ID NO: 825212 - RNA, 12 nt, Homo sapiens
guaggcacagac

SEQ ID NO: 825213 - RNA, 21 nt, Homo sapiens
guauaaccuucaugaugaauu

SEQ ID NO: 825214 - RNA, 14 nt, Homo sapiens
guccaucagccucc

SEQ ID NO: 825215 - RNA, 22 nt, Homo sapiens
gucucuuguaauccgaaucucu

SEQ ID NO: 825216 - RNA, 16 nt, Homo sapiens
gucugggcacagucag

SEQ ID NO: 825217 - RNA, 13 nt, Homo sapiens
gucuuguguuucu

SEQ ID NO: 825218 - RNA, 15 nt, Homo sapiens
gucuuuacagaauca

SEQ ID NO: 825219 - RNA, 17 nt, Homo sapiens
gugacauuuccaugcau

SEQ ID NO: 825220 - RNA, 12 nt, Homo sapiens
gugagacccagc

SEQ ID NO: 825221 - RNA, 16 nt, Homo sapiens
gugcacaucugugucu

SEQ ID NO: 825222 - RNA, 14 nt, Homo sapiens
guggaagaaggaaa

SEQ ID NO: 825223 - RNA, 20 nt, Homo sapiens
gugggcucccugacugggag

SEQ ID NO: 825224 - RNA, 21 nt, Homo sapiens
gaguugguguucauaauuuca

SEQ ID NO: 825225 - RNA, 13 nt, Homo sapiens
gauauugcagcuu

SEQ ID NO: 825226 - RNA, 21 nt, Homo sapiens
gauccgucuuuggccuccucc

SEQ ID NO: 825227 - RNA, 17 nt, Homo sapiens
gaucuguguuuacuuaa

SEQ ID NO: 825228 - RNA, 13 nt, Homo sapiens
gcaaggugacauu

SEQ ID NO: 825229 - RNA, 13 nt, Homo sapiens
gcagaccacugau

SEQ ID NO: 825230 - RNA, 14 nt, Homo sapiens
gcagaccacugaua

SEQ ID NO: 825231 - RNA, 22 nt, Homo sapiens
gcagacgugagugugacuuuuu

SEQ ID NO: 825232 - RNA, 21 nt, Homo sapiens
gcagugacuuuagaaacaaau

SEQ ID NO: 825233 - RNA, 21 nt, Homo sapiens
gcauccagagucccugccugg

SEQ ID NO: 825234 - RNA, 17 nt, Homo sapiens
gcauuuucaagcaguua

SEQ ID NO: 825235 - RNA, 11 nt, Homo sapiens
gccacauggga

SEQ ID NO: 825236 - RNA, 19 nt, Homo sapiens
gccagaaaacauaugcauu

SEQ ID NO: 825237 - RNA, 12 nt, Homo sapiens
gccagacuuccc

SEQ ID NO: 825238 - RNA, 23 nt, Homo sapiens
gccauuauuucaaccgcuugcca

SEQ ID NO: 825239 - RNA, 14 nt, Homo sapiens
gccauucuuuccca

SEQ ID NO: 825240 - RNA, 16 nt, Homo sapiens
gccccaggcauugcca

SEQ ID NO: 825241 - RNA, 23 nt, Homo sapiens
gcccuuuuaguucuuagagcacu

SEQ ID NO: 825242 - RNA, 16 nt, Homo sapiens
gccgagaguccaucag

SEQ ID NO: 825243 - RNA, 21 nt, Homo sapiens
gccugagguuugccagcauuu

SEQ ID NO: 825244 - RNA, 22 nt, Homo sapiens
gccugaucagcgccgcaccagc

SEQ ID NO: 825245 - RNA, 17 nt, Homo sapiens
gccuggaccagccucuc

SEQ ID NO: 825246 - RNA, 14 nt, Homo sapiens
gccuugccaugucu

SEQ ID NO: 825247 - RNA, 22 nt, Homo sapiens
gcuaugugaagaguaagucaac

SEQ ID NO: 825248 - RNA, 16 nt, Homo sapiens
gcucacgugucuuuag

SEQ ID NO: 825249 - RNA, 13 nt, Homo sapiens
gcucaggugcaag

SEQ ID NO: 825250 - RNA, 13 nt, Homo sapiens
gcucaucauucuc

SEQ ID NO: 825251 - RNA, 13 nt, Homo sapiens
gcuccauguagaa

SEQ ID NO: 825252 - RNA, 17 nt, Homo sapiens
gcucgcccacaaacuga

SEQ ID NO: 825253 - RNA, 16 nt, Homo sapiens
gcucgcuuugagugac

SEQ ID NO: 825254 - RNA, 23 nt, Homo sapiens
gcugcuuucgaauaaagugaaua

SEQ ID NO: 825255 - RNA, 12 nt, Homo sapiens
gcuuauauucau

SEQ ID NO: 825256 - RNA, 21 nt, Homo sapiens
gcuuucauguaaacugugcac

SEQ ID NO: 825257 - RNA, 12 nt, Homo sapiens
gcuuuguggcac

SEQ ID NO: 825258 - RNA, 15 nt, Homo sapiens
gcuuuguggcacugg

SEQ ID NO: 825259 - RNA, 15 nt, Homo sapiens
ggaaaacaagcauuc

SEQ ID NO: 825260 - RNA, 19 nt, Homo sapiens
ggaacuuuuauuacugggg

SEQ ID NO: 825261 - RNA, 17 nt, Homo sapiens
ggacaugaagauucuuu

SEQ ID NO: 825262 - RNA, 16 nt, Homo sapiens
ggaccagccucuccac

SEQ ID NO: 825263 - RNA, 13 nt, Homo sapiens
ggagggcaggcau

SEQ ID NO: 825264 - RNA, 20 nt, Homo sapiens
ggcacaaauuguacauuuga

SEQ ID NO: 825265 - RNA, 9 nt, Homo sapiens
ggcacauug

SEQ ID NO: 825266 - RNA, 18 nt, Homo sapiens
ggcuguggccuaaccugc

SEQ ID NO: 825267 - RNA, 23 nt, Homo sapiens
ggcuuaaggagaggagaaacuga

SEQ ID NO: 825268 - RNA, 16 nt, Homo sapiens
gggacuccaguucaca

SEQ ID NO: 825269 - RNA, 16 nt, Homo sapiens
uaucucaaacuacugg

SEQ ID NO: 825270 - RNA, 20 nt, Homo sapiens
uaugagucucuaugaucuug

SEQ ID NO: 825271 - RNA, 15 nt, Homo sapiens
uaugauauugcagcu

SEQ ID NO: 825272 - RNA, 19 nt, Homo sapiens
uauugcagcuuauauucau

SEQ ID NO: 825273 - RNA, 18 nt, Homo sapiens
uauuuauauguacauaca

SEQ ID NO: 825274 - RNA, 16 nt, Homo sapiens
uauuuuuguacguuau

SEQ ID NO: 825275 - RNA, 17 nt, Homo sapiens
ucaaccgcuugccauau

SEQ ID NO: 825276 - RNA, 22 nt, Homo sapiens
ucagcaccuacaguguacaguc

SEQ ID NO: 825277 - RNA, 21 nt, Homo sapiens
ucagugcucccucacauguca

SEQ ID NO: 825278 - RNA, 12 nt, Homo sapiens
ucauacauuaua

SEQ ID NO: 825279 - RNA, 14 nt, Homo sapiens
ucaugaucaucaca

SEQ ID NO: 825280 - RNA, 20 nt, Homo sapiens
uccaacugccagaacaugga

SEQ ID NO: 825281 - RNA, 21 nt, Homo sapiens
uccccuggggagucugggcac

SEQ ID NO: 825282 - RNA, 15 nt, Homo sapiens
ucccucaucuguccc

SEQ ID NO: 825283 - RNA, 14 nt, Homo sapiens
ucccuguaaccucu

SEQ ID NO: 825284 - RNA, 14 nt, Homo sapiens
uccuccaugggaga

SEQ ID NO: 825285 - RNA, 19 nt, Homo sapiens
uccucugugaccaaugucu

SEQ ID NO: 825286 - RNA, 13 nt, Homo sapiens
uccugggcccucu

SEQ ID NO: 825287 - RNA, 16 nt, Homo sapiens
uccuuggacuacuugu

SEQ ID NO: 825288 - RNA, 12 nt, Homo sapiens
ucggugugcacc

SEQ ID NO: 825289 - RNA, 19 nt, Homo sapiens
ucgugguaggacuguagaa

SEQ ID NO: 825290 - RNA, 23 nt, Homo sapiens
uucucaguaaauauuaaccugaa

SEQ ID NO: 825291 - RNA, 15 nt, Homo sapiens
uucuguacucaaaug

SEQ ID NO: 825292 - RNA, 14 nt, Homo sapiens
uugaugcaugcacu

SEQ ID NO: 825293 - RNA, 14 nt, Homo sapiens
uugcaaccucgcug

SEQ ID NO: 825294 - RNA, 21 nt, Homo sapiens
uugccucugaagccuauguau

SEQ ID NO: 825295 - RNA, 11 nt, Homo sapiens
uugcuguagaa

SEQ ID NO: 825296 - RNA, 16 nt, Homo sapiens
uuggcucacugcaacu

SEQ ID NO: 825297 - RNA, 20 nt, Homo sapiens
uuguaucaaaugugacauua

SEQ ID NO: 825298 - RNA, 17 nt, Homo sapiens
uuguguuacugcaguga

SEQ ID NO: 825299 - RNA, 23 nt, Homo sapiens
uuguucgccgcguggaaugugag

SEQ ID NO: 825300 - RNA, 16 nt, Homo sapiens
uuguugcugucaagau

SEQ ID NO: 825301 - RNA, 14 nt, Homo sapiens
uuuaaaaucuguca

SEQ ID NO: 825302 - RNA, 12 nt, Homo sapiens
uuuaaaucugag

SEQ ID NO: 825303 - RNA, 18 nt, Homo sapiens
uuuagacccugcauuuau

SEQ ID NO: 825304 - RNA, 20 nt, Homo sapiens
uuuauauguacauacauaua

SEQ ID NO: 825305 - RNA, 14 nt, Homo sapiens
uuuauugcuuguug

SEQ ID NO: 825306 - RNA, 20 nt, Homo sapiens
uuuauuuaacugugcaguga

SEQ ID NO: 825307 - RNA, 22 nt, Homo sapiens
uuuauuuauguaggaucuguca

SEQ ID NO: 825308 - RNA, 16 nt, Homo sapiens
uuucaaaaccuuuuga

SEQ ID NO: 825309 - RNA, 18 nt, Homo sapiens
uuucaaauuggagcuuca

SEQ ID NO: 825310 - RNA, 13 nt, Homo sapiens
uuucaccauuuga

SEQ ID NO: 825311 - RNA, 18 nt, Homo sapiens
uuucagguuccaaucaga

SEQ ID NO: 825312 - RNA, 21 nt, Homo sapiens
ccauuuggcaaugccaucauc

SEQ ID NO: 825313 - RNA, 17 nt, Homo sapiens
cccagggggcggggugc

SEQ ID NO: 825314 - RNA, 21 nt, Homo sapiens
cccugacugggaguugaucgc

SEQ ID NO: 825315 - RNA, 13 nt, Homo sapiens
ccgaaaucagaag

SEQ ID NO: 825316 - RNA, 13 nt, Homo sapiens
ccgcuugccauau

SEQ ID NO: 825317 - RNA, 21 nt, Homo sapiens
ccuaaauguggacaucaugaa

SEQ ID NO: 825318 - RNA, 22 nt, Homo sapiens
ccuagagggcccccuacuuguu

SEQ ID NO: 825319 - RNA, 14 nt, Homo sapiens
ccucacuucuggca

SEQ ID NO: 825320 - RNA, 16 nt, Homo sapiens
ccuccagaauggagcu

SEQ ID NO: 825321 - RNA, 16 nt, Homo sapiens
ccuccucugcccggga

SEQ ID NO: 825322 - RNA, 18 nt, Homo sapiens
ccuccugaagccacagca

SEQ ID NO: 825323 - RNA, 13 nt, Homo sapiens
ccucgagauccca

SEQ ID NO: 825324 - RNA, 16 nt, Homo sapiens
ccugggggugccagga

SEQ ID NO: 825325 - RNA, 14 nt, Homo sapiens
ccuuacaguaggag

SEQ ID NO: 825326 - RNA, 23 nt, Homo sapiens
ccuuagauguucuaagucuuucc

SEQ ID NO: 825327 - RNA, 12 nt, Homo sapiens
ccuuaugaauug

SEQ ID NO: 825328 - RNA, 20 nt, Homo sapiens
ccuuauuagagugucuuucc

SEQ ID NO: 825329 - RNA, 22 nt, Homo sapiens
ccuucaugaucaucacaaucau

SEQ ID NO: 825330 - RNA, 21 nt, Homo sapiens
ccuucaugaugaauuacuucu

SEQ ID NO: 825331 - RNA, 12 nt, Homo sapiens
ccuuccacugag

SEQ ID NO: 825332 - RNA, 17 nt, Homo sapiens
ccuucgauauaugacuu

SEQ ID NO: 825333 - RNA, 21 nt, Homo sapiens
ccuuuggcuaucuacugagac

SEQ ID NO: 825334 - RNA, 13 nt, Homo sapiens
cgaauaaagugaa

SEQ ID NO: 825335 - RNA, 10 nt, Homo sapiens
cgaguacuuc

SEQ ID NO: 825336 - RNA, 14 nt, Homo sapiens
cgccagacuuccca

SEQ ID NO: 825337 - RNA, 20 nt, Homo sapiens
cggagcaggggucugagcca

SEQ ID NO: 825338 - RNA, 16 nt, Homo sapiens
cgugauuuugcuguag

SEQ ID NO: 825339 - RNA, 22 nt, Homo sapiens
cuaaccugccgagaguccauca

SEQ ID NO: 825340 - RNA, 15 nt, Homo sapiens
cuaagcagaccacug

SEQ ID NO: 825341 - RNA, 17 nt, Homo sapiens
cuaagcagaccacugau

SEQ ID NO: 825342 - RNA, 17 nt, Homo sapiens
cuacugagacaugacua

SEQ ID NO: 825343 - RNA, 16 nt, Homo sapiens
cuagaaauauagagca

SEQ ID NO: 825344 - RNA, 22 nt, Homo sapiens
cuaggcuaggguggggagagac

SEQ ID NO: 825345 - RNA, 20 nt, Homo sapiens
cuaguucugccaggagacag

SEQ ID NO: 825346 - RNA, 12 nt, Homo sapiens
cuauuaucucaa

SEQ ID NO: 825347 - RNA, 15 nt, Homo sapiens
cucagaggguguccu

SEQ ID NO: 825348 - RNA, 18 nt, Homo sapiens
cucagucucugagcagug

SEQ ID NO: 825349 - RNA, 22 nt, Homo sapiens
cucauguauauuuuauaugaaa

SEQ ID NO: 825350 - RNA, 18 nt, Homo sapiens
cuccccuuguacucuugc

SEQ ID NO: 825351 - RNA, 17 nt, Homo sapiens
cuccucgagaucccaac

SEQ ID NO: 825352 - RNA, 14 nt, Homo sapiens
cuccugaagccaca

SEQ ID NO: 825353 - RNA, 13 nt, Homo sapiens
cucgagaucccaa

SEQ ID NO: 825354 - RNA, 20 nt, Homo sapiens
cucgugguaggacuguagaa

SEQ ID NO: 825355 - RNA, 13 nt, Homo sapiens
cucugaucccucu

SEQ ID NO: 825356 - RNA, 13 nt, Homo sapiens
cucugcccgggag

SEQ ID NO: 825357 - RNA, 19 nt, Homo sapiens
cugaaaacacugugcacau

SEQ ID NO: 825358 - RNA, 15 nt, Homo sapiens
cugaaauagagugaa

SEQ ID NO: 825359 - RNA, 19 nt, Homo sapiens
cugaaggagccccauuccu

SEQ ID NO: 825360 - RNA, 23 nt, Homo sapiens
cugaauagcagaagguugcaccu

SEQ ID NO: 825361 - RNA, 23 nt, Homo sapiens
cugaaucauccgaggcaaagaga

SEQ ID NO: 825362 - RNA, 22 nt, Homo sapiens
cugacccuaaauguggacauca

SEQ ID NO: 825363 - RNA, 22 nt, Homo sapiens
cugacccucaucuuucuuccaa

SEQ ID NO: 825364 - RNA, 14 nt, Homo sapiens
cugagauaccagcg

SEQ ID NO: 825365 - RNA, 15 nt, Homo sapiens
cugccagaacaugga

SEQ ID NO: 825366 - RNA, 16 nt, Homo sapiens
cugcccccaauccaug

SEQ ID NO: 825367 - RNA, 14 nt, Homo sapiens
cugccgagagucca

SEQ ID NO: 825368 - RNA, 13 nt, Homo sapiens
cugccuugccaug

SEQ ID NO: 825369 - RNA, 13 nt, Homo sapiens
cugcuaugaauua

SEQ ID NO: 825370 - RNA, 22 nt, Homo sapiens
cugcuccccacgucagcuggga

SEQ ID NO: 825371 - RNA, 14 nt, Homo sapiens
cugggcacagucag

SEQ ID NO: 825372 - RNA, 22 nt, Homo sapiens
cuggguuuuguauucucugagc

SEQ ID NO: 825373 - RNA, 18 nt, Homo sapiens
cuggugguggcucgggag

SEQ ID NO: 825374 - RNA, 17 nt, Homo sapiens
cuguaugucucguggua

SEQ ID NO: 825375 - RNA, 13 nt, Homo sapiens
cugucuccauggc

SEQ ID NO: 825376 - RNA, 22 nt, Homo sapiens
cugugcagguggggagacuggg

SEQ ID NO: 825377 - RNA, 17 nt, Homo sapiens
cuguuggcaaggugaca

SEQ ID NO: 825378 - RNA, 15 nt, Homo sapiens
cuuaaaaauuaaaga

SEQ ID NO: 825379 - RNA, 18 nt, Homo sapiens
cuuauauucauccaugcc

SEQ ID NO: 825380 - RNA, 20 nt, Homo sapiens
cuucuaguucugccaggaga

SEQ ID NO: 825381 - RNA, 18 nt, Homo sapiens
cuucuccauccacauggg

SEQ ID NO: 825382 - RNA, 18 nt, Homo sapiens
cuugaggaaaacaagcau

SEQ ID NO: 825383 - RNA, 23 nt, Homo sapiens
cuugcucaccaagaaguaacaaa

SEQ ID NO: 825384 - RNA, 12 nt, Homo sapiens
cuuuacauauau

SEQ ID NO: 825385 - RNA, 16 nt, Homo sapiens
cuuucuuccaaacagg

SEQ ID NO: 825386 - RNA, 19 nt, Homo sapiens
cuuuucaauguuagccaca

SEQ ID NO: 825387 - RNA, 18 nt, Homo sapiens
cuuuuuuuuaaguuacac

SEQ ID NO: 825388 - RNA, 14 nt, Homo sapiens
gaaaacacugugca

SEQ ID NO: 825389 - RNA, 19 nt, Homo sapiens
gaaaacacugugcacaucu

SEQ ID NO: 825390 - RNA, 12 nt, Homo sapiens
gaaaacaugacu

SEQ ID NO: 825391 - RNA, 18 nt, Homo sapiens
gaaacaccgagucucugu

SEQ ID NO: 825392 - RNA, 21 nt, Homo sapiens
gaaacugaggccauuauuuca

SEQ ID NO: 825393 - RNA, 21 nt, Homo sapiens
gaaagcaauacuguacauaaa

SEQ ID NO: 825394 - RNA, 16 nt, Homo sapiens
gaaccgaggcagggaa

SEQ ID NO: 825395 - RNA, 15 nt, Homo sapiens
gaacuccaguacuca

SEQ ID NO: 825396 - RNA, 14 nt, Homo sapiens
gaagaaaacaugac

SEQ ID NO: 825397 - RNA, 15 nt, Homo sapiens
gaagaaaacaugacu

SEQ ID NO: 825398 - RNA, 17 nt, Homo sapiens
gaagccuauguaugcca

SEQ ID NO: 825399 - RNA, 14 nt, Homo sapiens
gaaggcaaacccau

SEQ ID NO: 825400 - RNA, 14 nt, Homo sapiens
gaagggaugggaga

SEQ ID NO: 825401 - RNA, 21 nt, Homo sapiens
gaauaaaccaucaucuugcca

SEQ ID NO: 825402 - RNA, 13 nt, Homo sapiens
gaauaaagugaau

SEQ ID NO: 825403 - RNA, 20 nt, Homo sapiens
gaaucucuuuuugcuuucga

SEQ ID NO: 825404 - RNA, 20 nt, Homo sapiens
gacggaaaggaaaaacugau

SEQ ID NO: 825405 - RNA, 19 nt, Homo sapiens
gacgugagugugacuuuuu

SEQ ID NO: 825406 - RNA, 18 nt, Homo sapiens
gacgugauuuugcuguag

SEQ ID NO: 825407 - RNA, 21 nt, Homo sapiens
gacuccgggcacggcuuccca

SEQ ID NO: 825408 - RNA, 20 nt, Homo sapiens
gacuuuuugaaaaaaguaua

SEQ ID NO: 825409 - RNA, 14 nt, Homo sapiens
gagaaaaagggagg

SEQ ID NO: 825410 - RNA, 22 nt, Homo sapiens
gagagcucgcuuugagugacug

SEQ ID NO: 825411 - RNA, 17 nt, Homo sapiens
gagccgggucugccucu

SEQ ID NO: 825412 - RNA, 14 nt, Homo sapiens
gagccugacccuca

SEQ ID NO: 825413 - RNA, 11 nt, Homo sapiens
gagcugugcag

SEQ ID NO: 825414 - RNA, 16 nt, Homo sapiens
gagggcagucgauaga

SEQ ID NO: 825415 - RNA, 17 nt, Homo sapiens
gagguuugccagcauuu

SEQ ID NO: 825416 - RNA, 23 nt, Homo sapiens
gagugaccucacuucuggcacug

SEQ ID NO: 825417 - RNA, 21 nt, Homo sapiens
aucucaaacuacuggcaauuu

SEQ ID NO: 825418 - RNA, 22 nt, Homo sapiens
aucucaaacuacuggcaauuug

SEQ ID NO: 825419 - RNA, 20 nt, Homo sapiens
aucucauuggacccuuccau

SEQ ID NO: 825420 - RNA, 17 nt, Homo sapiens
aucuuaaaaauuaaaga

SEQ ID NO: 825421 - RNA, 16 nt, Homo sapiens
aucuucuucaccauuu

SEQ ID NO: 825422 - RNA, 20 nt, Homo sapiens
aucuugcuucugcuucucau

SEQ ID NO: 825423 - RNA, 18 nt, Homo sapiens
aucuuuagcuaauaaaga

SEQ ID NO: 825424 - RNA, 21 nt, Homo sapiens
aucuuucuuccaaacaggcuc

SEQ ID NO: 825425 - RNA, 22 nt, Homo sapiens
augagaauuugagugcucugau

SEQ ID NO: 825426 - RNA, 15 nt, Homo sapiens
augauguguagggcu

SEQ ID NO: 825427 - RNA, 15 nt, Homo sapiens
auggcagacaaagca

SEQ ID NO: 825428 - RNA, 19 nt, Homo sapiens
augggcagagcccaaggga

SEQ ID NO: 825429 - RNA, 14 nt, Homo sapiens
auguaaacugugca

SEQ ID NO: 825430 - RNA, 14 nt, Homo sapiens
auguauggcaugug

SEQ ID NO: 825431 - RNA, 14 nt, Homo sapiens
augucaauugucag

SEQ ID NO: 825432 - RNA, 23 nt, Homo sapiens
augucagaaguuucuuuuuacau

SEQ ID NO: 825433 - RNA, 19 nt, Homo sapiens
augugacauuauaugcacu

SEQ ID NO: 825434 - RNA, 15 nt, Homo sapiens
augugacucuuucca

SEQ ID NO: 825435 - RNA, 20 nt, Homo sapiens
auguguugccuggaagcaca

SEQ ID NO: 825436 - RNA, 18 nt, Homo sapiens
auguuagccacaguguau

SEQ ID NO: 825437 - RNA, 16 nt, Homo sapiens
auuaccuccugagaaa

SEQ ID NO: 825438 - RNA, 22 nt, Homo sapiens
auuauauuuccuuaaaauguga

SEQ ID NO: 825439 - RNA, 18 nt, Homo sapiens
auuaugagucucuaugau

SEQ ID NO: 825440 - RNA, 17 nt, Homo sapiens
auucuuucccaacaccu

SEQ ID NO: 825441 - RNA, 19 nt, Homo sapiens
auucuuucccaacaccucu

SEQ ID NO: 825442 - RNA, 20 nt, Homo sapiens
auucuuucccaauucacauc

SEQ ID NO: 825443 - RNA, 16 nt, Homo sapiens
auugaguuuucagugg

SEQ ID NO: 825444 - RNA, 19 nt, Homo sapiens
auuguaucaaaugugacau

SEQ ID NO: 825445 - RNA, 20 nt, Homo sapiens
auuucaaccgcuugccauau

SEQ ID NO: 825446 - RNA, 18 nt, Homo sapiens
auuugagugucuuugacu

SEQ ID NO: 825447 - RNA, 21 nt, Homo sapiens
auuugcaagggaaaagucucu

SEQ ID NO: 825448 - RNA, 19 nt, Homo sapiens
auuugcauaacaauuccuc

SEQ ID NO: 825449 - RNA, 16 nt, Homo sapiens
auuuggcaaugccauc

SEQ ID NO: 825450 - RNA, 21 nt, Homo sapiens
auuuuaaugaagaaaguggaa

SEQ ID NO: 825451 - RNA, 22 nt, Homo sapiens
auuuucccuucgauauaugacu

SEQ ID NO: 825452 - RNA, 19 nt, Homo sapiens
auuuucuuucauacauuau

SEQ ID NO: 825453 - RNA, 15 nt, Homo sapiens
auuuuuguacauuau

SEQ ID NO: 825454 - RNA, 13 nt, Homo sapiens
auuuuugugcaca

SEQ ID NO: 825455 - RNA, 20 nt, Homo sapiens
caaaaagauuuauuaauuaa

SEQ ID NO: 825456 - RNA, 17 nt, Homo sapiens
caaaaauugucccuuaa

SEQ ID NO: 825457 - RNA, 17 nt, Homo sapiens
caaagcuuucauguaaa

SEQ ID NO: 825458 - RNA, 22 nt, Homo sapiens
caaagcuuucauguaaacugug

SEQ ID NO: 825459 - RNA, 11 nt, Homo sapiens
caacagcauuu

SEQ ID NO: 825460 - RNA, 19 nt, Homo sapiens
aaugucuugaugcaugcac

SEQ ID NO: 825461 - RNA, 19 nt, Homo sapiens
aauuaaaauccucaaucca

SEQ ID NO: 825462 - RNA, 12 nt, Homo sapiens
aauuacuucuuc

SEQ ID NO: 825463 - RNA, 18 nt, Homo sapiens
aauuguaucaaaugugac

SEQ ID NO: 825464 - RNA, 14 nt, Homo sapiens
aauuucuacuuuga

SEQ ID NO: 825465 - RNA, 19 nt, Homo sapiens
aauuuucuaugaauugcua

SEQ ID NO: 825466 - RNA, 19 nt, Homo sapiens
acaaauuuuuuucuuguuu

SEQ ID NO: 825467 - RNA, 20 nt, Homo sapiens
acaccugaaaauuaugaguc

SEQ ID NO: 825468 - RNA, 12 nt, Homo sapiens
acagaagguccu

SEQ ID NO: 825469 - RNA, 17 nt, Homo sapiens
acagaaucaggcacuua

SEQ ID NO: 825470 - RNA, 17 nt, Homo sapiens
acagaaugaaucccaua

SEQ ID NO: 825471 - RNA, 13 nt, Homo sapiens
acaugacuaggaa

SEQ ID NO: 825472 - RNA, 13 nt, Homo sapiens
acauggauuccac

SEQ ID NO: 825473 - RNA, 17 nt, Homo sapiens
acauuaaaauagcacau

SEQ ID NO: 825474 - RNA, 13 nt, Homo sapiens
acauuuccaugca

SEQ ID NO: 825475 - RNA, 17 nt, Homo sapiens
accagacucuguugcaa

SEQ ID NO: 825476 - RNA, 17 nt, Homo sapiens
accagccucuccacuca

SEQ ID NO: 825477 - RNA, 13 nt, Homo sapiens
acccaugccauag

SEQ ID NO: 825478 - RNA, 19 nt, Homo sapiens
acccucaucuuucuuccaa

SEQ ID NO: 825479 - RNA, 19 nt, Homo sapiens
accgaggcagggaaggauc

SEQ ID NO: 825480 - RNA, 16 nt, Homo sapiens
accgauagcaggugaa

SEQ ID NO: 825481 - RNA, 23 nt, Homo sapiens
accgauuugcacccaugccauag

SEQ ID NO: 825482 - RNA, 16 nt, Homo sapiens
accucacuucuggcac

SEQ ID NO: 825483 - RNA, 22 nt, Homo sapiens
accucacuucuggcacugugac

SEQ ID NO: 825484 - RNA, 17 nt, Homo sapiens
accuccuguguggaaga

SEQ ID NO: 825485 - RNA, 17 nt, Homo sapiens
accucgcuggacucuca

SEQ ID NO: 825486 - RNA, 20 nt, Homo sapiens
accugaaaacacugugcaca

SEQ ID NO: 825487 - RNA, 15 nt, Homo sapiens
accugggcaaagccu

SEQ ID NO: 825488 - RNA, 19 nt, Homo sapiens
accuguggccaaguucuua

SEQ ID NO: 825489 - RNA, 21 nt, Homo sapiens
accuuugccuuccaacugcca

SEQ ID NO: 825490 - RNA, 17 nt, Homo sapiens
acgacugucuccauggc

SEQ ID NO: 825491 - RNA, 16 nt, Homo sapiens
acguauuuugauguuu

SEQ ID NO: 825492 - RNA, 11 nt, Homo sapiens
acuagggccaa

SEQ ID NO: 825493 - RNA, 20 nt, Homo sapiens
acucaugugacucuuuccaa

SEQ ID NO: 825494 - RNA, 14 nt, Homo sapiens
acugaacauuccag

SEQ ID NO: 825495 - RNA, 10 nt, Homo sapiens
acugcaguga

SEQ ID NO: 825496 - RNA, 11 nt, Homo sapiens
acugcagugac

SEQ ID NO: 825497 - RNA, 22 nt, Homo sapiens
acugccagaacauggauuccac

SEQ ID NO: 825498 - RNA, 14 nt, Homo sapiens
acugcuugaggaaa

SEQ ID NO: 825499 - RNA, 13 nt, Homo sapiens
acugucuccaugg

SEQ ID NO: 825500 - RNA, 13 nt, Homo sapiens
acuuaacaauuaa

SEQ ID NO: 825501 - RNA, 20 nt, Homo sapiens
acuuacccuaaaacaugugu

SEQ ID NO: 825502 - RNA, 16 nt, Homo sapiens
acuuacuuaguguuau

SEQ ID NO: 825503 - RNA, 14 nt, Homo sapiens
acuuauuuauauaa

SEQ ID NO: 825504 - RNA, 14 nt, Homo sapiens
acuucccacggcuc

SEQ ID NO: 825505 - RNA, 17 nt, Homo sapiens
acuuccuuggacuacuu

SEQ ID NO: 825506 - RNA, 18 nt, Homo sapiens
acuucucuauuaucucaa

SEQ ID NO: 825507 - RNA, 23 nt, Homo sapiens
acuugucccgggacaccuaggcu

SEQ ID NO: 825508 - RNA, 15 nt, Homo sapiens
acuuuuaaaacuaua

SEQ ID NO: 825509 - RNA, 20 nt, Homo sapiens
acuuuuugaaaaaaguauag

SEQ ID NO: 825510 - RNA, 14 nt, Homo sapiens
agaaaacaugacuu

SEQ ID NO: 825511 - RNA, 16 nt, Homo sapiens
agaaauauagagcauu

SEQ ID NO: 825512 - RNA, 14 nt, Homo sapiens
agaauacacuauca

SEQ ID NO: 825513 - RNA, 18 nt, Homo sapiens
agaauuugagugcucuga

SEQ ID NO: 825514 - RNA, 18 nt, Homo sapiens
agaauuuucaaauaagga

SEQ ID NO: 825515 - RNA, 21 nt, Homo sapiens
agacgggcccuggugguggcu

SEQ ID NO: 825516 - RNA, 19 nt, Homo sapiens
agacgugauuuugcuguag

SEQ ID NO: 825517 - RNA, 22 nt, Homo sapiens
agagaacaaugugcuaugugaa

SEQ ID NO: 825518 - RNA, 12 nt, Homo sapiens
agagcacuuuua

SEQ ID NO: 825519 - RNA, 18 nt, Homo sapiens
agagggcccccuacuugu

SEQ ID NO: 825520 - RNA, 17 nt, Homo sapiens
agagggcugccuuugga

SEQ ID NO: 825521 - RNA, 17 nt, Homo sapiens
agaggguguccugcacc

SEQ ID NO: 825522 - RNA, 22 nt, Homo sapiens
agagugaauuauauuuccuuaa

SEQ ID NO: 825523 - RNA, 19 nt, Homo sapiens
agcaacauugacccagaaa

SEQ ID NO: 825524 - RNA, 16 nt, Homo sapiens
agcaauaugcauuuaa

SEQ ID NO: 825525 - RNA, 11 nt, Homo sapiens
agcacaugugu

SEQ ID NO: 825526 - RNA, 19 nt, Homo sapiens
agcaccuacaguguacagu

SEQ ID NO: 825527 - RNA, 22 nt, Homo sapiens
agcacuuuuaacaaaaaaggaa

SEQ ID NO: 825528 - RNA, 14 nt, Homo sapiens
agcaucaaagcacu

SEQ ID NO: 825529 - RNA, 13 nt, Homo sapiens
agccauaugaaug

SEQ ID NO: 825530 - RNA, 13 nt, Homo sapiens
agcuaccagcuau

SEQ ID NO: 825531 - RNA, 20 nt, Homo sapiens
agcucugaaaccaguguuag

SEQ ID NO: 825532 - RNA, 23 nt, Homo sapiens
agcucugaaaccaguguuaggga

SEQ ID NO: 825533 - RNA, 12 nt, Homo sapiens
aggcaagcacuu

SEQ ID NO: 825534 - RNA, 21 nt, Homo sapiens
aggcagggaaggaucccauga

SEQ ID NO: 825535 - RNA, 23 nt, Homo sapiens
aggccagaaaacauaugcauuau

SEQ ID NO: 825536 - RNA, 19 nt, Homo sapiens
aggccauucuuucccaaca

SEQ ID NO: 825537 - RNA, 12 nt, Homo sapiens
aggcccucgcug

SEQ ID NO: 825538 - RNA, 15 nt, Homo sapiens
aggccucuguggcac

SEQ ID NO: 825539 - RNA, 16 nt, Homo sapiens
agggaaggaucccaug

SEQ ID NO: 825540 - RNA, 16 nt, Homo sapiens
agggacgccugggggu

SEQ ID NO: 825541 - RNA, 14 nt, Homo sapiens
agggagcuggaaaa

SEQ ID NO: 825542 - RNA, 16 nt, Homo sapiens
agggccacaugggagg

SEQ ID NO: 825543 - RNA, 17 nt, Homo sapiens
agguuagcugcucccca

SEQ ID NO: 825544 - RNA, 15 nt, Homo sapiens
agguuugccagcauu

SEQ ID NO: 825545 - RNA, 21 nt, Homo sapiens
agucaaccugccugacauuug

SEQ ID NO: 825546 - RNA, 15 nt, Homo sapiens
agucgaacaauucau

SEQ ID NO: 825547 - RNA, 12 nt, Homo sapiens
agucucuaugau

SEQ ID NO: 825548 - RNA, 16 nt, Homo sapiens
agugauuggcucugug

SEQ ID NO: 825549 - RNA, 20 nt, Homo sapiens
aguguuccccuuccacugag

SEQ ID NO: 825550 - RNA, 21 nt, Homo sapiens
aguucacaggccagaaaacau

SEQ ID NO: 825551 - RNA, 21 nt, Homo sapiens
aguugauugcgagaauuuuca

SEQ ID NO: 825552 - RNA, 21 nt, Homo sapiens
auaaaauuauauucacuacuu

SEQ ID NO: 825553 - RNA, 16 nt, Homo sapiens
auaaaauucauuaguu

SEQ ID NO: 825554 - RNA, 23 nt, Homo sapiens
auaaccuucaugaugaauuacuu

SEQ ID NO: 825555 - RNA, 21 nt, Homo sapiens
auagaaaacacgcaugagaua

SEQ ID NO: 825556 - RNA, 20 nt, Homo sapiens
auauauuuuugugcacauuu

SEQ ID NO: 825557 - RNA, 17 nt, Homo sapiens
auaugacuuuuucucag

SEQ ID NO: 825558 - RNA, 20 nt, Homo sapiens
auaugauauauaaaugugau

SEQ ID NO: 825559 - RNA, 14 nt, Homo sapiens
auauguacauacau

SEQ ID NO: 825560 - RNA, 15 nt, Homo sapiens
auauuuucaccauuu

SEQ ID NO: 825561 - RNA, 22 nt, Homo sapiens
aucauuucuauuucuccuccau

SEQ ID NO: 825562 - RNA, 12 nt, Homo sapiens
auccacauggga

SEQ ID NO: 825563 - RNA, 15 nt, Homo sapiens
aucccaugagcuccu

SEQ ID NO: 825564 - RNA, 23 nt, Homo sapiens
auccuacccccugugccuuguca

SEQ ID NO: 825565 - RNA, 15 nt, Homo sapiens
aaaaaucagugaaua

SEQ ID NO: 825566 - RNA, 14 nt, Homo sapiens
aaaacacugugcac

SEQ ID NO: 825567 - RNA, 19 nt, Homo sapiens
aaaaccucauuuaccauaa

SEQ ID NO: 825568 - RNA, 17 nt, Homo sapiens
aaaacucucaagcagac

SEQ ID NO: 825569 - RNA, 16 nt, Homo sapiens
aaaagggaacugaaca

SEQ ID NO: 825570 - RNA, 16 nt, Homo sapiens
aaacguccuacuguau

SEQ ID NO: 825571 - RNA, 17 nt, Homo sapiens
aaacuauguaacaugua

SEQ ID NO: 825572 - RNA, 22 nt, Homo sapiens
aaagcaauuauauuguccuccc

SEQ ID NO: 825573 - RNA, 12 nt, Homo sapiens
aaagcacuguuu

SEQ ID NO: 825574 - RNA, 23 nt, Homo sapiens
aaaguuguucgccgcguggaaug

SEQ ID NO: 825575 - RNA, 23 nt, Homo sapiens
aaaguuugggaagggaugggaga

SEQ ID NO: 825576 - RNA, 21 nt, Homo sapiens
aaauaauagacagcaaucaaa

SEQ ID NO: 825577 - RNA, 15 nt, Homo sapiens
aaauauauaugauau

SEQ ID NO: 825578 - RNA, 13 nt, Homo sapiens
aaauaucuugcaa

SEQ ID NO: 825579 - RNA, 15 nt, Homo sapiens
aaaucaguuauguca

SEQ ID NO: 825580 - RNA, 23 nt, Homo sapiens
aaaugcugguuuuucaguuuuca

SEQ ID NO: 825581 - RNA, 21 nt, Homo sapiens
aaauucauuaguuguuaguga

SEQ ID NO: 825582 - RNA, 14 nt, Homo sapiens
aaauuguauuauca

SEQ ID NO: 825583 - RNA, 19 nt, Homo sapiens
aacacauucugcuaugaau

SEQ ID NO: 825584 - RNA, 15 nt, Homo sapiens
aacacccuuaugaau

SEQ ID NO: 825585 - RNA, 23 nt, Homo sapiens
aaccucagugauuggcucugugg

SEQ ID NO: 825586 - RNA, 14 nt, Homo sapiens
aaccucauuuacca

SEQ ID NO: 825587 - RNA, 15 nt, Homo sapiens
aacucucaagcagac

SEQ ID NO: 825588 - RNA, 15 nt, Homo sapiens
aacugaacauuccag

SEQ ID NO: 825589 - RNA, 14 nt, Homo sapiens
aacugccagaacau

SEQ ID NO: 825590 - RNA, 21 nt, Homo sapiens
aacuguuggcaaggugacauu

SEQ ID NO: 825591 - RNA, 16 nt, Homo sapiens
aacuuuuauuacuggg

SEQ ID NO: 825592 - RNA, 15 nt, Homo sapiens
aagacuacacuguug

SEQ ID NO: 825593 - RNA, 21 nt, Homo sapiens
aagaggaaggccucuguggca

SEQ ID NO: 825594 - RNA, 17 nt, Homo sapiens
aagauacagaacucuuu

SEQ ID NO: 825595 - RNA, 12 nt, Homo sapiens
aagcacaugugu

SEQ ID NO: 825596 - RNA, 19 nt, Homo sapiens
aagcauucacaacuuguuu

SEQ ID NO: 825597 - RNA, 18 nt, Homo sapiens
aagccuauguaugccaug

SEQ ID NO: 825598 - RNA, 19 nt, Homo sapiens
aaggaucccaugagcuccu

SEQ ID NO: 825599 - RNA, 18 nt, Homo sapiens
aaguaagccucaccuuug

SEQ ID NO: 825600 - RNA, 18 nt, Homo sapiens
aaguauaggauaaauuac

SEQ ID NO: 825601 - RNA, 14 nt, Homo sapiens
aagucaaccugccu

SEQ ID NO: 825602 - RNA, 18 nt, Homo sapiens
aauaaaguucuguacuca

SEQ ID NO: 825603 - RNA, 13 nt, Homo sapiens
aauaaccaauccu

SEQ ID NO: 825604 - RNA, 16 nt, Homo sapiens
aauacauuuugcacaa

SEQ ID NO: 825605 - RNA, 21 nt, Homo sapiens
aauauauuuauauguacauac

SEQ ID NO: 825606 - RNA, 12 nt, Homo sapiens
aauaucuugcaa

SEQ ID NO: 825607 - RNA, 14 nt, Homo sapiens
aaucaaaugcaauu

SEQ ID NO: 825608 - RNA, 15 nt, Homo sapiens
aaugugauugcagcu

SEQ ID NO: 825609 - RNA, 15 nt, Homo sapiens
aauguucacuuuuga

SEQ ID NO: 825610 - RNA, 13 nt, Homo sapiens
aauuaaaccagac

SEQ ID NO: 825611 - RNA, 17 nt, Homo sapiens
aauuauauuguccuccc

SEQ ID NO: 825612 - RNA, 15 nt, Homo sapiens
aauuaugagucucua

SEQ ID NO: 825613 - RNA, 22 nt, Homo sapiens
aauucuguauuaaggugucaua

SEQ ID NO: 825614 - RNA, 20 nt, Homo sapiens
aauuuaaccagcaacauuga

SEQ ID NO: 825615 - RNA, 22 nt, Homo sapiens
aauuuucuaugaauugcuaauu

SEQ ID NO: 825616 - RNA, 20 nt, Homo sapiens
acaaaauaaccaauccugga

SEQ ID NO: 825617 - RNA, 16 nt, Homo sapiens
acaagucuggcacuuc

SEQ ID NO: 825618 - RNA, 16 nt, Homo sapiens
acagagcuucccugac

SEQ ID NO: 825619 - RNA, 23 nt, Homo sapiens
acagcucgggcccucugugagau

SEQ ID NO: 825620 - RNA, 17 nt, Homo sapiens
accacugauaaaaccau

SEQ ID NO: 825621 - RNA, 20 nt, Homo sapiens
accaggguugaccccagagg

SEQ ID NO: 825622 - RNA, 20 nt, Homo sapiens
accauuaaaaaguuggaguu

SEQ ID NO: 825623 - RNA, 16 nt, Homo sapiens
acccuaaaacaugugu

SEQ ID NO: 825624 - RNA, 16 nt, Homo sapiens
acccuaaaucuugacu

SEQ ID NO: 825625 - RNA, 15 nt, Homo sapiens
acccuaaauguggac

SEQ ID NO: 825626 - RNA, 14 nt, Homo sapiens
acccucaucuuucu

SEQ ID NO: 825627 - RNA, 13 nt, Homo sapiens
accguugcacaaa

SEQ ID NO: 825628 - RNA, 15 nt, Homo sapiens
accguugcacaaaaa

SEQ ID NO: 825629 - RNA, 21 nt, Homo sapiens
accucauuuaccauaaaaauc

SEQ ID NO: 825630 - RNA, 22 nt, Homo sapiens
acggagccacuccucugacuca

SEQ ID NO: 825631 - RNA, 17 nt, Homo sapiens
acguagauuuuugcucu

SEQ ID NO: 825632 - RNA, 20 nt, Homo sapiens
acuccgagagcaugcuuaau

SEQ ID NO: 825633 - RNA, 23 nt, Homo sapiens
acugcagggaaaauuauuugcau

SEQ ID NO: 825634 - RNA, 17 nt, Homo sapiens
acuucucuauuaucuca

SEQ ID NO: 825635 - RNA, 23 nt, Homo sapiens
acuucuggcacugugacuacuau

SEQ ID NO: 825636 - RNA, 12 nt, Homo sapiens
agaaaagccacg

SEQ ID NO: 825637 - RNA, 22 nt, Homo sapiens
agaaagguaaacaaacaaauaa

SEQ ID NO: 825638 - RNA, 13 nt, Homo sapiens
agaacuacugaua

SEQ ID NO: 825639 - RNA, 22 nt, Homo sapiens
agaagauggcacuuauaaccaa

SEQ ID NO: 825640 - RNA, 14 nt, Homo sapiens
agaaucaggcacuu

SEQ ID NO: 825641 - RNA, 11 nt, Homo sapiens
agaauggagcu

SEQ ID NO: 825642 - RNA, 22 nt, Homo sapiens
agacacuguucccagcuaccag

SEQ ID NO: 825643 - RNA, 14 nt, Homo sapiens
agaccacugauaaa

SEQ ID NO: 825644 - RNA, 14 nt, Homo sapiens
agaccgaaucucac

SEQ ID NO: 825645 - RNA, 13 nt, Homo sapiens
agagcacuuuuaa

SEQ ID NO: 825646 - RNA, 13 nt, Homo sapiens
agagugucuuucc

SEQ ID NO: 825647 - RNA, 21 nt, Homo sapiens
agauuuuuuuuguaacuucaa

SEQ ID NO: 825648 - RNA, 20 nt, Homo sapiens
agcagugaaugauucagugu

SEQ ID NO: 825649 - RNA, 21 nt, Homo sapiens
agcauacgguaugauauugca

SEQ ID NO: 825650 - RNA, 13 nt, Homo sapiens
agcccucaucccg

SEQ ID NO: 825651 - RNA, 17 nt, Homo sapiens
agccgggagccugaccc

SEQ ID NO: 825652 - RNA, 23 nt, Homo sapiens
agccuagaaauauagagcauuaa

SEQ ID NO: 825653 - RNA, 18 nt, Homo sapiens
agccuugcucaggugcaa

SEQ ID NO: 825654 - RNA, 15 nt, Homo sapiens
agcuaccagcuaugc

SEQ ID NO: 825655 - RNA, 22 nt, Homo sapiens
agcucaggaaccgaggcaggga

SEQ ID NO: 825656 - RNA, 20 nt, Homo sapiens
agcucgggcccucugugaga

SEQ ID NO: 825657 - RNA, 17 nt, Homo sapiens
agcugaacaaugaaugc

SEQ ID NO: 825658 - RNA, 18 nt, Homo sapiens
agcuuagacuaaggccau

SEQ ID NO: 825659 - RNA, 20 nt, Homo sapiens
aggaaaaucuuaaaauucuu

SEQ ID NO: 825660 - RNA, 18 nt, Homo sapiens
aggagggaggugcuucua

SEQ ID NO: 825661 - RNA, 20 nt, Homo sapiens
aggcaaagagaaaagccacg

SEQ ID NO: 825662 - RNA, 15 nt, Homo sapiens
aggcagcagugugag

SEQ ID NO: 825663 - RNA, 22 nt, Homo sapiens
aggcuccagagggcacucugcu

SEQ ID NO: 825664 - RNA, 17 nt, Homo sapiens
aggcucguugacuggcu

SEQ ID NO: 825665 - RNA, 18 nt, Homo sapiens
agggaaaauuauuugcau

SEQ ID NO: 825666 - RNA, 17 nt, Homo sapiens
aggugucauagcuauga

SEQ ID NO: 825667 - RNA, 18 nt, Homo sapiens
aguauaguuuugacagag

SEQ ID NO: 825668 - RNA, 16 nt, Homo sapiens
agucuuguauuaaguu

SEQ ID NO: 825669 - RNA, 19 nt, Homo sapiens
agugaauaaaccaucaucu

SEQ ID NO: 825670 - RNA, 15 nt, Homo sapiens
agugaauacauuuug

SEQ ID NO: 825671 - RNA, 20 nt, Homo sapiens
agugaccugcccuacauauc

SEQ ID NO: 825672 - RNA, 17 nt, Homo sapiens
agugauaugauguguag

SEQ ID NO: 825673 - RNA, 12 nt, Homo sapiens
agugauguaauc

SEQ ID NO: 825674 - RNA, 20 nt, Homo sapiens
aguggugcgaucuuggcuca

SEQ ID NO: 825675 - RNA, 16 nt, Homo sapiens
aguguuccccuuccac

SEQ ID NO: 825676 - RNA, 11 nt, Homo sapiens
aguugcuguau

SEQ ID NO: 825677 - RNA, 13 nt, Homo sapiens
aguugcuguaugu

SEQ ID NO: 825678 - RNA, 17 nt, Homo sapiens
auaaacguccuacugua

SEQ ID NO: 825679 - RNA, 19 nt, Homo sapiens
auaaccuucaugaugaauu

SEQ ID NO: 825680 - RNA, 14 nt, Homo sapiens
auacagaaugaauc

SEQ ID NO: 825681 - RNA, 19 nt, Homo sapiens
auacagagguaacuaucaa

SEQ ID NO: 825682 - RNA, 12 nt, Homo sapiens
auagaaacugag

SEQ ID NO: 825683 - RNA, 21 nt, Homo sapiens
auauaaaugugauugcagcuu

SEQ ID NO: 825684 - RNA, 21 nt, Homo sapiens
auauauaucccuuuacauaua

SEQ ID NO: 825685 - RNA, 20 nt, Homo sapiens
auauauauuuuugugcacau

SEQ ID NO: 825686 - RNA, 20 nt, Homo sapiens
auauauuuauauguacauac

SEQ ID NO: 825687 - RNA, 22 nt, Homo sapiens
auauauuuauauguacauacau

SEQ ID NO: 825688 - RNA, 17 nt, Homo sapiens
auaugaaagaaaacacc

SEQ ID NO: 825689 - RNA, 17 nt, Homo sapiens
auaugaaugucaguagu

SEQ ID NO: 825690 - RNA, 13 nt, Homo sapiens
auauguacauaca

SEQ ID NO: 825691 - RNA, 20 nt, Homo sapiens
auauuccucuaaaacucuca

SEQ ID NO: 825692 - RNA, 13 nt, Homo sapiens
aucaacagcauuu

SEQ ID NO: 825693 - RNA, 18 nt, Homo sapiens
aucagcgccgcaccagcc

SEQ ID NO: 825694 - RNA, 14 nt, Homo sapiens
aucaucauucucau

SEQ ID NO: 825695 - RNA, 18 nt, Homo sapiens
aucaucuccugccuuccu

SEQ ID NO: 825696 - RNA, 15 nt, Homo sapiens
aucauguguguccac

SEQ ID NO: 825697 - RNA, 17 nt, Homo sapiens
aucauucucugucucau

SEQ ID NO: 825698 - RNA, 12 nt, Homo sapiens
aucccuuuacau

SEQ ID NO: 825699 - RNA, 20 nt, Homo sapiens
aucgcugccuugccaugucu

SEQ ID NO: 825700 - RNA, 17 nt, Homo sapiens
aucucacucuguugccc

SEQ ID NO: 825701 - RNA, 19 nt, Homo sapiens
aucucacucuguugcccag

SEQ ID NO: 825702 - RNA, 22 nt, Homo sapiens
aucugucaaagaaaacuuccaa

SEQ ID NO: 825703 - RNA, 15 nt, Homo sapiens
aucuguguuuacuua

SEQ ID NO: 825704 - RNA, 14 nt, Homo sapiens
augaaagugcgaua

SEQ ID NO: 825705 - RNA, 20 nt, Homo sapiens
augacuuuaucauuuuguua

SEQ ID NO: 825706 - RNA, 22 nt, Homo sapiens
augaucaucacaaucaucauca

SEQ ID NO: 825707 - RNA, 14 nt, Homo sapiens
augcauaaaugcga

SEQ ID NO: 825708 - RNA, 16 nt, Homo sapiens
augcauaaaugcgauc

SEQ ID NO: 825709 - RNA, 19 nt, Homo sapiens
augcccuguaccugugcac

SEQ ID NO: 825710 - RNA, 11 nt, Homo sapiens
augugaugaau

SEQ ID NO: 825711 - RNA, 14 nt, Homo sapiens
augugauugcagcu

SEQ ID NO: 825712 - RNA, 23 nt, Homo sapiens
auguguaguuaauuuuauuccag

SEQ ID NO: 825713 - RNA, 21 nt, Homo sapiens
auguguggguguguguuacau

SEQ ID NO: 825714 - RNA, 13 nt, Homo sapiens
auguuuuguacuu

SEQ ID NO: 825715 - RNA, 14 nt, Homo sapiens
auguuuuguacuua

SEQ ID NO: 825716 - RNA, 16 nt, Homo sapiens
auuaaagacuaacuaa

SEQ ID NO: 825717 - RNA, 20 nt, Homo sapiens
auuaaccugaauuauuccaa

SEQ ID NO: 825718 - RNA, 15 nt, Homo sapiens
auuaauuuucuauga

SEQ ID NO: 825719 - RNA, 21 nt, Homo sapiens
auuauuucaaccgcuugccau

SEQ ID NO: 825720 - RNA, 19 nt, Homo sapiens
auucucugucucauccauc

SEQ ID NO: 825721 - RNA, 13 nt, Homo sapiens
auucuuucccaac

SEQ ID NO: 825722 - RNA, 18 nt, Homo sapiens
auugacccagaaauguau

SEQ ID NO: 825723 - RNA, 22 nt, Homo sapiens
auuggaauuuucuuucauacau

SEQ ID NO: 825724 - RNA, 18 nt, Homo sapiens
auuuagacccugcauuua

SEQ ID NO: 825725 - RNA, 16 nt, Homo sapiens
auuuauuuauguagga

SEQ ID NO: 825726 - RNA, 20 nt, Homo sapiens
auuuccuuaaaaugugagug

SEQ ID NO: 825727 - RNA, 19 nt, Homo sapiens
auuucuccuccaugggaga

SEQ ID NO: 825728 - RNA, 13 nt, Homo sapiens
auuugagugcucu

SEQ ID NO: 825729 - RNA, 15 nt, Homo sapiens
auuuuauaugaaaga

SEQ ID NO: 825730 - RNA, 19 nt, Homo sapiens
auuuugcacaaaguaagcc

SEQ ID NO: 825731 - RNA, 19 nt, Homo sapiens
auuuuuguacauuauguua

SEQ ID NO: 825732 - RNA, 14 nt, Homo sapiens
auuuuugugcacau

SEQ ID NO: 825733 - RNA, 21 nt, Homo sapiens
caaacuccuuguaggucugca

SEQ ID NO: 825734 - RNA, 23 nt, Homo sapiens
caaagcaaggaaacuauguaaca

SEQ ID NO: 825735 - RNA, 20 nt, Homo sapiens
caaaguaagccucaccuuug

SEQ ID NO: 825736 - RNA, 13 nt, Homo sapiens
caaauguauuuca

SEQ ID NO: 825737 - RNA, 13 nt, Homo sapiens
caaaugugacauu

SEQ ID NO: 825738 - RNA, 20 nt, Homo sapiens
caaccucgcuggacucucag

SEQ ID NO: 825739 - RNA, 20 nt, Homo sapiens
caaguucuuaguugcuguau

SEQ ID NO: 825740 - RNA, 19 nt, Homo sapiens
caaucaucaucauucucau

SEQ ID NO: 825741 - RNA, 18 nt, Homo sapiens
caauccagcuauguuaua

SEQ ID NO: 825742 - RNA, 17 nt, Homo sapiens
caauuuuaaaucugaga

SEQ ID NO: 825743 - RNA, 16 nt, Homo sapiens
ucuuggaauacuugaa

SEQ ID NO: 825744 - RNA, 22 nt, Homo sapiens
ucuugguugaggaaacaaacau

SEQ ID NO: 825745 - RNA, 22 nt, Homo sapiens
ucuuguuguggaggcugaaaag

SEQ ID NO: 825746 - RNA, 14 nt, Homo sapiens
ucuuucccaauuca

SEQ ID NO: 825747 - RNA, 17 nt, Homo sapiens
ucuuucccaauucacau

SEQ ID NO: 825748 - RNA, 18 nt, Homo sapiens
ugaaaauuaugagucucu

SEQ ID NO: 825749 - RNA, 15 nt, Homo sapiens
ugaaauagagugaau

SEQ ID NO: 825750 - RNA, 22 nt, Homo sapiens
ugaaccaagaccauugaauucu

SEQ ID NO: 825751 - RNA, 22 nt, Homo sapiens
ugaauaaaccaucaucuugcca

SEQ ID NO: 825752 - RNA, 20 nt, Homo sapiens
ugaauacauuuugcacaaag

SEQ ID NO: 825753 - RNA, 19 nt, Homo sapiens
ugaccaauauuguacaguu

SEQ ID NO: 825754 - RNA, 21 nt, Homo sapiens
ugacccucaucuuucuuccaa

SEQ ID NO: 825755 - RNA, 12 nt, Homo sapiens
ugagcugugcag

SEQ ID NO: 825756 - RNA, 15 nt, Homo sapiens
ugaggaacccuuaca

SEQ ID NO: 825757 - RNA, 21 nt, Homo sapiens
ugauauauaaaugugauugca

SEQ ID NO: 825758 - RNA, 22 nt, Homo sapiens
ugcaaaaggacucucaggacca

SEQ ID NO: 825759 - RNA, 13 nt, Homo sapiens
ugcacacuuugcc

SEQ ID NO: 825760 - RNA, 19 nt, Homo sapiens
ugcagcuuauauucaucca

SEQ ID NO: 825761 - RNA, 23 nt, Homo sapiens
ugcagugaccugcccuacauauc

SEQ ID NO: 825762 - RNA, 23 nt, Homo sapiens
ugcauuuaaauacagucuuccau

SEQ ID NO: 825763 - RNA, 14 nt, Homo sapiens
ugccagcauuuccc

SEQ ID NO: 825764 - RNA, 20 nt, Homo sapiens
ugcccaggcuggagugcagu

SEQ ID NO: 825765 - RNA, 17 nt, Homo sapiens
ugcccccaauccaugaa

SEQ ID NO: 825766 - RNA, 16 nt, Homo sapiens
ugccuuccaacugcca

SEQ ID NO: 825767 - RNA, 19 nt, Homo sapiens
ugcuccuugggcccuuuga

SEQ ID NO: 825768 - RNA, 18 nt, Homo sapiens
ugcuuuguagaacagagc

SEQ ID NO: 825769 - RNA, 21 nt, Homo sapiens
uggaauauuguccauugucca

SEQ ID NO: 825770 - RNA, 21 nt, Homo sapiens
uggauacagaaugaaucccau

SEQ ID NO: 825771 - RNA, 17 nt, Homo sapiens
uggcacuuauaaccaaa

SEQ ID NO: 825772 - RNA, 14 nt, Homo sapiens
ugguacaaggaaua

SEQ ID NO: 825773 - RNA, 21 nt, Homo sapiens
ugguauaaacguccuacugua

SEQ ID NO: 825774 - RNA, 22 nt, Homo sapiens
ugguauaaacguccuacuguau

SEQ ID NO: 825775 - RNA, 15 nt, Homo sapiens
uggugcgaucuuggc

SEQ ID NO: 825776 - RNA, 15 nt, Homo sapiens
ugguggagggccaca

SEQ ID NO: 825777 - RNA, 18 nt, Homo sapiens
ugguuuuucaguuuucag

SEQ ID NO: 825778 - RNA, 16 nt, Homo sapiens
uguacagucuuguauu

SEQ ID NO: 825779 - RNA, 18 nt, Homo sapiens
uguacuugccuuauuaga

SEQ ID NO: 825780 - RNA, 14 nt, Homo sapiens
ugucacaccugaaa

SEQ ID NO: 825781 - RNA, 19 nt, Homo sapiens
ugucacgccagacuuccca

SEQ ID NO: 825782 - RNA, 16 nt, Homo sapiens
ugucauagcuaugaca

SEQ ID NO: 825783 - RNA, 18 nt, Homo sapiens
ugugaaguuuaauugacu

SEQ ID NO: 825784 - RNA, 12 nt, Homo sapiens
ugugacuacuau

SEQ ID NO: 825785 - RNA, 16 nt, Homo sapiens
ugugcagugacuguag

SEQ ID NO: 825786 - RNA, 18 nt, Homo sapiens
ugugcucagagaccccuc

SEQ ID NO: 825787 - RNA, 15 nt, Homo sapiens
ugugggcuccaugua

SEQ ID NO: 825788 - RNA, 18 nt, Homo sapiens
uguggggugggcacauug

SEQ ID NO: 825789 - RNA, 14 nt, Homo sapiens
ugugugaccccaaa

SEQ ID NO: 825790 - RNA, 17 nt, Homo sapiens
uguguggggugggcaca

SEQ ID NO: 825791 - RNA, 13 nt, Homo sapiens
uguguuacauaca

SEQ ID NO: 825792 - RNA, 21 nt, Homo sapiens
uguucuuagcugaacaaugaa

SEQ ID NO: 825793 - RNA, 16 nt, Homo sapiens
uguugucacaccugaa

SEQ ID NO: 825794 - RNA, 19 nt, Homo sapiens
uguuuagaacuacugauaa

SEQ ID NO: 825795 - RNA, 14 nt, Homo sapiens
uuaaaaacaaacaa

SEQ ID NO: 825796 - RNA, 17 nt, Homo sapiens
uuaagaggggaaaacaa

SEQ ID NO: 825797 - RNA, 21 nt, Homo sapiens
uuaaggagaggagaaacugag

SEQ ID NO: 825798 - RNA, 22 nt, Homo sapiens
uuaaguuacacauuuuucagau

SEQ ID NO: 825799 - RNA, 23 nt, Homo sapiens
uuacaguaggagcccagcucuga

SEQ ID NO: 825800 - RNA, 14 nt, Homo sapiens
uuacauucauaucu

SEQ ID NO: 825801 - RNA, 22 nt, Homo sapiens
uuaccugaaauaaaauucauua

SEQ ID NO: 825802 - RNA, 13 nt, Homo sapiens
uuagagcacuuuu

SEQ ID NO: 825803 - RNA, 20 nt, Homo sapiens
uuagccuugcucaggugcaa

SEQ ID NO: 825804 - RNA, 14 nt, Homo sapiens
uuagcuaauaaaga

SEQ ID NO: 825805 - RNA, 15 nt, Homo sapiens
uuagugauggagcuu

SEQ ID NO: 825806 - RNA, 15 nt, Homo sapiens
uuauauucacuacuu

SEQ ID NO: 825807 - RNA, 18 nt, Homo sapiens
uuaucaccgugggcuccc

SEQ ID NO: 825808 - RNA, 23 nt, Homo sapiens
uuaugccaccugaauaaagaaug

SEQ ID NO: 825809 - RNA, 17 nt, Homo sapiens
uuauuaauuaaaccaga

SEQ ID NO: 825810 - RNA, 19 nt, Homo sapiens
uuauuagagugucuuucca

SEQ ID NO: 825811 - RNA, 16 nt, Homo sapiens
uucacaucuaaccuca

SEQ ID NO: 825812 - RNA, 16 nt, Homo sapiens
uucauaaguauuucaa

SEQ ID NO: 825813 - RNA, 11 nt, Homo sapiens
uuccaaaaaga

SEQ ID NO: 825814 - RNA, 15 nt, Homo sapiens
uuccaaccggcuuug

SEQ ID NO: 825815 - RNA, 21 nt, Homo sapiens
uuccuucaugaucaucacaau

SEQ ID NO: 825816 - RNA, 18 nt, Homo sapiens
uucgaauaaagugaauac

SEQ ID NO: 825817 - RNA, 15 nt, Homo sapiens
uucuaguucugccag

SEQ ID NO: 825818 - RNA, 20 nt, Homo sapiens
uucucauuucuguagccuga

SEQ ID NO: 825819 - RNA, 13 nt, Homo sapiens
uucuccuccaugg

SEQ ID NO: 825820 - RNA, 23 nt, Homo sapiens
uucuggcacugugacuacuaugg

SEQ ID NO: 825821 - RNA, 13 nt, Homo sapiens
uugcaaggcauuu

SEQ ID NO: 825822 - RNA, 21 nt, Homo sapiens
uugcacaaaguaagccucacc

SEQ ID NO: 825823 - RNA, 18 nt, Homo sapiens
uugccaugucuuguucag

SEQ ID NO: 825824 - RNA, 23 nt, Homo sapiens
uugcuggggcucgugcccugcau

SEQ ID NO: 825825 - RNA, 19 nt, Homo sapiens
uuggaauacuugaaaaccu

SEQ ID NO: 825826 - RNA, 18 nt, Homo sapiens
uuggcaugaaagugcgau

SEQ ID NO: 825827 - RNA, 20 nt, Homo sapiens
uugggauugagucugugcca

SEQ ID NO: 825828 - RNA, 18 nt, Homo sapiens
uuguguuacugcagugac

SEQ ID NO: 825829 - RNA, 19 nt, Homo sapiens
uuguucgccgcguggaaug

SEQ ID NO: 825830 - RNA, 14 nt, Homo sapiens
uuguuuaccagaga

SEQ ID NO: 825831 - RNA, 14 nt, Homo sapiens
uuuaaccagcaaca

SEQ ID NO: 825832 - RNA, 12 nt, Homo sapiens
uuucaauugcau

SEQ ID NO: 825833 - RNA, 19 nt, Homo sapiens
uuucagguuccaaucagaa

SEQ ID NO: 825834 - RNA, 16 nt, Homo sapiens
uuucccaacaccucuu

SEQ ID NO: 825835 - RNA, 19 nt, Homo sapiens
uuugaagguauaaccuuca

SEQ ID NO: 825836 - RNA, 12 nt, Homo sapiens
uuuguacauuau

SEQ ID NO: 825837 - RNA, 19 nt, Homo sapiens
uuuguucacuucgaugacu

SEQ ID NO: 825838 - RNA, 15 nt, Homo sapiens
uuuuagcucauguau

SEQ ID NO: 825839 - RNA, 23 nt, Homo sapiens
uuuucaauguuagccacagugua

SEQ ID NO: 825840 - RNA, 12 nt, Homo sapiens
uuuucugauuug

SEQ ID NO: 825841 - RNA, 18 nt, Homo sapiens
uuuugcacacuuugccau

SEQ ID NO: 825842 - RNA, 11 nt, Homo sapiens
uuuuugcucuu

SEQ ID NO: 825843 - RNA, 17 nt, Homo sapiens
cacagaagguccuggug

SEQ ID NO: 825844 - RNA, 16 nt, Homo sapiens
cacaucuaaccucauc

SEQ ID NO: 825845 - RNA, 19 nt, Homo sapiens
cacccaugccauagaaacu

SEQ ID NO: 825846 - RNA, 17 nt, Homo sapiens
cacgugcaaaaauguau

SEQ ID NO: 825847 - RNA, 15 nt, Homo sapiens
cacguucugcucauc

SEQ ID NO: 825848 - RNA, 16 nt, Homo sapiens
cacuaacaaacucuga

SEQ ID NO: 825849 - RNA, 21 nt, Homo sapiens
cacuagcaauaaaaugcuaau

SEQ ID NO: 825850 - RNA, 15 nt, Homo sapiens
cacugcuugaggaaa

SEQ ID NO: 825851 - RNA, 22 nt, Homo sapiens
cacuguuuaacugggagugaua

SEQ ID NO: 825852 - RNA, 16 nt, Homo sapiens
cagaaaacauaugcau

SEQ ID NO: 825853 - RNA, 17 nt, Homo sapiens
cagaaucaaaugcaauu

SEQ ID NO: 825854 - RNA, 12 nt, Homo sapiens
cagaccacugau

SEQ ID NO: 825855 - RNA, 16 nt, Homo sapiens
cagcaacauugaccca

SEQ ID NO: 825856 - RNA, 13 nt, Homo sapiens
cagcuuauauuca

SEQ ID NO: 825857 - RNA, 17 nt, Homo sapiens
cagcuuauauucaucca

SEQ ID NO: 825858 - RNA, 13 nt, Homo sapiens
caggcauugccaa

SEQ ID NO: 825859 - RNA, 17 nt, Homo sapiens
caggguguuaaggcagu

SEQ ID NO: 825860 - RNA, 22 nt, Homo sapiens
caggguguuaaggcagugacuu

SEQ ID NO: 825861 - RNA, 13 nt, Homo sapiens
cagucuuggaaua

SEQ ID NO: 825862 - RNA, 18 nt, Homo sapiens
caguggugcgaucuuggc

SEQ ID NO: 825863 - RNA, 13 nt, Homo sapiens
caguguacagucu

SEQ ID NO: 825864 - RNA, 20 nt, Homo sapiens
caguguuaaaugugaugaau

SEQ ID NO: 825865 - RNA, 22 nt, Homo sapiens
cauacgguaugauauugcagcu

SEQ ID NO: 825866 - RNA, 18 nt, Homo sapiens
cauauugaugugugucua

SEQ ID NO: 825867 - RNA, 22 nt, Homo sapiens
caucuaaccucaucuucuucac

SEQ ID NO: 825868 - RNA, 21 nt, Homo sapiens
caucucccagauaaugugaaa

SEQ ID NO: 825869 - RNA, 21 nt, Homo sapiens
caucuuucuuccaaacaggcu

SEQ ID NO: 825870 - RNA, 18 nt, Homo sapiens
caugaucaucacaaucau

SEQ ID NO: 825871 - RNA, 21 nt, Homo sapiens
cauggcagaaggcaaacccau

SEQ ID NO: 825872 - RNA, 16 nt, Homo sapiens
cauguaaacugugcac

SEQ ID NO: 825873 - RNA, 16 nt, Homo sapiens
caugucuuguucagaa

SEQ ID NO: 825874 - RNA, 20 nt, Homo sapiens
cauuauaugcacuagcaaua

SEQ ID NO: 825875 - RNA, 17 nt, Homo sapiens
cauuauuucaaccgcuu

SEQ ID NO: 825876 - RNA, 21 nt, Homo sapiens
cauucuuucccaacaccucuu

SEQ ID NO: 825877 - RNA, 22 nt, Homo sapiens
cauuuaguuugauuauucagug

SEQ ID NO: 825878 - RNA, 12 nt, Homo sapiens
cauuuccaugca

SEQ ID NO: 825879 - RNA, 15 nt, Homo sapiens
cauuuccaugcauaa

SEQ ID NO: 825880 - RNA, 22 nt, Homo sapiens
cauuucuauuucuccuccaugg

SEQ ID NO: 825881 - RNA, 21 nt, Homo sapiens
cauuucucuugcucaccaaga

SEQ ID NO: 825882 - RNA, 13 nt, Homo sapiens
ccaaagacuacac

SEQ ID NO: 825883 - RNA, 17 nt, Homo sapiens
ccaaagcuuucauguaa

SEQ ID NO: 825884 - RNA, 14 nt, Homo sapiens
ccaaagugguauag

SEQ ID NO: 825885 - RNA, 16 nt, Homo sapiens
ccaagaaguaacaaaa

SEQ ID NO: 825886 - RNA, 21 nt, Homo sapiens
ccaaguucuuaguugcuguau

SEQ ID NO: 825887 - RNA, 15 nt, Homo sapiens
ccacacuagcuugca

SEQ ID NO: 825888 - RNA, 14 nt, Homo sapiens
ccacaggacauuuc

SEQ ID NO: 825889 - RNA, 23 nt, Homo sapiens
ccacauccuccacguucugcuca

SEQ ID NO: 825890 - RNA, 20 nt, Homo sapiens
ccacggaccguugcacaaaa

SEQ ID NO: 825891 - RNA, 18 nt, Homo sapiens
ccagagcguguagugaau

SEQ ID NO: 825892 - RNA, 12 nt, Homo sapiens
ccaggaccaguc

SEQ ID NO: 825893 - RNA, 13 nt, Homo sapiens
cccagaaauguau

SEQ ID NO: 825894 - RNA, 17 nt, Homo sapiens
cccagaaauguauggca

SEQ ID NO: 825895 - RNA, 15 nt, Homo sapiens
ccccaggcauugcca

SEQ ID NO: 825896 - RNA, 14 nt, Homo sapiens
cccuaaaacaugug

SEQ ID NO: 825897 - RNA, 18 nt, Homo sapiens
cccuaagcagaccacuga

SEQ ID NO: 825898 - RNA, 18 nt, Homo sapiens
cccucaucuuucuuccaa

SEQ ID NO: 825899 - RNA, 16 nt, Homo sapiens
cccucuacuccaugca

SEQ ID NO: 825900 - RNA, 13 nt, Homo sapiens
cccuuaugaauug

SEQ ID NO: 825901 - RNA, 19 nt, Homo sapiens
ccgcaaaagacaagucuuu

SEQ ID NO: 825902 - RNA, 11 nt, Homo sapiens
ccguugcacaa

SEQ ID NO: 825903 - RNA, 19 nt, Homo sapiens
ccuacccccugugccuugu

SEQ ID NO: 825904 - RNA, 15 nt, Homo sapiens
ccuaggcuagggugg

SEQ ID NO: 825905 - RNA, 20 nt, Homo sapiens
ccucacuucuggcacuguga

SEQ ID NO: 825906 - RNA, 18 nt, Homo sapiens
ccucaucccgagcaccuc

SEQ ID NO: 825907 - RNA, 16 nt, Homo sapiens
ccuccugggcccucuc

SEQ ID NO: 825908 - RNA, 20 nt, Homo sapiens
ccucgagaucccaacacugc

SEQ ID NO: 825909 - RNA, 15 nt, Homo sapiens
ccucgcuggacucuc

SEQ ID NO: 825910 - RNA, 12 nt, Homo sapiens
ccucugacucag

SEQ ID NO: 825911 - RNA, 20 nt, Homo sapiens
ccugagguuugccagcauuu

SEQ ID NO: 825912 - RNA, 21 nt, Homo sapiens
ccugaucagagccgugguccu

SEQ ID NO: 825913 - RNA, 14 nt, Homo sapiens
ccugggcaaagccu

SEQ ID NO: 825914 - RNA, 19 nt, Homo sapiens
ccuggggagucugggcaca

SEQ ID NO: 825915 - RNA, 16 nt, Homo sapiens
ccuguaccugugcacg

SEQ ID NO: 825916 - RNA, 22 nt, Homo sapiens
ccuuagauguucuaagucuuuc

SEQ ID NO: 825917 - RNA, 13 nt, Homo sapiens
ccuuccaacugcc

SEQ ID NO: 825918 - RNA, 18 nt, Homo sapiens
ccuuucuucagacacuga

SEQ ID NO: 825919 - RNA, 15 nt, Homo sapiens
ccuuuuaguucuuag

SEQ ID NO: 825920 - RNA, 22 nt, Homo sapiens
cgaauaaagugaauacauuuug

SEQ ID NO: 825921 - RNA, 21 nt, Homo sapiens
cgaggcaaagagaaaagccac

SEQ ID NO: 825922 - RNA, 22 nt, Homo sapiens
cgcugagcgaggagaugcuccu

SEQ ID NO: 825923 - RNA, 14 nt, Homo sapiens
cgucagcugggaca

SEQ ID NO: 825924 - RNA, 15 nt, Homo sapiens
cgucagcugggacac

SEQ ID NO: 825925 - RNA, 15 nt, Homo sapiens
cuaaagcaauaugca

SEQ ID NO: 825926 - RNA, 23 nt, Homo sapiens
cuaauucugagggaauuuaacca

SEQ ID NO: 825927 - RNA, 14 nt, Homo sapiens
cuacugauaacgua

SEQ ID NO: 825928 - RNA, 14 nt, Homo sapiens
cuagggaucccuca

SEQ ID NO: 825929 - RNA, 21 nt, Homo sapiens
cuauauuuauuuauguaggau

SEQ ID NO: 825930 - RNA, 20 nt, Homo sapiens
cuaucuacugagacaugacu

SEQ ID NO: 825931 - RNA, 15 nt, Homo sapiens
cucaucuuucuucca

SEQ ID NO: 825932 - RNA, 23 nt, Homo sapiens
cuccacucaugugacucuuucca

SEQ ID NO: 825933 - RNA, 17 nt, Homo sapiens
cucccagauaaugugaa

SEQ ID NO: 825934 - RNA, 22 nt, Homo sapiens
cuccucuuucaaccucagugau

SEQ ID NO: 825935 - RNA, 15 nt, Homo sapiens
cuccugaagccacag

SEQ ID NO: 825936 - RNA, 13 nt, Homo sapiens
cucuauuaucuca

SEQ ID NO: 825937 - RNA, 17 nt, Homo sapiens
cucucacuauaccagua

SEQ ID NO: 825938 - RNA, 21 nt, Homo sapiens
cucucagucucugagcaguga

SEQ ID NO: 825939 - RNA, 15 nt, Homo sapiens
cucugaaaccagugu

SEQ ID NO: 825940 - RNA, 14 nt, Homo sapiens
cucugugaccaaug

SEQ ID NO: 825941 - RNA, 18 nt, Homo sapiens
cucugugggcuccaugua

SEQ ID NO: 825942 - RNA, 17 nt, Homo sapiens
cugaaauagagugaauu

SEQ ID NO: 825943 - RNA, 21 nt, Homo sapiens
cugaccaauauuguacaguuu

SEQ ID NO: 825944 - RNA, 22 nt, Homo sapiens
cugauuaccuccuguguggaag

SEQ ID NO: 825945 - RNA, 19 nt, Homo sapiens
cugcaccggggccugggca

SEQ ID NO: 825946 - RNA, 22 nt, Homo sapiens
cugcauuuauagcauacgguau

SEQ ID NO: 825947 - RNA, 13 nt, Homo sapiens
auagagccugagg

SEQ ID NO: 825948 - RNA, 18 nt, Homo sapiens
auauaugacuuuuucuca

SEQ ID NO: 825949 - RNA, 23 nt, Homo sapiens
auauaugauauauaaaugugauu

SEQ ID NO: 825950 - RNA, 14 nt, Homo sapiens
auaugcauuaugaa

SEQ ID NO: 825951 - RNA, 16 nt, Homo sapiens
auauucagaaaauacu

SEQ ID NO: 825952 - RNA, 20 nt, Homo sapiens
auauuuauauguacauacau

SEQ ID NO: 825953 - RNA, 19 nt, Homo sapiens
auauuuuaaaaucugucac

SEQ ID NO: 825954 - RNA, 15 nt, Homo sapiens
auauuuuugugcaca

SEQ ID NO: 825955 - RNA, 17 nt, Homo sapiens
auauuuuugugcacauu

SEQ ID NO: 825956 - RNA, 16 nt, Homo sapiens
aucaucaucauucuca

SEQ ID NO: 825957 - RNA, 13 nt, Homo sapiens
aucaucauucuca

SEQ ID NO: 825958 - RNA, 16 nt, Homo sapiens
aucauucucauucuca

SEQ ID NO: 825959 - RNA, 19 nt, Homo sapiens
auccagguaauccaagaua

SEQ ID NO: 825960 - RNA, 17 nt, Homo sapiens
auccaugaaccaagacc

SEQ ID NO: 825961 - RNA, 11 nt, Homo sapiens
aucccaugagc

SEQ ID NO: 825962 - RNA, 21 nt, Homo sapiens
auccuacccccugugccuugu

SEQ ID NO: 825963 - RNA, 18 nt, Homo sapiens
aucgcugccuugccaugu

SEQ ID NO: 825964 - RNA, 17 nt, Homo sapiens
aucuaaaucgguaaaua

SEQ ID NO: 825965 - RNA, 18 nt, Homo sapiens
aucuacugagacaugacu

SEQ ID NO: 825966 - RNA, 22 nt, Homo sapiens
aucucauuggacccuuccaugg

SEQ ID NO: 825967 - RNA, 15 nt, Homo sapiens
aucuuuagcuaauaa

SEQ ID NO: 825968 - RNA, 15 nt, Homo sapiens
aaaaauaaacucugc

SEQ ID NO: 825969 - RNA, 15 nt, Homo sapiens
aaaacacugugcaca

SEQ ID NO: 825970 - RNA, 22 nt, Homo sapiens
aaaacauaugcauuaugaaguu

SEQ ID NO: 825971 - RNA, 14 nt, Homo sapiens
aaaagacugaccaa

SEQ ID NO: 825972 - RNA, 18 nt, Homo sapiens
aaaauacaugacauuuau

SEQ ID NO: 825973 - RNA, 18 nt, Homo sapiens
aaaauagagccugaggga

SEQ ID NO: 825974 - RNA, 14 nt, Homo sapiens
aaaauagcacauga

SEQ ID NO: 825975 - RNA, 18 nt, Homo sapiens
aaaauuauuugcauaaca

SEQ ID NO: 825976 - RNA, 17 nt, Homo sapiens
aaacaaauguauuucaa

SEQ ID NO: 825977 - RNA, 12 nt, Homo sapiens
aaacaacucuuu

SEQ ID NO: 825978 - RNA, 15 nt, Homo sapiens
aaagacuacacuguu

SEQ ID NO: 825979 - RNA, 21 nt, Homo sapiens
aaagauaaccaguuuuugcag

SEQ ID NO: 825980 - RNA, 17 nt, Homo sapiens
aaagcuauauguuguaa

SEQ ID NO: 825981 - RNA, 17 nt, Homo sapiens
aaaguuugggaagggau

SEQ ID NO: 825982 - RNA, 17 nt, Homo sapiens
aaauagagccugaggga

SEQ ID NO: 825983 - RNA, 23 nt, Homo sapiens
aaauauagagcauuaacaaagua

SEQ ID NO: 825984 - RNA, 16 nt, Homo sapiens
aaaugcugguuuuuca

SEQ ID NO: 825985 - RNA, 22 nt, Homo sapiens
aaaugcuuuguagaacagagca

SEQ ID NO: 825986 - RNA, 22 nt, Homo sapiens
aaaugguccaggagaaggccaa

SEQ ID NO: 825987 - RNA, 13 nt, Homo sapiens
aaaugugaugaau

SEQ ID NO: 825988 - RNA, 13 nt, Homo sapiens
aaauuacauuaaa

SEQ ID NO: 825989 - RNA, 15 nt, Homo sapiens
aaauuguacauuuga

SEQ ID NO: 825990 - RNA, 15 nt, Homo sapiens
aaauuguauuaucaa

SEQ ID NO: 825991 - RNA, 22 nt, Homo sapiens
aaauuguauuaucaacagcauu

SEQ ID NO: 825992 - RNA, 20 nt, Homo sapiens
aacauaugcauuaugaaguu

SEQ ID NO: 825993 - RNA, 18 nt, Homo sapiens
aacauggauuccacugaa

SEQ ID NO: 825994 - RNA, 12 nt, Homo sapiens
aaccagcaacau

SEQ ID NO: 825995 - RNA, 14 nt, Homo sapiens
aaccggcuuugugg

SEQ ID NO: 825996 - RNA, 21 nt, Homo sapiens
aaccggcuuuguggcacuggg

SEQ ID NO: 825997 - RNA, 15 nt, Homo sapiens
aacuacuggcaauuu

SEQ ID NO: 825998 - RNA, 18 nt, Homo sapiens
aacuccccuuguacucuu

SEQ ID NO: 825999 - RNA, 22 nt, Homo sapiens
aacuccuuguaggucugcagau

SEQ ID NO: 826000 - RNA, 16 nt, Homo sapiens
aacuuacuuaguguua

SEQ ID NO: 826001 - RNA, 19 nt, Homo sapiens
aacuuggauguaccugccc

SEQ ID NO: 826002 - RNA, 16 nt, Homo sapiens
cccaauucacaucuaa

SEQ ID NO: 826003 - RNA, 19 nt, Homo sapiens
cccagaaauguauggcaug

SEQ ID NO: 826004 - RNA, 11 nt, Homo sapiens
cccagcacugc

SEQ ID NO: 826005 - RNA, 17 nt, Homo sapiens
cccccggagcagggguc

SEQ ID NO: 826006 - RNA, 17 nt, Homo sapiens
ccccugugccuugucac

SEQ ID NO: 826007 - RNA, 17 nt, Homo sapiens
cccuguaccugugcacg

SEQ ID NO: 826008 - RNA, 20 nt, Homo sapiens
ccgggaagagggugauugcu

SEQ ID NO: 826009 - RNA, 11 nt, Homo sapiens
ccgggacaccu

SEQ ID NO: 826010 - RNA, 22 nt, Homo sapiens
ccgugcucgcccacaaacugau

SEQ ID NO: 826011 - RNA, 16 nt, Homo sapiens
ccguugcacaaaaagg

SEQ ID NO: 826012 - RNA, 20 nt, Homo sapiens
ccuaaagaggaaaagugcaa

SEQ ID NO: 826013 - RNA, 18 nt, Homo sapiens
ccuaagcagaccacugau

SEQ ID NO: 826014 - RNA, 16 nt, Homo sapiens
ccucacuucuggcacu

SEQ ID NO: 826015 - RNA, 16 nt, Homo sapiens
ccucaucuuucuucca

SEQ ID NO: 826016 - RNA, 14 nt, Homo sapiens
ccucauuuaccaua

SEQ ID NO: 826017 - RNA, 22 nt, Homo sapiens
ccucuccacucaugugacucuu

SEQ ID NO: 826018 - RNA, 17 nt, Homo sapiens
ccugaaaauuaugaguc

SEQ ID NO: 826019 - RNA, 17 nt, Homo sapiens
ccugcaaaaggacucuc

SEQ ID NO: 826020 - RNA, 22 nt, Homo sapiens
ccuuaaaaugugagugaccuca

SEQ ID NO: 826021 - RNA, 13 nt, Homo sapiens
ccuuaaggcucuu

SEQ ID NO: 826022 - RNA, 22 nt, Homo sapiens
ccuuuggacuugucccgggaca

SEQ ID NO: 826023 - RNA, 14 nt, Homo sapiens
gagaguccaucagc

SEQ ID NO: 826024 - RNA, 16 nt, Homo sapiens
gagaucccaacacugc

SEQ ID NO: 826025 - RNA, 17 nt, Homo sapiens
gagcaggguuagcucac

SEQ ID NO: 826026 - RNA, 21 nt, Homo sapiens
gagcagugaaugauucagugu

SEQ ID NO: 826027 - RNA, 14 nt, Homo sapiens
gaggagaaacugag

SEQ ID NO: 826028 - RNA, 17 nt, Homo sapiens
gagggccacaugggagg

SEQ ID NO: 826029 - RNA, 21 nt, Homo sapiens
gauaaaucaguuaugucaauu

SEQ ID NO: 826030 - RNA, 15 nt, Homo sapiens
gauacagaacucuuu

SEQ ID NO: 826031 - RNA, 16 nt, Homo sapiens
gauacagaaugaaucc

SEQ ID NO: 826032 - RNA, 19 nt, Homo sapiens
gauauaugacuuuuucuca

SEQ ID NO: 826033 - RNA, 20 nt, Homo sapiens
gauauaugacuuuuucucag

SEQ ID NO: 826034 - RNA, 9 nt, Homo sapiens
gauggagcu

SEQ ID NO: 826035 - RNA, 16 nt, Homo sapiens
gauuuugcuguagaag

SEQ ID NO: 826036 - RNA, 19 nt, Homo sapiens
gcaaaauacaugacauuua

SEQ ID NO: 826037 - RNA, 14 nt, Homo sapiens
gcaacauugaccca

SEQ ID NO: 826038 - RNA, 23 nt, Homo sapiens
gcaaggaaacuauguaacaugua

SEQ ID NO: 826039 - RNA, 17 nt, Homo sapiens
gcaaucaaacgaagaca

SEQ ID NO: 826040 - RNA, 13 nt, Homo sapiens
gcacagccuggcu

SEQ ID NO: 826041 - RNA, 18 nt, Homo sapiens
gcacccaugccauagaaa

SEQ ID NO: 826042 - RNA, 20 nt, Homo sapiens
gcacuguucccccugugcag

SEQ ID NO: 826043 - RNA, 21 nt, Homo sapiens
gcagaccacugauaaaaccau

SEQ ID NO: 826044 - RNA, 14 nt, Homo sapiens
aaaaaguauaggau

SEQ ID NO: 826045 - RNA, 21 nt, Homo sapiens
aaaaauaaacucugcacuuau

SEQ ID NO: 826046 - RNA, 13 nt, Homo sapiens
cugagcugugcag

SEQ ID NO: 826047 - RNA, 19 nt, Homo sapiens
cugagggaauuuaaccagc

SEQ ID NO: 826048 - RNA, 18 nt, Homo sapiens
cugauguuuaaaagucca

SEQ ID NO: 826049 - RNA, 16 nt, Homo sapiens
cugccagcauuucccu

SEQ ID NO: 826050 - RNA, 13 nt, Homo sapiens
cuggagugcagug

SEQ ID NO: 826051 - RNA, 20 nt, Homo sapiens
cuggagugcaguggugcgau

SEQ ID NO: 826052 - RNA, 19 nt, Homo sapiens
cugggacugugcucagaga

SEQ ID NO: 826053 - RNA, 22 nt, Homo sapiens
cugggagugauaugauguguag

SEQ ID NO: 826054 - RNA, 18 nt, Homo sapiens
cuguaccugugcacguug

SEQ ID NO: 826055 - RNA, 16 nt, Homo sapiens
cuguauuaagccacuu

SEQ ID NO: 826056 - RNA, 20 nt, Homo sapiens
cugucaaagaaaacuuccaa

SEQ ID NO: 826057 - RNA, 19 nt, Homo sapiens
cugucacguagaacuugga

SEQ ID NO: 826058 - RNA, 13 nt, Homo sapiens
cuguuuagaacua

SEQ ID NO: 826059 - RNA, 22 nt, Homo sapiens
cuuaagacgugauuuugcugua

SEQ ID NO: 826060 - RNA, 22 nt, Homo sapiens
cuuaugaauugaugacuauaua

SEQ ID NO: 826061 - RNA, 18 nt, Homo sapiens
cuuccauuugcaagggaa

SEQ ID NO: 826062 - RNA, 12 nt, Homo sapiens
cuucccacggcu

SEQ ID NO: 826063 - RNA, 21 nt, Homo sapiens
cuucccacggcuccucgagau

SEQ ID NO: 826064 - RNA, 15 nt, Homo sapiens
cuuccucuccugucu

SEQ ID NO: 826065 - RNA, 13 nt, Homo sapiens
cuucugcuucuca

SEQ ID NO: 826066 - RNA, 16 nt, Homo sapiens
cuucuguaugugacaa

SEQ ID NO: 826067 - RNA, 10 nt, Homo sapiens
cuugcugaug

SEQ ID NO: 826068 - RNA, 13 nt, Homo sapiens
cuugggcucccug

SEQ ID NO: 826069 - RNA, 15 nt, Homo sapiens
cuuuacauauauaug

SEQ ID NO: 826070 - RNA, 22 nt, Homo sapiens
cuuuaguuuuugugaaguuuaa

SEQ ID NO: 826071 - RNA, 20 nt, Homo sapiens
cuuuccaaaaccuaaagagg

SEQ ID NO: 826072 - RNA, 16 nt, Homo sapiens
cuuugagugacugggu

SEQ ID NO: 826073 - RNA, 16 nt, Homo sapiens
cuuuguggcacugggg

SEQ ID NO: 826074 - RNA, 17 nt, Homo sapiens
cuuuugacaaaggcaag

SEQ ID NO: 826075 - RNA, 17 nt, Homo sapiens
cuuuuguuuaccagaga

SEQ ID NO: 826076 - RNA, 22 nt, Homo sapiens
cuuuuuuuugagaauacacuau

SEQ ID NO: 826077 - RNA, 14 nt, Homo sapiens
gaaaaaaguauagg

SEQ ID NO: 826078 - RNA, 12 nt, Homo sapiens
gaaaacauaugc

SEQ ID NO: 826079 - RNA, 13 nt, Homo sapiens
gaaaacaugacuu

SEQ ID NO: 826080 - RNA, 16 nt, Homo sapiens
gaaaagaaagcugcuu

SEQ ID NO: 826081 - RNA, 14 nt, Homo sapiens
gaaaauuauuugca

SEQ ID NO: 826082 - RNA, 22 nt, Homo sapiens
gaaacaacaauuucuacuuuga

SEQ ID NO: 826083 - RNA, 13 nt, Homo sapiens
gaaacaacucuuu

SEQ ID NO: 826084 - RNA, 21 nt, Homo sapiens
gaacacauucugcuaugaauu

SEQ ID NO: 826085 - RNA, 12 nt, Homo sapiens
gaaugucucagc

SEQ ID NO: 826086 - RNA, 23 nt, Homo sapiens
gaauugcuaauucugagggaauu

SEQ ID NO: 826087 - RNA, 12 nt, Homo sapiens
gaauuugagugc

SEQ ID NO: 826088 - RNA, 21 nt, Homo sapiens
gaccaauauuguacaguuuuu

SEQ ID NO: 826089 - RNA, 11 nt, Homo sapiens
gacugauuacc

SEQ ID NO: 826090 - RNA, 20 nt, Homo sapiens
gacuggguuuugugauugcc

SEQ ID NO: 826091 - RNA, 16 nt, Homo sapiens
gagagccaccaagagg

SEQ ID NO: 826092 - RNA, 20 nt, Homo sapiens
gagaguccaucagccuccau

SEQ ID NO: 826093 - RNA, 17 nt, Homo sapiens
gagauuaccuccugaga

SEQ ID NO: 826094 - RNA, 18 nt, Homo sapiens
gagauucuugugccucag

SEQ ID NO: 826095 - RNA, 16 nt, Homo sapiens
gagccgggagccugac

SEQ ID NO: 826096 - RNA, 20 nt, Homo sapiens
gagcucuggcuuugcaaggg

SEQ ID NO: 826097 - RNA, 21 nt, Homo sapiens
gagcuucccugacucauucug

SEQ ID NO: 826098 - RNA, 14 nt, Homo sapiens
gagucucuguauaa

SEQ ID NO: 826099 - RNA, 23 nt, Homo sapiens
gagugucuuuccacggagccacu

SEQ ID NO: 826100 - RNA, 20 nt, Homo sapiens
gauaaaucaguuaugucaau

SEQ ID NO: 826101 - RNA, 18 nt, Homo sapiens
gauaaucucuccauuccc

SEQ ID NO: 826102 - RNA, 13 nt, Homo sapiens
gauagcaggugaa

SEQ ID NO: 826103 - RNA, 12 nt, Homo sapiens
gaucccaugagc

SEQ ID NO: 826104 - RNA, 22 nt, Homo sapiens
gauguuuguacuuuuguguuac

SEQ ID NO: 826105 - RNA, 13 nt, Homo sapiens
gauuauucagugu

SEQ ID NO: 826106 - RNA, 20 nt, Homo sapiens
gauuugcacccaugccauag

SEQ ID NO: 826107 - RNA, 18 nt, Homo sapiens
gcaaaauacaugacauuu

SEQ ID NO: 826108 - RNA, 16 nt, Homo sapiens
gcaaagagaaaagcca

SEQ ID NO: 826109 - RNA, 16 nt, Homo sapiens
gcaaggaaacuaugua

SEQ ID NO: 826110 - RNA, 15 nt, Homo sapiens
gcaccuacaguguac

SEQ ID NO: 826111 - RNA, 20 nt, Homo sapiens
gcagggaaggaucccaugag

SEQ ID NO: 826112 - RNA, 20 nt, Homo sapiens
gcauacgguaugauauugca

SEQ ID NO: 826113 - RNA, 23 nt, Homo sapiens
gcauacgguaugauauugcagcu

SEQ ID NO: 826114 - RNA, 18 nt, Homo sapiens
gcaucaaccuacuuagaa

SEQ ID NO: 826115 - RNA, 16 nt, Homo sapiens
gccacuauuacuggga

SEQ ID NO: 826116 - RNA, 21 nt, Homo sapiens
gccagcauuucccuuccuucc

SEQ ID NO: 826117 - RNA, 19 nt, Homo sapiens
gcccaggcuggagugcagu

SEQ ID NO: 826118 - RNA, 19 nt, Homo sapiens
gccccaggcauugccaagg

SEQ ID NO: 826119 - RNA, 16 nt, Homo sapiens
gcccgggagcucagga

SEQ ID NO: 826120 - RNA, 21 nt, Homo sapiens
gccgagaguccaucagccucc

SEQ ID NO: 826121 - RNA, 17 nt, Homo sapiens
gcgaaaaaaucagugaa

SEQ ID NO: 826122 - RNA, 19 nt, Homo sapiens
gcgaagcguuguccucagc

SEQ ID NO: 826123 - RNA, 13 nt, Homo sapiens
gcgagguguaaag

SEQ ID NO: 826124 - RNA, 15 nt, Homo sapiens
gcucaucauucucug

SEQ ID NO: 826125 - RNA, 20 nt, Homo sapiens
gcuccauguagaagccacua

SEQ ID NO: 826126 - RNA, 21 nt, Homo sapiens
gcuccccacgucagcugggac

SEQ ID NO: 826127 - RNA, 19 nt, Homo sapiens
gcugccuuuggacuugucc

SEQ ID NO: 826128 - RNA, 20 nt, Homo sapiens
gcuggagugcaguggugcga

SEQ ID NO: 826129 - RNA, 16 nt, Homo sapiens
gcuguggcauccagag

SEQ ID NO: 826130 - RNA, 21 nt, Homo sapiens
gcuguuuagaacuacugauaa

SEQ ID NO: 826131 - RNA, 21 nt, Homo sapiens
gcuuagacuaaggccauuauu

SEQ ID NO: 826132 - RNA, 17 nt, Homo sapiens
ggaagagggugauugcu

SEQ ID NO: 826133 - RNA, 15 nt, Homo sapiens
ggaaguuuguucacu

SEQ ID NO: 826134 - RNA, 20 nt, Homo sapiens
ggaccagccucuccacucau

SEQ ID NO: 826135 - RNA, 15 nt, Homo sapiens
ggcaaagccuaguga

SEQ ID NO: 826136 - RNA, 20 nt, Homo sapiens
ggcagucugagagaggccau

SEQ ID NO: 826137 - RNA, 16 nt, Homo sapiens
ggccauucuuucccaa

SEQ ID NO: 826138 - RNA, 15 nt, Homo sapiens
ggcuucccaggggaa

SEQ ID NO: 826139 - RNA, 18 nt, Homo sapiens
gggagccugacccucauc

SEQ ID NO: 826140 - RNA, 21 nt, Homo sapiens
gggcacggcuucccaggggaa

SEQ ID NO: 826141 - RNA, 18 nt, Homo sapiens
gguaauuaguaacaugug

SEQ ID NO: 826142 - RNA, 14 nt, Homo sapiens
gguaugauauugca

SEQ ID NO: 826143 - RNA, 23 nt, Homo sapiens
ggugcuacacccuuuuccagcug

SEQ ID NO: 826144 - RNA, 17 nt, Homo sapiens
gguguguguuacauaca

SEQ ID NO: 826145 - RNA, 21 nt, Homo sapiens
guaccuucaaacuagggccaa

SEQ ID NO: 826146 - RNA, 23 nt, Homo sapiens
guacuuacaucuuuguuuaccau

SEQ ID NO: 826147 - RNA, 17 nt, Homo sapiens
guagaagccacuauuac

SEQ ID NO: 826148 - RNA, 15 nt, Homo sapiens
guauuaaguuguuaa

SEQ ID NO: 826149 - RNA, 18 nt, Homo sapiens
guauuuuuucacuuguac

SEQ ID NO: 826150 - RNA, 15 nt, Homo sapiens
gucauagcuaugaca

SEQ ID NO: 826151 - RNA, 14 nt, Homo sapiens
ugcuuaaucuugcu

SEQ ID NO: 826152 - RNA, 14 nt, Homo sapiens
ugcuuguuauuaga

SEQ ID NO: 826153 - RNA, 21 nt, Homo sapiens
uggaauacuugaaaaccucau

SEQ ID NO: 826154 - RNA, 17 nt, Homo sapiens
uggaccagccucuccac

SEQ ID NO: 826155 - RNA, 18 nt, Homo sapiens
uggagugcaguggugcga

SEQ ID NO: 826156 - RNA, 15 nt, Homo sapiens
uggcaaggugacauu

SEQ ID NO: 826157 - RNA, 23 nt, Homo sapiens
uggcaugaaagugcgauaacuua

SEQ ID NO: 826158 - RNA, 13 nt, Homo sapiens
ugggcagagccca

SEQ ID NO: 826159 - RNA, 14 nt, Homo sapiens
ugggcagagcccaa

SEQ ID NO: 826160 - RNA, 16 nt, Homo sapiens
ugggcccuuugagugc

SEQ ID NO: 826161 - RNA, 16 nt, Homo sapiens
uggggugggcacauug

SEQ ID NO: 826162 - RNA, 14 nt, Homo sapiens
uguacagucuugua

SEQ ID NO: 826163 - RNA, 14 nt, Homo sapiens
uguaccugugcacg

SEQ ID NO: 826164 - RNA, 15 nt, Homo sapiens
uguaccugugcacgu

SEQ ID NO: 826165 - RNA, 20 nt, Homo sapiens
uguacuuuuggcaugaaagu

SEQ ID NO: 826166 - RNA, 15 nt, Homo sapiens
uguaucaaaugugac

SEQ ID NO: 826167 - RNA, 16 nt, Homo sapiens
uguaucaaaugugaca

SEQ ID NO: 826168 - RNA, 18 nt, Homo sapiens
uguaucaaaugugacauu

SEQ ID NO: 826169 - RNA, 21 nt, Homo sapiens
ugucaaagaaaacuuccaaaa

SEQ ID NO: 826170 - RNA, 22 nt, Homo sapiens
ugucaaagaaaacuuccaaaaa

SEQ ID NO: 826171 - RNA, 15 nt, Homo sapiens
ugucauagcuaugac

SEQ ID NO: 826172 - RNA, 23 nt, Homo sapiens
ugucucgugguaggacuguagaa

SEQ ID NO: 826173 - RNA, 22 nt, Homo sapiens
ugucuuugacuugguuaaagga

SEQ ID NO: 826174 - RNA, 20 nt, Homo sapiens
ugugaccaaugucuugaugc

SEQ ID NO: 826175 - RNA, 14 nt, Homo sapiens
ugugacuacuaugg

SEQ ID NO: 826176 - RNA, 15 nt, Homo sapiens
ugugacucuuuccaa

SEQ ID NO: 826177 - RNA, 11 nt, Homo sapiens
ugugcacauuu

SEQ ID NO: 826178 - RNA, 14 nt, Homo sapiens
uguguuacauacac

SEQ ID NO: 826179 - RNA, 20 nt, Homo sapiens
uguuaauaaaaguacauguu

SEQ ID NO: 826180 - RNA, 10 nt, Homo sapiens
uguuacauac

SEQ ID NO: 826181 - RNA, 16 nt, Homo sapiens
uguucccccugugcag

SEQ ID NO: 826182 - RNA, 22 nt, Homo sapiens
uguucuaagucuuuccauugga

SEQ ID NO: 826183 - RNA, 15 nt, Homo sapiens
uguucuuagcugaac

SEQ ID NO: 826184 - RNA, 17 nt, Homo sapiens
uguuguacauacagagg

SEQ ID NO: 826185 - RNA, 21 nt, Homo sapiens
uuaaaucaacgaguacuucaa

SEQ ID NO: 826186 - RNA, 21 nt, Homo sapiens
uuaacaauuaauuuucuauga

SEQ ID NO: 826187 - RNA, 16 nt, Homo sapiens
uuaauuuuauuccagu

SEQ ID NO: 826188 - RNA, 10 nt, Homo sapiens
uuacauacac

SEQ ID NO: 826189 - RNA, 16 nt, Homo sapiens
uuaccagagaaaaagg

SEQ ID NO: 826190 - RNA, 23 nt, Homo sapiens
uuagauguucuaagucuuuccau

SEQ ID NO: 826191 - RNA, 22 nt, Homo sapiens
uuaucaccgugggcucccugac

SEQ ID NO: 826192 - RNA, 15 nt, Homo sapiens
uucacuuuugacaaa

SEQ ID NO: 826193 - RNA, 15 nt, Homo sapiens
uucaugaucaucaca

SEQ ID NO: 826194 - RNA, 21 nt, Homo sapiens
uuccacugaaauagagugaau

SEQ ID NO: 826195 - RNA, 22 nt, Homo sapiens
uucccagcuaccagcuaugcca

SEQ ID NO: 826196 - RNA, 22 nt, Homo sapiens
uuccccucuacuccaugcacau

SEQ ID NO: 826197 - RNA, 16 nt, Homo sapiens
uuccccuuccacugag

SEQ ID NO: 826198 - RNA, 16 nt, Homo sapiens
uuccuuaaaaugugag

SEQ ID NO: 826199 - RNA, 22 nt, Homo sapiens
uucuccuguugcaaugacacau

SEQ ID NO: 826200 - RNA, 12 nt, Homo sapiens
uucuggcacugu

SEQ ID NO: 826201 - RNA, 20 nt, Homo sapiens
uucuggcacugugacuacua

SEQ ID NO: 826202 - RNA, 17 nt, Homo sapiens
uucuuccaaacaggcuc

SEQ ID NO: 826203 - RNA, 18 nt, Homo sapiens
uugagaauacacuaucaa

SEQ ID NO: 826204 - RNA, 13 nt, Homo sapiens
uugcacaaaaagg

SEQ ID NO: 826205 - RNA, 16 nt, Homo sapiens
uugccuggaagcacau

SEQ ID NO: 826206 - RNA, 21 nt, Homo sapiens
uuggaacuuuuauuacugggg

SEQ ID NO: 826207 - RNA, 20 nt, Homo sapiens
uuggcuaucuacugagacau

SEQ ID NO: 826208 - RNA, 18 nt, Homo sapiens
uuggcuuguuuggagcau

SEQ ID NO: 826209 - RNA, 13 nt, Homo sapiens
uuguacucuugcu

SEQ ID NO: 826210 - RNA, 12 nt, Homo sapiens
uugugauugccu

SEQ ID NO: 826211 - RNA, 23 nt, Homo sapiens
uuuaaauacagucuuccauuugc

SEQ ID NO: 826212 - RNA, 22 nt, Homo sapiens
uuuaaaucaacgaguacuucaa

SEQ ID NO: 826213 - RNA, 21 nt, Homo sapiens
uuuaccugaaauaaaauucau

SEQ ID NO: 826214 - RNA, 16 nt, Homo sapiens
uuuauauguacauaca

SEQ ID NO: 826215 - RNA, 18 nt, Homo sapiens
uuucaaccgcuugccaua

SEQ ID NO: 826216 - RNA, 13 nt, Homo sapiens
uuucauacauuau

SEQ ID NO: 826217 - RNA, 22 nt, Homo sapiens
uuucauacauuauauuccucua

SEQ ID NO: 826218 - RNA, 15 nt, Homo sapiens
uuucccaacaccucu

SEQ ID NO: 826219 - RNA, 22 nt, Homo sapiens
uuucuacuuugaagucauacca

SEQ ID NO: 826220 - RNA, 19 nt, Homo sapiens
uuugagugucuuugacuug

SEQ ID NO: 826221 - RNA, 17 nt, Homo sapiens
uuugauuaaagacucca

SEQ ID NO: 826222 - RNA, 16 nt, Homo sapiens
uuugcacccaugccau

SEQ ID NO: 826223 - RNA, 11 nt, Homo sapiens
uuugcuguaga

SEQ ID NO: 826224 - RNA, 12 nt, Homo sapiens
uuugcuguagaa

SEQ ID NO: 826225 - RNA, 12 nt, Homo sapiens
uuuucacuugua

SEQ ID NO: 826226 - RNA, 13 nt, Homo sapiens
uuuugcuguagaa

SEQ ID NO: 826227 - RNA, 18 nt, Homo sapiens
uuuuuguucaaagccagc

SEQ ID NO: 826228 - RNA, 21 nt, Homo sapiens
uacuuugaagucauaccaaug

SEQ ID NO: 826229 - RNA, 22 nt, Homo sapiens
uagaagccacuauuacugggac

SEQ ID NO: 826230 - RNA, 15 nt, Homo sapiens
uagagaauagcuuua

SEQ ID NO: 826231 - RNA, 14 nt, Homo sapiens
uagauuuuugcucu

SEQ ID NO: 826232 - RNA, 21 nt, Homo sapiens
uaggaucugucaaagaaaacu

SEQ ID NO: 826233 - RNA, 20 nt, Homo sapiens
uagucaagugcguccacgag

SEQ ID NO: 826234 - RNA, 17 nt, Homo sapiens
uagugaaucacguaaag

SEQ ID NO: 826235 - RNA, 16 nt, Homo sapiens
uaguucugccaggaga

SEQ ID NO: 826236 - RNA, 12 nt, Homo sapiens
uaguugcuguau

SEQ ID NO: 826237 - RNA, 23 nt, Homo sapiens
uauaaagauacagaacucuuuca

SEQ ID NO: 826238 - RNA, 21 nt, Homo sapiens
uauaaaugugauugcagcuuu

SEQ ID NO: 826239 - RNA, 16 nt, Homo sapiens
uauagaaaugcugguu

SEQ ID NO: 826240 - RNA, 21 nt, Homo sapiens
uauauaaaugugauugcagcu

SEQ ID NO: 826241 - RNA, 20 nt, Homo sapiens
uauauauuuuugugcacauu

SEQ ID NO: 826242 - RNA, 14 nt, Homo sapiens
uauauguacauaca

SEQ ID NO: 826243 - RNA, 16 nt, Homo sapiens
uauauucauccaugcc

SEQ ID NO: 826244 - RNA, 19 nt, Homo sapiens
uauauuguauuaagggcau

SEQ ID NO: 826245 - RNA, 13 nt, Homo sapiens
uauauuuccuuaa

SEQ ID NO: 826246 - RNA, 23 nt, Homo sapiens
uaugagucucuaugaucuuggca

SEQ ID NO: 826247 - RNA, 13 nt, Homo sapiens
uauguaacaugua

SEQ ID NO: 826248 - RNA, 13 nt, Homo sapiens
uauuaaccugaau

SEQ ID NO: 826249 - RNA, 15 nt, Homo sapiens
uauuaagccacuuaa

SEQ ID NO: 826250 - RNA, 15 nt, Homo sapiens
uauuaaggugucaua

SEQ ID NO: 826251 - RNA, 16 nt, Homo sapiens
uauuaauuaaaccaga

SEQ ID NO: 826252 - RNA, 16 nt, Homo sapiens
uauuguuucaauugca

SEQ ID NO: 826253 - RNA, 21 nt, Homo sapiens
uauuuauagucgaacaauuca

SEQ ID NO: 826254 - RNA, 17 nt, Homo sapiens
uauuucaaccgcuugcc

SEQ ID NO: 826255 - RNA, 21 nt, Homo sapiens
uauuucaaccgcuugccauau

SEQ ID NO: 826256 - RNA, 15 nt, Homo sapiens
uauuuuaagacguga

SEQ ID NO: 826257 - RNA, 14 nt, Homo sapiens
uauuuuugugcaca

SEQ ID NO: 826258 - RNA, 14 nt, Homo sapiens
ucaaacuacuggca

SEQ ID NO: 826259 - RNA, 17 nt, Homo sapiens
ucaaagaaaacuuccaa

SEQ ID NO: 826260 - RNA, 14 nt, Homo sapiens
ucaaagcacuguuu

SEQ ID NO: 826261 - RNA, 16 nt, Homo sapiens
ucaaccgcuugccaua

SEQ ID NO: 826262 - RNA, 22 nt, Homo sapiens
ucacaaucaucaucauucucau

SEQ ID NO: 826263 - RNA, 23 nt, Homo sapiens
ucacgugucuuuagaacuccagu

SEQ ID NO: 826264 - RNA, 16 nt, Homo sapiens
ucagacuuacuuacuc

SEQ ID NO: 826265 - RNA, 18 nt, Homo sapiens
ucaggguguuaaggcagu

SEQ ID NO: 826266 - RNA, 13 nt, Homo sapiens
ucagucucugagc

SEQ ID NO: 826267 - RNA, 16 nt, Homo sapiens
ucaucaugugugucca

SEQ ID NO: 826268 - RNA, 21 nt, Homo sapiens
ucaucccgagcaccuccacau

SEQ ID NO: 826269 - RNA, 16 nt, Homo sapiens
ucaugugacucuuucc

SEQ ID NO: 826270 - RNA, 17 nt, Homo sapiens
ucaugugacucuuucca

SEQ ID NO: 826271 - RNA, 18 nt, Homo sapiens
ucaugugacucuuuccaa

SEQ ID NO: 826272 - RNA, 23 nt, Homo sapiens
ucauguguguccacgacugucuc

SEQ ID NO: 826273 - RNA, 15 nt, Homo sapiens
ucauucucauucuca

SEQ ID NO: 826274 - RNA, 19 nt, Homo sapiens
ucauuuuguuauagaaacu

SEQ ID NO: 826275 - RNA, 23 nt, Homo sapiens
uccacggagccacuccucugacu

SEQ ID NO: 826276 - RNA, 18 nt, Homo sapiens
uccagagucccugccugg

SEQ ID NO: 826277 - RNA, 16 nt, Homo sapiens
uccaggagaaggccaa

SEQ ID NO: 826278 - RNA, 10 nt, Homo sapiens
ucccaugagc

SEQ ID NO: 826279 - RNA, 12 nt, Homo sapiens
ucccccacugau

SEQ ID NO: 826280 - RNA, 20 nt, Homo sapiens
ucccgggacaccuaggcuag

SEQ ID NO: 826281 - RNA, 19 nt, Homo sapiens
ucccuucgauauaugacuu

SEQ ID NO: 826282 - RNA, 22 nt, Homo sapiens
uccgaggcaaagagaaaagcca

SEQ ID NO: 826283 - RNA, 18 nt, Homo sapiens
uccuacuguaugugggaa

SEQ ID NO: 826284 - RNA, 18 nt, Homo sapiens
uccuccagaauggagcug

SEQ ID NO: 826285 - RNA, 16 nt, Homo sapiens
uccucugugaccaaug

SEQ ID NO: 826286 - RNA, 16 nt, Homo sapiens
uccucuuucaaccuca

SEQ ID NO: 826287 - RNA, 13 nt, Homo sapiens
uccuguguggaag

SEQ ID NO: 826288 - RNA, 13 nt, Homo sapiens
ucgauauaugacu

SEQ ID NO: 826289 - RNA, 20 nt, Homo sapiens
ucuaagagaacaaugugcua

SEQ ID NO: 826290 - RNA, 15 nt, Homo sapiens
ucuaugaauugcuaa

SEQ ID NO: 826291 - RNA, 14 nt, Homo sapiens
ucuaugaucuuggc

SEQ ID NO: 826292 - RNA, 21 nt, Homo sapiens
ucuauuuacauaaaaugggug

SEQ ID NO: 826293 - RNA, 16 nt, Homo sapiens
ucucaaacuacuggca

SEQ ID NO: 826294 - RNA, 18 nt, Homo sapiens
ucucagcgagguguaaag

SEQ ID NO: 826295 - RNA, 18 nt, Homo sapiens
ucuccacucaugugacuc

SEQ ID NO: 826296 - RNA, 18 nt, Homo sapiens
ucucuugcucaccaagaa

SEQ ID NO: 826297 - RNA, 23 nt, Homo sapiens
ucugagcagugaaugauucagug

SEQ ID NO: 826298 - RNA, 17 nt, Homo sapiens
ucugcccgggagcucag

SEQ ID NO: 826299 - RNA, 17 nt, Homo sapiens
ucuguggcacucagaua

SEQ ID NO: 826300 - RNA, 13 nt, Homo sapiens
ucuuaagacguga

SEQ ID NO: 826301 - RNA, 19 nt, Homo sapiens
ucuuagagcacuuuuaaca

SEQ ID NO: 826302 - RNA, 16 nt, Homo sapiens
ucuuguguuaccugaa

SEQ ID NO: 826303 - RNA, 16 nt, Homo sapiens
ucuuucauacauuaua

SEQ ID NO: 826304 - RNA, 13 nt, Homo sapiens
ucuuucccaacac

SEQ ID NO: 826305 - RNA, 17 nt, Homo sapiens
ugaaaacacugugcaca

SEQ ID NO: 826306 - RNA, 15 nt, Homo sapiens
ugaacucgaagccca

SEQ ID NO: 826307 - RNA, 21 nt, Homo sapiens
ugaacucgaagcccacaaucc

SEQ ID NO: 826308 - RNA, 13 nt, Homo sapiens
ugaagccacagca

SEQ ID NO: 826309 - RNA, 18 nt, Homo sapiens
ugaagccuauguaugcca

SEQ ID NO: 826310 - RNA, 16 nt, Homo sapiens
ugaaguuuaauugacu

SEQ ID NO: 826311 - RNA, 18 nt, Homo sapiens
ugaaguuuaauugacuua

SEQ ID NO: 826312 - RNA, 13 nt, Homo sapiens
ugacaaauucugu

SEQ ID NO: 826313 - RNA, 17 nt, Homo sapiens
ugacauuauaugcacua

SEQ ID NO: 826314 - RNA, 22 nt, Homo sapiens
ugaccucacuucuggcacugug

SEQ ID NO: 826315 - RNA, 22 nt, Homo sapiens
ugagucucuaugaucuuggcac

SEQ ID NO: 826316 - RNA, 14 nt, Homo sapiens
ugagugaccucacu

SEQ ID NO: 826317 - RNA, 13 nt, Homo sapiens
ugaguguguuugu

SEQ ID NO: 826318 - RNA, 14 nt, Homo sapiens
ugaguuuucagugg

SEQ ID NO: 826319 - RNA, 17 nt, Homo sapiens
ugauauauaaaugugau

SEQ ID NO: 826320 - RNA, 13 nt, Homo sapiens
ugauauugcagcu

SEQ ID NO: 826321 - RNA, 20 nt, Homo sapiens
ugaucagcgccgcaccagcc

SEQ ID NO: 826322 - RNA, 16 nt, Homo sapiens
ugaucuuggcacaaau

SEQ ID NO: 826323 - RNA, 16 nt, Homo sapiens
ugcaaaaggacucuca

SEQ ID NO: 826324 - RNA, 16 nt, Homo sapiens
ugcaacuucuaccucc

SEQ ID NO: 826325 - RNA, 14 nt, Homo sapiens
ugcacacuuugcca

SEQ ID NO: 826326 - RNA, 21 nt, Homo sapiens
ugcacuguucccccugugcag

SEQ ID NO: 826327 - RNA, 13 nt, Homo sapiens
ugcauuuauagca

SEQ ID NO: 826328 - RNA, 17 nt, Homo sapiens
ugccaugucuuguucag

SEQ ID NO: 826329 - RNA, 15 nt, Homo sapiens
ugcccgggagcucag

SEQ ID NO: 826330 - RNA, 13 nt, Homo sapiens
ugccugacauuug

SEQ ID NO: 826331 - RNA, 15 nt, Homo sapiens
ugcggagacccugag

SEQ ID NO: 826332 - RNA, 14 nt, Homo sapiens
ugcucaccaagaag

SEQ ID NO: 826333 - RNA, 19 nt, Homo sapiens
gggagacugggcugaggga

SEQ ID NO: 826334 - RNA, 15 nt, Homo sapiens
gggaguguugucaca

SEQ ID NO: 826335 - RNA, 15 nt, Homo sapiens
gggcuccauguagaa

SEQ ID NO: 826336 - RNA, 14 nt, Homo sapiens
gggcucgugcccug

SEQ ID NO: 826337 - RNA, 19 nt, Homo sapiens
ggguguuaaggcagugacu

SEQ ID NO: 826338 - RNA, 18 nt, Homo sapiens
ggguuagcucacgugucu

SEQ ID NO: 826339 - RNA, 13 nt, Homo sapiens
gguggagggccac

SEQ ID NO: 826340 - RNA, 12 nt, Homo sapiens
gguguguguuac

SEQ ID NO: 826341 - RNA, 18 nt, Homo sapiens
gguguguguuacauacac

SEQ ID NO: 826342 - RNA, 13 nt, Homo sapiens
guaaacugugcac

SEQ ID NO: 826343 - RNA, 14 nt, Homo sapiens
guaaacugugcacc

SEQ ID NO: 826344 - RNA, 21 nt, Homo sapiens
guaaagaaauauauaugauau

SEQ ID NO: 826345 - RNA, 19 nt, Homo sapiens
guaagccucaccuuugccu

SEQ ID NO: 826346 - RNA, 13 nt, Homo sapiens
guagaacuuggau

SEQ ID NO: 826347 - RNA, 14 nt, Homo sapiens
guaucaaaugugac

SEQ ID NO: 826348 - RNA, 15 nt, Homo sapiens
guaucaggacccaga

SEQ ID NO: 826349 - RNA, 21 nt, Homo sapiens
gucaaagaaaacuuccaaaaa

SEQ ID NO: 826350 - RNA, 19 nt, Homo sapiens
gucaaccugccugacauuu

SEQ ID NO: 826351 - RNA, 19 nt, Homo sapiens
guccacuuuuaaaacuaua

SEQ ID NO: 826352 - RNA, 18 nt, Homo sapiens
gucucuaugaucuuggca

SEQ ID NO: 826353 - RNA, 16 nt, Homo sapiens
gugaauaaaccaucau

SEQ ID NO: 826354 - RNA, 23 nt, Homo sapiens
gugaauaaaccaucaucuugcca

SEQ ID NO: 826355 - RNA, 16 nt, Homo sapiens
gugaauacauuuugca

SEQ ID NO: 826356 - RNA, 16 nt, Homo sapiens
gugaaugauucagugu

SEQ ID NO: 826357 - RNA, 16 nt, Homo sapiens
gugacauuuccaugca

SEQ ID NO: 826358 - RNA, 14 nt, Homo sapiens
gugagugaccucac

SEQ ID NO: 826359 - RNA, 16 nt, Homo sapiens
gugcgauaacuuaaca

SEQ ID NO: 826360 - RNA, 13 nt, Homo sapiens
guggcauccagag

SEQ ID NO: 826361 - RNA, 20 nt, Homo sapiens
guggggaccgggcucugaca

SEQ ID NO: 826362 - RNA, 17 nt, Homo sapiens
gugguccuuugggguga

SEQ ID NO: 826363 - RNA, 15 nt, Homo sapiens
guguacccauauaua

SEQ ID NO: 826364 - RNA, 14 nt, Homo sapiens
guguuaaaugugau

SEQ ID NO: 826365 - RNA, 14 nt, Homo sapiens
guguuacauacaca

SEQ ID NO: 826366 - RNA, 14 nt, Homo sapiens
guuaguuccuucau

SEQ ID NO: 826367 - RNA, 15 nt, Homo sapiens
guuauagaaacugau

SEQ ID NO: 826368 - RNA, 19 nt, Homo sapiens
guuauagaaacugauauau

SEQ ID NO: 826369 - RNA, 14 nt, Homo sapiens
guucccccugugca

SEQ ID NO: 826370 - RNA, 16 nt, Homo sapiens
guucuuagagcacuuu

SEQ ID NO: 826371 - RNA, 23 nt, Homo sapiens
guugauuucagcaccuacagugu

SEQ ID NO: 826372 - RNA, 19 nt, Homo sapiens
guuguucgccgcguggaau

SEQ ID NO: 826373 - RNA, 19 nt, Homo sapiens
guuuaaaaguccacuuuua

SEQ ID NO: 826374 - RNA, 22 nt, Homo sapiens
guuuaugcauagauaaucucuc

SEQ ID NO: 826375 - RNA, 22 nt, Homo sapiens
guuuuauuuaacugugcaguga

SEQ ID NO: 826376 - RNA, 21 nt, Homo sapiens
uaaaaauaaacucugcacuua

SEQ ID NO: 826377 - RNA, 14 nt, Homo sapiens
uaaaauucuuggga

SEQ ID NO: 826378 - RNA, 20 nt, Homo sapiens
uaaacuuacuuaguguuaug

SEQ ID NO: 826379 - RNA, 20 nt, Homo sapiens
uaaagaaauauauaugauau

SEQ ID NO: 826380 - RNA, 15 nt, Homo sapiens
uaaauaacagugugu

SEQ ID NO: 826381 - RNA, 17 nt, Homo sapiens
uaaggaacggcccuuuu

SEQ ID NO: 826382 - RNA, 20 nt, Homo sapiens
uaaggagaggagaaacugag

SEQ ID NO: 826383 - RNA, 17 nt, Homo sapiens
uaagucaaccugccuga

SEQ ID NO: 826384 - RNA, 16 nt, Homo sapiens
uaauuaguaacaugug

SEQ ID NO: 826385 - RNA, 18 nt, Homo sapiens
uacagucuuccauuugca

SEQ ID NO: 826386 - RNA, 13 nt, Homo sapiens
uacaugacauuua

SEQ ID NO: 826387 - RNA, 14 nt, Homo sapiens
uaccuccugagaaa

SEQ ID NO: 826388 - RNA, 17 nt, Homo sapiens
uaccuccuguguggaag

SEQ ID NO: 826389 - RNA, 21 nt, Homo sapiens
uaccugaaaacacugugcaca

SEQ ID NO: 826390 - RNA, 21 nt, Homo sapiens
uacucacccagggacuccagu

SEQ ID NO: 826391 - RNA, 20 nt, Homo sapiens
uacugagacaugacuaggaa

SEQ ID NO: 826392 - RNA, 14 nt, Homo sapiens
uacuggcaauuugu

SEQ ID NO: 826393 - RNA, 18 nt, Homo sapiens
caacauuuuuguacauua

SEQ ID NO: 826394 - RNA, 16 nt, Homo sapiens
caaccgcuugccauau

SEQ ID NO: 826395 - RNA, 14 nt, Homo sapiens
caacgaguacuuca

SEQ ID NO: 826396 - RNA, 16 nt, Homo sapiens
caagaaguaacaaaag

SEQ ID NO: 826397 - RNA, 19 nt, Homo sapiens
caagaaguaacaaaaguau

SEQ ID NO: 826398 - RNA, 14 nt, Homo sapiens
caagaucugaauuu

SEQ ID NO: 826399 - RNA, 23 nt, Homo sapiens
caagcaguuaguuccuucaugau

SEQ ID NO: 826400 - RNA, 21 nt, Homo sapiens
caagggaauucggugugcacc

SEQ ID NO: 826401 - RNA, 21 nt, Homo sapiens
caagggcuuuguuuugcacac

SEQ ID NO: 826402 - RNA, 17 nt, Homo sapiens
caaggugacauuuccau

SEQ ID NO: 826403 - RNA, 12 nt, Homo sapiens
caauaugcauuu

SEQ ID NO: 826404 - RNA, 16 nt, Homo sapiens
caauccagcuauguua

SEQ ID NO: 826405 - RNA, 19 nt, Homo sapiens
caauucuccuguugcaaug

SEQ ID NO: 826406 - RNA, 18 nt, Homo sapiens
cacaaaauaaccaauccu

SEQ ID NO: 826407 - RNA, 17 nt, Homo sapiens
cacagccuccccugcca

SEQ ID NO: 826408 - RNA, 17 nt, Homo sapiens
cacauuuuucagauaua

SEQ ID NO: 826409 - RNA, 19 nt, Homo sapiens
cacugaaauagagugaauu

SEQ ID NO: 826410 - RNA, 23 nt, Homo sapiens
cacuuaccugcaaacuccuugua

SEQ ID NO: 826411 - RNA, 21 nt, Homo sapiens
cacuucgaugacuggauacag

SEQ ID NO: 826412 - RNA, 14 nt, Homo sapiens
cagaacucuuucaa

SEQ ID NO: 826413 - RNA, 16 nt, Homo sapiens
cagaaggcaaacccau

SEQ ID NO: 826414 - RNA, 15 nt, Homo sapiens
cagagcuucccugac

SEQ ID NO: 826415 - RNA, 20 nt, Homo sapiens
cagagugaagcaucaaccua

SEQ ID NO: 826416 - RNA, 15 nt, Homo sapiens
cagcaccuacagugu

SEQ ID NO: 826417 - RNA, 20 nt, Homo sapiens
cagcuguuuaugcauagaua

SEQ ID NO: 826418 - RNA, 12 nt, Homo sapiens
caggcacugaga

SEQ ID NO: 826419 - RNA, 18 nt, Homo sapiens
caggccagaaaacauaug

SEQ ID NO: 826420 - RNA, 16 nt, Homo sapiens
caggcuggagugcagu

SEQ ID NO: 826421 - RNA, 16 nt, Homo sapiens
cagguuccaaucagaa

SEQ ID NO: 826422 - RNA, 13 nt, Homo sapiens
cagucaaccuggg

SEQ ID NO: 826423 - RNA, 14 nt, Homo sapiens
cagucuuccauuug

SEQ ID NO: 826424 - RNA, 17 nt, Homo sapiens
cagugacuuuagaaaca

SEQ ID NO: 826425 - RNA, 12 nt, Homo sapiens
cagugcucccuc

SEQ ID NO: 826426 - RNA, 14 nt, Homo sapiens
caguguacagucuu

SEQ ID NO: 826427 - RNA, 13 nt, Homo sapiens
cauaacaauuccu

SEQ ID NO: 826428 - RNA, 18 nt, Homo sapiens
cauacauuauauuccucu

SEQ ID NO: 826429 - RNA, 14 nt, Homo sapiens
caucaaagcacugu

SEQ ID NO: 826430 - RNA, 21 nt, Homo sapiens
cauccagagucccugccugga

SEQ ID NO: 826431 - RNA, 21 nt, Homo sapiens
cauccuacccccugugccuug

SEQ ID NO: 826432 - RNA, 21 nt, Homo sapiens
caugagcuccuuaaggcucuu

SEQ ID NO: 826433 - RNA, 15 nt, Homo sapiens
caugaggaccaggug

SEQ ID NO: 826434 - RNA, 17 nt, Homo sapiens
caugaucaucacaauca

SEQ ID NO: 826435 - RNA, 13 nt, Homo sapiens
cauggauuccacu

SEQ ID NO: 826436 - RNA, 17 nt, Homo sapiens
caugguggguccauggg

SEQ ID NO: 826437 - RNA, 21 nt, Homo sapiens
cauucccguggaacguuuuuc

SEQ ID NO: 826438 - RNA, 17 nt, Homo sapiens
cauuuccaugcauaaau

SEQ ID NO: 826439 - RNA, 16 nt, Homo sapiens
cauuuggcaaugccau

SEQ ID NO: 826440 - RNA, 15 nt, Homo sapiens
cauuuuguuauagaa

SEQ ID NO: 826441 - RNA, 16 nt, Homo sapiens
ccaaagacuacacugu

SEQ ID NO: 826442 - RNA, 18 nt, Homo sapiens
ccaaagacuacacuguug

SEQ ID NO: 826443 - RNA, 19 nt, Homo sapiens
ccaaagcccaaagugguau

SEQ ID NO: 826444 - RNA, 17 nt, Homo sapiens
ccaauccuggacaugaa

SEQ ID NO: 826445 - RNA, 12 nt, Homo sapiens
ccacaaacugau

SEQ ID NO: 826446 - RNA, 20 nt, Homo sapiens
ccacacauaacuguuuugca

SEQ ID NO: 826447 - RNA, 17 nt, Homo sapiens
ccacacuagcuugcaga

SEQ ID NO: 826448 - RNA, 18 nt, Homo sapiens
ccacucaugugacucuuu

SEQ ID NO: 826449 - RNA, 14 nt, Homo sapiens
ccagagucccugcc

SEQ ID NO: 826450 - RNA, 17 nt, Homo sapiens
ccaguuuuugcagagaa

SEQ ID NO: 826451 - RNA, 20 nt, Homo sapiens
ccauauuuucaccauuugau

SEQ ID NO: 826452 - RNA, 23 nt, Homo sapiens
ccaucagugcucccucacauguc

SEQ ID NO: 826453 - RNA, 23 nt, Homo sapiens
ccaugagcuccuuaaggcucuuu

SEQ ID NO: 826454 - RNA, 12 nt, Homo sapiens
cacaaauuguac

SEQ ID NO: 826455 - RNA, 18 nt, Homo sapiens
cugccgagaguccaucag

SEQ ID NO: 826456 - RNA, 19 nt, Homo sapiens
guguacagucuuguauuaa

SEQ ID NO: 826457 - RNA, 19 nt, Homo sapiens
guguguuugugugcaugaa

SEQ ID NO: 826458 - RNA, 13 nt, Homo sapiens
agaaucaaaugca

SEQ ID NO: 826459 - RNA, 12 nt, Homo sapiens
agaauggagcug

SEQ ID NO: 826460 - RNA, 17 nt, Homo sapiens
agacaagucuggcacuu

SEQ ID NO: 826461 - RNA, 16 nt, Homo sapiens
agacugggcugaggga

SEQ ID NO: 826462 - RNA, 17 nt, Homo sapiens
agacuuacuuacuccca

SEQ ID NO: 826463 - RNA, 12 nt, Homo sapiens
agagaaaagcca

SEQ ID NO: 826464 - RNA, 23 nt, Homo sapiens
agagacgggcccuggugguggcu

SEQ ID NO: 826465 - RNA, 14 nt, Homo sapiens
agagcuucccugac

SEQ ID NO: 826466 - RNA, 12 nt, Homo sapiens
agagugaauuau

SEQ ID NO: 826467 - RNA, 15 nt, Homo sapiens
agcaauaaaaugcua

SEQ ID NO: 826468 - RNA, 21 nt, Homo sapiens
agcagcgccccucccaagagg

SEQ ID NO: 826469 - RNA, 23 nt, Homo sapiens
agcaggaaccaagaaagcaauac

SEQ ID NO: 826470 - RNA, 20 nt, Homo sapiens
agcaguuaguuccuucauga

SEQ ID NO: 826471 - RNA, 18 nt, Homo sapiens
agcauacgguaugauauu

SEQ ID NO: 826472 - RNA, 15 nt, Homo sapiens
agccaccaagaggga

SEQ ID NO: 826473 - RNA, 21 nt, Homo sapiens
agccuauguaugccauggagg

SEQ ID NO: 826474 - RNA, 23 nt, Homo sapiens
agccuauguaugccauggaggca

SEQ ID NO: 826475 - RNA, 18 nt, Homo sapiens
agcgaggaggcuccagag

SEQ ID NO: 826476 - RNA, 19 nt, Homo sapiens
agcgaggaggcuccagagg

SEQ ID NO: 826477 - RNA, 22 nt, Homo sapiens
agcugcuuucgaauaaagugaa

SEQ ID NO: 826478 - RNA, 18 nt, Homo sapiens
agcuggaaaaaguguccu

SEQ ID NO: 826479 - RNA, 22 nt, Homo sapiens
agcuuucauguaaacugugcac

SEQ ID NO: 826480 - RNA, 14 nt, Homo sapiens
aggaaaaccaugac

SEQ ID NO: 826481 - RNA, 21 nt, Homo sapiens
aggaauagucgcgcaagcauc

SEQ ID NO: 826482 - RNA, 13 nt, Homo sapiens
aggacuguagaaa

SEQ ID NO: 826483 - RNA, 13 nt, Homo sapiens
aggagaaacugag

SEQ ID NO: 826484 - RNA, 15 nt, Homo sapiens
aggagggcaggcauc

SEQ ID NO: 826485 - RNA, 19 nt, Homo sapiens
agggaacugaacauuccag

SEQ ID NO: 826486 - RNA, 11 nt, Homo sapiens
agggaauuuaa

SEQ ID NO: 826487 - RNA, 16 nt, Homo sapiens
agggacuccaguucac

SEQ ID NO: 826488 - RNA, 12 nt, Homo sapiens
agggaugggaga

SEQ ID NO: 826489 - RNA, 16 nt, Homo sapiens
agguuugccagcauuu

SEQ ID NO: 826490 - RNA, 11 nt, Homo sapiens
aguaacaugug

SEQ ID NO: 826491 - RNA, 15 nt, Homo sapiens
aguaacauguguuaa

SEQ ID NO: 826492 - RNA, 19 nt, Homo sapiens
aguacuuacccuaaaacau

SEQ ID NO: 826493 - RNA, 23 nt, Homo sapiens
aguauaggauaaauuacauuaaa

SEQ ID NO: 826494 - RNA, 20 nt, Homo sapiens
agucagacuuacuuacuccc

SEQ ID NO: 826495 - RNA, 22 nt, Homo sapiens
aguccacuuuuaaaacuauauu

SEQ ID NO: 826496 - RNA, 14 nt, Homo sapiens
agucucuaugaucu

SEQ ID NO: 826497 - RNA, 17 nt, Homo sapiens
agugaccugcccuacau

SEQ ID NO: 826498 - RNA, 20 nt, Homo sapiens
agugacuuuagaaacaaauu

SEQ ID NO: 826499 - RNA, 23 nt, Homo sapiens
agugcaguggugcgaucuuggcu

SEQ ID NO: 826500 - RNA, 17 nt, Homo sapiens
aguggugcgaucuuggc

SEQ ID NO: 826501 - RNA, 23 nt, Homo sapiens
aguguuccccuuccacugagggc

SEQ ID NO: 826502 - RNA, 17 nt, Homo sapiens
aguuaauuuuauuccag

SEQ ID NO: 826503 - RNA, 18 nt, Homo sapiens
aguuccccucuacuccau

SEQ ID NO: 826504 - RNA, 16 nt, Homo sapiens
aguugguguucauaau

SEQ ID NO: 826505 - RNA, 15 nt, Homo sapiens
aguuguuaauaaaag

SEQ ID NO: 826506 - RNA, 19 nt, Homo sapiens
aguuguucgccgcguggaa

SEQ ID NO: 826507 - RNA, 15 nt, Homo sapiens
aguuuauacuucucu

SEQ ID NO: 826508 - RNA, 20 nt, Homo sapiens
auaaccuucaugaugaauua

SEQ ID NO: 826509 - RNA, 21 nt, Homo sapiens
auaacuuuuuuuuaaguuaca

SEQ ID NO: 826510 - RNA, 14 nt, Homo sapiens
auacgguaugauau

SEQ ID NO: 826511 - RNA, 21 nt, Homo sapiens
auacuagccuagaaauauaga

SEQ ID NO: 826512 - RNA, 19 nt, Homo sapiens
auacuucucuauuaucuca

SEQ ID NO: 826513 - RNA, 19 nt, Homo sapiens
auauauauuuuugugcaca

SEQ ID NO: 826514 - RNA, 19 nt, Homo sapiens
auauugcagcuuauauuca

SEQ ID NO: 826515 - RNA, 20 nt, Homo sapiens
auauugcagcuuauauucau

SEQ ID NO: 826516 - RNA, 17 nt, Homo sapiens
aucaaaucagucuugga

SEQ ID NO: 826517 - RNA, 22 nt, Homo sapiens
aucaaaugugacauuauaugca

SEQ ID NO: 826518 - RNA, 16 nt, Homo sapiens
aucaacgaguacuuca

SEQ ID NO: 826519 - RNA, 20 nt, Homo sapiens
aucaccgugggcucccugac

SEQ ID NO: 826520 - RNA, 16 nt, Homo sapiens
aucagaacuguuggca

SEQ ID NO: 826521 - RNA, 15 nt, Homo sapiens
aucaggacccagagg

SEQ ID NO: 826522 - RNA, 21 nt, Homo sapiens
aucagucuuggaauacuugaa

SEQ ID NO: 826523 - RNA, 19 nt, Homo sapiens
aucagugaauaaaccauca

SEQ ID NO: 826524 - RNA, 18 nt, Homo sapiens
aucauccgaggcaaagag

SEQ ID NO: 826525 - RNA, 14 nt, Homo sapiens
auccacaugggagc

SEQ ID NO: 826526 - RNA, 22 nt, Homo sapiens
auccccuaagcagaccacugau

SEQ ID NO: 826527 - RNA, 16 nt, Homo sapiens
aucgcugccuugccau

SEQ ID NO: 826528 - RNA, 15 nt, Homo sapiens
aucucaaacuacugg

SEQ ID NO: 826529 - RNA, 23 nt, Homo sapiens
aucucauuggacccuuccauggu

SEQ ID NO: 826530 - RNA, 21 nt, Homo sapiens
aucugucaaagaaaacuucca

SEQ ID NO: 826531 - RNA, 14 nt, Homo sapiens
aucuguguuuacuu

SEQ ID NO: 826532 - RNA, 17 nt, Homo sapiens
aucuugguuuaacucuu

SEQ ID NO: 826533 - RNA, 13 nt, Homo sapiens
aucuuucuuccaa

SEQ ID NO: 826534 - RNA, 16 nt, Homo sapiens
augaaagggcaaagac

SEQ ID NO: 826535 - RNA, 18 nt, Homo sapiens
augagcuccuuaaggcuc

SEQ ID NO: 826536 - RNA, 17 nt, Homo sapiens
auggcccugcaaaagga

SEQ ID NO: 826537 - RNA, 23 nt, Homo sapiens
augguggagggccacaugggagg

SEQ ID NO: 826538 - RNA, 15 nt, Homo sapiens
auguaaacugugcac

SEQ ID NO: 826539 - RNA, 16 nt, Homo sapiens
auguaaacugugcacc

SEQ ID NO: 826540 - RNA, 23 nt, Homo sapiens
auguaacauguaggaaguaggaa

SEQ ID NO: 826541 - RNA, 12 nt, Homo sapiens
auguacauacau

SEQ ID NO: 826542 - RNA, 18 nt, Homo sapiens
auguaggaucugucaaag

SEQ ID NO: 826543 - RNA, 14 nt, Homo sapiens
auguauaugcacuu

SEQ ID NO: 826544 - RNA, 15 nt, Homo sapiens
auuaauuaaaccaga

SEQ ID NO: 826545 - RNA, 17 nt, Homo sapiens
auuaauuaaaccagacu

SEQ ID NO: 826546 - RNA, 17 nt, Homo sapiens
auuauaugcacuagcaa

SEQ ID NO: 826547 - RNA, 13 nt, Homo sapiens
auuaucaacagca

SEQ ID NO: 826548 - RNA, 12 nt, Homo sapiens
auucaguguuaa

SEQ ID NO: 826549 - RNA, 17 nt, Homo sapiens
auucucugucucaucca

SEQ ID NO: 826550 - RNA, 18 nt, Homo sapiens
auuggaauuuucuuucau

SEQ ID NO: 826551 - RNA, 22 nt, Homo sapiens
auuuaguuugauuauucagugu

SEQ ID NO: 826552 - RNA, 19 nt, Homo sapiens
auuugcacccaugccauag

SEQ ID NO: 826553 - RNA, 18 nt, Homo sapiens
auuuuucagauauaaaag

SEQ ID NO: 826554 - RNA, 14 nt, Homo sapiens
auuuuuguacauua

SEQ ID NO: 826555 - RNA, 20 nt, Homo sapiens
caaagaaaacuuccaaaaag

SEQ ID NO: 826556 - RNA, 16 nt, Homo sapiens
caaagagaaaagccac

SEQ ID NO: 826557 - RNA, 13 nt, Homo sapiens
caaaugcaauuuu

SEQ ID NO: 826558 - RNA, 15 nt, Homo sapiens
caacucuuugagaaa

SEQ ID NO: 826559 - RNA, 20 nt, Homo sapiens
caagucuuuacagaaucaaa

SEQ ID NO: 826560 - RNA, 21 nt, Homo sapiens
caaguucuuaguugcuguaug

SEQ ID NO: 826561 - RNA, 16 nt, Homo sapiens
caauauuguacaguuu

SEQ ID NO: 826562 - RNA, 14 nt, Homo sapiens
caauguuagccaca

SEQ ID NO: 826563 - RNA, 14 nt, Homo sapiens
ucucugagcaguga

SEQ ID NO: 826564 - RNA, 15 nt, Homo sapiens
ucucugagcagugaa

SEQ ID NO: 826565 - RNA, 19 nt, Homo sapiens
ucucugagcagugaaugau

SEQ ID NO: 826566 - RNA, 12 nt, Homo sapiens
ucucugcucugc

SEQ ID NO: 826567 - RNA, 17 nt, Homo sapiens
ucugacucagggcuccu

SEQ ID NO: 826568 - RNA, 19 nt, Homo sapiens
ucugagcagugaaugauuc

SEQ ID NO: 826569 - RNA, 13 nt, Homo sapiens
ucugagcugugca

SEQ ID NO: 826570 - RNA, 14 nt, Homo sapiens
ucugagcugugcag

SEQ ID NO: 826571 - RNA, 14 nt, Homo sapiens
ucugcucaucauuc

SEQ ID NO: 826572 - RNA, 16 nt, Homo sapiens
ucuguguuuacuuaag

SEQ ID NO: 826573 - RNA, 15 nt, Homo sapiens
ucuuaaaauucuugg

SEQ ID NO: 826574 - RNA, 23 nt, Homo sapiens
ucuuaagacgugauuuugcugua

SEQ ID NO: 826575 - RNA, 13 nt, Homo sapiens
ugaaaaaaguaua

SEQ ID NO: 826576 - RNA, 16 nt, Homo sapiens
ugaaaacacugugcac

SEQ ID NO: 826577 - RNA, 11 nt, Homo sapiens
ugaacauucca

SEQ ID NO: 826578 - RNA, 20 nt, Homo sapiens
ugaagcaucaaccuacuuag

SEQ ID NO: 826579 - RNA, 15 nt, Homo sapiens
ugacauuauaugcac

SEQ ID NO: 826580 - RNA, 18 nt, Homo sapiens
ugacuacuauggcuguuu

SEQ ID NO: 826581 - RNA, 14 nt, Homo sapiens
ugagucugugccac

SEQ ID NO: 826582 - RNA, 15 nt, Homo sapiens
ugaguguguaugugu

SEQ ID NO: 826583 - RNA, 15 nt, Homo sapiens
ugauauugcagcuua

SEQ ID NO: 826584 - RNA, 14 nt, Homo sapiens
ugaugaauuacuuc

SEQ ID NO: 826585 - RNA, 22 nt, Homo sapiens
ugauuucagcaccuacagugua

SEQ ID NO: 826586 - RNA, 20 nt, Homo sapiens
ugcaaaggggugcaugggaa

SEQ ID NO: 826587 - RNA, 19 nt, Homo sapiens
ugcaagcagaaccuuggaa

SEQ ID NO: 826588 - RNA, 15 nt, Homo sapiens
ugcagcuuauauuca

SEQ ID NO: 826589 - RNA, 22 nt, Homo sapiens
ugcauaaaugcgauccacagaa

SEQ ID NO: 826590 - RNA, 23 nt, Homo sapiens
ugccacagccuccccugccaggg

SEQ ID NO: 826591 - RNA, 15 nt, Homo sapiens
ugccagcauuucccu

SEQ ID NO: 826592 - RNA, 19 nt, Homo sapiens
ugcccuguaccugugcacg

SEQ ID NO: 826593 - RNA, 16 nt, Homo sapiens
ugccuugccaugucuu

SEQ ID NO: 826594 - RNA, 14 nt, Homo sapiens
ugcgaacagcaaac

SEQ ID NO: 826595 - RNA, 21 nt, Homo sapiens
ugcuguagaagauggcacuua

SEQ ID NO: 826596 - RNA, 22 nt, Homo sapiens
ugcuucuaguucugccaggaga

SEQ ID NO: 826597 - RNA, 21 nt, Homo sapiens
uggaacuuuuauuacuggggu

SEQ ID NO: 826598 - RNA, 20 nt, Homo sapiens
uggaagaaggaaacaccgag

SEQ ID NO: 826599 - RNA, 12 nt, Homo sapiens
uggagagccacc

SEQ ID NO: 826600 - RNA, 16 nt, Homo sapiens
ugggaaagggcuguug

SEQ ID NO: 826601 - RNA, 16 nt, Homo sapiens
ugggcgaagcuaaaag

SEQ ID NO: 826602 - RNA, 15 nt, Homo sapiens
uguaaacugugcacc

SEQ ID NO: 826603 - RNA, 10 nt, Homo sapiens
uguacauaca

SEQ ID NO: 826604 - RNA, 17 nt, Homo sapiens
uguacauuugagugucu

SEQ ID NO: 826605 - RNA, 21 nt, Homo sapiens
uguauucucugagcugugcag

SEQ ID NO: 826606 - RNA, 17 nt, Homo sapiens
uguccaggcacugagau

SEQ ID NO: 826607 - RNA, 16 nt, Homo sapiens
ugucguaggaaaacca

SEQ ID NO: 826608 - RNA, 20 nt, Homo sapiens
ugugcaugaaagagaaagac

SEQ ID NO: 826609 - RNA, 15 nt, Homo sapiens
ugugccucagccucc

SEQ ID NO: 826610 - RNA, 21 nt, Homo sapiens
uguggguguguguuacauaca

SEQ ID NO: 826611 - RNA, 22 nt, Homo sapiens
ugugucccauggcagacaaagc

SEQ ID NO: 826612 - RNA, 19 nt, Homo sapiens
ugugucccccucuguccag

SEQ ID NO: 826613 - RNA, 13 nt, Homo sapiens
uguguuucuuuag

SEQ ID NO: 826614 - RNA, 18 nt, Homo sapiens
uguugccuggaagcacau

SEQ ID NO: 826615 - RNA, 12 nt, Homo sapiens
uguuuacuuaag

SEQ ID NO: 826616 - RNA, 20 nt, Homo sapiens
uguuucaauugcaucuccca

SEQ ID NO: 826617 - RNA, 20 nt, Homo sapiens
uguuuuuguucaaagccagc

SEQ ID NO: 826618 - RNA, 17 nt, Homo sapiens
uuaaaaauaaacucugc

SEQ ID NO: 826619 - RNA, 18 nt, Homo sapiens
uuaaaaguccacuuuuaa

SEQ ID NO: 826620 - RNA, 21 nt, Homo sapiens
uuaaaaugugagugaccucac

SEQ ID NO: 826621 - RNA, 14 nt, Homo sapiens
uuaaagacuaacua

SEQ ID NO: 826622 - RNA, 14 nt, Homo sapiens
uuaagaggggaaaa

SEQ ID NO: 826623 - RNA, 14 nt, Homo sapiens
uuaauaaaaguaca

SEQ ID NO: 826624 - RNA, 18 nt, Homo sapiens
uuaaugaagaaaguggaa

SEQ ID NO: 826625 - RNA, 15 nt, Homo sapiens
uuaauuuuauuccag

SEQ ID NO: 826626 - RNA, 15 nt, Homo sapiens
uuagacccugcauuu

SEQ ID NO: 826627 - RNA, 13 nt, Homo sapiens
uuagcugaacaau

SEQ ID NO: 826628 - RNA, 16 nt, Homo sapiens
uuagcugaacaaugaa

SEQ ID NO: 826629 - RNA, 21 nt, Homo sapiens
uuauacuucucuauuaucuca

SEQ ID NO: 826630 - RNA, 15 nt, Homo sapiens
uuauauguacauaca

SEQ ID NO: 826631 - RNA, 23 nt, Homo sapiens
uuauuuaccugaaauaaaauuca

SEQ ID NO: 826632 - RNA, 16 nt, Homo sapiens
uucaagagauucuugu

SEQ ID NO: 826633 - RNA, 10 nt, Homo sapiens
uuccacugag

SEQ ID NO: 826634 - RNA, 16 nt, Homo sapiens
uuccauuugcaaggga

SEQ ID NO: 826635 - RNA, 16 nt, Homo sapiens
uucccacaggacauuu

SEQ ID NO: 826636 - RNA, 13 nt, Homo sapiens
uucccccacugau

SEQ ID NO: 826637 - RNA, 20 nt, Homo sapiens
uucucaguaaauauuaaccu

SEQ ID NO: 826638 - RNA, 15 nt, Homo sapiens
uucuccuguugcaau

SEQ ID NO: 826639 - RNA, 22 nt, Homo sapiens
uucugauuugaagguauaaccu

SEQ ID NO: 826640 - RNA, 17 nt, Homo sapiens
uucuuucccaacaccuc

SEQ ID NO: 826641 - RNA, 22 nt, Homo sapiens
uugcaaccucgcuggacucuca

SEQ ID NO: 826642 - RNA, 16 nt, Homo sapiens
uugcacccaugccaua

SEQ ID NO: 826643 - RNA, 13 nt, Homo sapiens
uugcagaaaccua

SEQ ID NO: 826644 - RNA, 20 nt, Homo sapiens
uugcagcuuauauucaucca

SEQ ID NO: 826645 - RNA, 21 nt, Homo sapiens
uugcagcuuauauucauccau

SEQ ID NO: 826646 - RNA, 16 nt, Homo sapiens
uugccacuacccccuc

SEQ ID NO: 826647 - RNA, 21 nt, Homo sapiens
uugcccaggcuggagugcagu

SEQ ID NO: 826648 - RNA, 16 nt, Homo sapiens
uugcgagaauuuucaa

SEQ ID NO: 826649 - RNA, 14 nt, Homo sapiens
uuggaauacuugaa

SEQ ID NO: 826650 - RNA, 13 nt, Homo sapiens
uuggcaaugccau

SEQ ID NO: 826651 - RNA, 15 nt, Homo sapiens
uugggcccuuugagu

SEQ ID NO: 826652 - RNA, 23 nt, Homo sapiens
uugguuaaaggaaguuuguucac

SEQ ID NO: 826653 - RNA, 16 nt, Homo sapiens
uuguaacuucaaauau

SEQ ID NO: 826654 - RNA, 20 nt, Homo sapiens
uuguagaacagagcaguaga

SEQ ID NO: 826655 - RNA, 17 nt, Homo sapiens
uuguauuaucaacagca

SEQ ID NO: 826656 - RNA, 16 nt, Homo sapiens
uuguucagaagacaca

SEQ ID NO: 826657 - RNA, 22 nt, Homo sapiens
uuguucgccgcguggaauguga

SEQ ID NO: 826658 - RNA, 14 nt, Homo sapiens
uuguugcugucaag

SEQ ID NO: 826659 - RNA, 16 nt, Homo sapiens
uuuaaggucugacuga

SEQ ID NO: 826660 - RNA, 23 nt, Homo sapiens
uuuacagaaucaaaugcaauuuu

SEQ ID NO: 826661 - RNA, 22 nt, Homo sapiens
uuuaccauaaaaauccuucuca

SEQ ID NO: 826662 - RNA, 20 nt, Homo sapiens
uuuauagucgaacaauucau

SEQ ID NO: 826663 - RNA, 14 nt, Homo sapiens
uuuccaaccggcuu

SEQ ID NO: 826664 - RNA, 15 nt, Homo sapiens
uuuccgaaaucagaa

SEQ ID NO: 826665 - RNA, 21 nt, Homo sapiens
uuucuucauuucucuugcuca

SEQ ID NO: 826666 - RNA, 18 nt, Homo sapiens
uuugaaauuaaccucuca

SEQ ID NO: 826667 - RNA, 21 nt, Homo sapiens
uuugauguuuuguacuuacau

SEQ ID NO: 826668 - RNA, 20 nt, Homo sapiens
uuugcaagggaaaagucucu

SEQ ID NO: 826669 - RNA, 19 nt, Homo sapiens
augaaucccauaauugaca

SEQ ID NO: 826670 - RNA, 12 nt, Homo sapiens
augaucuuggca

SEQ ID NO: 826671 - RNA, 22 nt, Homo sapiens
augcacuguucccccugugcag

SEQ ID NO: 826672 - RNA, 11 nt, Homo sapiens
auggauuccac

SEQ ID NO: 826673 - RNA, 16 nt, Homo sapiens
auggauuccacugaaa

SEQ ID NO: 826674 - RNA, 17 nt, Homo sapiens
augggugucuguugcaa

SEQ ID NO: 826675 - RNA, 16 nt, Homo sapiens
augugacucuuuccaa

SEQ ID NO: 826676 - RNA, 11 nt, Homo sapiens
auguguugccu

SEQ ID NO: 826677 - RNA, 22 nt, Homo sapiens
auguucacuuuugacaaaggca

SEQ ID NO: 826678 - RNA, 19 nt, Homo sapiens
auuaccuccuguguggaag

SEQ ID NO: 826679 - RNA, 16 nt, Homo sapiens
auuauaugcacuagca

SEQ ID NO: 826680 - RNA, 16 nt, Homo sapiens
auuaucaacagcauuu

SEQ ID NO: 826681 - RNA, 22 nt, Homo sapiens
auuccacugaaauagagugaau

SEQ ID NO: 826682 - RNA, 13 nt, Homo sapiens
auucucauucuca

SEQ ID NO: 826683 - RNA, 18 nt, Homo sapiens
auucucugagcugugcag

SEQ ID NO: 826684 - RNA, 14 nt, Homo sapiens
auugacccagaaau

SEQ ID NO: 826685 - RNA, 22 nt, Homo sapiens
auugcugccccaucagugcucc

SEQ ID NO: 826686 - RNA, 20 nt, Homo sapiens
auuguaucaaaugugacauu

SEQ ID NO: 826687 - RNA, 13 nt, Homo sapiens
auuuaaacuucuu

SEQ ID NO: 826688 - RNA, 13 nt, Homo sapiens
auuuauuuaugua

SEQ ID NO: 826689 - RNA, 19 nt, Homo sapiens
auuucaaccgcuugccaua

SEQ ID NO: 826690 - RNA, 16 nt, Homo sapiens
auuucuccuccauggg

SEQ ID NO: 826691 - RNA, 19 nt, Homo sapiens
auuuuuuuuguaacuucaa

SEQ ID NO: 826692 - RNA, 15 nt, Homo sapiens
caaaaauaucuugca

SEQ ID NO: 826693 - RNA, 15 nt, Homo sapiens
caaaaggacucucag

SEQ ID NO: 826694 - RNA, 21 nt, Homo sapiens
caaacuacuggcaauuuguaa

SEQ ID NO: 826695 - RNA, 15 nt, Homo sapiens
caaagagaaaagcca

SEQ ID NO: 826696 - RNA, 15 nt, Homo sapiens
caaaguaagccucac

SEQ ID NO: 826697 - RNA, 15 nt, Homo sapiens
caacagcauuuucaa

SEQ ID NO: 826698 - RNA, 18 nt, Homo sapiens
caaccggcuuuguggcac

SEQ ID NO: 826699 - RNA, 12 nt, Homo sapiens
caaccucaguga

SEQ ID NO: 826700 - RNA, 18 nt, Homo sapiens
caaccugccugacauuug

SEQ ID NO: 826701 - RNA, 19 nt, Homo sapiens
caacugccagaacauggau

SEQ ID NO: 826702 - RNA, 13 nt, Homo sapiens
caaggaagucaaa

SEQ ID NO: 826703 - RNA, 13 nt, Homo sapiens
caauccuauguuu

SEQ ID NO: 826704 - RNA, 13 nt, Homo sapiens
caaugacacauag

SEQ ID NO: 826705 - RNA, 13 nt, Homo sapiens
cacaggggagcag

SEQ ID NO: 826706 - RNA, 19 nt, Homo sapiens
cacauucugcuaugaauua

SEQ ID NO: 826707 - RNA, 13 nt, Homo sapiens
cacccaugccaua

SEQ ID NO: 826708 - RNA, 14 nt, Homo sapiens
cacuauuacuggga

SEQ ID NO: 826709 - RNA, 15 nt, Homo sapiens
cacugauaaaaccau

SEQ ID NO: 826710 - RNA, 23 nt, Homo sapiens
cacugcuugaggaaaacaagcau

SEQ ID NO: 826711 - RNA, 20 nt, Homo sapiens
cacuuccuuggacuacuugu

SEQ ID NO: 826712 - RNA, 21 nt, Homo sapiens
cacuuccuuggacuacuuguu

SEQ ID NO: 826713 - RNA, 12 nt, Homo sapiens
cagaauggagcu

SEQ ID NO: 826714 - RNA, 20 nt, Homo sapiens
cagaccacugauaaaaccau

SEQ ID NO: 826715 - RNA, 16 nt, Homo sapiens
cagacuucccacggcu

SEQ ID NO: 826716 - RNA, 23 nt, Homo sapiens
cagagugagacccagcccucauc

SEQ ID NO: 826717 - RNA, 19 nt, Homo sapiens
cagauauuaaauaacagug

SEQ ID NO: 826718 - RNA, 11 nt, Homo sapiens
cagcauuuccc

SEQ ID NO: 826719 - RNA, 13 nt, Homo sapiens
cagcuguuuaugc

SEQ ID NO: 826720 - RNA, 15 nt, Homo sapiens
caggugaacucgaag

SEQ ID NO: 826721 - RNA, 22 nt, Homo sapiens
cagucuuccauuugcaagggaa

SEQ ID NO: 826722 - RNA, 12 nt, Homo sapiens
cagucuuggaau

SEQ ID NO: 826723 - RNA, 22 nt, Homo sapiens
cagugaccugcccuacauaucu

SEQ ID NO: 826724 - RNA, 21 nt, Homo sapiens
cauacagagguaacuaucaau

SEQ ID NO: 826725 - RNA, 19 nt, Homo sapiens
caucaucuccugccuuccu

SEQ ID NO: 826726 - RNA, 16 nt, Homo sapiens
cauccaucaucaugug

SEQ ID NO: 826727 - RNA, 16 nt, Homo sapiens
caugaagauucuuucc

SEQ ID NO: 826728 - RNA, 15 nt, Homo sapiens
caugaugaauuacuu

SEQ ID NO: 826729 - RNA, 16 nt, Homo sapiens
caugcauaaaugcgau

SEQ ID NO: 826730 - RNA, 17 nt, Homo sapiens
caugcccuguaccugug

SEQ ID NO: 826731 - RNA, 17 nt, Homo sapiens
cauguaaacugugcacc

SEQ ID NO: 826732 - RNA, 23 nt, Homo sapiens
cauuaguuguuagugauggagcu

SEQ ID NO: 826733 - RNA, 14 nt, Homo sapiens
cauuauaugcacua

SEQ ID NO: 826734 - RNA, 23 nt, Homo sapiens
cauuauuucaaccgcuugccaua

SEQ ID NO: 826735 - RNA, 20 nt, Homo sapiens
cauucuuucccaacaccucu

SEQ ID NO: 826736 - RNA, 22 nt, Homo sapiens
ccaaaaagauuuauuaauuaaa

SEQ ID NO: 826737 - RNA, 18 nt, Homo sapiens
ccaacacugccagcauuu

SEQ ID NO: 826738 - RNA, 22 nt, Homo sapiens
ccaagcaggaaaugaaaauguc

SEQ ID NO: 826739 - RNA, 21 nt, Homo sapiens
ccaauacguagauuuuugcuc

SEQ ID NO: 826740 - RNA, 23 nt, Homo sapiens
ccacacauaacuguuuugcacgu

SEQ ID NO: 826741 - RNA, 21 nt, Homo sapiens
ccacauccuccacguucugcu

SEQ ID NO: 826742 - RNA, 20 nt, Homo sapiens
ccagaggauugcugccccau

SEQ ID NO: 826743 - RNA, 15 nt, Homo sapiens
ccagagggcacucug

SEQ ID NO: 826744 - RNA, 14 nt, Homo sapiens
ccagcuaugccaaa

SEQ ID NO: 826745 - RNA, 17 nt, Homo sapiens
ccaggcuggagugcagu

SEQ ID NO: 826746 - RNA, 20 nt, Homo sapiens
ccaggcuggagugcaguggu

SEQ ID NO: 826747 - RNA, 15 nt, Homo sapiens
ccaguuuuugcagag

SEQ ID NO: 826748 - RNA, 13 nt, Homo sapiens
ccauagaaacuga

SEQ ID NO: 826749 - RNA, 16 nt, Homo sapiens
ccauagaaacugaggc

SEQ ID NO: 826750 - RNA, 12 nt, Homo sapiens
ccauauuuucac

SEQ ID NO: 826751 - RNA, 14 nt, Homo sapiens
ccaucagugcuccc

SEQ ID NO: 826752 - RNA, 23 nt, Homo sapiens
ccauuauuucaaccgcuugccau

SEQ ID NO: 826753 - RNA, 16 nt, Homo sapiens
aaucucuccauucccg

SEQ ID NO: 826754 - RNA, 21 nt, Homo sapiens
aaugcugguuuuucaguuuuc

SEQ ID NO: 826755 - RNA, 20 nt, Homo sapiens
aaugugacauuauaugcacu

SEQ ID NO: 826756 - RNA, 15 nt, Homo sapiens
aauuaguaacaugug

SEQ ID NO: 826757 - RNA, 16 nt, Homo sapiens
aauuauauuuccuuaa

SEQ ID NO: 826758 - RNA, 15 nt, Homo sapiens
aauucggugugcacc

SEQ ID NO: 826759 - RNA, 19 nt, Homo sapiens
aauucuccuguugcaauga

SEQ ID NO: 826760 - RNA, 14 nt, Homo sapiens
acaaucagcuccuu

SEQ ID NO: 826761 - RNA, 19 nt, Homo sapiens
acaauccucgucugaauca

SEQ ID NO: 826762 - RNA, 16 nt, Homo sapiens
acacccuuaugaauug

SEQ ID NO: 826763 - RNA, 23 nt, Homo sapiens
acacuagcuugcagaaaccuaga

SEQ ID NO: 826764 - RNA, 18 nt, Homo sapiens
acagagcuucccugacuc

SEQ ID NO: 826765 - RNA, 22 nt, Homo sapiens
acagucuuguauuaaguuguua

SEQ ID NO: 826766 - RNA, 20 nt, Homo sapiens
acauacagagguaacuauca

SEQ ID NO: 826767 - RNA, 16 nt, Homo sapiens
acauaugcauuaugaa

SEQ ID NO: 826768 - RNA, 10 nt, Homo sapiens
acaugggagc

SEQ ID NO: 826769 - RNA, 16 nt, Homo sapiens
accaauauuguacagu

SEQ ID NO: 826770 - RNA, 18 nt, Homo sapiens
accagcaacauugaccca

SEQ ID NO: 826771 - RNA, 15 nt, Homo sapiens
acccaugccauagaa

SEQ ID NO: 826772 - RNA, 17 nt, Homo sapiens
accgugggcucccugac

SEQ ID NO: 826773 - RNA, 18 nt, Homo sapiens
accugaaaacacugugca

SEQ ID NO: 826774 - RNA, 19 nt, Homo sapiens
accugaaaacacugugcac

SEQ ID NO: 826775 - RNA, 22 nt, Homo sapiens
accugaaauaaaauucauuagu

SEQ ID NO: 826776 - RNA, 16 nt, Homo sapiens
accugccgagagucca

SEQ ID NO: 826777 - RNA, 12 nt, Homo sapiens
accuugugagag

SEQ ID NO: 826778 - RNA, 18 nt, Homo sapiens
acgucagcugggacaccc

SEQ ID NO: 826779 - RNA, 22 nt, Homo sapiens
acuaaaauuguaucaaauguga

SEQ ID NO: 826780 - RNA, 23 nt, Homo sapiens
acuaccuugguucccccacugau

SEQ ID NO: 826781 - RNA, 15 nt, Homo sapiens
acuacuggcaauuug

SEQ ID NO: 826782 - RNA, 15 nt, Homo sapiens
acuauguaacaugua

SEQ ID NO: 826783 - RNA, 19 nt, Homo sapiens
acucaugugacucuuucca

SEQ ID NO: 826784 - RNA, 15 nt, Homo sapiens
acucgugucuggcac

SEQ ID NO: 826785 - RNA, 14 nt, Homo sapiens
acugauuaccuccu

SEQ ID NO: 826786 - RNA, 18 nt, Homo sapiens
acuguaugugggaauuua

SEQ ID NO: 826787 - RNA, 19 nt, Homo sapiens
acuguuggcaaggugacau

SEQ ID NO: 826788 - RNA, 19 nt, Homo sapiens
acuucaagaucugaauuug

SEQ ID NO: 826789 - RNA, 15 nt, Homo sapiens
acuugaaaaccucau

SEQ ID NO: 826790 - RNA, 14 nt, Homo sapiens
acuugucccgggac

SEQ ID NO: 826791 - RNA, 19 nt, Homo sapiens
acuugucccgggacaccua

SEQ ID NO: 826792 - RNA, 23 nt, Homo sapiens
agaaacguguacccauauauaau

SEQ ID NO: 826793 - RNA, 19 nt, Homo sapiens
agaaacugaggccauuauu

SEQ ID NO: 826794 - RNA, 12 nt, Homo sapiens
agaacuacugau

SEQ ID NO: 826795 - RNA, 20 nt, Homo sapiens
agaccccucucccagcuauu

SEQ ID NO: 826796 - RNA, 21 nt, Homo sapiens
agacgugauuuugcuguagaa

SEQ ID NO: 826797 - RNA, 13 nt, Homo sapiens
agacuaaggccau

SEQ ID NO: 826798 - RNA, 21 nt, Homo sapiens
agacugcccagcuaaagcaau

SEQ ID NO: 826799 - RNA, 16 nt, Homo sapiens
agagauucuugugccu

SEQ ID NO: 826800 - RNA, 15 nt, Homo sapiens
agagguaacuaucaa

SEQ ID NO: 826801 - RNA, 16 nt, Homo sapiens
agagucccugccugga

SEQ ID NO: 826802 - RNA, 19 nt, Homo sapiens
agauaaucucuccauuccc

SEQ ID NO: 826803 - RNA, 13 nt, Homo sapiens
agaucccaacacu

SEQ ID NO: 826804 - RNA, 19 nt, Homo sapiens
agauguucuaagucuuucc

SEQ ID NO: 826805 - RNA, 20 nt, Homo sapiens
agcaaaauacaugacauuua

SEQ ID NO: 826806 - RNA, 17 nt, Homo sapiens
agcauuuagacccugca

SEQ ID NO: 826807 - RNA, 22 nt, Homo sapiens
agccacggaccguugcacaaaa

SEQ ID NO: 826808 - RNA, 17 nt, Homo sapiens
agccauaugaaugucag

SEQ ID NO: 826809 - RNA, 18 nt, Homo sapiens
agccuccauccuaccccc

SEQ ID NO: 826810 - RNA, 15 nt, Homo sapiens
agcuccuuaaggcuc

SEQ ID NO: 826811 - RNA, 20 nt, Homo sapiens
agcuguuuaugcauagauaa

SEQ ID NO: 826812 - RNA, 12 nt, Homo sapiens
aggacuguagaa

SEQ ID NO: 826813 - RNA, 14 nt, Homo sapiens
aggagggaggugcu

SEQ ID NO: 826814 - RNA, 19 nt, Homo sapiens
aggcuuaaggagaggagaa

SEQ ID NO: 826815 - RNA, 19 nt, Homo sapiens
agggaugggagaguggcuu

SEQ ID NO: 826816 - RNA, 14 nt, Homo sapiens
agggccacauggga

SEQ ID NO: 826817 - RNA, 15 nt, Homo sapiens
agggcugccuuugga

SEQ ID NO: 826818 - RNA, 17 nt, Homo sapiens
agguaaacaaacaaaua

SEQ ID NO: 826819 - RNA, 16 nt, Homo sapiens
agguccuggugguauu

SEQ ID NO: 826820 - RNA, 18 nt, Homo sapiens
agguucuuuaaaaugcca

SEQ ID NO: 826821 - RNA, 16 nt, Homo sapiens
aguaacaaaaguauag

SEQ ID NO: 826822 - RNA, 21 nt, Homo sapiens
aguaaggaacggcccuuuuag

SEQ ID NO: 826823 - RNA, 18 nt, Homo sapiens
agucucuaugaucuuggc

SEQ ID NO: 826824 - RNA, 12 nt, Homo sapiens
agugauggagcu

SEQ ID NO: 826825 - RNA, 23 nt, Homo sapiens
aguuaauuuuauuccaguaagga

SEQ ID NO: 826826 - RNA, 20 nt, Homo sapiens
aguugguguucauaauuuca

SEQ ID NO: 826827 - RNA, 19 nt, Homo sapiens
aguuuauacuucucuauua

SEQ ID NO: 826828 - RNA, 18 nt, Homo sapiens
aguuugauuauucagugu

SEQ ID NO: 826829 - RNA, 13 nt, Homo sapiens
aguuuuugcagag

SEQ ID NO: 826830 - RNA, 12 nt, Homo sapiens
auaaagugaaua

SEQ ID NO: 826831 - RNA, 15 nt, Homo sapiens
auaaaucaguuaugu

SEQ ID NO: 826832 - RNA, 14 nt, Homo sapiens
auaaauuacauuaa

SEQ ID NO: 826833 - RNA, 20 nt, Homo sapiens
auaaccaguuuuugcagaga

SEQ ID NO: 826834 - RNA, 15 nt, Homo sapiens
auaauugacaugggc

SEQ ID NO: 826835 - RNA, 14 nt, Homo sapiens
auacauuauauucc

SEQ ID NO: 826836 - RNA, 13 nt, Homo sapiens
auacuguacauaa

SEQ ID NO: 826837 - RNA, 12 nt, Homo sapiens
auagaaacugau

SEQ ID NO: 826838 - RNA, 20 nt, Homo sapiens
aaaaauguauaugcacuuau

SEQ ID NO: 826839 - RNA, 11 nt, Homo sapiens
aaaacacugug

SEQ ID NO: 826840 - RNA, 12 nt, Homo sapiens
aaaacauaugca

SEQ ID NO: 826841 - RNA, 13 nt, Homo sapiens
aaaagacugacca

SEQ ID NO: 826842 - RNA, 12 nt, Homo sapiens
aaaaugugagug

SEQ ID NO: 826843 - RNA, 20 nt, Homo sapiens
aaaauucuugggaguguugu

SEQ ID NO: 826844 - RNA, 14 nt, Homo sapiens
aaacauaugcauua

SEQ ID NO: 826845 - RNA, 11 nt, Homo sapiens
aaaccaugacg

SEQ ID NO: 826846 - RNA, 18 nt, Homo sapiens
aaacuauguaacauguag

SEQ ID NO: 826847 - RNA, 12 nt, Homo sapiens
aaacugugcacc

SEQ ID NO: 826848 - RNA, 17 nt, Homo sapiens
aaagacugauuaccucc

SEQ ID NO: 826849 - RNA, 20 nt, Homo sapiens
aaagcacuguuuaacuggga

SEQ ID NO: 826850 - RNA, 23 nt, Homo sapiens
aaagcuuucauguaaacugugca

SEQ ID NO: 826851 - RNA, 15 nt, Homo sapiens
aaauacagucuucca

SEQ ID NO: 826852 - RNA, 14 nt, Homo sapiens
aaauagagugaauu

SEQ ID NO: 826853 - RNA, 20 nt, Homo sapiens
aacaaaaauuaaaauccuca

SEQ ID NO: 826854 - RNA, 16 nt, Homo sapiens
aacaaauguauuucaa

SEQ ID NO: 826855 - RNA, 20 nt, Homo sapiens
aacauggauuccacugaaau

SEQ ID NO: 826856 - RNA, 16 nt, Homo sapiens
aacauugacccagaaa

SEQ ID NO: 826857 - RNA, 21 nt, Homo sapiens
aacauugacccagaaauguau

SEQ ID NO: 826858 - RNA, 19 nt, Homo sapiens
aaccagcaacauugaccca

SEQ ID NO: 826859 - RNA, 16 nt, Homo sapiens
aaccaucaucuugcca

SEQ ID NO: 826860 - RNA, 14 nt, Homo sapiens
aaccgcuugccaua

SEQ ID NO: 826861 - RNA, 20 nt, Homo sapiens
aacuccuuguaggucugcag

SEQ ID NO: 826862 - RNA, 19 nt, Homo sapiens
aacugaggccauuauuuca

SEQ ID NO: 826863 - RNA, 13 nt, Homo sapiens
aacugccagaaca

SEQ ID NO: 826864 - RNA, 20 nt, Homo sapiens
aacuuccaaaaagauuuauu

SEQ ID NO: 826865 - RNA, 12 nt, Homo sapiens
aagcacuugugg

SEQ ID NO: 826866 - RNA, 22 nt, Homo sapiens
aagcaucccgcuggugccuccc

SEQ ID NO: 826867 - RNA, 20 nt, Homo sapiens
aaggaaaaacugauguuuaa

SEQ ID NO: 826868 - RNA, 16 nt, Homo sapiens
aaggagccccauuccu

SEQ ID NO: 826869 - RNA, 13 nt, Homo sapiens
aaggccucugugg

SEQ ID NO: 826870 - RNA, 16 nt, Homo sapiens
aagugaauacauuuug

SEQ ID NO: 826871 - RNA, 15 nt, Homo sapiens
aagugcgauaacuua

SEQ ID NO: 826872 - RNA, 20 nt, Homo sapiens
aaguuucuuuuuacauucau

SEQ ID NO: 826873 - RNA, 23 nt, Homo sapiens
aauauuguccauuguccaauccu

SEQ ID NO: 826874 - RNA, 12 nt, Homo sapiens
aauccaugaacc

SEQ ID NO: 826875 - RNA, 17 nt, Homo sapiens
aauccuucucacuaaaa

SEQ ID NO: 826876 - RNA, 21 nt, Homo sapiens
ccuuuggggugaacuaccuug

SEQ ID NO: 826877 - RNA, 14 nt, Homo sapiens
cgaacaauucauau

SEQ ID NO: 826878 - RNA, 21 nt, Homo sapiens
cgaacaauucauauauuugaa

SEQ ID NO: 826879 - RNA, 14 nt, Homo sapiens
cgaguguuugccag

SEQ ID NO: 826880 - RNA, 15 nt, Homo sapiens
cgggacaccuaggcu

SEQ ID NO: 826881 - RNA, 13 nt, Homo sapiens
cguaggaaaacca

SEQ ID NO: 826882 - RNA, 19 nt, Homo sapiens
cgugauuuugcuguagaag

SEQ ID NO: 826883 - RNA, 22 nt, Homo sapiens
cuacagagcuucccugacucau

SEQ ID NO: 826884 - RNA, 17 nt, Homo sapiens
cuaccagcuaugccaaa

SEQ ID NO: 826885 - RNA, 21 nt, Homo sapiens
cuacccccugugccuugucac

SEQ ID NO: 826886 - RNA, 15 nt, Homo sapiens
cuacugagacaugac

SEQ ID NO: 826887 - RNA, 15 nt, Homo sapiens
cuagggaucccucau

SEQ ID NO: 826888 - RNA, 13 nt, Homo sapiens
cuaguucugccag

SEQ ID NO: 826889 - RNA, 13 nt, Homo sapiens
cuaugaucuuggc

SEQ ID NO: 826890 - RNA, 14 nt, Homo sapiens
cuauguaacaugua

SEQ ID NO: 826891 - RNA, 22 nt, Homo sapiens
cuauguuuuuguucaaagccag

SEQ ID NO: 826892 - RNA, 19 nt, Homo sapiens
cuauuuuaagacgugaaug

SEQ ID NO: 826893 - RNA, 18 nt, Homo sapiens
cucagaggguguccugca

SEQ ID NO: 826894 - RNA, 16 nt, Homo sapiens
cucaggaaccgaggca

SEQ ID NO: 826895 - RNA, 16 nt, Homo sapiens
cucaucuuucuuccaa

SEQ ID NO: 826896 - RNA, 18 nt, Homo sapiens
cucaugugacucuuucca

SEQ ID NO: 826897 - RNA, 19 nt, Homo sapiens
cuccauguagaagccacua

SEQ ID NO: 826898 - RNA, 21 nt, Homo sapiens
cuccauguagaagccacuauu

SEQ ID NO: 826899 - RNA, 15 nt, Homo sapiens
cucuaaaacucucaa

SEQ ID NO: 826900 - RNA, 14 nt, Homo sapiens
cucugaaaccagug

SEQ ID NO: 826901 - RNA, 17 nt, Homo sapiens
cucugaaaccaguguua

SEQ ID NO: 826902 - RNA, 15 nt, Homo sapiens
cucugagcugugcag

SEQ ID NO: 826903 - RNA, 21 nt, Homo sapiens
cucugagguuuccgaaaucag

SEQ ID NO: 826904 - RNA, 15 nt, Homo sapiens
cugaccaauauugua

SEQ ID NO: 826905 - RNA, 20 nt, Homo sapiens
cugaccaauauuguacaguu

SEQ ID NO: 826906 - RNA, 12 nt, Homo sapiens
cugacugacaaa

SEQ ID NO: 826907 - RNA, 18 nt, Homo sapiens
cugagacaugacuaggaa

SEQ ID NO: 826908 - RNA, 14 nt, Homo sapiens
cugagagaggccau

SEQ ID NO: 826909 - RNA, 19 nt, Homo sapiens
cugagguuugccagcauuu

SEQ ID NO: 826910 - RNA, 15 nt, Homo sapiens
cugccgagaguccau

SEQ ID NO: 826911 - RNA, 21 nt, Homo sapiens
cugccuucaccuccucuuuca

SEQ ID NO: 826912 - RNA, 21 nt, Homo sapiens
cugccuugccaugucuuguuc

SEQ ID NO: 826913 - RNA, 15 nt, Homo sapiens
cugcuccccacguca

SEQ ID NO: 826914 - RNA, 13 nt, Homo sapiens
cuggacucucagu

SEQ ID NO: 826915 - RNA, 20 nt, Homo sapiens
cuggcuguggccuaaccugc

SEQ ID NO: 826916 - RNA, 14 nt, Homo sapiens
cuguaaccucuuca

SEQ ID NO: 826917 - RNA, 16 nt, Homo sapiens
cuguaccugugcacgu

SEQ ID NO: 826918 - RNA, 16 nt, Homo sapiens
cuguaggcacagacaa

SEQ ID NO: 826919 - RNA, 21 nt, Homo sapiens
cuguauaaucuauuuacauaa

SEQ ID NO: 826920 - RNA, 16 nt, Homo sapiens
cugugacuacuauggc

SEQ ID NO: 826921 - RNA, 15 nt, Homo sapiens
cuguggccaaguucu

SEQ ID NO: 826922 - RNA, 21 nt, Homo sapiens
cuuaaaaugugagugaccuca

SEQ ID NO: 826923 - RNA, 15 nt, Homo sapiens
cuuacuuaguguuau

SEQ ID NO: 826924 - RNA, 17 nt, Homo sapiens
cuuagcugaacaaugaa

SEQ ID NO: 826925 - RNA, 14 nt, Homo sapiens
cuuauauucaucca

SEQ ID NO: 826926 - RNA, 21 nt, Homo sapiens
cuucaugaucaucacaaucau

SEQ ID NO: 826927 - RNA, 15 nt, Homo sapiens
cuucccacggcuccu

SEQ ID NO: 826928 - RNA, 13 nt, Homo sapiens
cuucgaugacugg

SEQ ID NO: 826929 - RNA, 16 nt, Homo sapiens
cuucuaguucugccag

SEQ ID NO: 826930 - RNA, 12 nt, Homo sapiens
cuucucauuucu

SEQ ID NO: 826931 - RNA, 16 nt, Homo sapiens
cuucuggcacugugac

SEQ ID NO: 826932 - RNA, 14 nt, Homo sapiens
cuuucauacauuau

SEQ ID NO: 826933 - RNA, 14 nt, Homo sapiens
cuuuccaaccggcu

SEQ ID NO: 826934 - RNA, 13 nt, Homo sapiens
cuuucuuccaaac

SEQ ID NO: 826935 - RNA, 22 nt, Homo sapiens
cuuuggacuugucccgggacac

SEQ ID NO: 826936 - RNA, 22 nt, Homo sapiens
cuuuuaguucuuagagcacuuu

SEQ ID NO: 826937 - RNA, 19 nt, Homo sapiens
gaaaacacccuuaugaauu

SEQ ID NO: 826938 - RNA, 15 nt, Homo sapiens
gaaaacacugugcac

SEQ ID NO: 826939 - RNA, 16 nt, Homo sapiens
gaaaacacugugcaca

SEQ ID NO: 826940 - RNA, 18 nt, Homo sapiens
gaaaagaaaaaaaauaau

SEQ ID NO: 826941 - RNA, 17 nt, Homo sapiens
gaaaagggaacugaaca

SEQ ID NO: 826942 - RNA, 14 nt, Homo sapiens
gaaauauagagcau

SEQ ID NO: 826943 - RNA, 23 nt, Homo sapiens
gaaaugcugguuuuucaguuuuc

SEQ ID NO: 826944 - RNA, 16 nt, Homo sapiens
gaacugaacauuccag

SEQ ID NO: 826945 - RNA, 16 nt, Homo sapiens
gaagaaggaaacaccg

SEQ ID NO: 826946 - RNA, 18 nt, Homo sapiens
gaagcaucaaagcacugu

SEQ ID NO: 826947 - RNA, 14 nt, Homo sapiens
gaaugauucagugu

SEQ ID NO: 826948 - RNA, 17 nt, Homo sapiens
gaauuauauuuccuuaa

SEQ ID NO: 826949 - RNA, 15 nt, Homo sapiens
gacaugacuaggaag

SEQ ID NO: 826950 - RNA, 19 nt, Homo sapiens
gaccaaugucuugaugcau

SEQ ID NO: 826951 - RNA, 19 nt, Homo sapiens
gaccccagaggauugcugc

SEQ ID NO: 826952 - RNA, 23 nt, Homo sapiens
gacccuaaauguggacaucauga

SEQ ID NO: 826953 - RNA, 16 nt, Homo sapiens
gaccgaaucucacucu

SEQ ID NO: 826954 - RNA, 21 nt, Homo sapiens
gaccgauagcaggugaacucg

SEQ ID NO: 826955 - RNA, 17 nt, Homo sapiens
gaccugcccuacauauc

SEQ ID NO: 826956 - RNA, 13 nt, Homo sapiens
gacuccaguuaaa

SEQ ID NO: 826957 - RNA, 18 nt, Homo sapiens
gacucuuuccaaccggcu

SEQ ID NO: 826958 - RNA, 20 nt, Homo sapiens
gacuugucccgggacaccua

SEQ ID NO: 826959 - RNA, 13 nt, Homo sapiens
gagaguccaucag

SEQ ID NO: 826960 - RNA, 22 nt, Homo sapiens
caauucauauauuugaagugga

SEQ ID NO: 826961 - RNA, 12 nt, Homo sapiens
cacacuuugcca

SEQ ID NO: 826962 - RNA, 17 nt, Homo sapiens
cacaugucaguaccuuc

SEQ ID NO: 826963 - RNA, 17 nt, Homo sapiens
cacauucugcuaugaau

SEQ ID NO: 826964 - RNA, 14 nt, Homo sapiens
cacccaugccauag

SEQ ID NO: 826965 - RNA, 18 nt, Homo sapiens
cacugaaauagagugaau

SEQ ID NO: 826966 - RNA, 22 nt, Homo sapiens
cagaaaacauaugcauuaugaa

SEQ ID NO: 826967 - RNA, 15 nt, Homo sapiens
cagagcccaagggaa

SEQ ID NO: 826968 - RNA, 16 nt, Homo sapiens
cagagucccugccugg

SEQ ID NO: 826969 - RNA, 16 nt, Homo sapiens
cagagugaagcaucaa

SEQ ID NO: 826970 - RNA, 22 nt, Homo sapiens
cagagugagacccagcccucau

SEQ ID NO: 826971 - RNA, 13 nt, Homo sapiens
cagauaaugugaa

SEQ ID NO: 826972 - RNA, 21 nt, Homo sapiens
cagcauuuagacccugcauuu

SEQ ID NO: 826973 - RNA, 17 nt, Homo sapiens
cagccaaaaaggacuuu

SEQ ID NO: 826974 - RNA, 16 nt, Homo sapiens
cagccucuccacucau

SEQ ID NO: 826975 - RNA, 13 nt, Homo sapiens
cagcuaaagcaau

SEQ ID NO: 826976 - RNA, 19 nt, Homo sapiens
cagcucgggcccucuguga

SEQ ID NO: 826977 - RNA, 12 nt, Homo sapiens
cagcugggacac

SEQ ID NO: 826978 - RNA, 19 nt, Homo sapiens
cagggaaaauuauuugcau

SEQ ID NO: 826979 - RNA, 21 nt, Homo sapiens
caggguuagcucacgugucuu

SEQ ID NO: 826980 - RNA, 18 nt, Homo sapiens
cagguucuuuaaaaugcc

SEQ ID NO: 826981 - RNA, 19 nt, Homo sapiens
caguaaauauuaaccugaa

SEQ ID NO: 826982 - RNA, 17 nt, Homo sapiens
cagucuuccauuugcaa

SEQ ID NO: 826983 - RNA, 21 nt, Homo sapiens
cagugaaugauucaguguuaa

SEQ ID NO: 826984 - RNA, 22 nt, Homo sapiens
cauaccaaugaaaaaauguaua

SEQ ID NO: 826985 - RNA, 23 nt, Homo sapiens
cauauauuugaaguggagccaua

SEQ ID NO: 826986 - RNA, 17 nt, Homo sapiens
caucagugcucccucac

SEQ ID NO: 826987 - RNA, 17 nt, Homo sapiens
caucaucuccugccuuc

SEQ ID NO: 826988 - RNA, 17 nt, Homo sapiens
caucauucucugucuca

SEQ ID NO: 826989 - RNA, 15 nt, Homo sapiens
caucuuuguuuacca

SEQ ID NO: 826990 - RNA, 14 nt, Homo sapiens
caugaucaucacaa

SEQ ID NO: 826991 - RNA, 16 nt, Homo sapiens
cauggauuccacugaa

SEQ ID NO: 826992 - RNA, 22 nt, Homo sapiens
cauguauauuuuauaugaaaga

SEQ ID NO: 826993 - RNA, 17 nt, Homo sapiens
cauguguugccuggaag

SEQ ID NO: 826994 - RNA, 22 nt, Homo sapiens
cauguguugccuggaagcacau

SEQ ID NO: 826995 - RNA, 9 nt, Homo sapiens
cauucaguc

SEQ ID NO: 826996 - RNA, 12 nt, Homo sapiens
cauucucugucu

SEQ ID NO: 826997 - RNA, 14 nt, Homo sapiens
cauugaucugggau

SEQ ID NO: 826998 - RNA, 13 nt, Homo sapiens
cauuuauagcaua

SEQ ID NO: 826999 - RNA, 14 nt, Homo sapiens
cauuugagugucuu

SEQ ID NO: 827000 - RNA, 15 nt, Homo sapiens
ccaaaaguacuuacc

SEQ ID NO: 827001 - RNA, 13 nt, Homo sapiens
ccaaagcuauaug

SEQ ID NO: 827002 - RNA, 22 nt, Homo sapiens
ccacgagcuguuuacuagggau

SEQ ID NO: 827003 - RNA, 16 nt, Homo sapiens
ccacuccucugacuca

SEQ ID NO: 827004 - RNA, 16 nt, Homo sapiens
ccacuuuuaaaacuau

SEQ ID NO: 827005 - RNA, 22 nt, Homo sapiens
ccagaacauggauuccacugaa

SEQ ID NO: 827006 - RNA, 20 nt, Homo sapiens
ccagacuucccacggcuccu

SEQ ID NO: 827007 - RNA, 17 nt, Homo sapiens
ccagagaaaaagggagg

SEQ ID NO: 827008 - RNA, 17 nt, Homo sapiens
ccagcaacauugaccca

SEQ ID NO: 827009 - RNA, 19 nt, Homo sapiens
ccaugaaccaagaccauug

SEQ ID NO: 827010 - RNA, 16 nt, Homo sapiens
ccauggugugaucguc

SEQ ID NO: 827011 - RNA, 17 nt, Homo sapiens
cccaggcuggagugcag

SEQ ID NO: 827012 - RNA, 14 nt, Homo sapiens
ccccaauccaugaa

SEQ ID NO: 827013 - RNA, 15 nt, Homo sapiens
ccccauuccugggaa

SEQ ID NO: 827014 - RNA, 12 nt, Homo sapiens
cccccugugcag

SEQ ID NO: 827015 - RNA, 17 nt, Homo sapiens
cccuaaaucuugacuac

SEQ ID NO: 827016 - RNA, 22 nt, Homo sapiens
cccuaaauguggacaucaugaa

SEQ ID NO: 827017 - RNA, 12 nt, Homo sapiens
cccugcauuuau

SEQ ID NO: 827018 - RNA, 20 nt, Homo sapiens
cccuggggagucugggcaca

SEQ ID NO: 827019 - RNA, 22 nt, Homo sapiens
ccgacuuuuguuuaccagagaa

SEQ ID NO: 827020 - RNA, 12 nt, Homo sapiens
ccgcguggaaug

SEQ ID NO: 827021 - RNA, 14 nt, Homo sapiens
ccuauguaugccau

SEQ ID NO: 827022 - RNA, 23 nt, Homo sapiens
ccuauguuuuuguucaaagccag

SEQ ID NO: 827023 - RNA, 14 nt, Homo sapiens
ccucgcugccagcu

SEQ ID NO: 827024 - RNA, 13 nt, Homo sapiens
ccucuccacucau

SEQ ID NO: 827025 - RNA, 12 nt, Homo sapiens
ccucucugcucu

SEQ ID NO: 827026 - RNA, 18 nt, Homo sapiens
ccucuguccaggcacuga

SEQ ID NO: 827027 - RNA, 22 nt, Homo sapiens
ccugacccucaucuuucuucca

SEQ ID NO: 827028 - RNA, 15 nt, Homo sapiens
ccugagguuugccag

SEQ ID NO: 827029 - RNA, 22 nt, Homo sapiens
ccugagguuugccagcauuuag

SEQ ID NO: 827030 - RNA, 15 nt, Homo sapiens
ccugcccuacauauc

SEQ ID NO: 827031 - RNA, 17 nt, Homo sapiens
ccuucaugaucaucaca

SEQ ID NO: 827032 - RNA, 12 nt, Homo sapiens
ccuucaugauga

SEQ ID NO: 827033 - RNA, 19 nt, Homo sapiens
ccuucuccauccacauggg

SEQ ID NO: 827034 - RNA, 14 nt, Homo sapiens
ccuugccaugucuu

SEQ ID NO: 827035 - RNA, 19 nt, Homo sapiens
ccuugguucccccacugau

SEQ ID NO: 827036 - RNA, 20 nt, Homo sapiens
ccuugucguaggaaaaccau

SEQ ID NO: 827037 - RNA, 22 nt, Homo sapiens
ccuugucguaggaaaaccauga

SEQ ID NO: 827038 - RNA, 20 nt, Homo sapiens
ccuuuggacuugucccggga

SEQ ID NO: 827039 - RNA, 16 nt, Homo sapiens
cgaacaauucauauau

SEQ ID NO: 827040 - RNA, 11 nt, Homo sapiens
cgaucuuggcu

SEQ ID NO: 827041 - RNA, 14 nt, Homo sapiens
cgcugccuugccau

SEQ ID NO: 827042 - RNA, 18 nt, Homo sapiens
cgggagccugacccucau

SEQ ID NO: 827043 - RNA, 13 nt, Homo sapiens
cguccuacuguau

SEQ ID NO: 827044 - RNA, 13 nt, Homo sapiens
cgugggcucccug

SEQ ID NO: 827045 - RNA, 19 nt, Homo sapiens
cgugguaggacuguagaaa

SEQ ID NO: 827046 - RNA, 22 nt, Homo sapiens
cuaaaauuguaucaaaugugac

SEQ ID NO: 827047 - RNA, 16 nt, Homo sapiens
cuaagagaacaaugug

SEQ ID NO: 827048 - RNA, 20 nt, Homo sapiens
cuacccccugugccuuguca

SEQ ID NO: 827049 - RNA, 22 nt, Homo sapiens
cuaccuugguucccccacugau

SEQ ID NO: 827050 - RNA, 13 nt, Homo sapiens
cuagcuugcagaa

SEQ ID NO: 827051 - RNA, 16 nt, Homo sapiens
cuagggccaagcccag

SEQ ID NO: 827052 - RNA, 17 nt, Homo sapiens
cuaguucugccaggaga

SEQ ID NO: 827053 - RNA, 14 nt, Homo sapiens
cuauguuauauuga

SEQ ID NO: 827054 - RNA, 17 nt, Homo sapiens
cucaucccgagcaccuc

SEQ ID NO: 827055 - RNA, 21 nt, Homo sapiens
cucauuggacccuuccauggu

SEQ ID NO: 827056 - RNA, 15 nt, Homo sapiens
cuccucgagauccca

SEQ ID NO: 827057 - RNA, 22 nt, Homo sapiens
cuccucgagaucccaacacugc

SEQ ID NO: 827058 - RNA, 16 nt, Homo sapiens
cuccuguugcaaugac

SEQ ID NO: 827059 - RNA, 19 nt, Homo sapiens
cucgugguaggacuguaga

SEQ ID NO: 827060 - RNA, 17 nt, Homo sapiens
cucuaugaucuuggcac

SEQ ID NO: 827061 - RNA, 18 nt, Homo sapiens
cucugacucagggcuccu

SEQ ID NO: 827062 - RNA, 10 nt, Homo sapiens
cucuguccag

SEQ ID NO: 827063 - RNA, 17 nt, Homo sapiens
cugaaauaaaauucauu

SEQ ID NO: 827064 - RNA, 22 nt, Homo sapiens
cugagagaggccauucuuuccc

SEQ ID NO: 827065 - RNA, 22 nt, Homo sapiens
cugagcagugaaugauucagug

SEQ ID NO: 827066 - RNA, 23 nt, Homo sapiens
uuugccauauuuucaccauuuga

SEQ ID NO: 827067 - RNA, 17 nt, Homo sapiens
uuuggaauauuguccau

SEQ ID NO: 827068 - RNA, 15 nt, Homo sapiens
uuuuacauucauauc

SEQ ID NO: 827069 - RNA, 20 nt, Homo sapiens
uuuugagaauacacuaucaa

SEQ ID NO: 827070 - RNA, 21 nt, Homo sapiens
uuuugcacaaaguaagccuca

SEQ ID NO: 827071 - RNA, 19 nt, Homo sapiens
uuuuugaaaaaaguauagg

SEQ ID NO: 827072 - RNA, 16 nt, Homo sapiens
aaaacaagcauucaca

SEQ ID NO: 827073 - RNA, 13 nt, Homo sapiens
aaaacacugugca

SEQ ID NO: 827074 - RNA, 11 nt, Homo sapiens
aaaacauaugc

SEQ ID NO: 827075 - RNA, 13 nt, Homo sapiens
aaaacaugacuuu

SEQ ID NO: 827076 - RNA, 20 nt, Homo sapiens
aaaaggacucucaggaccaa

SEQ ID NO: 827077 - RNA, 13 nt, Homo sapiens
aaaauacaugaca

SEQ ID NO: 827078 - RNA, 14 nt, Homo sapiens
aaaauaucuugcaa

SEQ ID NO: 827079 - RNA, 13 nt, Homo sapiens
aaacaaacaugac

SEQ ID NO: 827080 - RNA, 20 nt, Homo sapiens
aaacaugguggguccauggg

SEQ ID NO: 827081 - RNA, 23 nt, Homo sapiens
aaacucucaagcagacgugagug

SEQ ID NO: 827082 - RNA, 18 nt, Homo sapiens
aaagaaauuguauuauca

SEQ ID NO: 827083 - RNA, 16 nt, Homo sapiens
aaagacuacacuguug

SEQ ID NO: 827084 - RNA, 19 nt, Homo sapiens
aaagaggaaaagugcaaug

SEQ ID NO: 827085 - RNA, 16 nt, Homo sapiens
aaaggaaaaacugaug

SEQ ID NO: 827086 - RNA, 21 nt, Homo sapiens
aaauacagucuuccauuugca

SEQ ID NO: 827087 - RNA, 16 nt, Homo sapiens
aaauauagagcauuaa

SEQ ID NO: 827088 - RNA, 15 nt, Homo sapiens
aaaucuugacuacag

SEQ ID NO: 827089 - RNA, 17 nt, Homo sapiens
aaaugaaaaugucuugu

SEQ ID NO: 827090 - RNA, 18 nt, Homo sapiens
aaauguauggcaugugua

SEQ ID NO: 827091 - RNA, 17 nt, Homo sapiens
aaauguggacaucauga

SEQ ID NO: 827092 - RNA, 20 nt, Homo sapiens
aaauuguaucaaaugugaca

SEQ ID NO: 827093 - RNA, 22 nt, Homo sapiens
aaauuguaucaaaugugacauu

SEQ ID NO: 827094 - RNA, 15 nt, Homo sapiens
aacaaauguauuuca

SEQ ID NO: 827095 - RNA, 19 nt, Homo sapiens
aacagccaaaaaggacuuu

SEQ ID NO: 827096 - RNA, 19 nt, Homo sapiens
aaccgcuugccauauuccg

SEQ ID NO: 827097 - RNA, 20 nt, Homo sapiens
aaccgcuugccauauuccga

SEQ ID NO: 827098 - RNA, 16 nt, Homo sapiens
aaccugaauuauucca

SEQ ID NO: 827099 - RNA, 12 nt, Homo sapiens
aacuacugauaa

SEQ ID NO: 827100 - RNA, 16 nt, Homo sapiens
aacuauguaacaugua

SEQ ID NO: 827101 - RNA, 18 nt, Homo sapiens
aacugccagaacauggau

SEQ ID NO: 827102 - RNA, 13 nt, Homo sapiens
aacugugcaguga

SEQ ID NO: 827103 - RNA, 12 nt, Homo sapiens
aacuucuuguug

SEQ ID NO: 827104 - RNA, 19 nt, Homo sapiens
aagaccgauagcaggugaa

SEQ ID NO: 827105 - RNA, 23 nt, Homo sapiens
aagacgugauuuugcuguagaag

SEQ ID NO: 827106 - RNA, 20 nt, Homo sapiens
aagagggugauugcuggggc

SEQ ID NO: 827107 - RNA, 20 nt, Homo sapiens
aagauggcacuuauaaccaa

SEQ ID NO: 827108 - RNA, 23 nt, Homo sapiens
aagauuuauuaauuaaaccagac

SEQ ID NO: 827109 - RNA, 22 nt, Homo sapiens
aagauuuuuuuuguaacuucaa

SEQ ID NO: 827110 - RNA, 15 nt, Homo sapiens
aagcagaccacugau

SEQ ID NO: 827111 - RNA, 15 nt, Homo sapiens
aagcaguuaguuccu

SEQ ID NO: 827112 - RNA, 19 nt, Homo sapiens
aagcaucaaagcacuguuu

SEQ ID NO: 827113 - RNA, 22 nt, Homo sapiens
aagcuuucauguaaacugugca

SEQ ID NO: 827114 - RNA, 20 nt, Homo sapiens
aagggaauucggugugcacc

SEQ ID NO: 827115 - RNA, 16 nt, Homo sapiens
aagucauaccaaugaa

SEQ ID NO: 827116 - RNA, 18 nt, Homo sapiens
aaguucuuaguugcugua

SEQ ID NO: 827117 - RNA, 20 nt, Homo sapiens
aauaaaccaucaucuugcca

SEQ ID NO: 827118 - RNA, 14 nt, Homo sapiens
aauacauuuugcac

SEQ ID NO: 827119 - RNA, 20 nt, Homo sapiens
aauauauuuauauguacaua

SEQ ID NO: 827120 - RNA, 17 nt, Homo sapiens
aauauuuaaacuucuug

SEQ ID NO: 827121 - RNA, 22 nt, Homo sapiens
aaugugaaaaugguccaggaga

SEQ ID NO: 827122 - RNA, 12 nt, Homo sapiens
aaugugauugca

SEQ ID NO: 827123 - RNA, 17 nt, Homo sapiens
aauuaauuuucuaugaa

SEQ ID NO: 827124 - RNA, 22 nt, Homo sapiens
aauuauuugcauaacaauuccu

SEQ ID NO: 827125 - RNA, 23 nt, Homo sapiens
aauucucccacacuagcuugcag

SEQ ID NO: 827126 - RNA, 20 nt, Homo sapiens
aauuuucuaugaauugcuaa

SEQ ID NO: 827127 - RNA, 19 nt, Homo sapiens
aauuuucuuucauacauua

SEQ ID NO: 827128 - RNA, 17 nt, Homo sapiens
acaaauuguacauuuga

SEQ ID NO: 827129 - RNA, 19 nt, Homo sapiens
acaaucaucaucauucuca

SEQ ID NO: 827130 - RNA, 22 nt, Homo sapiens
acacuguucccagcuaccagcu

SEQ ID NO: 827131 - RNA, 19 nt, Homo sapiens
acagagcuucccugacuca

SEQ ID NO: 827132 - RNA, 19 nt, Homo sapiens
acagaguugguguucauaa

SEQ ID NO: 827133 - RNA, 20 nt, Homo sapiens
acagcucgggcccucuguga

SEQ ID NO: 827134 - RNA, 18 nt, Homo sapiens
acagucuuccauuugcaa

SEQ ID NO: 827135 - RNA, 15 nt, Homo sapiens
acaucugugucuugu

SEQ ID NO: 827136 - RNA, 20 nt, Homo sapiens
acaucuuuguuuaccauuaa

SEQ ID NO: 827137 - RNA, 14 nt, Homo sapiens
acauggauuccacu

SEQ ID NO: 827138 - RNA, 18 nt, Homo sapiens
acauucugcuaugaauua

SEQ ID NO: 827139 - RNA, 13 nt, Homo sapiens
accaauauuguac

SEQ ID NO: 827140 - RNA, 20 nt, Homo sapiens
accaauauuguacaguuuuu

SEQ ID NO: 827141 - RNA, 13 nt, Homo sapiens
accaaugucuuga

SEQ ID NO: 827142 - RNA, 20 nt, Homo sapiens
accauaaaaauccuucucac

SEQ ID NO: 827143 - RNA, 22 nt, Homo sapiens
accauuaaaaaguuggaguuau

SEQ ID NO: 827144 - RNA, 19 nt, Homo sapiens
acccauauauaauucuccc

SEQ ID NO: 827145 - RNA, 18 nt, Homo sapiens
acccucaucuuucuucca

SEQ ID NO: 827146 - RNA, 14 nt, Homo sapiens
accgcuugccauau

SEQ ID NO: 827147 - RNA, 16 nt, Homo sapiens
accggggccugggcag

SEQ ID NO: 827148 - RNA, 17 nt, Homo sapiens
accguugcacaaaaagg

SEQ ID NO: 827149 - RNA, 13 nt, Homo sapiens
accuacaguguac

SEQ ID NO: 827150 - RNA, 14 nt, Homo sapiens
accuacaguguaca

SEQ ID NO: 827151 - RNA, 22 nt, Homo sapiens
accuagagggcccccuacuugu

SEQ ID NO: 827152 - RNA, 18 nt, Homo sapiens
accugaaauaaaauucau

SEQ ID NO: 827153 - RNA, 15 nt, Homo sapiens
accugcaaacuccuu

SEQ ID NO: 827154 - RNA, 21 nt, Homo sapiens
accugugcacguuggaacuuu

SEQ ID NO: 827155 - RNA, 15 nt, Homo sapiens
acgccagacuuccca

SEQ ID NO: 827156 - RNA, 20 nt, Homo sapiens
acggagccacuccucugacu

SEQ ID NO: 827157 - RNA, 18 nt, Homo sapiens
acgugauuuugcuguaga

SEQ ID NO: 827158 - RNA, 15 nt, Homo sapiens
acuagggaucccuca

SEQ ID NO: 827159 - RNA, 12 nt, Homo sapiens
acuauuacuggg

SEQ ID NO: 827160 - RNA, 13 nt, Homo sapiens
acucagggcuccu

SEQ ID NO: 827161 - RNA, 14 nt, Homo sapiens
acucccauuuuccc

SEQ ID NO: 827162 - RNA, 18 nt, Homo sapiens
acugaaauagagugaauu

SEQ ID NO: 827163 - RNA, 15 nt, Homo sapiens
acugacaaauucugu

SEQ ID NO: 827164 - RNA, 22 nt, Homo sapiens
acugauuaccuccuguguggaa

SEQ ID NO: 827165 - RNA, 22 nt, Homo sapiens
acugcagggaaaauuauuugca

SEQ ID NO: 827166 - RNA, 17 nt, Homo sapiens
acugccagaacauggau

SEQ ID NO: 827167 - RNA, 19 nt, Homo sapiens
acuguacauaaaaugucau

SEQ ID NO: 827168 - RNA, 18 nt, Homo sapiens
acuguucccccugugcag

SEQ ID NO: 827169 - RNA, 16 nt, Homo sapiens
acuucccacggcuccu

SEQ ID NO: 827170 - RNA, 15 nt, Homo sapiens
acuucuggcacugug

SEQ ID NO: 827171 - RNA, 19 nt, Homo sapiens
acuucuggcacugugacua

SEQ ID NO: 827172 - RNA, 12 nt, Homo sapiens
agaaacugagaa

SEQ ID NO: 827173 - RNA, 23 nt, Homo sapiens
agaaacugaggccauuauuucaa

SEQ ID NO: 827174 - RNA, 14 nt, Homo sapiens
agaacuacugauaa

SEQ ID NO: 827175 - RNA, 15 nt, Homo sapiens
agaagacacagggga

SEQ ID NO: 827176 - RNA, 15 nt, Homo sapiens
agaauagaaaacacg

SEQ ID NO: 827177 - RNA, 16 nt, Homo sapiens
guccaggcacugagau

SEQ ID NO: 827178 - RNA, 17 nt, Homo sapiens
guccauuguccaauccu

SEQ ID NO: 827179 - RNA, 16 nt, Homo sapiens
gucgaacaauucauau

SEQ ID NO: 827180 - RNA, 23 nt, Homo sapiens
gucucgugguaggacuguagaaa

SEQ ID NO: 827181 - RNA, 23 nt, Homo sapiens
gucugaaucauccgaggcaaaga

SEQ ID NO: 827182 - RNA, 14 nt, Homo sapiens
gugacucuuuccaa

SEQ ID NO: 827183 - RNA, 22 nt, Homo sapiens
gugccuugucacgccagacuuc

SEQ ID NO: 827184 - RNA, 19 nt, Homo sapiens
guguaucgcugccuugcca

SEQ ID NO: 827185 - RNA, 22 nt, Homo sapiens
guguguaucgcugccuugccau

SEQ ID NO: 827186 - RNA, 21 nt, Homo sapiens
guguguguuacauacacagaa

SEQ ID NO: 827187 - RNA, 19 nt, Homo sapiens
guuaaggcagugacuuuag

SEQ ID NO: 827188 - RNA, 21 nt, Homo sapiens
guuaccugaaaacacugugca

SEQ ID NO: 827189 - RNA, 19 nt, Homo sapiens
guucuuagcugaacaauga

SEQ ID NO: 827190 - RNA, 17 nt, Homo sapiens
guuugauuauucagugu

SEQ ID NO: 827191 - RNA, 14 nt, Homo sapiens
guuuuugcagagaa

SEQ ID NO: 827192 - RNA, 22 nt, Homo sapiens
uaaaacucucaagcagacguga

SEQ ID NO: 827193 - RNA, 12 nt, Homo sapiens
uaaaaugccaag

SEQ ID NO: 827194 - RNA, 17 nt, Homo sapiens
uaaaccaucaucuugcc

SEQ ID NO: 827195 - RNA, 14 nt, Homo sapiens
uaaagacuaacuaa

SEQ ID NO: 827196 - RNA, 22 nt, Homo sapiens
uaaauauuaaccugaauuauuc

SEQ ID NO: 827197 - RNA, 13 nt, Homo sapiens
uaacaaaaguaua

SEQ ID NO: 827198 - RNA, 15 nt, Homo sapiens
uaacaaaaguauagu

SEQ ID NO: 827199 - RNA, 22 nt, Homo sapiens
uaagccucaccuuugccuucca

SEQ ID NO: 827200 - RNA, 16 nt, Homo sapiens
uaauaaaaguacaugu

SEQ ID NO: 827201 - RNA, 22 nt, Homo sapiens
uacaguaggagcccagcucuga

SEQ ID NO: 827202 - RNA, 20 nt, Homo sapiens
uacaguuuuuauugcuuguu

SEQ ID NO: 827203 - RNA, 19 nt, Homo sapiens
uacauauauauguaugugg

SEQ ID NO: 827204 - RNA, 13 nt, Homo sapiens
uaccagcuaugcc

SEQ ID NO: 827205 - RNA, 17 nt, Homo sapiens
uacccccugugccuugu

SEQ ID NO: 827206 - RNA, 14 nt, Homo sapiens
uaccugacacuccc

SEQ ID NO: 827207 - RNA, 21 nt, Homo sapiens
uaccugcccccaauccaugaa

SEQ ID NO: 827208 - RNA, 21 nt, Homo sapiens
uaccuugguucccccacugau

SEQ ID NO: 827209 - RNA, 16 nt, Homo sapiens
uacuccaugcacauag

SEQ ID NO: 827210 - RNA, 21 nt, Homo sapiens
uacuuacaucuuuguuuacca

SEQ ID NO: 827211 - RNA, 21 nt, Homo sapiens
uacuuuugcccuuugauuaaa

SEQ ID NO: 827212 - RNA, 16 nt, Homo sapiens
uagaaaagggaacuga

SEQ ID NO: 827213 - RNA, 14 nt, Homo sapiens
uagaagauggcacu

SEQ ID NO: 827214 - RNA, 21 nt, Homo sapiens
uagacccugcauuuauagcau

SEQ ID NO: 827215 - RNA, 20 nt, Homo sapiens
uagcaaaauacaugacauuu

SEQ ID NO: 827216 - RNA, 15 nt, Homo sapiens
uagcacaugauuuuc

SEQ ID NO: 827217 - RNA, 13 nt, Homo sapiens
uagcauacgguau

SEQ ID NO: 827218 - RNA, 14 nt, Homo sapiens
uaggaaaaccauga

SEQ ID NO: 827219 - RNA, 14 nt, Homo sapiens
uagggaucccucau

SEQ ID NO: 827220 - RNA, 12 nt, Homo sapiens
uaguaacaugug

SEQ ID NO: 827221 - RNA, 13 nt, Homo sapiens
uaguucugccagg

SEQ ID NO: 827222 - RNA, 16 nt, Homo sapiens
uauaaaagacugacca

SEQ ID NO: 827223 - RNA, 21 nt, Homo sapiens
uauaaaauuauauucacuacu

SEQ ID NO: 827224 - RNA, 13 nt, Homo sapiens
uauaaaugugauu

SEQ ID NO: 827225 - RNA, 22 nt, Homo sapiens
uauagucgaacaauucauauau

SEQ ID NO: 827226 - RNA, 21 nt, Homo sapiens
uauauauuuuugugcacauuu

SEQ ID NO: 827227 - RNA, 15 nt, Homo sapiens
uauauguacauacau

SEQ ID NO: 827228 - RNA, 18 nt, Homo sapiens
uauauuaaagacuaacua

SEQ ID NO: 827229 - RNA, 19 nt, Homo sapiens
uauauuuauuuauguagga

SEQ ID NO: 827230 - RNA, 15 nt, Homo sapiens
uaucgcugccuugcc

SEQ ID NO: 827231 - RNA, 21 nt, Homo sapiens
uaugccauggaggcacuaaca

SEQ ID NO: 827232 - RNA, 12 nt, Homo sapiens
uauguacauaca

SEQ ID NO: 827233 - RNA, 18 nt, Homo sapiens
uauguacauacauauaua

SEQ ID NO: 827234 - RNA, 18 nt, Homo sapiens
uauguuauuggaauuuuc

SEQ ID NO: 827235 - RNA, 15 nt, Homo sapiens
uauugcagcuuauau

SEQ ID NO: 827236 - RNA, 17 nt, Homo sapiens
uauuuuaagacgugaau

SEQ ID NO: 827237 - RNA, 15 nt, Homo sapiens
ucaaccgcuugccau

SEQ ID NO: 827238 - RNA, 22 nt, Homo sapiens
ucaagcagacgugagugugacu

SEQ ID NO: 827239 - RNA, 12 nt, Homo sapiens
ucaauccagcua

SEQ ID NO: 827240 - RNA, 23 nt, Homo sapiens
ucaccauuuggcaaugccaucau

SEQ ID NO: 827241 - RNA, 15 nt, Homo sapiens
ucacuauuacuugaa

SEQ ID NO: 827242 - RNA, 14 nt, Homo sapiens
ucacuucgaugacu

SEQ ID NO: 827243 - RNA, 19 nt, Homo sapiens
ucacuucgaugacuggaua

SEQ ID NO: 827244 - RNA, 18 nt, Homo sapiens
ucagaaaauacuagccua

SEQ ID NO: 827245 - RNA, 18 nt, Homo sapiens
ucagauaccgacuggggc

SEQ ID NO: 827246 - RNA, 23 nt, Homo sapiens
ucagauauaaaagacugaccaau

SEQ ID NO: 827247 - RNA, 16 nt, Homo sapiens
ucagcaccuacagugu

SEQ ID NO: 827248 - RNA, 19 nt, Homo sapiens
ucagucucugagcagugaa

SEQ ID NO: 827249 - RNA, 18 nt, Homo sapiens
ucagugaauaaaccauca

SEQ ID NO: 827250 - RNA, 15 nt, Homo sapiens
ucaguguuaaaugug

SEQ ID NO: 827251 - RNA, 10 nt, Homo sapiens
ucauauugau

SEQ ID NO: 827252 - RNA, 20 nt, Homo sapiens
ucauauugaugugugucuag

SEQ ID NO: 827253 - RNA, 17 nt, Homo sapiens
ucauguaaacugugcac

SEQ ID NO: 827254 - RNA, 13 nt, Homo sapiens
ucauuuaccauaa

SEQ ID NO: 827255 - RNA, 19 nt, Homo sapiens
uccaaaaccuaaagaggaa

SEQ ID NO: 827256 - RNA, 12 nt, Homo sapiens
uccaaucagaac

SEQ ID NO: 827257 - RNA, 23 nt, Homo sapiens
uccacucaugugacucuuuccaa

SEQ ID NO: 827258 - RNA, 18 nt, Homo sapiens
uccaucagccuccauccu

SEQ ID NO: 827259 - RNA, 19 nt, Homo sapiens
ucccagcuauuccuacucu

SEQ ID NO: 827260 - RNA, 22 nt, Homo sapiens
uccccuggggagucugggcaca

SEQ ID NO: 827261 - RNA, 15 nt, Homo sapiens
uccccuuccacugag

SEQ ID NO: 827262 - RNA, 13 nt, Homo sapiens
ucccuuuacauau

SEQ ID NO: 827263 - RNA, 15 nt, Homo sapiens
uccgaggcaaagaga

SEQ ID NO: 827264 - RNA, 13 nt, Homo sapiens
uccgaguguuugc

SEQ ID NO: 827265 - RNA, 22 nt, Homo sapiens
uccuacccccugugccuuguca

SEQ ID NO: 827266 - RNA, 13 nt, Homo sapiens
uccucugacucag

SEQ ID NO: 827267 - RNA, 20 nt, Homo sapiens
uccucugcccgggagcucag

SEQ ID NO: 827268 - RNA, 19 nt, Homo sapiens
uccuguguggaagaaggaa

SEQ ID NO: 827269 - RNA, 24 nt, Homo sapiens
uccuguugcaaugacacauaggaa

SEQ ID NO: 827270 - RNA, 21 nt, Homo sapiens
uccuugucguaggaaaaccau

SEQ ID NO: 827271 - RNA, 22 nt, Homo sapiens
uccuugucguaggaaaaccaug

SEQ ID NO: 827272 - RNA, 15 nt, Homo sapiens
ucgaacaauucauau

SEQ ID NO: 827273 - RNA, 22 nt, Homo sapiens
ucgauauaugacuuuuucucag

SEQ ID NO: 827274 - RNA, 16 nt, Homo sapiens
ucgcccacaaacugau

SEQ ID NO: 827275 - RNA, 20 nt, Homo sapiens
ucgcccacaaacugauuucu

SEQ ID NO: 827276 - RNA, 19 nt, Homo sapiens
ucuacagagcuucccugac

SEQ ID NO: 827277 - RNA, 21 nt, Homo sapiens
ucuacuaacaaucagcuccuu

SEQ ID NO: 827278 - RNA, 23 nt, Homo sapiens
ucuaguugauugcgagaauuuuc

SEQ ID NO: 827279 - RNA, 13 nt, Homo sapiens
ucuauuaucucaa

SEQ ID NO: 827280 - RNA, 19 nt, Homo sapiens
ucucaggaccaaagcuuuc

SEQ ID NO: 827281 - RNA, 16 nt, Homo sapiens
ucucccuccucugccc

SEQ ID NO: 827282 - RNA, 19 nt, Homo sapiens
aacuuuuugcaaggcauuu

SEQ ID NO: 827283 - RNA, 11 nt, Homo sapiens
aagacugacca

SEQ ID NO: 827284 - RNA, 17 nt, Homo sapiens
aagcaauacuguacaua

SEQ ID NO: 827285 - RNA, 20 nt, Homo sapiens
aagcaggaaaugaaaauguc

SEQ ID NO: 827286 - RNA, 13 nt, Homo sapiens
aagcaggaaccaa

SEQ ID NO: 827287 - RNA, 21 nt, Homo sapiens
aagccacggaccguugcacaa

SEQ ID NO: 827288 - RNA, 11 nt, Homo sapiens
aaggacucuca

SEQ ID NO: 827289 - RNA, 14 nt, Homo sapiens
aaggcucuuuugua

SEQ ID NO: 827290 - RNA, 18 nt, Homo sapiens
aaguacauguuaaacuua

SEQ ID NO: 827291 - RNA, 14 nt, Homo sapiens
aagucuggcacuuc

SEQ ID NO: 827292 - RNA, 16 nt, Homo sapiens
aaguuuaauugacuua

SEQ ID NO: 827293 - RNA, 19 nt, Homo sapiens
aaguuucuuuuuacauuca

SEQ ID NO: 827294 - RNA, 18 nt, Homo sapiens
aaguuugggaagggaugg

SEQ ID NO: 827295 - RNA, 13 nt, Homo sapiens
aauaacagugugu

SEQ ID NO: 827296 - RNA, 20 nt, Homo sapiens
aauacagucuuccauuugca

SEQ ID NO: 827297 - RNA, 21 nt, Homo sapiens
aauacagucuuccauuugcaa

SEQ ID NO: 827298 - RNA, 13 nt, Homo sapiens
aauagagugaauu

SEQ ID NO: 827299 - RNA, 17 nt, Homo sapiens
aaucagaacuguuggca

SEQ ID NO: 827300 - RNA, 22 nt, Homo sapiens
aaucagucuuggaauacuugaa

SEQ ID NO: 827301 - RNA, 20 nt, Homo sapiens
aauccaugaaccaagaccau

SEQ ID NO: 827302 - RNA, 20 nt, Homo sapiens
gcagcuuagacuaaggccau

SEQ ID NO: 827303 - RNA, 18 nt, Homo sapiens
gcaggaaaugaaaauguc

SEQ ID NO: 827304 - RNA, 20 nt, Homo sapiens
gcagguggggagacugggcu

SEQ ID NO: 827305 - RNA, 15 nt, Homo sapiens
gcagugacuuuagaa

SEQ ID NO: 827306 - RNA, 16 nt, Homo sapiens
gcauguguaguuaauu

SEQ ID NO: 827307 - RNA, 13 nt, Homo sapiens
gcauuaacaaagu

SEQ ID NO: 827308 - RNA, 14 nt, Homo sapiens
gccagaaaacauau

SEQ ID NO: 827309 - RNA, 18 nt, Homo sapiens
gccagacuucccacggcu

SEQ ID NO: 827310 - RNA, 22 nt, Homo sapiens
gccauaugaaugucaguaguuu

SEQ ID NO: 827311 - RNA, 20 nt, Homo sapiens
gcccaggcuggagugcagug

SEQ ID NO: 827312 - RNA, 21 nt, Homo sapiens
gcccuucccacaggacauuuc

SEQ ID NO: 827313 - RNA, 20 nt, Homo sapiens
gccuccuccagaauggagcu

SEQ ID NO: 827314 - RNA, 14 nt, Homo sapiens
gccucugaagccua

SEQ ID NO: 827315 - RNA, 15 nt, Homo sapiens
gccuuaaccaugagg

SEQ ID NO: 827316 - RNA, 20 nt, Homo sapiens
gccuugucacgccagacuuc

SEQ ID NO: 827317 - RNA, 14 nt, Homo sapiens
gcggggugcagaag

SEQ ID NO: 827318 - RNA, 23 nt, Homo sapiens
gcugaaacguggguaaggauuua

SEQ ID NO: 827319 - RNA, 18 nt, Homo sapiens
gcugccagcucuguauca

SEQ ID NO: 827320 - RNA, 16 nt, Homo sapiens
gcugccucuaccugac

SEQ ID NO: 827321 - RNA, 14 nt, Homo sapiens
gcuguagaagaugg

SEQ ID NO: 827322 - RNA, 19 nt, Homo sapiens
gcuguggccuaaccugccg

SEQ ID NO: 827323 - RNA, 23 nt, Homo sapiens
gcuuaaggagaggagaaacugag

SEQ ID NO: 827324 - RNA, 15 nt, Homo sapiens
gcuucccugacucau

SEQ ID NO: 827325 - RNA, 16 nt, Homo sapiens
ggagcuggcccucucc

SEQ ID NO: 827326 - RNA, 21 nt, Homo sapiens
ggaggcuccagagggcacucu

SEQ ID NO: 827327 - RNA, 17 nt, Homo sapiens
ggauacagaaugaaucc

SEQ ID NO: 827328 - RNA, 17 nt, Homo sapiens
ggaugguggagggccac

SEQ ID NO: 827329 - RNA, 17 nt, Homo sapiens
ggcaggaccuguggcca

SEQ ID NO: 827330 - RNA, 16 nt, Homo sapiens
ggcauguguaguuaau

SEQ ID NO: 827331 - RNA, 23 nt, Homo sapiens
ggcccuucccacaggacauuucu

SEQ ID NO: 827332 - RNA, 14 nt, Homo sapiens
ggccuuaaccauga

SEQ ID NO: 827333 - RNA, 19 nt, Homo sapiens
ggcgagcucuggcuuugca

SEQ ID NO: 827334 - RNA, 14 nt, Homo sapiens
ggcuuuguggcacu

SEQ ID NO: 827335 - RNA, 15 nt, Homo sapiens
gggaguuuagggugg

SEQ ID NO: 827336 - RNA, 13 nt, Homo sapiens
guaccugugcacg

SEQ ID NO: 827337 - RNA, 19 nt, Homo sapiens
guagaaaagggaacugaac

SEQ ID NO: 827338 - RNA, 22 nt, Homo sapiens
guagaaaauuuguuauuuugca

SEQ ID NO: 827339 - RNA, 14 nt, Homo sapiens
guaggaucugucaa

SEQ ID NO: 827340 - RNA, 15 nt, Homo sapiens
guaucaaaugugaca

SEQ ID NO: 827341 - RNA, 21 nt, Homo sapiens
guaucaaaugugacauuauau

SEQ ID NO: 827342 - RNA, 24 nt, Homo sapiens
guccacgagcuguuuacuagggau

SEQ ID NO: 827343 - RNA, 15 nt, Homo sapiens
gugaauaaaccauca

SEQ ID NO: 827344 - RNA, 19 nt, Homo sapiens
gugacauuuccaugcauaa

SEQ ID NO: 827345 - RNA, 17 nt, Homo sapiens
gugcagaagaauccgag

SEQ ID NO: 827346 - RNA, 19 nt, Homo sapiens
gugcccugcaucccucucc

SEQ ID NO: 827347 - RNA, 20 nt, Homo sapiens
gugcucgcccacaaacugau

SEQ ID NO: 827348 - RNA, 15 nt, Homo sapiens
gugucaccugugcuu

SEQ ID NO: 827349 - RNA, 14 nt, Homo sapiens
guguccugcaccgg

SEQ ID NO: 827350 - RNA, 12 nt, Homo sapiens
guguuacauaca

SEQ ID NO: 827351 - RNA, 22 nt, Homo sapiens
guuaccugaaaacacugugcac

SEQ ID NO: 827352 - RNA, 13 nt, Homo sapiens
guuacugcaguga

SEQ ID NO: 827353 - RNA, 14 nt, Homo sapiens
guucccccacugau

SEQ ID NO: 827354 - RNA, 12 nt, Homo sapiens
guugcacaaaaa

SEQ ID NO: 827355 - RNA, 15 nt, Homo sapiens
guugcuguaugucuc

SEQ ID NO: 827356 - RNA, 15 nt, Homo sapiens
guugucacaccugaa

SEQ ID NO: 827357 - RNA, 19 nt, Homo sapiens
guuguuaauaaaaguacau

SEQ ID NO: 827358 - RNA, 12 nt, Homo sapiens
guuuaccagaga

SEQ ID NO: 827359 - RNA, 15 nt, Homo sapiens
guuuuguauucucug

SEQ ID NO: 827360 - RNA, 12 nt, Homo sapiens
uaaaacaugugu

SEQ ID NO: 827361 - RNA, 15 nt, Homo sapiens
uaaacucugcacuua

SEQ ID NO: 827362 - RNA, 13 nt, Homo sapiens
uaaacugugcacc

SEQ ID NO: 827363 - RNA, 15 nt, Homo sapiens
uaaauacagucuucc

SEQ ID NO: 827364 - RNA, 17 nt, Homo sapiens
uaaccugaauuauucca

SEQ ID NO: 827365 - RNA, 16 nt, Homo sapiens
uaagcagaccacugau

SEQ ID NO: 827366 - RNA, 14 nt, Homo sapiens
uaaggucugacuga

SEQ ID NO: 827367 - RNA, 19 nt, Homo sapiens
uaaguuacacauuuuucag

SEQ ID NO: 827368 - RNA, 14 nt, Homo sapiens
uacagaacucuuuc

SEQ ID NO: 827369 - RNA, 20 nt, Homo sapiens
uacagaaucaaaugcaauuu

SEQ ID NO: 827370 - RNA, 15 nt, Homo sapiens
uacauauauauaucc

SEQ ID NO: 827371 - RNA, 16 nt, Homo sapiens
uacauuauauuccucu

SEQ ID NO: 827372 - RNA, 18 nt, Homo sapiens
uaccuccuguguggaaga

SEQ ID NO: 827373 - RNA, 21 nt, Homo sapiens
uacugggacugugcucagaga

SEQ ID NO: 827374 - RNA, 21 nt, Homo sapiens
uacugggguuuuucuaagaaa

SEQ ID NO: 827375 - RNA, 15 nt, Homo sapiens
uacuugaaaaccuca

SEQ ID NO: 827376 - RNA, 22 nt, Homo sapiens
uagaaacugaggccauuauuuc

SEQ ID NO: 827377 - RNA, 14 nt, Homo sapiens
uagacuaaggccau

SEQ ID NO: 827378 - RNA, 12 nt, Homo sapiens
uagagcacuuuu

SEQ ID NO: 827379 - RNA, 18 nt, Homo sapiens
uagcauacgguaugauau

SEQ ID NO: 827380 - RNA, 13 nt, Homo sapiens
uaggaaguaggaa

SEQ ID NO: 827381 - RNA, 17 nt, Homo sapiens
uagucgaacaauucaua

SEQ ID NO: 827382 - RNA, 14 nt, Homo sapiens
uagugauggagcuu

SEQ ID NO: 827383 - RNA, 16 nt, Homo sapiens
uauaauugaguuuuca

SEQ ID NO: 827384 - RNA, 18 nt, Homo sapiens
uauauauuuuugugcaca

SEQ ID NO: 827385 - RNA, 19 nt, Homo sapiens
uauauuugaaguggagcca

SEQ ID NO: 827386 - RNA, 22 nt, Homo sapiens
uuucucuugcucaccaagaagu

SEQ ID NO: 827387 - RNA, 15 nt, Homo sapiens
uuugauuauucagug

SEQ ID NO: 827388 - RNA, 15 nt, Homo sapiens
uuuggccuccuccag

SEQ ID NO: 827389 - RNA, 12 nt, Homo sapiens
uuuguuuaccag

SEQ ID NO: 827390 - RNA, 15 nt, Homo sapiens
uuuuccuguucuuaa

SEQ ID NO: 827391 - RNA, 21 nt, Homo sapiens
uuuucuaagaaagaaauugua

SEQ ID NO: 827392 - RNA, 17 nt, Homo sapiens
uuuugaaauuaaccucu

SEQ ID NO: 827393 - RNA, 15 nt, Homo sapiens
uuuugaacacauucu

SEQ ID NO: 827394 - RNA, 13 nt, Homo sapiens
uuuugugauugcc

SEQ ID NO: 827395 - RNA, 21 nt, Homo sapiens
uuuuugguauuuuuguguaua

SEQ ID NO: 827396 - RNA, 14 nt, Homo sapiens
ucuaagucuuucca

SEQ ID NO: 827397 - RNA, 15 nt, Homo sapiens
ucuacuaacaaucag

SEQ ID NO: 827398 - RNA, 17 nt, Homo sapiens
ucuacugagacaugacu

SEQ ID NO: 827399 - RNA, 17 nt, Homo sapiens
ucucacuaaaauggaua

SEQ ID NO: 827400 - RNA, 13 nt, Homo sapiens
ucucauccaucau

SEQ ID NO: 827401 - RNA, 22 nt, Homo sapiens
ucucccacacuagcuugcagaa

SEQ ID NO: 827402 - RNA, 13 nt, Homo sapiens
ucucuaugaucuu

SEQ ID NO: 827403 - RNA, 18 nt, Homo sapiens
ucugcucaucauucucug

SEQ ID NO: 827404 - RNA, 18 nt, Homo sapiens
ucuuagcugaacaaugaa

SEQ ID NO: 827405 - RNA, 14 nt, Homo sapiens
ucuucaccauuugg

SEQ ID NO: 827406 - RNA, 24 nt, Homo sapiens
ucuucaccauuuggcaaugccauc

SEQ ID NO: 827407 - RNA, 22 nt, Homo sapiens
ucuucaggguguuaaggcagug

SEQ ID NO: 827408 - RNA, 12 nt, Homo sapiens
ucuuccaaacag

SEQ ID NO: 827409 - RNA, 18 nt, Homo sapiens
ucuuccaaacaggcucag

SEQ ID NO: 827410 - RNA, 17 nt, Homo sapiens
ucuugaugcaugcacug

SEQ ID NO: 827411 - RNA, 15 nt, Homo sapiens
ucuuucauacauuau

SEQ ID NO: 827412 - RNA, 19 nt, Homo sapiens
ugaaaaugguccaggagaa

SEQ ID NO: 827413 - RNA, 23 nt, Homo sapiens
ugaacagguucuuuaaaaugcca

SEQ ID NO: 827414 - RNA, 12 nt, Homo sapiens
ugaacauuccag

SEQ ID NO: 827415 - RNA, 22 nt, Homo sapiens
ugaacuuuccaaaaccuaaaga

SEQ ID NO: 827416 - RNA, 23 nt, Homo sapiens
ugacaacauuuuuguacauuaug

SEQ ID NO: 827417 - RNA, 20 nt, Homo sapiens
ugacacucccuugggcuccc

SEQ ID NO: 827418 - RNA, 14 nt, Homo sapiens
ugacauuauaugca

SEQ ID NO: 827419 - RNA, 19 nt, Homo sapiens
ugaccugcccuacauaucu

SEQ ID NO: 827420 - RNA, 21 nt, Homo sapiens
ugaccugcccuacauaucuaa

SEQ ID NO: 827421 - RNA, 16 nt, Homo sapiens
ugagaccgaaucucac

SEQ ID NO: 827422 - RNA, 19 nt, Homo sapiens
ugagggagccuggccccau

SEQ ID NO: 827423 - RNA, 12 nt, Homo sapiens
ugauauugcagc

SEQ ID NO: 827424 - RNA, 16 nt, Homo sapiens
ugcaccaagcaggaaa

SEQ ID NO: 827425 - RNA, 20 nt, Homo sapiens
ugcaguggugcgaucuuggc

SEQ ID NO: 827426 - RNA, 21 nt, Homo sapiens
ugccagcauuuagacccugca

SEQ ID NO: 827427 - RNA, 15 nt, Homo sapiens
ugccuucaccuccuc

SEQ ID NO: 827428 - RNA, 17 nt, Homo sapiens
ugccuuuggacuugucc

SEQ ID NO: 827429 - RNA, 14 nt, Homo sapiens
ugcuguaugucucg

SEQ ID NO: 827430 - RNA, 15 nt, Homo sapiens
uggaagcacaugugu

SEQ ID NO: 827431 - RNA, 12 nt, Homo sapiens
uggacuuguccc

SEQ ID NO: 827432 - RNA, 12 nt, Homo sapiens
uggcuguggcau

SEQ ID NO: 827433 - RNA, 13 nt, Homo sapiens
ugggugucuguug

SEQ ID NO: 827434 - RNA, 12 nt, Homo sapiens
ugguacaaggaa

SEQ ID NO: 827435 - RNA, 19 nt, Homo sapiens
ugguucccccacugaucac

SEQ ID NO: 827436 - RNA, 22 nt, Homo sapiens
uguacaguuuuuauugcuuguu

SEQ ID NO: 827437 - RNA, 15 nt, Homo sapiens
uguacuugccuuauu

SEQ ID NO: 827438 - RNA, 18 nt, Homo sapiens
uguagaagauggcacuua

SEQ ID NO: 827439 - RNA, 17 nt, Homo sapiens
uguagaagccacuauua

SEQ ID NO: 827440 - RNA, 11 nt, Homo sapiens
uguaugugaca

SEQ ID NO: 827441 - RNA, 16 nt, Homo sapiens
ugucccgggacaccua

SEQ ID NO: 827442 - RNA, 20 nt, Homo sapiens
ugucguaggaaaaccaugac

SEQ ID NO: 827443 - RNA, 22 nt, Homo sapiens
ugugacauuauaugcacuagca

SEQ ID NO: 827444 - RNA, 21 nt, Homo sapiens
ugugaccaaugucuugaugca

SEQ ID NO: 827445 - RNA, 23 nt, Homo sapiens
ugugagugaccucacuucuggca

SEQ ID NO: 827446 - RNA, 18 nt, Homo sapiens
ugugucccccucugucca

SEQ ID NO: 827447 - RNA, 11 nt, Homo sapiens
uguguuuacuu

SEQ ID NO: 827448 - RNA, 11 nt, Homo sapiens
uguuacauaca

SEQ ID NO: 827449 - RNA, 12 nt, Homo sapiens
uguuacauacac

SEQ ID NO: 827450 - RNA, 20 nt, Homo sapiens
uguuaccugaaaacacugug

SEQ ID NO: 827451 - RNA, 23 nt, Homo sapiens
uguuaccugaaaacacugugcac

SEQ ID NO: 827452 - RNA, 18 nt, Homo sapiens
uguuccccuuccacugag

SEQ ID NO: 827453 - RNA, 16 nt, Homo sapiens
uguugcaaugacacau

SEQ ID NO: 827454 - RNA, 22 nt, Homo sapiens
uuaaaaauaaacucugcacuua

SEQ ID NO: 827455 - RNA, 16 nt, Homo sapiens
uuaaaaguccacuuuu

SEQ ID NO: 827456 - RNA, 13 nt, Homo sapiens
uuaaaaucuguca

SEQ ID NO: 827457 - RNA, 18 nt, Homo sapiens
uuaaaaucugucacguag

SEQ ID NO: 827458 - RNA, 14 nt, Homo sapiens
uuaaacuuacuuag

SEQ ID NO: 827459 - RNA, 17 nt, Homo sapiens
uuaaauacagucuucca

SEQ ID NO: 827460 - RNA, 21 nt, Homo sapiens
uuaaccugaauuauuccaacu

SEQ ID NO: 827461 - RNA, 15 nt, Homo sapiens
uuaauuuucuaugaa

SEQ ID NO: 827462 - RNA, 17 nt, Homo sapiens
uuagagugucuuuccac

SEQ ID NO: 827463 - RNA, 16 nt, Homo sapiens
uuauauguacauacau

SEQ ID NO: 827464 - RNA, 20 nt, Homo sapiens
uuauauguacauacauauau

SEQ ID NO: 827465 - RNA, 13 nt, Homo sapiens
uuauauucaucca

SEQ ID NO: 827466 - RNA, 23 nt, Homo sapiens
uuaugagucucuaugaucuuggc

SEQ ID NO: 827467 - RNA, 16 nt, Homo sapiens
uuauuaauuaaaccag

SEQ ID NO: 827468 - RNA, 13 nt, Homo sapiens
uuauuccaacucc

SEQ ID NO: 827469 - RNA, 20 nt, Homo sapiens
uuauuuaacugugcagugac

SEQ ID NO: 827470 - RNA, 17 nt, Homo sapiens
uucaauugcaucuccca

SEQ ID NO: 827471 - RNA, 23 nt, Homo sapiens
uucagauauaaaagacugaccaa

SEQ ID NO: 827472 - RNA, 15 nt, Homo sapiens
uucaguuuucaggag

SEQ ID NO: 827473 - RNA, 19 nt, Homo sapiens
uuccaaacaggcucagagg

SEQ ID NO: 827474 - RNA, 14 nt, Homo sapiens
uuccaacugccaga

SEQ ID NO: 827475 - RNA, 17 nt, Homo sapiens
uuccaacugccagaaca

SEQ ID NO: 827476 - RNA, 17 nt, Homo sapiens
uucccacaggacauuuc

SEQ ID NO: 827477 - RNA, 16 nt, Homo sapiens
uucgaauaaagugaau

SEQ ID NO: 827478 - RNA, 19 nt, Homo sapiens
uucuaguucugccaggaga

SEQ ID NO: 827479 - RNA, 22 nt, Homo sapiens
uucucaguaaauauuaaccuga

SEQ ID NO: 827480 - RNA, 17 nt, Homo sapiens
ucuuccauuugcaaggg

SEQ ID NO: 827481 - RNA, 19 nt, Homo sapiens
ucuugacuacagucaggaa

SEQ ID NO: 827482 - RNA, 15 nt, Homo sapiens
guuagugauggagcu

SEQ ID NO: 827483 - RNA, 12 nt, Homo sapiens
guucaaagccag

SEQ ID NO: 827484 - RNA, 21 nt, Homo sapiens
guucgccgcguggaaugugag

SEQ ID NO: 827485 - RNA, 13 nt, Homo sapiens
guucuuagcugaa

SEQ ID NO: 827486 - RNA, 21 nt, Homo sapiens
guuguuaauaaaaguacaugu

SEQ ID NO: 827487 - RNA, 22 nt, Homo sapiens
guuuaacugggagugauaugau

SEQ ID NO: 827488 - RNA, 20 nt, Homo sapiens
guuuaugcauagauaaucuc

SEQ ID NO: 827489 - RNA, 22 nt, Homo sapiens
guuucauauugaugugugucua

SEQ ID NO: 827490 - RNA, 15 nt, Homo sapiens
guuuuguacuuacau

SEQ ID NO: 827491 - RNA, 16 nt, Homo sapiens
guuuuuaaaacccagu

SEQ ID NO: 827492 - RNA, 23 nt, Homo sapiens
uaaaaguacauguuaaacuuacu

SEQ ID NO: 827493 - RNA, 16 nt, Homo sapiens
uaaacucugcacuuau

SEQ ID NO: 827494 - RNA, 18 nt, Homo sapiens
uaaagcaauaugcauuua

SEQ ID NO: 827495 - RNA, 14 nt, Homo sapiens
uaacaaacucugag

SEQ ID NO: 827496 - RNA, 22 nt, Homo sapiens
uaaccaaagcccaaagugguau

SEQ ID NO: 827497 - RNA, 22 nt, Homo sapiens
uaaccagcaacauugacccaga

SEQ ID NO: 827498 - RNA, 12 nt, Homo sapiens
uaaccugaauua

SEQ ID NO: 827499 - RNA, 13 nt, Homo sapiens
uaacuaucaauau

SEQ ID NO: 827500 - RNA, 14 nt, Homo sapiens
uaacugugcaguga

SEQ ID NO: 827501 - RNA, 13 nt, Homo sapiens
uaacuucaaauau

SEQ ID NO: 827502 - RNA, 15 nt, Homo sapiens
uaagagaacaaugug

SEQ ID NO: 827503 - RNA, 22 nt, Homo sapiens
uaagucaaccugccugacauuu

SEQ ID NO: 827504 - RNA, 14 nt, Homo sapiens
uaauagacagcaau

SEQ ID NO: 827505 - RNA, 20 nt, Homo sapiens
uacacauuuuucagauauaa

SEQ ID NO: 827506 - RNA, 19 nt, Homo sapiens
uacagaaucaaaugcaauu

SEQ ID NO: 827507 - RNA, 19 nt, Homo sapiens
uacagaaugaaucccauaa

SEQ ID NO: 827508 - RNA, 16 nt, Homo sapiens
uacagucuuguauuaa

SEQ ID NO: 827509 - RNA, 15 nt, Homo sapiens
uacauacagagguaa

SEQ ID NO: 827510 - RNA, 12 nt, Homo sapiens
uacauacauaua

SEQ ID NO: 827511 - RNA, 21 nt, Homo sapiens
uaccaguauaauugaguuuuc

SEQ ID NO: 827512 - RNA, 20 nt, Homo sapiens
uaccugaaauaaaauucauu

SEQ ID NO: 827513 - RNA, 15 nt, Homo sapiens
uacucccauuuuccc

SEQ ID NO: 827514 - RNA, 11 nt, Homo sapiens
uacugcaguga

SEQ ID NO: 827515 - RNA, 12 nt, Homo sapiens
uacugcagugac

SEQ ID NO: 827516 - RNA, 17 nt, Homo sapiens
uacugggacugugcuca

SEQ ID NO: 827517 - RNA, 16 nt, Homo sapiens
uacuucaagaucugaa

SEQ ID NO: 827518 - RNA, 16 nt, Homo sapiens
uagaacuccaguacuc

SEQ ID NO: 827519 - RNA, 21 nt, Homo sapiens
uagaagccacuauuacuggga

SEQ ID NO: 827520 - RNA, 18 nt, Homo sapiens
uagagauuaccuccugag

SEQ ID NO: 827521 - RNA, 20 nt, Homo sapiens
uagauaaucucuccauuccc

SEQ ID NO: 827522 - RNA, 22 nt, Homo sapiens
uagcaggugaacucgaagccca

SEQ ID NO: 827523 - RNA, 18 nt, Homo sapiens
uaggauaaauuacauuaa

SEQ ID NO: 827524 - RNA, 14 nt, Homo sapiens
uaggucugcagaug

SEQ ID NO: 827525 - RNA, 22 nt, Homo sapiens
uagugaaucacguaaagcuaga

SEQ ID NO: 827526 - RNA, 19 nt, Homo sapiens
uaguucuuagagcacuuuu

SEQ ID NO: 827527 - RNA, 20 nt, Homo sapiens
uauacuucucuauuaucuca

SEQ ID NO: 827528 - RNA, 18 nt, Homo sapiens
uauauaaaugugauugca

SEQ ID NO: 827529 - RNA, 15 nt, Homo sapiens
uauauuuuugugcac

SEQ ID NO: 827530 - RNA, 14 nt, Homo sapiens
uaucaacagcauuu

SEQ ID NO: 827531 - RNA, 17 nt, Homo sapiens
uaucaccgugggcuccc

SEQ ID NO: 827532 - RNA, 23 nt, Homo sapiens
uaucucaaacuacuggcaauuug

SEQ ID NO: 827533 - RNA, 21 nt, Homo sapiens
uaugccaaaccuuggcauuuu

SEQ ID NO: 827534 - RNA, 19 nt, Homo sapiens
uauggcauguguaguuaau

SEQ ID NO: 827535 - RNA, 13 nt, Homo sapiens
uauguacauacau

SEQ ID NO: 827536 - RNA, 22 nt, Homo sapiens
uauguagcaaaauacaugacau

SEQ ID NO: 827537 - RNA, 20 nt, Homo sapiens
uauuacugggacugugcuca

SEQ ID NO: 827538 - RNA, 12 nt, Homo sapiens
uauuuaccugaa

SEQ ID NO: 827539 - RNA, 12 nt, Homo sapiens
uauuuauagucg

SEQ ID NO: 827540 - RNA, 14 nt, Homo sapiens
uauuugcauaacaa

SEQ ID NO: 827541 - RNA, 19 nt, Homo sapiens
ucaaagaaaacuuccaaaa

SEQ ID NO: 827542 - RNA, 10 nt, Homo sapiens
ucaaagccag

SEQ ID NO: 827543 - RNA, 18 nt, Homo sapiens
ucaaaugugacauuauau

SEQ ID NO: 827544 - RNA, 16 nt, Homo sapiens
ucaaauuggagcuuca

SEQ ID NO: 827545 - RNA, 22 nt, Homo sapiens
ucaacagcauuuucaagcaguu

SEQ ID NO: 827546 - RNA, 18 nt, Homo sapiens
ucaaccugggcaaagccu

SEQ ID NO: 827547 - RNA, 21 nt, Homo sapiens
ucacaaucaucaucauucuca

SEQ ID NO: 827548 - RNA, 17 nt, Homo sapiens
ucacaugucaguaccuu

SEQ ID NO: 827549 - RNA, 19 nt, Homo sapiens
ucaccauuuggcaaugcca

SEQ ID NO: 827550 - RNA, 20 nt, Homo sapiens
ucaccauuuggcaaugccau

SEQ ID NO: 827551 - RNA, 16 nt, Homo sapiens
ucacguaaagcuagaa

SEQ ID NO: 827552 - RNA, 20 nt, Homo sapiens
ucaguaaauauuaaccugaa

SEQ ID NO: 827553 - RNA, 18 nt, Homo sapiens
ucaucauucucugucuca

SEQ ID NO: 827554 - RNA, 12 nt, Homo sapiens
ucaucuugccac

SEQ ID NO: 827555 - RNA, 15 nt, Homo sapiens
ucaucuuucuuccaa

SEQ ID NO: 827556 - RNA, 21 nt, Homo sapiens
ucauucucugucucauccauc

SEQ ID NO: 827557 - RNA, 19 nt, Homo sapiens
uccacguucugcucaucau

SEQ ID NO: 827558 - RNA, 13 nt, Homo sapiens
ucccacaggacau

SEQ ID NO: 827559 - RNA, 20 nt, Homo sapiens
uccccuggggagucugggca

SEQ ID NO: 827560 - RNA, 14 nt, Homo sapiens
uccucaauccagcu

SEQ ID NO: 827561 - RNA, 18 nt, Homo sapiens
uccucgagaucccaacac

SEQ ID NO: 827562 - RNA, 23 nt, Homo sapiens
uccuuaaaaugugagugaccuca

SEQ ID NO: 827563 - RNA, 18 nt, Homo sapiens
uccuucaugaucaucaca

SEQ ID NO: 827564 - RNA, 15 nt, Homo sapiens
ucgaauaaagugaau

SEQ ID NO: 827565 - RNA, 14 nt, Homo sapiens
ucuaaaacucucaa

SEQ ID NO: 827566 - RNA, 15 nt, Homo sapiens
ucuaagaaagaaauu

SEQ ID NO: 827567 - RNA, 16 nt, Homo sapiens
ucuacuccaugcacau

SEQ ID NO: 827568 - RNA, 17 nt, Homo sapiens
ucuacuccaugcacaua

SEQ ID NO: 827569 - RNA, 18 nt, Homo sapiens
ucuacugagacaugacua

SEQ ID NO: 827570 - RNA, 19 nt, Homo sapiens
ucuauuucuccuccauggg

SEQ ID NO: 827571 - RNA, 15 nt, Homo sapiens
ucucacuaaaaugga

SEQ ID NO: 827572 - RNA, 15 nt, Homo sapiens
ucucacuauaccagu

SEQ ID NO: 827573 - RNA, 14 nt, Homo sapiens
ucucaggaccaaag

SEQ ID NO: 827574 - RNA, 20 nt, Homo sapiens
ucucaggaccaaagcuuuca

SEQ ID NO: 827575 - RNA, 10 nt, Homo sapiens
ucucauuucu

SEQ ID NO: 827576 - RNA, 18 nt, Homo sapiens
ucucgugguaggacugua

SEQ ID NO: 827577 - RNA, 21 nt, Homo sapiens
ucugaaggagccccauuccug

SEQ ID NO: 827578 - RNA, 20 nt, Homo sapiens
ucugcgugucaccugugcuu

SEQ ID NO: 827579 - RNA, 19 nt, Homo sapiens
ucuguaugugacaacauuu

SEQ ID NO: 827580 - RNA, 21 nt, Homo sapiens
ucugucaaagaaaacuuccaa

SEQ ID NO: 827581 - RNA, 19 nt, Homo sapiens
ucugugggcuccauguaga

SEQ ID NO: 827582 - RNA, 15 nt, Homo sapiens
ucuguguuuacuuaa

SEQ ID NO: 827583 - RNA, 14 nt, Homo sapiens
ucuuaguugcugua

SEQ ID NO: 827584 - RNA, 21 nt, Homo sapiens
ucuucaggguguuaaggcagu

SEQ ID NO: 827585 - RNA, 14 nt, Homo sapiens
aaacaaaauuccau

SEQ ID NO: 827586 - RNA, 16 nt, Homo sapiens
aaacagggacaaagaa

SEQ ID NO: 827587 - RNA, 14 nt, Homo sapiens
aaacauaugcauua

SEQ ID NO: 827588 - RNA, 17 nt, Homo sapiens
aaacccagaucgcugug

SEQ ID NO: 827589 - RNA, 15 nt, Homo sapiens
aaacccuaucuguga

SEQ ID NO: 827590 - RNA, 19 nt, Homo sapiens
aaacuagucuguuggcaau

SEQ ID NO: 827591 - RNA, 23 nt, Homo sapiens
aaacuuaaggaagcaaaugcuac

SEQ ID NO: 827592 - RNA, 19 nt, Homo sapiens
aaagaacugccccaucucc

SEQ ID NO: 827593 - RNA, 12 nt, Homo sapiens
aaagagacugag

SEQ ID NO: 827594 - RNA, 22 nt, Homo sapiens
aaagcugcugagaaucuagccu

SEQ ID NO: 827595 - RNA, 16 nt, Homo sapiens
aaaggaaaaacugaug

SEQ ID NO: 827596 - RNA, 13 nt, Homo sapiens
aaaggaagaugua

SEQ ID NO: 827597 - RNA, 11 nt, Homo sapiens
aaaguauauau

SEQ ID NO: 827598 - RNA, 22 nt, Homo sapiens
aaaguaugccuuccuguuuaaa

SEQ ID NO: 827599 - RNA, 11 nt, Homo sapiens
aaagugcugua

SEQ ID NO: 827600 - RNA, 16 nt, Homo sapiens
aaauaaagcugugaca

SEQ ID NO: 827601 - RNA, 16 nt, Homo sapiens
aaauacaaauuggaca

SEQ ID NO: 827602 - RNA, 14 nt, Homo sapiens
aaauagagugaauu

SEQ ID NO: 827603 - RNA, 14 nt, Homo sapiens
aaauaguaauguga

SEQ ID NO: 827604 - RNA, 23 nt, Homo sapiens
aaaucagcuuuauagguuuauua

SEQ ID NO: 827605 - RNA, 14 nt, Homo sapiens
aaaucguauucuaa

SEQ ID NO: 827606 - RNA, 15 nt, Homo sapiens
aaaugaaucuuacuc

SEQ ID NO: 827607 - RNA, 18 nt, Homo sapiens
aaauguauggcaugugua

SEQ ID NO: 827608 - RNA, 19 nt, Homo sapiens
aaauguuuauacguggaaa

SEQ ID NO: 827609 - RNA, 13 nt, Homo sapiens
aaauugaugagag

SEQ ID NO: 827610 - RNA, 19 nt, Homo sapiens
aacaaaagcuuuucuuucc

SEQ ID NO: 827611 - RNA, 17 nt, Homo sapiens
aacaaugaauucuucaa

SEQ ID NO: 827612 - RNA, 16 nt, Homo sapiens
aacaauggagauauca

SEQ ID NO: 827613 - RNA, 19 nt, Homo sapiens
aacacaagaauuacacuaa

SEQ ID NO: 827614 - RNA, 15 nt, Homo sapiens
aacacugaagugcuu

SEQ ID NO: 827615 - RNA, 15 nt, Homo sapiens
aacagagcugggcua

SEQ ID NO: 827616 - RNA, 16 nt, Homo sapiens
aacagaggcauuuaaa

SEQ ID NO: 827617 - RNA, 14 nt, Homo sapiens
aacagggacaaaga

SEQ ID NO: 827618 - RNA, 18 nt, Homo sapiens
aacagggaugcuaucucg

SEQ ID NO: 827619 - RNA, 13 nt, Homo sapiens
aacauuaccaaaa

SEQ ID NO: 827620 - RNA, 21 nt, Homo sapiens
aaccagagcuggaacacaaua

SEQ ID NO: 827621 - RNA, 12 nt, Homo sapiens
aaccagcaacau

SEQ ID NO: 827622 - RNA, 16 nt, Homo sapiens
aaccccaagacagucu

SEQ ID NO: 827623 - RNA, 13 nt, Homo sapiens
aaccccaugggcu

SEQ ID NO: 827624 - RNA, 22 nt, Homo sapiens
aacccccagcccacagagccug

SEQ ID NO: 827625 - RNA, 17 nt, Homo sapiens
aaccccgcggugcucug

SEQ ID NO: 827626 - RNA, 17 nt, Homo sapiens
aacccuuaaaaaugcac

SEQ ID NO: 827627 - RNA, 18 nt, Homo sapiens
aaccgacuuuucuaaagc

SEQ ID NO: 827628 - RNA, 17 nt, Homo sapiens
aaccuccuccuccaguu

SEQ ID NO: 827629 - RNA, 20 nt, Homo sapiens
aacguugaauugaugaugca

SEQ ID NO: 827630 - RNA, 14 nt, Homo sapiens
aacuaaaagcauag

SEQ ID NO: 827631 - RNA, 14 nt, Homo sapiens
aacuauuuauuuca

SEQ ID NO: 827632 - RNA, 14 nt, Homo sapiens
aacugccagaacau

SEQ ID NO: 827633 - RNA, 20 nt, Homo sapiens
aacuuccaaaaagauuuauu

SEQ ID NO: 827634 - RNA, 12 nt, Homo sapiens
aacuucuuguug

SEQ ID NO: 827635 - RNA, 19 nt, Homo sapiens
aacuugcuucuaaaugccc

SEQ ID NO: 827636 - RNA, 17 nt, Homo sapiens
aacuuuaaaaaagcaaa

SEQ ID NO: 827637 - RNA, 15 nt, Homo sapiens
aagaaagacuuauca

SEQ ID NO: 827638 - RNA, 16 nt, Homo sapiens
aagacccaguguaaag

SEQ ID NO: 827639 - RNA, 15 nt, Homo sapiens
aagacuacacuguug

SEQ ID NO: 827640 - RNA, 11 nt, Homo sapiens
aagagcacagc

SEQ ID NO: 827641 - RNA, 15 nt, Homo sapiens
aagauuauauaucau

SEQ ID NO: 827642 - RNA, 12 nt, Homo sapiens
aagcacaugugu

SEQ ID NO: 827643 - RNA, 23 nt, Homo sapiens
aagcuaaaaugaaaaauagugug

SEQ ID NO: 827644 - RNA, 17 nt, Homo sapiens
aaggcauuuuauaugaa

SEQ ID NO: 827645 - RNA, 21 nt, Homo sapiens
aaggcuucuccacaaccuccu

SEQ ID NO: 827646 - RNA, 19 nt, Homo sapiens
aagggacaccaagccuugg

SEQ ID NO: 827647 - RNA, 20 nt, Homo sapiens
aaggucuagacuaguuacau

SEQ ID NO: 827648 - RNA, 21 nt, Homo sapiens
aaguaggaacucuuaagcaau

SEQ ID NO: 827649 - RNA, 17 nt, Homo sapiens
aaguauauauucuacac

SEQ ID NO: 827650 - RNA, 18 nt, Homo sapiens
aaguauauauucuacaca

SEQ ID NO: 827651 - RNA, 14 nt, Homo sapiens
aaguaugccuuccu

SEQ ID NO: 827652 - RNA, 18 nt, Homo sapiens
aaguaugugaauaugaau

SEQ ID NO: 827653 - RNA, 20 nt, Homo sapiens
aagucacuggccaguggcug

SEQ ID NO: 827654 - RNA, 16 nt, Homo sapiens
aagugaauacauuuug

SEQ ID NO: 827655 - RNA, 15 nt, Homo sapiens
aagugcgauaacuua

SEQ ID NO: 827656 - RNA, 19 nt, Homo sapiens
aaguucugguaugaacuug

SEQ ID NO: 827657 - RNA, 15 nt, Homo sapiens
aauaauguaauacug

SEQ ID NO: 827658 - RNA, 16 nt, Homo sapiens
aauaauguauacacau

SEQ ID NO: 827659 - RNA, 17 nt, Homo sapiens
aauaauuggcuuugcag

SEQ ID NO: 827660 - RNA, 14 nt, Homo sapiens
aauacauuuugcac

SEQ ID NO: 827661 - RNA, 18 nt, Homo sapiens
aauacguguucaaaaauu

SEQ ID NO: 827662 - RNA, 21 nt, Homo sapiens
aauacuguuucacuaauacuu

SEQ ID NO: 827663 - RNA, 14 nt, Homo sapiens
aauaugaauugaca

SEQ ID NO: 827664 - RNA, 17 nt, Homo sapiens
aauauuuaaacuucuug

SEQ ID NO: 827665 - RNA, 22 nt, Homo sapiens
aaucagucuuggaauacuugaa

SEQ ID NO: 827666 - RNA, 15 nt, Homo sapiens
aauccaugugcugcu

SEQ ID NO: 827667 - RNA, 17 nt, Homo sapiens
aauccuucucacuaaaa

SEQ ID NO: 827668 - RNA, 13 nt, Homo sapiens
aaucuuacuccuu

SEQ ID NO: 827669 - RNA, 15 nt, Homo sapiens
aaugaagaaagggag

SEQ ID NO: 827670 - RNA, 16 nt, Homo sapiens
aaugaagacccagugu

SEQ ID NO: 827671 - RNA, 14 nt, Homo sapiens
aaugaauucuucaa

SEQ ID NO: 827672 - RNA, 14 nt, Homo sapiens
aaugaugggucagu

SEQ ID NO: 827673 - RNA, 20 nt, Homo sapiens
aaugcccaguucacuucuuu

SEQ ID NO: 827674 - RNA, 17 nt, Homo sapiens
aaugcuuaguuggugaa

SEQ ID NO: 827675 - RNA, 20 nt, Homo sapiens
aauggguacaauguacauua

SEQ ID NO: 827676 - RNA, 18 nt, Homo sapiens
aauguuugaguaccugau

SEQ ID NO: 827677 - RNA, 12 nt, Homo sapiens
aauuacuucuuc

SEQ ID NO: 827678 - RNA, 15 nt, Homo sapiens
aauuaugagucucua

SEQ ID NO: 827679 - RNA, 21 nt, Homo sapiens
aauuccacaucaaguguucca

SEQ ID NO: 827680 - RNA, 20 nt, Homo sapiens
aauucugcaacuagccaagg

SEQ ID NO: 827681 - RNA, 13 nt, Homo sapiens
aauugaugaugca

SEQ ID NO: 827682 - RNA, 17 nt, Homo sapiens
aauugcaaaacuagaca

SEQ ID NO: 827683 - RNA, 14 nt, Homo sapiens
aauuuggucaagaa

SEQ ID NO: 827684 - RNA, 21 nt, Homo sapiens
aauuuguaagcaacuugcuuc

SEQ ID NO: 827685 - RNA, 19 nt, Homo sapiens
aauuuguuuuauauucucu

SEQ ID NO: 827686 - RNA, 18 nt, Homo sapiens
aauuuuauugcuggaauc

SEQ ID NO: 827687 - RNA, 15 nt, Homo sapiens
aauuuucccacugca

SEQ ID NO: 827688 - RNA, 20 nt, Homo sapiens
aauuuucuaugaauugcuaa

SEQ ID NO: 827689 - RNA, 13 nt, Homo sapiens
acaaaagcaagaa

SEQ ID NO: 827690 - RNA, 15 nt, Homo sapiens
acaauguauaagcua

SEQ ID NO: 827691 - RNA, 22 nt, Homo sapiens
acacaccaaguggaggauucau

SEQ ID NO: 827692 - RNA, 12 nt, Homo sapiens
acacagcuccuc

SEQ ID NO: 827693 - RNA, 21 nt, Homo sapiens
acacaucccggccucuuccac

SEQ ID NO: 827694 - RNA, 18 nt, Homo sapiens
acacauggacacaccaga

SEQ ID NO: 827695 - RNA, 21 nt, Homo sapiens
acaccauucaucucuaacaua

SEQ ID NO: 827696 - RNA, 22 nt, Homo sapiens
acacccccaccuccugcaauaa

SEQ ID NO: 827697 - RNA, 20 nt, Homo sapiens
acagacacucccacuuggca

SEQ ID NO: 827698 - RNA, 16 nt, Homo sapiens
acagacagagaaggca

SEQ ID NO: 827699 - RNA, 14 nt, Homo sapiens
acagauuguucuca

SEQ ID NO: 827700 - RNA, 15 nt, Homo sapiens
acagauuguucucaa

SEQ ID NO: 827701 - RNA, 19 nt, Homo sapiens
uggaucuggggacugagug

SEQ ID NO: 827702 - RNA, 12 nt, Homo sapiens
uggaucugugag

SEQ ID NO: 827703 - RNA, 14 nt, Homo sapiens
uggcaaagugcugu

SEQ ID NO: 827704 - RNA, 13 nt, Homo sapiens
uggcaggugcaga

SEQ ID NO: 827705 - RNA, 23 nt, Homo sapiens
uggcaugaaagugcgauaacuua

SEQ ID NO: 827706 - RNA, 22 nt, Homo sapiens
uggccuguucuucuauggguug

SEQ ID NO: 827707 - RNA, 12 nt, Homo sapiens
uggcugccuugu

SEQ ID NO: 827708 - RNA, 17 nt, Homo sapiens
ugggagaaugucaguau

SEQ ID NO: 827709 - RNA, 18 nt, Homo sapiens
ugggcaggguacagacac

SEQ ID NO: 827710 - RNA, 16 nt, Homo sapiens
ugggcgaagcuaaaag

SEQ ID NO: 827711 - RNA, 16 nt, Homo sapiens
uggggaugucucucau

SEQ ID NO: 827712 - RNA, 19 nt, Homo sapiens
uggggucuugcuauauugc

SEQ ID NO: 827713 - RNA, 18 nt, Homo sapiens
uggucauuuccuaugcaa

SEQ ID NO: 827714 - RNA, 15 nt, Homo sapiens
uggugcgaucuuggc

SEQ ID NO: 827715 - RNA, 16 nt, Homo sapiens
ugguguugacauacau

SEQ ID NO: 827716 - RNA, 19 nt, Homo sapiens
uguaaaauaaguauuucca

SEQ ID NO: 827717 - RNA, 17 nt, Homo sapiens
uguaaagaauaaaugaa

SEQ ID NO: 827718 - RNA, 15 nt, Homo sapiens
uguaaaggccuuuaa

SEQ ID NO: 827719 - RNA, 13 nt, Homo sapiens
uguaaauaugcaa

SEQ ID NO: 827720 - RNA, 15 nt, Homo sapiens
uguaaauaugcaaau

SEQ ID NO: 827721 - RNA, 16 nt, Homo sapiens
uguaaauuuaugugau

SEQ ID NO: 827722 - RNA, 11 nt, Homo sapiens
uguaauacugu

SEQ ID NO: 827723 - RNA, 23 nt, Homo sapiens
uguaccgggcuggccugugccua

SEQ ID NO: 827724 - RNA, 20 nt, Homo sapiens
uguacugauacuauucaaug

SEQ ID NO: 827725 - RNA, 20 nt, Homo sapiens
uguacuuuuggcaugaaagu

SEQ ID NO: 827726 - RNA, 19 nt, Homo sapiens
uguagccauggcucaggca

SEQ ID NO: 827727 - RNA, 20 nt, Homo sapiens
uguauauuugagaaaacagg

SEQ ID NO: 827728 - RNA, 16 nt, Homo sapiens
uguaucuucagacuca

SEQ ID NO: 827729 - RNA, 11 nt, Homo sapiens
uguaugugaca

SEQ ID NO: 827730 - RNA, 20 nt, Homo sapiens
uguauuuaccuucuaccucu

SEQ ID NO: 827731 - RNA, 22 nt, Homo sapiens
ugucaaagaaaacuuccaaaaa

SEQ ID NO: 827732 - RNA, 21 nt, Homo sapiens
ugucaagcuaguucacacucu

SEQ ID NO: 827733 - RNA, 18 nt, Homo sapiens
ugucagaaacucgaugaa

SEQ ID NO: 827734 - RNA, 20 nt, Homo sapiens
ugucguaggaaaaccaugac

SEQ ID NO: 827735 - RNA, 23 nt, Homo sapiens
ugugaaauucaaccugugucuua

SEQ ID NO: 827736 - RNA, 12 nt, Homo sapiens
ugugacuacuau

SEQ ID NO: 827737 - RNA, 18 nt, Homo sapiens
uguggaggccugaugcug

SEQ ID NO: 827738 - RNA, 21 nt, Homo sapiens
uguuacuaaagucacauauaa

SEQ ID NO: 827739 - RNA, 18 nt, Homo sapiens
uguuccauuggguccucu

SEQ ID NO: 827740 - RNA, 13 nt, Homo sapiens
uguucucacuuau

SEQ ID NO: 827741 - RNA, 15 nt, Homo sapiens
uguucuuagcugaac

SEQ ID NO: 827742 - RNA, 18 nt, Homo sapiens
uguugccuggaagcacau

SEQ ID NO: 827743 - RNA, 16 nt, Homo sapiens
uguugucacaccugaa

SEQ ID NO: 827744 - RNA, 22 nt, Homo sapiens
uguuucauacauguagaauucg

SEQ ID NO: 827745 - RNA, 14 nt, Homo sapiens
uuaaaauaggauua

SEQ ID NO: 827746 - RNA, 12 nt, Homo sapiens
uuaaacugauua

SEQ ID NO: 827747 - RNA, 23 nt, Homo sapiens
aaaaaagcaaauuucaugcacug

SEQ ID NO: 827748 - RNA, 20 nt, Homo sapiens
aaaaauaguguguccaugca

SEQ ID NO: 827749 - RNA, 22 nt, Homo sapiens
aaaaaugcacaccucaugaguc

SEQ ID NO: 827750 - RNA, 11 nt, Homo sapiens
aaaacauaugc

SEQ ID NO: 827751 - RNA, 12 nt, Homo sapiens
aaaacauaugca

SEQ ID NO: 827752 - RNA, 13 nt, Homo sapiens
aaaacaugacuuu

SEQ ID NO: 827753 - RNA, 14 nt, Homo sapiens
aaaagcuguucuca

SEQ ID NO: 827754 - RNA, 23 nt, Homo sapiens
aaaauacuguuucacuaauacuu

SEQ ID NO: 827755 - RNA, 16 nt, Homo sapiens
aaacaaaucaguuggc

SEQ ID NO: 827756 - RNA, 13 nt, Homo sapiens
aaacaccauucau

SEQ ID NO: 827757 - RNA, 20 nt, Homo sapiens
aaacagggaauacauuguau

SEQ ID NO: 827758 - RNA, 16 nt, Homo sapiens
aaacugcuuaagugga

SEQ ID NO: 827759 - RNA, 22 nt, Homo sapiens
aaagaagcuucaugccagguua

SEQ ID NO: 827760 - RNA, 15 nt, Homo sapiens
aaagacuacacuguu

SEQ ID NO: 827761 - RNA, 19 nt, Homo sapiens
aaagauaugcuaagcagua

SEQ ID NO: 827762 - RNA, 20 nt, Homo sapiens
aaagcacuguuuaacuggga

SEQ ID NO: 827763 - RNA, 13 nt, Homo sapiens
aaagcuguucuca

SEQ ID NO: 827764 - RNA, 21 nt, Homo sapiens
aaaggaccucuucugaagcua

SEQ ID NO: 827765 - RNA, 16 nt, Homo sapiens
aaauacuguuucacua

SEQ ID NO: 827766 - RNA, 13 nt, Homo sapiens
aaaugaaucuuac

SEQ ID NO: 827767 - RNA, 15 nt, Homo sapiens
aaauuguacauuuga

SEQ ID NO: 827768 - RNA, 12 nt, Homo sapiens
aaauuuggucaa

SEQ ID NO: 827769 - RNA, 18 nt, Homo sapiens
aaauuuuacugacagaaa

SEQ ID NO: 827770 - RNA, 17 nt, Homo sapiens
aacaagacaaagcaaag

SEQ ID NO: 827771 - RNA, 15 nt, Homo sapiens
aacacaauaaugugu

SEQ ID NO: 827772 - RNA, 18 nt, Homo sapiens
aacaggccuugagcacaa

SEQ ID NO: 827773 - RNA, 20 nt, Homo sapiens
aacauaugcauuaugaaguu

SEQ ID NO: 827774 - RNA, 17 nt, Homo sapiens
aacaugcaacaaaaaug

SEQ ID NO: 827775 - RNA, 17 nt, Homo sapiens
aacaugcuugcauuaua

SEQ ID NO: 827776 - RNA, 16 nt, Homo sapiens
aacauugacccagaaa

SEQ ID NO: 827777 - RNA, 20 nt, Homo sapiens
aacauuuguaaaaauacugu

SEQ ID NO: 827778 - RNA, 13 nt, Homo sapiens
aaccgacuuuucu

SEQ ID NO: 827779 - RNA, 19 nt, Homo sapiens
aaccgcuugccauauuccg

SEQ ID NO: 827780 - RNA, 20 nt, Homo sapiens
aaccgcuugccauauuccga

SEQ ID NO: 827781 - RNA, 14 nt, Homo sapiens
aaccucauuuacca

SEQ ID NO: 827782 - RNA, 23 nt, Homo sapiens
aacguugaauugaugaugcaguu

SEQ ID NO: 827783 - RNA, 22 nt, Homo sapiens
aacuaacccuuaaaaaugcaca

SEQ ID NO: 827784 - RNA, 16 nt, Homo sapiens
aacuagucuguuggca

SEQ ID NO: 827785 - RNA, 16 nt, Homo sapiens
aacuauuuauuucacc

SEQ ID NO: 827786 - RNA, 18 nt, Homo sapiens
aacuccccuuguacucuu

SEQ ID NO: 827787 - RNA, 19 nt, Homo sapiens
aacuugaggacacaugucc

SEQ ID NO: 827788 - RNA, 16 nt, Homo sapiens
aagaagcuucaugcca

SEQ ID NO: 827789 - RNA, 13 nt, Homo sapiens
aagacaaagcaaa

SEQ ID NO: 827790 - RNA, 17 nt, Homo sapiens
aagacaaagcaaagcca

SEQ ID NO: 827791 - RNA, 21 nt, Homo sapiens
aagacccaguguaaagaauaa

SEQ ID NO: 827792 - RNA, 19 nt, Homo sapiens
aagaccgauagcaggugaa

SEQ ID NO: 827793 - RNA, 13 nt, Homo sapiens
aagagacugagcc

SEQ ID NO: 827794 - RNA, 23 nt, Homo sapiens
aagauuuauuaauuaaaccagac

SEQ ID NO: 827795 - RNA, 18 nt, Homo sapiens
aagcaacuugcuucuaaa

SEQ ID NO: 827796 - RNA, 21 nt, Homo sapiens
aagcagugccucgaggcaccg

SEQ ID NO: 827797 - RNA, 19 nt, Homo sapiens
aagcaucaaagcacuguuu

SEQ ID NO: 827798 - RNA, 21 nt, Homo sapiens
aagccacggaccguugcacaa

SEQ ID NO: 827799 - RNA, 16 nt, Homo sapiens
aagccagcuuuccuca

SEQ ID NO: 827800 - RNA, 21 nt, Homo sapiens
aagcuguacucagagcagagc

SEQ ID NO: 827801 - RNA, 13 nt, Homo sapiens
aaggcaagcacca

SEQ ID NO: 827802 - RNA, 17 nt, Homo sapiens
aaggccucccacaguga

SEQ ID NO: 827803 - RNA, 14 nt, Homo sapiens
aaggcugagcucuu

SEQ ID NO: 827804 - RNA, 14 nt, Homo sapiens
aagggagaguucuu

SEQ ID NO: 827805 - RNA, 16 nt, Homo sapiens
aagguuucacuguuca

SEQ ID NO: 827806 - RNA, 20 nt, Homo sapiens
aagguuucacuguucaugaa

SEQ ID NO: 827807 - RNA, 18 nt, Homo sapiens
aaguaagccucaccuuug

SEQ ID NO: 827808 - RNA, 16 nt, Homo sapiens
aagucuaaacaaugaa

SEQ ID NO: 827809 - RNA, 15 nt, Homo sapiens
aagucuccuguauca

SEQ ID NO: 827810 - RNA, 16 nt, Homo sapiens
aagucuccuguaucau

SEQ ID NO: 827811 - RNA, 17 nt, Homo sapiens
aagucugagauggauug

SEQ ID NO: 827812 - RNA, 16 nt, Homo sapiens
aagugaaagacuugaa

SEQ ID NO: 827813 - RNA, 13 nt, Homo sapiens
aaguggauucagu

SEQ ID NO: 827814 - RNA, 15 nt, Homo sapiens
aaguuggguuaggag

SEQ ID NO: 827815 - RNA, 18 nt, Homo sapiens
aaguuugggaagggaugg

SEQ ID NO: 827816 - RNA, 17 nt, Homo sapiens
aauaaaaagugccuaaa

SEQ ID NO: 827817 - RNA, 21 nt, Homo sapiens
aauaaagcugcugagaaucua

SEQ ID NO: 827818 - RNA, 21 nt, Homo sapiens
aauaaauaagcaaaaugccaa

SEQ ID NO: 827819 - RNA, 17 nt, Homo sapiens
aauaaaugaaucuuacu

SEQ ID NO: 827820 - RNA, 20 nt, Homo sapiens
aauaaaugaaucuuacuccu

SEQ ID NO: 827821 - RNA, 17 nt, Homo sapiens
aauaauguaauacugua

SEQ ID NO: 827822 - RNA, 13 nt, Homo sapiens
aauaauguauaca

SEQ ID NO: 827823 - RNA, 13 nt, Homo sapiens
aauaauucaucaa

SEQ ID NO: 827824 - RNA, 17 nt, Homo sapiens
aauacugcguguucuca

SEQ ID NO: 827825 - RNA, 15 nt, Homo sapiens
aauacuguauugaau

SEQ ID NO: 827826 - RNA, 19 nt, Homo sapiens
aauagaaccaagaauucua

SEQ ID NO: 827827 - RNA, 17 nt, Homo sapiens
aauaguaaugugaugcu

SEQ ID NO: 827828 - RNA, 18 nt, Homo sapiens
aauauaaguaaugaaggc

SEQ ID NO: 827829 - RNA, 17 nt, Homo sapiens
aauauaucaauguaaca

SEQ ID NO: 827830 - RNA, 18 nt, Homo sapiens
aauaucugagaaguguau

SEQ ID NO: 827831 - RNA, 22 nt, Homo sapiens
aauaucugagaaguguauauag

SEQ ID NO: 827832 - RNA, 16 nt, Homo sapiens
aauauuauauaaccca

SEQ ID NO: 827833 - RNA, 15 nt, Homo sapiens
aaucaagucugugaa

SEQ ID NO: 827834 - RNA, 19 nt, Homo sapiens
aauccagagauaauugcca

SEQ ID NO: 827835 - RNA, 23 nt, Homo sapiens
aauccaugugcugcuguggcauc

SEQ ID NO: 827836 - RNA, 19 nt, Homo sapiens
aaucuccacuguuauucua

SEQ ID NO: 827837 - RNA, 23 nt, Homo sapiens
aaucugagaggccacagugcaau

SEQ ID NO: 827838 - RNA, 16 nt, Homo sapiens
aaucuuccugccucag

SEQ ID NO: 827839 - RNA, 21 nt, Homo sapiens
aauggguacaauguacauuau

SEQ ID NO: 827840 - RNA, 16 nt, Homo sapiens
aauguaauauuuacaa

SEQ ID NO: 827841 - RNA, 17 nt, Homo sapiens
aaugucaguauguggaa

SEQ ID NO: 827842 - RNA, 12 nt, Homo sapiens
aauugcauuuaa

SEQ ID NO: 827843 - RNA, 12 nt, Homo sapiens
aauuuacuguga

SEQ ID NO: 827844 - RNA, 17 nt, Homo sapiens
aauuugaaacacaagaa

SEQ ID NO: 827845 - RNA, 18 nt, Homo sapiens
aauuuuaugugcuucaca

SEQ ID NO: 827846 - RNA, 22 nt, Homo sapiens
aauuuucuaugaauugcuaauu

SEQ ID NO: 827847 - RNA, 21 nt, Homo sapiens
acaaauucuuuuucacacuga

SEQ ID NO: 827848 - RNA, 19 nt, Homo sapiens
acaaauuuuuuucuuguuu

SEQ ID NO: 827849 - RNA, 22 nt, Homo sapiens
acaauguugcauuuaugaugca

SEQ ID NO: 827850 - RNA, 15 nt, Homo sapiens
acacauacauugcca

SEQ ID NO: 827851 - RNA, 21 nt, Homo sapiens
acacccccaccuccugcaaua

SEQ ID NO: 827852 - RNA, 20 nt, Homo sapiens
acaccugaaaauuaugaguc

SEQ ID NO: 827853 - RNA, 17 nt, Homo sapiens
acacucccacuuggcau

SEQ ID NO: 827854 - RNA, 20 nt, Homo sapiens
acacucccacuuggcaucau

SEQ ID NO: 827855 - RNA, 21 nt, Homo sapiens
acacuuggagcccgugcagua

SEQ ID NO: 827856 - RNA, 23 nt, Homo sapiens
acagacacucccacuuggcauca

SEQ ID NO: 827857 - RNA, 14 nt, Homo sapiens
acagaggcauuuaa

SEQ ID NO: 827858 - RNA, 19 nt, Homo sapiens
acagaguugguguucauaa

SEQ ID NO: 827859 - RNA, 17 nt, Homo sapiens
acagggaauacauugua

SEQ ID NO: 827860 - RNA, 16 nt, Homo sapiens
acagguuggaucucac

SEQ ID NO: 827861 - RNA, 18 nt, Homo sapiens
acaguccucacagccucu

SEQ ID NO: 827862 - RNA, 13 nt, Homo sapiens
acagugacaguca

SEQ ID NO: 827863 - RNA, 11 nt, Homo sapiens
acagugcaguu

SEQ ID NO: 827864 - RNA, 23 nt, Homo sapiens
acaguucuguuggucuacagaaa

SEQ ID NO: 827865 - RNA, 16 nt, Homo sapiens
acauaaacacauacau

SEQ ID NO: 827866 - RNA, 21 nt, Homo sapiens
acauacauugccaauuuucca

SEQ ID NO: 827867 - RNA, 15 nt, Homo sapiens
acaucaaguguucca

SEQ ID NO: 827868 - RNA, 18 nt, Homo sapiens
acaucuucauuaauacug

SEQ ID NO: 827869 - RNA, 20 nt, Homo sapiens
acaucuuuguuuaccauuaa

SEQ ID NO: 827870 - RNA, 16 nt, Homo sapiens
acaugcuugcauuaua

SEQ ID NO: 827871 - RNA, 14 nt, Homo sapiens
acauggauuccacu

SEQ ID NO: 827872 - RNA, 20 nt, Homo sapiens
acauuccucugcagcacuuc

SEQ ID NO: 827873 - RNA, 20 nt, Homo sapiens
acauuguauuaauaccaaag

SEQ ID NO: 827874 - RNA, 21 nt, Homo sapiens
acauuguauuaauaccaaagu

SEQ ID NO: 827875 - RNA, 14 nt, Homo sapiens
acauuuguuccaug

SEQ ID NO: 827876 - RNA, 23 nt, Homo sapiens
acauuuuguacaaagauaugcua

SEQ ID NO: 827877 - RNA, 20 nt, Homo sapiens
accacagcaaggcaccugca

SEQ ID NO: 827878 - RNA, 17 nt, Homo sapiens
accagacucuguugcaa

SEQ ID NO: 827879 - RNA, 16 nt, Homo sapiens
accaggagacagacag

SEQ ID NO: 827880 - RNA, 20 nt, Homo sapiens
accauuaaaaaguuggaguu

SEQ ID NO: 827881 - RNA, 22 nt, Homo sapiens
acccaguguaaagaauaaauga

SEQ ID NO: 827882 - RNA, 22 nt, Homo sapiens
accccagccccaacuccagggg

SEQ ID NO: 827883 - RNA, 11 nt, Homo sapiens
accccaucuca

SEQ ID NO: 827884 - RNA, 22 nt, Homo sapiens
accccucccagcugacaguccu

SEQ ID NO: 827885 - RNA, 20 nt, Homo sapiens
accccuggccucaagcaauc

SEQ ID NO: 827886 - RNA, 16 nt, Homo sapiens
acccuaucugugauuc

SEQ ID NO: 827887 - RNA, 13 nt, Homo sapiens
acccugaguucau

SEQ ID NO: 827888 - RNA, 17 nt, Homo sapiens
acccuucagauuugccu

SEQ ID NO: 827889 - RNA, 15 nt, Homo sapiens
accguugcacaaaaa

SEQ ID NO: 827890 - RNA, 16 nt, Homo sapiens
accuaccaugcugcuu

SEQ ID NO: 827891 - RNA, 15 nt, Homo sapiens
accuccacauaccug

SEQ ID NO: 827892 - RNA, 16 nt, Homo sapiens
accuccuccuccaguu

SEQ ID NO: 827893 - RNA, 20 nt, Homo sapiens
accucucaacauuaccaaaa

SEQ ID NO: 827894 - RNA, 23 nt, Homo sapiens
accugugucuuauagguuuccac

SEQ ID NO: 827895 - RNA, 21 nt, Homo sapiens
accuuugccuuccaacugcca

SEQ ID NO: 827896 - RNA, 13 nt, Homo sapiens
acgaaggggcccc

SEQ ID NO: 827897 - RNA, 17 nt, Homo sapiens
acguagauuuuugcucu

SEQ ID NO: 827898 - RNA, 16 nt, Homo sapiens
acguauuuugauguuu

SEQ ID NO: 827899 - RNA, 12 nt, Homo sapiens
acgugugaggau

SEQ ID NO: 827900 - RNA, 18 nt, Homo sapiens
acuaaaacuggaaaugua

SEQ ID NO: 827901 - RNA, 18 nt, Homo sapiens
acucaaggccuccagcca

SEQ ID NO: 827902 - RNA, 14 nt, Homo sapiens
acucagcagcagag

SEQ ID NO: 827903 - RNA, 16 nt, Homo sapiens
acucagcagcagagag

SEQ ID NO: 827904 - RNA, 13 nt, Homo sapiens
acucccacuuccc

SEQ ID NO: 827905 - RNA, 15 nt, Homo sapiens
acucccacuuggcau

SEQ ID NO: 827906 - RNA, 14 nt, Homo sapiens
acucccauuuuccc

SEQ ID NO: 827907 - RNA, 16 nt, Homo sapiens
acucuuuaagaccuca

SEQ ID NO: 827908 - RNA, 14 nt, Homo sapiens
acugaagugcuugc

SEQ ID NO: 827909 - RNA, 15 nt, Homo sapiens
acugauacuauucaa

SEQ ID NO: 827910 - RNA, 22 nt, Homo sapiens
acugccagaacauggauuccac

SEQ ID NO: 827911 - RNA, 17 nt, Homo sapiens
acugcugggcuuggcag

SEQ ID NO: 827912 - RNA, 13 nt, Homo sapiens
acugcuguagaca

SEQ ID NO: 827913 - RNA, 12 nt, Homo sapiens
acuguccugcuc

SEQ ID NO: 827914 - RNA, 20 nt, Homo sapiens
acuguuuucucugaucucaa

SEQ ID NO: 827915 - RNA, 16 nt, Homo sapiens
acuucacuaccaaaug

SEQ ID NO: 827916 - RNA, 14 nt, Homo sapiens
acuucagauuucaa

SEQ ID NO: 827917 - RNA, 15 nt, Homo sapiens
acuucaucaaucaaa

SEQ ID NO: 827918 - RNA, 19 nt, Homo sapiens
acuuccuucagcaucucac

SEQ ID NO: 827919 - RNA, 23 nt, Homo sapiens
acuugaggacacauguccagugg

SEQ ID NO: 827920 - RNA, 16 nt, Homo sapiens
acuugccacacacugu

SEQ ID NO: 827921 - RNA, 15 nt, Homo sapiens
acuuuaccacuaugc

SEQ ID NO: 827922 - RNA, 20 nt, Homo sapiens
acuuuuugaaaaaaguauag

SEQ ID NO: 827923 - RNA, 19 nt, Homo sapiens
agaaaacacaacauuuuaa

SEQ ID NO: 827924 - RNA, 14 nt, Homo sapiens
agaaaacaugacuu

SEQ ID NO: 827925 - RNA, 22 nt, Homo sapiens
agaaaaccacaacuaaaacugg

SEQ ID NO: 827926 - RNA, 16 nt, Homo sapiens
agaaaagcaguggcuc

SEQ ID NO: 827927 - RNA, 17 nt, Homo sapiens
agaaacaaauaaacuag

SEQ ID NO: 827928 - RNA, 21 nt, Homo sapiens
agaaacacaaauguaaaauaa

SEQ ID NO: 827929 - RNA, 18 nt, Homo sapiens
agaaauuuuacugacaga

SEQ ID NO: 827930 - RNA, 16 nt, Homo sapiens
agaacagaggcauuua

SEQ ID NO: 827931 - RNA, 22 nt, Homo sapiens
agaacauuccucugcagcacuu

SEQ ID NO: 827932 - RNA, 12 nt, Homo sapiens
agaacuacugau

SEQ ID NO: 827933 - RNA, 14 nt, Homo sapiens
agaacuacugauaa

SEQ ID NO: 827934 - RNA, 19 nt, Homo sapiens
agaauaauuucuccucauu

SEQ ID NO: 827935 - RNA, 14 nt, Homo sapiens
agaauacacuauca

SEQ ID NO: 827936 - RNA, 21 nt, Homo sapiens
agaauagcauguucguauuac

SEQ ID NO: 827937 - RNA, 15 nt, Homo sapiens
agaauccccacaggg

SEQ ID NO: 827938 - RNA, 17 nt, Homo sapiens
agaauccccacagggaa

SEQ ID NO: 827939 - RNA, 15 nt, Homo sapiens
agaccauuuguauua

SEQ ID NO: 827940 - RNA, 18 nt, Homo sapiens
agaccauuuguauuacca

SEQ ID NO: 827941 - RNA, 14 nt, Homo sapiens
agacccaguguaaa

SEQ ID NO: 827942 - RNA, 14 nt, Homo sapiens
agaccgaaucucac

SEQ ID NO: 827943 - RNA, 20 nt, Homo sapiens
agacugaaccagagcuggaa

SEQ ID NO: 827944 - RNA, 12 nt, Homo sapiens
agagaaaagcca

SEQ ID NO: 827945 - RNA, 14 nt, Homo sapiens
agagccacuaccuu

SEQ ID NO: 827946 - RNA, 23 nt, Homo sapiens
agaauagcauguucguauuacaa

SEQ ID NO: 827947 - RNA, 14 nt, Homo sapiens
agaaucaagucugu

SEQ ID NO: 827948 - RNA, 14 nt, Homo sapiens
agacaaagcaaagc

SEQ ID NO: 827949 - RNA, 15 nt, Homo sapiens
agacccaguguaaag

SEQ ID NO: 827950 - RNA, 21 nt, Homo sapiens
agacccaguguaaagaauaaa

SEQ ID NO: 827951 - RNA, 18 nt, Homo sapiens
agacugaaagcagcagcu

SEQ ID NO: 827952 - RNA, 17 nt, Homo sapiens
agacuuacuuacuccca

SEQ ID NO: 827953 - RNA, 12 nt, Homo sapiens
agagaccaaaaa

SEQ ID NO: 827954 - RNA, 13 nt, Homo sapiens
agagaccaaaaau

SEQ ID NO: 827955 - RNA, 12 nt, Homo sapiens
agagacugagcc

SEQ ID NO: 827956 - RNA, 14 nt, Homo sapiens
agagagugcuauug

SEQ ID NO: 827957 - RNA, 12 nt, Homo sapiens
agagauacagua

SEQ ID NO: 827958 - RNA, 16 nt, Homo sapiens
agagauucuugugccu

SEQ ID NO: 827959 - RNA, 13 nt, Homo sapiens
agagcacuuuuaa

SEQ ID NO: 827960 - RNA, 15 nt, Homo sapiens
agagccuccuaaaau

SEQ ID NO: 827961 - RNA, 22 nt, Homo sapiens
agagggaccaaauugcuucuag

SEQ ID NO: 827962 - RNA, 12 nt, Homo sapiens
agagugaauuau

SEQ ID NO: 827963 - RNA, 17 nt, Homo sapiens
agauaucaguuaucaau

SEQ ID NO: 827964 - RNA, 19 nt, Homo sapiens
agauguggcaaagugcugu

SEQ ID NO: 827965 - RNA, 12 nt, Homo sapiens
agauuguucuca

SEQ ID NO: 827966 - RNA, 19 nt, Homo sapiens
agcaacauugacccagaaa

SEQ ID NO: 827967 - RNA, 14 nt, Homo sapiens
agcaacugugcuac

SEQ ID NO: 827968 - RNA, 18 nt, Homo sapiens
agcaaggacaaccugccc

SEQ ID NO: 827969 - RNA, 17 nt, Homo sapiens
agcacccugggugccau

SEQ ID NO: 827970 - RNA, 17 nt, Homo sapiens
agcacguguggccuguu

SEQ ID NO: 827971 - RNA, 16 nt, Homo sapiens
agcaguggcuccauug

SEQ ID NO: 827972 - RNA, 20 nt, Homo sapiens
agcaugggacugugccuuug

SEQ ID NO: 827973 - RNA, 22 nt, Homo sapiens
agccacggaccguugcacaaaa

SEQ ID NO: 827974 - RNA, 17 nt, Homo sapiens
agccagaggucuggccc

SEQ ID NO: 827975 - RNA, 18 nt, Homo sapiens
agccaugccucaugccac

SEQ ID NO: 827976 - RNA, 23 nt, Homo sapiens
agccaugugucauguaauacuga

SEQ ID NO: 827977 - RNA, 23 nt, Homo sapiens
agcccgggucaucuguaccucug

SEQ ID NO: 827978 - RNA, 19 nt, Homo sapiens
agccuacacuauucuagca

SEQ ID NO: 827979 - RNA, 15 nt, Homo sapiens
agccugaugauggaa

SEQ ID NO: 827980 - RNA, 16 nt, Homo sapiens
agcuaagccugaugau

SEQ ID NO: 827981 - RNA, 18 nt, Homo sapiens
agcuccucuccuugggcu

SEQ ID NO: 827982 - RNA, 13 nt, Homo sapiens
agcucuacucugg

SEQ ID NO: 827983 - RNA, 23 nt, Homo sapiens
agcugcaugggugccugcugcug

SEQ ID NO: 827984 - RNA, 14 nt, Homo sapiens
agcuggaacccugg

SEQ ID NO: 827985 - RNA, 20 nt, Homo sapiens
agcugggccccaugcucugc

SEQ ID NO: 827986 - RNA, 14 nt, Homo sapiens
agcuguagccaugg

SEQ ID NO: 827987 - RNA, 17 nt, Homo sapiens
agcuguagccauggcuc

SEQ ID NO: 827988 - RNA, 21 nt, Homo sapiens
agcuugagggugacuauggag

SEQ ID NO: 827989 - RNA, 22 nt, Homo sapiens
aggaaagcuaagucuugucuca

SEQ ID NO: 827990 - RNA, 23 nt, Homo sapiens
aggaacuagacuuuccuuugcac

SEQ ID NO: 827991 - RNA, 21 nt, Homo sapiens
aggaggggaaaaaacaaaauc

SEQ ID NO: 827992 - RNA, 15 nt, Homo sapiens
aggagucaacuggcu

SEQ ID NO: 827993 - RNA, 15 nt, Homo sapiens
aggagucccugccau

SEQ ID NO: 827994 - RNA, 20 nt, Homo sapiens
aggauacucuuaaucucacu

SEQ ID NO: 827995 - RNA, 19 nt, Homo sapiens
aggauuauuuuaaauacaa

SEQ ID NO: 827996 - RNA, 14 nt, Homo sapiens
aggcaccagaagaa

SEQ ID NO: 827997 - RNA, 22 nt, Homo sapiens
aggcaccuggccugcugggaac

SEQ ID NO: 827998 - RNA, 16 nt, Homo sapiens
aggcacugguggcauc

SEQ ID NO: 827999 - RNA, 14 nt, Homo sapiens
aggcagcauuccau

SEQ ID NO: 828000 - RNA, 14 nt, Homo sapiens
aggccagagugcug

SEQ ID NO: 828001 - RNA, 17 nt, Homo sapiens
aggccagcaccaucucu

SEQ ID NO: 828002 - RNA, 14 nt, Homo sapiens
aggccaucuuccag

SEQ ID NO: 828003 - RNA, 19 nt, Homo sapiens
aggcucugggcucagggcu

SEQ ID NO: 828004 - RNA, 15 nt, Homo sapiens
aggcugcacugcagu

SEQ ID NO: 828005 - RNA, 19 nt, Homo sapiens
agggaaacuggcugagggg

SEQ ID NO: 828006 - RNA, 16 nt, Homo sapiens
agggacuccaguucac

SEQ ID NO: 828007 - RNA, 18 nt, Homo sapiens
agggauuuggggcucaga

SEQ ID NO: 828008 - RNA, 15 nt, Homo sapiens
agggcagagccaugg

SEQ ID NO: 828009 - RNA, 18 nt, Homo sapiens
agggcaguaccugggaaa

SEQ ID NO: 828010 - RNA, 22 nt, Homo sapiens
agggcugccccuguagguugcu

SEQ ID NO: 828011 - RNA, 13 nt, Homo sapiens
uauuaaccugaau

SEQ ID NO: 828012 - RNA, 16 nt, Homo sapiens
uauuaauuaaaccaga

SEQ ID NO: 828013 - RNA, 18 nt, Homo sapiens
uauuagagcugccugugc

SEQ ID NO: 828014 - RNA, 21 nt, Homo sapiens
uauuagagcugccugugccuu

SEQ ID NO: 828015 - RNA, 20 nt, Homo sapiens
uauuagcaacugugcuacac

SEQ ID NO: 828016 - RNA, 15 nt, Homo sapiens
uauucaaaauuuugu

SEQ ID NO: 828017 - RNA, 16 nt, Homo sapiens
uauucaagcaacagca

SEQ ID NO: 828018 - RNA, 23 nt, Homo sapiens
uauuccgggugccauucccacua

SEQ ID NO: 828019 - RNA, 14 nt, Homo sapiens
uauucucuaagaua

SEQ ID NO: 828020 - RNA, 15 nt, Homo sapiens
uauuguauuacauuu

SEQ ID NO: 828021 - RNA, 21 nt, Homo sapiens
uauuucaaccgcuugccauau

SEQ ID NO: 828022 - RNA, 20 nt, Homo sapiens
ucaaacuccuggacucaugc

SEQ ID NO: 828023 - RNA, 15 nt, Homo sapiens
ucaacauuaccaaaa

SEQ ID NO: 828024 - RNA, 16 nt, Homo sapiens
ucaacauuaccaaaau

SEQ ID NO: 828025 - RNA, 15 nt, Homo sapiens
ucaaccgcuugccau

SEQ ID NO: 828026 - RNA, 15 nt, Homo sapiens
ucaaggccucccaca

SEQ ID NO: 828027 - RNA, 21 nt, Homo sapiens
ucacaagucuaaacaaugaau

SEQ ID NO: 828028 - RNA, 22 nt, Homo sapiens
ucaccaggggcaggcacagcac

SEQ ID NO: 828029 - RNA, 18 nt, Homo sapiens
ucagcuucugcugggcug

SEQ ID NO: 828030 - RNA, 18 nt, Homo sapiens
ucaggccauugucccuga

SEQ ID NO: 828031 - RNA, 16 nt, Homo sapiens
ucagggaccacagcaa

SEQ ID NO: 828032 - RNA, 18 nt, Homo sapiens
ucaggguguuaaggcagu

SEQ ID NO: 828033 - RNA, 12 nt, Homo sapiens
ucaguaugugga

SEQ ID NO: 828034 - RNA, 16 nt, Homo sapiens
ucauagcucacuguaa

SEQ ID NO: 828035 - RNA, 12 nt, Homo sapiens
ucaucaggccau

SEQ ID NO: 828036 - RNA, 17 nt, Homo sapiens
ucauccccucguccugu

SEQ ID NO: 828037 - RNA, 15 nt, Homo sapiens
ucaugcaaucuuccu

SEQ ID NO: 828038 - RNA, 19 nt, Homo sapiens
ucauuuuguuauagaaacu

SEQ ID NO: 828039 - RNA, 17 nt, Homo sapiens
uccaacauuaaaagcca

SEQ ID NO: 828040 - RNA, 19 nt, Homo sapiens
uccaagugaaugaguuucc

SEQ ID NO: 828041 - RNA, 22 nt, Homo sapiens
uccaagugaaugaguuuccagc

SEQ ID NO: 828042 - RNA, 12 nt, Homo sapiens
uccacucccacu

SEQ ID NO: 828043 - RNA, 17 nt, Homo sapiens
uccagccacuuauuucc

SEQ ID NO: 828044 - RNA, 22 nt, Homo sapiens
uccagccacuuauuuccaugga

SEQ ID NO: 828045 - RNA, 20 nt, Homo sapiens
uccauccauggggcugauug

SEQ ID NO: 828046 - RNA, 15 nt, Homo sapiens
uccaugauaacugca

SEQ ID NO: 828047 - RNA, 17 nt, Homo sapiens
ucccaccccggccucca

SEQ ID NO: 828048 - RNA, 23 nt, Homo sapiens
ucccacugcacccccuccugcug

SEQ ID NO: 828049 - RNA, 13 nt, Homo sapiens
ucccacuuggcau

SEQ ID NO: 828050 - RNA, 18 nt, Homo sapiens
uccccacagugacaguca

SEQ ID NO: 828051 - RNA, 13 nt, Homo sapiens
uccccucaaccca

SEQ ID NO: 828052 - RNA, 13 nt, Homo sapiens
uccccucccucag

SEQ ID NO: 828053 - RNA, 17 nt, Homo sapiens
uccccucccuguauaag

SEQ ID NO: 828054 - RNA, 14 nt, Homo sapiens
ucccucauccauag

SEQ ID NO: 828055 - RNA, 12 nt, Homo sapiens
ucccuugaccau

SEQ ID NO: 828056 - RNA, 22 nt, Homo sapiens
uccgaggcaaagagaaaagcca

SEQ ID NO: 828057 - RNA, 20 nt, Homo sapiens
uccggccuccugucccucau

SEQ ID NO: 828058 - RNA, 19 nt, Homo sapiens
uccuaaaggcccacuggca

SEQ ID NO: 828059 - RNA, 19 nt, Homo sapiens
guccaggaaggcagcugcu

SEQ ID NO: 828060 - RNA, 17 nt, Homo sapiens
gucugggccacucaggg

SEQ ID NO: 828061 - RNA, 12 nt, Homo sapiens
gucugucccaaa

SEQ ID NO: 828062 - RNA, 22 nt, Homo sapiens
gucuuuaacaucuugaacuggu

SEQ ID NO: 828063 - RNA, 20 nt, Homo sapiens
gugaaagucuccuguaucau

SEQ ID NO: 828064 - RNA, 16 nt, Homo sapiens
gugaacacacucagca

SEQ ID NO: 828065 - RNA, 16 nt, Homo sapiens
gugacagucacuuccu

SEQ ID NO: 828066 - RNA, 20 nt, Homo sapiens
gugacccuucagggccagaa

SEQ ID NO: 828067 - RNA, 13 nt, Homo sapiens
gugagaccaccuc

SEQ ID NO: 828068 - RNA, 23 nt, Homo sapiens
gugagaccaccucucaauauuca

SEQ ID NO: 828069 - RNA, 14 nt, Homo sapiens
gugaggggcucucu

SEQ ID NO: 828070 - RNA, 15 nt, Homo sapiens
gugaguggcagccau

SEQ ID NO: 828071 - RNA, 23 nt, Homo sapiens
gugauggcgcgggaggcaccagc

SEQ ID NO: 828072 - RNA, 19 nt, Homo sapiens
gugccauucccacuaagcu

SEQ ID NO: 828073 - RNA, 13 nt, Homo sapiens
gugcggugcauac

SEQ ID NO: 828074 - RNA, 16 nt, Homo sapiens
gugcugccaguccucu

SEQ ID NO: 828075 - RNA, 20 nt, Homo sapiens
gugcuuaaaagcuguucuca

SEQ ID NO: 828076 - RNA, 22 nt, Homo sapiens
guggcuggaucugugaggggcu

SEQ ID NO: 828077 - RNA, 20 nt, Homo sapiens
guggucauuuccuaugcaaa

SEQ ID NO: 828078 - RNA, 22 nt, Homo sapiens
guggugucgcgccuucuccccc

SEQ ID NO: 828079 - RNA, 19 nt, Homo sapiens
guguaaagaauaaaugaau

SEQ ID NO: 828080 - RNA, 16 nt, Homo sapiens
gugugggaguguguaa

SEQ ID NO: 828081 - RNA, 13 nt, Homo sapiens
guguguccaugca

SEQ ID NO: 828082 - RNA, 19 nt, Homo sapiens
gugugugggaguguguaau

SEQ ID NO: 828083 - RNA, 14 nt, Homo sapiens
guguucuucauuac

SEQ ID NO: 828084 - RNA, 19 nt, Homo sapiens
guguucuucauuaccucag

SEQ ID NO: 828085 - RNA, 14 nt, Homo sapiens
guuccccacaguga

SEQ ID NO: 828086 - RNA, 16 nt, Homo sapiens
guuuaaaaaaaguaua

SEQ ID NO: 828087 - RNA, 18 nt, Homo sapiens
guuuagaaucaagucugu

SEQ ID NO: 828088 - RNA, 20 nt, Homo sapiens
guuugaauggagauucugau

SEQ ID NO: 828089 - RNA, 24 nt, Homo sapiens
guuuucacauaugacaauguugca

SEQ ID NO: 828090 - RNA, 15 nt, Homo sapiens
guuuuccacugugcu

SEQ ID NO: 828091 - RNA, 12 nt, Homo sapiens
uaaaacaugugu

SEQ ID NO: 828092 - RNA, 22 nt, Homo sapiens
uaaaacucucaagcagacguga

SEQ ID NO: 828093 - RNA, 22 nt, Homo sapiens
uaaaagaaaaaguaugugaaua

SEQ ID NO: 828094 - RNA, 17 nt, Homo sapiens
uaaaauaaguauuucca

SEQ ID NO: 828095 - RNA, 15 nt, Homo sapiens
uaaacuacuuguaaa

SEQ ID NO: 828096 - RNA, 17 nt, Homo sapiens
uaaacuggauacuguac

SEQ ID NO: 828097 - RNA, 18 nt, Homo sapiens
uaaagaauaaaugaaucu

SEQ ID NO: 828098 - RNA, 14 nt, Homo sapiens
uaaaggccuggaac

SEQ ID NO: 828099 - RNA, 19 nt, Homo sapiens
uaaagguuucacuguucau

SEQ ID NO: 828100 - RNA, 14 nt, Homo sapiens
uaaauagaugacaa

SEQ ID NO: 828101 - RNA, 18 nt, Homo sapiens
uaaaucugacagucucaa

SEQ ID NO: 828102 - RNA, 15 nt, Homo sapiens
uaaauuuaugugaug

SEQ ID NO: 828103 - RNA, 13 nt, Homo sapiens
uaacaaaaguaua

SEQ ID NO: 828104 - RNA, 22 nt, Homo sapiens
uaaccagcaacauugacccaga

SEQ ID NO: 828105 - RNA, 22 nt, Homo sapiens
uaagccucaccuuugccuucca

SEQ ID NO: 828106 - RNA, 17 nt, Homo sapiens
uaaggaacggcccuuuu

SEQ ID NO: 828107 - RNA, 13 nt, Homo sapiens
uaaggugggucca

SEQ ID NO: 828108 - RNA, 16 nt, Homo sapiens
uaagguggguccagga

SEQ ID NO: 828109 - RNA, 18 nt, Homo sapiens
uaagugguauauacauau

SEQ ID NO: 828110 - RNA, 11 nt, Homo sapiens
uaauaccaaag

SEQ ID NO: 828111 - RNA, 15 nt, Homo sapiens
uaauacuuacuguua

SEQ ID NO: 828112 - RNA, 15 nt, Homo sapiens
uaauauaugcucaac

SEQ ID NO: 828113 - RNA, 12 nt, Homo sapiens
uaauccaugugc

SEQ ID NO: 828114 - RNA, 14 nt, Homo sapiens
uaaucuccacuguu

SEQ ID NO: 828115 - RNA, 16 nt, Homo sapiens
uaaucugagaggccac

SEQ ID NO: 828116 - RNA, 21 nt, Homo sapiens
uaaucugagaggccacagugc

SEQ ID NO: 828117 - RNA, 16 nt, Homo sapiens
uaaugaagacccagug

SEQ ID NO: 828118 - RNA, 19 nt, Homo sapiens
uaaugaagacccaguguaa

SEQ ID NO: 828119 - RNA, 21 nt, Homo sapiens
uaaugcacauccucauucacu

SEQ ID NO: 828120 - RNA, 14 nt, Homo sapiens
uaauguaauacugu

SEQ ID NO: 828121 - RNA, 17 nt, Homo sapiens
uaauguauacacaugga

SEQ ID NO: 828122 - RNA, 19 nt, Homo sapiens
uaauuuugugaaagaagga

SEQ ID NO: 828123 - RNA, 14 nt, Homo sapiens
uacaaaaggcauuu

SEQ ID NO: 828124 - RNA, 16 nt, Homo sapiens
uacaaagauaugcuaa

SEQ ID NO: 828125 - RNA, 15 nt, Homo sapiens
uacacccccaccucc

SEQ ID NO: 828126 - RNA, 15 nt, Homo sapiens
uacacugcaucucaa

SEQ ID NO: 828127 - RNA, 21 nt, Homo sapiens
uacagacacucccacuuggca

SEQ ID NO: 828128 - RNA, 14 nt, Homo sapiens
uacagaggacagua

SEQ ID NO: 828129 - RNA, 15 nt, Homo sapiens
uacagauuguucuca

SEQ ID NO: 828130 - RNA, 12 nt, Homo sapiens
uacagugcaguu

SEQ ID NO: 828131 - RNA, 13 nt, Homo sapiens
uacauauaugcaa

SEQ ID NO: 828132 - RNA, 14 nt, Homo sapiens
uacauuaaggagca

SEQ ID NO: 828133 - RNA, 16 nt, Homo sapiens
uacauuauauuccucu

SEQ ID NO: 828134 - RNA, 18 nt, Homo sapiens
uacauugccaauuuucca

SEQ ID NO: 828135 - RNA, 21 nt, Homo sapiens
uaccaaaguguuuggucauuu

SEQ ID NO: 828136 - RNA, 15 nt, Homo sapiens
uaccacuaugcaaua

SEQ ID NO: 828137 - RNA, 15 nt, Homo sapiens
uaccagcaucuccca

SEQ ID NO: 828138 - RNA, 13 nt, Homo sapiens
uaccaugcugcuu

SEQ ID NO: 828139 - RNA, 12 nt, Homo sapiens
uacccucccacc

SEQ ID NO: 828140 - RNA, 20 nt, Homo sapiens
uaccuaggcaccaucauuua

SEQ ID NO: 828141 - RNA, 14 nt, Homo sapiens
uaccucuuggcugc

SEQ ID NO: 828142 - RNA, 22 nt, Homo sapiens
uacucaagcagaucucaucuca

SEQ ID NO: 828143 - RNA, 21 nt, Homo sapiens
uacucacccagggacuccagu

SEQ ID NO: 828144 - RNA, 16 nt, Homo sapiens
uacuguauuucauuau

SEQ ID NO: 828145 - RNA, 20 nt, Homo sapiens
uacuguugguuaaaugacaa

SEQ ID NO: 828146 - RNA, 17 nt, Homo sapiens
uacuugccacacacugu

SEQ ID NO: 828147 - RNA, 18 nt, Homo sapiens
uacuugccacacacuguu

SEQ ID NO: 828148 - RNA, 20 nt, Homo sapiens
uacuuuucagaauugaagga

SEQ ID NO: 828149 - RNA, 22 nt, Homo sapiens
uagaaacugaggccauuauuuc

SEQ ID NO: 828150 - RNA, 18 nt, Homo sapiens
uagaaguuaaagucaaua

SEQ ID NO: 828151 - RNA, 15 nt, Homo sapiens
uagaauaaaugaaga

SEQ ID NO: 828152 - RNA, 18 nt, Homo sapiens
uagaaucaagucugugaa

SEQ ID NO: 828153 - RNA, 19 nt, Homo sapiens
uagaaucaagucugugaaa

SEQ ID NO: 828154 - RNA, 23 nt, Homo sapiens
uagaggugggcagcugggcccca

SEQ ID NO: 828155 - RNA, 22 nt, Homo sapiens
uagcaggugaacucgaagccca

SEQ ID NO: 828156 - RNA, 14 nt, Homo sapiens
uagcccagugcuuc

SEQ ID NO: 828157 - RNA, 18 nt, Homo sapiens
uaggacuggguuccccac

SEQ ID NO: 828158 - RNA, 17 nt, Homo sapiens
uaggagagaacagggau

SEQ ID NO: 828159 - RNA, 17 nt, Homo sapiens
uaggaguugaguacagu

SEQ ID NO: 828160 - RNA, 17 nt, Homo sapiens
uaggccagcaccaucuc

SEQ ID NO: 828161 - RNA, 20 nt, Homo sapiens
uaggccagcaccaucucuuu

SEQ ID NO: 828162 - RNA, 19 nt, Homo sapiens
uagguuuccacugccaaaa

SEQ ID NO: 828163 - RNA, 22 nt, Homo sapiens
uaguggcuguccagugcccauu

SEQ ID NO: 828164 - RNA, 19 nt, Homo sapiens
uaguucuuagagcacuuuu

SEQ ID NO: 828165 - RNA, 16 nt, Homo sapiens
uaguuggugaaaccca

SEQ ID NO: 828166 - RNA, 18 nt, Homo sapiens
uauauuaaagacuaacua

SEQ ID NO: 828167 - RNA, 19 nt, Homo sapiens
uaucagccugugccacgau

SEQ ID NO: 828168 - RNA, 13 nt, Homo sapiens
uauccauccaugg

SEQ ID NO: 828169 - RNA, 13 nt, Homo sapiens
uauccuguucuca

SEQ ID NO: 828170 - RNA, 21 nt, Homo sapiens
uaucuacuaguaauaauguaa

SEQ ID NO: 828171 - RNA, 18 nt, Homo sapiens
uaugaauugacagacugu

SEQ ID NO: 828172 - RNA, 16 nt, Homo sapiens
uaugagagaacuauug

SEQ ID NO: 828173 - RNA, 12 nt, Homo sapiens
uaugaugcaguu

SEQ ID NO: 828174 - RNA, 20 nt, Homo sapiens
uaugcaauauaucaauguaa

SEQ ID NO: 828175 - RNA, 19 nt, Homo sapiens
uauguauauguauaucuau

SEQ ID NO: 828176 - RNA, 13 nt, Homo sapiens
gaugaugcaguuu

SEQ ID NO: 828177 - RNA, 22 nt, Homo sapiens
gaugcuaucucgcuagccauau

SEQ ID NO: 828178 - RNA, 17 nt, Homo sapiens
gaugcugaugcuguuaa

SEQ ID NO: 828179 - RNA, 17 nt, Homo sapiens
gaugcuguuaaccaaag

SEQ ID NO: 828180 - RNA, 23 nt, Homo sapiens
gauuaaaaucuggcaaaguuaua

SEQ ID NO: 828181 - RNA, 16 nt, Homo sapiens
gauucuuccugcuuag

SEQ ID NO: 828182 - RNA, 21 nt, Homo sapiens
gauuuaaugaagacccagugu

SEQ ID NO: 828183 - RNA, 20 nt, Homo sapiens
gauuugcacccaugccauag

SEQ ID NO: 828184 - RNA, 22 nt, Homo sapiens
gauuugccagcacaggggcccc

SEQ ID NO: 828185 - RNA, 23 nt, Homo sapiens
gcaaaaguggggcuaaaugaagu

SEQ ID NO: 828186 - RNA, 14 nt, Homo sapiens
gcaacauugaccca

SEQ ID NO: 828187 - RNA, 18 nt, Homo sapiens
gcaacucuauagacuuuu

SEQ ID NO: 828188 - RNA, 13 nt, Homo sapiens
gcaagcagggaaa

SEQ ID NO: 828189 - RNA, 14 nt, Homo sapiens
gcaagucacuggcc

SEQ ID NO: 828190 - RNA, 15 nt, Homo sapiens
gcacaaauuguacau

SEQ ID NO: 828191 - RNA, 23 nt, Homo sapiens
gcacagcccugggagggggcuau

SEQ ID NO: 828192 - RNA, 23 nt, Homo sapiens
gcaccuaugagauggccaugcuc

SEQ ID NO: 828193 - RNA, 13 nt, Homo sapiens
gcacggcuuccca

SEQ ID NO: 828194 - RNA, 22 nt, Homo sapiens
gcacguguggccuguucuucua

SEQ ID NO: 828195 - RNA, 21 nt, Homo sapiens
gcagaucucaucucaugacag

SEQ ID NO: 828196 - RNA, 17 nt, Homo sapiens
gcagcauuccaugacca

SEQ ID NO: 828197 - RNA, 15 nt, Homo sapiens
gcagcuucugccacu

SEQ ID NO: 828198 - RNA, 15 nt, Homo sapiens
gcagugacuuuagaa

SEQ ID NO: 828199 - RNA, 11 nt, Homo sapiens
gcaucauucac

SEQ ID NO: 828200 - RNA, 13 nt, Homo sapiens
gcauuagcuacuu

SEQ ID NO: 828201 - RNA, 14 nt, Homo sapiens
gccacacacuguuc

SEQ ID NO: 828202 - RNA, 14 nt, Homo sapiens
gccacagugcaauu

SEQ ID NO: 828203 - RNA, 13 nt, Homo sapiens
gccacuaccuuug

SEQ ID NO: 828204 - RNA, 14 nt, Homo sapiens
gccagaaaacauau

SEQ ID NO: 828205 - RNA, 19 nt, Homo sapiens
gccagaaaacauaugcauu

SEQ ID NO: 828206 - RNA, 16 nt, Homo sapiens
gccagucuugccuagg

SEQ ID NO: 828207 - RNA, 11 nt, Homo sapiens
gccauucugau

SEQ ID NO: 828208 - RNA, 19 nt, Homo sapiens
gccauugaacaaaugugug

SEQ ID NO: 828209 - RNA, 16 nt, Homo sapiens
gcccaugggcacugcu

SEQ ID NO: 828210 - RNA, 16 nt, Homo sapiens
gccccaacuccagggg

SEQ ID NO: 828211 - RNA, 16 nt, Homo sapiens
gccucccacagugacu

SEQ ID NO: 828212 - RNA, 21 nt, Homo sapiens
gccuccuuuccccucccucag

SEQ ID NO: 828213 - RNA, 18 nt, Homo sapiens
gccucugugucacuggcu

SEQ ID NO: 828214 - RNA, 17 nt, Homo sapiens
gccugagcuggggccac

SEQ ID NO: 828215 - RNA, 15 nt, Homo sapiens
gccugaugauggaag

SEQ ID NO: 828216 - RNA, 16 nt, Homo sapiens
gccuggcuccccacga

SEQ ID NO: 828217 - RNA, 16 nt, Homo sapiens
gccugggggcagugac

SEQ ID NO: 828218 - RNA, 23 nt, Homo sapiens
gccuucuccacagggacacaguc

SEQ ID NO: 828219 - RNA, 19 nt, Homo sapiens
gccuucucccccccggggc

SEQ ID NO: 828220 - RNA, 14 nt, Homo sapiens
gccuuuguugcuca

SEQ ID NO: 828221 - RNA, 15 nt, Homo sapiens
gccuuuguugcucag

SEQ ID NO: 828222 - RNA, 15 nt, Homo sapiens
gcgaccccaucugcc

SEQ ID NO: 828223 - RNA, 20 nt, Homo sapiens
gcguaggagagaacagggau

SEQ ID NO: 828224 - RNA, 20 nt, Homo sapiens
gcuauggggauagaugugug

SEQ ID NO: 828225 - RNA, 12 nt, Homo sapiens
gcuccacagugu

SEQ ID NO: 828226 - RNA, 13 nt, Homo sapiens
gcuccagcaucca

SEQ ID NO: 828227 - RNA, 12 nt, Homo sapiens
gcucgugcagua

SEQ ID NO: 828228 - RNA, 15 nt, Homo sapiens
gcucguuucucucaa

SEQ ID NO: 828229 - RNA, 23 nt, Homo sapiens
gcugagcagguguucuucauuac

SEQ ID NO: 828230 - RNA, 20 nt, Homo sapiens
gcugauuuccaggccccuga

SEQ ID NO: 828231 - RNA, 20 nt, Homo sapiens
gcugcagcugggccccaugc

SEQ ID NO: 828232 - RNA, 20 nt, Homo sapiens
gcugccaugccacugccagg

SEQ ID NO: 828233 - RNA, 22 nt, Homo sapiens
gcugccuccacucccacuuccc

SEQ ID NO: 828234 - RNA, 10 nt, Homo sapiens
gcugcugaga

SEQ ID NO: 828235 - RNA, 18 nt, Homo sapiens
gcugcugagaaucuagcc

SEQ ID NO: 828236 - RNA, 19 nt, Homo sapiens
gcugcugagaaucuagccu

SEQ ID NO: 828237 - RNA, 20 nt, Homo sapiens
gcuggagugcaguggugcga

SEQ ID NO: 828238 - RNA, 21 nt, Homo sapiens
gcuggcuggggccuaucagug

SEQ ID NO: 828239 - RNA, 19 nt, Homo sapiens
gcugggaauaagugccagg

SEQ ID NO: 828240 - RNA, 14 nt, Homo sapiens
gcugggcacugcca

SEQ ID NO: 828241 - RNA, 19 nt, Homo sapiens
gcuggguggcccauccccc

SEQ ID NO: 828242 - RNA, 20 nt, Homo sapiens
gcuguacccuuccaccuccu

SEQ ID NO: 828243 - RNA, 12 nt, Homo sapiens
gcuguuaaccaa

SEQ ID NO: 828244 - RNA, 21 nt, Homo sapiens
gcuuaaacuugacccaggugg

SEQ ID NO: 828245 - RNA, 14 nt, Homo sapiens
gcuuagcuugaggg

SEQ ID NO: 828246 - RNA, 13 nt, Homo sapiens
gcuuugcaggcuc

SEQ ID NO: 828247 - RNA, 19 nt, Homo sapiens
ggaaaaaacaaaaucaugu

SEQ ID NO: 828248 - RNA, 15 nt, Homo sapiens
ggacaccaagccuug

SEQ ID NO: 828249 - RNA, 15 nt, Homo sapiens
ggagcccgugcagua

SEQ ID NO: 828250 - RNA, 20 nt, Homo sapiens
ggauacaauguauaagcuac

SEQ ID NO: 828251 - RNA, 12 nt, Homo sapiens
ggaugucucuca

SEQ ID NO: 828252 - RNA, 22 nt, Homo sapiens
ggcaaagaacugccccaucucc

SEQ ID NO: 828253 - RNA, 20 nt, Homo sapiens
ggcacugcuggguggcccau

SEQ ID NO: 828254 - RNA, 15 nt, Homo sapiens
ggcagagccaugggc

SEQ ID NO: 828255 - RNA, 20 nt, Homo sapiens
ggcagucugaacccuugugc

SEQ ID NO: 828256 - RNA, 16 nt, Homo sapiens
ggcauccacccagugc

SEQ ID NO: 828257 - RNA, 16 nt, Homo sapiens
ggcauuaaagugcugu

SEQ ID NO: 828258 - RNA, 13 nt, Homo sapiens
ggccaucuuccag

SEQ ID NO: 828259 - RNA, 21 nt, Homo sapiens
ggcccucccugucuccagggc

SEQ ID NO: 828260 - RNA, 15 nt, Homo sapiens
ggcccugugccuugg

SEQ ID NO: 828261 - RNA, 12 nt, Homo sapiens
ggccuccacucc

SEQ ID NO: 828262 - RNA, 17 nt, Homo sapiens
ggccuggcacagugucu

SEQ ID NO: 828263 - RNA, 22 nt, Homo sapiens
ggccugggggcagugacuggca

SEQ ID NO: 828264 - RNA, 17 nt, Homo sapiens
ggccuucuccacaggga

SEQ ID NO: 828265 - RNA, 23 nt, Homo sapiens
ggcugacaccuaccaugcugcuu

SEQ ID NO: 828266 - RNA, 14 nt, Homo sapiens
ggcugagcucuuau

SEQ ID NO: 828267 - RNA, 18 nt, Homo sapiens
ggcuggcugaguggaaug

SEQ ID NO: 828268 - RNA, 15 nt, Homo sapiens
gggacacaggggcaa

SEQ ID NO: 828269 - RNA, 16 nt, Homo sapiens
gggagaaugucaguau

SEQ ID NO: 828270 - RNA, 23 nt, Homo sapiens
gggauuucuucgcugcucuagcu

SEQ ID NO: 828271 - RNA, 14 nt, Homo sapiens
gggccauacuggcc

SEQ ID NO: 828272 - RNA, 19 nt, Homo sapiens
gggcucucucaugauagaa

SEQ ID NO: 828273 - RNA, 15 nt, Homo sapiens
ggggaugucucucau

SEQ ID NO: 828274 - RNA, 18 nt, Homo sapiens
ggguuagcucacgugucu

SEQ ID NO: 828275 - RNA, 18 nt, Homo sapiens
ggucauuuccuaugcaaa

SEQ ID NO: 828276 - RNA, 16 nt, Homo sapiens
ggugacuucaggugga

SEQ ID NO: 828277 - RNA, 12 nt, Homo sapiens
ggugcugagcuu

SEQ ID NO: 828278 - RNA, 20 nt, Homo sapiens
guaaagaauaaaugaaucuu

SEQ ID NO: 828279 - RNA, 13 nt, Homo sapiens
guaaauaugcaaa

SEQ ID NO: 828280 - RNA, 23 nt, Homo sapiens
guaacaggccuugagcacaaaau

SEQ ID NO: 828281 - RNA, 18 nt, Homo sapiens
guaauuuaaaauugugau

SEQ ID NO: 828282 - RNA, 15 nt, Homo sapiens
guaauuuuaucuaaa

SEQ ID NO: 828283 - RNA, 16 nt, Homo sapiens
guacaauguacauuau

SEQ ID NO: 828284 - RNA, 17 nt, Homo sapiens
guaccagaacuauuuau

SEQ ID NO: 828285 - RNA, 21 nt, Homo sapiens
guaccucucaacauuaccaaa

SEQ ID NO: 828286 - RNA, 15 nt, Homo sapiens
guagguagacacaaa

SEQ ID NO: 828287 - RNA, 21 nt, Homo sapiens
guauaaccuucaugaugaauu

SEQ ID NO: 828288 - RNA, 11 nt, Homo sapiens
guaugugaaua

SEQ ID NO: 828289 - RNA, 15 nt, Homo sapiens
gucauguaauacuga

SEQ ID NO: 828290 - RNA, 17 nt, Homo sapiens
gucauuuccuaugcaaa

SEQ ID NO: 828291 - RNA, 13 nt, Homo sapiens
guccaagggccau

SEQ ID NO: 828292 - RNA, 19 nt, Homo sapiens
guccacuuuuaaaacuaua

SEQ ID NO: 828293 - RNA, 21 nt, Homo sapiens
ugcaggagucccugccaucau

SEQ ID NO: 828294 - RNA, 19 nt, Homo sapiens
ugcaguuucaaguaccaaa

SEQ ID NO: 828295 - RNA, 18 nt, Homo sapiens
ugcauuuaugaugcaguu

SEQ ID NO: 828296 - RNA, 15 nt, Homo sapiens
ugccaccugucuguc

SEQ ID NO: 828297 - RNA, 20 nt, Homo sapiens
ugcccagacucaaggccucc

SEQ ID NO: 828298 - RNA, 20 nt, Homo sapiens
ugcccaggcuggagugcagu

SEQ ID NO: 828299 - RNA, 17 nt, Homo sapiens
ugcccaugggcacugcu

SEQ ID NO: 828300 - RNA, 21 nt, Homo sapiens
ugcguaggagagaacagggau

SEQ ID NO: 828301 - RNA, 20 nt, Homo sapiens
ugcuaucucgcuagccauau

SEQ ID NO: 828302 - RNA, 18 nt, Homo sapiens
ugcuugcccgcucccaca

SEQ ID NO: 828303 - RNA, 23 nt, Homo sapiens
uggaaugcagggaagagggcagu

SEQ ID NO: 828304 - RNA, 22 nt, Homo sapiens
uggagagaucauagcucacugu

SEQ ID NO: 828305 - RNA, 16 nt, Homo sapiens
uggagcccgugcagua

SEQ ID NO: 828306 - RNA, 18 nt, Homo sapiens
uggagugcaguggugcga

SEQ ID NO: 828307 - RNA, 16 nt, Homo sapiens
uggcaucuccauguag

SEQ ID NO: 828308 - RNA, 19 nt, Homo sapiens
uggcauuaaagugcuguau

SEQ ID NO: 828309 - RNA, 20 nt, Homo sapiens
uggccuuccccuuuugccug

SEQ ID NO: 828310 - RNA, 21 nt, Homo sapiens
uggcgcgggaggcaccagcuc

SEQ ID NO: 828311 - RNA, 21 nt, Homo sapiens
uggcggcuuccuguccacucu

SEQ ID NO: 828312 - RNA, 22 nt, Homo sapiens
uggcugagagaguggcauuggc

SEQ ID NO: 828313 - RNA, 15 nt, Homo sapiens
uggcuggaucuguga

SEQ ID NO: 828314 - RNA, 14 nt, Homo sapiens
ugggaagaaguaaa

SEQ ID NO: 828315 - RNA, 18 nt, Homo sapiens
ugggcucugugggcugca

SEQ ID NO: 828316 - RNA, 19 nt, Homo sapiens
uggguacaauguacauuau

SEQ ID NO: 828317 - RNA, 17 nt, Homo sapiens
uggguuggacaaccuca

SEQ ID NO: 828318 - RNA, 14 nt, Homo sapiens
ugguagacugugac

SEQ ID NO: 828319 - RNA, 15 nt, Homo sapiens
ugguagacugugaca

SEQ ID NO: 828320 - RNA, 13 nt, Homo sapiens
ugguccaucucau

SEQ ID NO: 828321 - RNA, 14 nt, Homo sapiens
uguaaauaugcaaa

SEQ ID NO: 828322 - RNA, 16 nt, Homo sapiens
uguaauacacagugag

SEQ ID NO: 828323 - RNA, 15 nt, Homo sapiens
uguacaaagauaugc

SEQ ID NO: 828324 - RNA, 15 nt, Homo sapiens
uguauaagcuacuca

SEQ ID NO: 828325 - RNA, 13 nt, Homo sapiens
uguauaauggugu

SEQ ID NO: 828326 - RNA, 14 nt, Homo sapiens
uguauccauccaug

SEQ ID NO: 828327 - RNA, 19 nt, Homo sapiens
uguauccauccauggggcu

SEQ ID NO: 828328 - RNA, 16 nt, Homo sapiens
ugucauguaauacuga

SEQ ID NO: 828329 - RNA, 17 nt, Homo sapiens
ugucauguaauacugaa

SEQ ID NO: 828330 - RNA, 13 nt, Homo sapiens
uguccagcagcug

SEQ ID NO: 828331 - RNA, 15 nt, Homo sapiens
ugucccucauccaua

SEQ ID NO: 828332 - RNA, 14 nt, Homo sapiens
uguccugccagcug

SEQ ID NO: 828333 - RNA, 22 nt, Homo sapiens
ugucguuuucacauaugacaau

SEQ ID NO: 828334 - RNA, 21 nt, Homo sapiens
ugucuccagggcccccaccga

SEQ ID NO: 828335 - RNA, 22 nt, Homo sapiens
ugucuccuccagcgugguggaa

SEQ ID NO: 828336 - RNA, 15 nt, Homo sapiens
ugucucucaugacca

SEQ ID NO: 828337 - RNA, 14 nt, Homo sapiens
ugucugucccaaag

SEQ ID NO: 828338 - RNA, 23 nt, Homo sapiens
ugugagugaccucacuucuggca

SEQ ID NO: 828339 - RNA, 14 nt, Homo sapiens
ugugauguguccug

SEQ ID NO: 828340 - RNA, 17 nt, Homo sapiens
aggggcaaagaacugcc

SEQ ID NO: 828341 - RNA, 20 nt, Homo sapiens
aggggcaggcacagcacagg

SEQ ID NO: 828342 - RNA, 23 nt, Homo sapiens
aggggcaggccugggacccagcu

SEQ ID NO: 828343 - RNA, 16 nt, Homo sapiens
aggguccgcaccagcu

SEQ ID NO: 828344 - RNA, 21 nt, Homo sapiens
aggguugggcgugcuaccugc

SEQ ID NO: 828345 - RNA, 22 nt, Homo sapiens
aggguugggcgugcuaccugca

SEQ ID NO: 828346 - RNA, 22 nt, Homo sapiens
aggucucgcugaugcugggcug

SEQ ID NO: 828347 - RNA, 14 nt, Homo sapiens
agguggguccagga

SEQ ID NO: 828348 - RNA, 21 nt, Homo sapiens
agguguucuucauuaccucag

SEQ ID NO: 828349 - RNA, 21 nt, Homo sapiens
agguuaggaaggcagcauucc

SEQ ID NO: 828350 - RNA, 21 nt, Homo sapiens
aguaaggaacggcccuuuuag

SEQ ID NO: 828351 - RNA, 21 nt, Homo sapiens
aguaauaauguaauacuguag

SEQ ID NO: 828352 - RNA, 16 nt, Homo sapiens
aguaucuucaaaaaua

SEQ ID NO: 828353 - RNA, 20 nt, Homo sapiens
agucagacuuacuuacuccc

SEQ ID NO: 828354 - RNA, 18 nt, Homo sapiens
agucucuaugaucuuggc

SEQ ID NO: 828355 - RNA, 14 nt, Homo sapiens
agugaacacacuca

SEQ ID NO: 828356 - RNA, 15 nt, Homo sapiens
agugaauacauuuug

SEQ ID NO: 828357 - RNA, 20 nt, Homo sapiens
agugacuuuagaaacaaauu

SEQ ID NO: 828358 - RNA, 17 nt, Homo sapiens
agugauaugauguguag

SEQ ID NO: 828359 - RNA, 21 nt, Homo sapiens
agugcagagaaagaaagggaa

SEQ ID NO: 828360 - RNA, 14 nt, Homo sapiens
aguggcagccaugc

SEQ ID NO: 828361 - RNA, 17 nt, Homo sapiens
aguggugcgaucuuggc

SEQ ID NO: 828362 - RNA, 22 nt, Homo sapiens
aguguuaggccuggcacagugu

SEQ ID NO: 828363 - RNA, 17 nt, Homo sapiens
aguuaauuuuauuccag

SEQ ID NO: 828364 - RNA, 18 nt, Homo sapiens
aguucaagugaucuuuca

SEQ ID NO: 828365 - RNA, 20 nt, Homo sapiens
aguuccagauuguucugucc

SEQ ID NO: 828366 - RNA, 21 nt, Homo sapiens
aguuccagauuguucugucca

SEQ ID NO: 828367 - RNA, 11 nt, Homo sapiens
aguucugauga

SEQ ID NO: 828368 - RNA, 21 nt, Homo sapiens
aguuguauuuugacaaaaaug

SEQ ID NO: 828369 - RNA, 22 nt, Homo sapiens
aguuuccagcuaagccugauga

SEQ ID NO: 828370 - RNA, 19 nt, Homo sapiens
auaaacacauacauugcca

SEQ ID NO: 828371 - RNA, 12 nt, Homo sapiens
auaaagugaaua

SEQ ID NO: 828372 - RNA, 13 nt, Homo sapiens
auaaauaagcaaa

SEQ ID NO: 828373 - RNA, 15 nt, Homo sapiens
auaaaucaguuaugu

SEQ ID NO: 828374 - RNA, 18 nt, Homo sapiens
auaaaugaagaaagggag

SEQ ID NO: 828375 - RNA, 12 nt, Homo sapiens
auaaaugaaucu

SEQ ID NO: 828376 - RNA, 14 nt, Homo sapiens
auaaauuacauuaa

SEQ ID NO: 828377 - RNA, 13 nt, Homo sapiens
auaaguauuucca

SEQ ID NO: 828378 - RNA, 22 nt, Homo sapiens
auaaguauuuccauaacucaua

SEQ ID NO: 828379 - RNA, 10 nt, Homo sapiens
auaauuuugu

SEQ ID NO: 828380 - RNA, 14 nt, Homo sapiens
auaauuuuguaaga

SEQ ID NO: 828381 - RNA, 21 nt, Homo sapiens
auaauuuuguaagaggcuuca

SEQ ID NO: 828382 - RNA, 23 nt, Homo sapiens
auacauauaugaguugccuauau

SEQ ID NO: 828383 - RNA, 20 nt, Homo sapiens
auacaucuucauuaauacug

SEQ ID NO: 828384 - RNA, 12 nt, Homo sapiens
auacauugccaa

SEQ ID NO: 828385 - RNA, 23 nt, Homo sapiens
auaccaaaguguuuggucauuuu

SEQ ID NO: 828386 - RNA, 17 nt, Homo sapiens
auacuguacugauacua

SEQ ID NO: 828387 - RNA, 12 nt, Homo sapiens
auagaaacugag

SEQ ID NO: 828388 - RNA, 12 nt, Homo sapiens
auagaaacugau

SEQ ID NO: 828389 - RNA, 20 nt, Homo sapiens
auagcaccuccacauaccug

SEQ ID NO: 828390 - RNA, 22 nt, Homo sapiens
auagcauguucguauuacaaga

SEQ ID NO: 828391 - RNA, 21 nt, Homo sapiens
auagcucacuguaaccucaaa

SEQ ID NO: 828392 - RNA, 13 nt, Homo sapiens
cacccaugccaua

SEQ ID NO: 828393 - RNA, 16 nt, Homo sapiens
caccgagaggaaaaag

SEQ ID NO: 828394 - RNA, 13 nt, Homo sapiens
cacgucugccagg

SEQ ID NO: 828395 - RNA, 16 nt, Homo sapiens
cacuaagcuuucuccu

SEQ ID NO: 828396 - RNA, 19 nt, Homo sapiens
cacuacuguauuucauuau

SEQ ID NO: 828397 - RNA, 23 nt, Homo sapiens
cacucuggaaaugcaaauagaau

SEQ ID NO: 828398 - RNA, 16 nt, Homo sapiens
cacugaagugcuugca

SEQ ID NO: 828399 - RNA, 15 nt, Homo sapiens
cacuggcugccucca

SEQ ID NO: 828400 - RNA, 16 nt, Homo sapiens
cacuucacuaccaaau

SEQ ID NO: 828401 - RNA, 16 nt, Homo sapiens
cacuuccccuccuacc

SEQ ID NO: 828402 - RNA, 13 nt, Homo sapiens
cagaaauucucaa

SEQ ID NO: 828403 - RNA, 20 nt, Homo sapiens
cagacugaaccagagcugga

SEQ ID NO: 828404 - RNA, 16 nt, Homo sapiens
cagagccuuuuacccc

SEQ ID NO: 828405 - RNA, 13 nt, Homo sapiens
cagagcugggaaa

SEQ ID NO: 828406 - RNA, 13 nt, Homo sapiens
cagaggacaguau

SEQ ID NO: 828407 - RNA, 23 nt, Homo sapiens
cagaugggcuguuucguguagug

SEQ ID NO: 828408 - RNA, 13 nt, Homo sapiens
cagauuguucuca

SEQ ID NO: 828409 - RNA, 11 nt, Homo sapiens
cagcacagcaa

SEQ ID NO: 828410 - RNA, 21 nt, Homo sapiens
cagcaccaucucuuuaccucc

SEQ ID NO: 828411 - RNA, 16 nt, Homo sapiens
cagccacuuauuucca

SEQ ID NO: 828412 - RNA, 20 nt, Homo sapiens
cagcuuuccucaucaggcca

SEQ ID NO: 828413 - RNA, 17 nt, Homo sapiens
caggcagccacgucuca

SEQ ID NO: 828414 - RNA, 18 nt, Homo sapiens
caggccacuguggccaga

SEQ ID NO: 828415 - RNA, 18 nt, Homo sapiens
caggccauugucccugaa

SEQ ID NO: 828416 - RNA, 20 nt, Homo sapiens
caggccauugucccugaaga

SEQ ID NO: 828417 - RNA, 16 nt, Homo sapiens
caggccugggacccag

SEQ ID NO: 828418 - RNA, 16 nt, Homo sapiens
caggcuggagugcagu

SEQ ID NO: 828419 - RNA, 17 nt, Homo sapiens
cagggaagagggcagua

SEQ ID NO: 828420 - RNA, 18 nt, Homo sapiens
cagggauucuuccugcuu

SEQ ID NO: 828421 - RNA, 20 nt, Homo sapiens
cagggauucuuccugcuuag

SEQ ID NO: 828422 - RNA, 19 nt, Homo sapiens
cagggcugaggccucucau

SEQ ID NO: 828423 - RNA, 22 nt, Homo sapiens
caggguguuaaggcagugacuu

SEQ ID NO: 828424 - RNA, 15 nt, Homo sapiens
caggugcugacaaua

SEQ ID NO: 828425 - RNA, 19 nt, Homo sapiens
caguaaauauuaaccugaa

SEQ ID NO: 828426 - RNA, 16 nt, Homo sapiens
caguaacaugcaacaa

SEQ ID NO: 828427 - RNA, 14 nt, Homo sapiens
cagucucuucugau

SEQ ID NO: 828428 - RNA, 12 nt, Homo sapiens
cagugacuggca

SEQ ID NO: 828429 - RNA, 17 nt, Homo sapiens
cagugagaagccagcuu

SEQ ID NO: 828430 - RNA, 10 nt, Homo sapiens
cagugcaguu

SEQ ID NO: 828431 - RNA, 11 nt, Homo sapiens
cagugcaguuu

SEQ ID NO: 828432 - RNA, 22 nt, Homo sapiens
cagugccuuuguagccuauguc

SEQ ID NO: 828433 - RNA, 19 nt, Homo sapiens
caguguuaggccuggcaca

SEQ ID NO: 828434 - RNA, 13 nt, Homo sapiens
caguucugaugag

SEQ ID NO: 828435 - RNA, 23 nt, Homo sapiens
cauaaauuuaugguucucaggcc

SEQ ID NO: 828436 - RNA, 20 nt, Homo sapiens
cauaacucauaauccagaga

SEQ ID NO: 828437 - RNA, 21 nt, Homo sapiens
cauaauccagagauaauugcc

SEQ ID NO: 828438 - RNA, 24 nt, Homo sapiens
cauauauaauuuuauugcuggaau

SEQ ID NO: 828439 - RNA, 13 nt, Homo sapiens
cauauaugcaaua

SEQ ID NO: 828440 - RNA, 14 nt, Homo sapiens
cauauaugcaauau

SEQ ID NO: 828441 - RNA, 16 nt, Homo sapiens
caucaguuaggauuag

SEQ ID NO: 828442 - RNA, 17 nt, Homo sapiens
cauccauagcaccucca

SEQ ID NO: 828443 - RNA, 21 nt, Homo sapiens
cauccuggcccaucaguguac

SEQ ID NO: 828444 - RNA, 16 nt, Homo sapiens
caucucuuuaccuccu

SEQ ID NO: 828445 - RNA, 17 nt, Homo sapiens
caucuucauuaauacug

SEQ ID NO: 828446 - RNA, 15 nt, Homo sapiens
caugccacugccagg

SEQ ID NO: 828447 - RNA, 22 nt, Homo sapiens
caugcuugcauuauauuuguaa

SEQ ID NO: 828448 - RNA, 11 nt, Homo sapiens
caugcuuucuc

SEQ ID NO: 828449 - RNA, 18 nt, Homo sapiens
cauggcguaaugggccug

SEQ ID NO: 828450 - RNA, 16 nt, Homo sapiens
cauggggcugauugua

SEQ ID NO: 828451 - RNA, 17 nt, Homo sapiens
cauuauuucaaccgcuu

SEQ ID NO: 828452 - RNA, 18 nt, Homo sapiens
cauuuaugaugcaguuuc

SEQ ID NO: 828453 - RNA, 15 nt, Homo sapiens
cauuuccuaugcaaa

SEQ ID NO: 828454 - RNA, 14 nt, Homo sapiens
cauuuuauuacacu

SEQ ID NO: 828455 - RNA, 16 nt, Homo sapiens
cauuuuauuacacuaa

SEQ ID NO: 828456 - RNA, 15 nt, Homo sapiens
cauuuuguuauagaa

SEQ ID NO: 828457 - RNA, 22 nt, Homo sapiens
ccaaaaagauuuauuaauuaaa

SEQ ID NO: 828458 - RNA, 22 nt, Homo sapiens
agcugcuuucgaauaaagugaa

SEQ ID NO: 828459 - RNA, 13 nt, Homo sapiens
cucuuuaccuccu

SEQ ID NO: 828460 - RNA, 23 nt, Homo sapiens
cugaaccagagcuggaacacaau

SEQ ID NO: 828461 - RNA, 18 nt, Homo sapiens
cugaaggggcacaccacu

SEQ ID NO: 828462 - RNA, 19 nt, Homo sapiens
cugaagguuuccuggucca

SEQ ID NO: 828463 - RNA, 19 nt, Homo sapiens
cugagggaauuuaaccagc

SEQ ID NO: 828464 - RNA, 18 nt, Homo sapiens
cugaugcuguuaaccaaa

SEQ ID NO: 828465 - RNA, 20 nt, Homo sapiens
cugaugcuguuaaccaaagg

SEQ ID NO: 828466 - RNA, 23 nt, Homo sapiens
cugcaaauauuagcaaagaagcu

SEQ ID NO: 828467 - RNA, 19 nt, Homo sapiens
cugcagcugggccccaugc

SEQ ID NO: 828468 - RNA, 19 nt, Homo sapiens
cugccaccacgucugccag

SEQ ID NO: 828469 - RNA, 18 nt, Homo sapiens
cugcccugccaccugucu

SEQ ID NO: 828470 - RNA, 23 nt, Homo sapiens
cugccuccuuuccccucccucag

SEQ ID NO: 828471 - RNA, 21 nt, Homo sapiens
cugccuugccaugucuuguuc

SEQ ID NO: 828472 - RNA, 22 nt, Homo sapiens
cugcguaggagagaacagggau

SEQ ID NO: 828473 - RNA, 18 nt, Homo sapiens
cugcucagagucuaucaa

SEQ ID NO: 828474 - RNA, 18 nt, Homo sapiens
cugcucugcucagagucu

SEQ ID NO: 828475 - RNA, 17 nt, Homo sapiens
cugcuguggcaucagga

SEQ ID NO: 828476 - RNA, 12 nt, Homo sapiens
cugcuguugcca

SEQ ID NO: 828477 - RNA, 15 nt, Homo sapiens
cuggaaaugcaaaua

SEQ ID NO: 828478 - RNA, 20 nt, Homo sapiens
cuggagaccgcuucaccccu

SEQ ID NO: 828479 - RNA, 20 nt, Homo sapiens
cuggaucugugaggggcucu

SEQ ID NO: 828480 - RNA, 21 nt, Homo sapiens
cuggcaauucacaaauagcca

SEQ ID NO: 828481 - RNA, 13 nt, Homo sapiens
cuggcacaguguc

SEQ ID NO: 828482 - RNA, 12 nt, Homo sapiens
cuggcccugugc

SEQ ID NO: 828483 - RNA, 16 nt, Homo sapiens
cuggccucaagcaauc

SEQ ID NO: 828484 - RNA, 22 nt, Homo sapiens
cugggagugauaugauguguag

SEQ ID NO: 828485 - RNA, 20 nt, Homo sapiens
cugggcucccucaaaugaca

SEQ ID NO: 828486 - RNA, 19 nt, Homo sapiens
cuggggaugucucucauga

SEQ ID NO: 828487 - RNA, 19 nt, Homo sapiens
cuggguuccccacagugac

SEQ ID NO: 828488 - RNA, 16 nt, Homo sapiens
cugucugucccaaaga

SEQ ID NO: 828489 - RNA, 17 nt, Homo sapiens
cugugccuaucaccucu

SEQ ID NO: 828490 - RNA, 14 nt, Homo sapiens
cugugccuuuugcc

SEQ ID NO: 828491 - RNA, 14 nt, Homo sapiens
cuguguauucucau

SEQ ID NO: 828492 - RNA, 23 nt, Homo sapiens
cugugucuuauagguuuccacug

SEQ ID NO: 828493 - RNA, 14 nt, Homo sapiens
cuguuaaccaaagg

SEQ ID NO: 828494 - RNA, 13 nt, Homo sapiens
cuguuuagaacua

SEQ ID NO: 828495 - RNA, 21 nt, Homo sapiens
cuuaaaaugugagugaccuca

SEQ ID NO: 828496 - RNA, 15 nt, Homo sapiens
cuuaaacuugaccca

SEQ ID NO: 828497 - RNA, 16 nt, Homo sapiens
cuuaaucuccacuguu

SEQ ID NO: 828498 - RNA, 20 nt, Homo sapiens
cuuaguuggugaaacccaga

SEQ ID NO: 828499 - RNA, 15 nt, Homo sapiens
cuuauagguuuccac

SEQ ID NO: 828500 - RNA, 19 nt, Homo sapiens
cuuaucaacauuuguucca

SEQ ID NO: 828501 - RNA, 23 nt, Homo sapiens
cuuaucaacauuuguuccaugag

SEQ ID NO: 828502 - RNA, 16 nt, Homo sapiens
cuuaucugauacuuau

SEQ ID NO: 828503 - RNA, 13 nt, Homo sapiens
cuucauuaccuca

SEQ ID NO: 828504 - RNA, 17 nt, Homo sapiens
cuucauuaccucaguga

SEQ ID NO: 828505 - RNA, 22 nt, Homo sapiens
cuuccugcuuaaacuugaccca

SEQ ID NO: 828506 - RNA, 15 nt, Homo sapiens
cuuccuguccacucu

SEQ ID NO: 828507 - RNA, 17 nt, Homo sapiens
cuuccuucagcaucuca

SEQ ID NO: 828508 - RNA, 21 nt, Homo sapiens
caccucaugagucuaccugag

SEQ ID NO: 828509 - RNA, 15 nt, Homo sapiens
caccucuuaugcaca

SEQ ID NO: 828510 - RNA, 19 nt, Homo sapiens
caccugacaauggcagcua

SEQ ID NO: 828511 - RNA, 15 nt, Homo sapiens
cacgcaagggcauca

SEQ ID NO: 828512 - RNA, 14 nt, Homo sapiens
cacucugugcccau

SEQ ID NO: 828513 - RNA, 16 nt, Homo sapiens
cacuggcugccuccac

SEQ ID NO: 828514 - RNA, 16 nt, Homo sapiens
cacuguccugcuccac

SEQ ID NO: 828515 - RNA, 16 nt, Homo sapiens
cacuuauuuccaugga

SEQ ID NO: 828516 - RNA, 22 nt, Homo sapiens
cagaaaacauaugcauuaugaa

SEQ ID NO: 828517 - RNA, 11 nt, Homo sapiens
cagaaaugcaa

SEQ ID NO: 828518 - RNA, 21 nt, Homo sapiens
cagacucuuuuuguaccuggu

SEQ ID NO: 828519 - RNA, 21 nt, Homo sapiens
cagaggcauuuaaaauggaaa

SEQ ID NO: 828520 - RNA, 18 nt, Homo sapiens
cagaucuuuuugugaaau

SEQ ID NO: 828521 - RNA, 19 nt, Homo sapiens
cagcaagaaacguguucua

SEQ ID NO: 828522 - RNA, 11 nt, Homo sapiens
cagcaucucac

SEQ ID NO: 828523 - RNA, 20 nt, Homo sapiens
cagccacuuauuuccaugga

SEQ ID NO: 828524 - RNA, 18 nt, Homo sapiens
cagcccgggucaucugua

SEQ ID NO: 828525 - RNA, 14 nt, Homo sapiens
cagccugauggcca

SEQ ID NO: 828526 - RNA, 15 nt, Homo sapiens
cagcuggaacccugg

SEQ ID NO: 828527 - RNA, 14 nt, Homo sapiens
caggcacugagaau

SEQ ID NO: 828528 - RNA, 18 nt, Homo sapiens
caggccagaaaacauaug

SEQ ID NO: 828529 - RNA, 18 nt, Homo sapiens
caggccagagugcugcca

SEQ ID NO: 828530 - RNA, 23 nt, Homo sapiens
caggcccucccugucuccagggc

SEQ ID NO: 828531 - RNA, 22 nt, Homo sapiens
caggggcaaagaacugccccau

SEQ ID NO: 828532 - RNA, 14 nt, Homo sapiens
caggggcaggcaca

SEQ ID NO: 828533 - RNA, 17 nt, Homo sapiens
caggguguuaaggcagu

SEQ ID NO: 828534 - RNA, 14 nt, Homo sapiens
caggugcugacaau

SEQ ID NO: 828535 - RNA, 18 nt, Homo sapiens
cagguucuuuaaaaugcc

SEQ ID NO: 828536 - RNA, 18 nt, Homo sapiens
caguacucccuuccauac

SEQ ID NO: 828537 - RNA, 21 nt, Homo sapiens
caguacuguugguuaaaugac

SEQ ID NO: 828538 - RNA, 22 nt, Homo sapiens
caguauaccuggcaauucacaa

SEQ ID NO: 828539 - RNA, 22 nt, Homo sapiens
cagucucuucugauuaaagaga

SEQ ID NO: 828540 - RNA, 15 nt, Homo sapiens
cagucuggugcccag

SEQ ID NO: 828541 - RNA, 20 nt, Homo sapiens
cagucuggugcccagacuca

SEQ ID NO: 828542 - RNA, 12 nt, Homo sapiens
cagucuuggaau

SEQ ID NO: 828543 - RNA, 18 nt, Homo sapiens
cagugagacacaguaauu

SEQ ID NO: 828544 - RNA, 16 nt, Homo sapiens
cagugcccauuccuca

SEQ ID NO: 828545 - RNA, 18 nt, Homo sapiens
caguggcuggaucuguga

SEQ ID NO: 828546 - RNA, 14 nt, Homo sapiens
cauacauugccaau

SEQ ID NO: 828547 - RNA, 14 nt, Homo sapiens
cauaugauacugau

SEQ ID NO: 828548 - RNA, 19 nt, Homo sapiens
cauccaacauuaaaagcca

SEQ ID NO: 828549 - RNA, 23 nt, Homo sapiens
caucucuuuaccuccuaauucca

SEQ ID NO: 828550 - RNA, 14 nt, Homo sapiens
caucuguaccucug

SEQ ID NO: 828551 - RNA, 23 nt, Homo sapiens
caugaccaaaugcuuuuccucaa

SEQ ID NO: 828552 - RNA, 12 nt, Homo sapiens
caugaccagaaa

SEQ ID NO: 828553 - RNA, 17 nt, Homo sapiens
caugaguuggcugggaa

SEQ ID NO: 828554 - RNA, 20 nt, Homo sapiens
caugcugcuuuuuggcacag

SEQ ID NO: 828555 - RNA, 14 nt, Homo sapiens
caugguagacugug

SEQ ID NO: 828556 - RNA, 17 nt, Homo sapiens
caugguagacugugaca

SEQ ID NO: 828557 - RNA, 18 nt, Homo sapiens
caugugcugcuguggcau

SEQ ID NO: 828558 - RNA, 17 nt, Homo sapiens
cauguguugccuggaag

SEQ ID NO: 828559 - RNA, 16 nt, Homo sapiens
cauguucguauuacaa

SEQ ID NO: 828560 - RNA, 13 nt, Homo sapiens
cauuaauacugug

SEQ ID NO: 828561 - RNA, 20 nt, Homo sapiens
cauuaucagccugugccacg

SEQ ID NO: 828562 - RNA, 23 nt, Homo sapiens
cauuauuucaaccgcuugccaua

SEQ ID NO: 828563 - RNA, 22 nt, Homo sapiens
cauucacagcaagucacuggcc

SEQ ID NO: 828564 - RNA, 22 nt, Homo sapiens
cauucacuaagccaugccaugc

SEQ ID NO: 828565 - RNA, 17 nt, Homo sapiens
cauuguauuaauaccaa

SEQ ID NO: 828566 - RNA, 22 nt, Homo sapiens
cauuuaggacuggguuccccac

SEQ ID NO: 828567 - RNA, 16 nt, Homo sapiens
cauuuaugaugcaguu

SEQ ID NO: 828568 - RNA, 21 nt, Homo sapiens
cauuucucuugcucaccaaga

SEQ ID NO: 828569 - RNA, 18 nt, Homo sapiens
cauuucuugguaugauca

SEQ ID NO: 828570 - RNA, 18 nt, Homo sapiens
cauuuguaaaaauacugu

SEQ ID NO: 828571 - RNA, 12 nt, Homo sapiens
cauuuucauuaa

SEQ ID NO: 828572 - RNA, 13 nt, Homo sapiens
cauuuugcauuag

SEQ ID NO: 828573 - RNA, 16 nt, Homo sapiens
cauuuuguacaaagau

SEQ ID NO: 828574 - RNA, 21 nt, Homo sapiens
ccaauacguagauuuuugcuc

SEQ ID NO: 828575 - RNA, 14 nt, Homo sapiens
ccacauaccuggcc

SEQ ID NO: 828576 - RNA, 15 nt, Homo sapiens
ccaccuccugcaaua

SEQ ID NO: 828577 - RNA, 12 nt, Homo sapiens
ccacuccagaga

SEQ ID NO: 828578 - RNA, 20 nt, Homo sapiens
ccacugcacccccuccugcu

SEQ ID NO: 828579 - RNA, 22 nt, Homo sapiens
ccacuggcauuaaagugcugua

SEQ ID NO: 828580 - RNA, 17 nt, Homo sapiens
ccagaaaagcaguggcu

SEQ ID NO: 828581 - RNA, 15 nt, Homo sapiens
ccagaaacagggaca

SEQ ID NO: 828582 - RNA, 16 nt, Homo sapiens
ccagaacuauuuauuu

SEQ ID NO: 828583 - RNA, 17 nt, Homo sapiens
ccagagguuaucugccu

SEQ ID NO: 828584 - RNA, 15 nt, Homo sapiens
ccagagugcugccag

SEQ ID NO: 828585 - RNA, 17 nt, Homo sapiens
ccagcaacauugaccca

SEQ ID NO: 828586 - RNA, 22 nt, Homo sapiens
ccagccugggacucccagugaa

SEQ ID NO: 828587 - RNA, 14 nt, Homo sapiens
ccagcuuuccucau

SEQ ID NO: 828588 - RNA, 15 nt, Homo sapiens
ccaggaaggcagcug

SEQ ID NO: 828589 - RNA, 23 nt, Homo sapiens
ccaggagacagacagagaaggca

SEQ ID NO: 828590 - RNA, 17 nt, Homo sapiens
ccaggauccugcaggaa

SEQ ID NO: 828591 - RNA, 18 nt, Homo sapiens
ccaggcugcacugcagug

SEQ ID NO: 828592 - RNA, 23 nt, Homo sapiens
ccucacugcuguagacauuugcu

SEQ ID NO: 828593 - RNA, 16 nt, Homo sapiens
ccucacuucuggcacu

SEQ ID NO: 828594 - RNA, 14 nt, Homo sapiens
ccucccacagugac

SEQ ID NO: 828595 - RNA, 13 nt, Homo sapiens
ccucccucaggcc

SEQ ID NO: 828596 - RNA, 21 nt, Homo sapiens
ccucccuguauaagacacuuu

SEQ ID NO: 828597 - RNA, 19 nt, Homo sapiens
ccucuucuuauucaugcuu

SEQ ID NO: 828598 - RNA, 14 nt, Homo sapiens
ccugaaccccaugg

SEQ ID NO: 828599 - RNA, 22 nt, Homo sapiens
ccugagucggccccacauggga

SEQ ID NO: 828600 - RNA, 16 nt, Homo sapiens
ccugcacuguccugcu

SEQ ID NO: 828601 - RNA, 13 nt, Homo sapiens
ccugccucaggcu

SEQ ID NO: 828602 - RNA, 14 nt, Homo sapiens
ccuggccucacugg

SEQ ID NO: 828603 - RNA, 21 nt, Homo sapiens
ccugggaaggcuaaguucagu

SEQ ID NO: 828604 - RNA, 11 nt, Homo sapiens
ccugugcagca

SEQ ID NO: 828605 - RNA, 16 nt, Homo sapiens
ccuuaaaaaugcacac

SEQ ID NO: 828606 - RNA, 21 nt, Homo sapiens
ccuucagaacagaggcauuua

SEQ ID NO: 828607 - RNA, 22 nt, Homo sapiens
ccuucagaacagaggcauuuaa

SEQ ID NO: 828608 - RNA, 14 nt, Homo sapiens
ccuucagcaucuca

SEQ ID NO: 828609 - RNA, 16 nt, Homo sapiens
ccuucuaauccaugug

SEQ ID NO: 828610 - RNA, 15 nt, Homo sapiens
ccuucuugcuucuca

SEQ ID NO: 828611 - RNA, 15 nt, Homo sapiens
ccuuggugugcugua

SEQ ID NO: 828612 - RNA, 17 nt, Homo sapiens
ccuuguccugccagcug

SEQ ID NO: 828613 - RNA, 17 nt, Homo sapiens
ccuuuccccucccucag

SEQ ID NO: 828614 - RNA, 17 nt, Homo sapiens
ccuuuguagccuauguc

SEQ ID NO: 828615 - RNA, 18 nt, Homo sapiens
ccuuuuaccccugcacag

SEQ ID NO: 828616 - RNA, 15 nt, Homo sapiens
ccuuuuaguucuuag

SEQ ID NO: 828617 - RNA, 21 nt, Homo sapiens
ccuuuuauucauauuuucaca

SEQ ID NO: 828618 - RNA, 22 nt, Homo sapiens
cgagauguucgcucgugcagua

SEQ ID NO: 828619 - RNA, 20 nt, Homo sapiens
cgaugaauguguugauuuga

SEQ ID NO: 828620 - RNA, 19 nt, Homo sapiens
cgcuaaagguguaagacuu

SEQ ID NO: 828621 - RNA, 17 nt, Homo sapiens
cggacugcccccagaaa

SEQ ID NO: 828622 - RNA, 17 nt, Homo sapiens
cggccuuuguugcucag

SEQ ID NO: 828623 - RNA, 14 nt, Homo sapiens
cguauuacaagaga

SEQ ID NO: 828624 - RNA, 21 nt, Homo sapiens
cguauucuaauucuucauuau

SEQ ID NO: 828625 - RNA, 21 nt, Homo sapiens
cgucuacucauuccccggggc

SEQ ID NO: 828626 - RNA, 13 nt, Homo sapiens
cgugcuaccugca

SEQ ID NO: 828627 - RNA, 18 nt, Homo sapiens
cguugaauugaugaugca

SEQ ID NO: 828628 - RNA, 18 nt, Homo sapiens
cguuucucucaauuugaa

SEQ ID NO: 828629 - RNA, 22 nt, Homo sapiens
cuaaagaguuauucaaaugaag

SEQ ID NO: 828630 - RNA, 18 nt, Homo sapiens
cuaaauuacagugcaguu

SEQ ID NO: 828631 - RNA, 20 nt, Homo sapiens
cuaaauuacagugcaguuua

SEQ ID NO: 828632 - RNA, 14 nt, Homo sapiens
cuaagacaccugca

SEQ ID NO: 828633 - RNA, 15 nt, Homo sapiens
cuaauuccacacccu

SEQ ID NO: 828634 - RNA, 17 nt, Homo sapiens
cuaauuccacacccuca

SEQ ID NO: 828635 - RNA, 18 nt, Homo sapiens
cuaauucugggaagggag

SEQ ID NO: 828636 - RNA, 12 nt, Homo sapiens
cuacacauauau

SEQ ID NO: 828637 - RNA, 23 nt, Homo sapiens
cuaccccucccagcugacagucc

SEQ ID NO: 828638 - RNA, 18 nt, Homo sapiens
cuacucauuccccggggc

SEQ ID NO: 828639 - RNA, 14 nt, Homo sapiens
cuacugauaacgua

SEQ ID NO: 828640 - RNA, 17 nt, Homo sapiens
cuacuuguaaaggugcu

SEQ ID NO: 828641 - RNA, 18 nt, Homo sapiens
cuaggaguugaguacagu

SEQ ID NO: 828642 - RNA, 22 nt, Homo sapiens
cuauauauccaagaagcaugca

SEQ ID NO: 828643 - RNA, 23 nt, Homo sapiens
cuauuagagcugccugugccuuu

SEQ ID NO: 828644 - RNA, 17 nt, Homo sapiens
cucaccugguugaccca

SEQ ID NO: 828645 - RNA, 18 nt, Homo sapiens
cucacuucaucaaucaaa

SEQ ID NO: 828646 - RNA, 20 nt, Homo sapiens
cuccaccuaguggcugucca

SEQ ID NO: 828647 - RNA, 15 nt, Homo sapiens
cuccaguucugauga

SEQ ID NO: 828648 - RNA, 15 nt, Homo sapiens
cucccacagugacuc

SEQ ID NO: 828649 - RNA, 20 nt, Homo sapiens
cuccuagaggugggcagcug

SEQ ID NO: 828650 - RNA, 13 nt, Homo sapiens
cuccugauggcca

SEQ ID NO: 828651 - RNA, 13 nt, Homo sapiens
cuccugcagggau

SEQ ID NO: 828652 - RNA, 17 nt, Homo sapiens
cuccugcugccuaauaa

SEQ ID NO: 828653 - RNA, 16 nt, Homo sapiens
cuccuguugcaaugac

SEQ ID NO: 828654 - RNA, 11 nt, Homo sapiens
cucgugcagua

SEQ ID NO: 828655 - RNA, 15 nt, Homo sapiens
cucuaaaacucucaa

SEQ ID NO: 828656 - RNA, 20 nt, Homo sapiens
cucucccaccccggccucca

SEQ ID NO: 828657 - RNA, 11 nt, Homo sapiens
cucuuccauau

SEQ ID NO: 828658 - RNA, 12 nt, Homo sapiens
cucuuuaccucc

SEQ ID NO: 828659 - RNA, 15 nt, Homo sapiens
cugaaauagagugaa

SEQ ID NO: 828660 - RNA, 17 nt, Homo sapiens
cugaaauagagugaauu

SEQ ID NO: 828661 - RNA, 20 nt, Homo sapiens
cugaaggaauagccagagag

SEQ ID NO: 828662 - RNA, 14 nt, Homo sapiens
cugacagaaaugca

SEQ ID NO: 828663 - RNA, 17 nt, Homo sapiens
cugacagaaaugcaauc

SEQ ID NO: 828664 - RNA, 20 nt, Homo sapiens
cugacagaaaugcaaucucc

SEQ ID NO: 828665 - RNA, 14 nt, Homo sapiens
cugacuucaggggc

SEQ ID NO: 828666 - RNA, 20 nt, Homo sapiens
cugaguagcauauauaauuu

SEQ ID NO: 828667 - RNA, 21 nt, Homo sapiens
cugaguagcuaggacuauggg

SEQ ID NO: 828668 - RNA, 14 nt, Homo sapiens
cugaugccauguaa

SEQ ID NO: 828669 - RNA, 18 nt, Homo sapiens
cugauguuuaaaagucca

SEQ ID NO: 828670 - RNA, 22 nt, Homo sapiens
cugcaggaacgagcacuggcca

SEQ ID NO: 828671 - RNA, 16 nt, Homo sapiens
cugccaaaacaaugcc

SEQ ID NO: 828672 - RNA, 17 nt, Homo sapiens
cugccaugccacugcca

SEQ ID NO: 828673 - RNA, 13 nt, Homo sapiens
cugccccaucucc

SEQ ID NO: 828674 - RNA, 16 nt, Homo sapiens
guucuuagagcacuuu

SEQ ID NO: 828675 - RNA, 13 nt, Homo sapiens
guucuuagcugaa

SEQ ID NO: 828676 - RNA, 16 nt, Homo sapiens
guucuucauuaccuca

SEQ ID NO: 828677 - RNA, 16 nt, Homo sapiens
guugaccacuccagag

SEQ ID NO: 828678 - RNA, 12 nt, Homo sapiens
guugcacaaaaa

SEQ ID NO: 828679 - RNA, 20 nt, Homo sapiens
guugcauuuaugaugcaguu

SEQ ID NO: 828680 - RNA, 12 nt, Homo sapiens
guugcauuuuac

SEQ ID NO: 828681 - RNA, 17 nt, Homo sapiens
guugggcagagcuggac

SEQ ID NO: 828682 - RNA, 18 nt, Homo sapiens
guuuaaaaaaaguauaua

SEQ ID NO: 828683 - RNA, 16 nt, Homo sapiens
guuucaaguaccaaaa

SEQ ID NO: 828684 - RNA, 14 nt, Homo sapiens
guuucacuguucau

SEQ ID NO: 828685 - RNA, 13 nt, Homo sapiens
guuuggucauuuu

SEQ ID NO: 828686 - RNA, 22 nt, Homo sapiens
uaaaaacaacaaaaacaaacaa

SEQ ID NO: 828687 - RNA, 17 nt, Homo sapiens
uaaaagaauuugugaca

SEQ ID NO: 828688 - RNA, 15 nt, Homo sapiens
uaaaagcuguucuca

SEQ ID NO: 828689 - RNA, 14 nt, Homo sapiens
uaaaauaguagcau

SEQ ID NO: 828690 - RNA, 19 nt, Homo sapiens
uaaacaaugaauucuucaa

SEQ ID NO: 828691 - RNA, 15 nt, Homo sapiens
uaaacacaauuccaa

SEQ ID NO: 828692 - RNA, 18 nt, Homo sapiens
uaaacacauacauugcca

SEQ ID NO: 828693 - RNA, 20 nt, Homo sapiens
uaaacauugguauauuucca

SEQ ID NO: 828694 - RNA, 15 nt, Homo sapiens
uaaacuaaaagcaua

SEQ ID NO: 828695 - RNA, 21 nt, Homo sapiens
uaaagaauaaaugaaucuuac

SEQ ID NO: 828696 - RNA, 22 nt, Homo sapiens
uaaagaauaaaugaaucuuacu

SEQ ID NO: 828697 - RNA, 15 nt, Homo sapiens
uaaauaacagugugu

SEQ ID NO: 828698 - RNA, 12 nt, Homo sapiens
uaaauaagcaaa

SEQ ID NO: 828699 - RNA, 19 nt, Homo sapiens
uaaauaagcaaaaugccaa

SEQ ID NO: 828700 - RNA, 13 nt, Homo sapiens
uaaauagaugaca

SEQ ID NO: 828701 - RNA, 20 nt, Homo sapiens
uaaauccuugggagucauua

SEQ ID NO: 828702 - RNA, 16 nt, Homo sapiens
uaaauuuaugugaugg

SEQ ID NO: 828703 - RNA, 20 nt, Homo sapiens
uaacaaaacuauacuuguac

SEQ ID NO: 828704 - RNA, 15 nt, Homo sapiens
uaacauaugauacug

SEQ ID NO: 828705 - RNA, 13 nt, Homo sapiens
uaacuuagaagga

SEQ ID NO: 828706 - RNA, 17 nt, Homo sapiens
uaagcaacuugcuucua

SEQ ID NO: 828707 - RNA, 13 nt, Homo sapiens
uaagccugaugau

SEQ ID NO: 828708 - RNA, 20 nt, Homo sapiens
uaagcugagcuccuuagccu

SEQ ID NO: 828709 - RNA, 22 nt, Homo sapiens
uaauacacagugagacacagua

SEQ ID NO: 828710 - RNA, 21 nt, Homo sapiens
uaauacugaaccacuuugaua

SEQ ID NO: 828711 - RNA, 14 nt, Homo sapiens
uaauagacacugga

SEQ ID NO: 828712 - RNA, 20 nt, Homo sapiens
uaaucuuugaaagcugaaua

SEQ ID NO: 828713 - RNA, 17 nt, Homo sapiens
uaaugaagacccagugu

SEQ ID NO: 828714 - RNA, 18 nt, Homo sapiens
uaauuuuuuacauuuucc

SEQ ID NO: 828715 - RNA, 18 nt, Homo sapiens
cauacauuauauuccucu

SEQ ID NO: 828716 - RNA, 21 nt, Homo sapiens
cauaccuggcccugugccuug

SEQ ID NO: 828717 - RNA, 22 nt, Homo sapiens
cauaccuggcccugugccuugg

SEQ ID NO: 828718 - RNA, 20 nt, Homo sapiens
cauaguucuuacuacuugcc

SEQ ID NO: 828719 - RNA, 16 nt, Homo sapiens
cauaugauacugaugc

SEQ ID NO: 828720 - RNA, 23 nt, Homo sapiens
caucucuaacauaugauacugau

SEQ ID NO: 828721 - RNA, 13 nt, Homo sapiens
caucuuccaggug

SEQ ID NO: 828722 - RNA, 16 nt, Homo sapiens
caugaauacacuuaca

SEQ ID NO: 828723 - RNA, 18 nt, Homo sapiens
caugaccagaaacaggga

SEQ ID NO: 828724 - RNA, 13 nt, Homo sapiens
cauggauuccacu

SEQ ID NO: 828725 - RNA, 15 nt, Homo sapiens
cauggccuucccucc

SEQ ID NO: 828726 - RNA, 13 nt, Homo sapiens
caugggacugugc

SEQ ID NO: 828727 - RNA, 16 nt, Homo sapiens
caugguagacugugac

SEQ ID NO: 828728 - RNA, 20 nt, Homo sapiens
caugugucauguaauacuga

SEQ ID NO: 828729 - RNA, 12 nt, Homo sapiens
cauuaauacugu

SEQ ID NO: 828730 - RNA, 16 nt, Homo sapiens
cauuacuuguauaaau

SEQ ID NO: 828731 - RNA, 16 nt, Homo sapiens
cauuagcuacuuuuca

SEQ ID NO: 828732 - RNA, 18 nt, Homo sapiens
cauugaaauuuacuguga

SEQ ID NO: 828733 - RNA, 21 nt, Homo sapiens
cauuggaccuuuccugaggaa

SEQ ID NO: 828734 - RNA, 19 nt, Homo sapiens
cauugggcugacaccuacc

SEQ ID NO: 828735 - RNA, 14 nt, Homo sapiens
cauugguaucugau

SEQ ID NO: 828736 - RNA, 12 nt, Homo sapiens
cauugguguuga

SEQ ID NO: 828737 - RNA, 12 nt, Homo sapiens
cauugucccuga

SEQ ID NO: 828738 - RNA, 14 nt, Homo sapiens
cauuugagugucuu

SEQ ID NO: 828739 - RNA, 16 nt, Homo sapiens
ccaaagacuacacugu

SEQ ID NO: 828740 - RNA, 18 nt, Homo sapiens
ccaaagacuacacuguug

SEQ ID NO: 828741 - RNA, 22 nt, Homo sapiens
ccaaaggggcugcuggggcaug

SEQ ID NO: 828742 - RNA, 13 nt, Homo sapiens
ccaacuccagggg

SEQ ID NO: 828743 - RNA, 19 nt, Homo sapiens
ccaagguuuuggagucagu

SEQ ID NO: 828744 - RNA, 23 nt, Homo sapiens
ccaagugaaugaguuuccagcua

SEQ ID NO: 828745 - RNA, 19 nt, Homo sapiens
ccaauucuucugcugccau

SEQ ID NO: 828746 - RNA, 16 nt, Homo sapiens
ccacacccucacugcu

SEQ ID NO: 828747 - RNA, 23 nt, Homo sapiens
ccaccuaguggcuguccagugcc

SEQ ID NO: 828748 - RNA, 20 nt, Homo sapiens
ccaccugacaauggcagcua

SEQ ID NO: 828749 - RNA, 19 nt, Homo sapiens
ccacucaggggucauucau

SEQ ID NO: 828750 - RNA, 12 nt, Homo sapiens
ccacuggcauua

SEQ ID NO: 828751 - RNA, 23 nt, Homo sapiens
ccagacuuuaccacuaugcaaua

SEQ ID NO: 828752 - RNA, 18 nt, Homo sapiens
ccagagcuggaaggcagg

SEQ ID NO: 828753 - RNA, 22 nt, Homo sapiens
ccagagcuggaaggcagggcag

SEQ ID NO: 828754 - RNA, 20 nt, Homo sapiens
ccagaggaagggacaccaag

SEQ ID NO: 828755 - RNA, 19 nt, Homo sapiens
ccagcaucucccaguucau

SEQ ID NO: 828756 - RNA, 15 nt, Homo sapiens
ccaggccaucuucca

SEQ ID NO: 828757 - RNA, 20 nt, Homo sapiens
ccaggcuggagugcaguggu

SEQ ID NO: 828758 - RNA, 19 nt, Homo sapiens
ccagggccugggggcagug

SEQ ID NO: 828759 - RNA, 20 nt, Homo sapiens
ccagguggggugaggcagug

SEQ ID NO: 828760 - RNA, 21 nt, Homo sapiens
ccaguguaaagaauaaaugaa

SEQ ID NO: 828761 - RNA, 11 nt, Homo sapiens
ccaguuuccaa

SEQ ID NO: 828762 - RNA, 17 nt, Homo sapiens
ccaucccucggacccac

SEQ ID NO: 828763 - RNA, 13 nt, Homo sapiens
ccaucucuuuacc

SEQ ID NO: 828764 - RNA, 16 nt, Homo sapiens
ccaucucuuuaccucc

SEQ ID NO: 828765 - RNA, 20 nt, Homo sapiens
ccaugugucauguaauacug

SEQ ID NO: 828766 - RNA, 16 nt, Homo sapiens
ccauucccccaugugg

SEQ ID NO: 828767 - RNA, 19 nt, Homo sapiens
cccacguccugucagugcc

SEQ ID NO: 828768 - RNA, 14 nt, Homo sapiens
cccacuuggcauca

SEQ ID NO: 828769 - RNA, 13 nt, Homo sapiens
cccagaaauguau

SEQ ID NO: 828770 - RNA, 19 nt, Homo sapiens
cccagaaauguauggcaug

SEQ ID NO: 828771 - RNA, 22 nt, Homo sapiens
cccagugcuucuccaacacuga

SEQ ID NO: 828772 - RNA, 14 nt, Homo sapiens
cccaguguaaagaa

SEQ ID NO: 828773 - RNA, 19 nt, Homo sapiens
ccccaagcagccagccagu

SEQ ID NO: 828774 - RNA, 15 nt, Homo sapiens
ccccagcccuuugca

SEQ ID NO: 828775 - RNA, 14 nt, Homo sapiens
cccccaugcugccu

SEQ ID NO: 828776 - RNA, 14 nt, Homo sapiens
cccccugccagucu

SEQ ID NO: 828777 - RNA, 14 nt, Homo sapiens
ccccuccugcugca

SEQ ID NO: 828778 - RNA, 14 nt, Homo sapiens
ccccugccagugaa

SEQ ID NO: 828779 - RNA, 22 nt, Homo sapiens
ccccuuaaggguugaaggcagu

SEQ ID NO: 828780 - RNA, 15 nt, Homo sapiens
cccgcggugcucugg

SEQ ID NO: 828781 - RNA, 13 nt, Homo sapiens
cccucccaacaga

SEQ ID NO: 828782 - RNA, 13 nt, Homo sapiens
cccucgugccagu

SEQ ID NO: 828783 - RNA, 15 nt, Homo sapiens
acagcccagacuuua

SEQ ID NO: 828784 - RNA, 16 nt, Homo sapiens
acagggacacagucug

SEQ ID NO: 828785 - RNA, 17 nt, Homo sapiens
acagugcccagcuaauu

SEQ ID NO: 828786 - RNA, 19 nt, Homo sapiens
acauaaacacauacauugc

SEQ ID NO: 828787 - RNA, 23 nt, Homo sapiens
acauaccuggcccugugccuugg

SEQ ID NO: 828788 - RNA, 12 nt, Homo sapiens
acauaugacaau

SEQ ID NO: 828789 - RNA, 13 nt, Homo sapiens
acauaugacaaug

SEQ ID NO: 828790 - RNA, 16 nt, Homo sapiens
acauaugcauuaugaa

SEQ ID NO: 828791 - RNA, 23 nt, Homo sapiens
acauauucccaugguagacugug

SEQ ID NO: 828792 - RNA, 15 nt, Homo sapiens
acauuccacagugcc

SEQ ID NO: 828793 - RNA, 12 nt, Homo sapiens
acauuuguucca

SEQ ID NO: 828794 - RNA, 17 nt, Homo sapiens
acauuuuauuacacuaa

SEQ ID NO: 828795 - RNA, 15 nt, Homo sapiens
acauuuugcauuaga

SEQ ID NO: 828796 - RNA, 12 nt, Homo sapiens
accaaauugcuu

SEQ ID NO: 828797 - RNA, 23 nt, Homo sapiens
accaagccuuggcucuacccuga

SEQ ID NO: 828798 - RNA, 14 nt, Homo sapiens
accagcugcucugc

SEQ ID NO: 828799 - RNA, 20 nt, Homo sapiens
accaucucuuuaccuccuaa

SEQ ID NO: 828800 - RNA, 22 nt, Homo sapiens
accauggugugucaugcucacu

SEQ ID NO: 828801 - RNA, 15 nt, Homo sapiens
acccagcuacucugu

SEQ ID NO: 828802 - RNA, 21 nt, Homo sapiens
acccagcuacucuguccaggc

SEQ ID NO: 828803 - RNA, 14 nt, Homo sapiens
acccaggaagggaa

SEQ ID NO: 828804 - RNA, 12 nt, Homo sapiens
accccaucucau

SEQ ID NO: 828805 - RNA, 18 nt, Homo sapiens
acccuggaauucagcacc

SEQ ID NO: 828806 - RNA, 16 nt, Homo sapiens
accgauagcaggugaa

SEQ ID NO: 828807 - RNA, 23 nt, Homo sapiens
accgauuugcacccaugccauag

SEQ ID NO: 828808 - RNA, 21 nt, Homo sapiens
accgggcuggccugugccuau

SEQ ID NO: 828809 - RNA, 13 nt, Homo sapiens
accguugcacaaa

SEQ ID NO: 828810 - RNA, 17 nt, Homo sapiens
accucacacuacuguau

SEQ ID NO: 828811 - RNA, 16 nt, Homo sapiens
accucacuucuggcac

SEQ ID NO: 828812 - RNA, 19 nt, Homo sapiens
accucaugagucuaccuga

SEQ ID NO: 828813 - RNA, 21 nt, Homo sapiens
accucauuuaccauaaaaauc

SEQ ID NO: 828814 - RNA, 22 nt, Homo sapiens
accuccuagaggugggcagcug

SEQ ID NO: 828815 - RNA, 18 nt, Homo sapiens
accuguccauaaaguaau

SEQ ID NO: 828816 - RNA, 14 nt, Homo sapiens
accuucuaccucuu

SEQ ID NO: 828817 - RNA, 15 nt, Homo sapiens
accuuuucccgggga

SEQ ID NO: 828818 - RNA, 20 nt, Homo sapiens
acgcucccccgcagucccca

SEQ ID NO: 828819 - RNA, 13 nt, Homo sapiens
acuaaugaucacu

SEQ ID NO: 828820 - RNA, 18 nt, Homo sapiens
acuaccaaaugagcauua

SEQ ID NO: 828821 - RNA, 22 nt, Homo sapiens
acuaguaauaauguaauacugu

SEQ ID NO: 828822 - RNA, 14 nt, Homo sapiens
acuauucaaugcaa

SEQ ID NO: 828823 - RNA, 16 nt, Homo sapiens
acuauucuagcaggag

SEQ ID NO: 828824 - RNA, 14 nt, Homo sapiens
acucaggggucauu

SEQ ID NO: 828825 - RNA, 16 nt, Homo sapiens
acucaggggucauuca

SEQ ID NO: 828826 - RNA, 12 nt, Homo sapiens
acucccacuucc

SEQ ID NO: 828827 - RNA, 18 nt, Homo sapiens
acucuauacucaaucaag

SEQ ID NO: 828828 - RNA, 20 nt, Homo sapiens
acucucagcagcuaugguag

SEQ ID NO: 828829 - RNA, 21 nt, Homo sapiens
acucuggagguuuguuuagaa

SEQ ID NO: 828830 - RNA, 17 nt, Homo sapiens
acucuguccaggccacu

SEQ ID NO: 828831 - RNA, 18 nt, Homo sapiens
acucugugcccaugggca

SEQ ID NO: 828832 - RNA, 18 nt, Homo sapiens
acugaaauagagugaauu

SEQ ID NO: 828833 - RNA, 16 nt, Homo sapiens
acugagaaugauagua

SEQ ID NO: 828834 - RNA, 19 nt, Homo sapiens
acugcacccccuccugcug

SEQ ID NO: 828835 - RNA, 20 nt, Homo sapiens
acugcuguagacauuugcua

SEQ ID NO: 828836 - RNA, 14 nt, Homo sapiens
acuggcagcuccuc

SEQ ID NO: 828837 - RNA, 19 nt, Homo sapiens
acuggcugccuccacuccc

SEQ ID NO: 828838 - RNA, 15 nt, Homo sapiens
acuguauugaauauu

SEQ ID NO: 828839 - RNA, 19 nt, Homo sapiens
acuguccugcuccacagug

SEQ ID NO: 828840 - RNA, 20 nt, Homo sapiens
acuguccugcuccacagugu

SEQ ID NO: 828841 - RNA, 14 nt, Homo sapiens
acugugacacagcu

SEQ ID NO: 828842 - RNA, 14 nt, Homo sapiens
acugugagacugua

SEQ ID NO: 828843 - RNA, 22 nt, Homo sapiens
acuguuauucuauuauaucaga

SEQ ID NO: 828844 - RNA, 13 nt, Homo sapiens
acuguucaugaau

SEQ ID NO: 828845 - RNA, 20 nt, Homo sapiens
acuuacccuaaaacaugugu

SEQ ID NO: 828846 - RNA, 16 nt, Homo sapiens
acuuauuuccauggau

SEQ ID NO: 828847 - RNA, 16 nt, Homo sapiens
acuucaucaaucaaau

SEQ ID NO: 828848 - RNA, 22 nt, Homo sapiens
acuucgguuccucugauuucaa

SEQ ID NO: 828849 - RNA, 15 nt, Homo sapiens
acuucuggcacugug

SEQ ID NO: 828850 - RNA, 15 nt, Homo sapiens
acuuggcaucauuca

SEQ ID NO: 828851 - RNA, 15 nt, Homo sapiens
acuuuuaaaacuaua

SEQ ID NO: 828852 - RNA, 15 nt, Homo sapiens
agaaaaccacaacua

SEQ ID NO: 828853 - RNA, 12 nt, Homo sapiens
agaaaagccacg

SEQ ID NO: 828854 - RNA, 14 nt, Homo sapiens
agaaagaaagggaa

SEQ ID NO: 828855 - RNA, 22 nt, Homo sapiens
agaaagacuuaucaacauuugu

SEQ ID NO: 828856 - RNA, 14 nt, Homo sapiens
agaaaugagucugu

SEQ ID NO: 828857 - RNA, 19 nt, Homo sapiens
agaacagggaugcuaucuc

SEQ ID NO: 828858 - RNA, 13 nt, Homo sapiens
agaaccauuacaa

SEQ ID NO: 828859 - RNA, 17 nt, Homo sapiens
agaacugccccaucucc

SEQ ID NO: 828860 - RNA, 22 nt, Homo sapiens
agaauaaaugaaucuuacuccu

SEQ ID NO: 828861 - RNA, 15 nt, Homo sapiens
agaaucaagucugug

SEQ ID NO: 828862 - RNA, 13 nt, Homo sapiens
agaaucuagccuc

SEQ ID NO: 828863 - RNA, 18 nt, Homo sapiens
agaauuuucaaauaagga

SEQ ID NO: 828864 - RNA, 18 nt, Homo sapiens
agacauuugcuaugagcu

SEQ ID NO: 828865 - RNA, 18 nt, Homo sapiens
agaccaccucucaauauu

SEQ ID NO: 828866 - RNA, 21 nt, Homo sapiens
agacuagagagauauuaaguc

SEQ ID NO: 828867 - RNA, 20 nt, Homo sapiens
agacuuuaccacuaugcaau

SEQ ID NO: 828868 - RNA, 23 nt, Homo sapiens
agagaaagaaagggaaacuggcu

SEQ ID NO: 828869 - RNA, 18 nt, Homo sapiens
agagauacaguauaccug

SEQ ID NO: 828870 - RNA, 12 nt, Homo sapiens
agagcacuuuua

SEQ ID NO: 828871 - RNA, 21 nt, Homo sapiens
agagccaugugucauguaaua

SEQ ID NO: 828872 - RNA, 23 nt, Homo sapiens
agagcugccugugccuuuugcca

SEQ ID NO: 828873 - RNA, 14 nt, Homo sapiens
agaggacaguauuu

SEQ ID NO: 828874 - RNA, 14 nt, Homo sapiens
agagguuaucugcc

SEQ ID NO: 828875 - RNA, 23 nt, Homo sapiens
agauaacagcuuaacauuuacau

SEQ ID NO: 828876 - RNA, 17 nt, Homo sapiens
agauauuggauacccca

SEQ ID NO: 828877 - RNA, 18 nt, Homo sapiens
agaucucaucucaugaca

SEQ ID NO: 828878 - RNA, 20 nt, Homo sapiens
agauguggcaaagugcugua

SEQ ID NO: 828879 - RNA, 17 nt, Homo sapiens
agauuggcucccaacuc

SEQ ID NO: 828880 - RNA, 22 nt, Homo sapiens
agauuguucuguccaguuucca

SEQ ID NO: 828881 - RNA, 23 nt, Homo sapiens
agauuguucuguccaguuuccaa

SEQ ID NO: 828882 - RNA, 23 nt, Homo sapiens
agauuuuuguuuuccacugugcu

SEQ ID NO: 828883 - RNA, 23 nt, Homo sapiens
agcaaaugcuacauauaugcaau

SEQ ID NO: 828884 - RNA, 11 nt, Homo sapiens
agcacaugugu

SEQ ID NO: 828885 - RNA, 22 nt, Homo sapiens
agcacuuuuaacaaaaaaggaa

SEQ ID NO: 828886 - RNA, 20 nt, Homo sapiens
agcauaggaaaccacacaga

SEQ ID NO: 828887 - RNA, 14 nt, Homo sapiens
agcaucaaagcacu

SEQ ID NO: 828888 - RNA, 10 nt, Homo sapiens
agcaucucac

SEQ ID NO: 828889 - RNA, 22 nt, Homo sapiens
agcaucucccaguucauaauca

SEQ ID NO: 828890 - RNA, 18 nt, Homo sapiens
agcauuagcuacuuuuca

SEQ ID NO: 828891 - RNA, 17 nt, Homo sapiens
agccacauuuugcauua

SEQ ID NO: 828892 - RNA, 19 nt, Homo sapiens
agccacuuauuuccaugga

SEQ ID NO: 828893 - RNA, 20 nt, Homo sapiens
agccauauauuuucugagua

SEQ ID NO: 828894 - RNA, 20 nt, Homo sapiens
agcccucgaaccaaggcagc

SEQ ID NO: 828895 - RNA, 15 nt, Homo sapiens
agccguccauggcac

SEQ ID NO: 828896 - RNA, 21 nt, Homo sapiens
agccuucuccugucuccauga

SEQ ID NO: 828897 - RNA, 17 nt, Homo sapiens
agccuuggcucuacccu

SEQ ID NO: 828898 - RNA, 16 nt, Homo sapiens
agcuaaacgcaauguc

SEQ ID NO: 828899 - RNA, 20 nt, Homo sapiens
agcugcaugggugccugcug

SEQ ID NO: 828900 - RNA, 16 nt, Homo sapiens
aggccucccacaguga

SEQ ID NO: 828901 - RNA, 16 nt, Homo sapiens
aggccuggcacagugu

SEQ ID NO: 828902 - RNA, 21 nt, Homo sapiens
aggcuaagaugagauuugcca

SEQ ID NO: 828903 - RNA, 15 nt, Homo sapiens
agggaaguccuugca

SEQ ID NO: 828904 - RNA, 16 nt, Homo sapiens
agggagagagugcuau

SEQ ID NO: 828905 - RNA, 22 nt, Homo sapiens
agggcagaauaaauaagcaaaa

SEQ ID NO: 828906 - RNA, 22 nt, Homo sapiens
aggggcaggcccugcacugucc

SEQ ID NO: 828907 - RNA, 16 nt, Homo sapiens
aggggcccgcuugccu

SEQ ID NO: 828908 - RNA, 20 nt, Homo sapiens
agggggcgcucaggacccag

SEQ ID NO: 828909 - RNA, 14 nt, Homo sapiens
agggugacuaugga

SEQ ID NO: 828910 - RNA, 17 nt, Homo sapiens
agguaaacaaacaaaua

SEQ ID NO: 828911 - RNA, 20 nt, Homo sapiens
agguaaugcacauccucauu

SEQ ID NO: 828912 - RNA, 14 nt, Homo sapiens
aggugcugacaaua

SEQ ID NO: 828913 - RNA, 23 nt, Homo sapiens
agguguucuucauuaccucagug

SEQ ID NO: 828914 - RNA, 21 nt, Homo sapiens
agguuuguuuagaagaagugu

SEQ ID NO: 828915 - RNA, 20 nt, Homo sapiens
aguaaugaaggcauauuucc

SEQ ID NO: 828916 - RNA, 21 nt, Homo sapiens
aguaaugccacacauugugcu

SEQ ID NO: 828917 - RNA, 21 nt, Homo sapiens
aguacacuuccugugccaugu

SEQ ID NO: 828918 - RNA, 13 nt, Homo sapiens
aguaugugaauau

SEQ ID NO: 828919 - RNA, 12 nt, Homo sapiens
agucauuaccac

SEQ ID NO: 828920 - RNA, 21 nt, Homo sapiens
agucucaaauuuuucaucucu

SEQ ID NO: 828921 - RNA, 13 nt, Homo sapiens
agucuguuggcaa

SEQ ID NO: 828922 - RNA, 15 nt, Homo sapiens
agucuguuggcaauu

SEQ ID NO: 828923 - RNA, 15 nt, Homo sapiens
agucuguuugaaaug

SEQ ID NO: 828924 - RNA, 17 nt, Homo sapiens
agugaacacacucagca

SEQ ID NO: 828925 - RNA, 22 nt, Homo sapiens
agugagccccuccccagccagc

SEQ ID NO: 828926 - RNA, 15 nt, Homo sapiens
agugcuauuguagag

SEQ ID NO: 828927 - RNA, 11 nt, Homo sapiens
agugcugccau

SEQ ID NO: 828928 - RNA, 16 nt, Homo sapiens
agugggucccacuucc

SEQ ID NO: 828929 - RNA, 16 nt, Homo sapiens
agugguauauacauau

SEQ ID NO: 828930 - RNA, 20 nt, Homo sapiens
aguggugcgaucuuggcuca

SEQ ID NO: 828931 - RNA, 19 nt, Homo sapiens
aguguaaagaauaaaugaa

SEQ ID NO: 828932 - RNA, 17 nt, Homo sapiens
aguuacaaaauacaaaa

SEQ ID NO: 828933 - RNA, 22 nt, Homo sapiens
aguuaugguuuccucauuuuac

SEQ ID NO: 828934 - RNA, 17 nt, Homo sapiens
aguucccggagcacagc

SEQ ID NO: 828935 - RNA, 21 nt, Homo sapiens
aguugauugcgagaauuuuca

SEQ ID NO: 828936 - RNA, 18 nt, Homo sapiens
aguuucagaaauucucaa

SEQ ID NO: 828937 - RNA, 23 nt, Homo sapiens
aguuuccagcuaagccugaugau

SEQ ID NO: 828938 - RNA, 17 nt, Homo sapiens
auaaacugaagagcuua

SEQ ID NO: 828939 - RNA, 17 nt, Homo sapiens
auaaaugaaucuuacuc

SEQ ID NO: 828940 - RNA, 17 nt, Homo sapiens
auaaaugauguacuaca

SEQ ID NO: 828941 - RNA, 19 nt, Homo sapiens
auaaccuucaugaugaauu

SEQ ID NO: 828942 - RNA, 20 nt, Homo sapiens
auaaucuaaacaccaaaaac

SEQ ID NO: 828943 - RNA, 20 nt, Homo sapiens
auagacacuggagacuugga

SEQ ID NO: 828944 - RNA, 12 nt, Homo sapiens
auagaugacaaa

SEQ ID NO: 828945 - RNA, 22 nt, Homo sapiens
auaggaaaccacacagacuugg

SEQ ID NO: 828946 - RNA, 21 nt, Homo sapiens
auaguuacaaaauacaaaagu

SEQ ID NO: 828947 - RNA, 15 nt, Homo sapiens
auaguuaugccugua

SEQ ID NO: 828948 - RNA, 19 nt, Homo sapiens
auauauaguuguacauaua

SEQ ID NO: 828949 - RNA, 18 nt, Homo sapiens
auauaugacuuuuucuca

SEQ ID NO: 828950 - RNA, 14 nt, Homo sapiens
auauaugcaauaua

SEQ ID NO: 828951 - RNA, 19 nt, Homo sapiens
auauccucucagcucucuu

SEQ ID NO: 828952 - RNA, 11 nt, Homo sapiens
auaugcaaauc

SEQ ID NO: 828953 - RNA, 20 nt, Homo sapiens
auauuccgggugccauuccc

SEQ ID NO: 828954 - RNA, 14 nt, Homo sapiens
auauuuccauucau

SEQ ID NO: 828955 - RNA, 16 nt, Homo sapiens
auauuucccaauacau

SEQ ID NO: 828956 - RNA, 22 nt, Homo sapiens
aucaccucuuaugcacaccucc

SEQ ID NO: 828957 - RNA, 18 nt, Homo sapiens
aucauccgaggcaaagag

SEQ ID NO: 828958 - RNA, 17 nt, Homo sapiens
auccagagauaauugcc

SEQ ID NO: 828959 - RNA, 14 nt, Homo sapiens
auccaugugcugcu

SEQ ID NO: 828960 - RNA, 19 nt, Homo sapiens
auccuguucucauggauuu

SEQ ID NO: 828961 - RNA, 16 nt, Homo sapiens
aucgcugccuugccau

SEQ ID NO: 828962 - RNA, 18 nt, Homo sapiens
aucgcugccuugccaugu

SEQ ID NO: 828963 - RNA, 20 nt, Homo sapiens
aucgcugccuugccaugucu

SEQ ID NO: 828964 - RNA, 19 nt, Homo sapiens
aucucacucuguugcccag

SEQ ID NO: 828965 - RNA, 23 nt, Homo sapiens
aucucccuagccugcuuuugucc

SEQ ID NO: 828966 - RNA, 20 nt, Homo sapiens
aucucuaaacugcuguuaau

SEQ ID NO: 828967 - RNA, 22 nt, Homo sapiens
aucucuaacauaugauacugau

SEQ ID NO: 828968 - RNA, 16 nt, Homo sapiens
aucugagaauugcaaa

SEQ ID NO: 828969 - RNA, 17 nt, Homo sapiens
aucugagaggccacagu

SEQ ID NO: 828970 - RNA, 13 nt, Homo sapiens
aucuguaccucug

SEQ ID NO: 828971 - RNA, 22 nt, Homo sapiens
aucugucaaagaaaacuuccaa

SEQ ID NO: 828972 - RNA, 14 nt, Homo sapiens
aucuguguuuacuu

SEQ ID NO: 828973 - RNA, 15 nt, Homo sapiens
aucuguguuuacuua

SEQ ID NO: 828974 - RNA, 14 nt, Homo sapiens
aucuguucugggug

SEQ ID NO: 828975 - RNA, 17 nt, Homo sapiens
aucuucauuaauacugu

SEQ ID NO: 828976 - RNA, 16 nt, Homo sapiens
augaagacccagugua

SEQ ID NO: 828977 - RNA, 17 nt, Homo sapiens
augaagacccaguguaa

SEQ ID NO: 828978 - RNA, 15 nt, Homo sapiens
augaaucuuacuccu

SEQ ID NO: 828979 - RNA, 12 nt, Homo sapiens
augaucuuggca

SEQ ID NO: 828980 - RNA, 18 nt, Homo sapiens
augauuuuaagaggcuuu

SEQ ID NO: 828981 - RNA, 17 nt, Homo sapiens
augcaguuuucauauau

SEQ ID NO: 828982 - RNA, 18 nt, Homo sapiens
augcuacauauaugcaau

SEQ ID NO: 828983 - RNA, 23 nt, Homo sapiens
augcuaucucgcuagccauauau

SEQ ID NO: 828984 - RNA, 19 nt, Homo sapiens
augcucugccccaagcccc

SEQ ID NO: 828985 - RNA, 22 nt, Homo sapiens
augcuggaugaugaaauggauu

SEQ ID NO: 828986 - RNA, 15 nt, Homo sapiens
augcuguuaaccaaa

SEQ ID NO: 828987 - RNA, 16 nt, Homo sapiens
auggauuccacugaaa

SEQ ID NO: 828988 - RNA, 18 nt, Homo sapiens
auggcucaggcaagcccc

SEQ ID NO: 828989 - RNA, 20 nt, Homo sapiens
augggaaccuaguacucucu

SEQ ID NO: 828990 - RNA, 16 nt, Homo sapiens
augguagacugugaca

SEQ ID NO: 828991 - RNA, 21 nt, Homo sapiens
auguaaaauaaguauuuccau

SEQ ID NO: 828992 - RNA, 12 nt, Homo sapiens
auguaauacuga

SEQ ID NO: 828993 - RNA, 22 nt, Homo sapiens
auguauaucuauaucucuaaac

SEQ ID NO: 828994 - RNA, 17 nt, Homo sapiens
auguauauguauaucua

SEQ ID NO: 828995 - RNA, 20 nt, Homo sapiens
augugauggucaggaucuca

SEQ ID NO: 828996 - RNA, 16 nt, Homo sapiens
auguguguguguugug

SEQ ID NO: 828997 - RNA, 22 nt, Homo sapiens
auguugcauuuaugaugcaguu

SEQ ID NO: 828998 - RNA, 16 nt, Homo sapiens
auuaaagacuaacuaa

SEQ ID NO: 828999 - RNA, 15 nt, Homo sapiens
auuaauuaaaccaga

SEQ ID NO: 829000 - RNA, 17 nt, Homo sapiens
auuaauuaaaccagacu

SEQ ID NO: 829001 - RNA, 15 nt, Homo sapiens
auuaauuuucuauga

SEQ ID NO: 829002 - RNA, 16 nt, Homo sapiens
auuacagugcaguuua

SEQ ID NO: 829003 - RNA, 22 nt, Homo sapiens
auuauauuuccuuaaaauguga

SEQ ID NO: 829004 - RNA, 13 nt, Homo sapiens
auuauucccauga

SEQ ID NO: 829005 - RNA, 15 nt, Homo sapiens
auuauuguauuacau

SEQ ID NO: 829006 - RNA, 18 nt, Homo sapiens
auucaggcagcacugaca

SEQ ID NO: 829007 - RNA, 15 nt, Homo sapiens
auucauauucaagca

SEQ ID NO: 829008 - RNA, 17 nt, Homo sapiens
auucauggcuuaugcuu

SEQ ID NO: 829009 - RNA, 15 nt, Homo sapiens
auuccacacccucac

SEQ ID NO: 829010 - RNA, 20 nt, Homo sapiens
auucccaugguagacuguga

SEQ ID NO: 829011 - RNA, 14 nt, Homo sapiens
auucuacacauaua

SEQ ID NO: 829012 - RNA, 21 nt, Homo sapiens
auucuacacauauauguauau

SEQ ID NO: 829013 - RNA, 13 nt, Homo sapiens
auucuuccugcuu

SEQ ID NO: 829014 - RNA, 15 nt, Homo sapiens
auucuuugaccuguu

SEQ ID NO: 829015 - RNA, 18 nt, Homo sapiens
auuggcccucauuccaag

SEQ ID NO: 829016 - RNA, 22 nt, Homo sapiens
aaaaagaagaaagacacaaaga

SEQ ID NO: 829017 - RNA, 23 nt, Homo sapiens
aaaaagcucugaagacccaaaga

SEQ ID NO: 829018 - RNA, 14 nt, Homo sapiens
aaaaaguauaggau

SEQ ID NO: 829019 - RNA, 22 nt, Homo sapiens
aaaacauaugcauuaugaaguu

SEQ ID NO: 829020 - RNA, 22 nt, Homo sapiens
aaaacguugaauugaugaugca

SEQ ID NO: 829021 - RNA, 23 nt, Homo sapiens
aaaacguugaauugaugaugcag

SEQ ID NO: 829022 - RNA, 18 nt, Homo sapiens
aaaacuuaaggaagcaaa

SEQ ID NO: 829023 - RNA, 15 nt, Homo sapiens
aaaagauuauauauc

SEQ ID NO: 829024 - RNA, 21 nt, Homo sapiens
aaaagcuuuucuuuccuuuug

SEQ ID NO: 829025 - RNA, 18 nt, Homo sapiens
aaaaggcacugugaacua

SEQ ID NO: 829026 - RNA, 14 nt, Homo sapiens
aaaaguauauauuc

SEQ ID NO: 829027 - RNA, 21 nt, Homo sapiens
aaaauaaucuaaacaccaaaa

SEQ ID NO: 829028 - RNA, 16 nt, Homo sapiens
aaaauggaaaagagag

SEQ ID NO: 829029 - RNA, 19 nt, Homo sapiens
aaacacaagaauuacacua

SEQ ID NO: 829030 - RNA, 20 nt, Homo sapiens
aaacacaagaauuacacuaa

SEQ ID NO: 829031 - RNA, 19 nt, Homo sapiens
aaacauugguauauuucca

SEQ ID NO: 829032 - RNA, 11 nt, Homo sapiens
aaaccaugacg

SEQ ID NO: 829033 - RNA, 15 nt, Homo sapiens
aaacuggauacugua

SEQ ID NO: 829034 - RNA, 11 nt, Homo sapiens
aaagacacaaa

SEQ ID NO: 829035 - RNA, 17 nt, Homo sapiens
aaagcucugaacaaaag

SEQ ID NO: 829036 - RNA, 15 nt, Homo sapiens
aaagggaaacuggcu

SEQ ID NO: 829037 - RNA, 20 nt, Homo sapiens
aaaguuauauuuacuuuaaa

SEQ ID NO: 829038 - RNA, 17 nt, Homo sapiens
aaaguuugggaagggau

SEQ ID NO: 829039 - RNA, 20 nt, Homo sapiens
aaauacacuuccugcuuaaa

SEQ ID NO: 829040 - RNA, 15 nt, Homo sapiens
aaauaguguguccau

SEQ ID NO: 829041 - RNA, 17 nt, Homo sapiens
aaauauauagcuugaaa

SEQ ID NO: 829042 - RNA, 23 nt, Homo sapiens
aaauauuuuccaaagagccaugu

SEQ ID NO: 829043 - RNA, 15 nt, Homo sapiens
aaaucaguuauguca

SEQ ID NO: 829044 - RNA, 16 nt, Homo sapiens
aaaucauuuucauuaa

SEQ ID NO: 829045 - RNA, 14 nt, Homo sapiens
aaaugaaucuuacu

SEQ ID NO: 829046 - RNA, 11 nt, Homo sapiens
aaaugacaauu

SEQ ID NO: 829047 - RNA, 17 nt, Homo sapiens
aaauguggacaucauga

SEQ ID NO: 829048 - RNA, 13 nt, Homo sapiens
aaauuacauuaaa

SEQ ID NO: 829049 - RNA, 16 nt, Homo sapiens
aaauuauuguauuaca

SEQ ID NO: 829050 - RNA, 22 nt, Homo sapiens
aaauucuuuuucacacugaugu

SEQ ID NO: 829051 - RNA, 13 nt, Homo sapiens
aaauuuaugugau

SEQ ID NO: 829052 - RNA, 13 nt, Homo sapiens
aacaaacaaaagc

SEQ ID NO: 829053 - RNA, 17 nt, Homo sapiens
aacaaauaaacuagucu

SEQ ID NO: 829054 - RNA, 16 nt, Homo sapiens
aacaauaauucaucaa

SEQ ID NO: 829055 - RNA, 18 nt, Homo sapiens
aacacaagaauuacacua

SEQ ID NO: 829056 - RNA, 20 nt, Homo sapiens
aacaggccuugagcacaaaa

SEQ ID NO: 829057 - RNA, 16 nt, Homo sapiens
aacaugcuugcauuau

SEQ ID NO: 829058 - RNA, 18 nt, Homo sapiens
aacauggauuccacugaa

SEQ ID NO: 829059 - RNA, 20 nt, Homo sapiens
aacauggauuccacugaaau

SEQ ID NO: 829060 - RNA, 19 nt, Homo sapiens
aaccacccuaucaucaguu

SEQ ID NO: 829061 - RNA, 19 nt, Homo sapiens
aaccagcaacauugaccca

SEQ ID NO: 829062 - RNA, 20 nt, Homo sapiens
aacccuucagauuugccuua

SEQ ID NO: 829063 - RNA, 14 nt, Homo sapiens
aaccgcuugccaua

SEQ ID NO: 829064 - RNA, 18 nt, Homo sapiens
aaccuguccauaaaguaa

SEQ ID NO: 829065 - RNA, 17 nt, Homo sapiens
aaccuucuaauccaugu

SEQ ID NO: 829066 - RNA, 16 nt, Homo sapiens
aacgcaaugucauuuu

SEQ ID NO: 829067 - RNA, 12 nt, Homo sapiens
aacuacugauaa

SEQ ID NO: 829068 - RNA, 19 nt, Homo sapiens
aacugaggccauuauuuca

SEQ ID NO: 829069 - RNA, 16 nt, Homo sapiens
aacuuaaggaagcaaa

SEQ ID NO: 829070 - RNA, 13 nt, Homo sapiens
aagaaaaccacaa

SEQ ID NO: 829071 - RNA, 19 nt, Homo sapiens
aagaacugccccaucuccu

SEQ ID NO: 829072 - RNA, 16 nt, Homo sapiens
aagaauaaaugaaucu

SEQ ID NO: 829073 - RNA, 11 nt, Homo sapiens
aagacccagug

SEQ ID NO: 829074 - RNA, 15 nt, Homo sapiens
aagaggcaaagaauc

SEQ ID NO: 829075 - RNA, 20 nt, Homo sapiens
aagauaguuacaaaauacaa

SEQ ID NO: 829076 - RNA, 15 nt, Homo sapiens
aagaucuauauugua

SEQ ID NO: 829077 - RNA, 15 nt, Homo sapiens
aagcaacuugcuucu

SEQ ID NO: 829078 - RNA, 17 nt, Homo sapiens
aagcaagaaaaccacaa

SEQ ID NO: 829079 - RNA, 13 nt, Homo sapiens
aagcccuggcaac

SEQ ID NO: 829080 - RNA, 20 nt, Homo sapiens
aagccucugugucacuggcu

SEQ ID NO: 829081 - RNA, 23 nt, Homo sapiens
aagccucugugucacuggcugcc

SEQ ID NO: 829082 - RNA, 13 nt, Homo sapiens
aagcuaccaaaaa

SEQ ID NO: 829083 - RNA, 14 nt, Homo sapiens
aagcuaccaaaaaa

SEQ ID NO: 829084 - RNA, 20 nt, Homo sapiens
aagcugugccacccugggcu

SEQ ID NO: 829085 - RNA, 20 nt, Homo sapiens
aaggaaaaacugauguuuaa

SEQ ID NO: 829086 - RNA, 14 nt, Homo sapiens
aaggagaaaaugca

SEQ ID NO: 829087 - RNA, 15 nt, Homo sapiens
aaggagaaaaugcau

SEQ ID NO: 829088 - RNA, 14 nt, Homo sapiens
aaggagagcauagg

SEQ ID NO: 829089 - RNA, 22 nt, Homo sapiens
aagguuuccugguccaucucau

SEQ ID NO: 829090 - RNA, 18 nt, Homo sapiens
aaguauaggauaaauuac

SEQ ID NO: 829091 - RNA, 12 nt, Homo sapiens
aagucacauaua

SEQ ID NO: 829092 - RNA, 15 nt, Homo sapiens
aagucacuggccagu

SEQ ID NO: 829093 - RNA, 14 nt, Homo sapiens
aagugaucuuucaa

SEQ ID NO: 829094 - RNA, 15 nt, Homo sapiens
aaguguagcacccug

SEQ ID NO: 829095 - RNA, 20 nt, Homo sapiens
aaguguuuucucagaacagc

SEQ ID NO: 829096 - RNA, 21 nt, Homo sapiens
aaguucaaccucuuacaauaa

SEQ ID NO: 829097 - RNA, 21 nt, Homo sapiens
aauaaacuagucuguuggcaa

SEQ ID NO: 829098 - RNA, 19 nt, Homo sapiens
aauaaaugauguacuacau

SEQ ID NO: 829099 - RNA, 13 nt, Homo sapiens
aauaacagugugu

SEQ ID NO: 829100 - RNA, 14 nt, Homo sapiens
aauaagaaacacaa

SEQ ID NO: 829101 - RNA, 16 nt, Homo sapiens
aauaagcaaaaugcca

SEQ ID NO: 829102 - RNA, 21 nt, Homo sapiens
aauaagcuaaacgcaauguca

SEQ ID NO: 829103 - RNA, 12 nt, Homo sapiens
aauaagugccag

SEQ ID NO: 829104 - RNA, 15 nt, Homo sapiens
aauaauauaugcuca

SEQ ID NO: 829105 - RNA, 15 nt, Homo sapiens
aauaauguauacaca

SEQ ID NO: 829106 - RNA, 13 nt, Homo sapiens
aauagagugaauu

SEQ ID NO: 829107 - RNA, 18 nt, Homo sapiens
aauauaaauuuacauaua

SEQ ID NO: 829108 - RNA, 13 nt, Homo sapiens
aauauaaugaguc

SEQ ID NO: 829109 - RNA, 15 nt, Homo sapiens
aauauuagcaaagaa

SEQ ID NO: 829110 - RNA, 21 nt, Homo sapiens
aauauuagcaaagaagcuuca

SEQ ID NO: 829111 - RNA, 15 nt, Homo sapiens
aauccccacagggaa

SEQ ID NO: 829112 - RNA, 16 nt, Homo sapiens
aaucucacuucaucaa

SEQ ID NO: 829113 - RNA, 17 nt, Homo sapiens
aaugaaucuuacuccuu

SEQ ID NO: 829114 - RNA, 18 nt, Homo sapiens
aaugcacauccucauuca

SEQ ID NO: 829115 - RNA, 18 nt, Homo sapiens
aauguauucauauuacaa

SEQ ID NO: 829116 - RNA, 23 nt, Homo sapiens
aauguugcauuuaugaugcaguu

SEQ ID NO: 829117 - RNA, 16 nt, Homo sapiens
aauuauauuuccuuaa

SEQ ID NO: 829118 - RNA, 20 nt, Homo sapiens
aauucgcagugauauacuua

SEQ ID NO: 829119 - RNA, 19 nt, Homo sapiens
aauucuccuguugcaauga

SEQ ID NO: 829120 - RNA, 14 nt, Homo sapiens
aauugaugaugcag

SEQ ID NO: 829121 - RNA, 18 nt, Homo sapiens
aauuuguuuuauauucuc

SEQ ID NO: 829122 - RNA, 20 nt, Homo sapiens
aauuuuccagggcucaaaaa

SEQ ID NO: 829123 - RNA, 19 nt, Homo sapiens
aauuuucuaugaauugcua

SEQ ID NO: 829124 - RNA, 19 nt, Homo sapiens
acaaccucauuuuaacuca

SEQ ID NO: 829125 - RNA, 20 nt, Homo sapiens
acaauaaaggcugagcucuu

SEQ ID NO: 829126 - RNA, 20 nt, Homo sapiens
cugcucgaagaacaauguca

SEQ ID NO: 829127 - RNA, 22 nt, Homo sapiens
cugcuuucgaauaaagugaaua

SEQ ID NO: 829128 - RNA, 13 nt, Homo sapiens
cuggagugcagug

SEQ ID NO: 829129 - RNA, 14 nt, Homo sapiens
cuggcccaucagug

SEQ ID NO: 829130 - RNA, 17 nt, Homo sapiens
cuggcccugugccuugg

SEQ ID NO: 829131 - RNA, 15 nt, Homo sapiens
cuggcuggccagucu

SEQ ID NO: 829132 - RNA, 18 nt, Homo sapiens
cugggccugcuuuuccag

SEQ ID NO: 829133 - RNA, 16 nt, Homo sapiens
cugggccugugcagca

SEQ ID NO: 829134 - RNA, 18 nt, Homo sapiens
cugggggcagauauuucc

SEQ ID NO: 829135 - RNA, 14 nt, Homo sapiens
cugguccaucucau

SEQ ID NO: 829136 - RNA, 15 nt, Homo sapiens
cuguacuaaggagca

SEQ ID NO: 829137 - RNA, 19 nt, Homo sapiens
cuguacuaaggagcaugau

SEQ ID NO: 829138 - RNA, 21 nt, Homo sapiens
cuguagacauuugcuaugagc

SEQ ID NO: 829139 - RNA, 16 nt, Homo sapiens
cugucagaggcuaaga

SEQ ID NO: 829140 - RNA, 15 nt, Homo sapiens
cuguccaguuuccaa

SEQ ID NO: 829141 - RNA, 18 nt, Homo sapiens
cuguccaguuuccaaagg

SEQ ID NO: 829142 - RNA, 12 nt, Homo sapiens
cugucccaaaga

SEQ ID NO: 829143 - RNA, 21 nt, Homo sapiens
cugucccgccuuccuccucca

SEQ ID NO: 829144 - RNA, 21 nt, Homo sapiens
cugugaggggcucucucauga

SEQ ID NO: 829145 - RNA, 20 nt, Homo sapiens
cugugggggaagagcacagc

SEQ ID NO: 829146 - RNA, 18 nt, Homo sapiens
cuguugguuaaaugacaa

SEQ ID NO: 829147 - RNA, 16 nt, Homo sapiens
cuuacaguuaggauuu

SEQ ID NO: 829148 - RNA, 13 nt, Homo sapiens
cuuacuacuugcc

SEQ ID NO: 829149 - RNA, 17 nt, Homo sapiens
cuuagcugaacaaugaa

SEQ ID NO: 829150 - RNA, 19 nt, Homo sapiens
cuuauuuguauaauggugu

SEQ ID NO: 829151 - RNA, 23 nt, Homo sapiens
cuucacuaccaaaugagcauuag

SEQ ID NO: 829152 - RNA, 14 nt, Homo sapiens
cuucagauuugccu

SEQ ID NO: 829153 - RNA, 16 nt, Homo sapiens
cuucagauuugccuua

SEQ ID NO: 829154 - RNA, 14 nt, Homo sapiens
cuucagcaucucac

SEQ ID NO: 829155 - RNA, 13 nt, Homo sapiens
cuucagggccaga

SEQ ID NO: 829156 - RNA, 15 nt, Homo sapiens
cuucauuaauacugu

SEQ ID NO: 829157 - RNA, 13 nt, Homo sapiens
cuuccucacaaaa

SEQ ID NO: 829158 - RNA, 18 nt, Homo sapiens
cuuccugugcccugcaaa

SEQ ID NO: 829159 - RNA, 13 nt, Homo sapiens
cuucgaugacugg

SEQ ID NO: 829160 - RNA, 16 nt, Homo sapiens
cuucuaauccaugugc

SEQ ID NO: 829161 - RNA, 23 nt, Homo sapiens
cuucuaccucuuggcugccuugu

SEQ ID NO: 829162 - RNA, 22 nt, Homo sapiens
ccaggugggcgggcagcacagc

SEQ ID NO: 829163 - RNA, 21 nt, Homo sapiens
ccaguggcuggaucugugagg

SEQ ID NO: 829164 - RNA, 19 nt, Homo sapiens
ccauagguaauacaaaaag

SEQ ID NO: 829165 - RNA, 13 nt, Homo sapiens
cccacaguccuca

SEQ ID NO: 829166 - RNA, 10 nt, Homo sapiens
cccacuuccc

SEQ ID NO: 829167 - RNA, 19 nt, Homo sapiens
cccacuuggcaucauucac

SEQ ID NO: 829168 - RNA, 17 nt, Homo sapiens
cccagaaauguauggca

SEQ ID NO: 829169 - RNA, 20 nt, Homo sapiens
cccagagguuaucugccugg

SEQ ID NO: 829170 - RNA, 21 nt, Homo sapiens
cccaggcccuaggauuccucc

SEQ ID NO: 829171 - RNA, 19 nt, Homo sapiens
cccaggcugcacugcagug

SEQ ID NO: 829172 - RNA, 16 nt, Homo sapiens
cccaggcuggucuuga

SEQ ID NO: 829173 - RNA, 20 nt, Homo sapiens
cccagggccugggggcagug

SEQ ID NO: 829174 - RNA, 12 nt, Homo sapiens
cccaguguaaag

SEQ ID NO: 829175 - RNA, 21 nt, Homo sapiens
cccaugguagacugugacaca

SEQ ID NO: 829176 - RNA, 21 nt, Homo sapiens
ccccaagguuuuggagucagu

SEQ ID NO: 829177 - RNA, 17 nt, Homo sapiens
ccccacagugacaguca

SEQ ID NO: 829178 - RNA, 11 nt, Homo sapiens
ccccaccuacu

SEQ ID NO: 829179 - RNA, 15 nt, Homo sapiens
ccccagccuggccca

SEQ ID NO: 829180 - RNA, 17 nt, Homo sapiens
ccccaucucauucaggu

SEQ ID NO: 829181 - RNA, 21 nt, Homo sapiens
ccccucccagcugacaguccu

SEQ ID NO: 829182 - RNA, 17 nt, Homo sapiens
ccccuggacauauuccc

SEQ ID NO: 829183 - RNA, 16 nt, Homo sapiens
ccccugguaagcagag

SEQ ID NO: 829184 - RNA, 24 nt, Homo sapiens
cccucaaggccucccacagugacu

SEQ ID NO: 829185 - RNA, 16 nt, Homo sapiens
cccuccugcugccuaa

SEQ ID NO: 829186 - RNA, 18 nt, Homo sapiens
cccucuugccccaacccc

SEQ ID NO: 829187 - RNA, 14 nt, Homo sapiens
ccgaccccaucuca

SEQ ID NO: 829188 - RNA, 14 nt, Homo sapiens
ccgcggugcucugg

SEQ ID NO: 829189 - RNA, 18 nt, Homo sapiens
ccggccaggugggcgggc

SEQ ID NO: 829190 - RNA, 11 nt, Homo sapiens
ccguugcacaa

SEQ ID NO: 829191 - RNA, 17 nt, Homo sapiens
ccuaauuccacacccuc

SEQ ID NO: 829192 - RNA, 14 nt, Homo sapiens
ccuaucaucaguua

SEQ ID NO: 829193 - RNA, 20 nt, Homo sapiens
ccuaugugaguuucagaaau

SEQ ID NO: 829194 - RNA, 18 nt, Homo sapiens
ccucaccugguugaccca

SEQ ID NO: 829195 - RNA, 16 nt, Homo sapiens
cuucuagaauccccac

SEQ ID NO: 829196 - RNA, 21 nt, Homo sapiens
cuucuagaauccccacaggga

SEQ ID NO: 829197 - RNA, 23 nt, Homo sapiens
cuucuagaauccccacagggaaa

SEQ ID NO: 829198 - RNA, 14 nt, Homo sapiens
cuucuccacaggga

SEQ ID NO: 829199 - RNA, 23 nt, Homo sapiens
cuucuccacagggacacagucug

SEQ ID NO: 829200 - RNA, 17 nt, Homo sapiens
cuucucccccccggggc

SEQ ID NO: 829201 - RNA, 22 nt, Homo sapiens
cuucucuugggaacuccacucu

SEQ ID NO: 829202 - RNA, 16 nt, Homo sapiens
cuucuguaugugacaa

SEQ ID NO: 829203 - RNA, 22 nt, Homo sapiens
cuugagcacaaaauuuggucaa

SEQ ID NO: 829204 - RNA, 14 nt, Homo sapiens
cuugagucugaggc

SEQ ID NO: 829205 - RNA, 19 nt, Homo sapiens
cuugcuuugggcuuugcag

SEQ ID NO: 829206 - RNA, 19 nt, Homo sapiens
cuuguaccauuucacaaac

SEQ ID NO: 829207 - RNA, 22 nt, Homo sapiens
cuuguauggcucucaagugaaa

SEQ ID NO: 829208 - RNA, 22 nt, Homo sapiens
cuuuaaaauaaaauaauuuuau

SEQ ID NO: 829209 - RNA, 15 nt, Homo sapiens
cuuuaccacuaugca

SEQ ID NO: 829210 - RNA, 14 nt, Homo sapiens
cuuucacucaggcu

SEQ ID NO: 829211 - RNA, 16 nt, Homo sapiens
cuuugagaacaaugga

SEQ ID NO: 829212 - RNA, 19 nt, Homo sapiens
cuuuggggacaguuggcag

SEQ ID NO: 829213 - RNA, 13 nt, Homo sapiens
cuuugucccagaa

SEQ ID NO: 829214 - RNA, 22 nt, Homo sapiens
cuuuuaguucuuagagcacuuu

SEQ ID NO: 829215 - RNA, 14 nt, Homo sapiens
cuuuugucccagaa

SEQ ID NO: 829216 - RNA, 22 nt, Homo sapiens
cuuuuuuuugagaauacacuau

SEQ ID NO: 829217 - RNA, 12 nt, Homo sapiens
gaaaacaugacu

SEQ ID NO: 829218 - RNA, 20 nt, Homo sapiens
gaaaacuuaaggaagcaaau

SEQ ID NO: 829219 - RNA, 15 nt, Homo sapiens
gaaaauuaugagucu

SEQ ID NO: 829220 - RNA, 18 nt, Homo sapiens
gaaagucuccuguaucau

SEQ ID NO: 829221 - RNA, 21 nt, Homo sapiens
gaaauauugcucuaauucuuu

SEQ ID NO: 829222 - RNA, 22 nt, Homo sapiens
gaacagggaugcuaucucgcua

SEQ ID NO: 829223 - RNA, 20 nt, Homo sapiens
gaacauggauuccacugaaa

SEQ ID NO: 829224 - RNA, 18 nt, Homo sapiens
gaaccaaggcagccucca

SEQ ID NO: 829225 - RNA, 21 nt, Homo sapiens
gaaccaaggcagccuccagag

SEQ ID NO: 829226 - RNA, 19 nt, Homo sapiens
gaacuccaguacucaccca

SEQ ID NO: 829227 - RNA, 20 nt, Homo sapiens
gaacugccccaucuccuccc

SEQ ID NO: 829228 - RNA, 19 nt, Homo sapiens
gaacuuuaaaaaagcaaau

SEQ ID NO: 829229 - RNA, 15 nt, Homo sapiens
gaagaaagacacaaa

SEQ ID NO: 829230 - RNA, 17 nt, Homo sapiens
gaagacccaguguaaag

SEQ ID NO: 829231 - RNA, 18 nt, Homo sapiens
gaagauguaagaagcuaa

SEQ ID NO: 829232 - RNA, 13 nt, Homo sapiens
gaagcaaaugcua

SEQ ID NO: 829233 - RNA, 20 nt, Homo sapiens
gaagccgucugacuccagag

SEQ ID NO: 829234 - RNA, 17 nt, Homo sapiens
gaagugugggucugugu

SEQ ID NO: 829235 - RNA, 22 nt, Homo sapiens
gaagugugucacccuuaggcca

SEQ ID NO: 829236 - RNA, 17 nt, Homo sapiens
gaauaggaggggaaaaa

SEQ ID NO: 829237 - RNA, 20 nt, Homo sapiens
gaauaggaggggaaaaaaca

SEQ ID NO: 829238 - RNA, 14 nt, Homo sapiens
gaaucuuacuccuu

SEQ ID NO: 829239 - RNA, 17 nt, Homo sapiens
gaaugaguuuccagcua

SEQ ID NO: 829240 - RNA, 22 nt, Homo sapiens
gaauugaaggagaaaaugcauu

SEQ ID NO: 829241 - RNA, 14 nt, Homo sapiens
gaauugaugaugca

SEQ ID NO: 829242 - RNA, 17 nt, Homo sapiens
gaauugaugaugcaguu

SEQ ID NO: 829243 - RNA, 15 nt, Homo sapiens
gaauuuguaagcaac

SEQ ID NO: 829244 - RNA, 23 nt, Homo sapiens
gaauuuuuugagagaaugagaug

SEQ ID NO: 829245 - RNA, 15 nt, Homo sapiens
gacaaccucauuuua

SEQ ID NO: 829246 - RNA, 17 nt, Homo sapiens
gacagacagagaaggca

SEQ ID NO: 829247 - RNA, 22 nt, Homo sapiens
gaccaccucucaauauucaaua

SEQ ID NO: 829248 - RNA, 15 nt, Homo sapiens
gacccaggcccucca

SEQ ID NO: 829249 - RNA, 16 nt, Homo sapiens
gaccgaaucucacucu

SEQ ID NO: 829250 - RNA, 20 nt, Homo sapiens
gacggaaaggaaaaacugau

SEQ ID NO: 829251 - RNA, 21 nt, Homo sapiens
gacggcugcucgaagaacaau

SEQ ID NO: 829252 - RNA, 14 nt, Homo sapiens
gacuauggguacau

SEQ ID NO: 829253 - RNA, 19 nt, Homo sapiens
gacugaaggggcacaccac

SEQ ID NO: 829254 - RNA, 20 nt, Homo sapiens
gacuggguuccccacaguga

SEQ ID NO: 829255 - RNA, 20 nt, Homo sapiens
gagaagccagcuuuccucau

SEQ ID NO: 829256 - RNA, 21 nt, Homo sapiens
gagaagccagcuuuccucauc

SEQ ID NO: 829257 - RNA, 16 nt, Homo sapiens
gagagaacagggaugc

SEQ ID NO: 829258 - RNA, 14 nt, Homo sapiens
gagagagugcuauu

SEQ ID NO: 829259 - RNA, 23 nt, Homo sapiens
gagagcagcuucugccacuuccc

SEQ ID NO: 829260 - RNA, 19 nt, Homo sapiens
gagaggccacagugcaauu

SEQ ID NO: 829261 - RNA, 21 nt, Homo sapiens
gagauguggcaaagugcugua

SEQ ID NO: 829262 - RNA, 21 nt, Homo sapiens
gagauguucgcucgugcagua

SEQ ID NO: 829263 - RNA, 18 nt, Homo sapiens
gagcacuugcguccugca

SEQ ID NO: 829264 - RNA, 20 nt, Homo sapiens
gagccaugugucauguaaua

SEQ ID NO: 829265 - RNA, 15 nt, Homo sapiens
gagcuggaacacaau

SEQ ID NO: 829266 - RNA, 14 nt, Homo sapiens
gagcuggaaggcag

SEQ ID NO: 829267 - RNA, 12 nt, Homo sapiens
gaggaagggaca

SEQ ID NO: 829268 - RNA, 19 nt, Homo sapiens
gaggggagugugugcagcg

SEQ ID NO: 829269 - RNA, 18 nt, Homo sapiens
gagucaacuggcuggcca

SEQ ID NO: 829270 - RNA, 20 nt, Homo sapiens
gauaaaucaguuaugucaau

SEQ ID NO: 829271 - RNA, 14 nt, Homo sapiens
gauagaaggcuaug

SEQ ID NO: 829272 - RNA, 22 nt, Homo sapiens
gauauuucccaauacauaccac

SEQ ID NO: 829273 - RNA, 16 nt, Homo sapiens
gcuucaugccagguua

SEQ ID NO: 829274 - RNA, 12 nt, Homo sapiens
gcuugacacaaa

SEQ ID NO: 829275 - RNA, 23 nt, Homo sapiens
gcuuguagcagaaggcaagcacc

SEQ ID NO: 829276 - RNA, 15 nt, Homo sapiens
gcuuugaaaaugcag

SEQ ID NO: 829277 - RNA, 15 nt, Homo sapiens
ggaacacaauaaugu

SEQ ID NO: 829278 - RNA, 16 nt, Homo sapiens
ggaacucuuaagcaau

SEQ ID NO: 829279 - RNA, 19 nt, Homo sapiens
ggaaggucuccccaugugc

SEQ ID NO: 829280 - RNA, 13 nt, Homo sapiens
ggaauacauugua

SEQ ID NO: 829281 - RNA, 18 nt, Homo sapiens
ggacgcaauugugggaug

SEQ ID NO: 829282 - RNA, 20 nt, Homo sapiens
ggacuauggguacauuccac

SEQ ID NO: 829283 - RNA, 23 nt, Homo sapiens
ggagugaggaugucugggccacu

SEQ ID NO: 829284 - RNA, 14 nt, Homo sapiens
ggcaaagugcugua

SEQ ID NO: 829285 - RNA, 20 nt, Homo sapiens
ggcagaauaaauaagcaaaa

SEQ ID NO: 829286 - RNA, 16 nt, Homo sapiens
ggcauguguaguuaau

SEQ ID NO: 829287 - RNA, 11 nt, Homo sapiens
ggccagcacca

SEQ ID NO: 829288 - RNA, 16 nt, Homo sapiens
ggccagcaccaucucu

SEQ ID NO: 829289 - RNA, 20 nt, Homo sapiens
ggcccagcuguagccauggc

SEQ ID NO: 829290 - RNA, 17 nt, Homo sapiens
ggccuccugucccucau

SEQ ID NO: 829291 - RNA, 21 nt, Homo sapiens
ggcugacaccuaccaugcugc

SEQ ID NO: 829292 - RNA, 15 nt, Homo sapiens
ggcugagcucuuauc

SEQ ID NO: 829293 - RNA, 20 nt, Homo sapiens
ggcugaggccucucauucca

SEQ ID NO: 829294 - RNA, 14 nt, Homo sapiens
gggaagagggcagu

SEQ ID NO: 829295 - RNA, 21 nt, Homo sapiens
gggacauuaguaacugcacac

SEQ ID NO: 829296 - RNA, 16 nt, Homo sapiens
gggcucagaguggggu

SEQ ID NO: 829297 - RNA, 14 nt, Homo sapiens
gggcucucucauga

SEQ ID NO: 829298 - RNA, 14 nt, Homo sapiens
gggcugacugggac

SEQ ID NO: 829299 - RNA, 17 nt, Homo sapiens
gggcugaggccucucau

SEQ ID NO: 829300 - RNA, 19 nt, Homo sapiens
gggcugauuguauuuaccu

SEQ ID NO: 829301 - RNA, 10 nt, Homo sapiens
gggucugugu

SEQ ID NO: 829302 - RNA, 11 nt, Homo sapiens
gggugccauuc

SEQ ID NO: 829303 - RNA, 21 nt, Homo sapiens
gguacagacacucccacuugg

SEQ ID NO: 829304 - RNA, 23 nt, Homo sapiens
gguaccucucaacauuaccaaaa

SEQ ID NO: 829305 - RNA, 14 nt, Homo sapiens
gguagguugggaga

SEQ ID NO: 829306 - RNA, 13 nt, Homo sapiens
ggugacacaucca

SEQ ID NO: 829307 - RNA, 17 nt, Homo sapiens
gguguuacuaaagucac

SEQ ID NO: 829308 - RNA, 13 nt, Homo sapiens
gguuuuuucacau

SEQ ID NO: 829309 - RNA, 16 nt, Homo sapiens
guaacaaaaguauagu

SEQ ID NO: 829310 - RNA, 14 nt, Homo sapiens
guaacacaccaagu

SEQ ID NO: 829311 - RNA, 18 nt, Homo sapiens
guaauaauguaauacugu

SEQ ID NO: 829312 - RNA, 12 nt, Homo sapiens
guaccuggugac

SEQ ID NO: 829313 - RNA, 17 nt, Homo sapiens
guacuccuuaaauuuau

SEQ ID NO: 829314 - RNA, 23 nt, Homo sapiens
guacuuacaucuuuguuuaccau

SEQ ID NO: 829315 - RNA, 16 nt, Homo sapiens
guagaauaaaugaaga

SEQ ID NO: 829316 - RNA, 14 nt, Homo sapiens
guaggaucugucaa

SEQ ID NO: 829317 - RNA, 19 nt, Homo sapiens
guauaaugguguuacuaaa

SEQ ID NO: 829318 - RNA, 22 nt, Homo sapiens
guauucaggcacugagaaugau

SEQ ID NO: 829319 - RNA, 19 nt, Homo sapiens
guauuuuagcaggguacau

SEQ ID NO: 829320 - RNA, 17 nt, Homo sapiens
guccaccugccuaucca

SEQ ID NO: 829321 - RNA, 23 nt, Homo sapiens
gucccagaaugccuccugcaggg

SEQ ID NO: 829322 - RNA, 19 nt, Homo sapiens
gucccagagguuaucugcc

SEQ ID NO: 829323 - RNA, 20 nt, Homo sapiens
gucccagagguuaucugccu

SEQ ID NO: 829324 - RNA, 15 nt, Homo sapiens
gucccccccaggugc

SEQ ID NO: 829325 - RNA, 17 nt, Homo sapiens
guccugcuccacagugu

SEQ ID NO: 829326 - RNA, 17 nt, Homo sapiens
gucgucaaguugcagau

SEQ ID NO: 829327 - RNA, 17 nt, Homo sapiens
gucuccccaugugccug

SEQ ID NO: 829328 - RNA, 18 nt, Homo sapiens
gucucuaugaucuuggca

SEQ ID NO: 829329 - RNA, 14 nt, Homo sapiens
gucugucccaaaga

SEQ ID NO: 829330 - RNA, 14 nt, Homo sapiens
gugaacuuacacuu

SEQ ID NO: 829331 - RNA, 16 nt, Homo sapiens
gugaauacauuuugca

SEQ ID NO: 829332 - RNA, 14 nt, Homo sapiens
gugagugaccucac

SEQ ID NO: 829333 - RNA, 21 nt, Homo sapiens
gugauguguccugauaagcug

SEQ ID NO: 829334 - RNA, 16 nt, Homo sapiens
gugccaggauggaaug

SEQ ID NO: 829335 - RNA, 13 nt, Homo sapiens
gugcccugcaaau

SEQ ID NO: 829336 - RNA, 15 nt, Homo sapiens
gugcucuccuacccc

SEQ ID NO: 829337 - RNA, 21 nt, Homo sapiens
gugcugcuguggcaucaggaa

SEQ ID NO: 829338 - RNA, 21 nt, Homo sapiens
guggucauuuccuaugcaaau

SEQ ID NO: 829339 - RNA, 20 nt, Homo sapiens
gugugccccccauccuggcc

SEQ ID NO: 829340 - RNA, 13 nt, Homo sapiens
guguguguguaug

SEQ ID NO: 829341 - RNA, 17 nt, Homo sapiens
guuaaacuacuuguaaa

SEQ ID NO: 829342 - RNA, 16 nt, Homo sapiens
guuaaaucuuuuggca

SEQ ID NO: 829343 - RNA, 19 nt, Homo sapiens
guuaaggcagugacuuuag

SEQ ID NO: 829344 - RNA, 19 nt, Homo sapiens
guuaggccuggcacagugu

SEQ ID NO: 829345 - RNA, 15 nt, Homo sapiens
guuauagaaacugau

SEQ ID NO: 829346 - RNA, 13 nt, Homo sapiens
guucaguucuguu

SEQ ID NO: 829347 - RNA, 22 nt, Homo sapiens
guucaucauuggcccucauucc

SEQ ID NO: 829348 - RNA, 9 nt, Homo sapiens
guuccugug

SEQ ID NO: 829349 - RNA, 11 nt, Homo sapiens
guucucaggcc

SEQ ID NO: 829350 - RNA, 18 nt, Homo sapiens
auaguuuuguuuguuaga

SEQ ID NO: 829351 - RNA, 15 nt, Homo sapiens
auauacauauaugag

SEQ ID NO: 829352 - RNA, 13 nt, Homo sapiens
auauauccaagaa

SEQ ID NO: 829353 - RNA, 18 nt, Homo sapiens
auauaugcucaaccagaa

SEQ ID NO: 829354 - RNA, 19 nt, Homo sapiens
auaucugagaaguguauau

SEQ ID NO: 829355 - RNA, 17 nt, Homo sapiens
auaugacuuuuucucag

SEQ ID NO: 829356 - RNA, 14 nt, Homo sapiens
auaugcauuaugaa

SEQ ID NO: 829357 - RNA, 20 nt, Homo sapiens
auauuccucuaaaacucuca

SEQ ID NO: 829358 - RNA, 19 nt, Homo sapiens
auauuuuaaaaaaucaaaa

SEQ ID NO: 829359 - RNA, 20 nt, Homo sapiens
auauuuuuauccuguucuca

SEQ ID NO: 829360 - RNA, 18 nt, Homo sapiens
auauuuuucaaaaucaaa

SEQ ID NO: 829361 - RNA, 19 nt, Homo sapiens
auauuuuucaaaaucaaag

SEQ ID NO: 829362 - RNA, 17 nt, Homo sapiens
aucaacauuuguuccau

SEQ ID NO: 829363 - RNA, 14 nt, Homo sapiens
aucaagucugugaa

SEQ ID NO: 829364 - RNA, 20 nt, Homo sapiens
aucauuggcccucauuccaa

SEQ ID NO: 829365 - RNA, 18 nt, Homo sapiens
aucauuuaggauacucuu

SEQ ID NO: 829366 - RNA, 20 nt, Homo sapiens
aucauuucuugguaugauca

SEQ ID NO: 829367 - RNA, 22 nt, Homo sapiens
auccauagcaccuccacauacc

SEQ ID NO: 829368 - RNA, 12 nt, Homo sapiens
auccuguucuca

SEQ ID NO: 829369 - RNA, 16 nt, Homo sapiens
aucguuagaggagcaa

SEQ ID NO: 829370 - RNA, 16 nt, Homo sapiens
aucuaaacaccaaaaa

SEQ ID NO: 829371 - RNA, 20 nt, Homo sapiens
aucuaaauuacagugcaguu

SEQ ID NO: 829372 - RNA, 18 nt, Homo sapiens
aucuacugagacaugacu

SEQ ID NO: 829373 - RNA, 17 nt, Homo sapiens
aucucacucuguugccc

SEQ ID NO: 829374 - RNA, 15 nt, Homo sapiens
aucucaggugccacu

SEQ ID NO: 829375 - RNA, 18 nt, Homo sapiens
aucucauucagguguucu

SEQ ID NO: 829376 - RNA, 15 nt, Homo sapiens
aucucuuuaccuccu

SEQ ID NO: 829377 - RNA, 16 nt, Homo sapiens
aucugagaaacuuaaa

SEQ ID NO: 829378 - RNA, 20 nt, Homo sapiens
augaaaaccacccuaucauc

SEQ ID NO: 829379 - RNA, 19 nt, Homo sapiens
augaagacccaguguaaag

SEQ ID NO: 829380 - RNA, 20 nt, Homo sapiens
augaauagagaguauguaau

SEQ ID NO: 829381 - RNA, 22 nt, Homo sapiens
augagcuggggaugucucucau

SEQ ID NO: 829382 - RNA, 23 nt, Homo sapiens
augauauuuuuauccuguucuca

SEQ ID NO: 829383 - RNA, 22 nt, Homo sapiens
augaugagguuuucuuaacuua

SEQ ID NO: 829384 - RNA, 13 nt, Homo sapiens
augaugcaguuuu

SEQ ID NO: 829385 - RNA, 13 nt, Homo sapiens
augcaguuuucau

SEQ ID NO: 829386 - RNA, 19 nt, Homo sapiens
augcccagcacaauucauu

SEQ ID NO: 829387 - RNA, 16 nt, Homo sapiens
auggaagggccuucuc

SEQ ID NO: 829388 - RNA, 14 nt, Homo sapiens
auggagauucugau

SEQ ID NO: 829389 - RNA, 14 nt, Homo sapiens
auggggugggccca

SEQ ID NO: 829390 - RNA, 13 nt, Homo sapiens
auggguacauucc

SEQ ID NO: 829391 - RNA, 16 nt, Homo sapiens
auguaaaggccuuuaa

SEQ ID NO: 829392 - RNA, 15 nt, Homo sapiens
augugcuucacauaa

SEQ ID NO: 829393 - RNA, 21 nt, Homo sapiens
augugggggucuguguguuua

SEQ ID NO: 829394 - RNA, 16 nt, Homo sapiens
auguucguauuacaag

SEQ ID NO: 829395 - RNA, 20 nt, Homo sapiens
auguucguauuacaagagaa

SEQ ID NO: 829396 - RNA, 23 nt, Homo sapiens
auuacagguuggaucucacaaau

SEQ ID NO: 829397 - RNA, 16 nt, Homo sapiens
auuaccaaaaucauuu

SEQ ID NO: 829398 - RNA, 19 nt, Homo sapiens
auuaguauucaggcacuga

SEQ ID NO: 829399 - RNA, 21 nt, Homo sapiens
auuauuucaaccgcuugccau

SEQ ID NO: 829400 - RNA, 18 nt, Homo sapiens
auucacagcaagucacug

SEQ ID NO: 829401 - RNA, 16 nt, Homo sapiens
auucaggcacugagaa

SEQ ID NO: 829402 - RNA, 22 nt, Homo sapiens
auucccaugguagacugugaca

SEQ ID NO: 829403 - RNA, 20 nt, Homo sapiens
auuccugggccuguccccca

SEQ ID NO: 829404 - RNA, 18 nt, Homo sapiens
auucucaaaauacguguu

SEQ ID NO: 829405 - RNA, 22 nt, Homo sapiens
auugaaggagaaaaugcauuau

SEQ ID NO: 829406 - RNA, 21 nt, Homo sapiens
auugugaauaaaaauugauga

SEQ ID NO: 829407 - RNA, 10 nt, Homo sapiens
auugugaugu

SEQ ID NO: 829408 - RNA, 20 nt, Homo sapiens
auuuacuuaauggguacaau

SEQ ID NO: 829409 - RNA, 21 nt, Homo sapiens
auuuaugguucucaggccuga

SEQ ID NO: 829410 - RNA, 16 nt, Homo sapiens
auuucaaauuaaucuu

SEQ ID NO: 829411 - RNA, 20 nt, Homo sapiens
auuucaaccgcuugccauau

SEQ ID NO: 829412 - RNA, 21 nt, Homo sapiens
auuucaugcacugauuaaaau

SEQ ID NO: 829413 - RNA, 15 nt, Homo sapiens
auuuccauaacucau

SEQ ID NO: 829414 - RNA, 19 nt, Homo sapiens
ccggccuccugucccucau

SEQ ID NO: 829415 - RNA, 14 nt, Homo sapiens
ccuaggauuccucc

SEQ ID NO: 829416 - RNA, 18 nt, Homo sapiens
ccuauuuuggacguguga

SEQ ID NO: 829417 - RNA, 14 nt, Homo sapiens
ccucacuucuggca

SEQ ID NO: 829418 - RNA, 14 nt, Homo sapiens
ccucauccauagca

SEQ ID NO: 829419 - RNA, 14 nt, Homo sapiens
ccucauuuaccaua

SEQ ID NO: 829420 - RNA, 18 nt, Homo sapiens
ccuccacucccacuuccc

SEQ ID NO: 829421 - RNA, 17 nt, Homo sapiens
ccuccccacaguccuca

SEQ ID NO: 829422 - RNA, 17 nt, Homo sapiens
ccucccugccugcuccu

SEQ ID NO: 829423 - RNA, 18 nt, Homo sapiens
ccuccugucccucaucca

SEQ ID NO: 829424 - RNA, 16 nt, Homo sapiens
ccucucaacauuacca

SEQ ID NO: 829425 - RNA, 20 nt, Homo sapiens
ccucucaacauuaccaaaau

SEQ ID NO: 829426 - RNA, 18 nt, Homo sapiens
ccucuccaguaucuucac

SEQ ID NO: 829427 - RNA, 14 nt, Homo sapiens
ccucugcagcacuu

SEQ ID NO: 829428 - RNA, 17 nt, Homo sapiens
ccucuuggcugccuugu

SEQ ID NO: 829429 - RNA, 17 nt, Homo sapiens
ccugaaaauuaugaguc

SEQ ID NO: 829430 - RNA, 14 nt, Homo sapiens
ccugacaauggcag

SEQ ID NO: 829431 - RNA, 16 nt, Homo sapiens
ccuggacauauuccca

SEQ ID NO: 829432 - RNA, 19 nt, Homo sapiens
ccuggauguguggggcaug

SEQ ID NO: 829433 - RNA, 16 nt, Homo sapiens
ccuggcccaucagugu

SEQ ID NO: 829434 - RNA, 15 nt, Homo sapiens
ccuguccauaaagua

SEQ ID NO: 829435 - RNA, 13 nt, Homo sapiens
ccugugacuaugg

SEQ ID NO: 829436 - RNA, 17 nt, Homo sapiens
ccuguguccagcagcug

SEQ ID NO: 829437 - RNA, 17 nt, Homo sapiens
ccuguuuaaaaaaagua

SEQ ID NO: 829438 - RNA, 22 nt, Homo sapiens
ccuuaaaaugugagugaccuca

SEQ ID NO: 829439 - RNA, 12 nt, Homo sapiens
ccuucaugauga

SEQ ID NO: 829440 - RNA, 20 nt, Homo sapiens
ccuuccuucuugcuucucau

SEQ ID NO: 829441 - RNA, 16 nt, Homo sapiens
ccuucuccacagggac

SEQ ID NO: 829442 - RNA, 12 nt, Homo sapiens
ccuuggggccug

SEQ ID NO: 829443 - RNA, 14 nt, Homo sapiens
ccuuugucccagaa

SEQ ID NO: 829444 - RNA, 13 nt, Homo sapiens
ccuuuugccaucc

SEQ ID NO: 829445 - RNA, 15 nt, Homo sapiens
ccuuuuucuaccuuu

SEQ ID NO: 829446 - RNA, 14 nt, Homo sapiens
cgcugccuugccau

SEQ ID NO: 829447 - RNA, 23 nt, Homo sapiens
cgcuuugucugucggugacuccu

SEQ ID NO: 829448 - RNA, 23 nt, Homo sapiens
cggugcauacacccccaccuccu

SEQ ID NO: 829449 - RNA, 21 nt, Homo sapiens
cuaaagucacauauaaaaguu

SEQ ID NO: 829450 - RNA, 18 nt, Homo sapiens
cuaauagaaccaagaauu

SEQ ID NO: 829451 - RNA, 13 nt, Homo sapiens
cuaauccaugugc

SEQ ID NO: 829452 - RNA, 23 nt, Homo sapiens
cuacuaguaauaauguaauacug

SEQ ID NO: 829453 - RNA, 13 nt, Homo sapiens
cuacuggcagcuc

SEQ ID NO: 829454 - RNA, 18 nt, Homo sapiens
cuacuugccacacacugu

SEQ ID NO: 829455 - RNA, 15 nt, Homo sapiens
cuacuuguaaaggug

SEQ ID NO: 829456 - RNA, 20 nt, Homo sapiens
cuacuuguaaaggugcugca

SEQ ID NO: 829457 - RNA, 23 nt, Homo sapiens
cuagaaccuucuaauccaugugc

SEQ ID NO: 829458 - RNA, 13 nt, Homo sapiens
cuagaauccccac

SEQ ID NO: 829459 - RNA, 18 nt, Homo sapiens
cuagaauccccacaggga

SEQ ID NO: 829460 - RNA, 22 nt, Homo sapiens
cuagugugaguggcagccaugc

SEQ ID NO: 829461 - RNA, 13 nt, Homo sapiens
cuauaccuaugug

SEQ ID NO: 829462 - RNA, 21 nt, Homo sapiens
cuauauuuauuuauguaggau

SEQ ID NO: 829463 - RNA, 20 nt, Homo sapiens
cuaucaccucuuaugcacac

SEQ ID NO: 829464 - RNA, 20 nt, Homo sapiens
cuaucuacugagacaugacu

SEQ ID NO: 829465 - RNA, 13 nt, Homo sapiens
cuaugaucuuggc

SEQ ID NO: 829466 - RNA, 15 nt, Homo sapiens
cucagaucauuauca

SEQ ID NO: 829467 - RNA, 16 nt, Homo sapiens
cucaggggucauucau

SEQ ID NO: 829468 - RNA, 23 nt, Homo sapiens
cucaucaggccauugucccugaa

SEQ ID NO: 829469 - RNA, 15 nt, Homo sapiens
cuccacagugcugcu

SEQ ID NO: 829470 - RNA, 17 nt, Homo sapiens
cuccaccgccauggcuu

SEQ ID NO: 829471 - RNA, 13 nt, Homo sapiens
cucccacagugac

SEQ ID NO: 829472 - RNA, 18 nt, Homo sapiens
cuccccacaguccucaca

SEQ ID NO: 829473 - RNA, 18 nt, Homo sapiens
cuccccuuguacucuugc

SEQ ID NO: 829474 - RNA, 12 nt, Homo sapiens
cucuacccugag

SEQ ID NO: 829475 - RNA, 18 nt, Homo sapiens
cucucaagugaaagacuu

SEQ ID NO: 829476 - RNA, 23 nt, Homo sapiens
cucucgcaagggaaguccuugca

SEQ ID NO: 829477 - RNA, 13 nt, Homo sapiens
cucucucaugaua

SEQ ID NO: 829478 - RNA, 13 nt, Homo sapiens
cucuguccugacu

SEQ ID NO: 829479 - RNA, 17 nt, Homo sapiens
cucuuacaauaagcuaa

SEQ ID NO: 829480 - RNA, 21 nt, Homo sapiens
cucuugugcccuucugagccc

SEQ ID NO: 829481 - RNA, 21 nt, Homo sapiens
caaauauuuuuugaguguaug

SEQ ID NO: 829482 - RNA, 16 nt, Homo sapiens
caaaugcuuuuccuca

SEQ ID NO: 829483 - RNA, 16 nt, Homo sapiens
caaauuuuucaucucu

SEQ ID NO: 829484 - RNA, 18 nt, Homo sapiens
caaccucauuuuaacuca

SEQ ID NO: 829485 - RNA, 19 nt, Homo sapiens
caacugccagaacauggau

SEQ ID NO: 829486 - RNA, 23 nt, Homo sapiens
caacugugcuacacuugcaccug

SEQ ID NO: 829487 - RNA, 14 nt, Homo sapiens
caagaaaaccacaa

SEQ ID NO: 829488 - RNA, 19 nt, Homo sapiens
caagaaguaacaaaaguau

SEQ ID NO: 829489 - RNA, 21 nt, Homo sapiens
caaggaggucgggauggggcu

SEQ ID NO: 829490 - RNA, 15 nt, Homo sapiens
caaggcuaguuccuu

SEQ ID NO: 829491 - RNA, 16 nt, Homo sapiens
caauauaucaauguaa

SEQ ID NO: 829492 - RNA, 13 nt, Homo sapiens
caaugacacauag

SEQ ID NO: 829493 - RNA, 21 nt, Homo sapiens
caaugcuuugggaggccaagg

SEQ ID NO: 829494 - RNA, 21 nt, Homo sapiens
caauguugcauuuaugaugca

SEQ ID NO: 829495 - RNA, 19 nt, Homo sapiens
caauucuccuguugcaaug

SEQ ID NO: 829496 - RNA, 23 nt, Homo sapiens
cacaaaucaaagcaagggcucca

SEQ ID NO: 829497 - RNA, 17 nt, Homo sapiens
cacaaccuccuccucca

SEQ ID NO: 829498 - RNA, 15 nt, Homo sapiens
cacaagaauuacacu

SEQ ID NO: 829499 - RNA, 21 nt, Homo sapiens
cacaccucccacccccuguau

SEQ ID NO: 829500 - RNA, 21 nt, Homo sapiens
cacagcugcagcugggcccca

SEQ ID NO: 829501 - RNA, 14 nt, Homo sapiens
cacagggacacagu

SEQ ID NO: 829502 - RNA, 12 nt, Homo sapiens
cacauaaaggua

SEQ ID NO: 829503 - RNA, 12 nt, Homo sapiens
cacauacauugc

SEQ ID NO: 829504 - RNA, 20 nt, Homo sapiens
cacauuuugcauuagacaga

SEQ ID NO: 829505 - RNA, 16 nt, Homo sapiens
cacccagugcugccau

SEQ ID NO: 829506 - RNA, 14 nt, Homo sapiens
cacccaugccauag

SEQ ID NO: 829507 - RNA, 19 nt, Homo sapiens
cacccaugccauagaaacu

SEQ ID NO: 829508 - RNA, 17 nt, Homo sapiens
caccgccauggcuucca

SEQ ID NO: 829509 - RNA, 22 nt, Homo sapiens
caccuaguggcuguccagugcc

SEQ ID NO: 829510 - RNA, 18 nt, Homo sapiens
caccuauauauccaagaa

SEQ ID NO: 829511 - RNA, 21 nt, Homo sapiens
uacacuuggagcccgugcagu

SEQ ID NO: 829512 - RNA, 21 nt, Homo sapiens
uacauguagaauucgcaguga

SEQ ID NO: 829513 - RNA, 20 nt, Homo sapiens
uacauuguauuaauaccaaa

SEQ ID NO: 829514 - RNA, 16 nt, Homo sapiens
uacauuuuauuacacu

SEQ ID NO: 829515 - RNA, 19 nt, Homo sapiens
uacauuuuauuacacuaaa

SEQ ID NO: 829516 - RNA, 15 nt, Homo sapiens
uacauuuuuguacac

SEQ ID NO: 829517 - RNA, 17 nt, Homo sapiens
uaccgggcuggccugug

SEQ ID NO: 829518 - RNA, 20 nt, Homo sapiens
uaccuggcccugugccuugg

SEQ ID NO: 829519 - RNA, 11 nt, Homo sapiens
uaccugggaaa

SEQ ID NO: 829520 - RNA, 15 nt, Homo sapiens
uaccuucuaccucuu

SEQ ID NO: 829521 - RNA, 18 nt, Homo sapiens
uacuaaagucacauauaa

SEQ ID NO: 829522 - RNA, 15 nt, Homo sapiens
uacuaaggagcauga

SEQ ID NO: 829523 - RNA, 20 nt, Homo sapiens
uacugcacauuuuguacaaa

SEQ ID NO: 829524 - RNA, 14 nt, Homo sapiens
uacugugagacugu

SEQ ID NO: 829525 - RNA, 19 nt, Homo sapiens
uacuuaauggguacaaugu

SEQ ID NO: 829526 - RNA, 16 nt, Homo sapiens
uagaacuccaguacuc

SEQ ID NO: 829527 - RNA, 18 nt, Homo sapiens
uagaucugauggugagcu

SEQ ID NO: 829528 - RNA, 15 nt, Homo sapiens
uagcacaugauuuuc

SEQ ID NO: 829529 - RNA, 19 nt, Homo sapiens
uagcagaaggcaagcacca

SEQ ID NO: 829530 - RNA, 14 nt, Homo sapiens
uaggaaaaccauga

SEQ ID NO: 829531 - RNA, 21 nt, Homo sapiens
uaggaacugcugggcuuggca

SEQ ID NO: 829532 - RNA, 22 nt, Homo sapiens
uaggaaggcagcauuccaugac

SEQ ID NO: 829533 - RNA, 18 nt, Homo sapiens
uaggauaaauuacauuaa

SEQ ID NO: 829534 - RNA, 21 nt, Homo sapiens
uaggaucugucaaagaaaacu

SEQ ID NO: 829535 - RNA, 13 nt, Homo sapiens
uaguagugucuuc

SEQ ID NO: 829536 - RNA, 18 nt, Homo sapiens
uagucuguuggcaauuga

SEQ ID NO: 829537 - RNA, 13 nt, Homo sapiens
uauaaacauuggu

SEQ ID NO: 829538 - RNA, 18 nt, Homo sapiens
uauaaauacacuuccugc

SEQ ID NO: 829539 - RNA, 21 nt, Homo sapiens
uauaaauacacuuccugcuua

SEQ ID NO: 829540 - RNA, 13 nt, Homo sapiens
uauauacauauau

SEQ ID NO: 829541 - RNA, 19 nt, Homo sapiens
uauaugguuuuuccagcua

SEQ ID NO: 829542 - RNA, 20 nt, Homo sapiens
uauauugguuuuuccagcua

SEQ ID NO: 829543 - RNA, 13 nt, Homo sapiens
uauauuuccuuaa

SEQ ID NO: 829544 - RNA, 19 nt, Homo sapiens
uaucaccucuuaugcacac

SEQ ID NO: 829545 - RNA, 19 nt, Homo sapiens
uaucucgcuagccauauau

SEQ ID NO: 829546 - RNA, 14 nt, Homo sapiens
uaugaacuugagga

SEQ ID NO: 829547 - RNA, 20 nt, Homo sapiens
uaugacaauguugcauuuau

SEQ ID NO: 829548 - RNA, 22 nt, Homo sapiens
uaugagcuggggaugucucuca

SEQ ID NO: 829549 - RNA, 20 nt, Homo sapiens
uaugagucucuaugaucuug

SEQ ID NO: 829550 - RNA, 12 nt, Homo sapiens
uaugcaaaucag

SEQ ID NO: 829551 - RNA, 14 nt, Homo sapiens
uauggguacauucc

SEQ ID NO: 829552 - RNA, 14 nt, Homo sapiens
uaugguucucaggc

SEQ ID NO: 829553 - RNA, 17 nt, Homo sapiens
uaugguucucucgcaag

SEQ ID NO: 829554 - RNA, 15 nt, Homo sapiens
uaugugcuucacaua

SEQ ID NO: 829555 - RNA, 23 nt, Homo sapiens
uauguggaagugugggucugugu

SEQ ID NO: 829556 - RNA, 16 nt, Homo sapiens
uaugugggggucugug

SEQ ID NO: 829557 - RNA, 16 nt, Homo sapiens
uauuaaauguugcaca

SEQ ID NO: 829558 - RNA, 16 nt, Homo sapiens
uauuaccauuacuugu

SEQ ID NO: 829559 - RNA, 17 nt, Homo sapiens
uauuagcaacugugcua

SEQ ID NO: 829560 - RNA, 12 nt, Homo sapiens
uauucccaugag

SEQ ID NO: 829561 - RNA, 16 nt, Homo sapiens
uauuguggucauuucc

SEQ ID NO: 829562 - RNA, 18 nt, Homo sapiens
uauuuaccuucuaccucu

SEQ ID NO: 829563 - RNA, 17 nt, Homo sapiens
uauuucaaccgcuugcc

SEQ ID NO: 829564 - RNA, 19 nt, Homo sapiens
uauuucccucuacugagua

SEQ ID NO: 829565 - RNA, 14 nt, Homo sapiens
uauuugcuauucaa

SEQ ID NO: 829566 - RNA, 13 nt, Homo sapiens
uauuuucacauga

SEQ ID NO: 829567 - RNA, 16 nt, Homo sapiens
uauuuuggacguguga

SEQ ID NO: 829568 - RNA, 14 nt, Homo sapiens
ucaaagcacuguuu

SEQ ID NO: 829569 - RNA, 21 nt, Homo sapiens
ucaaauuuuucaucucuucaa

SEQ ID NO: 829570 - RNA, 22 nt, Homo sapiens
ucaagcaauccuccugccucag

SEQ ID NO: 829571 - RNA, 22 nt, Homo sapiens
ucaagcagacgugagugugacu

SEQ ID NO: 829572 - RNA, 19 nt, Homo sapiens
ucaaggccucccacaguga

SEQ ID NO: 829573 - RNA, 13 nt, Homo sapiens
ucaaguaccaaaa

SEQ ID NO: 829574 - RNA, 15 nt, Homo sapiens
ucaagugaucuuuca

SEQ ID NO: 829575 - RNA, 20 nt, Homo sapiens
ucacagcaagucacuggcca

SEQ ID NO: 829576 - RNA, 14 nt, Homo sapiens
ucaccccugcacuu

SEQ ID NO: 829577 - RNA, 17 nt, Homo sapiens
ucaccucuuaugcacac

SEQ ID NO: 829578 - RNA, 16 nt, Homo sapiens
ucacuguucaugaaua

SEQ ID NO: 829579 - RNA, 21 nt, Homo sapiens
ucacuuccuucagcaucucac

SEQ ID NO: 829580 - RNA, 18 nt, Homo sapiens
ucagacuuaaaauuccac

SEQ ID NO: 829581 - RNA, 14 nt, Homo sapiens
ucagagucuaucaa

SEQ ID NO: 829582 - RNA, 19 nt, Homo sapiens
ucaggaaaggaagauguaa

SEQ ID NO: 829583 - RNA, 19 nt, Homo sapiens
ucagggaccacagcaaggc

SEQ ID NO: 829584 - RNA, 12 nt, Homo sapiens
uuuguugcucag

SEQ ID NO: 829585 - RNA, 20 nt, Homo sapiens
uuuuaaauacaaaaggcauu

SEQ ID NO: 829586 - RNA, 15 nt, Homo sapiens
uuuuauuacacuaaa

SEQ ID NO: 829587 - RNA, 11 nt, Homo sapiens
uuuuugcucuu

SEQ ID NO: 829588 - RNA, 11 nt, Homo sapiens
cccugccauca

SEQ ID NO: 829589 - RNA, 22 nt, Homo sapiens
ccgccuuccuccuccacagugc

SEQ ID NO: 829590 - RNA, 19 nt, Homo sapiens
ccgggcuggccugugccua

SEQ ID NO: 829591 - RNA, 13 nt, Homo sapiens
ccgggugccauuc

SEQ ID NO: 829592 - RNA, 16 nt, Homo sapiens
ccguugcacaaaaagg

SEQ ID NO: 829593 - RNA, 12 nt, Homo sapiens
ccuaugcaaaua

SEQ ID NO: 829594 - RNA, 23 nt, Homo sapiens
ccucaaacuccuggacucaugca

SEQ ID NO: 829595 - RNA, 11 nt, Homo sapiens
ccucaagaaga

SEQ ID NO: 829596 - RNA, 16 nt, Homo sapiens
ccucagugagaagcca

SEQ ID NO: 829597 - RNA, 13 nt, Homo sapiens
ccuccagccacuu

SEQ ID NO: 829598 - RNA, 15 nt, Homo sapiens
ccuccugucccucau

SEQ ID NO: 829599 - RNA, 17 nt, Homo sapiens
ccucuuucuaucuucac

SEQ ID NO: 829600 - RNA, 18 nt, Homo sapiens
ccugccucaggcuucuga

SEQ ID NO: 829601 - RNA, 13 nt, Homo sapiens
ccuggcacagugu

SEQ ID NO: 829602 - RNA, 15 nt, Homo sapiens
ccuggcccaucagug

SEQ ID NO: 829603 - RNA, 17 nt, Homo sapiens
ccugggaaaggacccac

SEQ ID NO: 829604 - RNA, 18 nt, Homo sapiens
ccugggggcagugacugg

SEQ ID NO: 829605 - RNA, 15 nt, Homo sapiens
ccugguccaucucau

SEQ ID NO: 829606 - RNA, 23 nt, Homo sapiens
ccugucccagagguuaucugccu

SEQ ID NO: 829607 - RNA, 15 nt, Homo sapiens
ccugugccuuuugcc

SEQ ID NO: 829608 - RNA, 23 nt, Homo sapiens
ccugugucuuauagguuuccacu

SEQ ID NO: 829609 - RNA, 11 nt, Homo sapiens
ccuuacucuga

SEQ ID NO: 829610 - RNA, 20 nt, Homo sapiens
ccuucagaacagaggcauuu

SEQ ID NO: 829611 - RNA, 14 nt, Homo sapiens
ccuucagauuugcc

SEQ ID NO: 829612 - RNA, 13 nt, Homo sapiens
ccuuccaacugcc

SEQ ID NO: 829613 - RNA, 19 nt, Homo sapiens
ccuucccuccccacagucc

SEQ ID NO: 829614 - RNA, 22 nt, Homo sapiens
ccuugcaagcuaauucuuugac

SEQ ID NO: 829615 - RNA, 13 nt, Homo sapiens
ccuugugaaggaa

SEQ ID NO: 829616 - RNA, 21 nt, Homo sapiens
ccuuuggcuaucuacugagac

SEQ ID NO: 829617 - RNA, 22 nt, Homo sapiens
ccuuugggaggcagcaucaggg

SEQ ID NO: 829618 - RNA, 22 nt, Homo sapiens
ccuuuuauucauauuuucacau

SEQ ID NO: 829619 - RNA, 22 nt, Homo sapiens
ccuuuugcaacaagacaaagca

SEQ ID NO: 829620 - RNA, 22 nt, Homo sapiens
cgaauaaagugaauacauuuug

SEQ ID NO: 829621 - RNA, 14 nt, Homo sapiens
cgaccccaucucau

SEQ ID NO: 829622 - RNA, 21 nt, Homo sapiens
cgaggcaaagagaaaagccac

SEQ ID NO: 829623 - RNA, 19 nt, Homo sapiens
cgauugcaggagucccugc

SEQ ID NO: 829624 - RNA, 13 nt, Homo sapiens
cguaggaaaacca

SEQ ID NO: 829625 - RNA, 14 nt, Homo sapiens
cgugugaggaugug

SEQ ID NO: 829626 - RNA, 23 nt, Homo sapiens
cuaaagaguuauucaaaugaagg

SEQ ID NO: 829627 - RNA, 15 nt, Homo sapiens
cuaaagucacauaua

SEQ ID NO: 829628 - RNA, 16 nt, Homo sapiens
cuaaagucacauauaa

SEQ ID NO: 829629 - RNA, 12 nt, Homo sapiens
cuaagcuuucuc

SEQ ID NO: 829630 - RNA, 12 nt, Homo sapiens
cuaaugaucacu

SEQ ID NO: 829631 - RNA, 23 nt, Homo sapiens
cuaauucugagggaauuuaacca

SEQ ID NO: 829632 - RNA, 11 nt, Homo sapiens
cuacacauaua

SEQ ID NO: 829633 - RNA, 10 nt, Homo sapiens
cuacauauau

SEQ ID NO: 829634 - RNA, 15 nt, Homo sapiens
cuacauauaugcaau

SEQ ID NO: 829635 - RNA, 14 nt, Homo sapiens
cuaccugagcauuc

SEQ ID NO: 829636 - RNA, 13 nt, Homo sapiens
cuacucauucccc

SEQ ID NO: 829637 - RNA, 12 nt, Homo sapiens
cuacuugccaca

SEQ ID NO: 829638 - RNA, 17 nt, Homo sapiens
uuagaaacaccauucau

SEQ ID NO: 829639 - RNA, 20 nt, Homo sapiens
uuagagcugccugugccuuu

SEQ ID NO: 829640 - RNA, 16 nt, Homo sapiens
uuagcugaacaaugaa

SEQ ID NO: 829641 - RNA, 16 nt, Homo sapiens
uuaggaaaaauuccac

SEQ ID NO: 829642 - RNA, 14 nt, Homo sapiens
uuaucagccugugc

SEQ ID NO: 829643 - RNA, 19 nt, Homo sapiens
uuauugcuggaaucuacua

SEQ ID NO: 829644 - RNA, 15 nt, Homo sapiens
uuauuuccauggauu

SEQ ID NO: 829645 - RNA, 20 nt, Homo sapiens
uucaauaaagcugcugagaa

SEQ ID NO: 829646 - RNA, 22 nt, Homo sapiens
uucacaaauagccauugaacaa

SEQ ID NO: 829647 - RNA, 17 nt, Homo sapiens
uucacacuauccagcua

SEQ ID NO: 829648 - RNA, 14 nt, Homo sapiens
uucagauuugccuu

SEQ ID NO: 829649 - RNA, 15 nt, Homo sapiens
uucagauuugccuua

SEQ ID NO: 829650 - RNA, 19 nt, Homo sapiens
uucagugagccccucccca

SEQ ID NO: 829651 - RNA, 14 nt, Homo sapiens
uucaugccagguua

SEQ ID NO: 829652 - RNA, 13 nt, Homo sapiens
uucauuaauacug

SEQ ID NO: 829653 - RNA, 22 nt, Homo sapiens
uuccauauuuauguaccauauu

SEQ ID NO: 829654 - RNA, 17 nt, Homo sapiens
uuccugguccaucucau

SEQ ID NO: 829655 - RNA, 19 nt, Homo sapiens
uucuaaagcucugaacaaa

SEQ ID NO: 829656 - RNA, 22 nt, Homo sapiens
uucuaagugguauauacauaug

SEQ ID NO: 829657 - RNA, 15 nt, Homo sapiens
uucuaauccaugugc

SEQ ID NO: 829658 - RNA, 21 nt, Homo sapiens
uucuauggguuggacaaccuc

SEQ ID NO: 829659 - RNA, 20 nt, Homo sapiens
uucucaguaaauauuaaccu

SEQ ID NO: 829660 - RNA, 14 nt, Homo sapiens
uucugccacuuccc

SEQ ID NO: 829661 - RNA, 15 nt, Homo sapiens
uucuggcacugguug

SEQ ID NO: 829662 - RNA, 20 nt, Homo sapiens
uucuggcacugugacuacua

SEQ ID NO: 829663 - RNA, 17 nt, Homo sapiens
uucuguccaguuuccaa

SEQ ID NO: 829664 - RNA, 23 nt, Homo sapiens
uugaaaauaauucuuugagacag

SEQ ID NO: 829665 - RNA, 14 nt, Homo sapiens
uugaaacacaagaa

SEQ ID NO: 829666 - RNA, 15 nt, Homo sapiens
uugaacugguuguga

SEQ ID NO: 829667 - RNA, 21 nt, Homo sapiens
uugaauggagauucugauuca

SEQ ID NO: 829668 - RNA, 18 nt, Homo sapiens
uugauuaaaaucuggcaa

SEQ ID NO: 829669 - RNA, 21 nt, Homo sapiens
uugcacaaaguaagccucacc

SEQ ID NO: 829670 - RNA, 14 nt, Homo sapiens
uuggaauacuugaa

SEQ ID NO: 829671 - RNA, 19 nt, Homo sapiens
uuggaauacuugaaaaccu

SEQ ID NO: 829672 - RNA, 14 nt, Homo sapiens
uuggacaaccucau

SEQ ID NO: 829673 - RNA, 16 nt, Homo sapiens
uuggcagcucuacucu

SEQ ID NO: 829674 - RNA, 16 nt, Homo sapiens
uuggcucacugcaacu

SEQ ID NO: 829675 - RNA, 20 nt, Homo sapiens
uuggcugagagaguggcauu

SEQ ID NO: 829676 - RNA, 14 nt, Homo sapiens
uugggaggccaagg

SEQ ID NO: 829677 - RNA, 21 nt, Homo sapiens
uugggcagagcuggacaaggu

SEQ ID NO: 829678 - RNA, 14 nt, Homo sapiens
uugguauauuucca

SEQ ID NO: 829679 - RNA, 23 nt, Homo sapiens
uugguuaaaggaaguuuguucac

SEQ ID NO: 829680 - RNA, 18 nt, Homo sapiens
uuguacaaagauaugcua

SEQ ID NO: 829681 - RNA, 15 nt, Homo sapiens
uuguauuaccauuac

SEQ ID NO: 829682 - RNA, 23 nt, Homo sapiens
uugugaaagaaggagcaagagaa

SEQ ID NO: 829683 - RNA, 16 nt, Homo sapiens
uugugauguguccuga

SEQ ID NO: 829684 - RNA, 14 nt, Homo sapiens
uuuaaaaaagcaaa

SEQ ID NO: 829685 - RNA, 14 nt, Homo sapiens
uuuaaccagcaaca

SEQ ID NO: 829686 - RNA, 15 nt, Homo sapiens
uuuaauaucugagaa

SEQ ID NO: 829687 - RNA, 22 nt, Homo sapiens
uuuaaugaagacccaguguaaa

SEQ ID NO: 829688 - RNA, 14 nt, Homo sapiens
uuuaccacuaugca

SEQ ID NO: 829689 - RNA, 20 nt, Homo sapiens
uuuagaacagagggaccaaa

SEQ ID NO: 829690 - RNA, 20 nt, Homo sapiens
uuuagaaucaagucugugaa

SEQ ID NO: 829691 - RNA, 18 nt, Homo sapiens
uuuagcaggguacauauu

SEQ ID NO: 829692 - RNA, 20 nt, Homo sapiens
uuucacauaaacacauacau

SEQ ID NO: 829693 - RNA, 15 nt, Homo sapiens
uuucacuguucauga

SEQ ID NO: 829694 - RNA, 11 nt, Homo sapiens
uuucagaguuu

SEQ ID NO: 829695 - RNA, 13 nt, Homo sapiens
uuucauacauuau

SEQ ID NO: 829696 - RNA, 18 nt, Homo sapiens
uuucaucucuucaaucac

SEQ ID NO: 829697 - RNA, 15 nt, Homo sapiens
uuuccaaagagccau

SEQ ID NO: 829698 - RNA, 15 nt, Homo sapiens
uuuccacugccaaaa

SEQ ID NO: 829699 - RNA, 13 nt, Homo sapiens
uuuccuaugcaaa

SEQ ID NO: 829700 - RNA, 22 nt, Homo sapiens
uuucuaaagcucugaacaaaag

SEQ ID NO: 829701 - RNA, 22 nt, Homo sapiens
uuucucuugcucaccaagaagu

SEQ ID NO: 829702 - RNA, 12 nt, Homo sapiens
uuugaaacacaa

SEQ ID NO: 829703 - RNA, 19 nt, Homo sapiens
uuugaagguauaaccuuca

SEQ ID NO: 829704 - RNA, 16 nt, Homo sapiens
uuugcacccaugccau

SEQ ID NO: 829705 - RNA, 11 nt, Homo sapiens
uuuggggcuca

SEQ ID NO: 829706 - RNA, 16 nt, Homo sapiens
uuuguaaaaauacugu

SEQ ID NO: 829707 - RNA, 16 nt, Homo sapiens
uuuguaaauaugcaaa

SEQ ID NO: 829708 - RNA, 12 nt, Homo sapiens
uuuguacauuau

SEQ ID NO: 829709 - RNA, 14 nt, Homo sapiens
uuuuaauugcaaca

SEQ ID NO: 829710 - RNA, 19 nt, Homo sapiens
uuuucuaacccagucuuau

SEQ ID NO: 829711 - RNA, 14 nt, Homo sapiens
uuuucucaugauga

SEQ ID NO: 829712 - RNA, 12 nt, Homo sapiens
uuuucugauuug

SEQ ID NO: 829713 - RNA, 20 nt, Homo sapiens
uuuugagaauacacuaucaa

SEQ ID NO: 829714 - RNA, 21 nt, Homo sapiens
uuuugcacaaaguaagccuca

SEQ ID NO: 829715 - RNA, 23 nt, Homo sapiens
uuuuuauaaaaaauggugccuga

SEQ ID NO: 829716 - RNA, 12 nt, Homo sapiens
uuuuucagaaag

SEQ ID NO: 829717 - RNA, 17 nt, Homo sapiens
ucucgcuagccauauau

SEQ ID NO: 829718 - RNA, 18 nt, Homo sapiens
ucucuaaacugcuguuaa

SEQ ID NO: 829719 - RNA, 15 nt, Homo sapiens
ucucuuuaccuccua

SEQ ID NO: 829720 - RNA, 17 nt, Homo sapiens
ucugaguagcauauaua

SEQ ID NO: 829721 - RNA, 14 nt, Homo sapiens
ucugggaagggaga

SEQ ID NO: 829722 - RNA, 21 nt, Homo sapiens
ucugucaaagaaaacuuccaa

SEQ ID NO: 829723 - RNA, 14 nt, Homo sapiens
ucugucccaaagaa

SEQ ID NO: 829724 - RNA, 23 nt, Homo sapiens
ucugugaaagucuccuguaucau

SEQ ID NO: 829725 - RNA, 19 nt, Homo sapiens
ucuguguguguguaugugg

SEQ ID NO: 829726 - RNA, 21 nt, Homo sapiens
ucuuauuuuucuagucaguaa

SEQ ID NO: 829727 - RNA, 22 nt, Homo sapiens
ucuucaggguguuaaggcagug

SEQ ID NO: 829728 - RNA, 12 nt, Homo sapiens
ucuucauuaccu

SEQ ID NO: 829729 - RNA, 15 nt, Homo sapiens
ucuucauuaccucag

SEQ ID NO: 829730 - RNA, 22 nt, Homo sapiens
ucuuccacccauucccccaugu

SEQ ID NO: 829731 - RNA, 14 nt, Homo sapiens
ucuuccugccucag

SEQ ID NO: 829732 - RNA, 15 nt, Homo sapiens
ucuuucauacauuau

SEQ ID NO: 829733 - RNA, 16 nt, Homo sapiens
ucuuucauacauuaua

SEQ ID NO: 829734 - RNA, 18 nt, Homo sapiens
ucuuuccuuuugcaacaa

SEQ ID NO: 829735 - RNA, 18 nt, Homo sapiens
ucuuugcagagccuuuua

SEQ ID NO: 829736 - RNA, 21 nt, Homo sapiens
ugaaaaauaguguguccaugc

SEQ ID NO: 829737 - RNA, 20 nt, Homo sapiens
ugaaaauaaccaugaauaca

SEQ ID NO: 829738 - RNA, 18 nt, Homo sapiens
ugaaaauuaugagucucu

SEQ ID NO: 829739 - RNA, 16 nt, Homo sapiens
ugaaagaaggagcaag

SEQ ID NO: 829740 - RNA, 15 nt, Homo sapiens
ugaaauagagugaau

SEQ ID NO: 829741 - RNA, 23 nt, Homo sapiens
ugaaccccuggccucaagcaauc

SEQ ID NO: 829742 - RNA, 16 nt, Homo sapiens
ugaagacccaguguaa

SEQ ID NO: 829743 - RNA, 16 nt, Homo sapiens
ugaaggagaaaaugca

SEQ ID NO: 829744 - RNA, 11 nt, Homo sapiens
ugaagugcuug

SEQ ID NO: 829745 - RNA, 18 nt, Homo sapiens
ugacaauacugcugccuu

SEQ ID NO: 829746 - RNA, 16 nt, Homo sapiens
ugacaauguugcauuu

SEQ ID NO: 829747 - RNA, 14 nt, Homo sapiens
ugacagaaaugcaa

SEQ ID NO: 829748 - RNA, 14 nt, Homo sapiens
ugaccccuuuucag

SEQ ID NO: 829749 - RNA, 22 nt, Homo sapiens
ugacggcugcucgaagaacaau

SEQ ID NO: 829750 - RNA, 16 nt, Homo sapiens
ugacucucagcagcua

SEQ ID NO: 829751 - RNA, 13 nt, Homo sapiens
ugagacaagcccu

SEQ ID NO: 829752 - RNA, 19 nt, Homo sapiens
ugagaggccacagugcaau

SEQ ID NO: 829753 - RNA, 17 nt, Homo sapiens
ugagcaaggacaaccug

SEQ ID NO: 829754 - RNA, 14 nt, Homo sapiens
ugaggccucucauu

SEQ ID NO: 829755 - RNA, 15 nt, Homo sapiens
ugaggcuuccaggcu

SEQ ID NO: 829756 - RNA, 18 nt, Homo sapiens
ugaggggcucucucauga

SEQ ID NO: 829757 - RNA, 21 nt, Homo sapiens
ugauuaguauucaggcacuga

SEQ ID NO: 829758 - RNA, 18 nt, Homo sapiens
ugcaauaaaauaguagca

SEQ ID NO: 829759 - RNA, 15 nt, Homo sapiens
ugcacaccucaugag

SEQ ID NO: 829760 - RNA, 17 nt, Homo sapiens
ugcaccaggagacagac

SEQ ID NO: 829761 - RNA, 15 nt, Homo sapiens
ugcacuguccugcuc

SEQ ID NO: 829762 - RNA, 23 nt, Homo sapiens
ugcacuguccugcuccacagugu

SEQ ID NO: 829763 - RNA, 23 nt, Homo sapiens
ugcagcugggccccaugcucugc

SEQ ID NO: 829764 - RNA, 16 nt, Homo sapiens
ugcagugcugagauag

SEQ ID NO: 829765 - RNA, 14 nt, Homo sapiens
ugcaguuccaucag

SEQ ID NO: 829766 - RNA, 18 nt, Homo sapiens
ugcaugcauacacaccca

SEQ ID NO: 829767 - RNA, 19 nt, Homo sapiens
ugcauguaauacacaguga

SEQ ID NO: 829768 - RNA, 15 nt, Homo sapiens
ugcauuuaugaugca

SEQ ID NO: 829769 - RNA, 14 nt, Homo sapiens
ugccaaaacaaugc

SEQ ID NO: 829770 - RNA, 18 nt, Homo sapiens
ugcccgaccccaucucau

SEQ ID NO: 829771 - RNA, 24 nt, Homo sapiens
ugcccggcgcccucuguccugacu

SEQ ID NO: 829772 - RNA, 19 nt, Homo sapiens
ugccugggccugugcagca

SEQ ID NO: 829773 - RNA, 16 nt, Homo sapiens
ugccuuccaacugcca

SEQ ID NO: 829774 - RNA, 16 nt, Homo sapiens
ugccuugccaugucuu

SEQ ID NO: 829775 - RNA, 21 nt, Homo sapiens
ugccuuugggaggcagcauca

SEQ ID NO: 829776 - RNA, 22 nt, Homo sapiens
ugcguaggagagaacagggaug

SEQ ID NO: 829777 - RNA, 10 nt, Homo sapiens
ugcugccuaa

SEQ ID NO: 829778 - RNA, 18 nt, Homo sapiens
ugcuguagacauuugcua

SEQ ID NO: 829779 - RNA, 18 nt, Homo sapiens
ugcuguauccauccaugg

SEQ ID NO: 829780 - RNA, 12 nt, Homo sapiens
ugcuucacauaa

SEQ ID NO: 829781 - RNA, 16 nt, Homo sapiens
ugcuugcccgcuccca

SEQ ID NO: 829782 - RNA, 15 nt, Homo sapiens
uggaagcacaugugu

SEQ ID NO: 829783 - RNA, 21 nt, Homo sapiens
uggaauacuugaaaaccucau

SEQ ID NO: 829784 - RNA, 18 nt, Homo sapiens
uggauuuugcauguaaua

SEQ ID NO: 829785 - RNA, 15 nt, Homo sapiens
uggcaaagugcugua

SEQ ID NO: 829786 - RNA, 15 nt, Homo sapiens
uggcaagcagggaaa

SEQ ID NO: 829787 - RNA, 14 nt, Homo sapiens
uggcccuaugcuuc

SEQ ID NO: 829788 - RNA, 21 nt, Homo sapiens
uggccuauuuuggacguguga

SEQ ID NO: 829789 - RNA, 15 nt, Homo sapiens
ugggaacuccacucu

SEQ ID NO: 829790 - RNA, 22 nt, Homo sapiens
ugggccacucaggggucauuca

SEQ ID NO: 829791 - RNA, 14 nt, Homo sapiens
ugggcgugcuaccu

SEQ ID NO: 829792 - RNA, 14 nt, Homo sapiens
ugguauauuuccau

SEQ ID NO: 829793 - RNA, 20 nt, Homo sapiens
ugguaugaacuugaggacac

SEQ ID NO: 829794 - RNA, 21 nt, Homo sapiens
uggucccaaguaguagugucu

SEQ ID NO: 829795 - RNA, 14 nt, Homo sapiens
uguaaaaauacugu

SEQ ID NO: 829796 - RNA, 20 nt, Homo sapiens
uguaaaauaaguauuuccau

SEQ ID NO: 829797 - RNA, 20 nt, Homo sapiens
uguaagcaacuugcuucuaa

SEQ ID NO: 829798 - RNA, 18 nt, Homo sapiens
uguaauuuaaaauuguga

SEQ ID NO: 829799 - RNA, 11 nt, Homo sapiens
uguacauauau

SEQ ID NO: 829800 - RNA, 17 nt, Homo sapiens
uguacauuugagugucu

SEQ ID NO: 829801 - RNA, 16 nt, Homo sapiens
uguagaauaaaugaag

SEQ ID NO: 829802 - RNA, 21 nt, Homo sapiens
uguagaauucgcagugauaua

SEQ ID NO: 829803 - RNA, 22 nt, Homo sapiens
uguauaaugguguuacuaaagu

SEQ ID NO: 829804 - RNA, 16 nt, Homo sapiens
uguauuaauaccaaag

SEQ ID NO: 829805 - RNA, 15 nt, Homo sapiens
ugucccagaaaagca

SEQ ID NO: 829806 - RNA, 16 nt, Homo sapiens
ugucccagaaugccuc

SEQ ID NO: 829807 - RNA, 21 nt, Homo sapiens
ugucccagaaugccuccugca

SEQ ID NO: 829808 - RNA, 12 nt, Homo sapiens
ugucucucauga

SEQ ID NO: 829809 - RNA, 22 nt, Homo sapiens
ugucuuauagguuuccacugcc

SEQ ID NO: 829810 - RNA, 23 nt, Homo sapiens
ugugaaggaauuauucccaugag

SEQ ID NO: 829811 - RNA, 16 nt, Homo sapiens
ugugauggcaaagaag

SEQ ID NO: 829812 - RNA, 21 nt, Homo sapiens
ugugccauguuauucagcuca

SEQ ID NO: 829813 - RNA, 20 nt, Homo sapiens
uguuaggccuggcacagugu

SEQ ID NO: 829814 - RNA, 15 nt, Homo sapiens
uguucccuugaccau

SEQ ID NO: 829815 - RNA, 21 nt, Homo sapiens
uguucuguccaguuuccaaag

SEQ ID NO: 829816 - RNA, 23 nt, Homo sapiens
uguucuucauuaccucagugaga

SEQ ID NO: 829817 - RNA, 16 nt, Homo sapiens
uguugcacaucauuca

SEQ ID NO: 829818 - RNA, 12 nt, Homo sapiens
uguuuacuuaag

SEQ ID NO: 829819 - RNA, 19 nt, Homo sapiens
uguuuagaacuacugauaa

SEQ ID NO: 829820 - RNA, 16 nt, Homo sapiens
uguuuuccacugugcu

SEQ ID NO: 829821 - RNA, 18 nt, Homo sapiens
uuaaaaguccacuuuuaa

SEQ ID NO: 829822 - RNA, 11 nt, Homo sapiens
uuaaaauggaa

SEQ ID NO: 829823 - RNA, 21 nt, Homo sapiens
uuaaaaugugagugaccucac

SEQ ID NO: 829824 - RNA, 14 nt, Homo sapiens
uuaacaacugugaa

SEQ ID NO: 829825 - RNA, 13 nt, Homo sapiens
uuaacgacaauuu

SEQ ID NO: 829826 - RNA, 23 nt, Homo sapiens
uuaagacuucuggucauuuccaa

SEQ ID NO: 829827 - RNA, 12 nt, Homo sapiens
uuaauaccaaag

SEQ ID NO: 829828 - RNA, 20 nt, Homo sapiens
uuaauacugacucagugucu

SEQ ID NO: 829829 - RNA, 14 nt, Homo sapiens
uuaauacuguguua

SEQ ID NO: 829830 - RNA, 15 nt, Homo sapiens
uuaauuuuauuccag

SEQ ID NO: 829831 - RNA, 16 nt, Homo sapiens
uuaauuuuauuccagu

SEQ ID NO: 829832 - RNA, 15 nt, Homo sapiens
uuaauuuucuaugaa

SEQ ID NO: 829833 - RNA, 17 nt, Homo sapiens
uuacauuuuccugugua

SEQ ID NO: 829834 - RNA, 17 nt, Homo sapiens
uaccuggcaauucacaa

SEQ ID NO: 829835 - RNA, 19 nt, Homo sapiens
uaccuggcccugugccuug

SEQ ID NO: 829836 - RNA, 14 nt, Homo sapiens
uaccuucuaccucu

SEQ ID NO: 829837 - RNA, 16 nt, Homo sapiens
uacuccaugcacauag

SEQ ID NO: 829838 - RNA, 14 nt, Homo sapiens
uacucuguccaggc

SEQ ID NO: 829839 - RNA, 17 nt, Homo sapiens
uacucuuucacucaggc

SEQ ID NO: 829840 - RNA, 20 nt, Homo sapiens
uacugagacaugacuaggaa

SEQ ID NO: 829841 - RNA, 16 nt, Homo sapiens
uacuuguaaaggugcu

SEQ ID NO: 829842 - RNA, 13 nt, Homo sapiens
uagaagacaauuu

SEQ ID NO: 829843 - RNA, 17 nt, Homo sapiens
uagaaucaagucuguga

SEQ ID NO: 829844 - RNA, 23 nt, Homo sapiens
uagaauuuuuugagagaaugaga

SEQ ID NO: 829845 - RNA, 12 nt, Homo sapiens
uagaggagcaac

SEQ ID NO: 829846 - RNA, 19 nt, Homo sapiens
uagcaaagaagcuucaugc

SEQ ID NO: 829847 - RNA, 18 nt, Homo sapiens
uagcaccuccacauaccu

SEQ ID NO: 829848 - RNA, 13 nt, Homo sapiens
uagcauauauaau

SEQ ID NO: 829849 - RNA, 22 nt, Homo sapiens
uagcauguucguauuacaagag

SEQ ID NO: 829850 - RNA, 15 nt, Homo sapiens
uagccuuugucccag

SEQ ID NO: 829851 - RNA, 17 nt, Homo sapiens
uaggaaggcagcauucc

SEQ ID NO: 829852 - RNA, 23 nt, Homo sapiens
uaggacuggguuccccacaguga

SEQ ID NO: 829853 - RNA, 17 nt, Homo sapiens
uaggccuggcacagugu

SEQ ID NO: 829854 - RNA, 17 nt, Homo sapiens
uaggguccuggcccucu

SEQ ID NO: 829855 - RNA, 19 nt, Homo sapiens
uaguucuuacuacuugcca

SEQ ID NO: 829856 - RNA, 22 nt, Homo sapiens
uauaaacauugguauauuucca

SEQ ID NO: 829857 - RNA, 23 nt, Homo sapiens
uauaaacauugguauauuuccau

SEQ ID NO: 829858 - RNA, 18 nt, Homo sapiens
uauauaauuuuauugcug

SEQ ID NO: 829859 - RNA, 17 nt, Homo sapiens
uauauaguuugugguaa

SEQ ID NO: 829860 - RNA, 19 nt, Homo sapiens
uauauauucuacacauaua

SEQ ID NO: 829861 - RNA, 17 nt, Homo sapiens
uauauuuccauucaugc

SEQ ID NO: 829862 - RNA, 21 nt, Homo sapiens
uauauuuucugaguagcauau

SEQ ID NO: 829863 - RNA, 18 nt, Homo sapiens
uaucaccucuuaugcaca

SEQ ID NO: 829864 - RNA, 13 nt, Homo sapiens
uaucuguacugaa

SEQ ID NO: 829865 - RNA, 13 nt, Homo sapiens
uaugaacuugagg

SEQ ID NO: 829866 - RNA, 23 nt, Homo sapiens
uaugagcuggggaugucucucau

SEQ ID NO: 829867 - RNA, 14 nt, Homo sapiens
uaugauacugaugc

SEQ ID NO: 829868 - RNA, 15 nt, Homo sapiens
uaugaugcaguuuca

SEQ ID NO: 829869 - RNA, 13 nt, Homo sapiens
uaugcacaccucc

SEQ ID NO: 829870 - RNA, 19 nt, Homo sapiens
uauggcauguguaguuaau

SEQ ID NO: 829871 - RNA, 19 nt, Homo sapiens
uauggcucuggcaccacua

SEQ ID NO: 829872 - RNA, 18 nt, Homo sapiens
uauggguuggacaaccuc

SEQ ID NO: 829873 - RNA, 20 nt, Homo sapiens
uauggguuggacaaccucau

SEQ ID NO: 829874 - RNA, 22 nt, Homo sapiens
uaugguaggaacugcugggcuu

SEQ ID NO: 829875 - RNA, 16 nt, Homo sapiens
uaugugcuucacauaa

SEQ ID NO: 829876 - RNA, 22 nt, Homo sapiens
uauguggaagugugggucugug

SEQ ID NO: 829877 - RNA, 18 nt, Homo sapiens
uauguuauuggaauuuuc

SEQ ID NO: 829878 - RNA, 18 nt, Homo sapiens
uauuagcaacugugcuac

SEQ ID NO: 829879 - RNA, 14 nt, Homo sapiens
uauucaaaugaagg

SEQ ID NO: 829880 - RNA, 15 nt, Homo sapiens
uauucaggcacugag

SEQ ID NO: 829881 - RNA, 20 nt, Homo sapiens
ucaaagggagagagugcuau

SEQ ID NO: 829882 - RNA, 22 nt, Homo sapiens
ucaaagggagagagugcuauug

SEQ ID NO: 829883 - RNA, 17 nt, Homo sapiens
ucaaccgcuugccauau

SEQ ID NO: 829884 - RNA, 16 nt, Homo sapiens
ucaagugaucuuucaa

SEQ ID NO: 829885 - RNA, 14 nt, Homo sapiens
ucaaugcaaugaaa

SEQ ID NO: 829886 - RNA, 14 nt, Homo sapiens
ucacauauaaaagu

SEQ ID NO: 829887 - RNA, 21 nt, Homo sapiens
ucaccaggggcaggcacagca

SEQ ID NO: 829888 - RNA, 17 nt, Homo sapiens
ucaccuuuucccgggga

SEQ ID NO: 829889 - RNA, 23 nt, Homo sapiens
ucacgugucuuuagaacuccagu

SEQ ID NO: 829890 - RNA, 14 nt, Homo sapiens
ucacuaauacuuac

SEQ ID NO: 829891 - RNA, 14 nt, Homo sapiens
ucacuucgaugacu

SEQ ID NO: 829892 - RNA, 14 nt, Homo sapiens
ucagagcugggaaa

SEQ ID NO: 829893 - RNA, 12 nt, Homo sapiens
ucagauuugccu

SEQ ID NO: 829894 - RNA, 18 nt, Homo sapiens
ucagcaaggggcucugcc

SEQ ID NO: 829895 - RNA, 19 nt, Homo sapiens
ucagcacguguggccuguu

SEQ ID NO: 829896 - RNA, 12 nt, Homo sapiens
ucagcaucucac

SEQ ID NO: 829897 - RNA, 14 nt, Homo sapiens
ucagcaucucacuu

SEQ ID NO: 829898 - RNA, 15 nt, Homo sapiens
ucaggcuucugagua

SEQ ID NO: 829899 - RNA, 16 nt, Homo sapiens
ucaguaaacaaaucag

SEQ ID NO: 829900 - RNA, 20 nt, Homo sapiens
ucaguaaauauuaaccugaa

SEQ ID NO: 829901 - RNA, 11 nt, Homo sapiens
ucaguaugugg

SEQ ID NO: 829902 - RNA, 16 nt, Homo sapiens
ucauaauccagagaua

SEQ ID NO: 829903 - RNA, 11 nt, Homo sapiens
ucauuaccuca

SEQ ID NO: 829904 - RNA, 17 nt, Homo sapiens
ucauugacuaaagccau

SEQ ID NO: 829905 - RNA, 18 nt, Homo sapiens
ucauuggcccucauucca

SEQ ID NO: 829906 - RNA, 23 nt, Homo sapiens
uccaaggaggucgggauggggcu

SEQ ID NO: 829907 - RNA, 22 nt, Homo sapiens
uccacaaccuccuccuccaguu

SEQ ID NO: 829908 - RNA, 20 nt, Homo sapiens
uccaccuaguggcuguccag

SEQ ID NO: 829909 - RNA, 13 nt, Homo sapiens
uccagcagcugcg

SEQ ID NO: 829910 - RNA, 14 nt, Homo sapiens
uccaggaaggcagc

SEQ ID NO: 829911 - RNA, 16 nt, Homo sapiens
uccaggaaggcagcug

SEQ ID NO: 829912 - RNA, 22 nt, Homo sapiens
uccagugggaggugagaccacc

SEQ ID NO: 829913 - RNA, 14 nt, Homo sapiens
uccaguucugauga

SEQ ID NO: 829914 - RNA, 20 nt, Homo sapiens
uccauucaugccaaagcaaa

SEQ ID NO: 829915 - RNA, 10 nt, Homo sapiens
ucccaaagaa

SEQ ID NO: 829916 - RNA, 11 nt, Homo sapiens
ucccagugucu

SEQ ID NO: 829917 - RNA, 17 nt, Homo sapiens
ucccaugguagacugug

SEQ ID NO: 829918 - RNA, 18 nt, Homo sapiens
ucccaugguagacuguga

SEQ ID NO: 829919 - RNA, 12 nt, Homo sapiens
uccccacaggga

SEQ ID NO: 829920 - RNA, 17 nt, Homo sapiens
ucccccgacacugcugc

SEQ ID NO: 829921 - RNA, 11 nt, Homo sapiens
ucccugggaag

SEQ ID NO: 829922 - RNA, 16 nt, Homo sapiens
ucccugucuccagggc

SEQ ID NO: 829923 - RNA, 15 nt, Homo sapiens
uccgcaccagcugcu

SEQ ID NO: 829924 - RNA, 19 nt, Homo sapiens
uccuagaggugggcagcug

SEQ ID NO: 829925 - RNA, 20 nt, Homo sapiens
uccuaugcuucgagccaugg

SEQ ID NO: 829926 - RNA, 18 nt, Homo sapiens
uccuccaguucugaugag

SEQ ID NO: 829927 - RNA, 17 nt, Homo sapiens
uccugcuccacaguguu

SEQ ID NO: 829928 - RNA, 16 nt, Homo sapiens
uccuggugauucugau

SEQ ID NO: 829929 - RNA, 13 nt, Homo sapiens
uccugucccucau

SEQ ID NO: 829930 - RNA, 19 nt, Homo sapiens
uccugucccucauccauag

SEQ ID NO: 829931 - RNA, 24 nt, Homo sapiens
uccuguugcaaugacacauaggaa

SEQ ID NO: 829932 - RNA, 22 nt, Homo sapiens
uccuuagccuuugucccagaau

SEQ ID NO: 829933 - RNA, 11 nt, Homo sapiens
uccuucuugcu

SEQ ID NO: 829934 - RNA, 21 nt, Homo sapiens
uccuugucguaggaaaaccau

SEQ ID NO: 829935 - RNA, 20 nt, Homo sapiens
ucgaaccaaggcagccucca

SEQ ID NO: 829936 - RNA, 23 nt, Homo sapiens
ucgagauguucgcucgugcagua

SEQ ID NO: 829937 - RNA, 13 nt, Homo sapiens
ucgauauaugacu

SEQ ID NO: 829938 - RNA, 14 nt, Homo sapiens
ucuaaaacucucaa

SEQ ID NO: 829939 - RNA, 19 nt, Homo sapiens
ucuaacauaugauacugau

SEQ ID NO: 829940 - RNA, 19 nt, Homo sapiens
ucuaagugguauauacaua

SEQ ID NO: 829941 - RNA, 14 nt, Homo sapiens
ucuaauccaugugc

SEQ ID NO: 829942 - RNA, 22 nt, Homo sapiens
ucuacuagaaccuucuaaucca

SEQ ID NO: 829943 - RNA, 17 nt, Homo sapiens
ucuacugagacaugacu

SEQ ID NO: 829944 - RNA, 18 nt, Homo sapiens
ucuacugagacaugacua

SEQ ID NO: 829945 - RNA, 19 nt, Homo sapiens
ucuagaauccccacaggga

SEQ ID NO: 829946 - RNA, 14 nt, Homo sapiens
ucuaugaucuuggc

SEQ ID NO: 829947 - RNA, 14 nt, Homo sapiens
ucucaauuugaaac

SEQ ID NO: 829948 - RNA, 16 nt, Homo sapiens
ucucagugcucuccua

SEQ ID NO: 829949 - RNA, 13 nt, Homo sapiens
ucuccacagggac

SEQ ID NO: 829950 - RNA, 16 nt, Homo sapiens
ucuccucccauggccu

SEQ ID NO: 829951 - RNA, 15 nt, Homo sapiens
ggcugcuggggcaug

SEQ ID NO: 829952 - RNA, 15 nt, Homo sapiens
ggcuucccaggggaa

SEQ ID NO: 829953 - RNA, 14 nt, Homo sapiens
ggcuuugggguccu

SEQ ID NO: 829954 - RNA, 16 nt, Homo sapiens
gggacuccaguucaca

SEQ ID NO: 829955 - RNA, 16 nt, Homo sapiens
gggagagagugcuauu

SEQ ID NO: 829956 - RNA, 14 nt, Homo sapiens
gggaguguguaauu

SEQ ID NO: 829957 - RNA, 15 nt, Homo sapiens
gggaguguugucaca

SEQ ID NO: 829958 - RNA, 23 nt, Homo sapiens
gggcaaagaacugccccaucucc

SEQ ID NO: 829959 - RNA, 21 nt, Homo sapiens
gggcacggcuucccaggggaa

SEQ ID NO: 829960 - RNA, 21 nt, Homo sapiens
gggcagaauaaauaagcaaaa

SEQ ID NO: 829961 - RNA, 22 nt, Homo sapiens
gggcugcccgcucccagugucu

SEQ ID NO: 829962 - RNA, 15 nt, Homo sapiens
ggggagcaugggacu

SEQ ID NO: 829963 - RNA, 13 nt, Homo sapiens
ggggcucucucau

SEQ ID NO: 829964 - RNA, 16 nt, Homo sapiens
gggggaagagcacagc

SEQ ID NO: 829965 - RNA, 13 nt, Homo sapiens
gguauauuuccau

SEQ ID NO: 829966 - RNA, 20 nt, Homo sapiens
gguccugcaaucuccagggc

SEQ ID NO: 829967 - RNA, 22 nt, Homo sapiens
ggugcgaucuuggcucacugca

SEQ ID NO: 829968 - RNA, 12 nt, Homo sapiens
ggugcguggcug

SEQ ID NO: 829969 - RNA, 17 nt, Homo sapiens
gguuccccacagugaca

SEQ ID NO: 829970 - RNA, 11 nt, Homo sapiens
gguucucaggc

SEQ ID NO: 829971 - RNA, 12 nt, Homo sapiens
gguugaaggcag

SEQ ID NO: 829972 - RNA, 11 nt, Homo sapiens
gguugcaacaa

SEQ ID NO: 829973 - RNA, 13 nt, Homo sapiens
gguuuagaaucaa

SEQ ID NO: 829974 - RNA, 14 nt, Homo sapiens
gguuuuuccagcua

SEQ ID NO: 829975 - RNA, 15 nt, Homo sapiens
guaaaggccuuuaau

SEQ ID NO: 829976 - RNA, 16 nt, Homo sapiens
guaaauagaugacaaa

SEQ ID NO: 829977 - RNA, 14 nt, Homo sapiens
guaagcaacuugcu

SEQ ID NO: 829978 - RNA, 21 nt, Homo sapiens
guaaugcacauccucauucac

SEQ ID NO: 829979 - RNA, 15 nt, Homo sapiens
guacucucugcucua

SEQ ID NO: 829980 - RNA, 16 nt, Homo sapiens
guagacauuugcuaug

SEQ ID NO: 829981 - RNA, 14 nt, Homo sapiens
guagauaacagcuu

SEQ ID NO: 829982 - RNA, 14 nt, Homo sapiens
guaguagugucuuc

SEQ ID NO: 829983 - RNA, 17 nt, Homo sapiens
guauaguaaucauugac

SEQ ID NO: 829984 - RNA, 15 nt, Homo sapiens
guaucuucacacucu

SEQ ID NO: 829985 - RNA, 22 nt, Homo sapiens
guauguuuuaauugcauuuaaa

SEQ ID NO: 829986 - RNA, 14 nt, Homo sapiens
guauuaauaccaaa

SEQ ID NO: 829987 - RNA, 16 nt, Homo sapiens
gucaucuguaccucug

SEQ ID NO: 829988 - RNA, 19 nt, Homo sapiens
guccacccaggcugcacug

SEQ ID NO: 829989 - RNA, 21 nt, Homo sapiens
guccacccaggcugcacugca

SEQ ID NO: 829990 - RNA, 18 nt, Homo sapiens
guccacucucggggcccu

SEQ ID NO: 829991 - RNA, 11 nt, Homo sapiens
guccaucucau

SEQ ID NO: 829992 - RNA, 14 nt, Homo sapiens
guccgcaccagcug

SEQ ID NO: 829993 - RNA, 20 nt, Homo sapiens
guccucaccugguugaccca

SEQ ID NO: 829994 - RNA, 13 nt, Homo sapiens
guccuuccugugc

SEQ ID NO: 829995 - RNA, 22 nt, Homo sapiens
guccuuccugugcccugcaaau

SEQ ID NO: 829996 - RNA, 20 nt, Homo sapiens
guccuuuuauaaacauuggu

SEQ ID NO: 829997 - RNA, 16 nt, Homo sapiens
gucugggccacucagg

SEQ ID NO: 829998 - RNA, 22 nt, Homo sapiens
gucugugaaagucuccuguauc

SEQ ID NO: 829999 - RNA, 19 nt, Homo sapiens
gucuguguguuuaugugug

SEQ ID NO: 830000 - RNA, 17 nt, Homo sapiens
gugaggggcucucucau

SEQ ID NO: 830001 - RNA, 13 nt, Homo sapiens
gugccugcugcug

SEQ ID NO: 830002 - RNA, 18 nt, Homo sapiens
gugccuuggugugcugua

SEQ ID NO: 830003 - RNA, 17 nt, Homo sapiens
gugcuacacuugcaccu

SEQ ID NO: 830004 - RNA, 17 nt, Homo sapiens
guggaaggcagugaaca

SEQ ID NO: 830005 - RNA, 12 nt, Homo sapiens
guggacaccugc

SEQ ID NO: 830006 - RNA, 14 nt, Homo sapiens
guggcaucaggaaa

SEQ ID NO: 830007 - RNA, 14 nt, Homo sapiens
guggccuuccccuu

SEQ ID NO: 830008 - RNA, 16 nt, Homo sapiens
gugggucccacuuccc

SEQ ID NO: 830009 - RNA, 17 nt, Homo sapiens
gugggucccacuucccc

SEQ ID NO: 830010 - RNA, 18 nt, Homo sapiens
gugguagaaauuuuuacc

SEQ ID NO: 830011 - RNA, 11 nt, Homo sapiens
guggucauuuc

SEQ ID NO: 830012 - RNA, 18 nt, Homo sapiens
guguaaagaauaaaugaa

SEQ ID NO: 830013 - RNA, 13 nt, Homo sapiens
gugucacccuuag

SEQ ID NO: 830014 - RNA, 16 nt, Homo sapiens
guguucaguaaacaaa

SEQ ID NO: 830015 - RNA, 23 nt, Homo sapiens
guguucuucauuaccucagugag

SEQ ID NO: 830016 - RNA, 16 nt, Homo sapiens
guucgcucgugcagua

SEQ ID NO: 830017 - RNA, 13 nt, Homo sapiens
guucguauuacaa

SEQ ID NO: 830018 - RNA, 16 nt, Homo sapiens
guucugguaugaacuu

SEQ ID NO: 830019 - RNA, 18 nt, Homo sapiens
guucuuacuacuugccac

SEQ ID NO: 830020 - RNA, 23 nt, Homo sapiens
guugaaaacuuaaggaagcaaau

SEQ ID NO: 830021 - RNA, 16 nt, Homo sapiens
guugcacaucauucau

SEQ ID NO: 830022 - RNA, 19 nt, Homo sapiens
guugcauuuaugaugcagu

SEQ ID NO: 830023 - RNA, 15 nt, Homo sapiens
guugucacaccugaa

SEQ ID NO: 830024 - RNA, 22 nt, Homo sapiens
guuuaacugggagugauaugau

SEQ ID NO: 830025 - RNA, 21 nt, Homo sapiens
guuuagaaucaagucugugaa

SEQ ID NO: 830026 - RNA, 22 nt, Homo sapiens
guuuguaaguggauucaguuca

SEQ ID NO: 830027 - RNA, 13 nt, Homo sapiens
guuuuuucacaua

SEQ ID NO: 830028 - RNA, 23 nt, Homo sapiens
guuuuuuuagaagacaauuuuca

SEQ ID NO: 830029 - RNA, 20 nt, Homo sapiens
uaaaaauacuguuucacuaa

SEQ ID NO: 830030 - RNA, 23 nt, Homo sapiens
uaaaagaaaaaguaugugaauau

SEQ ID NO: 830031 - RNA, 12 nt, Homo sapiens
uaaaaugccaag

SEQ ID NO: 830032 - RNA, 14 nt, Homo sapiens
uaaaauucuuggga

SEQ ID NO: 830033 - RNA, 14 nt, Homo sapiens
uaaacaugcuugca

SEQ ID NO: 830034 - RNA, 18 nt, Homo sapiens
uaaacuugacccaggugg

SEQ ID NO: 830035 - RNA, 17 nt, Homo sapiens
uaaagaauaaaugaauc

SEQ ID NO: 830036 - RNA, 19 nt, Homo sapiens
uaaagaauaaaugaaucuu

SEQ ID NO: 830037 - RNA, 19 nt, Homo sapiens
uaaagcucugaacaaaagc

SEQ ID NO: 830038 - RNA, 13 nt, Homo sapiens
uaaagcugcugag

SEQ ID NO: 830039 - RNA, 17 nt, Homo sapiens
uaaaggugcugcacugg

SEQ ID NO: 830040 - RNA, 13 nt, Homo sapiens
uaaauacaaaagg

SEQ ID NO: 830041 - RNA, 15 nt, Homo sapiens
uaaauauaaguaaug

SEQ ID NO: 830042 - RNA, 13 nt, Homo sapiens
uaaaugacaauuu

SEQ ID NO: 830043 - RNA, 13 nt, Homo sapiens
uaaaugcccaguu

SEQ ID NO: 830044 - RNA, 21 nt, Homo sapiens
uaaauguugcacaucauucau

SEQ ID NO: 830045 - RNA, 21 nt, Homo sapiens
uaaauuuaugguucucaggcc

SEQ ID NO: 830046 - RNA, 15 nt, Homo sapiens
uaacaaaaguauagu

SEQ ID NO: 830047 - RNA, 17 nt, Homo sapiens
uaaccugaauuauucca

SEQ ID NO: 830048 - RNA, 22 nt, Homo sapiens
uaacuuuaggaaccaccauauu

SEQ ID NO: 830049 - RNA, 16 nt, Homo sapiens
uaagcaaaaugccaaa

SEQ ID NO: 830050 - RNA, 12 nt, Homo sapiens
uaaguauuucca

SEQ ID NO: 830051 - RNA, 13 nt, Homo sapiens
uaaguucuaucag

SEQ ID NO: 830052 - RNA, 21 nt, Homo sapiens
uaauaucugagaaguguauau

SEQ ID NO: 830053 - RNA, 17 nt, Homo sapiens
uaaucucacuucaucaa

SEQ ID NO: 830054 - RNA, 18 nt, Homo sapiens
uaaugaagacccagugua

SEQ ID NO: 830055 - RNA, 19 nt, Homo sapiens
uaaugcacauccucauuca

SEQ ID NO: 830056 - RNA, 16 nt, Homo sapiens
uaauguaauacuguag

SEQ ID NO: 830057 - RNA, 17 nt, Homo sapiens
uaauucaucaaguaauc

SEQ ID NO: 830058 - RNA, 23 nt, Homo sapiens
uaauuccacacccucacugcugu

SEQ ID NO: 830059 - RNA, 23 nt, Homo sapiens
uaauugugaauaaaaauugauga

SEQ ID NO: 830060 - RNA, 22 nt, Homo sapiens
uacaagagaaacaaauaaacua

SEQ ID NO: 830061 - RNA, 19 nt, Homo sapiens
uacagaaugaaucccauaa

SEQ ID NO: 830062 - RNA, 14 nt, Homo sapiens
uacaucuucauuaa

SEQ ID NO: 830063 - RNA, 23 nt, Homo sapiens
uaccaacagcuuuucccaggaga

SEQ ID NO: 830064 - RNA, 21 nt, Homo sapiens
uacccauagguaauacaaaaa

SEQ ID NO: 830065 - RNA, 17 nt, Homo sapiens
uaccccaccucaugccu

SEQ ID NO: 830066 - RNA, 15 nt, Homo sapiens
uacccucccaccaga

SEQ ID NO: 830067 - RNA, 19 nt, Homo sapiens
uaccucuuggcugccuugu

SEQ ID NO: 830068 - RNA, 13 nt, Homo sapiens
uaccugagcauuc

SEQ ID NO: 830069 - RNA, 12 nt, Homo sapiens
gaauuacacuaa

SEQ ID NO: 830070 - RNA, 16 nt, Homo sapiens
gacaaccucauuuuaa

SEQ ID NO: 830071 - RNA, 15 nt, Homo sapiens
gacagaaaugcaauc

SEQ ID NO: 830072 - RNA, 17 nt, Homo sapiens
gacagaagaucuauauu

SEQ ID NO: 830073 - RNA, 15 nt, Homo sapiens
gacaugacuaggaag

SEQ ID NO: 830074 - RNA, 19 nt, Homo sapiens
gaccaccucucaauauuca

SEQ ID NO: 830075 - RNA, 14 nt, Homo sapiens
gaccuguugggagu

SEQ ID NO: 830076 - RNA, 19 nt, Homo sapiens
gacgugagugugacuuuuu

SEQ ID NO: 830077 - RNA, 15 nt, Homo sapiens
gacgugugaggaugu

SEQ ID NO: 830078 - RNA, 23 nt, Homo sapiens
gacuccagaaucugcuguugcca

SEQ ID NO: 830079 - RNA, 21 nt, Homo sapiens
gacuccgggcacggcuuccca

SEQ ID NO: 830080 - RNA, 12 nt, Homo sapiens
gacuuaucaaca

SEQ ID NO: 830081 - RNA, 16 nt, Homo sapiens
gacuuccuggggcccc

SEQ ID NO: 830082 - RNA, 23 nt, Homo sapiens
gagaaauacagaagaaaauaaua

SEQ ID NO: 830083 - RNA, 16 nt, Homo sapiens
gagaacagggaugcua

SEQ ID NO: 830084 - RNA, 20 nt, Homo sapiens
gagacagacagagaaggcag

SEQ ID NO: 830085 - RNA, 21 nt, Homo sapiens
gagagaacagggaugcuaucu

SEQ ID NO: 830086 - RNA, 20 nt, Homo sapiens
gagagggggcucuccaaagg

SEQ ID NO: 830087 - RNA, 19 nt, Homo sapiens
gagauggggucuugcuaua

SEQ ID NO: 830088 - RNA, 21 nt, Homo sapiens
gagcagcuucugccacuuccc

SEQ ID NO: 830089 - RNA, 13 nt, Homo sapiens
gagcaggguccug

SEQ ID NO: 830090 - RNA, 13 nt, Homo sapiens
gagccacuaccuu

SEQ ID NO: 830091 - RNA, 21 nt, Homo sapiens
gagcuuaaagauaguuacaaa

SEQ ID NO: 830092 - RNA, 16 nt, Homo sapiens
gaggagacccuggaau

SEQ ID NO: 830093 - RNA, 16 nt, Homo sapiens
gaggccucucauucca

SEQ ID NO: 830094 - RNA, 17 nt, Homo sapiens
gaggucgggauggggcu

SEQ ID NO: 830095 - RNA, 16 nt, Homo sapiens
gaggugagaccaccuc

SEQ ID NO: 830096 - RNA, 11 nt, Homo sapiens
gagugaccuca

SEQ ID NO: 830097 - RNA, 20 nt, Homo sapiens
gagugggguagguugggaga

SEQ ID NO: 830098 - RNA, 15 nt, Homo sapiens
gagugguuguugcca

SEQ ID NO: 830099 - RNA, 21 nt, Homo sapiens
gauaaaucaguuaugucaauu

SEQ ID NO: 830100 - RNA, 13 nt, Homo sapiens
gauagcaggugaa

SEQ ID NO: 830101 - RNA, 20 nt, Homo sapiens
gauaucaguuaucaauguua

SEQ ID NO: 830102 - RNA, 18 nt, Homo sapiens
gaucauuaucagccugug

SEQ ID NO: 830103 - RNA, 18 nt, Homo sapiens
gaucauugguaucugaua

SEQ ID NO: 830104 - RNA, 17 nt, Homo sapiens
gaucuguguuuacuuaa

SEQ ID NO: 830105 - RNA, 13 nt, Homo sapiens
gauguguggacac

SEQ ID NO: 830106 - RNA, 19 nt, Homo sapiens
gauguucgcucgugcagua

SEQ ID NO: 830107 - RNA, 17 nt, Homo sapiens
gauguuuuguacuuaca

SEQ ID NO: 830108 - RNA, 15 nt, Homo sapiens
gauuccccuggacau

SEQ ID NO: 830109 - RNA, 17 nt, Homo sapiens
gauuccccuggacauau

SEQ ID NO: 830110 - RNA, 21 nt, Homo sapiens
gauuuauuaauuaaaccagac

SEQ ID NO: 830111 - RNA, 20 nt, Homo sapiens
gauuuuuguuuuccacugug

SEQ ID NO: 830112 - RNA, 16 nt, Homo sapiens
gcaaagagaaaagcca

SEQ ID NO: 830113 - RNA, 13 nt, Homo sapiens
gcaaagugcugua

SEQ ID NO: 830114 - RNA, 21 nt, Homo sapiens
gcaccaucauuuaaugugaca

SEQ ID NO: 830115 - RNA, 22 nt, Homo sapiens
gcaccaucauuuaaugugacag

SEQ ID NO: 830116 - RNA, 18 nt, Homo sapiens
gcacccaugccauagaaa

SEQ ID NO: 830117 - RNA, 22 nt, Homo sapiens
gcaggauccgcugccaccacgu

SEQ ID NO: 830118 - RNA, 14 nt, Homo sapiens
gcagggauucuucc

SEQ ID NO: 830119 - RNA, 21 nt, Homo sapiens
gcagugacuuuagaaacaaau

SEQ ID NO: 830120 - RNA, 19 nt, Homo sapiens
gcagugggucccacuuccc

SEQ ID NO: 830121 - RNA, 18 nt, Homo sapiens
gcaguuucaaguaccaaa

SEQ ID NO: 830122 - RNA, 18 nt, Homo sapiens
gcauccagccuguguguu

SEQ ID NO: 830123 - RNA, 16 nt, Homo sapiens
gcauguguaguuaauu

SEQ ID NO: 830124 - RNA, 15 nt, Homo sapiens
gcauuaaagugcugu

SEQ ID NO: 830125 - RNA, 15 nt, Homo sapiens
gcauuuaugaugcag

SEQ ID NO: 830126 - RNA, 17 nt, Homo sapiens
gcauuuaugaugcaguu

SEQ ID NO: 830127 - RNA, 16 nt, Homo sapiens
gccacuguggccagag

SEQ ID NO: 830128 - RNA, 14 nt, Homo sapiens
gccauagccccaua

SEQ ID NO: 830129 - RNA, 22 nt, Homo sapiens
gccaugcucaaccccccuccca

SEQ ID NO: 830130 - RNA, 20 nt, Homo sapiens
gcccagacucaaggccucca

SEQ ID NO: 830131 - RNA, 17 nt, Homo sapiens
gcccaggccaucuucca

SEQ ID NO: 830132 - RNA, 17 nt, Homo sapiens
gcccaggcuggucuuga

SEQ ID NO: 830133 - RNA, 18 nt, Homo sapiens
gcccaucucaggugccac

SEQ ID NO: 830134 - RNA, 14 nt, Homo sapiens
gccccagaucugcc

SEQ ID NO: 830135 - RNA, 23 nt, Homo sapiens
gccccgaaccucaccugaccuca

SEQ ID NO: 830136 - RNA, 16 nt, Homo sapiens
gcccgaccccaucuca

SEQ ID NO: 830137 - RNA, 14 nt, Homo sapiens
gcccuuguccugcc

SEQ ID NO: 830138 - RNA, 13 nt, Homo sapiens
gccgcccaaagag

SEQ ID NO: 830139 - RNA, 21 nt, Homo sapiens
gccuaggaguugaguacagug

SEQ ID NO: 830140 - RNA, 19 nt, Homo sapiens
gccuccacucccacuuccc

SEQ ID NO: 830141 - RNA, 14 nt, Homo sapiens
gccucccacaguga

SEQ ID NO: 830142 - RNA, 14 nt, Homo sapiens
gccugggacccagc

SEQ ID NO: 830143 - RNA, 22 nt, Homo sapiens
gcuaaaaugaaaaauagugugu

SEQ ID NO: 830144 - RNA, 14 nt, Homo sapiens
gcuaagccugauga

SEQ ID NO: 830145 - RNA, 15 nt, Homo sapiens
gcuaagccugaugau

SEQ ID NO: 830146 - RNA, 15 nt, Homo sapiens
gcuacacuugcaccu

SEQ ID NO: 830147 - RNA, 18 nt, Homo sapiens
gcuaugguucucucgcaa

SEQ ID NO: 830148 - RNA, 15 nt, Homo sapiens
gcuauuguagagcca

SEQ ID NO: 830149 - RNA, 20 nt, Homo sapiens
gcucacagcuggaacccugg

SEQ ID NO: 830150 - RNA, 22 nt, Homo sapiens
gcuccuuggcacccccaugcug

SEQ ID NO: 830151 - RNA, 19 nt, Homo sapiens
gcucuacccugaguucaua

SEQ ID NO: 830152 - RNA, 22 nt, Homo sapiens
gcucuggcaccacuaggguccu

SEQ ID NO: 830153 - RNA, 16 nt, Homo sapiens
gcugaauuccuuuaca

SEQ ID NO: 830154 - RNA, 18 nt, Homo sapiens
gcugacuuguaucuucag

SEQ ID NO: 830155 - RNA, 18 nt, Homo sapiens
gcugaggccucucauucc

SEQ ID NO: 830156 - RNA, 21 nt, Homo sapiens
gcugccaccacgucugccagg

SEQ ID NO: 830157 - RNA, 12 nt, Homo sapiens
gcugccuaauaa

SEQ ID NO: 830158 - RNA, 20 nt, Homo sapiens
gcugcugagaaucuagccuc

SEQ ID NO: 830159 - RNA, 19 nt, Homo sapiens
gcuguagacauuugcuaug

SEQ ID NO: 830160 - RNA, 17 nt, Homo sapiens
gcuguauccauccaugg

SEQ ID NO: 830161 - RNA, 21 nt, Homo sapiens
gcuguguuacuaaugaucacu

SEQ ID NO: 830162 - RNA, 16 nt, Homo sapiens
gcuucugccacuuccc

SEQ ID NO: 830163 - RNA, 18 nt, Homo sapiens
ggaaaaaggcuucuccac

SEQ ID NO: 830164 - RNA, 19 nt, Homo sapiens
ggaaaguuugggaagggau

SEQ ID NO: 830165 - RNA, 14 nt, Homo sapiens
ggaagagggcagua

SEQ ID NO: 830166 - RNA, 13 nt, Homo sapiens
ggaagggacacca

SEQ ID NO: 830167 - RNA, 16 nt, Homo sapiens
ggaauuauucccauga

SEQ ID NO: 830168 - RNA, 16 nt, Homo sapiens
ggacaaccucauuuua

SEQ ID NO: 830169 - RNA, 21 nt, Homo sapiens
ggagagagcagcuucugccac

SEQ ID NO: 830170 - RNA, 23 nt, Homo sapiens
ggaggucgggauggggcuuguag

SEQ ID NO: 830171 - RNA, 17 nt, Homo sapiens
ggauacagaaugaaucc

SEQ ID NO: 830172 - RNA, 14 nt, Homo sapiens
ggauccgcugccac

SEQ ID NO: 830173 - RNA, 20 nt, Homo sapiens
ggcacaaauuguacauuuga

SEQ ID NO: 830174 - RNA, 15 nt, Homo sapiens
ggcacccccaugcug

SEQ ID NO: 830175 - RNA, 18 nt, Homo sapiens
ggcagcaucagggacaca

SEQ ID NO: 830176 - RNA, 22 nt, Homo sapiens
ggcagucugaacccuugugcuu

SEQ ID NO: 830177 - RNA, 22 nt, Homo sapiens
ggcauccacccagugcugccau

SEQ ID NO: 830178 - RNA, 19 nt, Homo sapiens
ggccaagagcaucgugacc

SEQ ID NO: 830179 - RNA, 15 nt, Homo sapiens
ggccacacccaggaa

SEQ ID NO: 830180 - RNA, 17 nt, Homo sapiens
ggccacuguggccagag

SEQ ID NO: 830181 - RNA, 14 nt, Homo sapiens
ggccugacucucag

SEQ ID NO: 830182 - RNA, 19 nt, Homo sapiens
ggcuaaaugaaguguguua

SEQ ID NO: 830183 - RNA, 16 nt, Homo sapiens
ggcuccuggcugccag

SEQ ID NO: 830184 - RNA, 12 nt, Homo sapiens
ggcugagcucuu

SEQ ID NO: 830185 - RNA, 23 nt, Homo sapiens
ggcugccuccacucccacuuccc

SEQ ID NO: 830186 - RNA, 23 nt, Homo sapiens
cuagaagugguuuccugauaaca

SEQ ID NO: 830187 - RNA, 19 nt, Homo sapiens
cuaggaguugaguacagug

SEQ ID NO: 830188 - RNA, 17 nt, Homo sapiens
cuaguaauaauguaaua

SEQ ID NO: 830189 - RNA, 21 nt, Homo sapiens
cuaguaauaauguaauacugu

SEQ ID NO: 830190 - RNA, 23 nt, Homo sapiens
cuauccuaaaggcccacuggcau

SEQ ID NO: 830191 - RNA, 19 nt, Homo sapiens
cuaugagauggccaugcuc

SEQ ID NO: 830192 - RNA, 11 nt, Homo sapiens
cuaugguucuc

SEQ ID NO: 830193 - RNA, 14 nt, Homo sapiens
cuauguuguaauau

SEQ ID NO: 830194 - RNA, 16 nt, Homo sapiens
cuauuuuggacgugug

SEQ ID NO: 830195 - RNA, 17 nt, Homo sapiens
cuauuuuggacguguga

SEQ ID NO: 830196 - RNA, 17 nt, Homo sapiens
cucaacauuaccaaaau

SEQ ID NO: 830197 - RNA, 20 nt, Homo sapiens
cucaaggccucccacaguga

SEQ ID NO: 830198 - RNA, 18 nt, Homo sapiens
cucaauuugaaacacaag

SEQ ID NO: 830199 - RNA, 23 nt, Homo sapiens
cucagaucauuaucagccugugc

SEQ ID NO: 830200 - RNA, 16 nt, Homo sapiens
cucauuccaagcacuu

SEQ ID NO: 830201 - RNA, 14 nt, Homo sapiens
cucauuuuaacuca

SEQ ID NO: 830202 - RNA, 12 nt, Homo sapiens
cuccacauaccu

SEQ ID NO: 830203 - RNA, 16 nt, Homo sapiens
cuccaguucugaugag

SEQ ID NO: 830204 - RNA, 18 nt, Homo sapiens
cuccauugguguugacau

SEQ ID NO: 830205 - RNA, 22 nt, Homo sapiens
cuccauugguguugacauacau

SEQ ID NO: 830206 - RNA, 22 nt, Homo sapiens
cucccaccccggccuccacucc

SEQ ID NO: 830207 - RNA, 22 nt, Homo sapiens
cucccuauccuaaaggcccacu

SEQ ID NO: 830208 - RNA, 19 nt, Homo sapiens
cuccggggucugugcugug

SEQ ID NO: 830209 - RNA, 18 nt, Homo sapiens
cuccugucccucauccau

SEQ ID NO: 830210 - RNA, 14 nt, Homo sapiens
cucguccacagggg

SEQ ID NO: 830211 - RNA, 20 nt, Homo sapiens
cucuacucuggagguuuguu

SEQ ID NO: 830212 - RNA, 17 nt, Homo sapiens
cucuaugaucuuggcac

SEQ ID NO: 830213 - RNA, 22 nt, Homo sapiens
cucucaacauuaccaaaaucau

SEQ ID NO: 830214 - RNA, 11 nt, Homo sapiens
cucucucauga

SEQ ID NO: 830215 - RNA, 13 nt, Homo sapiens
cucuuaugcacac

SEQ ID NO: 830216 - RNA, 13 nt, Homo sapiens
cugaaccccaugg

SEQ ID NO: 830217 - RNA, 23 nt, Homo sapiens
cugaaucauccgaggcaaagaga

SEQ ID NO: 830218 - RNA, 22 nt, Homo sapiens
cugaauuuguaagcaacuugcu

SEQ ID NO: 830219 - RNA, 12 nt, Homo sapiens
cugacaccuacc

SEQ ID NO: 830220 - RNA, 22 nt, Homo sapiens
cugacccuaaauguggacauca

SEQ ID NO: 830221 - RNA, 14 nt, Homo sapiens
cugagaaucuagcc

SEQ ID NO: 830222 - RNA, 18 nt, Homo sapiens
cugagucccuccaugcaa

SEQ ID NO: 830223 - RNA, 20 nt, Homo sapiens
cugaguggaaugcagggaag

SEQ ID NO: 830224 - RNA, 21 nt, Homo sapiens
cugauggaccgggugggccug

SEQ ID NO: 830225 - RNA, 13 nt, Homo sapiens
cugauggccaagg

SEQ ID NO: 830226 - RNA, 20 nt, Homo sapiens
cugcacauuuuguacaaaga

SEQ ID NO: 830227 - RNA, 21 nt, Homo sapiens
cugcagcacuucacuaccaaa

SEQ ID NO: 830228 - RNA, 14 nt, Homo sapiens
cugcauguucugcu

SEQ ID NO: 830229 - RNA, 12 nt, Homo sapiens
cugccacuuccc

SEQ ID NO: 830230 - RNA, 15 nt, Homo sapiens
cugccagaacaugga

SEQ ID NO: 830231 - RNA, 23 nt, Homo sapiens
cugccaucauguuuacagaggac

SEQ ID NO: 830232 - RNA, 19 nt, Homo sapiens
cugcccgaccccaucucau

SEQ ID NO: 830233 - RNA, 22 nt, Homo sapiens
cugccuucuccccuccaaguga

SEQ ID NO: 830234 - RNA, 13 nt, Homo sapiens
cugccuugccaug

SEQ ID NO: 830235 - RNA, 21 nt, Homo sapiens
cuggagaaagggaaguggaag

SEQ ID NO: 830236 - RNA, 19 nt, Homo sapiens
cugggccccaugcucugcc

SEQ ID NO: 830237 - RNA, 18 nt, Homo sapiens
cuggguuccccacaguga

SEQ ID NO: 830238 - RNA, 20 nt, Homo sapiens
cuggguuggcgcacccuccc

SEQ ID NO: 830239 - RNA, 15 nt, Homo sapiens
cuguaacaauacugg

SEQ ID NO: 830240 - RNA, 21 nt, Homo sapiens
cuguccaggccacuguggcca

SEQ ID NO: 830241 - RNA, 15 nt, Homo sapiens
cuguccagugcccau

SEQ ID NO: 830242 - RNA, 19 nt, Homo sapiens
cugucccucauccauagca

SEQ ID NO: 830243 - RNA, 19 nt, Homo sapiens
cuguccugcuccacagugu

SEQ ID NO: 830244 - RNA, 13 nt, Homo sapiens
cugucuccagggc

SEQ ID NO: 830245 - RNA, 14 nt, Homo sapiens
cugucugucugucu

SEQ ID NO: 830246 - RNA, 16 nt, Homo sapiens
cugugccuaucaccuc

SEQ ID NO: 830247 - RNA, 15 nt, Homo sapiens
cuuaaaaaugcacac

SEQ ID NO: 830248 - RNA, 17 nt, Homo sapiens
cuuaaaagcuguucuca

SEQ ID NO: 830249 - RNA, 23 nt, Homo sapiens
cuuaaaggccuggaaccagggag

SEQ ID NO: 830250 - RNA, 20 nt, Homo sapiens
cuuaaucuccacuguuauuc

SEQ ID NO: 830251 - RNA, 19 nt, Homo sapiens
cuuaauggguacaauguac

SEQ ID NO: 830252 - RNA, 14 nt, Homo sapiens
cuucauuaccucag

SEQ ID NO: 830253 - RNA, 18 nt, Homo sapiens
cuucauuucucuugcuca

SEQ ID NO: 830254 - RNA, 13 nt, Homo sapiens
cuucccugacacu

SEQ ID NO: 830255 - RNA, 13 nt, Homo sapiens
cuuccucugguaa

SEQ ID NO: 830256 - RNA, 17 nt, Homo sapiens
cuucuccacaaccuccu

SEQ ID NO: 830257 - RNA, 23 nt, Homo sapiens
cuucuccacaaccuccuccucca

SEQ ID NO: 830258 - RNA, 17 nt, Homo sapiens
cuucuccccuccaagug

SEQ ID NO: 830259 - RNA, 18 nt, Homo sapiens
cuucuccccuccaaguga

SEQ ID NO: 830260 - RNA, 16 nt, Homo sapiens
cuucuggcacugugac

SEQ ID NO: 830261 - RNA, 13 nt, Homo sapiens
cuucuucuucuag

SEQ ID NO: 830262 - RNA, 17 nt, Homo sapiens
cuugaaagcaguuaaac

SEQ ID NO: 830263 - RNA, 15 nt, Homo sapiens
cuugggaacuccacu

SEQ ID NO: 830264 - RNA, 16 nt, Homo sapiens
cuugggcuacuggcag

SEQ ID NO: 830265 - RNA, 18 nt, Homo sapiens
cuuguagcagaaggcaag

SEQ ID NO: 830266 - RNA, 21 nt, Homo sapiens
cuuuaaaaaagcaaauuucau

SEQ ID NO: 830267 - RNA, 22 nt, Homo sapiens
cuuuacaacuaaauaacacaga

SEQ ID NO: 830268 - RNA, 14 nt, Homo sapiens
cuuucauacauuau

SEQ ID NO: 830269 - RNA, 16 nt, Homo sapiens
cuuuccccucccucag

SEQ ID NO: 830270 - RNA, 16 nt, Homo sapiens
cuuuccucaucaggcc

SEQ ID NO: 830271 - RNA, 18 nt, Homo sapiens
cuuucgaauaaagugaau

SEQ ID NO: 830272 - RNA, 22 nt, Homo sapiens
cuuuggguuggagcuguuccau

SEQ ID NO: 830273 - RNA, 15 nt, Homo sapiens
cuuuugcaacaagac

SEQ ID NO: 830274 - RNA, 18 nt, Homo sapiens
gaaaaaaaauaauagaaa

SEQ ID NO: 830275 - RNA, 13 nt, Homo sapiens
gaaaaaggcuucu

SEQ ID NO: 830276 - RNA, 15 nt, Homo sapiens
gaaaacauaugcauu

SEQ ID NO: 830277 - RNA, 16 nt, Homo sapiens
gaaaacaugacuuuau

SEQ ID NO: 830278 - RNA, 18 nt, Homo sapiens
gaaaagaaaaaaaauaau

SEQ ID NO: 830279 - RNA, 20 nt, Homo sapiens
gaaaccuguccauaaaguaa

SEQ ID NO: 830280 - RNA, 14 nt, Homo sapiens
gaaauagagugaau

SEQ ID NO: 830281 - RNA, 16 nt, Homo sapiens
gaaauuuacugugaga

SEQ ID NO: 830282 - RNA, 20 nt, Homo sapiens
gaaauuuuuaccaacucuau

SEQ ID NO: 830283 - RNA, 17 nt, Homo sapiens
gaacauggauuccacug

SEQ ID NO: 830284 - RNA, 22 nt, Homo sapiens
gaaccccuggccucaagcaauc

SEQ ID NO: 830285 - RNA, 18 nt, Homo sapiens
gaacuauuuauuucaccc

SEQ ID NO: 830286 - RNA, 17 nt, Homo sapiens
gaacugccccaucuccu

SEQ ID NO: 830287 - RNA, 15 nt, Homo sapiens
gaagacccaguguaa

SEQ ID NO: 830288 - RNA, 23 nt, Homo sapiens
gaagacccaguguaaagaauaaa

SEQ ID NO: 830289 - RNA, 13 nt, Homo sapiens
gaagagaagggca

SEQ ID NO: 830290 - RNA, 16 nt, Homo sapiens
gaagccugaggcaaaa

SEQ ID NO: 830291 - RNA, 12 nt, Homo sapiens
gaaggagaaaau

SEQ ID NO: 830292 - RNA, 14 nt, Homo sapiens
gaagggaugggaga

SEQ ID NO: 830293 - RNA, 23 nt, Homo sapiens
gaagggccuucuccacagggaca

SEQ ID NO: 830294 - RNA, 15 nt, Homo sapiens
gaaguccuucaguga

SEQ ID NO: 830295 - RNA, 11 nt, Homo sapiens
gaagugcuugc

SEQ ID NO: 830296 - RNA, 22 nt, Homo sapiens
gaauaaaugaaucuuacuccuu

SEQ ID NO: 830297 - RNA, 15 nt, Homo sapiens
gaauccccacaggga

SEQ ID NO: 830298 - RNA, 16 nt, Homo sapiens
gaauccccacagggaa

SEQ ID NO: 830299 - RNA, 17 nt, Homo sapiens
gaaucugcuguugccau

SEQ ID NO: 830300 - RNA, 12 nt, Homo sapiens
gaaugcagggaa

SEQ ID NO: 830301 - RNA, 16 nt, Homo sapiens
gaaugcuugcuguaau

SEQ ID NO: 830302 - RNA, 23 nt, Homo sapiens
gaauguucccugcacccuggaaa

SEQ ID NO: 830303 - RNA, 16 nt, Homo sapiens
ccaagaaguaacaaaa

SEQ ID NO: 830304 - RNA, 17 nt, Homo sapiens
ccaagguuacucagcag

SEQ ID NO: 830305 - RNA, 16 nt, Homo sapiens
ccaagugaaugaguuu

SEQ ID NO: 830306 - RNA, 17 nt, Homo sapiens
ccaauugccucuugcag

SEQ ID NO: 830307 - RNA, 13 nt, Homo sapiens
ccacacccaggaa

SEQ ID NO: 830308 - RNA, 14 nt, Homo sapiens
ccaccgcaugcccc

SEQ ID NO: 830309 - RNA, 10 nt, Homo sapiens
ccaccucuca

SEQ ID NO: 830310 - RNA, 20 nt, Homo sapiens
ccacggaccguugcacaaaa

SEQ ID NO: 830311 - RNA, 18 nt, Homo sapiens
ccacguccugucagugcc

SEQ ID NO: 830312 - RNA, 18 nt, Homo sapiens
ccacucaggggucauuca

SEQ ID NO: 830313 - RNA, 17 nt, Homo sapiens
ccacuuauuuccaugga

SEQ ID NO: 830314 - RNA, 16 nt, Homo sapiens
ccacuuuuaaaacuau

SEQ ID NO: 830315 - RNA, 22 nt, Homo sapiens
ccagaacauggauuccacugaa

SEQ ID NO: 830316 - RNA, 18 nt, Homo sapiens
ccagaaugccuccugcag

SEQ ID NO: 830317 - RNA, 17 nt, Homo sapiens
ccagagccacuaccuuu

SEQ ID NO: 830318 - RNA, 12 nt, Homo sapiens
ccagaucugccu

SEQ ID NO: 830319 - RNA, 12 nt, Homo sapiens
ccagcacagggg

SEQ ID NO: 830320 - RNA, 16 nt, Homo sapiens
ccagcuguagccaugg

SEQ ID NO: 830321 - RNA, 17 nt, Homo sapiens
ccagcuuuccucaucag

SEQ ID NO: 830322 - RNA, 12 nt, Homo sapiens
ccaggaaggcag

SEQ ID NO: 830323 - RNA, 17 nt, Homo sapiens
ccaggcugcacugcagu

SEQ ID NO: 830324 - RNA, 19 nt, Homo sapiens
ccaggcugcacugcaguga

SEQ ID NO: 830325 - RNA, 17 nt, Homo sapiens
ccaggcuggagugcagu

SEQ ID NO: 830326 - RNA, 21 nt, Homo sapiens
ccagggccugggggcagugac

SEQ ID NO: 830327 - RNA, 22 nt, Homo sapiens
ccagggucuugggcuacuggca

SEQ ID NO: 830328 - RNA, 20 nt, Homo sapiens
ccauauuuuaaaaaaucaaa

SEQ ID NO: 830329 - RNA, 21 nt, Homo sapiens
ccaugccacugccaggcaccu

SEQ ID NO: 830330 - RNA, 17 nt, Homo sapiens
ccaugggccugggccug

SEQ ID NO: 830331 - RNA, 15 nt, Homo sapiens
ccaugguagacugug

SEQ ID NO: 830332 - RNA, 21 nt, Homo sapiens
ccaugguagacugugacacag

SEQ ID NO: 830333 - RNA, 20 nt, Homo sapiens
ccaugugccugcaccaggag

SEQ ID NO: 830334 - RNA, 23 nt, Homo sapiens
ccauguggcugaagacauuccaa

SEQ ID NO: 830335 - RNA, 18 nt, Homo sapiens
ccaugugucauguaauac

SEQ ID NO: 830336 - RNA, 23 nt, Homo sapiens
ccauuauuucaaccgcuugccau

SEQ ID NO: 830337 - RNA, 15 nt, Homo sapiens
cccacuggcauuaaa

SEQ ID NO: 830338 - RNA, 15 nt, Homo sapiens
cccagcagacuugag

SEQ ID NO: 830339 - RNA, 22 nt, Homo sapiens
cccagcugacaguccucuccac

SEQ ID NO: 830340 - RNA, 17 nt, Homo sapiens
cccaggccuccagccuc

SEQ ID NO: 830341 - RNA, 14 nt, Homo sapiens
cccaggcugcacug

SEQ ID NO: 830342 - RNA, 17 nt, Homo sapiens
cccaggcuggagugcag

SEQ ID NO: 830343 - RNA, 18 nt, Homo sapiens
cccaugguagacugugac

SEQ ID NO: 830344 - RNA, 19 nt, Homo sapiens
cccaugguagacugugaca

SEQ ID NO: 830345 - RNA, 12 nt, Homo sapiens
ccccacagugac

SEQ ID NO: 830346 - RNA, 15 nt, Homo sapiens
ccccaugugccugca

SEQ ID NO: 830347 - RNA, 18 nt, Homo sapiens
ccccgcccaggcuggcca

SEQ ID NO: 830348 - RNA, 23 nt, Homo sapiens
cccgcugggauuucuucgcugcu

SEQ ID NO: 830349 - RNA, 23 nt, Homo sapiens
ccgacacugcugcaccagaguga

SEQ ID NO: 830350 - RNA, 14 nt, Homo sapiens
ccgggcucagggac

SEQ ID NO: 830351 - RNA, 20 nt, Homo sapiens
ccgggucaucuguaccucug

SEQ ID NO: 830352 - RNA, 21 nt, Homo sapiens
ccgucggacugcccccagaaa

SEQ ID NO: 830353 - RNA, 16 nt, Homo sapiens
ccgugcaguacaggca

SEQ ID NO: 830354 - RNA, 21 nt, Homo sapiens
ccuaaauguggacaucaugaa

SEQ ID NO: 830355 - RNA, 18 nt, Homo sapiens
ccuaggccaaaugcacaa

SEQ ID NO: 830356 - RNA, 11 nt, Homo sapiens
ccuaucaccuc

SEQ ID NO: 830357 - RNA, 22 nt, Homo sapiens
ccucacugcuguagacauuugc

SEQ ID NO: 830358 - RNA, 20 nt, Homo sapiens
ccucacuucuggcacuguga

SEQ ID NO: 830359 - RNA, 19 nt, Homo sapiens
ccuccaagugaaugaguuu

SEQ ID NO: 830360 - RNA, 11 nt, Homo sapiens
ccuccuacccu

SEQ ID NO: 830361 - RNA, 21 nt, Homo sapiens
ccuccuagaggugggcagcug

SEQ ID NO: 830362 - RNA, 15 nt, Homo sapiens
ccuccugauggccaa

SEQ ID NO: 830363 - RNA, 12 nt, Homo sapiens
ccucucauucca

SEQ ID NO: 830364 - RNA, 21 nt, Homo sapiens
ccugcccacuuagccguccau

SEQ ID NO: 830365 - RNA, 15 nt, Homo sapiens
ccugcuccacagugu

SEQ ID NO: 830366 - RNA, 21 nt, Homo sapiens
ccugggggcagugacuggcag

SEQ ID NO: 830367 - RNA, 14 nt, Homo sapiens
ccugguccaucuca

SEQ ID NO: 830368 - RNA, 12 nt, Homo sapiens
ccuguacccagc

SEQ ID NO: 830369 - RNA, 12 nt, Homo sapiens
ccuguauuccca

SEQ ID NO: 830370 - RNA, 14 nt, Homo sapiens
ccugucuccagggc

SEQ ID NO: 830371 - RNA, 20 nt, Homo sapiens
ccuguuuaaaaaaaguauau

SEQ ID NO: 830372 - RNA, 21 nt, Homo sapiens
ccuucaugaugaauuacuucu

SEQ ID NO: 830373 - RNA, 17 nt, Homo sapiens
ccuucgauauaugacuu

SEQ ID NO: 830374 - RNA, 12 nt, Homo sapiens
ccuucuaccucu

SEQ ID NO: 830375 - RNA, 17 nt, Homo sapiens
ccuucuccacagggaca

SEQ ID NO: 830376 - RNA, 20 nt, Homo sapiens
ccuugagcacaaaauuuggu

SEQ ID NO: 830377 - RNA, 14 nt, Homo sapiens
ccuugccaugucuu

SEQ ID NO: 830378 - RNA, 19 nt, Homo sapiens
ccuuggcacccccaugcug

SEQ ID NO: 830379 - RNA, 23 nt, Homo sapiens
ccuuggugugcuguauccaucca

SEQ ID NO: 830380 - RNA, 20 nt, Homo sapiens
ccuugucguaggaaaaccau

SEQ ID NO: 830381 - RNA, 22 nt, Homo sapiens
ccuugucguaggaaaaccauga

SEQ ID NO: 830382 - RNA, 13 nt, Homo sapiens
ccuuugagggcag

SEQ ID NO: 830383 - RNA, 22 nt, Homo sapiens
ccuuugcaggcccagcagacuu

SEQ ID NO: 830384 - RNA, 13 nt, Homo sapiens
cgaauaaagugaa

SEQ ID NO: 830385 - RNA, 13 nt, Homo sapiens
cgaccccaucuca

SEQ ID NO: 830386 - RNA, 11 nt, Homo sapiens
cgaucuuggcu

SEQ ID NO: 830387 - RNA, 20 nt, Homo sapiens
cgccuucucccccccggggc

SEQ ID NO: 830388 - RNA, 18 nt, Homo sapiens
cgcgggaggcaccagcuc

SEQ ID NO: 830389 - RNA, 21 nt, Homo sapiens
cggacucacuauggccagaaa

SEQ ID NO: 830390 - RNA, 17 nt, Homo sapiens
cggcaagcgagcacagu

SEQ ID NO: 830391 - RNA, 18 nt, Homo sapiens
cggccuccugucccucau

SEQ ID NO: 830392 - RNA, 15 nt, Homo sapiens
cggccuuuguugcuc

SEQ ID NO: 830393 - RNA, 15 nt, Homo sapiens
cguauuacaagagaa

SEQ ID NO: 830394 - RNA, 14 nt, Homo sapiens
cguccauggcacca

SEQ ID NO: 830395 - RNA, 21 nt, Homo sapiens
cguugaauugaugaugcaguu

SEQ ID NO: 830396 - RNA, 18 nt, Homo sapiens
cuaaaaucguauucuaau

SEQ ID NO: 830397 - RNA, 19 nt, Homo sapiens
cuaaacgcaaugucauuuu

SEQ ID NO: 830398 - RNA, 20 nt, Homo sapiens
cuaaacugcuguuaauugau

SEQ ID NO: 830399 - RNA, 21 nt, Homo sapiens
cuaaagaguuauucaaaugaa

SEQ ID NO: 830400 - RNA, 11 nt, Homo sapiens
cuaaaugaagu

SEQ ID NO: 830401 - RNA, 23 nt, Homo sapiens
cuaacccccagcccacagagccu

SEQ ID NO: 830402 - RNA, 14 nt, Homo sapiens
cuaagccugaugau

SEQ ID NO: 830403 - RNA, 14 nt, Homo sapiens
cuacauauaugcaa

SEQ ID NO: 830404 - RNA, 18 nt, Homo sapiens
cuacauuuuauuacacua

SEQ ID NO: 830405 - RNA, 20 nt, Homo sapiens
cuacauuuuauuacacuaaa

SEQ ID NO: 830406 - RNA, 21 nt, Homo sapiens
cuaccccucccagcugacagu

SEQ ID NO: 830407 - RNA, 13 nt, Homo sapiens
cuaccucuuggcu

SEQ ID NO: 830408 - RNA, 15 nt, Homo sapiens
cuaccugagcauuca

SEQ ID NO: 830409 - RNA, 20 nt, Homo sapiens
cuaccugagcauucaggcag

SEQ ID NO: 830410 - RNA, 17 nt, Homo sapiens
cuaccuuuguccaggcc

SEQ ID NO: 830411 - RNA, 15 nt, Homo sapiens
cuacugagacaugac

SEQ ID NO: 830412 - RNA, 17 nt, Homo sapiens
cuacugagacaugacua

SEQ ID NO: 830413 - RNA, 16 nt, Homo sapiens
cuacuuguaaaggugc

SEQ ID NO: 830414 - RNA, 18 nt, Homo sapiens
cuaguaauaauguaauac

SEQ ID NO: 830415 - RNA, 16 nt, Homo sapiens
cuagucuguuggcaau

SEQ ID NO: 830416 - RNA, 20 nt, Homo sapiens
cuauaguuauacaucuucau

SEQ ID NO: 830417 - RNA, 19 nt, Homo sapiens
cuaucaccucuuaugcaca

SEQ ID NO: 830418 - RNA, 13 nt, Homo sapiens
cuauuuauuucac

SEQ ID NO: 830419 - RNA, 14 nt, Homo sapiens
cucaaucaagcaaa

SEQ ID NO: 830420 - RNA, 12 nt, Homo sapiens
gguccaucucau

SEQ ID NO: 830421 - RNA, 19 nt, Homo sapiens
ggugccacucccugagcuu

SEQ ID NO: 830422 - RNA, 12 nt, Homo sapiens
ggugugcuguau

SEQ ID NO: 830423 - RNA, 15 nt, Homo sapiens
guaaauagaugacaa

SEQ ID NO: 830424 - RNA, 19 nt, Homo sapiens
guaagccucaccuuugccu

SEQ ID NO: 830425 - RNA, 17 nt, Homo sapiens
guaauaauguaauacug

SEQ ID NO: 830426 - RNA, 19 nt, Homo sapiens
guaauuuugugaaagaagg

SEQ ID NO: 830427 - RNA, 14 nt, Homo sapiens
guacacuuccugug

SEQ ID NO: 830428 - RNA, 12 nt, Homo sapiens
guacagacacuc

SEQ ID NO: 830429 - RNA, 13 nt, Homo sapiens
guacagacacucc

SEQ ID NO: 830430 - RNA, 16 nt, Homo sapiens
guacagauuguucuca

SEQ ID NO: 830431 - RNA, 14 nt, Homo sapiens
guacccuuccaccu

SEQ ID NO: 830432 - RNA, 11 nt, Homo sapiens
guaccuaugug

SEQ ID NO: 830433 - RNA, 14 nt, Homo sapiens
guaggaacugcugg

SEQ ID NO: 830434 - RNA, 13 nt, Homo sapiens
guauauacauaug

SEQ ID NO: 830435 - RNA, 21 nt, Homo sapiens
guauauauucuacacauauau

SEQ ID NO: 830436 - RNA, 15 nt, Homo sapiens
guauuaauaccaaag

SEQ ID NO: 830437 - RNA, 19 nt, Homo sapiens
guauucccaccccuggacu

SEQ ID NO: 830438 - RNA, 21 nt, Homo sapiens
gucaaagaaaacuuccaaaaa

SEQ ID NO: 830439 - RNA, 22 nt, Homo sapiens
gucacuuccuucagcaucucac

SEQ ID NO: 830440 - RNA, 19 nt, Homo sapiens
gucagaaacucgaugaaug

SEQ ID NO: 830441 - RNA, 15 nt, Homo sapiens
gucaguauguggaag

SEQ ID NO: 830442 - RNA, 14 nt, Homo sapiens
gucauguaauacug

SEQ ID NO: 830443 - RNA, 13 nt, Homo sapiens
guccaguuuccaa

SEQ ID NO: 830444 - RNA, 15 nt, Homo sapiens
guccugacuucaggg

SEQ ID NO: 830445 - RNA, 13 nt, Homo sapiens
guccugucagugc

SEQ ID NO: 830446 - RNA, 23 nt, Homo sapiens
guccuucagugagccccucccca

SEQ ID NO: 830447 - RNA, 15 nt, Homo sapiens
gucggugacuccuga

SEQ ID NO: 830448 - RNA, 22 nt, Homo sapiens
gucucucccaccccggccucca

SEQ ID NO: 830449 - RNA, 23 nt, Homo sapiens
gucugaaucauccgaggcaaaga

SEQ ID NO: 830450 - RNA, 16 nt, Homo sapiens
gucuguuggcaauuga

SEQ ID NO: 830451 - RNA, 22 nt, Homo sapiens
gugaggaugucugggccacuca

SEQ ID NO: 830452 - RNA, 16 nt, Homo sapiens
gugcagaugggcuguu

SEQ ID NO: 830453 - RNA, 16 nt, Homo sapiens
gugcgauaacuuaaca

SEQ ID NO: 830454 - RNA, 16 nt, Homo sapiens
guggaaugcagggaag

SEQ ID NO: 830455 - RNA, 13 nt, Homo sapiens
guggaggauucau

SEQ ID NO: 830456 - RNA, 15 nt, Homo sapiens
guggauucaguucau

SEQ ID NO: 830457 - RNA, 22 nt, Homo sapiens
guggccuuccccuuuugccugg

SEQ ID NO: 830458 - RNA, 19 nt, Homo sapiens
guguaucgcugccuugcca

SEQ ID NO: 830459 - RNA, 22 nt, Homo sapiens
guguguaucgcugccuugccau

SEQ ID NO: 830460 - RNA, 18 nt, Homo sapiens
guuacaaaauacaaaagu

SEQ ID NO: 830461 - RNA, 19 nt, Homo sapiens
guuacuaaagucacauaua

SEQ ID NO: 830462 - RNA, 19 nt, Homo sapiens
guuauagaaacugauauau

SEQ ID NO: 830463 - RNA, 19 nt, Homo sapiens
guucuggguguugaccacu

SEQ ID NO: 830464 - RNA, 19 nt, Homo sapiens
guucuuagcugaacaauga

SEQ ID NO: 830465 - RNA, 21 nt, Homo sapiens
guugcauuuaugaugcaguuu

SEQ ID NO: 830466 - RNA, 17 nt, Homo sapiens
guuuaaaaaaaguauau

SEQ ID NO: 830467 - RNA, 19 nt, Homo sapiens
guuuaaaaguccacuuuua

SEQ ID NO: 830468 - RNA, 20 nt, Homo sapiens
guuuagaaucaagucuguga

SEQ ID NO: 830469 - RNA, 15 nt, Homo sapiens
guuucacuaauacuu

SEQ ID NO: 830470 - RNA, 22 nt, Homo sapiens
guuuccagcuaagccugaugau

SEQ ID NO: 830471 - RNA, 18 nt, Homo sapiens
guuuccugguccaucuca

SEQ ID NO: 830472 - RNA, 19 nt, Homo sapiens
guuuccugguccaucucau

SEQ ID NO: 830473 - RNA, 19 nt, Homo sapiens
guuucucccccugccaguc

SEQ ID NO: 830474 - RNA, 19 nt, Homo sapiens
guuuucuaacccagucuua

SEQ ID NO: 830475 - RNA, 15 nt, Homo sapiens
guuuuguacuuacau

SEQ ID NO: 830476 - RNA, 15 nt, Homo sapiens
uaaaaucuggcaaag

SEQ ID NO: 830477 - RNA, 14 nt, Homo sapiens
uaaaauugugaugu

SEQ ID NO: 830478 - RNA, 14 nt, Homo sapiens
uaaacccuuaccaa

SEQ ID NO: 830479 - RNA, 11 nt, Homo sapiens
uaaacuagucu

SEQ ID NO: 830480 - RNA, 14 nt, Homo sapiens
uaaagacuaacuaa

SEQ ID NO: 830481 - RNA, 16 nt, Homo sapiens
uaaaggcccacuggca

SEQ ID NO: 830482 - RNA, 18 nt, Homo sapiens
uaaaguaauuuugugaaa

SEQ ID NO: 830483 - RNA, 18 nt, Homo sapiens
uaaauaauguauacacau

SEQ ID NO: 830484 - RNA, 22 nt, Homo sapiens
uaaauauuaaccugaauuauuc

SEQ ID NO: 830485 - RNA, 17 nt, Homo sapiens
uaaaucauuuucauuaa

SEQ ID NO: 830486 - RNA, 17 nt, Homo sapiens
uaaaugaaucuuacucc

SEQ ID NO: 830487 - RNA, 18 nt, Homo sapiens
uaaaugaaucuuacuccu

SEQ ID NO: 830488 - RNA, 17 nt, Homo sapiens
uaaaugauguacuacau

SEQ ID NO: 830489 - RNA, 18 nt, Homo sapiens
uaaaugauguacuacauu

SEQ ID NO: 830490 - RNA, 22 nt, Homo sapiens
uaacaugguacacugcaucuca

SEQ ID NO: 830491 - RNA, 12 nt, Homo sapiens
uaaccugaauua

SEQ ID NO: 830492 - RNA, 12 nt, Homo sapiens
uaacgacaauuu

SEQ ID NO: 830493 - RNA, 22 nt, Homo sapiens
uaacucagucuuuaaucugaga

SEQ ID NO: 830494 - RNA, 17 nt, Homo sapiens
uaagaaugcagauuccu

SEQ ID NO: 830495 - RNA, 14 nt, Homo sapiens
uaagcaaaaugcca

SEQ ID NO: 830496 - RNA, 18 nt, Homo sapiens
uaagcaacuugcuucuaa

SEQ ID NO: 830497 - RNA, 15 nt, Homo sapiens
uaagucuugucucau

SEQ ID NO: 830498 - RNA, 22 nt, Homo sapiens
uaauaaaaaguaacacaccaag

SEQ ID NO: 830499 - RNA, 14 nt, Homo sapiens
uaauauaugcucaa

SEQ ID NO: 830500 - RNA, 20 nt, Homo sapiens
uaauauuuuucaaaaucaaa

SEQ ID NO: 830501 - RNA, 20 nt, Homo sapiens
uaauccagagauaauugcca

SEQ ID NO: 830502 - RNA, 13 nt, Homo sapiens
uaauugcauuuaa

SEQ ID NO: 830503 - RNA, 23 nt, Homo sapiens
uacaagagaaacaaauaaacuag

SEQ ID NO: 830504 - RNA, 19 nt, Homo sapiens
uacauaccacuuugaauag

SEQ ID NO: 830505 - RNA, 18 nt, Homo sapiens
uacauaguucuuacuacu

SEQ ID NO: 830506 - RNA, 21 nt, Homo sapiens
uacaucuucauuaauacugug

SEQ ID NO: 830507 - RNA, 16 nt, Homo sapiens
uaccaaaaucauuucu

SEQ ID NO: 830508 - RNA, 23 nt, Homo sapiens
uaccaaaguguuuggucauuuua

SEQ ID NO: 830509 - RNA, 16 nt, Homo sapiens
uaccaaaugagcauua

SEQ ID NO: 830510 - RNA, 16 nt, Homo sapiens
uacccccccuccugcu

SEQ ID NO: 830511 - RNA, 23 nt, Homo sapiens
uaccuccuaauuccacacccuca

SEQ ID NO: 830512 - RNA, 21 nt, Homo sapiens
uaccuucuaccucuuggcugc

SEQ ID NO: 830513 - RNA, 21 nt, Homo sapiens
uacuacuugccacacacuguu

SEQ ID NO: 830514 - RNA, 15 nt, Homo sapiens
uacucccauuuuccc

SEQ ID NO: 830515 - RNA, 21 nt, Homo sapiens
uacuuacaucuuuguuuacca

SEQ ID NO: 830516 - RNA, 15 nt, Homo sapiens
uacuugaaaaccuca

SEQ ID NO: 830517 - RNA, 24 nt, Homo sapiens
uagaaggauggcaucuccauguag

SEQ ID NO: 830518 - RNA, 20 nt, Homo sapiens
uagaagugguuuccugauaa

SEQ ID NO: 830519 - RNA, 13 nt, Homo sapiens
uagagauacagua

SEQ ID NO: 830520 - RNA, 12 nt, Homo sapiens
uagagcacuuuu

SEQ ID NO: 830521 - RNA, 14 nt, Homo sapiens
uagagcugccugug

SEQ ID NO: 830522 - RNA, 14 nt, Homo sapiens
uagauuuuugcucu

SEQ ID NO: 830523 - RNA, 12 nt, Homo sapiens
uagcagaaggca

SEQ ID NO: 830524 - RNA, 18 nt, Homo sapiens
uagcagaaggcaagcacc

SEQ ID NO: 830525 - RNA, 14 nt, Homo sapiens
uagccuccaaaagu

SEQ ID NO: 830526 - RNA, 21 nt, Homo sapiens
uaggaaggcagcauuccauga

SEQ ID NO: 830527 - RNA, 21 nt, Homo sapiens
uaggacuauggguacauucca

SEQ ID NO: 830528 - RNA, 14 nt, Homo sapiens
uagguagacacaaa

SEQ ID NO: 830529 - RNA, 17 nt, Homo sapiens
uagguccaagggccaua

SEQ ID NO: 830530 - RNA, 19 nt, Homo sapiens
uaguuacaaaauacaaaag

SEQ ID NO: 830531 - RNA, 14 nt, Homo sapiens
uauaaauguaaaaa

SEQ ID NO: 830532 - RNA, 20 nt, Homo sapiens
uauaauuuuauugcuggaau

SEQ ID NO: 830533 - RNA, 18 nt, Homo sapiens
uauacauaugacauauau

SEQ ID NO: 830534 - RNA, 23 nt, Homo sapiens
uauaccuggcaauucacaaauag

SEQ ID NO: 830535 - RNA, 14 nt, Homo sapiens
uauagguuuccacu

SEQ ID NO: 830536 - RNA, 19 nt, Homo sapiens
uauagguuuccacugccaa

SEQ ID NO: 830537 - RNA, 19 nt, Homo sapiens
uugauuuaauaucugagaa

SEQ ID NO: 830538 - RNA, 13 nt, Homo sapiens
uugcacaaaaagg

SEQ ID NO: 830539 - RNA, 18 nt, Homo sapiens
uugccaugucuuguucag

SEQ ID NO: 830540 - RNA, 20 nt, Homo sapiens
uugccuuauuggcagcucua

SEQ ID NO: 830541 - RNA, 15 nt, Homo sapiens
uuggagcuguuccau

SEQ ID NO: 830542 - RNA, 15 nt, Homo sapiens
uuggcucuacccuga

SEQ ID NO: 830543 - RNA, 10 nt, Homo sapiens
uugggcuccu

SEQ ID NO: 830544 - RNA, 14 nt, Homo sapiens
uuguaaauaugcaa

SEQ ID NO: 830545 - RNA, 13 nt, Homo sapiens
uuguacucuugcu

SEQ ID NO: 830546 - RNA, 14 nt, Homo sapiens
uuguuuuauauucu

SEQ ID NO: 830547 - RNA, 22 nt, Homo sapiens
uuuaaaaauuauauacauauau

SEQ ID NO: 830548 - RNA, 20 nt, Homo sapiens
uuuaauaucugagaagugua

SEQ ID NO: 830549 - RNA, 15 nt, Homo sapiens
uuuaauugcauuuaa

SEQ ID NO: 830550 - RNA, 11 nt, Homo sapiens
uuuaauuuugu

SEQ ID NO: 830551 - RNA, 11 nt, Homo sapiens
uuuacauauau

SEQ ID NO: 830552 - RNA, 20 nt, Homo sapiens
uuuaccacuaugcaauauau

SEQ ID NO: 830553 - RNA, 18 nt, Homo sapiens
uuuagaaucaagucugug

SEQ ID NO: 830554 - RNA, 11 nt, Homo sapiens
uuuaugguucu

SEQ ID NO: 830555 - RNA, 16 nt, Homo sapiens
uuuauuuuucucauga

SEQ ID NO: 830556 - RNA, 19 nt, Homo sapiens
uuucaaaauuguugcaucc

SEQ ID NO: 830557 - RNA, 22 nt, Homo sapiens
uuucauacauuauauuccucua

SEQ ID NO: 830558 - RNA, 18 nt, Homo sapiens
uuuccugguccaucucau

SEQ ID NO: 830559 - RNA, 19 nt, Homo sapiens
uuucuaaagcucugaacaa

SEQ ID NO: 830560 - RNA, 21 nt, Homo sapiens
uuucuucauuucucuugcuca

SEQ ID NO: 830561 - RNA, 21 nt, Homo sapiens
uuugauguuuuguacuuacau

SEQ ID NO: 830562 - RNA, 18 nt, Homo sapiens
uuuuauuuccacauaaag

SEQ ID NO: 830563 - RNA, 13 nt, Homo sapiens
uuuucacacugau

SEQ ID NO: 830564 - RNA, 14 nt, Homo sapiens
uuuugauagauauc

SEQ ID NO: 830565 - RNA, 22 nt, Homo sapiens
uuuuuggaaaauaaaaagugcc

SEQ ID NO: 830566 - RNA, 20 nt, Homo sapiens
aaaauucuugggaguguugu

SEQ ID NO: 830567 - RNA, 21 nt, Homo sapiens
aaaauuuggucaagaaaugag

SEQ ID NO: 830568 - RNA, 15 nt, Homo sapiens
aaaaaguaugugaau

SEQ ID NO: 830569 - RNA, 16 nt, Homo sapiens
aaaaaugcacaccuca

SEQ ID NO: 830570 - RNA, 15 nt, Homo sapiens
aaaacaacaaauacu

SEQ ID NO: 830571 - RNA, 18 nt, Homo sapiens
aaaacagggaauacauug

SEQ ID NO: 830572 - RNA, 19 nt, Homo sapiens
aaaaccucauuuaccauaa

SEQ ID NO: 830573 - RNA, 17 nt, Homo sapiens
aaaacucucaagcagac

SEQ ID NO: 830574 - RNA, 14 nt, Homo sapiens
aaaagagaccaaaa

SEQ ID NO: 830575 - RNA, 14 nt, Homo sapiens
aaaaguuaaacuac

SEQ ID NO: 830576 - RNA, 21 nt, Homo sapiens
aaaauaaccaugaauacacuu

SEQ ID NO: 830577 - RNA, 18 nt, Homo sapiens
aaaauaguguguccaugc

SEQ ID NO: 830578 - RNA, 10 nt, Homo sapiens
aaaaucaaaa

SEQ ID NO: 830579 - RNA, 11 nt, Homo sapiens
aaaaugaagga

SEQ ID NO: 830580 - RNA, 12 nt, Homo sapiens
aaaaugugagug

SEQ ID NO: 830581 - RNA, 21 nt, Homo sapiens
aaaauuuuguaaauaugcaaa

SEQ ID NO: 830582 - RNA, 23 nt, Homo sapiens
aaacucucaagcagacgugagug

SEQ ID NO: 830583 - RNA, 18 nt, Homo sapiens
aaagaauaaaugaaucuu

SEQ ID NO: 830584 - RNA, 16 nt, Homo sapiens
aaagacuacacuguug

SEQ ID NO: 830585 - RNA, 12 nt, Homo sapiens
aaagcacuguuu

SEQ ID NO: 830586 - RNA, 20 nt, Homo sapiens
aaagcaguggcuccauuggu

SEQ ID NO: 830587 - RNA, 13 nt, Homo sapiens
aaaguaaugccac

SEQ ID NO: 830588 - RNA, 23 nt, Homo sapiens
aaaguuugggaagggaugggaga

SEQ ID NO: 830589 - RNA, 16 nt, Homo sapiens
aaauacacuuccugcu

SEQ ID NO: 830590 - RNA, 21 nt, Homo sapiens
aaauacuguuucacuaauacu

SEQ ID NO: 830591 - RNA, 14 nt, Homo sapiens
aaauagaugacaaa

SEQ ID NO: 830592 - RNA, 18 nt, Homo sapiens
aaauauaaaaacaacaaa

SEQ ID NO: 830593 - RNA, 20 nt, Homo sapiens
aaaucuaugagcaacuccuu

SEQ ID NO: 830594 - RNA, 17 nt, Homo sapiens
aaaucugacagucucaa

SEQ ID NO: 830595 - RNA, 15 nt, Homo sapiens
aaaugcuuuuccuca

SEQ ID NO: 830596 - RNA, 16 nt, Homo sapiens
aaaugcuuuuccucaa

SEQ ID NO: 830597 - RNA, 22 nt, Homo sapiens
aaauguaaaauaaguauuucca

SEQ ID NO: 830598 - RNA, 16 nt, Homo sapiens
aaauuacagugcaguu

SEQ ID NO: 830599 - RNA, 22 nt, Homo sapiens
aaauuccacaucaaguguucca

SEQ ID NO: 830600 - RNA, 15 nt, Homo sapiens
aaauucuuuuucaca

SEQ ID NO: 830601 - RNA, 13 nt, Homo sapiens
aaauugcuucuag

SEQ ID NO: 830602 - RNA, 14 nt, Homo sapiens
aaauuuacugugag

SEQ ID NO: 830603 - RNA, 21 nt, Homo sapiens
aacagcacuuucuguaguaau

SEQ ID NO: 830604 - RNA, 22 nt, Homo sapiens
aacaugguacacugcaucucaa

SEQ ID NO: 830605 - RNA, 21 nt, Homo sapiens
aacauugacccagaaauguau

SEQ ID NO: 830606 - RNA, 21 nt, Homo sapiens
aacauuuguaaaaauacuguu

SEQ ID NO: 830607 - RNA, 16 nt, Homo sapiens
aaccugaauuauucca

SEQ ID NO: 830608 - RNA, 13 nt, Homo sapiens
aaccugugucuua

SEQ ID NO: 830609 - RNA, 15 nt, Homo sapiens
aacgcuugacacaaa

SEQ ID NO: 830610 - RNA, 14 nt, Homo sapiens
aacucuauacucaa

SEQ ID NO: 830611 - RNA, 15 nt, Homo sapiens
aacucucaagcagac

SEQ ID NO: 830612 - RNA, 13 nt, Homo sapiens
aacucuuaagcaa

SEQ ID NO: 830613 - RNA, 13 nt, Homo sapiens
aacugccagaaca

SEQ ID NO: 830614 - RNA, 18 nt, Homo sapiens
aacugccagaacauggau

SEQ ID NO: 830615 - RNA, 15 nt, Homo sapiens
aacugccccaucucc

SEQ ID NO: 830616 - RNA, 14 nt, Homo sapiens
aacuggauacugua

SEQ ID NO: 830617 - RNA, 15 nt, Homo sapiens
aacuggauacuguac

SEQ ID NO: 830618 - RNA, 24 nt, Homo sapiens
aacuuagaaggauggcaucuccau

SEQ ID NO: 830619 - RNA, 20 nt, Homo sapiens
aacuugaggacacaugucca

SEQ ID NO: 830620 - RNA, 23 nt, Homo sapiens
aacuugaggacacauguccagug

SEQ ID NO: 830621 - RNA, 18 nt, Homo sapiens
aagaacugccccaucucc

SEQ ID NO: 830622 - RNA, 18 nt, Homo sapiens
aagaagcuucaugccagg

SEQ ID NO: 830623 - RNA, 12 nt, Homo sapiens
aagaauuacacu

SEQ ID NO: 830624 - RNA, 12 nt, Homo sapiens
aagacccagugu

SEQ ID NO: 830625 - RNA, 13 nt, Homo sapiens
aagacccagugua

SEQ ID NO: 830626 - RNA, 19 nt, Homo sapiens
aagacccaguguaaagaau

SEQ ID NO: 830627 - RNA, 17 nt, Homo sapiens
aagacuuaucaacauuu

SEQ ID NO: 830628 - RNA, 23 nt, Homo sapiens
aagagaaacaaauaaacuagucu

SEQ ID NO: 830629 - RNA, 13 nt, Homo sapiens
aagagaccaaaaa

SEQ ID NO: 830630 - RNA, 23 nt, Homo sapiens
aagaugagauuugccagcacagg

SEQ ID NO: 830631 - RNA, 22 nt, Homo sapiens
aagcaaaugcuacauauaugca

SEQ ID NO: 830632 - RNA, 14 nt, Homo sapiens
aagcaagggcucca

SEQ ID NO: 830633 - RNA, 11 nt, Homo sapiens
aagcagggaaa

SEQ ID NO: 830634 - RNA, 14 nt, Homo sapiens
aagccaugccaugc

SEQ ID NO: 830635 - RNA, 24 nt, Homo sapiens
aagccuccugcccccugccaguga

SEQ ID NO: 830636 - RNA, 12 nt, Homo sapiens
aagccugaugau

SEQ ID NO: 830637 - RNA, 13 nt, Homo sapiens
aagcgagcacagu

SEQ ID NO: 830638 - RNA, 21 nt, Homo sapiens
aagcugcugagaaucuagccu

SEQ ID NO: 830639 - RNA, 21 nt, Homo sapiens
aagcugugccacccugggcuc

SEQ ID NO: 830640 - RNA, 19 nt, Homo sapiens
aaggaagauguaagaagcu

SEQ ID NO: 830641 - RNA, 20 nt, Homo sapiens
aaggcagugaacacacucag

SEQ ID NO: 830642 - RNA, 18 nt, Homo sapiens
aaggccucccacagugac

SEQ ID NO: 830643 - RNA, 18 nt, Homo sapiens
aagggacaccaagccuug

SEQ ID NO: 830644 - RNA, 12 nt, Homo sapiens
aagguuacugau

SEQ ID NO: 830645 - RNA, 18 nt, Homo sapiens
aagguuucacuguucaug

SEQ ID NO: 830646 - RNA, 16 nt, Homo sapiens
aaguaguagugucuuc

SEQ ID NO: 830647 - RNA, 12 nt, Homo sapiens
aaguucuaucag

SEQ ID NO: 830648 - RNA, 19 nt, Homo sapiens
aaguuuuuuuagaagacaa

SEQ ID NO: 830649 - RNA, 24 nt, Homo sapiens
aauaagcuaaacgcaaugucauuu

SEQ ID NO: 830650 - RNA, 22 nt, Homo sapiens
aauaauagacacuggagacuug

SEQ ID NO: 830651 - RNA, 20 nt, Homo sapiens
aauaaucuaaacaccaaaaa

SEQ ID NO: 830652 - RNA, 20 nt, Homo sapiens
aauaauuucuccucauuuaa

SEQ ID NO: 830653 - RNA, 16 nt, Homo sapiens
aauacaaaaggcauuu

SEQ ID NO: 830654 - RNA, 16 nt, Homo sapiens
aauacauuuugcacaa

SEQ ID NO: 830655 - RNA, 22 nt, Homo sapiens
aauacugaaccacuuugauauu

SEQ ID NO: 830656 - RNA, 17 nt, Homo sapiens
aauaguguguccaugca

SEQ ID NO: 830657 - RNA, 11 nt, Homo sapiens
aauauucaaua

SEQ ID NO: 830658 - RNA, 23 nt, Homo sapiens
aauauucaauaaagcugcugaga

SEQ ID NO: 830659 - RNA, 23 nt, Homo sapiens
aaucaagucugugaaagucuccu

SEQ ID NO: 830660 - RNA, 15 nt, Homo sapiens
aaucauuuucauuaa

SEQ ID NO: 830661 - RNA, 21 nt, Homo sapiens
aauccaugugcugcuguggca

SEQ ID NO: 830662 - RNA, 19 nt, Homo sapiens
aaugaagacccaguguaaa

SEQ ID NO: 830663 - RNA, 23 nt, Homo sapiens
aaugaagacccaguguaaagaau

SEQ ID NO: 830664 - RNA, 18 nt, Homo sapiens
aaugccuauaaaaugccc

SEQ ID NO: 830665 - RNA, 13 nt, Homo sapiens
aauguaauacugu

SEQ ID NO: 830666 - RNA, 20 nt, Homo sapiens
aauguugcauuuaugaugca

SEQ ID NO: 830667 - RNA, 21 nt, Homo sapiens
aauguugcauuuaugaugcag

SEQ ID NO: 830668 - RNA, 13 nt, Homo sapiens
aauuaaaccagac

SEQ ID NO: 830669 - RNA, 17 nt, Homo sapiens
aauuaauuuucuaugaa

SEQ ID NO: 830670 - RNA, 15 nt, Homo sapiens
aauuacagugcaguu

SEQ ID NO: 830671 - RNA, 18 nt, Homo sapiens
aauucuuuuucacacuga

SEQ ID NO: 830672 - RNA, 16 nt, Homo sapiens
aauugaugaugcaguu

SEQ ID NO: 830673 - RNA, 11 nt, Homo sapiens
aauugcaacaa

SEQ ID NO: 830674 - RNA, 14 nt, Homo sapiens
aauugcaacaaugc

SEQ ID NO: 830675 - RNA, 20 nt, Homo sapiens
aauuuaaccagcaacauuga

SEQ ID NO: 830676 - RNA, 21 nt, Homo sapiens
aauuuauauaaaaauaccuua

SEQ ID NO: 830677 - RNA, 13 nt, Homo sapiens
aauuugaaacaca

SEQ ID NO: 830678 - RNA, 19 nt, Homo sapiens
aauuuucuuucauacauua

SEQ ID NO: 830679 - RNA, 18 nt, Homo sapiens
aauuuuguaaauaugcaa

SEQ ID NO: 830680 - RNA, 15 nt, Homo sapiens
acaaagauaugcuaa

SEQ ID NO: 830681 - RNA, 21 nt, Homo sapiens
acaaagcaaagccacauuuug

SEQ ID NO: 830682 - RNA, 18 nt, Homo sapiens
acaaauaaacuagucugu

SEQ ID NO: 830683 - RNA, 17 nt, Homo sapiens
acaaauuguacauuuga

SEQ ID NO: 830684 - RNA, 23 nt, Homo sapiens
acaaccuccuccuccaguucuga

SEQ ID NO: 830685 - RNA, 15 nt, Homo sapiens
acaauaauucaucaa

SEQ ID NO: 830686 - RNA, 19 nt, Homo sapiens
acaauccucgucugaauca

SEQ ID NO: 830687 - RNA, 16 nt, Homo sapiens
acaaugaauucuucaa

SEQ ID NO: 830688 - RNA, 23 nt, Homo sapiens
acaauguugcauuuaugaugcag

SEQ ID NO: 830689 - RNA, 16 nt, Homo sapiens
acaauuuuuaagcauu

SEQ ID NO: 830690 - RNA, 15 nt, Homo sapiens
acacaccaaguggag

SEQ ID NO: 830691 - RNA, 17 nt, Homo sapiens
acacauguccaguggga

SEQ ID NO: 830692 - RNA, 21 nt, Homo sapiens
acaccuacaugaaaagcagaa

SEQ ID NO: 830693 - RNA, 12 nt, Homo sapiens
acacuacuguau

SEQ ID NO: 830694 - RNA, 20 nt, Homo sapiens
acacucuugucaacucucca

SEQ ID NO: 830695 - RNA, 15 nt, Homo sapiens
acagacacucccacu

SEQ ID NO: 830696 - RNA, 17 nt, Homo sapiens
acagcuuaacauuuaca

SEQ ID NO: 830697 - RNA, 19 nt, Homo sapiens
acaggggccccagaucugc

SEQ ID NO: 830698 - RNA, 15 nt, Homo sapiens
acagugucugggcug

SEQ ID NO: 830699 - RNA, 22 nt, Homo sapiens
acauaguucuuacuacuugcca

SEQ ID NO: 830700 - RNA, 17 nt, Homo sapiens
acauccucauucacuaa

SEQ ID NO: 830701 - RNA, 13 nt, Homo sapiens
acauggauuccac

SEQ ID NO: 830702 - RNA, 21 nt, Homo sapiens
acauguagaauucgcagugau

SEQ ID NO: 830703 - RNA, 12 nt, Homo sapiens
acauuaccaaaa

SEQ ID NO: 830704 - RNA, 13 nt, Homo sapiens
acauugguauauu

SEQ ID NO: 830705 - RNA, 13 nt, Homo sapiens
acauugugcuugg

SEQ ID NO: 830706 - RNA, 19 nt, Homo sapiens
acauuuguaaaaauacugu

SEQ ID NO: 830707 - RNA, 20 nt, Homo sapiens
acauuuguaaaaauacuguu

SEQ ID NO: 830708 - RNA, 13 nt, Homo sapiens
acauuuuccugug

SEQ ID NO: 830709 - RNA, 15 nt, Homo sapiens
acauuuuuguacaca

SEQ ID NO: 830710 - RNA, 15 nt, Homo sapiens
accaaaugagcauua

SEQ ID NO: 830711 - RNA, 18 nt, Homo sapiens
accaaaugcuuuuccuca

SEQ ID NO: 830712 - RNA, 14 nt, Homo sapiens
accaaauugcuucu

SEQ ID NO: 830713 - RNA, 14 nt, Homo sapiens
accaaggcagccuc

SEQ ID NO: 830714 - RNA, 18 nt, Homo sapiens
accagcaacauugaccca

SEQ ID NO: 830715 - RNA, 22 nt, Homo sapiens
accaggguccgcaccagcugcu

SEQ ID NO: 830716 - RNA, 18 nt, Homo sapiens
auugggcugacaccuacc

SEQ ID NO: 830717 - RNA, 12 nt, Homo sapiens
auuguaugucaa

SEQ ID NO: 830718 - RNA, 17 nt, Homo sapiens
auuguauuaauaccaaa

SEQ ID NO: 830719 - RNA, 20 nt, Homo sapiens
auuuaaugaagacccagugu

SEQ ID NO: 830720 - RNA, 17 nt, Homo sapiens
auuuaccuucuaccucu

SEQ ID NO: 830721 - RNA, 21 nt, Homo sapiens
auuuaggauacucuuaaucuc

SEQ ID NO: 830722 - RNA, 13 nt, Homo sapiens
auuuccuaugcaa

SEQ ID NO: 830723 - RNA, 15 nt, Homo sapiens
auuuccuaugcaaau

SEQ ID NO: 830724 - RNA, 20 nt, Homo sapiens
auuuccuuaaaaugugagug

SEQ ID NO: 830725 - RNA, 13 nt, Homo sapiens
auuugcuaugagc

SEQ ID NO: 830726 - RNA, 17 nt, Homo sapiens
auuuguaaaaauacugu

SEQ ID NO: 830727 - RNA, 20 nt, Homo sapiens
auuuguauaaugguguuacu

SEQ ID NO: 830728 - RNA, 19 nt, Homo sapiens
auuuuauugcuggaaucua

SEQ ID NO: 830729 - RNA, 18 nt, Homo sapiens
auuuuauuuuucucauga

SEQ ID NO: 830730 - RNA, 19 nt, Homo sapiens
auuuucuuucauacauuau

SEQ ID NO: 830731 - RNA, 15 nt, Homo sapiens
auuuuggacguguga

SEQ ID NO: 830732 - RNA, 14 nt, Homo sapiens
auuuuuguacauua

SEQ ID NO: 830733 - RNA, 15 nt, Homo sapiens
auuuuuguacauuau

SEQ ID NO: 830734 - RNA, 20 nt, Homo sapiens
caaaaguggggcuaaaugaa

SEQ ID NO: 830735 - RNA, 13 nt, Homo sapiens
caaaauguuuaua

SEQ ID NO: 830736 - RNA, 11 nt, Homo sapiens
caaacaaaagc

SEQ ID NO: 830737 - RNA, 15 nt, Homo sapiens
caaagagaaaagcca

SEQ ID NO: 830738 - RNA, 15 nt, Homo sapiens
caaauaaacuagucu

SEQ ID NO: 830739 - RNA, 13 nt, Homo sapiens
caaauuucaugca

SEQ ID NO: 830740 - RNA, 20 nt, Homo sapiens
caacaaugcaaaagccaaga

SEQ ID NO: 830741 - RNA, 19 nt, Homo sapiens
caacaauggggugggccca

SEQ ID NO: 830742 - RNA, 18 nt, Homo sapiens
caacauuuguuccaugag

SEQ ID NO: 830743 - RNA, 18 nt, Homo sapiens
caacauuuuuguacauua

SEQ ID NO: 830744 - RNA, 22 nt, Homo sapiens
caaccccuguacccagcuccuu

SEQ ID NO: 830745 - RNA, 16 nt, Homo sapiens
caaccgcuugccauau

SEQ ID NO: 830746 - RNA, 12 nt, Homo sapiens
caacuccagggg

SEQ ID NO: 830747 - RNA, 12 nt, Homo sapiens
caacugugcuac

SEQ ID NO: 830748 - RNA, 18 nt, Homo sapiens
caagcagaucucaucuca

SEQ ID NO: 830749 - RNA, 17 nt, Homo sapiens
caagccccucagcccuu

SEQ ID NO: 830750 - RNA, 21 nt, Homo sapiens
caagcccuggcaacauaguga

SEQ ID NO: 830751 - RNA, 21 nt, Homo sapiens
caaguaguagugucuuccuag

SEQ ID NO: 830752 - RNA, 13 nt, Homo sapiens
caagucugugaaa

SEQ ID NO: 830753 - RNA, 15 nt, Homo sapiens
caaguuuuucagaaa

SEQ ID NO: 830754 - RNA, 15 nt, Homo sapiens
caaugccuauaaaau

SEQ ID NO: 830755 - RNA, 23 nt, Homo sapiens
caaugugauggucaggaucucau

SEQ ID NO: 830756 - RNA, 17 nt, Homo sapiens
caauuugaaacacaaga

SEQ ID NO: 830757 - RNA, 23 nt, Homo sapiens
cacaacccuucagauuugccuua

SEQ ID NO: 830758 - RNA, 20 nt, Homo sapiens
cacaaccuccuccuccaguu

SEQ ID NO: 830759 - RNA, 16 nt, Homo sapiens
cacaacuaaaacugga

SEQ ID NO: 830760 - RNA, 14 nt, Homo sapiens
cacacauugugcuu

SEQ ID NO: 830761 - RNA, 13 nt, Homo sapiens
cacaccaagugga

SEQ ID NO: 830762 - RNA, 22 nt, Homo sapiens
cacacugauguagauaacagcu

SEQ ID NO: 830763 - RNA, 21 nt, Homo sapiens
cacagcaagucacuggccagu

SEQ ID NO: 830764 - RNA, 13 nt, Homo sapiens
cacaggggagcag

SEQ ID NO: 830765 - RNA, 22 nt, Homo sapiens
cacagucuggugcccagacuca

SEQ ID NO: 830766 - RNA, 23 nt, Homo sapiens
cacauaccuggcccugugccuug

SEQ ID NO: 830767 - RNA, 23 nt, Homo sapiens
cacauuuugcauuagacagauga

SEQ ID NO: 830768 - RNA, 21 nt, Homo sapiens
caccaaacugcacacacagcu

SEQ ID NO: 830769 - RNA, 21 nt, Homo sapiens
caccaggagacagacagagaa

SEQ ID NO: 830770 - RNA, 15 nt, Homo sapiens
cacccaggcugcacu

SEQ ID NO: 830771 - RNA, 22 nt, Homo sapiens
caccgagaggaaaaaggcuucu

SEQ ID NO: 830772 - RNA, 22 nt, Homo sapiens
caccuccuagaggugggcagcu

SEQ ID NO: 830773 - RNA, 16 nt, Homo sapiens
caccuccugcaauaaa

SEQ ID NO: 830774 - RNA, 13 nt, Homo sapiens
cacuaagccaugc

SEQ ID NO: 830775 - RNA, 20 nt, Homo sapiens
cacuauuucccucuacugag

SEQ ID NO: 830776 - RNA, 18 nt, Homo sapiens
cacugaaauagagugaau

SEQ ID NO: 830777 - RNA, 19 nt, Homo sapiens
cacugaaauagagugaauu

SEQ ID NO: 830778 - RNA, 13 nt, Homo sapiens
cacuggcauuaaa

SEQ ID NO: 830779 - RNA, 17 nt, Homo sapiens
cacuguaacaauacugg

SEQ ID NO: 830780 - RNA, 21 nt, Homo sapiens
cacuucgaugacuggauacag

SEQ ID NO: 830781 - RNA, 16 nt, Homo sapiens
cagaaaacauaugcau

SEQ ID NO: 830782 - RNA, 19 nt, Homo sapiens
cagacucaaggccuccagc

SEQ ID NO: 830783 - RNA, 14 nt, Homo sapiens
cagacuuuaccacu

SEQ ID NO: 830784 - RNA, 13 nt, Homo sapiens
cagagagggccca

SEQ ID NO: 830785 - RNA, 16 nt, Homo sapiens
cagagauaauugccau

SEQ ID NO: 830786 - RNA, 15 nt, Homo sapiens
cagagccacuaccuu

SEQ ID NO: 830787 - RNA, 16 nt, Homo sapiens
cagagcuggaaggcag

SEQ ID NO: 830788 - RNA, 19 nt, Homo sapiens
cagauauuaaauaacagug

SEQ ID NO: 830789 - RNA, 16 nt, Homo sapiens
cagcaacauugaccca

SEQ ID NO: 830790 - RNA, 23 nt, Homo sapiens
cagcacguguggccuguucuucu

SEQ ID NO: 830791 - RNA, 11 nt, Homo sapiens
cagcaucaggg

SEQ ID NO: 830792 - RNA, 15 nt, Homo sapiens
cagcaucucacuucu

SEQ ID NO: 830793 - RNA, 16 nt, Homo sapiens
cagcauuccaugacca

SEQ ID NO: 830794 - RNA, 18 nt, Homo sapiens
cagcauuccaugaccaga

SEQ ID NO: 830795 - RNA, 16 nt, Homo sapiens
cagcugacaguccucu

SEQ ID NO: 830796 - RNA, 15 nt, Homo sapiens
cagcuguagccaugg

SEQ ID NO: 830797 - RNA, 23 nt, Homo sapiens
caggaggaggugccaacaguguu

SEQ ID NO: 830798 - RNA, 15 nt, Homo sapiens
caggccuugagcaca

SEQ ID NO: 830799 - RNA, 18 nt, Homo sapiens
caggguccgcaccagcug

SEQ ID NO: 830800 - RNA, 21 nt, Homo sapiens
caggguuagcucacgugucuu

SEQ ID NO: 830801 - RNA, 15 nt, Homo sapiens
caggugaacucgaag

SEQ ID NO: 830802 - RNA, 15 nt, Homo sapiens
caguccccagcccuu

SEQ ID NO: 830803 - RNA, 14 nt, Homo sapiens
cagucuugccuagg

SEQ ID NO: 830804 - RNA, 13 nt, Homo sapiens
cagucuuggaaua

SEQ ID NO: 830805 - RNA, 17 nt, Homo sapiens
cagugacuuuagaaaca

SEQ ID NO: 830806 - RNA, 22 nt, Homo sapiens
cagugugccccccauccuggcc

SEQ ID NO: 830807 - RNA, 23 nt, Homo sapiens
caguucacuucuuugcagagccu

SEQ ID NO: 830808 - RNA, 22 nt, Homo sapiens
caguugacagaauggugccaug

SEQ ID NO: 830809 - RNA, 16 nt, Homo sapiens
caguuuagaacagagg

SEQ ID NO: 830810 - RNA, 16 nt, Homo sapiens
cauaaagguauuuaga

SEQ ID NO: 830811 - RNA, 19 nt, Homo sapiens
cauaaaguaugccuuccug

SEQ ID NO: 830812 - RNA, 23 nt, Homo sapiens
cauacacccccaccuccugcaau

SEQ ID NO: 830813 - RNA, 21 nt, Homo sapiens
cauaugacaauguugcauuua

SEQ ID NO: 830814 - RNA, 13 nt, Homo sapiens
cauauuuucacau

SEQ ID NO: 830815 - RNA, 14 nt, Homo sapiens
caucaaagcacugu

SEQ ID NO: 830816 - RNA, 16 nt, Homo sapiens
caucuccauguagaau

SEQ ID NO: 830817 - RNA, 22 nt, Homo sapiens
caucuuugggacaccucagaaa

SEQ ID NO: 830818 - RNA, 15 nt, Homo sapiens
caucuuuguuuacca

SEQ ID NO: 830819 - RNA, 15 nt, Homo sapiens
caugaugaauuacuu

SEQ ID NO: 830820 - RNA, 16 nt, Homo sapiens
cauggauuccacugaa

SEQ ID NO: 830821 - RNA, 22 nt, Homo sapiens
caugguagacugugacacagcu

SEQ ID NO: 830822 - RNA, 16 nt, Homo sapiens
caugucuuguucagaa

SEQ ID NO: 830823 - RNA, 22 nt, Homo sapiens
cauguguugccuggaagcacau

SEQ ID NO: 830824 - RNA, 18 nt, Homo sapiens
cauucaggcagcacugac

SEQ ID NO: 830825 - RNA, 13 nt, Homo sapiens
cauucccccaugu

SEQ ID NO: 830826 - RNA, 19 nt, Homo sapiens
cauugguguugacauacau

SEQ ID NO: 830827 - RNA, 16 nt, Homo sapiens
cauuuccuaugcaaau

SEQ ID NO: 830828 - RNA, 14 nt, Homo sapiens
cauuuguuccauga

SEQ ID NO: 830829 - RNA, 21 nt, Homo sapiens
cauuuugcauuagacagauga

SEQ ID NO: 830830 - RNA, 18 nt, Homo sapiens
ccaaaacguugaauugau

SEQ ID NO: 830831 - RNA, 16 nt, Homo sapiens
ccaacagcuuuuccca

SEQ ID NO: 830832 - RNA, 17 nt, Homo sapiens
gagcaggguuagcucac

SEQ ID NO: 830833 - RNA, 21 nt, Homo sapiens
gagcaugggacugugccuuug

SEQ ID NO: 830834 - RNA, 20 nt, Homo sapiens
gagcccaggccguuccccuu

SEQ ID NO: 830835 - RNA, 23 nt, Homo sapiens
gagccuuuuaccccugcacaguu

SEQ ID NO: 830836 - RNA, 17 nt, Homo sapiens
gagcuccuuagccuuug

SEQ ID NO: 830837 - RNA, 22 nt, Homo sapiens
gagcuggggaugucucucauga

SEQ ID NO: 830838 - RNA, 23 nt, Homo sapiens
gagugaccucacuucuggcacug

SEQ ID NO: 830839 - RNA, 20 nt, Homo sapiens
gaguuauucaaaugaaggug

SEQ ID NO: 830840 - RNA, 16 nt, Homo sapiens
gauacagaaugaaucc

SEQ ID NO: 830841 - RNA, 19 nt, Homo sapiens
gauauaugacuuuuucuca

SEQ ID NO: 830842 - RNA, 21 nt, Homo sapiens
gauauuuuuauccuguucuca

SEQ ID NO: 830843 - RNA, 23 nt, Homo sapiens
gaucauuaucagccugugccacg

SEQ ID NO: 830844 - RNA, 22 nt, Homo sapiens
gaugcaguuucaaguaccaaaa

SEQ ID NO: 830845 - RNA, 18 nt, Homo sapiens
gauggagaggggguacaa

SEQ ID NO: 830846 - RNA, 15 nt, Homo sapiens
gauggccaggccaga

SEQ ID NO: 830847 - RNA, 20 nt, Homo sapiens
gauguaccagcaucucccag

SEQ ID NO: 830848 - RNA, 21 nt, Homo sapiens
gauguggauggaggugaugaa

SEQ ID NO: 830849 - RNA, 21 nt, Homo sapiens
gauuaguauucaggcacugag

SEQ ID NO: 830850 - RNA, 21 nt, Homo sapiens
gauuauguccuacaaugucaa

SEQ ID NO: 830851 - RNA, 17 nt, Homo sapiens
gauugcgagaauuuuca

SEQ ID NO: 830852 - RNA, 11 nt, Homo sapiens
gauuguucuca

SEQ ID NO: 830853 - RNA, 22 nt, Homo sapiens
gauuguucuguccaguuuccaa

SEQ ID NO: 830854 - RNA, 18 nt, Homo sapiens
gauuucuucgcugcucua

SEQ ID NO: 830855 - RNA, 21 nt, Homo sapiens
gcaaaaacugcuuaaguggau

SEQ ID NO: 830856 - RNA, 15 nt, Homo sapiens
gcaacuugcuucuaa

SEQ ID NO: 830857 - RNA, 14 nt, Homo sapiens
gcaagcaccaggcu

SEQ ID NO: 830858 - RNA, 22 nt, Homo sapiens
gcacuguccugcuccacagugu

SEQ ID NO: 830859 - RNA, 22 nt, Homo sapiens
gcagacgugagugugacuuuuu

SEQ ID NO: 830860 - RNA, 15 nt, Homo sapiens
gcagcauuccaugac

SEQ ID NO: 830861 - RNA, 17 nt, Homo sapiens
gcagccacgucucaaca

SEQ ID NO: 830862 - RNA, 16 nt, Homo sapiens
gcagugaacacacuca

SEQ ID NO: 830863 - RNA, 19 nt, Homo sapiens
gcaguuucaaguaccaaaa

SEQ ID NO: 830864 - RNA, 20 nt, Homo sapiens
gcauccacccagugcugcca

SEQ ID NO: 830865 - RNA, 20 nt, Homo sapiens
gccagcacaggggccccaga

SEQ ID NO: 830866 - RNA, 19 nt, Homo sapiens
gccaggagucugugcucuu

SEQ ID NO: 830867 - RNA, 21 nt, Homo sapiens
gccaguggcuggaucugugag

SEQ ID NO: 830868 - RNA, 20 nt, Homo sapiens
gccauguuauucagcucacu

SEQ ID NO: 830869 - RNA, 17 nt, Homo sapiens
gccauucccacuaagcu

SEQ ID NO: 830870 - RNA, 20 nt, Homo sapiens
gcccaggcuggagugcagug

SEQ ID NO: 830871 - RNA, 16 nt, Homo sapiens
gcccccugccagugaa

SEQ ID NO: 830872 - RNA, 17 nt, Homo sapiens
gcccgaccccaucucau

SEQ ID NO: 830873 - RNA, 16 nt, Homo sapiens
gcccucuguccugacu

SEQ ID NO: 830874 - RNA, 15 nt, Homo sapiens
gcccugcccugccac

SEQ ID NO: 830875 - RNA, 10 nt, Homo sapiens
gccuccacuc

SEQ ID NO: 830876 - RNA, 15 nt, Homo sapiens
gccucccacagugac

SEQ ID NO: 830877 - RNA, 16 nt, Homo sapiens
gccuccugucccucau

SEQ ID NO: 830878 - RNA, 23 nt, Homo sapiens
gccugaugauggaagggccuucu

SEQ ID NO: 830879 - RNA, 16 nt, Homo sapiens
gccugggggauguacc

SEQ ID NO: 830880 - RNA, 15 nt, Homo sapiens
gccugugccuaucac

SEQ ID NO: 830881 - RNA, 12 nt, Homo sapiens
gccugugccuuu

SEQ ID NO: 830882 - RNA, 16 nt, Homo sapiens
gccuucuccacaggga

SEQ ID NO: 830883 - RNA, 22 nt, Homo sapiens
gccuucuccacagggacacagu

SEQ ID NO: 830884 - RNA, 16 nt, Homo sapiens
gcgggaggcaccagcu

SEQ ID NO: 830885 - RNA, 18 nt, Homo sapiens
gcguuuggcccugugacu

SEQ ID NO: 830886 - RNA, 15 nt, Homo sapiens
gcuacauauaugcaa

SEQ ID NO: 830887 - RNA, 16 nt, Homo sapiens
gcuacauauaugcaau

SEQ ID NO: 830888 - RNA, 21 nt, Homo sapiens
gcuacuuuucagaauugaagg

SEQ ID NO: 830889 - RNA, 13 nt, Homo sapiens
gcucaccaagaag

SEQ ID NO: 830890 - RNA, 16 nt, Homo sapiens
gcucacgugucuuuag

SEQ ID NO: 830891 - RNA, 20 nt, Homo sapiens
gcuccauugguguugacaua

SEQ ID NO: 830892 - RNA, 23 nt, Homo sapiens
gcucgggcccaggccaucuucca

SEQ ID NO: 830893 - RNA, 17 nt, Homo sapiens
gcucugugggcugcacu

SEQ ID NO: 830894 - RNA, 22 nt, Homo sapiens
gcugaggccucucauuccagag

SEQ ID NO: 830895 - RNA, 19 nt, Homo sapiens
gcugccccuggugcacugg

SEQ ID NO: 830896 - RNA, 17 nt, Homo sapiens
gcugccuccacucccac

SEQ ID NO: 830897 - RNA, 14 nt, Homo sapiens
gcugccugccuugg

SEQ ID NO: 830898 - RNA, 15 nt, Homo sapiens
gcuggaacacaauaa

SEQ ID NO: 830899 - RNA, 16 nt, Homo sapiens
gcuggcaagcagggaa

SEQ ID NO: 830900 - RNA, 19 nt, Homo sapiens
gcugggaaauucaugugga

SEQ ID NO: 830901 - RNA, 14 nt, Homo sapiens
gcuggggaugucuc

SEQ ID NO: 830902 - RNA, 21 nt, Homo sapiens
gcuguuuagaacuacugauaa

SEQ ID NO: 830903 - RNA, 18 nt, Homo sapiens
gcuuaaaagcuguucuca

SEQ ID NO: 830904 - RNA, 20 nt, Homo sapiens
gcuuaggauugcaaugucaa

SEQ ID NO: 830905 - RNA, 17 nt, Homo sapiens
gcuucugccacuuccca

SEQ ID NO: 830906 - RNA, 11 nt, Homo sapiens
gcuugccauau

SEQ ID NO: 830907 - RNA, 13 nt, Homo sapiens
gcuuguagcagaa

SEQ ID NO: 830908 - RNA, 17 nt, Homo sapiens
gcuuuacucaagcagau

SEQ ID NO: 830909 - RNA, 12 nt, Homo sapiens
ggaaauguauau

SEQ ID NO: 830910 - RNA, 15 nt, Homo sapiens
ggaaguuuguucacu

SEQ ID NO: 830911 - RNA, 15 nt, Homo sapiens
ggagagagugcuauu

SEQ ID NO: 830912 - RNA, 23 nt, Homo sapiens
ggaggcaccagcucuguggccug

SEQ ID NO: 830913 - RNA, 14 nt, Homo sapiens
ggaggccugaugcu

SEQ ID NO: 830914 - RNA, 21 nt, Homo sapiens
ggaucuguuuguaaguggauu

SEQ ID NO: 830915 - RNA, 16 nt, Homo sapiens
ggauguaccagcaucu

SEQ ID NO: 830916 - RNA, 15 nt, Homo sapiens
ggaugucucucauga

SEQ ID NO: 830917 - RNA, 16 nt, Homo sapiens
ggauguguggggcaug

SEQ ID NO: 830918 - RNA, 22 nt, Homo sapiens
ggauuauuuuaaauacaaaagg

SEQ ID NO: 830919 - RNA, 13 nt, Homo sapiens
ggcaauucacaaa

SEQ ID NO: 830920 - RNA, 21 nt, Homo sapiens
ggcagggcugaggccucucau

SEQ ID NO: 830921 - RNA, 12 nt, Homo sapiens
ggcaggugcaga

SEQ ID NO: 830922 - RNA, 20 nt, Homo sapiens
ggcagugggucccacuuccc

SEQ ID NO: 830923 - RNA, 13 nt, Homo sapiens
ggcaugugugccu

SEQ ID NO: 830924 - RNA, 18 nt, Homo sapiens
ggccacagugcaauuuua

SEQ ID NO: 830925 - RNA, 16 nt, Homo sapiens
ggccccagaucugccu

SEQ ID NO: 830926 - RNA, 15 nt, Homo sapiens
ggccccccuccaggc

SEQ ID NO: 830927 - RNA, 15 nt, Homo sapiens
ggcccucuucuuauu

SEQ ID NO: 830928 - RNA, 17 nt, Homo sapiens
ggccucccacagugacu

SEQ ID NO: 830929 - RNA, 18 nt, Homo sapiens
ggccuucuccacagggac

SEQ ID NO: 830930 - RNA, 21 nt, Homo sapiens
ggcuaagaugagauuugccag

SEQ ID NO: 830931 - RNA, 12 nt, Homo sapiens
ggcucacagcug

SEQ ID NO: 830932 - RNA, 17 nt, Homo sapiens
ggcugagagaguggcau

SEQ ID NO: 830933 - RNA, 11 nt, Homo sapiens
ggcugccuugu

SEQ ID NO: 830934 - RNA, 21 nt, Homo sapiens
ggcugcucgaagaacaauguc

SEQ ID NO: 830935 - RNA, 15 nt, Homo sapiens
ggcuuugggguccua

SEQ ID NO: 830936 - RNA, 12 nt, Homo sapiens
gggaaacuggcu

SEQ ID NO: 830937 - RNA, 22 nt, Homo sapiens
gggagcaugggacugugccuuu

SEQ ID NO: 830938 - RNA, 23 nt, Homo sapiens
gggcagaguuucugcaguuccau

SEQ ID NO: 830939 - RNA, 22 nt, Homo sapiens
gggccacucaggggucauucau

SEQ ID NO: 830940 - RNA, 21 nt, Homo sapiens
ggguaugcucguuucucucaa

SEQ ID NO: 830941 - RNA, 22 nt, Homo sapiens
gggucucggugguaccaggucu

SEQ ID NO: 830942 - RNA, 21 nt, Homo sapiens
ggguggaggggagugugugca

SEQ ID NO: 830943 - RNA, 19 nt, Homo sapiens
ggguguuaaggcagugacu

SEQ ID NO: 830944 - RNA, 17 nt, Homo sapiens
ggguuggacaaccucau

SEQ ID NO: 830945 - RNA, 14 nt, Homo sapiens
gguagacugugaca

SEQ ID NO: 830946 - RNA, 22 nt, Homo sapiens
gguauauuuccauucaugccaa

SEQ ID NO: 830947 - RNA, 15 nt, Homo sapiens
gguccaggaaggcag

SEQ ID NO: 830948 - RNA, 18 nt, Homo sapiens
ugccugugccuuuugcca

SEQ ID NO: 830949 - RNA, 16 nt, Homo sapiens
ugccuuggugugcugu

SEQ ID NO: 830950 - RNA, 12 nt, Homo sapiens
ugcggugcauac

SEQ ID NO: 830951 - RNA, 16 nt, Homo sapiens
ugcuacauauaugcaa

SEQ ID NO: 830952 - RNA, 17 nt, Homo sapiens
ugcuacauauaugcaau

SEQ ID NO: 830953 - RNA, 22 nt, Homo sapiens
ugcuaucucgcuagccauauau

SEQ ID NO: 830954 - RNA, 19 nt, Homo sapiens
ugcuauuguagagccagag

SEQ ID NO: 830955 - RNA, 22 nt, Homo sapiens
ugcucaaccccccucccagaca

SEQ ID NO: 830956 - RNA, 14 nt, Homo sapiens
ugcucaccaagaag

SEQ ID NO: 830957 - RNA, 19 nt, Homo sapiens
ugcugccaguccucugcau

SEQ ID NO: 830958 - RNA, 18 nt, Homo sapiens
ugcugccuaauaaagaga

SEQ ID NO: 830959 - RNA, 15 nt, Homo sapiens
ugcugggcuuggcag

SEQ ID NO: 830960 - RNA, 20 nt, Homo sapiens
ugcuguagacauuugcuaug

SEQ ID NO: 830961 - RNA, 18 nt, Homo sapiens
ugcuuaaacuugacccag

SEQ ID NO: 830962 - RNA, 13 nt, Homo sapiens
ugcuucgagccau

SEQ ID NO: 830963 - RNA, 19 nt, Homo sapiens
ugcuugcuguaauguauau

SEQ ID NO: 830964 - RNA, 17 nt, Homo sapiens
ugcuuuuguccuguuau

SEQ ID NO: 830965 - RNA, 22 nt, Homo sapiens
uggaacccuggugucuccucca

SEQ ID NO: 830966 - RNA, 18 nt, Homo sapiens
uggaagugugggucugug

SEQ ID NO: 830967 - RNA, 13 nt, Homo sapiens
uggacaagguguc

SEQ ID NO: 830968 - RNA, 19 nt, Homo sapiens
uggagaaagggaaguggaa

SEQ ID NO: 830969 - RNA, 17 nt, Homo sapiens
uggagauuggcucccaa

SEQ ID NO: 830970 - RNA, 17 nt, Homo sapiens
uggagcaaacagcugua

SEQ ID NO: 830971 - RNA, 15 nt, Homo sapiens
uggagcccgugcagu

SEQ ID NO: 830972 - RNA, 13 nt, Homo sapiens
uggaggugaugaa

SEQ ID NO: 830973 - RNA, 21 nt, Homo sapiens
uggagguuuguuuagaagaag

SEQ ID NO: 830974 - RNA, 21 nt, Homo sapiens
uggauacagaaugaaucccau

SEQ ID NO: 830975 - RNA, 14 nt, Homo sapiens
uggcacugguugua

SEQ ID NO: 830976 - RNA, 15 nt, Homo sapiens
uggccugcugggaac

SEQ ID NO: 830977 - RNA, 21 nt, Homo sapiens
uggcugggaauaagugccagg

SEQ ID NO: 830978 - RNA, 19 nt, Homo sapiens
ugggaaggcuaaguucagu

SEQ ID NO: 830979 - RNA, 13 nt, Homo sapiens
ugggcuacuggca

SEQ ID NO: 830980 - RNA, 18 nt, Homo sapiens
uggggaugucucucauga

SEQ ID NO: 830981 - RNA, 15 nt, Homo sapiens
uggggcugauuguau

SEQ ID NO: 830982 - RNA, 22 nt, Homo sapiens
uggguaugcucguuucucucaa

SEQ ID NO: 830983 - RNA, 14 nt, Homo sapiens
ugggucaguuguau

SEQ ID NO: 830984 - RNA, 14 nt, Homo sapiens
uggguguugaccac

SEQ ID NO: 830985 - RNA, 17 nt, Homo sapiens
ugguacacugcaucuca

SEQ ID NO: 830986 - RNA, 22 nt, Homo sapiens
ugguacugcacauuuuguacaa

SEQ ID NO: 830987 - RNA, 19 nt, Homo sapiens
uggucauuuccuaugcaaa

SEQ ID NO: 830988 - RNA, 18 nt, Homo sapiens
uggugcagccuacacuau

SEQ ID NO: 830989 - RNA, 13 nt, Homo sapiens
uggugugcuguau

SEQ ID NO: 830990 - RNA, 16 nt, Homo sapiens
uggugugucaugcuca

SEQ ID NO: 830991 - RNA, 23 nt, Homo sapiens
ugguuacagcccagacuuuacca

SEQ ID NO: 830992 - RNA, 18 nt, Homo sapiens
uguaaagaauaaaugaau

SEQ ID NO: 830993 - RNA, 22 nt, Homo sapiens
uguaaagaauaaaugaaucuua

SEQ ID NO: 830994 - RNA, 15 nt, Homo sapiens
uguaaguggauucag

SEQ ID NO: 830995 - RNA, 15 nt, Homo sapiens
uguagaauaaaugaa

SEQ ID NO: 830996 - RNA, 17 nt, Homo sapiens
uguagaauaaaugaaga

SEQ ID NO: 830997 - RNA, 22 nt, Homo sapiens
uguauguuuuaauugcauuuaa

SEQ ID NO: 830998 - RNA, 21 nt, Homo sapiens
ugucaaagaaaacuuccaaaa

SEQ ID NO: 830999 - RNA, 14 nt, Homo sapiens
ugucacaccugaaa

SEQ ID NO: 831000 - RNA, 12 nt, Homo sapiens
ugucccaaagaa

SEQ ID NO: 831001 - RNA, 18 nt, Homo sapiens
ugucccagaaugccuccu

SEQ ID NO: 831002 - RNA, 22 nt, Homo sapiens
ugucccucauccauagcaccuc

SEQ ID NO: 831003 - RNA, 16 nt, Homo sapiens
ugucguaggaaaacca

SEQ ID NO: 831004 - RNA, 23 nt, Homo sapiens
ugucguuucccucccaacagagc

SEQ ID NO: 831005 - RNA, 18 nt, Homo sapiens
ugucguuuucacauauga

SEQ ID NO: 831006 - RNA, 22 nt, Homo sapiens
ugucuuugacuugguuaaagga

SEQ ID NO: 831007 - RNA, 14 nt, Homo sapiens
ugugacuacuaugg

SEQ ID NO: 831008 - RNA, 15 nt, Homo sapiens
ugugccucagccucc

SEQ ID NO: 831009 - RNA, 14 nt, Homo sapiens
ugugcuacacuugc

SEQ ID NO: 831010 - RNA, 17 nt, Homo sapiens
uguggguuuuuucacau

SEQ ID NO: 831011 - RNA, 11 nt, Homo sapiens
uguguuuacuu

SEQ ID NO: 831012 - RNA, 14 nt, Homo sapiens
uguuacuaaugauc

SEQ ID NO: 831013 - RNA, 17 nt, Homo sapiens
uguucgcucgugcagua

SEQ ID NO: 831014 - RNA, 16 nt, Homo sapiens
uguugcaaugacacau

SEQ ID NO: 831015 - RNA, 14 nt, Homo sapiens
uguuuuaguucuug

SEQ ID NO: 831016 - RNA, 16 nt, Homo sapiens
uuaaaagcuguucuca

SEQ ID NO: 831017 - RNA, 21 nt, Homo sapiens
uuaaaaucuggcaaaguuaua

SEQ ID NO: 831018 - RNA, 11 nt, Homo sapiens
uuaaagucaau

SEQ ID NO: 831019 - RNA, 14 nt, Homo sapiens
uuaaauacaaaagg

SEQ ID NO: 831020 - RNA, 14 nt, Homo sapiens
uuaaaugacaauuu

SEQ ID NO: 831021 - RNA, 21 nt, Homo sapiens
uuaaauguugcacaucauuca

SEQ ID NO: 831022 - RNA, 19 nt, Homo sapiens
uuaaugaagacccagugua

SEQ ID NO: 831023 - RNA, 22 nt, Homo sapiens
uuaaugaagacccaguguaaag

SEQ ID NO: 831024 - RNA, 18 nt, Homo sapiens
uuaaugugacaguguuca

SEQ ID NO: 831025 - RNA, 14 nt, Homo sapiens
uuaauugcauuuaa

SEQ ID NO: 831026 - RNA, 14 nt, Homo sapiens
uuacaauaagcuaa

SEQ ID NO: 831027 - RNA, 14 nt, Homo sapiens
uuaccccugcacag

SEQ ID NO: 831028 - RNA, 18 nt, Homo sapiens
uuacuaaagucacauaua

SEQ ID NO: 831029 - RNA, 13 nt, Homo sapiens
uuagacagaugac

SEQ ID NO: 831030 - RNA, 14 nt, Homo sapiens
uuauccuguucuca

SEQ ID NO: 831031 - RNA, 15 nt, Homo sapiens
uuaugcuuguuucau

SEQ ID NO: 831032 - RNA, 11 nt, Homo sapiens
uuauuuccaca

SEQ ID NO: 831033 - RNA, 22 nt, Homo sapiens
uucaaaauuuuguaaauaugca

SEQ ID NO: 831034 - RNA, 16 nt, Homo sapiens
uucaagagauucuugu

SEQ ID NO: 831035 - RNA, 15 nt, Homo sapiens
uucacauaugacaau

SEQ ID NO: 831036 - RNA, 17 nt, Homo sapiens
uucaccccugcacuuca

SEQ ID NO: 831037 - RNA, 20 nt, Homo sapiens
uucagaacagaggcauuuaa

SEQ ID NO: 831038 - RNA, 20 nt, Homo sapiens
uucagcacccugggugccau

SEQ ID NO: 831039 - RNA, 13 nt, Homo sapiens
uucagcaucucac

SEQ ID NO: 831040 - RNA, 12 nt, Homo sapiens
uucauuaccuca

SEQ ID NO: 831041 - RNA, 11 nt, Homo sapiens
uuccaaaaaga

SEQ ID NO: 831042 - RNA, 21 nt, Homo sapiens
uuccacacccucacugcugua

SEQ ID NO: 831043 - RNA, 20 nt, Homo sapiens
uuccagcuaagccugaugau

SEQ ID NO: 831044 - RNA, 18 nt, Homo sapiens
uuccauggauuccccugg

SEQ ID NO: 831045 - RNA, 16 nt, Homo sapiens
uucccaauacauacca

SEQ ID NO: 831046 - RNA, 13 nt, Homo sapiens
uuccccacaguga

SEQ ID NO: 831047 - RNA, 22 nt, Homo sapiens
uuccccucuacuccaugcacau

SEQ ID NO: 831048 - RNA, 21 nt, Homo sapiens
uuccggccuccugucccucau

SEQ ID NO: 831049 - RNA, 22 nt, Homo sapiens
uuccugagggcuaauucuggga

SEQ ID NO: 831050 - RNA, 16 nt, Homo sapiens
uuccuucccugggaag

SEQ ID NO: 831051 - RNA, 16 nt, Homo sapiens
uucgaauaaagugaau

SEQ ID NO: 831052 - RNA, 18 nt, Homo sapiens
uucgaauaaagugaauac

SEQ ID NO: 831053 - RNA, 17 nt, Homo sapiens
uucguauuacaagagaa

SEQ ID NO: 831054 - RNA, 16 nt, Homo sapiens
uucuaauccaugugcu

SEQ ID NO: 831055 - RNA, 15 nt, Homo sapiens
uucuccuguugcaau

SEQ ID NO: 831056 - RNA, 17 nt, Homo sapiens
uucugaguagcauauau

SEQ ID NO: 831057 - RNA, 12 nt, Homo sapiens
uucuggcacugu

SEQ ID NO: 831058 - RNA, 23 nt, Homo sapiens
uucuggcacugugacuacuaugg

SEQ ID NO: 831059 - RNA, 22 nt, Homo sapiens
uucugggaagggagaguucuuu

SEQ ID NO: 831060 - RNA, 18 nt, Homo sapiens
uucuggguguugaccacu

SEQ ID NO: 831061 - RNA, 15 nt, Homo sapiens
uucuuuacauuugau

SEQ ID NO: 831062 - RNA, 20 nt, Homo sapiens
uucuuuagagggaaggaaua

SEQ ID NO: 831063 - RNA, 20 nt, Homo sapiens
uugaaggagaaaaugcauua

SEQ ID NO: 831064 - RNA, 18 nt, Homo sapiens
uugagaauacacuaucaa

SEQ ID NO: 831065 - RNA, 13 nt, Homo sapiens
ugugccagaguua

SEQ ID NO: 831066 - RNA, 18 nt, Homo sapiens
ugugccuuggugugcugu

SEQ ID NO: 831067 - RNA, 15 nt, Homo sapiens
ugugcuucacauaau

SEQ ID NO: 831068 - RNA, 18 nt, Homo sapiens
uguggccuguguccagca

SEQ ID NO: 831069 - RNA, 21 nt, Homo sapiens
uguggggagggauuuggggcu

SEQ ID NO: 831070 - RNA, 20 nt, Homo sapiens
uguggguuuuuucacauaaa

SEQ ID NO: 831071 - RNA, 14 nt, Homo sapiens
ugugugaccccaaa

SEQ ID NO: 831072 - RNA, 18 nt, Homo sapiens
uguuauuuuuuauuucca

SEQ ID NO: 831073 - RNA, 14 nt, Homo sapiens
uguucucuucuaua

SEQ ID NO: 831074 - RNA, 21 nt, Homo sapiens
uguucuuagcugaacaaugaa

SEQ ID NO: 831075 - RNA, 21 nt, Homo sapiens
uguuguggagaaaagagccag

SEQ ID NO: 831076 - RNA, 21 nt, Homo sapiens
uguuguggguuuuuucacaua

SEQ ID NO: 831077 - RNA, 22 nt, Homo sapiens
uguuguggguuuuuucacauaa

SEQ ID NO: 831078 - RNA, 19 nt, Homo sapiens
uguuuacagaggacaguau

SEQ ID NO: 831079 - RNA, 19 nt, Homo sapiens
uguuuucucagaacagcug

SEQ ID NO: 831080 - RNA, 20 nt, Homo sapiens
uuaaaaaaaguauauauucu

SEQ ID NO: 831081 - RNA, 14 nt, Homo sapiens
uuaaaaaagcaaau

SEQ ID NO: 831082 - RNA, 16 nt, Homo sapiens
uuaaaaguccacuuuu

SEQ ID NO: 831083 - RNA, 15 nt, Homo sapiens
uuaaacccuuaccaa

SEQ ID NO: 831084 - RNA, 19 nt, Homo sapiens
uuaaacuugacccaggugg

SEQ ID NO: 831085 - RNA, 16 nt, Homo sapiens
uuaaaugacaauuuau

SEQ ID NO: 831086 - RNA, 21 nt, Homo sapiens
uuaacaauuaauuuucuauga

SEQ ID NO: 831087 - RNA, 20 nt, Homo sapiens
uuaacaucuugaacugguug

SEQ ID NO: 831088 - RNA, 21 nt, Homo sapiens
uuaaccugaauuauuccaacu

SEQ ID NO: 831089 - RNA, 21 nt, Homo sapiens
uuaacuuaaaagaacauguau

SEQ ID NO: 831090 - RNA, 16 nt, Homo sapiens
uuaauaagucauugaa

SEQ ID NO: 831091 - RNA, 13 nt, Homo sapiens
uuaauaccaaagu

SEQ ID NO: 831092 - RNA, 18 nt, Homo sapiens
uuaaucugagaggccaca

SEQ ID NO: 831093 - RNA, 20 nt, Homo sapiens
uuacaaguuuuuuaggauuc

SEQ ID NO: 831094 - RNA, 13 nt, Homo sapiens
uuacuacuugcca

SEQ ID NO: 831095 - RNA, 14 nt, Homo sapiens
uuagaagacaauuu

SEQ ID NO: 831096 - RNA, 13 nt, Homo sapiens
uuagagcacuuuu

SEQ ID NO: 831097 - RNA, 16 nt, Homo sapiens
uuagcaggguacauau

SEQ ID NO: 831098 - RNA, 16 nt, Homo sapiens
uuaggauuugugguaa

SEQ ID NO: 831099 - RNA, 17 nt, Homo sapiens
uuauagguuuccacugc

SEQ ID NO: 831100 - RNA, 15 nt, Homo sapiens
uuauauuuacuuuaa

SEQ ID NO: 831101 - RNA, 23 nt, Homo sapiens
uuauauuuguaaauuuaugugau

SEQ ID NO: 831102 - RNA, 23 nt, Homo sapiens
uuaugagucucuaugaucuuggc

SEQ ID NO: 831103 - RNA, 16 nt, Homo sapiens
uuauuaauuaaaccag

SEQ ID NO: 831104 - RNA, 17 nt, Homo sapiens
uuauuaauuaaaccaga

SEQ ID NO: 831105 - RNA, 20 nt, Homo sapiens
uucacauaaacacauacauu

SEQ ID NO: 831106 - RNA, 15 nt, Homo sapiens
uucacuaauacuuac

SEQ ID NO: 831107 - RNA, 15 nt, Homo sapiens
uucagaaauucucaa

SEQ ID NO: 831108 - RNA, 17 nt, Homo sapiens
uuccaacugccagaaca

SEQ ID NO: 831109 - RNA, 21 nt, Homo sapiens
uuccacugaaauagagugaau

SEQ ID NO: 831110 - RNA, 14 nt, Homo sapiens
uucccaauacauac

SEQ ID NO: 831111 - RNA, 17 nt, Homo sapiens
uuccuguguauucucau

SEQ ID NO: 831112 - RNA, 20 nt, Homo sapiens
uucgaaaccuguccauaaag

SEQ ID NO: 831113 - RNA, 13 nt, Homo sapiens
uucgagggguccu

SEQ ID NO: 831114 - RNA, 14 nt, Homo sapiens
uucuacacauauau

SEQ ID NO: 831115 - RNA, 20 nt, Homo sapiens
uucuaccucuuggcugccuu

SEQ ID NO: 831116 - RNA, 17 nt, Homo sapiens
uucuagaauccccacag

SEQ ID NO: 831117 - RNA, 23 nt, Homo sapiens
uucucaguaaauauuaaccugaa

SEQ ID NO: 831118 - RNA, 18 nt, Homo sapiens
uucuccugucuccaugau

SEQ ID NO: 831119 - RNA, 13 nt, Homo sapiens
uucugaguagcau

SEQ ID NO: 831120 - RNA, 22 nt, Homo sapiens
uucugauuugaagguauaaccu

SEQ ID NO: 831121 - RNA, 19 nt, Homo sapiens
uucuggaagcuaccaaaaa

SEQ ID NO: 831122 - RNA, 16 nt, Homo sapiens
uucuucauuaccucag

SEQ ID NO: 831123 - RNA, 16 nt, Homo sapiens
uucuuuuucacacuga

SEQ ID NO: 831124 - RNA, 19 nt, Homo sapiens
uugaauugaugaugcaguu

SEQ ID NO: 831125 - RNA, 18 nt, Homo sapiens
uugcaggcucugggcuca

SEQ ID NO: 831126 - RNA, 21 nt, Homo sapiens
uugcccaggcuggagugcagu

SEQ ID NO: 831127 - RNA, 16 nt, Homo sapiens
uugcgagaauuuucaa

SEQ ID NO: 831128 - RNA, 10 nt, Homo sapiens
uugcuucuag

SEQ ID NO: 831129 - RNA, 16 nt, Homo sapiens
uuggagccacuccugu

SEQ ID NO: 831130 - RNA, 13 nt, Homo sapiens
uugguauauuucc

SEQ ID NO: 831131 - RNA, 15 nt, Homo sapiens
uuggugaaacccaga

SEQ ID NO: 831132 - RNA, 15 nt, Homo sapiens
uuguaaauaugcaaa

SEQ ID NO: 831133 - RNA, 16 nt, Homo sapiens
uuguauuuaccuucua

SEQ ID NO: 831134 - RNA, 20 nt, Homo sapiens
uuguauuuaccuucuaccuc

SEQ ID NO: 831135 - RNA, 13 nt, Homo sapiens
accaggucuccuc

SEQ ID NO: 831136 - RNA, 22 nt, Homo sapiens
accauuaaaaaguuggaguuau

SEQ ID NO: 831137 - RNA, 16 nt, Homo sapiens
acccagcuaugguucu

SEQ ID NO: 831138 - RNA, 13 nt, Homo sapiens
acccaguguaaag

SEQ ID NO: 831139 - RNA, 12 nt, Homo sapiens
acccccaugcug

SEQ ID NO: 831140 - RNA, 20 nt, Homo sapiens
acccccccuccugcugccua

SEQ ID NO: 831141 - RNA, 16 nt, Homo sapiens
acccuaaaacaugugu

SEQ ID NO: 831142 - RNA, 15 nt, Homo sapiens
acccuaagaugaagc

SEQ ID NO: 831143 - RNA, 14 nt, Homo sapiens
acccugggugccau

SEQ ID NO: 831144 - RNA, 21 nt, Homo sapiens
accuaugagauggccaugcuc

SEQ ID NO: 831145 - RNA, 16 nt, Homo sapiens
accucaccugaccuca

SEQ ID NO: 831146 - RNA, 22 nt, Homo sapiens
accuccuccuccaguucugaug

SEQ ID NO: 831147 - RNA, 17 nt, Homo sapiens
accucuuggcugccuug

SEQ ID NO: 831148 - RNA, 19 nt, Homo sapiens
accuggcccugugccuugg

SEQ ID NO: 831149 - RNA, 23 nt, Homo sapiens
accuucuaauccaugugcugcug

SEQ ID NO: 831150 - RNA, 20 nt, Homo sapiens
acgccccgaaccucaccuga

SEQ ID NO: 831151 - RNA, 14 nt, Homo sapiens
acguugaauugaug

SEQ ID NO: 831152 - RNA, 14 nt, Homo sapiens
acuaaaagaauuug

SEQ ID NO: 831153 - RNA, 20 nt, Homo sapiens
acuaccaaaugagcauuagc

SEQ ID NO: 831154 - RNA, 22 nt, Homo sapiens
acuagaaccuucuaauccaugu

SEQ ID NO: 831155 - RNA, 21 nt, Homo sapiens
acuauggagcugagcaggugu

SEQ ID NO: 831156 - RNA, 18 nt, Homo sapiens
acucagucuuuaaucuga

SEQ ID NO: 831157 - RNA, 23 nt, Homo sapiens
acugagugugggagugcagagaa

SEQ ID NO: 831158 - RNA, 20 nt, Homo sapiens
acugcacacacagcuccucu

SEQ ID NO: 831159 - RNA, 17 nt, Homo sapiens
acugccagaacauggau

SEQ ID NO: 831160 - RNA, 21 nt, Homo sapiens
acuggagacuuggaagaguug

SEQ ID NO: 831161 - RNA, 23 nt, Homo sapiens
acuggccagagagggcccagcug

SEQ ID NO: 831162 - RNA, 21 nt, Homo sapiens
acuggcuggccagucuggguc

SEQ ID NO: 831163 - RNA, 21 nt, Homo sapiens
acugggagagcugguggugca

SEQ ID NO: 831164 - RNA, 20 nt, Homo sapiens
acuggguuccccacagugac

SEQ ID NO: 831165 - RNA, 17 nt, Homo sapiens
acuggucccaaguagua

SEQ ID NO: 831166 - RNA, 16 nt, Homo sapiens
acuguaacaauacugg

SEQ ID NO: 831167 - RNA, 17 nt, Homo sapiens
acuuaaaagaacaugua

SEQ ID NO: 831168 - RNA, 13 nt, Homo sapiens
acuuaacaauuaa

SEQ ID NO: 831169 - RNA, 14 nt, Homo sapiens
acuuaucaacauuu

SEQ ID NO: 831170 - RNA, 23 nt, Homo sapiens
acuucagguggagagcacuagaa

SEQ ID NO: 831171 - RNA, 14 nt, Homo sapiens
acuucaucaaucaa

SEQ ID NO: 831172 - RNA, 15 nt, Homo sapiens
acuugaaaaccucau

SEQ ID NO: 831173 - RNA, 22 nt, Homo sapiens
acuugcaccugguacugcacau

SEQ ID NO: 831174 - RNA, 14 nt, Homo sapiens
acuugcguccugca

SEQ ID NO: 831175 - RNA, 17 nt, Homo sapiens
acuuuaccacuaugcaa

SEQ ID NO: 831176 - RNA, 18 nt, Homo sapiens
acuuuuuccagaauuuga

SEQ ID NO: 831177 - RNA, 19 nt, Homo sapiens
agaaaagcaguggcuccau

SEQ ID NO: 831178 - RNA, 19 nt, Homo sapiens
agaaacugaggccauuauu

SEQ ID NO: 831179 - RNA, 23 nt, Homo sapiens
agaaacugaggccauuauuucaa

SEQ ID NO: 831180 - RNA, 17 nt, Homo sapiens
agaacagaggcauuuaa

SEQ ID NO: 831181 - RNA, 18 nt, Homo sapiens
agaacugccccaucuccu

SEQ ID NO: 831182 - RNA, 16 nt, Homo sapiens
agaagaaagacacaaa

SEQ ID NO: 831183 - RNA, 15 nt, Homo sapiens
agaagacacagggga

SEQ ID NO: 831184 - RNA, 13 nt, Homo sapiens
agaagccagcuuu

SEQ ID NO: 831185 - RNA, 14 nt, Homo sapiens
agaaggcaagcacc

SEQ ID NO: 831186 - RNA, 15 nt, Homo sapiens
agaauaaaugaaucu

SEQ ID NO: 831187 - RNA, 22 nt, Homo sapiens
uccucaaagggagagagugcua

SEQ ID NO: 831188 - RNA, 17 nt, Homo sapiens
uccucagaucauuauca

SEQ ID NO: 831189 - RNA, 22 nt, Homo sapiens
uccugaggaagagggacuguuc

SEQ ID NO: 831190 - RNA, 22 nt, Homo sapiens
uccugcaauaaaauaguagcau

SEQ ID NO: 831191 - RNA, 14 nt, Homo sapiens
uccugccucaggcu

SEQ ID NO: 831192 - RNA, 16 nt, Homo sapiens
uccugcuccacagugu

SEQ ID NO: 831193 - RNA, 21 nt, Homo sapiens
uccugcugcuguaacugcuga

SEQ ID NO: 831194 - RNA, 22 nt, Homo sapiens
uccuugucguaggaaaaccaug

SEQ ID NO: 831195 - RNA, 15 nt, Homo sapiens
ucgaauaaagugaau

SEQ ID NO: 831196 - RNA, 13 nt, Homo sapiens
ucggcuccugcug

SEQ ID NO: 831197 - RNA, 18 nt, Homo sapiens
ucgggcuccugugcccuu

SEQ ID NO: 831198 - RNA, 16 nt, Homo sapiens
ucuaaacugcuguuaa

SEQ ID NO: 831199 - RNA, 12 nt, Homo sapiens
ucuaaaugccca

SEQ ID NO: 831200 - RNA, 19 nt, Homo sapiens
ucuaaauuacagugcaguu

SEQ ID NO: 831201 - RNA, 21 nt, Homo sapiens
ucuaccuuuuuuucucuccua

SEQ ID NO: 831202 - RNA, 16 nt, Homo sapiens
ucuacuccaugcacau

SEQ ID NO: 831203 - RNA, 17 nt, Homo sapiens
ucucaacauuaccaaaa

SEQ ID NO: 831204 - RNA, 15 nt, Homo sapiens
ucucacuaaaaugga

SEQ ID NO: 831205 - RNA, 17 nt, Homo sapiens
ucucaugaccaaaugcu

SEQ ID NO: 831206 - RNA, 17 nt, Homo sapiens
ucucaugauagaaggcu

SEQ ID NO: 831207 - RNA, 13 nt, Homo sapiens
ucucauuccagag

SEQ ID NO: 831208 - RNA, 16 nt, Homo sapiens
ucuccccaggccucca

SEQ ID NO: 831209 - RNA, 13 nt, Homo sapiens
ucucuaugaucuu

SEQ ID NO: 831210 - RNA, 22 nt, Homo sapiens
ucucucccaccccggccuccac

SEQ ID NO: 831211 - RNA, 11 nt, Homo sapiens
ucugagcccac

SEQ ID NO: 831212 - RNA, 19 nt, Homo sapiens
ucuguaugugacaacauuu

SEQ ID NO: 831213 - RNA, 21 nt, Homo sapiens
ucugugaggggcucucucaug

SEQ ID NO: 831214 - RNA, 16 nt, Homo sapiens
ucuguguuuacuuaag

SEQ ID NO: 831215 - RNA, 19 nt, Homo sapiens
ucuuagagcacuuuuaaca

SEQ ID NO: 831216 - RNA, 18 nt, Homo sapiens
ucuuauuuuucuagucag

SEQ ID NO: 831217 - RNA, 18 nt, Homo sapiens
ucuucaaucacuagucaa

SEQ ID NO: 831218 - RNA, 22 nt, Homo sapiens
ucuucuauggguuggacaaccu

SEQ ID NO: 831219 - RNA, 17 nt, Homo sapiens
ucuucuuauucaugcuu

SEQ ID NO: 831220 - RNA, 16 nt, Homo sapiens
ucuuggaauacuugaa

SEQ ID NO: 831221 - RNA, 20 nt, Homo sapiens
ucuugggcuacuggcagcuc

SEQ ID NO: 831222 - RNA, 12 nt, Homo sapiens
ucuuuaccuccu

SEQ ID NO: 831223 - RNA, 21 nt, Homo sapiens
ucuuucuuuucuauuagugaa

SEQ ID NO: 831224 - RNA, 21 nt, Homo sapiens
ucuuugggacaccucagaaaa

SEQ ID NO: 831225 - RNA, 21 nt, Homo sapiens
ucuuuugaaaauaaccaugaa

SEQ ID NO: 831226 - RNA, 14 nt, Homo sapiens
ucuuuugucccaga

SEQ ID NO: 831227 - RNA, 16 nt, Homo sapiens
ucuuuugucccagaaa

SEQ ID NO: 831228 - RNA, 13 nt, Homo sapiens
ugaaaaaaguaua

SEQ ID NO: 831229 - RNA, 22 nt, Homo sapiens
ugaaaaauaguguguccaugca

SEQ ID NO: 831230 - RNA, 17 nt, Homo sapiens
ugaaacacaagaauuac

SEQ ID NO: 831231 - RNA, 18 nt, Homo sapiens
ugaaagucuccuguauca

SEQ ID NO: 831232 - RNA, 15 nt, Homo sapiens
ugaacacacucagca

SEQ ID NO: 831233 - RNA, 23 nt, Homo sapiens
ugaacagguucuuuaaaaugcca

SEQ ID NO: 831234 - RNA, 15 nt, Homo sapiens
ugaacucgaagccca

SEQ ID NO: 831235 - RNA, 13 nt, Homo sapiens
ugaagacccagug

SEQ ID NO: 831236 - RNA, 23 nt, Homo sapiens
ugaagacccaguguaaagaauaa

SEQ ID NO: 831237 - RNA, 23 nt, Homo sapiens
ugacaaauucuuuuucacacuga

SEQ ID NO: 831238 - RNA, 19 nt, Homo sapiens
ugacaauuuauguggauuu

SEQ ID NO: 831239 - RNA, 21 nt, Homo sapiens
ugacacagcugagcuggccua

SEQ ID NO: 831240 - RNA, 16 nt, Homo sapiens
ugacauacauccaaca

SEQ ID NO: 831241 - RNA, 22 nt, Homo sapiens
ugaccucacuucuggcacugug

SEQ ID NO: 831242 - RNA, 18 nt, Homo sapiens
ugacuacuauggcuguuu

SEQ ID NO: 831243 - RNA, 21 nt, Homo sapiens
ugagaacaagucacagcugca

SEQ ID NO: 831244 - RNA, 16 nt, Homo sapiens
ugagcauuagcuacuu

SEQ ID NO: 831245 - RNA, 18 nt, Homo sapiens
ugagcuggggaugucucu

SEQ ID NO: 831246 - RNA, 20 nt, Homo sapiens
ugagcuggggaugucucuca

SEQ ID NO: 831247 - RNA, 18 nt, Homo sapiens
ugaggcaaaaacugcuua

SEQ ID NO: 831248 - RNA, 13 nt, Homo sapiens
ugaggccucucau

SEQ ID NO: 831249 - RNA, 15 nt, Homo sapiens
ugaggggcucucuca

SEQ ID NO: 831250 - RNA, 22 nt, Homo sapiens
ugagucucuaugaucuuggcac

SEQ ID NO: 831251 - RNA, 14 nt, Homo sapiens
ugagugaccucacu

SEQ ID NO: 831252 - RNA, 16 nt, Homo sapiens
ugaguggcagccaugc

SEQ ID NO: 831253 - RNA, 16 nt, Homo sapiens
ugauggccaggccaga

SEQ ID NO: 831254 - RNA, 18 nt, Homo sapiens
ugauuaaaaucuggcaaa

SEQ ID NO: 831255 - RNA, 19 nt, Homo sapiens
ugcacauuuuguacaaaga

SEQ ID NO: 831256 - RNA, 18 nt, Homo sapiens
agccuuggcucuacccug

SEQ ID NO: 831257 - RNA, 13 nt, Homo sapiens
agcuaagucuugu

SEQ ID NO: 831258 - RNA, 19 nt, Homo sapiens
agcuacucacuuaucugau

SEQ ID NO: 831259 - RNA, 20 nt, Homo sapiens
agcuauuagcaacugugcua

SEQ ID NO: 831260 - RNA, 15 nt, Homo sapiens
agcucugaacaaaag

SEQ ID NO: 831261 - RNA, 16 nt, Homo sapiens
agcucugaacaaaagc

SEQ ID NO: 831262 - RNA, 19 nt, Homo sapiens
agcugacaguccucuccac

SEQ ID NO: 831263 - RNA, 15 nt, Homo sapiens
agcuggacaaggugu

SEQ ID NO: 831264 - RNA, 17 nt, Homo sapiens
agcugggccccaugcuc

SEQ ID NO: 831265 - RNA, 11 nt, Homo sapiens
agcuguucuca

SEQ ID NO: 831266 - RNA, 17 nt, Homo sapiens
agcuucugccacuuccc

SEQ ID NO: 831267 - RNA, 18 nt, Homo sapiens
agcuucugccacuuccca

SEQ ID NO: 831268 - RNA, 14 nt, Homo sapiens
aggaaaaccaugac

SEQ ID NO: 831269 - RNA, 23 nt, Homo sapiens
aggacuuagggugucguuuucac

SEQ ID NO: 831270 - RNA, 16 nt, Homo sapiens
aggagaaaaugcauua

SEQ ID NO: 831271 - RNA, 16 nt, Homo sapiens
aggagagaacagggau

SEQ ID NO: 831272 - RNA, 21 nt, Homo sapiens
aggagucccugccaucauguu

SEQ ID NO: 831273 - RNA, 23 nt, Homo sapiens
aggauuauuuuaaauacaaaagg

SEQ ID NO: 831274 - RNA, 19 nt, Homo sapiens
aggcaagccccucagcccu

SEQ ID NO: 831275 - RNA, 14 nt, Homo sapiens
aggcacagcacagg

SEQ ID NO: 831276 - RNA, 13 nt, Homo sapiens
aggccaaggcagg

SEQ ID NO: 831277 - RNA, 17 nt, Homo sapiens
aggccagagugcugcca

SEQ ID NO: 831278 - RNA, 15 nt, Homo sapiens
aggccagcaccaucu

SEQ ID NO: 831279 - RNA, 16 nt, Homo sapiens
aggcucacagcuggaa

SEQ ID NO: 831280 - RNA, 11 nt, Homo sapiens
agggaauuuaa

SEQ ID NO: 831281 - RNA, 19 nt, Homo sapiens
agggaugggagaguggcuu

SEQ ID NO: 831282 - RNA, 21 nt, Homo sapiens
agggccaacgcuugacacaaa

SEQ ID NO: 831283 - RNA, 20 nt, Homo sapiens
agggccuucuccacagggac

SEQ ID NO: 831284 - RNA, 14 nt, Homo sapiens
aggggcucucucau

SEQ ID NO: 831285 - RNA, 14 nt, Homo sapiens
aggggucauucaug

SEQ ID NO: 831286 - RNA, 13 nt, Homo sapiens
aggucuccuccac

SEQ ID NO: 831287 - RNA, 21 nt, Homo sapiens
aggucucgcugaugcugggcu

SEQ ID NO: 831288 - RNA, 20 nt, Homo sapiens
aggugggcgggcagcacagc

SEQ ID NO: 831289 - RNA, 23 nt, Homo sapiens
agguuaucugccuggccuggcuc

SEQ ID NO: 831290 - RNA, 18 nt, Homo sapiens
agguucuuuaaaaugcca

SEQ ID NO: 831291 - RNA, 19 nt, Homo sapiens
agguuucacuguucaugaa

SEQ ID NO: 831292 - RNA, 17 nt, Homo sapiens
aguaacacaccaagugg

SEQ ID NO: 831293 - RNA, 20 nt, Homo sapiens
aguaacaggccuugagcaca

SEQ ID NO: 831294 - RNA, 20 nt, Homo sapiens
aguaauuuugugaaagaagg

SEQ ID NO: 831295 - RNA, 22 nt, Homo sapiens
aguacuguugguuaaaugacaa

SEQ ID NO: 831296 - RNA, 15 nt, Homo sapiens
aguauguggaagugu

SEQ ID NO: 831297 - RNA, 19 nt, Homo sapiens
aguauucaggcacugagaa

SEQ ID NO: 831298 - RNA, 23 nt, Homo sapiens
agucacuuccuucagcaucucac

SEQ ID NO: 831299 - RNA, 13 nt, Homo sapiens
agucauccucaga

SEQ ID NO: 831300 - RNA, 21 nt, Homo sapiens
agucauugaaauuuacuguga

SEQ ID NO: 831301 - RNA, 22 nt, Homo sapiens
aguccacuuuuaaaacuauauu

SEQ ID NO: 831302 - RNA, 17 nt, Homo sapiens
agucccugccaucaugu

SEQ ID NO: 831303 - RNA, 10 nt, Homo sapiens
aguccucaca

SEQ ID NO: 831304 - RNA, 12 nt, Homo sapiens
agucucuaugau

SEQ ID NO: 831305 - RNA, 14 nt, Homo sapiens
agucucuaugaucu

SEQ ID NO: 831306 - RNA, 14 nt, Homo sapiens
agucuguuggcaau

SEQ ID NO: 831307 - RNA, 15 nt, Homo sapiens
agugagacacaguaa

SEQ ID NO: 831308 - RNA, 23 nt, Homo sapiens
agugcaguggugcgaucuuggcu

SEQ ID NO: 831309 - RNA, 23 nt, Homo sapiens
agugcuugcagaucaucugggga

SEQ ID NO: 831310 - RNA, 15 nt, Homo sapiens
agugggguagguugg

SEQ ID NO: 831311 - RNA, 17 nt, Homo sapiens
agugggucccacuuccc

SEQ ID NO: 831312 - RNA, 18 nt, Homo sapiens
agugggucccacuucccc

SEQ ID NO: 831313 - RNA, 14 nt, Homo sapiens
agugguuguugcca

SEQ ID NO: 831314 - RNA, 23 nt, Homo sapiens
agugugaguggcagccaugccuc

SEQ ID NO: 831315 - RNA, 17 nt, Homo sapiens
aguguucaguaaacaaa

SEQ ID NO: 831316 - RNA, 23 nt, Homo sapiens
aguuaauuuuauuccaguaagga

SEQ ID NO: 831317 - RNA, 18 nt, Homo sapiens
aguuacaaaauacaaaag

SEQ ID NO: 831318 - RNA, 19 nt, Homo sapiens
aguuauacaucuucauuaa

SEQ ID NO: 831319 - RNA, 21 nt, Homo sapiens
aguucacaggccagaaaacau

SEQ ID NO: 831320 - RNA, 20 nt, Homo sapiens
aguugguguucauaauuuca

SEQ ID NO: 831321 - RNA, 20 nt, Homo sapiens
aguuuugacgguuuaugcug

SEQ ID NO: 831322 - RNA, 16 nt, Homo sapiens
aguuuugagaaacaaa

SEQ ID NO: 831323 - RNA, 18 nt, Homo sapiens
auaaacaugcuugcauua

SEQ ID NO: 831324 - RNA, 21 nt, Homo sapiens
auaaacauugguauauuucca

SEQ ID NO: 831325 - RNA, 20 nt, Homo sapiens
auaaacuagucuguuggcaa

SEQ ID NO: 831326 - RNA, 18 nt, Homo sapiens
auaaccccaagacagucu

SEQ ID NO: 831327 - RNA, 18 nt, Homo sapiens
auaaucacaacccuucag

SEQ ID NO: 831328 - RNA, 17 nt, Homo sapiens
auaauguaauacuguag

SEQ ID NO: 831329 - RNA, 23 nt, Homo sapiens
auacacccccaccuccugcaaua

SEQ ID NO: 831330 - RNA, 14 nt, Homo sapiens
auacagaaugaauc

SEQ ID NO: 831331 - RNA, 15 nt, Homo sapiens
auacaucuucauuaa

SEQ ID NO: 831332 - RNA, 13 nt, Homo sapiens
auacauguagaau

SEQ ID NO: 831333 - RNA, 23 nt, Homo sapiens
auagaaauguaaaaguacucuga

SEQ ID NO: 831334 - RNA, 15 nt, Homo sapiens
auaguucuuacuacu

SEQ ID NO: 831335 - RNA, 13 nt, Homo sapiens
auauacauaugac

SEQ ID NO: 831336 - RNA, 14 nt, Homo sapiens
auauacauaugaca

SEQ ID NO: 831337 - RNA, 16 nt, Homo sapiens
auauacauaugacaua

SEQ ID NO: 831338 - RNA, 23 nt, Homo sapiens
auauccaagaagcaugcagagaa

SEQ ID NO: 831339 - RNA, 12 nt, Homo sapiens
auauucccaugg

SEQ ID NO: 831340 - RNA, 20 nt, Homo sapiens
auauuucccaauacauacca

SEQ ID NO: 831341 - RNA, 18 nt, Homo sapiens
auauuuuaaaaaaucaaa

SEQ ID NO: 831342 - RNA, 15 nt, Homo sapiens
auauuuucacaugac

SEQ ID NO: 831343 - RNA, 17 nt, Homo sapiens
aucauagcucacuguaa

SEQ ID NO: 831344 - RNA, 15 nt, Homo sapiens
aucauuaucagccug

SEQ ID NO: 831345 - RNA, 21 nt, Homo sapiens
aucauugacuaaagccauuug

SEQ ID NO: 831346 - RNA, 17 nt, Homo sapiens
auccaagaagcaugcag

SEQ ID NO: 831347 - RNA, 19 nt, Homo sapiens
auccauggggcugauugua

SEQ ID NO: 831348 - RNA, 20 nt, Homo sapiens
auccaugugcugcuguggca

SEQ ID NO: 831349 - RNA, 23 nt, Homo sapiens
auccaugugcugcuguggcauca

SEQ ID NO: 831350 - RNA, 23 nt, Homo sapiens
auccuauuuugaaccccucucca

SEQ ID NO: 831351 - RNA, 17 nt, Homo sapiens
uuguccugccagcugcc

SEQ ID NO: 831352 - RNA, 20 nt, Homo sapiens
uuguggguuuuuucacauaa

SEQ ID NO: 831353 - RNA, 11 nt, Homo sapiens
uuguugcucag

SEQ ID NO: 831354 - RNA, 22 nt, Homo sapiens
uuuaccauaaaaauccuucuca

SEQ ID NO: 831355 - RNA, 20 nt, Homo sapiens
uuuaucuaaauuacagugca

SEQ ID NO: 831356 - RNA, 14 nt, Homo sapiens
uuuaugaugcaguu

SEQ ID NO: 831357 - RNA, 12 nt, Homo sapiens
uuuaugguucuc

SEQ ID NO: 831358 - RNA, 18 nt, Homo sapiens
uuucaaccgcuugccaua

SEQ ID NO: 831359 - RNA, 15 nt, Homo sapiens
uuucaauaucauuac

SEQ ID NO: 831360 - RNA, 17 nt, Homo sapiens
uuucacauaaacacaua

SEQ ID NO: 831361 - RNA, 21 nt, Homo sapiens
uuucagaauugaaggagaaaa

SEQ ID NO: 831362 - RNA, 19 nt, Homo sapiens
uuuccaaagggcaguaaag

SEQ ID NO: 831363 - RNA, 21 nt, Homo sapiens
uuuccacugccaaaacaaugc

SEQ ID NO: 831364 - RNA, 20 nt, Homo sapiens
uuuccacugugcuauuacaa

SEQ ID NO: 831365 - RNA, 21 nt, Homo sapiens
uuucuaaagcucugaacaaaa

SEQ ID NO: 831366 - RNA, 14 nt, Homo sapiens
uuugaauuaaucua

SEQ ID NO: 831367 - RNA, 22 nt, Homo sapiens
uuugagaacaauggagauauca

SEQ ID NO: 831368 - RNA, 18 nt, Homo sapiens
uuugcaacaagacaaagc

SEQ ID NO: 831369 - RNA, 20 nt, Homo sapiens
uuugggguccuagcccagug

SEQ ID NO: 831370 - RNA, 16 nt, Homo sapiens
uuuucacauaugacaa

SEQ ID NO: 831371 - RNA, 23 nt, Homo sapiens
uuuucucuccuaagacaccugca

SEQ ID NO: 831372 - RNA, 18 nt, Homo sapiens
uuuuuaccuaggcaccau

SEQ ID NO: 831373 - RNA, 20 nt, Homo sapiens
uuuuuaccuauaccuaugug

SEQ ID NO: 831374 - RNA, 19 nt, Homo sapiens
uuuuugaaaaaaguauagg

SEQ ID NO: 831375 - RNA, 14 nt, Homo sapiens
uuuuuguacacauc

SEQ ID NO: 831376 - RNA, 21 nt, Homo sapiens
ucuaauccaugugcugcugug

SEQ ID NO: 831377 - RNA, 13 nt, Homo sapiens
ucuacacauauau

SEQ ID NO: 831378 - RNA, 22 nt, Homo sapiens
ucuacauuuuauuacacuaaau

SEQ ID NO: 831379 - RNA, 23 nt, Homo sapiens
ucuaguugauugcgagaauuuuc

SEQ ID NO: 831380 - RNA, 15 nt, Homo sapiens
ucuaugaauugcuaa

SEQ ID NO: 831381 - RNA, 19 nt, Homo sapiens
ucuauggguuggacaaccu

SEQ ID NO: 831382 - RNA, 19 nt, Homo sapiens
ucucaauuugaaacacaag

SEQ ID NO: 831383 - RNA, 17 nt, Homo sapiens
ucucacuaaaauggaua

SEQ ID NO: 831384 - RNA, 18 nt, Homo sapiens
ucucaggccugacucuca

SEQ ID NO: 831385 - RNA, 13 nt, Homo sapiens
ucuccccaugugc

SEQ ID NO: 831386 - RNA, 13 nt, Homo sapiens
ucuccuuugaggg

SEQ ID NO: 831387 - RNA, 23 nt, Homo sapiens
ucucuccuaagacaccugcaaua

SEQ ID NO: 831388 - RNA, 16 nt, Homo sapiens
ucucucgcaagggaag

SEQ ID NO: 831389 - RNA, 18 nt, Homo sapiens
ucucuugcucaccaagaa

SEQ ID NO: 831390 - RNA, 12 nt, Homo sapiens
ucugccacuucc

SEQ ID NO: 831391 - RNA, 23 nt, Homo sapiens
ucuguguguguguaugugggggu

SEQ ID NO: 831392 - RNA, 15 nt, Homo sapiens
ucuguguuuacuuaa

SEQ ID NO: 831393 - RNA, 18 nt, Homo sapiens
ucuuagcugaacaaugaa

SEQ ID NO: 831394 - RNA, 14 nt, Homo sapiens
ucuucauuaccuca

SEQ ID NO: 831395 - RNA, 16 nt, Homo sapiens
ucuuccuaguauauua

SEQ ID NO: 831396 - RNA, 23 nt, Homo sapiens
ucuucuagaauccccacagggaa

SEQ ID NO: 831397 - RNA, 23 nt, Homo sapiens
ucuucuauauuccgggugccauu

SEQ ID NO: 831398 - RNA, 22 nt, Homo sapiens
ucuucuuauucaugcuuucucc

SEQ ID NO: 831399 - RNA, 20 nt, Homo sapiens
ugaaaaccacccuaucauca

SEQ ID NO: 831400 - RNA, 19 nt, Homo sapiens
ugaacuauuagagcugccu

SEQ ID NO: 831401 - RNA, 21 nt, Homo sapiens
ugaacucgaagcccacaaucc

SEQ ID NO: 831402 - RNA, 15 nt, Homo sapiens
ugaaucuuacuccuu

SEQ ID NO: 831403 - RNA, 19 nt, Homo sapiens
ugaauguguugauuugaga

SEQ ID NO: 831404 - RNA, 15 nt, Homo sapiens
ugacaauggcagcua

SEQ ID NO: 831405 - RNA, 16 nt, Homo sapiens
ugagaccgaaucucac

SEQ ID NO: 831406 - RNA, 15 nt, Homo sapiens
ugagcagguguucuu

SEQ ID NO: 831407 - RNA, 23 nt, Homo sapiens
ugagcagguguucuucauuaccu

SEQ ID NO: 831408 - RNA, 17 nt, Homo sapiens
ugagcuggggaugucuc

SEQ ID NO: 831409 - RNA, 22 nt, Homo sapiens
ugagcuggggaugucucucaug

SEQ ID NO: 831410 - RNA, 23 nt, Homo sapiens
ugagggccaacgcuugacacaaa

SEQ ID NO: 831411 - RNA, 16 nt, Homo sapiens
ugaggggcucucucau

SEQ ID NO: 831412 - RNA, 19 nt, Homo sapiens
ugagggugacuauggagcu

SEQ ID NO: 831413 - RNA, 17 nt, Homo sapiens
ugagucuguuugaaaug

SEQ ID NO: 831414 - RNA, 19 nt, Homo sapiens
ugaucacucuggaaaugca

SEQ ID NO: 831415 - RNA, 14 nt, Homo sapiens
ugaugaauuacuuc

SEQ ID NO: 831416 - RNA, 17 nt, Homo sapiens
ugaugaugcaguuuuca

SEQ ID NO: 831417 - RNA, 13 nt, Homo sapiens
ugaugccauguaa

SEQ ID NO: 831418 - RNA, 18 nt, Homo sapiens
ugauggugagcugggaag

SEQ ID NO: 831419 - RNA, 16 nt, Homo sapiens
ugauguacuacauuaa

SEQ ID NO: 831420 - RNA, 15 nt, Homo sapiens
ugauuguauuuaccu

SEQ ID NO: 831421 - RNA, 15 nt, Homo sapiens
ugauuucaaggccau

SEQ ID NO: 831422 - RNA, 14 nt, Homo sapiens
ugcacaucauucau

SEQ ID NO: 831423 - RNA, 23 nt, Homo sapiens
ugcacucugugcccaugggcacu

SEQ ID NO: 831424 - RNA, 14 nt, Homo sapiens
ugcacuguccugcu

SEQ ID NO: 831425 - RNA, 19 nt, Homo sapiens
ugcagggaagagggcagua

SEQ ID NO: 831426 - RNA, 16 nt, Homo sapiens
ugcauuuaugaugcag

SEQ ID NO: 831427 - RNA, 20 nt, Homo sapiens
ugccagucucuucugauuaa

SEQ ID NO: 831428 - RNA, 17 nt, Homo sapiens
ugccaugucuuguucag

SEQ ID NO: 831429 - RNA, 21 nt, Homo sapiens
ugccuccacucccacuucccu

SEQ ID NO: 831430 - RNA, 21 nt, Homo sapiens
ugccuguacuaaggagcauga

SEQ ID NO: 831431 - RNA, 15 nt, Homo sapiens
ugccuuccuguuuaa

SEQ ID NO: 831432 - RNA, 15 nt, Homo sapiens
ugccuuuaaauauaa

SEQ ID NO: 831433 - RNA, 23 nt, Homo sapiens
ugcggugcauacacccccaccuc

SEQ ID NO: 831434 - RNA, 12 nt, Homo sapiens
ugcuacauauau

SEQ ID NO: 831435 - RNA, 13 nt, Homo sapiens
ugcuauauugccc

SEQ ID NO: 831436 - RNA, 21 nt, Homo sapiens
ugcuauuguagagccagaggu

SEQ ID NO: 831437 - RNA, 14 nt, Homo sapiens
ugcuccacaguguu

SEQ ID NO: 831438 - RNA, 21 nt, Homo sapiens
ugcugaugcuguuaaccaaag

SEQ ID NO: 831439 - RNA, 21 nt, Homo sapiens
ugcuguagacauuugcuauga

SEQ ID NO: 831440 - RNA, 15 nt, Homo sapiens
ugcuguauccaucca

SEQ ID NO: 831441 - RNA, 14 nt, Homo sapiens
ugcuguuaaccaaa

SEQ ID NO: 831442 - RNA, 23 nt, Homo sapiens
ugcuuagcuugagggugacuaug

SEQ ID NO: 831443 - RNA, 19 nt, Homo sapiens
uggaacacaauaauguguc

SEQ ID NO: 831444 - RNA, 18 nt, Homo sapiens
uggaagggccuucuccac

SEQ ID NO: 831445 - RNA, 24 nt, Homo sapiens
uggagcugagcagguguucuucau

SEQ ID NO: 831446 - RNA, 19 nt, Homo sapiens
gaugaaaaccacccuauca

SEQ ID NO: 831447 - RNA, 18 nt, Homo sapiens
gauggcaucuccauguag

SEQ ID NO: 831448 - RNA, 13 nt, Homo sapiens
gauuauauaucau

SEQ ID NO: 831449 - RNA, 22 nt, Homo sapiens
gcaaaugcuacauauaugcaau

SEQ ID NO: 831450 - RNA, 18 nt, Homo sapiens
gcacaaaguaagccucac

SEQ ID NO: 831451 - RNA, 23 nt, Homo sapiens
gcagaucuuuuugugaaauucaa

SEQ ID NO: 831452 - RNA, 13 nt, Homo sapiens
gcagcucuacucu

SEQ ID NO: 831453 - RNA, 19 nt, Homo sapiens
gcagguguucuucauuacc

SEQ ID NO: 831454 - RNA, 17 nt, Homo sapiens
gcaucucccaguucaua

SEQ ID NO: 831455 - RNA, 14 nt, Homo sapiens
gcauuccaugacca

SEQ ID NO: 831456 - RNA, 18 nt, Homo sapiens
gcauuuaugaugcaguuu

SEQ ID NO: 831457 - RNA, 16 nt, Homo sapiens
gccaccacgucugcca

SEQ ID NO: 831458 - RNA, 19 nt, Homo sapiens
gccacucaggggucauuca

SEQ ID NO: 831459 - RNA, 18 nt, Homo sapiens
gccaggcguuggugccac

SEQ ID NO: 831460 - RNA, 23 nt, Homo sapiens
gccauuauuucaaccgcuugcca

SEQ ID NO: 831461 - RNA, 20 nt, Homo sapiens
gcccacuguaacaauacugg

SEQ ID NO: 831462 - RNA, 19 nt, Homo sapiens
gcccaggcuggagugcagu

SEQ ID NO: 831463 - RNA, 23 nt, Homo sapiens
gcccuuuuaguucuuagagcacu

SEQ ID NO: 831464 - RNA, 18 nt, Homo sapiens
gccguccauggcaccagc

SEQ ID NO: 831465 - RNA, 21 nt, Homo sapiens
gccuggcuccccacgagucac

SEQ ID NO: 831466 - RNA, 15 nt, Homo sapiens
gccugggacccagcu

SEQ ID NO: 831467 - RNA, 15 nt, Homo sapiens
gccuuauuggcagcu

SEQ ID NO: 831468 - RNA, 20 nt, Homo sapiens
gccuucuccccuccaaguga

SEQ ID NO: 831469 - RNA, 14 nt, Homo sapiens
gccuugccaugucu

SEQ ID NO: 831470 - RNA, 15 nt, Homo sapiens
gccuugccaugucuu

SEQ ID NO: 831471 - RNA, 18 nt, Homo sapiens
gccuuuuauaaaccucua

SEQ ID NO: 831472 - RNA, 19 nt, Homo sapiens
gcuaaacgcaaugucauuu

SEQ ID NO: 831473 - RNA, 14 nt, Homo sapiens
gcuacuggcagcuc

SEQ ID NO: 831474 - RNA, 17 nt, Homo sapiens
gcuaucucgcuagccau

SEQ ID NO: 831475 - RNA, 15 nt, Homo sapiens
gcucuggcaccacua

SEQ ID NO: 831476 - RNA, 22 nt, Homo sapiens
gcugagucccuccaugcaaaag

SEQ ID NO: 831477 - RNA, 23 nt, Homo sapiens
gcugcucuuagugcccgccuagg

SEQ ID NO: 831478 - RNA, 23 nt, Homo sapiens
gcugcuuucgaauaaagugaaua

SEQ ID NO: 831479 - RNA, 14 nt, Homo sapiens
gcugggccccaccu

SEQ ID NO: 831480 - RNA, 22 nt, Homo sapiens
gcuguccagugcccauuccuca

SEQ ID NO: 831481 - RNA, 23 nt, Homo sapiens
gcuuaugcuuguuucauacaugu

SEQ ID NO: 831482 - RNA, 19 nt, Homo sapiens
gcuucaccccugcacuuca

SEQ ID NO: 831483 - RNA, 11 nt, Homo sapiens
cacugcuguag

SEQ ID NO: 831484 - RNA, 21 nt, Homo sapiens
cacuggcauuaaagugcugua

SEQ ID NO: 831485 - RNA, 22 nt, Homo sapiens
cacuguuuaacugggagugaua

SEQ ID NO: 831486 - RNA, 12 nt, Homo sapiens
cacuuaucugau

SEQ ID NO: 831487 - RNA, 15 nt, Homo sapiens
cacuuauuuccaugg

SEQ ID NO: 831488 - RNA, 18 nt, Homo sapiens
cacuucuucuucuagaau

SEQ ID NO: 831489 - RNA, 20 nt, Homo sapiens
cacuucuuugcagagccuuu

SEQ ID NO: 831490 - RNA, 11 nt, Homo sapiens
cagaacagagg

SEQ ID NO: 831491 - RNA, 22 nt, Homo sapiens
cagaaggagggcagagccaugg

SEQ ID NO: 831492 - RNA, 16 nt, Homo sapiens
cagaauaaauaagcaa

SEQ ID NO: 831493 - RNA, 20 nt, Homo sapiens
cagaaucgcuaauagaacca

SEQ ID NO: 831494 - RNA, 18 nt, Homo sapiens
cagaaucugcuguugcca

SEQ ID NO: 831495 - RNA, 18 nt, Homo sapiens
cagagaaagaaagggaaa

SEQ ID NO: 831496 - RNA, 16 nt, Homo sapiens
cagagccacuaccuuu

SEQ ID NO: 831497 - RNA, 13 nt, Homo sapiens
cagagcugggcua

SEQ ID NO: 831498 - RNA, 13 nt, Homo sapiens
cagcacugacaau

SEQ ID NO: 831499 - RNA, 15 nt, Homo sapiens
cagccagucuugccu

SEQ ID NO: 831500 - RNA, 18 nt, Homo sapiens
cagccaugccucaugcca

SEQ ID NO: 831501 - RNA, 20 nt, Homo sapiens
cagcccacagagccugaauu

SEQ ID NO: 831502 - RNA, 17 nt, Homo sapiens
cagccccaacuccaggg

SEQ ID NO: 831503 - RNA, 18 nt, Homo sapiens
cagccccaacuccagggg

SEQ ID NO: 831504 - RNA, 19 nt, Homo sapiens
cagccuucuccugucucca

SEQ ID NO: 831505 - RNA, 22 nt, Homo sapiens
cagcguuuuuaccuaggcacca

SEQ ID NO: 831506 - RNA, 16 nt, Homo sapiens
cagcuaagccugauga

SEQ ID NO: 831507 - RNA, 17 nt, Homo sapiens
cagcuaagccugaugau

SEQ ID NO: 831508 - RNA, 17 nt, Homo sapiens
cagcuuuucccaggaga

SEQ ID NO: 831509 - RNA, 23 nt, Homo sapiens
cagcuuuucccaggagaccauuu

SEQ ID NO: 831510 - RNA, 20 nt, Homo sapiens
caggaggguugggcgugcua

SEQ ID NO: 831511 - RNA, 13 nt, Homo sapiens
caggagucccugc

SEQ ID NO: 831512 - RNA, 18 nt, Homo sapiens
caggagucccugccauca

SEQ ID NO: 831513 - RNA, 15 nt, Homo sapiens
caggcacagcacagg

SEQ ID NO: 831514 - RNA, 16 nt, Homo sapiens
cagggaagagggcagu

SEQ ID NO: 831515 - RNA, 22 nt, Homo sapiens
cagguaggcccuuguccugcca

SEQ ID NO: 831516 - RNA, 23 nt, Homo sapiens
caggucuccuccaccgccauggc

SEQ ID NO: 831517 - RNA, 21 nt, Homo sapiens
cagguguucuucauuaccuca

SEQ ID NO: 831518 - RNA, 22 nt, Homo sapiens
caguacacuuccugugccaugu

SEQ ID NO: 831519 - RNA, 18 nt, Homo sapiens
caguacagauuguucuca

SEQ ID NO: 831520 - RNA, 18 nt, Homo sapiens
caguagguagacacaaac

SEQ ID NO: 831521 - RNA, 23 nt, Homo sapiens
cagugauggcgcgggaggcacca

SEQ ID NO: 831522 - RNA, 18 nt, Homo sapiens
cagugcccauuccucacc

SEQ ID NO: 831523 - RNA, 19 nt, Homo sapiens
caguggcuggaucugugag

SEQ ID NO: 831524 - RNA, 18 nt, Homo sapiens
caguggugcgaucuuggc

SEQ ID NO: 831525 - RNA, 19 nt, Homo sapiens
caguguaaagaauaaauga

SEQ ID NO: 831526 - RNA, 20 nt, Homo sapiens
caguguaaagaauaaaugaa

SEQ ID NO: 831527 - RNA, 15 nt, Homo sapiens
cagugucuuccugug

SEQ ID NO: 831528 - RNA, 14 nt, Homo sapiens
caguguucaguaaa

SEQ ID NO: 831529 - RNA, 12 nt, Homo sapiens
caguucugauga

SEQ ID NO: 831530 - RNA, 19 nt, Homo sapiens
cauaauucuuuugaaaaua

SEQ ID NO: 831531 - RNA, 18 nt, Homo sapiens
agcugggccccaccuacu

SEQ ID NO: 831532 - RNA, 19 nt, Homo sapiens
agcuggggaugucucucau

SEQ ID NO: 831533 - RNA, 15 nt, Homo sapiens
agcuucugcugggcu

SEQ ID NO: 831534 - RNA, 19 nt, Homo sapiens
agcuuuccucaucaggcca

SEQ ID NO: 831535 - RNA, 15 nt, Homo sapiens
aggaaggcagcugcu

SEQ ID NO: 831536 - RNA, 13 nt, Homo sapiens
aggaccacagugg

SEQ ID NO: 831537 - RNA, 19 nt, Homo sapiens
aggagcugauuuccaggcc

SEQ ID NO: 831538 - RNA, 14 nt, Homo sapiens
aggagucagggaga

SEQ ID NO: 831539 - RNA, 20 nt, Homo sapiens
aggcaaagagaaaagccacg

SEQ ID NO: 831540 - RNA, 14 nt, Homo sapiens
aggcaccaucauuu

SEQ ID NO: 831541 - RNA, 20 nt, Homo sapiens
aggcagugggucccacuucc

SEQ ID NO: 831542 - RNA, 23 nt, Homo sapiens
aggccagaaaacauaugcauuau

SEQ ID NO: 831543 - RNA, 23 nt, Homo sapiens
aggccuccagccacuuauuucca

SEQ ID NO: 831544 - RNA, 14 nt, Homo sapiens
aggccuugagcaca

SEQ ID NO: 831545 - RNA, 20 nt, Homo sapiens
agggacaccaagccuuggcu

SEQ ID NO: 831546 - RNA, 12 nt, Homo sapiens
agggaugggaga

SEQ ID NO: 831547 - RNA, 23 nt, Homo sapiens
agggcagggcugaggccucucau

SEQ ID NO: 831548 - RNA, 17 nt, Homo sapiens
agggcccagcuguagcc

SEQ ID NO: 831549 - RNA, 18 nt, Homo sapiens
agggccccucccucugcc

SEQ ID NO: 831550 - RNA, 19 nt, Homo sapiens
agggcuccagcauccagcc

SEQ ID NO: 831551 - RNA, 15 nt, Homo sapiens
aggggcucucucaug

SEQ ID NO: 831552 - RNA, 13 nt, Homo sapiens
aggggucauucau

SEQ ID NO: 831553 - RNA, 16 nt, Homo sapiens
agguaaugcacauccu

SEQ ID NO: 831554 - RNA, 13 nt, Homo sapiens
agguagacacaaa

SEQ ID NO: 831555 - RNA, 15 nt, Homo sapiens
aggugagaccaccuc

SEQ ID NO: 831556 - RNA, 16 nt, Homo sapiens
aggugccaacaguguu

SEQ ID NO: 831557 - RNA, 23 nt, Homo sapiens
agguggguccaggaaggcagcug

SEQ ID NO: 831558 - RNA, 20 nt, Homo sapiens
agguguucuucauuaccuca

SEQ ID NO: 831559 - RNA, 21 nt, Homo sapiens
agguuuccugguccaucucau

SEQ ID NO: 831560 - RNA, 19 nt, Homo sapiens
aguaaacuggauacuguac

SEQ ID NO: 831561 - RNA, 16 nt, Homo sapiens
aguaacaaaaguauag

SEQ ID NO: 831562 - RNA, 14 nt, Homo sapiens
aguaacacaccaag

SEQ ID NO: 831563 - RNA, 17 nt, Homo sapiens
aguaacugcacacuauu

SEQ ID NO: 831564 - RNA, 16 nt, Homo sapiens
aguaaugccacacauu

SEQ ID NO: 831565 - RNA, 14 nt, Homo sapiens
aguaauuuuuuaca

SEQ ID NO: 831566 - RNA, 20 nt, Homo sapiens
aguaauuuuuuacauuuucc

SEQ ID NO: 831567 - RNA, 17 nt, Homo sapiens
aguacagauuguucuca

SEQ ID NO: 831568 - RNA, 19 nt, Homo sapiens
aguacucucugcucuagcc

SEQ ID NO: 831569 - RNA, 19 nt, Homo sapiens
aguacuuacccuaaaacau

SEQ ID NO: 831570 - RNA, 12 nt, Homo sapiens
aguagcauauau

SEQ ID NO: 831571 - RNA, 16 nt, Homo sapiens
aguagguagacacaaa

SEQ ID NO: 831572 - RNA, 14 nt, Homo sapiens
aguagugucuuccu

SEQ ID NO: 831573 - RNA, 23 nt, Homo sapiens
aguauaggauaaauuacauuaaa

SEQ ID NO: 831574 - RNA, 18 nt, Homo sapiens
aguauaguuuugacagag

SEQ ID NO: 831575 - RNA, 11 nt, Homo sapiens
aguauuuccau

SEQ ID NO: 831576 - RNA, 16 nt, Homo sapiens
agucauccucagauca

SEQ ID NO: 831577 - RNA, 12 nt, Homo sapiens
aguccucugcau

SEQ ID NO: 831578 - RNA, 21 nt, Homo sapiens
agucgcaggauccgcugccac

SEQ ID NO: 831579 - RNA, 13 nt, Homo sapiens
agucucuucugau

SEQ ID NO: 831580 - RNA, 13 nt, Homo sapiens
agugaacacacuc

SEQ ID NO: 831581 - RNA, 11 nt, Homo sapiens
agugacaguca

SEQ ID NO: 831582 - RNA, 13 nt, Homo sapiens
agugagaagccag

SEQ ID NO: 831583 - RNA, 10 nt, Homo sapiens
agugcaguuu

SEQ ID NO: 831584 - RNA, 19 nt, Homo sapiens
agugggaggugagaccacc

SEQ ID NO: 831585 - RNA, 18 nt, Homo sapiens
aguuccccucuacuccau

SEQ ID NO: 831586 - RNA, 12 nt, Homo sapiens
aguucugaugag

SEQ ID NO: 831587 - RNA, 16 nt, Homo sapiens
aguugguguucauaau

SEQ ID NO: 831588 - RNA, 17 nt, Homo sapiens
aguuucaaguaccaaaa

SEQ ID NO: 831589 - RNA, 15 nt, Homo sapiens
auaaacuagucuguu

SEQ ID NO: 831590 - RNA, 16 nt, Homo sapiens
auaaagagacugagcc

SEQ ID NO: 831591 - RNA, 18 nt, Homo sapiens
auaaaggcugagcucuua

SEQ ID NO: 831592 - RNA, 20 nt, Homo sapiens
auaaccuucaugaugaauua

SEQ ID NO: 831593 - RNA, 23 nt, Homo sapiens
auaaccuucaugaugaauuacuu

SEQ ID NO: 831594 - RNA, 14 nt, Homo sapiens
auaagaaacacaaa

SEQ ID NO: 831595 - RNA, 20 nt, Homo sapiens
auaagcagucauccucagau

SEQ ID NO: 831596 - RNA, 23 nt, Homo sapiens
auaagcagucauccucagaucau

SEQ ID NO: 831597 - RNA, 17 nt, Homo sapiens
auaauagaagacaaaga

SEQ ID NO: 831598 - RNA, 16 nt, Homo sapiens
auaauguaauacugua

SEQ ID NO: 831599 - RNA, 15 nt, Homo sapiens
auaauugacaugggc

SEQ ID NO: 831600 - RNA, 19 nt, Homo sapiens
auaauuuucuggcacuggu

SEQ ID NO: 831601 - RNA, 23 nt, Homo sapiens
auacaguauaccuggcaauucac

SEQ ID NO: 831602 - RNA, 14 nt, Homo sapiens
auacauaccacuuu

SEQ ID NO: 831603 - RNA, 14 nt, Homo sapiens
auacauuauauucc

SEQ ID NO: 831604 - RNA, 23 nt, Homo sapiens
auacauuguauuaauaccaaagu

SEQ ID NO: 831605 - RNA, 20 nt, Homo sapiens
auaccuggcccugugccuug

SEQ ID NO: 831606 - RNA, 15 nt, Homo sapiens
auagcaccuccacau

SEQ ID NO: 831607 - RNA, 18 nt, Homo sapiens
auagcaccuccacauacc

SEQ ID NO: 831608 - RNA, 20 nt, Homo sapiens
auagcauguucguauuacaa

SEQ ID NO: 831609 - RNA, 16 nt, Homo sapiens
auaggcugcauaugag

SEQ ID NO: 831610 - RNA, 12 nt, Homo sapiens
auagguuuccac

SEQ ID NO: 831611 - RNA, 14 nt, Homo sapiens
auaguaaugugaug

SEQ ID NO: 831612 - RNA, 14 nt, Homo sapiens
auaguguguccaug

SEQ ID NO: 831613 - RNA, 18 nt, Homo sapiens
auauaaacaugcuugcau

SEQ ID NO: 831614 - RNA, 13 nt, Homo sapiens
auauccaagaagc

SEQ ID NO: 831615 - RNA, 14 nt, Homo sapiens
auaugacaauguug

SEQ ID NO: 831616 - RNA, 17 nt, Homo sapiens
auauuauaucacuccca

SEQ ID NO: 831617 - RNA, 18 nt, Homo sapiens
auauucaauaaagcugcu

SEQ ID NO: 831618 - RNA, 22 nt, Homo sapiens
auauucccaugguagacuguga

SEQ ID NO: 831619 - RNA, 16 nt, Homo sapiens
auauuuccaauaacua

SEQ ID NO: 831620 - RNA, 18 nt, Homo sapiens
auauuuccauucaugcca

SEQ ID NO: 831621 - RNA, 13 nt, Homo sapiens
auauuuucacaug

SEQ ID NO: 831622 - RNA, 18 nt, Homo sapiens
auauuuucugaguagcau

SEQ ID NO: 831623 - RNA, 17 nt, Homo sapiens
aucaaaucagucuugga

SEQ ID NO: 831624 - RNA, 18 nt, Homo sapiens
aucaacauuuguuccaug

SEQ ID NO: 831625 - RNA, 22 nt, Homo sapiens
aucaagucugugaaagucuccu

SEQ ID NO: 831626 - RNA, 21 nt, Homo sapiens
aucagucuuggaauacuugaa

SEQ ID NO: 831627 - RNA, 14 nt, Homo sapiens
aucauuuaauguga

SEQ ID NO: 831628 - RNA, 21 nt, Homo sapiens
auccaugugcugcuguggcau

SEQ ID NO: 831629 - RNA, 15 nt, Homo sapiens
auccuccugccucag

SEQ ID NO: 831630 - RNA, 16 nt, Homo sapiens
auccugcgagcuccuu

SEQ ID NO: 831631 - RNA, 21 nt, Homo sapiens
auccuugggagucauuaccac

SEQ ID NO: 831632 - RNA, 12 nt, Homo sapiens
aucuauaucucu

SEQ ID NO: 831633 - RNA, 20 nt, Homo sapiens
aucuauuuucacacuaucca

SEQ ID NO: 831634 - RNA, 20 nt, Homo sapiens
aucucacuucaucaaucaaa

SEQ ID NO: 831635 - RNA, 13 nt, Homo sapiens
aucuccacuguua

SEQ ID NO: 831636 - RNA, 14 nt, Homo sapiens
aucugauaucuguu

SEQ ID NO: 831637 - RNA, 18 nt, Homo sapiens
aucuuccugccucaggcu

SEQ ID NO: 831638 - RNA, 13 nt, Homo sapiens
augaaaagcagaa

SEQ ID NO: 831639 - RNA, 20 nt, Homo sapiens
augaacuuuaaaaaagcaaa

SEQ ID NO: 831640 - RNA, 16 nt, Homo sapiens
augaaucuuacuccuu

SEQ ID NO: 831641 - RNA, 18 nt, Homo sapiens
augaauugacagacuguu

SEQ ID NO: 831642 - RNA, 19 nt, Homo sapiens
augacaauguugcauuuau

SEQ ID NO: 831643 - RNA, 20 nt, Homo sapiens
augacuuuaucauuuuguua

SEQ ID NO: 831644 - RNA, 18 nt, Homo sapiens
augagcaaggacaaccug

SEQ ID NO: 831645 - RNA, 20 nt, Homo sapiens
augagcauuagcuacuuuuc

SEQ ID NO: 831646 - RNA, 23 nt, Homo sapiens
augagcuggggaugucucucaug

SEQ ID NO: 831647 - RNA, 22 nt, Homo sapiens
acacaggggcaaagaacugccc

SEQ ID NO: 831648 - RNA, 18 nt, Homo sapiens
acagaagaucuauauugu

SEQ ID NO: 831649 - RNA, 17 nt, Homo sapiens
acagaaugaaucccaua

SEQ ID NO: 831650 - RNA, 16 nt, Homo sapiens
acagcuuaacauuuac

SEQ ID NO: 831651 - RNA, 13 nt, Homo sapiens
acagugcaguuua

SEQ ID NO: 831652 - RNA, 15 nt, Homo sapiens
acauaaacacauaca

SEQ ID NO: 831653 - RNA, 15 nt, Homo sapiens
acauacauccaacau

SEQ ID NO: 831654 - RNA, 22 nt, Homo sapiens
acauaccuggcccugugccuug

SEQ ID NO: 831655 - RNA, 14 nt, Homo sapiens
acauauauguauau

SEQ ID NO: 831656 - RNA, 14 nt, Homo sapiens
acauaugacauaua

SEQ ID NO: 831657 - RNA, 13 nt, Homo sapiens
acaugacuaggaa

SEQ ID NO: 831658 - RNA, 19 nt, Homo sapiens
acauggacacaccagagug

SEQ ID NO: 831659 - RNA, 17 nt, Homo sapiens
acauuaaaauagcacau

SEQ ID NO: 831660 - RNA, 16 nt, Homo sapiens
acauucaaaaaccccu

SEQ ID NO: 831661 - RNA, 23 nt, Homo sapiens
acauuuugcauuagacagaugac

SEQ ID NO: 831662 - RNA, 19 nt, Homo sapiens
accaaaugcuuuuccucaa

SEQ ID NO: 831663 - RNA, 14 nt, Homo sapiens
accacuaggguccu

SEQ ID NO: 831664 - RNA, 19 nt, Homo sapiens
accacuaugcaauauauca

SEQ ID NO: 831665 - RNA, 20 nt, Homo sapiens
accauaaaaauccuucucac

SEQ ID NO: 831666 - RNA, 17 nt, Homo sapiens
accaucucuuuaccucc

SEQ ID NO: 831667 - RNA, 22 nt, Homo sapiens
accaugaauacacuuacaguua

SEQ ID NO: 831668 - RNA, 20 nt, Homo sapiens
acccagugcugccaugccac

SEQ ID NO: 831669 - RNA, 13 nt, Homo sapiens
acccaugccauag

SEQ ID NO: 831670 - RNA, 15 nt, Homo sapiens
acccaugccauagaa

SEQ ID NO: 831671 - RNA, 14 nt, Homo sapiens
accccaucugccca

SEQ ID NO: 831672 - RNA, 17 nt, Homo sapiens
accccgcggugcucugg

SEQ ID NO: 831673 - RNA, 15 nt, Homo sapiens
acccuaaauguggac

SEQ ID NO: 831674 - RNA, 15 nt, Homo sapiens
acccuaucaucaguu

SEQ ID NO: 831675 - RNA, 14 nt, Homo sapiens
acccuuaggccagc

SEQ ID NO: 831676 - RNA, 22 nt, Homo sapiens
acccuuaggccagcaccaucuc

SEQ ID NO: 831677 - RNA, 14 nt, Homo sapiens
accgcuugccauau

SEQ ID NO: 831678 - RNA, 17 nt, Homo sapiens
accguugcacaaaaagg

SEQ ID NO: 831679 - RNA, 22 nt, Homo sapiens
accucacuucuggcacugugac

SEQ ID NO: 831680 - RNA, 23 nt, Homo sapiens
accuccuaauuccacacccucac

SEQ ID NO: 831681 - RNA, 21 nt, Homo sapiens
accuccuccuccaguucugau

SEQ ID NO: 831682 - RNA, 15 nt, Homo sapiens
accucuuaugcacac

SEQ ID NO: 831683 - RNA, 18 nt, Homo sapiens
accugacaauggcagcua

SEQ ID NO: 831684 - RNA, 18 nt, Homo sapiens
accuggcccugugccuug

SEQ ID NO: 831685 - RNA, 13 nt, Homo sapiens
accuucuaaucca

SEQ ID NO: 831686 - RNA, 15 nt, Homo sapiens
accuuuccugaggaa

SEQ ID NO: 831687 - RNA, 20 nt, Homo sapiens
acgagucaccugcaagcccc

SEQ ID NO: 831688 - RNA, 12 nt, Homo sapiens
acuaaaagaauu

SEQ ID NO: 831689 - RNA, 15 nt, Homo sapiens
acuaaggagcaugau

SEQ ID NO: 831690 - RNA, 19 nt, Homo sapiens
acuacuugccacacacugu

SEQ ID NO: 831691 - RNA, 20 nt, Homo sapiens
acuacuugccacacacuguu

SEQ ID NO: 831692 - RNA, 17 nt, Homo sapiens
acuauggguacauucca

SEQ ID NO: 831693 - RNA, 17 nt, Homo sapiens
acucaggggucauucau

SEQ ID NO: 831694 - RNA, 13 nt, Homo sapiens
acucucugcucua

SEQ ID NO: 831695 - RNA, 22 nt, Homo sapiens
acucuuuaagaccucaaaccau

SEQ ID NO: 831696 - RNA, 14 nt, Homo sapiens
acugaaggggcaca

SEQ ID NO: 831697 - RNA, 23 nt, Homo sapiens
acugcguaggagagaacagggau

SEQ ID NO: 831698 - RNA, 16 nt, Homo sapiens
acugcugggcuuggca

SEQ ID NO: 831699 - RNA, 21 nt, Homo sapiens
acuggaaauguauauuuugua

SEQ ID NO: 831700 - RNA, 15 nt, Homo sapiens
acuggcagcuccucu

SEQ ID NO: 831701 - RNA, 12 nt, Homo sapiens
acuggcauuaaa

SEQ ID NO: 831702 - RNA, 20 nt, Homo sapiens
acuguugguuaaaugacaau

SEQ ID NO: 831703 - RNA, 19 nt, Homo sapiens
acuucuggcacugugacua

SEQ ID NO: 831704 - RNA, 23 nt, Homo sapiens
acuucuggcacugugacuacuau

SEQ ID NO: 831705 - RNA, 21 nt, Homo sapiens
acuugcaccugguacugcaca

SEQ ID NO: 831706 - RNA, 12 nt, Homo sapiens
agaaaaugcauu

SEQ ID NO: 831707 - RNA, 14 nt, Homo sapiens
agaaacuuaaacaa

SEQ ID NO: 831708 - RNA, 13 nt, Homo sapiens
agaaagacacaaa

SEQ ID NO: 831709 - RNA, 17 nt, Homo sapiens
agaaagggaaacuggcu

SEQ ID NO: 831710 - RNA, 22 nt, Homo sapiens
agaaagguaaacaaacaaauaa

SEQ ID NO: 831711 - RNA, 13 nt, Homo sapiens
agaacuacugaua

SEQ ID NO: 831712 - RNA, 17 nt, Homo sapiens
agaagaaagacacaaag

SEQ ID NO: 831713 - RNA, 22 nt, Homo sapiens
agaaggcagcaggcggccuuug

SEQ ID NO: 831714 - RNA, 15 nt, Homo sapiens
agaaggcuaugggga

SEQ ID NO: 831715 - RNA, 17 nt, Homo sapiens
agaaguaaaagcuaauu

SEQ ID NO: 831716 - RNA, 14 nt, Homo sapiens
agaauaaaugaauc

SEQ ID NO: 831717 - RNA, 20 nt, Homo sapiens
agaauaaaugaaucuuacuc

SEQ ID NO: 831718 - RNA, 12 nt, Homo sapiens
agaaucaagucu

SEQ ID NO: 831719 - RNA, 23 nt, Homo sapiens
agacacucccacuuggcaucauu

SEQ ID NO: 831720 - RNA, 19 nt, Homo sapiens
agacauuugcuaugagcug

SEQ ID NO: 831721 - RNA, 13 nt, Homo sapiens
agaccaccucuca

SEQ ID NO: 831722 - RNA, 19 nt, Homo sapiens
agaccauuuguauuaccau

SEQ ID NO: 831723 - RNA, 19 nt, Homo sapiens
agacccugagacuccagaa

SEQ ID NO: 831724 - RNA, 23 nt, Homo sapiens
agacuugaauuuaguuuuuuacc

SEQ ID NO: 831725 - RNA, 14 nt, Homo sapiens
agagaaacaaauaa

SEQ ID NO: 831726 - RNA, 13 nt, Homo sapiens
agagaacagggau

SEQ ID NO: 831727 - RNA, 17 nt, Homo sapiens
agagccaugugucaugu

SEQ ID NO: 831728 - RNA, 20 nt, Homo sapiens
agaggaaaaaggcuucucca

SEQ ID NO: 831729 - RNA, 22 nt, Homo sapiens
agaggcuaagaugagauuugcc

SEQ ID NO: 831730 - RNA, 15 nt, Homo sapiens
agaggggcagccgcu

SEQ ID NO: 831731 - RNA, 22 nt, Homo sapiens
agagugaauuauauuuccuuaa

SEQ ID NO: 831732 - RNA, 18 nt, Homo sapiens
agaguggcauuggcagca

SEQ ID NO: 831733 - RNA, 21 nt, Homo sapiens
agagugggguagguugggaga

SEQ ID NO: 831734 - RNA, 22 nt, Homo sapiens
agauaacagcuuaacauuuaca

SEQ ID NO: 831735 - RNA, 20 nt, Homo sapiens
agauauuucccaauacauac

SEQ ID NO: 831736 - RNA, 18 nt, Homo sapiens
agaucgcuguguuacuaa

SEQ ID NO: 831737 - RNA, 17 nt, Homo sapiens
agauguaaauagaugac

SEQ ID NO: 831738 - RNA, 20 nt, Homo sapiens
agauguucgcucgugcagua

SEQ ID NO: 831739 - RNA, 12 nt, Homo sapiens
agauguuuauau

SEQ ID NO: 831740 - RNA, 13 nt, Homo sapiens
agauuugccuuau

SEQ ID NO: 831741 - RNA, 19 nt, Homo sapiens
agcaaauuagaaacaccau

SEQ ID NO: 831742 - RNA, 16 nt, Homo sapiens
agcaagucacuggcca

SEQ ID NO: 831743 - RNA, 19 nt, Homo sapiens
agcaagucacuggccagug

SEQ ID NO: 831744 - RNA, 20 nt, Homo sapiens
agcaaugguaauugugaaua

SEQ ID NO: 831745 - RNA, 13 nt, Homo sapiens
agcacugacaaua

SEQ ID NO: 831746 - RNA, 22 nt, Homo sapiens
agcagcuucugccacuucccag

SEQ ID NO: 831747 - RNA, 11 nt, Homo sapiens
agccaugggcc

SEQ ID NO: 831748 - RNA, 22 nt, Homo sapiens
agccaugugucauguaauacug

SEQ ID NO: 831749 - RNA, 14 nt, Homo sapiens
agccccacagccca

SEQ ID NO: 831750 - RNA, 15 nt, Homo sapiens
agcuaagccugauga

SEQ ID NO: 831751 - RNA, 17 nt, Homo sapiens
agcugaacaaugaaugc

SEQ ID NO: 831752 - RNA, 21 nt, Homo sapiens
agcuggaacacaauaaugugu

SEQ ID NO: 831753 - RNA, 17 nt, Homo sapiens
agcuugaaagcaguuaa

SEQ ID NO: 831754 - RNA, 21 nt, Homo sapiens
agcuuuucccaggagaccauu

SEQ ID NO: 831755 - RNA, 20 nt, Homo sapiens
aggaaaaucuuaaaauucuu

SEQ ID NO: 831756 - RNA, 20 nt, Homo sapiens
aggaagccugaggcaaaaac

SEQ ID NO: 831757 - RNA, 22 nt, Homo sapiens
aggagaccauuuguauuaccau

SEQ ID NO: 831758 - RNA, 17 nt, Homo sapiens
aggcaagccccucagcc

SEQ ID NO: 831759 - RNA, 17 nt, Homo sapiens
aggccacagugcaauuu

SEQ ID NO: 831760 - RNA, 15 nt, Homo sapiens
aggccauugucccug

SEQ ID NO: 831761 - RNA, 18 nt, Homo sapiens
aggcccacuggcauuaaa

SEQ ID NO: 831762 - RNA, 16 nt, Homo sapiens
aggcccuccaugggcu

SEQ ID NO: 831763 - RNA, 15 nt, Homo sapiens
ccaaaaguacuuacc

SEQ ID NO: 831764 - RNA, 13 nt, Homo sapiens
ccaaagacuacac

SEQ ID NO: 831765 - RNA, 15 nt, Homo sapiens
ccaaauugcuucuag

SEQ ID NO: 831766 - RNA, 17 nt, Homo sapiens
ccaacagagcugggcua

SEQ ID NO: 831767 - RNA, 21 nt, Homo sapiens
ccaacauuaaaagccaccccc

SEQ ID NO: 831768 - RNA, 18 nt, Homo sapiens
ccaacgcuugacacaaag

SEQ ID NO: 831769 - RNA, 15 nt, Homo sapiens
ccaagaagcaugcag

SEQ ID NO: 831770 - RNA, 18 nt, Homo sapiens
ccaaggggguggacgcaa

SEQ ID NO: 831771 - RNA, 12 nt, Homo sapiens
ccacccuaucau

SEQ ID NO: 831772 - RNA, 16 nt, Homo sapiens
ccaccugacaauggca

SEQ ID NO: 831773 - RNA, 19 nt, Homo sapiens
ccacuuccccuccuacccc

SEQ ID NO: 831774 - RNA, 17 nt, Homo sapiens
ccacuuggcaucauuca

SEQ ID NO: 831775 - RNA, 23 nt, Homo sapiens
ccagaaggagggcagagccaugg

SEQ ID NO: 831776 - RNA, 18 nt, Homo sapiens
ccagaggucuggcccuau

SEQ ID NO: 831777 - RNA, 13 nt, Homo sapiens
ccagagugcugcc

SEQ ID NO: 831778 - RNA, 16 nt, Homo sapiens
ccagauucugugccaa

SEQ ID NO: 831779 - RNA, 21 nt, Homo sapiens
ccagccugggacucccaguga

SEQ ID NO: 831780 - RNA, 14 nt, Homo sapiens
ccaguucugaugag

SEQ ID NO: 831781 - RNA, 13 nt, Homo sapiens
ccauagaaacuga

SEQ ID NO: 831782 - RNA, 16 nt, Homo sapiens
ccauagaaacugaggc

SEQ ID NO: 831783 - RNA, 14 nt, Homo sapiens
ccauagcaccucca

SEQ ID NO: 831784 - RNA, 21 nt, Homo sapiens
ccauauuggcaaggcugccac

SEQ ID NO: 831785 - RNA, 15 nt, Homo sapiens
ccaucucauucaggu

SEQ ID NO: 831786 - RNA, 23 nt, Homo sapiens
ccaugggcuagugugaguggcag

SEQ ID NO: 831787 - RNA, 21 nt, Homo sapiens
ccauggggcugauuguauuua

SEQ ID NO: 831788 - RNA, 18 nt, Homo sapiens
ccaugguagacugugaca

SEQ ID NO: 831789 - RNA, 16 nt, Homo sapiens
ccaugugcugcugugg

SEQ ID NO: 831790 - RNA, 15 nt, Homo sapiens
ccauugguguugaca

SEQ ID NO: 831791 - RNA, 21 nt, Homo sapiens
cccaauacauaccacuuugaa

SEQ ID NO: 831792 - RNA, 11 nt, Homo sapiens
cccacagugac

SEQ ID NO: 831793 - RNA, 17 nt, Homo sapiens
cccaccuccugcaauaa

SEQ ID NO: 831794 - RNA, 23 nt, Homo sapiens
cccacuaagcuuucuccuuugag

SEQ ID NO: 831795 - RNA, 18 nt, Homo sapiens
cccagaaugccuccugca

SEQ ID NO: 831796 - RNA, 17 nt, Homo sapiens
cccagcuguagccaugg

SEQ ID NO: 831797 - RNA, 18 nt, Homo sapiens
cccaggugcaggugcuga

SEQ ID NO: 831798 - RNA, 21 nt, Homo sapiens
cccaguguaaagaauaaauga

SEQ ID NO: 831799 - RNA, 14 nt, Homo sapiens
ccccaagacagucu

SEQ ID NO: 831800 - RNA, 12 nt, Homo sapiens
ccccacagccca

SEQ ID NO: 831801 - RNA, 24 nt, Homo sapiens
ccccagagccacuaccuuugucca

SEQ ID NO: 831802 - RNA, 15 nt, Homo sapiens
ccccauccuggccca

SEQ ID NO: 831803 - RNA, 18 nt, Homo sapiens
cccccucccagacaggcc

SEQ ID NO: 831804 - RNA, 20 nt, Homo sapiens
ccccucccagcugacagucc

SEQ ID NO: 831805 - RNA, 13 nt, Homo sapiens
ccccugucuggaa

SEQ ID NO: 831806 - RNA, 14 nt, Homo sapiens
cccuaaaacaugug

SEQ ID NO: 831807 - RNA, 22 nt, Homo sapiens
cccuaaauguggacaucaugaa

SEQ ID NO: 831808 - RNA, 21 nt, Homo sapiens
cccucccuguauaagacacuu

SEQ ID NO: 831809 - RNA, 16 nt, Homo sapiens
cccucuacuccaugca

SEQ ID NO: 831810 - RNA, 24 nt, Homo sapiens
cccugcccgaccccaucucauuca

SEQ ID NO: 831811 - RNA, 20 nt, Homo sapiens
cccuuaaggguugaaggcag

SEQ ID NO: 831812 - RNA, 13 nt, Homo sapiens
ccgcuugccauau

SEQ ID NO: 831813 - RNA, 15 nt, Homo sapiens
cuucuccacagggac

SEQ ID NO: 831814 - RNA, 15 nt, Homo sapiens
cuugccuaggccaaa

SEQ ID NO: 831815 - RNA, 10 nt, Homo sapiens
cuugcugaug

SEQ ID NO: 831816 - RNA, 18 nt, Homo sapiens
cuuggcacccccaugcug

SEQ ID NO: 831817 - RNA, 19 nt, Homo sapiens
cuuggcagcccgggucauc

SEQ ID NO: 831818 - RNA, 19 nt, Homo sapiens
cuugggaguguugucacac

SEQ ID NO: 831819 - RNA, 19 nt, Homo sapiens
cuugggcuacuggcagcuc

SEQ ID NO: 831820 - RNA, 20 nt, Homo sapiens
cuuguaaaggugcugcacug

SEQ ID NO: 831821 - RNA, 15 nt, Homo sapiens
cuuuaaaaaagcaaa

SEQ ID NO: 831822 - RNA, 16 nt, Homo sapiens
cuuuguugcucagcaa

SEQ ID NO: 831823 - RNA, 16 nt, Homo sapiens
cuuuuauaaaccucua

SEQ ID NO: 831824 - RNA, 13 nt, Homo sapiens
cuuuugucccaga

SEQ ID NO: 831825 - RNA, 14 nt, Homo sapiens
gaaaaaaguauagg

SEQ ID NO: 831826 - RNA, 19 nt, Homo sapiens
gaaaagcaguggcuccauu

SEQ ID NO: 831827 - RNA, 12 nt, Homo sapiens
gaaaaugcauua

SEQ ID NO: 831828 - RNA, 19 nt, Homo sapiens
gaaacaaauaaacuagucu

SEQ ID NO: 831829 - RNA, 16 nt, Homo sapiens
gaaacauuccgaagag

SEQ ID NO: 831830 - RNA, 21 nt, Homo sapiens
gaaacugaggccauuauuuca

SEQ ID NO: 831831 - RNA, 16 nt, Homo sapiens
gaaauaaaugauguac

SEQ ID NO: 831832 - RNA, 14 nt, Homo sapiens
gaacaaugaaugcu

SEQ ID NO: 831833 - RNA, 11 nt, Homo sapiens
gaacuccacuc

SEQ ID NO: 831834 - RNA, 15 nt, Homo sapiens
gaacuccaguacuca

SEQ ID NO: 831835 - RNA, 14 nt, Homo sapiens
gaagaaaacaugac

SEQ ID NO: 831836 - RNA, 15 nt, Homo sapiens
gaagaaaacaugacu

SEQ ID NO: 831837 - RNA, 17 nt, Homo sapiens
gaagccagcuuuccuca

SEQ ID NO: 831838 - RNA, 17 nt, Homo sapiens
gaagcuucaugccaggu

SEQ ID NO: 831839 - RNA, 14 nt, Homo sapiens
gaaggaauuauucc

SEQ ID NO: 831840 - RNA, 15 nt, Homo sapiens
gaaggaauuauuccc

SEQ ID NO: 831841 - RNA, 18 nt, Homo sapiens
gaaggagcaagagaacau

SEQ ID NO: 831842 - RNA, 11 nt, Homo sapiens
gaaggcagcug

SEQ ID NO: 831843 - RNA, 22 nt, Homo sapiens
gaagggccuucuccacagggac

SEQ ID NO: 831844 - RNA, 23 nt, Homo sapiens
gaagguuuccugguccaucucau

SEQ ID NO: 831845 - RNA, 16 nt, Homo sapiens
gaaguaaaagcuaauu

SEQ ID NO: 831846 - RNA, 17 nt, Homo sapiens
gaauaaaugaaucuuac

SEQ ID NO: 831847 - RNA, 21 nt, Homo sapiens
gaauauuuuauuuuuuuggca

SEQ ID NO: 831848 - RNA, 22 nt, Homo sapiens
gaaugaguuuccagcuaagccu

SEQ ID NO: 831849 - RNA, 13 nt, Homo sapiens
gaaugcagggaag

SEQ ID NO: 831850 - RNA, 17 nt, Homo sapiens
gaaugggagcugcaaac

SEQ ID NO: 831851 - RNA, 17 nt, Homo sapiens
gaauuauauuuccuuaa

SEQ ID NO: 831852 - RNA, 23 nt, Homo sapiens
gaauugcuaauucugagggaauu

SEQ ID NO: 831853 - RNA, 18 nt, Homo sapiens
gacccaguguaaagaaua

SEQ ID NO: 831854 - RNA, 18 nt, Homo sapiens
gacccuucagggccagaa

SEQ ID NO: 831855 - RNA, 14 nt, Homo sapiens
gacucucagcagcu

SEQ ID NO: 831856 - RNA, 21 nt, Homo sapiens
gacugguggccccugccuugg

SEQ ID NO: 831857 - RNA, 20 nt, Homo sapiens
gagaaacaaauaaacuaguc

SEQ ID NO: 831858 - RNA, 14 nt, Homo sapiens
gagaaagaaaggga

SEQ ID NO: 831859 - RNA, 21 nt, Homo sapiens
gagaaguuucgagggguccuc

SEQ ID NO: 831860 - RNA, 14 nt, Homo sapiens
gagagaacagggau

SEQ ID NO: 831861 - RNA, 22 nt, Homo sapiens
gagagaucauagcucacuguaa

SEQ ID NO: 831862 - RNA, 15 nt, Homo sapiens
gagauggccaugcuc

SEQ ID NO: 831863 - RNA, 20 nt, Homo sapiens
gagauggggucuugcuauau

SEQ ID NO: 831864 - RNA, 18 nt, Homo sapiens
gagauucuugugccucag

SEQ ID NO: 831865 - RNA, 16 nt, Homo sapiens
gagcaaacagcuguau

SEQ ID NO: 831866 - RNA, 21 nt, Homo sapiens
gagcaaccccuguacccagcu

SEQ ID NO: 831867 - RNA, 19 nt, Homo sapiens
gagcuuagccuugugcccu

SEQ ID NO: 831868 - RNA, 22 nt, Homo sapiens
gagggccaacgcuugacacaaa

SEQ ID NO: 831869 - RNA, 19 nt, Homo sapiens
gaguauggccacugcccca

SEQ ID NO: 831870 - RNA, 14 nt, Homo sapiens
gagucugugcucuu

SEQ ID NO: 831871 - RNA, 21 nt, Homo sapiens
gaguugguguucauaauuuca

SEQ ID NO: 831872 - RNA, 20 nt, Homo sapiens
gaguuuccagcuaagccuga

SEQ ID NO: 831873 - RNA, 23 nt, Homo sapiens
gaguuuccagcuaagccugauga

SEQ ID NO: 831874 - RNA, 14 nt, Homo sapiens
gaguuucugcaguu

SEQ ID NO: 831875 - RNA, 10 nt, Homo sapiens
gauaaacuaa

SEQ ID NO: 831876 - RNA, 17 nt, Homo sapiens
gauaaacuaaaagcaua

SEQ ID NO: 831877 - RNA, 20 nt, Homo sapiens
gauauaugacuuuuucucag

SEQ ID NO: 831878 - RNA, 16 nt, Homo sapiens
gaucgcuguguuacua

SEQ ID NO: 831879 - RNA, 23 nt, Homo sapiens
gaucucacaaauaauaaugucag

SEQ ID NO: 831880 - RNA, 12 nt, Homo sapiens
gaugaugcaguu

SEQ ID NO: 831881 - RNA, 11 nt, Homo sapiens
auuuccaugga

SEQ ID NO: 831882 - RNA, 19 nt, Homo sapiens
auuuccuggugauucugau

SEQ ID NO: 831883 - RNA, 17 nt, Homo sapiens
auuugaaacacaagaau

SEQ ID NO: 831884 - RNA, 18 nt, Homo sapiens
auuugagugucuuugacu

SEQ ID NO: 831885 - RNA, 16 nt, Homo sapiens
auuuuaaauacaaaag

SEQ ID NO: 831886 - RNA, 21 nt, Homo sapiens
auuuuaugugcuucacauaau

SEQ ID NO: 831887 - RNA, 19 nt, Homo sapiens
auuuugcacaaaguaagcc

SEQ ID NO: 831888 - RNA, 13 nt, Homo sapiens
auuuugcauuaga

SEQ ID NO: 831889 - RNA, 16 nt, Homo sapiens
auuuuguaaauaugca

SEQ ID NO: 831890 - RNA, 18 nt, Homo sapiens
auuuuguaaauaugcaaa

SEQ ID NO: 831891 - RNA, 21 nt, Homo sapiens
auuuugugaaagaaggagcaa

SEQ ID NO: 831892 - RNA, 17 nt, Homo sapiens
caaaaacaaacaaaagc

SEQ ID NO: 831893 - RNA, 23 nt, Homo sapiens
caaaagguaaugcacauccucau

SEQ ID NO: 831894 - RNA, 22 nt, Homo sapiens
caaaaguggggcuaaaugaagu

SEQ ID NO: 831895 - RNA, 20 nt, Homo sapiens
caaagaaaacuuccaaaaag

SEQ ID NO: 831896 - RNA, 21 nt, Homo sapiens
caaagaacugccccaucuccu

SEQ ID NO: 831897 - RNA, 13 nt, Homo sapiens
caaagcaaagcca

SEQ ID NO: 831898 - RNA, 20 nt, Homo sapiens
caaaguaagccucaccuuug

SEQ ID NO: 831899 - RNA, 16 nt, Homo sapiens
caaauaauuggcuuug

SEQ ID NO: 831900 - RNA, 21 nt, Homo sapiens
caaaucaguuggcaggcacca

SEQ ID NO: 831901 - RNA, 19 nt, Homo sapiens
caaaugcuacauauaugca

SEQ ID NO: 831902 - RNA, 23 nt, Homo sapiens
caaauguaaaauaaguauuucca

SEQ ID NO: 831903 - RNA, 19 nt, Homo sapiens
caaauguguggguuuuuaa

SEQ ID NO: 831904 - RNA, 16 nt, Homo sapiens
caaauucuuuuucaca

SEQ ID NO: 831905 - RNA, 17 nt, Homo sapiens
caaauucuuuuucacac

SEQ ID NO: 831906 - RNA, 20 nt, Homo sapiens
caaauucuuuuucacacuga

SEQ ID NO: 831907 - RNA, 14 nt, Homo sapiens
caaauugcuucuag

SEQ ID NO: 831908 - RNA, 14 nt, Homo sapiens
caacaaauacuucc

SEQ ID NO: 831909 - RNA, 14 nt, Homo sapiens
caacaaguugccuc

SEQ ID NO: 831910 - RNA, 14 nt, Homo sapiens
caacauuaccaaaa

SEQ ID NO: 831911 - RNA, 19 nt, Homo sapiens
caacucuauacucaaucaa

SEQ ID NO: 831912 - RNA, 22 nt, Homo sapiens
caacuuguguuuauggcauuua

SEQ ID NO: 831913 - RNA, 15 nt, Homo sapiens
caagaagcaugcaga

SEQ ID NO: 831914 - RNA, 16 nt, Homo sapiens
caagaaguaacaaaag

SEQ ID NO: 831915 - RNA, 23 nt, Homo sapiens
caagauaaccccaagacagucuu

SEQ ID NO: 831916 - RNA, 20 nt, Homo sapiens
caagcuuuggguuggagcug

SEQ ID NO: 831917 - RNA, 17 nt, Homo sapiens
caaggccucccacagug

SEQ ID NO: 831918 - RNA, 18 nt, Homo sapiens
caaggccucccacaguga

SEQ ID NO: 831919 - RNA, 19 nt, Homo sapiens
caagguuuuggagucagua

SEQ ID NO: 831920 - RNA, 20 nt, Homo sapiens
caauaacuuuauaugaagua

SEQ ID NO: 831921 - RNA, 20 nt, Homo sapiens
caaugucagaaacucgauga

SEQ ID NO: 831922 - RNA, 18 nt, Homo sapiens
caauucaaugcaaugaaa

SEQ ID NO: 831923 - RNA, 22 nt, Homo sapiens
cacaagucuaaacaaugaauuc

SEQ ID NO: 831924 - RNA, 21 nt, Homo sapiens
cacacuauuucccucuacuga

SEQ ID NO: 831925 - RNA, 17 nt, Homo sapiens
cacagauauuguuauaa

SEQ ID NO: 831926 - RNA, 13 nt, Homo sapiens
cacaggggcccca

SEQ ID NO: 831927 - RNA, 19 nt, Homo sapiens
cacagugacagucacuucc

SEQ ID NO: 831928 - RNA, 21 nt, Homo sapiens
cacauaaacacauacauugcc

SEQ ID NO: 831929 - RNA, 13 nt, Homo sapiens
cacauaugacaau

SEQ ID NO: 831930 - RNA, 22 nt, Homo sapiens
cacaucauucauucacuguaua

SEQ ID NO: 831931 - RNA, 19 nt, Homo sapiens
caccaucucuuuaccuccu

SEQ ID NO: 831932 - RNA, 13 nt, Homo sapiens
augaugcaguuuc

SEQ ID NO: 831933 - RNA, 15 nt, Homo sapiens
augauguguagggcu

SEQ ID NO: 831934 - RNA, 13 nt, Homo sapiens
augcaauucaaug

SEQ ID NO: 831935 - RNA, 18 nt, Homo sapiens
augccuauaaaaugccca

SEQ ID NO: 831936 - RNA, 15 nt, Homo sapiens
augcuugcauuauau

SEQ ID NO: 831937 - RNA, 11 nt, Homo sapiens
auggauuccac

SEQ ID NO: 831938 - RNA, 14 nt, Homo sapiens
auggccaggccaga

SEQ ID NO: 831939 - RNA, 17 nt, Homo sapiens
auguaaauagaugacaa

SEQ ID NO: 831940 - RNA, 14 nt, Homo sapiens
auguaccagcaucu

SEQ ID NO: 831941 - RNA, 18 nt, Homo sapiens
auguaggaucugucaaag

SEQ ID NO: 831942 - RNA, 14 nt, Homo sapiens
auguauggcaugug

SEQ ID NO: 831943 - RNA, 13 nt, Homo sapiens
augucucucauga

SEQ ID NO: 831944 - RNA, 19 nt, Homo sapiens
augugacaguguucaguaa

SEQ ID NO: 831945 - RNA, 16 nt, Homo sapiens
augugagcgagcaagc

SEQ ID NO: 831946 - RNA, 24 nt, Homo sapiens
augugaguuucagaaauucucaaa

SEQ ID NO: 831947 - RNA, 15 nt, Homo sapiens
auguucguauuacaa

SEQ ID NO: 831948 - RNA, 20 nt, Homo sapiens
auuaaccugaauuauuccaa

SEQ ID NO: 831949 - RNA, 13 nt, Homo sapiens
auuaauaccaaag

SEQ ID NO: 831950 - RNA, 12 nt, Homo sapiens
auuauucccaug

SEQ ID NO: 831951 - RNA, 15 nt, Homo sapiens
auucacaaauagcca

SEQ ID NO: 831952 - RNA, 20 nt, Homo sapiens
auucacagcaagucacuggc

SEQ ID NO: 831953 - RNA, 21 nt, Homo sapiens
auucaggcagcacugacaaua

SEQ ID NO: 831954 - RNA, 15 nt, Homo sapiens
auugcaacaaugcaa

SEQ ID NO: 831955 - RNA, 18 nt, Homo sapiens
auugguguugacauacau

SEQ ID NO: 831956 - RNA, 14 nt, Homo sapiens
auuguggucauuuc

SEQ ID NO: 831957 - RNA, 13 nt, Homo sapiens
auuuaaacuucuu

SEQ ID NO: 831958 - RNA, 18 nt, Homo sapiens
auuuaccuucuaccucuu

SEQ ID NO: 831959 - RNA, 23 nt, Homo sapiens
auuuaggacuggguuccccacag

SEQ ID NO: 831960 - RNA, 14 nt, Homo sapiens
auuuaggauacucu

SEQ ID NO: 831961 - RNA, 15 nt, Homo sapiens
auuuaugaugcaguu

SEQ ID NO: 831962 - RNA, 15 nt, Homo sapiens
auuuaugguucucag

SEQ ID NO: 831963 - RNA, 13 nt, Homo sapiens
auuuaugugaugg

SEQ ID NO: 831964 - RNA, 18 nt, Homo sapiens
auuuauguggauuuugca

SEQ ID NO: 831965 - RNA, 13 nt, Homo sapiens
auuuauuuaugua

SEQ ID NO: 831966 - RNA, 19 nt, Homo sapiens
auuucaaccgcuugccaua

SEQ ID NO: 831967 - RNA, 15 nt, Homo sapiens
auuucccaauacaua

SEQ ID NO: 831968 - RNA, 21 nt, Homo sapiens
auuugauaaacuaaaagcaua

SEQ ID NO: 831969 - RNA, 15 nt, Homo sapiens
auuuuaaauacaaaa

SEQ ID NO: 831970 - RNA, 20 nt, Homo sapiens
auuuuagcaggguacauauu

SEQ ID NO: 831971 - RNA, 19 nt, Homo sapiens
auuuuaucuaaauuacagu

SEQ ID NO: 831972 - RNA, 12 nt, Homo sapiens
auuuugcauuag

SEQ ID NO: 831973 - RNA, 16 nt, Homo sapiens
auuuuuuaaauuuaca

SEQ ID NO: 831974 - RNA, 16 nt, Homo sapiens
auuuuuuauuuccaca

SEQ ID NO: 831975 - RNA, 20 nt, Homo sapiens
caaaaagauuuauuaauuaa

SEQ ID NO: 831976 - RNA, 16 nt, Homo sapiens
caaagagaaaagccac

SEQ ID NO: 831977 - RNA, 19 nt, Homo sapiens
caaagagaaaucacagggg

SEQ ID NO: 831978 - RNA, 13 nt, Homo sapiens
caaauaaacuagu

SEQ ID NO: 831979 - RNA, 20 nt, Homo sapiens
caaauuagaaacaccauuca

SEQ ID NO: 831980 - RNA, 16 nt, Homo sapiens
caaauugcuucuagga

SEQ ID NO: 831981 - RNA, 20 nt, Homo sapiens
caacaaaaacaaacaaaagc

SEQ ID NO: 831982 - RNA, 22 nt, Homo sapiens
caacaccuauauauccaagaag

SEQ ID NO: 831983 - RNA, 15 nt, Homo sapiens
caacucuauacucaa

SEQ ID NO: 831984 - RNA, 14 nt, Homo sapiens
caacuugcuucuaa

SEQ ID NO: 831985 - RNA, 20 nt, Homo sapiens
caagaagaaugggagcugca

SEQ ID NO: 831986 - RNA, 17 nt, Homo sapiens
caagaauuacacuaaua

SEQ ID NO: 831987 - RNA, 16 nt, Homo sapiens
caaggacaaccugccc

SEQ ID NO: 831988 - RNA, 12 nt, Homo sapiens
caaguaccaaaa

SEQ ID NO: 831989 - RNA, 12 nt, Homo sapiens
cacaaauuguac

SEQ ID NO: 831990 - RNA, 12 nt, Homo sapiens
cacaagcucaga

SEQ ID NO: 831991 - RNA, 20 nt, Homo sapiens
cacaauaaaggcugagcucu

SEQ ID NO: 831992 - RNA, 15 nt, Homo sapiens
cacacccaggaaggg

SEQ ID NO: 831993 - RNA, 13 nt, Homo sapiens
cacacuacuguau

SEQ ID NO: 831994 - RNA, 13 nt, Homo sapiens
cacagggacacag

SEQ ID NO: 831995 - RNA, 18 nt, Homo sapiens
cacaucaaguguuccauu

SEQ ID NO: 831996 - RNA, 18 nt, Homo sapiens
caccaucucuuuaccucc

SEQ ID NO: 831997 - RNA, 16 nt, Homo sapiens
cacccaucuuccugcu

SEQ ID NO: 831998 - RNA, 15 nt, Homo sapiens
cacccuaucaucagu

SEQ ID NO: 831999 - RNA, 19 nt, Homo sapiens
caccuaguggcuguccagu

SEQ ID NO: 832000 - RNA, 20 nt, Homo sapiens
caccuaguggcuguccagug

SEQ ID NO: 832001 - RNA, 14 nt, Homo sapiens
caccuccugcaaua

SEQ ID NO: 832002 - RNA, 22 nt, Homo sapiens
aaaaguucaaccucuuacaaua

SEQ ID NO: 832003 - RNA, 16 nt, Homo sapiens
aaaauaaguauuucca

SEQ ID NO: 832004 - RNA, 14 nt, Homo sapiens
aaaauagcacauga

SEQ ID NO: 832005 - RNA, 20 nt, Homo sapiens
cucacacuacuguauuucau

SEQ ID NO: 832006 - RNA, 14 nt, Homo sapiens
cucaucaggccauu

SEQ ID NO: 832007 - RNA, 15 nt, Homo sapiens
cucauuccagaggaa

SEQ ID NO: 832008 - RNA, 16 nt, Homo sapiens
cuccacagugcugcuu

SEQ ID NO: 832009 - RNA, 17 nt, Homo sapiens
cuccagaaucugcuguu

SEQ ID NO: 832010 - RNA, 13 nt, Homo sapiens
cucccacagcuuc

SEQ ID NO: 832011 - RNA, 12 nt, Homo sapiens
cucccacaguga

SEQ ID NO: 832012 - RNA, 17 nt, Homo sapiens
cucccagcugacagucc

SEQ ID NO: 832013 - RNA, 19 nt, Homo sapiens
cucccagcugacaguccuc

SEQ ID NO: 832014 - RNA, 21 nt, Homo sapiens
cuccccagcccuuugcaggcc

SEQ ID NO: 832015 - RNA, 15 nt, Homo sapiens
cuccuaagacaccug

SEQ ID NO: 832016 - RNA, 18 nt, Homo sapiens
cuccuuuuucuaccuuuu

SEQ ID NO: 832017 - RNA, 21 nt, Homo sapiens
cucgcaagggaaguccuugca

SEQ ID NO: 832018 - RNA, 21 nt, Homo sapiens
cucugaaauuggguuccauau

SEQ ID NO: 832019 - RNA, 14 nt, Homo sapiens
cucugaacaaaagc

SEQ ID NO: 832020 - RNA, 22 nt, Homo sapiens
cucuggcggcuuccuguccacu

SEQ ID NO: 832021 - RNA, 16 nt, Homo sapiens
cugaaccgacuuuucu

SEQ ID NO: 832022 - RNA, 18 nt, Homo sapiens
cugagacaugacuaggaa

SEQ ID NO: 832023 - RNA, 19 nt, Homo sapiens
cugagcagguguucuucau

SEQ ID NO: 832024 - RNA, 23 nt, Homo sapiens
cugagcagguguucuucauuacc

SEQ ID NO: 832025 - RNA, 21 nt, Homo sapiens
cugagccacucgcagucgcag

SEQ ID NO: 832026 - RNA, 18 nt, Homo sapiens
cugaggggauaccauaaa

SEQ ID NO: 832027 - RNA, 20 nt, Homo sapiens
cugaggggauaccauaaaaa

SEQ ID NO: 832028 - RNA, 18 nt, Homo sapiens
cugauacuuauuuaccua

SEQ ID NO: 832029 - RNA, 14 nt, Homo sapiens
cugauuaguauuca

SEQ ID NO: 832030 - RNA, 13 nt, Homo sapiens
cugauucaguggg

SEQ ID NO: 832031 - RNA, 15 nt, Homo sapiens
cugcaguuccaucag

SEQ ID NO: 832032 - RNA, 22 nt, Homo sapiens
cugcauuugguaggaagccuga

SEQ ID NO: 832033 - RNA, 20 nt, Homo sapiens
cuggagugcaguggugcgau

SEQ ID NO: 832034 - RNA, 16 nt, Homo sapiens
cuggcaagcagggaaa

SEQ ID NO: 832035 - RNA, 12 nt, Homo sapiens
cuggccagagag

SEQ ID NO: 832036 - RNA, 22 nt, Homo sapiens
cuggccuauuuuggacguguga

SEQ ID NO: 832037 - RNA, 23 nt, Homo sapiens
cuggccuauuuuggacgugugag

SEQ ID NO: 832038 - RNA, 12 nt, Homo sapiens
cuggcugccagg

SEQ ID NO: 832039 - RNA, 21 nt, Homo sapiens
cuggggaugucucucaugacc

SEQ ID NO: 832040 - RNA, 15 nt, Homo sapiens
cuggguguugaccac

SEQ ID NO: 832041 - RNA, 20 nt, Homo sapiens
cugucaaagaaaacuuccaa

SEQ ID NO: 832042 - RNA, 16 nt, Homo sapiens
cugugacuacuauggc

SEQ ID NO: 832043 - RNA, 20 nt, Homo sapiens
cugugccuuggugugcugua

SEQ ID NO: 832044 - RNA, 21 nt, Homo sapiens
cugugccuuggugugcuguau

SEQ ID NO: 832045 - RNA, 21 nt, Homo sapiens
cuguggaggccugaugcugcc

SEQ ID NO: 832046 - RNA, 11 nt, Homo sapiens
cuguggcacag

SEQ ID NO: 832047 - RNA, 22 nt, Homo sapiens
cuguuaaccaaagggcagaaua

SEQ ID NO: 832048 - RNA, 16 nt, Homo sapiens
cuguucuuuuguccca

SEQ ID NO: 832049 - RNA, 17 nt, Homo sapiens
cuguuucacuaauacuu

SEQ ID NO: 832050 - RNA, 18 nt, Homo sapiens
cuuaaaagaacauguaua

SEQ ID NO: 832051 - RNA, 14 nt, Homo sapiens
cuuaauggguacaa

SEQ ID NO: 832052 - RNA, 23 nt, Homo sapiens
cuuaauugaaaugaaaauuuaau

SEQ ID NO: 832053 - RNA, 15 nt, Homo sapiens
cuuaggccagcacca

SEQ ID NO: 832054 - RNA, 21 nt, Homo sapiens
cuuauagguuuccacugccaa

SEQ ID NO: 832055 - RNA, 14 nt, Homo sapiens
cuuauuuccaugga

SEQ ID NO: 832056 - RNA, 15 nt, Homo sapiens
cuucacuaccaaaug

SEQ ID NO: 832057 - RNA, 14 nt, Homo sapiens
cuucauuaauacug

SEQ ID NO: 832058 - RNA, 23 nt, Homo sapiens
cuuccagguggggugaggcagug

SEQ ID NO: 832059 - RNA, 20 nt, Homo sapiens
cuuccuccugauggccaaga

SEQ ID NO: 832060 - RNA, 21 nt, Homo sapiens
cuugagagaaaaagugccccu

SEQ ID NO: 832061 - RNA, 14 nt, Homo sapiens
cuugcuauauugcc

SEQ ID NO: 832062 - RNA, 23 nt, Homo sapiens
cuugcucaccaagaaguaacaaa

SEQ ID NO: 832063 - RNA, 19 nt, Homo sapiens
cuugcuucuaaaugcccag

SEQ ID NO: 832064 - RNA, 17 nt, Homo sapiens
cuuggagcccgugcagu

SEQ ID NO: 832065 - RNA, 18 nt, Homo sapiens
cuuggagcccgugcagua

SEQ ID NO: 832066 - RNA, 14 nt, Homo sapiens
cuugucucauuuag

SEQ ID NO: 832067 - RNA, 20 nt, Homo sapiens
cuuuauagguuuauuacaag

SEQ ID NO: 832068 - RNA, 22 nt, Homo sapiens
cuuuauuuauuaagaaugucau

SEQ ID NO: 832069 - RNA, 16 nt, Homo sapiens
cuuugcaggcccagca

SEQ ID NO: 832070 - RNA, 22 nt, Homo sapiens
cuuuugacaaauucuuuuucac

SEQ ID NO: 832071 - RNA, 11 nt, Homo sapiens
cuuuuucacac

SEQ ID NO: 832072 - RNA, 14 nt, Homo sapiens
cuuuuucacacuga

SEQ ID NO: 832073 - RNA, 14 nt, Homo sapiens
cuuuuucuaccuuu

SEQ ID NO: 832074 - RNA, 18 nt, Homo sapiens
gaaaaauaguguguccau

SEQ ID NO: 832075 - RNA, 12 nt, Homo sapiens
gaaaacauaugc

SEQ ID NO: 832076 - RNA, 13 nt, Homo sapiens
gaaaacaugacuu

SEQ ID NO: 832077 - RNA, 17 nt, Homo sapiens
gaaaaccacaacuaaaa

SEQ ID NO: 832078 - RNA, 22 nt, Homo sapiens
gaaaaccucauuuaccauaaaa

SEQ ID NO: 832079 - RNA, 16 nt, Homo sapiens
gaaaagaaagcugcuu

SEQ ID NO: 832080 - RNA, 13 nt, Homo sapiens
gaaaaugcauuau

SEQ ID NO: 832081 - RNA, 18 nt, Homo sapiens
gaaaccacacagacuugg

SEQ ID NO: 832082 - RNA, 12 nt, Homo sapiens
gaaagacacaaa

SEQ ID NO: 832083 - RNA, 20 nt, Homo sapiens
gaaauucaaccugugucuua

SEQ ID NO: 832084 - RNA, 20 nt, Homo sapiens
gaaauuuacugugagacugu

SEQ ID NO: 832085 - RNA, 19 nt, Homo sapiens
gaacaauggagauaucagu

SEQ ID NO: 832086 - RNA, 17 nt, Homo sapiens
gaacagaggcauuuaaa

SEQ ID NO: 832087 - RNA, 21 nt, Homo sapiens
gaacauuccucugcagcacuu

SEQ ID NO: 832088 - RNA, 21 nt, Homo sapiens
gaacgagcacuggccagagag

SEQ ID NO: 832089 - RNA, 14 nt, Homo sapiens
gaagacccagugua

SEQ ID NO: 832090 - RNA, 16 nt, Homo sapiens
gaagacccaguguaaa

SEQ ID NO: 832091 - RNA, 21 nt, Homo sapiens
gaagacccaguguaaagaaua

SEQ ID NO: 832092 - RNA, 18 nt, Homo sapiens
gaagcaucaaagcacugu

SEQ ID NO: 832093 - RNA, 19 nt, Homo sapiens
gaagccugaggcaaaaacu

SEQ ID NO: 832094 - RNA, 14 nt, Homo sapiens
gaagcuucaugcca

SEQ ID NO: 832095 - RNA, 18 nt, Homo sapiens
gaaggaauagccagagag

SEQ ID NO: 832096 - RNA, 19 nt, Homo sapiens
gaaggaggagucagggaga

SEQ ID NO: 832097 - RNA, 14 nt, Homo sapiens
gaaggcuaugggga

SEQ ID NO: 832098 - RNA, 13 nt, Homo sapiens
gaauaaagugaau

SEQ ID NO: 832099 - RNA, 22 nt, Homo sapiens
gaauaaauaagcaaaaugccaa

SEQ ID NO: 832100 - RNA, 14 nt, Homo sapiens
gaauaaaugaaucu

SEQ ID NO: 832101 - RNA, 23 nt, Homo sapiens
gaauacauuguauuaauaccaaa

SEQ ID NO: 832102 - RNA, 16 nt, Homo sapiens
gaaucaagucugugaa

SEQ ID NO: 832103 - RNA, 23 nt, Homo sapiens
gacaauguugcauuuaugaugca

SEQ ID NO: 832104 - RNA, 20 nt, Homo sapiens
gaccaaaugcuuuuccucaa

SEQ ID NO: 832105 - RNA, 12 nt, Homo sapiens
gaccccaucuca

SEQ ID NO: 832106 - RNA, 13 nt, Homo sapiens
gaccccaucucau

SEQ ID NO: 832107 - RNA, 23 nt, Homo sapiens
gacccuaaauguggacaucauga

SEQ ID NO: 832108 - RNA, 21 nt, Homo sapiens
gaccgauagcaggugaacucg

SEQ ID NO: 832109 - RNA, 14 nt, Homo sapiens
gaccguugcacaaa

SEQ ID NO: 832110 - RNA, 12 nt, Homo sapiens
gacuauggagcu

SEQ ID NO: 832111 - RNA, 17 nt, Homo sapiens
gacucuuaaauauacuu

SEQ ID NO: 832112 - RNA, 18 nt, Homo sapiens
gacugaaggggcacacca

SEQ ID NO: 832113 - RNA, 15 nt, Homo sapiens
gacugugacacagcu

SEQ ID NO: 832114 - RNA, 20 nt, Homo sapiens
gacuuuuugaaaaaaguaua

SEQ ID NO: 832115 - RNA, 17 nt, Homo sapiens
gagaaacaaauaaacua

SEQ ID NO: 832116 - RNA, 12 nt, Homo sapiens
gagaacagggau

SEQ ID NO: 832117 - RNA, 13 nt, Homo sapiens
gagaaugucagua

SEQ ID NO: 832118 - RNA, 20 nt, Homo sapiens
gagagcacuagaagugguuu

SEQ ID NO: 832119 - RNA, 15 nt, Homo sapiens
gagcacuggccagag

SEQ ID NO: 832120 - RNA, 16 nt, Homo sapiens
gagcagcuucugccac

SEQ ID NO: 832121 - RNA, 21 nt, Homo sapiens
uauaucauaaaguaugccuuc

SEQ ID NO: 832122 - RNA, 19 nt, Homo sapiens
uauauuuauuuauguagga

SEQ ID NO: 832123 - RNA, 19 nt, Homo sapiens
uaucaaggugcuuuuggca

SEQ ID NO: 832124 - RNA, 15 nt, Homo sapiens
uaucgcugccuugcc

SEQ ID NO: 832125 - RNA, 16 nt, Homo sapiens
uaucuguuugcuucua

SEQ ID NO: 832126 - RNA, 23 nt, Homo sapiens
uaugagucucuaugaucuuggca

SEQ ID NO: 832127 - RNA, 18 nt, Homo sapiens
uaugcaaaucagcuuuau

SEQ ID NO: 832128 - RNA, 15 nt, Homo sapiens
uaugguucucaggcc

SEQ ID NO: 832129 - RNA, 17 nt, Homo sapiens
uaugugggggucugugu

SEQ ID NO: 832130 - RNA, 18 nt, Homo sapiens
uauuacacuaaaugauau

SEQ ID NO: 832131 - RNA, 17 nt, Homo sapiens
uauucaauaaagcugcu

SEQ ID NO: 832132 - RNA, 21 nt, Homo sapiens
uauucccaugguagacuguga

SEQ ID NO: 832133 - RNA, 17 nt, Homo sapiens
uauucucuaagauauau

SEQ ID NO: 832134 - RNA, 14 nt, Homo sapiens
uauuggcagcucua

SEQ ID NO: 832135 - RNA, 15 nt, Homo sapiens
uauuugcuauucaaa

SEQ ID NO: 832136 - RNA, 17 nt, Homo sapiens
uauuuguauaauggugu

SEQ ID NO: 832137 - RNA, 14 nt, Homo sapiens
uauuuuucucauga

SEQ ID NO: 832138 - RNA, 18 nt, Homo sapiens
ucaaaaacacuugagaag

SEQ ID NO: 832139 - RNA, 17 nt, Homo sapiens
ucaaaaggcacugugaa

SEQ ID NO: 832140 - RNA, 23 nt, Homo sapiens
ucaaaaggcacugugaacuauuu

SEQ ID NO: 832141 - RNA, 17 nt, Homo sapiens
ucaaagaaaacuuccaa

SEQ ID NO: 832142 - RNA, 19 nt, Homo sapiens
ucaaagaaaacuuccaaaa

SEQ ID NO: 832143 - RNA, 17 nt, Homo sapiens
ucaaauuuuucaucucu

SEQ ID NO: 832144 - RNA, 14 nt, Homo sapiens
ucaacauuaccaaa

SEQ ID NO: 832145 - RNA, 16 nt, Homo sapiens
ucaaccgcuugccaua

SEQ ID NO: 832146 - RNA, 14 nt, Homo sapiens
ucaaguaccaaaac

SEQ ID NO: 832147 - RNA, 16 nt, Homo sapiens
ucacacuauccagcua

SEQ ID NO: 832148 - RNA, 14 nt, Homo sapiens
ucacagcugcagcu

SEQ ID NO: 832149 - RNA, 21 nt, Homo sapiens
ucaccucuuaugcacaccucc

SEQ ID NO: 832150 - RNA, 18 nt, Homo sapiens
ucacuaauacuuacuguu

SEQ ID NO: 832151 - RNA, 11 nt, Homo sapiens
ucacucaggcu

SEQ ID NO: 832152 - RNA, 16 nt, Homo sapiens
ucacugcuguagacau

SEQ ID NO: 832153 - RNA, 19 nt, Homo sapiens
ucacuucgaugacuggaua

SEQ ID NO: 832154 - RNA, 22 nt, Homo sapiens
ucagaacagcugaaacauuccg

SEQ ID NO: 832155 - RNA, 16 nt, Homo sapiens
ucagacuuacuuacuc

SEQ ID NO: 832156 - RNA, 14 nt, Homo sapiens
ucagaucauuauca

SEQ ID NO: 832157 - RNA, 15 nt, Homo sapiens
ucaggaucaucugag

SEQ ID NO: 832158 - RNA, 21 nt, Homo sapiens
ucagguggagagcacuagaag

SEQ ID NO: 832159 - RNA, 23 nt, Homo sapiens
ucauguaauacugaaccacuuug

SEQ ID NO: 832160 - RNA, 19 nt, Homo sapiens
ucauguuuacagaggacag

SEQ ID NO: 832161 - RNA, 23 nt, Homo sapiens
ucauuaccacgccuugaccuucc

SEQ ID NO: 832162 - RNA, 16 nt, Homo sapiens
ucauucacuaagccau

SEQ ID NO: 832163 - RNA, 13 nt, Homo sapiens
ucauuuaccauaa

SEQ ID NO: 832164 - RNA, 17 nt, Homo sapiens
uccaauaacuagugaua

SEQ ID NO: 832165 - RNA, 14 nt, Homo sapiens
uccacagugcugcu

SEQ ID NO: 832166 - RNA, 18 nt, Homo sapiens
uccacaucaaguguucca

SEQ ID NO: 832167 - RNA, 18 nt, Homo sapiens
uccagcuaagccugauga

SEQ ID NO: 832168 - RNA, 15 nt, Homo sapiens
uccaguucugaugag

SEQ ID NO: 832169 - RNA, 17 nt, Homo sapiens
uccauugguguugacau

SEQ ID NO: 832170 - RNA, 21 nt, Homo sapiens
ucccaacuccucccuauccua

SEQ ID NO: 832171 - RNA, 18 nt, Homo sapiens
ucccacuaagcuuucucc

SEQ ID NO: 832172 - RNA, 18 nt, Homo sapiens
ucccugaagagaagggca

SEQ ID NO: 832173 - RNA, 20 nt, Homo sapiens
ucccugaagagaagggcagg

SEQ ID NO: 832174 - RNA, 23 nt, Homo sapiens
ucccuguggaauguaccuaugug

SEQ ID NO: 832175 - RNA, 19 nt, Homo sapiens
ucccuucgauauaugacuu

SEQ ID NO: 832176 - RNA, 14 nt, Homo sapiens
uccucaaagggaga

SEQ ID NO: 832177 - RNA, 21 nt, Homo sapiens
uccucauucacuaagccaugc

SEQ ID NO: 832178 - RNA, 12 nt, Homo sapiens
uccuccguccac

SEQ ID NO: 832179 - RNA, 21 nt, Homo sapiens
uccuggcccucuucuuauuca

SEQ ID NO: 832180 - RNA, 15 nt, Homo sapiens
uccuucccugggaag

SEQ ID NO: 832181 - RNA, 17 nt, Homo sapiens
uccuuuccccucccuca

SEQ ID NO: 832182 - RNA, 21 nt, Homo sapiens
uccuuuccccucccucaggcc

SEQ ID NO: 832183 - RNA, 22 nt, Homo sapiens
ucgauauaugacuuuuucucag

SEQ ID NO: 832184 - RNA, 16 nt, Homo sapiens
ucuaauucuucauuau

SEQ ID NO: 832185 - RNA, 18 nt, Homo sapiens
ucuacauuuuauuacacu

SEQ ID NO: 832186 - RNA, 20 nt, Homo sapiens
ucuaccucuuggcugccuug

SEQ ID NO: 832187 - RNA, 15 nt, Homo sapiens
ucuaccugagcauuc

SEQ ID NO: 832188 - RNA, 17 nt, Homo sapiens
ucuacuccaugcacaua

SEQ ID NO: 832189 - RNA, 18 nt, Homo sapiens
ucuaggagucaacuggcu

SEQ ID NO: 832190 - RNA, 11 nt, Homo sapiens
ucuaucuucac

SEQ ID NO: 832191 - RNA, 16 nt, Homo sapiens
ucuccccuccaaguga

SEQ ID NO: 832192 - RNA, 20 nt, Homo sapiens
ucucuaacauaugauacuga

SEQ ID NO: 832193 - RNA, 13 nt, Homo sapiens
ucucucaugacca

SEQ ID NO: 832194 - RNA, 13 nt, Homo sapiens
ucugacagucuca

SEQ ID NO: 832195 - RNA, 12 nt, Homo sapiens
ucuguccaggcc

SEQ ID NO: 832196 - RNA, 15 nt, Homo sapiens
ucuuaaaauucuugg

SEQ ID NO: 832197 - RNA, 18 nt, Homo sapiens
ucuuauucaugcuuucuc

SEQ ID NO: 832198 - RNA, 21 nt, Homo sapiens
ucuucaggguguuaaggcagu

SEQ ID NO: 832199 - RNA, 20 nt, Homo sapiens
ucuucauuaccucagugaga

SEQ ID NO: 832200 - RNA, 20 nt, Homo sapiens
ucuugaaccccuggccucaa

SEQ ID NO: 832201 - RNA, 21 nt, Homo sapiens
ucuugaacugguugugaauaa

SEQ ID NO: 832202 - RNA, 22 nt, Homo sapiens
ucuuguauggcucucaagugaa

SEQ ID NO: 832203 - RNA, 22 nt, Homo sapiens
ucuuguuguggaggcugaaaag

SEQ ID NO: 832204 - RNA, 17 nt, Homo sapiens
ucuuugagaacaaugga

SEQ ID NO: 832205 - RNA, 15 nt, Homo sapiens
ucuuuuucacacuga

SEQ ID NO: 832206 - RNA, 15 nt, Homo sapiens
ugaacccuugugcuu

SEQ ID NO: 832207 - RNA, 12 nt, Homo sapiens
ugaagaaaggga

SEQ ID NO: 832208 - RNA, 13 nt, Homo sapiens
ugaagacauucca

SEQ ID NO: 832209 - RNA, 22 nt, Homo sapiens
ugaagacccaguguaaagaaua

SEQ ID NO: 832210 - RNA, 17 nt, Homo sapiens
ugaaggagaaaaugcau

SEQ ID NO: 832211 - RNA, 22 nt, Homo sapiens
ugaauaauuuucuggcacuggu

SEQ ID NO: 832212 - RNA, 12 nt, Homo sapiens
ugaauacacuua

SEQ ID NO: 832213 - RNA, 20 nt, Homo sapiens
ugaauacauuuugcacaaag

SEQ ID NO: 832214 - RNA, 23 nt, Homo sapiens
ugacaacauuuuuguacauuaug

SEQ ID NO: 832215 - RNA, 16 nt, Homo sapiens
ugacaguccucuccac

SEQ ID NO: 832216 - RNA, 16 nt, Homo sapiens
ugacuccugaagguuu

SEQ ID NO: 832217 - RNA, 15 nt, Homo sapiens
ugagaaaacagggaa

SEQ ID NO: 832218 - RNA, 19 nt, Homo sapiens
ugagaaaacagggaauaca

SEQ ID NO: 832219 - RNA, 18 nt, Homo sapiens
ugagaagccagcuuuccu

SEQ ID NO: 832220 - RNA, 12 nt, Homo sapiens
ugagcugggaag

SEQ ID NO: 832221 - RNA, 20 nt, Homo sapiens
ugagggugacuauggagcug

SEQ ID NO: 832222 - RNA, 17 nt, Homo sapiens
ugauaagcugagcuccu

SEQ ID NO: 832223 - RNA, 16 nt, Homo sapiens
ugaucuuggcacaaau

SEQ ID NO: 832224 - RNA, 15 nt, Homo sapiens
ugaugaaaaccaccc

SEQ ID NO: 832225 - RNA, 13 nt, Homo sapiens
ugaugaugcaguu

SEQ ID NO: 832226 - RNA, 14 nt, Homo sapiens
ugauuucagaagga

SEQ ID NO: 832227 - RNA, 16 nt, Homo sapiens
ugcaacuucuaccucc

SEQ ID NO: 832228 - RNA, 16 nt, Homo sapiens
ugcacccccuccugcu

SEQ ID NO: 832229 - RNA, 20 nt, Homo sapiens
ugcagagaaagaaagggaaa

SEQ ID NO: 832230 - RNA, 18 nt, Homo sapiens
ugcagggaagagggcagu

SEQ ID NO: 832231 - RNA, 20 nt, Homo sapiens
ugcaguggugcgaucuuggc

SEQ ID NO: 832232 - RNA, 17 nt, Homo sapiens
ugccacucccugagcuu

SEQ ID NO: 832233 - RNA, 21 nt, Homo sapiens
ugccaggcguuggugccacuu

SEQ ID NO: 832234 - RNA, 20 nt, Homo sapiens
ugccauguaaaggccuuuaa

SEQ ID NO: 832235 - RNA, 18 nt, Homo sapiens
ugccauucccacuaagcu

SEQ ID NO: 832236 - RNA, 17 nt, Homo sapiens
ugcccgaccccaucuca

SEQ ID NO: 832237 - RNA, 17 nt, Homo sapiens
agagcugaacuauuaga

SEQ ID NO: 832238 - RNA, 21 nt, Homo sapiens
agagggaccaaauugcuucua

SEQ ID NO: 832239 - RNA, 19 nt, Homo sapiens
agagugcugccaguccucu

SEQ ID NO: 832240 - RNA, 20 nt, Homo sapiens
agaguuauucaaaugaaggu

SEQ ID NO: 832241 - RNA, 16 nt, Homo sapiens
agaguuuucuaaccca

SEQ ID NO: 832242 - RNA, 22 nt, Homo sapiens
agauaaccccaagacagucuuu

SEQ ID NO: 832243 - RNA, 13 nt, Homo sapiens
agauaauugccau

SEQ ID NO: 832244 - RNA, 23 nt, Homo sapiens
agauuauauaucauaaaguaugc

SEQ ID NO: 832245 - RNA, 21 nt, Homo sapiens
agauuucaaauuaaucuuucu

SEQ ID NO: 832246 - RNA, 14 nt, Homo sapiens
agcaaaaugccaaa

SEQ ID NO: 832247 - RNA, 18 nt, Homo sapiens
agcaaaugcuacauauau

SEQ ID NO: 832248 - RNA, 21 nt, Homo sapiens
agcaccaucucuuuaccuccu

SEQ ID NO: 832249 - RNA, 23 nt, Homo sapiens
agcaggcggccuuuguugcucag

SEQ ID NO: 832250 - RNA, 17 nt, Homo sapiens
agcaucucccaguucau

SEQ ID NO: 832251 - RNA, 19 nt, Homo sapiens
agcauguucguauuacaag

SEQ ID NO: 832252 - RNA, 14 nt, Homo sapiens
agccagccugggac

SEQ ID NO: 832253 - RNA, 21 nt, Homo sapiens
agcccacuguaacaauacugg

SEQ ID NO: 832254 - RNA, 24 nt, Homo sapiens
agcccccuggaugggcauugggcu

SEQ ID NO: 832255 - RNA, 23 nt, Homo sapiens
agccccggugugcggugcauaca

SEQ ID NO: 832256 - RNA, 21 nt, Homo sapiens
agccugcuuuuguccuguuau

SEQ ID NO: 832257 - RNA, 12 nt, Homo sapiens
agccuggcccag

SEQ ID NO: 832258 - RNA, 14 nt, Homo sapiens
uuaaagacuaacua

SEQ ID NO: 832259 - RNA, 18 nt, Homo sapiens
uuaaguucuaucagugac

SEQ ID NO: 832260 - RNA, 19 nt, Homo sapiens
uuaauacugacucaguguc

SEQ ID NO: 832261 - RNA, 18 nt, Homo sapiens
uuaauggguacaauguac

SEQ ID NO: 832262 - RNA, 17 nt, Homo sapiens
uuacacuaaaugauauu

SEQ ID NO: 832263 - RNA, 20 nt, Homo sapiens
uuaccuucuaccucuuggcu

SEQ ID NO: 832264 - RNA, 16 nt, Homo sapiens
uuagagcugccugugc

SEQ ID NO: 832265 - RNA, 13 nt, Homo sapiens
uuagcugaacaau

SEQ ID NO: 832266 - RNA, 20 nt, Homo sapiens
uuaggaaggcagcauuccau

SEQ ID NO: 832267 - RNA, 20 nt, Homo sapiens
uuaggccuggcacagugucu

SEQ ID NO: 832268 - RNA, 14 nt, Homo sapiens
uuauagguuuccac

SEQ ID NO: 832269 - RNA, 15 nt, Homo sapiens
uuauagguuuccacu

SEQ ID NO: 832270 - RNA, 13 nt, Homo sapiens
uuaucugauacuu

SEQ ID NO: 832271 - RNA, 23 nt, Homo sapiens
uuauuacacuaaaugauauucau

SEQ ID NO: 832272 - RNA, 13 nt, Homo sapiens
uuauuccaacucc

SEQ ID NO: 832273 - RNA, 18 nt, Homo sapiens
uuauuuauuuugugguaa

SEQ ID NO: 832274 - RNA, 13 nt, Homo sapiens
uuauuuccaugga

SEQ ID NO: 832275 - RNA, 14 nt, Homo sapiens
uuauuuccauggau

SEQ ID NO: 832276 - RNA, 14 nt, Homo sapiens
uucaaguaccaaaa

SEQ ID NO: 832277 - RNA, 10 nt, Homo sapiens
uucacauaaa

SEQ ID NO: 832278 - RNA, 19 nt, Homo sapiens
uucagaacagaggcauuua

SEQ ID NO: 832279 - RNA, 23 nt, Homo sapiens
uuccaacaauggggugggcccau

SEQ ID NO: 832280 - RNA, 14 nt, Homo sapiens
uuccaacugccaga

SEQ ID NO: 832281 - RNA, 12 nt, Homo sapiens
uuccuaugcaaa

SEQ ID NO: 832282 - RNA, 16 nt, Homo sapiens
uuccuuaaaaugugag

SEQ ID NO: 832283 - RNA, 16 nt, Homo sapiens
uuccuucagcaucuca

SEQ ID NO: 832284 - RNA, 15 nt, Homo sapiens
uucgcucgugcagua

SEQ ID NO: 832285 - RNA, 13 nt, Homo sapiens
uucguauuacaag

SEQ ID NO: 832286 - RNA, 19 nt, Homo sapiens
uucuacauuuuauuacacu

SEQ ID NO: 832287 - RNA, 22 nt, Homo sapiens
uucucaguaaauauuaaccuga

SEQ ID NO: 832288 - RNA, 22 nt, Homo sapiens
uucuccuguugcaaugacacau

SEQ ID NO: 832289 - RNA, 18 nt, Homo sapiens
uucuuaaucuccacuguu

SEQ ID NO: 832290 - RNA, 22 nt, Homo sapiens
uucuuccucacaaaaccauauc

SEQ ID NO: 832291 - RNA, 12 nt, Homo sapiens
uucuucuauggg

SEQ ID NO: 832292 - RNA, 17 nt, Homo sapiens
uucuuuuucacacugau

SEQ ID NO: 832293 - RNA, 18 nt, Homo sapiens
uugaacugguugugaaua

SEQ ID NO: 832294 - RNA, 21 nt, Homo sapiens
uugaaggagaaaaugcauuau

SEQ ID NO: 832295 - RNA, 13 nt, Homo sapiens
uugagcacaaaau

SEQ ID NO: 832296 - RNA, 17 nt, Homo sapiens
uugaggacacaugucca

SEQ ID NO: 832297 - RNA, 12 nt, Homo sapiens
uugaugaugcag

SEQ ID NO: 832298 - RNA, 16 nt, Homo sapiens
uugaugaugcaguuuu

SEQ ID NO: 832299 - RNA, 20 nt, Homo sapiens
uugcaacaagacaaagcaaa

SEQ ID NO: 832300 - RNA, 16 nt, Homo sapiens
uugcacccaugccaua

SEQ ID NO: 832301 - RNA, 14 nt, Homo sapiens
uugccacacacugu

SEQ ID NO: 832302 - RNA, 16 nt, Homo sapiens
uugccuggaagcacau

SEQ ID NO: 832303 - RNA, 23 nt, Homo sapiens
uuggcagcucuacucuggagguu

SEQ ID NO: 832304 - RNA, 18 nt, Homo sapiens
uuggcaugaaagugcgau

SEQ ID NO: 832305 - RNA, 20 nt, Homo sapiens
uuggcuaucuacugagacau

SEQ ID NO: 832306 - RNA, 11 nt, Homo sapiens
uuggugccacu

SEQ ID NO: 832307 - RNA, 15 nt, Homo sapiens
uuguagcagaaggca

SEQ ID NO: 832308 - RNA, 21 nt, Homo sapiens
uugucucauuuaggacugggu

SEQ ID NO: 832309 - RNA, 16 nt, Homo sapiens
uuguucagaagacaca

SEQ ID NO: 832310 - RNA, 15 nt, Homo sapiens
uuuaaaaaaaguaua

SEQ ID NO: 832311 - RNA, 14 nt, Homo sapiens
uuuaaaauugugau

SEQ ID NO: 832312 - RNA, 22 nt, Homo sapiens
uuuaagaggcuuuggcccaaug

SEQ ID NO: 832313 - RNA, 19 nt, Homo sapiens
uuuagagauggggucuugc

SEQ ID NO: 832314 - RNA, 22 nt, Homo sapiens
uuuauuuauguaggaucuguca

SEQ ID NO: 832315 - RNA, 12 nt, Homo sapiens
uuuauuuccaca

SEQ ID NO: 832316 - RNA, 21 nt, Homo sapiens
uuuccacauaaagguauuuag

SEQ ID NO: 832317 - RNA, 20 nt, Homo sapiens
uuuccagaauuugaauauua

SEQ ID NO: 832318 - RNA, 15 nt, Homo sapiens
uuucccaauacauac

SEQ ID NO: 832319 - RNA, 17 nt, Homo sapiens
uuuccugguccaucuca

SEQ ID NO: 832320 - RNA, 23 nt, Homo sapiens
uuucuaaagcucugaacaaaagc

SEQ ID NO: 832321 - RNA, 19 nt, Homo sapiens
uuugagugucuuugacuug

SEQ ID NO: 832322 - RNA, 13 nt, Homo sapiens
uuugcagagccuu

SEQ ID NO: 832323 - RNA, 17 nt, Homo sapiens
uuugccaaggcucuccc

SEQ ID NO: 832324 - RNA, 20 nt, Homo sapiens
uuuggggcucagaguggggu

SEQ ID NO: 832325 - RNA, 19 nt, Homo sapiens
uuuguucacuucgaugacu

SEQ ID NO: 832326 - RNA, 13 nt, Homo sapiens
uuuguuccaugag

SEQ ID NO: 832327 - RNA, 12 nt, Homo sapiens
auccuggcccau

SEQ ID NO: 832328 - RNA, 21 nt, Homo sapiens
aucuacuagaaccuucuaauc

SEQ ID NO: 832329 - RNA, 17 nt, Homo sapiens
aucuccccaggccucca

SEQ ID NO: 832330 - RNA, 24 nt, Homo sapiens
aucucuaacauaugauacugaugc

SEQ ID NO: 832331 - RNA, 14 nt, Homo sapiens
aucucuuuaccucc

SEQ ID NO: 832332 - RNA, 21 nt, Homo sapiens
aucugucaaagaaaacuucca

SEQ ID NO: 832333 - RNA, 23 nt, Homo sapiens
aucugugaggggcucucucauga

SEQ ID NO: 832334 - RNA, 15 nt, Homo sapiens
aucuuccugcugcug

SEQ ID NO: 832335 - RNA, 23 nt, Homo sapiens
augaaaaauaguguguccaugca

SEQ ID NO: 832336 - RNA, 14 nt, Homo sapiens
augaaagugcgaua

SEQ ID NO: 832337 - RNA, 15 nt, Homo sapiens
augaagacccagugu

SEQ ID NO: 832338 - RNA, 18 nt, Homo sapiens
augaagacccaguguaaa

SEQ ID NO: 832339 - RNA, 19 nt, Homo sapiens
augaaucccauaauugaca

SEQ ID NO: 832340 - RNA, 22 nt, Homo sapiens
augacggcugcucgaagaacaa

SEQ ID NO: 832341 - RNA, 20 nt, Homo sapiens
augagcaaggacaaccugcc

SEQ ID NO: 832342 - RNA, 21 nt, Homo sapiens
augaggcacgccugccuucuc

SEQ ID NO: 832343 - RNA, 16 nt, Homo sapiens
augauaauuuacuuaa

SEQ ID NO: 832344 - RNA, 16 nt, Homo sapiens
augauacugaugccau

SEQ ID NO: 832345 - RNA, 21 nt, Homo sapiens
augcaguuucaaguaccaaaa

SEQ ID NO: 832346 - RNA, 17 nt, Homo sapiens
augcuguuaaccaaagg

SEQ ID NO: 832347 - RNA, 18 nt, Homo sapiens
auggaagggccuucucca

SEQ ID NO: 832348 - RNA, 18 nt, Homo sapiens
auggagaggggguacaau

SEQ ID NO: 832349 - RNA, 19 nt, Homo sapiens
auggaguguuuuaguucuu

SEQ ID NO: 832350 - RNA, 18 nt, Homo sapiens
auggcucuggcaccacua

SEQ ID NO: 832351 - RNA, 15 nt, Homo sapiens
augguagacugugac

SEQ ID NO: 832352 - RNA, 14 nt, Homo sapiens
augguuuccucauu

SEQ ID NO: 832353 - RNA, 15 nt, Homo sapiens
auguaccagcaucuc

SEQ ID NO: 832354 - RNA, 14 nt, Homo sapiens
augucaauugucag

SEQ ID NO: 832355 - RNA, 15 nt, Homo sapiens
auguggaucugggga

SEQ ID NO: 832356 - RNA, 18 nt, Homo sapiens
auguggcaaagugcugua

SEQ ID NO: 832357 - RNA, 23 nt, Homo sapiens
auguguaguuaauuuuauuccag

SEQ ID NO: 832358 - RNA, 11 nt, Homo sapiens
auguguugccu

SEQ ID NO: 832359 - RNA, 20 nt, Homo sapiens
auguguugccuggaagcaca

SEQ ID NO: 832360 - RNA, 18 nt, Homo sapiens
auguucgcucgugcagua

SEQ ID NO: 832361 - RNA, 13 nt, Homo sapiens
auguuuuguacuu

SEQ ID NO: 832362 - RNA, 14 nt, Homo sapiens
auguuuuguacuua

SEQ ID NO: 832363 - RNA, 19 nt, Homo sapiens
auuacaagagaaacaaaua

SEQ ID NO: 832364 - RNA, 14 nt, Homo sapiens
auuacagugcaguu

SEQ ID NO: 832365 - RNA, 15 nt, Homo sapiens
auuaguaacugcaca

SEQ ID NO: 832366 - RNA, 23 nt, Homo sapiens
auuauaaaaauaauauaugcuca

SEQ ID NO: 832367 - RNA, 18 nt, Homo sapiens
auuaugagucucuaugau

SEQ ID NO: 832368 - RNA, 19 nt, Homo sapiens
auucaaccugugucuuaua

SEQ ID NO: 832369 - RNA, 21 nt, Homo sapiens
auucaauaaagcugcugagaa

SEQ ID NO: 832370 - RNA, 13 nt, Homo sapiens
auucacagcaagu

SEQ ID NO: 832371 - RNA, 23 nt, Homo sapiens
auuccacacccucacugcuguag

SEQ ID NO: 832372 - RNA, 22 nt, Homo sapiens
auuccacugaaauagagugaau

SEQ ID NO: 832373 - RNA, 17 nt, Homo sapiens
auucucagugcucuccu

SEQ ID NO: 832374 - RNA, 18 nt, Homo sapiens
auugaaauuuacugugag

SEQ ID NO: 832375 - RNA, 18 nt, Homo sapiens
auugaauaucaguugaca

SEQ ID NO: 832376 - RNA, 14 nt, Homo sapiens
auugacccagaaau

SEQ ID NO: 832377 - RNA, 18 nt, Homo sapiens
auugacccagaaauguau

SEQ ID NO: 832378 - RNA, 16 nt, Homo sapiens
auugcaggagucccug

SEQ ID NO: 832379 - RNA, 23 nt, Homo sapiens
auugcauuuaaaaauauauagcu

SEQ ID NO: 832380 - RNA, 14 nt, Homo sapiens
auugccauucugau

SEQ ID NO: 832381 - RNA, 18 nt, Homo sapiens
auuggaauuuucuuucau

SEQ ID NO: 832382 - RNA, 22 nt, Homo sapiens
auuggaauuuucuuucauacau

SEQ ID NO: 832383 - RNA, 19 nt, Homo sapiens
auugguauauuuccauuca

SEQ ID NO: 832384 - RNA, 15 nt, Homo sapiens
auuguaugucaagau

SEQ ID NO: 832385 - RNA, 19 nt, Homo sapiens
auuguauuaauaccaaagu

SEQ ID NO: 832386 - RNA, 21 nt, Homo sapiens
auuguauuuaccuucuaccuc

SEQ ID NO: 832387 - RNA, 22 nt, Homo sapiens
auuguauuuuagcaggguacau

SEQ ID NO: 832388 - RNA, 12 nt, Homo sapiens
auugucccugaa

SEQ ID NO: 832389 - RNA, 13 nt, Homo sapiens
auuuaaaauggaa

SEQ ID NO: 832390 - RNA, 22 nt, Homo sapiens
auuuaaugaagacccaguguaa

SEQ ID NO: 832391 - RNA, 17 nt, Homo sapiens
auuuaugaugcaguuuc

SEQ ID NO: 832392 - RNA, 22 nt, Homo sapiens
auuuauguggauuuugcaugua

SEQ ID NO: 832393 - RNA, 16 nt, Homo sapiens
auuuauuuauguagga

SEQ ID NO: 832394 - RNA, 15 nt, Homo sapiens
auuucccucuacuga

SEQ ID NO: 832395 - RNA, 19 nt, Homo sapiens
auuugcacccaugccauag

SEQ ID NO: 832396 - RNA, 15 nt, Homo sapiens
auuuggucaagaaau

SEQ ID NO: 832397 - RNA, 20 nt, Homo sapiens
auuuguaaauuuaugugaug

SEQ ID NO: 832398 - RNA, 22 nt, Homo sapiens
auuuucccuucgauauaugacu

SEQ ID NO: 832399 - RNA, 16 nt, Homo sapiens
auuuuggacgugugag

SEQ ID NO: 832400 - RNA, 19 nt, Homo sapiens
auuuuguaaauaugcaaau

SEQ ID NO: 832401 - RNA, 19 nt, Homo sapiens
auuuuuguacauuauguua

SEQ ID NO: 832402 - RNA, 23 nt, Homo sapiens
caaaacguugaauugaugaugca

SEQ ID NO: 832403 - RNA, 18 nt, Homo sapiens
caaaagcaagaaaaccac

SEQ ID NO: 832404 - RNA, 21 nt, Homo sapiens
caaaaguggggcuaaaugaag

SEQ ID NO: 832405 - RNA, 14 nt, Homo sapiens
caaaauacaaaagu

SEQ ID NO: 832406 - RNA, 20 nt, Homo sapiens
caaaauuuuguaaauaugca

SEQ ID NO: 832407 - RNA, 21 nt, Homo sapiens
caaaauuuuguaaauaugcaa

SEQ ID NO: 832408 - RNA, 22 nt, Homo sapiens
caaaauuuuguaaauaugcaaa

SEQ ID NO: 832409 - RNA, 21 nt, Homo sapiens
caaaccucacacuacuguauu

SEQ ID NO: 832410 - RNA, 20 nt, Homo sapiens
caaagaacugccccaucucc

SEQ ID NO: 832411 - RNA, 15 nt, Homo sapiens
caaaguaagccucac

SEQ ID NO: 832412 - RNA, 18 nt, Homo sapiens
caaauauuagcaaagaag

SEQ ID NO: 832413 - RNA, 19 nt, Homo sapiens
ucaggucccccccaggugc

SEQ ID NO: 832414 - RNA, 18 nt, Homo sapiens
ucagucuuuaaucugaga

SEQ ID NO: 832415 - RNA, 17 nt, Homo sapiens
ucagugucugccuuuaa

SEQ ID NO: 832416 - RNA, 15 nt, Homo sapiens
ucauaaucacaaccc

SEQ ID NO: 832417 - RNA, 12 nt, Homo sapiens
ucauacauuaua

SEQ ID NO: 832418 - RNA, 15 nt, Homo sapiens
ucaucuguaccucug

SEQ ID NO: 832419 - RNA, 14 nt, Homo sapiens
ucauguaauacuga

SEQ ID NO: 832420 - RNA, 13 nt, Homo sapiens
ucauucauucacu

SEQ ID NO: 832421 - RNA, 14 nt, Homo sapiens
ucauuccccggggc

SEQ ID NO: 832422 - RNA, 15 nt, Homo sapiens
uccaaagagccaugu

SEQ ID NO: 832423 - RNA, 20 nt, Homo sapiens
uccaacugccagaacaugga

SEQ ID NO: 832424 - RNA, 17 nt, Homo sapiens
uccacacccucacugcu

SEQ ID NO: 832425 - RNA, 20 nt, Homo sapiens
uccacccaggcugcacugca

SEQ ID NO: 832426 - RNA, 15 nt, Homo sapiens
uccacccagugcugc

SEQ ID NO: 832427 - RNA, 16 nt, Homo sapiens
uccacucccacuuccc

SEQ ID NO: 832428 - RNA, 14 nt, Homo sapiens
uccaguaucuucac

SEQ ID NO: 832429 - RNA, 15 nt, Homo sapiens
uccaguuuccaaagg

SEQ ID NO: 832430 - RNA, 23 nt, Homo sapiens
uccauaaaguaauuuugugaaag

SEQ ID NO: 832431 - RNA, 21 nt, Homo sapiens
uccauguagaauaaaugaaga

SEQ ID NO: 832432 - RNA, 21 nt, Homo sapiens
ucccaugguagacugugacac

SEQ ID NO: 832433 - RNA, 21 nt, Homo sapiens
uccccacagugacagucacuu

SEQ ID NO: 832434 - RNA, 14 nt, Homo sapiens
uccccuccaaguga

SEQ ID NO: 832435 - RNA, 14 nt, Homo sapiens
uccccuggacauau

SEQ ID NO: 832436 - RNA, 15 nt, Homo sapiens
uccccuggacauauu

SEQ ID NO: 832437 - RNA, 22 nt, Homo sapiens
uccccuggggacgccaaggagg

SEQ ID NO: 832438 - RNA, 19 nt, Homo sapiens
ucccgccuuccuccuccac

SEQ ID NO: 832439 - RNA, 15 nt, Homo sapiens
ucccucaaaugacag

SEQ ID NO: 832440 - RNA, 11 nt, Homo sapiens
ucccucaggcc

SEQ ID NO: 832441 - RNA, 19 nt, Homo sapiens
ucccucaggccgaaggagg

SEQ ID NO: 832442 - RNA, 19 nt, Homo sapiens
ucccuggucccucguccac

SEQ ID NO: 832443 - RNA, 15 nt, Homo sapiens
uccgaggcaaagaga

SEQ ID NO: 832444 - RNA, 22 nt, Homo sapiens
uccgcugccaccacgucugcca

SEQ ID NO: 832445 - RNA, 19 nt, Homo sapiens
uccggccuccugucccuca

SEQ ID NO: 832446 - RNA, 16 nt, Homo sapiens
uccuccacagugcugc

SEQ ID NO: 832447 - RNA, 18 nt, Homo sapiens
uccuccacagugcugcuu

SEQ ID NO: 832448 - RNA, 13 nt, Homo sapiens
uccugcugccuaa

SEQ ID NO: 832449 - RNA, 16 nt, Homo sapiens
uccugguccaucucau

SEQ ID NO: 832450 - RNA, 16 nt, Homo sapiens
uccugucccucaucca

SEQ ID NO: 832451 - RNA, 11 nt, Homo sapiens
uccuguucuca

SEQ ID NO: 832452 - RNA, 23 nt, Homo sapiens
uccuuaaaaugugagugaccuca

SEQ ID NO: 832453 - RNA, 16 nt, Homo sapiens
uccuucagcaucucac

SEQ ID NO: 832454 - RNA, 18 nt, Homo sapiens
uccuuuccccucccucag

SEQ ID NO: 832455 - RNA, 18 nt, Homo sapiens
ucuaagugguauauacau

SEQ ID NO: 832456 - RNA, 16 nt, Homo sapiens
ucuaauccaugugcug

SEQ ID NO: 832457 - RNA, 13 nt, Homo sapiens
accuugucugcua

SEQ ID NO: 832458 - RNA, 16 nt, Homo sapiens
acgagagagucuucca

SEQ ID NO: 832459 - RNA, 15 nt, Homo sapiens
acgaucuuccuggcu

SEQ ID NO: 832460 - RNA, 21 nt, Homo sapiens
acgcuaguuaucaugcauguu

SEQ ID NO: 832461 - RNA, 14 nt, Homo sapiens
acggccacagucau

SEQ ID NO: 832462 - RNA, 16 nt, Homo sapiens
acgguaaguguucuca

SEQ ID NO: 832463 - RNA, 20 nt, Homo sapiens
acgugacuggccugcuggau

SEQ ID NO: 832464 - RNA, 21 nt, Homo sapiens
acguggucuuucuuacaagga

SEQ ID NO: 832465 - RNA, 14 nt, Homo sapiens
acuaaaauguucua

SEQ ID NO: 832466 - RNA, 18 nt, Homo sapiens
acuacagagaaggcugcc

SEQ ID NO: 832467 - RNA, 21 nt, Homo sapiens
acucaaaacccaucugggcuc

SEQ ID NO: 832468 - RNA, 13 nt, Homo sapiens
acucaacccauug

SEQ ID NO: 832469 - RNA, 21 nt, Homo sapiens
acucaagaagcaggcuacacu

SEQ ID NO: 832470 - RNA, 23 nt, Homo sapiens
acucacacggacacucaaaagcu

SEQ ID NO: 832471 - RNA, 21 nt, Homo sapiens
acucagccuggcugauuauca

SEQ ID NO: 832472 - RNA, 20 nt, Homo sapiens
acucaggugcugaaggguaa

SEQ ID NO: 832473 - RNA, 15 nt, Homo sapiens
acucauccauccagg

SEQ ID NO: 832474 - RNA, 23 nt, Homo sapiens
acucauugcaaccuccaccuucu

SEQ ID NO: 832475 - RNA, 14 nt, Homo sapiens
acuccuagggccac

SEQ ID NO: 832476 - RNA, 13 nt, Homo sapiens
acuccucaggguu

SEQ ID NO: 832477 - RNA, 13 nt, Homo sapiens
acucgugugcaac

SEQ ID NO: 832478 - RNA, 17 nt, Homo sapiens
acucugacaacagacuu

SEQ ID NO: 832479 - RNA, 19 nt, Homo sapiens
acugaguuuauacucaccu

SEQ ID NO: 832480 - RNA, 14 nt, Homo sapiens
acugauccuguuuc

SEQ ID NO: 832481 - RNA, 23 nt, Homo sapiens
acugauucucucuuguccuucac

SEQ ID NO: 832482 - RNA, 20 nt, Homo sapiens
acugcagccacugauucucu

SEQ ID NO: 832483 - RNA, 18 nt, Homo sapiens
acugcagcuaacuuauca

SEQ ID NO: 832484 - RNA, 22 nt, Homo sapiens
acugcagcuaacuuaucaucac

SEQ ID NO: 832485 - RNA, 18 nt, Homo sapiens
acugcaggcaucacagcu

SEQ ID NO: 832486 - RNA, 15 nt, Homo sapiens
acugcucugaugaag

SEQ ID NO: 832487 - RNA, 23 nt, Homo sapiens
acuggaugcauguuuuccagcuc

SEQ ID NO: 832488 - RNA, 23 nt, Homo sapiens
acuggucagggcaaaccugccuc

SEQ ID NO: 832489 - RNA, 15 nt, Homo sapiens
acuguaaacauucau

SEQ ID NO: 832490 - RNA, 14 nt, Homo sapiens
acuguacugagaca

SEQ ID NO: 832491 - RNA, 21 nt, Homo sapiens
acuguacugagacauuacagu

SEQ ID NO: 832492 - RNA, 13 nt, Homo sapiens
acuguuugucuca

SEQ ID NO: 832493 - RNA, 20 nt, Homo sapiens
acuguuugucucaccuaccc

SEQ ID NO: 832494 - RNA, 16 nt, Homo sapiens
acuuagguguggggga

SEQ ID NO: 832495 - RNA, 17 nt, Homo sapiens
acuugagcgugaaucug

SEQ ID NO: 832496 - RNA, 17 nt, Homo sapiens
acuugucaggagugugu

SEQ ID NO: 832497 - RNA, 13 nt, Homo sapiens
acuuugcugcuaa

SEQ ID NO: 832498 - RNA, 20 nt, Homo sapiens
acuuuugugcuccccuuugc

SEQ ID NO: 832499 - RNA, 18 nt, Homo sapiens
agaaaaagaucuuucauu

SEQ ID NO: 832500 - RNA, 21 nt, Homo sapiens
agaaaaauaugaccacacucc

SEQ ID NO: 832501 - RNA, 19 nt, Homo sapiens
agaaaagaugcacuuugcu

SEQ ID NO: 832502 - RNA, 16 nt, Homo sapiens
agaaaaugaagcccua

SEQ ID NO: 832503 - RNA, 12 nt, Homo sapiens
agaacacuguga

SEQ ID NO: 832504 - RNA, 20 nt, Homo sapiens
agaagguggguuuucaucaa

SEQ ID NO: 832505 - RNA, 13 nt, Homo sapiens
agaauguuuucaa

SEQ ID NO: 832506 - RNA, 21 nt, Homo sapiens
agaauguuuucaaauguucuc

SEQ ID NO: 832507 - RNA, 17 nt, Homo sapiens
agacaagugacuguauc

SEQ ID NO: 832508 - RNA, 21 nt, Homo sapiens
agacaccaccacccuugccau

SEQ ID NO: 832509 - RNA, 23 nt, Homo sapiens
agacaccaccacccuugccaugg

SEQ ID NO: 832510 - RNA, 23 nt, Homo sapiens
agacagucccugccaauggacua

SEQ ID NO: 832511 - RNA, 17 nt, Homo sapiens
agaccaucccugaaggc

SEQ ID NO: 832512 - RNA, 13 nt, Homo sapiens
uuagaaaaaccac

SEQ ID NO: 832513 - RNA, 21 nt, Homo sapiens
uuagacuuaauagaaacauug

SEQ ID NO: 832514 - RNA, 15 nt, Homo sapiens
uuagaugaaugucag

SEQ ID NO: 832515 - RNA, 22 nt, Homo sapiens
uuagcaaaaaaugaacagugau

SEQ ID NO: 832516 - RNA, 12 nt, Homo sapiens
uuaggauguaca

SEQ ID NO: 832517 - RNA, 20 nt, Homo sapiens
uuaggauuucuguauuugcc

SEQ ID NO: 832518 - RNA, 20 nt, Homo sapiens
uuaggucaguagacugugau

SEQ ID NO: 832519 - RNA, 20 nt, Homo sapiens
uuagugauuauauuucaccc

SEQ ID NO: 832520 - RNA, 18 nt, Homo sapiens
uuaguuuuuaaucucucc

SEQ ID NO: 832521 - RNA, 12 nt, Homo sapiens
uuaucauaugcu

SEQ ID NO: 832522 - RNA, 16 nt, Homo sapiens
uuaucaugcauguuau

SEQ ID NO: 832523 - RNA, 16 nt, Homo sapiens
uuaugacuucauuaau

SEQ ID NO: 832524 - RNA, 23 nt, Homo sapiens
uucaaaaacaugcuuuuccaaac

SEQ ID NO: 832525 - RNA, 15 nt, Homo sapiens
uucaaacuacuuugc

SEQ ID NO: 832526 - RNA, 16 nt, Homo sapiens
uucaagagcacacuug

SEQ ID NO: 832527 - RNA, 22 nt, Homo sapiens
uucaaguaaaaaucaauacccu

SEQ ID NO: 832528 - RNA, 19 nt, Homo sapiens
uucaaguacuguaacugug

SEQ ID NO: 832529 - RNA, 14 nt, Homo sapiens
uucaaucccaggau

SEQ ID NO: 832530 - RNA, 16 nt, Homo sapiens
uucaaucuggauucau

SEQ ID NO: 832531 - RNA, 21 nt, Homo sapiens
uucacagagauggaugcaugu

SEQ ID NO: 832532 - RNA, 15 nt, Homo sapiens
uucacucauacaucu

SEQ ID NO: 832533 - RNA, 18 nt, Homo sapiens
uucagagcugacacagga

SEQ ID NO: 832534 - RNA, 14 nt, Homo sapiens
uucagcucugcaag

SEQ ID NO: 832535 - RNA, 18 nt, Homo sapiens
uucaggcaacgcacaaaa

SEQ ID NO: 832536 - RNA, 17 nt, Homo sapiens
uucauacauuaucucac

SEQ ID NO: 832537 - RNA, 14 nt, Homo sapiens
uucaugcauggaaa

SEQ ID NO: 832538 - RNA, 19 nt, Homo sapiens
uucauucuuuuugaaaugu

SEQ ID NO: 832539 - RNA, 22 nt, Homo sapiens
uuccaaagagugcuaagcauua

SEQ ID NO: 832540 - RNA, 18 nt, Homo sapiens
uuccaaggcuacuacaga

SEQ ID NO: 832541 - RNA, 14 nt, Homo sapiens
uuccagugaggcuc

SEQ ID NO: 832542 - RNA, 15 nt, Homo sapiens
uuccauggacuuugu

SEQ ID NO: 832543 - RNA, 14 nt, Homo sapiens
uuccccacuugaga

SEQ ID NO: 832544 - RNA, 18 nt, Homo sapiens
uucccuaaaaucagggaa

SEQ ID NO: 832545 - RNA, 17 nt, Homo sapiens
uucccuacaguugaaaa

SEQ ID NO: 832546 - RNA, 18 nt, Homo sapiens
uucccuagucuauucauu

SEQ ID NO: 832547 - RNA, 16 nt, Homo sapiens
uucccucccaguuuuc

SEQ ID NO: 832548 - RNA, 22 nt, Homo sapiens
uucccuucaucuggaaccauca

SEQ ID NO: 832549 - RNA, 21 nt, Homo sapiens
uucccuuuuuuggcugcugaa

SEQ ID NO: 832550 - RNA, 23 nt, Homo sapiens
uuccucauuagcauuuugcuaaa

SEQ ID NO: 832551 - RNA, 17 nt, Homo sapiens
uuccugauggcaggaug

SEQ ID NO: 832552 - RNA, 11 nt, Homo sapiens
uuccugcaaug

SEQ ID NO: 832553 - RNA, 21 nt, Homo sapiens
uuccugcaaugaagucucuga

SEQ ID NO: 832554 - RNA, 20 nt, Homo sapiens
uuccuggcuccaacacugcu

SEQ ID NO: 832555 - RNA, 19 nt, Homo sapiens
uucuauucaucucaaggaa

SEQ ID NO: 832556 - RNA, 13 nt, Homo sapiens
uucugaaacacac

SEQ ID NO: 832557 - RNA, 13 nt, Homo sapiens
uucugaaagggac

SEQ ID NO: 832558 - RNA, 15 nt, Homo sapiens
uucuguauucacuua

SEQ ID NO: 832559 - RNA, 12 nt, Homo sapiens
uucuuuccugag

SEQ ID NO: 832560 - RNA, 20 nt, Homo sapiens
uugaagggcaagaaauggcg

SEQ ID NO: 832561 - RNA, 14 nt, Homo sapiens
uugagacaggagac

SEQ ID NO: 832562 - RNA, 18 nt, Homo sapiens
uugagugacagcuuucug

SEQ ID NO: 832563 - RNA, 19 nt, Homo sapiens
uugauaggauguggauuaa

SEQ ID NO: 832564 - RNA, 14 nt, Homo sapiens
uugcaccacugcac

SEQ ID NO: 832565 - RNA, 20 nt, Homo sapiens
uugcaggaccucaggugaga

SEQ ID NO: 832566 - RNA, 23 nt, Homo sapiens
uugcauuuaauuuauugaggcuu

SEQ ID NO: 832567 - RNA, 21 nt, Homo sapiens
uugccaaggcuggagugcagu

SEQ ID NO: 832568 - RNA, 15 nt, Homo sapiens
uugccauugacuucu

SEQ ID NO: 832569 - RNA, 17 nt, Homo sapiens
uugcggggauaaagaga

SEQ ID NO: 832570 - RNA, 15 nt, Homo sapiens
uuggaauuuugugcc

SEQ ID NO: 832571 - RNA, 16 nt, Homo sapiens
uuggacagaagcagcu

SEQ ID NO: 832572 - RNA, 19 nt, Homo sapiens
uuggagaagcucaucagaa

SEQ ID NO: 832573 - RNA, 21 nt, Homo sapiens
uuggcgggggcuuggcugugc

SEQ ID NO: 832574 - RNA, 22 nt, Homo sapiens
uuggcugugcccucagauuccg

SEQ ID NO: 832575 - RNA, 13 nt, Homo sapiens
uugucuacacucu

SEQ ID NO: 832576 - RNA, 13 nt, Homo sapiens
uugugaugcauuu

SEQ ID NO: 832577 - RNA, 19 nt, Homo sapiens
uuguucuguuuugugagaa

SEQ ID NO: 832578 - RNA, 13 nt, Homo sapiens
uuguucuugugaa

SEQ ID NO: 832579 - RNA, 20 nt, Homo sapiens
uuguucuuuggaaauacaca

SEQ ID NO: 832580 - RNA, 13 nt, Homo sapiens
uuuaaaaacucac

SEQ ID NO: 832581 - RNA, 17 nt, Homo sapiens
uuuaaagcuugcucaca

SEQ ID NO: 832582 - RNA, 15 nt, Homo sapiens
uuuaaccuacuagac

SEQ ID NO: 832583 - RNA, 17 nt, Homo sapiens
uuuacugcgaauaagcu

SEQ ID NO: 832584 - RNA, 20 nt, Homo sapiens
uuuagaaccaccaacaagca

SEQ ID NO: 832585 - RNA, 15 nt, Homo sapiens
uuuagaugaauguca

SEQ ID NO: 832586 - RNA, 19 nt, Homo sapiens
uuuauacucaccuuuuaug

SEQ ID NO: 832587 - RNA, 13 nt, Homo sapiens
uuuaugcuuuaaa

SEQ ID NO: 832588 - RNA, 10 nt, Homo sapiens
uuuccaugau

SEQ ID NO: 832589 - RNA, 20 nt, Homo sapiens
uuuccgguguuuaagacauu

SEQ ID NO: 832590 - RNA, 19 nt, Homo sapiens
uuucugaaccauuacugua

SEQ ID NO: 832591 - RNA, 17 nt, Homo sapiens
uuugaaaccaaaccaga

SEQ ID NO: 832592 - RNA, 14 nt, Homo sapiens
uuugagacaggaga

SEQ ID NO: 832593 - RNA, 18 nt, Homo sapiens
uuugaugguaaccauaau

SEQ ID NO: 832594 - RNA, 13 nt, Homo sapiens
uuuggcaaagcca

SEQ ID NO: 832595 - RNA, 13 nt, Homo sapiens
uuugguugcuuua

SEQ ID NO: 832596 - RNA, 13 nt, Homo sapiens
uuuuaguugucaa

SEQ ID NO: 832597 - RNA, 16 nt, Homo sapiens
uuuuaugaaagcacug

SEQ ID NO: 832598 - RNA, 14 nt, Homo sapiens
uuuuccugccaggc

SEQ ID NO: 832599 - RNA, 21 nt, Homo sapiens
uuuucuccugccugugcugug

SEQ ID NO: 832600 - RNA, 14 nt, Homo sapiens
uuuugaaaugucaa

SEQ ID NO: 832601 - RNA, 20 nt, Homo sapiens
uuuugaagauucuauguuaa

SEQ ID NO: 832602 - RNA, 16 nt, Homo sapiens
uuuugguugcuuuaau

SEQ ID NO: 832603 - RNA, 13 nt, Homo sapiens
uuuuuuucaccuc

SEQ ID NO: 832604 - RNA, 18 nt, Homo sapiens
auuaugaugugugaaaac

SEQ ID NO: 832605 - RNA, 14 nt, Homo sapiens
auucagcucugcaa

SEQ ID NO: 832606 - RNA, 15 nt, Homo sapiens
auucaucaaauggaa

SEQ ID NO: 832607 - RNA, 10 nt, Homo sapiens
auucauucca

SEQ ID NO: 832608 - RNA, 12 nt, Homo sapiens
auucauuccauu

SEQ ID NO: 832609 - RNA, 23 nt, Homo sapiens
auucauucuuuuugaaaugucaa

SEQ ID NO: 832610 - RNA, 16 nt, Homo sapiens
auuccccacccugaaa

SEQ ID NO: 832611 - RNA, 21 nt, Homo sapiens
auuccuguuucugaaccauua

SEQ ID NO: 832612 - RNA, 22 nt, Homo sapiens
auuccuguuucugaaccauuac

SEQ ID NO: 832613 - RNA, 16 nt, Homo sapiens
auucgauccccuguca

SEQ ID NO: 832614 - RNA, 22 nt, Homo sapiens
auucucaggccaucaucagugg

SEQ ID NO: 832615 - RNA, 22 nt, Homo sapiens
auucugaggguccacuacucaa

SEQ ID NO: 832616 - RNA, 17 nt, Homo sapiens
auucuguuuauagaaua

SEQ ID NO: 832617 - RNA, 16 nt, Homo sapiens
auugaaaugauuucac

SEQ ID NO: 832618 - RNA, 17 nt, Homo sapiens
auugacuucuucccaag

SEQ ID NO: 832619 - RNA, 15 nt, Homo sapiens
auugcagacugugua

SEQ ID NO: 832620 - RNA, 20 nt, Homo sapiens
auugccuuuagugaucacag

SEQ ID NO: 832621 - RNA, 15 nt, Homo sapiens
auuuaagauauguaa

SEQ ID NO: 832622 - RNA, 15 nt, Homo sapiens
auuuaauccucucaa

SEQ ID NO: 832623 - RNA, 17 nt, Homo sapiens
auuuauugaaaugauuu

SEQ ID NO: 832624 - RNA, 13 nt, Homo sapiens
auuucaagaccuc

SEQ ID NO: 832625 - RNA, 15 nt, Homo sapiens
auuucugaccuugua

SEQ ID NO: 832626 - RNA, 15 nt, Homo sapiens
auuuuagcuacuaua

SEQ ID NO: 832627 - RNA, 22 nt, Homo sapiens
auuuuuuugugggaaauccaca

SEQ ID NO: 832628 - RNA, 19 nt, Homo sapiens
caaaaaaugaacagugaua

SEQ ID NO: 832629 - RNA, 17 nt, Homo sapiens
caaaacagaaaaugaag

SEQ ID NO: 832630 - RNA, 13 nt, Homo sapiens
caaaacucaguag

SEQ ID NO: 832631 - RNA, 15 nt, Homo sapiens
caaaagcccauucau

SEQ ID NO: 832632 - RNA, 18 nt, Homo sapiens
caaaagcccauucauucc

SEQ ID NO: 832633 - RNA, 19 nt, Homo sapiens
caaaagcccauucauucca

SEQ ID NO: 832634 - RNA, 20 nt, Homo sapiens
caaaagcccauucauuccau

SEQ ID NO: 832635 - RNA, 16 nt, Homo sapiens
caaaagcucauccauu

SEQ ID NO: 832636 - RNA, 21 nt, Homo sapiens
caaacauguaagcauaacuua

SEQ ID NO: 832637 - RNA, 15 nt, Homo sapiens
caaacccaggcuauu

SEQ ID NO: 832638 - RNA, 17 nt, Homo sapiens
caaaccucugugagcau

SEQ ID NO: 832639 - RNA, 19 nt, Homo sapiens
caaacgaaaaacauuucaa

SEQ ID NO: 832640 - RNA, 21 nt, Homo sapiens
caaagccaauaacacacagcu

SEQ ID NO: 832641 - RNA, 13 nt, Homo sapiens
caaagcguggaca

SEQ ID NO: 832642 - RNA, 13 nt, Homo sapiens
caaaggcugagaa

SEQ ID NO: 832643 - RNA, 18 nt, Homo sapiens
caaaggcugagaacacug

SEQ ID NO: 832644 - RNA, 22 nt, Homo sapiens
caaaggcugagaacacugugaa

SEQ ID NO: 832645 - RNA, 14 nt, Homo sapiens
caaagggcaugggu

SEQ ID NO: 832646 - RNA, 16 nt, Homo sapiens
caaagucaugcaaagg

SEQ ID NO: 832647 - RNA, 18 nt, Homo sapiens
caaauagccagugcuagu

SEQ ID NO: 832648 - RNA, 15 nt, Homo sapiens
caaaugcccaaggga

SEQ ID NO: 832649 - RNA, 14 nt, Homo sapiens
caaaugcugaccca

SEQ ID NO: 832650 - RNA, 22 nt, Homo sapiens
caacaauuauuugaagauuuaa

SEQ ID NO: 832651 - RNA, 22 nt, Homo sapiens
caacaccucugcacaagcugca

SEQ ID NO: 832652 - RNA, 14 nt, Homo sapiens
caacacugcugcuc

SEQ ID NO: 832653 - RNA, 23 nt, Homo sapiens
caacauaauuuuuauuuuuggca

SEQ ID NO: 832654 - RNA, 22 nt, Homo sapiens
caacauuacagggaaugccuga

SEQ ID NO: 832655 - RNA, 18 nt, Homo sapiens
caaccuccaccuucuggg

SEQ ID NO: 832656 - RNA, 13 nt, Homo sapiens
caagcagccaagg

SEQ ID NO: 832657 - RNA, 20 nt, Homo sapiens
caagcaggaaccccaggaga

SEQ ID NO: 832658 - RNA, 23 nt, Homo sapiens
caagcucaaagcguggacaggug

SEQ ID NO: 832659 - RNA, 15 nt, Homo sapiens
caagcucccaaggga

SEQ ID NO: 832660 - RNA, 13 nt, Homo sapiens
caaggacacagau

SEQ ID NO: 832661 - RNA, 15 nt, Homo sapiens
caaggacacagauga

SEQ ID NO: 832662 - RNA, 16 nt, Homo sapiens
caaggaggccacguga

SEQ ID NO: 832663 - RNA, 13 nt, Homo sapiens
caaggcacugccu

SEQ ID NO: 832664 - RNA, 14 nt, Homo sapiens
caaggcacugccug

SEQ ID NO: 832665 - RNA, 16 nt, Homo sapiens
caaggcacugccugau

SEQ ID NO: 832666 - RNA, 17 nt, Homo sapiens
acugcugcuccagugca

SEQ ID NO: 832667 - RNA, 18 nt, Homo sapiens
acuggaacucagugugac

SEQ ID NO: 832668 - RNA, 23 nt, Homo sapiens
acuggaagguggggacagggaug

SEQ ID NO: 832669 - RNA, 12 nt, Homo sapiens
acuggaugcaug

SEQ ID NO: 832670 - RNA, 20 nt, Homo sapiens
acugggugcgucuccaguca

SEQ ID NO: 832671 - RNA, 15 nt, Homo sapiens
acuggguucccauuc

SEQ ID NO: 832672 - RNA, 21 nt, Homo sapiens
acuguaaagcuuugugcagau

SEQ ID NO: 832673 - RNA, 15 nt, Homo sapiens
acuguugagucaaaa

SEQ ID NO: 832674 - RNA, 20 nt, Homo sapiens
acuguuuagaugaaugucag

SEQ ID NO: 832675 - RNA, 22 nt, Homo sapiens
acuguuugucucaccuacccau

SEQ ID NO: 832676 - RNA, 14 nt, Homo sapiens
acuuaccuaccaca

SEQ ID NO: 832677 - RNA, 18 nt, Homo sapiens
acuuauauguucuaauua

SEQ ID NO: 832678 - RNA, 18 nt, Homo sapiens
acuuaucaucacacaacu

SEQ ID NO: 832679 - RNA, 21 nt, Homo sapiens
acuucuuaguaugugcauuua

SEQ ID NO: 832680 - RNA, 17 nt, Homo sapiens
acuuggcuacacaggga

SEQ ID NO: 832681 - RNA, 19 nt, Homo sapiens
acuuggcuacacagggaug

SEQ ID NO: 832682 - RNA, 21 nt, Homo sapiens
acuugucccuuuuuuguccca

SEQ ID NO: 832683 - RNA, 13 nt, Homo sapiens
acuuuacuaagua

SEQ ID NO: 832684 - RNA, 14 nt, Homo sapiens
acuuuuaauuaaau

SEQ ID NO: 832685 - RNA, 18 nt, Homo sapiens
acuuuuauuuccagugaa

SEQ ID NO: 832686 - RNA, 23 nt, Homo sapiens
acuuuucugugucauaccacaau

SEQ ID NO: 832687 - RNA, 17 nt, Homo sapiens
acuuuugccauugacuu

SEQ ID NO: 832688 - RNA, 15 nt, Homo sapiens
agaaaaacaaauuca

SEQ ID NO: 832689 - RNA, 22 nt, Homo sapiens
agaaaauuggaacucuacucaa

SEQ ID NO: 832690 - RNA, 22 nt, Homo sapiens
agaaacaccccucugucuagga

SEQ ID NO: 832691 - RNA, 23 nt, Homo sapiens
agaaacaccccucugucuaggac

SEQ ID NO: 832692 - RNA, 12 nt, Homo sapiens
agaaacuuuauu

SEQ ID NO: 832693 - RNA, 16 nt, Homo sapiens
agaaauuaaguaucug

SEQ ID NO: 832694 - RNA, 18 nt, Homo sapiens
agaacacauaauucagga

SEQ ID NO: 832695 - RNA, 23 nt, Homo sapiens
agaaggccacuguuugucucacc

SEQ ID NO: 832696 - RNA, 18 nt, Homo sapiens
agaauaguucccuagucu

SEQ ID NO: 832697 - RNA, 15 nt, Homo sapiens
agaauuuaucucuuu

SEQ ID NO: 832698 - RNA, 19 nt, Homo sapiens
agacaagaacuuggaggca

SEQ ID NO: 832699 - RNA, 19 nt, Homo sapiens
agacaagagggacaagugg

SEQ ID NO: 832700 - RNA, 24 nt, Homo sapiens
agacaagugacuguaucuguguag

SEQ ID NO: 832701 - RNA, 22 nt, Homo sapiens
agacaaugugaaaagaaaaaug

SEQ ID NO: 832702 - RNA, 18 nt, Homo sapiens
agacaugagugcgugcuc

SEQ ID NO: 832703 - RNA, 21 nt, Homo sapiens
agaccaagcugugcccugacc

SEQ ID NO: 832704 - RNA, 14 nt, Homo sapiens
agacuggaaggugg

SEQ ID NO: 832705 - RNA, 13 nt, Homo sapiens
agacuugggaugg

SEQ ID NO: 832706 - RNA, 20 nt, Homo sapiens
agacuuuacauggaugccaa

SEQ ID NO: 832707 - RNA, 13 nt, Homo sapiens
agacuuuucccaa

SEQ ID NO: 832708 - RNA, 23 nt, Homo sapiens
agagaccaggcaaagcaagugau

SEQ ID NO: 832709 - RNA, 13 nt, Homo sapiens
agagagccuggug

SEQ ID NO: 832710 - RNA, 22 nt, Homo sapiens
agagagucgcaucucagugcag

SEQ ID NO: 832711 - RNA, 22 nt, Homo sapiens
agagagucuuccagguacugau

SEQ ID NO: 832712 - RNA, 22 nt, Homo sapiens
agagcacacuuggcccaagugg

SEQ ID NO: 832713 - RNA, 12 nt, Homo sapiens
agagccuuccag

SEQ ID NO: 832714 - RNA, 19 nt, Homo sapiens
agagggcacacacugugua

SEQ ID NO: 832715 - RNA, 14 nt, Homo sapiens
agagggcaggcaug

SEQ ID NO: 832716 - RNA, 17 nt, Homo sapiens
agagggcuuucucagga

SEQ ID NO: 832717 - RNA, 12 nt, Homo sapiens
agagguuugcuu

SEQ ID NO: 832718 - RNA, 19 nt, Homo sapiens
agaguaacagucaucauuu

SEQ ID NO: 832719 - RNA, 18 nt, Homo sapiens
agaguauaaauaaccaau

SEQ ID NO: 832720 - RNA, 15 nt, Homo sapiens
agaguauggagcuca

SEQ ID NO: 832721 - RNA, 17 nt, Homo sapiens
agagugcuaagcauuag

SEQ ID NO: 832722 - RNA, 13 nt, Homo sapiens
agaugaaugucag

SEQ ID NO: 832723 - RNA, 13 nt, Homo sapiens
agaugucacagau

SEQ ID NO: 832724 - RNA, 16 nt, Homo sapiens
agcaaaggcugagaac

SEQ ID NO: 832725 - RNA, 13 nt, Homo sapiens
caucaagcuguac

SEQ ID NO: 832726 - RNA, 19 nt, Homo sapiens
caucagugcccuccaggau

SEQ ID NO: 832727 - RNA, 13 nt, Homo sapiens
caucccaggaucg

SEQ ID NO: 832728 - RNA, 23 nt, Homo sapiens
caucccaggaucgcaagagccau

SEQ ID NO: 832729 - RNA, 13 nt, Homo sapiens
caucucaaggaau

SEQ ID NO: 832730 - RNA, 13 nt, Homo sapiens
caucucagugcag

SEQ ID NO: 832731 - RNA, 20 nt, Homo sapiens
caucuuacaaaaacaagaca

SEQ ID NO: 832732 - RNA, 20 nt, Homo sapiens
caugaaagcaucugagcuaa

SEQ ID NO: 832733 - RNA, 17 nt, Homo sapiens
caugccuggauggggcu

SEQ ID NO: 832734 - RNA, 18 nt, Homo sapiens
caugcugaagccaaagcc

SEQ ID NO: 832735 - RNA, 20 nt, Homo sapiens
caugcugaagccaaagccaa

SEQ ID NO: 832736 - RNA, 15 nt, Homo sapiens
cauggaaauucccuu

SEQ ID NO: 832737 - RNA, 19 nt, Homo sapiens
cauggacaaggaugaucua

SEQ ID NO: 832738 - RNA, 12 nt, Homo sapiens
cauggaugccaa

SEQ ID NO: 832739 - RNA, 14 nt, Homo sapiens
cauggccaccacca

SEQ ID NO: 832740 - RNA, 18 nt, Homo sapiens
cauguaccucugauuaau

SEQ ID NO: 832741 - RNA, 16 nt, Homo sapiens
cauguauuuguuugca

SEQ ID NO: 832742 - RNA, 20 nt, Homo sapiens
cauuaauaauaaauucccug

SEQ ID NO: 832743 - RNA, 19 nt, Homo sapiens
cauucaggcaacgcacaaa

SEQ ID NO: 832744 - RNA, 23 nt, Homo sapiens
cauucaucaagcuguacauuugg

SEQ ID NO: 832745 - RNA, 22 nt, Homo sapiens
cauuuaagagacagucacccca

SEQ ID NO: 832746 - RNA, 16 nt, Homo sapiens
cauuuaauccucucaa

SEQ ID NO: 832747 - RNA, 15 nt, Homo sapiens
cauuuaucaucacaa

SEQ ID NO: 832748 - RNA, 14 nt, Homo sapiens
cauuuggucucagg

SEQ ID NO: 832749 - RNA, 13 nt, Homo sapiens
cauuuugcuagac

SEQ ID NO: 832750 - RNA, 16 nt, Homo sapiens
cauuuuugaaaccaaa

SEQ ID NO: 832751 - RNA, 14 nt, Homo sapiens
ccaaaacaauuucu

SEQ ID NO: 832752 - RNA, 20 nt, Homo sapiens
ccaaaagcccauucauucca

SEQ ID NO: 832753 - RNA, 12 nt, Homo sapiens
ccaaacagugac

SEQ ID NO: 832754 - RNA, 20 nt, Homo sapiens
ccaaagccaauaacacacag

SEQ ID NO: 832755 - RNA, 17 nt, Homo sapiens
ccaaccggucacccagg

SEQ ID NO: 832756 - RNA, 11 nt, Homo sapiens
ccaagacauuc

SEQ ID NO: 832757 - RNA, 22 nt, Homo sapiens
ccaagcaccaccaaacacagug

SEQ ID NO: 832758 - RNA, 21 nt, Homo sapiens
ccaagccuacuuuugccauug

SEQ ID NO: 832759 - RNA, 23 nt, Homo sapiens
ccaagcugugcccugaccacccu

SEQ ID NO: 832760 - RNA, 16 nt, Homo sapiens
ccaaggcuacuacaga

SEQ ID NO: 832761 - RNA, 18 nt, Homo sapiens
ccaaggcuggagugcagu

SEQ ID NO: 832762 - RNA, 13 nt, Homo sapiens
ccaauaaagccuu

SEQ ID NO: 832763 - RNA, 21 nt, Homo sapiens
ccaauauuuaccagaccacaa

SEQ ID NO: 832764 - RNA, 12 nt, Homo sapiens
ccaauuccucau

SEQ ID NO: 832765 - RNA, 18 nt, Homo sapiens
ccacaaccgaccagaugc

SEQ ID NO: 832766 - RNA, 22 nt, Homo sapiens
ccacaagacccuugugguccca

SEQ ID NO: 832767 - RNA, 15 nt, Homo sapiens
ccacaugccaagcac

SEQ ID NO: 832768 - RNA, 15 nt, Homo sapiens
ccaccaacauacucc

SEQ ID NO: 832769 - RNA, 22 nt, Homo sapiens
ccacccagaugggggaaagcac

SEQ ID NO: 832770 - RNA, 24 nt, Homo sapiens
ccacccucaugcugugugacucaa

SEQ ID NO: 832771 - RNA, 16 nt, Homo sapiens
ccacgcccagcuaauu

SEQ ID NO: 832772 - RNA, 19 nt, Homo sapiens
ccacgugggcaaacaggca

SEQ ID NO: 832773 - RNA, 16 nt, Homo sapiens
ccacuguuugucucac

SEQ ID NO: 832774 - RNA, 16 nt, Homo sapiens
ccagacacauguccaa

SEQ ID NO: 832775 - RNA, 23 nt, Homo sapiens
ccagagccuuaauaaacguccac

SEQ ID NO: 832776 - RNA, 19 nt, Homo sapiens
ccagagguggauguuauga

SEQ ID NO: 832777 - RNA, 19 nt, Homo sapiens
ccagcaucccuugaccagg

SEQ ID NO: 832778 - RNA, 14 nt, Homo sapiens
ccagccacugugau

SEQ ID NO: 832779 - RNA, 15 nt, Homo sapiens
ccagcuccucaucca

SEQ ID NO: 832780 - RNA, 15 nt, Homo sapiens
ccagcucugguccau

SEQ ID NO: 832781 - RNA, 14 nt, Homo sapiens
ccagcuuaucucag

SEQ ID NO: 832782 - RNA, 15 nt, Homo sapiens
ccaguaaacagagga

SEQ ID NO: 832783 - RNA, 19 nt, Homo sapiens
ccauaccacccaaugcuga

SEQ ID NO: 832784 - RNA, 22 nt, Homo sapiens
ccauaggcccagugagaugcau

SEQ ID NO: 832785 - RNA, 18 nt, Homo sapiens
auuacaggcgugagccac

SEQ ID NO: 832786 - RNA, 20 nt, Homo sapiens
auuacaguuuggaaguguua

SEQ ID NO: 832787 - RNA, 23 nt, Homo sapiens
auuagcuuuaauuaagcucucau

SEQ ID NO: 832788 - RNA, 18 nt, Homo sapiens
auuauaauuaguuccuca

SEQ ID NO: 832789 - RNA, 21 nt, Homo sapiens
auuauauuucacccaucucuc

SEQ ID NO: 832790 - RNA, 16 nt, Homo sapiens
auuauuccccuaggcu

SEQ ID NO: 832791 - RNA, 19 nt, Homo sapiens
auuauuuuaaacauuauga

SEQ ID NO: 832792 - RNA, 17 nt, Homo sapiens
auucaaucccaggaugu

SEQ ID NO: 832793 - RNA, 15 nt, Homo sapiens
auucauacauuaucu

SEQ ID NO: 832794 - RNA, 17 nt, Homo sapiens
auucauacauuaucuca

SEQ ID NO: 832795 - RNA, 17 nt, Homo sapiens
auucaucucaaggaaua

SEQ ID NO: 832796 - RNA, 11 nt, Homo sapiens
auucauuccau

SEQ ID NO: 832797 - RNA, 13 nt, Homo sapiens
auuccccuaggcu

SEQ ID NO: 832798 - RNA, 23 nt, Homo sapiens
auucccuguuaaaauuuaaccua

SEQ ID NO: 832799 - RNA, 14 nt, Homo sapiens
auuccgcaccaaua

SEQ ID NO: 832800 - RNA, 15 nt, Homo sapiens
auuccugaugaccaa

SEQ ID NO: 832801 - RNA, 23 nt, Homo sapiens
auucgaaugacgguaaguguucu

SEQ ID NO: 832802 - RNA, 20 nt, Homo sapiens
auucuaacgcaaaaauagcu

SEQ ID NO: 832803 - RNA, 18 nt, Homo sapiens
auucuaagucaauccaag

SEQ ID NO: 832804 - RNA, 11 nt, Homo sapiens
auucuacucaa

SEQ ID NO: 832805 - RNA, 16 nt, Homo sapiens
auucuacucaaaguca

SEQ ID NO: 832806 - RNA, 14 nt, Homo sapiens
auucugaugcauac

SEQ ID NO: 832807 - RNA, 20 nt, Homo sapiens
auucuggcuagugucuauca

SEQ ID NO: 832808 - RNA, 13 nt, Homo sapiens
auucuuagcaaaa

SEQ ID NO: 832809 - RNA, 18 nt, Homo sapiens
auucuuuacccccuggga

SEQ ID NO: 832810 - RNA, 12 nt, Homo sapiens
auugagcaccug

SEQ ID NO: 832811 - RNA, 16 nt, Homo sapiens
auugauucaugucuca

SEQ ID NO: 832812 - RNA, 19 nt, Homo sapiens
auugccuuuagugaucaca

SEQ ID NO: 832813 - RNA, 16 nt, Homo sapiens
auugcuaagaagggaa

SEQ ID NO: 832814 - RNA, 15 nt, Homo sapiens
auuguggaaaaccag

SEQ ID NO: 832815 - RNA, 15 nt, Homo sapiens
auuguggaugaugau

SEQ ID NO: 832816 - RNA, 17 nt, Homo sapiens
auuuaagagacagucac

SEQ ID NO: 832817 - RNA, 22 nt, Homo sapiens
auuuaauuacuucuuaguaugu

SEQ ID NO: 832818 - RNA, 21 nt, Homo sapiens
auuuauugaaaugauuucaca

SEQ ID NO: 832819 - RNA, 14 nt, Homo sapiens
auuuauugagcacc

SEQ ID NO: 832820 - RNA, 18 nt, Homo sapiens
auuuauugagcaccugca

SEQ ID NO: 832821 - RNA, 21 nt, Homo sapiens
auuuugcggcauuaaagccau

SEQ ID NO: 832822 - RNA, 22 nt, Homo sapiens
auuuugguguccuauuaaagga

SEQ ID NO: 832823 - RNA, 19 nt, Homo sapiens
auuuuguuuuugucuuaaa

SEQ ID NO: 832824 - RNA, 22 nt, Homo sapiens
auuuuuauuuuuggcaaagcca

SEQ ID NO: 832825 - RNA, 13 nt, Homo sapiens
auuuuucuaacua

SEQ ID NO: 832826 - RNA, 22 nt, Homo sapiens
caaaaaaucucaauucuucccu

SEQ ID NO: 832827 - RNA, 23 nt, Homo sapiens
caaacaaacgaaaaacauuucaa

SEQ ID NO: 832828 - RNA, 15 nt, Homo sapiens
caaacacugcaggca

SEQ ID NO: 832829 - RNA, 20 nt, Homo sapiens
caaaccugccucccauucua

SEQ ID NO: 832830 - RNA, 13 nt, Homo sapiens
caaagagugcuaa

SEQ ID NO: 832831 - RNA, 19 nt, Homo sapiens
caaagaugaucaguaugaa

SEQ ID NO: 832832 - RNA, 23 nt, Homo sapiens
caaagccuccuccagccgccaug

SEQ ID NO: 832833 - RNA, 21 nt, Homo sapiens
caaaggcugagaacacuguga

SEQ ID NO: 832834 - RNA, 18 nt, Homo sapiens
caaagugagacaguccag

SEQ ID NO: 832835 - RNA, 13 nt, Homo sapiens
caaauagccagug

SEQ ID NO: 832836 - RNA, 17 nt, Homo sapiens
caaauauuuauaagcua

SEQ ID NO: 832837 - RNA, 16 nt, Homo sapiens
caaaugcccaagggaa

SEQ ID NO: 832838 - RNA, 15 nt, Homo sapiens
caaauggaagacaca

SEQ ID NO: 832839 - RNA, 18 nt, Homo sapiens
caaauggcuacaucucca

SEQ ID NO: 832840 - RNA, 15 nt, Homo sapiens
caaauuuuagauuua

SEQ ID NO: 832841 - RNA, 17 nt, Homo sapiens
caacaagcaagcuccca

SEQ ID NO: 832842 - RNA, 17 nt, Homo sapiens
caacacucaagucuauu

SEQ ID NO: 832843 - RNA, 18 nt, Homo sapiens
caacagacuucugaaaua

SEQ ID NO: 832844 - RNA, 15 nt, Homo sapiens
caacauuacagggaa

SEQ ID NO: 832845 - RNA, 18 nt, Homo sapiens
caaccggucacccaggag

SEQ ID NO: 832846 - RNA, 21 nt, Homo sapiens
uucugaggguccacuacucaa

SEQ ID NO: 832847 - RNA, 16 nt, Homo sapiens
uucugagguaaccuca

SEQ ID NO: 832848 - RNA, 14 nt, Homo sapiens
uucuguauuugcca

SEQ ID NO: 832849 - RNA, 13 nt, Homo sapiens
uucugugucauac

SEQ ID NO: 832850 - RNA, 21 nt, Homo sapiens
uucuuaaauaauaaagaucau

SEQ ID NO: 832851 - RNA, 20 nt, Homo sapiens
uugaaauagugucugaugaa

SEQ ID NO: 832852 - RNA, 13 nt, Homo sapiens
uugaagauucuau

SEQ ID NO: 832853 - RNA, 13 nt, Homo sapiens
uugaagccuuugu

SEQ ID NO: 832854 - RNA, 20 nt, Homo sapiens
uugagaaauuaaguaucuga

SEQ ID NO: 832855 - RNA, 22 nt, Homo sapiens
uugagcgugaaucuguaucuug

SEQ ID NO: 832856 - RNA, 20 nt, Homo sapiens
uugagcucaggaguuugaga

SEQ ID NO: 832857 - RNA, 20 nt, Homo sapiens
uugaggauuguggaaaacca

SEQ ID NO: 832858 - RNA, 21 nt, Homo sapiens
uugagugacagcuuucuggga

SEQ ID NO: 832859 - RNA, 23 nt, Homo sapiens
uugauaagagggcacacacugug

SEQ ID NO: 832860 - RNA, 13 nt, Homo sapiens
uugcaaauagcca

SEQ ID NO: 832861 - RNA, 23 nt, Homo sapiens
uugccaagcucaggaccaggcaa

SEQ ID NO: 832862 - RNA, 23 nt, Homo sapiens
uugccugcacaaacucaccaucu

SEQ ID NO: 832863 - RNA, 20 nt, Homo sapiens
uugcuccagauucugaugca

SEQ ID NO: 832864 - RNA, 19 nt, Homo sapiens
uuggacagaagcagcucuu

SEQ ID NO: 832865 - RNA, 23 nt, Homo sapiens
uuggaggagcaaaggcugagaac

SEQ ID NO: 832866 - RNA, 15 nt, Homo sapiens
uuggccaucucugga

SEQ ID NO: 832867 - RNA, 21 nt, Homo sapiens
uuggccuauuccauucuggau

SEQ ID NO: 832868 - RNA, 13 nt, Homo sapiens
uuggccucuugua

SEQ ID NO: 832869 - RNA, 21 nt, Homo sapiens
uugggauauucugaaacuuga

SEQ ID NO: 832870 - RNA, 23 nt, Homo sapiens
uuguaguugcaauagaacagaga

SEQ ID NO: 832871 - RNA, 22 nt, Homo sapiens
uugucaagcaguagacaagcaa

SEQ ID NO: 832872 - RNA, 14 nt, Homo sapiens
uugucacaugaaac

SEQ ID NO: 832873 - RNA, 20 nt, Homo sapiens
uuguccuuuuucacuuugaa

SEQ ID NO: 832874 - RNA, 22 nt, Homo sapiens
uuguuugagaaauuaaguaucu

SEQ ID NO: 832875 - RNA, 19 nt, Homo sapiens
uuguuugcauaggugaucu

SEQ ID NO: 832876 - RNA, 19 nt, Homo sapiens
uuuaaaaugaaaugcauuu

SEQ ID NO: 832877 - RNA, 21 nt, Homo sapiens
uuuaaugcuccaaaugcugac

SEQ ID NO: 832878 - RNA, 11 nt, Homo sapiens
uuuacaguguu

SEQ ID NO: 832879 - RNA, 20 nt, Homo sapiens
uuuagcagauuuaagauaug

SEQ ID NO: 832880 - RNA, 16 nt, Homo sapiens
uuuauaaaacuuugaa

SEQ ID NO: 832881 - RNA, 20 nt, Homo sapiens
uuucaacuugucucuauaau

SEQ ID NO: 832882 - RNA, 23 nt, Homo sapiens
uuuccacauaaggaaacuggguu

SEQ ID NO: 832883 - RNA, 12 nt, Homo sapiens
uuuccuccugag

SEQ ID NO: 832884 - RNA, 18 nt, Homo sapiens
uuuccuucauucaaccca

SEQ ID NO: 832885 - RNA, 15 nt, Homo sapiens
uuucuaagccuuuga

SEQ ID NO: 832886 - RNA, 17 nt, Homo sapiens
uuucuaagccuuugaga

SEQ ID NO: 832887 - RNA, 23 nt, Homo sapiens
uuucuuguaaggcauacugccuu

SEQ ID NO: 832888 - RNA, 18 nt, Homo sapiens
uuugaagguagaauguuu

SEQ ID NO: 832889 - RNA, 18 nt, Homo sapiens
uuugaauuggacaauaau

SEQ ID NO: 832890 - RNA, 22 nt, Homo sapiens
uuugcaucagcaacaaccagca

SEQ ID NO: 832891 - RNA, 19 nt, Homo sapiens
uuugccaagucucccaaua

SEQ ID NO: 832892 - RNA, 21 nt, Homo sapiens
uuugcuaaaugugaaugauga

SEQ ID NO: 832893 - RNA, 16 nt, Homo sapiens
uuuggaaguguuaacu

SEQ ID NO: 832894 - RNA, 17 nt, Homo sapiens
uuuggccccacuuugaa

SEQ ID NO: 832895 - RNA, 14 nt, Homo sapiens
uuugugaugcauuu

SEQ ID NO: 832896 - RNA, 17 nt, Homo sapiens
uuugugggaaauccaca

SEQ ID NO: 832897 - RNA, 21 nt, Homo sapiens
uuuuaaaaaaaucccauuuaa

SEQ ID NO: 832898 - RNA, 22 nt, Homo sapiens
uuuuacauacauugauucaugu

SEQ ID NO: 832899 - RNA, 19 nt, Homo sapiens
uuuuagacccuauugcugc

SEQ ID NO: 832900 - RNA, 19 nt, Homo sapiens
uuuuccagcuccucaucca

SEQ ID NO: 832901 - RNA, 18 nt, Homo sapiens
uuuuuaaaaaacugcuga

SEQ ID NO: 832902 - RNA, 21 nt, Homo sapiens
uuuuugacauuuacuguggau

SEQ ID NO: 832903 - RNA, 21 nt, Homo sapiens
uuuuuggaaggggacacguga

SEQ ID NO: 832904 - RNA, 15 nt, Homo sapiens
uggaaucuagccgau

SEQ ID NO: 832905 - RNA, 13 nt, Homo sapiens
uggaaucuuguaa

SEQ ID NO: 832906 - RNA, 20 nt, Homo sapiens
uggaaugggcagcucaucuc

SEQ ID NO: 832907 - RNA, 24 nt, Homo sapiens
uggacaauaaucucacuaccuuau

SEQ ID NO: 832908 - RNA, 17 nt, Homo sapiens
uggacagaagcagcucu

SEQ ID NO: 832909 - RNA, 23 nt, Homo sapiens
uggaccauaaccccggaagccaa

SEQ ID NO: 832910 - RNA, 19 nt, Homo sapiens
uggacccugaggcccagag

SEQ ID NO: 832911 - RNA, 12 nt, Homo sapiens
uggacggaacca

SEQ ID NO: 832912 - RNA, 11 nt, Homo sapiens
uggacucagcc

SEQ ID NO: 832913 - RNA, 20 nt, Homo sapiens
uggacuccugcacacgcucc

SEQ ID NO: 832914 - RNA, 15 nt, Homo sapiens
uggacuggaugcaug

SEQ ID NO: 832915 - RNA, 22 nt, Homo sapiens
uggacuuuuauuuccagugaaa

SEQ ID NO: 832916 - RNA, 19 nt, Homo sapiens
uggagaggcccggccucuc

SEQ ID NO: 832917 - RNA, 13 nt, Homo sapiens
uggagauagggaa

SEQ ID NO: 832918 - RNA, 17 nt, Homo sapiens
uggagaucccacauauu

SEQ ID NO: 832919 - RNA, 19 nt, Homo sapiens
uggagcccauccagucucc

SEQ ID NO: 832920 - RNA, 19 nt, Homo sapiens
uggagcuugaaauaguguc

SEQ ID NO: 832921 - RNA, 18 nt, Homo sapiens
uggaucucacaagcacuu

SEQ ID NO: 832922 - RNA, 19 nt, Homo sapiens
uggaugcagaaacaguuca

SEQ ID NO: 832923 - RNA, 19 nt, Homo sapiens
uggcaaagaugaucaguau

SEQ ID NO: 832924 - RNA, 15 nt, Homo sapiens
uggcacugccaugca

SEQ ID NO: 832925 - RNA, 20 nt, Homo sapiens
uggcagcgccucaucuucaa

SEQ ID NO: 832926 - RNA, 13 nt, Homo sapiens
uggcagcucagag

SEQ ID NO: 832927 - RNA, 21 nt, Homo sapiens
uggccaagaucacaguggcca

SEQ ID NO: 832928 - RNA, 13 nt, Homo sapiens
uggccaaugagau

SEQ ID NO: 832929 - RNA, 18 nt, Homo sapiens
uggccacggccacagcca

SEQ ID NO: 832930 - RNA, 13 nt, Homo sapiens
uggcccacgcacu

SEQ ID NO: 832931 - RNA, 12 nt, Homo sapiens
uggccuuucaua

SEQ ID NO: 832932 - RNA, 14 nt, Homo sapiens
uggcuacaucucca

SEQ ID NO: 832933 - RNA, 12 nt, Homo sapiens
uggcuccaaacc

SEQ ID NO: 832934 - RNA, 15 nt, Homo sapiens
uggcuccaacacugc

SEQ ID NO: 832935 - RNA, 20 nt, Homo sapiens
uggcuccaacacugcugcuc

SEQ ID NO: 832936 - RNA, 19 nt, Homo sapiens
uggcugauuaucaccaucc

SEQ ID NO: 832937 - RNA, 14 nt, Homo sapiens
ugggaaaaccagac

SEQ ID NO: 832938 - RNA, 14 nt, Homo sapiens
ugggacauugccuu

SEQ ID NO: 832939 - RNA, 16 nt, Homo sapiens
ugggcaaacaggcagu

SEQ ID NO: 832940 - RNA, 14 nt, Homo sapiens
ugggcaaugugaua

SEQ ID NO: 832941 - RNA, 21 nt, Homo sapiens
ugggcagagcagagaccaucc

SEQ ID NO: 832942 - RNA, 19 nt, Homo sapiens
ugggcccccaaauggaaau

SEQ ID NO: 832943 - RNA, 15 nt, Homo sapiens
ugggggaaagcacag

SEQ ID NO: 832944 - RNA, 20 nt, Homo sapiens
ugggugaauaauacaguauc

SEQ ID NO: 832945 - RNA, 20 nt, Homo sapiens
ugguccauagagagcaagac

SEQ ID NO: 832946 - RNA, 14 nt, Homo sapiens
uggucuacacugug

SEQ ID NO: 832947 - RNA, 12 nt, Homo sapiens
ugguggcagcuc

SEQ ID NO: 832948 - RNA, 20 nt, Homo sapiens
ugguucugaugaugugccug

SEQ ID NO: 832949 - RNA, 22 nt, Homo sapiens
ugguuuuuaaaaaacugcugac

SEQ ID NO: 832950 - RNA, 21 nt, Homo sapiens
uguaaacuaguuacuaaacau

SEQ ID NO: 832951 - RNA, 17 nt, Homo sapiens
uguacugagacauuaca

SEQ ID NO: 832952 - RNA, 18 nt, Homo sapiens
uguauuaaagacagaggc

SEQ ID NO: 832953 - RNA, 16 nt, Homo sapiens
uguauuucaacuuguc

SEQ ID NO: 832954 - RNA, 20 nt, Homo sapiens
ugucacauagagugaucuuu

SEQ ID NO: 832955 - RNA, 22 nt, Homo sapiens
ugucagaugcugugcaaauguu

SEQ ID NO: 832956 - RNA, 23 nt, Homo sapiens
ugucauuuuuauaaaacuuugaa

SEQ ID NO: 832957 - RNA, 18 nt, Homo sapiens
ugucccauuagcaaaaau

SEQ ID NO: 832958 - RNA, 19 nt, Homo sapiens
uguccggucccugucccag

SEQ ID NO: 832959 - RNA, 17 nt, Homo sapiens
uguccucccuuguggcu

SEQ ID NO: 832960 - RNA, 18 nt, Homo sapiens
ugucuauuaucacauuaa

SEQ ID NO: 832961 - RNA, 19 nt, Homo sapiens
ugucuggauucccaggaug

SEQ ID NO: 832962 - RNA, 19 nt, Homo sapiens
ugugaaauaccaaccugaa

SEQ ID NO: 832963 - RNA, 22 nt, Homo sapiens
ugugacaauggcaacaauuuga

SEQ ID NO: 832964 - RNA, 19 nt, Homo sapiens
ugugacuccucaggguuga

SEQ ID NO: 832965 - RNA, 16 nt, Homo sapiens
ugugcaucuguacuca

SEQ ID NO: 832966 - RNA, 13 nt, Homo sapiens
ugugcccucagau

SEQ ID NO: 832967 - RNA, 13 nt, Homo sapiens
ugugcccugacca

SEQ ID NO: 832968 - RNA, 11 nt, Homo sapiens
ugugcugugac

SEQ ID NO: 832969 - RNA, 15 nt, Homo sapiens
ugugggaaauccaca

SEQ ID NO: 832970 - RNA, 14 nt, Homo sapiens
uguguuggguugaa

SEQ ID NO: 832971 - RNA, 20 nt, Homo sapiens
uguuaacuauuuauucccug

SEQ ID NO: 832972 - RNA, 19 nt, Homo sapiens
uguuaacugagugccuuuu

SEQ ID NO: 832973 - RNA, 19 nt, Homo sapiens
uguuaugucaaacugucuu

SEQ ID NO: 832974 - RNA, 15 nt, Homo sapiens
uguuccccaucaucu

SEQ ID NO: 832975 - RNA, 12 nt, Homo sapiens
uguuugucucac

SEQ ID NO: 832976 - RNA, 19 nt, Homo sapiens
uuaaaaaagauaaacacaa

SEQ ID NO: 832977 - RNA, 21 nt, Homo sapiens
uuaaaaaagauaaacacaaga

SEQ ID NO: 832978 - RNA, 19 nt, Homo sapiens
uuaaagcuugcucacaucu

SEQ ID NO: 832979 - RNA, 15 nt, Homo sapiens
uuaaauguuucucaa

SEQ ID NO: 832980 - RNA, 18 nt, Homo sapiens
uuaacaaauugcauuugu

SEQ ID NO: 832981 - RNA, 11 nt, Homo sapiens
uuaaccaccua

SEQ ID NO: 832982 - RNA, 17 nt, Homo sapiens
uuaagcucugcuauuag

SEQ ID NO: 832983 - RNA, 20 nt, Homo sapiens
uuaaggauuuuaugcuuuaa

SEQ ID NO: 832984 - RNA, 22 nt, Homo sapiens
uuaauauuuauaggucacuuug

SEQ ID NO: 832985 - RNA, 20 nt, Homo sapiens
uuaauuuauugaggcuuuaa

SEQ ID NO: 832986 - RNA, 20 nt, Homo sapiens
uuacaaugcauucugaggua

SEQ ID NO: 832987 - RNA, 20 nt, Homo sapiens
uuacagcuggguggcacugc

SEQ ID NO: 832988 - RNA, 15 nt, Homo sapiens
uuaccuaccacaugc

SEQ ID NO: 832989 - RNA, 19 nt, Homo sapiens
uuagaaaaaccaccaccau

SEQ ID NO: 832990 - RNA, 20 nt, Homo sapiens
uuagaggaucccucucugga

SEQ ID NO: 832991 - RNA, 17 nt, Homo sapiens
uuagggaaaacauucca

SEQ ID NO: 832992 - RNA, 16 nt, Homo sapiens
uuaguaugugcauuua

SEQ ID NO: 832993 - RNA, 16 nt, Homo sapiens
uuauaguaaugugacu

SEQ ID NO: 832994 - RNA, 12 nt, Homo sapiens
uuauaugauuca

SEQ ID NO: 832995 - RNA, 14 nt, Homo sapiens
uuauauucauucuu

SEQ ID NO: 832996 - RNA, 12 nt, Homo sapiens
uuaucaguccaa

SEQ ID NO: 832997 - RNA, 17 nt, Homo sapiens
uuaucaugcauguuaug

SEQ ID NO: 832998 - RNA, 13 nt, Homo sapiens
uuaucucaggggu

SEQ ID NO: 832999 - RNA, 23 nt, Homo sapiens
uuaucugucccagguuaucuggg

SEQ ID NO: 833000 - RNA, 14 nt, Homo sapiens
uuaugcuuccacag

SEQ ID NO: 833001 - RNA, 18 nt, Homo sapiens
uuauucaaaaugauguau

SEQ ID NO: 833002 - RNA, 17 nt, Homo sapiens
uuauuuaucaaguguau

SEQ ID NO: 833003 - RNA, 20 nt, Homo sapiens
uuauuuccagugaaaucagu

SEQ ID NO: 833004 - RNA, 15 nt, Homo sapiens
uucaaauguucucca

SEQ ID NO: 833005 - RNA, 19 nt, Homo sapiens
uucaccuaagucucuguga

SEQ ID NO: 833006 - RNA, 21 nt, Homo sapiens
uucagaaucacuucugagaac

SEQ ID NO: 833007 - RNA, 21 nt, Homo sapiens
uucagagacuccugcaggcag

SEQ ID NO: 833008 - RNA, 19 nt, Homo sapiens
uucagauuccccacucagc

SEQ ID NO: 833009 - RNA, 15 nt, Homo sapiens
uucagcugguugagg

SEQ ID NO: 833010 - RNA, 22 nt, Homo sapiens
uucaggaagcagcuuuccccau

SEQ ID NO: 833011 - RNA, 14 nt, Homo sapiens
uucauaacaucgaa

SEQ ID NO: 833012 - RNA, 18 nt, Homo sapiens
uucauacauuaucucacu

SEQ ID NO: 833013 - RNA, 17 nt, Homo sapiens
uucauaccuacauguau

SEQ ID NO: 833014 - RNA, 21 nt, Homo sapiens
uucauucaggcaacgcacaaa

SEQ ID NO: 833015 - RNA, 19 nt, Homo sapiens
uucccaaaagcccauucau

SEQ ID NO: 833016 - RNA, 20 nt, Homo sapiens
uucccaggacuagagcacaa

SEQ ID NO: 833017 - RNA, 14 nt, Homo sapiens
uuccccaagacauu

SEQ ID NO: 833018 - RNA, 16 nt, Homo sapiens
uuccccaagacauucu

SEQ ID NO: 833019 - RNA, 13 nt, Homo sapiens
uuccucaugugau

SEQ ID NO: 833020 - RNA, 18 nt, Homo sapiens
uuccucuuuccaucuacc

SEQ ID NO: 833021 - RNA, 20 nt, Homo sapiens
uucgcaggauucuuccuccc

SEQ ID NO: 833022 - RNA, 14 nt, Homo sapiens
uucuacccaggugc

SEQ ID NO: 833023 - RNA, 23 nt, Homo sapiens
uucuacccuccaugugagaauau

SEQ ID NO: 833024 - RNA, 12 nt, Homo sapiens
uucucucuuguc

SEQ ID NO: 833025 - RNA, 23 nt, Homo sapiens
uucugacccaugcugcccuguga

SEQ ID NO: 833026 - RNA, 11 nt, Homo sapiens
uucugagauca

SEQ ID NO: 833027 - RNA, 22 nt, Homo sapiens
cagagauggaugcauguucuga

SEQ ID NO: 833028 - RNA, 13 nt, Homo sapiens
cagagcaagugag

SEQ ID NO: 833029 - RNA, 22 nt, Homo sapiens
cagagcuuggacuggaugcaug

SEQ ID NO: 833030 - RNA, 22 nt, Homo sapiens
cagagguuugcuuccucaguaa

SEQ ID NO: 833031 - RNA, 21 nt, Homo sapiens
cagaguauuggucuccucuca

SEQ ID NO: 833032 - RNA, 17 nt, Homo sapiens
cagaguuccccaugcag

SEQ ID NO: 833033 - RNA, 12 nt, Homo sapiens
cagauacuuggg

SEQ ID NO: 833034 - RNA, 14 nt, Homo sapiens
cagauauauagaag

SEQ ID NO: 833035 - RNA, 15 nt, Homo sapiens
cagaugcugugcaaa

SEQ ID NO: 833036 - RNA, 21 nt, Homo sapiens
cagaugcugugcaaauguuau

SEQ ID NO: 833037 - RNA, 17 nt, Homo sapiens
cagauuccccacucagc

SEQ ID NO: 833038 - RNA, 18 nt, Homo sapiens
cagauuccgcaccaauaa

SEQ ID NO: 833039 - RNA, 19 nt, Homo sapiens
cagauuccuggcagagcca

SEQ ID NO: 833040 - RNA, 17 nt, Homo sapiens
cagauuugggcuggaac

SEQ ID NO: 833041 - RNA, 21 nt, Homo sapiens
cagcacugccugcucccaucc

SEQ ID NO: 833042 - RNA, 22 nt, Homo sapiens
cagcaguggacucaaaacccau

SEQ ID NO: 833043 - RNA, 15 nt, Homo sapiens
cagccucacaguccu

SEQ ID NO: 833044 - RNA, 22 nt, Homo sapiens
cagccucugaaaaccaauguuc

SEQ ID NO: 833045 - RNA, 15 nt, Homo sapiens
cagcgugaagggauu

SEQ ID NO: 833046 - RNA, 16 nt, Homo sapiens
cagcuaacaauuguga

SEQ ID NO: 833047 - RNA, 20 nt, Homo sapiens
cagcuaacacacagcuccca

SEQ ID NO: 833048 - RNA, 14 nt, Homo sapiens
cagcucauuucacu

SEQ ID NO: 833049 - RNA, 20 nt, Homo sapiens
cagcucauuucacuuuacac

SEQ ID NO: 833050 - RNA, 21 nt, Homo sapiens
cagcucauuucacuuuacacg

SEQ ID NO: 833051 - RNA, 19 nt, Homo sapiens
cagcuccccagaguccucu

SEQ ID NO: 833052 - RNA, 15 nt, Homo sapiens
cagcucugcaagaau

SEQ ID NO: 833053 - RNA, 13 nt, Homo sapiens
cagcuuaucucag

SEQ ID NO: 833054 - RNA, 22 nt, Homo sapiens
cagcuuaucucaggggugugcg

SEQ ID NO: 833055 - RNA, 14 nt, Homo sapiens
cagcuucuacggug

SEQ ID NO: 833056 - RNA, 23 nt, Homo sapiens
cagcuuguaaugguucuuuacac

SEQ ID NO: 833057 - RNA, 14 nt, Homo sapiens
caggaagcagcuuu

SEQ ID NO: 833058 - RNA, 19 nt, Homo sapiens
caggagaccuggcacugga

SEQ ID NO: 833059 - RNA, 15 nt, Homo sapiens
caggaggauggcaaa

SEQ ID NO: 833060 - RNA, 19 nt, Homo sapiens
caggauagagugggacagu

SEQ ID NO: 833061 - RNA, 16 nt, Homo sapiens
caggauguacaaggac

SEQ ID NO: 833062 - RNA, 16 nt, Homo sapiens
caggauuuaaguuuca

SEQ ID NO: 833063 - RNA, 19 nt, Homo sapiens
caggcuacacugacacugg

SEQ ID NO: 833064 - RNA, 13 nt, Homo sapiens
cagggccaugcag

SEQ ID NO: 833065 - RNA, 19 nt, Homo sapiens
caggguugagguccagccc

SEQ ID NO: 833066 - RNA, 20 nt, Homo sapiens
cagguccccuuucagagaua

SEQ ID NO: 833067 - RNA, 21 nt, Homo sapiens
caguaacauuucuguucucau

SEQ ID NO: 833068 - RNA, 16 nt, Homo sapiens
caguaacgcaggggaa

SEQ ID NO: 833069 - RNA, 22 nt, Homo sapiens
caguccaaccagaaacaccccu

SEQ ID NO: 833070 - RNA, 12 nt, Homo sapiens
cagugacauuua

SEQ ID NO: 833071 - RNA, 19 nt, Homo sapiens
cagugccacccaugcagcu

SEQ ID NO: 833072 - RNA, 18 nt, Homo sapiens
cagugucuggcacuuggg

SEQ ID NO: 833073 - RNA, 15 nt, Homo sapiens
cagugugacuccuca

SEQ ID NO: 833074 - RNA, 13 nt, Homo sapiens
caguuaagccuuu

SEQ ID NO: 833075 - RNA, 14 nt, Homo sapiens
caguuagcucucaa

SEQ ID NO: 833076 - RNA, 16 nt, Homo sapiens
caguucaccuugaaga

SEQ ID NO: 833077 - RNA, 23 nt, Homo sapiens
caguuccauuucauuugugccag

SEQ ID NO: 833078 - RNA, 18 nt, Homo sapiens
caguuccugagaccagcc

SEQ ID NO: 833079 - RNA, 16 nt, Homo sapiens
caguuugucacaugaa

SEQ ID NO: 833080 - RNA, 21 nt, Homo sapiens
cauaauuuuuauuuuuggcaa

SEQ ID NO: 833081 - RNA, 15 nt, Homo sapiens
cauacacagaaacca

SEQ ID NO: 833082 - RNA, 14 nt, Homo sapiens
cauacauuaucuca

SEQ ID NO: 833083 - RNA, 13 nt, Homo sapiens
cauacucaccuca

SEQ ID NO: 833084 - RNA, 17 nt, Homo sapiens
cauagagugaucuuucc

SEQ ID NO: 833085 - RNA, 23 nt, Homo sapiens
cauaggcccagugagaugcauuc

SEQ ID NO: 833086 - RNA, 21 nt, Homo sapiens
cauauucaggaagcucagggc

SEQ ID NO: 833087 - RNA, 19 nt, Homo sapiens
cauauuuuauuauagucac

SEQ ID NO: 833088 - RNA, 24 nt, Homo sapiens
caucaaauggaagacacauugaaa

SEQ ID NO: 833089 - RNA, 17 nt, Homo sapiens
auucaggcaacgcacaa

SEQ ID NO: 833090 - RNA, 16 nt, Homo sapiens
auucaucucaaggaau

SEQ ID NO: 833091 - RNA, 22 nt, Homo sapiens
auuccauucuggaagugacuuu

SEQ ID NO: 833092 - RNA, 19 nt, Homo sapiens
auucuagguuugcaagaaa

SEQ ID NO: 833093 - RNA, 19 nt, Homo sapiens
auucuuuuugaaaugucaa

SEQ ID NO: 833094 - RNA, 16 nt, Homo sapiens
auuggaacucuacuca

SEQ ID NO: 833095 - RNA, 14 nt, Homo sapiens
auuggaagagcaca

SEQ ID NO: 833096 - RNA, 20 nt, Homo sapiens
auugucagaugcugugcaaa

SEQ ID NO: 833097 - RNA, 13 nt, Homo sapiens
auuuaagauaugu

SEQ ID NO: 833098 - RNA, 14 nt, Homo sapiens
auuuaaguuucaca

SEQ ID NO: 833099 - RNA, 17 nt, Homo sapiens
auuuauaaucacuuuuu

SEQ ID NO: 833100 - RNA, 17 nt, Homo sapiens
auuuccagccagggcug

SEQ ID NO: 833101 - RNA, 21 nt, Homo sapiens
auuuccucaugugaucacaau

SEQ ID NO: 833102 - RNA, 21 nt, Homo sapiens
auuucugaccuuguaccucuc

SEQ ID NO: 833103 - RNA, 23 nt, Homo sapiens
auuucugaccuuguaccucucuu

SEQ ID NO: 833104 - RNA, 22 nt, Homo sapiens
auuucugaggagccugcaacau

SEQ ID NO: 833105 - RNA, 17 nt, Homo sapiens
auuucuucuacaacuca

SEQ ID NO: 833106 - RNA, 11 nt, Homo sapiens
auuugagacag

SEQ ID NO: 833107 - RNA, 14 nt, Homo sapiens
auuugagacaggga

SEQ ID NO: 833108 - RNA, 23 nt, Homo sapiens
auuuguucauuaaacgucauuca

SEQ ID NO: 833109 - RNA, 21 nt, Homo sapiens
auuuuguuuuugucuuaaaaa

SEQ ID NO: 833110 - RNA, 14 nt, Homo sapiens
auuuuugaaaccaa

SEQ ID NO: 833111 - RNA, 16 nt, Homo sapiens
caaaaaaagaaaaaga

SEQ ID NO: 833112 - RNA, 19 nt, Homo sapiens
caaaaacaugcuuuuccaa

SEQ ID NO: 833113 - RNA, 21 nt, Homo sapiens
caaaagcccauucauuccauu

SEQ ID NO: 833114 - RNA, 22 nt, Homo sapiens
caaaagcccauucauuccauuc

SEQ ID NO: 833115 - RNA, 20 nt, Homo sapiens
caaacaauaguaauucucag

SEQ ID NO: 833116 - RNA, 14 nt, Homo sapiens
caaacaccuggacu

SEQ ID NO: 833117 - RNA, 20 nt, Homo sapiens
caaacacugcaggcaucaca

SEQ ID NO: 833118 - RNA, 16 nt, Homo sapiens
caaacuacaaagcuga

SEQ ID NO: 833119 - RNA, 20 nt, Homo sapiens
caaagggcaugggucgggag

SEQ ID NO: 833120 - RNA, 22 nt, Homo sapiens
caaagucaucccucuguucaca

SEQ ID NO: 833121 - RNA, 11 nt, Homo sapiens
caaagugugac

SEQ ID NO: 833122 - RNA, 17 nt, Homo sapiens
caaauagccagugcuag

SEQ ID NO: 833123 - RNA, 13 nt, Homo sapiens
caaaucaaagcag

SEQ ID NO: 833124 - RNA, 14 nt, Homo sapiens
caaaugcagcuuua

SEQ ID NO: 833125 - RNA, 20 nt, Homo sapiens
caaauggaagacacauugaa

SEQ ID NO: 833126 - RNA, 20 nt, Homo sapiens
caaaugucuuccuggauuau

SEQ ID NO: 833127 - RNA, 13 nt, Homo sapiens
caaauguuauuau

SEQ ID NO: 833128 - RNA, 11 nt, Homo sapiens
caaauguucuc

SEQ ID NO: 833129 - RNA, 22 nt, Homo sapiens
caacaagcaagcucccaaggga

SEQ ID NO: 833130 - RNA, 14 nt, Homo sapiens
cucuacaaaaagca

SEQ ID NO: 833131 - RNA, 22 nt, Homo sapiens
cucuacccucuuagaaaaacca

SEQ ID NO: 833132 - RNA, 14 nt, Homo sapiens
cucuacucuaggga

SEQ ID NO: 833133 - RNA, 13 nt, Homo sapiens
cucugaaaaccaa

SEQ ID NO: 833134 - RNA, 22 nt, Homo sapiens
cucugacaacagacuucugaaa

SEQ ID NO: 833135 - RNA, 16 nt, Homo sapiens
cucugaggcugaaauu

SEQ ID NO: 833136 - RNA, 15 nt, Homo sapiens
cucugagugcuagcu

SEQ ID NO: 833137 - RNA, 15 nt, Homo sapiens
cucugaucaaguauu

SEQ ID NO: 833138 - RNA, 15 nt, Homo sapiens
cucuggucuauauaa

SEQ ID NO: 833139 - RNA, 20 nt, Homo sapiens
cucuuaccagggagauuugc

SEQ ID NO: 833140 - RNA, 21 nt, Homo sapiens
cucuuaccagggagauuugcu

SEQ ID NO: 833141 - RNA, 23 nt, Homo sapiens
cucuuaccagggagauuugcuca

SEQ ID NO: 833142 - RNA, 19 nt, Homo sapiens
cucuucaguuaagccuuug

SEQ ID NO: 833143 - RNA, 23 nt, Homo sapiens
cucuucuccaccucccacaaagg

SEQ ID NO: 833144 - RNA, 21 nt, Homo sapiens
cucuugagccugggaggucaa

SEQ ID NO: 833145 - RNA, 13 nt, Homo sapiens
cucuuggugccuc

SEQ ID NO: 833146 - RNA, 20 nt, Homo sapiens
cucuuguccuucacaucacc

SEQ ID NO: 833147 - RNA, 14 nt, Homo sapiens
cugaacucugacaa

SEQ ID NO: 833148 - RNA, 21 nt, Homo sapiens
cugaagaaaaugaagcccuau

SEQ ID NO: 833149 - RNA, 15 nt, Homo sapiens
cugaaggacugugac

SEQ ID NO: 833150 - RNA, 16 nt, Homo sapiens
cugaaggacugugaca

SEQ ID NO: 833151 - RNA, 19 nt, Homo sapiens
cugaaggcugaaagacagg

SEQ ID NO: 833152 - RNA, 17 nt, Homo sapiens
cugaauuaugcuuccac

SEQ ID NO: 833153 - RNA, 16 nt, Homo sapiens
cugagaacacugugaa

SEQ ID NO: 833154 - RNA, 17 nt, Homo sapiens
cugaggcccagugcaua

SEQ ID NO: 833155 - RNA, 21 nt, Homo sapiens
cugaggcccagugcauaugca

SEQ ID NO: 833156 - RNA, 16 nt, Homo sapiens
cugaggcugaaauuca

SEQ ID NO: 833157 - RNA, 20 nt, Homo sapiens
cugagugccuggccaaaggg

SEQ ID NO: 833158 - RNA, 21 nt, Homo sapiens
cugauaugucuagggugugau

SEQ ID NO: 833159 - RNA, 14 nt, Homo sapiens
cugauccugugaag

SEQ ID NO: 833160 - RNA, 14 nt, Homo sapiens
cugaugcagucacg

SEQ ID NO: 833161 - RNA, 18 nt, Homo sapiens
cugauguccucaccacau

SEQ ID NO: 833162 - RNA, 19 nt, Homo sapiens
cugcacaaacucaccaucu

SEQ ID NO: 833163 - RNA, 15 nt, Homo sapiens
cugcacacaggacag

SEQ ID NO: 833164 - RNA, 21 nt, Homo sapiens
cugcacacuguccuauuauau

SEQ ID NO: 833165 - RNA, 15 nt, Homo sapiens
cugcagccaagcaaa

SEQ ID NO: 833166 - RNA, 21 nt, Homo sapiens
cugcagcuuuguuuguuguca

SEQ ID NO: 833167 - RNA, 21 nt, Homo sapiens
aucaguuagagcugacacaaa

SEQ ID NO: 833168 - RNA, 17 nt, Homo sapiens
aucaucaguggagccau

SEQ ID NO: 833169 - RNA, 14 nt, Homo sapiens
aucccucuguucac

SEQ ID NO: 833170 - RNA, 15 nt, Homo sapiens
auccgggaucaaagu

SEQ ID NO: 833171 - RNA, 14 nt, Homo sapiens
auccuagcacuuug

SEQ ID NO: 833172 - RNA, 14 nt, Homo sapiens
auccuaggcauuug

SEQ ID NO: 833173 - RNA, 15 nt, Homo sapiens
auccuaggcauuugc

SEQ ID NO: 833174 - RNA, 21 nt, Homo sapiens
auccuggcucuuuggagauca

SEQ ID NO: 833175 - RNA, 15 nt, Homo sapiens
aucuacauacacagu

SEQ ID NO: 833176 - RNA, 23 nt, Homo sapiens
aucuacauacacaguggccaagc

SEQ ID NO: 833177 - RNA, 14 nt, Homo sapiens
aucuaccaacgaaa

SEQ ID NO: 833178 - RNA, 16 nt, Homo sapiens
aucuaggaagacuuug

SEQ ID NO: 833179 - RNA, 15 nt, Homo sapiens
aucucacaagcacuu

SEQ ID NO: 833180 - RNA, 17 nt, Homo sapiens
aucucauuuaauccucu

SEQ ID NO: 833181 - RNA, 17 nt, Homo sapiens
aucucuggaugccugau

SEQ ID NO: 833182 - RNA, 17 nt, Homo sapiens
aucugacaucucugcaa

SEQ ID NO: 833183 - RNA, 16 nt, Homo sapiens
aucugagcuaacuuau

SEQ ID NO: 833184 - RNA, 14 nt, Homo sapiens
aucuggaaccauca

SEQ ID NO: 833185 - RNA, 14 nt, Homo sapiens
aucuuuggacagaa

SEQ ID NO: 833186 - RNA, 23 nt, Homo sapiens
augaaccugcccugcucccacag

SEQ ID NO: 833187 - RNA, 20 nt, Homo sapiens
augaacuauggacggugcuc

SEQ ID NO: 833188 - RNA, 21 nt, Homo sapiens
augaagguggaacaagcacag

SEQ ID NO: 833189 - RNA, 22 nt, Homo sapiens
augacgguaaguguucucauga

SEQ ID NO: 833190 - RNA, 16 nt, Homo sapiens
augagcgccaccucuu

SEQ ID NO: 833191 - RNA, 13 nt, Homo sapiens
augaggaaacuuu

SEQ ID NO: 833192 - RNA, 19 nt, Homo sapiens
augaugugugaaaacuggu

SEQ ID NO: 833193 - RNA, 20 nt, Homo sapiens
augcauguuuuccagcuccu

SEQ ID NO: 833194 - RNA, 16 nt, Homo sapiens
augccaagcacugugc

SEQ ID NO: 833195 - RNA, 17 nt, Homo sapiens
augccagcuuaucucag

SEQ ID NO: 833196 - RNA, 16 nt, Homo sapiens
augcugacccaugcaa

SEQ ID NO: 833197 - RNA, 18 nt, Homo sapiens
augcugacccaugcaaua

SEQ ID NO: 833198 - RNA, 15 nt, Homo sapiens
auggaagugucugga

SEQ ID NO: 833199 - RNA, 19 nt, Homo sapiens
auggcauuuggucucaggc

SEQ ID NO: 833200 - RNA, 15 nt, Homo sapiens
augggcagcucaucu

SEQ ID NO: 833201 - RNA, 15 nt, Homo sapiens
auggucagaauuucc

SEQ ID NO: 833202 - RNA, 20 nt, Homo sapiens
auggucccaggcuucccaaa

SEQ ID NO: 833203 - RNA, 17 nt, Homo sapiens
auguaagcauaacuuau

SEQ ID NO: 833204 - RNA, 17 nt, Homo sapiens
auguaauuauauauacu

SEQ ID NO: 833205 - RNA, 18 nt, Homo sapiens
auguaguuuugugaugca

SEQ ID NO: 833206 - RNA, 21 nt, Homo sapiens
auguaguuuugugaugcauuu

SEQ ID NO: 833207 - RNA, 19 nt, Homo sapiens
augucaaacugucuuggcu

SEQ ID NO: 833208 - RNA, 19 nt, Homo sapiens
augucauuguucuugugaa

SEQ ID NO: 833209 - RNA, 14 nt, Homo sapiens
augugaugaucuac

SEQ ID NO: 833210 - RNA, 21 nt, Homo sapiens
augugcuuguuaacugagugc

SEQ ID NO: 833211 - RNA, 13 nt, Homo sapiens
auguugaagccuu

SEQ ID NO: 833212 - RNA, 20 nt, Homo sapiens
auguuuuucuucucccucag

SEQ ID NO: 833213 - RNA, 14 nt, Homo sapiens
auuaaagacagagg

SEQ ID NO: 833214 - RNA, 23 nt, Homo sapiens
auuagccaagugugguagagugu

SEQ ID NO: 833215 - RNA, 19 nt, Homo sapiens
auuaucacauuaaucucaa

SEQ ID NO: 833216 - RNA, 14 nt, Homo sapiens
auucaaaaugaugu

SEQ ID NO: 833217 - RNA, 20 nt, Homo sapiens
auucacccccaaacagugac

SEQ ID NO: 833218 - RNA, 17 nt, Homo sapiens
auucagcucugcaagaa

SEQ ID NO: 833219 - RNA, 13 nt, Homo sapiens
auucauacauuau

SEQ ID NO: 833220 - RNA, 23 nt, Homo sapiens
auucccuucaucuggaaccauca

SEQ ID NO: 833221 - RNA, 16 nt, Homo sapiens
auuccugaugaccaau

SEQ ID NO: 833222 - RNA, 17 nt, Homo sapiens
auucgcugugucagcau

SEQ ID NO: 833223 - RNA, 18 nt, Homo sapiens
auucucaggccaucauca

SEQ ID NO: 833224 - RNA, 22 nt, Homo sapiens
auucuccaccugccagggacag

SEQ ID NO: 833225 - RNA, 21 nt, Homo sapiens
auucugagguaaccucauuau

SEQ ID NO: 833226 - RNA, 23 nt, Homo sapiens
auucugagguaaccucauuauca

SEQ ID NO: 833227 - RNA, 13 nt, Homo sapiens
auugaagaugaac

SEQ ID NO: 833228 - RNA, 20 nt, Homo sapiens
auugagcaccugcaggcgug

SEQ ID NO: 833229 - RNA, 19 nt, Homo sapiens
auugaggcuuuaaaacuua

SEQ ID NO: 833230 - RNA, 19 nt, Homo sapiens
auugagggagcugggagac

SEQ ID NO: 833231 - RNA, 15 nt, Homo sapiens
auuggucuccucuca

SEQ ID NO: 833232 - RNA, 21 nt, Homo sapiens
auugucagaugcugugcaaau

SEQ ID NO: 833233 - RNA, 18 nt, Homo sapiens
auuuaaccuacuagacaa

SEQ ID NO: 833234 - RNA, 22 nt, Homo sapiens
auuuaaggaagaaucuucugcc

SEQ ID NO: 833235 - RNA, 16 nt, Homo sapiens
auuuagggaaagguag

SEQ ID NO: 833236 - RNA, 15 nt, Homo sapiens
auuuaucaucacaaa

SEQ ID NO: 833237 - RNA, 14 nt, Homo sapiens
auuuauuuauucau

SEQ ID NO: 833238 - RNA, 13 nt, Homo sapiens
auuucacagugug

SEQ ID NO: 833239 - RNA, 17 nt, Homo sapiens
auuucacccaucucuca

SEQ ID NO: 833240 - RNA, 13 nt, Homo sapiens
auuucauaugaca

SEQ ID NO: 833241 - RNA, 14 nt, Homo sapiens
auuugaagauuuaa

SEQ ID NO: 833242 - RNA, 18 nt, Homo sapiens
auuugagauguauuucaa

SEQ ID NO: 833243 - RNA, 16 nt, Homo sapiens
auuugcugaauacaga

SEQ ID NO: 833244 - RNA, 14 nt, Homo sapiens
auuugcuucacuca

SEQ ID NO: 833245 - RNA, 17 nt, Homo sapiens
auuuuaaggcauauuua

SEQ ID NO: 833246 - RNA, 19 nt, Homo sapiens
auuuuaaguaucagagguc

SEQ ID NO: 833247 - RNA, 13 nt, Homo sapiens
auuuuagucacac

SEQ ID NO: 833248 - RNA, 15 nt, Homo sapiens
auuuuaugcuuuaaa

SEQ ID NO: 833249 - RNA, 19 nt, Homo sapiens
auuuugcuaaaugugaaug

SEQ ID NO: 833250 - RNA, 17 nt, Homo sapiens
auuuugguguccuauua

SEQ ID NO: 833251 - RNA, 17 nt, Homo sapiens
auuuuuuuucuguuaua

SEQ ID NO: 833252 - RNA, 20 nt, Homo sapiens
auuuuuuuuuccaaaacaau

SEQ ID NO: 833253 - RNA, 20 nt, Homo sapiens
caaaaauagcucuugcuuug

SEQ ID NO: 833254 - RNA, 17 nt, Homo sapiens
caaaauauagcuuucau

SEQ ID NO: 833255 - RNA, 13 nt, Homo sapiens
caaacaggcaguu

SEQ ID NO: 833256 - RNA, 22 nt, Homo sapiens
caaacaggcaguuggccagaga

SEQ ID NO: 833257 - RNA, 11 nt, Homo sapiens
caaacagugac

SEQ ID NO: 833258 - RNA, 14 nt, Homo sapiens
caaacuacaaagcu

SEQ ID NO: 833259 - RNA, 23 nt, Homo sapiens
caaagcagggucugggcaggacu

SEQ ID NO: 833260 - RNA, 20 nt, Homo sapiens
caaaggcugagaacacugug

SEQ ID NO: 833261 - RNA, 11 nt, Homo sapiens
caaaguuggcg

SEQ ID NO: 833262 - RNA, 17 nt, Homo sapiens
caaauauuauucuuaau

SEQ ID NO: 833263 - RNA, 14 nt, Homo sapiens
caaaugcccagcuu

SEQ ID NO: 833264 - RNA, 18 nt, Homo sapiens
caaaugggaaaaccagac

SEQ ID NO: 833265 - RNA, 14 nt, Homo sapiens
caaauugcagacug

SEQ ID NO: 833266 - RNA, 16 nt, Homo sapiens
caaauugcagacugug

SEQ ID NO: 833267 - RNA, 14 nt, Homo sapiens
caaauugcauuugu

SEQ ID NO: 833268 - RNA, 22 nt, Homo sapiens
caacacugcugcuccagugcag

SEQ ID NO: 833269 - RNA, 23 nt, Homo sapiens
caacacugcugcuccagugcagg

SEQ ID NO: 833270 - RNA, 18 nt, Homo sapiens
caacaugccagccacugu

SEQ ID NO: 833271 - RNA, 14 nt, Homo sapiens
caaccugaagacac

SEQ ID NO: 833272 - RNA, 20 nt, Homo sapiens
caacugcagaaaauguccuc

SEQ ID NO: 833273 - RNA, 14 nt, Homo sapiens
caacuuuugugcuc

SEQ ID NO: 833274 - RNA, 16 nt, Homo sapiens
caagaccucugugcac

SEQ ID NO: 833275 - RNA, 20 nt, Homo sapiens
caagacgcugugcugcccug

SEQ ID NO: 833276 - RNA, 15 nt, Homo sapiens
caaggaagguggugg

SEQ ID NO: 833277 - RNA, 17 nt, Homo sapiens
caaggcuggagugcagu

SEQ ID NO: 833278 - RNA, 19 nt, Homo sapiens
caaggcugggggaagaagc

SEQ ID NO: 833279 - RNA, 21 nt, Homo sapiens
caagggaacuugagcgugaau

SEQ ID NO: 833280 - RNA, 17 nt, Homo sapiens
caaguacuguaacugug

SEQ ID NO: 833281 - RNA, 16 nt, Homo sapiens
caauaaaaaaaaaccu

SEQ ID NO: 833282 - RNA, 13 nt, Homo sapiens
caauaaagccuuc

SEQ ID NO: 833283 - RNA, 12 nt, Homo sapiens
caauacuaggaa

SEQ ID NO: 833284 - RNA, 22 nt, Homo sapiens
caauacuaggaaguaaagugaa

SEQ ID NO: 833285 - RNA, 18 nt, Homo sapiens
caauauuuccucauguga

SEQ ID NO: 833286 - RNA, 19 nt, Homo sapiens
caauccaagagucugauga

SEQ ID NO: 833287 - RNA, 19 nt, Homo sapiens
caaucccaggauguacaag

SEQ ID NO: 833288 - RNA, 19 nt, Homo sapiens
caaucuuaacucauugcaa

SEQ ID NO: 833289 - RNA, 18 nt, Homo sapiens
cugugcccucagauuccg

SEQ ID NO: 833290 - RNA, 18 nt, Homo sapiens
cuguguagacuauuugcu

SEQ ID NO: 833291 - RNA, 20 nt, Homo sapiens
cuguucaagagcacacuugg

SEQ ID NO: 833292 - RNA, 18 nt, Homo sapiens
cuguuuucugaaacacac

SEQ ID NO: 833293 - RNA, 14 nt, Homo sapiens
cuguuuugugagaa

SEQ ID NO: 833294 - RNA, 18 nt, Homo sapiens
cuuaaaauaaaguuaaac

SEQ ID NO: 833295 - RNA, 23 nt, Homo sapiens
cuuaaaggaagguucugguguga

SEQ ID NO: 833296 - RNA, 18 nt, Homo sapiens
cuuaacuuuacuaaguaa

SEQ ID NO: 833297 - RNA, 17 nt, Homo sapiens
cuuaaggcuugaaguaa

SEQ ID NO: 833298 - RNA, 23 nt, Homo sapiens
cuuaaggcuugaaguaaccuuau

SEQ ID NO: 833299 - RNA, 12 nt, Homo sapiens
cuuagaacaaag

SEQ ID NO: 833300 - RNA, 18 nt, Homo sapiens
cuuaguaugugcauuuaa

SEQ ID NO: 833301 - RNA, 20 nt, Homo sapiens
cuuaucaagcagccaaggga

SEQ ID NO: 833302 - RNA, 17 nt, Homo sapiens
cuucacccuggagccca

SEQ ID NO: 833303 - RNA, 21 nt, Homo sapiens
cuuccaaagagugcuaagcau

SEQ ID NO: 833304 - RNA, 21 nt, Homo sapiens
cuuccaacucaaacucuuaaa

SEQ ID NO: 833305 - RNA, 20 nt, Homo sapiens
cuucccuaaaaucagggaau

SEQ ID NO: 833306 - RNA, 15 nt, Homo sapiens
cuuccuggauuauuc

SEQ ID NO: 833307 - RNA, 22 nt, Homo sapiens
cuucuaggacgccacccagcaa

SEQ ID NO: 833308 - RNA, 18 nt, Homo sapiens
cuucugccccagcuuugc

SEQ ID NO: 833309 - RNA, 18 nt, Homo sapiens
cuucuggguucaagcgau

SEQ ID NO: 833310 - RNA, 21 nt, Homo sapiens
cuugagaauuacccuuuugcc

SEQ ID NO: 833311 - RNA, 23 nt, Homo sapiens
cuugccauggagguuaagcacuu

SEQ ID NO: 833312 - RNA, 20 nt, Homo sapiens
cuugcucugagugcuagcua

SEQ ID NO: 833313 - RNA, 24 nt, Homo sapiens
cuuggcacauuuaagagacaguca

SEQ ID NO: 833314 - RNA, 17 nt, Homo sapiens
cuuggcuacacagggau

SEQ ID NO: 833315 - RNA, 21 nt, Homo sapiens
cuuguaaugguucuuuacaca

SEQ ID NO: 833316 - RNA, 17 nt, Homo sapiens
cuuguagucuuggcuaa

SEQ ID NO: 833317 - RNA, 14 nt, Homo sapiens
cuugucugcuaaau

SEQ ID NO: 833318 - RNA, 24 nt, Homo sapiens
cuuguuccccaucaucuguggaac

SEQ ID NO: 833319 - RNA, 18 nt, Homo sapiens
cuuuaacacagugucugg

SEQ ID NO: 833320 - RNA, 17 nt, Homo sapiens
cuuuaauuaagcucuca

SEQ ID NO: 833321 - RNA, 18 nt, Homo sapiens
cuuuacuaaguaaucuca

SEQ ID NO: 833322 - RNA, 23 nt, Homo sapiens
cuuuaguuagugauuauauuuca

SEQ ID NO: 833323 - RNA, 18 nt, Homo sapiens
cuuuaugcuguaaauaau

SEQ ID NO: 833324 - RNA, 20 nt, Homo sapiens
cuuuaugcuguaaauaauca

SEQ ID NO: 833325 - RNA, 22 nt, Homo sapiens
cuuucccccugugaaagcaaaa

SEQ ID NO: 833326 - RNA, 23 nt, Homo sapiens
cuuucccucccuuccucuuucca

SEQ ID NO: 833327 - RNA, 14 nt, Homo sapiens
cuuuccuucauuca

SEQ ID NO: 833328 - RNA, 11 nt, Homo sapiens
cuuucuucccu

SEQ ID NO: 833329 - RNA, 20 nt, Homo sapiens
cuuucuucccuacaguugaa

SEQ ID NO: 833330 - RNA, 23 nt, Homo sapiens
cuuugaugguaaccauaauggaa

SEQ ID NO: 833331 - RNA, 19 nt, Homo sapiens
cuuugugcagauucuuuac

SEQ ID NO: 833332 - RNA, 23 nt, Homo sapiens
cuuuuaaugcuccaaaugcugac

SEQ ID NO: 833333 - RNA, 22 nt, Homo sapiens
cuuuuccaugcacccucauaca

SEQ ID NO: 833334 - RNA, 13 nt, Homo sapiens
cuuuucugaauua

SEQ ID NO: 833335 - RNA, 21 nt, Homo sapiens
cuuuucuguccgagcuuugaa

SEQ ID NO: 833336 - RNA, 16 nt, Homo sapiens
cuuuucugugucauac

SEQ ID NO: 833337 - RNA, 15 nt, Homo sapiens
cuuuuucacuuugaa

SEQ ID NO: 833338 - RNA, 22 nt, Homo sapiens
gaaaaagaucuuucauuuugca

SEQ ID NO: 833339 - RNA, 12 nt, Homo sapiens
gaaaacacuguu

SEQ ID NO: 833340 - RNA, 20 nt, Homo sapiens
gaaaaccagcucagcacugc

SEQ ID NO: 833341 - RNA, 18 nt, Homo sapiens
gaaacaccccucugucua

SEQ ID NO: 833342 - RNA, 15 nt, Homo sapiens
gaaagugaccauguu

SEQ ID NO: 833343 - RNA, 13 nt, Homo sapiens
gaaauagugucug

SEQ ID NO: 833344 - RNA, 14 nt, Homo sapiens
gaaaugauuucaca

SEQ ID NO: 833345 - RNA, 18 nt, Homo sapiens
gaacacauaauucaggaa

SEQ ID NO: 833346 - RNA, 19 nt, Homo sapiens
gaacaccauugagggagcu

SEQ ID NO: 833347 - RNA, 14 nt, Homo sapiens
gaacacuccuucac

SEQ ID NO: 833348 - RNA, 11 nt, Homo sapiens
gaacacuguga

SEQ ID NO: 833349 - RNA, 19 nt, Homo sapiens
gaacagugauaaguauacu

SEQ ID NO: 833350 - RNA, 13 nt, Homo sapiens
gaaccauuacugu

SEQ ID NO: 833351 - RNA, 15 nt, Homo sapiens
gaaccauuacuguaa

SEQ ID NO: 833352 - RNA, 14 nt, Homo sapiens
gaaccccaggagau

SEQ ID NO: 833353 - RNA, 20 nt, Homo sapiens
gaacugcuggauucaaguga

SEQ ID NO: 833354 - RNA, 19 nt, Homo sapiens
gaagaaaucuuucucccuc

SEQ ID NO: 833355 - RNA, 17 nt, Homo sapiens
gaagaaucuguuuccca

SEQ ID NO: 833356 - RNA, 23 nt, Homo sapiens
gaagagcccgcagggccaugcag

SEQ ID NO: 833357 - RNA, 23 nt, Homo sapiens
gaagagccuugcggaagguucua

SEQ ID NO: 833358 - RNA, 18 nt, Homo sapiens
gaagauauaacuauugcc

SEQ ID NO: 833359 - RNA, 20 nt, Homo sapiens
gaagauauaacuauugccca

SEQ ID NO: 833360 - RNA, 14 nt, Homo sapiens
gaagccaaagccaa

SEQ ID NO: 833361 - RNA, 15 nt, Homo sapiens
gaagcugcauaugau

SEQ ID NO: 833362 - RNA, 21 nt, Homo sapiens
gaaggccacuguuugucucac

SEQ ID NO: 833363 - RNA, 17 nt, Homo sapiens
gaagggcguucuaggua

SEQ ID NO: 833364 - RNA, 19 nt, Homo sapiens
gaagguggggacagggaug

SEQ ID NO: 833365 - RNA, 15 nt, Homo sapiens
gaauauuagugaccu

SEQ ID NO: 833366 - RNA, 20 nt, Homo sapiens
gaauuauaauuaguuccuca

SEQ ID NO: 833367 - RNA, 21 nt, Homo sapiens
gaauuuaucucuuuaguuagu

SEQ ID NO: 833368 - RNA, 18 nt, Homo sapiens
gaauuucauaugacauuc

SEQ ID NO: 833369 - RNA, 13 nt, Homo sapiens
gaauuucccacau

SEQ ID NO: 833370 - RNA, 14 nt, Homo sapiens
gacaaaucaaagca

SEQ ID NO: 833371 - RNA, 15 nt, Homo sapiens
gacaaggaaaggcaa

SEQ ID NO: 833372 - RNA, 21 nt, Homo sapiens
gacaagugacuguaucugugu

SEQ ID NO: 833373 - RNA, 17 nt, Homo sapiens
gacaaguggggacugca

SEQ ID NO: 833374 - RNA, 15 nt, Homo sapiens
gacaccuaacucuuc

SEQ ID NO: 833375 - RNA, 14 nt, Homo sapiens
gacagaagcagcuc

SEQ ID NO: 833376 - RNA, 19 nt, Homo sapiens
gacagucccugccaaugga

SEQ ID NO: 833377 - RNA, 17 nt, Homo sapiens
gacagugccucuuccag

SEQ ID NO: 833378 - RNA, 19 nt, Homo sapiens
gaccaggcaaagcaaguga

SEQ ID NO: 833379 - RNA, 22 nt, Homo sapiens
gaccaggcaaugugacuuugca

SEQ ID NO: 833380 - RNA, 13 nt, Homo sapiens
gaccaucccugaa

SEQ ID NO: 833381 - RNA, 14 nt, Homo sapiens
gacccuauugcugc

SEQ ID NO: 833382 - RNA, 15 nt, Homo sapiens
gaccugacagcccaa

SEQ ID NO: 833383 - RNA, 23 nt, Homo sapiens
gaccuggcaaggacacagaugaa

SEQ ID NO: 833384 - RNA, 20 nt, Homo sapiens
gacggaggccuacucuucca

SEQ ID NO: 833385 - RNA, 22 nt, Homo sapiens
gacgugauucaauucaacacuc

SEQ ID NO: 833386 - RNA, 15 nt, Homo sapiens
gacuauuuuauauga

SEQ ID NO: 833387 - RNA, 17 nt, Homo sapiens
gacucaaaaauagggaa

SEQ ID NO: 833388 - RNA, 22 nt, Homo sapiens
gacucaaaaauagggaaguaac

SEQ ID NO: 833389 - RNA, 21 nt, Homo sapiens
gacuccuaggcaggacaugcu

SEQ ID NO: 833390 - RNA, 15 nt, Homo sapiens
gacuggccugcugga

SEQ ID NO: 833391 - RNA, 14 nt, Homo sapiens
gacuugcaaaaagg

SEQ ID NO: 833392 - RNA, 21 nt, Homo sapiens
gagaaaauuggaacucuacuc

SEQ ID NO: 833393 - RNA, 14 nt, Homo sapiens
gagacagugaggcu

SEQ ID NO: 833394 - RNA, 16 nt, Homo sapiens
gagaccaggcaaagca

SEQ ID NO: 833395 - RNA, 17 nt, Homo sapiens
gagacgggguuugccau

SEQ ID NO: 833396 - RNA, 18 nt, Homo sapiens
gagaggcccggccucuca

SEQ ID NO: 833397 - RNA, 16 nt, Homo sapiens
gagagucgcaucucag

SEQ ID NO: 833398 - RNA, 24 nt, Homo sapiens
gagaugaacccuggcauuuggccu

SEQ ID NO: 833399 - RNA, 19 nt, Homo sapiens
gagcaaaucaucugcauuc

SEQ ID NO: 833400 - RNA, 18 nt, Homo sapiens
gagcaagugagacccugu

SEQ ID NO: 833401 - RNA, 17 nt, Homo sapiens
gagcccauccagucucc

SEQ ID NO: 833402 - RNA, 14 nt, Homo sapiens
gagcccuuaugaca

SEQ ID NO: 833403 - RNA, 13 nt, Homo sapiens
gagccuggugccc

SEQ ID NO: 833404 - RNA, 22 nt, Homo sapiens
gagcucagagagggcaggcaug

SEQ ID NO: 833405 - RNA, 16 nt, Homo sapiens
gagcugacacaggaug

SEQ ID NO: 833406 - RNA, 13 nt, Homo sapiens
gaggaaacuuuga

SEQ ID NO: 833407 - RNA, 20 nt, Homo sapiens
gaggcaggaggaucacuuga

SEQ ID NO: 833408 - RNA, 18 nt, Homo sapiens
gaggcaguuccauuucau

SEQ ID NO: 833409 - RNA, 21 nt, Homo sapiens
gaggcauuugcagcugugcca

SEQ ID NO: 833410 - RNA, 14 nt, Homo sapiens
ucauuauguuaaua

SEQ ID NO: 833411 - RNA, 14 nt, Homo sapiens
ucauucaguacuua

SEQ ID NO: 833412 - RNA, 13 nt, Homo sapiens
ucauuucuucuac

SEQ ID NO: 833413 - RNA, 16 nt, Homo sapiens
uccaaacccaggcuau

SEQ ID NO: 833414 - RNA, 18 nt, Homo sapiens
uccaaggaaaccacagcu

SEQ ID NO: 833415 - RNA, 17 nt, Homo sapiens
uccacaguguugccaga

SEQ ID NO: 833416 - RNA, 20 nt, Homo sapiens
uccaggggugggacacccug

SEQ ID NO: 833417 - RNA, 23 nt, Homo sapiens
uccaggggugggacacccuguga

SEQ ID NO: 833418 - RNA, 18 nt, Homo sapiens
uccaggguccacaggaag

SEQ ID NO: 833419 - RNA, 13 nt, Homo sapiens
uccagugcaggag

SEQ ID NO: 833420 - RNA, 21 nt, Homo sapiens
ucccaaagugcugggaauuac

SEQ ID NO: 833421 - RNA, 21 nt, Homo sapiens
ucccaacuuguauuaaagaca

SEQ ID NO: 833422 - RNA, 14 nt, Homo sapiens
ucccagcaguggac

SEQ ID NO: 833423 - RNA, 11 nt, Homo sapiens
ucccagcauug

SEQ ID NO: 833424 - RNA, 12 nt, Homo sapiens
ucccaggcuucc

SEQ ID NO: 833425 - RNA, 16 nt, Homo sapiens
ucccaugacccaggcu

SEQ ID NO: 833426 - RNA, 22 nt, Homo sapiens
ucccuaucuuugccacccucau

SEQ ID NO: 833427 - RNA, 22 nt, Homo sapiens
ucccuauuuuuuuucuguuaua

SEQ ID NO: 833428 - RNA, 16 nt, Homo sapiens
ucccugguucugauga

SEQ ID NO: 833429 - RNA, 13 nt, Homo sapiens
ucccuuucuuccc

SEQ ID NO: 833430 - RNA, 19 nt, Homo sapiens
uccuaaaacaaaagcucau

SEQ ID NO: 833431 - RNA, 13 nt, Homo sapiens
uccuagcacuuug

SEQ ID NO: 833432 - RNA, 21 nt, Homo sapiens
uccuagcgcagccaugugauu

SEQ ID NO: 833433 - RNA, 18 nt, Homo sapiens
uccuaggcauuugcugaa

SEQ ID NO: 833434 - RNA, 15 nt, Homo sapiens
uccucaaacacugca

SEQ ID NO: 833435 - RNA, 15 nt, Homo sapiens
uccuccguggcacau

SEQ ID NO: 833436 - RNA, 18 nt, Homo sapiens
uccucuaugaacuaugga

SEQ ID NO: 833437 - RNA, 16 nt, Homo sapiens
uccucucccucaucaa

SEQ ID NO: 833438 - RNA, 20 nt, Homo sapiens
uccugaaaaaaaaccugaga

SEQ ID NO: 833439 - RNA, 23 nt, Homo sapiens
uccugaagguguuuuucauucac

SEQ ID NO: 833440 - RNA, 19 nt, Homo sapiens
uccugccugugcugugacu

SEQ ID NO: 833441 - RNA, 16 nt, Homo sapiens
uccuggaucucccuga

SEQ ID NO: 833442 - RNA, 21 nt, Homo sapiens
uccuuaacacugagcugucau

SEQ ID NO: 833443 - RNA, 19 nt, Homo sapiens
uccuucacagaugggugcu

SEQ ID NO: 833444 - RNA, 17 nt, Homo sapiens
uccuucauucaacccac

SEQ ID NO: 833445 - RNA, 17 nt, Homo sapiens
uccuuuuucacuuugaa

SEQ ID NO: 833446 - RNA, 22 nt, Homo sapiens
ucgaacugcuggauucaaguga

SEQ ID NO: 833447 - RNA, 16 nt, Homo sapiens
ucgcaucucagugcag

SEQ ID NO: 833448 - RNA, 19 nt, Homo sapiens
ucggcaggacacccugaua

SEQ ID NO: 833449 - RNA, 12 nt, Homo sapiens
ucuaagccuuug

SEQ ID NO: 833450 - RNA, 20 nt, Homo sapiens
ucuaggcuggggaaguccuc

SEQ ID NO: 833451 - RNA, 23 nt, Homo sapiens
ucuaugaccucgcccuccacaaa

SEQ ID NO: 833452 - RNA, 16 nt, Homo sapiens
ucucaaccaccuuuca

SEQ ID NO: 833453 - RNA, 15 nt, Homo sapiens
ucucacaagcacuuu

SEQ ID NO: 833454 - RNA, 23 nt, Homo sapiens
ucucagccccugauccugugaag

SEQ ID NO: 833455 - RNA, 17 nt, Homo sapiens
ucuccaccugccaggga

SEQ ID NO: 833456 - RNA, 16 nt, Homo sapiens
ucuccgucucccaaag

SEQ ID NO: 833457 - RNA, 18 nt, Homo sapiens
ucucgaacugcuggauuc

SEQ ID NO: 833458 - RNA, 14 nt, Homo sapiens
ucucucuucuccac

SEQ ID NO: 833459 - RNA, 18 nt, Homo sapiens
ucucugacgcuugugaca

SEQ ID NO: 833460 - RNA, 15 nt, Homo sapiens
ucugaaccauuacug

SEQ ID NO: 833461 - RNA, 16 nt, Homo sapiens
ucugacaacagacuuc

SEQ ID NO: 833462 - RNA, 22 nt, Homo sapiens
ucugaccaguuuaaccugaugc

SEQ ID NO: 833463 - RNA, 16 nt, Homo sapiens
ucugagcuaacuuaua

SEQ ID NO: 833464 - RNA, 22 nt, Homo sapiens
ucugauccuaguuccaccauca

SEQ ID NO: 833465 - RNA, 11 nt, Homo sapiens
ucuggcagcuc

SEQ ID NO: 833466 - RNA, 12 nt, Homo sapiens
ucuggcagcuca

SEQ ID NO: 833467 - RNA, 19 nt, Homo sapiens
ucuggccguugauguuggc

SEQ ID NO: 833468 - RNA, 13 nt, Homo sapiens
ucuggugugaacu

SEQ ID NO: 833469 - RNA, 11 nt, Homo sapiens
ucuuaacucac

SEQ ID NO: 833470 - RNA, 15 nt, Homo sapiens
ucuuagcucaaugag

SEQ ID NO: 833471 - RNA, 23 nt, Homo sapiens
ucuucacuggguucccauucuga

SEQ ID NO: 833472 - RNA, 14 nt, Homo sapiens
ucuuccucccugga

SEQ ID NO: 833473 - RNA, 19 nt, Homo sapiens
ucuuuaaaaacucacuuac

SEQ ID NO: 833474 - RNA, 18 nt, Homo sapiens
ucuuuaguuagugauuau

SEQ ID NO: 833475 - RNA, 16 nt, Homo sapiens
ucuuucuuacaaggaa

SEQ ID NO: 833476 - RNA, 15 nt, Homo sapiens
ucuuuggacagaagc

SEQ ID NO: 833477 - RNA, 19 nt, Homo sapiens
ucuuuucuugcaugaggcu

SEQ ID NO: 833478 - RNA, 17 nt, Homo sapiens
ucuuuuuuugagugaca

SEQ ID NO: 833479 - RNA, 23 nt, Homo sapiens
ugaaaaggguguuagcuaaagga

SEQ ID NO: 833480 - RNA, 13 nt, Homo sapiens
ugaaacauuugca

SEQ ID NO: 833481 - RNA, 23 nt, Homo sapiens
ugaaauaccaaccugaagacacc

SEQ ID NO: 833482 - RNA, 12 nt, Homo sapiens
ugaaaugcauuu

SEQ ID NO: 833483 - RNA, 16 nt, Homo sapiens
ugaacuaaacuuucac

SEQ ID NO: 833484 - RNA, 15 nt, Homo sapiens
ugaagcuaauaauuc

SEQ ID NO: 833485 - RNA, 15 nt, Homo sapiens
ugaaggcaaugccau

SEQ ID NO: 833486 - RNA, 18 nt, Homo sapiens
ugaagucucugaagugaa

SEQ ID NO: 833487 - RNA, 15 nt, Homo sapiens
ugaaguuuccuuggc

SEQ ID NO: 833488 - RNA, 20 nt, Homo sapiens
ugaauaauacaguaucucag

SEQ ID NO: 833489 - RNA, 22 nt, Homo sapiens
ugaauaauguaguuuugugaug

SEQ ID NO: 833490 - RNA, 16 nt, Homo sapiens
ugaauuaugcuuccac

SEQ ID NO: 833491 - RNA, 15 nt, Homo sapiens
ugaauugaaauguuc

SEQ ID NO: 833492 - RNA, 14 nt, Homo sapiens
ugacaucauuugua

SEQ ID NO: 833493 - RNA, 16 nt, Homo sapiens
ugacaucucugcaauc

SEQ ID NO: 833494 - RNA, 22 nt, Homo sapiens
ugacauuuauuuuucucaugaa

SEQ ID NO: 833495 - RNA, 12 nt, Homo sapiens
ugaccacacucc

SEQ ID NO: 833496 - RNA, 17 nt, Homo sapiens
ugaccaguuuaaccuga

SEQ ID NO: 833497 - RNA, 21 nt, Homo sapiens
ugaccaguuuaaccugaugca

SEQ ID NO: 833498 - RNA, 21 nt, Homo sapiens
ugacccaugcugcccugugag

SEQ ID NO: 833499 - RNA, 14 nt, Homo sapiens
ugaccugacagccc

SEQ ID NO: 833500 - RNA, 15 nt, Homo sapiens
ugacuguaucugugu

SEQ ID NO: 833501 - RNA, 16 nt, Homo sapiens
ugagacccugucucaa

SEQ ID NO: 833502 - RNA, 16 nt, Homo sapiens
ugagaucauucacuca

SEQ ID NO: 833503 - RNA, 21 nt, Homo sapiens
ugaggcccagugcauaugcaa

SEQ ID NO: 833504 - RNA, 12 nt, Homo sapiens
ugagguaaccuc

SEQ ID NO: 833505 - RNA, 21 nt, Homo sapiens
ugauacaaauugcagacugug

SEQ ID NO: 833506 - RNA, 19 nt, Homo sapiens
ugauccuaggcauuugcug

SEQ ID NO: 833507 - RNA, 14 nt, Homo sapiens
ugauccugugaagu

SEQ ID NO: 833508 - RNA, 13 nt, Homo sapiens
ugaugcugggauu

SEQ ID NO: 833509 - RNA, 17 nt, Homo sapiens
ugauguuggcugggaac

SEQ ID NO: 833510 - RNA, 16 nt, Homo sapiens
ugauucagacagcugc

SEQ ID NO: 833511 - RNA, 19 nt, Homo sapiens
ugauucauacauuaucuca

SEQ ID NO: 833512 - RNA, 15 nt, Homo sapiens
ugauuucacagugug

SEQ ID NO: 833513 - RNA, 20 nt, Homo sapiens
ugcaaacucuuuggucguuu

SEQ ID NO: 833514 - RNA, 17 nt, Homo sapiens
ugcaauagaacagagaa

SEQ ID NO: 833515 - RNA, 19 nt, Homo sapiens
ugcacaacauuacagggaa

SEQ ID NO: 833516 - RNA, 13 nt, Homo sapiens
ugcacacaggaca

SEQ ID NO: 833517 - RNA, 14 nt, Homo sapiens
ugcacccaccuguu

SEQ ID NO: 833518 - RNA, 17 nt, Homo sapiens
ugcagaaacaguucacc

SEQ ID NO: 833519 - RNA, 15 nt, Homo sapiens
ugcagcugugccaua

SEQ ID NO: 833520 - RNA, 16 nt, Homo sapiens
ugcaggaccucaggug

SEQ ID NO: 833521 - RNA, 17 nt, Homo sapiens
ugcaggcaucacagcua

SEQ ID NO: 833522 - RNA, 16 nt, Homo sapiens
ugcaguaaacuuuuaa

SEQ ID NO: 833523 - RNA, 20 nt, Homo sapiens
ugcauauuuuauuauaguca

SEQ ID NO: 833524 - RNA, 19 nt, Homo sapiens
ugcaucguuucaucuucca

SEQ ID NO: 833525 - RNA, 15 nt, Homo sapiens
ugcaucuguacucac

SEQ ID NO: 833526 - RNA, 15 nt, Homo sapiens
ugcauggaaauuccc

SEQ ID NO: 833527 - RNA, 23 nt, Homo sapiens
ugcauucugagguaaccucauua

SEQ ID NO: 833528 - RNA, 20 nt, Homo sapiens
ugccaaccggucacccagga

SEQ ID NO: 833529 - RNA, 19 nt, Homo sapiens
ugccaagcacugugcucag

SEQ ID NO: 833530 - RNA, 16 nt, Homo sapiens
ugccagccacugugau

SEQ ID NO: 833531 - RNA, 23 nt, Homo sapiens
ugccaugccagcuuaucucaggg

SEQ ID NO: 833532 - RNA, 17 nt, Homo sapiens
agcaaaugccugccaaa

SEQ ID NO: 833533 - RNA, 21 nt, Homo sapiens
agcaccuuagacagucccugc

SEQ ID NO: 833534 - RNA, 21 nt, Homo sapiens
agcacuuuaacacagugucug

SEQ ID NO: 833535 - RNA, 22 nt, Homo sapiens
agcagagacgggguuugccaug

SEQ ID NO: 833536 - RNA, 21 nt, Homo sapiens
agcagauauauuaagugacug

SEQ ID NO: 833537 - RNA, 21 nt, Homo sapiens
agcagccucagaacaaaguga

SEQ ID NO: 833538 - RNA, 15 nt, Homo sapiens
agcagugcaggcaca

SEQ ID NO: 833539 - RNA, 21 nt, Homo sapiens
agcaguggacucaaaacccau

SEQ ID NO: 833540 - RNA, 23 nt, Homo sapiens
agcaucagagguuugcuuccuca

SEQ ID NO: 833541 - RNA, 20 nt, Homo sapiens
agcaucagugcccuccagga

SEQ ID NO: 833542 - RNA, 19 nt, Homo sapiens
agcaucccuugaccaggcc

SEQ ID NO: 833543 - RNA, 16 nt, Homo sapiens
agcauguuuagacuuu

SEQ ID NO: 833544 - RNA, 13 nt, Homo sapiens
agcauuagcuuua

SEQ ID NO: 833545 - RNA, 23 nt, Homo sapiens
agccaaccugggggcuuuaggga

SEQ ID NO: 833546 - RNA, 15 nt, Homo sapiens
agccagcucauuuca

SEQ ID NO: 833547 - RNA, 12 nt, Homo sapiens
agccagugcuag

SEQ ID NO: 833548 - RNA, 19 nt, Homo sapiens
agcccaccccucaacaccu

SEQ ID NO: 833549 - RNA, 18 nt, Homo sapiens
agcccauccagucuccca

SEQ ID NO: 833550 - RNA, 15 nt, Homo sapiens
agcccauucauucca

SEQ ID NO: 833551 - RNA, 14 nt, Homo sapiens
agccccaauucgau

SEQ ID NO: 833552 - RNA, 17 nt, Homo sapiens
agccguuuguuccccaa

SEQ ID NO: 833553 - RNA, 16 nt, Homo sapiens
agccucugaaaaccaa

SEQ ID NO: 833554 - RNA, 20 nt, Homo sapiens
agccugcucauguaccucug

SEQ ID NO: 833555 - RNA, 17 nt, Homo sapiens
agccugcuccagcuguu

SEQ ID NO: 833556 - RNA, 17 nt, Homo sapiens
agccuggaacaucauca

SEQ ID NO: 833557 - RNA, 14 nt, Homo sapiens
agccuggcuccaaa

SEQ ID NO: 833558 - RNA, 15 nt, Homo sapiens
agccuggugcugcug

SEQ ID NO: 833559 - RNA, 23 nt, Homo sapiens
agcggcuggcagcccaccccuca

SEQ ID NO: 833560 - RNA, 13 nt, Homo sapiens
agcuaacuuauca

SEQ ID NO: 833561 - RNA, 14 nt, Homo sapiens
agcuaagauauaau

SEQ ID NO: 833562 - RNA, 22 nt, Homo sapiens
agcucaaagcguggacaggugu

SEQ ID NO: 833563 - RNA, 13 nt, Homo sapiens
agcuccacagugu

SEQ ID NO: 833564 - RNA, 14 nt, Homo sapiens
agcucuugcuuuga

SEQ ID NO: 833565 - RNA, 22 nt, Homo sapiens
agcugaagaaaaugaagcccua

SEQ ID NO: 833566 - RNA, 18 nt, Homo sapiens
agcugacacaggaugaag

SEQ ID NO: 833567 - RNA, 13 nt, Homo sapiens
agcugcacccuca

SEQ ID NO: 833568 - RNA, 18 nt, Homo sapiens
agcugccugggaucccuc

SEQ ID NO: 833569 - RNA, 19 nt, Homo sapiens
agcuggcggaucuagugac

SEQ ID NO: 833570 - RNA, 16 nt, Homo sapiens
agcugugcccugacca

SEQ ID NO: 833571 - RNA, 13 nt, Homo sapiens
agcuguguucaca

SEQ ID NO: 833572 - RNA, 15 nt, Homo sapiens
aggaaaccacagcug

SEQ ID NO: 833573 - RNA, 22 nt, Homo sapiens
aggaaaccacagcugcuggaga

SEQ ID NO: 833574 - RNA, 13 nt, Homo sapiens
aggaacacuccuu

SEQ ID NO: 833575 - RNA, 16 nt, Homo sapiens
aggaaccccaggagau

SEQ ID NO: 833576 - RNA, 20 nt, Homo sapiens
aggaagccucccacgacugc

SEQ ID NO: 833577 - RNA, 19 nt, Homo sapiens
aggaauacauaaaguaugu

SEQ ID NO: 833578 - RNA, 16 nt, Homo sapiens
aggaauccacucccag

SEQ ID NO: 833579 - RNA, 13 nt, Homo sapiens
aggacauggacaa

SEQ ID NO: 833580 - RNA, 20 nt, Homo sapiens
aggaccaggcaaugugacuu

SEQ ID NO: 833581 - RNA, 16 nt, Homo sapiens
aggagacacaacaacu

SEQ ID NO: 833582 - RNA, 22 nt, Homo sapiens
aggagaccuggcacuggaugca

SEQ ID NO: 833583 - RNA, 18 nt, Homo sapiens
aggagaggggcacagggu

SEQ ID NO: 833584 - RNA, 14 nt, Homo sapiens
aggaguacagguga

SEQ ID NO: 833585 - RNA, 19 nt, Homo sapiens
aggauagacuuuucccaag

SEQ ID NO: 833586 - RNA, 17 nt, Homo sapiens
aggauagagugggacag

SEQ ID NO: 833587 - RNA, 17 nt, Homo sapiens
aggcaguuggccagaga

SEQ ID NO: 833588 - RNA, 15 nt, Homo sapiens
aggccagaugcacau

SEQ ID NO: 833589 - RNA, 22 nt, Homo sapiens
aggccauuccccgucucugguu

SEQ ID NO: 833590 - RNA, 17 nt, Homo sapiens
aggcccaaggaguaagu

SEQ ID NO: 833591 - RNA, 23 nt, Homo sapiens
aggccccucuccuccguggcaca

SEQ ID NO: 833592 - RNA, 16 nt, Homo sapiens
aggcccuucucuccag

SEQ ID NO: 833593 - RNA, 15 nt, Homo sapiens
aggcuccaaacugga

SEQ ID NO: 833594 - RNA, 15 nt, Homo sapiens
auaucaaucucucuu

SEQ ID NO: 833595 - RNA, 15 nt, Homo sapiens
auaucagugggcucu

SEQ ID NO: 833596 - RNA, 17 nt, Homo sapiens
auaucccuuacuuuaac

SEQ ID NO: 833597 - RNA, 17 nt, Homo sapiens
auaugauagaugacaaa

SEQ ID NO: 833598 - RNA, 16 nt, Homo sapiens
auauuugguuuggcca

SEQ ID NO: 833599 - RNA, 22 nt, Homo sapiens
auauuuuuguacugaaucucau

SEQ ID NO: 833600 - RNA, 13 nt, Homo sapiens
aucaagacuggaa

SEQ ID NO: 833601 - RNA, 14 nt, Homo sapiens
aucaagcagccaag

SEQ ID NO: 833602 - RNA, 23 nt, Homo sapiens
aucacaguuuugguugcuuuaau

SEQ ID NO: 833603 - RNA, 23 nt, Homo sapiens
aucaccaucaauuuuaguuguca

SEQ ID NO: 833604 - RNA, 17 nt, Homo sapiens
aucaccuccaccauacu

SEQ ID NO: 833605 - RNA, 22 nt, Homo sapiens
aucagaggucuauuuuuaccua

SEQ ID NO: 833606 - RNA, 23 nt, Homo sapiens
aucagcaacaaccagcaucccuu

SEQ ID NO: 833607 - RNA, 17 nt, Homo sapiens
aucagccugcuccagcu

SEQ ID NO: 833608 - RNA, 21 nt, Homo sapiens
aucagccugggcaaugugaua

SEQ ID NO: 833609 - RNA, 13 nt, Homo sapiens
aucaggaggccag

SEQ ID NO: 833610 - RNA, 14 nt, Homo sapiens
aucaucuguggaac

SEQ ID NO: 833611 - RNA, 16 nt, Homo sapiens
auccacacugagcuga

SEQ ID NO: 833612 - RNA, 15 nt, Homo sapiens
aucccacauauuuca

SEQ ID NO: 833613 - RNA, 14 nt, Homo sapiens
aucccucauccuca

SEQ ID NO: 833614 - RNA, 23 nt, Homo sapiens
aucuacccuccgauuguuccuga

SEQ ID NO: 833615 - RNA, 18 nt, Homo sapiens
aucucuccaccuuccaaa

SEQ ID NO: 833616 - RNA, 11 nt, Homo sapiens
aucuuuggaca

SEQ ID NO: 833617 - RNA, 13 nt, Homo sapiens
augaaaugcauuu

SEQ ID NO: 833618 - RNA, 22 nt, Homo sapiens
augaacauaaucuaccaacgaa

SEQ ID NO: 833619 - RNA, 20 nt, Homo sapiens
augaaccugcccugcuccca

SEQ ID NO: 833620 - RNA, 20 nt, Homo sapiens
augagcaucccaggaucgca

SEQ ID NO: 833621 - RNA, 19 nt, Homo sapiens
augauaauauuguggugcc

SEQ ID NO: 833622 - RNA, 15 nt, Homo sapiens
augauagaugacaaa

SEQ ID NO: 833623 - RNA, 16 nt, Homo sapiens
augauagaugacaaau

SEQ ID NO: 833624 - RNA, 18 nt, Homo sapiens
augaucuaggaagacuuu

SEQ ID NO: 833625 - RNA, 14 nt, Homo sapiens
augauguauguuga

SEQ ID NO: 833626 - RNA, 19 nt, Homo sapiens
augaugugaguacccagga

SEQ ID NO: 833627 - RNA, 23 nt, Homo sapiens
augauucacccccaaacagugac

SEQ ID NO: 833628 - RNA, 16 nt, Homo sapiens
augauuucacagugug

SEQ ID NO: 833629 - RNA, 16 nt, Homo sapiens
augcaaagucaugcaa

SEQ ID NO: 833630 - RNA, 22 nt, Homo sapiens
augcaauauuuccucaugugau

SEQ ID NO: 833631 - RNA, 13 nt, Homo sapiens
augcagacaugag

SEQ ID NO: 833632 - RNA, 13 nt, Homo sapiens
augcagcgugaag

SEQ ID NO: 833633 - RNA, 15 nt, Homo sapiens
augcagguucagguc

SEQ ID NO: 833634 - RNA, 12 nt, Homo sapiens
augcauucugag

SEQ ID NO: 833635 - RNA, 19 nt, Homo sapiens
augccagccacugugauag

SEQ ID NO: 833636 - RNA, 19 nt, Homo sapiens
augccagcuuaucucaggg

SEQ ID NO: 833637 - RNA, 16 nt, Homo sapiens
augccugauugccaag

SEQ ID NO: 833638 - RNA, 17 nt, Homo sapiens
augccugauugccaagc

SEQ ID NO: 833639 - RNA, 17 nt, Homo sapiens
augcuaauuuuauuaua

SEQ ID NO: 833640 - RNA, 11 nt, Homo sapiens
augcuggccag

SEQ ID NO: 833641 - RNA, 14 nt, Homo sapiens
augcuuauaggugg

SEQ ID NO: 833642 - RNA, 18 nt, Homo sapiens
augcuuuaagugcacaac

SEQ ID NO: 833643 - RNA, 12 nt, Homo sapiens
auggacuuuguu

SEQ ID NO: 833644 - RNA, 17 nt, Homo sapiens
auggagguuaagcacuu

SEQ ID NO: 833645 - RNA, 14 nt, Homo sapiens
auggauuuccagcc

SEQ ID NO: 833646 - RNA, 12 nt, Homo sapiens
auggccaugcag

SEQ ID NO: 833647 - RNA, 14 nt, Homo sapiens
auggcuacaucucc

SEQ ID NO: 833648 - RNA, 22 nt, Homo sapiens
auggguuagggaaaacauucca

SEQ ID NO: 833649 - RNA, 19 nt, Homo sapiens
augguaguuuuacaguguu

SEQ ID NO: 833650 - RNA, 19 nt, Homo sapiens
augucacagauuccuggca

SEQ ID NO: 833651 - RNA, 20 nt, Homo sapiens
augugauuacccucuggguc

SEQ ID NO: 833652 - RNA, 18 nt, Homo sapiens
auguuggcugggaacuca

SEQ ID NO: 833653 - RNA, 16 nt, Homo sapiens
auguuuagcagauuua

SEQ ID NO: 833654 - RNA, 17 nt, Homo sapiens
auguuuagcagauuuaa

SEQ ID NO: 833655 - RNA, 17 nt, Homo sapiens
auuacaggcgugagcca

SEQ ID NO: 833656 - RNA, 19 nt, Homo sapiens
caaccugggggcuuuaggg

SEQ ID NO: 833657 - RNA, 20 nt, Homo sapiens
caacuuguauuaaagacaga

SEQ ID NO: 833658 - RNA, 15 nt, Homo sapiens
caagaaaaauaugac

SEQ ID NO: 833659 - RNA, 17 nt, Homo sapiens
caagagaagcauucuca

SEQ ID NO: 833660 - RNA, 14 nt, Homo sapiens
caagagcacacuug

SEQ ID NO: 833661 - RNA, 16 nt, Homo sapiens
caagagccauguagaa

SEQ ID NO: 833662 - RNA, 14 nt, Homo sapiens
caagcaaauggcca

SEQ ID NO: 833663 - RNA, 21 nt, Homo sapiens
caagcaagcucccaagggaug

SEQ ID NO: 833664 - RNA, 15 nt, Homo sapiens
caagcagccaaggga

SEQ ID NO: 833665 - RNA, 13 nt, Homo sapiens
caagcucccaagg

SEQ ID NO: 833666 - RNA, 16 nt, Homo sapiens
caaggaaaccacagcu

SEQ ID NO: 833667 - RNA, 14 nt, Homo sapiens
caaggagacacaac

SEQ ID NO: 833668 - RNA, 22 nt, Homo sapiens
caaggagacacaacaacuccua

SEQ ID NO: 833669 - RNA, 19 nt, Homo sapiens
caaggaguaaguacaaaua

SEQ ID NO: 833670 - RNA, 23 nt, Homo sapiens
caaggaguaaguacaaauauucc

SEQ ID NO: 833671 - RNA, 21 nt, Homo sapiens
caagucucccaauauccaauu

SEQ ID NO: 833672 - RNA, 18 nt, Homo sapiens
caagugauccgcccaucu

SEQ ID NO: 833673 - RNA, 15 nt, Homo sapiens
caagugccuuagcaa

SEQ ID NO: 833674 - RNA, 17 nt, Homo sapiens
caaguuguuugagaaau

SEQ ID NO: 833675 - RNA, 22 nt, Homo sapiens
caauaaaaaaaaaccuagcauc

SEQ ID NO: 833676 - RNA, 18 nt, Homo sapiens
caauaacacacagcuaac

SEQ ID NO: 833677 - RNA, 22 nt, Homo sapiens
caauaaucucacuaccuuauua

SEQ ID NO: 833678 - RNA, 19 nt, Homo sapiens
caauaguaauucucaggcc

SEQ ID NO: 833679 - RNA, 20 nt, Homo sapiens
caauauuuccucaugugauc

SEQ ID NO: 833680 - RNA, 21 nt, Homo sapiens
caaugagcauguuuagacuuu

SEQ ID NO: 833681 - RNA, 20 nt, Homo sapiens
caaugugggcagagauugga

SEQ ID NO: 833682 - RNA, 20 nt, Homo sapiens
caauuagacaagaacuugga

SEQ ID NO: 833683 - RNA, 22 nt, Homo sapiens
caauuauuuauuaaaugcccag

SEQ ID NO: 833684 - RNA, 19 nt, Homo sapiens
caauuugagauguauuuca

SEQ ID NO: 833685 - RNA, 23 nt, Homo sapiens
caauuuuaaaaugaaaugcauuu

SEQ ID NO: 833686 - RNA, 22 nt, Homo sapiens
cacacugggugcgucuccaguc

SEQ ID NO: 833687 - RNA, 11 nt, Homo sapiens
cacacuguaaa

SEQ ID NO: 833688 - RNA, 20 nt, Homo sapiens
cacagcucccauaaccgcug

SEQ ID NO: 833689 - RNA, 23 nt, Homo sapiens
cacaggaugaaggcaaugccauc

SEQ ID NO: 833690 - RNA, 16 nt, Homo sapiens
cacagugccacccaug

SEQ ID NO: 833691 - RNA, 17 nt, Homo sapiens
cacagugcugaccagac

SEQ ID NO: 833692 - RNA, 21 nt, Homo sapiens
cacaguuuugguugcuuuaau

SEQ ID NO: 833693 - RNA, 16 nt, Homo sapiens
cacaugccaagcacug

SEQ ID NO: 833694 - RNA, 19 nt, Homo sapiens
cacauguccaagaagccca

SEQ ID NO: 833695 - RNA, 16 nt, Homo sapiens
cacauuaaucucaaag

SEQ ID NO: 833696 - RNA, 16 nt, Homo sapiens
caccagggccuggcug

SEQ ID NO: 833697 - RNA, 22 nt, Homo sapiens
cacccagaugggggaaagcaca

SEQ ID NO: 833698 - RNA, 13 nt, Homo sapiens
caccccugcaguu

SEQ ID NO: 833699 - RNA, 19 nt, Homo sapiens
caccuaagucucugugaau

SEQ ID NO: 833700 - RNA, 16 nt, Homo sapiens
caccucugcacaagcu

SEQ ID NO: 833701 - RNA, 23 nt, Homo sapiens
caccuugcggggauaaagagaga

SEQ ID NO: 833702 - RNA, 17 nt, Homo sapiens
cacgagagagucuucca

SEQ ID NO: 833703 - RNA, 14 nt, Homo sapiens
cacggccacaguca

SEQ ID NO: 833704 - RNA, 11 nt, Homo sapiens
cacggcugcug

SEQ ID NO: 833705 - RNA, 14 nt, Homo sapiens
cacuggaugcagaa

SEQ ID NO: 833706 - RNA, 23 nt, Homo sapiens
cacugugaagagaaccauaucaa

SEQ ID NO: 833707 - RNA, 23 nt, Homo sapiens
cacuucaaacuacuuugcugcua

SEQ ID NO: 833708 - RNA, 15 nt, Homo sapiens
cacuuggcaucagcu

SEQ ID NO: 833709 - RNA, 20 nt, Homo sapiens
cacuugguucuuguacucua

SEQ ID NO: 833710 - RNA, 18 nt, Homo sapiens
cagaaaaagaucuuucau

SEQ ID NO: 833711 - RNA, 15 nt, Homo sapiens
cagacaagugacugu

SEQ ID NO: 833712 - RNA, 13 nt, Homo sapiens
cagaccucaugcc

SEQ ID NO: 833713 - RNA, 20 nt, Homo sapiens
cagagaaaauaaaagcacuu

SEQ ID NO: 833714 - RNA, 15 nt, Homo sapiens
cagagaccaucccug

SEQ ID NO: 833715 - RNA, 19 nt, Homo sapiens
cagagacgggguuugccau

SEQ ID NO: 833716 - RNA, 16 nt, Homo sapiens
cauggccgugaacuuu

SEQ ID NO: 833717 - RNA, 16 nt, Homo sapiens
cauguugagaccucag

SEQ ID NO: 833718 - RNA, 17 nt, Homo sapiens
cauguugagaccucagc

SEQ ID NO: 833719 - RNA, 12 nt, Homo sapiens
cauuaaagccau

SEQ ID NO: 833720 - RNA, 12 nt, Homo sapiens
cauuacagggaa

SEQ ID NO: 833721 - RNA, 20 nt, Homo sapiens
cauuacagggaaugccugag

SEQ ID NO: 833722 - RNA, 17 nt, Homo sapiens
cauuaccuucucccuca

SEQ ID NO: 833723 - RNA, 17 nt, Homo sapiens
cauuauuaaauguuucu

SEQ ID NO: 833724 - RNA, 18 nt, Homo sapiens
cauucauuccauucugga

SEQ ID NO: 833725 - RNA, 19 nt, Homo sapiens
cauucauuccauucuggaa

SEQ ID NO: 833726 - RNA, 22 nt, Homo sapiens
cauuccauccuugagucaaaaa

SEQ ID NO: 833727 - RNA, 16 nt, Homo sapiens
cauuccauucuggaag

SEQ ID NO: 833728 - RNA, 21 nt, Homo sapiens
cauuguucuugugaacccaaa

SEQ ID NO: 833729 - RNA, 22 nt, Homo sapiens
cauuucaaaagguauuuauuga

SEQ ID NO: 833730 - RNA, 14 nt, Homo sapiens
cauuucacuuuaca

SEQ ID NO: 833731 - RNA, 20 nt, Homo sapiens
cauuucugagaucaaaacgg

SEQ ID NO: 833732 - RNA, 20 nt, Homo sapiens
cauuucuguucucauuugau

SEQ ID NO: 833733 - RNA, 11 nt, Homo sapiens
cauuuggucuc

SEQ ID NO: 833734 - RNA, 13 nt, Homo sapiens
cauuuuauagaau

SEQ ID NO: 833735 - RNA, 17 nt, Homo sapiens
cauuuuuauguuauuac

SEQ ID NO: 833736 - RNA, 18 nt, Homo sapiens
ccaaacuggagcuugaaa

SEQ ID NO: 833737 - RNA, 14 nt, Homo sapiens
ccaaagagugcuaa

SEQ ID NO: 833738 - RNA, 17 nt, Homo sapiens
ccaaauuuuagauuuac

SEQ ID NO: 833739 - RNA, 21 nt, Homo sapiens
ccaaauuuuagauuuaccuug

SEQ ID NO: 833740 - RNA, 19 nt, Homo sapiens
ccaagcugugcccugacca

SEQ ID NO: 833741 - RNA, 15 nt, Homo sapiens
ccaaggaaaccacag

SEQ ID NO: 833742 - RNA, 12 nt, Homo sapiens
ccaaggugggag

SEQ ID NO: 833743 - RNA, 20 nt, Homo sapiens
ccaagucucccaauauccaa

SEQ ID NO: 833744 - RNA, 22 nt, Homo sapiens
ccaauaaagccuucaaacuccc

SEQ ID NO: 833745 - RNA, 11 nt, Homo sapiens
ccaauuccuca

SEQ ID NO: 833746 - RNA, 16 nt, Homo sapiens
ccacaaccgaccagau

SEQ ID NO: 833747 - RNA, 14 nt, Homo sapiens
ccacacuccagcug

SEQ ID NO: 833748 - RNA, 20 nt, Homo sapiens
ccacagcgaaggcacaugcc

SEQ ID NO: 833749 - RNA, 19 nt, Homo sapiens
ccacagcgcuggccgggac

SEQ ID NO: 833750 - RNA, 18 nt, Homo sapiens
ccaccaccaucaccagac

SEQ ID NO: 833751 - RNA, 15 nt, Homo sapiens
ccacccucaugcugu

SEQ ID NO: 833752 - RNA, 18 nt, Homo sapiens
ccaccucucucacuccuu

SEQ ID NO: 833753 - RNA, 15 nt, Homo sapiens
ccacggccacagcca

SEQ ID NO: 833754 - RNA, 15 nt, Homo sapiens
ccacggccacaguca

SEQ ID NO: 833755 - RNA, 14 nt, Homo sapiens
ccacugccuuugac

SEQ ID NO: 833756 - RNA, 19 nt, Homo sapiens
ccacugugaagagaaccau

SEQ ID NO: 833757 - RNA, 16 nt, Homo sapiens
ccagaaccaauuauuu

SEQ ID NO: 833758 - RNA, 23 nt, Homo sapiens
ccagaugggggaaagcacaggug

SEQ ID NO: 833759 - RNA, 18 nt, Homo sapiens
ccagcgugugacuacucc

SEQ ID NO: 833760 - RNA, 15 nt, Homo sapiens
ccagcucagcacugc

SEQ ID NO: 833761 - RNA, 14 nt, Homo sapiens
ccagcugccgcacc

SEQ ID NO: 833762 - RNA, 21 nt, Homo sapiens
ccagcuguguucacacuguaa

SEQ ID NO: 833763 - RNA, 13 nt, Homo sapiens
ccaggcaaagcaa

SEQ ID NO: 833764 - RNA, 13 nt, Homo sapiens
ccaggcaggcuaa

SEQ ID NO: 833765 - RNA, 13 nt, Homo sapiens
ccaguggcugcug

SEQ ID NO: 833766 - RNA, 20 nt, Homo sapiens
ccauaaccccggaagccaaa

SEQ ID NO: 833767 - RNA, 18 nt, Homo sapiens
ccauauuaacaaauugca

SEQ ID NO: 833768 - RNA, 21 nt, Homo sapiens
ccaucaguuagagcugacaca

SEQ ID NO: 833769 - RNA, 16 nt, Homo sapiens
ccauccuugagucaaa

SEQ ID NO: 833770 - RNA, 15 nt, Homo sapiens
ccaugcagcugcucc

SEQ ID NO: 833771 - RNA, 20 nt, Homo sapiens
cuccuucaccuuugucccca

SEQ ID NO: 833772 - RNA, 17 nt, Homo sapiens
cuccuuccucugaggcu

SEQ ID NO: 833773 - RNA, 12 nt, Homo sapiens
cucgugugcaac

SEQ ID NO: 833774 - RNA, 17 nt, Homo sapiens
cucuaccugcacacugu

SEQ ID NO: 833775 - RNA, 17 nt, Homo sapiens
cucuccuccguggcaca

SEQ ID NO: 833776 - RNA, 14 nt, Homo sapiens
cucugacaacagac

SEQ ID NO: 833777 - RNA, 13 nt, Homo sapiens
cucugcacaagcu

SEQ ID NO: 833778 - RNA, 16 nt, Homo sapiens
cucuuagaaaaaccac

SEQ ID NO: 833779 - RNA, 21 nt, Homo sapiens
cucuucccauaccacccaaug

SEQ ID NO: 833780 - RNA, 20 nt, Homo sapiens
cugaaauagacccacaagag

SEQ ID NO: 833781 - RNA, 17 nt, Homo sapiens
cugaaccauuacuguaa

SEQ ID NO: 833782 - RNA, 18 nt, Homo sapiens
cugaaccauuacuguaau

SEQ ID NO: 833783 - RNA, 20 nt, Homo sapiens
cugaacuuguuuucugggaa

SEQ ID NO: 833784 - RNA, 13 nt, Homo sapiens
cugacccaugcaa

SEQ ID NO: 833785 - RNA, 23 nt, Homo sapiens
cugagaugaacccuggcauuugg

SEQ ID NO: 833786 - RNA, 12 nt, Homo sapiens
cugaggugggag

SEQ ID NO: 833787 - RNA, 20 nt, Homo sapiens
cugaggugggaggaucucuu

SEQ ID NO: 833788 - RNA, 18 nt, Homo sapiens
cugagugggggaucacag

SEQ ID NO: 833789 - RNA, 21 nt, Homo sapiens
cugauacaaauugcagacugu

SEQ ID NO: 833790 - RNA, 16 nt, Homo sapiens
cugcacccacccagga

SEQ ID NO: 833791 - RNA, 12 nt, Homo sapiens
cugcauaugaua

SEQ ID NO: 833792 - RNA, 13 nt, Homo sapiens
cugccaaacacau

SEQ ID NO: 833793 - RNA, 14 nt, Homo sapiens
cugcccuccaagac

SEQ ID NO: 833794 - RNA, 17 nt, Homo sapiens
cugcccugcucccacag

SEQ ID NO: 833795 - RNA, 15 nt, Homo sapiens
cugcuccagugcagg

SEQ ID NO: 833796 - RNA, 14 nt, Homo sapiens
cugcucccacagaa

SEQ ID NO: 833797 - RNA, 12 nt, Homo sapiens
cugcuguauacu

SEQ ID NO: 833798 - RNA, 16 nt, Homo sapiens
cugcuguauacuguac

SEQ ID NO: 833799 - RNA, 14 nt, Homo sapiens
cuggaacaucauca

SEQ ID NO: 833800 - RNA, 16 nt, Homo sapiens
cuggagugcaguggcg

SEQ ID NO: 833801 - RNA, 22 nt, Homo sapiens
cuggaugcagccucacaguccu

SEQ ID NO: 833802 - RNA, 15 nt, Homo sapiens
cuggcaagaaugugu

SEQ ID NO: 833803 - RNA, 20 nt, Homo sapiens
cuggcacugcuuccagugag

SEQ ID NO: 833804 - RNA, 23 nt, Homo sapiens
cuggccagggccuggaagacaga

SEQ ID NO: 833805 - RNA, 13 nt, Homo sapiens
cuggccgggaccc

SEQ ID NO: 833806 - RNA, 19 nt, Homo sapiens
cuggccucugcugauccuc

SEQ ID NO: 833807 - RNA, 12 nt, Homo sapiens
cuggcuccaaac

SEQ ID NO: 833808 - RNA, 20 nt, Homo sapiens
cugggauccgggaucaaagu

SEQ ID NO: 833809 - RNA, 23 nt, Homo sapiens
cugggcaaggaggccacgugaug

SEQ ID NO: 833810 - RNA, 17 nt, Homo sapiens
cugggcugaacacucca

SEQ ID NO: 833811 - RNA, 12 nt, Homo sapiens
cuggguggacau

SEQ ID NO: 833812 - RNA, 18 nt, Homo sapiens
cuggguggcacugccaug

SEQ ID NO: 833813 - RNA, 18 nt, Homo sapiens
cugguugaugccugugaa

SEQ ID NO: 833814 - RNA, 17 nt, Homo sapiens
cuguaaaauggagacac

SEQ ID NO: 833815 - RNA, 13 nt, Homo sapiens
cuguaaacauuca

SEQ ID NO: 833816 - RNA, 14 nt, Homo sapiens
cuguaaacauucau

SEQ ID NO: 833817 - RNA, 14 nt, Homo sapiens
cuguaaauaaucag

SEQ ID NO: 833818 - RNA, 21 nt, Homo sapiens
cuguaauccuagcacuuuggg

SEQ ID NO: 833819 - RNA, 17 nt, Homo sapiens
cuguccuauuauauuca

SEQ ID NO: 833820 - RNA, 13 nt, Homo sapiens
cugugauggggcc

SEQ ID NO: 833821 - RNA, 14 nt, Homo sapiens
cugugcacgcagug

SEQ ID NO: 833822 - RNA, 14 nt, Homo sapiens
cugugcccucagau

SEQ ID NO: 833823 - RNA, 12 nt, Homo sapiens
cugugcccugac

SEQ ID NO: 833824 - RNA, 18 nt, Homo sapiens
cuguggaugauaaaacac

SEQ ID NO: 833825 - RNA, 14 nt, Homo sapiens
cugugucuuggaau

SEQ ID NO: 833826 - RNA, 12 nt, Homo sapiens
cuguuaugucaa

SEQ ID NO: 833827 - RNA, 12 nt, Homo sapiens
cuguucacagag

SEQ ID NO: 833828 - RNA, 17 nt, Homo sapiens
cuguucucugcccucca

SEQ ID NO: 833829 - RNA, 18 nt, Homo sapiens
cuguugaauuucccacau

SEQ ID NO: 833830 - RNA, 19 nt, Homo sapiens
cuguuuauagaauaaggga

SEQ ID NO: 833831 - RNA, 14 nt, Homo sapiens
cuguuugucucacc

SEQ ID NO: 833832 - RNA, 14 nt, Homo sapiens
cuuaaauccauccu

SEQ ID NO: 833833 - RNA, 13 nt, Homo sapiens
cuuaacacugagc

SEQ ID NO: 833834 - RNA, 18 nt, Homo sapiens
cuuaccuaccacaugcca

SEQ ID NO: 833835 - RNA, 13 nt, Homo sapiens
cuuagacaguccc

SEQ ID NO: 833836 - RNA, 22 nt, Homo sapiens
cuuaggcaugacuguagaauuu

SEQ ID NO: 833837 - RNA, 17 nt, Homo sapiens
cuuagguuggcaaaaag

SEQ ID NO: 833838 - RNA, 17 nt, Homo sapiens
cuuauagacaacauggc

SEQ ID NO: 833839 - RNA, 23 nt, Homo sapiens
cuuauggauguccccagcagaga

SEQ ID NO: 833840 - RNA, 17 nt, Homo sapiens
cuucaccuaagucucug

SEQ ID NO: 833841 - RNA, 16 nt, Homo sapiens
cuuccagugaacauuc

SEQ ID NO: 833842 - RNA, 20 nt, Homo sapiens
cuuccuggauuauucaaaau

SEQ ID NO: 833843 - RNA, 20 nt, Homo sapiens
gccacggccacagccacuaa

SEQ ID NO: 833844 - RNA, 14 nt, Homo sapiens
gccacgugggcaaa

SEQ ID NO: 833845 - RNA, 18 nt, Homo sapiens
gccagcucauuucacuuu

SEQ ID NO: 833846 - RNA, 19 nt, Homo sapiens
gccagcuuaucucaggggu

SEQ ID NO: 833847 - RNA, 21 nt, Homo sapiens
gccaggccacccugccucuac

SEQ ID NO: 833848 - RNA, 22 nt, Homo sapiens
gccaguaaacagaggaguacag

SEQ ID NO: 833849 - RNA, 21 nt, Homo sapiens
gccaugcagaccucaugccca

SEQ ID NO: 833850 - RNA, 12 nt, Homo sapiens
gccccacuuuga

SEQ ID NO: 833851 - RNA, 13 nt, Homo sapiens
gccccacuuugaa

SEQ ID NO: 833852 - RNA, 17 nt, Homo sapiens
gcccccuguacauuugu

SEQ ID NO: 833853 - RNA, 23 nt, Homo sapiens
gcccugugggcccccaaauggaa

SEQ ID NO: 833854 - RNA, 18 nt, Homo sapiens
gccguuuguuccccaaga

SEQ ID NO: 833855 - RNA, 13 nt, Homo sapiens
gccucaucuucaa

SEQ ID NO: 833856 - RNA, 16 nt, Homo sapiens
gccucugcacuccccu

SEQ ID NO: 833857 - RNA, 15 nt, Homo sapiens
gccuggcuccaaacc

SEQ ID NO: 833858 - RNA, 23 nt, Homo sapiens
gccuggcuccaaacccucgaggc

SEQ ID NO: 833859 - RNA, 15 nt, Homo sapiens
gccugggaucccuca

SEQ ID NO: 833860 - RNA, 13 nt, Homo sapiens
gcggcuggcagcc

SEQ ID NO: 833861 - RNA, 15 nt, Homo sapiens
gcgugaaucuguauc

SEQ ID NO: 833862 - RNA, 13 nt, Homo sapiens
gcuaacacacagc

SEQ ID NO: 833863 - RNA, 15 nt, Homo sapiens
gcuaauuuguguauu

SEQ ID NO: 833864 - RNA, 14 nt, Homo sapiens
gcuaggaacacucc

SEQ ID NO: 833865 - RNA, 18 nt, Homo sapiens
gcuaggaacacuccuuca

SEQ ID NO: 833866 - RNA, 23 nt, Homo sapiens
gcuaucccuuuccaaaggccaug

SEQ ID NO: 833867 - RNA, 18 nt, Homo sapiens
gcucauguaccucugauu

SEQ ID NO: 833868 - RNA, 18 nt, Homo sapiens
gcucauuucacuuuacac

SEQ ID NO: 833869 - RNA, 14 nt, Homo sapiens
gcucccacagaaca

SEQ ID NO: 833870 - RNA, 19 nt, Homo sapiens
gcucccugguucugaugau

SEQ ID NO: 833871 - RNA, 15 nt, Homo sapiens
gcucucauagcucau

SEQ ID NO: 833872 - RNA, 15 nt, Homo sapiens
gcugaaggguaauau

SEQ ID NO: 833873 - RNA, 20 nt, Homo sapiens
gcugacaccuaacucuucuu

SEQ ID NO: 833874 - RNA, 19 nt, Homo sapiens
gcuggagccuggugcccua

SEQ ID NO: 833875 - RNA, 20 nt, Homo sapiens
gcuggagccuggugcccuaa

SEQ ID NO: 833876 - RNA, 19 nt, Homo sapiens
gcuggagugcaguggcgca

SEQ ID NO: 833877 - RNA, 12 nt, Homo sapiens
gcuggggccaaa

SEQ ID NO: 833878 - RNA, 17 nt, Homo sapiens
gcugguugagguuucaa

SEQ ID NO: 833879 - RNA, 19 nt, Homo sapiens
gcuuaaaauaaaguuaaac

SEQ ID NO: 833880 - RNA, 20 nt, Homo sapiens
gcuuaaaggggcuagaguga

SEQ ID NO: 833881 - RNA, 14 nt, Homo sapiens
gcuuagaacaaagg

SEQ ID NO: 833882 - RNA, 22 nt, Homo sapiens
gcuucucacugccaugccagcu

SEQ ID NO: 833883 - RNA, 22 nt, Homo sapiens
gcuucuccaggguccacaggaa

SEQ ID NO: 833884 - RNA, 21 nt, Homo sapiens
gcuuggcacucaggugcugaa

SEQ ID NO: 833885 - RNA, 18 nt, Homo sapiens
gcuuggcugugcccucag

SEQ ID NO: 833886 - RNA, 13 nt, Homo sapiens
gcuuuccccaugu

SEQ ID NO: 833887 - RNA, 15 nt, Homo sapiens
gcuuugaaaauucag

SEQ ID NO: 833888 - RNA, 16 nt, Homo sapiens
ggaaaauauccauccu

SEQ ID NO: 833889 - RNA, 16 nt, Homo sapiens
ggaaaauggccaugca

SEQ ID NO: 833890 - RNA, 17 nt, Homo sapiens
ggaaacuuaaccaccua

SEQ ID NO: 833891 - RNA, 15 nt, Homo sapiens
ggaaagguaguguau

SEQ ID NO: 833892 - RNA, 20 nt, Homo sapiens
ggaacagauucacacugucu

SEQ ID NO: 833893 - RNA, 22 nt, Homo sapiens
ggaagagcccgcagggccaugc

SEQ ID NO: 833894 - RNA, 13 nt, Homo sapiens
ggaagcugagaug

SEQ ID NO: 833895 - RNA, 21 nt, Homo sapiens
ggaagcuuucugucuccuuaa

SEQ ID NO: 833896 - RNA, 17 nt, Homo sapiens
ggaagguucuacgccag

SEQ ID NO: 833897 - RNA, 16 nt, Homo sapiens
ggaaguccucugggua

SEQ ID NO: 833898 - RNA, 12 nt, Homo sapiens
ggaaugccugag

SEQ ID NO: 833899 - RNA, 16 nt, Homo sapiens
ggacagaagcagcucu

SEQ ID NO: 833900 - RNA, 15 nt, Homo sapiens
ggacaugaaacucca

SEQ ID NO: 833901 - RNA, 19 nt, Homo sapiens
ggacauggccccugugagu

SEQ ID NO: 833902 - RNA, 18 nt, Homo sapiens
ggacuugggcgggacaca

SEQ ID NO: 833903 - RNA, 20 nt, Homo sapiens
ggacuuuuauuuccagugaa

SEQ ID NO: 833904 - RNA, 14 nt, Homo sapiens
ggagaggggacgca

SEQ ID NO: 833905 - RNA, 13 nt, Homo sapiens
ggagaggggcaca

SEQ ID NO: 833906 - RNA, 19 nt, Homo sapiens
ggagauuugcucaauaccu

SEQ ID NO: 833907 - RNA, 23 nt, Homo sapiens
ggagcaaaggcugagaacacugu

SEQ ID NO: 833908 - RNA, 12 nt, Homo sapiens
ggagcucagaga

SEQ ID NO: 833909 - RNA, 17 nt, Homo sapiens
ggaggauguucgucuca

SEQ ID NO: 833910 - RNA, 14 nt, Homo sapiens
ggaguacaggugaa

SEQ ID NO: 833911 - RNA, 22 nt, Homo sapiens
ggagugggcccaaugcacuuug

SEQ ID NO: 833912 - RNA, 15 nt, Homo sapiens
ggaucccucucugga

SEQ ID NO: 833913 - RNA, 24 nt, Homo sapiens
ggauccuccaggugcacaagcucc

SEQ ID NO: 833914 - RNA, 19 nt, Homo sapiens
ggaugcugacaucauuugu

SEQ ID NO: 833915 - RNA, 20 nt, Homo sapiens
auagacccacaagaggcagu

SEQ ID NO: 833916 - RNA, 14 nt, Homo sapiens
auaggcccagugag

SEQ ID NO: 833917 - RNA, 16 nt, Homo sapiens
auaguucccuagucua

SEQ ID NO: 833918 - RNA, 20 nt, Homo sapiens
auaguucccuagucuauuca

SEQ ID NO: 833919 - RNA, 21 nt, Homo sapiens
auaguucccuagucuauucau

SEQ ID NO: 833920 - RNA, 13 nt, Homo sapiens
auauauacuauau

SEQ ID NO: 833921 - RNA, 20 nt, Homo sapiens
auaugcaauguauagugucu

SEQ ID NO: 833922 - RNA, 15 nt, Homo sapiens
auaugggcacuuuaa

SEQ ID NO: 833923 - RNA, 19 nt, Homo sapiens
auauuuuauuauagucacu

SEQ ID NO: 833924 - RNA, 23 nt, Homo sapiens
aucaaauggaagacacauugaaa

SEQ ID NO: 833925 - RNA, 13 nt, Homo sapiens
aucacacaacuca

SEQ ID NO: 833926 - RNA, 18 nt, Homo sapiens
aucacaguuuugguugcu

SEQ ID NO: 833927 - RNA, 11 nt, Homo sapiens
aucaccagaca

SEQ ID NO: 833928 - RNA, 18 nt, Homo sapiens
aucaggaggccaggccac

SEQ ID NO: 833929 - RNA, 18 nt, Homo sapiens
aucagugcccuccaggau

SEQ ID NO: 833930 - RNA, 15 nt, Homo sapiens
aucaguuacucuuca

SEQ ID NO: 833931 - RNA, 17 nt, Homo sapiens
aucauacuuaacuuuac

SEQ ID NO: 833932 - RNA, 16 nt, Homo sapiens
aucaucacaaauggcu

SEQ ID NO: 833933 - RNA, 16 nt, Homo sapiens
aucccuuaccucggug

SEQ ID NO: 833934 - RNA, 15 nt, Homo sapiens
auccuagcacuuugg

SEQ ID NO: 833935 - RNA, 18 nt, Homo sapiens
auccuguuucuugcucug

SEQ ID NO: 833936 - RNA, 24 nt, Homo sapiens
auccuuggaaauuggaagagcaca

SEQ ID NO: 833937 - RNA, 14 nt, Homo sapiens
aucucaauucuucc

SEQ ID NO: 833938 - RNA, 16 nt, Homo sapiens
aucucacaagcacuuu

SEQ ID NO: 833939 - RNA, 14 nt, Homo sapiens
aucucacagcauuu

SEQ ID NO: 833940 - RNA, 16 nt, Homo sapiens
aucucacuaccuuauu

SEQ ID NO: 833941 - RNA, 19 nt, Homo sapiens
aucugacaucucugcaauc

SEQ ID NO: 833942 - RNA, 13 nt, Homo sapiens
aucugcaaugugg

SEQ ID NO: 833943 - RNA, 19 nt, Homo sapiens
aucuuacaaaaacaagaca

SEQ ID NO: 833944 - RNA, 12 nt, Homo sapiens
aucuuuggacag

SEQ ID NO: 833945 - RNA, 20 nt, Homo sapiens
aucuuuggacagaagcagcu

SEQ ID NO: 833946 - RNA, 21 nt, Homo sapiens
aucuuuggacagaagcagcuc

SEQ ID NO: 833947 - RNA, 18 nt, Homo sapiens
augaagguggaacaagca

SEQ ID NO: 833948 - RNA, 19 nt, Homo sapiens
augacaucagcaauacaga

SEQ ID NO: 833949 - RNA, 17 nt, Homo sapiens
augacauucaugccugg

SEQ ID NO: 833950 - RNA, 20 nt, Homo sapiens
augagccuggcaagaaugug

SEQ ID NO: 833951 - RNA, 14 nt, Homo sapiens
augaucaguaugaa

SEQ ID NO: 833952 - RNA, 21 nt, Homo sapiens
augauguauguugaagccuuu

SEQ ID NO: 833953 - RNA, 21 nt, Homo sapiens
augcaaauaacaaaugccaaa

SEQ ID NO: 833954 - RNA, 18 nt, Homo sapiens
augccaaccggucaccca

SEQ ID NO: 833955 - RNA, 21 nt, Homo sapiens
augccaaccggucacccagga

SEQ ID NO: 833956 - RNA, 17 nt, Homo sapiens
augccaagcacugugcu

SEQ ID NO: 833957 - RNA, 18 nt, Homo sapiens
augccaagcacugugcuc

SEQ ID NO: 833958 - RNA, 21 nt, Homo sapiens
augcugauguccucaccacau

SEQ ID NO: 833959 - RNA, 17 nt, Homo sapiens
augcugugcaaauguua

SEQ ID NO: 833960 - RNA, 20 nt, Homo sapiens
augcuuuaaacauugguucu

SEQ ID NO: 833961 - RNA, 17 nt, Homo sapiens
auggaaauucccuucau

SEQ ID NO: 833962 - RNA, 13 nt, Homo sapiens
auggaagugucug

SEQ ID NO: 833963 - RNA, 13 nt, Homo sapiens
auggcgucugcuc

SEQ ID NO: 833964 - RNA, 20 nt, Homo sapiens
auggguuagggaaaacauuc

SEQ ID NO: 833965 - RNA, 23 nt, Homo sapiens
auggguuagggaaaacauuccau

SEQ ID NO: 833966 - RNA, 20 nt, Homo sapiens
auguaacaacaauuauuuga

SEQ ID NO: 833967 - RNA, 16 nt, Homo sapiens
auguauguaaauagcu

SEQ ID NO: 833968 - RNA, 15 nt, Homo sapiens
augucacagauuccu

SEQ ID NO: 833969 - RNA, 22 nt, Homo sapiens
auguccaagaagcccaggaaag

SEQ ID NO: 833970 - RNA, 23 nt, Homo sapiens
augucucacgucucccuaaaaau

SEQ ID NO: 833971 - RNA, 18 nt, Homo sapiens
augucuucuguauucacu

SEQ ID NO: 833972 - RNA, 19 nt, Homo sapiens
augucuucuguauucacuu

SEQ ID NO: 833973 - RNA, 18 nt, Homo sapiens
augugugaaaacugguua

SEQ ID NO: 833974 - RNA, 17 nt, Homo sapiens
auuagaauuucauauga

SEQ ID NO: 833975 - RNA, 14 nt, Homo sapiens
auuauauucauucu

SEQ ID NO: 833976 - RNA, 19 nt, Homo sapiens
acacugggugcgucuccag

SEQ ID NO: 833977 - RNA, 21 nt, Homo sapiens
acagaggaugcugacaucauu

SEQ ID NO: 833978 - RNA, 21 nt, Homo sapiens
acagauuccuggcagagccau

SEQ ID NO: 833979 - RNA, 15 nt, Homo sapiens
acagcauuugccaag

SEQ ID NO: 833980 - RNA, 18 nt, Homo sapiens
acagccucugaaaaccaa

SEQ ID NO: 833981 - RNA, 19 nt, Homo sapiens
acagcuaacacacagcucc

SEQ ID NO: 833982 - RNA, 22 nt, Homo sapiens
acagcugugucugccaaacaca

SEQ ID NO: 833983 - RNA, 15 nt, Homo sapiens
acaggacagcgggaa

SEQ ID NO: 833984 - RNA, 19 nt, Homo sapiens
acagucaccccaggacuca

SEQ ID NO: 833985 - RNA, 23 nt, Homo sapiens
acagucaugguggccacggccac

SEQ ID NO: 833986 - RNA, 15 nt, Homo sapiens
acaguccucccaucu

SEQ ID NO: 833987 - RNA, 11 nt, Homo sapiens
acagugacauu

SEQ ID NO: 833988 - RNA, 15 nt, Homo sapiens
acaguuuggaagugu

SEQ ID NO: 833989 - RNA, 17 nt, Homo sapiens
acauaaggaaacugggu

SEQ ID NO: 833990 - RNA, 14 nt, Homo sapiens
acauacucccaucu

SEQ ID NO: 833991 - RNA, 16 nt, Homo sapiens
acaucuuggcacauuu

SEQ ID NO: 833992 - RNA, 20 nt, Homo sapiens
acaugauaccucugaucaag

SEQ ID NO: 833993 - RNA, 14 nt, Homo sapiens
acaugccaagcacu

SEQ ID NO: 833994 - RNA, 18 nt, Homo sapiens
acaugcugaagccaaagc

SEQ ID NO: 833995 - RNA, 13 nt, Homo sapiens
acauuaucucacu

SEQ ID NO: 833996 - RNA, 14 nt, Homo sapiens
acauucaucaagcu

SEQ ID NO: 833997 - RNA, 17 nt, Homo sapiens
acauuccugaugcuucu

SEQ ID NO: 833998 - RNA, 14 nt, Homo sapiens
acauugauucaugu

SEQ ID NO: 833999 - RNA, 15 nt, Homo sapiens
acauuuaagagacag

SEQ ID NO: 834000 - RNA, 14 nt, Homo sapiens
acauuuacugugga

SEQ ID NO: 834001 - RNA, 16 nt, Homo sapiens
acauuuauuuuucuca

SEQ ID NO: 834002 - RNA, 22 nt, Homo sapiens
acauuuauuuuucucaugaauc

SEQ ID NO: 834003 - RNA, 20 nt, Homo sapiens
accaaacccggccugauuaa

SEQ ID NO: 834004 - RNA, 11 nt, Homo sapiens
accaaccuggg

SEQ ID NO: 834005 - RNA, 16 nt, Homo sapiens
accacaaaacuuuucu

SEQ ID NO: 834006 - RNA, 13 nt, Homo sapiens
accacaugccaag

SEQ ID NO: 834007 - RNA, 19 nt, Homo sapiens
accaccacccuugccaugg

SEQ ID NO: 834008 - RNA, 20 nt, Homo sapiens
accacgugagaucauucacu

SEQ ID NO: 834009 - RNA, 14 nt, Homo sapiens
accacuucagcuga

SEQ ID NO: 834010 - RNA, 18 nt, Homo sapiens
accaggcaaagcaaguga

SEQ ID NO: 834011 - RNA, 14 nt, Homo sapiens
accaucaagccacc

SEQ ID NO: 834012 - RNA, 24 nt, Homo sapiens
accaugauuaaccacuucagcuga

SEQ ID NO: 834013 - RNA, 13 nt, Homo sapiens
accauuacuguaa

SEQ ID NO: 834014 - RNA, 10 nt, Homo sapiens
acccaagggc

SEQ ID NO: 834015 - RNA, 19 nt, Homo sapiens
acccaauauuuaccagacc

SEQ ID NO: 834016 - RNA, 12 nt, Homo sapiens
acccaggaugau

SEQ ID NO: 834017 - RNA, 23 nt, Homo sapiens
acccaggcuauucggcaaggaag

SEQ ID NO: 834018 - RNA, 16 nt, Homo sapiens
acccaguuagcucuca

SEQ ID NO: 834019 - RNA, 15 nt, Homo sapiens
accccaagcaggaac

SEQ ID NO: 834020 - RNA, 20 nt, Homo sapiens
accccagacgaugucuucau

SEQ ID NO: 834021 - RNA, 17 nt, Homo sapiens
accccgcugauggagcc

SEQ ID NO: 834022 - RNA, 14 nt, Homo sapiens
acccucaugcugug

SEQ ID NO: 834023 - RNA, 15 nt, Homo sapiens
acccuccccacagug

SEQ ID NO: 834024 - RNA, 18 nt, Homo sapiens
acccuccccacagugcca

SEQ ID NO: 834025 - RNA, 22 nt, Homo sapiens
acccucugggucucaguguccu

SEQ ID NO: 834026 - RNA, 19 nt, Homo sapiens
acccucuuagaaaaaccac

SEQ ID NO: 834027 - RNA, 16 nt, Homo sapiens
acccugccucuaccca

SEQ ID NO: 834028 - RNA, 22 nt, Homo sapiens
acccuucugcuguauacuguac

SEQ ID NO: 834029 - RNA, 13 nt, Homo sapiens
acccuugccaugg

SEQ ID NO: 834030 - RNA, 21 nt, Homo sapiens
acccuuuggccccacuuugaa

SEQ ID NO: 834031 - RNA, 23 nt, Homo sapiens
accguucauucaggcaacgcaca

SEQ ID NO: 834032 - RNA, 17 nt, Homo sapiens
accuaagucucugugaa

SEQ ID NO: 834033 - RNA, 19 nt, Homo sapiens
accuaagucucugugaauu

SEQ ID NO: 834034 - RNA, 13 nt, Homo sapiens
accuacccaugac

SEQ ID NO: 834035 - RNA, 14 nt, Homo sapiens
accuacccaugacc

SEQ ID NO: 834036 - RNA, 14 nt, Homo sapiens
accuacuagacaau

SEQ ID NO: 834037 - RNA, 21 nt, Homo sapiens
accucaccccacuguggcuga

SEQ ID NO: 834038 - RNA, 19 nt, Homo sapiens
accucagcuuugauauuuc

SEQ ID NO: 834039 - RNA, 20 nt, Homo sapiens
accucaggugagaagcagag

SEQ ID NO: 834040 - RNA, 14 nt, Homo sapiens
accuccugucucug

SEQ ID NO: 834041 - RNA, 13 nt, Homo sapiens
accugaagacacc

SEQ ID NO: 834042 - RNA, 22 nt, Homo sapiens
accuuauagguuacucauaagg

SEQ ID NO: 834043 - RNA, 19 nt, Homo sapiens
accuugaagaaccucucac

SEQ ID NO: 834044 - RNA, 21 nt, Homo sapiens
uaagcacuuuaacacaguguc

SEQ ID NO: 834045 - RNA, 14 nt, Homo sapiens
uaaggaaacugggu

SEQ ID NO: 834046 - RNA, 15 nt, Homo sapiens
uaaggcugaacuugu

SEQ ID NO: 834047 - RNA, 15 nt, Homo sapiens
uaaguguucucauga

SEQ ID NO: 834048 - RNA, 19 nt, Homo sapiens
uaaguuucacagcacuuac

SEQ ID NO: 834049 - RNA, 15 nt, Homo sapiens
uaauagaaacauuga

SEQ ID NO: 834050 - RNA, 16 nt, Homo sapiens
uaauagaaacauugaa

SEQ ID NO: 834051 - RNA, 15 nt, Homo sapiens
uaauagaauucuguu

SEQ ID NO: 834052 - RNA, 15 nt, Homo sapiens
uaauauggacucagc

SEQ ID NO: 834053 - RNA, 13 nt, Homo sapiens
uaaucaacugggc

SEQ ID NO: 834054 - RNA, 18 nt, Homo sapiens
uaaucucacagcauuugc

SEQ ID NO: 834055 - RNA, 21 nt, Homo sapiens
uaaucucacagcauuugccaa

SEQ ID NO: 834056 - RNA, 21 nt, Homo sapiens
uacagcuggguggcacugcca

SEQ ID NO: 834057 - RNA, 19 nt, Homo sapiens
uacaguuugucacaugaaa

SEQ ID NO: 834058 - RNA, 15 nt, Homo sapiens
uacauaaaguaugug

SEQ ID NO: 834059 - RNA, 20 nt, Homo sapiens
uacauaaaguaugugcauau

SEQ ID NO: 834060 - RNA, 16 nt, Homo sapiens
uacaucuccaaauauc

SEQ ID NO: 834061 - RNA, 19 nt, Homo sapiens
uacauugauucaugucuca

SEQ ID NO: 834062 - RNA, 16 nt, Homo sapiens
uacauuugugcuccau

SEQ ID NO: 834063 - RNA, 18 nt, Homo sapiens
uaccacaugccaagcacu

SEQ ID NO: 834064 - RNA, 21 nt, Homo sapiens
uacccuuuggccccacuuuga

SEQ ID NO: 834065 - RNA, 15 nt, Homo sapiens
uaccuaauuguggau

SEQ ID NO: 834066 - RNA, 16 nt, Homo sapiens
uacucaaaaauuugcu

SEQ ID NO: 834067 - RNA, 23 nt, Homo sapiens
uacucccaucugugaaaggaaag

SEQ ID NO: 834068 - RNA, 14 nt, Homo sapiens
uacuuuuuacauac

SEQ ID NO: 834069 - RNA, 19 nt, Homo sapiens
uagaaacauugaagaugaa

SEQ ID NO: 834070 - RNA, 14 nt, Homo sapiens
uagaaauuccccac

SEQ ID NO: 834071 - RNA, 19 nt, Homo sapiens
uagaacagugcuugccaca

SEQ ID NO: 834072 - RNA, 19 nt, Homo sapiens
uagaaccaccaacaagcaa

SEQ ID NO: 834073 - RNA, 21 nt, Homo sapiens
uagaaggcacaauaugggcac

SEQ ID NO: 834074 - RNA, 23 nt, Homo sapiens
uagacaacauggccgugaacuuu

SEQ ID NO: 834075 - RNA, 12 nt, Homo sapiens
uagacugugauu

SEQ ID NO: 834076 - RNA, 15 nt, Homo sapiens
uagacuuuucccaag

SEQ ID NO: 834077 - RNA, 20 nt, Homo sapiens
uagagcaggcguucagcuca

SEQ ID NO: 834078 - RNA, 23 nt, Homo sapiens
uagauuuuagacccuauugcugc

SEQ ID NO: 834079 - RNA, 14 nt, Homo sapiens
uagccagcuguguu

SEQ ID NO: 834080 - RNA, 17 nt, Homo sapiens
uagcuuagcaucagagg

SEQ ID NO: 834081 - RNA, 15 nt, Homo sapiens
uaggaagacuuugga

SEQ ID NO: 834082 - RNA, 15 nt, Homo sapiens
uaggcaggacaugcu

SEQ ID NO: 834083 - RNA, 14 nt, Homo sapiens
uaggcauuugcuga

SEQ ID NO: 834084 - RNA, 15 nt, Homo sapiens
uaggcauuugcugaa

SEQ ID NO: 834085 - RNA, 17 nt, Homo sapiens
uagggaaaacauuccau

SEQ ID NO: 834086 - RNA, 13 nt, Homo sapiens
uaguaauucucag

SEQ ID NO: 834087 - RNA, 18 nt, Homo sapiens
uagugucuauuaucacau

SEQ ID NO: 834088 - RNA, 17 nt, Homo sapiens
uagugucugaugaaugu

SEQ ID NO: 834089 - RNA, 22 nt, Homo sapiens
uaguuacuaaacauguauguaa

SEQ ID NO: 834090 - RNA, 15 nt, Homo sapiens
uaguuuuuaaucucu

SEQ ID NO: 834091 - RNA, 22 nt, Homo sapiens
uauauuuuuguacugaaucuca

SEQ ID NO: 834092 - RNA, 16 nt, Homo sapiens
uaucaaguguauuuga

SEQ ID NO: 834093 - RNA, 15 nt, Homo sapiens
uaucagcuacaauug

SEQ ID NO: 834094 - RNA, 15 nt, Homo sapiens
uaucaggguauucca

SEQ ID NO: 834095 - RNA, 13 nt, Homo sapiens
uaucaguccaaag

SEQ ID NO: 834096 - RNA, 15 nt, Homo sapiens
uaugcuuuacugcga

SEQ ID NO: 834097 - RNA, 14 nt, Homo sapiens
uauguaaauagcua

SEQ ID NO: 834098 - RNA, 21 nt, Homo sapiens
uauguaaauagcuaagauaua

SEQ ID NO: 834099 - RNA, 21 nt, Homo sapiens
uauguauugugcaauguguau

SEQ ID NO: 834100 - RNA, 14 nt, Homo sapiens
uauuagaauuucau

SEQ ID NO: 834101 - RNA, 21 nt, Homo sapiens
uauuccuguuucugaaccauu

SEQ ID NO: 834102 - RNA, 21 nt, Homo sapiens
uauugcucacccagugcccuc

SEQ ID NO: 834103 - RNA, 14 nt, Homo sapiens
uauuuauucccugu

SEQ ID NO: 834104 - RNA, 18 nt, Homo sapiens
uauuuuaaguaucagagg

SEQ ID NO: 834105 - RNA, 12 nt, Homo sapiens
ucaaaugggcug

SEQ ID NO: 834106 - RNA, 18 nt, Homo sapiens
ucaaaugggcugcugcuu

SEQ ID NO: 834107 - RNA, 18 nt, Homo sapiens
ucaacccauuguugucaa

SEQ ID NO: 834108 - RNA, 20 nt, Homo sapiens
ucaagcagccaagggaugaa

SEQ ID NO: 834109 - RNA, 18 nt, Homo sapiens
ucaagcaguagacaagca

SEQ ID NO: 834110 - RNA, 18 nt, Homo sapiens
ucaaggaauaaugggcuu

SEQ ID NO: 834111 - RNA, 23 nt, Homo sapiens
ucaaguacuguaacugugucaug

SEQ ID NO: 834112 - RNA, 21 nt, Homo sapiens
ucaaguauuuuugacauuuac

SEQ ID NO: 834113 - RNA, 22 nt, Homo sapiens
ucaauccaagagucugaugauu

SEQ ID NO: 834114 - RNA, 15 nt, Homo sapiens
ucaaucucucuuaga

SEQ ID NO: 834115 - RNA, 20 nt, Homo sapiens
ucaauguuuagcagauuuaa

SEQ ID NO: 834116 - RNA, 14 nt, Homo sapiens
ucacaaacuacaaa

SEQ ID NO: 834117 - RNA, 18 nt, Homo sapiens
ucacacgggggcagcuga

SEQ ID NO: 834118 - RNA, 21 nt, Homo sapiens
ucacaguuuugguugcuuuaa

SEQ ID NO: 834119 - RNA, 14 nt, Homo sapiens
ucaccaucugugca

SEQ ID NO: 834120 - RNA, 13 nt, Homo sapiens
ucacccaucucuc

SEQ ID NO: 834121 - RNA, 22 nt, Homo sapiens
ucaccuggggcugcuggccuga

SEQ ID NO: 834122 - RNA, 20 nt, Homo sapiens
ucacuggguucccauucuga

SEQ ID NO: 834123 - RNA, 14 nt, Homo sapiens
ucagaacaaaguga

SEQ ID NO: 834124 - RNA, 19 nt, Homo sapiens
ucagacagcugccugggau

SEQ ID NO: 834125 - RNA, 19 nt, Homo sapiens
ucagcaaaagaugcuucuc

SEQ ID NO: 834126 - RNA, 18 nt, Homo sapiens
ucagccuggcugauuauc

SEQ ID NO: 834127 - RNA, 16 nt, Homo sapiens
ucagccuugcaaauag

SEQ ID NO: 834128 - RNA, 16 nt, Homo sapiens
ucaggaagcucagggc

SEQ ID NO: 834129 - RNA, 16 nt, Homo sapiens
ucaggagaaaaagccu

SEQ ID NO: 834130 - RNA, 15 nt, Homo sapiens
ucaggagcagccuca

SEQ ID NO: 834131 - RNA, 20 nt, Homo sapiens
ucaggccaucaucaguggag

SEQ ID NO: 834132 - RNA, 15 nt, Homo sapiens
ucagugggcucucuu

SEQ ID NO: 834133 - RNA, 23 nt, Homo sapiens
ucaguuguuauuuauugaaauga

SEQ ID NO: 834134 - RNA, 17 nt, Homo sapiens
ucauaaggcauauacaa

SEQ ID NO: 834135 - RNA, 16 nt, Homo sapiens
ucauacucaccucacc

SEQ ID NO: 834136 - RNA, 19 nt, Homo sapiens
ucauacucaccucacccca

SEQ ID NO: 834137 - RNA, 20 nt, Homo sapiens
ucaucaaauggaagacacau

SEQ ID NO: 834138 - RNA, 23 nt, Homo sapiens
ucaucacaaauggcuacaucucc

SEQ ID NO: 834139 - RNA, 16 nt, Homo sapiens
ucaucacacaacucag

SEQ ID NO: 834140 - RNA, 16 nt, Homo sapiens
ucaucauuuaucauca

SEQ ID NO: 834141 - RNA, 18 nt, Homo sapiens
ucaucauuuaucaucaca

SEQ ID NO: 834142 - RNA, 13 nt, Homo sapiens
ucauccauuugcg

SEQ ID NO: 834143 - RNA, 13 nt, Homo sapiens
ucaucucaaggaa

SEQ ID NO: 834144 - RNA, 18 nt, Homo sapiens
ucaugcugugugacucaa

SEQ ID NO: 834145 - RNA, 13 nt, Homo sapiens
ucauucaguacuu

SEQ ID NO: 834146 - RNA, 19 nt, Homo sapiens
ucauuggaaauuuagcauu

SEQ ID NO: 834147 - RNA, 12 nt, Homo sapiens
ucauuucacuuu

SEQ ID NO: 834148 - RNA, 22 nt, Homo sapiens
ucauuucacuuuacacgcucau

SEQ ID NO: 834149 - RNA, 20 nt, Homo sapiens
ucauuucuucuacaacucau

SEQ ID NO: 834150 - RNA, 16 nt, Homo sapiens
uccaaaugcccagcuu

SEQ ID NO: 834151 - RNA, 16 nt, Homo sapiens
uccaacacugcugcuc

SEQ ID NO: 834152 - RNA, 24 nt, Homo sapiens
uccaauuaaggauuuuaugcuuua

SEQ ID NO: 834153 - RNA, 15 nt, Homo sapiens
uccaccugccaggga

SEQ ID NO: 834154 - RNA, 16 nt, Homo sapiens
uccaggauagacuuuu

SEQ ID NO: 834155 - RNA, 12 nt, Homo sapiens
uccaggggccac

SEQ ID NO: 834156 - RNA, 15 nt, Homo sapiens
uccaguccaaggaaa

SEQ ID NO: 834157 - RNA, 11 nt, Homo sapiens
uccagugcagg

SEQ ID NO: 834158 - RNA, 21 nt, Homo sapiens
uccaucaguuagagcugacac

SEQ ID NO: 834159 - RNA, 16 nt, Homo sapiens
uccaugauguuuucca

SEQ ID NO: 834160 - RNA, 21 nt, Homo sapiens
uccaugugagaauauuuuucc

SEQ ID NO: 834161 - RNA, 17 nt, Homo sapiens
ucccaaaagcccauuca

SEQ ID NO: 834162 - RNA, 16 nt, Homo sapiens
ucccaaagugcuggga

SEQ ID NO: 834163 - RNA, 15 nt, Homo sapiens
ucccaacucacccca

SEQ ID NO: 834164 - RNA, 14 nt, Homo sapiens
ucccaauauccaau

SEQ ID NO: 834165 - RNA, 16 nt, Homo sapiens
ucccaggcuucccaaa

SEQ ID NO: 834166 - RNA, 9 nt, Homo sapiens
ucccagugc

SEQ ID NO: 834167 - RNA, 12 nt, Homo sapiens
aaaaaaacguau

SEQ ID NO: 834168 - RNA, 13 nt, Homo sapiens
aaaaacucacuua

SEQ ID NO: 834169 - RNA, 23 nt, Homo sapiens
aaaaaugcguaagaccaagcugu

SEQ ID NO: 834170 - RNA, 11 nt, Homo sapiens
aaaacauucca

SEQ ID NO: 834171 - RNA, 24 nt, Homo sapiens
aaaaccaauguucucucuucucca

SEQ ID NO: 834172 - RNA, 23 nt, Homo sapiens
aaaaccaccaccaucaccagaca

SEQ ID NO: 834173 - RNA, 17 nt, Homo sapiens
aaaaccagcgugugacu

SEQ ID NO: 834174 - RNA, 18 nt, Homo sapiens
aaaacuuuucuaauacuc

SEQ ID NO: 834175 - RNA, 23 nt, Homo sapiens
aaaacuuuucuaauacucuaccc

SEQ ID NO: 834176 - RNA, 19 nt, Homo sapiens
aaaagcccauucauuccau

SEQ ID NO: 834177 - RNA, 18 nt, Homo sapiens
aaaaggaaggcucuucuc

SEQ ID NO: 834178 - RNA, 19 nt, Homo sapiens
aaaauaugaccacacucca

SEQ ID NO: 834179 - RNA, 21 nt, Homo sapiens
aaacacacgagcaaacccaga

SEQ ID NO: 834180 - RNA, 19 nt, Homo sapiens
aaacacccucacacuggga

SEQ ID NO: 834181 - RNA, 18 nt, Homo sapiens
aaacagcucgacuuuaaa

SEQ ID NO: 834182 - RNA, 22 nt, Homo sapiens
aaacaggcaguuggccagagag

SEQ ID NO: 834183 - RNA, 14 nt, Homo sapiens
aaacagugacauuu

SEQ ID NO: 834184 - RNA, 15 nt, Homo sapiens
aaacaugcuuuucca

SEQ ID NO: 834185 - RNA, 14 nt, Homo sapiens
aaacauguauguaa

SEQ ID NO: 834186 - RNA, 14 nt, Homo sapiens
aaacaugugcccuc

SEQ ID NO: 834187 - RNA, 17 nt, Homo sapiens
aaacccggccugauuaa

SEQ ID NO: 834188 - RNA, 19 nt, Homo sapiens
aaauguuguuuuaggaaua

SEQ ID NO: 834189 - RNA, 13 nt, Homo sapiens
aaauugcauuugu

SEQ ID NO: 834190 - RNA, 14 nt, Homo sapiens
aaauuugcuucacu

SEQ ID NO: 834191 - RNA, 16 nt, Homo sapiens
aacaaaagcucaucca

SEQ ID NO: 834192 - RNA, 22 nt, Homo sapiens
aacaacuccuagggccacugaa

SEQ ID NO: 834193 - RNA, 20 nt, Homo sapiens
aacacacgagcaaacccaga

SEQ ID NO: 834194 - RNA, 13 nt, Homo sapiens
aacacagugucug

SEQ ID NO: 834195 - RNA, 19 nt, Homo sapiens
aacacugcaggcaucacag

SEQ ID NO: 834196 - RNA, 13 nt, Homo sapiens
aacacugcugcuc

SEQ ID NO: 834197 - RNA, 21 nt, Homo sapiens
aacacugcugcuccagugcag

SEQ ID NO: 834198 - RNA, 19 nt, Homo sapiens
aacagaggaguacagguga

SEQ ID NO: 834199 - RNA, 21 nt, Homo sapiens
aacaucaucaaggcacugccu

SEQ ID NO: 834200 - RNA, 15 nt, Homo sapiens
aacauucaucaagcu

SEQ ID NO: 834201 - RNA, 16 nt, Homo sapiens
aacauuucaaaaggua

SEQ ID NO: 834202 - RNA, 19 nt, Homo sapiens
aaccacauuucuaagccuu

SEQ ID NO: 834203 - RNA, 13 nt, Homo sapiens
aaccaccuuucag

SEQ ID NO: 834204 - RNA, 19 nt, Homo sapiens
aaccagaaacaccccucug

SEQ ID NO: 834205 - RNA, 15 nt, Homo sapiens
aaccauuacuguaau

SEQ ID NO: 834206 - RNA, 11 nt, Homo sapiens
aacccaaagug

SEQ ID NO: 834207 - RNA, 23 nt, Homo sapiens
aacccaaagugugacucauuaaa

SEQ ID NO: 834208 - RNA, 19 nt, Homo sapiens
aacccagagguggauguua

SEQ ID NO: 834209 - RNA, 20 nt, Homo sapiens
aaccuacuagacaaugaugu

SEQ ID NO: 834210 - RNA, 19 nt, Homo sapiens
aaccuccaccuucuggguu

SEQ ID NO: 834211 - RNA, 13 nt, Homo sapiens
aacuaaaauguuc

SEQ ID NO: 834212 - RNA, 15 nt, Homo sapiens
aacuaaaauguucua

SEQ ID NO: 834213 - RNA, 16 nt, Homo sapiens
aacucaaacucuuaaa

SEQ ID NO: 834214 - RNA, 19 nt, Homo sapiens
aacucagugugacuccuca

SEQ ID NO: 834215 - RNA, 16 nt, Homo sapiens
aacucuaccugcacac

SEQ ID NO: 834216 - RNA, 21 nt, Homo sapiens
aacugaaggggugcacccacc

SEQ ID NO: 834217 - RNA, 18 nt, Homo sapiens
aacuuguauuaaagacag

SEQ ID NO: 834218 - RNA, 15 nt, Homo sapiens
aacuuuauucaagua

SEQ ID NO: 834219 - RNA, 20 nt, Homo sapiens
aacuuuuaauuaaaugcuca

SEQ ID NO: 834220 - RNA, 13 nt, Homo sapiens
aacuuuugugcuc

SEQ ID NO: 834221 - RNA, 16 nt, Homo sapiens
aacuuuugugcucccc

SEQ ID NO: 834222 - RNA, 19 nt, Homo sapiens
aagaaaucuuucucccuca

SEQ ID NO: 834223 - RNA, 22 nt, Homo sapiens
aagaagcccaggaaaggcucca

SEQ ID NO: 834224 - RNA, 15 nt, Homo sapiens
aagaagcucucuccu

SEQ ID NO: 834225 - RNA, 15 nt, Homo sapiens
aagaauuuaucucuu

SEQ ID NO: 834226 - RNA, 21 nt, Homo sapiens
aagaauuuaucucuuuaguua

SEQ ID NO: 834227 - RNA, 17 nt, Homo sapiens
aagacaccguucauuca

SEQ ID NO: 834228 - RNA, 20 nt, Homo sapiens
aagacccuuguggucccacc

SEQ ID NO: 834229 - RNA, 19 nt, Homo sapiens
aagagaaaaaauauuuucc

SEQ ID NO: 834230 - RNA, 23 nt, Homo sapiens
aagagagucgcaucucagugcag

SEQ ID NO: 834231 - RNA, 17 nt, Homo sapiens
aagagcacacuuggccc

SEQ ID NO: 834232 - RNA, 15 nt, Homo sapiens
aagaguaacagucau

SEQ ID NO: 834233 - RNA, 11 nt, Homo sapiens
aagaucuuuca

SEQ ID NO: 834234 - RNA, 22 nt, Homo sapiens
aagaugcuucucacugccaugc

SEQ ID NO: 834235 - RNA, 16 nt, Homo sapiens
aagauucuauguuaau

SEQ ID NO: 834236 - RNA, 21 nt, Homo sapiens
aagcacucgugugcaacagac

SEQ ID NO: 834237 - RNA, 11 nt, Homo sapiens
aagcacugugc

SEQ ID NO: 834238 - RNA, 21 nt, Homo sapiens
aagcacuuuaacacagugucu

SEQ ID NO: 834239 - RNA, 23 nt, Homo sapiens
aagcauuuuauaaaucgcuuuug

SEQ ID NO: 834240 - RNA, 16 nt, Homo sapiens
aagccaaagccaauaa

SEQ ID NO: 834241 - RNA, 16 nt, Homo sapiens
aagccaggauuguguu

SEQ ID NO: 834242 - RNA, 17 nt, Homo sapiens
aagcccauucauuccau

SEQ ID NO: 834243 - RNA, 15 nt, Homo sapiens
aagccgugauuuuca

SEQ ID NO: 834244 - RNA, 18 nt, Homo sapiens
aagcucaggaccaggcaa

SEQ ID NO: 834245 - RNA, 17 nt, Homo sapiens
aagcugccgguucuuaa

SEQ ID NO: 834246 - RNA, 21 nt, Homo sapiens
aagcugugcccugaccacccu

SEQ ID NO: 834247 - RNA, 12 nt, Homo sapiens
aaggaaacuggg

SEQ ID NO: 834248 - RNA, 18 nt, Homo sapiens
aaggaaacuggguuccug

SEQ ID NO: 834249 - RNA, 21 nt, Homo sapiens
aaggaaacuggguuccugcaa

SEQ ID NO: 834250 - RNA, 15 nt, Homo sapiens
aaggacacagaugaa

SEQ ID NO: 834251 - RNA, 21 nt, Homo sapiens
aaggaucuuaggcaugacugu

SEQ ID NO: 834252 - RNA, 19 nt, Homo sapiens
aaggauuuuaugcuuuaaa

SEQ ID NO: 834253 - RNA, 14 nt, Homo sapiens
aaggcaaaugccca

SEQ ID NO: 834254 - RNA, 12 nt, Homo sapiens
aaggcacaugcc

SEQ ID NO: 834255 - RNA, 22 nt, Homo sapiens
aaggcuugaaguaaccuuauag

SEQ ID NO: 834256 - RNA, 13 nt, Homo sapiens
aagggcauggguc

SEQ ID NO: 834257 - RNA, 16 nt, Homo sapiens
aagguaguguaucauu

SEQ ID NO: 834258 - RNA, 16 nt, Homo sapiens
ucccaucucacacaug

SEQ ID NO: 834259 - RNA, 20 nt, Homo sapiens
ucccaucuugauaagaccac

SEQ ID NO: 834260 - RNA, 17 nt, Homo sapiens
ucccccagcagccuggg

SEQ ID NO: 834261 - RNA, 14 nt, Homo sapiens
ucccccuuccaugg

SEQ ID NO: 834262 - RNA, 18 nt, Homo sapiens
ucccuagucuauucauua

SEQ ID NO: 834263 - RNA, 15 nt, Homo sapiens
ucccucaucaaggac

SEQ ID NO: 834264 - RNA, 17 nt, Homo sapiens
ucccuucaugcauggaa

SEQ ID NO: 834265 - RNA, 13 nt, Homo sapiens
uccgggaucaaag

SEQ ID NO: 834266 - RNA, 19 nt, Homo sapiens
uccuaaccuuccuguaaac

SEQ ID NO: 834267 - RNA, 20 nt, Homo sapiens
uccuagcgcagccaugugau

SEQ ID NO: 834268 - RNA, 16 nt, Homo sapiens
uccucaguaacauuuc

SEQ ID NO: 834269 - RNA, 12 nt, Homo sapiens
uccuccaggugc

SEQ ID NO: 834270 - RNA, 18 nt, Homo sapiens
uccuggaucucccugaga

SEQ ID NO: 834271 - RNA, 23 nt, Homo sapiens
uccuggcaaagaugaucaguaug

SEQ ID NO: 834272 - RNA, 24 nt, Homo sapiens
uccuguuucugaaccauuacugua

SEQ ID NO: 834273 - RNA, 22 nt, Homo sapiens
uccuuaccagcagagcaccuua

SEQ ID NO: 834274 - RNA, 19 nt, Homo sapiens
uccuugagagaccaggcaa

SEQ ID NO: 834275 - RNA, 14 nt, Homo sapiens
uccuuuuucacuuu

SEQ ID NO: 834276 - RNA, 19 nt, Homo sapiens
ucgcaucucagugcaggag

SEQ ID NO: 834277 - RNA, 16 nt, Homo sapiens
ucggggacacaggcca

SEQ ID NO: 834278 - RNA, 14 nt, Homo sapiens
ucuaacgcaaaaau

SEQ ID NO: 834279 - RNA, 13 nt, Homo sapiens
ucuaagccuuuga

SEQ ID NO: 834280 - RNA, 14 nt, Homo sapiens
ucuacgccagggga

SEQ ID NO: 834281 - RNA, 16 nt, Homo sapiens
ucuagggaaaaaccag

SEQ ID NO: 834282 - RNA, 18 nt, Homo sapiens
ucuauauaaccacauuuc

SEQ ID NO: 834283 - RNA, 11 nt, Homo sapiens
ucuauguuaau

SEQ ID NO: 834284 - RNA, 18 nt, Homo sapiens
ucucaaguuaucagggua

SEQ ID NO: 834285 - RNA, 22 nt, Homo sapiens
ucucaauguuuagcagauuuaa

SEQ ID NO: 834286 - RNA, 18 nt, Homo sapiens
ucucacacaugagcauca

SEQ ID NO: 834287 - RNA, 15 nt, Homo sapiens
ucucacagcauuugc

SEQ ID NO: 834288 - RNA, 17 nt, Homo sapiens
ucucacagcauuugcca

SEQ ID NO: 834289 - RNA, 12 nt, Homo sapiens
ucucagugcagg

SEQ ID NO: 834290 - RNA, 11 nt, Homo sapiens
ucucagugucc

SEQ ID NO: 834291 - RNA, 17 nt, Homo sapiens
ucucauacucaccucac

SEQ ID NO: 834292 - RNA, 13 nt, Homo sapiens
ucucccugagaug

SEQ ID NO: 834293 - RNA, 11 nt, Homo sapiens
ucucucaggaa

SEQ ID NO: 834294 - RNA, 13 nt, Homo sapiens
ucucucuucucca

SEQ ID NO: 834295 - RNA, 24 nt, Homo sapiens
ucucuuaccagggagauuugcuca

SEQ ID NO: 834296 - RNA, 18 nt, Homo sapiens
ucucuuguccuucacauc

SEQ ID NO: 834297 - RNA, 17 nt, Homo sapiens
ucugaaccauuacugua

SEQ ID NO: 834298 - RNA, 19 nt, Homo sapiens
ucugaggguccacuacuca

SEQ ID NO: 834299 - RNA, 19 nt, Homo sapiens
ucugcauuccugaugacca

SEQ ID NO: 834300 - RNA, 23 nt, Homo sapiens
ucuggcacccuguccgucuccag

SEQ ID NO: 834301 - RNA, 19 nt, Homo sapiens
ucuggcuagugucuaucag

SEQ ID NO: 834302 - RNA, 15 nt, Homo sapiens
ucugucccacuuggc

SEQ ID NO: 834303 - RNA, 21 nt, Homo sapiens
ucuuaaguuuauacucuuaua

SEQ ID NO: 834304 - RNA, 23 nt, Homo sapiens
ucuuaccagggagauuugcucaa

SEQ ID NO: 834305 - RNA, 19 nt, Homo sapiens
ucuuaguaugugcauuuaa

SEQ ID NO: 834306 - RNA, 16 nt, Homo sapiens
ucuucagagcugacac

SEQ ID NO: 834307 - RNA, 13 nt, Homo sapiens
ucuuccccagaua

SEQ ID NO: 834308 - RNA, 14 nt, Homo sapiens
ucuucucuacucua

SEQ ID NO: 834309 - RNA, 12 nt, Homo sapiens
ucuuggugccuc

SEQ ID NO: 834310 - RNA, 13 nt, Homo sapiens
ucuuuggacagaa

SEQ ID NO: 834311 - RNA, 16 nt, Homo sapiens
ugaaacauuugcaaaa

SEQ ID NO: 834312 - RNA, 14 nt, Homo sapiens
ugaaagcuauauca

SEQ ID NO: 834313 - RNA, 21 nt, Homo sapiens
ugaaagcuauaucaaucucuc

SEQ ID NO: 834314 - RNA, 15 nt, Homo sapiens
ugaagccaaagccaa

SEQ ID NO: 834315 - RNA, 17 nt, Homo sapiens
ugaagccccucccugag

SEQ ID NO: 834316 - RNA, 17 nt, Homo sapiens
ugaaggcaaugccaucc

SEQ ID NO: 834317 - RNA, 21 nt, Homo sapiens
ugaaggcaaugccauccucaa

SEQ ID NO: 834318 - RNA, 19 nt, Homo sapiens
ugaagguagaauguuuuca

SEQ ID NO: 834319 - RNA, 16 nt, Homo sapiens
ugaauaauacaguauc

SEQ ID NO: 834320 - RNA, 18 nt, Homo sapiens
ugacgcuugugacagugc

SEQ ID NO: 834321 - RNA, 15 nt, Homo sapiens
ugacuccucaggguu

SEQ ID NO: 834322 - RNA, 14 nt, Homo sapiens
ugacuggccugcug

SEQ ID NO: 834323 - RNA, 12 nt, Homo sapiens
ugacuguaucug

SEQ ID NO: 834324 - RNA, 17 nt, Homo sapiens
ugacuguaucuguguag

SEQ ID NO: 834325 - RNA, 15 nt, Homo sapiens
ugacuuaggugugaa

SEQ ID NO: 834326 - RNA, 12 nt, Homo sapiens
ugagaacacugu

SEQ ID NO: 834327 - RNA, 13 nt, Homo sapiens
ugagaacacugug

SEQ ID NO: 834328 - RNA, 13 nt, Homo sapiens
ugagaucauucac

SEQ ID NO: 834329 - RNA, 15 nt, Homo sapiens
ugagaugggcuuccc

SEQ ID NO: 834330 - RNA, 21 nt, Homo sapiens
ugagccuucagcacuaaccua

SEQ ID NO: 834331 - RNA, 23 nt, Homo sapiens
ugagcgugaaucuguaucuugcc

SEQ ID NO: 834332 - RNA, 15 nt, Homo sapiens
ugaggcccagugcau

SEQ ID NO: 834333 - RNA, 14 nt, Homo sapiens
ugaggcugcaccca

SEQ ID NO: 834334 - RNA, 15 nt, Homo sapiens
ugaggcugggcuccc

SEQ ID NO: 834335 - RNA, 17 nt, Homo sapiens
ugaggcuuagcuuugcu

SEQ ID NO: 834336 - RNA, 16 nt, Homo sapiens
ugaggcuuuggcaaau

SEQ ID NO: 834337 - RNA, 17 nt, Homo sapiens
ugaggggcuggcacuga

SEQ ID NO: 834338 - RNA, 19 nt, Homo sapiens
ugagucaaaaaaucucaau

SEQ ID NO: 834339 - RNA, 22 nt, Homo sapiens
ugauaagagggcacacacugug

SEQ ID NO: 834340 - RNA, 22 nt, Homo sapiens
ugauacaaauugcagacugugu

SEQ ID NO: 834341 - RNA, 17 nt, Homo sapiens
ugauacuucgacacugu

SEQ ID NO: 834342 - RNA, 15 nt, Homo sapiens
ugaucacaauuugca

SEQ ID NO: 834343 - RNA, 18 nt, Homo sapiens
ugaucaguaugaaaaugu

SEQ ID NO: 834344 - RNA, 12 nt, Homo sapiens
ugauccugugaa

SEQ ID NO: 834345 - RNA, 14 nt, Homo sapiens
ugaugaauguuaaa

SEQ ID NO: 834346 - RNA, 21 nt, Homo sapiens
ugaugcugggauuuacacuug

SEQ ID NO: 834347 - RNA, 22 nt, Homo sapiens
ugauuauauuucacccaucucu

SEQ ID NO: 834348 - RNA, 23 nt, Homo sapiens
ugauuuauggucagaauuucccu

SEQ ID NO: 834349 - RNA, 20 nt, Homo sapiens
ugcaauauuuccucauguga

SEQ ID NO: 834350 - RNA, 16 nt, Homo sapiens
ugcacuccagccuggg

SEQ ID NO: 834351 - RNA, 12 nt, Homo sapiens
ugcagacaugag

SEQ ID NO: 834352 - RNA, 17 nt, Homo sapiens
ugcagccacugauucuc

SEQ ID NO: 834353 - RNA, 16 nt, Homo sapiens
ugcauauuuuauuaua

SEQ ID NO: 834354 - RNA, 20 nt, Homo sapiens
ugccaaacacauuuacccuu

SEQ ID NO: 834355 - RNA, 15 nt, Homo sapiens
ugccaaccggucacc

SEQ ID NO: 834356 - RNA, 19 nt, Homo sapiens
ugccaacuucuucagagcu

SEQ ID NO: 834357 - RNA, 18 nt, Homo sapiens
ugccacccucaugcugug

SEQ ID NO: 834358 - RNA, 22 nt, Homo sapiens
ugccagaaugcuuuaggaugua

SEQ ID NO: 834359 - RNA, 19 nt, Homo sapiens
ugccagcuuaucucagggg

SEQ ID NO: 834360 - RNA, 17 nt, Homo sapiens
ugccaugcuggccaggc

SEQ ID NO: 834361 - RNA, 17 nt, Homo sapiens
ugcccuccaagaccuuc

SEQ ID NO: 834362 - RNA, 18 nt, Homo sapiens
ugcccuggagaugucaca

SEQ ID NO: 834363 - RNA, 14 nt, Homo sapiens
ugccgccagcugcc

SEQ ID NO: 834364 - RNA, 18 nt, Homo sapiens
ugcgaauaagcuuuuaau

SEQ ID NO: 834365 - RNA, 17 nt, Homo sapiens
ugcgagugcucauuuca

SEQ ID NO: 834366 - RNA, 17 nt, Homo sapiens
ugcggcauuaaagccau

SEQ ID NO: 834367 - RNA, 16 nt, Homo sapiens
ugcgucucauacucac

SEQ ID NO: 834368 - RNA, 19 nt, Homo sapiens
ugcuaagcauuagcuuuaa

SEQ ID NO: 834369 - RNA, 20 nt, Homo sapiens
ugcucaucugguaacucaac

SEQ ID NO: 834370 - RNA, 16 nt, Homo sapiens
ugcucauguaccucug

SEQ ID NO: 834371 - RNA, 19 nt, Homo sapiens
ugcucccugguucugauga

SEQ ID NO: 834372 - RNA, 22 nt, Homo sapiens
ugcucugagugcuagcuagcca

SEQ ID NO: 834373 - RNA, 12 nt, Homo sapiens
ugcugaagccaa

SEQ ID NO: 834374 - RNA, 18 nt, Homo sapiens
ugcugaccagacagccuc

SEQ ID NO: 834375 - RNA, 17 nt, Homo sapiens
ugcugaggcccagugca

SEQ ID NO: 834376 - RNA, 17 nt, Homo sapiens
ugcugcuccagugcagg

SEQ ID NO: 834377 - RNA, 15 nt, Homo sapiens
ugcugugugacucaa

SEQ ID NO: 834378 - RNA, 19 nt, Homo sapiens
ugcuuugcccagcauuuua

SEQ ID NO: 834379 - RNA, 13 nt, Homo sapiens
uggaaacagcucg

SEQ ID NO: 834380 - RNA, 14 nt, Homo sapiens
uggaacaagcacag

SEQ ID NO: 834381 - RNA, 22 nt, Homo sapiens
uggaagacagagaccuccugcc

SEQ ID NO: 834382 - RNA, 14 nt, Homo sapiens
aagcaccaagcuca

SEQ ID NO: 834383 - RNA, 19 nt, Homo sapiens
aagcaccaccaaacacagu

SEQ ID NO: 834384 - RNA, 19 nt, Homo sapiens
aagcaggacuaaaugucua

SEQ ID NO: 834385 - RNA, 19 nt, Homo sapiens
aagcaucugagcuaacuua

SEQ ID NO: 834386 - RNA, 19 nt, Homo sapiens
aagccaauaacacacagcu

SEQ ID NO: 834387 - RNA, 21 nt, Homo sapiens
aagccagaaaaagaucuuuca

SEQ ID NO: 834388 - RNA, 18 nt, Homo sapiens
aagcccauucauuccauu

SEQ ID NO: 834389 - RNA, 16 nt, Homo sapiens
aagcucccaagggaug

SEQ ID NO: 834390 - RNA, 17 nt, Homo sapiens
aagcucccaagggaugg

SEQ ID NO: 834391 - RNA, 23 nt, Homo sapiens
aagcugaagaaaaugaagcccua

SEQ ID NO: 834392 - RNA, 22 nt, Homo sapiens
aagcugagaugaacccuggcau

SEQ ID NO: 834393 - RNA, 14 nt, Homo sapiens
aaggaauccacucc

SEQ ID NO: 834394 - RNA, 18 nt, Homo sapiens
aaggaggccacgugaugu

SEQ ID NO: 834395 - RNA, 17 nt, Homo sapiens
aaggaguaaguacaaau

SEQ ID NO: 834396 - RNA, 23 nt, Homo sapiens
aaggaugaucuaggaagacuuug

SEQ ID NO: 834397 - RNA, 19 nt, Homo sapiens
aaggcaaugccauccucaa

SEQ ID NO: 834398 - RNA, 20 nt, Homo sapiens
aaggcguggagcugccugau

SEQ ID NO: 834399 - RNA, 22 nt, Homo sapiens
aagggaacuugagcgugaaucu

SEQ ID NO: 834400 - RNA, 23 nt, Homo sapiens
aagggcacgagagagucuuccag

SEQ ID NO: 834401 - RNA, 17 nt, Homo sapiens
aagguggggacagggau

SEQ ID NO: 834402 - RNA, 19 nt, Homo sapiens
aagguggggacagggauga

SEQ ID NO: 834403 - RNA, 19 nt, Homo sapiens
aaguaaucucacagcauuu

SEQ ID NO: 834404 - RNA, 22 nt, Homo sapiens
aaguaaucucacagcauuugcc

SEQ ID NO: 834405 - RNA, 17 nt, Homo sapiens
aaguacuguaacugugu

SEQ ID NO: 834406 - RNA, 13 nt, Homo sapiens
aaguauugaauua

SEQ ID NO: 834407 - RNA, 12 nt, Homo sapiens
aagugagcagaa

SEQ ID NO: 834408 - RNA, 20 nt, Homo sapiens
aaguguuuguuggcaauuau

SEQ ID NO: 834409 - RNA, 15 nt, Homo sapiens
aaguuacagcuguga

SEQ ID NO: 834410 - RNA, 14 nt, Homo sapiens
aaguugacaccuuu

SEQ ID NO: 834411 - RNA, 16 nt, Homo sapiens
aauaaagucucuuccu

SEQ ID NO: 834412 - RNA, 18 nt, Homo sapiens
aauaacaaaugccaaauu

SEQ ID NO: 834413 - RNA, 20 nt, Homo sapiens
aauaauacaguaucucaggg

SEQ ID NO: 834414 - RNA, 14 nt, Homo sapiens
aauaaucucacuac

SEQ ID NO: 834415 - RNA, 21 nt, Homo sapiens
aauacagacuacuucuucccc

SEQ ID NO: 834416 - RNA, 14 nt, Homo sapiens
aauacaguaucuca

SEQ ID NO: 834417 - RNA, 22 nt, Homo sapiens
aauacauaaaguaugugcauau

SEQ ID NO: 834418 - RNA, 14 nt, Homo sapiens
aauagaacagagaa

SEQ ID NO: 834419 - RNA, 14 nt, Homo sapiens
aauagaagggcaaa

SEQ ID NO: 834420 - RNA, 13 nt, Homo sapiens
aauagcacaugau

SEQ ID NO: 834421 - RNA, 19 nt, Homo sapiens
aauagggaaguaacaguaa

SEQ ID NO: 834422 - RNA, 23 nt, Homo sapiens
aauauauuuuaaguaucagaggu

SEQ ID NO: 834423 - RNA, 15 nt, Homo sapiens
aauauccauccugaa

SEQ ID NO: 834424 - RNA, 16 nt, Homo sapiens
aauaucccuuacuuua

SEQ ID NO: 834425 - RNA, 16 nt, Homo sapiens
aaucacuucugagaac

SEQ ID NO: 834426 - RNA, 20 nt, Homo sapiens
aaucagaauggaaugcucug

SEQ ID NO: 834427 - RNA, 18 nt, Homo sapiens
aaucagcaagaagauccu

SEQ ID NO: 834428 - RNA, 16 nt, Homo sapiens
aaucucacagcauuug

SEQ ID NO: 834429 - RNA, 18 nt, Homo sapiens
aaucucacagcauuugcc

SEQ ID NO: 834430 - RNA, 13 nt, Homo sapiens
aaucuggauucau

SEQ ID NO: 834431 - RNA, 14 nt, Homo sapiens
aaugaaaugcauuu

SEQ ID NO: 834432 - RNA, 18 nt, Homo sapiens
aaugaaaugcauuuugcu

SEQ ID NO: 834433 - RNA, 16 nt, Homo sapiens
aaugagaucauuguga

SEQ ID NO: 834434 - RNA, 15 nt, Homo sapiens
aaugagccuggcaag

SEQ ID NO: 834435 - RNA, 13 nt, Homo sapiens
aaugcagcuuuaa

SEQ ID NO: 834436 - RNA, 20 nt, Homo sapiens
aaugccugagugccuggcca

SEQ ID NO: 834437 - RNA, 18 nt, Homo sapiens
aauggcuacaucuccaaa

SEQ ID NO: 834438 - RNA, 20 nt, Homo sapiens
aaugguaguuuuacaguguu

SEQ ID NO: 834439 - RNA, 18 nt, Homo sapiens
aaugucuucuguauucac

SEQ ID NO: 834440 - RNA, 22 nt, Homo sapiens
aauuaaggguaugauuaacucu

SEQ ID NO: 834441 - RNA, 16 nt, Homo sapiens
aauuauauauacuaua

SEQ ID NO: 834442 - RNA, 17 nt, Homo sapiens
aauuauauauacuauau

SEQ ID NO: 834443 - RNA, 13 nt, Homo sapiens
aauuaugcuucca

SEQ ID NO: 834444 - RNA, 12 nt, Homo sapiens
aauuauuugaag

SEQ ID NO: 834445 - RNA, 18 nt, Homo sapiens
aauuauuugaagauuuaa

SEQ ID NO: 834446 - RNA, 22 nt, Homo sapiens
aauucaggaagcagcuuucccc

SEQ ID NO: 834447 - RNA, 18 nt, Homo sapiens
aauugcuaagaagggaaa

SEQ ID NO: 834448 - RNA, 12 nt, Homo sapiens
aauuuaucucuu

SEQ ID NO: 834449 - RNA, 19 nt, Homo sapiens
aauuuuuauuuuuggcaaa

SEQ ID NO: 834450 - RNA, 21 nt, Homo sapiens
acaaacucaccaucugugcac

SEQ ID NO: 834451 - RNA, 17 nt, Homo sapiens
acaaauggcuacaucuc

SEQ ID NO: 834452 - RNA, 18 nt, Homo sapiens
acaaaugggaaaaccaga

SEQ ID NO: 834453 - RNA, 17 nt, Homo sapiens
acaagacuucagauucc

SEQ ID NO: 834454 - RNA, 20 nt, Homo sapiens
acaagcaauuagacaagaac

SEQ ID NO: 834455 - RNA, 16 nt, Homo sapiens
acaaggcgaucccauc

SEQ ID NO: 834456 - RNA, 20 nt, Homo sapiens
acaauuauuugaagauuuaa

SEQ ID NO: 834457 - RNA, 13 nt, Homo sapiens
acacaacaacucc

SEQ ID NO: 834458 - RNA, 21 nt, Homo sapiens
acacaggccagcuccacagug

SEQ ID NO: 834459 - RNA, 21 nt, Homo sapiens
acaccauaggucaccuuuauu

SEQ ID NO: 834460 - RNA, 17 nt, Homo sapiens
acaccaugauuaaccac

SEQ ID NO: 834461 - RNA, 20 nt, Homo sapiens
acacucaagaagcaggcuac

SEQ ID NO: 834462 - RNA, 19 nt, Homo sapiens
acacucccuucccaugacc

SEQ ID NO: 834463 - RNA, 20 nt, Homo sapiens
acacugcugcuccagugcag

SEQ ID NO: 834464 - RNA, 22 nt, Homo sapiens
acacugcugcuccagugcagga

SEQ ID NO: 834465 - RNA, 14 nt, Homo sapiens
acagauuccuggca

SEQ ID NO: 834466 - RNA, 19 nt, Homo sapiens
acagccaggcggcuggaau

SEQ ID NO: 834467 - RNA, 20 nt, Homo sapiens
acagcugcuggagacuccua

SEQ ID NO: 834468 - RNA, 22 nt, Homo sapiens
acaggaaaaaaaauuaggccgu

SEQ ID NO: 834469 - RNA, 15 nt, Homo sapiens
acaggcgugagccac

SEQ ID NO: 834470 - RNA, 22 nt, Homo sapiens
acagggaaugccugagugccug

SEQ ID NO: 834471 - RNA, 14 nt, Homo sapiens
acagggcauucaaa

SEQ ID NO: 834472 - RNA, 19 nt, Homo sapiens
acaguaaauggcuuaucca

SEQ ID NO: 834473 - RNA, 15 nt, Homo sapiens
acaguaugucccaua

SEQ ID NO: 834474 - RNA, 22 nt, Homo sapiens
acagucaucauuuaucaucaca

SEQ ID NO: 834475 - RNA, 14 nt, Homo sapiens
acagugaggcugca

SEQ ID NO: 834476 - RNA, 13 nt, Homo sapiens
acagugauaagua

SEQ ID NO: 834477 - RNA, 14 nt, Homo sapiens
acagugccucuucc

SEQ ID NO: 834478 - RNA, 19 nt, Homo sapiens
acagugccucuuccaguga

SEQ ID NO: 834479 - RNA, 18 nt, Homo sapiens
acauagagugaucuuucc

SEQ ID NO: 834480 - RNA, 21 nt, Homo sapiens
acaucaaguaugguaggggag

SEQ ID NO: 834481 - RNA, 13 nt, Homo sapiens
acaucagucacaa

SEQ ID NO: 834482 - RNA, 14 nt, Homo sapiens
acaucucugcaauc

SEQ ID NO: 834483 - RNA, 18 nt, Homo sapiens
acaugccagccacuguga

SEQ ID NO: 834484 - RNA, 15 nt, Homo sapiens
acaugcuuuuccaaa

SEQ ID NO: 834485 - RNA, 12 nt, Homo sapiens
acauuaugaugu

SEQ ID NO: 834486 - RNA, 17 nt, Homo sapiens
acauucaucaagcugua

SEQ ID NO: 834487 - RNA, 13 nt, Homo sapiens
acauucaugccug

SEQ ID NO: 834488 - RNA, 18 nt, Homo sapiens
acauugauucaugucuca

SEQ ID NO: 834489 - RNA, 15 nt, Homo sapiens
acauuuacuguggau

SEQ ID NO: 834490 - RNA, 16 nt, Homo sapiens
acauuucuguucucau

SEQ ID NO: 834491 - RNA, 22 nt, Homo sapiens
acauuucuguucucauuugauc

SEQ ID NO: 834492 - RNA, 13 nt, Homo sapiens
accaaaucacuga

SEQ ID NO: 834493 - RNA, 19 nt, Homo sapiens
accaagcugugcccugacc

SEQ ID NO: 834494 - RNA, 14 nt, Homo sapiens
accaauaaagccuu

SEQ ID NO: 834495 - RNA, 17 nt, Homo sapiens
accacauuucuaagccu

SEQ ID NO: 834496 - RNA, 18 nt, Homo sapiens
accaccacccuugccaug

SEQ ID NO: 834497 - RNA, 15 nt, Homo sapiens
accagaaacaccccu

SEQ ID NO: 834498 - RNA, 20 nt, Homo sapiens
accauaaaaaggaauccacu

SEQ ID NO: 834499 - RNA, 23 nt, Homo sapiens
accaucugugcacgcaguggccu

SEQ ID NO: 834500 - RNA, 12 nt, Homo sapiens
accauuacugua

SEQ ID NO: 834501 - RNA, 14 nt, Homo sapiens
accauuacuguaau

SEQ ID NO: 834502 - RNA, 16 nt, Homo sapiens
accauuuguauccacu

SEQ ID NO: 834503 - RNA, 18 nt, Homo sapiens
accauuuuugaaaccaaa

SEQ ID NO: 834504 - RNA, 20 nt, Homo sapiens
cauucacucauacaucuggc

SEQ ID NO: 834505 - RNA, 16 nt, Homo sapiens
cauucaucaagcugua

SEQ ID NO: 834506 - RNA, 12 nt, Homo sapiens
cauucauuccau

SEQ ID NO: 834507 - RNA, 20 nt, Homo sapiens
cauucuuuuugaaaugucaa

SEQ ID NO: 834508 - RNA, 16 nt, Homo sapiens
cauugauucaugucuc

SEQ ID NO: 834509 - RNA, 20 nt, Homo sapiens
cauuuaaaacaagacuucag

SEQ ID NO: 834510 - RNA, 16 nt, Homo sapiens
cauuuauuuuucucau

SEQ ID NO: 834511 - RNA, 22 nt, Homo sapiens
cauuuggccucuuguagucuug

SEQ ID NO: 834512 - RNA, 15 nt, Homo sapiens
ccaaacccaggcuau

SEQ ID NO: 834513 - RNA, 11 nt, Homo sapiens
ccaaagggaua

SEQ ID NO: 834514 - RNA, 16 nt, Homo sapiens
ccaaaugcagcuuuaa

SEQ ID NO: 834515 - RNA, 22 nt, Homo sapiens
ccaaaugcugacccaugcaaua

SEQ ID NO: 834516 - RNA, 11 nt, Homo sapiens
ccaaccacaga

SEQ ID NO: 834517 - RNA, 16 nt, Homo sapiens
ccaaccugaagacacc

SEQ ID NO: 834518 - RNA, 15 nt, Homo sapiens
ccaagaucacagugg

SEQ ID NO: 834519 - RNA, 18 nt, Homo sapiens
ccaagcaggaaccccagg

SEQ ID NO: 834520 - RNA, 14 nt, Homo sapiens
ccaaggcuggagug

SEQ ID NO: 834521 - RNA, 18 nt, Homo sapiens
ccaauaucccuuacuuua

SEQ ID NO: 834522 - RNA, 17 nt, Homo sapiens
ccaauauuuaccagacc

SEQ ID NO: 834523 - RNA, 20 nt, Homo sapiens
ccaaugagaucauugugaag

SEQ ID NO: 834524 - RNA, 22 nt, Homo sapiens
ccaaugggaugaggucacuuuu

SEQ ID NO: 834525 - RNA, 21 nt, Homo sapiens
ccacaaaugggaaaaccagac

SEQ ID NO: 834526 - RNA, 23 nt, Homo sapiens
ccacagaacacagcaauuccuca

SEQ ID NO: 834527 - RNA, 15 nt, Homo sapiens
ccaccaucaccagac

SEQ ID NO: 834528 - RNA, 14 nt, Homo sapiens
ccacccuugccaug

SEQ ID NO: 834529 - RNA, 22 nt, Homo sapiens
ccaccuguuuucugaaacacac

SEQ ID NO: 834530 - RNA, 18 nt, Homo sapiens
ccaccuugucugcuaaau

SEQ ID NO: 834531 - RNA, 14 nt, Homo sapiens
ccaccuuucuggac

SEQ ID NO: 834532 - RNA, 14 nt, Homo sapiens
ccacucccaggcag

SEQ ID NO: 834533 - RNA, 15 nt, Homo sapiens
ccacuguuugucuca

SEQ ID NO: 834534 - RNA, 13 nt, Homo sapiens
ccagaauuucaaa

SEQ ID NO: 834535 - RNA, 20 nt, Homo sapiens
ccagccugggugacagagca

SEQ ID NO: 834536 - RNA, 23 nt, Homo sapiens
ccagcuccacaguguugccagag

SEQ ID NO: 834537 - RNA, 15 nt, Homo sapiens
ccaggagcagccaca

SEQ ID NO: 834538 - RNA, 14 nt, Homo sapiens
ccaggauagacuuu

SEQ ID NO: 834539 - RNA, 20 nt, Homo sapiens
ccaggauagacuuuucccaa

SEQ ID NO: 834540 - RNA, 17 nt, Homo sapiens
ccaggcccaaggaguaa

SEQ ID NO: 834541 - RNA, 17 nt, Homo sapiens
ccagucauuauguuaau

SEQ ID NO: 834542 - RNA, 21 nt, Homo sapiens
ccaguuuaaccugaugcaguc

SEQ ID NO: 834543 - RNA, 12 nt, Homo sapiens
ccaucaccagac

SEQ ID NO: 834544 - RNA, 20 nt, Homo sapiens
ccaucagcaaauauuauucu

SEQ ID NO: 834545 - RNA, 15 nt, Homo sapiens
ccaugacccaggcug

SEQ ID NO: 834546 - RNA, 10 nt, Homo sapiens
ccauggacuu

SEQ ID NO: 834547 - RNA, 20 nt, Homo sapiens
ccauguaagcaccccuucau

SEQ ID NO: 834548 - RNA, 15 nt, Homo sapiens
ccauguagaagcugc

SEQ ID NO: 834549 - RNA, 22 nt, Homo sapiens
ccauguagaagcugcaucuugu

SEQ ID NO: 834550 - RNA, 12 nt, Homo sapiens
ccauuacuguaa

SEQ ID NO: 834551 - RNA, 13 nt, Homo sapiens
ccauucauuccau

SEQ ID NO: 834552 - RNA, 14 nt, Homo sapiens
ccauugacuucuuc

SEQ ID NO: 834553 - RNA, 16 nt, Homo sapiens
ccauuuuugaaaccaa

SEQ ID NO: 834554 - RNA, 17 nt, Homo sapiens
ccauuuuugaaaccaaa

SEQ ID NO: 834555 - RNA, 17 nt, Homo sapiens
cccaaaagcccauucau

SEQ ID NO: 834556 - RNA, 19 nt, Homo sapiens
cccaagccuacuuuugcca

SEQ ID NO: 834557 - RNA, 11 nt, Homo sapiens
cccaagggaaa

SEQ ID NO: 834558 - RNA, 17 nt, Homo sapiens
cccacuguggcugauuu

SEQ ID NO: 834559 - RNA, 20 nt, Homo sapiens
cccacuguggcugauuugga

SEQ ID NO: 834560 - RNA, 18 nt, Homo sapiens
cccagaguccucuaugaa

SEQ ID NO: 834561 - RNA, 21 nt, Homo sapiens
cccagccccuucugacccaug

SEQ ID NO: 834562 - RNA, 15 nt, Homo sapiens
cccaggcugggcaag

SEQ ID NO: 834563 - RNA, 23 nt, Homo sapiens
cccagguuucuggucucuaggcu

SEQ ID NO: 834564 - RNA, 16 nt, Homo sapiens
cccaguuagcucucaa

SEQ ID NO: 834565 - RNA, 13 nt, Homo sapiens
cccaucucuacaa

SEQ ID NO: 834566 - RNA, 14 nt, Homo sapiens
cccauucauuccau

SEQ ID NO: 834567 - RNA, 19 nt, Homo sapiens
cccauucuacucaaaguca

SEQ ID NO: 834568 - RNA, 15 nt, Homo sapiens
ccccacucagccuuu

SEQ ID NO: 834569 - RNA, 11 nt, Homo sapiens
ccccacuuuga

SEQ ID NO: 834570 - RNA, 15 nt, Homo sapiens
cccccuuccauggac

SEQ ID NO: 834571 - RNA, 18 nt, Homo sapiens
ccccucaacaccucugca

SEQ ID NO: 834572 - RNA, 19 nt, Homo sapiens
ccccucccacagcgcuggc

SEQ ID NO: 834573 - RNA, 22 nt, Homo sapiens
ccccuguagagugggagcugag

SEQ ID NO: 834574 - RNA, 19 nt, Homo sapiens
cccuaaccucugagucacc

SEQ ID NO: 834575 - RNA, 14 nt, Homo sapiens
cccuagucuauuca

SEQ ID NO: 834576 - RNA, 21 nt, Homo sapiens
cccuagucuauucauuauauu

SEQ ID NO: 834577 - RNA, 12 nt, Homo sapiens
cccuauuacuug

SEQ ID NO: 834578 - RNA, 14 nt, Homo sapiens
cccuauuacuuguu

SEQ ID NO: 834579 - RNA, 18 nt, Homo sapiens
cccucaacaccucugcac

SEQ ID NO: 834580 - RNA, 19 nt, Homo sapiens
cccucuccucucuuccucc

SEQ ID NO: 834581 - RNA, 18 nt, Homo sapiens
cccugagcuuucugcuau

SEQ ID NO: 834582 - RNA, 18 nt, Homo sapiens
cccuggaaggacauccau

SEQ ID NO: 834583 - RNA, 16 nt, Homo sapiens
cccugguggcagcuca

SEQ ID NO: 834584 - RNA, 21 nt, Homo sapiens
cccuguaccacaaacacauua

SEQ ID NO: 834585 - RNA, 18 nt, Homo sapiens
ccgagccuggcuccaaac

SEQ ID NO: 834586 - RNA, 12 nt, Homo sapiens
ccggaagccaaa

SEQ ID NO: 834587 - RNA, 17 nt, Homo sapiens
ccgguguuuaagacauu

SEQ ID NO: 834588 - RNA, 17 nt, Homo sapiens
ccgguucuuaaauccau

SEQ ID NO: 834589 - RNA, 18 nt, Homo sapiens
ccuaaaacaaaagcucau

SEQ ID NO: 834590 - RNA, 17 nt, Homo sapiens
ccuaagucucugugaau

SEQ ID NO: 834591 - RNA, 17 nt, Homo sapiens
ccuaggcauuugcugaa

SEQ ID NO: 834592 - RNA, 17 nt, Homo sapiens
ccucaacugaaggggug

SEQ ID NO: 834593 - RNA, 19 nt, Homo sapiens
ccucacacugggacuugca

SEQ ID NO: 834594 - RNA, 15 nt, Homo sapiens
ccucaccccacugug

SEQ ID NO: 834595 - RNA, 20 nt, Homo sapiens
ccucaucuguaaaauggaga

SEQ ID NO: 834596 - RNA, 22 nt, Homo sapiens
ccucaucuguaaaauggagaca

SEQ ID NO: 834597 - RNA, 22 nt, Homo sapiens
ccucaugugaucacaauuugca

SEQ ID NO: 834598 - RNA, 19 nt, Homo sapiens
ccucauuagcauuuugcua

SEQ ID NO: 834599 - RNA, 20 nt, Homo sapiens
ccuccaccuucuggguucaa

SEQ ID NO: 834600 - RNA, 18 nt, Homo sapiens
ccuccaggauagacuuuu

SEQ ID NO: 834601 - RNA, 11 nt, Homo sapiens
ccuccucacaa

SEQ ID NO: 834602 - RNA, 17 nt, Homo sapiens
ccuccugaggcuuuggc

SEQ ID NO: 834603 - RNA, 13 nt, Homo sapiens
ccucuaugaacua

SEQ ID NO: 834604 - RNA, 19 nt, Homo sapiens
ccucucagaacauacugau

SEQ ID NO: 834605 - RNA, 22 nt, Homo sapiens
ccucugucuaggacugcagugu

SEQ ID NO: 834606 - RNA, 21 nt, Homo sapiens
ccugcaccccugcaguuugag

SEQ ID NO: 834607 - RNA, 21 nt, Homo sapiens
ccugcccccuguacauuugug

SEQ ID NO: 834608 - RNA, 14 nt, Homo sapiens
ccugcucccacaga

SEQ ID NO: 834609 - RNA, 20 nt, Homo sapiens
ccuggaacaucaucaaggca

SEQ ID NO: 834610 - RNA, 19 nt, Homo sapiens
ccuggagcccauccagucu

SEQ ID NO: 834611 - RNA, 16 nt, Homo sapiens
ccuggccaaagggaua

SEQ ID NO: 834612 - RNA, 16 nt, Homo sapiens
ccuggccccucagggu

SEQ ID NO: 834613 - RNA, 22 nt, Homo sapiens
ccuggcugggaguggcauguau

SEQ ID NO: 834614 - RNA, 17 nt, Homo sapiens
ccugggguaccaagaga

SEQ ID NO: 834615 - RNA, 19 nt, Homo sapiens
ccugugaguacuacagucc

SEQ ID NO: 834616 - RNA, 22 nt, Homo sapiens
ccuguuucugaaccauuacugu

SEQ ID NO: 834617 - RNA, 12 nt, Homo sapiens
ccuuaacacuga

SEQ ID NO: 834618 - RNA, 20 nt, Homo sapiens
ccuucugcuguauacuguac

SEQ ID NO: 834619 - RNA, 21 nt, Homo sapiens
ccuugagucaaaaaaucucaa

SEQ ID NO: 834620 - RNA, 16 nt, Homo sapiens
ccuuuaguggcuucau

SEQ ID NO: 834621 - RNA, 23 nt, Homo sapiens
ccuuuccgguguuuaagacauuu

SEQ ID NO: 834622 - RNA, 19 nt, Homo sapiens
ccuuuggccccacuuugaa

SEQ ID NO: 834623 - RNA, 16 nt, Homo sapiens
ccuuuuucacuuugaa

SEQ ID NO: 834624 - RNA, 14 nt, Homo sapiens
ccuuuuuuaaggaa

SEQ ID NO: 834625 - RNA, 21 nt, Homo sapiens
cgaaagacgugauucaauuca

SEQ ID NO: 834626 - RNA, 19 nt, Homo sapiens
ggaaugggcagcucaucuc

SEQ ID NO: 834627 - RNA, 17 nt, Homo sapiens
ggaauguaugugcacau

SEQ ID NO: 834628 - RNA, 23 nt, Homo sapiens
ggacaaggaugaucuaggaagac

SEQ ID NO: 834629 - RNA, 16 nt, Homo sapiens
ggacacaggcuccaaa

SEQ ID NO: 834630 - RNA, 21 nt, Homo sapiens
ggacauugccuuuucuagccc

SEQ ID NO: 834631 - RNA, 18 nt, Homo sapiens
ggacuauuacauccacau

SEQ ID NO: 834632 - RNA, 18 nt, Homo sapiens
ggacucagccuugcaaau

SEQ ID NO: 834633 - RNA, 19 nt, Homo sapiens
ggacuugggcgggacacag

SEQ ID NO: 834634 - RNA, 19 nt, Homo sapiens
ggaugcagccucacagucc

SEQ ID NO: 834635 - RNA, 22 nt, Homo sapiens
ggaugccaaccggucacccagg

SEQ ID NO: 834636 - RNA, 23 nt, Homo sapiens
ggaugccaaccggucacccagga

SEQ ID NO: 834637 - RNA, 19 nt, Homo sapiens
ggauuuccagccagggcug

SEQ ID NO: 834638 - RNA, 15 nt, Homo sapiens
ggcaaaacucaguag

SEQ ID NO: 834639 - RNA, 12 nt, Homo sapiens
ggcaaacaggca

SEQ ID NO: 834640 - RNA, 19 nt, Homo sapiens
ggcaauuauuccccuaggc

SEQ ID NO: 834641 - RNA, 21 nt, Homo sapiens
ggcacaauaugggcacuuuaa

SEQ ID NO: 834642 - RNA, 15 nt, Homo sapiens
ggcacacacugugua

SEQ ID NO: 834643 - RNA, 15 nt, Homo sapiens
ggcacauuccuugcc

SEQ ID NO: 834644 - RNA, 14 nt, Homo sapiens
ggcacuugggacaa

SEQ ID NO: 834645 - RNA, 14 nt, Homo sapiens
ggcagcucagagag

SEQ ID NO: 834646 - RNA, 14 nt, Homo sapiens
ggcagcucaucucu

SEQ ID NO: 834647 - RNA, 14 nt, Homo sapiens
ggcauagaugcagg

SEQ ID NO: 834648 - RNA, 13 nt, Homo sapiens
ggcaucacagcua

SEQ ID NO: 834649 - RNA, 19 nt, Homo sapiens
ggcaugaagcugcauauga

SEQ ID NO: 834650 - RNA, 17 nt, Homo sapiens
ggccacagccacuaauc

SEQ ID NO: 834651 - RNA, 23 nt, Homo sapiens
ggccacagucaugguggccacgg

SEQ ID NO: 834652 - RNA, 21 nt, Homo sapiens
ggccagccuuucccccuguga

SEQ ID NO: 834653 - RNA, 17 nt, Homo sapiens
ggcccagugcauaugca

SEQ ID NO: 834654 - RNA, 14 nt, Homo sapiens
ggccccucaggguc

SEQ ID NO: 834655 - RNA, 16 nt, Homo sapiens
ggccucucacaaaaga

SEQ ID NO: 834656 - RNA, 16 nt, Homo sapiens
ggcggaucuuuggaca

SEQ ID NO: 834657 - RNA, 16 nt, Homo sapiens
ggcuccaacacugcug

SEQ ID NO: 834658 - RNA, 19 nt, Homo sapiens
ggcugggaacucaccuggg

SEQ ID NO: 834659 - RNA, 24 nt, Homo sapiens
ggcuuuaaaacuuauccuccauga

SEQ ID NO: 834660 - RNA, 13 nt, Homo sapiens
gggaacucaccug

SEQ ID NO: 834661 - RNA, 20 nt, Homo sapiens
gggaagggugguggagccag

SEQ ID NO: 834662 - RNA, 20 nt, Homo sapiens
gggaggucaaggcugcagug

SEQ ID NO: 834663 - RNA, 20 nt, Homo sapiens
gggauauuugguuuggccau

SEQ ID NO: 834664 - RNA, 19 nt, Homo sapiens
gggcauagaugcaggugag

SEQ ID NO: 834665 - RNA, 24 nt, Homo sapiens
gggccaugcagaccucaugcccag

SEQ ID NO: 834666 - RNA, 22 nt, Homo sapiens
gggccccugucgucaggaccuc

SEQ ID NO: 834667 - RNA, 22 nt, Homo sapiens
gggccuguuaugucaaacuguc

SEQ ID NO: 834668 - RNA, 21 nt, Homo sapiens
gggcucccuucccaccucucu

SEQ ID NO: 834669 - RNA, 14 nt, Homo sapiens
ggguaucuggugac

SEQ ID NO: 834670 - RNA, 17 nt, Homo sapiens
gguaguauuacaccacc

SEQ ID NO: 834671 - RNA, 13 nt, Homo sapiens
gguaguguaucau

SEQ ID NO: 834672 - RNA, 15 nt, Homo sapiens
ggucaguagacugug

SEQ ID NO: 834673 - RNA, 19 nt, Homo sapiens
ggucauuuuuauguuauua

SEQ ID NO: 834674 - RNA, 17 nt, Homo sapiens
ggugaggggcuggcacu

SEQ ID NO: 834675 - RNA, 24 nt, Homo sapiens
ggugaucucauuuaauccucucaa

SEQ ID NO: 834676 - RNA, 15 nt, Homo sapiens
gguggaacaagcaca

SEQ ID NO: 834677 - RNA, 22 nt, Homo sapiens
gguggccucuccuuguggccug

SEQ ID NO: 834678 - RNA, 20 nt, Homo sapiens
ggugggcuucccaguggcug

SEQ ID NO: 834679 - RNA, 14 nt, Homo sapiens
gguggucacuggaa

SEQ ID NO: 834680 - RNA, 15 nt, Homo sapiens
gguuaucugggcaua

SEQ ID NO: 834681 - RNA, 18 nt, Homo sapiens
guaaagggcgcaaagggc

SEQ ID NO: 834682 - RNA, 17 nt, Homo sapiens
guaaucucacagcauuu

SEQ ID NO: 834683 - RNA, 17 nt, Homo sapiens
guaauucucaggccauc

SEQ ID NO: 834684 - RNA, 16 nt, Homo sapiens
guacauuugugcucca

SEQ ID NO: 834685 - RNA, 17 nt, Homo sapiens
guacugagacauuacag

SEQ ID NO: 834686 - RNA, 15 nt, Homo sapiens
guaggaagacuuugg

SEQ ID NO: 834687 - RNA, 14 nt, Homo sapiens
guauaaauaaccaa

SEQ ID NO: 834688 - RNA, 11 nt, Homo sapiens
guauacuguac

SEQ ID NO: 834689 - RNA, 12 nt, Homo sapiens
gucaacauuucu

SEQ ID NO: 834690 - RNA, 22 nt, Homo sapiens
gucaaccccaaguuaguucaau

SEQ ID NO: 834691 - RNA, 20 nt, Homo sapiens
gucaagcaguagacaagcaa

SEQ ID NO: 834692 - RNA, 21 nt, Homo sapiens
gucaauccaagagucugauga

SEQ ID NO: 834693 - RNA, 22 nt, Homo sapiens
gucacguggaggagcagugcag

SEQ ID NO: 834694 - RNA, 21 nt, Homo sapiens
guccucccaucucacacauga

SEQ ID NO: 834695 - RNA, 12 nt, Homo sapiens
gucuacacugug

SEQ ID NO: 834696 - RNA, 17 nt, Homo sapiens
gucucaccuacccauga

SEQ ID NO: 834697 - RNA, 22 nt, Homo sapiens
gucucaguguccucaucuguaa

SEQ ID NO: 834698 - RNA, 17 nt, Homo sapiens
gucucauacucaccuca

SEQ ID NO: 834699 - RNA, 18 nt, Homo sapiens
gucuccagucaucuguaa

SEQ ID NO: 834700 - RNA, 14 nt, Homo sapiens
gucucccaaagugc

SEQ ID NO: 834701 - RNA, 16 nt, Homo sapiens
gucuccuuaacacuga

SEQ ID NO: 834702 - RNA, 17 nt, Homo sapiens
gucuuucuuacaaggaa

SEQ ID NO: 834703 - RNA, 20 nt, Homo sapiens
gugaaagcuauaucaaucuc

SEQ ID NO: 834704 - RNA, 17 nt, Homo sapiens
gugaagaauuuaucucu

SEQ ID NO: 834705 - RNA, 22 nt, Homo sapiens
gugacagccguuuguuccccaa

SEQ ID NO: 834706 - RNA, 19 nt, Homo sapiens
gugacauuuauuuuucuca

SEQ ID NO: 834707 - RNA, 14 nt, Homo sapiens
gugaucacagcagc

SEQ ID NO: 834708 - RNA, 20 nt, Homo sapiens
gugauuacccucugggucuc

SEQ ID NO: 834709 - RNA, 14 nt, Homo sapiens
gugauucuuagcaa

SEQ ID NO: 834710 - RNA, 12 nt, Homo sapiens
gugccaauguau

SEQ ID NO: 834711 - RNA, 17 nt, Homo sapiens
gugccacccaugcagcu

SEQ ID NO: 834712 - RNA, 23 nt, Homo sapiens
gugcuaggaacacuccuucacag

SEQ ID NO: 834713 - RNA, 17 nt, Homo sapiens
guggcagcucaccucuc

SEQ ID NO: 834714 - RNA, 20 nt, Homo sapiens
gugucuggcacuugggacaa

SEQ ID NO: 834715 - RNA, 18 nt, Homo sapiens
guguugccagagccuuaa

SEQ ID NO: 834716 - RNA, 23 nt, Homo sapiens
guguuuccuggcacugcuuccag

SEQ ID NO: 834717 - RNA, 15 nt, Homo sapiens
guuaacugagugccu

SEQ ID NO: 834718 - RNA, 14 nt, Homo sapiens
guuacugucuucag

SEQ ID NO: 834719 - RNA, 18 nt, Homo sapiens
guuagcuaaaggaucuua

SEQ ID NO: 834720 - RNA, 19 nt, Homo sapiens
guuaguuuuuaaucucucc

SEQ ID NO: 834721 - RNA, 19 nt, Homo sapiens
guuaucugucccagguuau

SEQ ID NO: 834722 - RNA, 21 nt, Homo sapiens
guucagaaucacuucugagaa

SEQ ID NO: 834723 - RNA, 19 nt, Homo sapiens
guuccaaggcuacuacaga

SEQ ID NO: 834724 - RNA, 18 nt, Homo sapiens
guugauguuggcugggaa

SEQ ID NO: 834725 - RNA, 19 nt, Homo sapiens
guugcaauagaacagagaa

SEQ ID NO: 834726 - RNA, 19 nt, Homo sapiens
guugcaggaccucagguga

SEQ ID NO: 834727 - RNA, 22 nt, Homo sapiens
guuggcgggggcuuggcugugc

SEQ ID NO: 834728 - RNA, 15 nt, Homo sapiens
guuuagcagauuuaa

SEQ ID NO: 834729 - RNA, 20 nt, Homo sapiens
guuucugaaccauuacugua

SEQ ID NO: 834730 - RNA, 19 nt, Homo sapiens
guuuggaaguguuaacuau

SEQ ID NO: 834731 - RNA, 15 nt, Homo sapiens
guuuggccaucucug

SEQ ID NO: 834732 - RNA, 21 nt, Homo sapiens
guuuguuccccaagacauucu

SEQ ID NO: 834733 - RNA, 20 nt, Homo sapiens
guuuuaaagcuugcucacau

SEQ ID NO: 834734 - RNA, 21 nt, Homo sapiens
guuuuacaguguuucuggcuu

SEQ ID NO: 834735 - RNA, 21 nt, Homo sapiens
guuuuauuuugguguccuauu

SEQ ID NO: 834736 - RNA, 15 nt, Homo sapiens
guuuucuucugugau

SEQ ID NO: 834737 - RNA, 15 nt, Homo sapiens
guuuuuaagccuuaa

SEQ ID NO: 834738 - RNA, 22 nt, Homo sapiens
uaaaaaaaaaacguauugcauu

SEQ ID NO: 834739 - RNA, 20 nt, Homo sapiens
uaaaaaaaaaccuagcaucu

SEQ ID NO: 834740 - RNA, 16 nt, Homo sapiens
uaaaacaaaagcucau

SEQ ID NO: 834741 - RNA, 18 nt, Homo sapiens
uaaaacccaagugccuua

SEQ ID NO: 834742 - RNA, 14 nt, Homo sapiens
uaaaauuauuccuu

SEQ ID NO: 834743 - RNA, 17 nt, Homo sapiens
uaaaauuuaaccuacua

SEQ ID NO: 834744 - RNA, 22 nt, Homo sapiens
uaaacagaggaguacaggugaa

SEQ ID NO: 834745 - RNA, 21 nt, Homo sapiens
uaaacauucaucaagcuguac

SEQ ID NO: 834746 - RNA, 22 nt, Homo sapiens
uaaacauugguucuuguauuaa

SEQ ID NO: 834747 - RNA, 19 nt, Homo sapiens
uucauuaaaucaacuuuau

SEQ ID NO: 834748 - RNA, 15 nt, Homo sapiens
uucauucacuuuaau

SEQ ID NO: 834749 - RNA, 10 nt, Homo sapiens
uucauuccau

SEQ ID NO: 834750 - RNA, 23 nt, Homo sapiens
uucauuuggcauuccccacuuga

SEQ ID NO: 834751 - RNA, 13 nt, Homo sapiens
uuccaaaggccau

SEQ ID NO: 834752 - RNA, 13 nt, Homo sapiens
uuccauucuggaa

SEQ ID NO: 834753 - RNA, 21 nt, Homo sapiens
uucccauaccacccaaugcug

SEQ ID NO: 834754 - RNA, 14 nt, Homo sapiens
uuccccacucagcc

SEQ ID NO: 834755 - RNA, 13 nt, Homo sapiens
uuccgcaccaaua

SEQ ID NO: 834756 - RNA, 17 nt, Homo sapiens
uuccugaaccgaugaga

SEQ ID NO: 834757 - RNA, 19 nt, Homo sapiens
uucuaaaaauaaaaguauu

SEQ ID NO: 834758 - RNA, 20 nt, Homo sapiens
uucuaaaaauaaaaguauug

SEQ ID NO: 834759 - RNA, 16 nt, Homo sapiens
uucucccucagucugg

SEQ ID NO: 834760 - RNA, 15 nt, Homo sapiens
uucucucuucuccac

SEQ ID NO: 834761 - RNA, 20 nt, Homo sapiens
uucucuuuuccuuugguccu

SEQ ID NO: 834762 - RNA, 14 nt, Homo sapiens
uucugaaccauuac

SEQ ID NO: 834763 - RNA, 17 nt, Homo sapiens
uucugaaccauuacugu

SEQ ID NO: 834764 - RNA, 19 nt, Homo sapiens
uucugaaccauuacuguaa

SEQ ID NO: 834765 - RNA, 20 nt, Homo sapiens
uucugaggguccacuacuca

SEQ ID NO: 834766 - RNA, 18 nt, Homo sapiens
uucugcuguauacuguac

SEQ ID NO: 834767 - RNA, 18 nt, Homo sapiens
uucuggacggaaccacgu

SEQ ID NO: 834768 - RNA, 19 nt, Homo sapiens
uucugguugaugccuguga

SEQ ID NO: 834769 - RNA, 20 nt, Homo sapiens
uucuguccgagcuuugaaaa

SEQ ID NO: 834770 - RNA, 17 nt, Homo sapiens
uucuguucucauuugau

SEQ ID NO: 834771 - RNA, 22 nt, Homo sapiens
uucuucaccuaagucucuguga

SEQ ID NO: 834772 - RNA, 19 nt, Homo sapiens
uucuucagagacuccugca

SEQ ID NO: 834773 - RNA, 16 nt, Homo sapiens
uucuucccuacaguug

SEQ ID NO: 834774 - RNA, 18 nt, Homo sapiens
uucuuuuugaaaugucaa

SEQ ID NO: 834775 - RNA, 12 nt, Homo sapiens
uugaaaugucaa

SEQ ID NO: 834776 - RNA, 11 nt, Homo sapiens
uugaagccuuu

SEQ ID NO: 834777 - RNA, 19 nt, Homo sapiens
uugaauuggacaauaaucu

SEQ ID NO: 834778 - RNA, 20 nt, Homo sapiens
uugagaauuacccuuuugcc

SEQ ID NO: 834779 - RNA, 16 nt, Homo sapiens
uugaggauuguggaaa

SEQ ID NO: 834780 - RNA, 20 nt, Homo sapiens
uugaguccagaaguuugaga

SEQ ID NO: 834781 - RNA, 22 nt, Homo sapiens
uugauaagagggcacacacugu

SEQ ID NO: 834782 - RNA, 17 nt, Homo sapiens
uugcaaggcugauuuau

SEQ ID NO: 834783 - RNA, 18 nt, Homo sapiens
uugcaggaccucagguga

SEQ ID NO: 834784 - RNA, 14 nt, Homo sapiens
uugcaucagcaaca

SEQ ID NO: 834785 - RNA, 13 nt, Homo sapiens
uugcaugaggcua

SEQ ID NO: 834786 - RNA, 13 nt, Homo sapiens
uugccagagccuu

SEQ ID NO: 834787 - RNA, 15 nt, Homo sapiens
uugccagagccuuaa

SEQ ID NO: 834788 - RNA, 19 nt, Homo sapiens
uugccauuacgcuaguuau

SEQ ID NO: 834789 - RNA, 14 nt, Homo sapiens
uugccuaaacccua

SEQ ID NO: 834790 - RNA, 17 nt, Homo sapiens
uugcuacugguucagca

SEQ ID NO: 834791 - RNA, 16 nt, Homo sapiens
uuggaauuuugugccc

SEQ ID NO: 834792 - RNA, 15 nt, Homo sapiens
uuggauuguccccga

SEQ ID NO: 834793 - RNA, 16 nt, Homo sapiens
uuggccaucucuggau

SEQ ID NO: 834794 - RNA, 16 nt, Homo sapiens
uuggccccacuuugaa

SEQ ID NO: 834795 - RNA, 16 nt, Homo sapiens
uugggauauucugaaa

SEQ ID NO: 834796 - RNA, 14 nt, Homo sapiens
uugucagaugcugu

SEQ ID NO: 834797 - RNA, 17 nt, Homo sapiens
uugugagcaggcuguga

SEQ ID NO: 834798 - RNA, 23 nt, Homo sapiens
uugugcaauguguauaaacaaga

SEQ ID NO: 834799 - RNA, 17 nt, Homo sapiens
uuuaaacauuaugaugu

SEQ ID NO: 834800 - RNA, 11 nt, Homo sapiens
uuuaagacauu

SEQ ID NO: 834801 - RNA, 20 nt, Homo sapiens
uuuacacgcucauggacuga

SEQ ID NO: 834802 - RNA, 17 nt, Homo sapiens
uuuacuaaguaaucuca

SEQ ID NO: 834803 - RNA, 18 nt, Homo sapiens
uuuauacucuuauagaca

SEQ ID NO: 834804 - RNA, 11 nt, Homo sapiens
uuuauaugauu

SEQ ID NO: 834805 - RNA, 19 nt, Homo sapiens
uuuaucaaguguauuugaa

SEQ ID NO: 834806 - RNA, 13 nt, Homo sapiens
uuuaucauaugcu

SEQ ID NO: 834807 - RNA, 13 nt, Homo sapiens
uuuauuauauaua

SEQ ID NO: 834808 - RNA, 17 nt, Homo sapiens
uuuccaaaggccaugga

SEQ ID NO: 834809 - RNA, 22 nt, Homo sapiens
uuuccaugcacccucauacaca

SEQ ID NO: 834810 - RNA, 23 nt, Homo sapiens
uuucccccuugaggauuguggaa

SEQ ID NO: 834811 - RNA, 19 nt, Homo sapiens
uuucccuucuuacaaugca

SEQ ID NO: 834812 - RNA, 20 nt, Homo sapiens
uuuccucaugugaucacaau

SEQ ID NO: 834813 - RNA, 24 nt, Homo sapiens
uuuccuggcacugcuuccagugag

SEQ ID NO: 834814 - RNA, 18 nt, Homo sapiens
uuucuuuuuuauacucaa

SEQ ID NO: 834815 - RNA, 14 nt, Homo sapiens
uuugacauuuacug

SEQ ID NO: 834816 - RNA, 17 nt, Homo sapiens
uuugagauguauuucaa

SEQ ID NO: 834817 - RNA, 17 nt, Homo sapiens
uuugauaggauguggau

SEQ ID NO: 834818 - RNA, 14 nt, Homo sapiens
uuugauucagacag

SEQ ID NO: 834819 - RNA, 17 nt, Homo sapiens
uuugcagcugugccaua

SEQ ID NO: 834820 - RNA, 19 nt, Homo sapiens
uuugccacccucaugcugu

SEQ ID NO: 834821 - RNA, 10 nt, Homo sapiens
uuugccaugc

SEQ ID NO: 834822 - RNA, 22 nt, Homo sapiens
uuuggcauuccccacuugagaa

SEQ ID NO: 834823 - RNA, 22 nt, Homo sapiens
uuugugcagagauaaagaccuu

SEQ ID NO: 834824 - RNA, 20 nt, Homo sapiens
uuuuaaaaugaaaugcauuu

SEQ ID NO: 834825 - RNA, 23 nt, Homo sapiens
uuuucccccuugaggauugugga

SEQ ID NO: 834826 - RNA, 21 nt, Homo sapiens
uuuugguugcuuuaauaucau

SEQ ID NO: 834827 - RNA, 14 nt, Homo sapiens
uuuuuaaguguucu

SEQ ID NO: 834828 - RNA, 12 nt, Homo sapiens
uuuuucucauga

SEQ ID NO: 834829 - RNA, 12 nt, Homo sapiens
aaaaaaaauccc

SEQ ID NO: 834830 - RNA, 17 nt, Homo sapiens
aaaaauaaagcacuuau

SEQ ID NO: 834831 - RNA, 16 nt, Homo sapiens
aaaaauagcucuugcu

SEQ ID NO: 834832 - RNA, 18 nt, Homo sapiens
aaaaauuugcuucacuca

SEQ ID NO: 834833 - RNA, 18 nt, Homo sapiens
aaaacaugcuuuuccaaa

SEQ ID NO: 834834 - RNA, 23 nt, Homo sapiens
aaaaccccaucucuacaaaaagc

SEQ ID NO: 834835 - RNA, 14 nt, Homo sapiens
aaaacguauugcau

SEQ ID NO: 834836 - RNA, 17 nt, Homo sapiens
aaaagcccauucauucc

SEQ ID NO: 834837 - RNA, 18 nt, Homo sapiens
aaaagcccauucauucca

SEQ ID NO: 834838 - RNA, 15 nt, Homo sapiens
aaaauaugaccacac

SEQ ID NO: 834839 - RNA, 19 nt, Homo sapiens
aaaaucagccugcuccagc

SEQ ID NO: 834840 - RNA, 17 nt, Homo sapiens
aaaaugaaaugcauuuu

SEQ ID NO: 834841 - RNA, 14 nt, Homo sapiens
aaaaugaagcccua

SEQ ID NO: 834842 - RNA, 22 nt, Homo sapiens
aaaauguccucccuuguggcuu

SEQ ID NO: 834843 - RNA, 14 nt, Homo sapiens
aaacaaaagcucau

SEQ ID NO: 834844 - RNA, 15 nt, Homo sapiens
aaacaaauucaucaa

SEQ ID NO: 834845 - RNA, 16 nt, Homo sapiens
aaacaccaggauuuaa

SEQ ID NO: 834846 - RNA, 14 nt, Homo sapiens
aaacagcugagggu

SEQ ID NO: 834847 - RNA, 18 nt, Homo sapiens
aaacauucaucaagcugu

SEQ ID NO: 834848 - RNA, 16 nt, Homo sapiens
aaacauuccauccuug

SEQ ID NO: 834849 - RNA, 21 nt, Homo sapiens
aaacauugguucuuguauuaa

SEQ ID NO: 834850 - RNA, 14 nt, Homo sapiens
aaaccaaaucacug

SEQ ID NO: 834851 - RNA, 13 nt, Homo sapiens
aaacccucgaggc

SEQ ID NO: 834852 - RNA, 13 nt, Homo sapiens
aaacuacuuugcu

SEQ ID NO: 834853 - RNA, 14 nt, Homo sapiens
aaacugucuuggcu

SEQ ID NO: 834854 - RNA, 21 nt, Homo sapiens
aaacuuugauaggauguggau

SEQ ID NO: 834855 - RNA, 22 nt, Homo sapiens
aaacuuuuaauuaaaugcucau

SEQ ID NO: 834856 - RNA, 18 nt, Homo sapiens
aaagagagucgcaucuca

SEQ ID NO: 834857 - RNA, 15 nt, Homo sapiens
aaagaguaggaagac

SEQ ID NO: 834858 - RNA, 19 nt, Homo sapiens
aaagaucuuucauuuugca

SEQ ID NO: 834859 - RNA, 15 nt, Homo sapiens
aaagcaggugcaaca

SEQ ID NO: 834860 - RNA, 21 nt, Homo sapiens
aaagcaucugagcuaacuuau

SEQ ID NO: 834861 - RNA, 15 nt, Homo sapiens
aaagcccauucauuc

SEQ ID NO: 834862 - RNA, 17 nt, Homo sapiens
aaagccuucaaacuccc

SEQ ID NO: 834863 - RNA, 19 nt, Homo sapiens
aaaggcugggaccacguga

SEQ ID NO: 834864 - RNA, 16 nt, Homo sapiens
aaaguguuuguuggca

SEQ ID NO: 834865 - RNA, 13 nt, Homo sapiens
aaauagugucuga

SEQ ID NO: 834866 - RNA, 17 nt, Homo sapiens
aaauagugucugaugaa

SEQ ID NO: 834867 - RNA, 20 nt, Homo sapiens
aaauauuuugcggcauuaaa

SEQ ID NO: 834868 - RNA, 14 nt, Homo sapiens
aaaugaaaugcauu

SEQ ID NO: 834869 - RNA, 15 nt, Homo sapiens
aaaugaaaugcauuu

SEQ ID NO: 834870 - RNA, 15 nt, Homo sapiens
aaaugaacagugaua

SEQ ID NO: 834871 - RNA, 22 nt, Homo sapiens
aaaugacacaacuugucccuuu

SEQ ID NO: 834872 - RNA, 15 nt, Homo sapiens
aaaugcagcuuuaaa

SEQ ID NO: 834873 - RNA, 19 nt, Homo sapiens
aaauggaagacacauugaa

SEQ ID NO: 834874 - RNA, 22 nt, Homo sapiens
aaaugucauuguucuugugaac

SEQ ID NO: 834875 - RNA, 19 nt, Homo sapiens
aaauucccuggccuuucau

SEQ ID NO: 834876 - RNA, 21 nt, Homo sapiens
aaauucuguuuuucuaggccu

SEQ ID NO: 834877 - RNA, 15 nt, Homo sapiens
aaauugucagaugcu

SEQ ID NO: 834878 - RNA, 17 nt, Homo sapiens
aaauuuuagauuuaccu

SEQ ID NO: 834879 - RNA, 21 nt, Homo sapiens
aacaaccagcaucccuugacc

SEQ ID NO: 834880 - RNA, 16 nt, Homo sapiens
aacaagacacccaagu

SEQ ID NO: 834881 - RNA, 20 nt, Homo sapiens
aacacaaacgggcucagcaa

SEQ ID NO: 834882 - RNA, 21 nt, Homo sapiens
aacaccaggauuuaaguuuca

SEQ ID NO: 834883 - RNA, 13 nt, Homo sapiens
aacaccucugcac

SEQ ID NO: 834884 - RNA, 11 nt, Homo sapiens
aacacugugaa

SEQ ID NO: 834885 - RNA, 13 nt, Homo sapiens
aacagauaauccc

SEQ ID NO: 834886 - RNA, 20 nt, Homo sapiens
aacaucaucaaggcacugcc

SEQ ID NO: 834887 - RNA, 19 nt, Homo sapiens
aacaugccagccacuguga

SEQ ID NO: 834888 - RNA, 13 nt, Homo sapiens
aacauuaugaugu

SEQ ID NO: 834889 - RNA, 14 nt, Homo sapiens
aaccacuucagcug

SEQ ID NO: 834890 - RNA, 19 nt, Homo sapiens
aaccagcaucccuugacca

SEQ ID NO: 834891 - RNA, 14 nt, Homo sapiens
aaccauuacuguaa

SEQ ID NO: 834892 - RNA, 17 nt, Homo sapiens
aacccagagguggaugu

SEQ ID NO: 834893 - RNA, 16 nt, Homo sapiens
aacccggccugauuaa

SEQ ID NO: 834894 - RNA, 13 nt, Homo sapiens
aaccuacuagaca

SEQ ID NO: 834895 - RNA, 15 nt, Homo sapiens
aaccucauuaucagu

SEQ ID NO: 834896 - RNA, 20 nt, Homo sapiens
aacucaaacucuuaaaaccc

SEQ ID NO: 834897 - RNA, 14 nt, Homo sapiens
aacucuuaaaaccc

SEQ ID NO: 834898 - RNA, 13 nt, Homo sapiens
aacuuaaccaccu

SEQ ID NO: 834899 - RNA, 14 nt, Homo sapiens
aacuuaucaucaca

SEQ ID NO: 834900 - RNA, 22 nt, Homo sapiens
aacuugagcgugaaucuguauc

SEQ ID NO: 834901 - RNA, 12 nt, Homo sapiens
aacuugggccac

SEQ ID NO: 834902 - RNA, 22 nt, Homo sapiens
aacuuuacuaaguaaucucaca

SEQ ID NO: 834903 - RNA, 16 nt, Homo sapiens
aacuuuaucauaugcu

SEQ ID NO: 834904 - RNA, 23 nt, Homo sapiens
aacuuuguuuagcccaaaaccaa

SEQ ID NO: 834905 - RNA, 15 nt, Homo sapiens
aacuuuugugcuccc

SEQ ID NO: 834906 - RNA, 18 nt, Homo sapiens
aagaaagcaggugcaaca

SEQ ID NO: 834907 - RNA, 18 nt, Homo sapiens
aagaauguguuuaaacuu

SEQ ID NO: 834908 - RNA, 19 nt, Homo sapiens
aagacuucagauuccccac

SEQ ID NO: 834909 - RNA, 16 nt, Homo sapiens
aagagaaccauaucaa

SEQ ID NO: 834910 - RNA, 17 nt, Homo sapiens
aagagagucgcaucuca

SEQ ID NO: 834911 - RNA, 18 nt, Homo sapiens
aagagggcacacacugug

SEQ ID NO: 834912 - RNA, 19 nt, Homo sapiens
aagagggcacacacugugu

SEQ ID NO: 834913 - RNA, 21 nt, Homo sapiens
aagagguuuuaaaaaaauccc

SEQ ID NO: 834914 - RNA, 20 nt, Homo sapiens
aagaguaacagucaucauuu

SEQ ID NO: 834915 - RNA, 22 nt, Homo sapiens
aagaguaacagucaucauuuau

SEQ ID NO: 834916 - RNA, 18 nt, Homo sapiens
aagaguaggaagacuuug

SEQ ID NO: 834917 - RNA, 20 nt, Homo sapiens
aagauauguaacaacaauua

SEQ ID NO: 834918 - RNA, 20 nt, Homo sapiens
aagaucuuucauuuugcacc

SEQ ID NO: 834919 - RNA, 21 nt, Homo sapiens
aagauuuagcacccuucugcu

SEQ ID NO: 834920 - RNA, 12 nt, Homo sapiens
aagcaaaugccu

SEQ ID NO: 834921 - RNA, 15 nt, Homo sapiens
uccagugcaggagac

SEQ ID NO: 834922 - RNA, 17 nt, Homo sapiens
uccaucuuuccugaugg

SEQ ID NO: 834923 - RNA, 19 nt, Homo sapiens
uccaugauguuuuccauga

SEQ ID NO: 834924 - RNA, 21 nt, Homo sapiens
ucccacagcgcuggccgggac

SEQ ID NO: 834925 - RNA, 12 nt, Homo sapiens
ucccagcccagc

SEQ ID NO: 834926 - RNA, 20 nt, Homo sapiens
ucccaguggcugcugcccag

SEQ ID NO: 834927 - RNA, 15 nt, Homo sapiens
ucccaucugugaaag

SEQ ID NO: 834928 - RNA, 12 nt, Homo sapiens
ucccauucugag

SEQ ID NO: 834929 - RNA, 13 nt, Homo sapiens
uccccacagugcc

SEQ ID NO: 834930 - RNA, 18 nt, Homo sapiens
ucccccugacaacacuca

SEQ ID NO: 834931 - RNA, 15 nt, Homo sapiens
uccccuucccuccaa

SEQ ID NO: 834932 - RNA, 15 nt, Homo sapiens
ucccuucaucuggaa

SEQ ID NO: 834933 - RNA, 13 nt, Homo sapiens
ucccuuggacauu

SEQ ID NO: 834934 - RNA, 22 nt, Homo sapiens
uccuagcgcagccaugugauua

SEQ ID NO: 834935 - RNA, 15 nt, Homo sapiens
uccuagggccacuga

SEQ ID NO: 834936 - RNA, 17 nt, Homo sapiens
uccuagggccacugaag

SEQ ID NO: 834937 - RNA, 22 nt, Homo sapiens
uccuccaugaauaucaguuauu

SEQ ID NO: 834938 - RNA, 14 nt, Homo sapiens
uccuccguggcaca

SEQ ID NO: 834939 - RNA, 20 nt, Homo sapiens
uccucucaaccaccuuucag

SEQ ID NO: 834940 - RNA, 23 nt, Homo sapiens
uccucucaaccaccuuucagaua

SEQ ID NO: 834941 - RNA, 21 nt, Homo sapiens
uccucugacagaagaacccca

SEQ ID NO: 834942 - RNA, 19 nt, Homo sapiens
uccuguuucuugcucugag

SEQ ID NO: 834943 - RNA, 15 nt, Homo sapiens
uccuuggaaauugga

SEQ ID NO: 834944 - RNA, 21 nt, Homo sapiens
ucgagccacaaccgaccagau

SEQ ID NO: 834945 - RNA, 21 nt, Homo sapiens
ucgauccccugucacgugugg

SEQ ID NO: 834946 - RNA, 17 nt, Homo sapiens
ucgcaucucagugcagg

SEQ ID NO: 834947 - RNA, 13 nt, Homo sapiens
ucuagaauuccag

SEQ ID NO: 834948 - RNA, 15 nt, Homo sapiens
ucuaggacugcagug

SEQ ID NO: 834949 - RNA, 16 nt, Homo sapiens
ucuauauaaccacauu

SEQ ID NO: 834950 - RNA, 12 nt, Homo sapiens
ucuauucauuau

SEQ ID NO: 834951 - RNA, 14 nt, Homo sapiens
ucucaauucuuccc

SEQ ID NO: 834952 - RNA, 19 nt, Homo sapiens
ucucaccuacccaugaccu

SEQ ID NO: 834953 - RNA, 17 nt, Homo sapiens
ucuccaccuuccaaaga

SEQ ID NO: 834954 - RNA, 22 nt, Homo sapiens
ucuccaggggccacaagaccau

SEQ ID NO: 834955 - RNA, 12 nt, Homo sapiens
ucuccuccgugg

SEQ ID NO: 834956 - RNA, 17 nt, Homo sapiens
ucucggggucagguucu

SEQ ID NO: 834957 - RNA, 12 nt, Homo sapiens
ucucugugaauu

SEQ ID NO: 834958 - RNA, 13 nt, Homo sapiens
ucugaaccauuac

SEQ ID NO: 834959 - RNA, 19 nt, Homo sapiens
ucugacgcuugugacagug

SEQ ID NO: 834960 - RNA, 15 nt, Homo sapiens
ucugaucaaguauuu

SEQ ID NO: 834961 - RNA, 22 nt, Homo sapiens
ucuggcagaggagggagcauca

SEQ ID NO: 834962 - RNA, 15 nt, Homo sapiens
ucuggcucuuccagg

SEQ ID NO: 834963 - RNA, 15 nt, Homo sapiens
ucugggccagaauuu

SEQ ID NO: 834964 - RNA, 13 nt, Homo sapiens
ucuguauuugcca

SEQ ID NO: 834965 - RNA, 19 nt, Homo sapiens
ucugucuccuuaacacuga

SEQ ID NO: 834966 - RNA, 13 nt, Homo sapiens
ucuuagcaaaaaa

SEQ ID NO: 834967 - RNA, 13 nt, Homo sapiens
ucuucacuugguu

SEQ ID NO: 834968 - RNA, 20 nt, Homo sapiens
ucuucccuaucuuugccacc

SEQ ID NO: 834969 - RNA, 19 nt, Homo sapiens
ucuuccuggauuauucaaa

SEQ ID NO: 834970 - RNA, 13 nt, Homo sapiens
ucuucucuacucu

SEQ ID NO: 834971 - RNA, 23 nt, Homo sapiens
ucuucugccccagcuuugcagga

SEQ ID NO: 834972 - RNA, 9 nt, Homo sapiens
ucuuuccau

SEQ ID NO: 834973 - RNA, 19 nt, Homo sapiens
ucuuucuuuuuuggccauc

SEQ ID NO: 834974 - RNA, 18 nt, Homo sapiens
ucuuuggacagaagcagc

SEQ ID NO: 834975 - RNA, 14 nt, Homo sapiens
ucuuuggacccuga

SEQ ID NO: 834976 - RNA, 12 nt, Homo sapiens
aaaaagccucca

SEQ ID NO: 834977 - RNA, 22 nt, Homo sapiens
aaaaagccuccaguccaaggaa

SEQ ID NO: 834978 - RNA, 21 nt, Homo sapiens
aaaaauagccugccucuucuc

SEQ ID NO: 834979 - RNA, 15 nt, Homo sapiens
aaaaaucccuuaccu

SEQ ID NO: 834980 - RNA, 14 nt, Homo sapiens
aaaaauuaggccgu

SEQ ID NO: 834981 - RNA, 18 nt, Homo sapiens
aaaaguggauggaagugu

SEQ ID NO: 834982 - RNA, 14 nt, Homo sapiens
aaaauagcucuugc

SEQ ID NO: 834983 - RNA, 22 nt, Homo sapiens
aaaauagggaaguaacaguaac

SEQ ID NO: 834984 - RNA, 19 nt, Homo sapiens
aaaaucucaauucuucccu

SEQ ID NO: 834985 - RNA, 19 nt, Homo sapiens
aaaaugaaaugcauuuugc

SEQ ID NO: 834986 - RNA, 15 nt, Homo sapiens
aaaaugacacaacuu

SEQ ID NO: 834987 - RNA, 18 nt, Homo sapiens
aaaaugauguauguugaa

SEQ ID NO: 834988 - RNA, 20 nt, Homo sapiens
aaaauuggaacucuacucaa

SEQ ID NO: 834989 - RNA, 14 nt, Homo sapiens
aaacaagacuucag

SEQ ID NO: 834990 - RNA, 13 nt, Homo sapiens
aaacacauuuacc

SEQ ID NO: 834991 - RNA, 22 nt, Homo sapiens
aaacauguauguaaauagcuaa

SEQ ID NO: 834992 - RNA, 21 nt, Homo sapiens
aaacauucaucaagcuguaca

SEQ ID NO: 834993 - RNA, 18 nt, Homo sapiens
aaaccuagcaucuuacaa

SEQ ID NO: 834994 - RNA, 17 nt, Homo sapiens
aaacguauugcauuuaa

SEQ ID NO: 834995 - RNA, 18 nt, Homo sapiens
aaacucuccucugcugcu

SEQ ID NO: 834996 - RNA, 13 nt, Homo sapiens
aaacuuuauucaa

SEQ ID NO: 834997 - RNA, 18 nt, Homo sapiens
aaagacgauuugucaguu

SEQ ID NO: 834998 - RNA, 20 nt, Homo sapiens
aaagcaggugcaacacucaa

SEQ ID NO: 834999 - RNA, 14 nt, Homo sapiens
aaaggaauccacuc

SEQ ID NO: 835000 - RNA, 22 nt, Homo sapiens
aaaggaauccacucccaggcag

SEQ ID NO: 835001 - RNA, 20 nt, Homo sapiens
aaaggcugagaacacuguga

SEQ ID NO: 835002 - RNA, 15 nt, Homo sapiens
aaauaaaagcacuua

SEQ ID NO: 835003 - RNA, 22 nt, Homo sapiens
aaauacacagugcugaccagac

SEQ ID NO: 835004 - RNA, 22 nt, Homo sapiens
aaauacaguuugucacaugaaa

SEQ ID NO: 835005 - RNA, 22 nt, Homo sapiens
aaauacuguuugagguuuuuaa

SEQ ID NO: 835006 - RNA, 22 nt, Homo sapiens
aaauagacccacaagaggcagu

SEQ ID NO: 835007 - RNA, 12 nt, Homo sapiens
aaauagugucug

SEQ ID NO: 835008 - RNA, 18 nt, Homo sapiens
aaaugauuucacagugug

SEQ ID NO: 835009 - RNA, 23 nt, Homo sapiens
aaaugcccagcuuaaaggggcua

SEQ ID NO: 835010 - RNA, 14 nt, Homo sapiens
aaauggcuuaucca

SEQ ID NO: 835011 - RNA, 21 nt, Homo sapiens
aaaugucuucuguauucacuu

SEQ ID NO: 835012 - RNA, 15 nt, Homo sapiens
aaauuauuuaucaag

SEQ ID NO: 835013 - RNA, 14 nt, Homo sapiens
aaauuuaaccuacu

SEQ ID NO: 835014 - RNA, 15 nt, Homo sapiens
aaauuuuuauguaau

SEQ ID NO: 835015 - RNA, 15 nt, Homo sapiens
aacacacagcuccca

SEQ ID NO: 835016 - RNA, 19 nt, Homo sapiens
aacacccucacacugggac

SEQ ID NO: 835017 - RNA, 20 nt, Homo sapiens
aacagacaagugacuguauc

SEQ ID NO: 835018 - RNA, 22 nt, Homo sapiens
aacagauaaucccuguauuuca

SEQ ID NO: 835019 - RNA, 16 nt, Homo sapiens
aacaugcuuuuccaaa

SEQ ID NO: 835020 - RNA, 22 nt, Homo sapiens
aacaugcuuuuccaaacccagg

SEQ ID NO: 835021 - RNA, 20 nt, Homo sapiens
aacauggccgugaacuuuau

SEQ ID NO: 835022 - RNA, 19 nt, Homo sapiens
aacauguaagcauaacuua

SEQ ID NO: 835023 - RNA, 16 nt, Homo sapiens
aacauuucuguucuca

SEQ ID NO: 835024 - RNA, 22 nt, Homo sapiens
aaccacuucagcugacuuuucu

SEQ ID NO: 835025 - RNA, 17 nt, Homo sapiens
aaccagagccugagugu

SEQ ID NO: 835026 - RNA, 23 nt, Homo sapiens
aaccagggccccggggccuguua

SEQ ID NO: 835027 - RNA, 16 nt, Homo sapiens
aaccccaucucuacaa

SEQ ID NO: 835028 - RNA, 22 nt, Homo sapiens
aacccggccugauuaaaguuaa

SEQ ID NO: 835029 - RNA, 21 nt, Homo sapiens
aacccuuucugggaugcaaua

SEQ ID NO: 835030 - RNA, 17 nt, Homo sapiens
aaccuagcaucuuacaa

SEQ ID NO: 835031 - RNA, 20 nt, Homo sapiens
aaccuccaccuucuggguuc

SEQ ID NO: 835032 - RNA, 13 nt, Homo sapiens
aaccuccuaaaau

SEQ ID NO: 835033 - RNA, 14 nt, Homo sapiens
aaccugaugcaguc

SEQ ID NO: 835034 - RNA, 12 nt, Homo sapiens
aacgcacaaaac

SEQ ID NO: 835035 - RNA, 18 nt, Homo sapiens
aacguccacagaguauaa

SEQ ID NO: 835036 - RNA, 19 nt, Homo sapiens
aacuagggaagauaauauu

SEQ ID NO: 835037 - RNA, 12 nt, Homo sapiens
aacucaguguga

SEQ ID NO: 835038 - RNA, 14 nt, Homo sapiens
aacucagugugacu

SEQ ID NO: 835039 - RNA, 18 nt, Homo sapiens
aacuggguuccugcaaug

SEQ ID NO: 835040 - RNA, 22 nt, Homo sapiens
aacuguuauuuauaaucacuuu

SEQ ID NO: 835041 - RNA, 20 nt, Homo sapiens
aacuuuguuuagcccaaaac

SEQ ID NO: 835042 - RNA, 20 nt, Homo sapiens
aagaaaucuuucucccucaa

SEQ ID NO: 835043 - RNA, 13 nt, Homo sapiens
aagaaccucucac

SEQ ID NO: 835044 - RNA, 22 nt, Homo sapiens
aagaaggccacuguuugucuca

SEQ ID NO: 835045 - RNA, 14 nt, Homo sapiens
aagaauuuaucucu

SEQ ID NO: 835046 - RNA, 18 nt, Homo sapiens
aagaccuucuccuucacc

SEQ ID NO: 835047 - RNA, 21 nt, Homo sapiens
aagacgauuugucaguuauuu

SEQ ID NO: 835048 - RNA, 14 nt, Homo sapiens
aagacgugauucaa

SEQ ID NO: 835049 - RNA, 19 nt, Homo sapiens
aagacuuuggaaagacuuu

SEQ ID NO: 835050 - RNA, 19 nt, Homo sapiens
aagaguaggaagacuuugg

SEQ ID NO: 835051 - RNA, 19 nt, Homo sapiens
aagagugcuaagcauuagc

SEQ ID NO: 835052 - RNA, 12 nt, Homo sapiens
aagcaagcuccc

SEQ ID NO: 835053 - RNA, 20 nt, Homo sapiens
aagcacaggugggcuuccca

SEQ ID NO: 835054 - RNA, 13 nt, Homo sapiens
aagcauaacuuau

SEQ ID NO: 835055 - RNA, 13 nt, Homo sapiens
aagcauuagcuuu

SEQ ID NO: 835056 - RNA, 14 nt, Homo sapiens
aagcccauucauuc

SEQ ID NO: 835057 - RNA, 17 nt, Homo sapiens
aagccuuugagacuguu

SEQ ID NO: 835058 - RNA, 14 nt, Homo sapiens
aagcucauccauuu

SEQ ID NO: 835059 - RNA, 17 nt, Homo sapiens
aagcugugcccugacca

SEQ ID NO: 835060 - RNA, 20 nt, Homo sapiens
aaggacugcagccacugauu

SEQ ID NO: 835061 - RNA, 13 nt, Homo sapiens
aaggacugugaca

SEQ ID NO: 835062 - RNA, 20 nt, Homo sapiens
aaggagacacaacaacuccu

SEQ ID NO: 835063 - RNA, 15 nt, Homo sapiens
aaggagauaagaaag

SEQ ID NO: 835064 - RNA, 16 nt, Homo sapiens
aaggaggccacgugau

SEQ ID NO: 835065 - RNA, 18 nt, Homo sapiens
aaggaugugggggaagac

SEQ ID NO: 835066 - RNA, 15 nt, Homo sapiens
aaggcacugccugau

SEQ ID NO: 835067 - RNA, 19 nt, Homo sapiens
aaggccacuguuugucuca

SEQ ID NO: 835068 - RNA, 18 nt, Homo sapiens
aaggcugagaacacugug

SEQ ID NO: 835069 - RNA, 19 nt, Homo sapiens
aaggcuugaaguaaccuua

SEQ ID NO: 835070 - RNA, 14 nt, Homo sapiens
aagggagaaaauaa

SEQ ID NO: 835071 - RNA, 15 nt, Homo sapiens
aaggguaucugguga

SEQ ID NO: 835072 - RNA, 21 nt, Homo sapiens
aagggucucccucuguugcca

SEQ ID NO: 835073 - RNA, 18 nt, Homo sapiens
aagguauuuauugagcac

SEQ ID NO: 835074 - RNA, 11 nt, Homo sapiens
aagguucucuc

SEQ ID NO: 835075 - RNA, 14 nt, Homo sapiens
aaguaugugcauau

SEQ ID NO: 835076 - RNA, 16 nt, Homo sapiens
aagucgucuuaacuca

SEQ ID NO: 835077 - RNA, 14 nt, Homo sapiens
aagucuauugaaua

SEQ ID NO: 835078 - RNA, 19 nt, Homo sapiens
aagugagacccugucucaa

SEQ ID NO: 835079 - RNA, 22 nt, Homo sapiens
aagugcacaacauuacagggaa

SEQ ID NO: 835080 - RNA, 15 nt, Homo sapiens
aagugcugggaauua

SEQ ID NO: 835081 - RNA, 19 nt, Homo sapiens
aagugguacuaacuuuccu

SEQ ID NO: 835082 - RNA, 23 nt, Homo sapiens
aaguugauauagaacagugcuug

SEQ ID NO: 835083 - RNA, 13 nt, Homo sapiens
aaguuugagauca

SEQ ID NO: 835084 - RNA, 17 nt, Homo sapiens
aauaaaguuaaacugau

SEQ ID NO: 835085 - RNA, 22 nt, Homo sapiens
aauaaauucccuggccuuucau

SEQ ID NO: 835086 - RNA, 18 nt, Homo sapiens
aauacaaacaccuggacu

SEQ ID NO: 835087 - RNA, 18 nt, Homo sapiens
aauaccuggccucauuua

SEQ ID NO: 835088 - RNA, 15 nt, Homo sapiens
aauagcacaugauuu

SEQ ID NO: 835089 - RNA, 16 nt, Homo sapiens
aauagggaaguaacag

SEQ ID NO: 835090 - RNA, 19 nt, Homo sapiens
aauaguucccuagucuauu

SEQ ID NO: 835091 - RNA, 23 nt, Homo sapiens
aauaucccuuggacauuuuaugu

SEQ ID NO: 835092 - RNA, 15 nt, Homo sapiens
aauauuuauaagcua

SEQ ID NO: 835093 - RNA, 20 nt, Homo sapiens
aaucaaagcagauauauuaa

SEQ ID NO: 835094 - RNA, 21 nt, Homo sapiens
aaucaucugcauuccugauga

SEQ ID NO: 835095 - RNA, 23 nt, Homo sapiens
aaucuaccaacgaaagacgugau

SEQ ID NO: 835096 - RNA, 17 nt, Homo sapiens
aaucucaauucuucccu

SEQ ID NO: 835097 - RNA, 14 nt, Homo sapiens
aaucucuccaccuu

SEQ ID NO: 835098 - RNA, 19 nt, Homo sapiens
aaucucucuuagaguccag

SEQ ID NO: 835099 - RNA, 13 nt, Homo sapiens
aaugaacagugau

SEQ ID NO: 835100 - RNA, 17 nt, Homo sapiens
aaugauuucacagugug

SEQ ID NO: 835101 - RNA, 23 nt, Homo sapiens
aaugauuucacagugugugguca

SEQ ID NO: 835102 - RNA, 23 nt, Homo sapiens
aaugcauuuugcuagacaguuaa

SEQ ID NO: 835103 - RNA, 15 nt, Homo sapiens
aaugcucuggucuau

SEQ ID NO: 835104 - RNA, 16 nt, Homo sapiens
aaugcugauguccuca

SEQ ID NO: 835105 - RNA, 17 nt, Homo sapiens
aaugcuuuaggauguac

SEQ ID NO: 835106 - RNA, 15 nt, Homo sapiens
aauggcuacaucucc

SEQ ID NO: 835107 - RNA, 15 nt, Homo sapiens
aaugggaaaaccaga

SEQ ID NO: 835108 - RNA, 16 nt, Homo sapiens
aaugucuuccuggauu

SEQ ID NO: 835109 - RNA, 17 nt, Homo sapiens
aauguucuccagucauu

SEQ ID NO: 835110 - RNA, 22 nt, Homo sapiens
aauguuguuuuaggaauacaua

SEQ ID NO: 835111 - RNA, 13 nt, Homo sapiens
aauuaaaugcuca

SEQ ID NO: 835112 - RNA, 21 nt, Homo sapiens
aauuaguuccucauuagcauu

SEQ ID NO: 835113 - RNA, 18 nt, Homo sapiens
aauucccuggccuuucau

SEQ ID NO: 835114 - RNA, 24 nt, Homo sapiens
aauucuaacgcaaaaauagcucuu

SEQ ID NO: 835115 - RNA, 23 nt, Homo sapiens
aauugugaagucgucuuaacuca

SEQ ID NO: 835116 - RNA, 23 nt, Homo sapiens
aauuguuuuuaaguuuucaugaa

SEQ ID NO: 835117 - RNA, 12 nt, Homo sapiens
aauuuaaccuac

SEQ ID NO: 835118 - RNA, 19 nt, Homo sapiens
aauuuaucucuuuaguuag

SEQ ID NO: 835119 - RNA, 22 nt, Homo sapiens
aauuucccucugauaugucuag

SEQ ID NO: 835120 - RNA, 19 nt, Homo sapiens
aauuuuaaaaugaaaugca

SEQ ID NO: 835121 - RNA, 13 nt, Homo sapiens
acaaacucaccau

SEQ ID NO: 835122 - RNA, 15 nt, Homo sapiens
acaaauugcauuugu

SEQ ID NO: 835123 - RNA, 13 nt, Homo sapiens
acaacaugguguc

SEQ ID NO: 835124 - RNA, 15 nt, Homo sapiens
acaagacacccaagu

SEQ ID NO: 835125 - RNA, 15 nt, Homo sapiens
acaagagggacaagu

SEQ ID NO: 835126 - RNA, 16 nt, Homo sapiens
acaagcugcacccuca

SEQ ID NO: 835127 - RNA, 11 nt, Homo sapiens
acaaugcauuc

SEQ ID NO: 835128 - RNA, 21 nt, Homo sapiens
acaauuugagauguauuucaa

SEQ ID NO: 835129 - RNA, 22 nt, Homo sapiens
acaauuugcaguaaacuuuuaa

SEQ ID NO: 835130 - RNA, 17 nt, Homo sapiens
acacagcucccauaacc

SEQ ID NO: 835131 - RNA, 16 nt, Homo sapiens
acacauuuacccuuug

SEQ ID NO: 835132 - RNA, 20 nt, Homo sapiens
acaccaggauuuaaguuuca

SEQ ID NO: 835133 - RNA, 16 nt, Homo sapiens
acacucaaaagcuggg

SEQ ID NO: 835134 - RNA, 15 nt, Homo sapiens
acacugcaggcauca

SEQ ID NO: 835135 - RNA, 19 nt, Homo sapiens
acacugcugcuccagugca

SEQ ID NO: 835136 - RNA, 21 nt, Homo sapiens
acacugcugcuccagugcagg

SEQ ID NO: 835137 - RNA, 16 nt, Homo sapiens
acacuguaaacauuca

SEQ ID NO: 835138 - RNA, 15 nt, Homo sapiens
acagauucacacugu

SEQ ID NO: 835139 - RNA, 17 nt, Homo sapiens
guuuugugagaacuaau

SEQ ID NO: 835140 - RNA, 12 nt, Homo sapiens
uaaaagcacuua

SEQ ID NO: 835141 - RNA, 21 nt, Homo sapiens
uaaaauggagacaccaccacc

SEQ ID NO: 835142 - RNA, 17 nt, Homo sapiens
uaaagcuuugugcagau

SEQ ID NO: 835143 - RNA, 17 nt, Homo sapiens
uaaagguccuggcaaag

SEQ ID NO: 835144 - RNA, 13 nt, Homo sapiens
uaaauaaccaauu

SEQ ID NO: 835145 - RNA, 18 nt, Homo sapiens
uaaauaaccaauuccuca

SEQ ID NO: 835146 - RNA, 12 nt, Homo sapiens
uaaauagcuaag

SEQ ID NO: 835147 - RNA, 20 nt, Homo sapiens
uaaauucccuggccuuucau

SEQ ID NO: 835148 - RNA, 17 nt, Homo sapiens
uaacaaauugcauuugu

SEQ ID NO: 835149 - RNA, 12 nt, Homo sapiens
uaacacacagcu

SEQ ID NO: 835150 - RNA, 22 nt, Homo sapiens
uaacccuuucugggaugcaaua

SEQ ID NO: 835151 - RNA, 14 nt, Homo sapiens
uaaccuacuagaca

SEQ ID NO: 835152 - RNA, 22 nt, Homo sapiens
uaaccucugagucaccaucuua

SEQ ID NO: 835153 - RNA, 21 nt, Homo sapiens
uaacgcaaaaauagcucuugc

SEQ ID NO: 835154 - RNA, 18 nt, Homo sapiens
uaacucuaccugcacacu

SEQ ID NO: 835155 - RNA, 19 nt, Homo sapiens
uaagaacuaaaauguucua

SEQ ID NO: 835156 - RNA, 13 nt, Homo sapiens
uaagaagggaaaa

SEQ ID NO: 835157 - RNA, 13 nt, Homo sapiens
uaagaaugaaaua

SEQ ID NO: 835158 - RNA, 20 nt, Homo sapiens
uaagcacuuuaacacagugu

SEQ ID NO: 835159 - RNA, 15 nt, Homo sapiens
uaaggaauaccuguc

SEQ ID NO: 835160 - RNA, 15 nt, Homo sapiens
uaaggcauauacaaa

SEQ ID NO: 835161 - RNA, 18 nt, Homo sapiens
uaagggagaaaauaaucc

SEQ ID NO: 835162 - RNA, 14 nt, Homo sapiens
uaaguaaucucaca

SEQ ID NO: 835163 - RNA, 12 nt, Homo sapiens
uaaguacaaaua

SEQ ID NO: 835164 - RNA, 14 nt, Homo sapiens
uaagucucugugaa

SEQ ID NO: 835165 - RNA, 19 nt, Homo sapiens
uaagucuguuuuaugacuu

SEQ ID NO: 835166 - RNA, 21 nt, Homo sapiens
uaauaaauuauuuauuauuaa

SEQ ID NO: 835167 - RNA, 15 nt, Homo sapiens
uaauagaagcuuaaa

SEQ ID NO: 835168 - RNA, 21 nt, Homo sapiens
uaaugguaguuuuacaguguu

SEQ ID NO: 835169 - RNA, 14 nt, Homo sapiens
uaauuaaaugcuca

SEQ ID NO: 835170 - RNA, 15 nt, Homo sapiens
uaauuaaaugcucau

SEQ ID NO: 835171 - RNA, 14 nt, Homo sapiens
uaauuaguuccuca

SEQ ID NO: 835172 - RNA, 19 nt, Homo sapiens
uacaaugcauucugaggua

SEQ ID NO: 835173 - RNA, 22 nt, Homo sapiens
uacacaguggccaagcggccau

SEQ ID NO: 835174 - RNA, 18 nt, Homo sapiens
uacagggcauucaaaugg

SEQ ID NO: 835175 - RNA, 16 nt, Homo sapiens
uacaggugaagcacca

SEQ ID NO: 835176 - RNA, 14 nt, Homo sapiens
uacaucuccaaaua

SEQ ID NO: 835177 - RNA, 16 nt, Homo sapiens
uaccacaaacacauua

SEQ ID NO: 835178 - RNA, 20 nt, Homo sapiens
uaccacaugccaagcacugu

SEQ ID NO: 835179 - RNA, 17 nt, Homo sapiens
uaccacugcucugauga

SEQ ID NO: 835180 - RNA, 14 nt, Homo sapiens
uaccugcacacugu

SEQ ID NO: 835181 - RNA, 20 nt, Homo sapiens
uacuaacuuuccuucauuca

SEQ ID NO: 835182 - RNA, 14 nt, Homo sapiens
uacuauauauguga

SEQ ID NO: 835183 - RNA, 20 nt, Homo sapiens
uacucaccucaccccacugu

SEQ ID NO: 835184 - RNA, 14 nt, Homo sapiens
uacugagacauuac

SEQ ID NO: 835185 - RNA, 23 nt, Homo sapiens
uacugcagcuuuguuuguuguca

SEQ ID NO: 835186 - RNA, 16 nt, Homo sapiens
uacuuuuaaaugucuu

SEQ ID NO: 835187 - RNA, 22 nt, Homo sapiens
uagaagguucucuccuccccaa

SEQ ID NO: 835188 - RNA, 16 nt, Homo sapiens
uagagugggacaguuc

SEQ ID NO: 835189 - RNA, 14 nt, Homo sapiens
uagaugaaugucag

SEQ ID NO: 835190 - RNA, 22 nt, Homo sapiens
uagcagcagggagggcuucugc

SEQ ID NO: 835191 - RNA, 15 nt, Homo sapiens
uagccaaguguggua

SEQ ID NO: 835192 - RNA, 18 nt, Homo sapiens
uagcuuagcaucagaggu

SEQ ID NO: 835193 - RNA, 22 nt, Homo sapiens
uagcuuuaauuaagcucucaua

SEQ ID NO: 835194 - RNA, 16 nt, Homo sapiens
uaggaacacuccuuca

SEQ ID NO: 835195 - RNA, 19 nt, Homo sapiens
uaggauuucuguauuugcc

SEQ ID NO: 835196 - RNA, 14 nt, Homo sapiens
uagggaaaaaccag

SEQ ID NO: 835197 - RNA, 17 nt, Homo sapiens
uaguuacuaaacaugua

SEQ ID NO: 835198 - RNA, 18 nt, Homo sapiens
uaguuacuaaacauguau

SEQ ID NO: 835199 - RNA, 16 nt, Homo sapiens
uaguuagugauuauau

SEQ ID NO: 835200 - RNA, 19 nt, Homo sapiens
uaguucaaucuggauucau

SEQ ID NO: 835201 - RNA, 22 nt, Homo sapiens
uaguuguaauuuuuuuguggga

SEQ ID NO: 835202 - RNA, 17 nt, Homo sapiens
uaguuuuuaaucucucc

SEQ ID NO: 835203 - RNA, 17 nt, Homo sapiens
uauaauuuaaacgugau

SEQ ID NO: 835204 - RNA, 16 nt, Homo sapiens
uauauaaccacauuuc

SEQ ID NO: 835205 - RNA, 18 nt, Homo sapiens
uaucuuugccacccucau

SEQ ID NO: 835206 - RNA, 15 nt, Homo sapiens
uaugaaaaugucauu

SEQ ID NO: 835207 - RNA, 15 nt, Homo sapiens
uaugacaucagcaau

SEQ ID NO: 835208 - RNA, 15 nt, Homo sapiens
uaugugcacaucugu

SEQ ID NO: 835209 - RNA, 20 nt, Homo sapiens
uauuaacaaauugcauuugu

SEQ ID NO: 835210 - RNA, 17 nt, Homo sapiens
uauucaaaaugauguau

SEQ ID NO: 835211 - RNA, 22 nt, Homo sapiens
uauugaaaugauuucacagugu

SEQ ID NO: 835212 - RNA, 16 nt, Homo sapiens
uauugagcaccugcag

SEQ ID NO: 835213 - RNA, 16 nt, Homo sapiens
uauuuaccagaccaca

SEQ ID NO: 835214 - RNA, 15 nt, Homo sapiens
uauuuauaaucacuu

SEQ ID NO: 835215 - RNA, 17 nt, Homo sapiens
uauuuaucaaguguauu

SEQ ID NO: 835216 - RNA, 19 nt, Homo sapiens
uauuuauugagcaccugca

SEQ ID NO: 835217 - RNA, 21 nt, Homo sapiens
uauuuuuguacugaaucucau

SEQ ID NO: 835218 - RNA, 19 nt, Homo sapiens
ucaaaccaaaucacugaac

SEQ ID NO: 835219 - RNA, 23 nt, Homo sapiens
ucaaacggccucacuaggcuucu

SEQ ID NO: 835220 - RNA, 23 nt, Homo sapiens
ucaaacuacuuugcugcuaauau

SEQ ID NO: 835221 - RNA, 19 nt, Homo sapiens
ucaacuguuuuugucuaca

SEQ ID NO: 835222 - RNA, 18 nt, Homo sapiens
ucaaguacuguaacugug

SEQ ID NO: 835223 - RNA, 15 nt, Homo sapiens
ucaagucuauugaau

SEQ ID NO: 835224 - RNA, 14 nt, Homo sapiens
ucaaguguauuuga

SEQ ID NO: 835225 - RNA, 20 nt, Homo sapiens
ucaauccaagagucugauga

SEQ ID NO: 835226 - RNA, 18 nt, Homo sapiens
ucaaucccaggauguaca

SEQ ID NO: 835227 - RNA, 22 nt, Homo sapiens
ucaaugagcauguuuagacuuu

SEQ ID NO: 835228 - RNA, 17 nt, Homo sapiens
ucaauguuuagcagauu

SEQ ID NO: 835229 - RNA, 16 nt, Homo sapiens
ucacaaacuacaaagc

SEQ ID NO: 835230 - RNA, 19 nt, Homo sapiens
ucacaaguuacagcuguga

SEQ ID NO: 835231 - RNA, 23 nt, Homo sapiens
ucacacugggacuugcaaaaagg

SEQ ID NO: 835232 - RNA, 17 nt, Homo sapiens
ucacacuguaaacauuc

SEQ ID NO: 835233 - RNA, 13 nt, Homo sapiens
ucacagcauuugc

SEQ ID NO: 835234 - RNA, 20 nt, Homo sapiens
ucacaguuuugguugcuuua

SEQ ID NO: 835235 - RNA, 17 nt, Homo sapiens
ucacauguggacuuuua

SEQ ID NO: 835236 - RNA, 16 nt, Homo sapiens
ucaccgaggacaugaa

SEQ ID NO: 835237 - RNA, 17 nt, Homo sapiens
ucaccgaggacaugaaa

SEQ ID NO: 835238 - RNA, 18 nt, Homo sapiens
ucaccuaagucucuguga

SEQ ID NO: 835239 - RNA, 21 nt, Homo sapiens
ucagaaacacccucacacugg

SEQ ID NO: 835240 - RNA, 20 nt, Homo sapiens
ucagaaucacuucugagaac

SEQ ID NO: 835241 - RNA, 18 nt, Homo sapiens
ucaggaccaggcaaugug

SEQ ID NO: 835242 - RNA, 13 nt, Homo sapiens
ucagggucccugg

SEQ ID NO: 835243 - RNA, 20 nt, Homo sapiens
ucaguaagacgacaaggaaa

SEQ ID NO: 835244 - RNA, 17 nt, Homo sapiens
ucaguccaaagggcaug

SEQ ID NO: 835245 - RNA, 16 nt, Homo sapiens
ucaguugcauucauua

SEQ ID NO: 835246 - RNA, 18 nt, Homo sapiens
ucauaaggcauauacaaa

SEQ ID NO: 835247 - RNA, 14 nt, Homo sapiens
ucauacucaccuca

SEQ ID NO: 835248 - RNA, 19 nt, Homo sapiens
ucaucaaauggaagacaca

SEQ ID NO: 835249 - RNA, 18 nt, Homo sapiens
ucaucaaggcacugccug

SEQ ID NO: 835250 - RNA, 22 nt, Homo sapiens
ucaucaguauugaagcauuuua

SEQ ID NO: 835251 - RNA, 22 nt, Homo sapiens
ucaucauuucacuugucaggag

SEQ ID NO: 835252 - RNA, 21 nt, Homo sapiens
ucaucuguaaaauggagacac

SEQ ID NO: 835253 - RNA, 24 nt, Homo sapiens
ucaugcaaaggcugggaccacgug

SEQ ID NO: 835254 - RNA, 16 nt, Homo sapiens
ucauuccauucuggaa

SEQ ID NO: 835255 - RNA, 21 nt, Homo sapiens
ucauucuuuuugaaaugucaa

SEQ ID NO: 835256 - RNA, 20 nt, Homo sapiens
ucauugaccugaggcccuuc

SEQ ID NO: 835257 - RNA, 15 nt, Homo sapiens
ucauuuaucaucaca

SEQ ID NO: 835258 - RNA, 14 nt, Homo sapiens
uccaaaggccaugg

SEQ ID NO: 835259 - RNA, 14 nt, Homo sapiens
uccacagaguauaa

SEQ ID NO: 835260 - RNA, 15 nt, Homo sapiens
uccacucccaggcag

SEQ ID NO: 835261 - RNA, 12 nt, Homo sapiens
uccagacacaug

SEQ ID NO: 835262 - RNA, 20 nt, Homo sapiens
ggagaaguaauccuagggaa

SEQ ID NO: 835263 - RNA, 14 nt, Homo sapiens
ggagaccuggcacu

SEQ ID NO: 835264 - RNA, 17 nt, Homo sapiens
ggagaccuggcacugga

SEQ ID NO: 835265 - RNA, 16 nt, Homo sapiens
ggagacuuuacaugga

SEQ ID NO: 835266 - RNA, 16 nt, Homo sapiens
ggagagcuggagccug

SEQ ID NO: 835267 - RNA, 21 nt, Homo sapiens
ggagcuugaaauagugucuga

SEQ ID NO: 835268 - RNA, 16 nt, Homo sapiens
ggaguggcauguauga

SEQ ID NO: 835269 - RNA, 18 nt, Homo sapiens
ggaguguggccacguggg

SEQ ID NO: 835270 - RNA, 15 nt, Homo sapiens
ggauagagugggaca

SEQ ID NO: 835271 - RNA, 13 nt, Homo sapiens
ggaucuuuggaca

SEQ ID NO: 835272 - RNA, 21 nt, Homo sapiens
ggaugccaaccggucacccag

SEQ ID NO: 835273 - RNA, 14 nt, Homo sapiens
ggauggaagugucu

SEQ ID NO: 835274 - RNA, 21 nt, Homo sapiens
ggcaauguucccccucuccuc

SEQ ID NO: 835275 - RNA, 23 nt, Homo sapiens
ggcaucaccuccaccauacucca

SEQ ID NO: 835276 - RNA, 20 nt, Homo sapiens
ggccaagaucacaguggcca

SEQ ID NO: 835277 - RNA, 16 nt, Homo sapiens
ggccacagucauggug

SEQ ID NO: 835278 - RNA, 16 nt, Homo sapiens
ggccacccugccucua

SEQ ID NO: 835279 - RNA, 13 nt, Homo sapiens
ggccagaauuuca

SEQ ID NO: 835280 - RNA, 20 nt, Homo sapiens
ggccaucucuggaugccuga

SEQ ID NO: 835281 - RNA, 16 nt, Homo sapiens
ggcccaaugcacuuug

SEQ ID NO: 835282 - RNA, 19 nt, Homo sapiens
ggccuccugugcaucugua

SEQ ID NO: 835283 - RNA, 12 nt, Homo sapiens
ggcgcaaagggc

SEQ ID NO: 835284 - RNA, 18 nt, Homo sapiens
ggcgcaaagggcaugggu

SEQ ID NO: 835285 - RNA, 22 nt, Homo sapiens
ggcggaucuuuggacagaagca

SEQ ID NO: 835286 - RNA, 16 nt, Homo sapiens
ggcuagugucuaucag

SEQ ID NO: 835287 - RNA, 19 nt, Homo sapiens
ggcugaaggacugugacag

SEQ ID NO: 835288 - RNA, 16 nt, Homo sapiens
ggcugagaacacugug

SEQ ID NO: 835289 - RNA, 18 nt, Homo sapiens
ggcugcacccacccagga

SEQ ID NO: 835290 - RNA, 14 nt, Homo sapiens
ggcuggagugcagu

SEQ ID NO: 835291 - RNA, 20 nt, Homo sapiens
ggcuggagugcaguggcgca

SEQ ID NO: 835292 - RNA, 13 nt, Homo sapiens
ggcuggcacugac

SEQ ID NO: 835293 - RNA, 15 nt, Homo sapiens
ggcugggaguggcau

SEQ ID NO: 835294 - RNA, 19 nt, Homo sapiens
ggcuuaagugagcagaaca

SEQ ID NO: 835295 - RNA, 15 nt, Homo sapiens
gggaauaaacuguug

SEQ ID NO: 835296 - RNA, 16 nt, Homo sapiens
gggaauaauagcacau

SEQ ID NO: 835297 - RNA, 13 nt, Homo sapiens
gggacagggauga

SEQ ID NO: 835298 - RNA, 15 nt, Homo sapiens
gggagagccuuccag

SEQ ID NO: 835299 - RNA, 23 nt, Homo sapiens
gggcacgagagagucuuccaggu

SEQ ID NO: 835300 - RNA, 22 nt, Homo sapiens
gggccaguuggucccccuucca

SEQ ID NO: 835301 - RNA, 22 nt, Homo sapiens
gggcuuggcugugcccucagau

SEQ ID NO: 835302 - RNA, 17 nt, Homo sapiens
gggcuuuagggaccugc

SEQ ID NO: 835303 - RNA, 15 nt, Homo sapiens
gggucucaguguccu

SEQ ID NO: 835304 - RNA, 21 nt, Homo sapiens
ggguguggcgcagcauauuca

SEQ ID NO: 835305 - RNA, 19 nt, Homo sapiens
gguauuuauugagcaccug

SEQ ID NO: 835306 - RNA, 12 nt, Homo sapiens
ggucacccagga

SEQ ID NO: 835307 - RNA, 20 nt, Homo sapiens
ggugggagugggcccaaugc

SEQ ID NO: 835308 - RNA, 22 nt, Homo sapiens
gguggggagcaaaucaucugca

SEQ ID NO: 835309 - RNA, 16 nt, Homo sapiens
gguucuacccaggugc

SEQ ID NO: 835310 - RNA, 15 nt, Homo sapiens
guaagcauaacuuau

SEQ ID NO: 835311 - RNA, 14 nt, Homo sapiens
guaaguguucucau

SEQ ID NO: 835312 - RNA, 21 nt, Homo sapiens
guaaucucacagcauuugcca

SEQ ID NO: 835313 - RNA, 12 nt, Homo sapiens
guaccucucuuu

SEQ ID NO: 835314 - RNA, 16 nt, Homo sapiens
guacuuuuuacauaca

SEQ ID NO: 835315 - RNA, 15 nt, Homo sapiens
guagcguacaucaau

SEQ ID NO: 835316 - RNA, 20 nt, Homo sapiens
guauacugggggcaaaauca

SEQ ID NO: 835317 - RNA, 16 nt, Homo sapiens
guauguugaagccuuu

SEQ ID NO: 835318 - RNA, 18 nt, Homo sapiens
guauuuauugagcaccug

SEQ ID NO: 835319 - RNA, 15 nt, Homo sapiens
gucacucuggcagcu

SEQ ID NO: 835320 - RNA, 21 nt, Homo sapiens
gucacuuuguuuuacugucuu

SEQ ID NO: 835321 - RNA, 20 nt, Homo sapiens
gucagaauuucccucugaua

SEQ ID NO: 835322 - RNA, 23 nt, Homo sapiens
gucaucaggagaaaaagccucca

SEQ ID NO: 835323 - RNA, 21 nt, Homo sapiens
gucauuuuuauaaaacuuuga

SEQ ID NO: 835324 - RNA, 19 nt, Homo sapiens
guccaaggaaaccacagcu

SEQ ID NO: 835325 - RNA, 18 nt, Homo sapiens
gucccaagcggugucucu

SEQ ID NO: 835326 - RNA, 15 nt, Homo sapiens
gucccaggcuuccca

SEQ ID NO: 835327 - RNA, 13 nt, Homo sapiens
guccgagcuuuga

SEQ ID NO: 835328 - RNA, 17 nt, Homo sapiens
guccuucacaucaccca

SEQ ID NO: 835329 - RNA, 18 nt, Homo sapiens
guccuucacaucacccau

SEQ ID NO: 835330 - RNA, 15 nt, Homo sapiens
guccuuuuucacuuu

SEQ ID NO: 835331 - RNA, 16 nt, Homo sapiens
gucgggggcuguggau

SEQ ID NO: 835332 - RNA, 16 nt, Homo sapiens
gucgucuuaacucacc

SEQ ID NO: 835333 - RNA, 15 nt, Homo sapiens
gucuauauaaccaca

SEQ ID NO: 835334 - RNA, 14 nt, Homo sapiens
gucucauacucacc

SEQ ID NO: 835335 - RNA, 21 nt, Homo sapiens
gucucugaagugaaacugcuu

SEQ ID NO: 835336 - RNA, 16 nt, Homo sapiens
gucuuccagguacuga

SEQ ID NO: 835337 - RNA, 16 nt, Homo sapiens
gucuucuguauucacu

SEQ ID NO: 835338 - RNA, 15 nt, Homo sapiens
gugaaaacugguuaa

SEQ ID NO: 835339 - RNA, 15 nt, Homo sapiens
gugaagcaccaagcu

SEQ ID NO: 835340 - RNA, 23 nt, Homo sapiens
gugaagucgucuuaacucaccau

SEQ ID NO: 835341 - RNA, 18 nt, Homo sapiens
gugacagcuuucugggau

SEQ ID NO: 835342 - RNA, 23 nt, Homo sapiens
gugacagcuuucugggaugucac

SEQ ID NO: 835343 - RNA, 16 nt, Homo sapiens
gugacauguguuggca

SEQ ID NO: 835344 - RNA, 16 nt, Homo sapiens
gugaccucagcuuuga

SEQ ID NO: 835345 - RNA, 21 nt, Homo sapiens
gugaccugacagcccaagggu

SEQ ID NO: 835346 - RNA, 13 nt, Homo sapiens
gugacuggccugc

SEQ ID NO: 835347 - RNA, 22 nt, Homo sapiens
gugagcuggauagacuugggau

SEQ ID NO: 835348 - RNA, 20 nt, Homo sapiens
gugccacaaauaaaauggau

SEQ ID NO: 835349 - RNA, 12 nt, Homo sapiens
guggacaggugu

SEQ ID NO: 835350 - RNA, 15 nt, Homo sapiens
guggcacugccaugc

SEQ ID NO: 835351 - RNA, 15 nt, Homo sapiens
guggccugaucagca

SEQ ID NO: 835352 - RNA, 14 nt, Homo sapiens
gugggauccuccag

SEQ ID NO: 835353 - RNA, 21 nt, Homo sapiens
gugggauggcauuuggucuca

SEQ ID NO: 835354 - RNA, 14 nt, Homo sapiens
guggggacagggau

SEQ ID NO: 835355 - RNA, 13 nt, Homo sapiens
guggucacuggaa

SEQ ID NO: 835356 - RNA, 14 nt, Homo sapiens
gugucauaccacaa

SEQ ID NO: 835357 - RNA, 14 nt, Homo sapiens
gugugacucauuaa

SEQ ID NO: 835358 - RNA, 16 nt, Homo sapiens
guguucacacuguaaa

SEQ ID NO: 835359 - RNA, 22 nt, Homo sapiens
guguucacacuguaaacauuca

SEQ ID NO: 835360 - RNA, 17 nt, Homo sapiens
guguuggcagccucuuc

SEQ ID NO: 835361 - RNA, 14 nt, Homo sapiens
guguuuguuggcaa

SEQ ID NO: 835362 - RNA, 19 nt, Homo sapiens
guuaacuauuuauucccug

SEQ ID NO: 835363 - RNA, 17 nt, Homo sapiens
guuaugcuuuacugcga

SEQ ID NO: 835364 - RNA, 19 nt, Homo sapiens
guuauuacagggcauucaa

SEQ ID NO: 835365 - RNA, 21 nt, Homo sapiens
guucaaucuggauucauauuu

SEQ ID NO: 835366 - RNA, 14 nt, Homo sapiens
guucccauucugag

SEQ ID NO: 835367 - RNA, 15 nt, Homo sapiens
guuccgagaagaaca

SEQ ID NO: 835368 - RNA, 19 nt, Homo sapiens
guucuacccuccaugugag

SEQ ID NO: 835369 - RNA, 16 nt, Homo sapiens
guugaauuucccacau

SEQ ID NO: 835370 - RNA, 23 nt, Homo sapiens
guugaauuucccacauacccucc

SEQ ID NO: 835371 - RNA, 15 nt, Homo sapiens
guugaugccugugaa

SEQ ID NO: 835372 - RNA, 19 nt, Homo sapiens
guugauucagcucugcaag

SEQ ID NO: 835373 - RNA, 17 nt, Homo sapiens
guugcacggcugcugag

SEQ ID NO: 835374 - RNA, 13 nt, Homo sapiens
guuggaacauccu

SEQ ID NO: 835375 - RNA, 16 nt, Homo sapiens
guuggucccccuucca

SEQ ID NO: 835376 - RNA, 22 nt, Homo sapiens
guuguuugauucagacagcugc

SEQ ID NO: 835377 - RNA, 14 nt, Homo sapiens
guuuaagacauuuu

SEQ ID NO: 835378 - RNA, 15 nt, Homo sapiens
guuuauguagucagu

SEQ ID NO: 835379 - RNA, 20 nt, Homo sapiens
guuucaaguacuguaacugu

SEQ ID NO: 835380 - RNA, 23 nt, Homo sapiens
guuuccuagcgcagccaugugau

SEQ ID NO: 835381 - RNA, 22 nt, Homo sapiens
guuucugaaccauuacuguaau

SEQ ID NO: 835382 - RNA, 21 nt, Homo sapiens
guuuguccuuuuucacuuuga

SEQ ID NO: 835383 - RNA, 19 nt, Homo sapiens
guuuucaucaagacuggaa

SEQ ID NO: 835384 - RNA, 16 nt, Homo sapiens
guuuugguugcuuuaa

SEQ ID NO: 835385 - RNA, 17 nt, Homo sapiens
ccugcuauguauuugca

SEQ ID NO: 835386 - RNA, 18 nt, Homo sapiens
ccugcuauguauuugcaa

SEQ ID NO: 835387 - RNA, 20 nt, Homo sapiens
ccuggaucucacaagcacuu

SEQ ID NO: 835388 - RNA, 22 nt, Homo sapiens
ccuggcaaggacacagaugaaa

SEQ ID NO: 835389 - RNA, 16 nt, Homo sapiens
ccuggcagagccaugg

SEQ ID NO: 835390 - RNA, 12 nt, Homo sapiens
ccuggcauuugg

SEQ ID NO: 835391 - RNA, 14 nt, Homo sapiens
ccugggcaauguga

SEQ ID NO: 835392 - RNA, 12 nt, Homo sapiens
ccuggugcccua

SEQ ID NO: 835393 - RNA, 15 nt, Homo sapiens
ccuggugcugcugcu

SEQ ID NO: 835394 - RNA, 18 nt, Homo sapiens
ccuguccugccuaaggcu

SEQ ID NO: 835395 - RNA, 21 nt, Homo sapiens
ccugugaacugaacucugaca

SEQ ID NO: 835396 - RNA, 11 nt, Homo sapiens
ccuguucucua

SEQ ID NO: 835397 - RNA, 13 nt, Homo sapiens
ccuuagacagucc

SEQ ID NO: 835398 - RNA, 13 nt, Homo sapiens
ccuucccaugacc

SEQ ID NO: 835399 - RNA, 16 nt, Homo sapiens
ccuucuuacaaugcau

SEQ ID NO: 835400 - RNA, 17 nt, Homo sapiens
ccuugaggauuguggaa

SEQ ID NO: 835401 - RNA, 15 nt, Homo sapiens
ccuugccugcacaaa

SEQ ID NO: 835402 - RNA, 21 nt, Homo sapiens
ccuuggaagggcguucuaggu

SEQ ID NO: 835403 - RNA, 15 nt, Homo sapiens
ccuuuagugaucaca

SEQ ID NO: 835404 - RNA, 12 nt, Homo sapiens
ccuuugccuugg

SEQ ID NO: 835405 - RNA, 21 nt, Homo sapiens
ccuuuguauuuuuacuuuuaa

SEQ ID NO: 835406 - RNA, 15 nt, Homo sapiens
ccuuuuucacuuuga

SEQ ID NO: 835407 - RNA, 15 nt, Homo sapiens
cgagagagucuucca

SEQ ID NO: 835408 - RNA, 16 nt, Homo sapiens
cgagugcucauuucag

SEQ ID NO: 835409 - RNA, 14 nt, Homo sapiens
cgaucccaucuuga

SEQ ID NO: 835410 - RNA, 18 nt, Homo sapiens
cgauuguuccugaaccga

SEQ ID NO: 835411 - RNA, 12 nt, Homo sapiens
cgcaaagggcau

SEQ ID NO: 835412 - RNA, 17 nt, Homo sapiens
cgcaccaauaaagccuu

SEQ ID NO: 835413 - RNA, 19 nt, Homo sapiens
cgccagauucuuuccugag

SEQ ID NO: 835414 - RNA, 19 nt, Homo sapiens
cggaucuuuggacagaagc

SEQ ID NO: 835415 - RNA, 14 nt, Homo sapiens
cgggguuugccaug

SEQ ID NO: 835416 - RNA, 18 nt, Homo sapiens
cgguuugaagccuggaac

SEQ ID NO: 835417 - RNA, 22 nt, Homo sapiens
cgugaacuuuaugcuguaaaua

SEQ ID NO: 835418 - RNA, 15 nt, Homo sapiens
cgugagccaccaaac

SEQ ID NO: 835419 - RNA, 18 nt, Homo sapiens
cgugggcaaacaggcagu

SEQ ID NO: 835420 - RNA, 15 nt, Homo sapiens
cgugugacuacuccc

SEQ ID NO: 835421 - RNA, 20 nt, Homo sapiens
cguuuguuccccaagacauu

SEQ ID NO: 835422 - RNA, 17 nt, Homo sapiens
cuaaaacaaaagcucau

SEQ ID NO: 835423 - RNA, 17 nt, Homo sapiens
cuaaacauguauguaaa

SEQ ID NO: 835424 - RNA, 18 nt, Homo sapiens
cuaaaugaguaaacccag

SEQ ID NO: 835425 - RNA, 17 nt, Homo sapiens
cuaacuuaucaucacac

SEQ ID NO: 835426 - RNA, 17 nt, Homo sapiens
cuaacuugucuuuggac

SEQ ID NO: 835427 - RNA, 15 nt, Homo sapiens
cuaacuuuccuucau

SEQ ID NO: 835428 - RNA, 18 nt, Homo sapiens
cuaacuuuccuucauuca

SEQ ID NO: 835429 - RNA, 16 nt, Homo sapiens
cuaagcauuagcuuua

SEQ ID NO: 835430 - RNA, 13 nt, Homo sapiens
cuaaguaaucuca

SEQ ID NO: 835431 - RNA, 12 nt, Homo sapiens
cuaauuguggau

SEQ ID NO: 835432 - RNA, 22 nt, Homo sapiens
cuaauuuguuuucccuucuuac

SEQ ID NO: 835433 - RNA, 16 nt, Homo sapiens
cuacacugacacuggu

SEQ ID NO: 835434 - RNA, 17 nt, Homo sapiens
cuaggcauuugcugaau

SEQ ID NO: 835435 - RNA, 14 nt, Homo sapiens
cuaguuaucaugca

SEQ ID NO: 835436 - RNA, 23 nt, Homo sapiens
cuaguuguaauuuuuuuguggga

SEQ ID NO: 835437 - RNA, 18 nt, Homo sapiens
cuaucuuugccacccuca

SEQ ID NO: 835438 - RNA, 14 nt, Homo sapiens
cuauuauauucauu

SEQ ID NO: 835439 - RNA, 19 nt, Homo sapiens
cuauuuuuuuucuguuaua

SEQ ID NO: 835440 - RNA, 20 nt, Homo sapiens
cucaaaagaaggccacuguu

SEQ ID NO: 835441 - RNA, 14 nt, Homo sapiens
cucaaugagcaugu

SEQ ID NO: 835442 - RNA, 12 nt, Homo sapiens
cucaauucuucc

SEQ ID NO: 835443 - RNA, 13 nt, Homo sapiens
cucacaagcacuu

SEQ ID NO: 835444 - RNA, 14 nt, Homo sapiens
cucacaagcacuuu

SEQ ID NO: 835445 - RNA, 20 nt, Homo sapiens
cucacacugggacuugcaaa

SEQ ID NO: 835446 - RNA, 16 nt, Homo sapiens
cucacagcauuugcca

SEQ ID NO: 835447 - RNA, 12 nt, Homo sapiens
cucacaucuugg

SEQ ID NO: 835448 - RNA, 13 nt, Homo sapiens
cucaccacaugcg

SEQ ID NO: 835449 - RNA, 13 nt, Homo sapiens
cucagaaggcaaa

SEQ ID NO: 835450 - RNA, 17 nt, Homo sapiens
cucagagagggugggag

SEQ ID NO: 835451 - RNA, 14 nt, Homo sapiens
cucagccuugcaaa

SEQ ID NO: 835452 - RNA, 11 nt, Homo sapiens
cucagccuuuu

SEQ ID NO: 835453 - RNA, 20 nt, Homo sapiens
cucagcuuggcacucaggug

SEQ ID NO: 835454 - RNA, 17 nt, Homo sapiens
cucaguagagaucuaua

SEQ ID NO: 835455 - RNA, 15 nt, Homo sapiens
cucaguucagaauca

SEQ ID NO: 835456 - RNA, 13 nt, Homo sapiens
cucaguuccugcc

SEQ ID NO: 835457 - RNA, 14 nt, Homo sapiens
cucauacucaccuc

SEQ ID NO: 835458 - RNA, 19 nt, Homo sapiens
cucaugcugugugacucaa

SEQ ID NO: 835459 - RNA, 23 nt, Homo sapiens
cucauggacugaguuuauacuca

SEQ ID NO: 835460 - RNA, 14 nt, Homo sapiens
cucaugugaucaca

SEQ ID NO: 835461 - RNA, 21 nt, Homo sapiens
cucaugugaucacaauuugca

SEQ ID NO: 835462 - RNA, 22 nt, Homo sapiens
cucauuggaaauuuagcauugu

SEQ ID NO: 835463 - RNA, 15 nt, Homo sapiens
cucauuucaggagca

SEQ ID NO: 835464 - RNA, 15 nt, Homo sapiens
cuccaaaugcagcuu

SEQ ID NO: 835465 - RNA, 13 nt, Homo sapiens
cuccacaguguug

SEQ ID NO: 835466 - RNA, 23 nt, Homo sapiens
cuccaccuuccaaagagugcuaa

SEQ ID NO: 835467 - RNA, 12 nt, Homo sapiens
cuccagugcagg

SEQ ID NO: 835468 - RNA, 21 nt, Homo sapiens
cuccaucaguuagagcugaca

SEQ ID NO: 835469 - RNA, 13 nt, Homo sapiens
cuccguggcacau

SEQ ID NO: 835470 - RNA, 16 nt, Homo sapiens
cuccuccguggcacau

SEQ ID NO: 835471 - RNA, 21 nt, Homo sapiens
cucuacucuagggaaaaacca

SEQ ID NO: 835472 - RNA, 18 nt, Homo sapiens
cucucaggaaucaucucc

SEQ ID NO: 835473 - RNA, 21 nt, Homo sapiens
cucugacgcuugugacagugc

SEQ ID NO: 835474 - RNA, 14 nt, Homo sapiens
cucuggaugccuga

SEQ ID NO: 835475 - RNA, 18 nt, Homo sapiens
cucugggucucagugucc

SEQ ID NO: 835476 - RNA, 21 nt, Homo sapiens
cucugucuaggacugcagugu

SEQ ID NO: 835477 - RNA, 11 nt, Homo sapiens
cugaaaaccaa

SEQ ID NO: 835478 - RNA, 22 nt, Homo sapiens
cugaaauagacccacaagaggc

SEQ ID NO: 835479 - RNA, 16 nt, Homo sapiens
cugaagccaaagccaa

SEQ ID NO: 835480 - RNA, 14 nt, Homo sapiens
cugaaggacuguga

SEQ ID NO: 835481 - RNA, 12 nt, Homo sapiens
cugaaucucaua

SEQ ID NO: 835482 - RNA, 16 nt, Homo sapiens
cugaauuaugcuucca

SEQ ID NO: 835483 - RNA, 22 nt, Homo sapiens
cugacaacagacuucugaaaua

SEQ ID NO: 835484 - RNA, 22 nt, Homo sapiens
cugaccaguuuaaccugaugca

SEQ ID NO: 835485 - RNA, 19 nt, Homo sapiens
cugacccaaccacagagga

SEQ ID NO: 835486 - RNA, 17 nt, Homo sapiens
cugagccuucagcacua

SEQ ID NO: 835487 - RNA, 19 nt, Homo sapiens
cugaggagccugcaacaug

SEQ ID NO: 835488 - RNA, 14 nt, Homo sapiens
cugaggcugaaauu

SEQ ID NO: 835489 - RNA, 14 nt, Homo sapiens
cugagucaccaucu

SEQ ID NO: 835490 - RNA, 23 nt, Homo sapiens
cugcaacaugccagccacuguga

SEQ ID NO: 835491 - RNA, 14 nt, Homo sapiens
cugcagccaagcaa

SEQ ID NO: 835492 - RNA, 15 nt, Homo sapiens
cugcauuccugauga

SEQ ID NO: 835493 - RNA, 16 nt, Homo sapiens
cugcugcuccagugca

SEQ ID NO: 835494 - RNA, 23 nt, Homo sapiens
cuggaacagauucacacugucug

SEQ ID NO: 835495 - RNA, 15 nt, Homo sapiens
cuggaacaucaucaa

SEQ ID NO: 835496 - RNA, 17 nt, Homo sapiens
cuggacggaaccacgua

SEQ ID NO: 835497 - RNA, 16 nt, Homo sapiens
cuggaucucccugaga

SEQ ID NO: 835498 - RNA, 13 nt, Homo sapiens
cuggaugccugau

SEQ ID NO: 835499 - RNA, 21 nt, Homo sapiens
cuggauguggagggggcgcgu

SEQ ID NO: 835500 - RNA, 12 nt, Homo sapiens
cuggcacugacu

SEQ ID NO: 835501 - RNA, 23 nt, Homo sapiens
cuggcugggaguggcauguauga

SEQ ID NO: 835502 - RNA, 20 nt, Homo sapiens
cugggagagccuuccagggg

SEQ ID NO: 835503 - RNA, 22 nt, Homo sapiens
cugggcaaggaggccacgugau

SEQ ID NO: 835504 - RNA, 15 nt, Homo sapiens
cugggcuugucugua

SEQ ID NO: 835505 - RNA, 12 nt, Homo sapiens
cuggggccaaau

SEQ ID NO: 835506 - RNA, 20 nt, Homo sapiens
cuggguaaaugcagcgugaa

SEQ ID NO: 835507 - RNA, 22 nt, Homo sapiens
cuggguggcacugccaugcagg

SEQ ID NO: 835508 - RNA, 21 nt, Homo sapiens
cugguauuccugccuccauau

SEQ ID NO: 835509 - RNA, 20 nt, Homo sapiens
acagcauuugccaagucucc

SEQ ID NO: 835510 - RNA, 19 nt, Homo sapiens
acagcgcuggccgggaccc

SEQ ID NO: 835511 - RNA, 16 nt, Homo sapiens
acagcucgacuuuaaa

SEQ ID NO: 835512 - RNA, 22 nt, Homo sapiens
acagcugcuggagacuccuagg

SEQ ID NO: 835513 - RNA, 20 nt, Homo sapiens
acagcuggguggcacugcca

SEQ ID NO: 835514 - RNA, 15 nt, Homo sapiens
acaggagaccuggca

SEQ ID NO: 835515 - RNA, 20 nt, Homo sapiens
acaggaugaaggcaaugcca

SEQ ID NO: 835516 - RNA, 19 nt, Homo sapiens
acaggcaaaacucaguaga

SEQ ID NO: 835517 - RNA, 13 nt, Homo sapiens
acagggcauucaa

SEQ ID NO: 835518 - RNA, 22 nt, Homo sapiens
acagugacauuuauuuuucuca

SEQ ID NO: 835519 - RNA, 21 nt, Homo sapiens
acaguggccaagaucacagug

SEQ ID NO: 835520 - RNA, 21 nt, Homo sapiens
acaguguugccagagccuuaa

SEQ ID NO: 835521 - RNA, 15 nt, Homo sapiens
acaguguuucuggcu

SEQ ID NO: 835522 - RNA, 15 nt, Homo sapiens
acaguuccugagacc

SEQ ID NO: 835523 - RNA, 22 nt, Homo sapiens
acaguugaaaaacagcugaggg

SEQ ID NO: 835524 - RNA, 19 nt, Homo sapiens
acaguuuugguugcuuuaa

SEQ ID NO: 835525 - RNA, 20 nt, Homo sapiens
acaguuuugguugcuuuaau

SEQ ID NO: 835526 - RNA, 22 nt, Homo sapiens
acauacauugauucaugucuca

SEQ ID NO: 835527 - RNA, 23 nt, Homo sapiens
acauacauugauucaugucucac

SEQ ID NO: 835528 - RNA, 12 nt, Homo sapiens
acauacucccau

SEQ ID NO: 835529 - RNA, 20 nt, Homo sapiens
acaucaucaaggcacugccu

SEQ ID NO: 835530 - RNA, 13 nt, Homo sapiens
acaucauuuguau

SEQ ID NO: 835531 - RNA, 19 nt, Homo sapiens
acauccacaugauaccucu

SEQ ID NO: 835532 - RNA, 15 nt, Homo sapiens
acauccauguuccga

SEQ ID NO: 835533 - RNA, 18 nt, Homo sapiens
acaugccaagcacugugc

SEQ ID NO: 835534 - RNA, 19 nt, Homo sapiens
acauguaagcauaacuuau

SEQ ID NO: 835535 - RNA, 21 nt, Homo sapiens
acauguguuggcagccucuuc

SEQ ID NO: 835536 - RNA, 21 nt, Homo sapiens
acauuacagggaaugccugag

SEQ ID NO: 835537 - RNA, 23 nt, Homo sapiens
acauuaugaugugugaaaacugg

SEQ ID NO: 835538 - RNA, 12 nt, Homo sapiens
acauuugugcuc

SEQ ID NO: 835539 - RNA, 14 nt, Homo sapiens
accaaaucacugaa

SEQ ID NO: 835540 - RNA, 18 nt, Homo sapiens
accaacauacucccaucu

SEQ ID NO: 835541 - RNA, 13 nt, Homo sapiens
accaauguucucu

SEQ ID NO: 835542 - RNA, 24 nt, Homo sapiens
accagauauauagaaggacugcag

SEQ ID NO: 835543 - RNA, 18 nt, Homo sapiens
accagcgugugacuacuc

SEQ ID NO: 835544 - RNA, 22 nt, Homo sapiens
accaguuuaaccugaugcaguc

SEQ ID NO: 835545 - RNA, 20 nt, Homo sapiens
accaucaauuuuaguuguca

SEQ ID NO: 835546 - RNA, 19 nt, Homo sapiens
accauuuuugaaaccaaac

SEQ ID NO: 835547 - RNA, 14 nt, Homo sapiens
acccaccccagugc

SEQ ID NO: 835548 - RNA, 17 nt, Homo sapiens
acccaggaguguggcca

SEQ ID NO: 835549 - RNA, 21 nt, Homo sapiens
acccaucucucaggaaucauc

SEQ ID NO: 835550 - RNA, 14 nt, Homo sapiens
acccucauacacag

SEQ ID NO: 835551 - RNA, 14 nt, Homo sapiens
accgaggacaugaa

SEQ ID NO: 835552 - RNA, 23 nt, Homo sapiens
accgcugauucucagggucucug

SEQ ID NO: 835553 - RNA, 15 nt, Homo sapiens
accuagcaucuuaca

SEQ ID NO: 835554 - RNA, 17 nt, Homo sapiens
accugcagccaagcaaa

SEQ ID NO: 835555 - RNA, 17 nt, Homo sapiens
accugccucccauucua

SEQ ID NO: 835556 - RNA, 16 nt, Homo sapiens
accugucccccugaca

SEQ ID NO: 835557 - RNA, 15 nt, Homo sapiens
acgaaaaacauuuca

SEQ ID NO: 835558 - RNA, 20 nt, Homo sapiens
acgccagauucuuuccugag

SEQ ID NO: 835559 - RNA, 12 nt, Homo sapiens
acggacacucaa

SEQ ID NO: 835560 - RNA, 17 nt, Homo sapiens
acggacacucaaaagcu

SEQ ID NO: 835561 - RNA, 12 nt, Homo sapiens
acgucauucagu

SEQ ID NO: 835562 - RNA, 20 nt, Homo sapiens
acgugagaucauucacucau

SEQ ID NO: 835563 - RNA, 22 nt, Homo sapiens
acgugauucaauucaacacucc

SEQ ID NO: 835564 - RNA, 23 nt, Homo sapiens
acguuuguccuuuuucacuuuga

SEQ ID NO: 835565 - RNA, 14 nt, Homo sapiens
acucauaaggcaua

SEQ ID NO: 835566 - RNA, 17 nt, Homo sapiens
acucgagucacacucaa

SEQ ID NO: 835567 - RNA, 19 nt, Homo sapiens
acucuucaguuaagccuuu

SEQ ID NO: 835568 - RNA, 13 nt, Homo sapiens
acugaacuuugcu

SEQ ID NO: 835569 - RNA, 13 nt, Homo sapiens
acugacacuggua

SEQ ID NO: 835570 - RNA, 21 nt, Homo sapiens
acugauucauacauuaucuca

SEQ ID NO: 835571 - RNA, 15 nt, Homo sapiens
acugccaugccagcu

SEQ ID NO: 835572 - RNA, 13 nt, Homo sapiens
ccaucaagccacc

SEQ ID NO: 835573 - RNA, 14 nt, Homo sapiens
ccaucaccagacag

SEQ ID NO: 835574 - RNA, 18 nt, Homo sapiens
ccaucagaaacacccuca

SEQ ID NO: 835575 - RNA, 18 nt, Homo sapiens
ccaucugugcacgcagug

SEQ ID NO: 835576 - RNA, 23 nt, Homo sapiens
ccaugcacccucauacacagaaa

SEQ ID NO: 835577 - RNA, 17 nt, Homo sapiens
ccauggacccaauauuu

SEQ ID NO: 835578 - RNA, 17 nt, Homo sapiens
ccauuucugagaucaaa

SEQ ID NO: 835579 - RNA, 19 nt, Homo sapiens
ccauuugcguuccaugaug

SEQ ID NO: 835580 - RNA, 17 nt, Homo sapiens
cccaaagugugacucau

SEQ ID NO: 835581 - RNA, 14 nt, Homo sapiens
cccacauauuucaa

SEQ ID NO: 835582 - RNA, 17 nt, Homo sapiens
cccagacaggacugcag

SEQ ID NO: 835583 - RNA, 24 nt, Homo sapiens
cccagacucuuuuuuugagugaca

SEQ ID NO: 835584 - RNA, 15 nt, Homo sapiens
cccagagguggaugu

SEQ ID NO: 835585 - RNA, 21 nt, Homo sapiens
cccagauagcuggcugggugg

SEQ ID NO: 835586 - RNA, 16 nt, Homo sapiens
cccaggaguguggcca

SEQ ID NO: 835587 - RNA, 22 nt, Homo sapiens
cccaggugguuauggagagggu

SEQ ID NO: 835588 - RNA, 12 nt, Homo sapiens
cccaucuugaua

SEQ ID NO: 835589 - RNA, 23 nt, Homo sapiens
cccauguaagcaccccuucauuu

SEQ ID NO: 835590 - RNA, 12 nt, Homo sapiens
ccccacuuugaa

SEQ ID NO: 835591 - RNA, 16 nt, Homo sapiens
ccccaggguccuguag

SEQ ID NO: 835592 - RNA, 13 nt, Homo sapiens
cccgaacaccauu

SEQ ID NO: 835593 - RNA, 16 nt, Homo sapiens
cccgagccuggcucca

SEQ ID NO: 835594 - RNA, 16 nt, Homo sapiens
cccucaacugaagggg

SEQ ID NO: 835595 - RNA, 13 nt, Homo sapiens
cccucagauuccg

SEQ ID NO: 835596 - RNA, 22 nt, Homo sapiens
cccucgaggcggaucuuuggac

SEQ ID NO: 835597 - RNA, 21 nt, Homo sapiens
cccucuauauauacaucauac

SEQ ID NO: 835598 - RNA, 20 nt, Homo sapiens
cccucugggucucagugucc

SEQ ID NO: 835599 - RNA, 13 nt, Homo sapiens
cccugcucccaca

SEQ ID NO: 835600 - RNA, 20 nt, Homo sapiens
cccuggcugaaggacuguga

SEQ ID NO: 835601 - RNA, 14 nt, Homo sapiens
cccugucucaaaaa

SEQ ID NO: 835602 - RNA, 19 nt, Homo sapiens
cccuucuuacaaugcauuc

SEQ ID NO: 835603 - RNA, 11 nt, Homo sapiens
cccuugccaug

SEQ ID NO: 835604 - RNA, 22 nt, Homo sapiens
cccuuuuuuggcugcugaaggc

SEQ ID NO: 835605 - RNA, 12 nt, Homo sapiens
ccgagaagaaca

SEQ ID NO: 835606 - RNA, 22 nt, Homo sapiens
ccgagcuuugaaaauucagugg

SEQ ID NO: 835607 - RNA, 16 nt, Homo sapiens
ccgcagggccaugcag

SEQ ID NO: 835608 - RNA, 20 nt, Homo sapiens
ccuagcacuuugggaggcca

SEQ ID NO: 835609 - RNA, 13 nt, Homo sapiens
ccuagucuauuca

SEQ ID NO: 835610 - RNA, 23 nt, Homo sapiens
ccucacacugggacuugcaaaaa

SEQ ID NO: 835611 - RNA, 12 nt, Homo sapiens
ccucagauuccg

SEQ ID NO: 835612 - RNA, 23 nt, Homo sapiens
ccucagcuuggcacucaggugcu

SEQ ID NO: 835613 - RNA, 14 nt, Homo sapiens
ccucauacacagaa

SEQ ID NO: 835614 - RNA, 20 nt, Homo sapiens
ccucauuuaaaacaagacuu

SEQ ID NO: 835615 - RNA, 23 nt, Homo sapiens
ccuccccaaggagacacaacaac

SEQ ID NO: 835616 - RNA, 15 nt, Homo sapiens
ccuccccacagugcc

SEQ ID NO: 835617 - RNA, 20 nt, Homo sapiens
ccuccccuggggacagcaag

SEQ ID NO: 835618 - RNA, 13 nt, Homo sapiens
ccuccguggcaca

SEQ ID NO: 835619 - RNA, 14 nt, Homo sapiens
ccuccguggcacau

SEQ ID NO: 835620 - RNA, 23 nt, Homo sapiens
ccuccuccagccgccaugcuccu

SEQ ID NO: 835621 - RNA, 15 nt, Homo sapiens
ccucgcccuccacaa

SEQ ID NO: 835622 - RNA, 11 nt, Homo sapiens
ccucuauauau

SEQ ID NO: 835623 - RNA, 15 nt, Homo sapiens
ccucuccuccguggc

SEQ ID NO: 835624 - RNA, 17 nt, Homo sapiens
ccucuggguaggaauca

SEQ ID NO: 835625 - RNA, 14 nt, Homo sapiens
ccucuguugccaag

SEQ ID NO: 835626 - RNA, 15 nt, Homo sapiens
ccucuguugccaagg

SEQ ID NO: 835627 - RNA, 13 nt, Homo sapiens
ccucuuucccucc

SEQ ID NO: 835628 - RNA, 20 nt, Homo sapiens
ccucuuucccucccuuccuc

SEQ ID NO: 835629 - RNA, 11 nt, Homo sapiens
ccucuuuggag

SEQ ID NO: 835630 - RNA, 22 nt, Homo sapiens
ccugaagguguuuuucauucac

SEQ ID NO: 835631 - RNA, 21 nt, Homo sapiens
ccugcaaccugauugugucuc

SEQ ID NO: 835632 - RNA, 18 nt, Homo sapiens
ccugcaccccugcaguuu

SEQ ID NO: 835633 - RNA, 19 nt, Homo sapiens
ccugcaggcgugaccugac

SEQ ID NO: 835634 - RNA, 16 nt, Homo sapiens
ccugcggugcuaucuc

SEQ ID NO: 835635 - RNA, 13 nt, Homo sapiens
cuguauacuguac

SEQ ID NO: 835636 - RNA, 13 nt, Homo sapiens
cuguauucacuua

SEQ ID NO: 835637 - RNA, 14 nt, Homo sapiens
cuguauucacuuau

SEQ ID NO: 835638 - RNA, 17 nt, Homo sapiens
cuguauuucaagaccuc

SEQ ID NO: 835639 - RNA, 18 nt, Homo sapiens
cugucacgugugggcaau

SEQ ID NO: 835640 - RNA, 23 nt, Homo sapiens
cugugcugugacucgagucacac

SEQ ID NO: 835641 - RNA, 14 nt, Homo sapiens
cugugugacucaaa

SEQ ID NO: 835642 - RNA, 22 nt, Homo sapiens
cuguguguuaagcucugcuauu

SEQ ID NO: 835643 - RNA, 17 nt, Homo sapiens
cuguucagcugguugag

SEQ ID NO: 835644 - RNA, 13 nt, Homo sapiens
cuguucuuagcuc

SEQ ID NO: 835645 - RNA, 19 nt, Homo sapiens
cuguuuagaugaaugucag

SEQ ID NO: 835646 - RNA, 19 nt, Homo sapiens
cuguuuuugucuacacucu

SEQ ID NO: 835647 - RNA, 20 nt, Homo sapiens
cuuaaugaaugaaugaauuc

SEQ ID NO: 835648 - RNA, 21 nt, Homo sapiens
cuuaauuauugauguuuucau

SEQ ID NO: 835649 - RNA, 18 nt, Homo sapiens
cuuaccacugcucugaug

SEQ ID NO: 835650 - RNA, 23 nt, Homo sapiens
cuuaccagcagagcaccuuagac

SEQ ID NO: 835651 - RNA, 16 nt, Homo sapiens
cuuagacagucccugc

SEQ ID NO: 835652 - RNA, 16 nt, Homo sapiens
cuuauccagcugguga

SEQ ID NO: 835653 - RNA, 16 nt, Homo sapiens
cuucagagcugacaca

SEQ ID NO: 835654 - RNA, 16 nt, Homo sapiens
cuucaguuaagccuuu

SEQ ID NO: 835655 - RNA, 14 nt, Homo sapiens
cuucaugcauggaa

SEQ ID NO: 835656 - RNA, 21 nt, Homo sapiens
cuuccacuuggcuacacaggg

SEQ ID NO: 835657 - RNA, 14 nt, Homo sapiens
cuuccagguacuga

SEQ ID NO: 835658 - RNA, 15 nt, Homo sapiens
cuuccagguacugau

SEQ ID NO: 835659 - RNA, 21 nt, Homo sapiens
cuucccaguggcugcugccca

SEQ ID NO: 835660 - RNA, 10 nt, Homo sapiens
cuucugccau

SEQ ID NO: 835661 - RNA, 19 nt, Homo sapiens
cuucuggguucaagcgauu

SEQ ID NO: 835662 - RNA, 22 nt, Homo sapiens
cuugaagaaccucucacuucac

SEQ ID NO: 835663 - RNA, 22 nt, Homo sapiens
cuugagcgugaaucuguaucuu

SEQ ID NO: 835664 - RNA, 16 nt, Homo sapiens
cuugccgucuaccuga

SEQ ID NO: 835665 - RNA, 17 nt, Homo sapiens
cuugcucacaucuuggc

SEQ ID NO: 835666 - RNA, 10 nt, Homo sapiens
cuuggcugug

SEQ ID NO: 835667 - RNA, 15 nt, Homo sapiens
cuuggcugugcccuc

SEQ ID NO: 835668 - RNA, 20 nt, Homo sapiens
cuugugccaacacucaagaa

SEQ ID NO: 835669 - RNA, 15 nt, Homo sapiens
cuuuaaaaagcucca

SEQ ID NO: 835670 - RNA, 19 nt, Homo sapiens
cuuuaaaacuuauccucca

SEQ ID NO: 835671 - RNA, 21 nt, Homo sapiens
cuuuaagugcacaacauuaca

SEQ ID NO: 835672 - RNA, 14 nt, Homo sapiens
cuuuaucauaugcu

SEQ ID NO: 835673 - RNA, 19 nt, Homo sapiens
cuuucagauaacuguuauu

SEQ ID NO: 835674 - RNA, 15 nt, Homo sapiens
cuuuccaaaggccau

SEQ ID NO: 835675 - RNA, 15 nt, Homo sapiens
cuuuccuucauucaa

SEQ ID NO: 835676 - RNA, 22 nt, Homo sapiens
cuuucugggaugucacagucca

SEQ ID NO: 835677 - RNA, 21 nt, Homo sapiens
cuuuggacagaagcagcucuu

SEQ ID NO: 835678 - RNA, 17 nt, Homo sapiens
cuuuggccccacuuuga

SEQ ID NO: 835679 - RNA, 18 nt, Homo sapiens
cuuuggccccacuuugaa

SEQ ID NO: 835680 - RNA, 13 nt, Homo sapiens
cuuuuaaugcucc

SEQ ID NO: 835681 - RNA, 19 nt, Homo sapiens
cuuuucgcaggauucuucc

SEQ ID NO: 835682 - RNA, 21 nt, Homo sapiens
cuuuucgcaggauucuuccuc

SEQ ID NO: 835683 - RNA, 22 nt, Homo sapiens
cuuuugugcuccccuuugccua

SEQ ID NO: 835684 - RNA, 14 nt, Homo sapiens
cuuuuuuauacuca

SEQ ID NO: 835685 - RNA, 16 nt, Homo sapiens
cuuuuuugucccauua

SEQ ID NO: 835686 - RNA, 13 nt, Homo sapiens
gaaaacauuccau

SEQ ID NO: 835687 - RNA, 16 nt, Homo sapiens
gaaaauaaaagcacuu

SEQ ID NO: 835688 - RNA, 14 nt, Homo sapiens
gaaaauguccuccc

SEQ ID NO: 835689 - RNA, 16 nt, Homo sapiens
gaaagccccugccccu

SEQ ID NO: 835690 - RNA, 14 nt, Homo sapiens
gaaagggucucccu

SEQ ID NO: 835691 - RNA, 13 nt, Homo sapiens
gaaagguagugua

SEQ ID NO: 835692 - RNA, 23 nt, Homo sapiens
gaaauacacagugcugaccagac

SEQ ID NO: 835693 - RNA, 17 nt, Homo sapiens
gaaaucuuucucccuca

SEQ ID NO: 835694 - RNA, 16 nt, Homo sapiens
gaaaugcauuuugcua

SEQ ID NO: 835695 - RNA, 20 nt, Homo sapiens
gaacaaagugagacagucca

SEQ ID NO: 835696 - RNA, 15 nt, Homo sapiens
gaacaaaugugaagg

SEQ ID NO: 835697 - RNA, 16 nt, Homo sapiens
gaacaccauugaggga

SEQ ID NO: 835698 - RNA, 19 nt, Homo sapiens
gaacagcugugucugccaa

SEQ ID NO: 835699 - RNA, 16 nt, Homo sapiens
gaacaucaucaaggca

SEQ ID NO: 835700 - RNA, 15 nt, Homo sapiens
gaacuugagcgugaa

SEQ ID NO: 835701 - RNA, 13 nt, Homo sapiens
gaagacaauguga

SEQ ID NO: 835702 - RNA, 17 nt, Homo sapiens
gaagauucuauguuaau

SEQ ID NO: 835703 - RNA, 19 nt, Homo sapiens
gaagccuuuguaaauuguc

SEQ ID NO: 835704 - RNA, 17 nt, Homo sapiens
gaaucaucuccuuugca

SEQ ID NO: 835705 - RNA, 20 nt, Homo sapiens
gaauguuuucaaauguucuc

SEQ ID NO: 835706 - RNA, 15 nt, Homo sapiens
gacacaaaccugccu

SEQ ID NO: 835707 - RNA, 21 nt, Homo sapiens
gacacaggcuccaaacuggag

SEQ ID NO: 835708 - RNA, 21 nt, Homo sapiens
gacaccaccacccuugccaug

SEQ ID NO: 835709 - RNA, 13 nt, Homo sapiens
gacagaagcagcu

SEQ ID NO: 835710 - RNA, 17 nt, Homo sapiens
gacagagaccuccugcc

SEQ ID NO: 835711 - RNA, 15 nt, Homo sapiens
gacagagcaagugag

SEQ ID NO: 835712 - RNA, 20 nt, Homo sapiens
gacagagguuaucuguccca

SEQ ID NO: 835713 - RNA, 17 nt, Homo sapiens
gacagccccuccuccau

SEQ ID NO: 835714 - RNA, 14 nt, Homo sapiens
gacaggaccaggga

SEQ ID NO: 835715 - RNA, 15 nt, Homo sapiens
gacagugaggcugca

SEQ ID NO: 835716 - RNA, 17 nt, Homo sapiens
gacauguuuuuauaugu

SEQ ID NO: 835717 - RNA, 21 nt, Homo sapiens
gaccacaguggccaagaucac

SEQ ID NO: 835718 - RNA, 22 nt, Homo sapiens
gaccacaguggccaagaucaca

SEQ ID NO: 835719 - RNA, 19 nt, Homo sapiens
gaccacgugagaucauuca

SEQ ID NO: 835720 - RNA, 18 nt, Homo sapiens
gaccagggauuuccauga

SEQ ID NO: 835721 - RNA, 20 nt, Homo sapiens
gaccaguuuaaccugaugca

SEQ ID NO: 835722 - RNA, 14 nt, Homo sapiens
gaccccgagccugg

SEQ ID NO: 835723 - RNA, 21 nt, Homo sapiens
gaccucagcuuugauauuuca

SEQ ID NO: 835724 - RNA, 12 nt, Homo sapiens
gaccuggcacug

SEQ ID NO: 835725 - RNA, 19 nt, Homo sapiens
gacggaggccuacucuucc

SEQ ID NO: 835726 - RNA, 17 nt, Homo sapiens
gacgggguuugccaugc

SEQ ID NO: 835727 - RNA, 17 nt, Homo sapiens
gacgguaaguguucuca

SEQ ID NO: 835728 - RNA, 20 nt, Homo sapiens
gacgguaaguguucucauga

SEQ ID NO: 835729 - RNA, 17 nt, Homo sapiens
gacucuuuggacacuca

SEQ ID NO: 835730 - RNA, 22 nt, Homo sapiens
gacuguucaagagcacacuugg

SEQ ID NO: 835731 - RNA, 13 nt, Homo sapiens
gacuucuucccaa

SEQ ID NO: 835732 - RNA, 15 nt, Homo sapiens
gagaccaucccugaa

SEQ ID NO: 835733 - RNA, 19 nt, Homo sapiens
gagacuccuaggcaggaca

SEQ ID NO: 835734 - RNA, 18 nt, Homo sapiens
gagauucuggcuaguguc

SEQ ID NO: 835735 - RNA, 23 nt, Homo sapiens
gagcaccugcaggcgugaccuga

SEQ ID NO: 835736 - RNA, 13 nt, Homo sapiens
gagcagaacaggu

SEQ ID NO: 835737 - RNA, 14 nt, Homo sapiens
gagcaggcugugag

SEQ ID NO: 835738 - RNA, 23 nt, Homo sapiens
gagcaucacaguuuugguugcuu

SEQ ID NO: 835739 - RNA, 23 nt, Homo sapiens
gagcccacgcccccacuggugac

SEQ ID NO: 835740 - RNA, 20 nt, Homo sapiens
gagcccgcagggccaugcag

SEQ ID NO: 835741 - RNA, 19 nt, Homo sapiens
gagccuggcuccaaacccu

SEQ ID NO: 835742 - RNA, 15 nt, Homo sapiens
gagcugacacaggau

SEQ ID NO: 835743 - RNA, 12 nt, Homo sapiens
gagcugucaugu

SEQ ID NO: 835744 - RNA, 18 nt, Homo sapiens
gagcuugaaauagugucu

SEQ ID NO: 835745 - RNA, 14 nt, Homo sapiens
gagcuugcuccaga

SEQ ID NO: 835746 - RNA, 14 nt, Homo sapiens
gagcuuucugcuau

SEQ ID NO: 835747 - RNA, 16 nt, Homo sapiens
gaggagccugcaacau

SEQ ID NO: 835748 - RNA, 19 nt, Homo sapiens
gaggauugcuugagcucag

SEQ ID NO: 835749 - RNA, 22 nt, Homo sapiens
gaggcaguuccauuucauuugu

SEQ ID NO: 835750 - RNA, 22 nt, Homo sapiens
gaggccccuucuagguggcaag

SEQ ID NO: 835751 - RNA, 15 nt, Homo sapiens
gaggccucgacccac

SEQ ID NO: 835752 - RNA, 15 nt, Homo sapiens
gagggcacacacugu

SEQ ID NO: 835753 - RNA, 17 nt, Homo sapiens
gaggugaaagcuauauc

SEQ ID NO: 835754 - RNA, 23 nt, Homo sapiens
gagucacacgggggcagcugaua

SEQ ID NO: 835755 - RNA, 20 nt, Homo sapiens
gagucgcaucucagugcagg

SEQ ID NO: 835756 - RNA, 13 nt, Homo sapiens
gagugaucuuucc

SEQ ID NO: 835757 - RNA, 15 nt, Homo sapiens
gagugcaguggcgca

SEQ ID NO: 835758 - RNA, 16 nt, Homo sapiens
gagugcuaagcauuag

SEQ ID NO: 835759 - RNA, 19 nt, Homo sapiens
gauacuucgacacuguucu

SEQ ID NO: 835760 - RNA, 13 nt, Homo sapiens
gauagacuuggga

SEQ ID NO: 835761 - RNA, 14 nt, Homo sapiens
gauagagugggaca

SEQ ID NO: 835762 - RNA, 22 nt, Homo sapiens
gauagagugggacaguuccuga

SEQ ID NO: 835763 - RNA, 17 nt, Homo sapiens
gaucacaguggccacgg

SEQ ID NO: 835764 - RNA, 14 nt, Homo sapiens
gaucccaucuugau

SEQ ID NO: 835765 - RNA, 16 nt, Homo sapiens
gauccuaaaacaaaag

SEQ ID NO: 835766 - RNA, 17 nt, Homo sapiens
gauccuaguuccaccau

SEQ ID NO: 835767 - RNA, 17 nt, Homo sapiens
gaucucacaagcacuuu

SEQ ID NO: 835768 - RNA, 13 nt, Homo sapiens
gaugauaaaacac

SEQ ID NO: 835769 - RNA, 16 nt, Homo sapiens
gaugauaaaacacaaa

SEQ ID NO: 835770 - RNA, 16 nt, Homo sapiens
gaugccagggacccac

SEQ ID NO: 835771 - RNA, 16 nt, Homo sapiens
gaugcugacaucauuu

SEQ ID NO: 835772 - RNA, 20 nt, Homo sapiens
gauguauguugaagccuuug

SEQ ID NO: 835773 - RNA, 14 nt, Homo sapiens
gauguccucaccac

SEQ ID NO: 835774 - RNA, 20 nt, Homo sapiens
gaugugccuggguggacaug

SEQ ID NO: 835775 - RNA, 13 nt, Homo sapiens
gauucacacuguc

SEQ ID NO: 835776 - RNA, 21 nt, Homo sapiens
gauucacccccaaacagugac

SEQ ID NO: 835777 - RNA, 23 nt, Homo sapiens
gauuccgcaccaauaaagccuuc

SEQ ID NO: 835778 - RNA, 18 nt, Homo sapiens
gauuccuggcagagccau

SEQ ID NO: 835779 - RNA, 14 nt, Homo sapiens
gauucuuagcaaaa

SEQ ID NO: 835780 - RNA, 15 nt, Homo sapiens
gauuuuaugcuuuaa

SEQ ID NO: 835781 - RNA, 16 nt, Homo sapiens
gauuuuaugcuuuaaa

SEQ ID NO: 835782 - RNA, 23 nt, Homo sapiens
gcaaaaucagaauggaaugcucu

SEQ ID NO: 835783 - RNA, 20 nt, Homo sapiens
gcaaaggcugagaacacugu

SEQ ID NO: 835784 - RNA, 18 nt, Homo sapiens
gcaaauauuuauaagcua

SEQ ID NO: 835785 - RNA, 20 nt, Homo sapiens
gcaaccuccaccuucugggu

SEQ ID NO: 835786 - RNA, 17 nt, Homo sapiens
gcaagugagacccuguc

SEQ ID NO: 835787 - RNA, 22 nt, Homo sapiens
gcaauacagacuacuucuuccc

SEQ ID NO: 835788 - RNA, 17 nt, Homo sapiens
gcaauuagacaagaacu

SEQ ID NO: 835789 - RNA, 18 nt, Homo sapiens
gcacaauaguaaccuggg

SEQ ID NO: 835790 - RNA, 15 nt, Homo sapiens
gcacaauaugggcac

SEQ ID NO: 835791 - RNA, 21 nt, Homo sapiens
gcacacacuguguacaguaaa

SEQ ID NO: 835792 - RNA, 18 nt, Homo sapiens
gcaccaauaaagccuuca

SEQ ID NO: 835793 - RNA, 15 nt, Homo sapiens
gcacuuuaaaugaag

SEQ ID NO: 835794 - RNA, 19 nt, Homo sapiens
gcacuuuaacacagugucu

SEQ ID NO: 835795 - RNA, 22 nt, Homo sapiens
gcagcagggagggcuucugcca

SEQ ID NO: 835796 - RNA, 18 nt, Homo sapiens
gcagccuggggucugaca

SEQ ID NO: 835797 - RNA, 18 nt, Homo sapiens
gcagcgccucaucuucaa

SEQ ID NO: 835798 - RNA, 14 nt, Homo sapiens
gcagcucaucucug

SEQ ID NO: 835799 - RNA, 12 nt, Homo sapiens
gcaggaccucag

SEQ ID NO: 835800 - RNA, 18 nt, Homo sapiens
gcaggauagagugggaca

SEQ ID NO: 835801 - RNA, 17 nt, Homo sapiens
gcauaugauagaugaca

SEQ ID NO: 835802 - RNA, 18 nt, Homo sapiens
gcauaugauagaugacaa

SEQ ID NO: 835803 - RNA, 19 nt, Homo sapiens
gcaucagagguuugcuucc

SEQ ID NO: 835804 - RNA, 13 nt, Homo sapiens
gcaucagugcccu

SEQ ID NO: 835805 - RNA, 15 nt, Homo sapiens
gcaucucagugcagg

SEQ ID NO: 835806 - RNA, 19 nt, Homo sapiens
gcauguaugacgugacugg

SEQ ID NO: 835807 - RNA, 17 nt, Homo sapiens
gcauuccugaugaccaa

SEQ ID NO: 835808 - RNA, 19 nt, Homo sapiens
gccaaccggucacccagga

SEQ ID NO: 835809 - RNA, 19 nt, Homo sapiens
gccaaggcuggagugcagu

SEQ ID NO: 835810 - RNA, 12 nt, Homo sapiens
gccaagggauga

SEQ ID NO: 835811 - RNA, 17 nt, Homo sapiens
gccaauaacacacagcu

SEQ ID NO: 835812 - RNA, 11 nt, Homo sapiens
gccacccagca

SEQ ID NO: 835813 - RNA, 17 nt, Homo sapiens
gccacggccacagucau

SEQ ID NO: 835814 - RNA, 16 nt, Homo sapiens
gccacuguuugucuca

SEQ ID NO: 835815 - RNA, 22 nt, Homo sapiens
gccagaguauuggucuccucuc

SEQ ID NO: 835816 - RNA, 21 nt, Homo sapiens
gccaguuggucccccuuccau

SEQ ID NO: 835817 - RNA, 21 nt, Homo sapiens
gcccaggaaaggcuccaggag

SEQ ID NO: 835818 - RNA, 14 nt, Homo sapiens
gcccauccagucuc

SEQ ID NO: 835819 - RNA, 20 nt, Homo sapiens
gcccaucuccgucucccaaa

SEQ ID NO: 835820 - RNA, 19 nt, Homo sapiens
gccccaccuugucugcuaa

SEQ ID NO: 835821 - RNA, 21 nt, Homo sapiens
gccccucuccuccguggcaca

SEQ ID NO: 835822 - RNA, 22 nt, Homo sapiens
gccccucuccuccguggcacau

SEQ ID NO: 835823 - RNA, 17 nt, Homo sapiens
gccccugauccugugaa

SEQ ID NO: 835824 - RNA, 20 nt, Homo sapiens
gccccugucgucaggaccuc

SEQ ID NO: 835825 - RNA, 21 nt, Homo sapiens
gccgagauugcaccacugcac

SEQ ID NO: 835826 - RNA, 13 nt, Homo sapiens
gccucacaguccu

SEQ ID NO: 835827 - RNA, 17 nt, Homo sapiens
gccucccuucaugcaug

SEQ ID NO: 835828 - RNA, 21 nt, Homo sapiens
gccuccgccucaguaagacga

SEQ ID NO: 835829 - RNA, 24 nt, Homo sapiens
gccucuuccagugaacauucccag

SEQ ID NO: 835830 - RNA, 23 nt, Homo sapiens
gccugaucagcaggagccaauau

SEQ ID NO: 835831 - RNA, 14 nt, Homo sapiens
gccugccucuucuc

SEQ ID NO: 835832 - RNA, 14 nt, Homo sapiens
gccuggacccugug

SEQ ID NO: 835833 - RNA, 21 nt, Homo sapiens
gccuggaucucacaagcacuu

SEQ ID NO: 835834 - RNA, 22 nt, Homo sapiens
gccuggaucucacaagcacuuu

SEQ ID NO: 835835 - RNA, 15 nt, Homo sapiens
gccugugcugugacu

SEQ ID NO: 835836 - RNA, 13 nt, Homo sapiens
gccuucaaacucc

SEQ ID NO: 835837 - RNA, 23 nt, Homo sapiens
gccuuccacuuggcuacacaggg

SEQ ID NO: 835838 - RNA, 18 nt, Homo sapiens
gcggaucuuuggacagaa

SEQ ID NO: 835839 - RNA, 16 nt, Homo sapiens
gcggcauuaaagccau

SEQ ID NO: 835840 - RNA, 11 nt, Homo sapiens
gcgggggcuug

SEQ ID NO: 835841 - RNA, 13 nt, Homo sapiens
gcgugcaggcagc

SEQ ID NO: 835842 - RNA, 17 nt, Homo sapiens
gcuaagcauuagcuuua

SEQ ID NO: 835843 - RNA, 15 nt, Homo sapiens
gcuauguauuugcaa

SEQ ID NO: 835844 - RNA, 18 nt, Homo sapiens
gcucacuguucuauucau

SEQ ID NO: 835845 - RNA, 15 nt, Homo sapiens
gcucccaagggaugg

SEQ ID NO: 835846 - RNA, 14 nt, Homo sapiens
gcugagaacacugu

SEQ ID NO: 835847 - RNA, 23 nt, Homo sapiens
gcugagggugagugggugaauaa

SEQ ID NO: 835848 - RNA, 22 nt, Homo sapiens
gcugauacaaauugcagacugu

SEQ ID NO: 835849 - RNA, 16 nt, Homo sapiens
gcugcacccacccagg

SEQ ID NO: 835850 - RNA, 17 nt, Homo sapiens
gcugcacccacccagga

SEQ ID NO: 835851 - RNA, 13 nt, Homo sapiens
gcugcuccagugc

SEQ ID NO: 835852 - RNA, 17 nt, Homo sapiens
gcugggagagccuucca

SEQ ID NO: 835853 - RNA, 16 nt, Homo sapiens
gcugggauuuacacuu

SEQ ID NO: 835854 - RNA, 17 nt, Homo sapiens
gcuggguggcacugcca

SEQ ID NO: 835855 - RNA, 21 nt, Homo sapiens
gcugugaguuugggccccaga

SEQ ID NO: 835856 - RNA, 17 nt, Homo sapiens
gcuuaagugagcagaac

SEQ ID NO: 835857 - RNA, 21 nt, Homo sapiens
gcuuaauuauugauguuuuca

SEQ ID NO: 835858 - RNA, 18 nt, Homo sapiens
gcuucgcaaaauguuuca

SEQ ID NO: 835859 - RNA, 21 nt, Homo sapiens
gcuucugguugaugccuguga

SEQ ID NO: 835860 - RNA, 15 nt, Homo sapiens
gcuugaaguaaccuu

SEQ ID NO: 835861 - RNA, 19 nt, Homo sapiens
gcuuuaaaacuuauccucc

SEQ ID NO: 835862 - RNA, 20 nt, Homo sapiens
gcuuuucaugcaaacucuuu

SEQ ID NO: 835863 - RNA, 22 nt, Homo sapiens
ggaaaaaacaccaggauuuaag

SEQ ID NO: 835864 - RNA, 14 nt, Homo sapiens
ggaaaccacagcug

SEQ ID NO: 835865 - RNA, 15 nt, Homo sapiens
ggaaaccacagcugc

SEQ ID NO: 835866 - RNA, 14 nt, Homo sapiens
ggaacucaguguga

SEQ ID NO: 835867 - RNA, 15 nt, Homo sapiens
ggaagacaaugugaa

SEQ ID NO: 835868 - RNA, 17 nt, Homo sapiens
ggaagggggcugggaca

SEQ ID NO: 835869 - RNA, 21 nt, Homo sapiens
ggaaguuaguuuuuaaucucu

SEQ ID NO: 835870 - RNA, 20 nt, Homo sapiens
ggaauaauagcacaugauuu

SEQ ID NO: 835871 - RNA, 14 nt, Homo sapiens
ggaauauacggaau

SEQ ID NO: 835872 - RNA, 13 nt, Homo sapiens
ggaaucaucuccu

SEQ ID NO: 835873 - RNA, 18 nt, Homo sapiens
ggaaucaucuccuuugca

SEQ ID NO: 835874 - RNA, 13 nt, Homo sapiens
ggacagaagcagc

SEQ ID NO: 835875 - RNA, 15 nt, Homo sapiens
ggacagaagcagcuc

SEQ ID NO: 835876 - RNA, 17 nt, Homo sapiens
ggacaggugaauggagg

SEQ ID NO: 835877 - RNA, 20 nt, Homo sapiens
ggaccacgugagaucauuca

SEQ ID NO: 835878 - RNA, 13 nt, Homo sapiens
ggacugaguuuau

SEQ ID NO: 835879 - RNA, 10 nt, Homo sapiens
ggacuuuguu

SEQ ID NO: 835880 - RNA, 23 nt, Homo sapiens
ggagaaaauuggaacucuacuca

SEQ ID NO: 835881 - RNA, 19 nt, Homo sapiens
aaaaaacaccaggauuuaa

SEQ ID NO: 835882 - RNA, 20 nt, Homo sapiens
aaaaaacguauugcauuuaa

SEQ ID NO: 835883 - RNA, 14 nt, Homo sapiens
aaaaacguauugca

SEQ ID NO: 835884 - RNA, 15 nt, Homo sapiens
aaaaacguauugcau

SEQ ID NO: 835885 - RNA, 19 nt, Homo sapiens
aaaaauaugaccacacucc

SEQ ID NO: 835886 - RNA, 14 nt, Homo sapiens
aaaaaugaacagug

SEQ ID NO: 835887 - RNA, 12 nt, Homo sapiens
aaaacauuccau

SEQ ID NO: 835888 - RNA, 12 nt, Homo sapiens
aaaaccuagcau

SEQ ID NO: 835889 - RNA, 23 nt, Homo sapiens
aaaagaugcuucucacugccaug

SEQ ID NO: 835890 - RNA, 11 nt, Homo sapiens
aaaagcacuua

SEQ ID NO: 835891 - RNA, 13 nt, Homo sapiens
aaaagcugggcag

SEQ ID NO: 835892 - RNA, 15 nt, Homo sapiens
aaaaugaacagugau

SEQ ID NO: 835893 - RNA, 23 nt, Homo sapiens
aaaaugaagguggaacaagcaca

SEQ ID NO: 835894 - RNA, 23 nt, Homo sapiens
aaaaugagcccuguccugccuaa

SEQ ID NO: 835895 - RNA, 23 nt, Homo sapiens
aaaaugucauuguucuugugaac

SEQ ID NO: 835896 - RNA, 19 nt, Homo sapiens
aaaauuaaucugggccaga

SEQ ID NO: 835897 - RNA, 20 nt, Homo sapiens
aaaauuaggccguuccuuca

SEQ ID NO: 835898 - RNA, 22 nt, Homo sapiens
aaacauucaucaagcuguacau

SEQ ID NO: 835899 - RNA, 11 nt, Homo sapiens
aaacauuccau

SEQ ID NO: 835900 - RNA, 15 nt, Homo sapiens
aaacguccacagagu

SEQ ID NO: 835901 - RNA, 13 nt, Homo sapiens
aaacucaccaucu

SEQ ID NO: 835902 - RNA, 20 nt, Homo sapiens
aaacuuauccuccaugaaua

SEQ ID NO: 835903 - RNA, 19 nt, Homo sapiens
aaacuuucacaccccagac

SEQ ID NO: 835904 - RNA, 20 nt, Homo sapiens
aaacuuuucuaauacucuac

SEQ ID NO: 835905 - RNA, 17 nt, Homo sapiens
aaagaaacuuuauucaa

SEQ ID NO: 835906 - RNA, 22 nt, Homo sapiens
aaagaccuuuuccaugcacccu

SEQ ID NO: 835907 - RNA, 19 nt, Homo sapiens
aaagagagucgcaucucag

SEQ ID NO: 835908 - RNA, 13 nt, Homo sapiens
aaagcacaggugg

SEQ ID NO: 835909 - RNA, 18 nt, Homo sapiens
aaagcccauucauuccau

SEQ ID NO: 835910 - RNA, 17 nt, Homo sapiens
aaagcguggacaggugu

SEQ ID NO: 835911 - RNA, 22 nt, Homo sapiens
aaagcuugcucacaucuuggca

SEQ ID NO: 835912 - RNA, 14 nt, Homo sapiens
aaagcuuugugcag

SEQ ID NO: 835913 - RNA, 16 nt, Homo sapiens
aaagcuuugugcagau

SEQ ID NO: 835914 - RNA, 20 nt, Homo sapiens
aaaggcaaaugcccaaggga

SEQ ID NO: 835915 - RNA, 19 nt, Homo sapiens
aaagggcgcaaagggcaug

SEQ ID NO: 835916 - RNA, 22 nt, Homo sapiens
aaagggucucccucuguugcca

SEQ ID NO: 835917 - RNA, 14 nt, Homo sapiens
aaagguccuggcaa

SEQ ID NO: 835918 - RNA, 21 nt, Homo sapiens
aaagucaucccucuguucaca

SEQ ID NO: 835919 - RNA, 14 nt, Homo sapiens
aaauaaaagcacuu

SEQ ID NO: 835920 - RNA, 13 nt, Homo sapiens
aaauaaacaugug

SEQ ID NO: 835921 - RNA, 17 nt, Homo sapiens
aaauaaagucucuuccu

SEQ ID NO: 835922 - RNA, 19 nt, Homo sapiens
aaauaucagugggcucucu

SEQ ID NO: 835923 - RNA, 16 nt, Homo sapiens
aaaucucaauucuucc

SEQ ID NO: 835924 - RNA, 18 nt, Homo sapiens
aaaugaguaaacccagcu

SEQ ID NO: 835925 - RNA, 16 nt, Homo sapiens
aaauggccaaugagau

SEQ ID NO: 835926 - RNA, 17 nt, Homo sapiens
aaaugggaaaaccagac

SEQ ID NO: 835927 - RNA, 19 nt, Homo sapiens
aaaugucuucuguauucac

SEQ ID NO: 835928 - RNA, 15 nt, Homo sapiens
uggaagggcguucua

SEQ ID NO: 835929 - RNA, 17 nt, Homo sapiens
uggaaggggacacguga

SEQ ID NO: 835930 - RNA, 21 nt, Homo sapiens
uggaaugggcagcucaucucu

SEQ ID NO: 835931 - RNA, 22 nt, Homo sapiens
uggaauuuugugcccccaugua

SEQ ID NO: 835932 - RNA, 12 nt, Homo sapiens
uggacagaagca

SEQ ID NO: 835933 - RNA, 14 nt, Homo sapiens
uggacucagccuug

SEQ ID NO: 835934 - RNA, 23 nt, Homo sapiens
uggagaagcucaucagaaacuca

SEQ ID NO: 835935 - RNA, 22 nt, Homo sapiens
uggagaggcccggccucucaca

SEQ ID NO: 835936 - RNA, 14 nt, Homo sapiens
uggagcugccugau

SEQ ID NO: 835937 - RNA, 20 nt, Homo sapiens
uggagggcacauuccuugcc

SEQ ID NO: 835938 - RNA, 19 nt, Homo sapiens
uggaggggggaggugggau

SEQ ID NO: 835939 - RNA, 16 nt, Homo sapiens
uggcacuugggacaaa

SEQ ID NO: 835940 - RNA, 15 nt, Homo sapiens
uggcagccucuucaa

SEQ ID NO: 835941 - RNA, 21 nt, Homo sapiens
uggcagcgccucaucuucaac

SEQ ID NO: 835942 - RNA, 16 nt, Homo sapiens
uggcauggccaccacc

SEQ ID NO: 835943 - RNA, 12 nt, Homo sapiens
uggccacggcca

SEQ ID NO: 835944 - RNA, 17 nt, Homo sapiens
uggccacggccacagcc

SEQ ID NO: 835945 - RNA, 18 nt, Homo sapiens
uggccacggccacggcca

SEQ ID NO: 835946 - RNA, 21 nt, Homo sapiens
uggccacggccacggccacag

SEQ ID NO: 835947 - RNA, 22 nt, Homo sapiens
uggccacgugggcaaacaggca

SEQ ID NO: 835948 - RNA, 23 nt, Homo sapiens
uggccagagagccuggugcugcu

SEQ ID NO: 835949 - RNA, 15 nt, Homo sapiens
uggccucccaacuca

SEQ ID NO: 835950 - RNA, 15 nt, Homo sapiens
uggccuccugugcau

SEQ ID NO: 835951 - RNA, 17 nt, Homo sapiens
uggcgcgcgccaccacg

SEQ ID NO: 835952 - RNA, 15 nt, Homo sapiens
uggcuacacagggau

SEQ ID NO: 835953 - RNA, 17 nt, Homo sapiens
uggcuuaacuuaguaua

SEQ ID NO: 835954 - RNA, 16 nt, Homo sapiens
ugggacacccugugau

SEQ ID NO: 835955 - RNA, 16 nt, Homo sapiens
ugggaggccaaggugg

SEQ ID NO: 835956 - RNA, 16 nt, Homo sapiens
ugggcagcucaucucu

SEQ ID NO: 835957 - RNA, 23 nt, Homo sapiens
ugggccccugucgucaggaccuc

SEQ ID NO: 835958 - RNA, 16 nt, Homo sapiens
uggggauaugauuuaa

SEQ ID NO: 835959 - RNA, 18 nt, Homo sapiens
ugggucucaguguccuca

SEQ ID NO: 835960 - RNA, 23 nt, Homo sapiens
uggguugcaggaccucaggugag

SEQ ID NO: 835961 - RNA, 18 nt, Homo sapiens
uggucccccuuccaugga

SEQ ID NO: 835962 - RNA, 18 nt, Homo sapiens
uggugcccuguucucuac

SEQ ID NO: 835963 - RNA, 22 nt, Homo sapiens
ugguggagccaguaaacagagg

SEQ ID NO: 835964 - RNA, 19 nt, Homo sapiens
uggugggggugcagaugag

SEQ ID NO: 835965 - RNA, 15 nt, Homo sapiens
ugguugagguuucaa

SEQ ID NO: 835966 - RNA, 16 nt, Homo sapiens
uguaaauagcuaagau

SEQ ID NO: 835967 - RNA, 17 nt, Homo sapiens
uguaagcauaacuuauu

SEQ ID NO: 835968 - RNA, 15 nt, Homo sapiens
uguagacuauuugcu

SEQ ID NO: 835969 - RNA, 12 nt, Homo sapiens
uguauucacuua

SEQ ID NO: 835970 - RNA, 18 nt, Homo sapiens
uguauuugcaaggcugau

SEQ ID NO: 835971 - RNA, 17 nt, Homo sapiens
uguauuuuuacuuuuaa

SEQ ID NO: 835972 - RNA, 19 nt, Homo sapiens
ugucacauagagugaucuu

SEQ ID NO: 835973 - RNA, 20 nt, Homo sapiens
uguccuuuuucacuuugaaa

SEQ ID NO: 835974 - RNA, 18 nt, Homo sapiens
ugucuaggacugcagugu

SEQ ID NO: 835975 - RNA, 17 nt, Homo sapiens
ugucuagggugugauuu

SEQ ID NO: 835976 - RNA, 15 nt, Homo sapiens
agacgggguuugcca

SEQ ID NO: 835977 - RNA, 17 nt, Homo sapiens
agacuauuuuauaugau

SEQ ID NO: 835978 - RNA, 14 nt, Homo sapiens
agagaagcauucuc

SEQ ID NO: 835979 - RNA, 17 nt, Homo sapiens
agagacgggguuugcca

SEQ ID NO: 835980 - RNA, 15 nt, Homo sapiens
agagacuccuugaga

SEQ ID NO: 835981 - RNA, 16 nt, Homo sapiens
agagagggcuuucuca

SEQ ID NO: 835982 - RNA, 19 nt, Homo sapiens
agagcaguuucuguccugc

SEQ ID NO: 835983 - RNA, 21 nt, Homo sapiens
agagcuuggacuggaugcaug

SEQ ID NO: 835984 - RNA, 12 nt, Homo sapiens
agaggggacgca

SEQ ID NO: 835985 - RNA, 20 nt, Homo sapiens
agaggugaaagcuauaucaa

SEQ ID NO: 835986 - RNA, 14 nt, Homo sapiens
agaguaacagucau

SEQ ID NO: 835987 - RNA, 14 nt, Homo sapiens
agagucgcaucuca

SEQ ID NO: 835988 - RNA, 21 nt, Homo sapiens
agagucgcaucucagugcagg

SEQ ID NO: 835989 - RNA, 12 nt, Homo sapiens
agaucacagugg

SEQ ID NO: 835990 - RNA, 14 nt, Homo sapiens
agaucauucacuca

SEQ ID NO: 835991 - RNA, 17 nt, Homo sapiens
agaugaacccuggcauu

SEQ ID NO: 835992 - RNA, 20 nt, Homo sapiens
agaugaacccuggcauuugg

SEQ ID NO: 835993 - RNA, 13 nt, Homo sapiens
agaugcaggugag

SEQ ID NO: 835994 - RNA, 14 nt, Homo sapiens
agauggaugcaugu

SEQ ID NO: 835995 - RNA, 14 nt, Homo sapiens
agauucacacuguc

SEQ ID NO: 835996 - RNA, 16 nt, Homo sapiens
agauuccgcaccaaua

SEQ ID NO: 835997 - RNA, 22 nt, Homo sapiens
agauucuggcuagugucuauca

SEQ ID NO: 835998 - RNA, 18 nt, Homo sapiens
agcaauacagacuacuuc

SEQ ID NO: 835999 - RNA, 20 nt, Homo sapiens
agcacacuuggcccaagugg

SEQ ID NO: 836000 - RNA, 11 nt, Homo sapiens
agcacaggugg

SEQ ID NO: 836001 - RNA, 13 nt, Homo sapiens
agcaccaagcuca

SEQ ID NO: 836002 - RNA, 22 nt, Homo sapiens
agcagagcaccuuagacagucc

SEQ ID NO: 836003 - RNA, 21 nt, Homo sapiens
agcagauuuaagauauguaac

SEQ ID NO: 836004 - RNA, 16 nt, Homo sapiens
agcagccaagggauga

SEQ ID NO: 836005 - RNA, 19 nt, Homo sapiens
agcaggcguucagcucacu

SEQ ID NO: 836006 - RNA, 16 nt, Homo sapiens
agcaguagacaagcaa

SEQ ID NO: 836007 - RNA, 14 nt, Homo sapiens
agcauuagcuuuaa

SEQ ID NO: 836008 - RNA, 24 nt, Homo sapiens
agccaaagccaauaacacacagcu

SEQ ID NO: 836009 - RNA, 11 nt, Homo sapiens
agccaagggau

SEQ ID NO: 836010 - RNA, 17 nt, Homo sapiens
agccagcucauuucacu

SEQ ID NO: 836011 - RNA, 15 nt, Homo sapiens
agccagcuguguuca

SEQ ID NO: 836012 - RNA, 13 nt, Homo sapiens
agcccaccccuca

SEQ ID NO: 836013 - RNA, 16 nt, Homo sapiens
agcccauccagucucc

SEQ ID NO: 836014 - RNA, 16 nt, Homo sapiens
agcccauucauuccau

SEQ ID NO: 836015 - RNA, 16 nt, Homo sapiens
agccugcccuccuuuc

SEQ ID NO: 836016 - RNA, 15 nt, Homo sapiens
agcgugaaucuguau

SEQ ID NO: 836017 - RNA, 15 nt, Homo sapiens
agcuaacacacagcu

SEQ ID NO: 836018 - RNA, 16 nt, Homo sapiens
agcucaccucucccuu

SEQ ID NO: 836019 - RNA, 14 nt, Homo sapiens
agcucacuguucua

SEQ ID NO: 836020 - RNA, 15 nt, Homo sapiens
agcucauaagaguaa

SEQ ID NO: 836021 - RNA, 19 nt, Homo sapiens
agcuccaaaugcagcuuua

SEQ ID NO: 836022 - RNA, 21 nt, Homo sapiens
agcucccaagggauggugccc

SEQ ID NO: 836023 - RNA, 13 nt, Homo sapiens
agcugaaccuggg

SEQ ID NO: 836024 - RNA, 12 nt, Homo sapiens
agcugcauauga

SEQ ID NO: 836025 - RNA, 22 nt, Homo sapiens
agcuggcgucaugcaaagucau

SEQ ID NO: 836026 - RNA, 15 nt, Homo sapiens
agcuggugagugaug

SEQ ID NO: 836027 - RNA, 17 nt, Homo sapiens
agcuuggcacucaggug

SEQ ID NO: 836028 - RNA, 19 nt, Homo sapiens
agcuuucugcuaucaaaga

SEQ ID NO: 836029 - RNA, 16 nt, Homo sapiens
agcuuugaaaauucag

SEQ ID NO: 836030 - RNA, 13 nt, Homo sapiens
agcuuugcaggau

SEQ ID NO: 836031 - RNA, 18 nt, Homo sapiens
aggaaaagggagcuauga

SEQ ID NO: 836032 - RNA, 15 nt, Homo sapiens
aggaagacaauguga

SEQ ID NO: 836033 - RNA, 12 nt, Homo sapiens
aggaagcucagg

SEQ ID NO: 836034 - RNA, 13 nt, Homo sapiens
aggaaucaucucc

SEQ ID NO: 836035 - RNA, 14 nt, Homo sapiens
aggaaucaucuccu

SEQ ID NO: 836036 - RNA, 14 nt, Homo sapiens
aggacacagaugaa

SEQ ID NO: 836037 - RNA, 15 nt, Homo sapiens
aggacacagaugaaa

SEQ ID NO: 836038 - RNA, 20 nt, Homo sapiens
aggagaccuggcacuggaug

SEQ ID NO: 836039 - RNA, 18 nt, Homo sapiens
aggagcagugcaggcaca

SEQ ID NO: 836040 - RNA, 13 nt, Homo sapiens
aggaguacaggug

SEQ ID NO: 836041 - RNA, 15 nt, Homo sapiens
aggaguacaggugaa

SEQ ID NO: 836042 - RNA, 17 nt, Homo sapiens
uuggaaugggcagcuca

SEQ ID NO: 836043 - RNA, 17 nt, Homo sapiens
uuggacagaagcagcuc

SEQ ID NO: 836044 - RNA, 16 nt, Homo sapiens
uuggcuacacagggau

SEQ ID NO: 836045 - RNA, 21 nt, Homo sapiens
uugggagcaccgccugugaaa

SEQ ID NO: 836046 - RNA, 21 nt, Homo sapiens
uuggggaaaauggccaugcag

SEQ ID NO: 836047 - RNA, 16 nt, Homo sapiens
uuggucccccuuccau

SEQ ID NO: 836048 - RNA, 14 nt, Homo sapiens
uuguagugcuuuga

SEQ ID NO: 836049 - RNA, 20 nt, Homo sapiens
uuguaguuuuggcuaguccu

SEQ ID NO: 836050 - RNA, 17 nt, Homo sapiens
uuguuccccaagacauu

SEQ ID NO: 836051 - RNA, 20 nt, Homo sapiens
uuguuccccaagacauucua

SEQ ID NO: 836052 - RNA, 16 nt, Homo sapiens
uuguuugauuucugac

SEQ ID NO: 836053 - RNA, 15 nt, Homo sapiens
uuuagggaccugcug

SEQ ID NO: 836054 - RNA, 21 nt, Homo sapiens
uuuaggucaguagacugugau

SEQ ID NO: 836055 - RNA, 16 nt, Homo sapiens
uuuagugaucacagca

SEQ ID NO: 836056 - RNA, 19 nt, Homo sapiens
uuuauaugauucacaugcu

SEQ ID NO: 836057 - RNA, 21 nt, Homo sapiens
uuuaucucuuuaguuagugau

SEQ ID NO: 836058 - RNA, 21 nt, Homo sapiens
uuuauggucagaauuucccuc

SEQ ID NO: 836059 - RNA, 12 nt, Homo sapiens
uuucauucacuu

SEQ ID NO: 836060 - RNA, 12 nt, Homo sapiens
uuucauugcugg

SEQ ID NO: 836061 - RNA, 19 nt, Homo sapiens
uuucccccugugaaagcaa

SEQ ID NO: 836062 - RNA, 22 nt, Homo sapiens
uuuccuagcgcagccaugugau

SEQ ID NO: 836063 - RNA, 20 nt, Homo sapiens
uuuccuucauucaacccacc

SEQ ID NO: 836064 - RNA, 18 nt, Homo sapiens
uuuccuuugguccuucaa

SEQ ID NO: 836065 - RNA, 13 nt, Homo sapiens
uuucgcucuuuga

SEQ ID NO: 836066 - RNA, 12 nt, Homo sapiens
uuucuguucuca

SEQ ID NO: 836067 - RNA, 13 nt, Homo sapiens
uuucuugcaugag

SEQ ID NO: 836068 - RNA, 17 nt, Homo sapiens
uuucuuuuuuauacuca

SEQ ID NO: 836069 - RNA, 23 nt, Homo sapiens
uuugacuuaggugugaagaccca

SEQ ID NO: 836070 - RNA, 19 nt, Homo sapiens
uuugcuaaaugugaaugau

SEQ ID NO: 836071 - RNA, 17 nt, Homo sapiens
uuuguagcguacaucaa

SEQ ID NO: 836072 - RNA, 19 nt, Homo sapiens
uuuguauuuuuacuuuuaa

SEQ ID NO: 836073 - RNA, 18 nt, Homo sapiens
uuuguuccccaagacauu

SEQ ID NO: 836074 - RNA, 23 nt, Homo sapiens
uuuuauaugucuaauaucuuaau

SEQ ID NO: 836075 - RNA, 13 nt, Homo sapiens
uuuucacuuugaa

SEQ ID NO: 836076 - RNA, 15 nt, Homo sapiens
uuuucccucuucacu

SEQ ID NO: 836077 - RNA, 16 nt, Homo sapiens
uuuuguacugaaucuc

SEQ ID NO: 836078 - RNA, 15 nt, Homo sapiens
uuuugugaugcauuu

SEQ ID NO: 836079 - RNA, 17 nt, Homo sapiens
uuuugugaugcauuuua

SEQ ID NO: 836080 - RNA, 16 nt, Homo sapiens
uuuuuggcaaagccag

SEQ ID NO: 836081 - RNA, 17 nt, Homo sapiens
cauccaggccauucccc

SEQ ID NO: 836082 - RNA, 24 nt, Homo sapiens
cauccauguuccgagaagaacaga

SEQ ID NO: 836083 - RNA, 15 nt, Homo sapiens
caucccucuguucac

SEQ ID NO: 836084 - RNA, 16 nt, Homo sapiens
caucccucuguucaca

SEQ ID NO: 836085 - RNA, 14 nt, Homo sapiens
caucccugaaggcc

SEQ ID NO: 836086 - RNA, 15 nt, Homo sapiens
caucccuggaaggac

SEQ ID NO: 836087 - RNA, 23 nt, Homo sapiens
cauccuaaaugaguaaacccagc

SEQ ID NO: 836088 - RNA, 19 nt, Homo sapiens
cauccuugagucaaaaaau

SEQ ID NO: 836089 - RNA, 24 nt, Homo sapiens
cauccuuggaaauuggaagagcac

SEQ ID NO: 836090 - RNA, 16 nt, Homo sapiens
caucuccuuugcagaa

SEQ ID NO: 836091 - RNA, 13 nt, Homo sapiens
caucucuacaaaa

SEQ ID NO: 836092 - RNA, 14 nt, Homo sapiens
caucugguaacuca

SEQ ID NO: 836093 - RNA, 15 nt, Homo sapiens
caucuguaaaaugga

SEQ ID NO: 836094 - RNA, 12 nt, Homo sapiens
caucuguacuca

SEQ ID NO: 836095 - RNA, 16 nt, Homo sapiens
caugaauaucaguuau

SEQ ID NO: 836096 - RNA, 15 nt, Homo sapiens
caugccaagcacugu

SEQ ID NO: 836097 - RNA, 22 nt, Homo sapiens
caugcuccuggcccacugcauc

SEQ ID NO: 836098 - RNA, 15 nt, Homo sapiens
caugcugcccuguga

SEQ ID NO: 836099 - RNA, 22 nt, Homo sapiens
caugcugugugacucaaaccaa

SEQ ID NO: 836100 - RNA, 12 nt, Homo sapiens
cauggaaauucc

SEQ ID NO: 836101 - RNA, 18 nt, Homo sapiens
cauggagagcuggagccu

SEQ ID NO: 836102 - RNA, 19 nt, Homo sapiens
caugggucgggagagggga

SEQ ID NO: 836103 - RNA, 17 nt, Homo sapiens
cauggucccaggcuucc

SEQ ID NO: 836104 - RNA, 14 nt, Homo sapiens
cauguccaagaagc

SEQ ID NO: 836105 - RNA, 19 nt, Homo sapiens
caugucuuuucuugcauga

SEQ ID NO: 836106 - RNA, 13 nt, Homo sapiens
cauuacaguuugg

SEQ ID NO: 836107 - RNA, 21 nt, Homo sapiens
cauuacgcuaguuaucaugca

SEQ ID NO: 836108 - RNA, 23 nt, Homo sapiens
cauuacgcuaguuaucaugcaug

SEQ ID NO: 836109 - RNA, 23 nt, Homo sapiens
cauuagagcaggcguucagcuca

SEQ ID NO: 836110 - RNA, 22 nt, Homo sapiens
cauuagcuuuaauuaagcucuc

SEQ ID NO: 836111 - RNA, 13 nt, Homo sapiens
cauuaucagucca

SEQ ID NO: 836112 - RNA, 19 nt, Homo sapiens
cauuauuaaauguuucuca

SEQ ID NO: 836113 - RNA, 12 nt, Homo sapiens
cauucacucaua

SEQ ID NO: 836114 - RNA, 13 nt, Homo sapiens
cauucuacucaaa

SEQ ID NO: 836115 - RNA, 16 nt, Homo sapiens
cauucuagguuugcaa

SEQ ID NO: 836116 - RNA, 18 nt, Homo sapiens
cauugccuuuucuagccc

SEQ ID NO: 836117 - RNA, 14 nt, Homo sapiens
cauugggauauucu

SEQ ID NO: 836118 - RNA, 20 nt, Homo sapiens
cauuguucuugugaacccaa

SEQ ID NO: 836119 - RNA, 14 nt, Homo sapiens
cauuguugucaagg

SEQ ID NO: 836120 - RNA, 18 nt, Homo sapiens
cauuuaaaaaaaaucccu

SEQ ID NO: 836121 - RNA, 14 nt, Homo sapiens
cauuuaucaucaca

SEQ ID NO: 836122 - RNA, 16 nt, Homo sapiens
cauuucucauguugaa

SEQ ID NO: 836123 - RNA, 16 nt, Homo sapiens
cauuucugagaucaaa

SEQ ID NO: 836124 - RNA, 13 nt, Homo sapiens
cauuuggccucuu

SEQ ID NO: 836125 - RNA, 22 nt, Homo sapiens
ccaaaagcccauucauuccauu

SEQ ID NO: 836126 - RNA, 12 nt, Homo sapiens
ccaaacuggagc

SEQ ID NO: 836127 - RNA, 22 nt, Homo sapiens
ccaaagccaauaacacacagcu

SEQ ID NO: 836128 - RNA, 19 nt, Homo sapiens
ccaaaggaauaaccuuucu

SEQ ID NO: 836129 - RNA, 21 nt, Homo sapiens
ccaacacugcugcuccagugc

SEQ ID NO: 836130 - RNA, 18 nt, Homo sapiens
ccaacgucugugccauuu

SEQ ID NO: 836131 - RNA, 21 nt, Homo sapiens
ccaacuucuucagagcugaca

SEQ ID NO: 836132 - RNA, 18 nt, Homo sapiens
ccaagagucugaugauuu

SEQ ID NO: 836133 - RNA, 23 nt, Homo sapiens
ccaauauccaauuuuaaaaugaa

SEQ ID NO: 836134 - RNA, 16 nt, Homo sapiens
ccaauauuuaccagac

SEQ ID NO: 836135 - RNA, 19 nt, Homo sapiens
ccaaugagaucauugugaa

SEQ ID NO: 836136 - RNA, 14 nt, Homo sapiens
ccacaagaccaucu

SEQ ID NO: 836137 - RNA, 22 nt, Homo sapiens
ccacagaggaugcugacaucau

SEQ ID NO: 836138 - RNA, 19 nt, Homo sapiens
ccacaggcaaaacucagua

SEQ ID NO: 836139 - RNA, 22 nt, Homo sapiens
ccacauauuucaaaaacaugcu

SEQ ID NO: 836140 - RNA, 17 nt, Homo sapiens
ccacauuccugaugcuu

SEQ ID NO: 836141 - RNA, 18 nt, Homo sapiens
ccacauuucuaagccuuu

SEQ ID NO: 836142 - RNA, 20 nt, Homo sapiens
ccacccaaugcugauguccu

SEQ ID NO: 836143 - RNA, 18 nt, Homo sapiens
ccacccugccucuaccca

SEQ ID NO: 836144 - RNA, 20 nt, Homo sapiens
ccacgugggcaaacaggcag

SEQ ID NO: 836145 - RNA, 21 nt, Homo sapiens
ccacgugggcaaacaggcagu

SEQ ID NO: 836146 - RNA, 20 nt, Homo sapiens
ccagagagccuggugcugcu

SEQ ID NO: 836147 - RNA, 21 nt, Homo sapiens
ccagaguuccccaugcagaca

SEQ ID NO: 836148 - RNA, 13 nt, Homo sapiens
ccagaugccaggg

SEQ ID NO: 836149 - RNA, 23 nt, Homo sapiens
ccagcaguggacucaaaacccau

SEQ ID NO: 836150 - RNA, 16 nt, Homo sapiens
ccagccagggcugcua

SEQ ID NO: 836151 - RNA, 12 nt, Homo sapiens
ccagccuugacc

SEQ ID NO: 836152 - RNA, 22 nt, Homo sapiens
ccagcuguguucacacuguaaa

SEQ ID NO: 836153 - RNA, 16 nt, Homo sapiens
ccaggguccacaggaa

SEQ ID NO: 836154 - RNA, 22 nt, Homo sapiens
ccaggugcuaggaacacuccuu

SEQ ID NO: 836155 - RNA, 20 nt, Homo sapiens
ccagugaggcucugcccuug

SEQ ID NO: 836156 - RNA, 19 nt, Homo sapiens
ccauauuaacaaauugcau

SEQ ID NO: 836157 - RNA, 14 nt, Homo sapiens
ccauccucaaacac

SEQ ID NO: 836158 - RNA, 17 nt, Homo sapiens
ccauccucaaacacugc

SEQ ID NO: 836159 - RNA, 15 nt, Homo sapiens
ccauccuugagucaa

SEQ ID NO: 836160 - RNA, 19 nt, Homo sapiens
ccaucucuacaaaaagcau

SEQ ID NO: 836161 - RNA, 13 nt, Homo sapiens
ccaucugcuccug

SEQ ID NO: 836162 - RNA, 14 nt, Homo sapiens
ccaugcagacauga

SEQ ID NO: 836163 - RNA, 17 nt, Homo sapiens
ccauguagaagcugcau

SEQ ID NO: 836164 - RNA, 17 nt, Homo sapiens
caacaauuugagaugua

SEQ ID NO: 836165 - RNA, 21 nt, Homo sapiens
caacacucaagucuauugaau

SEQ ID NO: 836166 - RNA, 14 nt, Homo sapiens
caacagacaaguga

SEQ ID NO: 836167 - RNA, 19 nt, Homo sapiens
caacaugccagccacugug

SEQ ID NO: 836168 - RNA, 13 nt, Homo sapiens
caacucaucuuag

SEQ ID NO: 836169 - RNA, 12 nt, Homo sapiens
caagaacuugga

SEQ ID NO: 836170 - RNA, 18 nt, Homo sapiens
caagaccaucuacauaca

SEQ ID NO: 836171 - RNA, 18 nt, Homo sapiens
caagaccucugugcacuu

SEQ ID NO: 836172 - RNA, 20 nt, Homo sapiens
caagacucuuuggacacuca

SEQ ID NO: 836173 - RNA, 16 nt, Homo sapiens
caagagcacacuuggc

SEQ ID NO: 836174 - RNA, 14 nt, Homo sapiens
caagagucugauga

SEQ ID NO: 836175 - RNA, 19 nt, Homo sapiens
caagcaagcucccaaggga

SEQ ID NO: 836176 - RNA, 17 nt, Homo sapiens
caagcagccaagggaug

SEQ ID NO: 836177 - RNA, 14 nt, Homo sapiens
caagcaguagacaa

SEQ ID NO: 836178 - RNA, 17 nt, Homo sapiens
caaggaguaaguacaaa

SEQ ID NO: 836179 - RNA, 17 nt, Homo sapiens
caaggccagaugcacau

SEQ ID NO: 836180 - RNA, 15 nt, Homo sapiens
caaggcugcagugag

SEQ ID NO: 836181 - RNA, 20 nt, Homo sapiens
caaguauuuuugacauuuac

SEQ ID NO: 836182 - RNA, 18 nt, Homo sapiens
caagucaagugaaaaagg

SEQ ID NO: 836183 - RNA, 17 nt, Homo sapiens
caagugauccgcccauc

SEQ ID NO: 836184 - RNA, 15 nt, Homo sapiens
caaguuaguucaauc

SEQ ID NO: 836185 - RNA, 12 nt, Homo sapiens
caauaaucucac

SEQ ID NO: 836186 - RNA, 15 nt, Homo sapiens
caaucuuaacucauu

SEQ ID NO: 836187 - RNA, 16 nt, Homo sapiens
caaugagaucauugug

SEQ ID NO: 836188 - RNA, 17 nt, Homo sapiens
caaugagaucauuguga

SEQ ID NO: 836189 - RNA, 19 nt, Homo sapiens
caauuauuugaagauuuaa

SEQ ID NO: 836190 - RNA, 22 nt, Homo sapiens
cacaccccagacgaugucuuca

SEQ ID NO: 836191 - RNA, 14 nt, Homo sapiens
cacacgagcaaacc

SEQ ID NO: 836192 - RNA, 16 nt, Homo sapiens
cacacuguccuauuau

SEQ ID NO: 836193 - RNA, 16 nt, Homo sapiens
cacagacccugcccug

SEQ ID NO: 836194 - RNA, 14 nt, Homo sapiens
cacagaggaugcug

SEQ ID NO: 836195 - RNA, 16 nt, Homo sapiens
cacagaggaugcugac

SEQ ID NO: 836196 - RNA, 22 nt, Homo sapiens
cacaggaugaaggcaaugccau

SEQ ID NO: 836197 - RNA, 20 nt, Homo sapiens
cacaguggccaagaucacag

SEQ ID NO: 836198 - RNA, 18 nt, Homo sapiens
cacagugggugaggagau

SEQ ID NO: 836199 - RNA, 19 nt, Homo sapiens
cacaguuuugguugcuuua

SEQ ID NO: 836200 - RNA, 23 nt, Homo sapiens
cacaucccuggaaggacauccau

SEQ ID NO: 836201 - RNA, 14 nt, Homo sapiens
cacauguggacuuu

SEQ ID NO: 836202 - RNA, 12 nt, Homo sapiens
cacauuccugau

SEQ ID NO: 836203 - RNA, 21 nt, Homo sapiens
caccaaacccggccugauuaa

SEQ ID NO: 836204 - RNA, 16 nt, Homo sapiens
caccaauaaagccuuc

SEQ ID NO: 836205 - RNA, 19 nt, Homo sapiens
caccacccuugccauggag

SEQ ID NO: 836206 - RNA, 16 nt, Homo sapiens
caccauaaaaaggaau

SEQ ID NO: 836207 - RNA, 14 nt, Homo sapiens
cacccacccaggag

SEQ ID NO: 836208 - RNA, 17 nt, Homo sapiens
cacccaucucucaggaa

SEQ ID NO: 836209 - RNA, 12 nt, Homo sapiens
caccccacugug

SEQ ID NO: 836210 - RNA, 21 nt, Homo sapiens
caccucagaguauggagcuca

SEQ ID NO: 836211 - RNA, 20 nt, Homo sapiens
caccuuccaaagagugcuaa

SEQ ID NO: 836212 - RNA, 20 nt, Homo sapiens
cacgugggcaaacaggcagu

SEQ ID NO: 836213 - RNA, 17 nt, Homo sapiens
cacucuggcagcucaga

SEQ ID NO: 836214 - RNA, 14 nt, Homo sapiens
cacugagcugaggg

SEQ ID NO: 836215 - RNA, 13 nt, Homo sapiens
cacugccugaugg

SEQ ID NO: 836216 - RNA, 15 nt, Homo sapiens
cacugccugcuccca

SEQ ID NO: 836217 - RNA, 22 nt, Homo sapiens
cacugugcugagucugaaggcu

SEQ ID NO: 836218 - RNA, 19 nt, Homo sapiens
cacuguuugucucaccuac

SEQ ID NO: 836219 - RNA, 22 nt, Homo sapiens
cacuuaaugaaugaaugaauuc

SEQ ID NO: 836220 - RNA, 18 nt, Homo sapiens
cacuuuguuuuacugucu

SEQ ID NO: 836221 - RNA, 14 nt, Homo sapiens
cagaaaaagaucuu

SEQ ID NO: 836222 - RNA, 17 nt, Homo sapiens
cagaaaaagaucuuuca

SEQ ID NO: 836223 - RNA, 16 nt, Homo sapiens
cagaaguuugagauca

SEQ ID NO: 836224 - RNA, 19 nt, Homo sapiens
cagaauggaaugcucuggu

SEQ ID NO: 836225 - RNA, 15 nt, Homo sapiens
cagacaggacugcag

SEQ ID NO: 836226 - RNA, 17 nt, Homo sapiens
cagacccugcccugugg

SEQ ID NO: 836227 - RNA, 21 nt, Homo sapiens
cagacuacuucuuccccagau

SEQ ID NO: 836228 - RNA, 22 nt, Homo sapiens
cagagagggcaggcaugaaguu

SEQ ID NO: 836229 - RNA, 17 nt, Homo sapiens
cagagcugacacaggau

SEQ ID NO: 836230 - RNA, 21 nt, Homo sapiens
cagaggaugcugacaucauuu

SEQ ID NO: 836231 - RNA, 16 nt, Homo sapiens
cagaggugaaagcuau

SEQ ID NO: 836232 - RNA, 21 nt, Homo sapiens
cagagguuugcuuccucagua

SEQ ID NO: 836233 - RNA, 19 nt, Homo sapiens
cagaugggggaaagcacag

SEQ ID NO: 836234 - RNA, 23 nt, Homo sapiens
cagcaaggccagaugcacauccc

SEQ ID NO: 836235 - RNA, 18 nt, Homo sapiens
cagcauuugccaagucuc

SEQ ID NO: 836236 - RNA, 12 nt, Homo sapiens
cagccaaccugg

SEQ ID NO: 836237 - RNA, 18 nt, Homo sapiens
cagccaggcggcuggaau

SEQ ID NO: 836238 - RNA, 16 nt, Homo sapiens
cagcccaagggugggu

SEQ ID NO: 836239 - RNA, 14 nt, Homo sapiens
cagcccccucacag

SEQ ID NO: 836240 - RNA, 13 nt, Homo sapiens
cagccguuuguuc

SEQ ID NO: 836241 - RNA, 19 nt, Homo sapiens
cagccugggugacagagca

SEQ ID NO: 836242 - RNA, 20 nt, Homo sapiens
cagccugggugacagagcaa

SEQ ID NO: 836243 - RNA, 22 nt, Homo sapiens
cagccuuuugggaauaauagca

SEQ ID NO: 836244 - RNA, 14 nt, Homo sapiens
cagcgugaagggau

SEQ ID NO: 836245 - RNA, 14 nt, Homo sapiens
cagcucagcacugc

SEQ ID NO: 836246 - RNA, 14 nt, Homo sapiens
ccucugaaaaccaa

SEQ ID NO: 836247 - RNA, 13 nt, Homo sapiens
ccucuguugccaa

SEQ ID NO: 836248 - RNA, 17 nt, Homo sapiens
ccucuuagaaaaaccac

SEQ ID NO: 836249 - RNA, 12 nt, Homo sapiens
ccucuucaaaau

SEQ ID NO: 836250 - RNA, 14 nt, Homo sapiens
ccucuucaaaauga

SEQ ID NO: 836251 - RNA, 18 nt, Homo sapiens
ccugaagucccagcauug

SEQ ID NO: 836252 - RNA, 23 nt, Homo sapiens
ccugacaacacucauugaccuga

SEQ ID NO: 836253 - RNA, 16 nt, Homo sapiens
ccugagugguccccac

SEQ ID NO: 836254 - RNA, 17 nt, Homo sapiens
ccugcaccccugcaguu

SEQ ID NO: 836255 - RNA, 20 nt, Homo sapiens
ccugccaaauuuuagauuua

SEQ ID NO: 836256 - RNA, 21 nt, Homo sapiens
ccuggcaaagaugaucaguau

SEQ ID NO: 836257 - RNA, 21 nt, Homo sapiens
ccuggcuccaacacugcugcu

SEQ ID NO: 836258 - RNA, 19 nt, Homo sapiens
ccuggcugaaggacuguga

SEQ ID NO: 836259 - RNA, 18 nt, Homo sapiens
ccuggcugggaguggcau

SEQ ID NO: 836260 - RNA, 17 nt, Homo sapiens
ccuggguaacuagggaa

SEQ ID NO: 836261 - RNA, 18 nt, Homo sapiens
ccuggguaacuagggaag

SEQ ID NO: 836262 - RNA, 13 nt, Homo sapiens
ccuggugcugcug

SEQ ID NO: 836263 - RNA, 15 nt, Homo sapiens
ccugguucugaugau

SEQ ID NO: 836264 - RNA, 23 nt, Homo sapiens
ccuguaccacaaacacauuacau

SEQ ID NO: 836265 - RNA, 20 nt, Homo sapiens
ccugugaguacuacaguccu

SEQ ID NO: 836266 - RNA, 14 nt, Homo sapiens
ccuuagacaguccc

SEQ ID NO: 836267 - RNA, 18 nt, Homo sapiens
ccuucaaagcaaaugucu

SEQ ID NO: 836268 - RNA, 17 nt, Homo sapiens
ccuucacaucacccaug

SEQ ID NO: 836269 - RNA, 14 nt, Homo sapiens
ccuucaucuggaac

SEQ ID NO: 836270 - RNA, 18 nt, Homo sapiens
ccuucugcuguauacugu

SEQ ID NO: 836271 - RNA, 19 nt, Homo sapiens
ccuugaaaacacuguucuc

SEQ ID NO: 836272 - RNA, 22 nt, Homo sapiens
ccuugaaaacacuguucucugc

SEQ ID NO: 836273 - RNA, 22 nt, Homo sapiens
ccuuggaaguugcauggcauca

SEQ ID NO: 836274 - RNA, 12 nt, Homo sapiens
ccuugucugcua

SEQ ID NO: 836275 - RNA, 22 nt, Homo sapiens
ccuuuccaaaugcccagcuuaa

SEQ ID NO: 836276 - RNA, 18 nt, Homo sapiens
ccuuugcagaaugaugca

SEQ ID NO: 836277 - RNA, 18 nt, Homo sapiens
ccuuuggccccacuuuga

SEQ ID NO: 836278 - RNA, 13 nt, Homo sapiens
ccuuuuucacuuu

SEQ ID NO: 836279 - RNA, 20 nt, Homo sapiens
cgagauugcaccacugcacu

SEQ ID NO: 836280 - RNA, 21 nt, Homo sapiens
cgagcaugccuggauggggcu

SEQ ID NO: 836281 - RNA, 17 nt, Homo sapiens
cgaggcggaucuuugga

SEQ ID NO: 836282 - RNA, 15 nt, Homo sapiens
cgagucacacucaag

SEQ ID NO: 836283 - RNA, 10 nt, Homo sapiens
cgcaaagggc

SEQ ID NO: 836284 - RNA, 18 nt, Homo sapiens
cgcaccaauaaagccuuc

SEQ ID NO: 836285 - RNA, 23 nt, Homo sapiens
cgccagauucuuuccugaggcug

SEQ ID NO: 836286 - RNA, 13 nt, Homo sapiens
cgcccuccacaaa

SEQ ID NO: 836287 - RNA, 11 nt, Homo sapiens
cggaagccaaa

SEQ ID NO: 836288 - RNA, 14 nt, Homo sapiens
cggaucuuuggaca

SEQ ID NO: 836289 - RNA, 21 nt, Homo sapiens
cgugaagggauuuuagucaca

SEQ ID NO: 836290 - RNA, 22 nt, Homo sapiens
cgugaagggauuuuagucacac

SEQ ID NO: 836291 - RNA, 20 nt, Homo sapiens
cguugauguuggcugggaac

SEQ ID NO: 836292 - RNA, 19 nt, Homo sapiens
cguuuguuccccaagacau

SEQ ID NO: 836293 - RNA, 14 nt, Homo sapiens
cuaaaauguucuaa

SEQ ID NO: 836294 - RNA, 18 nt, Homo sapiens
cuaaacuuucacacccca

SEQ ID NO: 836295 - RNA, 22 nt, Homo sapiens
cuaaaugugaaugaugauccua

SEQ ID NO: 836296 - RNA, 14 nt, Homo sapiens
cuaagaagggaaaa

SEQ ID NO: 836297 - RNA, 16 nt, Homo sapiens
cuaagucucugugaau

SEQ ID NO: 836298 - RNA, 11 nt, Homo sapiens
cuaauugugga

SEQ ID NO: 836299 - RNA, 19 nt, Homo sapiens
cuacaaaauauagcuuuca

SEQ ID NO: 836300 - RNA, 15 nt, Homo sapiens
cuacacugacacugg

SEQ ID NO: 836301 - RNA, 20 nt, Homo sapiens
cuaccaacgaaagacgugau

SEQ ID NO: 836302 - RNA, 21 nt, Homo sapiens
cuaccacaugccaagcacugu

SEQ ID NO: 836303 - RNA, 23 nt, Homo sapiens
cuacugugucuuggaaucuagcc

SEQ ID NO: 836304 - RNA, 20 nt, Homo sapiens
cuagcacuuugggaggccaa

SEQ ID NO: 836305 - RNA, 21 nt, Homo sapiens
cuaggggcuggggccaaauaa

SEQ ID NO: 836306 - RNA, 15 nt, Homo sapiens
cuauuauauucauuc

SEQ ID NO: 836307 - RNA, 18 nt, Homo sapiens
cucaaaccaaaucacuga

SEQ ID NO: 836308 - RNA, 16 nt, Homo sapiens
cucaaccaccuuucag

SEQ ID NO: 836309 - RNA, 13 nt, Homo sapiens
cucacagcauuug

SEQ ID NO: 836310 - RNA, 18 nt, Homo sapiens
cucaccuacccaugaccu

SEQ ID NO: 836311 - RNA, 15 nt, Homo sapiens
cucacgucucccuaa

SEQ ID NO: 836312 - RNA, 15 nt, Homo sapiens
cucaguguccucauc

SEQ ID NO: 836313 - RNA, 20 nt, Homo sapiens
cucaguguccucaucuguaa

SEQ ID NO: 836314 - RNA, 17 nt, Homo sapiens
cucaucagaaacucaaa

SEQ ID NO: 836315 - RNA, 22 nt, Homo sapiens
cucaucuuagguuggcaaaaag

SEQ ID NO: 836316 - RNA, 20 nt, Homo sapiens
cucaugcugugugacucaaa

SEQ ID NO: 836317 - RNA, 21 nt, Homo sapiens
cucauuucacuuuacacgcuc

SEQ ID NO: 836318 - RNA, 19 nt, Homo sapiens
cucauuuuagaaccaccaa

SEQ ID NO: 836319 - RNA, 20 nt, Homo sapiens
cuccacaaaugggaaaacca

SEQ ID NO: 836320 - RNA, 23 nt, Homo sapiens
cuccaucaguuagagcugacaca

SEQ ID NO: 836321 - RNA, 21 nt, Homo sapiens
cucccaagggauggugcccug

SEQ ID NO: 836322 - RNA, 23 nt, Homo sapiens
cuccccugccugcccuggugaca

SEQ ID NO: 836323 - RNA, 23 nt, Homo sapiens
cucccuauuuuuuuucuguuaua

SEQ ID NO: 836324 - RNA, 21 nt, Homo sapiens
cuccuagggccacugaagaua

SEQ ID NO: 836325 - RNA, 16 nt, Homo sapiens
cuccuggcccacugca

SEQ ID NO: 836326 - RNA, 20 nt, Homo sapiens
cuccuugagagaccaggcaa

SEQ ID NO: 836327 - RNA, 16 nt, Homo sapiens
cucgaggcggaucuuu

SEQ ID NO: 836328 - RNA, 22 nt, Homo sapiens
cucgaggcggaucuuuggacag

SEQ ID NO: 836329 - RNA, 12 nt, Homo sapiens
cucuacaaaaag

SEQ ID NO: 836330 - RNA, 18 nt, Homo sapiens
gaguacuacaguccuccc

SEQ ID NO: 836331 - RNA, 11 nt, Homo sapiens
gaguccucuau

SEQ ID NO: 836332 - RNA, 19 nt, Homo sapiens
gagugggcccaaugcacuu

SEQ ID NO: 836333 - RNA, 21 nt, Homo sapiens
gaguugauucagcucugcaag

SEQ ID NO: 836334 - RNA, 22 nt, Homo sapiens
gauaagaccaccaccucagagu

SEQ ID NO: 836335 - RNA, 21 nt, Homo sapiens
gauaagagggcacacacugug

SEQ ID NO: 836336 - RNA, 18 nt, Homo sapiens
gauaauauuguggugcca

SEQ ID NO: 836337 - RNA, 22 nt, Homo sapiens
gauacaaauugcagacugugua

SEQ ID NO: 836338 - RNA, 23 nt, Homo sapiens
gaucacagccucugaaaaccaau

SEQ ID NO: 836339 - RNA, 20 nt, Homo sapiens
gaucacauguggacuuuuau

SEQ ID NO: 836340 - RNA, 13 nt, Homo sapiens
gaucauugugaag

SEQ ID NO: 836341 - RNA, 15 nt, Homo sapiens
gaucccucucuggau

SEQ ID NO: 836342 - RNA, 22 nt, Homo sapiens
gaucuauauuuuuguacugaau

SEQ ID NO: 836343 - RNA, 16 nt, Homo sapiens
gaucucacaagcacuu

SEQ ID NO: 836344 - RNA, 14 nt, Homo sapiens
gaucuuuggacaga

SEQ ID NO: 836345 - RNA, 21 nt, Homo sapiens
gaugaucuaggaagacuuugg

SEQ ID NO: 836346 - RNA, 17 nt, Homo sapiens
gauggugcccuguucuc

SEQ ID NO: 836347 - RNA, 14 nt, Homo sapiens
gauucaugucucac

SEQ ID NO: 836348 - RNA, 22 nt, Homo sapiens
gauugaguuuucuucugugauu

SEQ ID NO: 836349 - RNA, 14 nt, Homo sapiens
gcaaaaauagcucu

SEQ ID NO: 836350 - RNA, 16 nt, Homo sapiens
gcaaaauagcuuggac

SEQ ID NO: 836351 - RNA, 22 nt, Homo sapiens
gcaaaauguuucaaguacugua

SEQ ID NO: 836352 - RNA, 23 nt, Homo sapiens
gcaaaggcugggaccacgugaga

SEQ ID NO: 836353 - RNA, 14 nt, Homo sapiens
gcaaaucaucugca

SEQ ID NO: 836354 - RNA, 16 nt, Homo sapiens
gcaaauggccaaugag

SEQ ID NO: 836355 - RNA, 17 nt, Homo sapiens
gcaaauggccaaugaga

SEQ ID NO: 836356 - RNA, 20 nt, Homo sapiens
gcaacaugccagccacugug

SEQ ID NO: 836357 - RNA, 18 nt, Homo sapiens
gcaagcggggaugucccu

SEQ ID NO: 836358 - RNA, 13 nt, Homo sapiens
gcacaauaguaac

SEQ ID NO: 836359 - RNA, 17 nt, Homo sapiens
gcacaauaguaaccugg

SEQ ID NO: 836360 - RNA, 19 nt, Homo sapiens
gcacacacuguguacagua

SEQ ID NO: 836361 - RNA, 18 nt, Homo sapiens
gcacagacccugcccugu

SEQ ID NO: 836362 - RNA, 17 nt, Homo sapiens
gcacagggucucuacca

SEQ ID NO: 836363 - RNA, 15 nt, Homo sapiens
gcaccaauaaagccu

SEQ ID NO: 836364 - RNA, 20 nt, Homo sapiens
gcaccacugcacuccagccu

SEQ ID NO: 836365 - RNA, 19 nt, Homo sapiens
gcaccugcagccaagcaaa

SEQ ID NO: 836366 - RNA, 13 nt, Homo sapiens
gcacugugcucag

SEQ ID NO: 836367 - RNA, 17 nt, Homo sapiens
gcacuuuaacacagugu

SEQ ID NO: 836368 - RNA, 22 nt, Homo sapiens
gcagagcagagaccaucccuga

SEQ ID NO: 836369 - RNA, 12 nt, Homo sapiens
gcagccaaggga

SEQ ID NO: 836370 - RNA, 15 nt, Homo sapiens
gcagccaagggauga

SEQ ID NO: 836371 - RNA, 18 nt, Homo sapiens
gcaggacuaaaugucuag

SEQ ID NO: 836372 - RNA, 15 nt, Homo sapiens
gcaggcgugaccuga

SEQ ID NO: 836373 - RNA, 12 nt, Homo sapiens
gcauaacuuauu

SEQ ID NO: 836374 - RNA, 17 nt, Homo sapiens
gcaucagcaacaaccag

SEQ ID NO: 836375 - RNA, 16 nt, Homo sapiens
gcauguuuuccagcuc

SEQ ID NO: 836376 - RNA, 13 nt, Homo sapiens
gcauucaaauggg

SEQ ID NO: 836377 - RNA, 15 nt, Homo sapiens
gcauucaaaugggcu

SEQ ID NO: 836378 - RNA, 16 nt, Homo sapiens
gcauuuggccucuugu

SEQ ID NO: 836379 - RNA, 16 nt, Homo sapiens
gccaagaucacagugg

SEQ ID NO: 836380 - RNA, 19 nt, Homo sapiens
gccaccaacauacucccau

SEQ ID NO: 836381 - RNA, 15 nt, Homo sapiens
cgcaucucagugcag

SEQ ID NO: 836382 - RNA, 20 nt, Homo sapiens
cggacuuagaaaaccagcuc

SEQ ID NO: 836383 - RNA, 15 nt, Homo sapiens
cggagaacaaaugug

SEQ ID NO: 836384 - RNA, 15 nt, Homo sapiens
cgguggucacuggaa

SEQ ID NO: 836385 - RNA, 16 nt, Homo sapiens
cgguguuuaagacauu

SEQ ID NO: 836386 - RNA, 16 nt, Homo sapiens
cgugugggcaauguuc

SEQ ID NO: 836387 - RNA, 22 nt, Homo sapiens
cguuuguccuuuuucacuuuga

SEQ ID NO: 836388 - RNA, 21 nt, Homo sapiens
cuaaccucugagucaccaucu

SEQ ID NO: 836389 - RNA, 23 nt, Homo sapiens
cuaacuuuccuucauucaaccca

SEQ ID NO: 836390 - RNA, 19 nt, Homo sapiens
cuaagccuuugagacuguu

SEQ ID NO: 836391 - RNA, 20 nt, Homo sapiens
cuaagcugccgguucuuaaa

SEQ ID NO: 836392 - RNA, 23 nt, Homo sapiens
cuaaguaaucucacagcauuugc

SEQ ID NO: 836393 - RNA, 19 nt, Homo sapiens
cuaauuaauaaauuauuua

SEQ ID NO: 836394 - RNA, 16 nt, Homo sapiens
cuacaaagcugaagaa

SEQ ID NO: 836395 - RNA, 14 nt, Homo sapiens
cuacccaugaccug

SEQ ID NO: 836396 - RNA, 20 nt, Homo sapiens
cuacucuagggaaaaaccag

SEQ ID NO: 836397 - RNA, 14 nt, Homo sapiens
cuacuugggagcac

SEQ ID NO: 836398 - RNA, 14 nt, Homo sapiens
cuagacaguuaaac

SEQ ID NO: 836399 - RNA, 17 nt, Homo sapiens
cuagggaaggguggugg

SEQ ID NO: 836400 - RNA, 23 nt, Homo sapiens
cuagguuugcaagaaaaauauga

SEQ ID NO: 836401 - RNA, 14 nt, Homo sapiens
cuagucuauucauu

SEQ ID NO: 836402 - RNA, 15 nt, Homo sapiens
cuagucuauucauua

SEQ ID NO: 836403 - RNA, 18 nt, Homo sapiens
cuaguggccgaaccagaa

SEQ ID NO: 836404 - RNA, 13 nt, Homo sapiens
cuauauugguuua

SEQ ID NO: 836405 - RNA, 12 nt, Homo sapiens
cuauucaucuca

SEQ ID NO: 836406 - RNA, 22 nt, Homo sapiens
cuauuuauuuauuuauucauua

SEQ ID NO: 836407 - RNA, 17 nt, Homo sapiens
cuauuugaacaugugcc

SEQ ID NO: 836408 - RNA, 15 nt, Homo sapiens
cucaaaaauagggaa

SEQ ID NO: 836409 - RNA, 21 nt, Homo sapiens
cucaauguuuagcagauuuaa

SEQ ID NO: 836410 - RNA, 20 nt, Homo sapiens
cucaauuuuuuucaccucuu

SEQ ID NO: 836411 - RNA, 12 nt, Homo sapiens
cucacgccugua

SEQ ID NO: 836412 - RNA, 17 nt, Homo sapiens
cucagaacauacugauu

SEQ ID NO: 836413 - RNA, 19 nt, Homo sapiens
cucagagagggcaggcaug

SEQ ID NO: 836414 - RNA, 23 nt, Homo sapiens
cucagccuugcaaauagccagug

SEQ ID NO: 836415 - RNA, 13 nt, Homo sapiens
cucagcuuugaua

SEQ ID NO: 836416 - RNA, 12 nt, Homo sapiens
cucaggaccagg

SEQ ID NO: 836417 - RNA, 18 nt, Homo sapiens
cucaggaguuugagacca

SEQ ID NO: 836418 - RNA, 21 nt, Homo sapiens
cucaggccaucaucaguggag

SEQ ID NO: 836419 - RNA, 13 nt, Homo sapiens
cucauacacagaa

SEQ ID NO: 836420 - RNA, 19 nt, Homo sapiens
cucaugagaaguugauaua

SEQ ID NO: 836421 - RNA, 13 nt, Homo sapiens
cuccaaacccucg

SEQ ID NO: 836422 - RNA, 22 nt, Homo sapiens
cuccaaaugcugacccaugcaa

SEQ ID NO: 836423 - RNA, 16 nt, Homo sapiens
cuccaauuaaggauuu

SEQ ID NO: 836424 - RNA, 14 nt, Homo sapiens
cuccagauucugau

SEQ ID NO: 836425 - RNA, 14 nt, Homo sapiens
cucccacaaaggag

SEQ ID NO: 836426 - RNA, 12 nt, Homo sapiens
cucccacagaac

SEQ ID NO: 836427 - RNA, 14 nt, Homo sapiens
cuccccacagugcc

SEQ ID NO: 836428 - RNA, 19 nt, Homo sapiens
cucccugguucugaugaug

SEQ ID NO: 836429 - RNA, 20 nt, Homo sapiens
cuccuccccaaggagacaca

SEQ ID NO: 836430 - RNA, 15 nt, Homo sapiens
cuccuccguggcaca

SEQ ID NO: 836431 - RNA, 23 nt, Homo sapiens
cuccugaaaaaaaaccugagauu

SEQ ID NO: 836432 - RNA, 14 nt, Homo sapiens
cuccuggacuccug

SEQ ID NO: 836433 - RNA, 23 nt, Homo sapiens
acccaaccacagaggaugcugac

SEQ ID NO: 836434 - RNA, 14 nt, Homo sapiens
acccaaguccaggc

SEQ ID NO: 836435 - RNA, 15 nt, Homo sapiens
acccagagguggaug

SEQ ID NO: 836436 - RNA, 22 nt, Homo sapiens
acccagaugggggaaagcacag

SEQ ID NO: 836437 - RNA, 17 nt, Homo sapiens
acccaguuagcucucaa

SEQ ID NO: 836438 - RNA, 22 nt, Homo sapiens
accccagugcuuguuccucuca

SEQ ID NO: 836439 - RNA, 20 nt, Homo sapiens
accccggaagccaaaccucu

SEQ ID NO: 836440 - RNA, 16 nt, Homo sapiens
accccucaacaccucu

SEQ ID NO: 836441 - RNA, 12 nt, Homo sapiens
acccucaugcug

SEQ ID NO: 836442 - RNA, 21 nt, Homo sapiens
acccuggagcccauccagucu

SEQ ID NO: 836443 - RNA, 23 nt, Homo sapiens
acccuggagcccauccagucucc

SEQ ID NO: 836444 - RNA, 14 nt, Homo sapiens
acccuggcauuugg

SEQ ID NO: 836445 - RNA, 20 nt, Homo sapiens
acccuuuggccccacuuuga

SEQ ID NO: 836446 - RNA, 18 nt, Homo sapiens
accuaagucucugugaau

SEQ ID NO: 836447 - RNA, 23 nt, Homo sapiens
accuaagucucugugaauugaaa

SEQ ID NO: 836448 - RNA, 21 nt, Homo sapiens
accuaccacaugccaagcacu

SEQ ID NO: 836449 - RNA, 15 nt, Homo sapiens
accuacccaugaccu

SEQ ID NO: 836450 - RNA, 16 nt, Homo sapiens
accuacccaugaccug

SEQ ID NO: 836451 - RNA, 20 nt, Homo sapiens
accuagaauuggcugaacuc

SEQ ID NO: 836452 - RNA, 21 nt, Homo sapiens
accucagaguauggagcucag

SEQ ID NO: 836453 - RNA, 22 nt, Homo sapiens
accucagaguauggagcucaga

SEQ ID NO: 836454 - RNA, 13 nt, Homo sapiens
accucucucacuc

SEQ ID NO: 836455 - RNA, 15 nt, Homo sapiens
accucugcacaagcu

SEQ ID NO: 836456 - RNA, 13 nt, Homo sapiens
accugaugcaguc

SEQ ID NO: 836457 - RNA, 18 nt, Homo sapiens
accuggccucugcacucc

SEQ ID NO: 836458 - RNA, 18 nt, Homo sapiens
accuggguaaaugcagcg

SEQ ID NO: 836459 - RNA, 21 nt, Homo sapiens
accuuucagauaacuguuauu

SEQ ID NO: 836460 - RNA, 22 nt, Homo sapiens
acgcaggccccucuccuccgug

SEQ ID NO: 836461 - RNA, 12 nt, Homo sapiens
acggccacaguc

SEQ ID NO: 836462 - RNA, 15 nt, Homo sapiens
acgggggcagcugau

SEQ ID NO: 836463 - RNA, 23 nt, Homo sapiens
acgguaaguguucucaugaagca

SEQ ID NO: 836464 - RNA, 19 nt, Homo sapiens
acgugggcaaacaggcagu

SEQ ID NO: 836465 - RNA, 17 nt, Homo sapiens
acuaaacauguauguaa

SEQ ID NO: 836466 - RNA, 23 nt, Homo sapiens
acuauggacggugcuccaggcag

SEQ ID NO: 836467 - RNA, 14 nt, Homo sapiens
acucaaucauuucu

SEQ ID NO: 836468 - RNA, 22 nt, Homo sapiens
acucagccuggcugauuaucac

SEQ ID NO: 836469 - RNA, 19 nt, Homo sapiens
acucaucccuaaugcugca

SEQ ID NO: 836470 - RNA, 12 nt, Homo sapiens
acucauugcaac

SEQ ID NO: 836471 - RNA, 16 nt, Homo sapiens
acuccuaggcaggaca

SEQ ID NO: 836472 - RNA, 14 nt, Homo sapiens
acugagacauuaca

SEQ ID NO: 836473 - RNA, 17 nt, Homo sapiens
acugaguuuauacucac

SEQ ID NO: 836474 - RNA, 15 nt, Homo sapiens
acugauucucucuug

SEQ ID NO: 836475 - RNA, 20 nt, Homo sapiens
acugcacuccagccugggug

SEQ ID NO: 836476 - RNA, 13 nt, Homo sapiens
acugcagcuuugu

SEQ ID NO: 836477 - RNA, 22 nt, Homo sapiens
acugcaucguuucaucuuccaa

SEQ ID NO: 836478 - RNA, 14 nt, Homo sapiens
acugccugcuccca

SEQ ID NO: 836479 - RNA, 19 nt, Homo sapiens
acuguaaacauucaucaag

SEQ ID NO: 836480 - RNA, 17 nt, Homo sapiens
acuguacugagacauua

SEQ ID NO: 836481 - RNA, 22 nt, Homo sapiens
acugugaagagaaccauaucaa

SEQ ID NO: 836482 - RNA, 18 nt, Homo sapiens
acuguuauuuauaaucac

SEQ ID NO: 836483 - RNA, 20 nt, Homo sapiens
acuguuccugagccuucagc

SEQ ID NO: 836484 - RNA, 19 nt, Homo sapiens
acuuaauagaaacauugaa

SEQ ID NO: 836485 - RNA, 14 nt, Homo sapiens
acuuaucaucacac

SEQ ID NO: 836486 - RNA, 20 nt, Homo sapiens
acuuggcuacacagggaugu

SEQ ID NO: 836487 - RNA, 15 nt, Homo sapiens
acuugggacauugcc

SEQ ID NO: 836488 - RNA, 20 nt, Homo sapiens
acuugggccacugugaagag

SEQ ID NO: 836489 - RNA, 19 nt, Homo sapiens
acuugggcgggacacaggc

SEQ ID NO: 836490 - RNA, 18 nt, Homo sapiens
acuugugccaacacucaa

SEQ ID NO: 836491 - RNA, 19 nt, Homo sapiens
acuuuaacacagugucugg

SEQ ID NO: 836492 - RNA, 21 nt, Homo sapiens
acuuuacacgcucauggacug

SEQ ID NO: 836493 - RNA, 19 nt, Homo sapiens
acuuuacuaaguaaucuca

SEQ ID NO: 836494 - RNA, 15 nt, Homo sapiens
acuuuaucauaugcu

SEQ ID NO: 836495 - RNA, 18 nt, Homo sapiens
acuuugauaggaugugga

SEQ ID NO: 836496 - RNA, 14 nt, Homo sapiens
acuuuuauuuccag

SEQ ID NO: 836497 - RNA, 11 nt, Homo sapiens
agaaaaaccac

SEQ ID NO: 836498 - RNA, 15 nt, Homo sapiens
agaaaaagaucuuuc

SEQ ID NO: 836499 - RNA, 17 nt, Homo sapiens
agaaaauaaaagcacuu

SEQ ID NO: 836500 - RNA, 15 nt, Homo sapiens
agaaagcaggugcaa

SEQ ID NO: 836501 - RNA, 19 nt, Homo sapiens
agaaaucuuucucccucaa

SEQ ID NO: 836502 - RNA, 22 nt, Homo sapiens
agaaauuaaguaucugacaucu

SEQ ID NO: 836503 - RNA, 13 nt, Homo sapiens
agaagcagcucuu

SEQ ID NO: 836504 - RNA, 17 nt, Homo sapiens
agaauauuagugaccuc

SEQ ID NO: 836505 - RNA, 21 nt, Homo sapiens
agaaucuguuucccagcagug

SEQ ID NO: 836506 - RNA, 19 nt, Homo sapiens
agaauggaaugcucugguc

SEQ ID NO: 836507 - RNA, 21 nt, Homo sapiens
agaauuauaauuaguuccuca

SEQ ID NO: 836508 - RNA, 16 nt, Homo sapiens
agacaagugacuguau

SEQ ID NO: 836509 - RNA, 21 nt, Homo sapiens
agacaagugacuguaucugug

SEQ ID NO: 836510 - RNA, 14 nt, Homo sapiens
agacaggacugcag

SEQ ID NO: 836511 - RNA, 21 nt, Homo sapiens
agacaugagugcgugcucagu

SEQ ID NO: 836512 - RNA, 21 nt, Homo sapiens
agaccaucuacauacacagug

SEQ ID NO: 836513 - RNA, 16 nt, Homo sapiens
agaccucugugcacuu

SEQ ID NO: 836514 - RNA, 23 nt, Homo sapiens
agacucuuuuuuugagugacagc

SEQ ID NO: 836515 - RNA, 14 nt, Homo sapiens
agacuuuacaugga

SEQ ID NO: 836516 - RNA, 20 nt, Homo sapiens
agagacgggguuugccaugc

SEQ ID NO: 836517 - RNA, 20 nt, Homo sapiens
agagacuugggacauugccu

SEQ ID NO: 836518 - RNA, 18 nt, Homo sapiens
agagagguuugcaguccc

SEQ ID NO: 836519 - RNA, 19 nt, Homo sapiens
agagagguuugcaguccca

SEQ ID NO: 836520 - RNA, 16 nt, Homo sapiens
agagagucgcaucuca

SEQ ID NO: 836521 - RNA, 23 nt, Homo sapiens
agagagucgcaucucagugcagg

SEQ ID NO: 836522 - RNA, 14 nt, Homo sapiens
agagagucuuccag

SEQ ID NO: 836523 - RNA, 19 nt, Homo sapiens
agagcaggcguucagcuca

SEQ ID NO: 836524 - RNA, 17 nt, Homo sapiens
agagccuggugcugcug

SEQ ID NO: 836525 - RNA, 16 nt, Homo sapiens
agagcugacacaggau

SEQ ID NO: 836526 - RNA, 17 nt, Homo sapiens
agagcuggagccuggug

SEQ ID NO: 836527 - RNA, 17 nt, Homo sapiens
agaggcccggccucuca

SEQ ID NO: 836528 - RNA, 18 nt, Homo sapiens
agagggcacacacugugu

SEQ ID NO: 836529 - RNA, 20 nt, Homo sapiens
agaguauuggucuccucuca

SEQ ID NO: 836530 - RNA, 13 nt, Homo sapiens
agauaaagaccuu

SEQ ID NO: 836531 - RNA, 23 nt, Homo sapiens
agauaacuguuauuuauaaucac

SEQ ID NO: 836532 - RNA, 22 nt, Homo sapiens
agaucacaguggccacggccac

SEQ ID NO: 836533 - RNA, 21 nt, Homo sapiens
agaucagccugggcaauguga

SEQ ID NO: 836534 - RNA, 18 nt, Homo sapiens
agaucuuucauuuugcac

SEQ ID NO: 836535 - RNA, 12 nt, Homo sapiens
agauggggacag

SEQ ID NO: 836536 - RNA, 16 nt, Homo sapiens
agauggggacagguga

SEQ ID NO: 836537 - RNA, 19 nt, Homo sapiens
agauuccuggcagagccau

SEQ ID NO: 836538 - RNA, 15 nt, Homo sapiens
agcaaaggcugagaa

SEQ ID NO: 836539 - RNA, 22 nt, Homo sapiens
agcacaugauuugggcucuaga

SEQ ID NO: 836540 - RNA, 16 nt, Homo sapiens
agcaccauaacuuugu

SEQ ID NO: 836541 - RNA, 15 nt, Homo sapiens
agcagccaagggaug

SEQ ID NO: 836542 - RNA, 18 nt, Homo sapiens
agcaggaaccccaggaga

SEQ ID NO: 836543 - RNA, 15 nt, Homo sapiens
agcaggacauggaca

SEQ ID NO: 836544 - RNA, 16 nt, Homo sapiens
agcaggcuacacugac

SEQ ID NO: 836545 - RNA, 15 nt, Homo sapiens
agcaucacaguuuug

SEQ ID NO: 836546 - RNA, 21 nt, Homo sapiens
agcauuagcuuuaauuaagcu

SEQ ID NO: 836547 - RNA, 16 nt, Homo sapiens
agcauuguagugcuuu

SEQ ID NO: 836548 - RNA, 20 nt, Homo sapiens
agcauuuugcuaaaugugaa

SEQ ID NO: 836549 - RNA, 12 nt, Homo sapiens
agccaaagccaa

SEQ ID NO: 836550 - RNA, 18 nt, Homo sapiens
agccaauaacacacagcu

SEQ ID NO: 836551 - RNA, 20 nt, Homo sapiens
agccauggucccaggcuucc

SEQ ID NO: 836552 - RNA, 14 nt, Homo sapiens
agccccauccucug

SEQ ID NO: 836553 - RNA, 17 nt, Homo sapiens
agccccgggaguggcgc

SEQ ID NO: 836554 - RNA, 13 nt, Homo sapiens
caaucuucucaga

SEQ ID NO: 836555 - RNA, 16 nt, Homo sapiens
caaugaagucucugaa

SEQ ID NO: 836556 - RNA, 14 nt, Homo sapiens
caaugauaaugcua

SEQ ID NO: 836557 - RNA, 19 nt, Homo sapiens
caauguuuagcagauuuaa

SEQ ID NO: 836558 - RNA, 16 nt, Homo sapiens
caauuauuugaagauu

SEQ ID NO: 836559 - RNA, 14 nt, Homo sapiens
cacaaauggcuaca

SEQ ID NO: 836560 - RNA, 13 nt, Homo sapiens
cacaagaccaucu

SEQ ID NO: 836561 - RNA, 17 nt, Homo sapiens
cacaagaccaucuacau

SEQ ID NO: 836562 - RNA, 12 nt, Homo sapiens
cacaagcacuuu

SEQ ID NO: 836563 - RNA, 20 nt, Homo sapiens
cacaauaugggcacuuuaaa

SEQ ID NO: 836564 - RNA, 14 nt, Homo sapiens
cacaauuugcagua

SEQ ID NO: 836565 - RNA, 17 nt, Homo sapiens
cacaccccagacgaugu

SEQ ID NO: 836566 - RNA, 13 nt, Homo sapiens
cacacucaaggga

SEQ ID NO: 836567 - RNA, 17 nt, Homo sapiens
cacacugagcugagggg

SEQ ID NO: 836568 - RNA, 20 nt, Homo sapiens
cacagaacacagcaauuccu

SEQ ID NO: 836569 - RNA, 22 nt, Homo sapiens
cacagauuccuggcagagccau

SEQ ID NO: 836570 - RNA, 18 nt, Homo sapiens
cacaggcaaaacucagua

SEQ ID NO: 836571 - RNA, 18 nt, Homo sapiens
cacaggcuccaaacugga

SEQ ID NO: 836572 - RNA, 16 nt, Homo sapiens
cacagggauguacaag

SEQ ID NO: 836573 - RNA, 18 nt, Homo sapiens
cacaguggccaagaucac

SEQ ID NO: 836574 - RNA, 12 nt, Homo sapiens
cacagugucugg

SEQ ID NO: 836575 - RNA, 21 nt, Homo sapiens
cacaguguugccagagccuua

SEQ ID NO: 836576 - RNA, 18 nt, Homo sapiens
cacaugccaagcacugug

SEQ ID NO: 836577 - RNA, 16 nt, Homo sapiens
caccaaacccggccug

SEQ ID NO: 836578 - RNA, 14 nt, Homo sapiens
caccacgcccagcu

SEQ ID NO: 836579 - RNA, 20 nt, Homo sapiens
caccacgguggucacuggaa

SEQ ID NO: 836580 - RNA, 15 nt, Homo sapiens
cacccugaaagcccu

SEQ ID NO: 836581 - RNA, 19 nt, Homo sapiens
caccucugcacaagcugca

SEQ ID NO: 836582 - RNA, 16 nt, Homo sapiens
caccuugucugcuaaa

SEQ ID NO: 836583 - RNA, 19 nt, Homo sapiens
cacgacugcccggcagggu

SEQ ID NO: 836584 - RNA, 20 nt, Homo sapiens
cacgagagagggcuuucuca

SEQ ID NO: 836585 - RNA, 17 nt, Homo sapiens
cacgguggucacuggaa

SEQ ID NO: 836586 - RNA, 21 nt, Homo sapiens
cacucacacggacacucaaaa

SEQ ID NO: 836587 - RNA, 15 nt, Homo sapiens
cacucaggugcugaa

SEQ ID NO: 836588 - RNA, 16 nt, Homo sapiens
cacucauacaucuggc

SEQ ID NO: 836589 - RNA, 19 nt, Homo sapiens
cacugcaggcaucacagcu

SEQ ID NO: 836590 - RNA, 23 nt, Homo sapiens
cacugccaugcagggccucacac

SEQ ID NO: 836591 - RNA, 14 nt, Homo sapiens
cacuguuugucuca

SEQ ID NO: 836592 - RNA, 12 nt, Homo sapiens
cacuuacaauuu

SEQ ID NO: 836593 - RNA, 19 nt, Homo sapiens
cacuucugagaacucaucc

SEQ ID NO: 836594 - RNA, 19 nt, Homo sapiens
cacuuuaacacagugucug

SEQ ID NO: 836595 - RNA, 19 nt, Homo sapiens
cagaaacaguucaccuuga

SEQ ID NO: 836596 - RNA, 24 nt, Homo sapiens
cagaaggaaccagcguguauauga

SEQ ID NO: 836597 - RNA, 20 nt, Homo sapiens
cagaauauuagugaccucag

SEQ ID NO: 836598 - RNA, 21 nt, Homo sapiens
cagagacgggguuugccaugc

SEQ ID NO: 836599 - RNA, 16 nt, Homo sapiens
cagagauaaagaccuu

SEQ ID NO: 836600 - RNA, 23 nt, Homo sapiens
cagagccauggucccaggcuucc

SEQ ID NO: 836601 - RNA, 21 nt, Homo sapiens
cagaggcugggugacaugugu

SEQ ID NO: 836602 - RNA, 17 nt, Homo sapiens
cagaguccucuaugaac

SEQ ID NO: 836603 - RNA, 22 nt, Homo sapiens
cagauauauagaaggacugcag

SEQ ID NO: 836604 - RNA, 15 nt, Homo sapiens
cagauucacacuguc

SEQ ID NO: 836605 - RNA, 14 nt, Homo sapiens
cagcaguggacuca

SEQ ID NO: 836606 - RNA, 17 nt, Homo sapiens
cagcccaagaugcuuua

SEQ ID NO: 836607 - RNA, 17 nt, Homo sapiens
cagccccuccuccauag

SEQ ID NO: 836608 - RNA, 15 nt, Homo sapiens
cagccugcuccagcu

SEQ ID NO: 836609 - RNA, 18 nt, Homo sapiens
cagccugggcaaugugau

SEQ ID NO: 836610 - RNA, 17 nt, Homo sapiens
cagcuaacuuaucauca

SEQ ID NO: 836611 - RNA, 19 nt, Homo sapiens
cagcuccacaguguugcca

SEQ ID NO: 836612 - RNA, 17 nt, Homo sapiens
cagcuccccagaguccu

SEQ ID NO: 836613 - RNA, 24 nt, Homo sapiens
cagcugacuuuucuguccgagcuu

SEQ ID NO: 836614 - RNA, 23 nt, Homo sapiens
cagcuggcgucaugcaaagucau

SEQ ID NO: 836615 - RNA, 19 nt, Homo sapiens
cagcugggaucacaugugg

SEQ ID NO: 836616 - RNA, 16 nt, Homo sapiens
cagcuuucugggaugu

SEQ ID NO: 836617 - RNA, 20 nt, Homo sapiens
cagcuuuucccaaaagccca

SEQ ID NO: 836618 - RNA, 17 nt, Homo sapiens
caggaaaggcuccagga

SEQ ID NO: 836619 - RNA, 17 nt, Homo sapiens
caggagaccuggcacug

SEQ ID NO: 836620 - RNA, 22 nt, Homo sapiens
caggagaccuggcacuggaugc

SEQ ID NO: 836621 - RNA, 20 nt, Homo sapiens
caggaguguggccacguggg

SEQ ID NO: 836622 - RNA, 18 nt, Homo sapiens
caggauagagugggacag

SEQ ID NO: 836623 - RNA, 22 nt, Homo sapiens
caggauagagugggacaguucc

SEQ ID NO: 836624 - RNA, 17 nt, Homo sapiens
caggcaaagcaagugau

SEQ ID NO: 836625 - RNA, 14 nt, Homo sapiens
caggccagcuccac

SEQ ID NO: 836626 - RNA, 21 nt, Homo sapiens
cagggaaugccugagugccug

SEQ ID NO: 836627 - RNA, 19 nt, Homo sapiens
caggugugccgacagaagg

SEQ ID NO: 836628 - RNA, 15 nt, Homo sapiens
cagguuggugggggc

SEQ ID NO: 836629 - RNA, 21 nt, Homo sapiens
caguaaauggcuuauccagcu

SEQ ID NO: 836630 - RNA, 17 nt, Homo sapiens
caguaugaaaaugucau

SEQ ID NO: 836631 - RNA, 16 nt, Homo sapiens
caguggcgcaaucuua

SEQ ID NO: 836632 - RNA, 18 nt, Homo sapiens
caguggcugcugcccagg

SEQ ID NO: 836633 - RNA, 17 nt, Homo sapiens
caguguccucaucugua

SEQ ID NO: 836634 - RNA, 12 nt, Homo sapiens
caguuaagccuu

SEQ ID NO: 836635 - RNA, 16 nt, Homo sapiens
caguucagaaucacuu

SEQ ID NO: 836636 - RNA, 20 nt, Homo sapiens
caguucagaaucacuucuga

SEQ ID NO: 836637 - RNA, 14 nt, Homo sapiens
caguuccauuucau

SEQ ID NO: 836638 - RNA, 20 nt, Homo sapiens
caguuuaaccugaugcaguc

SEQ ID NO: 836639 - RNA, 18 nt, Homo sapiens
cauaaaaaggaauccacu

SEQ ID NO: 836640 - RNA, 17 nt, Homo sapiens
cauaaaguaugugcaua

SEQ ID NO: 836641 - RNA, 19 nt, Homo sapiens
cauaaccccggaagccaaa

SEQ ID NO: 836642 - RNA, 19 nt, Homo sapiens
cauaaggcauauacaaaua

SEQ ID NO: 836643 - RNA, 22 nt, Homo sapiens
cauaauucaggaagcagcuuuc

SEQ ID NO: 836644 - RNA, 22 nt, Homo sapiens
cauaauuuuuauuuuuggcaaa

SEQ ID NO: 836645 - RNA, 22 nt, Homo sapiens
cauagagagcaagacgcugugc

SEQ ID NO: 836646 - RNA, 17 nt, Homo sapiens
cauauuaacaaauugca

SEQ ID NO: 836647 - RNA, 18 nt, Homo sapiens
cauauuaacaaauugcau

SEQ ID NO: 836648 - RNA, 18 nt, Homo sapiens
caucaaggcacugccuga

SEQ ID NO: 836649 - RNA, 22 nt, Homo sapiens
caucaaggcacugccugaugga

SEQ ID NO: 836650 - RNA, 16 nt, Homo sapiens
caucacacaacucagc

SEQ ID NO: 836651 - RNA, 17 nt, Homo sapiens
caucaccuccaccauac

SEQ ID NO: 836652 - RNA, 18 nt, Homo sapiens
caucaguauugaagcauu

SEQ ID NO: 836653 - RNA, 17 nt, Homo sapiens
caucaucaguggagcca

SEQ ID NO: 836654 - RNA, 15 nt, Homo sapiens
caucccuaaugcugc

SEQ ID NO: 836655 - RNA, 15 nt, Homo sapiens
cauccucaaacacug

SEQ ID NO: 836656 - RNA, 16 nt, Homo sapiens
cauccucaaacacugc

SEQ ID NO: 836657 - RNA, 22 nt, Homo sapiens
cauccuugucuuauucccuucc

SEQ ID NO: 836658 - RNA, 14 nt, Homo sapiens
caucucagugcagg

SEQ ID NO: 836659 - RNA, 15 nt, Homo sapiens
caucucagugcagga

SEQ ID NO: 836660 - RNA, 13 nt, Homo sapiens
caucucucaggaa

SEQ ID NO: 836661 - RNA, 11 nt, Homo sapiens
caucucugcaa

SEQ ID NO: 836662 - RNA, 17 nt, Homo sapiens
caucucuggaugccuga

SEQ ID NO: 836663 - RNA, 18 nt, Homo sapiens
caucucuggaugccugau

SEQ ID NO: 836664 - RNA, 19 nt, Homo sapiens
caucuuaagagaugccuca

SEQ ID NO: 836665 - RNA, 14 nt, Homo sapiens
caucuuccaacuca

SEQ ID NO: 836666 - RNA, 20 nt, Homo sapiens
caugagugcgugcucaguuc

SEQ ID NO: 836667 - RNA, 15 nt, Homo sapiens
caugcgagugcucau

SEQ ID NO: 836668 - RNA, 23 nt, Homo sapiens
cauggaaauucccuucaucugga

SEQ ID NO: 836669 - RNA, 19 nt, Homo sapiens
caugucucacgucucccua

SEQ ID NO: 836670 - RNA, 19 nt, Homo sapiens
caugugauuacccucuggg

SEQ ID NO: 836671 - RNA, 23 nt, Homo sapiens
cauguuaugcuuuacugcgaaua

SEQ ID NO: 836672 - RNA, 22 nt, Homo sapiens
cauguuuuccagcuccucaucc

SEQ ID NO: 836673 - RNA, 17 nt, Homo sapiens
cauguuuuucuucuccc

SEQ ID NO: 836674 - RNA, 15 nt, Homo sapiens
cauuauauuuaggga

SEQ ID NO: 836675 - RNA, 14 nt, Homo sapiens
gaggcggaucuuug

SEQ ID NO: 836676 - RNA, 20 nt, Homo sapiens
gaggcugcacccacccagga

SEQ ID NO: 836677 - RNA, 22 nt, Homo sapiens
gaggcugggcucccuucccacc

SEQ ID NO: 836678 - RNA, 17 nt, Homo sapiens
gagggggcgcgugcagg

SEQ ID NO: 836679 - RNA, 16 nt, Homo sapiens
gaguaggaagacuuug

SEQ ID NO: 836680 - RNA, 14 nt, Homo sapiens
gagugcgugcucag

SEQ ID NO: 836681 - RNA, 18 nt, Homo sapiens
gagugcuaagcauuagcu

SEQ ID NO: 836682 - RNA, 16 nt, Homo sapiens
gauauauagaaggacu

SEQ ID NO: 836683 - RNA, 16 nt, Homo sapiens
gaucccaucuugauaa

SEQ ID NO: 836684 - RNA, 14 nt, Homo sapiens
gauccuccaggugc

SEQ ID NO: 836685 - RNA, 17 nt, Homo sapiens
gaucuaggaagacuuug

SEQ ID NO: 836686 - RNA, 18 nt, Homo sapiens
gaucuaggaagacuuugg

SEQ ID NO: 836687 - RNA, 16 nt, Homo sapiens
gaucuuucauuuugca

SEQ ID NO: 836688 - RNA, 15 nt, Homo sapiens
gaucuuuggacagaa

SEQ ID NO: 836689 - RNA, 16 nt, Homo sapiens
gaucuuuggacagaag

SEQ ID NO: 836690 - RNA, 20 nt, Homo sapiens
gauggcauuuggucucaggc

SEQ ID NO: 836691 - RNA, 21 nt, Homo sapiens
gauguauguugaagccuuugu

SEQ ID NO: 836692 - RNA, 17 nt, Homo sapiens
gauucaauucaacacuc

SEQ ID NO: 836693 - RNA, 23 nt, Homo sapiens
gauucacccccaaacagugacau

SEQ ID NO: 836694 - RNA, 15 nt, Homo sapiens
gauucaugucucacg

SEQ ID NO: 836695 - RNA, 16 nt, Homo sapiens
gauuggagauagggaa

SEQ ID NO: 836696 - RNA, 14 nt, Homo sapiens
gcaaaccugccucc

SEQ ID NO: 836697 - RNA, 17 nt, Homo sapiens
gcaaagaugaucaguau

SEQ ID NO: 836698 - RNA, 19 nt, Homo sapiens
gcaaauaacaaaugccaaa

SEQ ID NO: 836699 - RNA, 14 nt, Homo sapiens
gcaacaaccagcau

SEQ ID NO: 836700 - RNA, 17 nt, Homo sapiens
gcaaggacacagaugaa

SEQ ID NO: 836701 - RNA, 23 nt, Homo sapiens
gcaaggacacagaugaaacacaa

SEQ ID NO: 836702 - RNA, 17 nt, Homo sapiens
gcaauacagacuacuuc

SEQ ID NO: 836703 - RNA, 20 nt, Homo sapiens
gcaaucuucucagaaggcaa

SEQ ID NO: 836704 - RNA, 16 nt, Homo sapiens
gcaauguauagugucu

SEQ ID NO: 836705 - RNA, 13 nt, Homo sapiens
gcacacacugugu

SEQ ID NO: 836706 - RNA, 19 nt, Homo sapiens
gcacagacccugcccugug

SEQ ID NO: 836707 - RNA, 15 nt, Homo sapiens
gcacugacugggcau

SEQ ID NO: 836708 - RNA, 17 nt, Homo sapiens
gcacuuuaaaugaagcu

SEQ ID NO: 836709 - RNA, 22 nt, Homo sapiens
gcacuuuguucuggcucuucca

SEQ ID NO: 836710 - RNA, 14 nt, Homo sapiens
gcagaccucaugcc

SEQ ID NO: 836711 - RNA, 19 nt, Homo sapiens
gcagagacgggguuugcca

SEQ ID NO: 836712 - RNA, 16 nt, Homo sapiens
gcagaugagguugcua

SEQ ID NO: 836713 - RNA, 14 nt, Homo sapiens
gcagauuuaagaua

SEQ ID NO: 836714 - RNA, 16 nt, Homo sapiens
gcagccacauuccuga

SEQ ID NO: 836715 - RNA, 20 nt, Homo sapiens
gcagccucacaguccuuacc

SEQ ID NO: 836716 - RNA, 20 nt, Homo sapiens
gcagccucuucaaaaugagc

SEQ ID NO: 836717 - RNA, 16 nt, Homo sapiens
gcaggcuacacugaca

SEQ ID NO: 836718 - RNA, 23 nt, Homo sapiens
gcagguuggugggggccucggug

SEQ ID NO: 836719 - RNA, 20 nt, Homo sapiens
gcaguggacucaaaacccau

SEQ ID NO: 836720 - RNA, 15 nt, Homo sapiens
gcauuccugaugacc

SEQ ID NO: 836721 - RNA, 22 nt, Homo sapiens
gccaaagccaauaacacacagc

SEQ ID NO: 836722 - RNA, 18 nt, Homo sapiens
gccaaccggucacccagg

SEQ ID NO: 836723 - RNA, 18 nt, Homo sapiens
gccaauaacacacagcua

SEQ ID NO: 836724 - RNA, 17 nt, Homo sapiens
gccacagccacuaauca

SEQ ID NO: 836725 - RNA, 20 nt, Homo sapiens
gccacuguuugucucaccua

SEQ ID NO: 836726 - RNA, 18 nt, Homo sapiens
gccaggcaugguggccca

SEQ ID NO: 836727 - RNA, 22 nt, Homo sapiens
gccaugugauuacccucugggu

SEQ ID NO: 836728 - RNA, 16 nt, Homo sapiens
gcccagugcauaugca

SEQ ID NO: 836729 - RNA, 19 nt, Homo sapiens
gcccagugcauaugcaaug

SEQ ID NO: 836730 - RNA, 18 nt, Homo sapiens
gcccaucuccgucuccca

SEQ ID NO: 836731 - RNA, 13 nt, Homo sapiens
gcccauggaugug

SEQ ID NO: 836732 - RNA, 13 nt, Homo sapiens
gccccaauucgau

SEQ ID NO: 836733 - RNA, 15 nt, Homo sapiens
gccccaauucgaucc

SEQ ID NO: 836734 - RNA, 17 nt, Homo sapiens
gcccccucacaguauug

SEQ ID NO: 836735 - RNA, 17 nt, Homo sapiens
gccccggggccuguuau

SEQ ID NO: 836736 - RNA, 22 nt, Homo sapiens
gccccugucgucaggaccuccu

SEQ ID NO: 836737 - RNA, 17 nt, Homo sapiens
gcccggaguggacugau

SEQ ID NO: 836738 - RNA, 19 nt, Homo sapiens
gcccucagauuccgcacca

SEQ ID NO: 836739 - RNA, 21 nt, Homo sapiens
gccguacucuuuggggcagcu

SEQ ID NO: 836740 - RNA, 20 nt, Homo sapiens
gccgugauuuucauugcugg

SEQ ID NO: 836741 - RNA, 17 nt, Homo sapiens
gccuacucuuccaucuu

SEQ ID NO: 836742 - RNA, 19 nt, Homo sapiens
gccucaguaagacgacaag

SEQ ID NO: 836743 - RNA, 16 nt, Homo sapiens
gccuccucacaacaug

SEQ ID NO: 836744 - RNA, 17 nt, Homo sapiens
gccugcuggauguggag

SEQ ID NO: 836745 - RNA, 17 nt, Homo sapiens
gccuggccccucagggu

SEQ ID NO: 836746 - RNA, 23 nt, Homo sapiens
gccuggggucugacaauaccucg

SEQ ID NO: 836747 - RNA, 18 nt, Homo sapiens
gccugugcugugacucga

SEQ ID NO: 836748 - RNA, 21 nt, Homo sapiens
gccuucccuaaaaucagggaa

SEQ ID NO: 836749 - RNA, 16 nt, Homo sapiens
gccuuucccccuguga

SEQ ID NO: 836750 - RNA, 13 nt, Homo sapiens
gcgcagccaugug

SEQ ID NO: 836751 - RNA, 16 nt, Homo sapiens
gcgcagccaugugauu

SEQ ID NO: 836752 - RNA, 17 nt, Homo sapiens
gcggauccaagcaaaug

SEQ ID NO: 836753 - RNA, 19 nt, Homo sapiens
gcuaacacacagcucccau

SEQ ID NO: 836754 - RNA, 15 nt, Homo sapiens
gcuagacaguuaaac

SEQ ID NO: 836755 - RNA, 21 nt, Homo sapiens
gcucaaagcguggacaggugu

SEQ ID NO: 836756 - RNA, 22 nt, Homo sapiens
gcucacuguucuauucaucuca

SEQ ID NO: 836757 - RNA, 18 nt, Homo sapiens
gcucaggaccaggcaaug

SEQ ID NO: 836758 - RNA, 20 nt, Homo sapiens
gcucaucagaaacucaaaag

SEQ ID NO: 836759 - RNA, 11 nt, Homo sapiens
gcucauuucag

SEQ ID NO: 836760 - RNA, 16 nt, Homo sapiens
gcuccaaaugcagcuu

SEQ ID NO: 836761 - RNA, 18 nt, Homo sapiens
gcuccaaaugcagcuuua

SEQ ID NO: 836762 - RNA, 17 nt, Homo sapiens
gcuccacaguguugcca

SEQ ID NO: 836763 - RNA, 17 nt, Homo sapiens
gcuccagugcaggagac

SEQ ID NO: 836764 - RNA, 21 nt, Homo sapiens
gcucucugacgcuugugacag

SEQ ID NO: 836765 - RNA, 13 nt, Homo sapiens
gcucugagugcua

SEQ ID NO: 836766 - RNA, 20 nt, Homo sapiens
gcucuuuguuuugugucucu

SEQ ID NO: 836767 - RNA, 15 nt, Homo sapiens
gcugaacucaugaga

SEQ ID NO: 836768 - RNA, 21 nt, Homo sapiens
gcugaacuuguuuucugggaa

SEQ ID NO: 836769 - RNA, 17 nt, Homo sapiens
gcugaggcccagugcau

SEQ ID NO: 836770 - RNA, 13 nt, Homo sapiens
gcugauguccuca

SEQ ID NO: 836771 - RNA, 14 nt, Homo sapiens
gcugcaugcgagug

SEQ ID NO: 836772 - RNA, 13 nt, Homo sapiens
gcugccugggauc

SEQ ID NO: 836773 - RNA, 23 nt, Homo sapiens
gcugcugcuuagcuugcaccuug

SEQ ID NO: 836774 - RNA, 21 nt, Homo sapiens
gcuggaacagauucacacugu

SEQ ID NO: 836775 - RNA, 21 nt, Homo sapiens
gcuggcgucaugcaaagucau

SEQ ID NO: 836776 - RNA, 20 nt, Homo sapiens
gcuggucucgaacugcugga

SEQ ID NO: 836777 - RNA, 17 nt, Homo sapiens
gcuguauacuguacuga

SEQ ID NO: 836778 - RNA, 18 nt, Homo sapiens
gcuguguucacacuguaa

SEQ ID NO: 836779 - RNA, 22 nt, Homo sapiens
gcuuaaaauaaaguuaaacuga

SEQ ID NO: 836780 - RNA, 20 nt, Homo sapiens
gcuuccucaguaacauuucu

SEQ ID NO: 836781 - RNA, 11 nt, Homo sapiens
gcuucugccau

SEQ ID NO: 836782 - RNA, 18 nt, Homo sapiens
gcuugaaauagugucuga

SEQ ID NO: 836783 - RNA, 22 nt, Homo sapiens
gcuugaaauagugucugaugaa

SEQ ID NO: 836784 - RNA, 16 nt, Homo sapiens
gcuuggcugugcccuc

SEQ ID NO: 836785 - RNA, 21 nt, Homo sapiens
gcuuguaaugguucuuuacac

SEQ ID NO: 836786 - RNA, 19 nt, Homo sapiens
gcuuuaauuaagcucucau

SEQ ID NO: 836787 - RNA, 23 nt, Homo sapiens
gcuuucugucuccuuaacacuga

SEQ ID NO: 836788 - RNA, 13 nt, Homo sapiens
gcuuugauauuuc

SEQ ID NO: 836789 - RNA, 23 nt, Homo sapiens
gcuuuuaaugcuccaaaugcuga

SEQ ID NO: 836790 - RNA, 19 nt, Homo sapiens
ggaaacagcucgacuuuaa

SEQ ID NO: 836791 - RNA, 21 nt, Homo sapiens
ggaagccaaaccucugugagc

SEQ ID NO: 836792 - RNA, 17 nt, Homo sapiens
ggaaggacauccauguu

SEQ ID NO: 836793 - RNA, 22 nt, Homo sapiens
ggaaggagaggagaggggcaca

SEQ ID NO: 836794 - RNA, 19 nt, Homo sapiens
ggaagguucuggugugaac

SEQ ID NO: 836795 - RNA, 18 nt, Homo sapiens
ggaauauuuaaacaguag

SEQ ID NO: 836796 - RNA, 19 nt, Homo sapiens
ugccauugacuucuuccca

SEQ ID NO: 836797 - RNA, 21 nt, Homo sapiens
ugccauugacuucuucccaag

SEQ ID NO: 836798 - RNA, 14 nt, Homo sapiens
ugcccucagauucc

SEQ ID NO: 836799 - RNA, 15 nt, Homo sapiens
ugccgccagcugccg

SEQ ID NO: 836800 - RNA, 19 nt, Homo sapiens
ugccucccuucaugcaugg

SEQ ID NO: 836801 - RNA, 22 nt, Homo sapiens
ugccuggaucucacaagcacuu

SEQ ID NO: 836802 - RNA, 15 nt, Homo sapiens
ugcuagacaguuaaa

SEQ ID NO: 836803 - RNA, 15 nt, Homo sapiens
ugcuauguauuugca

SEQ ID NO: 836804 - RNA, 16 nt, Homo sapiens
ugcuauguauuugcaa

SEQ ID NO: 836805 - RNA, 15 nt, Homo sapiens
ugcuccaaaugcuga

SEQ ID NO: 836806 - RNA, 18 nt, Homo sapiens
ugcuccagugcaggagac

SEQ ID NO: 836807 - RNA, 15 nt, Homo sapiens
ugcugaggcccagug

SEQ ID NO: 836808 - RNA, 21 nt, Homo sapiens
ugcugauccucccaggcuucc

SEQ ID NO: 836809 - RNA, 19 nt, Homo sapiens
ugcugcuugaggcaacuca

SEQ ID NO: 836810 - RNA, 17 nt, Homo sapiens
ugcuggauucaagugau

SEQ ID NO: 836811 - RNA, 13 nt, Homo sapiens
ugcugggaauuac

SEQ ID NO: 836812 - RNA, 19 nt, Homo sapiens
ugcuguauacuguacugag

SEQ ID NO: 836813 - RNA, 21 nt, Homo sapiens
ugcugugugacucaaaccaaa

SEQ ID NO: 836814 - RNA, 16 nt, Homo sapiens
ugcuugagcucaggag

SEQ ID NO: 836815 - RNA, 15 nt, Homo sapiens
uggaaaauaccuaau

SEQ ID NO: 836816 - RNA, 13 nt, Homo sapiens
uggaacaagcaca

SEQ ID NO: 836817 - RNA, 19 nt, Homo sapiens
uggaacagauucacacugu

SEQ ID NO: 836818 - RNA, 22 nt, Homo sapiens
uggaacaucaucaaggcacugc

SEQ ID NO: 836819 - RNA, 16 nt, Homo sapiens
uggaagagcacaagag

SEQ ID NO: 836820 - RNA, 23 nt, Homo sapiens
uggaaguugcauggcaucaccuc

SEQ ID NO: 836821 - RNA, 15 nt, Homo sapiens
uggacaauaaucuca

SEQ ID NO: 836822 - RNA, 15 nt, Homo sapiens
uggacagaagcagcu

SEQ ID NO: 836823 - RNA, 23 nt, Homo sapiens
uggaccugucacgauugucauca

SEQ ID NO: 836824 - RNA, 20 nt, Homo sapiens
uggacugaguuuauacucac

SEQ ID NO: 836825 - RNA, 16 nt, Homo sapiens
uggaggcaccauuugu

SEQ ID NO: 836826 - RNA, 20 nt, Homo sapiens
uggaugcagccucacagucc

SEQ ID NO: 836827 - RNA, 22 nt, Homo sapiens
uggaugccaaccggucacccag

SEQ ID NO: 836828 - RNA, 18 nt, Homo sapiens
uggaugccugauugccaa

SEQ ID NO: 836829 - RNA, 15 nt, Homo sapiens
uggauucaagugauc

SEQ ID NO: 836830 - RNA, 13 nt, Homo sapiens
uggauuuugucaa

SEQ ID NO: 836831 - RNA, 18 nt, Homo sapiens
uggcaaggacacagauga

SEQ ID NO: 836832 - RNA, 12 nt, Homo sapiens
uggcaccagcag

SEQ ID NO: 836833 - RNA, 16 nt, Homo sapiens
uggcacuggaugcaga

SEQ ID NO: 836834 - RNA, 17 nt, Homo sapiens
uggcacuggaugcagaa

SEQ ID NO: 836835 - RNA, 13 nt, Homo sapiens
uggcagagccaug

SEQ ID NO: 836836 - RNA, 17 nt, Homo sapiens
uggccacggccacggcc

SEQ ID NO: 836837 - RNA, 16 nt, Homo sapiens
uggcccacgcacuucg

SEQ ID NO: 836838 - RNA, 13 nt, Homo sapiens
uggcccacugcau

SEQ ID NO: 836839 - RNA, 16 nt, Homo sapiens
uggccccacuuugaag

SEQ ID NO: 836840 - RNA, 13 nt, Homo sapiens
uggccugcuggau

SEQ ID NO: 836841 - RNA, 19 nt, Homo sapiens
uggcuccaacacugcugcu

SEQ ID NO: 836842 - RNA, 17 nt, Homo sapiens
uggcugaaggacuguga

SEQ ID NO: 836843 - RNA, 20 nt, Homo sapiens
uggcuuaagugagcagaaca

SEQ ID NO: 836844 - RNA, 15 nt, Homo sapiens
ugggacacccuguga

SEQ ID NO: 836845 - RNA, 21 nt, Homo sapiens
ugggaccacgugagaucauuc

SEQ ID NO: 836846 - RNA, 15 nt, Homo sapiens
ugggagcaccgccug

SEQ ID NO: 836847 - RNA, 15 nt, Homo sapiens
ugggauggauuucca

SEQ ID NO: 836848 - RNA, 16 nt, Homo sapiens
ugggccagaauuucaa

SEQ ID NO: 836849 - RNA, 18 nt, Homo sapiens
ugggcccaaugcacuuug

SEQ ID NO: 836850 - RNA, 13 nt, Homo sapiens
ugggccuccucac

SEQ ID NO: 836851 - RNA, 22 nt, Homo sapiens
uggggcuaggggcuggggccaa

SEQ ID NO: 836852 - RNA, 22 nt, Homo sapiens
ugggggaucacagccucugaaa

SEQ ID NO: 836853 - RNA, 21 nt, Homo sapiens
uggguuagggaaaacauucca

SEQ ID NO: 836854 - RNA, 16 nt, Homo sapiens
uggguucaagcgauuc

SEQ ID NO: 836855 - RNA, 12 nt, Homo sapiens
uggucacuggaa

SEQ ID NO: 836856 - RNA, 20 nt, Homo sapiens
uggucguuuucaacagaauu

SEQ ID NO: 836857 - RNA, 22 nt, Homo sapiens
uggugcacuuuucugugucaua

SEQ ID NO: 836858 - RNA, 14 nt, Homo sapiens
ugguucugugccaa

SEQ ID NO: 836859 - RNA, 16 nt, Homo sapiens
uguaaaauggagacac

SEQ ID NO: 836860 - RNA, 15 nt, Homo sapiens
uguaccacaaacaca

SEQ ID NO: 836861 - RNA, 18 nt, Homo sapiens
uguauacuguacugagac

SEQ ID NO: 836862 - RNA, 16 nt, Homo sapiens
uguauucacuuauaug

SEQ ID NO: 836863 - RNA, 18 nt, Homo sapiens
uguccuuuuucacuuuga

SEQ ID NO: 836864 - RNA, 13 nt, Homo sapiens
ugucugccaaaca

SEQ ID NO: 836865 - RNA, 19 nt, Homo sapiens
ugucuggcacuugggacaa

SEQ ID NO: 836866 - RNA, 16 nt, Homo sapiens
ugugaacccaaagugu

SEQ ID NO: 836867 - RNA, 18 nt, Homo sapiens
ugugacaauggcaacaau

SEQ ID NO: 836868 - RNA, 13 nt, Homo sapiens
ugugauaaaaccc

SEQ ID NO: 836869 - RNA, 23 nt, Homo sapiens
ugugcaauguguauaaacaagaa

SEQ ID NO: 836870 - RNA, 12 nt, Homo sapiens
ugugcugugacu

SEQ ID NO: 836871 - RNA, 19 nt, Homo sapiens
uguguggucaacauuucuc

SEQ ID NO: 836872 - RNA, 16 nt, Homo sapiens
uguguucacacuguaa

SEQ ID NO: 836873 - RNA, 20 nt, Homo sapiens
uguguucacacuguaaacau

SEQ ID NO: 836874 - RNA, 17 nt, Homo sapiens
uguuagugguuacccag

SEQ ID NO: 836875 - RNA, 16 nt, Homo sapiens
uguuaucaccuagcug

SEQ ID NO: 836876 - RNA, 11 nt, Homo sapiens
uguuaugucaa

SEQ ID NO: 836877 - RNA, 12 nt, Homo sapiens
uguucaagagca

SEQ ID NO: 836878 - RNA, 18 nt, Homo sapiens
uguucaagagcacacuug

SEQ ID NO: 836879 - RNA, 15 nt, Homo sapiens
uguucacacuguaaa

SEQ ID NO: 836880 - RNA, 16 nt, Homo sapiens
uguuccccaucaucug

SEQ ID NO: 836881 - RNA, 16 nt, Homo sapiens
uguucuauucaucuca

SEQ ID NO: 836882 - RNA, 20 nt, Homo sapiens
uguucuauucaucucaagga

SEQ ID NO: 836883 - RNA, 12 nt, Homo sapiens
uguucuugugaa

SEQ ID NO: 836884 - RNA, 20 nt, Homo sapiens
uguuguuuuaggaauacaua

SEQ ID NO: 836885 - RNA, 18 nt, Homo sapiens
uguuuagcccaaaaccaa

SEQ ID NO: 836886 - RNA, 15 nt, Homo sapiens
uguuucugaaaggga

SEQ ID NO: 836887 - RNA, 16 nt, Homo sapiens
uguuucugaaccauua

SEQ ID NO: 836888 - RNA, 22 nt, Homo sapiens
uguuucugaaccauuacuguaa

SEQ ID NO: 836889 - RNA, 22 nt, Homo sapiens
uguuugucucaccuacccauga

SEQ ID NO: 836890 - RNA, 17 nt, Homo sapiens
uuaaacauuaugaugug

SEQ ID NO: 836891 - RNA, 23 nt, Homo sapiens
uuaaaucaacuuuaucauaugcu

SEQ ID NO: 836892 - RNA, 14 nt, Homo sapiens
uuaaaugaacaaga

SEQ ID NO: 836893 - RNA, 16 nt, Homo sapiens
uuaaaugcucaucugg

SEQ ID NO: 836894 - RNA, 22 nt, Homo sapiens
uuaagaacuagggagggggaaa

SEQ ID NO: 836895 - RNA, 12 nt, Homo sapiens
uuaagccuuaaa

SEQ ID NO: 836896 - RNA, 19 nt, Homo sapiens
uuaaggauuuuaugcuuua

SEQ ID NO: 836897 - RNA, 22 nt, Homo sapiens
uuacaauguaauagaagcuuaa

SEQ ID NO: 836898 - RNA, 20 nt, Homo sapiens
uuacccccugggagccccaa

SEQ ID NO: 836899 - RNA, 22 nt, Homo sapiens
uuacccuuuggccccacuuuga

SEQ ID NO: 836900 - RNA, 16 nt, Homo sapiens
uuacuaaguaaucuca

SEQ ID NO: 836901 - RNA, 17 nt, Homo sapiens
uuacugauucauacauu

SEQ ID NO: 836902 - RNA, 14 nt, Homo sapiens
uuacuguggauaaa

SEQ ID NO: 836903 - RNA, 23 nt, Homo sapiens
uuagcaaaaauuagaauuuuggu

SEQ ID NO: 836904 - RNA, 15 nt, Homo sapiens
uuagcauuuugcuaa

SEQ ID NO: 836905 - RNA, 18 nt, Homo sapiens
uuagggaaaacauuccau

SEQ ID NO: 836906 - RNA, 18 nt, Homo sapiens
uuagugaccucagcuuug

SEQ ID NO: 836907 - RNA, 16 nt, Homo sapiens
uuauaggucacuuugu

SEQ ID NO: 836908 - RNA, 18 nt, Homo sapiens
uuauaugauucacaugcu

SEQ ID NO: 836909 - RNA, 21 nt, Homo sapiens
uuauauuucacccaucucuca

SEQ ID NO: 836910 - RNA, 17 nt, Homo sapiens
uuauucaaaaugaugua

SEQ ID NO: 836911 - RNA, 16 nt, Homo sapiens
uuauuuauuuauucau

SEQ ID NO: 836912 - RNA, 12 nt, Homo sapiens
uucaaaugggcu

SEQ ID NO: 836913 - RNA, 22 nt, Homo sapiens
uucaccuaagucucugugaauu

SEQ ID NO: 836914 - RNA, 13 nt, Homo sapiens
uucagagauauaa

SEQ ID NO: 836915 - RNA, 22 nt, Homo sapiens
uucagagauauaauaagcccaa

SEQ ID NO: 836916 - RNA, 21 nt, Homo sapiens
uucauaugacauucaugccug

SEQ ID NO: 836917 - RNA, 13 nt, Homo sapiens
uucaugucucacg

SEQ ID NO: 836918 - RNA, 20 nt, Homo sapiens
agccccuggaugcagccuca

SEQ ID NO: 836919 - RNA, 15 nt, Homo sapiens
agcccgaacaccauu

SEQ ID NO: 836920 - RNA, 13 nt, Homo sapiens
agcccuauuacuu

SEQ ID NO: 836921 - RNA, 15 nt, Homo sapiens
agcccugagcuuucu

SEQ ID NO: 836922 - RNA, 20 nt, Homo sapiens
agccgagauugcaccacugc

SEQ ID NO: 836923 - RNA, 20 nt, Homo sapiens
agccgauggaaaauaccuaa

SEQ ID NO: 836924 - RNA, 22 nt, Homo sapiens
agccguuuguuccccaagacau

SEQ ID NO: 836925 - RNA, 14 nt, Homo sapiens
agccuggaacauca

SEQ ID NO: 836926 - RNA, 18 nt, Homo sapiens
agccuggcuccaaacccu

SEQ ID NO: 836927 - RNA, 20 nt, Homo sapiens
agccuggcuccaaacccucg

SEQ ID NO: 836928 - RNA, 16 nt, Homo sapiens
agccuggugcugcugc

SEQ ID NO: 836929 - RNA, 14 nt, Homo sapiens
agcgugaagggauu

SEQ ID NO: 836930 - RNA, 16 nt, Homo sapiens
agcgugugacuacucc

SEQ ID NO: 836931 - RNA, 14 nt, Homo sapiens
agcuagccagcugu

SEQ ID NO: 836932 - RNA, 19 nt, Homo sapiens
agcucucugacgcuuguga

SEQ ID NO: 836933 - RNA, 23 nt, Homo sapiens
agcugauacaaauugcagacugu

SEQ ID NO: 836934 - RNA, 13 nt, Homo sapiens
agcugcauaugau

SEQ ID NO: 836935 - RNA, 13 nt, Homo sapiens
agcugugucugcc

SEQ ID NO: 836936 - RNA, 18 nt, Homo sapiens
agcuuagcaucagagguu

SEQ ID NO: 836937 - RNA, 12 nt, Homo sapiens
agcuuaucucag

SEQ ID NO: 836938 - RNA, 14 nt, Homo sapiens
agcuuaucucaggg

SEQ ID NO: 836939 - RNA, 14 nt, Homo sapiens
aggaaaccacagcu

SEQ ID NO: 836940 - RNA, 14 nt, Homo sapiens
aggaauaccugucc

SEQ ID NO: 836941 - RNA, 21 nt, Homo sapiens
aggagacuuuacauggaugcc

SEQ ID NO: 836942 - RNA, 20 nt, Homo sapiens
aggagagcuagcagcaggga

SEQ ID NO: 836943 - RNA, 14 nt, Homo sapiens
aggaggccacguga

SEQ ID NO: 836944 - RNA, 21 nt, Homo sapiens
aggaugaaagugaccauguuu

SEQ ID NO: 836945 - RNA, 22 nt, Homo sapiens
aggaugauuuccuggggcacag

SEQ ID NO: 836946 - RNA, 18 nt, Homo sapiens
aggaugcugacaucauuu

SEQ ID NO: 836947 - RNA, 14 nt, Homo sapiens
aggauggcaaagag

SEQ ID NO: 836948 - RNA, 15 nt, Homo sapiens
aggauguucgucuca

SEQ ID NO: 836949 - RNA, 15 nt, Homo sapiens
aggcaguuccauuuc

SEQ ID NO: 836950 - RNA, 20 nt, Homo sapiens
aggcauacugccuuguuuaa

SEQ ID NO: 836951 - RNA, 14 nt, Homo sapiens
aggcauauacaaau

SEQ ID NO: 836952 - RNA, 21 nt, Homo sapiens
aggccacccugccucuaccca

SEQ ID NO: 836953 - RNA, 18 nt, Homo sapiens
aggccauuccccgucucu

SEQ ID NO: 836954 - RNA, 20 nt, Homo sapiens
aggcuccaggagcagccaca

SEQ ID NO: 836955 - RNA, 23 nt, Homo sapiens
aggcugauuuauggucagaauuu

SEQ ID NO: 836956 - RNA, 20 nt, Homo sapiens
aggcuggagugcaguggcgc

SEQ ID NO: 836957 - RNA, 16 nt, Homo sapiens
agggaaaacauuccau

SEQ ID NO: 836958 - RNA, 14 nt, Homo sapiens
agggagauuugcuc

SEQ ID NO: 836959 - RNA, 15 nt, Homo sapiens
agggagcugggagac

SEQ ID NO: 836960 - RNA, 20 nt, Homo sapiens
agggauggugcccuguucuc

SEQ ID NO: 836961 - RNA, 19 nt, Homo sapiens
agggauuuuagucacacgu

SEQ ID NO: 836962 - RNA, 14 nt, Homo sapiens
agggcacacacugu

SEQ ID NO: 836963 - RNA, 14 nt, Homo sapiens
agggccuggaagac

SEQ ID NO: 836964 - RNA, 14 nt, Homo sapiens
agggcgcaaagggc

SEQ ID NO: 836965 - RNA, 17 nt, Homo sapiens
agggcgcaaagggcaug

SEQ ID NO: 836966 - RNA, 20 nt, Homo sapiens
aggggaauaaacuguugagu

SEQ ID NO: 836967 - RNA, 18 nt, Homo sapiens
aggggagggcaggcuugg

SEQ ID NO: 836968 - RNA, 15 nt, Homo sapiens
aggggcuggggccaa

SEQ ID NO: 836969 - RNA, 20 nt, Homo sapiens
aggucaccuuuauucuggca

SEQ ID NO: 836970 - RNA, 24 nt, Homo sapiens
aggucacuuuguuuuacugucuua

SEQ ID NO: 836971 - RNA, 16 nt, Homo sapiens
aggucaguagacugug

SEQ ID NO: 836972 - RNA, 14 nt, Homo sapiens
aggugaaagcuaua

SEQ ID NO: 836973 - RNA, 18 nt, Homo sapiens
agguggaacaagcacaga

SEQ ID NO: 836974 - RNA, 19 nt, Homo sapiens
agguucuggugugaacuaa

SEQ ID NO: 836975 - RNA, 22 nt, Homo sapiens
aguaaacccagcugugagacaa

SEQ ID NO: 836976 - RNA, 22 nt, Homo sapiens
aguaaccuggguaaaugcagcg

SEQ ID NO: 836977 - RNA, 15 nt, Homo sapiens
aguaaguacaaauau

SEQ ID NO: 836978 - RNA, 12 nt, Homo sapiens
aguacaggugaa

SEQ ID NO: 836979 - RNA, 15 nt, Homo sapiens
aguacccaggaugau

SEQ ID NO: 836980 - RNA, 16 nt, Homo sapiens
aguauauuauuauuaa

SEQ ID NO: 836981 - RNA, 15 nt, Homo sapiens
aguaugugcauuuaa

SEQ ID NO: 836982 - RNA, 22 nt, Homo sapiens
agucaauccaagagucugauga

SEQ ID NO: 836983 - RNA, 19 nt, Homo sapiens
agucgcaucucagugcagg

SEQ ID NO: 836984 - RNA, 22 nt, Homo sapiens
agucucugaagugaaacugcuu

SEQ ID NO: 836985 - RNA, 12 nt, Homo sapiens
agucucugugaa

SEQ ID NO: 836986 - RNA, 19 nt, Homo sapiens
agugacagcuuucugggau

SEQ ID NO: 836987 - RNA, 21 nt, Homo sapiens
agugacagcuuucugggaugu

SEQ ID NO: 836988 - RNA, 18 nt, Homo sapiens
agugacuguaucugugua

SEQ ID NO: 836989 - RNA, 20 nt, Homo sapiens
agugacuguucaagagcaca

SEQ ID NO: 836990 - RNA, 20 nt, Homo sapiens
agugaucuuucccaagagaa

SEQ ID NO: 836991 - RNA, 20 nt, Homo sapiens
agugcacaacauuacaggga

SEQ ID NO: 836992 - RNA, 19 nt, Homo sapiens
agugccuggccaaagggau

SEQ ID NO: 836993 - RNA, 17 nt, Homo sapiens
agugccuuuugguggag

SEQ ID NO: 836994 - RNA, 18 nt, Homo sapiens
agugcuaguucugaccca

SEQ ID NO: 836995 - RNA, 15 nt, Homo sapiens
agugcugaccagaca

SEQ ID NO: 836996 - RNA, 17 nt, Homo sapiens
agugcuuguuccucuca

SEQ ID NO: 836997 - RNA, 12 nt, Homo sapiens
aguggagccaug

SEQ ID NO: 836998 - RNA, 14 nt, Homo sapiens
aguggcauguauga

SEQ ID NO: 836999 - RNA, 14 nt, Homo sapiens
agugggacaguucc

SEQ ID NO: 837000 - RNA, 13 nt, Homo sapiens
agugggugaauaa

SEQ ID NO: 837001 - RNA, 23 nt, Homo sapiens
aguguccucaucuguaaaaugga

SEQ ID NO: 837002 - RNA, 23 nt, Homo sapiens
aguguggccacgugggcaaacag

SEQ ID NO: 837003 - RNA, 20 nt, Homo sapiens
aguuagugauuauauuucac

SEQ ID NO: 837004 - RNA, 14 nt, Homo sapiens
aguuccaccaucaa

SEQ ID NO: 837005 - RNA, 18 nt, Homo sapiens
aguucccuagucuauuca

SEQ ID NO: 837006 - RNA, 14 nt, Homo sapiens
aguugccagucacc

SEQ ID NO: 837007 - RNA, 16 nt, Homo sapiens
aguuuaaccugaugca

SEQ ID NO: 837008 - RNA, 15 nt, Homo sapiens
auaaaauuauuccuu

SEQ ID NO: 837009 - RNA, 23 nt, Homo sapiens
auaaaguuucuguugauaaucau

SEQ ID NO: 837010 - RNA, 22 nt, Homo sapiens
auaaaucgcuuuugauaaucaa

SEQ ID NO: 837011 - RNA, 19 nt, Homo sapiens
auaagcuuuuaaugcucca

SEQ ID NO: 837012 - RNA, 16 nt, Homo sapiens
auaauacaguaucuca

SEQ ID NO: 837013 - RNA, 17 nt, Homo sapiens
auaauccagucuucacu

SEQ ID NO: 837014 - RNA, 14 nt, Homo sapiens
auacaguaucucag

SEQ ID NO: 837015 - RNA, 13 nt, Homo sapiens
auacuguacugag

SEQ ID NO: 837016 - RNA, 21 nt, Homo sapiens
auacuguacugagacauuaca

SEQ ID NO: 837017 - RNA, 22 nt, Homo sapiens
auacuguacugagacauuacag

SEQ ID NO: 837018 - RNA, 21 nt, Homo sapiens
auagcacaugauuugggcucu

SEQ ID NO: 837019 - RNA, 19 nt, Homo sapiens
auauaaaaauaaagcacuu

SEQ ID NO: 837020 - RNA, 14 nt, Homo sapiens
auauaauaagccca

SEQ ID NO: 837021 - RNA, 14 nt, Homo sapiens
auauagaacagugc

SEQ ID NO: 837022 - RNA, 15 nt, Homo sapiens
auauagaacagugcu

SEQ ID NO: 837023 - RNA, 18 nt, Homo sapiens
auaucagugggcucucuu

SEQ ID NO: 837024 - RNA, 21 nt, Homo sapiens
auauuaaggaagacaauguga

SEQ ID NO: 837025 - RNA, 17 nt, Homo sapiens
auauuuaccagaccaca

SEQ ID NO: 837026 - RNA, 19 nt, Homo sapiens
auauuucacccaucucuca

SEQ ID NO: 837027 - RNA, 20 nt, Homo sapiens
auauuucacccaucucucag

SEQ ID NO: 837028 - RNA, 18 nt, Homo sapiens
auauuuuguuuugugcag

SEQ ID NO: 837029 - RNA, 22 nt, Homo sapiens
aucaaauggaagacacauugaa

SEQ ID NO: 837030 - RNA, 13 nt, Homo sapiens
aucaagcuguaca

SEQ ID NO: 837031 - RNA, 20 nt, Homo sapiens
aucaaguauuuuugacauuu

SEQ ID NO: 837032 - RNA, 21 nt, Homo sapiens
aucacagcuaacaauugugaa

SEQ ID NO: 837033 - RNA, 20 nt, Homo sapiens
aucacauguggacuuuuauu

SEQ ID NO: 837034 - RNA, 19 nt, Homo sapiens
aucacuucugagaacucau

SEQ ID NO: 837035 - RNA, 14 nt, Homo sapiens
aucagaaacucaaa

SEQ ID NO: 837036 - RNA, 23 nt, Homo sapiens
aucagaggugaaagcuauaucaa

SEQ ID NO: 837037 - RNA, 21 nt, Homo sapiens
aucagcuggcgucaugcaaag

SEQ ID NO: 837038 - RNA, 17 nt, Homo sapiens
aucaggagaaaaagccu

SEQ ID NO: 837039 - RNA, 21 nt, Homo sapiens
aucaguuacucuucaguuaag

SEQ ID NO: 837040 - RNA, 15 nt, Homo sapiens
cgagccuggcuccaa

SEQ ID NO: 837041 - RNA, 14 nt, Homo sapiens
cgauccccugucac

SEQ ID NO: 837042 - RNA, 19 nt, Homo sapiens
cgcacaauaguaaccuggg

SEQ ID NO: 837043 - RNA, 16 nt, Homo sapiens
cgcaucucagugcagg

SEQ ID NO: 837044 - RNA, 20 nt, Homo sapiens
cgcuacccgggaagggggcu

SEQ ID NO: 837045 - RNA, 22 nt, Homo sapiens
cgcugggauccgggaucaaagu

SEQ ID NO: 837046 - RNA, 18 nt, Homo sapiens
cgcugugucagcauagaa

SEQ ID NO: 837047 - RNA, 17 nt, Homo sapiens
cggagaacaaaugugaa

SEQ ID NO: 837048 - RNA, 15 nt, Homo sapiens
cggcauuaaagccau

SEQ ID NO: 837049 - RNA, 12 nt, Homo sapiens
cggccacggcca

SEQ ID NO: 837050 - RNA, 14 nt, Homo sapiens
cgggaccccgagcc

SEQ ID NO: 837051 - RNA, 23 nt, Homo sapiens
cgggggcuuggcugugcccucag

SEQ ID NO: 837052 - RNA, 12 nt, Homo sapiens
cgguaagcacuu

SEQ ID NO: 837053 - RNA, 21 nt, Homo sapiens
cgguaagcacuuaaugaauga

SEQ ID NO: 837054 - RNA, 18 nt, Homo sapiens
cgugaaucuguaucuugc

SEQ ID NO: 837055 - RNA, 14 nt, Homo sapiens
cgugacagccguuu

SEQ ID NO: 837056 - RNA, 22 nt, Homo sapiens
cgugauguggagggcacauucc

SEQ ID NO: 837057 - RNA, 14 nt, Homo sapiens
cguggagcugccug

SEQ ID NO: 837058 - RNA, 22 nt, Homo sapiens
cuaaaauaagggcagagucaca

SEQ ID NO: 837059 - RNA, 23 nt, Homo sapiens
cuaaaauaagggcagagucacac

SEQ ID NO: 837060 - RNA, 14 nt, Homo sapiens
cuaaaaucagggaa

SEQ ID NO: 837061 - RNA, 21 nt, Homo sapiens
cuaaaugaguaaacccagcug

SEQ ID NO: 837062 - RNA, 13 nt, Homo sapiens
cuaacaauuguga

SEQ ID NO: 837063 - RNA, 21 nt, Homo sapiens
cuaacgcaaaaauagcucuug

SEQ ID NO: 837064 - RNA, 23 nt, Homo sapiens
cuaagagggagggagggcuccag

SEQ ID NO: 837065 - RNA, 15 nt, Homo sapiens
cuaagucucugugaa

SEQ ID NO: 837066 - RNA, 13 nt, Homo sapiens
cuacaauuguaaa

SEQ ID NO: 837067 - RNA, 19 nt, Homo sapiens
cuacaauuguaaacuaguu

SEQ ID NO: 837068 - RNA, 14 nt, Homo sapiens
cuacauacacagug

SEQ ID NO: 837069 - RNA, 21 nt, Homo sapiens
cuaccaacgaaagacgugauu

SEQ ID NO: 837070 - RNA, 12 nt, Homo sapiens
cuaccacaugcc

SEQ ID NO: 837071 - RNA, 13 nt, Homo sapiens
cuacuacagagaa

SEQ ID NO: 837072 - RNA, 17 nt, Homo sapiens
cuaggggcuggggccaa

SEQ ID NO: 837073 - RNA, 17 nt, Homo sapiens
cuagggugugauuuagg

SEQ ID NO: 837074 - RNA, 17 nt, Homo sapiens
cuaguuaucaugcaugu

SEQ ID NO: 837075 - RNA, 18 nt, Homo sapiens
cuaucccuuuccaaaggc

SEQ ID NO: 837076 - RNA, 13 nt, Homo sapiens
cuaugagggugag

SEQ ID NO: 837077 - RNA, 13 nt, Homo sapiens
cuauguauuugca

SEQ ID NO: 837078 - RNA, 13 nt, Homo sapiens
cuauuauauucau

SEQ ID NO: 837079 - RNA, 18 nt, Homo sapiens
cuauuuauucccuguuaa

SEQ ID NO: 837080 - RNA, 21 nt, Homo sapiens
cuauuuauuuauuuauucauu

SEQ ID NO: 837081 - RNA, 21 nt, Homo sapiens
cucaaaagcugggcagguugg

SEQ ID NO: 837082 - RNA, 19 nt, Homo sapiens
cucaaacucuuaaaaccca

SEQ ID NO: 837083 - RNA, 18 nt, Homo sapiens
cucaauuuuuuucaccuc

SEQ ID NO: 837084 - RNA, 22 nt, Homo sapiens
cucacacggacacucaaaagcu

SEQ ID NO: 837085 - RNA, 18 nt, Homo sapiens
cucacccuguaccacaaa

SEQ ID NO: 837086 - RNA, 10 nt, Homo sapiens
cucacuccuu

SEQ ID NO: 837087 - RNA, 13 nt, Homo sapiens
cucagcaaaagau

SEQ ID NO: 837088 - RNA, 15 nt, Homo sapiens
cucagccuugcaaau

SEQ ID NO: 837089 - RNA, 16 nt, Homo sapiens
cucaggaaucaucucc

SEQ ID NO: 837090 - RNA, 11 nt, Homo sapiens
cucagugcagg

SEQ ID NO: 837091 - RNA, 17 nt, Homo sapiens
cucagugugacuccuca

SEQ ID NO: 837092 - RNA, 14 nt, Homo sapiens
cucauacacagaaa

SEQ ID NO: 837093 - RNA, 18 nt, Homo sapiens
cucaucagaaacucaaaa

SEQ ID NO: 837094 - RNA, 23 nt, Homo sapiens
cucauccagggcucugaccaguu

SEQ ID NO: 837095 - RNA, 15 nt, Homo sapiens
cucauccucauaccc

SEQ ID NO: 837096 - RNA, 18 nt, Homo sapiens
cuccaagaccuucuccuu

SEQ ID NO: 837097 - RNA, 13 nt, Homo sapiens
cucccaagggaug

SEQ ID NO: 837098 - RNA, 16 nt, Homo sapiens
cucccaggcauucccc

SEQ ID NO: 837099 - RNA, 18 nt, Homo sapiens
cuccccuggggacagcaa

SEQ ID NO: 837100 - RNA, 13 nt, Homo sapiens
cuccccuuugccu

SEQ ID NO: 837101 - RNA, 22 nt, Homo sapiens
cucccugagugguccccaccuu

SEQ ID NO: 837102 - RNA, 19 nt, Homo sapiens
cucccuuguggcuuccuca

SEQ ID NO: 837103 - RNA, 13 nt, Homo sapiens
cuccucaggguug

SEQ ID NO: 837104 - RNA, 13 nt, Homo sapiens
cucuacaaaaagc

SEQ ID NO: 837105 - RNA, 24 nt, Homo sapiens
cucuaugaccucgcccuccacaaa

SEQ ID NO: 837106 - RNA, 14 nt, Homo sapiens
cucucagaacauac

SEQ ID NO: 837107 - RNA, 23 nt, Homo sapiens
cucucugacgcuugugacagugc

SEQ ID NO: 837108 - RNA, 17 nt, Homo sapiens
cucugacgcuugugaca

SEQ ID NO: 837109 - RNA, 22 nt, Homo sapiens
cucugcacaagcugcacccuca

SEQ ID NO: 837110 - RNA, 24 nt, Homo sapiens
cucugcugccgccccacccagaug

SEQ ID NO: 837111 - RNA, 22 nt, Homo sapiens
cucuggaugccugauugccaag

SEQ ID NO: 837112 - RNA, 14 nt, Homo sapiens
cucugguccauaga

SEQ ID NO: 837113 - RNA, 18 nt, Homo sapiens
cucugugaauugaaaugu

SEQ ID NO: 837114 - RNA, 19 nt, Homo sapiens
cucuuucccucccuuccuc

SEQ ID NO: 837115 - RNA, 19 nt, Homo sapiens
cucuuuuuuugagugacag

SEQ ID NO: 837116 - RNA, 18 nt, Homo sapiens
cugaaaaaaaaccugaga

SEQ ID NO: 837117 - RNA, 19 nt, Homo sapiens
cugaaaaccaauguucucu

SEQ ID NO: 837118 - RNA, 13 nt, Homo sapiens
cugaacacuccaa

SEQ ID NO: 837119 - RNA, 19 nt, Homo sapiens
cugaacucugacaacagac

SEQ ID NO: 837120 - RNA, 21 nt, Homo sapiens
cugacccaugcugcccuguga

SEQ ID NO: 837121 - RNA, 17 nt, Homo sapiens
cugagaacacugugaaa

SEQ ID NO: 837122 - RNA, 22 nt, Homo sapiens
cugaggagccugcaacaugcca

SEQ ID NO: 837123 - RNA, 22 nt, Homo sapiens
cugaggcccagugcauaugcaa

SEQ ID NO: 837124 - RNA, 23 nt, Homo sapiens
cugcaaucuucucagaaggcaaa

SEQ ID NO: 837125 - RNA, 12 nt, Homo sapiens
cugcacacuguc

SEQ ID NO: 837126 - RNA, 17 nt, Homo sapiens
cugcacccacccaggag

SEQ ID NO: 837127 - RNA, 19 nt, Homo sapiens
cugcaccccugcaguuuga

SEQ ID NO: 837128 - RNA, 14 nt, Homo sapiens
cugcacuccagccu

SEQ ID NO: 837129 - RNA, 14 nt, Homo sapiens
cugccaaacacauu

SEQ ID NO: 837130 - RNA, 15 nt, Homo sapiens
cugccaugccagcuu

SEQ ID NO: 837131 - RNA, 14 nt, Homo sapiens
cugcuccagugcag

SEQ ID NO: 837132 - RNA, 22 nt, Homo sapiens
cugcuccuggaucucccugaga

SEQ ID NO: 837133 - RNA, 18 nt, Homo sapiens
cugcuggauucaagugau

SEQ ID NO: 837134 - RNA, 15 nt, Homo sapiens
cugcuguauacugua

SEQ ID NO: 837135 - RNA, 17 nt, Homo sapiens
cugcuuccagugaggcu

SEQ ID NO: 837136 - RNA, 14 nt, Homo sapiens
cuggaacagauuca

SEQ ID NO: 837137 - RNA, 22 nt, Homo sapiens
cuggagcuugaaauagugucug

SEQ ID NO: 837138 - RNA, 20 nt, Homo sapiens
cuggagugcaguggcgcaau

SEQ ID NO: 837139 - RNA, 19 nt, Homo sapiens
cuggaucucacaagcacuu

SEQ ID NO: 837140 - RNA, 20 nt, Homo sapiens
cuggaucucacaagcacuuu

SEQ ID NO: 837141 - RNA, 15 nt, Homo sapiens
cuggaugcagccuca

SEQ ID NO: 837142 - RNA, 19 nt, Homo sapiens
cuggcacugcuuccaguga

SEQ ID NO: 837143 - RNA, 17 nt, Homo sapiens
cuggcacuugggacaaa

SEQ ID NO: 837144 - RNA, 21 nt, Homo sapiens
cuggccccucagggucccugg

SEQ ID NO: 837145 - RNA, 18 nt, Homo sapiens
cuggcugaaggacuguga

SEQ ID NO: 837146 - RNA, 18 nt, Homo sapiens
cuggcuuaacuuaguaua

SEQ ID NO: 837147 - RNA, 17 nt, Homo sapiens
cugggagagccuuccag

SEQ ID NO: 837148 - RNA, 17 nt, Homo sapiens
cugggaucacaugugga

SEQ ID NO: 837149 - RNA, 16 nt, Homo sapiens
cugggaugcaauacua

SEQ ID NO: 837150 - RNA, 17 nt, Homo sapiens
cugggucucaguguccu

SEQ ID NO: 837151 - RNA, 14 nt, Homo sapiens
cuggguuccugcaa

SEQ ID NO: 837152 - RNA, 17 nt, Homo sapiens
cuggucagggcaaaccu

SEQ ID NO: 837153 - RNA, 19 nt, Homo sapiens
cugguccccucuauauaua

SEQ ID NO: 837154 - RNA, 14 nt, Homo sapiens
cugguucugaugau

SEQ ID NO: 837155 - RNA, 20 nt, Homo sapiens
cuguaaagcuuugugcagau

SEQ ID NO: 837156 - RNA, 17 nt, Homo sapiens
cuguacugagacauuac

SEQ ID NO: 837157 - RNA, 18 nt, Homo sapiens
cuguacugagacauuaca

SEQ ID NO: 837158 - RNA, 19 nt, Homo sapiens
cugucuccuuaacacugag

SEQ ID NO: 837159 - RNA, 20 nt, Homo sapiens
cugucuccuuaacacugagc

SEQ ID NO: 837160 - RNA, 17 nt, Homo sapiens
cugugauucgguggaga

SEQ ID NO: 837161 - RNA, 23 nt, Homo sapiens
cugugauucgguggagacuauca

SEQ ID NO: 837162 - RNA, 17 nt, Homo sapiens
uaaagaaacuuuauuca

SEQ ID NO: 837163 - RNA, 15 nt, Homo sapiens
uaaagaucauguaaa

SEQ ID NO: 837164 - RNA, 16 nt, Homo sapiens
uaaagcuuugugcaga

SEQ ID NO: 837165 - RNA, 18 nt, Homo sapiens
uaaagggcgcaaagggca

SEQ ID NO: 837166 - RNA, 20 nt, Homo sapiens
uaaagggcgcaaagggcaug

SEQ ID NO: 837167 - RNA, 22 nt, Homo sapiens
uaaaugcucaucugguaacuca

SEQ ID NO: 837168 - RNA, 12 nt, Homo sapiens
uaaaugugaaug

SEQ ID NO: 837169 - RNA, 22 nt, Homo sapiens
uaaauugucagaugcugugcaa

SEQ ID NO: 837170 - RNA, 16 nt, Homo sapiens
uaacaaauugcauuug

SEQ ID NO: 837171 - RNA, 13 nt, Homo sapiens
uaacacagugucu

SEQ ID NO: 837172 - RNA, 19 nt, Homo sapiens
uaacaccaugauuaaccac

SEQ ID NO: 837173 - RNA, 16 nt, Homo sapiens
uaagagggcacacacu

SEQ ID NO: 837174 - RNA, 19 nt, Homo sapiens
uaagagggcacacacugug

SEQ ID NO: 837175 - RNA, 20 nt, Homo sapiens
uaagagggcacacacugugu

SEQ ID NO: 837176 - RNA, 13 nt, Homo sapiens
uaagcauaacuua

SEQ ID NO: 837177 - RNA, 18 nt, Homo sapiens
uaagccuuugagacuguu

SEQ ID NO: 837178 - RNA, 14 nt, Homo sapiens
uaaggcguggagcu

SEQ ID NO: 837179 - RNA, 21 nt, Homo sapiens
uaaguaaucucacagcauuug

SEQ ID NO: 837180 - RNA, 13 nt, Homo sapiens
uaaguaucagagg

SEQ ID NO: 837181 - RNA, 14 nt, Homo sapiens
uaaguaucagaggu

SEQ ID NO: 837182 - RNA, 13 nt, Homo sapiens
uaaguguucucau

SEQ ID NO: 837183 - RNA, 14 nt, Homo sapiens
uaauaucaucagua

SEQ ID NO: 837184 - RNA, 18 nt, Homo sapiens
uaauaucaucaguauuga

SEQ ID NO: 837185 - RNA, 19 nt, Homo sapiens
uaaucaugaaagcaucuga

SEQ ID NO: 837186 - RNA, 18 nt, Homo sapiens
uaaucucuccaccuucca

SEQ ID NO: 837187 - RNA, 21 nt, Homo sapiens
uaaucugggccagaauuucaa

SEQ ID NO: 837188 - RNA, 14 nt, Homo sapiens
uaaugugacuugga

SEQ ID NO: 837189 - RNA, 18 nt, Homo sapiens
uaauuuugagggcaugaa

SEQ ID NO: 837190 - RNA, 23 nt, Homo sapiens
uaauuuuuuugugggaaauccac

SEQ ID NO: 837191 - RNA, 18 nt, Homo sapiens
uacaaaauauagcuuuca

SEQ ID NO: 837192 - RNA, 21 nt, Homo sapiens
uacaaaauauagcuuucauaa

SEQ ID NO: 837193 - RNA, 19 nt, Homo sapiens
uacauaaaguaugugcaua

SEQ ID NO: 837194 - RNA, 12 nt, Homo sapiens
uacaucuccaaa

SEQ ID NO: 837195 - RNA, 17 nt, Homo sapiens
uaccaaccugaagacac

SEQ ID NO: 837196 - RNA, 22 nt, Homo sapiens
uaccacaugccaagcacugugc

SEQ ID NO: 837197 - RNA, 12 nt, Homo sapiens
uaccaugcugaa

SEQ ID NO: 837198 - RNA, 13 nt, Homo sapiens
uacccaugaccug

SEQ ID NO: 837199 - RNA, 22 nt, Homo sapiens
uacccuuuggccccacuuugaa

SEQ ID NO: 837200 - RNA, 19 nt, Homo sapiens
uacuacaguccucccaucu

SEQ ID NO: 837201 - RNA, 16 nt, Homo sapiens
uacucaccucacccca

SEQ ID NO: 837202 - RNA, 22 nt, Homo sapiens
uacucaccucaccccacugugg

SEQ ID NO: 837203 - RNA, 16 nt, Homo sapiens
uacuguacugagacau

SEQ ID NO: 837204 - RNA, 12 nt, Homo sapiens
uagaaaaaccac

SEQ ID NO: 837205 - RNA, 13 nt, Homo sapiens
uagaaaaaccacc

SEQ ID NO: 837206 - RNA, 12 nt, Homo sapiens
uagaagggcaaa

SEQ ID NO: 837207 - RNA, 15 nt, Homo sapiens
uagacuauuugcuua

SEQ ID NO: 837208 - RNA, 16 nt, Homo sapiens
uagacuuuucccaagc

SEQ ID NO: 837209 - RNA, 22 nt, Homo sapiens
uagagcaggcguucagcucacu

SEQ ID NO: 837210 - RNA, 16 nt, Homo sapiens
uagcacagacccugcc

SEQ ID NO: 837211 - RNA, 13 nt, Homo sapiens
uagccagugcuag

SEQ ID NO: 837212 - RNA, 22 nt, Homo sapiens
uagccugccucuucucuacucu

SEQ ID NO: 837213 - RNA, 19 nt, Homo sapiens
uagcgcagccaugugauua

SEQ ID NO: 837214 - RNA, 16 nt, Homo sapiens
uagcuugcaccuuguc

SEQ ID NO: 837215 - RNA, 21 nt, Homo sapiens
uaggcauuugcugaauacaga

SEQ ID NO: 837216 - RNA, 16 nt, Homo sapiens
uaggccguuccuucaa

SEQ ID NO: 837217 - RNA, 22 nt, Homo sapiens
uaggccuggggacggcuuuuac

SEQ ID NO: 837218 - RNA, 13 nt, Homo sapiens
uagggaccugcug

SEQ ID NO: 837219 - RNA, 18 nt, Homo sapiens
uagugaucacagcagcuu

SEQ ID NO: 837220 - RNA, 12 nt, Homo sapiens
uagugucuauca

SEQ ID NO: 837221 - RNA, 18 nt, Homo sapiens
uaguuuugugaugcauuu

SEQ ID NO: 837222 - RNA, 22 nt, Homo sapiens
uauagaacagugcuugccacag

SEQ ID NO: 837223 - RNA, 13 nt, Homo sapiens
uauaggucacuuu

SEQ ID NO: 837224 - RNA, 17 nt, Homo sapiens
uauauaugugaugaucu

SEQ ID NO: 837225 - RNA, 14 nt, Homo sapiens
uauaugauucacau

SEQ ID NO: 837226 - RNA, 14 nt, Homo sapiens
uaucaucaguauug

SEQ ID NO: 837227 - RNA, 19 nt, Homo sapiens
uauccuguuuuuaaaccau

SEQ ID NO: 837228 - RNA, 14 nt, Homo sapiens
uaucucacuugugc

SEQ ID NO: 837229 - RNA, 21 nt, Homo sapiens
uaucuguguagacuauuugcu

SEQ ID NO: 837230 - RNA, 18 nt, Homo sapiens
uaugaaagcacugcauga

SEQ ID NO: 837231 - RNA, 21 nt, Homo sapiens
uaugaacagcugugucugcca

SEQ ID NO: 837232 - RNA, 18 nt, Homo sapiens
uauggacucagccuugca

SEQ ID NO: 837233 - RNA, 13 nt, Homo sapiens
uauguugaagccu

SEQ ID NO: 837234 - RNA, 14 nt, Homo sapiens
uauucccuguuaaa

SEQ ID NO: 837235 - RNA, 14 nt, Homo sapiens
uauuguggugccac

SEQ ID NO: 837236 - RNA, 17 nt, Homo sapiens
uauuuaccagaccacaa

SEQ ID NO: 837237 - RNA, 16 nt, Homo sapiens
uauuucuguaccaaag

SEQ ID NO: 837238 - RNA, 23 nt, Homo sapiens
ucaaaaauagggaaguaacagua

SEQ ID NO: 837239 - RNA, 20 nt, Homo sapiens
ucaaauggaagacacauuga

SEQ ID NO: 837240 - RNA, 21 nt, Homo sapiens
ucaaauggaagacacauugaa

SEQ ID NO: 837241 - RNA, 18 nt, Homo sapiens
ucaaauguucuccaguca

SEQ ID NO: 837242 - RNA, 16 nt, Homo sapiens
ucaacaccucugcaca

SEQ ID NO: 837243 - RNA, 15 nt, Homo sapiens
ucaaggcugcaguga

SEQ ID NO: 837244 - RNA, 16 nt, Homo sapiens
ucaaggcugcagugag

SEQ ID NO: 837245 - RNA, 21 nt, Homo sapiens
ucaagggaacuugagcgugaa

SEQ ID NO: 837246 - RNA, 19 nt, Homo sapiens
ucaaguacuguaacugugu

SEQ ID NO: 837247 - RNA, 17 nt, Homo sapiens
ucaauaccuggccucau

SEQ ID NO: 837248 - RNA, 17 nt, Homo sapiens
ucaaucuggauucauau

SEQ ID NO: 837249 - RNA, 17 nt, Homo sapiens
ucacaaauggcuacauc

SEQ ID NO: 837250 - RNA, 19 nt, Homo sapiens
ucacacgguuugaagccug

SEQ ID NO: 837251 - RNA, 19 nt, Homo sapiens
ucacacuguaaacauucau

SEQ ID NO: 837252 - RNA, 18 nt, Homo sapiens
ucacagcuaacaauugug

SEQ ID NO: 837253 - RNA, 17 nt, Homo sapiens
ucacauagagugaucuu

SEQ ID NO: 837254 - RNA, 13 nt, Homo sapiens
ucacaucuuggca

SEQ ID NO: 837255 - RNA, 16 nt, Homo sapiens
ucaccauaaaaaggaa

SEQ ID NO: 837256 - RNA, 17 nt, Homo sapiens
ucacccccaaacaguga

SEQ ID NO: 837257 - RNA, 21 nt, Homo sapiens
ucaccuaagucucugugaauu

SEQ ID NO: 837258 - RNA, 16 nt, Homo sapiens
ucaccuacccaugacc

SEQ ID NO: 837259 - RNA, 15 nt, Homo sapiens
ucacugaacuuugcu

SEQ ID NO: 837260 - RNA, 19 nt, Homo sapiens
ucacuggaacucaguguga

SEQ ID NO: 837261 - RNA, 19 nt, Homo sapiens
ucacuugugccaacacuca

SEQ ID NO: 837262 - RNA, 19 nt, Homo sapiens
ucagagagggcaggcauga

SEQ ID NO: 837263 - RNA, 18 nt, Homo sapiens
ucagauuccgcaccaaua

SEQ ID NO: 837264 - RNA, 17 nt, Homo sapiens
ucagcaacaaccagcau

SEQ ID NO: 837265 - RNA, 19 nt, Homo sapiens
ucagcaauacagacuacuu

SEQ ID NO: 837266 - RNA, 15 nt, Homo sapiens
ucagcaggagccaau

SEQ ID NO: 837267 - RNA, 14 nt, Homo sapiens
ucagccuugcaaau

SEQ ID NO: 837268 - RNA, 16 nt, Homo sapiens
ucagcucacuguucua

SEQ ID NO: 837269 - RNA, 15 nt, Homo sapiens
ucaggcaacgcacaa

SEQ ID NO: 837270 - RNA, 14 nt, Homo sapiens
ucaggccaucauca

SEQ ID NO: 837271 - RNA, 18 nt, Homo sapiens
ucaguaagacgacaagga

SEQ ID NO: 837272 - RNA, 17 nt, Homo sapiens
ucagucacaaguuacag

SEQ ID NO: 837273 - RNA, 14 nt, Homo sapiens
ucagugcaggagag

SEQ ID NO: 837274 - RNA, 15 nt, Homo sapiens
ucaguuaagccuuug

SEQ ID NO: 837275 - RNA, 20 nt, Homo sapiens
ucauaaggcauauacaaaua

SEQ ID NO: 837276 - RNA, 12 nt, Homo sapiens
ucauaccacaau

SEQ ID NO: 837277 - RNA, 15 nt, Homo sapiens
ucauacucaccucac

SEQ ID NO: 837278 - RNA, 15 nt, Homo sapiens
ucauacuuaacuuua

SEQ ID NO: 837279 - RNA, 19 nt, Homo sapiens
ucaucaggagaaaaagccu

SEQ ID NO: 837280 - RNA, 21 nt, Homo sapiens
ucaucaguggagccauguuaa

SEQ ID NO: 837281 - RNA, 23 nt, Homo sapiens
ucauggacugaguuuauacucac

SEQ ID NO: 837282 - RNA, 20 nt, Homo sapiens
ucaugugaucacaauuugca

SEQ ID NO: 837283 - RNA, 17 nt, Homo sapiens
ucauuaucaguccaaag

SEQ ID NO: 837284 - RNA, 15 nt, Homo sapiens
aggcugaaagacagg

SEQ ID NO: 837285 - RNA, 17 nt, Homo sapiens
aggcugagccugcucau

SEQ ID NO: 837286 - RNA, 16 nt, Homo sapiens
aggcugccugcuaugu

SEQ ID NO: 837287 - RNA, 20 nt, Homo sapiens
aggcugccugcuauguauuu

SEQ ID NO: 837288 - RNA, 17 nt, Homo sapiens
agggaaaacauuccauc

SEQ ID NO: 837289 - RNA, 18 nt, Homo sapiens
agggaaaacauuccaucc

SEQ ID NO: 837290 - RNA, 19 nt, Homo sapiens
agggagggcuccagacaca

SEQ ID NO: 837291 - RNA, 23 nt, Homo sapiens
agggcaagaaauggcgucugcuc

SEQ ID NO: 837292 - RNA, 14 nt, Homo sapiens
aggggcuggcacug

SEQ ID NO: 837293 - RNA, 18 nt, Homo sapiens
agguaaggaauaccuguc

SEQ ID NO: 837294 - RNA, 19 nt, Homo sapiens
aggugcguguucagcagaa

SEQ ID NO: 837295 - RNA, 20 nt, Homo sapiens
aggugggaggauugcuugag

SEQ ID NO: 837296 - RNA, 15 nt, Homo sapiens
agguggggucacucu

SEQ ID NO: 837297 - RNA, 13 nt, Homo sapiens
agguuaagcacuu

SEQ ID NO: 837298 - RNA, 18 nt, Homo sapiens
agguuuuuaagccuuaaa

SEQ ID NO: 837299 - RNA, 16 nt, Homo sapiens
aguaaaaaucaauacc

SEQ ID NO: 837300 - RNA, 21 nt, Homo sapiens
aguaaagugaagaauuuaucu

SEQ ID NO: 837301 - RNA, 12 nt, Homo sapiens
aguaaguacaaa

SEQ ID NO: 837302 - RNA, 18 nt, Homo sapiens
aguaaguacaaauauucc

SEQ ID NO: 837303 - RNA, 21 nt, Homo sapiens
aguaaucucacagcauuugcc

SEQ ID NO: 837304 - RNA, 23 nt, Homo sapiens
aguaaucucacagcauuugccaa

SEQ ID NO: 837305 - RNA, 13 nt, Homo sapiens
aguagacaagcaa

SEQ ID NO: 837306 - RNA, 15 nt, Homo sapiens
aguaggaagacuuug

SEQ ID NO: 837307 - RNA, 19 nt, Homo sapiens
aguauacugggggcaaaau

SEQ ID NO: 837308 - RNA, 18 nt, Homo sapiens
aguaugaaaaugucauug

SEQ ID NO: 837309 - RNA, 20 nt, Homo sapiens
aguccaaggaaaccacagcu

SEQ ID NO: 837310 - RNA, 23 nt, Homo sapiens
aguccaaggaaaccacagcugcu

SEQ ID NO: 837311 - RNA, 15 nt, Homo sapiens
agucucugugaauug

SEQ ID NO: 837312 - RNA, 14 nt, Homo sapiens
agucuucuauuuau

SEQ ID NO: 837313 - RNA, 19 nt, Homo sapiens
agucuugcagcaggaucua

SEQ ID NO: 837314 - RNA, 17 nt, Homo sapiens
agugccuggccaaaggg

SEQ ID NO: 837315 - RNA, 22 nt, Homo sapiens
agugcuuguuccucucaucucc

SEQ ID NO: 837316 - RNA, 20 nt, Homo sapiens
agugggagcugaguggggga

SEQ ID NO: 837317 - RNA, 17 nt, Homo sapiens
aguggggcccauggaug

SEQ ID NO: 837318 - RNA, 15 nt, Homo sapiens
agugggggaucacag

SEQ ID NO: 837319 - RNA, 13 nt, Homo sapiens
agugguuacccag

SEQ ID NO: 837320 - RNA, 20 nt, Homo sapiens
aguuaaacuggcuuaacuua

SEQ ID NO: 837321 - RNA, 13 nt, Homo sapiens
aguuaggggagag

SEQ ID NO: 837322 - RNA, 20 nt, Homo sapiens
aguuaguuuuuaaucucucc

SEQ ID NO: 837323 - RNA, 21 nt, Homo sapiens
aguuccucauuagcauuuugc

SEQ ID NO: 837324 - RNA, 18 nt, Homo sapiens
aguuggucccccuuccau

SEQ ID NO: 837325 - RNA, 20 nt, Homo sapiens
aguuugagacaggagaccug

SEQ ID NO: 837326 - RNA, 18 nt, Homo sapiens
aguuuggaaguguuaacu

SEQ ID NO: 837327 - RNA, 17 nt, Homo sapiens
auaaaaccccaucucua

SEQ ID NO: 837328 - RNA, 13 nt, Homo sapiens
auaaaagcacuua

SEQ ID NO: 837329 - RNA, 17 nt, Homo sapiens
auaaaauuuuuauguaa

SEQ ID NO: 837330 - RNA, 19 nt, Homo sapiens
auaaagaaacuuuauucaa

SEQ ID NO: 837331 - RNA, 15 nt, Homo sapiens
auaaaguaugugcau

SEQ ID NO: 837332 - RNA, 12 nt, Homo sapiens
auaacuguuauu

SEQ ID NO: 837333 - RNA, 14 nt, Homo sapiens
auaaucaacugggc

SEQ ID NO: 837334 - RNA, 15 nt, Homo sapiens
auacaguaucucagg

SEQ ID NO: 837335 - RNA, 21 nt, Homo sapiens
auacauugauucaugucucac

SEQ ID NO: 837336 - RNA, 22 nt, Homo sapiens
auaccaaccugaagacaccguu

SEQ ID NO: 837337 - RNA, 23 nt, Homo sapiens
auaccacaauaaaaaaaaaccua

SEQ ID NO: 837338 - RNA, 15 nt, Homo sapiens
auaccuaauugugga

SEQ ID NO: 837339 - RNA, 12 nt, Homo sapiens
auagcucuugcu

SEQ ID NO: 837340 - RNA, 17 nt, Homo sapiens
auaggcccagugagaug

SEQ ID NO: 837341 - RNA, 21 nt, Homo sapiens
auagugucugaugaauguuaa

SEQ ID NO: 837342 - RNA, 12 nt, Homo sapiens
auauacaucaua

SEQ ID NO: 837343 - RNA, 19 nt, Homo sapiens
auauauagaaggacugcag

SEQ ID NO: 837344 - RNA, 14 nt, Homo sapiens
auauauuaagugac

SEQ ID NO: 837345 - RNA, 17 nt, Homo sapiens
ccaugucucgacucauc

SEQ ID NO: 837346 - RNA, 13 nt, Homo sapiens
ccauuacuguaau

SEQ ID NO: 837347 - RNA, 22 nt, Homo sapiens
ccauucuggaagugacuuuggc

SEQ ID NO: 837348 - RNA, 22 nt, Homo sapiens
cccaaaagcccauucauuccau

SEQ ID NO: 837349 - RNA, 17 nt, Homo sapiens
cccaauauuuaccagac

SEQ ID NO: 837350 - RNA, 10 nt, Homo sapiens
cccacuuuga

SEQ ID NO: 837351 - RNA, 12 nt, Homo sapiens
cccacuuugaag

SEQ ID NO: 837352 - RNA, 15 nt, Homo sapiens
cccacuuugaagggc

SEQ ID NO: 837353 - RNA, 18 nt, Homo sapiens
cccaugcagacaugagug

SEQ ID NO: 837354 - RNA, 17 nt, Homo sapiens
ccccaaguuaguucaau

SEQ ID NO: 837355 - RNA, 13 nt, Homo sapiens
ccccucuccuccg

SEQ ID NO: 837356 - RNA, 17 nt, Homo sapiens
cccgcagggccaugcag

SEQ ID NO: 837357 - RNA, 15 nt, Homo sapiens
cccggccucucacaa

SEQ ID NO: 837358 - RNA, 21 nt, Homo sapiens
cccuauugcugcuugaggcaa

SEQ ID NO: 837359 - RNA, 23 nt, Homo sapiens
cccucaacaccucugcacaagcu

SEQ ID NO: 837360 - RNA, 17 nt, Homo sapiens
cccuccaugugagaaua

SEQ ID NO: 837361 - RNA, 19 nt, Homo sapiens
cccuggagaugucacagau

SEQ ID NO: 837362 - RNA, 20 nt, Homo sapiens
cccuggagcccauccagucu

SEQ ID NO: 837363 - RNA, 14 nt, Homo sapiens
cccuggggacagca

SEQ ID NO: 837364 - RNA, 13 nt, Homo sapiens
cccuucugcugua

SEQ ID NO: 837365 - RNA, 15 nt, Homo sapiens
cccuuggacauuuua

SEQ ID NO: 837366 - RNA, 17 nt, Homo sapiens
cccuugucgugggaugg

SEQ ID NO: 837367 - RNA, 15 nt, Homo sapiens
cccuuuccaaaggcc

SEQ ID NO: 837368 - RNA, 17 nt, Homo sapiens
ccgagccuggcuccaaa

SEQ ID NO: 837369 - RNA, 13 nt, Homo sapiens
ccgaggacaugaa

SEQ ID NO: 837370 - RNA, 19 nt, Homo sapiens
ccgcaccaauaaagccuuc

SEQ ID NO: 837371 - RNA, 17 nt, Homo sapiens
ccuagcacacacuuuug

SEQ ID NO: 837372 - RNA, 15 nt, Homo sapiens
ccuaggcauuugcug

SEQ ID NO: 837373 - RNA, 19 nt, Homo sapiens
ccuagggccacugaagaua

SEQ ID NO: 837374 - RNA, 14 nt, Homo sapiens
ccucagcuuugaua

SEQ ID NO: 837375 - RNA, 14 nt, Homo sapiens
ccucaggcaggugg

SEQ ID NO: 837376 - RNA, 21 nt, Homo sapiens
ccucaguaagacgacaaggaa

SEQ ID NO: 837377 - RNA, 21 nt, Homo sapiens
ccucaguuuccugaccuauga

SEQ ID NO: 837378 - RNA, 20 nt, Homo sapiens
ccucaugcugugugacucaa

SEQ ID NO: 837379 - RNA, 13 nt, Homo sapiens
ccucauuagcauu

SEQ ID NO: 837380 - RNA, 20 nt, Homo sapiens
ccucauuagcauuuugcuaa

SEQ ID NO: 837381 - RNA, 22 nt, Homo sapiens
ccuccaggauagacuuuuccca

SEQ ID NO: 837382 - RNA, 15 nt, Homo sapiens
ccuccaggugcacaa

SEQ ID NO: 837383 - RNA, 19 nt, Homo sapiens
ccuccaugaauaucaguua

SEQ ID NO: 837384 - RNA, 17 nt, Homo sapiens
ccucccuucaugcaugg

SEQ ID NO: 837385 - RNA, 16 nt, Homo sapiens
ccucgcccuccacaaa

SEQ ID NO: 837386 - RNA, 14 nt, Homo sapiens
ccucucaaccaccu

SEQ ID NO: 837387 - RNA, 21 nt, Homo sapiens
ccucuucucuacucuagggaa

SEQ ID NO: 837388 - RNA, 20 nt, Homo sapiens
ccugccagccccugccauug

SEQ ID NO: 837389 - RNA, 21 nt, Homo sapiens
ccugcucauguaccucugauu

SEQ ID NO: 837390 - RNA, 13 nt, Homo sapiens
ccuggaagacaga

SEQ ID NO: 837391 - RNA, 22 nt, Homo sapiens
ccuggaugcagccucacagucc

SEQ ID NO: 837392 - RNA, 12 nt, Homo sapiens
ccuggcaagaau

SEQ ID NO: 837393 - RNA, 20 nt, Homo sapiens
ccuggcacuggaugcagaaa

SEQ ID NO: 837394 - RNA, 20 nt, Homo sapiens
ccuggcccacugcaucguuu

SEQ ID NO: 837395 - RNA, 20 nt, Homo sapiens
ccuggcugaaggacugugac

SEQ ID NO: 837396 - RNA, 15 nt, Homo sapiens
ccugggcaaugugau

SEQ ID NO: 837397 - RNA, 22 nt, Homo sapiens
ccugggugacagagcaagugag

SEQ ID NO: 837398 - RNA, 14 nt, Homo sapiens
ccugugaaauacca

SEQ ID NO: 837399 - RNA, 20 nt, Homo sapiens
ccuuaacacugagcugucau

SEQ ID NO: 837400 - RNA, 19 nt, Homo sapiens
ccuuaccacugcucugaug

SEQ ID NO: 837401 - RNA, 22 nt, Homo sapiens
ccuucaaguugagaacugguca

SEQ ID NO: 837402 - RNA, 17 nt, Homo sapiens
ccuuccaggggugggac

SEQ ID NO: 837403 - RNA, 15 nt, Homo sapiens
ccuucccaugaccca

SEQ ID NO: 837404 - RNA, 17 nt, Homo sapiens
ccuucccaugacccagg

SEQ ID NO: 837405 - RNA, 16 nt, Homo sapiens
ccuucccuccaagaag

SEQ ID NO: 837406 - RNA, 13 nt, Homo sapiens
ccuugagucaaaa

SEQ ID NO: 837407 - RNA, 18 nt, Homo sapiens
ccuugcaaauagccagug

SEQ ID NO: 837408 - RNA, 15 nt, Homo sapiens
ccuuuauucuggcag

SEQ ID NO: 837409 - RNA, 15 nt, Homo sapiens
ccuuucagagauaua

SEQ ID NO: 837410 - RNA, 19 nt, Homo sapiens
ccuuuugggaauaauagca

SEQ ID NO: 837411 - RNA, 17 nt, Homo sapiens
cgagccuggcuccaaac

SEQ ID NO: 837412 - RNA, 14 nt, Homo sapiens
cgcagccaugugau

SEQ ID NO: 837413 - RNA, 15 nt, Homo sapiens
cgcagggccaugcag

SEQ ID NO: 837414 - RNA, 22 nt, Homo sapiens
cuucucagaaggcaaaugacuu

SEQ ID NO: 837415 - RNA, 17 nt, Homo sapiens
cuucugcuguauacugu

SEQ ID NO: 837416 - RNA, 21 nt, Homo sapiens
cuucugcuguauacuguacug

SEQ ID NO: 837417 - RNA, 22 nt, Homo sapiens
cuucugcuguauacuguacuga

SEQ ID NO: 837418 - RNA, 12 nt, Homo sapiens
cuucuguauuca

SEQ ID NO: 837419 - RNA, 15 nt, Homo sapiens
cuucuguauucacuu

SEQ ID NO: 837420 - RNA, 16 nt, Homo sapiens
cuucuuacaaugcauu

SEQ ID NO: 837421 - RNA, 18 nt, Homo sapiens
cuugaaaacacuguucuc

SEQ ID NO: 837422 - RNA, 21 nt, Homo sapiens
cuugaaauagugucugaugaa

SEQ ID NO: 837423 - RNA, 16 nt, Homo sapiens
cuugaaguaaccuuau

SEQ ID NO: 837424 - RNA, 22 nt, Homo sapiens
cuugagaggguggaauauccaa

SEQ ID NO: 837425 - RNA, 21 nt, Homo sapiens
cuugauaagaccaccaccuca

SEQ ID NO: 837426 - RNA, 17 nt, Homo sapiens
cuugggagcaccgccug

SEQ ID NO: 837427 - RNA, 15 nt, Homo sapiens
cuugggcgggacaca

SEQ ID NO: 837428 - RNA, 21 nt, Homo sapiens
cuuguagucuuggcuaaggaa

SEQ ID NO: 837429 - RNA, 15 nt, Homo sapiens
cuugugaacccaaag

SEQ ID NO: 837430 - RNA, 16 nt, Homo sapiens
cuuuacauggaugcca

SEQ ID NO: 837431 - RNA, 18 nt, Homo sapiens
cuuucccucccuuccucu

SEQ ID NO: 837432 - RNA, 18 nt, Homo sapiens
cuuucugcuaucaaagag

SEQ ID NO: 837433 - RNA, 15 nt, Homo sapiens
cuuucugggaugcaa

SEQ ID NO: 837434 - RNA, 16 nt, Homo sapiens
cuuuggaaauacacag

SEQ ID NO: 837435 - RNA, 17 nt, Homo sapiens
cuuuggagaucaaggag

SEQ ID NO: 837436 - RNA, 21 nt, Homo sapiens
cuuuguuuagcccaaaaccaa

SEQ ID NO: 837437 - RNA, 16 nt, Homo sapiens
cuuuuccaaacccagg

SEQ ID NO: 837438 - RNA, 13 nt, Homo sapiens
cuuuugccauuga

SEQ ID NO: 837439 - RNA, 18 nt, Homo sapiens
cuuuuuuauacucaauca

SEQ ID NO: 837440 - RNA, 17 nt, Homo sapiens
gaaaacacuguucucug

SEQ ID NO: 837441 - RNA, 19 nt, Homo sapiens
gaaaaggaaggcucuucuc

SEQ ID NO: 837442 - RNA, 22 nt, Homo sapiens
gaaaaguggauggaagugucug

SEQ ID NO: 837443 - RNA, 17 nt, Homo sapiens
gaaaauaaaagcacuua

SEQ ID NO: 837444 - RNA, 21 nt, Homo sapiens
gaaaaugaagcccuauuacuu

SEQ ID NO: 837445 - RNA, 14 nt, Homo sapiens
gaaaauggccaugc

SEQ ID NO: 837446 - RNA, 15 nt, Homo sapiens
gaaaauguccucccu

SEQ ID NO: 837447 - RNA, 19 nt, Homo sapiens
gaaaauuggaacucuacuc

SEQ ID NO: 837448 - RNA, 20 nt, Homo sapiens
gaaaauuggaacucuacuca

SEQ ID NO: 837449 - RNA, 21 nt, Homo sapiens
gaaacaccccucugucuagga

SEQ ID NO: 837450 - RNA, 13 nt, Homo sapiens
gaaaccacagcug

SEQ ID NO: 837451 - RNA, 23 nt, Homo sapiens
gaaagaaaguugcacggcugcug

SEQ ID NO: 837452 - RNA, 17 nt, Homo sapiens
gaaagaggaagcuuucu

SEQ ID NO: 837453 - RNA, 22 nt, Homo sapiens
gaaagcacaggugggcuuccca

SEQ ID NO: 837454 - RNA, 22 nt, Homo sapiens
gaaagcaucugagcuaacuuau

SEQ ID NO: 837455 - RNA, 14 nt, Homo sapiens
gaaauagugucuga

SEQ ID NO: 837456 - RNA, 16 nt, Homo sapiens
gaaaucuuucucccuc

SEQ ID NO: 837457 - RNA, 11 nt, Homo sapiens
gaaaugcauuu

SEQ ID NO: 837458 - RNA, 20 nt, Homo sapiens
gaacauguuuuucuucuccc

SEQ ID NO: 837459 - RNA, 18 nt, Homo sapiens
gaacccuggcauuuggcc

SEQ ID NO: 837460 - RNA, 21 nt, Homo sapiens
gaacucaugagaaguugauau

SEQ ID NO: 837461 - RNA, 22 nt, Homo sapiens
gaacucugacaacagacuucug

SEQ ID NO: 837462 - RNA, 22 nt, Homo sapiens
gaacuugagcgugaaucuguau

SEQ ID NO: 837463 - RNA, 16 nt, Homo sapiens
gaacuuuaugcuguaa

SEQ ID NO: 837464 - RNA, 20 nt, Homo sapiens
gaacuuugcugagccuguaa

SEQ ID NO: 837465 - RNA, 15 nt, Homo sapiens
gaagauucuauguua

SEQ ID NO: 837466 - RNA, 12 nt, Homo sapiens
gaaggacuguga

SEQ ID NO: 837467 - RNA, 16 nt, Homo sapiens
gaaggcaaaugacuuu

SEQ ID NO: 837468 - RNA, 14 nt, Homo sapiens
gaaggcaaugccau

SEQ ID NO: 837469 - RNA, 13 nt, Homo sapiens
gaaguaaccuuau

SEQ ID NO: 837470 - RNA, 18 nt, Homo sapiens
gaauaauacaguaucuca

SEQ ID NO: 837471 - RNA, 15 nt, Homo sapiens
gaauacauaaaguau

SEQ ID NO: 837472 - RNA, 17 nt, Homo sapiens
gaauacauaaaguaugu

SEQ ID NO: 837473 - RNA, 19 nt, Homo sapiens
gaauaguucccuagucuau

SEQ ID NO: 837474 - RNA, 16 nt, Homo sapiens
gaaucacuucugagaa

SEQ ID NO: 837475 - RNA, 16 nt, Homo sapiens
gaaugggcagcucauc

SEQ ID NO: 837476 - RNA, 15 nt, Homo sapiens
gaauguaugugcaca

SEQ ID NO: 837477 - RNA, 13 nt, Homo sapiens
gaauuaugcuucc

SEQ ID NO: 837478 - RNA, 23 nt, Homo sapiens
gacaaugaugugaguacccagga

SEQ ID NO: 837479 - RNA, 20 nt, Homo sapiens
gacacaggaugaaggcaaug

SEQ ID NO: 837480 - RNA, 20 nt, Homo sapiens
gacaccaccacccuugccau

SEQ ID NO: 837481 - RNA, 21 nt, Homo sapiens
gacacucacacggacacucaa

SEQ ID NO: 837482 - RNA, 15 nt, Homo sapiens
gacagugccucuucc

SEQ ID NO: 837483 - RNA, 14 nt, Homo sapiens
gacaguuaaacugg

SEQ ID NO: 837484 - RNA, 15 nt, Homo sapiens
gaccacacuccagcu

SEQ ID NO: 837485 - RNA, 20 nt, Homo sapiens
gaccaggcaaagcaagugau

SEQ ID NO: 837486 - RNA, 15 nt, Homo sapiens
gaccaggcaauguga

SEQ ID NO: 837487 - RNA, 16 nt, Homo sapiens
gaccaggcaaugugac

SEQ ID NO: 837488 - RNA, 22 nt, Homo sapiens
gaccauaaccccggaagccaaa

SEQ ID NO: 837489 - RNA, 15 nt, Homo sapiens
gaccaucuacauaca

SEQ ID NO: 837490 - RNA, 20 nt, Homo sapiens
gacccagacaggacugcaga

SEQ ID NO: 837491 - RNA, 18 nt, Homo sapiens
gacccaugcugcccugug

SEQ ID NO: 837492 - RNA, 13 nt, Homo sapiens
gaccucagcuuug

SEQ ID NO: 837493 - RNA, 24 nt, Homo sapiens
gaccugucacgauugucaucagga

SEQ ID NO: 837494 - RNA, 14 nt, Homo sapiens
gaccuucuccuuca

SEQ ID NO: 837495 - RNA, 22 nt, Homo sapiens
gacgccaucccagccccaauga

SEQ ID NO: 837496 - RNA, 15 nt, Homo sapiens
gacgcuugugacagu

SEQ ID NO: 837497 - RNA, 14 nt, Homo sapiens
gacuagagcacaac

SEQ ID NO: 837498 - RNA, 18 nt, Homo sapiens
gacuauuugcuuauuuaa

SEQ ID NO: 837499 - RNA, 16 nt, Homo sapiens
gacucaaaacccaucu

SEQ ID NO: 837500 - RNA, 19 nt, Homo sapiens
gacugugauucuuagcaaa

SEQ ID NO: 837501 - RNA, 19 nt, Homo sapiens
gagaaaauaaaagcacuua

SEQ ID NO: 837502 - RNA, 14 nt, Homo sapiens
gagaacacugugaa

SEQ ID NO: 837503 - RNA, 23 nt, Homo sapiens
gagaauguuagaggaucccucuc

SEQ ID NO: 837504 - RNA, 21 nt, Homo sapiens
gagacaccaccacccuugcca

SEQ ID NO: 837505 - RNA, 22 nt, Homo sapiens
gagacaccaccacccuugccau

SEQ ID NO: 837506 - RNA, 12 nt, Homo sapiens
gagacagucacc

SEQ ID NO: 837507 - RNA, 22 nt, Homo sapiens
gagaccaggcaaagcaagugau

SEQ ID NO: 837508 - RNA, 17 nt, Homo sapiens
gagacuuuacauggaug

SEQ ID NO: 837509 - RNA, 13 nt, Homo sapiens
gagagaccaggca

SEQ ID NO: 837510 - RNA, 13 nt, Homo sapiens
gagagccuuccag

SEQ ID NO: 837511 - RNA, 17 nt, Homo sapiens
gagaggaaaaguggaug

SEQ ID NO: 837512 - RNA, 10 nt, Homo sapiens
gagauuuauu

SEQ ID NO: 837513 - RNA, 11 nt, Homo sapiens
gagcaaaggcu

SEQ ID NO: 837514 - RNA, 16 nt, Homo sapiens
gagcaaaggcugagaa

SEQ ID NO: 837515 - RNA, 21 nt, Homo sapiens
gagcaaaggcugagaacacug

SEQ ID NO: 837516 - RNA, 21 nt, Homo sapiens
gagcaaaucaucugcauuccu

SEQ ID NO: 837517 - RNA, 16 nt, Homo sapiens
gagcacacuuggccca

SEQ ID NO: 837518 - RNA, 18 nt, Homo sapiens
gagccaccaaacccggcc

SEQ ID NO: 837519 - RNA, 18 nt, Homo sapiens
gagccauguuaauguaau

SEQ ID NO: 837520 - RNA, 23 nt, Homo sapiens
gagcccggaguggacugauuuuc

SEQ ID NO: 837521 - RNA, 16 nt, Homo sapiens
gagccuggcaagaaug

SEQ ID NO: 837522 - RNA, 17 nt, Homo sapiens
gagcgugaaucuguauc

SEQ ID NO: 837523 - RNA, 18 nt, Homo sapiens
gagcugacacaaaccugc

SEQ ID NO: 837524 - RNA, 11 nt, Homo sapiens
gagcugggaug

SEQ ID NO: 837525 - RNA, 23 nt, Homo sapiens
gagcuugaaauagugucugauga

SEQ ID NO: 837526 - RNA, 23 nt, Homo sapiens
gagcuugcuccagauucugaugc

SEQ ID NO: 837527 - RNA, 14 nt, Homo sapiens
gaggaaacuuugau

SEQ ID NO: 837528 - RNA, 14 nt, Homo sapiens
gaggagcagugcag

SEQ ID NO: 837529 - RNA, 22 nt, Homo sapiens
gaggaugcugacaucauuugua

SEQ ID NO: 837530 - RNA, 22 nt, Homo sapiens
gaggauguucgucucaguuugu

SEQ ID NO: 837531 - RNA, 23 nt, Homo sapiens
gaggcuuagcuuugcucugccaa

SEQ ID NO: 837532 - RNA, 16 nt, Homo sapiens
gagggcacacacugug

SEQ ID NO: 837533 - RNA, 21 nt, Homo sapiens
gagggugaggggcuggcacug

SEQ ID NO: 837534 - RNA, 15 nt, Homo sapiens
gaggugggauccucc

SEQ ID NO: 837535 - RNA, 15 nt, Homo sapiens
gagguuaagcacuuu

SEQ ID NO: 837536 - RNA, 18 nt, Homo sapiens
ccaugucucgacucaucc

SEQ ID NO: 837537 - RNA, 17 nt, Homo sapiens
ccaugugauuacccucu

SEQ ID NO: 837538 - RNA, 17 nt, Homo sapiens
ccauuucauuugugcca

SEQ ID NO: 837539 - RNA, 13 nt, Homo sapiens
cccaaacagugac

SEQ ID NO: 837540 - RNA, 11 nt, Homo sapiens
cccaagacauu

SEQ ID NO: 837541 - RNA, 22 nt, Homo sapiens
cccaagggccuggccugagcug

SEQ ID NO: 837542 - RNA, 21 nt, Homo sapiens
cccacgacugcccggcagggu

SEQ ID NO: 837543 - RNA, 22 nt, Homo sapiens
cccacucagccuuuugggaaua

SEQ ID NO: 837544 - RNA, 11 nt, Homo sapiens
cccacuuugaa

SEQ ID NO: 837545 - RNA, 20 nt, Homo sapiens
cccagcucugguccauagag

SEQ ID NO: 837546 - RNA, 22 nt, Homo sapiens
cccaggcccagaccuucuagga

SEQ ID NO: 837547 - RNA, 13 nt, Homo sapiens
ccccagcuuugca

SEQ ID NO: 837548 - RNA, 16 nt, Homo sapiens
ccccuguacauuugug

SEQ ID NO: 837549 - RNA, 19 nt, Homo sapiens
ccccuucauuuggcauucc

SEQ ID NO: 837550 - RNA, 21 nt, Homo sapiens
cccucaugcugugugacucaa

SEQ ID NO: 837551 - RNA, 19 nt, Homo sapiens
cccucuccuccguggcaca

SEQ ID NO: 837552 - RNA, 17 nt, Homo sapiens
cccugcaguuugagaca

SEQ ID NO: 837553 - RNA, 16 nt, Homo sapiens
cccugguucugaugau

SEQ ID NO: 837554 - RNA, 24 nt, Homo sapiens
cccugugaguuuguacagucuugc

SEQ ID NO: 837555 - RNA, 16 nt, Homo sapiens
cccuucaugcauggaa

SEQ ID NO: 837556 - RNA, 12 nt, Homo sapiens
ccgaacaccauu

SEQ ID NO: 837557 - RNA, 18 nt, Homo sapiens
ccgguguuuaagacauuu

SEQ ID NO: 837558 - RNA, 16 nt, Homo sapiens
ccuaaugcugcagauu

SEQ ID NO: 837559 - RNA, 23 nt, Homo sapiens
ccuacaguugaaaaacagcugag

SEQ ID NO: 837560 - RNA, 18 nt, Homo sapiens
ccuacucuuccaucuuuc

SEQ ID NO: 837561 - RNA, 13 nt, Homo sapiens
ccuacuuuugcca

SEQ ID NO: 837562 - RNA, 16 nt, Homo sapiens
ccuaguuccaccauca

SEQ ID NO: 837563 - RNA, 14 nt, Homo sapiens
ccuaucuuugccac

SEQ ID NO: 837564 - RNA, 13 nt, Homo sapiens
ccucaaacacugc

SEQ ID NO: 837565 - RNA, 21 nt, Homo sapiens
ccucagauuccgcaccaauaa

SEQ ID NO: 837566 - RNA, 17 nt, Homo sapiens
ccucaggcaggugggau

SEQ ID NO: 837567 - RNA, 23 nt, Homo sapiens
ccucagggucccugguggcagcu

SEQ ID NO: 837568 - RNA, 13 nt, Homo sapiens
ccucaugcccagc

SEQ ID NO: 837569 - RNA, 19 nt, Homo sapiens
ccuccaggauagacuuuuc

SEQ ID NO: 837570 - RNA, 16 nt, Homo sapiens
ccucccugaguggucc

SEQ ID NO: 837571 - RNA, 18 nt, Homo sapiens
ccucgaggcggaucuuug

SEQ ID NO: 837572 - RNA, 18 nt, Homo sapiens
ccucuauauauacaucau

SEQ ID NO: 837573 - RNA, 14 nt, Homo sapiens
ccucucacaaaaga

SEQ ID NO: 837574 - RNA, 18 nt, Homo sapiens
cugcaugcgagugcucau

SEQ ID NO: 837575 - RNA, 18 nt, Homo sapiens
cugccauuucugagauca

SEQ ID NO: 837576 - RNA, 16 nt, Homo sapiens
cugccugcccugguga

SEQ ID NO: 837577 - RNA, 18 nt, Homo sapiens
cugcgucucauacucacc

SEQ ID NO: 837578 - RNA, 18 nt, Homo sapiens
cugcuaaauaaacaugug

SEQ ID NO: 837579 - RNA, 12 nt, Homo sapiens
cugcuccagcug

SEQ ID NO: 837580 - RNA, 16 nt, Homo sapiens
cugcuccagugcagga

SEQ ID NO: 837581 - RNA, 18 nt, Homo sapiens
cugcugcuccagugcagg

SEQ ID NO: 837582 - RNA, 19 nt, Homo sapiens
cugcuggauucaagugauc

SEQ ID NO: 837583 - RNA, 21 nt, Homo sapiens
cugcuguggcgugagggugag

SEQ ID NO: 837584 - RNA, 20 nt, Homo sapiens
cuggaacagauucacacugu

SEQ ID NO: 837585 - RNA, 22 nt, Homo sapiens
cuggaacucagugugacuccuc

SEQ ID NO: 837586 - RNA, 20 nt, Homo sapiens
cuggagcccauccagucucc

SEQ ID NO: 837587 - RNA, 16 nt, Homo sapiens
cuggcacuugggacaa

SEQ ID NO: 837588 - RNA, 16 nt, Homo sapiens
cuggcuccaaacccuc

SEQ ID NO: 837589 - RNA, 14 nt, Homo sapiens
cuggcugauuauca

SEQ ID NO: 837590 - RNA, 17 nt, Homo sapiens
cugggcauagaugcagg

SEQ ID NO: 837591 - RNA, 16 nt, Homo sapiens
cuggguuccugcaaug

SEQ ID NO: 837592 - RNA, 18 nt, Homo sapiens
cuggucuauauaaccaca

SEQ ID NO: 837593 - RNA, 13 nt, Homo sapiens
cuguaucugugua

SEQ ID NO: 837594 - RNA, 12 nt, Homo sapiens
cuguauuugcca

SEQ ID NO: 837595 - RNA, 11 nt, Homo sapiens
cugucuaggac

SEQ ID NO: 837596 - RNA, 17 nt, Homo sapiens
cugucuuaaguuuauac

SEQ ID NO: 837597 - RNA, 22 nt, Homo sapiens
cugugacucgagucacacucaa

SEQ ID NO: 837598 - RNA, 22 nt, Homo sapiens
cuguucuauucaucucaaggaa

SEQ ID NO: 837599 - RNA, 15 nt, Homo sapiens
cuguuucugaaccau

SEQ ID NO: 837600 - RNA, 23 nt, Homo sapiens
cuuaaaccgccaaggcuggggga

SEQ ID NO: 837601 - RNA, 15 nt, Homo sapiens
cuuaacucaccauaa

SEQ ID NO: 837602 - RNA, 15 nt, Homo sapiens
cuuaacucauugcaa

SEQ ID NO: 837603 - RNA, 17 nt, Homo sapiens
cuuaagagaugccucau

SEQ ID NO: 837604 - RNA, 15 nt, Homo sapiens
cuuacuuaggugugg

SEQ ID NO: 837605 - RNA, 14 nt, Homo sapiens
cuuacuuuaacccu

SEQ ID NO: 837606 - RNA, 14 nt, Homo sapiens
cuuagaaaaaccac

SEQ ID NO: 837607 - RNA, 14 nt, Homo sapiens
cuuaggcaugacug

SEQ ID NO: 837608 - RNA, 15 nt, Homo sapiens
cuuauccuccaugaa

SEQ ID NO: 837609 - RNA, 21 nt, Homo sapiens
cuucagagcugacacaggaug

SEQ ID NO: 837610 - RNA, 20 nt, Homo sapiens
cuuccuggcuccaacacugc

SEQ ID NO: 837611 - RNA, 19 nt, Homo sapiens
cuucugcuguauacuguac

SEQ ID NO: 837612 - RNA, 16 nt, Homo sapiens
cuucuguauucacuua

SEQ ID NO: 837613 - RNA, 19 nt, Homo sapiens
cuucuucagagcugacaca

SEQ ID NO: 837614 - RNA, 15 nt, Homo sapiens
cuugagcgugaaucu

SEQ ID NO: 837615 - RNA, 15 nt, Homo sapiens
cuugaggauugugga

SEQ ID NO: 837616 - RNA, 16 nt, Homo sapiens
cuugaggcaacucauc

SEQ ID NO: 837617 - RNA, 20 nt, Homo sapiens
cuugcaaauagccagugcua

SEQ ID NO: 837618 - RNA, 21 nt, Homo sapiens
cuuggaaauuggaagagcaca

SEQ ID NO: 837619 - RNA, 18 nt, Homo sapiens
cuuggcacucaggugcug

SEQ ID NO: 837620 - RNA, 14 nt, Homo sapiens
cuuggcuaaggaaa

SEQ ID NO: 837621 - RNA, 22 nt, Homo sapiens
cuuggggaaaauggccaugcag

SEQ ID NO: 837622 - RNA, 16 nt, Homo sapiens
cuugguaaucaugaaa

SEQ ID NO: 837623 - RNA, 19 nt, Homo sapiens
cuuguaaggcauacugccu

SEQ ID NO: 837624 - RNA, 23 nt, Homo sapiens
cuuguaaugguucuuuacacauc

SEQ ID NO: 837625 - RNA, 13 nt, Homo sapiens
cuugucugcuaaa

SEQ ID NO: 837626 - RNA, 18 nt, Homo sapiens
cuugucuuuggacccuga

SEQ ID NO: 837627 - RNA, 22 nt, Homo sapiens
cuuuaaaaagcuccaaaugcag

SEQ ID NO: 837628 - RNA, 15 nt, Homo sapiens
cuuuaaaacuuaucc

SEQ ID NO: 837629 - RNA, 15 nt, Homo sapiens
cuuuaagaacuaaaa

SEQ ID NO: 837630 - RNA, 23 nt, Homo sapiens
cuuuccccaugucucgacucauc

SEQ ID NO: 837631 - RNA, 22 nt, Homo sapiens
cuuuccuuguuccccaucaucu

SEQ ID NO: 837632 - RNA, 21 nt, Homo sapiens
cuuucucaggaccuaguugcu

SEQ ID NO: 837633 - RNA, 19 nt, Homo sapiens
cuuucugcuaucaaagagg

SEQ ID NO: 837634 - RNA, 23 nt, Homo sapiens
cuuugcagaaugaugcagguuca

SEQ ID NO: 837635 - RNA, 20 nt, Homo sapiens
cuuugcugagccuguaaaau

SEQ ID NO: 837636 - RNA, 13 nt, Homo sapiens
cuuuggacacuca

SEQ ID NO: 837637 - RNA, 19 nt, Homo sapiens
cuuuggacagaagcagcuc

SEQ ID NO: 837638 - RNA, 16 nt, Homo sapiens
cuuuggagaucaagga

SEQ ID NO: 837639 - RNA, 22 nt, Homo sapiens
cuuuggcaaauaaaccuccuaa

SEQ ID NO: 837640 - RNA, 21 nt, Homo sapiens
cuuuguuuguugucagcugaa

SEQ ID NO: 837641 - RNA, 16 nt, Homo sapiens
cuuuuauuuccaguga

SEQ ID NO: 837642 - RNA, 14 nt, Homo sapiens
cuuuuucacuuuga

SEQ ID NO: 837643 - RNA, 21 nt, Homo sapiens
cuuuuuuggcugcugaaggcu

SEQ ID NO: 837644 - RNA, 14 nt, Homo sapiens
cuuuuuugucccau

SEQ ID NO: 837645 - RNA, 13 nt, Homo sapiens
gaaaaacauuuca

SEQ ID NO: 837646 - RNA, 19 nt, Homo sapiens
gaaaaaccaccaccaucac

SEQ ID NO: 837647 - RNA, 16 nt, Homo sapiens
gaaaacugguuaauau

SEQ ID NO: 837648 - RNA, 23 nt, Homo sapiens
gaaaaggaaggcucuucucccca

SEQ ID NO: 837649 - RNA, 16 nt, Homo sapiens
gaaaauggccaugcag

SEQ ID NO: 837650 - RNA, 23 nt, Homo sapiens
gaaagcuauaucaaucucucuua

SEQ ID NO: 837651 - RNA, 22 nt, Homo sapiens
gaaaggcaaaugcccaagggaa

SEQ ID NO: 837652 - RNA, 17 nt, Homo sapiens
gaaauagugucugauga

SEQ ID NO: 837653 - RNA, 22 nt, Homo sapiens
gaaaucuuucucccucaacuga

SEQ ID NO: 837654 - RNA, 15 nt, Homo sapiens
gaaaugcauuuugcu

SEQ ID NO: 837655 - RNA, 22 nt, Homo sapiens
gaaauguucguuuucuccugcc

SEQ ID NO: 837656 - RNA, 20 nt, Homo sapiens
gaaauucuaacgcaaaaaua

SEQ ID NO: 837657 - RNA, 23 nt, Homo sapiens
gaaauuuagcauuguagugcuuu

SEQ ID NO: 837658 - RNA, 18 nt, Homo sapiens
gaacagguaguauuacac

SEQ ID NO: 837659 - RNA, 15 nt, Homo sapiens
cagcuccacaguguu

SEQ ID NO: 837660 - RNA, 17 nt, Homo sapiens
cagcugugacaauggca

SEQ ID NO: 837661 - RNA, 23 nt, Homo sapiens
cagcuguguucacacuguaaaca

SEQ ID NO: 837662 - RNA, 13 nt, Homo sapiens
cagcuuucuggga

SEQ ID NO: 837663 - RNA, 23 nt, Homo sapiens
cagcuuuguuuguugucagcuga

SEQ ID NO: 837664 - RNA, 13 nt, Homo sapiens
caggaagcucagg

SEQ ID NO: 837665 - RNA, 18 nt, Homo sapiens
caggagaccuggcacugg

SEQ ID NO: 837666 - RNA, 17 nt, Homo sapiens
caggauuuaaguuucac

SEQ ID NO: 837667 - RNA, 18 nt, Homo sapiens
caggcaacgcacaaaaca

SEQ ID NO: 837668 - RNA, 20 nt, Homo sapiens
caggcaacgcacaaaacaga

SEQ ID NO: 837669 - RNA, 23 nt, Homo sapiens
caggcaaugugacuuugcaucag

SEQ ID NO: 837670 - RNA, 20 nt, Homo sapiens
caggccaccccgcugaugga

SEQ ID NO: 837671 - RNA, 15 nt, Homo sapiens
caggcguucagcuca

SEQ ID NO: 837672 - RNA, 21 nt, Homo sapiens
cagguacugauccuguuucuu

SEQ ID NO: 837673 - RNA, 19 nt, Homo sapiens
cagguaguauuacaccacc

SEQ ID NO: 837674 - RNA, 13 nt, Homo sapiens
caggugaagcacc

SEQ ID NO: 837675 - RNA, 22 nt, Homo sapiens
caggugcaacacucaagucuau

SEQ ID NO: 837676 - RNA, 18 nt, Homo sapiens
caguaagacgacaaggaa

SEQ ID NO: 837677 - RNA, 14 nt, Homo sapiens
caguagagaucuau

SEQ ID NO: 837678 - RNA, 22 nt, Homo sapiens
cagucaugguggccacggccac

SEQ ID NO: 837679 - RNA, 15 nt, Homo sapiens
cagugaacauuccca

SEQ ID NO: 837680 - RNA, 14 nt, Homo sapiens
cagugagaugcauu

SEQ ID NO: 837681 - RNA, 17 nt, Homo sapiens
caguggcgcaaucuuaa

SEQ ID NO: 837682 - RNA, 15 nt, Homo sapiens
caguguccaaagcag

SEQ ID NO: 837683 - RNA, 13 nt, Homo sapiens
caguguugccaga

SEQ ID NO: 837684 - RNA, 20 nt, Homo sapiens
caguuauuuuuaaacuguaa

SEQ ID NO: 837685 - RNA, 17 nt, Homo sapiens
caguuuggaaguguuaa

SEQ ID NO: 837686 - RNA, 19 nt, Homo sapiens
cauaaccgcugauucucag

SEQ ID NO: 837687 - RNA, 20 nt, Homo sapiens
cauaauucaggaagcagcuu

SEQ ID NO: 837688 - RNA, 21 nt, Homo sapiens
cauacauugauucaugucuca

SEQ ID NO: 837689 - RNA, 23 nt, Homo sapiens
cauacauugauucaugucucacg

SEQ ID NO: 837690 - RNA, 19 nt, Homo sapiens
cauaccacccaaugcugau

SEQ ID NO: 837691 - RNA, 22 nt, Homo sapiens
cauagagaauauaaaaauaaag

SEQ ID NO: 837692 - RNA, 15 nt, Homo sapiens
cauaggcccagugag

SEQ ID NO: 837693 - RNA, 23 nt, Homo sapiens
cauauuuaacaaaauuugaauag

SEQ ID NO: 837694 - RNA, 21 nt, Homo sapiens
cauauuuucuuuaaaagacaa

SEQ ID NO: 837695 - RNA, 19 nt, Homo sapiens
caucaaauggaagacacau

SEQ ID NO: 837696 - RNA, 19 nt, Homo sapiens
caucauuauuuauguauug

SEQ ID NO: 837697 - RNA, 17 nt, Homo sapiens
caucauuucacuuguca

SEQ ID NO: 837698 - RNA, 16 nt, Homo sapiens
aaacuacaaagcugaa

SEQ ID NO: 837699 - RNA, 16 nt, Homo sapiens
aaacuaguuacuaaac

SEQ ID NO: 837700 - RNA, 22 nt, Homo sapiens
aaacucaaaagaaggccacugu

SEQ ID NO: 837701 - RNA, 19 nt, Homo sapiens
aaacuggguuccugcaaug

SEQ ID NO: 837702 - RNA, 12 nt, Homo sapiens
aaagcaaauguc

SEQ ID NO: 837703 - RNA, 19 nt, Homo sapiens
aaagccuccaguccaagga

SEQ ID NO: 837704 - RNA, 15 nt, Homo sapiens
aaagggcaugggucg

SEQ ID NO: 837705 - RNA, 18 nt, Homo sapiens
aaagggcgcaaagggcau

SEQ ID NO: 837706 - RNA, 19 nt, Homo sapiens
aaauaaaauuuuuauguaa

SEQ ID NO: 837707 - RNA, 13 nt, Homo sapiens
aaauaaaccuccu

SEQ ID NO: 837708 - RNA, 23 nt, Homo sapiens
aaauacacagugcugaccagaca

SEQ ID NO: 837709 - RNA, 21 nt, Homo sapiens
aaauaucagugggcucucuua

SEQ ID NO: 837710 - RNA, 18 nt, Homo sapiens
aaaugggaaaaccagacu

SEQ ID NO: 837711 - RNA, 22 nt, Homo sapiens
aaaugucuucuguauucacuua

SEQ ID NO: 837712 - RNA, 12 nt, Homo sapiens
aaauguuucuca

SEQ ID NO: 837713 - RNA, 20 nt, Homo sapiens
aaauucaucaaauggaagac

SEQ ID NO: 837714 - RNA, 17 nt, Homo sapiens
aaauucccuucaucugg

SEQ ID NO: 837715 - RNA, 17 nt, Homo sapiens
aaauuugcuucacucaa

SEQ ID NO: 837716 - RNA, 16 nt, Homo sapiens
aacaagcaagcuccca

SEQ ID NO: 837717 - RNA, 12 nt, Homo sapiens
aacaggcaguug

SEQ ID NO: 837718 - RNA, 23 nt, Homo sapiens
aacaguagcuuagcaucagaggu

SEQ ID NO: 837719 - RNA, 15 nt, Homo sapiens
aacagucaucauuua

SEQ ID NO: 837720 - RNA, 20 nt, Homo sapiens
aacaugccagccacugugau

SEQ ID NO: 837721 - RNA, 20 nt, Homo sapiens
aacauguaagcauaacuuau

SEQ ID NO: 837722 - RNA, 14 nt, Homo sapiens
aacauguauguaaa

SEQ ID NO: 837723 - RNA, 21 nt, Homo sapiens
aacauucaucaagcuguacau

SEQ ID NO: 837724 - RNA, 10 nt, Homo sapiens
aacauuccau

SEQ ID NO: 837725 - RNA, 21 nt, Homo sapiens
aaccagagccugaguguugcc

SEQ ID NO: 837726 - RNA, 19 nt, Homo sapiens
aacccaaagugugacucau

SEQ ID NO: 837727 - RNA, 16 nt, Homo sapiens
aaccggucacccagga

SEQ ID NO: 837728 - RNA, 22 nt, Homo sapiens
aaccuacuagacaaugauguga

SEQ ID NO: 837729 - RNA, 19 nt, Homo sapiens
aaccucugagucaccaucu

SEQ ID NO: 837730 - RNA, 12 nt, Homo sapiens
aaccugccuccc

SEQ ID NO: 837731 - RNA, 20 nt, Homo sapiens
aaccuggguaacuagggaag

SEQ ID NO: 837732 - RNA, 14 nt, Homo sapiens
aacuaaacuuucac

SEQ ID NO: 837733 - RNA, 18 nt, Homo sapiens
aacucauugcaaccucca

SEQ ID NO: 837734 - RNA, 17 nt, Homo sapiens
aacucuacucaacccau

SEQ ID NO: 837735 - RNA, 23 nt, Homo sapiens
aacuggucagggcaaaccugccu

SEQ ID NO: 837736 - RNA, 12 nt, Homo sapiens
aacuuuccuuca

SEQ ID NO: 837737 - RNA, 20 nt, Homo sapiens
aacuuuccuucauucaaccc

SEQ ID NO: 837738 - RNA, 19 nt, Homo sapiens
aacuuugauaggaugugga

SEQ ID NO: 837739 - RNA, 13 nt, Homo sapiens
aagaaaaugaagc

SEQ ID NO: 837740 - RNA, 20 nt, Homo sapiens
aagaacuuggaggcaccauu

SEQ ID NO: 837741 - RNA, 13 nt, Homo sapiens
aagaaucuguuuc

SEQ ID NO: 837742 - RNA, 22 nt, Homo sapiens
aagaaucuucugccccagcuuu

SEQ ID NO: 837743 - RNA, 10 nt, Homo sapiens
aagacauuuu

SEQ ID NO: 837744 - RNA, 16 nt, Homo sapiens
aagaccaccaccucag

SEQ ID NO: 837745 - RNA, 16 nt, Homo sapiens
aagagaagcauucuca

SEQ ID NO: 837746 - RNA, 15 nt, Homo sapiens
aagagcuugcuccag

SEQ ID NO: 837747 - RNA, 20 nt, Homo sapiens
aagagggagggagggcucca

SEQ ID NO: 837748 - RNA, 20 nt, Homo sapiens
aagaugcuucucacugccau

SEQ ID NO: 837749 - RNA, 16 nt, Homo sapiens
aagcaaaugccugcca

SEQ ID NO: 837750 - RNA, 14 nt, Homo sapiens
aagcaaauggccaa

SEQ ID NO: 837751 - RNA, 16 nt, Homo sapiens
aagcaaaugucuuccu

SEQ ID NO: 837752 - RNA, 19 nt, Homo sapiens
aagcacagauguucuucaa

SEQ ID NO: 837753 - RNA, 20 nt, Homo sapiens
aagcauaaaaauuagccaag

SEQ ID NO: 837754 - RNA, 20 nt, Homo sapiens
aagcaucugagcuaacuuau

SEQ ID NO: 837755 - RNA, 20 nt, Homo sapiens
aagcugaagaaaaugaagcc

SEQ ID NO: 837756 - RNA, 16 nt, Homo sapiens
aagcuuuuaaugcucc

SEQ ID NO: 837757 - RNA, 23 nt, Homo sapiens
aaggaaacuggguuccugcaaug

SEQ ID NO: 837758 - RNA, 17 nt, Homo sapiens
aaggaagacaaugugaa

SEQ ID NO: 837759 - RNA, 13 nt, Homo sapiens
aaggaagguucug

SEQ ID NO: 837760 - RNA, 23 nt, Homo sapiens
aaggaagguucuggugugaacua

SEQ ID NO: 837761 - RNA, 19 nt, Homo sapiens
aaggaugaucuaggaagac

SEQ ID NO: 837762 - RNA, 20 nt, Homo sapiens
aaggccacuguuugucucac

SEQ ID NO: 837763 - RNA, 15 nt, Homo sapiens
aaggcugccugcuau

SEQ ID NO: 837764 - RNA, 20 nt, Homo sapiens
aaggcuugaaguaaccuuau

SEQ ID NO: 837765 - RNA, 16 nt, Homo sapiens
aagggauggugcccug

SEQ ID NO: 837766 - RNA, 11 nt, Homo sapiens
aaguaaucuca

SEQ ID NO: 837767 - RNA, 14 nt, Homo sapiens
aagucccagcauug

SEQ ID NO: 837768 - RNA, 19 nt, Homo sapiens
aagucucccaauauccaau

SEQ ID NO: 837769 - RNA, 13 nt, Homo sapiens
aagugaaacugcu

SEQ ID NO: 837770 - RNA, 21 nt, Homo sapiens
aaguuaguuuuuaaucucucc

SEQ ID NO: 837771 - RNA, 23 nt, Homo sapiens
aaguuaguuuuuaaucucuccac

SEQ ID NO: 837772 - RNA, 21 nt, Homo sapiens
aaguugauauagaacagugcu

SEQ ID NO: 837773 - RNA, 15 nt, Homo sapiens
gaacagugcuugcca

SEQ ID NO: 837774 - RNA, 12 nt, Homo sapiens
gaaccauaucaa

SEQ ID NO: 837775 - RNA, 16 nt, Homo sapiens
gaaccauuacuguaau

SEQ ID NO: 837776 - RNA, 18 nt, Homo sapiens
gaaccugcccugcuccca

SEQ ID NO: 837777 - RNA, 21 nt, Homo sapiens
gaaccugcccugcucccacag

SEQ ID NO: 837778 - RNA, 13 nt, Homo sapiens
gaacucaguguga

SEQ ID NO: 837779 - RNA, 21 nt, Homo sapiens
gaacugcuggauucaagugau

SEQ ID NO: 837780 - RNA, 22 nt, Homo sapiens
gaagaacagauaaucccuguau

SEQ ID NO: 837781 - RNA, 14 nt, Homo sapiens
gaagaaucuguuuc

SEQ ID NO: 837782 - RNA, 18 nt, Homo sapiens
gaagaauuuaucucuuua

SEQ ID NO: 837783 - RNA, 20 nt, Homo sapiens
gaagauccuaaaacaaaagc

SEQ ID NO: 837784 - RNA, 24 nt, Homo sapiens
gaagauccuaaaacaaaagcucau

SEQ ID NO: 837785 - RNA, 18 nt, Homo sapiens
gaagcaggcuacacugac

SEQ ID NO: 837786 - RNA, 22 nt, Homo sapiens
gaagcauuuuauaaaucgcuuu

SEQ ID NO: 837787 - RNA, 20 nt, Homo sapiens
gaagguggggacagggauga

SEQ ID NO: 837788 - RNA, 20 nt, Homo sapiens
gaagguucuacgccagggga

SEQ ID NO: 837789 - RNA, 15 nt, Homo sapiens
gaagucuucuauuua

SEQ ID NO: 837790 - RNA, 17 nt, Homo sapiens
gaauaaaauuauuccuu

SEQ ID NO: 837791 - RNA, 20 nt, Homo sapiens
gaauaagcuuuuaaugcucc

SEQ ID NO: 837792 - RNA, 19 nt, Homo sapiens
gaauacaaacaccuggacu

SEQ ID NO: 837793 - RNA, 13 nt, Homo sapiens
gacacaaaccugc

SEQ ID NO: 837794 - RNA, 23 nt, Homo sapiens
gacacaggccagcuccacagugu

SEQ ID NO: 837795 - RNA, 16 nt, Homo sapiens
gacacauguccaagaa

SEQ ID NO: 837796 - RNA, 17 nt, Homo sapiens
gacagcugccugggauc

SEQ ID NO: 837797 - RNA, 15 nt, Homo sapiens
gacagcuuucuggga

SEQ ID NO: 837798 - RNA, 12 nt, Homo sapiens
gacaggugaaug

SEQ ID NO: 837799 - RNA, 21 nt, Homo sapiens
gacaugcugaagccaaagcca

SEQ ID NO: 837800 - RNA, 13 nt, Homo sapiens
gacauucaugccu

SEQ ID NO: 837801 - RNA, 21 nt, Homo sapiens
gacauuuauuuuucucaugaa

SEQ ID NO: 837802 - RNA, 18 nt, Homo sapiens
gacauuuuaugucuuucu

SEQ ID NO: 837803 - RNA, 17 nt, Homo sapiens
gaccaggccugggccag

SEQ ID NO: 837804 - RNA, 19 nt, Homo sapiens
gaccagggauuuccaugau

SEQ ID NO: 837805 - RNA, 21 nt, Homo sapiens
gaccauaaccccggaagccaa

SEQ ID NO: 837806 - RNA, 14 nt, Homo sapiens
gacccaaccacaga

SEQ ID NO: 837807 - RNA, 23 nt, Homo sapiens
gacccacggagcccuuaugacau

SEQ ID NO: 837808 - RNA, 13 nt, Homo sapiens
gacccaugcaaua

SEQ ID NO: 837809 - RNA, 19 nt, Homo sapiens
gacccaugcaauauuuccu

SEQ ID NO: 837810 - RNA, 13 nt, Homo sapiens
gacccaugcugcc

SEQ ID NO: 837811 - RNA, 23 nt, Homo sapiens
gaccucagcuuugauauuucacu

SEQ ID NO: 837812 - RNA, 12 nt, Homo sapiens
gaccuucuagga

SEQ ID NO: 837813 - RNA, 20 nt, Homo sapiens
gaccuucuccuucaccuuug

SEQ ID NO: 837814 - RNA, 14 nt, Homo sapiens
gacucagccuugca

SEQ ID NO: 837815 - RNA, 22 nt, Homo sapiens
gacucuuuuuuugagugacagc

SEQ ID NO: 837816 - RNA, 14 nt, Homo sapiens
gacuucuucccaag

SEQ ID NO: 837817 - RNA, 17 nt, Homo sapiens
gacuuuucccaagccua

SEQ ID NO: 837818 - RNA, 23 nt, Homo sapiens
gagaaaaaauauuuuccugccag

SEQ ID NO: 837819 - RNA, 20 nt, Homo sapiens
gagaaaaagccuccagucca

SEQ ID NO: 837820 - RNA, 13 nt, Homo sapiens
gagaacacuguga

SEQ ID NO: 837821 - RNA, 18 nt, Homo sapiens
gagacgggguuugccaug

SEQ ID NO: 837822 - RNA, 22 nt, Homo sapiens
gagacuccuaggcaggacaugc

SEQ ID NO: 837823 - RNA, 17 nt, Homo sapiens
gagagccuggugcugcu

SEQ ID NO: 837824 - RNA, 22 nt, Homo sapiens
gagagucgcaucucagugcagg

SEQ ID NO: 837825 - RNA, 18 nt, Homo sapiens
gagauggggacaggugaa

SEQ ID NO: 837826 - RNA, 16 nt, Homo sapiens
gagcaccgccugugaa

SEQ ID NO: 837827 - RNA, 22 nt, Homo sapiens
gagcagccucagaacaaaguga

SEQ ID NO: 837828 - RNA, 19 nt, Homo sapiens
gagccaccaaacccggccu

SEQ ID NO: 837829 - RNA, 21 nt, Homo sapiens
gagccaccaaacccggccuga

SEQ ID NO: 837830 - RNA, 15 nt, Homo sapiens
gagcccauccagucu

SEQ ID NO: 837831 - RNA, 21 nt, Homo sapiens
gagccgagauugcaccacugc

SEQ ID NO: 837832 - RNA, 16 nt, Homo sapiens
gagccuggcuccaaac

SEQ ID NO: 837833 - RNA, 14 nt, Homo sapiens
gagccuuccagggg

SEQ ID NO: 837834 - RNA, 18 nt, Homo sapiens
gagcugguccccucuaua

SEQ ID NO: 837835 - RNA, 16 nt, Homo sapiens
gaggaguacaggugaa

SEQ ID NO: 837836 - RNA, 13 nt, Homo sapiens
gaggccacgugau

SEQ ID NO: 837837 - RNA, 21 nt, Homo sapiens
gaggccccuucuagguggcaa

SEQ ID NO: 837838 - RNA, 20 nt, Homo sapiens
gaggucaaggcugcagugag

SEQ ID NO: 837839 - RNA, 22 nt, Homo sapiens
gagguggauguuaugaacagcu

SEQ ID NO: 837840 - RNA, 15 nt, Homo sapiens
gagugacagcuuucu

SEQ ID NO: 837841 - RNA, 20 nt, Homo sapiens
gagugccuggccaaagggau

SEQ ID NO: 837842 - RNA, 23 nt, Homo sapiens
gagugcuagcuagccagcugugu

SEQ ID NO: 837843 - RNA, 23 nt, Homo sapiens
gagugggcccaaugcacuuuguu

SEQ ID NO: 837844 - RNA, 15 nt, Homo sapiens
gauauagaacagugc

SEQ ID NO: 837845 - RNA, 17 nt, Homo sapiens
gauauauuaagugacug

SEQ ID NO: 837846 - RNA, 19 nt, Homo sapiens
gaucagccugggcaaugug

SEQ ID NO: 837847 - RNA, 20 nt, Homo sapiens
gaucagccugggcaauguga

SEQ ID NO: 837848 - RNA, 22 nt, Homo sapiens
gauccuaaaacaaaagcucauc

SEQ ID NO: 837849 - RNA, 12 nt, Homo sapiens
gauccuccaggu

SEQ ID NO: 837850 - RNA, 22 nt, Homo sapiens
gaucuuaggcaugacuguagaa

SEQ ID NO: 837851 - RNA, 19 nt, Homo sapiens
gaucuuucauuuugcaccu

SEQ ID NO: 837852 - RNA, 13 nt, Homo sapiens
gauggauuuccag

SEQ ID NO: 837853 - RNA, 21 nt, Homo sapiens
gaugggggaaagcacaggugg

SEQ ID NO: 837854 - RNA, 21 nt, Homo sapiens
gauggguggggagcaaaucau

SEQ ID NO: 837855 - RNA, 15 nt, Homo sapiens
gauuacccucugggu

SEQ ID NO: 837856 - RNA, 13 nt, Homo sapiens
gauucuauguuaa

SEQ ID NO: 837857 - RNA, 11 nt, Homo sapiens
gauucucaggg

SEQ ID NO: 837858 - RNA, 18 nt, Homo sapiens
gauucuggcuagugucua

SEQ ID NO: 837859 - RNA, 21 nt, Homo sapiens
gcaaaaauagcucuugcuuug

SEQ ID NO: 837860 - RNA, 13 nt, Homo sapiens
gcaaacaggcagu

SEQ ID NO: 837861 - RNA, 23 nt, Homo sapiens
gcaaaggcugagaacacugugaa

SEQ ID NO: 837862 - RNA, 17 nt, Homo sapiens
gcaacagacaagugacu

SEQ ID NO: 837863 - RNA, 21 nt, Homo sapiens
gcaacaugccagccacuguga

SEQ ID NO: 837864 - RNA, 16 nt, Homo sapiens
gcaagcucccaaggga

SEQ ID NO: 837865 - RNA, 21 nt, Homo sapiens
gcaaucuucucagaaggcaaa

SEQ ID NO: 837866 - RNA, 21 nt, Homo sapiens
gcacauuuaagagacagucac

SEQ ID NO: 837867 - RNA, 16 nt, Homo sapiens
gcaccaauaaagccuu

SEQ ID NO: 837868 - RNA, 21 nt, Homo sapiens
gcaccuagaauuggcugaacu

SEQ ID NO: 837869 - RNA, 14 nt, Homo sapiens
gcacugcaugaaua

SEQ ID NO: 837870 - RNA, 21 nt, Homo sapiens
gcacugccugauggaccuguc

SEQ ID NO: 837871 - RNA, 15 nt, Homo sapiens
gcacuugggacaaaa

SEQ ID NO: 837872 - RNA, 18 nt, Homo sapiens
gcacuuuucugugucaua

SEQ ID NO: 837873 - RNA, 16 nt, Homo sapiens
gcagagagguuugcag

SEQ ID NO: 837874 - RNA, 13 nt, Homo sapiens
gcagccucuucaa

SEQ ID NO: 837875 - RNA, 19 nt, Homo sapiens
gcagccuggggucugacaa

SEQ ID NO: 837876 - RNA, 22 nt, Homo sapiens
gcaggaggcccuugucguggga

SEQ ID NO: 837877 - RNA, 13 nt, Homo sapiens
gcaggauucuucc

SEQ ID NO: 837878 - RNA, 14 nt, Homo sapiens
gcaggcgugaccug

SEQ ID NO: 837879 - RNA, 14 nt, Homo sapiens
gcaggcuacacuga

SEQ ID NO: 837880 - RNA, 13 nt, Homo sapiens
gcaguagacaagc

SEQ ID NO: 837881 - RNA, 23 nt, Homo sapiens
gcauaaagucagggguucccuuu

SEQ ID NO: 837882 - RNA, 19 nt, Homo sapiens
gcauacugccuuguuuaau

SEQ ID NO: 837883 - RNA, 14 nt, Homo sapiens
gcaucacagcuaac

SEQ ID NO: 837884 - RNA, 15 nt, Homo sapiens
gcaucauuauuuaug

SEQ ID NO: 837885 - RNA, 22 nt, Homo sapiens
gcaucccaggaucgcaagagcc

SEQ ID NO: 837886 - RNA, 20 nt, Homo sapiens
gcauugccuuuagugaucac

SEQ ID NO: 837887 - RNA, 23 nt, Homo sapiens
gccaaauaaagucucuuccucca

SEQ ID NO: 837888 - RNA, 22 nt, Homo sapiens
gccaaauuuuagauuuaccuug

SEQ ID NO: 837889 - RNA, 17 nt, Homo sapiens
gccaaccggucacccag

SEQ ID NO: 837890 - RNA, 19 nt, Homo sapiens
gccaagaucacaguggcca

SEQ ID NO: 837891 - RNA, 20 nt, Homo sapiens
gccaagcucaggaccaggca

SEQ ID NO: 837892 - RNA, 20 nt, Homo sapiens
gccaaggcuggagugcagug

SEQ ID NO: 837893 - RNA, 19 nt, Homo sapiens
gccacagggccuuuggcag

SEQ ID NO: 837894 - RNA, 19 nt, Homo sapiens
gccacagucaugguggcca

SEQ ID NO: 837895 - RNA, 23 nt, Homo sapiens
aggcuggucucgaacugcuggau

SEQ ID NO: 837896 - RNA, 19 nt, Homo sapiens
aggcuugaaguaaccuuau

SEQ ID NO: 837897 - RNA, 13 nt, Homo sapiens
agggaaaaaccag

SEQ ID NO: 837898 - RNA, 21 nt, Homo sapiens
agggauuuuagucacacgugg

SEQ ID NO: 837899 - RNA, 15 nt, Homo sapiens
agggcacacacugug

SEQ ID NO: 837900 - RNA, 13 nt, Homo sapiens
aggggcacagggu

SEQ ID NO: 837901 - RNA, 21 nt, Homo sapiens
agggucucccucuguugccaa

SEQ ID NO: 837902 - RNA, 19 nt, Homo sapiens
agguauuuauugagcaccu

SEQ ID NO: 837903 - RNA, 23 nt, Homo sapiens
agguccuggcaaagaugaucagu

SEQ ID NO: 837904 - RNA, 23 nt, Homo sapiens
aggucggaccagcuuuucccaaa

SEQ ID NO: 837905 - RNA, 19 nt, Homo sapiens
aggugaagcaccaagcuca

SEQ ID NO: 837906 - RNA, 20 nt, Homo sapiens
aggugggaggaucucuugag

SEQ ID NO: 837907 - RNA, 16 nt, Homo sapiens
agguggggacagggau

SEQ ID NO: 837908 - RNA, 15 nt, Homo sapiens
agguuaagcacuuua

SEQ ID NO: 837909 - RNA, 12 nt, Homo sapiens
agguucuacccu

SEQ ID NO: 837910 - RNA, 14 nt, Homo sapiens
agguuggcaaaaag

SEQ ID NO: 837911 - RNA, 15 nt, Homo sapiens
aguaaaaaucaauac

SEQ ID NO: 837912 - RNA, 13 nt, Homo sapiens
aguacaggugaag

SEQ ID NO: 837913 - RNA, 13 nt, Homo sapiens
aguaugugcauau

SEQ ID NO: 837914 - RNA, 20 nt, Homo sapiens
aguccagccuggagaugaaa

SEQ ID NO: 837915 - RNA, 13 nt, Homo sapiens
agucucugugaau

SEQ ID NO: 837916 - RNA, 17 nt, Homo sapiens
agucuguuuuaugacuu

SEQ ID NO: 837917 - RNA, 13 nt, Homo sapiens
agucuucuauuua

SEQ ID NO: 837918 - RNA, 16 nt, Homo sapiens
agucuuggcuaaggaa

SEQ ID NO: 837919 - RNA, 16 nt, Homo sapiens
agugagaugcauucuu

SEQ ID NO: 837920 - RNA, 21 nt, Homo sapiens
agugaggcugcacccacccag

SEQ ID NO: 837921 - RNA, 21 nt, Homo sapiens
agugcacaacauuacagggaa

SEQ ID NO: 837922 - RNA, 16 nt, Homo sapiens
agugcaggcacaguau

SEQ ID NO: 837923 - RNA, 20 nt, Homo sapiens
agugccuggccaaagggaua

SEQ ID NO: 837924 - RNA, 12 nt, Homo sapiens
agugcuaagcau

SEQ ID NO: 837925 - RNA, 14 nt, Homo sapiens
agugcuaagcauua

SEQ ID NO: 837926 - RNA, 18 nt, Homo sapiens
aguggauggaagugucug

SEQ ID NO: 837927 - RNA, 13 nt, Homo sapiens
agugggcucucuu

SEQ ID NO: 837928 - RNA, 16 nt, Homo sapiens
agugucugaugaaugu

SEQ ID NO: 837929 - RNA, 15 nt, Homo sapiens
agugugacucauuaa

SEQ ID NO: 837930 - RNA, 16 nt, Homo sapiens
aguuagagcugacaca

SEQ ID NO: 837931 - RNA, 19 nt, Homo sapiens
aguuaucaugcauguuaug

SEQ ID NO: 837932 - RNA, 22 nt, Homo sapiens
aguucagaaucacuucugagaa

SEQ ID NO: 837933 - RNA, 17 nt, Homo sapiens
aguugagaacuggucag

SEQ ID NO: 837934 - RNA, 14 nt, Homo sapiens
aguugauucagcuc

SEQ ID NO: 837935 - RNA, 15 nt, Homo sapiens
aguugauucagcucu

SEQ ID NO: 837936 - RNA, 19 nt, Homo sapiens
aguuugagaccaaccuggg

SEQ ID NO: 837937 - RNA, 23 nt, Homo sapiens
aguuuggaaguguuaacuauuua

SEQ ID NO: 837938 - RNA, 20 nt, Homo sapiens
auaacuuuguuuagcccaaa

SEQ ID NO: 837939 - RNA, 23 nt, Homo sapiens
auaauauuaaggaagacaaugug

SEQ ID NO: 837940 - RNA, 15 nt, Homo sapiens
auaauuaguuccuca

SEQ ID NO: 837941 - RNA, 16 nt, Homo sapiens
auacaguaucucaggg

SEQ ID NO: 837942 - RNA, 20 nt, Homo sapiens
auacauugauucaugucuca

SEQ ID NO: 837943 - RNA, 21 nt, Homo sapiens
auacccuccuuccaccaaguu

SEQ ID NO: 837944 - RNA, 13 nt, Homo sapiens
auacucaccucac

SEQ ID NO: 837945 - RNA, 18 nt, Homo sapiens
auacucaccucaccccac

SEQ ID NO: 837946 - RNA, 13 nt, Homo sapiens
auagaacagagaa

SEQ ID NO: 837947 - RNA, 22 nt, Homo sapiens
auaguucccuagucuauucauu

SEQ ID NO: 837948 - RNA, 16 nt, Homo sapiens
auauaaccacauuucu

SEQ ID NO: 837949 - RNA, 18 nt, Homo sapiens
auauauacaucauacuua

SEQ ID NO: 837950 - RNA, 13 nt, Homo sapiens
auauggacucagc

SEQ ID NO: 837951 - RNA, 17 nt, Homo sapiens
auauuuccucaugugau

SEQ ID NO: 837952 - RNA, 20 nt, Homo sapiens
auauuuuucccaggacuaga

SEQ ID NO: 837953 - RNA, 16 nt, Homo sapiens
aucacagccucugaaa

SEQ ID NO: 837954 - RNA, 19 nt, Homo sapiens
aucagaauggaaugcucug

SEQ ID NO: 837955 - RNA, 13 nt, Homo sapiens
aucaguccaaagg

SEQ ID NO: 837956 - RNA, 17 nt, Homo sapiens
aucaguccaaagggcau

SEQ ID NO: 837957 - RNA, 14 nt, Homo sapiens
aucaugcauguuau

SEQ ID NO: 837958 - RNA, 16 nt, Homo sapiens
auccagucucccaacu

SEQ ID NO: 837959 - RNA, 16 nt, Homo sapiens
auccagucuucacugg

SEQ ID NO: 837960 - RNA, 20 nt, Homo sapiens
auccauuugcguuccaugau

SEQ ID NO: 837961 - RNA, 17 nt, Homo sapiens
aucccuaaugcugcaga

SEQ ID NO: 837962 - RNA, 15 nt, Homo sapiens
aucccuggaaggaca

SEQ ID NO: 837963 - RNA, 16 nt, Homo sapiens
aucccuuuccaaaggc

SEQ ID NO: 837964 - RNA, 23 nt, Homo sapiens
auccuaaaugaguaaacccagcu

SEQ ID NO: 837965 - RNA, 23 nt, Homo sapiens
auccuaggcugacaccuaacucu

SEQ ID NO: 837966 - RNA, 18 nt, Homo sapiens
auccuguuuuuaaaccau

SEQ ID NO: 837967 - RNA, 13 nt, Homo sapiens
aucgcaagagcca

SEQ ID NO: 837968 - RNA, 18 nt, Homo sapiens
aucgcuuuugauaaucaa

SEQ ID NO: 837969 - RNA, 19 nt, Homo sapiens
aucuaggaagacuuuggaa

SEQ ID NO: 837970 - RNA, 12 nt, Homo sapiens
aucucagugcag

SEQ ID NO: 837971 - RNA, 19 nt, Homo sapiens
aucuccgucucccaaagug

SEQ ID NO: 837972 - RNA, 19 nt, Homo sapiens
aucucugucccacuuggca

SEQ ID NO: 837973 - RNA, 22 nt, Homo sapiens
aucucugucccacuuggcauca

SEQ ID NO: 837974 - RNA, 23 nt, Homo sapiens
aucugggcauagaugcaggugag

SEQ ID NO: 837975 - RNA, 21 nt, Homo sapiens
aucuguaagagcuugcuccag

SEQ ID NO: 837976 - RNA, 14 nt, Homo sapiens
aucuguaucuugcc

SEQ ID NO: 837977 - RNA, 23 nt, Homo sapiens
aucuuuggacagaagcagcucuu

SEQ ID NO: 837978 - RNA, 13 nt, Homo sapiens
augaaaaugucau

SEQ ID NO: 837979 - RNA, 15 nt, Homo sapiens
augaaagcacugcau

SEQ ID NO: 837980 - RNA, 14 nt, Homo sapiens
augacaucagcaau

SEQ ID NO: 837981 - RNA, 13 nt, Homo sapiens
augacauucaugc

SEQ ID NO: 837982 - RNA, 18 nt, Homo sapiens
augauacuucgacacugu

SEQ ID NO: 837983 - RNA, 22 nt, Homo sapiens
augauccuaggcauuugcugaa

SEQ ID NO: 837984 - RNA, 22 nt, Homo sapiens
augauuuccuggggcacagugg

SEQ ID NO: 837985 - RNA, 19 nt, Homo sapiens
augcagaccucaugcccag

SEQ ID NO: 837986 - RNA, 17 nt, Homo sapiens
augcauggaaauucccu

SEQ ID NO: 837987 - RNA, 18 nt, Homo sapiens
augcauggaaauucccuu

SEQ ID NO: 837988 - RNA, 14 nt, Homo sapiens
augcauuuuauaga

SEQ ID NO: 837989 - RNA, 21 nt, Homo sapiens
augccaagcacugugcucagg

SEQ ID NO: 837990 - RNA, 16 nt, Homo sapiens
augccagcuuaucuca

SEQ ID NO: 837991 - RNA, 18 nt, Homo sapiens
augccagcuuaucucagg

SEQ ID NO: 837992 - RNA, 19 nt, Homo sapiens
augccugccaaauuuuaga

SEQ ID NO: 837993 - RNA, 18 nt, Homo sapiens
augcgagugcucauuuca

SEQ ID NO: 837994 - RNA, 20 nt, Homo sapiens
auggagguuaagcacuuuaa

SEQ ID NO: 837995 - RNA, 16 nt, Homo sapiens
auggcauuuggucuca

SEQ ID NO: 837996 - RNA, 23 nt, Homo sapiens
auggcauuuggucucaggcagca

SEQ ID NO: 837997 - RNA, 17 nt, Homo sapiens
augggcagcucaucucu

SEQ ID NO: 837998 - RNA, 23 nt, Homo sapiens
auggucccaggcuucccaaaagu

SEQ ID NO: 837999 - RNA, 17 nt, Homo sapiens
auguacaguuauggauu

SEQ ID NO: 838000 - RNA, 12 nt, Homo sapiens
auguauuugcaa

SEQ ID NO: 838001 - RNA, 14 nt, Homo sapiens
augucacagauucc

SEQ ID NO: 838002 - RNA, 22 nt, Homo sapiens
augugauaaaaccccaucucua

SEQ ID NO: 838003 - RNA, 17 nt, Homo sapiens
auguuccgagaagaaca

SEQ ID NO: 838004 - RNA, 16 nt, Homo sapiens
auuaaccacuucagcu

SEQ ID NO: 838005 - RNA, 22 nt, Homo sapiens
auuaaggauuuuaugcuuuaaa

SEQ ID NO: 838006 - RNA, 22 nt, Homo sapiens
auuaagugacuguucaagagca

SEQ ID NO: 838007 - RNA, 19 nt, Homo sapiens
auuacagggaaugccugag

SEQ ID NO: 838008 - RNA, 18 nt, Homo sapiens
auuagcauuuugcuaaau

SEQ ID NO: 838009 - RNA, 17 nt, Homo sapiens
auuagccaaguguggua

SEQ ID NO: 838010 - RNA, 22 nt, Homo sapiens
auuagcuuuaauuaagcucuca

SEQ ID NO: 838011 - RNA, 16 nt, Homo sapiens
auuauauauacuauau

SEQ ID NO: 838012 - RNA, 18 nt, Homo sapiens
auuaucucacuugugcca

SEQ ID NO: 838013 - RNA, 14 nt, Homo sapiens
auuauucaaaauga

SEQ ID NO: 838014 - RNA, 14 nt, Homo sapiens
auucaaucccagga

SEQ ID NO: 838015 - RNA, 21 nt, Homo sapiens
auucacccccaaacagugaca

SEQ ID NO: 838016 - RNA, 16 nt, Homo sapiens
auucacucauacaucu

SEQ ID NO: 838017 - RNA, 18 nt, Homo sapiens
auucaggaagcagcuuuc

SEQ ID NO: 838018 - RNA, 18 nt, Homo sapiens
acucuagggaaaaaccag

SEQ ID NO: 838019 - RNA, 12 nt, Homo sapiens
acugagcuguca

SEQ ID NO: 838020 - RNA, 19 nt, Homo sapiens
acugauccuguuucuugcu

SEQ ID NO: 838021 - RNA, 19 nt, Homo sapiens
acugcugcuccagugcagg

SEQ ID NO: 838022 - RNA, 17 nt, Homo sapiens
acuggcuuaacuuagua

SEQ ID NO: 838023 - RNA, 13 nt, Homo sapiens
acugggacuugca

SEQ ID NO: 838024 - RNA, 13 nt, Homo sapiens
acuguaaacauuc

SEQ ID NO: 838025 - RNA, 20 nt, Homo sapiens
acuguccuauuauauucauu

SEQ ID NO: 838026 - RNA, 18 nt, Homo sapiens
acuguucuauucaucuca

SEQ ID NO: 838027 - RNA, 16 nt, Homo sapiens
acuugagaauuacccu

SEQ ID NO: 838028 - RNA, 20 nt, Homo sapiens
acuuguuuggccuauuccau

SEQ ID NO: 838029 - RNA, 16 nt, Homo sapiens
acuuguuuucugggaa

SEQ ID NO: 838030 - RNA, 14 nt, Homo sapiens
acuuuaacacagug

SEQ ID NO: 838031 - RNA, 22 nt, Homo sapiens
acuuuguuuagcccaaaaccaa

SEQ ID NO: 838032 - RNA, 18 nt, Homo sapiens
acuuuguuuuacugucuu

SEQ ID NO: 838033 - RNA, 22 nt, Homo sapiens
acuuuugccauugacuucuucc

SEQ ID NO: 838034 - RNA, 22 nt, Homo sapiens
agaaaaugaagcccuauuacuu

SEQ ID NO: 838035 - RNA, 14 nt, Homo sapiens
agaaacacccucac

SEQ ID NO: 838036 - RNA, 14 nt, Homo sapiens
agaaagcaggugca

SEQ ID NO: 838037 - RNA, 14 nt, Homo sapiens
agaaauagcuuaug

SEQ ID NO: 838038 - RNA, 19 nt, Homo sapiens
agaaauccaagcaccacca

SEQ ID NO: 838039 - RNA, 18 nt, Homo sapiens
agaaauggcgucugcucu

SEQ ID NO: 838040 - RNA, 21 nt, Homo sapiens
agaaggccacuguuugucuca

SEQ ID NO: 838041 - RNA, 18 nt, Homo sapiens
agaagggcaaauauuuau

SEQ ID NO: 838042 - RNA, 19 nt, Homo sapiens
agaaggggaagcacucgug

SEQ ID NO: 838043 - RNA, 18 nt, Homo sapiens
agaauauaaaaauaaagc

SEQ ID NO: 838044 - RNA, 13 nt, Homo sapiens
agaauauuuuucc

SEQ ID NO: 838045 - RNA, 22 nt, Homo sapiens
agaaucuguuucccagcagugg

SEQ ID NO: 838046 - RNA, 19 nt, Homo sapiens
agacacaacaacuccuagg

SEQ ID NO: 838047 - RNA, 20 nt, Homo sapiens
agacaccaccacccuugcca

SEQ ID NO: 838048 - RNA, 17 nt, Homo sapiens
agacagagaccuccugc

SEQ ID NO: 838049 - RNA, 15 nt, Homo sapiens
agacaugagugcgug

SEQ ID NO: 838050 - RNA, 18 nt, Homo sapiens
agaccaagcugugcccug

SEQ ID NO: 838051 - RNA, 18 nt, Homo sapiens
agaccaucuacauacaca

SEQ ID NO: 838052 - RNA, 15 nt, Homo sapiens
agaccuggcacugga

SEQ ID NO: 838053 - RNA, 21 nt, Homo sapiens
agaccuggcacuggaugcaga

SEQ ID NO: 838054 - RNA, 15 nt, Homo sapiens
agaccuucuccuuca

SEQ ID NO: 838055 - RNA, 18 nt, Homo sapiens
agacgggguuugccaugc

SEQ ID NO: 838056 - RNA, 21 nt, Homo sapiens
agacuuaauagaaacauugaa

SEQ ID NO: 838057 - RNA, 23 nt, Homo sapiens
agacuuuuccaacccucaucacc

SEQ ID NO: 838058 - RNA, 18 nt, Homo sapiens
agacuuuucccaagccua

SEQ ID NO: 838059 - RNA, 15 nt, Homo sapiens
agagaagcauucuca

SEQ ID NO: 838060 - RNA, 17 nt, Homo sapiens
agagaauaaaaaaugua

SEQ ID NO: 838061 - RNA, 19 nt, Homo sapiens
agagagccuggugcugcug

SEQ ID NO: 838062 - RNA, 21 nt, Homo sapiens
agagagucuuccagguacuga

SEQ ID NO: 838063 - RNA, 23 nt, Homo sapiens
agagauuggaaugggcagcucau

SEQ ID NO: 838064 - RNA, 17 nt, Homo sapiens
agagcccgcagggccau

SEQ ID NO: 838065 - RNA, 21 nt, Homo sapiens
agagccugaguguugccuaau

SEQ ID NO: 838066 - RNA, 17 nt, Homo sapiens
agaguaggaagacuuug

SEQ ID NO: 838067 - RNA, 19 nt, Homo sapiens
agauauauuaagugacugu

SEQ ID NO: 838068 - RNA, 23 nt, Homo sapiens
agaucccacauauuucaaaaaca

SEQ ID NO: 838069 - RNA, 17 nt, Homo sapiens
agaugcaggugagccca

SEQ ID NO: 838070 - RNA, 19 nt, Homo sapiens
agaugcuuuaagugcacaa

SEQ ID NO: 838071 - RNA, 17 nt, Homo sapiens
agauggggacaggugaa

SEQ ID NO: 838072 - RNA, 22 nt, Homo sapiens
agaugggggaaagcacaggugg

SEQ ID NO: 838073 - RNA, 17 nt, Homo sapiens
agauucaaucccaggau

SEQ ID NO: 838074 - RNA, 21 nt, Homo sapiens
agauucaaucccaggauguac

SEQ ID NO: 838075 - RNA, 17 nt, Homo sapiens
agauuccgcaccaauaa

SEQ ID NO: 838076 - RNA, 23 nt, Homo sapiens
agcaaaggcugagaacacuguga

SEQ ID NO: 838077 - RNA, 14 nt, Homo sapiens
agcaaaugccugcc

SEQ ID NO: 838078 - RNA, 13 nt, Homo sapiens
agcaacugcagaa

SEQ ID NO: 838079 - RNA, 17 nt, Homo sapiens
agcaagcucccaaggga

SEQ ID NO: 838080 - RNA, 14 nt, Homo sapiens
agcacacacuuuug

SEQ ID NO: 838081 - RNA, 23 nt, Homo sapiens
agcacaggugggcuucccagugg

SEQ ID NO: 838082 - RNA, 18 nt, Homo sapiens
agcaccuuagacaguccc

SEQ ID NO: 838083 - RNA, 22 nt, Homo sapiens
agcacuuucccucuuggugccu

SEQ ID NO: 838084 - RNA, 17 nt, Homo sapiens
agcagagacuugggaca

SEQ ID NO: 838085 - RNA, 18 nt, Homo sapiens
agcaggauagagugggac

SEQ ID NO: 838086 - RNA, 15 nt, Homo sapiens
agcaggcuacacuga

SEQ ID NO: 838087 - RNA, 14 nt, Homo sapiens
agcaggcugugagu

SEQ ID NO: 838088 - RNA, 13 nt, Homo sapiens
agcauaacuuauu

SEQ ID NO: 838089 - RNA, 22 nt, Homo sapiens
agcaucugagcuaacuuauauu

SEQ ID NO: 838090 - RNA, 23 nt, Homo sapiens
agccaagcaaaugccugccaaau

SEQ ID NO: 838091 - RNA, 15 nt, Homo sapiens
agccaccaaacccgg

SEQ ID NO: 838092 - RNA, 18 nt, Homo sapiens
agccccgccccguuguga

SEQ ID NO: 838093 - RNA, 16 nt, Homo sapiens
agcccuggcugaagga

SEQ ID NO: 838094 - RNA, 14 nt, Homo sapiens
agccucacaguccu

SEQ ID NO: 838095 - RNA, 21 nt, Homo sapiens
agccugcucauguaccucuga

SEQ ID NO: 838096 - RNA, 14 nt, Homo sapiens
agccuggacccugu

SEQ ID NO: 838097 - RNA, 15 nt, Homo sapiens
agccugggcaaugug

SEQ ID NO: 838098 - RNA, 11 nt, Homo sapiens
agccuuccagg

SEQ ID NO: 838099 - RNA, 12 nt, Homo sapiens
agcggugucucu

SEQ ID NO: 838100 - RNA, 15 nt, Homo sapiens
agcguggacaggugu

SEQ ID NO: 838101 - RNA, 15 nt, Homo sapiens
agcucauuucacuuu

SEQ ID NO: 838102 - RNA, 14 nt, Homo sapiens
agcucccaagggau

SEQ ID NO: 838103 - RNA, 21 nt, Homo sapiens
agcuggauagacuugggaugg

SEQ ID NO: 838104 - RNA, 14 nt, Homo sapiens
agcugggagacccu

SEQ ID NO: 838105 - RNA, 17 nt, Homo sapiens
agcuguguucacacugu

SEQ ID NO: 838106 - RNA, 13 nt, Homo sapiens
agcuguucagcug

SEQ ID NO: 838107 - RNA, 19 nt, Homo sapiens
agcuugaaauagugucuga

SEQ ID NO: 838108 - RNA, 22 nt, Homo sapiens
agcuugaaauagugucugauga

SEQ ID NO: 838109 - RNA, 22 nt, Homo sapiens
agcuugcucacaucuuggcaca

SEQ ID NO: 838110 - RNA, 14 nt, Homo sapiens
agcuuggaccccuu

SEQ ID NO: 838111 - RNA, 22 nt, Homo sapiens
aggaaacuggguuccugcaaug

SEQ ID NO: 838112 - RNA, 14 nt, Homo sapiens
aggaaaggcuccag

SEQ ID NO: 838113 - RNA, 14 nt, Homo sapiens
aggaagacuuugga

SEQ ID NO: 838114 - RNA, 17 nt, Homo sapiens
aggaagcuuucugucuc

SEQ ID NO: 838115 - RNA, 15 nt, Homo sapiens
aggaaggcucuucuc

SEQ ID NO: 838116 - RNA, 20 nt, Homo sapiens
aggaaggcucuucuccccag

SEQ ID NO: 838117 - RNA, 12 nt, Homo sapiens
aggaaucaucuc

SEQ ID NO: 838118 - RNA, 23 nt, Homo sapiens
aggagacuuuacauggaugccaa

SEQ ID NO: 838119 - RNA, 13 nt, Homo sapiens
aggagcagugcag

SEQ ID NO: 838120 - RNA, 22 nt, Homo sapiens
aggaugaucuaggaagacuuug

SEQ ID NO: 838121 - RNA, 18 nt, Homo sapiens
aggauggcaaagagaguc

SEQ ID NO: 838122 - RNA, 17 nt, Homo sapiens
aggauuuuaugcuuuaa

SEQ ID NO: 838123 - RNA, 19 nt, Homo sapiens
aggcaaaugcccaagggaa

SEQ ID NO: 838124 - RNA, 13 nt, Homo sapiens
aggcaacugcauu

SEQ ID NO: 838125 - RNA, 22 nt, Homo sapiens
aggcagcaggauagagugggac

SEQ ID NO: 838126 - RNA, 16 nt, Homo sapiens
aggcaggggaauguau

SEQ ID NO: 838127 - RNA, 16 nt, Homo sapiens
aggcaugaaguuuccu

SEQ ID NO: 838128 - RNA, 15 nt, Homo sapiens
aggcaugacuguaga

SEQ ID NO: 838129 - RNA, 22 nt, Homo sapiens
aggccacacuucaaacuacuuu

SEQ ID NO: 838130 - RNA, 20 nt, Homo sapiens
aggccacccugccucuaccc

SEQ ID NO: 838131 - RNA, 21 nt, Homo sapiens
aggccauugggauauucugaa

SEQ ID NO: 838132 - RNA, 15 nt, Homo sapiens
aggcggaucuuugga

SEQ ID NO: 838133 - RNA, 22 nt, Homo sapiens
aggcggaucuuuggacagaagc

SEQ ID NO: 838134 - RNA, 13 nt, Homo sapiens
aggcuacacugac

SEQ ID NO: 838135 - RNA, 15 nt, Homo sapiens
aggcucgagcaugcc

SEQ ID NO: 838136 - RNA, 16 nt, Homo sapiens
aggcugagaacacugu

SEQ ID NO: 838137 - RNA, 18 nt, Homo sapiens
aggcugagaacacuguga

SEQ ID NO: 838138 - RNA, 19 nt, Homo sapiens
aggcugagaacacugugaa

SEQ ID NO: 838139 - RNA, 10 nt, Homo sapiens
aggcugcaaa

SEQ ID NO: 838140 - RNA, 20 nt, Homo sapiens
aggcugggagagccuuccag

SEQ ID NO: 838141 - RNA, 13 nt, Homo sapiens
aauaaaagcacuu

SEQ ID NO: 838142 - RNA, 14 nt, Homo sapiens
aauaaaagcacuua

SEQ ID NO: 838143 - RNA, 17 nt, Homo sapiens
aauaaaaggucggacca

SEQ ID NO: 838144 - RNA, 20 nt, Homo sapiens
aauacauaaaguaugugcau

SEQ ID NO: 838145 - RNA, 24 nt, Homo sapiens
aauacauaaaguaugugcauauuu

SEQ ID NO: 838146 - RNA, 18 nt, Homo sapiens
aauacuaggaaguaaagu

SEQ ID NO: 838147 - RNA, 23 nt, Homo sapiens
aauacuaggaaguaaagugaaga

SEQ ID NO: 838148 - RNA, 15 nt, Homo sapiens
aauagaaacauugaa

SEQ ID NO: 838149 - RNA, 15 nt, Homo sapiens
aauagugucugauga

SEQ ID NO: 838150 - RNA, 16 nt, Homo sapiens
aauagugucugaugaa

SEQ ID NO: 838151 - RNA, 14 nt, Homo sapiens
aauauggacucagc

SEQ ID NO: 838152 - RNA, 19 nt, Homo sapiens
aauauggacucagccuugc

SEQ ID NO: 838153 - RNA, 14 nt, Homo sapiens
aauaugggcacuuu

SEQ ID NO: 838154 - RNA, 21 nt, Homo sapiens
aauauuuauaggucacuuugu

SEQ ID NO: 838155 - RNA, 13 nt, Homo sapiens
aaucaaagcagau

SEQ ID NO: 838156 - RNA, 15 nt, Homo sapiens
aaugaaaugcauuuu

SEQ ID NO: 838157 - RNA, 17 nt, Homo sapiens
aaugaagcccuauuacu

SEQ ID NO: 838158 - RNA, 20 nt, Homo sapiens
aaugaugugaguacccagga

SEQ ID NO: 838159 - RNA, 13 nt, Homo sapiens
aaugccauccuca

SEQ ID NO: 838160 - RNA, 21 nt, Homo sapiens
aaugccauccucaaacacugc

SEQ ID NO: 838161 - RNA, 14 nt, Homo sapiens
aauguaugugcaca

SEQ ID NO: 838162 - RNA, 21 nt, Homo sapiens
aaugucuucuguauucacuua

SEQ ID NO: 838163 - RNA, 21 nt, Homo sapiens
aauguucuccagucauuaugu

SEQ ID NO: 838164 - RNA, 20 nt, Homo sapiens
aauuaagcucucauagcuca

SEQ ID NO: 838165 - RNA, 15 nt, Homo sapiens
aauucccuucaucug

SEQ ID NO: 838166 - RNA, 21 nt, Homo sapiens
aauucccuucaucuggaacca

SEQ ID NO: 838167 - RNA, 13 nt, Homo sapiens
aauuggacaauaa

SEQ ID NO: 838168 - RNA, 17 nt, Homo sapiens
aauuuucccucuucacu

SEQ ID NO: 838169 - RNA, 13 nt, Homo sapiens
acaaaauauagcu

SEQ ID NO: 838170 - RNA, 23 nt, Homo sapiens
acaaagcugaagaaaaugaagcc

SEQ ID NO: 838171 - RNA, 24 nt, Homo sapiens
acaaaggagagcuagcagcaggga

SEQ ID NO: 838172 - RNA, 13 nt, Homo sapiens
acaaauauuccug

SEQ ID NO: 838173 - RNA, 18 nt, Homo sapiens
acaaauggcuacaucucc

SEQ ID NO: 838174 - RNA, 22 nt, Homo sapiens
acaacauggccgugaacuuuau

SEQ ID NO: 838175 - RNA, 22 nt, Homo sapiens
acaagaccaucuacauacacag

SEQ ID NO: 838176 - RNA, 13 nt, Homo sapiens
acaagugacugua

SEQ ID NO: 838177 - RNA, 14 nt, Homo sapiens
acaauaaucucacu

SEQ ID NO: 838178 - RNA, 16 nt, Homo sapiens
acaauaguaauucuca

SEQ ID NO: 838179 - RNA, 23 nt, Homo sapiens
acaauaguaauucucaggccauc

SEQ ID NO: 838180 - RNA, 20 nt, Homo sapiens
acacaaacgggcucagcaaa

SEQ ID NO: 838181 - RNA, 19 nt, Homo sapiens
acacacgagcaaacccaga

SEQ ID NO: 838182 - RNA, 18 nt, Homo sapiens
acacagaugaaacacaaa

SEQ ID NO: 838183 - RNA, 14 nt, Homo sapiens
acacagcucccaua

SEQ ID NO: 838184 - RNA, 15 nt, Homo sapiens
acacaggaugaaggc

SEQ ID NO: 838185 - RNA, 17 nt, Homo sapiens
acacaggcuccaaacug

SEQ ID NO: 838186 - RNA, 14 nt, Homo sapiens
acacauaauucagg

SEQ ID NO: 838187 - RNA, 14 nt, Homo sapiens
acaccguucauuca

SEQ ID NO: 838188 - RNA, 17 nt, Homo sapiens
acacgagcaaacccaga

SEQ ID NO: 838189 - RNA, 23 nt, Homo sapiens
acacgggggcagcugauacaaau

SEQ ID NO: 838190 - RNA, 12 nt, Homo sapiens
acacugcugcuc

SEQ ID NO: 838191 - RNA, 18 nt, Homo sapiens
acacugcugcuccagugc

SEQ ID NO: 838192 - RNA, 22 nt, Homo sapiens
acacugugcugagucugaaggc

SEQ ID NO: 838193 - RNA, 20 nt, Homo sapiens
acagacaagugacuguaucu

SEQ ID NO: 838194 - RNA, 23 nt, Homo sapiens
acagauuccuggcagagccaugg

SEQ ID NO: 838195 - RNA, 11 nt, Homo sapiens
acagcauuugc

SEQ ID NO: 838196 - RNA, 23 nt, Homo sapiens
acaguaaauggcuuauccagcug

SEQ ID NO: 838197 - RNA, 12 nt, Homo sapiens
acaguaucucag

SEQ ID NO: 838198 - RNA, 14 nt, Homo sapiens
acaguaucucaggg

SEQ ID NO: 838199 - RNA, 13 nt, Homo sapiens
acagucaucauuu

SEQ ID NO: 838200 - RNA, 14 nt, Homo sapiens
acagucaucauuua

SEQ ID NO: 838201 - RNA, 16 nt, Homo sapiens
acagucaucauuuauc

SEQ ID NO: 838202 - RNA, 20 nt, Homo sapiens
acagucaucauuuaucauca

SEQ ID NO: 838203 - RNA, 20 nt, Homo sapiens
acagucuugcagcaggaucu

SEQ ID NO: 838204 - RNA, 17 nt, Homo sapiens
acagugggugaggagau

SEQ ID NO: 838205 - RNA, 16 nt, Homo sapiens
acagugucuggcacuu

SEQ ID NO: 838206 - RNA, 16 nt, Homo sapiens
acaguuaaacuggcuu

SEQ ID NO: 838207 - RNA, 16 nt, Homo sapiens
acaugccaagcacugu

SEQ ID NO: 838208 - RNA, 21 nt, Homo sapiens
acaugcugaagccaaagccaa

SEQ ID NO: 838209 - RNA, 21 nt, Homo sapiens
acaugcuuuuccaaacccagg

SEQ ID NO: 838210 - RNA, 15 nt, Homo sapiens
acauggaugccaacc

SEQ ID NO: 838211 - RNA, 16 nt, Homo sapiens
acauguauguaaauag

SEQ ID NO: 838212 - RNA, 22 nt, Homo sapiens
acauguuuuucuucucccucag

SEQ ID NO: 838213 - RNA, 19 nt, Homo sapiens
acauuaugaugugugaaaa

SEQ ID NO: 838214 - RNA, 19 nt, Homo sapiens
acauucaucaagcuguaca

SEQ ID NO: 838215 - RNA, 17 nt, Homo sapiens
acauuucuaagccuuug

SEQ ID NO: 838216 - RNA, 13 nt, Homo sapiens
acauuugugcucc

SEQ ID NO: 838217 - RNA, 15 nt, Homo sapiens
accaauaaagccuuc

SEQ ID NO: 838218 - RNA, 17 nt, Homo sapiens
accaauaaagccuucaa

SEQ ID NO: 838219 - RNA, 13 nt, Homo sapiens
accaauuccucau

SEQ ID NO: 838220 - RNA, 11 nt, Homo sapiens
accacaugcca

SEQ ID NO: 838221 - RNA, 15 nt, Homo sapiens
accaccaccaucacc

SEQ ID NO: 838222 - RNA, 12 nt, Homo sapiens
accaccuuucag

SEQ ID NO: 838223 - RNA, 21 nt, Homo sapiens
accacgugagaucauucacuc

SEQ ID NO: 838224 - RNA, 15 nt, Homo sapiens
accacugcucugaug

SEQ ID NO: 838225 - RNA, 21 nt, Homo sapiens
accagcagagcaccuuagaca

SEQ ID NO: 838226 - RNA, 19 nt, Homo sapiens
accagcaucccuugaccag

SEQ ID NO: 838227 - RNA, 14 nt, Homo sapiens
accagccaaccugg

SEQ ID NO: 838228 - RNA, 19 nt, Homo sapiens
accaguuuaaccugaugca

SEQ ID NO: 838229 - RNA, 12 nt, Homo sapiens
accaucccugaa

SEQ ID NO: 838230 - RNA, 20 nt, Homo sapiens
accaugauuaaccacuucag

SEQ ID NO: 838231 - RNA, 23 nt, Homo sapiens
accaugauuaaccacuucagcug

SEQ ID NO: 838232 - RNA, 9 nt, Homo sapiens
accaugcug

SEQ ID NO: 838233 - RNA, 15 nt, Homo sapiens
accauuacuguaauu

SEQ ID NO: 838234 - RNA, 22 nt, Homo sapiens
accauucuccaccugccaggga

SEQ ID NO: 838235 - RNA, 12 nt, Homo sapiens
acccacccagga

SEQ ID NO: 838236 - RNA, 15 nt, Homo sapiens
acccaugcagcugcu

SEQ ID NO: 838237 - RNA, 20 nt, Homo sapiens
accccgagccuggcuccaaa

SEQ ID NO: 838238 - RNA, 21 nt, Homo sapiens
acccuucugcuguauacugua

SEQ ID NO: 838239 - RNA, 16 nt, Homo sapiens
accuacaaggagauaa

SEQ ID NO: 838240 - RNA, 13 nt, Homo sapiens
accuacuagacaa

SEQ ID NO: 838241 - RNA, 17 nt, Homo sapiens
accucagcuuggcacuc

SEQ ID NO: 838242 - RNA, 12 nt, Homo sapiens
accucauuauca

SEQ ID NO: 838243 - RNA, 19 nt, Homo sapiens
accugccucccuucaugca

SEQ ID NO: 838244 - RNA, 20 nt, Homo sapiens
accugccucccuucaugcau

SEQ ID NO: 838245 - RNA, 16 nt, Homo sapiens
accuggcaaggacaca

SEQ ID NO: 838246 - RNA, 23 nt, Homo sapiens
accuuggaagggcguucuaggua

SEQ ID NO: 838247 - RNA, 13 nt, Homo sapiens
acgauuugucagu

SEQ ID NO: 838248 - RNA, 16 nt, Homo sapiens
acgccuguaauccuag

SEQ ID NO: 838249 - RNA, 18 nt, Homo sapiens
acgcuaguuaucaugcau

SEQ ID NO: 838250 - RNA, 14 nt, Homo sapiens
acgcuugugacagu

SEQ ID NO: 838251 - RNA, 22 nt, Homo sapiens
acggaauauuuaaacaguagcu

SEQ ID NO: 838252 - RNA, 14 nt, Homo sapiens
acgggcucagcaaa

SEQ ID NO: 838253 - RNA, 16 nt, Homo sapiens
acgguggucacuggaa

SEQ ID NO: 838254 - RNA, 23 nt, Homo sapiens
acgugauguggagggcacauucc

SEQ ID NO: 838255 - RNA, 21 nt, Homo sapiens
acuaaguaaucucacagcauu

SEQ ID NO: 838256 - RNA, 12 nt, Homo sapiens
acucaaaccaaa

SEQ ID NO: 838257 - RNA, 19 nt, Homo sapiens
acucaacccauuguuguca

SEQ ID NO: 838258 - RNA, 21 nt, Homo sapiens
acucacacggacacucaaaag

SEQ ID NO: 838259 - RNA, 23 nt, Homo sapiens
acucagccuugcaaauagccagu

SEQ ID NO: 838260 - RNA, 13 nt, Homo sapiens
acucaguagagau

SEQ ID NO: 838261 - RNA, 20 nt, Homo sapiens
acuccuaggcaggacaugcu

SEQ ID NO: 838262 - RNA, 22 nt, Homo sapiens
acucuacaaaauauagcuuuca

SEQ ID NO: 838263 - RNA, 17 nt, Homo sapiens
acucuacucaacccauu

SEQ ID NO: 838264 - RNA, 14 nt, Homo sapiens
ugugcccucagauu

SEQ ID NO: 838265 - RNA, 17 nt, Homo sapiens
ugugccugaagucccag

SEQ ID NO: 838266 - RNA, 17 nt, Homo sapiens
uguggaugauaaaacac

SEQ ID NO: 838267 - RNA, 20 nt, Homo sapiens
uguggccugggccuccucac

SEQ ID NO: 838268 - RNA, 14 nt, Homo sapiens
uguggcgcagcaua

SEQ ID NO: 838269 - RNA, 14 nt, Homo sapiens
uguggcuuccucag

SEQ ID NO: 838270 - RNA, 14 nt, Homo sapiens
uguguucacacugu

SEQ ID NO: 838271 - RNA, 15 nt, Homo sapiens
uguuacugucuucag

SEQ ID NO: 838272 - RNA, 22 nt, Homo sapiens
uguucuaaaaauaaaaguauug

SEQ ID NO: 838273 - RNA, 18 nt, Homo sapiens
uguuggguugaauauauu

SEQ ID NO: 838274 - RNA, 21 nt, Homo sapiens
uguuguuuuaggaauacauaa

SEQ ID NO: 838275 - RNA, 15 nt, Homo sapiens
uguuuaagacauuuu

SEQ ID NO: 838276 - RNA, 19 nt, Homo sapiens
uguuuccuagcacacacuu

SEQ ID NO: 838277 - RNA, 14 nt, Homo sapiens
uguuuuauuuuggu

SEQ ID NO: 838278 - RNA, 12 nt, Homo sapiens
uguuuuccauga

SEQ ID NO: 838279 - RNA, 14 nt, Homo sapiens
uguuuucucuugag

SEQ ID NO: 838280 - RNA, 15 nt, Homo sapiens
uguuuuucuaaagga

SEQ ID NO: 838281 - RNA, 23 nt, Homo sapiens
uuaaauaaaauuuuuauguaauu

SEQ ID NO: 838282 - RNA, 22 nt, Homo sapiens
uuaacuuuacuaaguaaucuca

SEQ ID NO: 838283 - RNA, 21 nt, Homo sapiens
uuaagcucucauagcucauaa

SEQ ID NO: 838284 - RNA, 18 nt, Homo sapiens
uuaaggaaaaauaaauau

SEQ ID NO: 838285 - RNA, 21 nt, Homo sapiens
uuaagucuuaucaagcagcca

SEQ ID NO: 838286 - RNA, 16 nt, Homo sapiens
uuaaguuuucaugaau

SEQ ID NO: 838287 - RNA, 18 nt, Homo sapiens
uuaauaaagacgauuugu

SEQ ID NO: 838288 - RNA, 16 nt, Homo sapiens
uuacaaaaacaagaca

SEQ ID NO: 838289 - RNA, 16 nt, Homo sapiens
uuacagggaaugccug

SEQ ID NO: 838290 - RNA, 20 nt, Homo sapiens
uuacauacauugauucaugu

SEQ ID NO: 838291 - RNA, 17 nt, Homo sapiens
ugaaucuguaucuugcc

SEQ ID NO: 838292 - RNA, 20 nt, Homo sapiens
ugacaauggcaacaauuuga

SEQ ID NO: 838293 - RNA, 19 nt, Homo sapiens
ugacacugguauuccugcc

SEQ ID NO: 838294 - RNA, 14 nt, Homo sapiens
ugacagugccucuu

SEQ ID NO: 838295 - RNA, 18 nt, Homo sapiens
ugacaucagcaauacaga

SEQ ID NO: 838296 - RNA, 16 nt, Homo sapiens
ugacauucaugccugg

SEQ ID NO: 838297 - RNA, 14 nt, Homo sapiens
ugaccucagcuuug

SEQ ID NO: 838298 - RNA, 19 nt, Homo sapiens
ugaccuuguaccucucuuu

SEQ ID NO: 838299 - RNA, 16 nt, Homo sapiens
ugacuucuucccaaga

SEQ ID NO: 838300 - RNA, 13 nt, Homo sapiens
ugacuuugcauca

SEQ ID NO: 838301 - RNA, 15 nt, Homo sapiens
ugagaacacugugaa

SEQ ID NO: 838302 - RNA, 23 nt, Homo sapiens
ugagaauauuuuucccaggacua

SEQ ID NO: 838303 - RNA, 23 nt, Homo sapiens
ugagacaggagaccuggcacugg

SEQ ID NO: 838304 - RNA, 15 nt, Homo sapiens
ugagaccaaccuggg

SEQ ID NO: 838305 - RNA, 19 nt, Homo sapiens
ugagauguauuucaacuug

SEQ ID NO: 838306 - RNA, 14 nt, Homo sapiens
ugagcauggagcug

SEQ ID NO: 838307 - RNA, 12 nt, Homo sapiens
ugagcuaacuua

SEQ ID NO: 838308 - RNA, 22 nt, Homo sapiens
ugaggcuuuaaaacuuauccuc

SEQ ID NO: 838309 - RNA, 19 nt, Homo sapiens
ugaguacuacaguccuccc

SEQ ID NO: 838310 - RNA, 18 nt, Homo sapiens
ugagucaaaaaaucucaa

SEQ ID NO: 838311 - RNA, 15 nt, Homo sapiens
ugagugcgugcucag

SEQ ID NO: 838312 - RNA, 20 nt, Homo sapiens
ugauacaaauugcagacugu

SEQ ID NO: 838313 - RNA, 23 nt, Homo sapiens
ugauauuucccuccccuggggac

SEQ ID NO: 838314 - RNA, 23 nt, Homo sapiens
ugaugcugggauuuacacuugag

SEQ ID NO: 838315 - RNA, 14 nt, Homo sapiens
ugauucaugucuca

SEQ ID NO: 838316 - RNA, 15 nt, Homo sapiens
ugauucaugucucac

SEQ ID NO: 838317 - RNA, 14 nt, Homo sapiens
ugauuuaaaucagc

SEQ ID NO: 838318 - RNA, 17 nt, Homo sapiens
ugcaaagucaugcaaag

SEQ ID NO: 838319 - RNA, 21 nt, Homo sapiens
ugcaaucuucucagaaggcaa

SEQ ID NO: 838320 - RNA, 13 nt, Homo sapiens
ugcaggcacagua

SEQ ID NO: 838321 - RNA, 16 nt, Homo sapiens
ugcaggcaucacagcu

SEQ ID NO: 838322 - RNA, 17 nt, Homo sapiens
ugcaguguggaguucac

SEQ ID NO: 838323 - RNA, 22 nt, Homo sapiens
ugcauguuuuccagcuccucau

SEQ ID NO: 838324 - RNA, 20 nt, Homo sapiens
ugcauucugagguaaccuca

SEQ ID NO: 838325 - RNA, 17 nt, Homo sapiens
ugcauuuaauuuauuga

SEQ ID NO: 838326 - RNA, 17 nt, Homo sapiens
ugccaagcucaggacca

SEQ ID NO: 838327 - RNA, 20 nt, Homo sapiens
ugccaaggcuggagugcagu

SEQ ID NO: 838328 - RNA, 16 nt, Homo sapiens
ugccagcuuaucucag

SEQ ID NO: 838329 - RNA, 20 nt, Homo sapiens
ugccagcuuaucucaggggu

SEQ ID NO: 838330 - RNA, 19 nt, Homo sapiens
ugccauccucaaacacugc

SEQ ID NO: 838331 - RNA, 20 nt, Homo sapiens
ugccauccucaaacacugca

SEQ ID NO: 838332 - RNA, 15 nt, Homo sapiens
ugccaugccagcuua

SEQ ID NO: 838333 - RNA, 22 nt, Homo sapiens
ugcccuuggccugaagucccag

SEQ ID NO: 838334 - RNA, 18 nt, Homo sapiens
ugccgucuaccugagggg

SEQ ID NO: 838335 - RNA, 13 nt, Homo sapiens
ugccuaaggcuga

SEQ ID NO: 838336 - RNA, 12 nt, Homo sapiens
ugccucauuuua

SEQ ID NO: 838337 - RNA, 18 nt, Homo sapiens
ugccucccuucaugcaug

SEQ ID NO: 838338 - RNA, 14 nt, Homo sapiens
ugccucuacccaac

SEQ ID NO: 838339 - RNA, 16 nt, Homo sapiens
ugccugugaacugaac

SEQ ID NO: 838340 - RNA, 16 nt, Homo sapiens
ugccuuuagugaucac

SEQ ID NO: 838341 - RNA, 22 nt, Homo sapiens
ugcgaauaagcuuuuaaugcuc

SEQ ID NO: 838342 - RNA, 15 nt, Homo sapiens
ugcuaaagccaggau

SEQ ID NO: 838343 - RNA, 13 nt, Homo sapiens
ugcuaaaugugaa

SEQ ID NO: 838344 - RNA, 20 nt, Homo sapiens
ugcuaguggccgaaccagaa

SEQ ID NO: 838345 - RNA, 14 nt, Homo sapiens
ugcuccagugcagg

SEQ ID NO: 838346 - RNA, 13 nt, Homo sapiens
ugcucccacagaa

SEQ ID NO: 838347 - RNA, 14 nt, Homo sapiens
ugcucccacagaac

SEQ ID NO: 838348 - RNA, 23 nt, Homo sapiens
ugcuccccaggccaccccgcuga

SEQ ID NO: 838349 - RNA, 16 nt, Homo sapiens
ugcucuggucuauaua

SEQ ID NO: 838350 - RNA, 23 nt, Homo sapiens
ugcugaggcccagugcauaugca

SEQ ID NO: 838351 - RNA, 16 nt, Homo sapiens
ugcugcuccagugcag

SEQ ID NO: 838352 - RNA, 19 nt, Homo sapiens
ugcuggccaggcuggucuc

SEQ ID NO: 838353 - RNA, 20 nt, Homo sapiens
ugcugggaauuacaggcgug

SEQ ID NO: 838354 - RNA, 13 nt, Homo sapiens
ugcuguauacugu

SEQ ID NO: 838355 - RNA, 21 nt, Homo sapiens
ugcuuuaauauaaaugcaaau

SEQ ID NO: 838356 - RNA, 15 nt, Homo sapiens
uggaaauucccuuca

SEQ ID NO: 838357 - RNA, 17 nt, Homo sapiens
uggaaauuuagcauugu

SEQ ID NO: 838358 - RNA, 16 nt, Homo sapiens
uggaacaagcacagau

SEQ ID NO: 838359 - RNA, 15 nt, Homo sapiens
uggaacucaguguga

SEQ ID NO: 838360 - RNA, 14 nt, Homo sapiens
uggaacucuacuca

SEQ ID NO: 838361 - RNA, 19 nt, Homo sapiens
uggaagguggggacaggga

SEQ ID NO: 838362 - RNA, 20 nt, Homo sapiens
uggaagguggggacagggau

SEQ ID NO: 838363 - RNA, 22 nt, Homo sapiens
uggacugaguuuauacucaccu

SEQ ID NO: 838364 - RNA, 14 nt, Homo sapiens
uggagacaccacca

SEQ ID NO: 838365 - RNA, 21 nt, Homo sapiens
uggagacuccuaggcaggaca

SEQ ID NO: 838366 - RNA, 19 nt, Homo sapiens
uggaucucacaagcacuuu

SEQ ID NO: 838367 - RNA, 14 nt, Homo sapiens
uggaugcauguucu

SEQ ID NO: 838368 - RNA, 17 nt, Homo sapiens
uggaugccaaccgguca

SEQ ID NO: 838369 - RNA, 13 nt, Homo sapiens
uggauucaaguga

SEQ ID NO: 838370 - RNA, 21 nt, Homo sapiens
uggauucaauuuuaaggcaua

SEQ ID NO: 838371 - RNA, 23 nt, Homo sapiens
uggauugugccuaauguguuuga

SEQ ID NO: 838372 - RNA, 16 nt, Homo sapiens
uggcacugacugggca

SEQ ID NO: 838373 - RNA, 21 nt, Homo sapiens
uggccaaugagaucauuguga

SEQ ID NO: 838374 - RNA, 14 nt, Homo sapiens
uggccccacuuuga

SEQ ID NO: 838375 - RNA, 13 nt, Homo sapiens
uggccgggacccc

SEQ ID NO: 838376 - RNA, 18 nt, Homo sapiens
uggcuaaggaaauucuaa

SEQ ID NO: 838377 - RNA, 14 nt, Homo sapiens
uggcuccaaacccu

SEQ ID NO: 838378 - RNA, 16 nt, Homo sapiens
uggcugggaguggcau

SEQ ID NO: 838379 - RNA, 18 nt, Homo sapiens
uggcuguuauucuuccac

SEQ ID NO: 838380 - RNA, 15 nt, Homo sapiens
ugggaaaaccagacu

SEQ ID NO: 838381 - RNA, 18 nt, Homo sapiens
ugggacaugggaaagggg

SEQ ID NO: 838382 - RNA, 16 nt, Homo sapiens
ugggcagagcagagac

SEQ ID NO: 838383 - RNA, 14 nt, Homo sapiens
ugggccacugugaa

SEQ ID NO: 838384 - RNA, 20 nt, Homo sapiens
ugggccuccucacaacaugg

SEQ ID NO: 838385 - RNA, 20 nt, Homo sapiens
uggggaaaauggccaugcag

SEQ ID NO: 838386 - RNA, 22 nt, Homo sapiens
uggggccaaauaaagucucuuc

SEQ ID NO: 838387 - RNA, 23 nt, Homo sapiens
ugggggaagaccuggcaaggaca

SEQ ID NO: 838388 - RNA, 14 nt, Homo sapiens
ugggggugcagaug

SEQ ID NO: 838389 - RNA, 20 nt, Homo sapiens
ugggugacagagcaagugag

SEQ ID NO: 838390 - RNA, 21 nt, Homo sapiens
ugguaguuuuacaguguuucu

SEQ ID NO: 838391 - RNA, 22 nt, Homo sapiens
uggucacuggaacucaguguga

SEQ ID NO: 838392 - RNA, 17 nt, Homo sapiens
uggucccaggcuuccca

SEQ ID NO: 838393 - RNA, 15 nt, Homo sapiens
uggucccccuuccau

SEQ ID NO: 838394 - RNA, 16 nt, Homo sapiens
ugguccccucuauaua

SEQ ID NO: 838395 - RNA, 13 nt, Homo sapiens
uggucuccucuca

SEQ ID NO: 838396 - RNA, 18 nt, Homo sapiens
ugguggccacggccacag

SEQ ID NO: 838397 - RNA, 22 nt, Homo sapiens
uguaaacauucaucaagcugua

SEQ ID NO: 838398 - RNA, 17 nt, Homo sapiens
uguaagauuuagcaccc

SEQ ID NO: 838399 - RNA, 17 nt, Homo sapiens
uguaagcaccccuucau

SEQ ID NO: 838400 - RNA, 10 nt, Homo sapiens
uguagagugg

SEQ ID NO: 838401 - RNA, 21 nt, Homo sapiens
uguauguaaauagcuaagaua

SEQ ID NO: 838402 - RNA, 18 nt, Homo sapiens
uguauguugaagccuuug

SEQ ID NO: 838403 - RNA, 16 nt, Homo sapiens
uguauuucaagaccuc

SEQ ID NO: 838404 - RNA, 18 nt, Homo sapiens
ugucacaugaaacauuug

SEQ ID NO: 838405 - RNA, 16 nt, Homo sapiens
uguccucaccacaugc

SEQ ID NO: 838406 - RNA, 19 nt, Homo sapiens
uguccuuuuucacuuugaa

SEQ ID NO: 838407 - RNA, 15 nt, Homo sapiens
ugucucaccuaccca

SEQ ID NO: 838408 - RNA, 16 nt, Homo sapiens
ugucuccuuaacacug

SEQ ID NO: 838409 - RNA, 18 nt, Homo sapiens
ugucuccuuaacacugag

SEQ ID NO: 838410 - RNA, 19 nt, Homo sapiens
ugucuucuguauucacuua

SEQ ID NO: 838411 - RNA, 18 nt, Homo sapiens
ugugaacccaaaguguga

SEQ ID NO: 838412 - RNA, 19 nt, Homo sapiens
ugugaacuaaacuuucaca

SEQ ID NO: 838413 - RNA, 23 nt, Homo sapiens
ugugaaugaugauccuaggcauu

SEQ ID NO: 838414 - RNA, 18 nt, Homo sapiens
ucaccucaccccacugug

SEQ ID NO: 838415 - RNA, 21 nt, Homo sapiens
ucacgauugucaucaggagaa

SEQ ID NO: 838416 - RNA, 13 nt, Homo sapiens
ucacuggaacuca

SEQ ID NO: 838417 - RNA, 12 nt, Homo sapiens
ucacuucacccu

SEQ ID NO: 838418 - RNA, 20 nt, Homo sapiens
ucacuuuaauagaagggcaa

SEQ ID NO: 838419 - RNA, 16 nt, Homo sapiens
ucagaaacacccucac

SEQ ID NO: 838420 - RNA, 18 nt, Homo sapiens
ucagaaggcaaaugacuu

SEQ ID NO: 838421 - RNA, 17 nt, Homo sapiens
ucagagcugacacagga

SEQ ID NO: 838422 - RNA, 22 nt, Homo sapiens
ucagaggugaaagcuauaucaa

SEQ ID NO: 838423 - RNA, 22 nt, Homo sapiens
ucagagguuugcuuccucagua

SEQ ID NO: 838424 - RNA, 16 nt, Homo sapiens
ucagaguauggagcuc

SEQ ID NO: 838425 - RNA, 17 nt, Homo sapiens
ucagcaagaagauccua

SEQ ID NO: 838426 - RNA, 21 nt, Homo sapiens
ucagccccugauccugugaag

SEQ ID NO: 838427 - RNA, 15 nt, Homo sapiens
ucagcugaaccuggg

SEQ ID NO: 838428 - RNA, 19 nt, Homo sapiens
ucaggaccaggcaauguga

SEQ ID NO: 838429 - RNA, 21 nt, Homo sapiens
ucaggagcagccucagaacaa

SEQ ID NO: 838430 - RNA, 21 nt, Homo sapiens
ucaggcagcaccacacugggu

SEQ ID NO: 838431 - RNA, 21 nt, Homo sapiens
ucaguaacauuucuguucuca

SEQ ID NO: 838432 - RNA, 13 nt, Homo sapiens
ucaguagacugug

SEQ ID NO: 838433 - RNA, 17 nt, Homo sapiens
ucaguagacugugauuc

SEQ ID NO: 838434 - RNA, 10 nt, Homo sapiens
ucagugucca

SEQ ID NO: 838435 - RNA, 20 nt, Homo sapiens
ucauacauuaucucacuugu

SEQ ID NO: 838436 - RNA, 23 nt, Homo sapiens
ucaucaaggcacugccugaugga

SEQ ID NO: 838437 - RNA, 16 nt, Homo sapiens
ucaugaaagcaucuga

SEQ ID NO: 838438 - RNA, 18 nt, Homo sapiens
ucaugaaucugcaaugug

SEQ ID NO: 838439 - RNA, 19 nt, Homo sapiens
ucaugcauggaaauucccu

SEQ ID NO: 838440 - RNA, 18 nt, Homo sapiens
ucauguaccucugauuaa

SEQ ID NO: 838441 - RNA, 21 nt, Homo sapiens
ucaugucucacgucucccuaa

SEQ ID NO: 838442 - RNA, 17 nt, Homo sapiens
ucauuagcauuuugcua

SEQ ID NO: 838443 - RNA, 13 nt, Homo sapiens
ucauucaacccac

SEQ ID NO: 838444 - RNA, 17 nt, Homo sapiens
ucauuguucuugugaac

SEQ ID NO: 838445 - RNA, 22 nt, Homo sapiens
ucauuguucuugugaacccaaa

SEQ ID NO: 838446 - RNA, 22 nt, Homo sapiens
ucauuuaaaacaagacuucaga

SEQ ID NO: 838447 - RNA, 23 nt, Homo sapiens
ucauuucaggagcagccucagaa

SEQ ID NO: 838448 - RNA, 15 nt, Homo sapiens
ucauuuguucauuaa

SEQ ID NO: 838449 - RNA, 15 nt, Homo sapiens
uccaaagagugcuaa

SEQ ID NO: 838450 - RNA, 21 nt, Homo sapiens
uccaaagggcauggguuuuau

SEQ ID NO: 838451 - RNA, 21 nt, Homo sapiens
uccaaggaaaccacagcugcu

SEQ ID NO: 838452 - RNA, 20 nt, Homo sapiens
uccaauauucgcugugucag

SEQ ID NO: 838453 - RNA, 11 nt, Homo sapiens
uccacucccag

SEQ ID NO: 838454 - RNA, 13 nt, Homo sapiens
uccagccccugga

SEQ ID NO: 838455 - RNA, 17 nt, Homo sapiens
uccaggauagacuuuuc

SEQ ID NO: 838456 - RNA, 16 nt, Homo sapiens
uccaggcccaaggagu

SEQ ID NO: 838457 - RNA, 16 nt, Homo sapiens
uccagggcaaggccau

SEQ ID NO: 838458 - RNA, 23 nt, Homo sapiens
uccaggggccacaagaccaucua

SEQ ID NO: 838459 - RNA, 14 nt, Homo sapiens
uccagguacugauc

SEQ ID NO: 838460 - RNA, 16 nt, Homo sapiens
uccauccuugagucaa

SEQ ID NO: 838461 - RNA, 21 nt, Homo sapiens
uccauccuugagucaaaaaau

SEQ ID NO: 838462 - RNA, 22 nt, Homo sapiens
ucccaaaagcccauucauucca

SEQ ID NO: 838463 - RNA, 23 nt, Homo sapiens
ucccaaaagcccauucauuccau

SEQ ID NO: 838464 - RNA, 19 nt, Homo sapiens
ucccaggacuagagcacaa

SEQ ID NO: 838465 - RNA, 18 nt, Homo sapiens
ucccagguuaucugggca

SEQ ID NO: 838466 - RNA, 19 nt, Homo sapiens
ucccauaccacccaaugcu

SEQ ID NO: 838467 - RNA, 14 nt, Homo sapiens
ucccccugugaaag

SEQ ID NO: 838468 - RNA, 16 nt, Homo sapiens
uccccucucagaacau

SEQ ID NO: 838469 - RNA, 22 nt, Homo sapiens
uccccugcccccuguacauuug

SEQ ID NO: 838470 - RNA, 20 nt, Homo sapiens
uccccugccugcccugguga

SEQ ID NO: 838471 - RNA, 23 nt, Homo sapiens
uccccugucacgugugggcaaug

SEQ ID NO: 838472 - RNA, 13 nt, Homo sapiens
ucccucauccuca

SEQ ID NO: 838473 - RNA, 14 nt, Homo sapiens
ucccugcaaccuga

SEQ ID NO: 838474 - RNA, 15 nt, Homo sapiens
ucccugccaauggac

SEQ ID NO: 838475 - RNA, 21 nt, Homo sapiens
ucccuucaucuggaaccauca

SEQ ID NO: 838476 - RNA, 19 nt, Homo sapiens
ucccuuugacgccauccca

SEQ ID NO: 838477 - RNA, 16 nt, Homo sapiens
uccuaaaacaaaagcu

SEQ ID NO: 838478 - RNA, 23 nt, Homo sapiens
uccuagcgcagccaugugauuac

SEQ ID NO: 838479 - RNA, 17 nt, Homo sapiens
uccuaguuccaccauca

SEQ ID NO: 838480 - RNA, 16 nt, Homo sapiens
uccuauuaaaggaaua

SEQ ID NO: 838481 - RNA, 14 nt, Homo sapiens
uccucaaacacugc

SEQ ID NO: 838482 - RNA, 21 nt, Homo sapiens
uccucauuagcauuuugcuaa

SEQ ID NO: 838483 - RNA, 22 nt, Homo sapiens
uccucccuuguggcuuccucag

SEQ ID NO: 838484 - RNA, 22 nt, Homo sapiens
uccucuggguaggaaucagcaa

SEQ ID NO: 838485 - RNA, 16 nt, Homo sapiens
uccugagaccagccaa

SEQ ID NO: 838486 - RNA, 22 nt, Homo sapiens
uccugagaccagccaaccuggg

SEQ ID NO: 838487 - RNA, 17 nt, Homo sapiens
uccugagugcuugcuuu

SEQ ID NO: 838488 - RNA, 12 nt, Homo sapiens
uccugcaaugaa

SEQ ID NO: 838489 - RNA, 13 nt, Homo sapiens
uccuuaacacuga

SEQ ID NO: 838490 - RNA, 15 nt, Homo sapiens
uccuucauucaaccc

SEQ ID NO: 838491 - RNA, 17 nt, Homo sapiens
uccuuugguccuucaaa

SEQ ID NO: 838492 - RNA, 16 nt, Homo sapiens
uccuuuuucacuuuga

SEQ ID NO: 838493 - RNA, 13 nt, Homo sapiens
ucgcaagagccau

SEQ ID NO: 838494 - RNA, 15 nt, Homo sapiens
ucgggggcuguggau

SEQ ID NO: 838495 - RNA, 16 nt, Homo sapiens
ucuacaaaauauagcu

SEQ ID NO: 838496 - RNA, 13 nt, Homo sapiens
ucuacccaggugc

SEQ ID NO: 838497 - RNA, 21 nt, Homo sapiens
ucucaaccaccuuucagauaa

SEQ ID NO: 838498 - RNA, 15 nt, Homo sapiens
ucucaauucuucccu

SEQ ID NO: 838499 - RNA, 14 nt, Homo sapiens
ucucacaagcacuu

SEQ ID NO: 838500 - RNA, 15 nt, Homo sapiens
ucucacuaccuuauu

SEQ ID NO: 838501 - RNA, 16 nt, Homo sapiens
ucuccaccuuccaaag

SEQ ID NO: 838502 - RNA, 20 nt, Homo sapiens
ucuccagucauuauguuaau

SEQ ID NO: 838503 - RNA, 14 nt, Homo sapiens
ucuccuuaacacug

SEQ ID NO: 838504 - RNA, 16 nt, Homo sapiens
ucucgaacugcuggau

SEQ ID NO: 838505 - RNA, 16 nt, Homo sapiens
ucucugcccuccaaga

SEQ ID NO: 838506 - RNA, 12 nt, Homo sapiens
ucugaaaaccaa

SEQ ID NO: 838507 - RNA, 18 nt, Homo sapiens
ucugaaccauuacuguaa

SEQ ID NO: 838508 - RNA, 22 nt, Homo sapiens
ucugccugcaccccugcaguuu

SEQ ID NO: 838509 - RNA, 16 nt, Homo sapiens
ucugcuguauacugua

SEQ ID NO: 838510 - RNA, 21 nt, Homo sapiens
ucugcuguauacuguacugag

SEQ ID NO: 838511 - RNA, 23 nt, Homo sapiens
ucugcuguauacuguacugagac

SEQ ID NO: 838512 - RNA, 19 nt, Homo sapiens
ucuggaaagggcacgagag

SEQ ID NO: 838513 - RNA, 19 nt, Homo sapiens
ucugggccagaauuucaaa

SEQ ID NO: 838514 - RNA, 14 nt, Homo sapiens
ucuguauucacuua

SEQ ID NO: 838515 - RNA, 21 nt, Homo sapiens
ucugucccagguuaucugggc

SEQ ID NO: 838516 - RNA, 19 nt, Homo sapiens
ucuuacaaugcauucugag

SEQ ID NO: 838517 - RNA, 16 nt, Homo sapiens
ucuuagaaaaaccacc

SEQ ID NO: 838518 - RNA, 19 nt, Homo sapiens
ucuucaacuuuugugcucc

SEQ ID NO: 838519 - RNA, 14 nt, Homo sapiens
ucuucauaccuaca

SEQ ID NO: 838520 - RNA, 16 nt, Homo sapiens
ucuuccagguacugau

SEQ ID NO: 838521 - RNA, 16 nt, Homo sapiens
ucuuccucccuggaau

SEQ ID NO: 838522 - RNA, 22 nt, Homo sapiens
ucuuccuggcuccaacacugcu

SEQ ID NO: 838523 - RNA, 22 nt, Homo sapiens
ucuuguaaagguccuggcaaag

SEQ ID NO: 838524 - RNA, 17 nt, Homo sapiens
ucuuucuuacaaggaag

SEQ ID NO: 838525 - RNA, 20 nt, Homo sapiens
ucuuuggacagaagcagcuc

SEQ ID NO: 838526 - RNA, 13 nt, Homo sapiens
ugaaaacacuguu

SEQ ID NO: 838527 - RNA, 13 nt, Homo sapiens
ugaaauagaccca

SEQ ID NO: 838528 - RNA, 13 nt, Homo sapiens
ugaaauagugucu

SEQ ID NO: 838529 - RNA, 13 nt, Homo sapiens
ugaaccauuacug

SEQ ID NO: 838530 - RNA, 18 nt, Homo sapiens
ugaaccauuacuguaauu

SEQ ID NO: 838531 - RNA, 17 nt, Homo sapiens
ugaacccuggcauuugg

SEQ ID NO: 838532 - RNA, 15 nt, Homo sapiens
ugaacuuuaugcugu

SEQ ID NO: 838533 - RNA, 13 nt, Homo sapiens
ugaaggacuguga

SEQ ID NO: 838534 - RNA, 15 nt, Homo sapiens
ugaaggacugugaca

SEQ ID NO: 838535 - RNA, 19 nt, Homo sapiens
ugaagguggaacaagcaca

SEQ ID NO: 838536 - RNA, 13 nt, Homo sapiens
ugaaguaaccuua

SEQ ID NO: 838537 - RNA, 11 nt, Homo sapiens
gucaaacuguc

SEQ ID NO: 838538 - RNA, 18 nt, Homo sapiens
gucacauagagugaucuu

SEQ ID NO: 838539 - RNA, 20 nt, Homo sapiens
gucacaugaaacauuugcaa

SEQ ID NO: 838540 - RNA, 22 nt, Homo sapiens
gucauuuuuauaaaacuuugaa

SEQ ID NO: 838541 - RNA, 15 nt, Homo sapiens
guccaaccagaaaca

SEQ ID NO: 838542 - RNA, 20 nt, Homo sapiens
guccaaccagaaacaccccu

SEQ ID NO: 838543 - RNA, 19 nt, Homo sapiens
guccaggcccaaggaguaa

SEQ ID NO: 838544 - RNA, 16 nt, Homo sapiens
guccuauuauauucau

SEQ ID NO: 838545 - RNA, 23 nt, Homo sapiens
guccucuggguaggaaucagcaa

SEQ ID NO: 838546 - RNA, 15 nt, Homo sapiens
gucuaggacugcagu

SEQ ID NO: 838547 - RNA, 15 nt, Homo sapiens
gucuuaacucaccau

SEQ ID NO: 838548 - RNA, 14 nt, Homo sapiens
gucuucuguauuca

SEQ ID NO: 838549 - RNA, 20 nt, Homo sapiens
gugacucgagucacacucaa

SEQ ID NO: 838550 - RNA, 21 nt, Homo sapiens
gugauuacccucugggucuca

SEQ ID NO: 838551 - RNA, 18 nt, Homo sapiens
gugauucuuagcaaaaaa

SEQ ID NO: 838552 - RNA, 20 nt, Homo sapiens
gugcacaacauuacagggaa

SEQ ID NO: 838553 - RNA, 18 nt, Homo sapiens
gugccuggccaaagggau

SEQ ID NO: 838554 - RNA, 13 nt, Homo sapiens
gugcugugacucg

SEQ ID NO: 838555 - RNA, 21 nt, Homo sapiens
gugcuugcuuuucaugcaaac

SEQ ID NO: 838556 - RNA, 15 nt, Homo sapiens
guggaacaagcacag

SEQ ID NO: 838557 - RNA, 17 nt, Homo sapiens
gugggcaaacaggcagu

SEQ ID NO: 838558 - RNA, 19 nt, Homo sapiens
guguaugguucugugccaa

SEQ ID NO: 838559 - RNA, 15 nt, Homo sapiens
gugucaugauucacc

SEQ ID NO: 838560 - RNA, 19 nt, Homo sapiens
gugugggggaagcaccaua

SEQ ID NO: 838561 - RNA, 17 nt, Homo sapiens
guuacucauaaggcaua

SEQ ID NO: 838562 - RNA, 20 nt, Homo sapiens
guuagugauuauauuucacc

SEQ ID NO: 838563 - RNA, 17 nt, Homo sapiens
guuaucaugcauguuau

SEQ ID NO: 838564 - RNA, 18 nt, Homo sapiens
guucaagagcacacuugg

SEQ ID NO: 838565 - RNA, 12 nt, Homo sapiens
guucagcagaac

SEQ ID NO: 838566 - RNA, 14 nt, Homo sapiens
guucagcucacugu

SEQ ID NO: 838567 - RNA, 22 nt, Homo sapiens
guuccugagccuucagcacuaa

SEQ ID NO: 838568 - RNA, 19 nt, Homo sapiens
guucuggcucuuccaggcu

SEQ ID NO: 838569 - RNA, 16 nt, Homo sapiens
guuucaaguacuguaa

SEQ ID NO: 838570 - RNA, 18 nt, Homo sapiens
guuucacaaacuacaaag

SEQ ID NO: 838571 - RNA, 17 nt, Homo sapiens
guuuccuggcacugcuu

SEQ ID NO: 838572 - RNA, 13 nt, Homo sapiens
guuucuccaagca

SEQ ID NO: 838573 - RNA, 18 nt, Homo sapiens
guuucugaaccauuacug

SEQ ID NO: 838574 - RNA, 15 nt, Homo sapiens
guuuggccuauucca

SEQ ID NO: 838575 - RNA, 22 nt, Homo sapiens
guuuguccuuuuucacuuugaa

SEQ ID NO: 838576 - RNA, 18 nt, Homo sapiens
guuuuaaagcuugcucac

SEQ ID NO: 838577 - RNA, 16 nt, Homo sapiens
guuuucuucugugauu

SEQ ID NO: 838578 - RNA, 21 nt, Homo sapiens
guuuuucuaaaggaguuuaug

SEQ ID NO: 838579 - RNA, 20 nt, Homo sapiens
uaaaaaggaauccacuccca

SEQ ID NO: 838580 - RNA, 19 nt, Homo sapiens
uaaaaugaaaugcauuuug

SEQ ID NO: 838581 - RNA, 20 nt, Homo sapiens
uaaaaugaaaugcauuuugc

SEQ ID NO: 838582 - RNA, 22 nt, Homo sapiens
uaaaauuuaaccuacuagacaa

SEQ ID NO: 838583 - RNA, 19 nt, Homo sapiens
uaaagaaaaaaauguauuu

SEQ ID NO: 838584 - RNA, 15 nt, Homo sapiens
uaaagcuuugugcag

SEQ ID NO: 838585 - RNA, 14 nt, Homo sapiens
uaaaguaugugcau

SEQ ID NO: 838586 - RNA, 15 nt, Homo sapiens
uaaaguaugugcaua

SEQ ID NO: 838587 - RNA, 22 nt, Homo sapiens
uaaaguuucuguugauaaucau

SEQ ID NO: 838588 - RNA, 22 nt, Homo sapiens
uaaaugucuucuguauucacuu

SEQ ID NO: 838589 - RNA, 23 nt, Homo sapiens
uaaaugucuucuguauucacuua

SEQ ID NO: 838590 - RNA, 20 nt, Homo sapiens
uaacaaaauuugaauagccc

SEQ ID NO: 838591 - RNA, 15 nt, Homo sapiens
uaacaauugugaagu

SEQ ID NO: 838592 - RNA, 13 nt, Homo sapiens
uaacacacagcua

SEQ ID NO: 838593 - RNA, 14 nt, Homo sapiens
uaacaccaugauua

SEQ ID NO: 838594 - RNA, 15 nt, Homo sapiens
uaagaauaguucccu

SEQ ID NO: 838595 - RNA, 22 nt, Homo sapiens
uaagagggcacacacuguguac

SEQ ID NO: 838596 - RNA, 23 nt, Homo sapiens
uaagaguaacagucaucauuuau

SEQ ID NO: 838597 - RNA, 16 nt, Homo sapiens
uaaggaagaaucuucu

SEQ ID NO: 838598 - RNA, 23 nt, Homo sapiens
uaaguaaucucacagcauuugcc

SEQ ID NO: 838599 - RNA, 16 nt, Homo sapiens
uaaguaucagcuacaa

SEQ ID NO: 838600 - RNA, 15 nt, Homo sapiens
uaagucucugugaau

SEQ ID NO: 838601 - RNA, 15 nt, Homo sapiens
uaauuuuauuauagu

SEQ ID NO: 838602 - RNA, 18 nt, Homo sapiens
uaauuuuuauuuuuggca

SEQ ID NO: 838603 - RNA, 19 nt, Homo sapiens
uaauuuuuauuuuuggcaa

SEQ ID NO: 838604 - RNA, 13 nt, Homo sapiens
uacaaacaccugg

SEQ ID NO: 838605 - RNA, 20 nt, Homo sapiens
uacagcuggguggcacugcc

SEQ ID NO: 838606 - RNA, 16 nt, Homo sapiens
uacaguaucucagggc

SEQ ID NO: 838607 - RNA, 15 nt, Homo sapiens
uacauuuggugcacu

SEQ ID NO: 838608 - RNA, 17 nt, Homo sapiens
uacccaggaugauuucc

SEQ ID NO: 838609 - RNA, 12 nt, Homo sapiens
uacccuuugaau

SEQ ID NO: 838610 - RNA, 17 nt, Homo sapiens
uaccuccugucucuggc

SEQ ID NO: 838611 - RNA, 19 nt, Homo sapiens
uaccucugaucaaguauuu

SEQ ID NO: 838612 - RNA, 13 nt, Homo sapiens
uacgccaggggaa

SEQ ID NO: 838613 - RNA, 15 nt, Homo sapiens
uacucaaagucaucc

SEQ ID NO: 838614 - RNA, 13 nt, Homo sapiens
uacucaacccauu

SEQ ID NO: 838615 - RNA, 20 nt, Homo sapiens
uacucaacccauuguuguca

SEQ ID NO: 838616 - RNA, 16 nt, Homo sapiens
uacucuuccaucuuuc

SEQ ID NO: 838617 - RNA, 15 nt, Homo sapiens
uagaaaaccagcuca

SEQ ID NO: 838618 - RNA, 22 nt, Homo sapiens
uagacaaugaugugaguaccca

SEQ ID NO: 838619 - RNA, 21 nt, Homo sapiens
uagacuuuaacauaagcuauu

SEQ ID NO: 838620 - RNA, 19 nt, Homo sapiens
uagacuuuucccaagccua

SEQ ID NO: 838621 - RNA, 14 nt, Homo sapiens
uagagcacaacaua

SEQ ID NO: 838622 - RNA, 20 nt, Homo sapiens
uagagugggacaguuccuga

SEQ ID NO: 838623 - RNA, 18 nt, Homo sapiens
uagcagauuuaagauaug

SEQ ID NO: 838624 - RNA, 12 nt, Homo sapiens
uagcaucagagg

SEQ ID NO: 838625 - RNA, 22 nt, Homo sapiens
uagcaucagagguuugcuuccu

SEQ ID NO: 838626 - RNA, 14 nt, Homo sapiens
uagcccaaaaccaa

SEQ ID NO: 838627 - RNA, 13 nt, Homo sapiens
uagcuaagauaua

SEQ ID NO: 838628 - RNA, 17 nt, Homo sapiens
uagcuagccagcugugu

SEQ ID NO: 838629 - RNA, 13 nt, Homo sapiens
uagcuugcaccuu

SEQ ID NO: 838630 - RNA, 19 nt, Homo sapiens
uagcuugcaccuugucaca

SEQ ID NO: 838631 - RNA, 20 nt, Homo sapiens
uaguaugggacuggccucug

SEQ ID NO: 838632 - RNA, 16 nt, Homo sapiens
uaguaugugcauuuaa

SEQ ID NO: 838633 - RNA, 14 nt, Homo sapiens
uagugguuacccag

SEQ ID NO: 838634 - RNA, 17 nt, Homo sapiens
uauaaagaaacuuuauu

SEQ ID NO: 838635 - RNA, 17 nt, Homo sapiens
uauacuguacugagaca

SEQ ID NO: 838636 - RNA, 17 nt, Homo sapiens
uauagucacuaguugua

SEQ ID NO: 838637 - RNA, 14 nt, Homo sapiens
uauaucaaucucuc

SEQ ID NO: 838638 - RNA, 17 nt, Homo sapiens
uauaucaaucucucuua

SEQ ID NO: 838639 - RNA, 21 nt, Homo sapiens
uauauuauuauuaauuacaau

SEQ ID NO: 838640 - RNA, 18 nt, Homo sapiens
uauccuccaugaauauca

SEQ ID NO: 838641 - RNA, 23 nt, Homo sapiens
uaugaccucgcccuccacaaaug

SEQ ID NO: 838642 - RNA, 18 nt, Homo sapiens
uaugacgugacuggccug

SEQ ID NO: 838643 - RNA, 12 nt, Homo sapiens
uaugugcacauc

SEQ ID NO: 838644 - RNA, 20 nt, Homo sapiens
uauuaaggaagacaauguga

SEQ ID NO: 838645 - RNA, 13 nt, Homo sapiens
uauuuaccagacc

SEQ ID NO: 838646 - RNA, 20 nt, Homo sapiens
uauuuuuguacugaaucuca

SEQ ID NO: 838647 - RNA, 18 nt, Homo sapiens
ucaaacuacuuugcugcu

SEQ ID NO: 838648 - RNA, 12 nt, Homo sapiens
ucaaauguucuc

SEQ ID NO: 838649 - RNA, 12 nt, Homo sapiens
ucaaggcacugc

SEQ ID NO: 838650 - RNA, 13 nt, Homo sapiens
ucaauccaagagu

SEQ ID NO: 838651 - RNA, 13 nt, Homo sapiens
ucacaagcacuuu

SEQ ID NO: 838652 - RNA, 19 nt, Homo sapiens
ucacacgggggcagcugau

SEQ ID NO: 838653 - RNA, 12 nt, Homo sapiens
ucacacuguaaa

SEQ ID NO: 838654 - RNA, 14 nt, Homo sapiens
ucacagccucugaa

SEQ ID NO: 838655 - RNA, 19 nt, Homo sapiens
ucaccaacgucugugccau

SEQ ID NO: 838656 - RNA, 22 nt, Homo sapiens
ucaccaucaauuuuaguuguca

SEQ ID NO: 838657 - RNA, 14 nt, Homo sapiens
ucacccaggaggau

SEQ ID NO: 838658 - RNA, 19 nt, Homo sapiens
ucaccuaagucucugugaa

SEQ ID NO: 838659 - RNA, 20 nt, Homo sapiens
ucaccuaagucucugugaau

SEQ ID NO: 838660 - RNA, 19 nt, Homo sapiens
gccacccugccucuaccca

SEQ ID NO: 838661 - RNA, 16 nt, Homo sapiens
gccacggccacaguca

SEQ ID NO: 838662 - RNA, 22 nt, Homo sapiens
gccacgugggcaaacaggcagu

SEQ ID NO: 838663 - RNA, 13 nt, Homo sapiens
gccagagccuuaa

SEQ ID NO: 838664 - RNA, 17 nt, Homo sapiens
gccagcuuaucucaggg

SEQ ID NO: 838665 - RNA, 18 nt, Homo sapiens
gccauccucaaacacugc

SEQ ID NO: 838666 - RNA, 22 nt, Homo sapiens
gccaugcagaccucaugcccag

SEQ ID NO: 838667 - RNA, 20 nt, Homo sapiens
gccauggagguuaagcacuu

SEQ ID NO: 838668 - RNA, 14 nt, Homo sapiens
gcccaaugcacuuu

SEQ ID NO: 838669 - RNA, 16 nt, Homo sapiens
gcccuacuucuuugcu

SEQ ID NO: 838670 - RNA, 14 nt, Homo sapiens
gcccucagauuccg

SEQ ID NO: 838671 - RNA, 21 nt, Homo sapiens
gccucccauucuacucaaagu

SEQ ID NO: 838672 - RNA, 21 nt, Homo sapiens
gccugaagucccagcauugau

SEQ ID NO: 838673 - RNA, 17 nt, Homo sapiens
gccuggggucugacaau

SEQ ID NO: 838674 - RNA, 16 nt, Homo sapiens
gccuggucguuuucaa

SEQ ID NO: 838675 - RNA, 14 nt, Homo sapiens
gccugugcugugac

SEQ ID NO: 838676 - RNA, 22 nt, Homo sapiens
gccuuuugggaauaauagcaca

SEQ ID NO: 838677 - RNA, 16 nt, Homo sapiens
gcgagugcucauuuca

SEQ ID NO: 838678 - RNA, 21 nt, Homo sapiens
gcgcaaucuuaacucauugca

SEQ ID NO: 838679 - RNA, 14 nt, Homo sapiens
gcgcgguggcucac

SEQ ID NO: 838680 - RNA, 21 nt, Homo sapiens
gcggggacucgguaagcacuu

SEQ ID NO: 838681 - RNA, 19 nt, Homo sapiens
gcgugaaucuguaucuugc

SEQ ID NO: 838682 - RNA, 15 nt, Homo sapiens
gcgugagccaccaaa

SEQ ID NO: 838683 - RNA, 13 nt, Homo sapiens
gcuaaagccagga

SEQ ID NO: 838684 - RNA, 14 nt, Homo sapiens
gcuacacugacacu

SEQ ID NO: 838685 - RNA, 19 nt, Homo sapiens
gcuacacugacacugguau

SEQ ID NO: 838686 - RNA, 18 nt, Homo sapiens
gcuagccagcuguguuca

SEQ ID NO: 838687 - RNA, 13 nt, Homo sapiens
gcucacuguucua

SEQ ID NO: 838688 - RNA, 22 nt, Homo sapiens
gcucagcaaaagaugcuucuca

SEQ ID NO: 838689 - RNA, 16 nt, Homo sapiens
gcucaggaccaggcaa

SEQ ID NO: 838690 - RNA, 22 nt, Homo sapiens
gcucagggcuaaacgggcauug

SEQ ID NO: 838691 - RNA, 19 nt, Homo sapiens
gcucaucagaaacucaaaa

SEQ ID NO: 838692 - RNA, 12 nt, Homo sapiens
gcucauuucacu

SEQ ID NO: 838693 - RNA, 13 nt, Homo sapiens
gcuccaaacccuc

SEQ ID NO: 838694 - RNA, 14 nt, Homo sapiens
gcuccaaaugcagc

SEQ ID NO: 838695 - RNA, 18 nt, Homo sapiens
gcuccagauucugaugca

SEQ ID NO: 838696 - RNA, 13 nt, Homo sapiens
gcuccagugcagg

SEQ ID NO: 838697 - RNA, 23 nt, Homo sapiens
gcucccaagggauggugcccugu

SEQ ID NO: 838698 - RNA, 12 nt, Homo sapiens
gcuccucaucca

SEQ ID NO: 838699 - RNA, 14 nt, Homo sapiens
gcucugccucccau

SEQ ID NO: 838700 - RNA, 23 nt, Homo sapiens
gcucuggucuauauaaccacauu

SEQ ID NO: 838701 - RNA, 16 nt, Homo sapiens
gcugcuccagugcagg

SEQ ID NO: 838702 - RNA, 14 nt, Homo sapiens
gcuggagugcagug

SEQ ID NO: 838703 - RNA, 15 nt, Homo sapiens
gcugggaguggcaug

SEQ ID NO: 838704 - RNA, 16 nt, Homo sapiens
gcuguuauucuuccac

SEQ ID NO: 838705 - RNA, 13 nt, Homo sapiens
gcuuggcugugcc

SEQ ID NO: 838706 - RNA, 23 nt, Homo sapiens
gcuuggcugugcccucagauucc

SEQ ID NO: 838707 - RNA, 23 nt, Homo sapiens
gcuuguuaacugagugccuuuug

SEQ ID NO: 838708 - RNA, 21 nt, Homo sapiens
gcuuuggcaaauaaaccuccu

SEQ ID NO: 838709 - RNA, 22 nt, Homo sapiens
ggaaaggcaaaugcccaaggga

SEQ ID NO: 838710 - RNA, 16 nt, Homo sapiens
ggaaaggcuccaggag

SEQ ID NO: 838711 - RNA, 22 nt, Homo sapiens
ggaagccucccacgacugcccg

SEQ ID NO: 838712 - RNA, 23 nt, Homo sapiens
ggaauaaaaugacacaacuuguc

SEQ ID NO: 838713 - RNA, 13 nt, Homo sapiens
ggaauaaacuguu

SEQ ID NO: 838714 - RNA, 20 nt, Homo sapiens
ggacaaggaugaucuaggaa

SEQ ID NO: 838715 - RNA, 13 nt, Homo sapiens
ggacaauaaucuc

SEQ ID NO: 838716 - RNA, 12 nt, Homo sapiens
ggacacaggcca

SEQ ID NO: 838717 - RNA, 20 nt, Homo sapiens
ggacauugccuuuucuagcc

SEQ ID NO: 838718 - RNA, 22 nt, Homo sapiens
ggaccccgagccuggcuccaaa

SEQ ID NO: 838719 - RNA, 14 nt, Homo sapiens
ggacuugggcggga

SEQ ID NO: 838720 - RNA, 24 nt, Homo sapiens
ggacuugggcgggacacaggcucc

SEQ ID NO: 838721 - RNA, 15 nt, Homo sapiens
ggagaccuggcacug

SEQ ID NO: 838722 - RNA, 22 nt, Homo sapiens
ggagcaucagugcccuccagga

SEQ ID NO: 838723 - RNA, 14 nt, Homo sapiens
ggagccugcaacau

SEQ ID NO: 838724 - RNA, 12 nt, Homo sapiens
ggaggagcagug

SEQ ID NO: 838725 - RNA, 15 nt, Homo sapiens
ggagggcuccagaca

SEQ ID NO: 838726 - RNA, 22 nt, Homo sapiens
ggagggcuccagacacaugucc

SEQ ID NO: 838727 - RNA, 17 nt, Homo sapiens
ggauagacuuuucccaa

SEQ ID NO: 838728 - RNA, 20 nt, Homo sapiens
ggauauuugguuuggccauc

SEQ ID NO: 838729 - RNA, 17 nt, Homo sapiens
ggaucgcaagagccaug

SEQ ID NO: 838730 - RNA, 17 nt, Homo sapiens
ggaucucacaagcacuu

SEQ ID NO: 838731 - RNA, 21 nt, Homo sapiens
ggauguuaugaacagcugugu

SEQ ID NO: 838732 - RNA, 15 nt, Homo sapiens
ggauucaauuuuaag

SEQ ID NO: 838733 - RNA, 14 nt, Homo sapiens
ggauucccaggaug

SEQ ID NO: 838734 - RNA, 14 nt, Homo sapiens
ggcaaacaggcagu

SEQ ID NO: 838735 - RNA, 16 nt, Homo sapiens
ggcaacgcacaaaaca

SEQ ID NO: 838736 - RNA, 12 nt, Homo sapiens
ggcagagccaug

SEQ ID NO: 838737 - RNA, 22 nt, Homo sapiens
ggcagcaggauagagugggaca

SEQ ID NO: 838738 - RNA, 15 nt, Homo sapiens
ggcaguuccauuuca

SEQ ID NO: 838739 - RNA, 24 nt, Homo sapiens
ggcauagaugcaggugagcccaug

SEQ ID NO: 838740 - RNA, 14 nt, Homo sapiens
ggcaugguggccca

SEQ ID NO: 838741 - RNA, 20 nt, Homo sapiens
ggccacagucaugguggcca

SEQ ID NO: 838742 - RNA, 19 nt, Homo sapiens
ggccacuguuugucucacc

SEQ ID NO: 838743 - RNA, 22 nt, Homo sapiens
ggcccagagggccugcaaggga

SEQ ID NO: 838744 - RNA, 16 nt, Homo sapiens
ggcccugccuccuuug

SEQ ID NO: 838745 - RNA, 21 nt, Homo sapiens
ggccugaagucccagcauuga

SEQ ID NO: 838746 - RNA, 17 nt, Homo sapiens
ggccuggucguuuucaa

SEQ ID NO: 838747 - RNA, 15 nt, Homo sapiens
ggcguggagcugccu

SEQ ID NO: 838748 - RNA, 14 nt, Homo sapiens
ggcuacacagggau

SEQ ID NO: 838749 - RNA, 15 nt, Homo sapiens
ggcuacacagggaug

SEQ ID NO: 838750 - RNA, 17 nt, Homo sapiens
ggcuacacugacacugg

SEQ ID NO: 838751 - RNA, 23 nt, Homo sapiens
ggcuucugguugaugccugugaa

SEQ ID NO: 838752 - RNA, 17 nt, Homo sapiens
ggcuuuagggaccugcu

SEQ ID NO: 838753 - RNA, 14 nt, Homo sapiens
gggaaaacauucca

SEQ ID NO: 838754 - RNA, 13 nt, Homo sapiens
gggaaaaccagac

SEQ ID NO: 838755 - RNA, 12 nt, Homo sapiens
gggaaugccuga

SEQ ID NO: 838756 - RNA, 19 nt, Homo sapiens
gggacgcaggccccucucc

SEQ ID NO: 838757 - RNA, 12 nt, Homo sapiens
gggacuugcaaa

SEQ ID NO: 838758 - RNA, 14 nt, Homo sapiens
gggagcugggagac

SEQ ID NO: 838759 - RNA, 13 nt, Homo sapiens
gggcacacacugu

SEQ ID NO: 838760 - RNA, 16 nt, Homo sapiens
gggccuguuaugucaa

SEQ ID NO: 838761 - RNA, 17 nt, Homo sapiens
gggcuaucccuuuccaa

SEQ ID NO: 838762 - RNA, 16 nt, Homo sapiens
gggcuggcacugacug

SEQ ID NO: 838763 - RNA, 14 nt, Homo sapiens
gggucucagugucc

SEQ ID NO: 838764 - RNA, 19 nt, Homo sapiens
gggucucccucuguugcca

SEQ ID NO: 838765 - RNA, 14 nt, Homo sapiens
ggucucgaacugcu

SEQ ID NO: 838766 - RNA, 15 nt, Homo sapiens
gguggggacagggau

SEQ ID NO: 838767 - RNA, 19 nt, Homo sapiens
ggugucuggauucccagga

SEQ ID NO: 838768 - RNA, 19 nt, Homo sapiens
gguuagggaaaacauucca

SEQ ID NO: 838769 - RNA, 12 nt, Homo sapiens
gguucugaugau

SEQ ID NO: 838770 - RNA, 19 nt, Homo sapiens
gguugcuuuaauaucauca

SEQ ID NO: 838771 - RNA, 12 nt, Homo sapiens
gguuucauucug

SEQ ID NO: 838772 - RNA, 19 nt, Homo sapiens
gguuugccaugcuggccag

SEQ ID NO: 838773 - RNA, 15 nt, Homo sapiens
gguuuuacugcagcu

SEQ ID NO: 838774 - RNA, 16 nt, Homo sapiens
guaaaauggagacacc

SEQ ID NO: 838775 - RNA, 22 nt, Homo sapiens
guaaacagaggaguacagguga

SEQ ID NO: 838776 - RNA, 16 nt, Homo sapiens
guaaagcuuugugcag

SEQ ID NO: 838777 - RNA, 17 nt, Homo sapiens
guaaagggcgcaaaggg

SEQ ID NO: 838778 - RNA, 16 nt, Homo sapiens
guaaauagcuaagaua

SEQ ID NO: 838779 - RNA, 13 nt, Homo sapiens
guaauucucaggc

SEQ ID NO: 838780 - RNA, 13 nt, Homo sapiens
guacuacaguccu

SEQ ID NO: 838781 - RNA, 19 nt, Homo sapiens
guaguuuugugaugcauuu

SEQ ID NO: 838782 - RNA, 13 nt, Homo sapiens
guauagugucuau

SEQ ID NO: 838783 - RNA, 20 nt, Homo sapiens
guauuuuguuuuugucuuaa

SEQ ID NO: 838784 - RNA, 22 nt, Homo sapiens
ggcaaagagagucgcaucucag

SEQ ID NO: 838785 - RNA, 16 nt, Homo sapiens
ggcacugccaugcagg

SEQ ID NO: 838786 - RNA, 13 nt, Homo sapiens
ggcacugccugau

SEQ ID NO: 838787 - RNA, 16 nt, Homo sapiens
ggcaugggucgggaga

SEQ ID NO: 838788 - RNA, 22 nt, Homo sapiens
ggccacagccacuaaucaggag

SEQ ID NO: 838789 - RNA, 21 nt, Homo sapiens
ggccacccugccucuacccaa

SEQ ID NO: 838790 - RNA, 17 nt, Homo sapiens
ggccagaugcacauccc

SEQ ID NO: 838791 - RNA, 22 nt, Homo sapiens
ggccccucuccuccguggcaca

SEQ ID NO: 838792 - RNA, 23 nt, Homo sapiens
ggccccucuccuccguggcacau

SEQ ID NO: 838793 - RNA, 19 nt, Homo sapiens
ggccgggcgcgguggcuca

SEQ ID NO: 838794 - RNA, 23 nt, Homo sapiens
ggcggaucuuuggacagaagcag

SEQ ID NO: 838795 - RNA, 13 nt, Homo sapiens
ggcuacacaggga

SEQ ID NO: 838796 - RNA, 16 nt, Homo sapiens
ggcuacacagggaugu

SEQ ID NO: 838797 - RNA, 19 nt, Homo sapiens
ggcuaggggcuggggccaa

SEQ ID NO: 838798 - RNA, 17 nt, Homo sapiens
ggcugaaggacugugac

SEQ ID NO: 838799 - RNA, 17 nt, Homo sapiens
ggcugcacccacccagg

SEQ ID NO: 838800 - RNA, 11 nt, Homo sapiens
ggcuggcacug

SEQ ID NO: 838801 - RNA, 14 nt, Homo sapiens
ggcuggguggcacc

SEQ ID NO: 838802 - RNA, 22 nt, Homo sapiens
ggcugguuagagguucccuuug

SEQ ID NO: 838803 - RNA, 16 nt, Homo sapiens
ggcuguuauucuucca

SEQ ID NO: 838804 - RNA, 19 nt, Homo sapiens
ggcuuuaaaacuuauccuc

SEQ ID NO: 838805 - RNA, 12 nt, Homo sapiens
gggaguggcgcg

SEQ ID NO: 838806 - RNA, 13 nt, Homo sapiens
gggaguggcgcgc

SEQ ID NO: 838807 - RNA, 12 nt, Homo sapiens
gggaugagcaug

SEQ ID NO: 838808 - RNA, 18 nt, Homo sapiens
gggcaugaagcugcauau

SEQ ID NO: 838809 - RNA, 22 nt, Homo sapiens
gggccuggccugagcugggaug

SEQ ID NO: 838810 - RNA, 12 nt, Homo sapiens
gggcucagcaaa

SEQ ID NO: 838811 - RNA, 20 nt, Homo sapiens
gggcucccuucccaccucuc

SEQ ID NO: 838812 - RNA, 12 nt, Homo sapiens
ggggacagggau

SEQ ID NO: 838813 - RNA, 19 nt, Homo sapiens
ggggacucgguaagcacuu

SEQ ID NO: 838814 - RNA, 20 nt, Homo sapiens
gggggcuuggcugugcccuc

SEQ ID NO: 838815 - RNA, 19 nt, Homo sapiens
gggugacagagcaagugag

SEQ ID NO: 838816 - RNA, 14 nt, Homo sapiens
ggguggggagcaaa

SEQ ID NO: 838817 - RNA, 19 nt, Homo sapiens
gguaaagggcgcaaagggc

SEQ ID NO: 838818 - RNA, 17 nt, Homo sapiens
gguaccaagagacuccu

SEQ ID NO: 838819 - RNA, 12 nt, Homo sapiens
gguaugauuaac

SEQ ID NO: 838820 - RNA, 15 nt, Homo sapiens
ggucacuggaacuca

SEQ ID NO: 838821 - RNA, 18 nt, Homo sapiens
ggucccaggcuucccaaa

SEQ ID NO: 838822 - RNA, 19 nt, Homo sapiens
ggugcacuuuucuguguca

SEQ ID NO: 838823 - RNA, 20 nt, Homo sapiens
ggugcacuuuucugugucau

SEQ ID NO: 838824 - RNA, 20 nt, Homo sapiens
gguuagggaaaacauuccau

SEQ ID NO: 838825 - RNA, 17 nt, Homo sapiens
guaaagcuuugugcaga

SEQ ID NO: 838826 - RNA, 20 nt, Homo sapiens
guaaagggcgcaaagggcau

SEQ ID NO: 838827 - RNA, 19 nt, Homo sapiens
guaaauagcuaagauauaa

SEQ ID NO: 838828 - RNA, 17 nt, Homo sapiens
guaacauuucuguucuc

SEQ ID NO: 838829 - RNA, 23 nt, Homo sapiens
guaacuguuuagaugaaugucag

SEQ ID NO: 838830 - RNA, 13 nt, Homo sapiens
guaacuuacuuag

SEQ ID NO: 838831 - RNA, 15 nt, Homo sapiens
guaaggaauaccugu

SEQ ID NO: 838832 - RNA, 15 nt, Homo sapiens
guacaaauauuccug

SEQ ID NO: 838833 - RNA, 13 nt, Homo sapiens
guacagucuugca

SEQ ID NO: 838834 - RNA, 19 nt, Homo sapiens
guacaucaaugauaaugcu

SEQ ID NO: 838835 - RNA, 14 nt, Homo sapiens
guacauuuggugca

SEQ ID NO: 838836 - RNA, 18 nt, Homo sapiens
guacuacaguccucccau

SEQ ID NO: 838837 - RNA, 20 nt, Homo sapiens
guauauuauuauuaauuaca

SEQ ID NO: 838838 - RNA, 16 nt, Homo sapiens
guauggagcucagaga

SEQ ID NO: 838839 - RNA, 13 nt, Homo sapiens
guauuaaagacag

SEQ ID NO: 838840 - RNA, 16 nt, Homo sapiens
guauucacuuauaugu

SEQ ID NO: 838841 - RNA, 19 nt, Homo sapiens
gucaucauuuaucaucaca

SEQ ID NO: 838842 - RNA, 14 nt, Homo sapiens
gucaugcaaaggcu

SEQ ID NO: 838843 - RNA, 14 nt, Homo sapiens
gucauuauguuaau

SEQ ID NO: 838844 - RNA, 17 nt, Homo sapiens
guccacaggaagugaag

SEQ ID NO: 838845 - RNA, 13 nt, Homo sapiens
gucccccuuccau

SEQ ID NO: 838846 - RNA, 18 nt, Homo sapiens
guccuuuuucacuuugaa

SEQ ID NO: 838847 - RNA, 14 nt, Homo sapiens
gucgcaucucagug

SEQ ID NO: 838848 - RNA, 18 nt, Homo sapiens
gucgcaucucagugcagg

SEQ ID NO: 838849 - RNA, 20 nt, Homo sapiens
gucucacgucucccuaaaaa

SEQ ID NO: 838850 - RNA, 13 nt, Homo sapiens
gucucccuaaaaa

SEQ ID NO: 838851 - RNA, 16 nt, Homo sapiens
gucucgacucauccau

SEQ ID NO: 838852 - RNA, 21 nt, Homo sapiens
gucucuauaauagaauucugu

SEQ ID NO: 838853 - RNA, 23 nt, Homo sapiens
gucuuaucaagcagccaagggau

SEQ ID NO: 838854 - RNA, 19 nt, Homo sapiens
gugaacauucccagcccag

SEQ ID NO: 838855 - RNA, 22 nt, Homo sapiens
gugagacaguccagccuggaga

SEQ ID NO: 838856 - RNA, 18 nt, Homo sapiens
gugaguacccaggaugau

SEQ ID NO: 838857 - RNA, 19 nt, Homo sapiens
gugauuauauuucacccau

SEQ ID NO: 838858 - RNA, 17 nt, Homo sapiens
gugauuuucauugcugg

SEQ ID NO: 838859 - RNA, 13 nt, Homo sapiens
gugcccccaugua

SEQ ID NO: 838860 - RNA, 14 nt, Homo sapiens
gugcccuguucucu

SEQ ID NO: 838861 - RNA, 22 nt, Homo sapiens
gugcucuuuguuuugugucucu

SEQ ID NO: 838862 - RNA, 20 nt, Homo sapiens
gugcugggaauuacaggcgu

SEQ ID NO: 838863 - RNA, 17 nt, Homo sapiens
gugucugccaaacacau

SEQ ID NO: 838864 - RNA, 21 nt, Homo sapiens
gugugcaacagacaagugacu

SEQ ID NO: 838865 - RNA, 16 nt, Homo sapiens
guguuuaagacauuuu

SEQ ID NO: 838866 - RNA, 17 nt, Homo sapiens
guuaaaauuuaaccuac

SEQ ID NO: 838867 - RNA, 22 nt, Homo sapiens
guuaagcacuuuaacacagugu

SEQ ID NO: 838868 - RNA, 12 nt, Homo sapiens
guuaagccuuug

SEQ ID NO: 838869 - RNA, 18 nt, Homo sapiens
guuaaguaucagcuacaa

SEQ ID NO: 838870 - RNA, 20 nt, Homo sapiens
guuauuuauaaucacuuuuu

SEQ ID NO: 838871 - RNA, 13 nt, Homo sapiens
guucacacuguaa

SEQ ID NO: 838872 - RNA, 15 nt, Homo sapiens
guucuacccaggugc

SEQ ID NO: 838873 - RNA, 13 nt, Homo sapiens
guucucauuugau

SEQ ID NO: 838874 - RNA, 21 nt, Homo sapiens
guucuccagucauuauguuaa

SEQ ID NO: 838875 - RNA, 18 nt, Homo sapiens
guuggcugggaacucacc

SEQ ID NO: 838876 - RNA, 17 nt, Homo sapiens
guuuagaugaaugucag

SEQ ID NO: 838877 - RNA, 18 nt, Homo sapiens
guuuagcccaaaaccaag

SEQ ID NO: 838878 - RNA, 21 nt, Homo sapiens
guuucugaaccauuacuguaa

SEQ ID NO: 838879 - RNA, 14 nt, Homo sapiens
guuucuugcucuga

SEQ ID NO: 838880 - RNA, 20 nt, Homo sapiens
guuucuugcucugagugcua

SEQ ID NO: 838881 - RNA, 19 nt, Homo sapiens
guuugucucaccuacccau

SEQ ID NO: 838882 - RNA, 14 nt, Homo sapiens
guuuuacugcagcu

SEQ ID NO: 838883 - RNA, 17 nt, Homo sapiens
guuuucaucaagacugg

SEQ ID NO: 838884 - RNA, 19 nt, Homo sapiens
guuuuuaaaaaacugcuga

SEQ ID NO: 838885 - RNA, 18 nt, Homo sapiens
guuuuucauucacuuuaa

SEQ ID NO: 838886 - RNA, 23 nt, Homo sapiens
uaaaaaaaaaacguauugcauuu

SEQ ID NO: 838887 - RNA, 12 nt, Homo sapiens
uaaaaagcucca

SEQ ID NO: 838888 - RNA, 19 nt, Homo sapiens
uaaaacaaaagcucaucca

SEQ ID NO: 838889 - RNA, 16 nt, Homo sapiens
uaaaacccaagugccu

SEQ ID NO: 838890 - RNA, 11 nt, Homo sapiens
uaaaagcacuu

SEQ ID NO: 838891 - RNA, 12 nt, Homo sapiens
uaaagccuucaa

SEQ ID NO: 838892 - RNA, 19 nt, Homo sapiens
uaaagggcgcaaagggcau

SEQ ID NO: 838893 - RNA, 16 nt, Homo sapiens
uaaaguaugugcauau

SEQ ID NO: 838894 - RNA, 14 nt, Homo sapiens
uaaauaaacaugug

SEQ ID NO: 838895 - RNA, 13 nt, Homo sapiens
uaaaugaacaaga

SEQ ID NO: 838896 - RNA, 15 nt, Homo sapiens
uaaaugaacaagaga

SEQ ID NO: 838897 - RNA, 21 nt, Homo sapiens
uaaaugucuucuguauucacu

SEQ ID NO: 838898 - RNA, 21 nt, Homo sapiens
uaaaugugaaugaugauccua

SEQ ID NO: 838899 - RNA, 16 nt, Homo sapiens
uaacauuucuguucuc

SEQ ID NO: 838900 - RNA, 17 nt, Homo sapiens
uaacauuucuguucuca

SEQ ID NO: 838901 - RNA, 18 nt, Homo sapiens
uaacauuucuguucucau

SEQ ID NO: 838902 - RNA, 24 nt, Homo sapiens
uaaccuggguaaaugcagcgugaa

SEQ ID NO: 838903 - RNA, 14 nt, Homo sapiens
uaacuauugcccag

SEQ ID NO: 838904 - RNA, 15 nt, Homo sapiens
uaacugagugccuuu

SEQ ID NO: 838905 - RNA, 23 nt, Homo sapiens
uaagaccaagcugugcccugacc

SEQ ID NO: 838906 - RNA, 21 nt, Homo sapiens
uaagagggagggagggcucca

SEQ ID NO: 838907 - RNA, 22 nt, Homo sapiens
aaggucggaccagcuuuuccca

SEQ ID NO: 838908 - RNA, 19 nt, Homo sapiens
aagguggaacaagcacaga

SEQ ID NO: 838909 - RNA, 21 nt, Homo sapiens
aaguaaagugaagaauuuauc

SEQ ID NO: 838910 - RNA, 17 nt, Homo sapiens
aaguacaaauauuccug

SEQ ID NO: 838911 - RNA, 21 nt, Homo sapiens
aaguacaaauauuccuguuuc

SEQ ID NO: 838912 - RNA, 15 nt, Homo sapiens
aaguacuguaacugu

SEQ ID NO: 838913 - RNA, 22 nt, Homo sapiens
aaguacuguaacugugucauga

SEQ ID NO: 838914 - RNA, 13 nt, Homo sapiens
aagucucugugaa

SEQ ID NO: 838915 - RNA, 18 nt, Homo sapiens
aagucucugugaauugaa

SEQ ID NO: 838916 - RNA, 21 nt, Homo sapiens
aagucuguuuuaugacuucau

SEQ ID NO: 838917 - RNA, 20 nt, Homo sapiens
aagugagacccugucucaaa

SEQ ID NO: 838918 - RNA, 22 nt, Homo sapiens
aagugagacccugucucaaaaa

SEQ ID NO: 838919 - RNA, 19 nt, Homo sapiens
aauaagggcagagucacac

SEQ ID NO: 838920 - RNA, 17 nt, Homo sapiens
aauaauucuucaccuaa

SEQ ID NO: 838921 - RNA, 17 nt, Homo sapiens
aauacaguaucucaggg

SEQ ID NO: 838922 - RNA, 23 nt, Homo sapiens
aauauagcuuucauaacaucgaa

SEQ ID NO: 838923 - RNA, 16 nt, Homo sapiens
aauaugggcacuuuaa

SEQ ID NO: 838924 - RNA, 21 nt, Homo sapiens
aauaugggcacuuuaaaugaa

SEQ ID NO: 838925 - RNA, 14 nt, Homo sapiens
aauauuuaccagac

SEQ ID NO: 838926 - RNA, 19 nt, Homo sapiens
aauauuuuguuuugugcag

SEQ ID NO: 838927 - RNA, 18 nt, Homo sapiens
aaucacuucugagaacuc

SEQ ID NO: 838928 - RNA, 14 nt, Homo sapiens
aaucagaauggaau

SEQ ID NO: 838929 - RNA, 17 nt, Homo sapiens
aaucaguuacucuucag

SEQ ID NO: 838930 - RNA, 16 nt, Homo sapiens
aaucaucuccuuugca

SEQ ID NO: 838931 - RNA, 15 nt, Homo sapiens
aaucucacagcauuu

SEQ ID NO: 838932 - RNA, 22 nt, Homo sapiens
aaugaagcuaauaauucuucac

SEQ ID NO: 838933 - RNA, 13 nt, Homo sapiens
aaugaauugcuaa

SEQ ID NO: 838934 - RNA, 19 nt, Homo sapiens
aaugaugauccuaggcauu

SEQ ID NO: 838935 - RNA, 15 nt, Homo sapiens
aaugauuucacagug

SEQ ID NO: 838936 - RNA, 13 nt, Homo sapiens
aaugcacuuuguu

SEQ ID NO: 838937 - RNA, 19 nt, Homo sapiens
aaugcagcgugaagggauu

SEQ ID NO: 838938 - RNA, 21 nt, Homo sapiens
aaugcccagccccuucugacc

SEQ ID NO: 838939 - RNA, 13 nt, Homo sapiens
aauggccaugcag

SEQ ID NO: 838940 - RNA, 18 nt, Homo sapiens
aaugggcagcucaucucu

SEQ ID NO: 838941 - RNA, 17 nt, Homo sapiens
aauguaauagaagcuua

SEQ ID NO: 838942 - RNA, 21 nt, Homo sapiens
aauguaguuuugugaugcauu

SEQ ID NO: 838943 - RNA, 22 nt, Homo sapiens
aauguaguuuugugaugcauuu

SEQ ID NO: 838944 - RNA, 15 nt, Homo sapiens
aauguaugugcacau

SEQ ID NO: 838945 - RNA, 17 nt, Homo sapiens
aaugucuucuguauuca

SEQ ID NO: 838946 - RNA, 20 nt, Homo sapiens
aaugucuucuguauucacuu

SEQ ID NO: 838947 - RNA, 18 nt, Homo sapiens
aauguuuagcagauuuaa

SEQ ID NO: 838948 - RNA, 21 nt, Homo sapiens
aauuacaggcgugagccacca

SEQ ID NO: 838949 - RNA, 16 nt, Homo sapiens
aauuauugauguuuuc

SEQ ID NO: 838950 - RNA, 13 nt, Homo sapiens
aauuuaaccuacu

SEQ ID NO: 838951 - RNA, 14 nt, Homo sapiens
aauuuuaguuguca

SEQ ID NO: 838952 - RNA, 17 nt, Homo sapiens
acaaacauguaagcaua

SEQ ID NO: 838953 - RNA, 12 nt, Homo sapiens
acaaauaaacuu

SEQ ID NO: 838954 - RNA, 13 nt, Homo sapiens
acaauaaucucac

SEQ ID NO: 838955 - RNA, 17 nt, Homo sapiens
acaauaugggcacuuua

SEQ ID NO: 838956 - RNA, 13 nt, Homo sapiens
acaaugugaaaag

SEQ ID NO: 838957 - RNA, 14 nt, Homo sapiens
acaauugugaaguc

SEQ ID NO: 838958 - RNA, 11 nt, Homo sapiens
acacccuguga

SEQ ID NO: 838959 - RNA, 21 nt, Homo sapiens
acacugggacuugcaaaaagg

SEQ ID NO: 838960 - RNA, 18 nt, Homo sapiens
aggaguuugagaccaacc

SEQ ID NO: 838961 - RNA, 21 nt, Homo sapiens
aggauauugggucagugucca

SEQ ID NO: 838962 - RNA, 19 nt, Homo sapiens
aggaugaaggcaaugccau

SEQ ID NO: 838963 - RNA, 15 nt, Homo sapiens
aggauuuaaguuuca

SEQ ID NO: 838964 - RNA, 17 nt, Homo sapiens
aggcacugccugaugga

SEQ ID NO: 838965 - RNA, 20 nt, Homo sapiens
aggcaggaggaucacuugag

SEQ ID NO: 838966 - RNA, 16 nt, Homo sapiens
aggcauauacaaauaa

SEQ ID NO: 838967 - RNA, 18 nt, Homo sapiens
aggccacuguuugucuca

SEQ ID NO: 838968 - RNA, 15 nt, Homo sapiens
aggccaucaucagug

SEQ ID NO: 838969 - RNA, 22 nt, Homo sapiens
aggccccucuccuccguggcac

SEQ ID NO: 838970 - RNA, 20 nt, Homo sapiens
aggcccuugucgugggaugg

SEQ ID NO: 838971 - RNA, 19 nt, Homo sapiens
aggcguggagcugccugau

SEQ ID NO: 838972 - RNA, 17 nt, Homo sapiens
aggcugagaacacugug

SEQ ID NO: 838973 - RNA, 18 nt, Homo sapiens
aggcuggggaaguccucu

SEQ ID NO: 838974 - RNA, 20 nt, Homo sapiens
agggaugaaagagaaggugg

SEQ ID NO: 838975 - RNA, 13 nt, Homo sapiens
agggccccggggc

SEQ ID NO: 838976 - RNA, 19 nt, Homo sapiens
agggccccggggccuguua

SEQ ID NO: 838977 - RNA, 15 nt, Homo sapiens
agggcuuucucagga

SEQ ID NO: 838978 - RNA, 23 nt, Homo sapiens
aggggcuguugaauuucccacau

SEQ ID NO: 838979 - RNA, 13 nt, Homo sapiens
aggggugggacac

SEQ ID NO: 838980 - RNA, 18 nt, Homo sapiens
aggugaaagcuauaucaa

SEQ ID NO: 838981 - RNA, 22 nt, Homo sapiens
aguacuguaacugugucaugau

SEQ ID NO: 838982 - RNA, 15 nt, Homo sapiens
aguagacaagcaauu

SEQ ID NO: 838983 - RNA, 14 nt, Homo sapiens
aguagacugugauu

SEQ ID NO: 838984 - RNA, 18 nt, Homo sapiens
aguagauaugaggcauuu

SEQ ID NO: 838985 - RNA, 18 nt, Homo sapiens
aguaggaagacuuuggaa

SEQ ID NO: 838986 - RNA, 16 nt, Homo sapiens
aguaugaaaaugucau

SEQ ID NO: 838987 - RNA, 21 nt, Homo sapiens
agucacacgggggcagcugau

SEQ ID NO: 838988 - RNA, 18 nt, Homo sapiens
agucacuaguuguaauuu

SEQ ID NO: 838989 - RNA, 14 nt, Homo sapiens
agucaguugcauuc

SEQ ID NO: 838990 - RNA, 20 nt, Homo sapiens
agucaugcaaaggcugggac

SEQ ID NO: 838991 - RNA, 13 nt, Homo sapiens
aguccagcuugua

SEQ ID NO: 838992 - RNA, 19 nt, Homo sapiens
agugaagaauuuaucucuu

SEQ ID NO: 838993 - RNA, 14 nt, Homo sapiens
agugaccagauaua

SEQ ID NO: 838994 - RNA, 21 nt, Homo sapiens
agugacuguucaagagcacac

SEQ ID NO: 838995 - RNA, 13 nt, Homo sapiens
agugagacccugu

SEQ ID NO: 838996 - RNA, 18 nt, Homo sapiens
agugcaggagagacagug

SEQ ID NO: 838997 - RNA, 12 nt, Homo sapiens
agugcauaugca

SEQ ID NO: 838998 - RNA, 18 nt, Homo sapiens
agugccacccaugcagcu

SEQ ID NO: 838999 - RNA, 16 nt, Homo sapiens
agugcuagcuagccag

SEQ ID NO: 839000 - RNA, 18 nt, Homo sapiens
agugggcccaaugcacuu

SEQ ID NO: 839001 - RNA, 19 nt, Homo sapiens
agugggugaauaauacagu

SEQ ID NO: 839002 - RNA, 13 nt, Homo sapiens
agugugagugugc

SEQ ID NO: 839003 - RNA, 13 nt, Homo sapiens
aguuugagacagg

SEQ ID NO: 839004 - RNA, 12 nt, Homo sapiens
auaaauaaccaa

SEQ ID NO: 839005 - RNA, 20 nt, Homo sapiens
auaacccaagguaccauccu

SEQ ID NO: 839006 - RNA, 21 nt, Homo sapiens
auaagagggcacacacugugu

SEQ ID NO: 839007 - RNA, 18 nt, Homo sapiens
auaagcuuuuaaugcucc

SEQ ID NO: 839008 - RNA, 17 nt, Homo sapiens
auaauaaagaucaugua

SEQ ID NO: 839009 - RNA, 17 nt, Homo sapiens
auaauacaguaucucag

SEQ ID NO: 839010 - RNA, 13 nt, Homo sapiens
auaaucacuuuuu

SEQ ID NO: 839011 - RNA, 15 nt, Homo sapiens
auaauucuucaccua

SEQ ID NO: 839012 - RNA, 15 nt, Homo sapiens
auacacagugcugac

SEQ ID NO: 839013 - RNA, 17 nt, Homo sapiens
auacaguuugucacaug

SEQ ID NO: 839014 - RNA, 20 nt, Homo sapiens
auacaguuugucacaugaaa

SEQ ID NO: 839015 - RNA, 19 nt, Homo sapiens
auacauuaucucacuugug

SEQ ID NO: 839016 - RNA, 17 nt, Homo sapiens
auaccugucccccugac

SEQ ID NO: 839017 - RNA, 16 nt, Homo sapiens
auacucccaucuguga

SEQ ID NO: 839018 - RNA, 16 nt, Homo sapiens
auacuguacugagaca

SEQ ID NO: 839019 - RNA, 14 nt, Homo sapiens
caaggcugcaguga

SEQ ID NO: 839020 - RNA, 16 nt, Homo sapiens
caaggcugugcucccu

SEQ ID NO: 839021 - RNA, 15 nt, Homo sapiens
caauaaagccuucaa

SEQ ID NO: 839022 - RNA, 19 nt, Homo sapiens
caauaaagccuucaaacuc

SEQ ID NO: 839023 - RNA, 14 nt, Homo sapiens
caauagaacagaga

SEQ ID NO: 839024 - RNA, 17 nt, Homo sapiens
caauaucccuuacuuua

SEQ ID NO: 839025 - RNA, 12 nt, Homo sapiens
caauccaagagu

SEQ ID NO: 839026 - RNA, 20 nt, Homo sapiens
caaucuucucagaaggcaaa

SEQ ID NO: 839027 - RNA, 15 nt, Homo sapiens
caaugauaaugcuaa

SEQ ID NO: 839028 - RNA, 16 nt, Homo sapiens
caaugcauucugaggu

SEQ ID NO: 839029 - RNA, 18 nt, Homo sapiens
caauggcaacaauuugag

SEQ ID NO: 839030 - RNA, 22 nt, Homo sapiens
caauuaaggauuuuaugcuuua

SEQ ID NO: 839031 - RNA, 18 nt, Homo sapiens
caauuauuugaagauuua

SEQ ID NO: 839032 - RNA, 20 nt, Homo sapiens
caauuuuaaaaugaaaugca

SEQ ID NO: 839033 - RNA, 23 nt, Homo sapiens
caauuuucuuuuuuauacucaau

SEQ ID NO: 839034 - RNA, 12 nt, Homo sapiens
cacaaaacagaa

SEQ ID NO: 839035 - RNA, 21 nt, Homo sapiens
cacaaauggcuacaucuccaa

SEQ ID NO: 839036 - RNA, 17 nt, Homo sapiens
cacaacauuacagggaa

SEQ ID NO: 839037 - RNA, 19 nt, Homo sapiens
cacaauaugggcacuuuaa

SEQ ID NO: 839038 - RNA, 12 nt, Homo sapiens
cacacacugugu

SEQ ID NO: 839039 - RNA, 13 nt, Homo sapiens
cacacagcuaaca

SEQ ID NO: 839040 - RNA, 19 nt, Homo sapiens
cacagaacacauaauucag

SEQ ID NO: 839041 - RNA, 13 nt, Homo sapiens
cacagaggaugcu

SEQ ID NO: 839042 - RNA, 20 nt, Homo sapiens
cacagcugcuggagacuccu

SEQ ID NO: 839043 - RNA, 21 nt, Homo sapiens
cacaguauugcucacccagug

SEQ ID NO: 839044 - RNA, 22 nt, Homo sapiens
cacaguccaaccagaaacaccc

SEQ ID NO: 839045 - RNA, 13 nt, Homo sapiens
cacaucacccaug

SEQ ID NO: 839046 - RNA, 21 nt, Homo sapiens
cacaugauaccucugaucaag

SEQ ID NO: 839047 - RNA, 12 nt, Homo sapiens
cacaugccaagc

SEQ ID NO: 839048 - RNA, 17 nt, Homo sapiens
cacaugccaagcacugu

SEQ ID NO: 839049 - RNA, 13 nt, Homo sapiens
caccagcagccug

SEQ ID NO: 839050 - RNA, 18 nt, Homo sapiens
caccaucaccagacaggu

SEQ ID NO: 839051 - RNA, 16 nt, Homo sapiens
caccauuuguauccac

SEQ ID NO: 839052 - RNA, 17 nt, Homo sapiens
cacccuucugcuguaua

SEQ ID NO: 839053 - RNA, 14 nt, Homo sapiens
cacccuugccaugg

SEQ ID NO: 839054 - RNA, 22 nt, Homo sapiens
cacccuugccauggagguuaag

SEQ ID NO: 839055 - RNA, 13 nt, Homo sapiens
caccucugcacaa

SEQ ID NO: 839056 - RNA, 15 nt, Homo sapiens
caccuggggcugcug

SEQ ID NO: 839057 - RNA, 13 nt, Homo sapiens
caccuugucacau

SEQ ID NO: 839058 - RNA, 20 nt, Homo sapiens
caccuuucuggacggaacca

SEQ ID NO: 839059 - RNA, 14 nt, Homo sapiens
cacgagcaaaccca

SEQ ID NO: 839060 - RNA, 15 nt, Homo sapiens
cacgcccagcuaauu

SEQ ID NO: 839061 - RNA, 16 nt, Homo sapiens
cacgugagaucauuca

SEQ ID NO: 839062 - RNA, 20 nt, Homo sapiens
cacgugagaucauucacuca

SEQ ID NO: 839063 - RNA, 15 nt, Homo sapiens
cacuaaccuaugagg

SEQ ID NO: 839064 - RNA, 14 nt, Homo sapiens
cacugcaggcauca

SEQ ID NO: 839065 - RNA, 18 nt, Homo sapiens
cacugccaugcagggccu

SEQ ID NO: 839066 - RNA, 20 nt, Homo sapiens
cacugcugcuccagugcagg

SEQ ID NO: 839067 - RNA, 17 nt, Homo sapiens
cacugggacuugcaaaa

SEQ ID NO: 839068 - RNA, 18 nt, Homo sapiens
cacugggacuugcaaaaa

SEQ ID NO: 839069 - RNA, 20 nt, Homo sapiens
cacuggguucccauucugag

SEQ ID NO: 839070 - RNA, 15 nt, Homo sapiens
cacuguuugucucac

SEQ ID NO: 839071 - RNA, 22 nt, Homo sapiens
cacuucugagaacucaucccua

SEQ ID NO: 839072 - RNA, 17 nt, Homo sapiens
cacuuuaacacaguguc

SEQ ID NO: 839073 - RNA, 21 nt, Homo sapiens
cagaacacagcaauuccucag

SEQ ID NO: 839074 - RNA, 21 nt, Homo sapiens
cagaaguuugagaucagccug

SEQ ID NO: 839075 - RNA, 18 nt, Homo sapiens
cagaauuucccucugaua

SEQ ID NO: 839076 - RNA, 16 nt, Homo sapiens
cagacaggaccaggga

SEQ ID NO: 839077 - RNA, 21 nt, Homo sapiens
cagagaaaauaaaagcacuua

SEQ ID NO: 839078 - RNA, 19 nt, Homo sapiens
cagagagccuggugcugcu

SEQ ID NO: 839079 - RNA, 19 nt, Homo sapiens
cagagauggaugcauguuc

SEQ ID NO: 839080 - RNA, 18 nt, Homo sapiens
cagaggaguacaggugaa

SEQ ID NO: 839081 - RNA, 16 nt, Homo sapiens
cagagguuugcuuccu

SEQ ID NO: 839082 - RNA, 17 nt, Homo sapiens
cagagguuugcuuccuc

SEQ ID NO: 839083 - RNA, 15 nt, Homo sapiens
cagcacuuacaauuu

SEQ ID NO: 839084 - RNA, 15 nt, Homo sapiens
cagcagagacggggu

SEQ ID NO: 839085 - RNA, 13 nt, Homo sapiens
cagcaucccuuga

SEQ ID NO: 839086 - RNA, 13 nt, Homo sapiens
cagccaagggaug

SEQ ID NO: 839087 - RNA, 17 nt, Homo sapiens
cagccacuaaucaggag

SEQ ID NO: 839088 - RNA, 20 nt, Homo sapiens
cagccagcucauuucacuuu

SEQ ID NO: 839089 - RNA, 19 nt, Homo sapiens
cagccccugauccugugaa

SEQ ID NO: 839090 - RNA, 21 nt, Homo sapiens
cagccguuuguuccccaagac

SEQ ID NO: 839091 - RNA, 18 nt, Homo sapiens
cagccuugcaaauagcca

SEQ ID NO: 839092 - RNA, 17 nt, Homo sapiens
cagcuaacaauugugaa

SEQ ID NO: 839093 - RNA, 12 nt, Homo sapiens
cagcuaacacac

SEQ ID NO: 839094 - RNA, 15 nt, Homo sapiens
cagcuacaauuguaa

SEQ ID NO: 839095 - RNA, 12 nt, Homo sapiens
cagcucaucucu

SEQ ID NO: 839096 - RNA, 11 nt, Homo sapiens
cagcucugcaa

SEQ ID NO: 839097 - RNA, 19 nt, Homo sapiens
cagcuggcgucaugcaaag

SEQ ID NO: 839098 - RNA, 17 nt, Homo sapiens
cagcuggguggcacugc

SEQ ID NO: 839099 - RNA, 15 nt, Homo sapiens
cagcuguguucacac

SEQ ID NO: 839100 - RNA, 20 nt, Homo sapiens
cagcuguguucacacuguaa

SEQ ID NO: 839101 - RNA, 21 nt, Homo sapiens
caggagacuuuacauggaugc

SEQ ID NO: 839102 - RNA, 19 nt, Homo sapiens
caggagagacagugaggcu

SEQ ID NO: 839103 - RNA, 14 nt, Homo sapiens
caggcaacgcacaa

SEQ ID NO: 839104 - RNA, 15 nt, Homo sapiens
caggcaacgcacaaa

SEQ ID NO: 839105 - RNA, 23 nt, Homo sapiens
caggccaccccgcugauggagcc

SEQ ID NO: 839106 - RNA, 14 nt, Homo sapiens
caggccaucaucag

SEQ ID NO: 839107 - RNA, 13 nt, Homo sapiens
caggcuacacuga

SEQ ID NO: 839108 - RNA, 15 nt, Homo sapiens
caggcuccaaacugg

SEQ ID NO: 839109 - RNA, 16 nt, Homo sapiens
caggcuccaaacugga

SEQ ID NO: 839110 - RNA, 17 nt, Homo sapiens
caggugaagcaccaagc

SEQ ID NO: 839111 - RNA, 14 nt, Homo sapiens
caggugaauggagg

SEQ ID NO: 839112 - RNA, 23 nt, Homo sapiens
caguaaacagaggaguacaggug

SEQ ID NO: 839113 - RNA, 14 nt, Homo sapiens
caguagacugugau

SEQ ID NO: 839114 - RNA, 17 nt, Homo sapiens
caguagacugugauucu

SEQ ID NO: 839115 - RNA, 12 nt, Homo sapiens
caguccaaggaa

SEQ ID NO: 839116 - RNA, 18 nt, Homo sapiens
caguccaaggaaaccaca

SEQ ID NO: 839117 - RNA, 18 nt, Homo sapiens
cagugaggcugcacccac

SEQ ID NO: 839118 - RNA, 17 nt, Homo sapiens
cagugcaggcacaguau

SEQ ID NO: 839119 - RNA, 13 nt, Homo sapiens
cagugcauaugca

SEQ ID NO: 839120 - RNA, 19 nt, Homo sapiens
caguggacucaaaacccau

SEQ ID NO: 839121 - RNA, 17 nt, Homo sapiens
caguuaagccuuuggaa

SEQ ID NO: 839122 - RNA, 15 nt, Homo sapiens
caguugcauucauua

SEQ ID NO: 839123 - RNA, 16 nt, Homo sapiens
cauaaaguaugugcau

SEQ ID NO: 839124 - RNA, 15 nt, Homo sapiens
cauaaggcauauaca

SEQ ID NO: 839125 - RNA, 14 nt, Homo sapiens
cauacuuaacuuua

SEQ ID NO: 839126 - RNA, 19 nt, Homo sapiens
cauauucaggaagcucagg

SEQ ID NO: 839127 - RNA, 21 nt, Homo sapiens
caucaaugauaaugcuaauuu

SEQ ID NO: 839128 - RNA, 13 nt, Homo sapiens
caucacaguuuug

SEQ ID NO: 839129 - RNA, 19 nt, Homo sapiens
caucagagguuugcuuccu

SEQ ID NO: 839130 - RNA, 14 nt, Homo sapiens
caucuacauacaca

SEQ ID NO: 839131 - RNA, 15 nt, Homo sapiens
caucuccaaauauca

SEQ ID NO: 839132 - RNA, 13 nt, Homo sapiens
caucucugcaauc

SEQ ID NO: 839133 - RNA, 18 nt, Homo sapiens
caucuggaaccaucagaa

SEQ ID NO: 839134 - RNA, 16 nt, Homo sapiens
caucuguaaaauggag

SEQ ID NO: 839135 - RNA, 23 nt, Homo sapiens
caugaccugaagccccucccuga

SEQ ID NO: 839136 - RNA, 17 nt, Homo sapiens
caugagaaguugauaua

SEQ ID NO: 839137 - RNA, 17 nt, Homo sapiens
caugauguuuuccauga

SEQ ID NO: 839138 - RNA, 18 nt, Homo sapiens
caugcacccucauacaca

SEQ ID NO: 839139 - RNA, 14 nt, Homo sapiens
caugccaagcacug

SEQ ID NO: 839140 - RNA, 18 nt, Homo sapiens
caugccaagcacugugcu

SEQ ID NO: 839141 - RNA, 21 nt, Homo sapiens
caugcuuagcaguccccuucc

SEQ ID NO: 839142 - RNA, 15 nt, Homo sapiens
cauggcaucaccucc

SEQ ID NO: 839143 - RNA, 19 nt, Homo sapiens
ugucucaccuacccaugac

SEQ ID NO: 839144 - RNA, 20 nt, Homo sapiens
ugugaaggcaggggaaugua

SEQ ID NO: 839145 - RNA, 18 nt, Homo sapiens
ugugcuuguuaacugagu

SEQ ID NO: 839146 - RNA, 18 nt, Homo sapiens
uguggaugauaaaacaca

SEQ ID NO: 839147 - RNA, 12 nt, Homo sapiens
ugugucagcaua

SEQ ID NO: 839148 - RNA, 17 nt, Homo sapiens
uguguucacacuguaaa

SEQ ID NO: 839149 - RNA, 21 nt, Homo sapiens
uguucacacuguaaacauuca

SEQ ID NO: 839150 - RNA, 20 nt, Homo sapiens
uguuccugaaccgaugagaa

SEQ ID NO: 839151 - RNA, 21 nt, Homo sapiens
uguucucauuugaucagggga

SEQ ID NO: 839152 - RNA, 14 nt, Homo sapiens
uguugaagccuuug

SEQ ID NO: 839153 - RNA, 13 nt, Homo sapiens
uguuggcaauuau

SEQ ID NO: 839154 - RNA, 12 nt, Homo sapiens
uguuuaagacau

SEQ ID NO: 839155 - RNA, 23 nt, Homo sapiens
uguuucugaaccauuacuguaau

SEQ ID NO: 839156 - RNA, 11 nt, Homo sapiens
uuaaacgucau

SEQ ID NO: 839157 - RNA, 24 nt, Homo sapiens
uuaaaucagccguguaaccaugga

SEQ ID NO: 839158 - RNA, 16 nt, Homo sapiens
uuaacaaaauuugaau

SEQ ID NO: 839159 - RNA, 14 nt, Homo sapiens
uuaacacagugucu

SEQ ID NO: 839160 - RNA, 16 nt, Homo sapiens
uuaacauaagcuauuu

SEQ ID NO: 839161 - RNA, 16 nt, Homo sapiens
uuaaccuacuagacaa

SEQ ID NO: 839162 - RNA, 15 nt, Homo sapiens
uuaaccugaugcagu

SEQ ID NO: 839163 - RNA, 17 nt, Homo sapiens
uuaagugagcagaacag

SEQ ID NO: 839164 - RNA, 19 nt, Homo sapiens
uuaauaucaucaguauuga

SEQ ID NO: 839165 - RNA, 15 nt, Homo sapiens
uuaauauuucugagg

SEQ ID NO: 839166 - RNA, 16 nt, Homo sapiens
uuaaucucuccaccuu

SEQ ID NO: 839167 - RNA, 13 nt, Homo sapiens
uuaaugauaauau

SEQ ID NO: 839168 - RNA, 20 nt, Homo sapiens
uuaauuacuucuuaguaugu

SEQ ID NO: 839169 - RNA, 22 nt, Homo sapiens
uuacauuauuaaauguuucuca

SEQ ID NO: 839170 - RNA, 23 nt, Homo sapiens
uuacccuuuggccccacuuugaa

SEQ ID NO: 839171 - RNA, 21 nt, Homo sapiens
uuacuaaacauguauguaaau

SEQ ID NO: 839172 - RNA, 22 nt, Homo sapiens
uuacucauaaggcauauacaaa

SEQ ID NO: 839173 - RNA, 15 nt, Homo sapiens
uuagacagucccugc

SEQ ID NO: 839174 - RNA, 22 nt, Homo sapiens
uuagcacccuucugcuguauac

SEQ ID NO: 839175 - RNA, 15 nt, Homo sapiens
uuagcccaaaaccaa

SEQ ID NO: 839176 - RNA, 19 nt, Homo sapiens
uuagugguuacccaguuag

SEQ ID NO: 839177 - RNA, 15 nt, Homo sapiens
uuauaaaucgcuuuu

SEQ ID NO: 839178 - RNA, 14 nt, Homo sapiens
uuaucaucacaaau

SEQ ID NO: 839179 - RNA, 18 nt, Homo sapiens
uuaucucacuugugccaa

SEQ ID NO: 839180 - RNA, 16 nt, Homo sapiens
uuauugauguuuucau

SEQ ID NO: 839181 - RNA, 18 nt, Homo sapiens
uucaaacggccucacuag

SEQ ID NO: 839182 - RNA, 14 nt, Homo sapiens
uucaaguacuguaa

SEQ ID NO: 839183 - RNA, 15 nt, Homo sapiens
uucaaguacuguaac

SEQ ID NO: 839184 - RNA, 16 nt, Homo sapiens
uucacagcacuuacaa

SEQ ID NO: 839185 - RNA, 22 nt, Homo sapiens
uucacuggguucccauucugag

SEQ ID NO: 839186 - RNA, 10 nt, Homo sapiens
uucacuuuga

SEQ ID NO: 839187 - RNA, 17 nt, Homo sapiens
uucagauaacuguuauu

SEQ ID NO: 839188 - RNA, 15 nt, Homo sapiens
uucaggaagcagcuu

SEQ ID NO: 839189 - RNA, 14 nt, Homo sapiens
uucaucaagcugua

SEQ ID NO: 839190 - RNA, 19 nt, Homo sapiens
uuccagugaacauucccag

SEQ ID NO: 839191 - RNA, 22 nt, Homo sapiens
uucccaaaagcccauucauucc

SEQ ID NO: 839192 - RNA, 22 nt, Homo sapiens
uucccuacaguugaaaaacagc

SEQ ID NO: 839193 - RNA, 19 nt, Homo sapiens
uucccuagucuauucauua

SEQ ID NO: 839194 - RNA, 21 nt, Homo sapiens
uuccgcaccaauaaagccuuc

SEQ ID NO: 839195 - RNA, 14 nt, Homo sapiens
uuccucaugugauc

SEQ ID NO: 839196 - RNA, 18 nt, Homo sapiens
uuccucauuagcauuuug

SEQ ID NO: 839197 - RNA, 12 nt, Homo sapiens
uuccugaggcug

SEQ ID NO: 839198 - RNA, 22 nt, Homo sapiens
uuccuggcacugcuuccaguga

SEQ ID NO: 839199 - RNA, 17 nt, Homo sapiens
uucuccaagcaggacau

SEQ ID NO: 839200 - RNA, 24 nt, Homo sapiens
uucuccaagcaggacauggacaag

SEQ ID NO: 839201 - RNA, 17 nt, Homo sapiens
uucuccaccugccaggg

SEQ ID NO: 839202 - RNA, 15 nt, Homo sapiens
uucucccucauuuca

SEQ ID NO: 839203 - RNA, 20 nt, Homo sapiens
uucuccugccugugcuguga

SEQ ID NO: 839204 - RNA, 22 nt, Homo sapiens
uucucuugagaggguggaauau

SEQ ID NO: 839205 - RNA, 18 nt, Homo sapiens
uucugacccaaccacaga

SEQ ID NO: 839206 - RNA, 17 nt, Homo sapiens
uucugcuguauacugua

SEQ ID NO: 839207 - RNA, 22 nt, Homo sapiens
uucugggaugcaauacuaggaa

SEQ ID NO: 839208 - RNA, 16 nt, Homo sapiens
uucuuagcucaaugag

SEQ ID NO: 839209 - RNA, 15 nt, Homo sapiens
uucuuguaaggcaua

SEQ ID NO: 839210 - RNA, 16 nt, Homo sapiens
uucuuguacucuacaa

SEQ ID NO: 839211 - RNA, 14 nt, Homo sapiens
uugaaauagugucu

SEQ ID NO: 839212 - RNA, 20 nt, Homo sapiens
uugauaaucaacugggcuga

SEQ ID NO: 839213 - RNA, 16 nt, Homo sapiens
uugauauuucacuuac

SEQ ID NO: 839214 - RNA, 21 nt, Homo sapiens
uugcaucagcaacaaccagca

SEQ ID NO: 839215 - RNA, 15 nt, Homo sapiens
uugcucugagugcua

SEQ ID NO: 839216 - RNA, 12 nt, Homo sapiens
uugcuucacuca

SEQ ID NO: 839217 - RNA, 13 nt, Homo sapiens
uugcuuugcccag

SEQ ID NO: 839218 - RNA, 22 nt, Homo sapiens
ugaaaagaauuguuggggguuu

SEQ ID NO: 839219 - RNA, 19 nt, Homo sapiens
ugaaaucaguuacucuuca

SEQ ID NO: 839220 - RNA, 16 nt, Homo sapiens
ugaaaugcauuuugcu

SEQ ID NO: 839221 - RNA, 15 nt, Homo sapiens
ugaagaaucuguuuc

SEQ ID NO: 839222 - RNA, 16 nt, Homo sapiens
ugaagaauuuaucucu

SEQ ID NO: 839223 - RNA, 19 nt, Homo sapiens
ugaagucccagauacuugg

SEQ ID NO: 839224 - RNA, 13 nt, Homo sapiens
ugaauaauacagu

SEQ ID NO: 839225 - RNA, 22 nt, Homo sapiens
ugaauaauacaguaucucaggg

SEQ ID NO: 839226 - RNA, 15 nt, Homo sapiens
ugaauaucaguuauu

SEQ ID NO: 839227 - RNA, 16 nt, Homo sapiens
ugaauuucccacauac

SEQ ID NO: 839228 - RNA, 22 nt, Homo sapiens
ugacacaggaugaaggcaaugc

SEQ ID NO: 839229 - RNA, 21 nt, Homo sapiens
ugacaggcagcagagacuugg

SEQ ID NO: 839230 - RNA, 16 nt, Homo sapiens
ugaccaaugggaugag

SEQ ID NO: 839231 - RNA, 20 nt, Homo sapiens
ugaccucgcccuccacaaau

SEQ ID NO: 839232 - RNA, 17 nt, Homo sapiens
ugaccugccucccuuca

SEQ ID NO: 839233 - RNA, 21 nt, Homo sapiens
ugaccuuguaccucucuuuga

SEQ ID NO: 839234 - RNA, 20 nt, Homo sapiens
ugacgcuugugacagugccu

SEQ ID NO: 839235 - RNA, 14 nt, Homo sapiens
ugagaacacuguga

SEQ ID NO: 839236 - RNA, 15 nt, Homo sapiens
ugagagaccaggcaa

SEQ ID NO: 839237 - RNA, 15 nt, Homo sapiens
ugagaucauugugaa

SEQ ID NO: 839238 - RNA, 22 nt, Homo sapiens
ugagaugaacccuggcauuugg

SEQ ID NO: 839239 - RNA, 15 nt, Homo sapiens
ugagcaucccaggau

SEQ ID NO: 839240 - RNA, 14 nt, Homo sapiens
ugagcuaacuuaua

SEQ ID NO: 839241 - RNA, 20 nt, Homo sapiens
ugaggacuugggcgggacac

SEQ ID NO: 839242 - RNA, 16 nt, Homo sapiens
ugaguacuacaguccu

SEQ ID NO: 839243 - RNA, 15 nt, Homo sapiens
ugagugggugaauaa

SEQ ID NO: 839244 - RNA, 14 nt, Homo sapiens
ugaguuuauacuca

SEQ ID NO: 839245 - RNA, 15 nt, Homo sapiens
ugaguuuguacaguc

SEQ ID NO: 839246 - RNA, 21 nt, Homo sapiens
ugauaagagggcacacacugu

SEQ ID NO: 839247 - RNA, 21 nt, Homo sapiens
ugauauagaacagugcuugcc

SEQ ID NO: 839248 - RNA, 14 nt, Homo sapiens
ugaucacaauuugc

SEQ ID NO: 839249 - RNA, 24 nt, Homo sapiens
ugauuauauuucacccaucucuca

SEQ ID NO: 839250 - RNA, 23 nt, Homo sapiens
ugcaacaugccagccacugugau

SEQ ID NO: 839251 - RNA, 22 nt, Homo sapiens
ugcaagaauugaagcaggacua

SEQ ID NO: 839252 - RNA, 18 nt, Homo sapiens
ugcacaaacucaccaucu

SEQ ID NO: 839253 - RNA, 16 nt, Homo sapiens
ugcacacgcuccuucc

SEQ ID NO: 839254 - RNA, 14 nt, Homo sapiens
ugcaccacugcacu

SEQ ID NO: 839255 - RNA, 15 nt, Homo sapiens
ugcacccacccagga

SEQ ID NO: 839256 - RNA, 24 nt, Homo sapiens
ugcacuuuguucuggcucuuccag

SEQ ID NO: 839257 - RNA, 23 nt, Homo sapiens
ugcagccucacaguccuuaccag

SEQ ID NO: 839258 - RNA, 16 nt, Homo sapiens
ugcagcuaacuuauca

SEQ ID NO: 839259 - RNA, 17 nt, Homo sapiens
ugcaggagagacaguga

SEQ ID NO: 839260 - RNA, 22 nt, Homo sapiens
ugcauaggugaucucauuuaau

SEQ ID NO: 839261 - RNA, 21 nt, Homo sapiens
ugcaugcgagugcucauuuca

SEQ ID NO: 839262 - RNA, 14 nt, Homo sapiens
ugcauuuaauuaga

SEQ ID NO: 839263 - RNA, 18 nt, Homo sapiens
ugccaaauuuuagauuua

SEQ ID NO: 839264 - RNA, 21 nt, Homo sapiens
ugccaaccggucacccaggag

SEQ ID NO: 839265 - RNA, 22 nt, Homo sapiens
ugccaagucucccaauauccaa

SEQ ID NO: 839266 - RNA, 23 nt, Homo sapiens
ugccauugacuucuucccaagau

SEQ ID NO: 839267 - RNA, 18 nt, Homo sapiens
ugcccggcaggguccuag

SEQ ID NO: 839268 - RNA, 15 nt, Homo sapiens
ugcccucagauuccg

SEQ ID NO: 839269 - RNA, 13 nt, Homo sapiens
ugccgcaccagcc

SEQ ID NO: 839270 - RNA, 13 nt, Homo sapiens
ugccucuacccaa

SEQ ID NO: 839271 - RNA, 17 nt, Homo sapiens
ugcgaauaagcuuuuaa

SEQ ID NO: 839272 - RNA, 18 nt, Homo sapiens
ugcggccuuuggcuucac

SEQ ID NO: 839273 - RNA, 20 nt, Homo sapiens
ugcuccuggaucucccugag

SEQ ID NO: 839274 - RNA, 18 nt, Homo sapiens
ugcucugagugcuagcua

SEQ ID NO: 839275 - RNA, 16 nt, Homo sapiens
ugcugaaggguaauau

SEQ ID NO: 839276 - RNA, 15 nt, Homo sapiens
ugcugauguccucac

SEQ ID NO: 839277 - RNA, 14 nt, Homo sapiens
ugcugcuuagcuug

SEQ ID NO: 839278 - RNA, 15 nt, Homo sapiens
ugcuguauacuguac

SEQ ID NO: 839279 - RNA, 18 nt, Homo sapiens
uggaaagaguaggaagac

SEQ ID NO: 839280 - RNA, 20 nt, Homo sapiens
uggaaauucccuucaucugg

SEQ ID NO: 839281 - RNA, 17 nt, Homo sapiens
uggaacaagcacagaug

SEQ ID NO: 839282 - RNA, 20 nt, Homo sapiens
uggaacagauucacacuguc

SEQ ID NO: 839283 - RNA, 18 nt, Homo sapiens
uggaagacacauugaaag

SEQ ID NO: 839284 - RNA, 23 nt, Homo sapiens
uggaagguggggacagggaugag

SEQ ID NO: 839285 - RNA, 19 nt, Homo sapiens
uggaaguugcauggcauca

SEQ ID NO: 839286 - RNA, 18 nt, Homo sapiens
ccaaagugcaggacauca

SEQ ID NO: 839287 - RNA, 20 nt, Homo sapiens
ccaaauuuaauuaaagccuu

SEQ ID NO: 839288 - RNA, 23 nt, Homo sapiens
ccaaauuuaauuaaagccuuaag

SEQ ID NO: 839289 - RNA, 22 nt, Homo sapiens
ccaaauuuuauuaaaagaguag

SEQ ID NO: 839290 - RNA, 17 nt, Homo sapiens
ccaagaacuugcaauac

SEQ ID NO: 839291 - RNA, 15 nt, Homo sapiens
ccaaggacuccaaag

SEQ ID NO: 839292 - RNA, 18 nt, Homo sapiens
ccaauccucccuggagaa

SEQ ID NO: 839293 - RNA, 21 nt, Homo sapiens
ccaauguucuaaaguuuugca

SEQ ID NO: 839294 - RNA, 14 nt, Homo sapiens
ccacaaaaguuccc

SEQ ID NO: 839295 - RNA, 17 nt, Homo sapiens
ccacagcacuagaguca

SEQ ID NO: 839296 - RNA, 16 nt, Homo sapiens
ccaccagcaaugcccu

SEQ ID NO: 839297 - RNA, 14 nt, Homo sapiens
ccacccuagcuuua

SEQ ID NO: 839298 - RNA, 21 nt, Homo sapiens
ccagaauggaauuuugcuaca

SEQ ID NO: 839299 - RNA, 20 nt, Homo sapiens
ccagacuuuuuuaaauguuu

SEQ ID NO: 839300 - RNA, 14 nt, Homo sapiens
ccagagcacaagaa

SEQ ID NO: 839301 - RNA, 13 nt, Homo sapiens
ccagcccacuggg

SEQ ID NO: 839302 - RNA, 14 nt, Homo sapiens
ccaggccuccagaa

SEQ ID NO: 839303 - RNA, 15 nt, Homo sapiens
ccagggaugcaaagg

SEQ ID NO: 839304 - RNA, 21 nt, Homo sapiens
ccauaaaucaauucauugugu

SEQ ID NO: 839305 - RNA, 15 nt, Homo sapiens
ccauaccagucaccu

SEQ ID NO: 839306 - RNA, 12 nt, Homo sapiens
ccauuugcugcc

SEQ ID NO: 839307 - RNA, 13 nt, Homo sapiens
cccaaagagcugu

SEQ ID NO: 839308 - RNA, 14 nt, Homo sapiens
cccaauccaugcuu

SEQ ID NO: 839309 - RNA, 21 nt, Homo sapiens
ccccaaauuuaauuaaagccu

SEQ ID NO: 839310 - RNA, 11 nt, Homo sapiens
ccccacugacc

SEQ ID NO: 839311 - RNA, 15 nt, Homo sapiens
ccccagcaguugaau

SEQ ID NO: 839312 - RNA, 16 nt, Homo sapiens
ccccaggccuccagaa

SEQ ID NO: 839313 - RNA, 23 nt, Homo sapiens
cccugccuguggaggugaccugu

SEQ ID NO: 839314 - RNA, 22 nt, Homo sapiens
ccgaauucuaugagcaugccaa

SEQ ID NO: 839315 - RNA, 22 nt, Homo sapiens
ccggccgcagcccccacugacc

SEQ ID NO: 839316 - RNA, 21 nt, Homo sapiens
ccuaucucuacuaaaaauaca

SEQ ID NO: 839317 - RNA, 14 nt, Homo sapiens
ccucacauauuauu

SEQ ID NO: 839318 - RNA, 14 nt, Homo sapiens
ccucacucaggaac

SEQ ID NO: 839319 - RNA, 23 nt, Homo sapiens
ccugacuggggucauuguguaag

SEQ ID NO: 839320 - RNA, 20 nt, Homo sapiens
ccuguaauuaaacuaguuua

SEQ ID NO: 839321 - RNA, 20 nt, Homo sapiens
ccuguuaggucucaugccca

SEQ ID NO: 839322 - RNA, 20 nt, Homo sapiens
ccuuucccagguaauuuaaa

SEQ ID NO: 839323 - RNA, 17 nt, Homo sapiens
cgaaagaggugaaagag

SEQ ID NO: 839324 - RNA, 15 nt, Homo sapiens
cgagaugaguuucug

SEQ ID NO: 839325 - RNA, 16 nt, Homo sapiens
cgaucaggaccugcuu

SEQ ID NO: 839326 - RNA, 15 nt, Homo sapiens
cgcuggacaccuaca

SEQ ID NO: 839327 - RNA, 18 nt, Homo sapiens
cggaggacgcuggggaaa

SEQ ID NO: 839328 - RNA, 18 nt, Homo sapiens
cggccaggcucccugacc

SEQ ID NO: 839329 - RNA, 15 nt, Homo sapiens
cggcgaagaggaccc

SEQ ID NO: 839330 - RNA, 14 nt, Homo sapiens
cgggaagugcagcg

SEQ ID NO: 839331 - RNA, 22 nt, Homo sapiens
cggugaaaccccaucucuacua

SEQ ID NO: 839332 - RNA, 16 nt, Homo sapiens
cgucacuacugcuacc

SEQ ID NO: 839333 - RNA, 15 nt, Homo sapiens
cuaaaaggaugucua

SEQ ID NO: 839334 - RNA, 21 nt, Homo sapiens
cuaaaguuuugcaacaauaaa

SEQ ID NO: 839335 - RNA, 15 nt, Homo sapiens
cuaaaucucuaauau

SEQ ID NO: 839336 - RNA, 13 nt, Homo sapiens
cuaagcaagccag

SEQ ID NO: 839337 - RNA, 12 nt, Homo sapiens
cuacaucugccu

SEQ ID NO: 839338 - RNA, 18 nt, Homo sapiens
cuaccaaaaacuagacau

SEQ ID NO: 839339 - RNA, 19 nt, Homo sapiens
cuacucgggaggcugaggu

SEQ ID NO: 839340 - RNA, 13 nt, Homo sapiens
cuagacauuauuu

SEQ ID NO: 839341 - RNA, 16 nt, Homo sapiens
cuaguuaaaagccuuu

SEQ ID NO: 839342 - RNA, 13 nt, Homo sapiens
cuauaaacacugu

SEQ ID NO: 839343 - RNA, 19 nt, Homo sapiens
cuauaacauagaauugcaa

SEQ ID NO: 839344 - RNA, 20 nt, Homo sapiens
cuauaacauagaauugcaau

SEQ ID NO: 839345 - RNA, 20 nt, Homo sapiens
cuauaauaaguuuugauaua

SEQ ID NO: 839346 - RNA, 19 nt, Homo sapiens
cuauuuuaaaccaauugca

SEQ ID NO: 839347 - RNA, 18 nt, Homo sapiens
cucaaauuguaauuaaua

SEQ ID NO: 839348 - RNA, 12 nt, Homo sapiens
cucaacaagcaa

SEQ ID NO: 839349 - RNA, 20 nt, Homo sapiens
cucaacaagcaagaucugcu

SEQ ID NO: 839350 - RNA, 17 nt, Homo sapiens
cucauuagcugaauuga

SEQ ID NO: 839351 - RNA, 16 nt, Homo sapiens
cuccaaggaggugaca

SEQ ID NO: 839352 - RNA, 16 nt, Homo sapiens
cucugaauaagcacuu

SEQ ID NO: 839353 - RNA, 20 nt, Homo sapiens
cucuggcuucccugcccaau

SEQ ID NO: 839354 - RNA, 19 nt, Homo sapiens
cugaaaguccugcuuuccu

SEQ ID NO: 839355 - RNA, 23 nt, Homo sapiens
cugaaccucuucaagagcaucug

SEQ ID NO: 839356 - RNA, 14 nt, Homo sapiens
cugaaucuucugaa

SEQ ID NO: 839357 - RNA, 20 nt, Homo sapiens
cugaccacccugccugugga

SEQ ID NO: 839358 - RNA, 13 nt, Homo sapiens
cugccuugcugcc

SEQ ID NO: 839359 - RNA, 16 nt, Homo sapiens
cuggagacagaaguca

SEQ ID NO: 839360 - RNA, 19 nt, Homo sapiens
cuggaggaaccacauauaa

SEQ ID NO: 839361 - RNA, 12 nt, Homo sapiens
cuggcacugaca

SEQ ID NO: 839362 - RNA, 20 nt, Homo sapiens
cuggcacuguggcacugcca

SEQ ID NO: 839363 - RNA, 17 nt, Homo sapiens
cuggcuaacacggugaa

SEQ ID NO: 839364 - RNA, 20 nt, Homo sapiens
cuggcuucccugcccaaucc

SEQ ID NO: 839365 - RNA, 16 nt, Homo sapiens
cuggggcaggaccacu

SEQ ID NO: 839366 - RNA, 22 nt, Homo sapiens
cugggguguaaugagcuccugc

SEQ ID NO: 839367 - RNA, 17 nt, Homo sapiens
cugguaaaagcaccauu

SEQ ID NO: 839368 - RNA, 17 nt, Homo sapiens
cuguacuaaaauaugca

SEQ ID NO: 839369 - RNA, 20 nt, Homo sapiens
cuguaugauucuauggagcu

SEQ ID NO: 839370 - RNA, 13 nt, Homo sapiens
cugucuuugcaaa

SEQ ID NO: 839371 - RNA, 19 nt, Homo sapiens
cuguuuguauauuugcaaa

SEQ ID NO: 839372 - RNA, 20 nt, Homo sapiens
cuuaaaaaaaacucuuuaac

SEQ ID NO: 839373 - RNA, 15 nt, Homo sapiens
cuuaaacagugucca

SEQ ID NO: 839374 - RNA, 21 nt, Homo sapiens
cuuaaaggcaccaucuaauag

SEQ ID NO: 839375 - RNA, 11 nt, Homo sapiens
cuuaagccauc

SEQ ID NO: 839376 - RNA, 23 nt, Homo sapiens
cuuaaugguaggucaaguaauaa

SEQ ID NO: 839377 - RNA, 18 nt, Homo sapiens
cuucaaauuggucugaaa

SEQ ID NO: 839378 - RNA, 19 nt, Homo sapiens
cuucaagagcaucuggaac

SEQ ID NO: 839379 - RNA, 16 nt, Homo sapiens
cuucagcuugcuuaga

SEQ ID NO: 839380 - RNA, 22 nt, Homo sapiens
cuucauucgagaugaguuucug

SEQ ID NO: 839381 - RNA, 22 nt, Homo sapiens
cuugaguggagguuuauaguua

SEQ ID NO: 839382 - RNA, 18 nt, Homo sapiens
cuugauucuugugauuga

SEQ ID NO: 839383 - RNA, 18 nt, Homo sapiens
cuugcggccacagcacua

SEQ ID NO: 839384 - RNA, 18 nt, Homo sapiens
cuuucaacucauugcauc

SEQ ID NO: 839385 - RNA, 13 nt, Homo sapiens
cuuucccaaauaa

SEQ ID NO: 839386 - RNA, 17 nt, Homo sapiens
cuuuguuuaaaugccaa

SEQ ID NO: 839387 - RNA, 17 nt, Homo sapiens
cuuuuuaaaaaauacca

SEQ ID NO: 839388 - RNA, 23 nt, Homo sapiens
cuuuuuugaaaucaguaaacacu

SEQ ID NO: 839389 - RNA, 17 nt, Homo sapiens
cuuuuuuguacuuuucu

SEQ ID NO: 839390 - RNA, 13 nt, Homo sapiens
gaaaagcaugaaa

SEQ ID NO: 839391 - RNA, 12 nt, Homo sapiens
gaaaccaugaca

SEQ ID NO: 839392 - RNA, 19 nt, Homo sapiens
gaaaccccaucucuacuaa

SEQ ID NO: 839393 - RNA, 21 nt, Homo sapiens
gaaacccuaucucuacuaaaa

SEQ ID NO: 839394 - RNA, 15 nt, Homo sapiens
gaaagaaaaggcaaa

SEQ ID NO: 839395 - RNA, 16 nt, Homo sapiens
gaaaguugcuuuuauu

SEQ ID NO: 839396 - RNA, 15 nt, Homo sapiens
gaaauacaacagaag

SEQ ID NO: 839397 - RNA, 20 nt, Homo sapiens
gaaauagcuacagugacaga

SEQ ID NO: 839398 - RNA, 15 nt, Homo sapiens
gaaaucacaagaaca

SEQ ID NO: 839399 - RNA, 18 nt, Homo sapiens
gaaaucaguaaacacugu

SEQ ID NO: 839400 - RNA, 21 nt, Homo sapiens
gaaaucaguaaacacugugua

SEQ ID NO: 839401 - RNA, 15 nt, Homo sapiens
gaaccuuacuggcac

SEQ ID NO: 839402 - RNA, 17 nt, Homo sapiens
gaaccuuacuggcacug

SEQ ID NO: 839403 - RNA, 15 nt, Homo sapiens
aucaauucauugugu

SEQ ID NO: 839404 - RNA, 16 nt, Homo sapiens
aucagaaaaugcagcc

SEQ ID NO: 839405 - RNA, 21 nt, Homo sapiens
aucagacuugcggccacagca

SEQ ID NO: 839406 - RNA, 14 nt, Homo sapiens
aucagcacugccag

SEQ ID NO: 839407 - RNA, 21 nt, Homo sapiens
aucauaaccacccuagcuuua

SEQ ID NO: 839408 - RNA, 21 nt, Homo sapiens
aucauauugguauucacuaau

SEQ ID NO: 839409 - RNA, 20 nt, Homo sapiens
aucauucagcgcaugcaccu

SEQ ID NO: 839410 - RNA, 24 nt, Homo sapiens
auccagaauggaauuuugcuacau

SEQ ID NO: 839411 - RNA, 21 nt, Homo sapiens
auccauuuuuaucaggauuuc

SEQ ID NO: 839412 - RNA, 15 nt, Homo sapiens
aucccuuccuuguua

SEQ ID NO: 839413 - RNA, 13 nt, Homo sapiens
aucuauaaacacu

SEQ ID NO: 839414 - RNA, 16 nt, Homo sapiens
aucuauaaacacuguu

SEQ ID NO: 839415 - RNA, 13 nt, Homo sapiens
aucuguacuuugu

SEQ ID NO: 839416 - RNA, 16 nt, Homo sapiens
aucuuuuuucccccac

SEQ ID NO: 839417 - RNA, 21 nt, Homo sapiens
augaaauaaaagaaacaaaug

SEQ ID NO: 839418 - RNA, 20 nt, Homo sapiens
augaaggagugcgugccugc

SEQ ID NO: 839419 - RNA, 12 nt, Homo sapiens
augacauguuau

SEQ ID NO: 839420 - RNA, 16 nt, Homo sapiens
augaguuucugaggau

SEQ ID NO: 839421 - RNA, 15 nt, Homo sapiens
augauuaacaaagca

SEQ ID NO: 839422 - RNA, 22 nt, Homo sapiens
augcuguacuaaaauaugcagg

SEQ ID NO: 839423 - RNA, 14 nt, Homo sapiens
auggggucugggug

SEQ ID NO: 839424 - RNA, 14 nt, Homo sapiens
augugacuuugaaa

SEQ ID NO: 839425 - RNA, 12 nt, Homo sapiens
auguuugcaaug

SEQ ID NO: 839426 - RNA, 16 nt, Homo sapiens
auuaauauaaccauaa

SEQ ID NO: 839427 - RNA, 21 nt, Homo sapiens
auuauucaggcuuuaggcaua

SEQ ID NO: 839428 - RNA, 14 nt, Homo sapiens
auuccaugcacucu

SEQ ID NO: 839429 - RNA, 17 nt, Homo sapiens
auucuccuguccuugua

SEQ ID NO: 839430 - RNA, 14 nt, Homo sapiens
auugcaaucuauaa

SEQ ID NO: 839431 - RNA, 20 nt, Homo sapiens
auugcccauuguuuuucuga

SEQ ID NO: 839432 - RNA, 16 nt, Homo sapiens
auuggcagccaaggaa

SEQ ID NO: 839433 - RNA, 22 nt, Homo sapiens
auuggucaagaaaagcaugaaa

SEQ ID NO: 839434 - RNA, 18 nt, Homo sapiens
auuguguuggcuuuacaa

SEQ ID NO: 839435 - RNA, 18 nt, Homo sapiens
auuuagaacuguauguca

SEQ ID NO: 839436 - RNA, 16 nt, Homo sapiens
auuuauugagugccaa

SEQ ID NO: 839437 - RNA, 18 nt, Homo sapiens
auuucauuucaggugcau

SEQ ID NO: 839438 - RNA, 12 nt, Homo sapiens
auuucuauucaa

SEQ ID NO: 839439 - RNA, 15 nt, Homo sapiens
auuucugaacaaaga

SEQ ID NO: 839440 - RNA, 16 nt, Homo sapiens
auuucuguauacugua

SEQ ID NO: 839441 - RNA, 15 nt, Homo sapiens
auuuguguguucacu

SEQ ID NO: 839442 - RNA, 16 nt, Homo sapiens
auuuuaagaaagagaa

SEQ ID NO: 839443 - RNA, 22 nt, Homo sapiens
caaaaauaucuuuuuuccccca

SEQ ID NO: 839444 - RNA, 18 nt, Homo sapiens
caaaagaaaccaugacaa

SEQ ID NO: 839445 - RNA, 14 nt, Homo sapiens
caaaauguacuuaa

SEQ ID NO: 839446 - RNA, 17 nt, Homo sapiens
aggaucagcacugccag

SEQ ID NO: 839447 - RNA, 17 nt, Homo sapiens
aggaugucuaaauguuu

SEQ ID NO: 839448 - RNA, 17 nt, Homo sapiens
aggccaagaacuugcaa

SEQ ID NO: 839449 - RNA, 17 nt, Homo sapiens
aggccagcccacugggc

SEQ ID NO: 839450 - RNA, 18 nt, Homo sapiens
aggcgcucagccuuggcu

SEQ ID NO: 839451 - RNA, 21 nt, Homo sapiens
aggcucugugggaggaugaag

SEQ ID NO: 839452 - RNA, 21 nt, Homo sapiens
agggaugcaaagguugcagug

SEQ ID NO: 839453 - RNA, 18 nt, Homo sapiens
agggcaguacaaugugac

SEQ ID NO: 839454 - RNA, 20 nt, Homo sapiens
agggcaugauuaacaaagca

SEQ ID NO: 839455 - RNA, 14 nt, Homo sapiens
agggcccucacuca

SEQ ID NO: 839456 - RNA, 21 nt, Homo sapiens
aggugcauuggagauucuuag

SEQ ID NO: 839457 - RNA, 21 nt, Homo sapiens
agguuucuauuuucucugaua

SEQ ID NO: 839458 - RNA, 16 nt, Homo sapiens
aguauucuugucaaaa

SEQ ID NO: 839459 - RNA, 21 nt, Homo sapiens
aguauuuaacuacaucugccu

SEQ ID NO: 839460 - RNA, 11 nt, Homo sapiens
agucagguguc

SEQ ID NO: 839461 - RNA, 22 nt, Homo sapiens
agucauggaggccaagaacuug

SEQ ID NO: 839462 - RNA, 17 nt, Homo sapiens
aguccaugaaaauacca

SEQ ID NO: 839463 - RNA, 19 nt, Homo sapiens
agugagaaggcaaccaaag

SEQ ID NO: 839464 - RNA, 16 nt, Homo sapiens
agugagugccaugcuu

SEQ ID NO: 839465 - RNA, 15 nt, Homo sapiens
agugcugcagcuuug

SEQ ID NO: 839466 - RNA, 18 nt, Homo sapiens
aguuauaauaacugaacu

SEQ ID NO: 839467 - RNA, 18 nt, Homo sapiens
aguuucuuuuauuuucau

SEQ ID NO: 839468 - RNA, 18 nt, Homo sapiens
auaaauaaaacagcagca

SEQ ID NO: 839469 - RNA, 16 nt, Homo sapiens
auaacauagaauugca

SEQ ID NO: 839470 - RNA, 22 nt, Homo sapiens
auacagcccucccccagcaguu

SEQ ID NO: 839471 - RNA, 15 nt, Homo sapiens
auagauuaaaucaua

SEQ ID NO: 839472 - RNA, 17 nt, Homo sapiens
auagcuacagugacaga

SEQ ID NO: 839473 - RNA, 21 nt, Homo sapiens
auauaaccauaaaucaauuca

SEQ ID NO: 839474 - RNA, 16 nt, Homo sapiens
auauagguugugcaaa

SEQ ID NO: 839475 - RNA, 17 nt, Homo sapiens
auaucuauaaacacugu

SEQ ID NO: 839476 - RNA, 19 nt, Homo sapiens
auauguaaauagugcagaa

SEQ ID NO: 839477 - RNA, 22 nt, Homo sapiens
auauugaauagggcuaggaaua

SEQ ID NO: 839478 - RNA, 18 nt, Homo sapiens
auauuguguugugcagca

SEQ ID NO: 839479 - RNA, 14 nt, Homo sapiens
auauuuacaaccua

SEQ ID NO: 839480 - RNA, 23 nt, Homo sapiens
auauuuuaagaaagagaaugaac

SEQ ID NO: 839481 - RNA, 19 nt, Homo sapiens
aucacaucuaaagcuuuau

SEQ ID NO: 839482 - RNA, 16 nt, Homo sapiens
aucaccuugcauuuca

SEQ ID NO: 839483 - RNA, 15 nt, Homo sapiens
aucaguaaacacugu

SEQ ID NO: 839484 - RNA, 12 nt, Homo sapiens
aucagucuuaau

SEQ ID NO: 839485 - RNA, 19 nt, Homo sapiens
aucauacuccuaugcuuua

SEQ ID NO: 839486 - RNA, 13 nt, Homo sapiens
aucaucagucuua

SEQ ID NO: 839487 - RNA, 13 nt, Homo sapiens
auccgggaggaca

SEQ ID NO: 839488 - RNA, 19 nt, Homo sapiens
aucuauaacuacauauuga

SEQ ID NO: 839489 - RNA, 20 nt, Homo sapiens
aucuccaguauucuugucaa

SEQ ID NO: 839490 - RNA, 23 nt, Homo sapiens
aucugguaaaagcaccauuguga

SEQ ID NO: 839491 - RNA, 23 nt, Homo sapiens
aucuuuggggaaacuaacaauau

SEQ ID NO: 839492 - RNA, 12 nt, Homo sapiens
augaacuuucuc

SEQ ID NO: 839493 - RNA, 21 nt, Homo sapiens
augacacacugcggugucugc

SEQ ID NO: 839494 - RNA, 13 nt, Homo sapiens
augagacuguguu

SEQ ID NO: 839495 - RNA, 23 nt, Homo sapiens
augaugaaacccuaucucuacua

SEQ ID NO: 839496 - RNA, 20 nt, Homo sapiens
augccuuccgacaccacugg

SEQ ID NO: 839497 - RNA, 21 nt, Homo sapiens
augccuuccgacaccacuggg

SEQ ID NO: 839498 - RNA, 20 nt, Homo sapiens
auggauuuauugagugccaa

SEQ ID NO: 839499 - RNA, 15 nt, Homo sapiens
auggcuauauggcaa

SEQ ID NO: 839500 - RNA, 13 nt, Homo sapiens
augguaacuuuac

SEQ ID NO: 839501 - RNA, 21 nt, Homo sapiens
auguaaaggucacuuuucaca

SEQ ID NO: 839502 - RNA, 18 nt, Homo sapiens
augugacugccaucaucu

SEQ ID NO: 839503 - RNA, 13 nt, Homo sapiens
auguuguguuguu

SEQ ID NO: 839504 - RNA, 13 nt, Homo sapiens
auguuugcaaugu

SEQ ID NO: 839505 - RNA, 15 nt, Homo sapiens
auguuuguacaagau

SEQ ID NO: 839506 - RNA, 15 nt, Homo sapiens
auuaaaagaguagaa

SEQ ID NO: 839507 - RNA, 23 nt, Homo sapiens
auucacuggggcaugagauuuug

SEQ ID NO: 839508 - RNA, 19 nt, Homo sapiens
auucaugcaacuugauucu

SEQ ID NO: 839509 - RNA, 11 nt, Homo sapiens
auuccaaggaa

SEQ ID NO: 839510 - RNA, 15 nt, Homo sapiens
auuccaggagauugg

SEQ ID NO: 839511 - RNA, 21 nt, Homo sapiens
auugaauagggcuaggaauau

SEQ ID NO: 839512 - RNA, 16 nt, Homo sapiens
auugcaucauuuacaa

SEQ ID NO: 839513 - RNA, 14 nt, Homo sapiens
auugcuaccaaaaa

SEQ ID NO: 839514 - RNA, 13 nt, Homo sapiens
auuguacaagcag

SEQ ID NO: 839515 - RNA, 19 nt, Homo sapiens
auuguguugugcagcauua

SEQ ID NO: 839516 - RNA, 22 nt, Homo sapiens
auuuucauauugcuaccaaaaa

SEQ ID NO: 839517 - RNA, 16 nt, Homo sapiens
auuuucucugauacuu

SEQ ID NO: 839518 - RNA, 17 nt, Homo sapiens
caaaauaaagaauagca

SEQ ID NO: 839519 - RNA, 18 nt, Homo sapiens
caaagagacccagucaau

SEQ ID NO: 839520 - RNA, 21 nt, Homo sapiens
caaagccgcggggacaccggg

SEQ ID NO: 839521 - RNA, 15 nt, Homo sapiens
caaagucaacuucca

SEQ ID NO: 839522 - RNA, 11 nt, Homo sapiens
caaaugaaaua

SEQ ID NO: 839523 - RNA, 15 nt, Homo sapiens
caaauggcuuacuua

SEQ ID NO: 839524 - RNA, 18 nt, Homo sapiens
caacagugagucugucag

SEQ ID NO: 839525 - RNA, 15 nt, Homo sapiens
caacgacugccguga

SEQ ID NO: 839526 - RNA, 22 nt, Homo sapiens
caacucauugcaucauuuacaa

SEQ ID NO: 839527 - RNA, 14 nt, Homo sapiens
caacucgugacagc

SEQ ID NO: 839528 - RNA, 22 nt, Homo sapiens
caacugaguggggaaaacagac

SEQ ID NO: 839529 - RNA, 14 nt, Homo sapiens
caagaacaaauaca

SEQ ID NO: 839530 - RNA, 15 nt, Homo sapiens
caagaacuugcaaua

SEQ ID NO: 839531 - RNA, 19 nt, Homo sapiens
caagaacuugcaauaccaa

SEQ ID NO: 839532 - RNA, 20 nt, Homo sapiens
caagacuuggcaacagaagc

SEQ ID NO: 839533 - RNA, 20 nt, Homo sapiens
caagaucgcgccacugcacu

SEQ ID NO: 839534 - RNA, 15 nt, Homo sapiens
caagcauuuuuccau

SEQ ID NO: 839535 - RNA, 13 nt, Homo sapiens
caaggaggugaca

SEQ ID NO: 839536 - RNA, 20 nt, Homo sapiens
caagggcccucacucaggaa

SEQ ID NO: 839537 - RNA, 16 nt, Homo sapiens
caaguaugaaguauaa

SEQ ID NO: 839538 - RNA, 14 nt, Homo sapiens
caaguuugcuaaaa

SEQ ID NO: 839539 - RNA, 19 nt, Homo sapiens
uuaccaacuuucuguaaac

SEQ ID NO: 839540 - RNA, 22 nt, Homo sapiens
uuauaguuucagauauauauca

SEQ ID NO: 839541 - RNA, 18 nt, Homo sapiens
uuauauagguugugcaaa

SEQ ID NO: 839542 - RNA, 11 nt, Homo sapiens
uuaugagauuu

SEQ ID NO: 839543 - RNA, 13 nt, Homo sapiens
uucaacgauguga

SEQ ID NO: 839544 - RNA, 19 nt, Homo sapiens
uucaacgaugugacugcca

SEQ ID NO: 839545 - RNA, 14 nt, Homo sapiens
uucacuguugaaaa

SEQ ID NO: 839546 - RNA, 16 nt, Homo sapiens
uucagaguggacuaca

SEQ ID NO: 839547 - RNA, 21 nt, Homo sapiens
uucagugucgggaauuuuccc

SEQ ID NO: 839548 - RNA, 18 nt, Homo sapiens
uucauauugcuaccaaaa

SEQ ID NO: 839549 - RNA, 23 nt, Homo sapiens
uucauggauucaggugcuggaga

SEQ ID NO: 839550 - RNA, 18 nt, Homo sapiens
uuccacacacgcuaugga

SEQ ID NO: 839551 - RNA, 20 nt, Homo sapiens
uucccaaauaaacucuaaac

SEQ ID NO: 839552 - RNA, 15 nt, Homo sapiens
uuccucaacaagcaa

SEQ ID NO: 839553 - RNA, 16 nt, Homo sapiens
uuccucuugcauuuca

SEQ ID NO: 839554 - RNA, 12 nt, Homo sapiens
uucuaugagcau

SEQ ID NO: 839555 - RNA, 23 nt, Homo sapiens
uugaaccagaaccagucuuucaa

SEQ ID NO: 839556 - RNA, 15 nt, Homo sapiens
uugaauuaccauaga

SEQ ID NO: 839557 - RNA, 21 nt, Homo sapiens
uugagcuagaaaucacaagaa

SEQ ID NO: 839558 - RNA, 21 nt, Homo sapiens
uugcaauaccaauguucuaaa

SEQ ID NO: 839559 - RNA, 12 nt, Homo sapiens
uugcuaccaaaa

SEQ ID NO: 839560 - RNA, 19 nt, Homo sapiens
uugcugccuucacccugaa

SEQ ID NO: 839561 - RNA, 14 nt, Homo sapiens
uugcuguuuacucc

SEQ ID NO: 839562 - RNA, 21 nt, Homo sapiens
uuggcuucuuaaaaacugugu

SEQ ID NO: 839563 - RNA, 14 nt, Homo sapiens
cagcccccacugac

SEQ ID NO: 839564 - RNA, 15 nt, Homo sapiens
cagcccccacugacc

SEQ ID NO: 839565 - RNA, 19 nt, Homo sapiens
caggaauugcccauuguuu

SEQ ID NO: 839566 - RNA, 21 nt, Homo sapiens
caggagcagcuggcacugaca

SEQ ID NO: 839567 - RNA, 22 nt, Homo sapiens
caggaggcagagguugcaauga

SEQ ID NO: 839568 - RNA, 15 nt, Homo sapiens
caggcucccugacca

SEQ ID NO: 839569 - RNA, 22 nt, Homo sapiens
caggcucccugaccacccugcc

SEQ ID NO: 839570 - RNA, 13 nt, Homo sapiens
cagguguggaccg

SEQ ID NO: 839571 - RNA, 16 nt, Homo sapiens
cagguguggaccggcc

SEQ ID NO: 839572 - RNA, 15 nt, Homo sapiens
cagucccagccucug

SEQ ID NO: 839573 - RNA, 14 nt, Homo sapiens
caguggcacuaaaa

SEQ ID NO: 839574 - RNA, 21 nt, Homo sapiens
caguuuuggagaaaaauuaca

SEQ ID NO: 839575 - RNA, 19 nt, Homo sapiens
cauaaaauugcaguuucau

SEQ ID NO: 839576 - RNA, 16 nt, Homo sapiens
cauaaaucaauucauu

SEQ ID NO: 839577 - RNA, 18 nt, Homo sapiens
cauaaguaagacuugauu

SEQ ID NO: 839578 - RNA, 14 nt, Homo sapiens
cauagaauugcaau

SEQ ID NO: 839579 - RNA, 22 nt, Homo sapiens
cauagggcaugauuaacaaagc

SEQ ID NO: 839580 - RNA, 16 nt, Homo sapiens
cauaugcuucuuuaaa

SEQ ID NO: 839581 - RNA, 19 nt, Homo sapiens
caucagucuuaauauucag

SEQ ID NO: 839582 - RNA, 18 nt, Homo sapiens
cauccugagugugaugaa

SEQ ID NO: 839583 - RNA, 21 nt, Homo sapiens
cauccuggcuaacacggugaa

SEQ ID NO: 839584 - RNA, 14 nt, Homo sapiens
caugcaacuugauu

SEQ ID NO: 839585 - RNA, 19 nt, Homo sapiens
cauggaggccaagaacuug

SEQ ID NO: 839586 - RNA, 22 nt, Homo sapiens
cauguaaucaacauggcuacuu

SEQ ID NO: 839587 - RNA, 16 nt, Homo sapiens
caugucccuccaaggc

SEQ ID NO: 839588 - RNA, 17 nt, Homo sapiens
cauguuugguaccaaga

SEQ ID NO: 839589 - RNA, 22 nt, Homo sapiens
cauugauucuccuguccuugua

SEQ ID NO: 839590 - RNA, 17 nt, Homo sapiens
cauugcaucauuuacaa

SEQ ID NO: 839591 - RNA, 22 nt, Homo sapiens
cauuguggccgccaugagcaac

SEQ ID NO: 839592 - RNA, 13 nt, Homo sapiens
cauuucaggugca

SEQ ID NO: 839593 - RNA, 18 nt, Homo sapiens
ccaaauuuagaaagcuua

SEQ ID NO: 839594 - RNA, 22 nt, Homo sapiens
ccaauguucuaaaguuuugcaa

SEQ ID NO: 839595 - RNA, 19 nt, Homo sapiens
ccagccuuauguguuacau

SEQ ID NO: 839596 - RNA, 13 nt, Homo sapiens
ccaguauaaucuc

SEQ ID NO: 839597 - RNA, 14 nt, Homo sapiens
ccauaccagucacc

SEQ ID NO: 839598 - RNA, 16 nt, Homo sapiens
ccauauucuaaauuca

SEQ ID NO: 839599 - RNA, 15 nt, Homo sapiens
ccauauugcucuuaa

SEQ ID NO: 839600 - RNA, 20 nt, Homo sapiens
ccaucucuacuaaaaauaca

SEQ ID NO: 839601 - RNA, 15 nt, Homo sapiens
ccaugugugcuaaua

SEQ ID NO: 839602 - RNA, 13 nt, Homo sapiens
ccauugugaagca

SEQ ID NO: 839603 - RNA, 22 nt, Homo sapiens
ccauuguggccgccaugagcaa

SEQ ID NO: 839604 - RNA, 16 nt, Homo sapiens
ccauuuuagaaaauca

SEQ ID NO: 839605 - RNA, 18 nt, Homo sapiens
cccaauccucccuggaga

SEQ ID NO: 839606 - RNA, 23 nt, Homo sapiens
cccagacuuuuuuaaauguuugc

SEQ ID NO: 839607 - RNA, 19 nt, Homo sapiens
cccaguacuuccuggacaa

SEQ ID NO: 839608 - RNA, 18 nt, Homo sapiens
ccccguggagcuggccaa

SEQ ID NO: 839609 - RNA, 13 nt, Homo sapiens
cccuaaucuuuuc

SEQ ID NO: 839610 - RNA, 21 nt, Homo sapiens
cccuauaucuauaaacacugu

SEQ ID NO: 839611 - RNA, 15 nt, Homo sapiens
cccuauuuuugcaau

SEQ ID NO: 839612 - RNA, 18 nt, Homo sapiens
ccgacaccacugggaacc

SEQ ID NO: 839613 - RNA, 18 nt, Homo sapiens
ccgcagcccccacugacc

SEQ ID NO: 839614 - RNA, 13 nt, Homo sapiens
ccgugaacacaaa

SEQ ID NO: 839615 - RNA, 18 nt, Homo sapiens
ccuauaucuauaaacacu

SEQ ID NO: 839616 - RNA, 19 nt, Homo sapiens
ccucaacaagcaagaucug

SEQ ID NO: 839617 - RNA, 15 nt, Homo sapiens
ccucugacucaccac

SEQ ID NO: 839618 - RNA, 12 nt, Homo sapiens
ccugacuuugac

SEQ ID NO: 839619 - RNA, 14 nt, Homo sapiens
ccugcccaugucca

SEQ ID NO: 839620 - RNA, 18 nt, Homo sapiens
ccugccccuccccaaaag

SEQ ID NO: 839621 - RNA, 20 nt, Homo sapiens
ccuggccaacaugaugaaac

SEQ ID NO: 839622 - RNA, 15 nt, Homo sapiens
ccuuuuaaguuugaa

SEQ ID NO: 839623 - RNA, 19 nt, Homo sapiens
ccuuuuuauucagcuagaa

SEQ ID NO: 839624 - RNA, 16 nt, Homo sapiens
cgacaccacugggaac

SEQ ID NO: 839625 - RNA, 12 nt, Homo sapiens
cgagaaccaguu

SEQ ID NO: 839626 - RNA, 13 nt, Homo sapiens
cgaguaccagcug

SEQ ID NO: 839627 - RNA, 17 nt, Homo sapiens
cgcagcccccacugacc

SEQ ID NO: 839628 - RNA, 11 nt, Homo sapiens
cgcgcacacac

SEQ ID NO: 839629 - RNA, 16 nt, Homo sapiens
cguauaaugcuuucug

SEQ ID NO: 839630 - RNA, 13 nt, Homo sapiens
cgugccugcuacg

SEQ ID NO: 839631 - RNA, 13 nt, Homo sapiens
cuaaagcuuuauc

SEQ ID NO: 839632 - RNA, 18 nt, Homo sapiens
cuaaagggagaaaugcca

SEQ ID NO: 839633 - RNA, 12 nt, Homo sapiens
cuacaagaauaa

SEQ ID NO: 839634 - RNA, 12 nt, Homo sapiens
cuagacuuucug

SEQ ID NO: 839635 - RNA, 16 nt, Homo sapiens
cuagcuaagcaagcca

SEQ ID NO: 839636 - RNA, 17 nt, Homo sapiens
cuauaacuacauauuga

SEQ ID NO: 839637 - RNA, 13 nt, Homo sapiens
cucaaaucuccag

SEQ ID NO: 839638 - RNA, 23 nt, Homo sapiens
cucaccacgaugacgccucugga

SEQ ID NO: 839639 - RNA, 15 nt, Homo sapiens
cucaggaacccugga

SEQ ID NO: 839640 - RNA, 15 nt, Homo sapiens
cucauagauugcaaa

SEQ ID NO: 839641 - RNA, 16 nt, Homo sapiens
cuccugcucauugugg

SEQ ID NO: 839642 - RNA, 22 nt, Homo sapiens
cuccuuuugguuccucacauau

SEQ ID NO: 839643 - RNA, 22 nt, Homo sapiens
cucgugacagccucugacucac

SEQ ID NO: 839644 - RNA, 17 nt, Homo sapiens
cucuacuaaaaauacaa

SEQ ID NO: 839645 - RNA, 14 nt, Homo sapiens
cucuuaaaucauuu

SEQ ID NO: 839646 - RNA, 14 nt, Homo sapiens
cucuugaaccagaa

SEQ ID NO: 839647 - RNA, 18 nt, Homo sapiens
cugaaaccuuaaauauca

SEQ ID NO: 839648 - RNA, 19 nt, Homo sapiens
cugagguuuugaauaaaaa

SEQ ID NO: 839649 - RNA, 14 nt, Homo sapiens
cugaguggggaaaa

SEQ ID NO: 839650 - RNA, 14 nt, Homo sapiens
cugauugacugugc

SEQ ID NO: 839651 - RNA, 19 nt, Homo sapiens
cugcaagaauuaaaacuga

SEQ ID NO: 839652 - RNA, 18 nt, Homo sapiens
cugccuucacccugaaca

SEQ ID NO: 839653 - RNA, 16 nt, Homo sapiens
cuggcuaacacgguga

SEQ ID NO: 839654 - RNA, 16 nt, Homo sapiens
cuggggaaauggugaa

SEQ ID NO: 839655 - RNA, 22 nt, Homo sapiens
cugguaaaagcaccauugugaa

SEQ ID NO: 839656 - RNA, 23 nt, Homo sapiens
cuguauaguuaggauagcauuuu

SEQ ID NO: 839657 - RNA, 17 nt, Homo sapiens
cugugaauuucaaaaaa

SEQ ID NO: 839658 - RNA, 20 nt, Homo sapiens
cuguggaugaugguugcaaa

SEQ ID NO: 839659 - RNA, 19 nt, Homo sapiens
cugugugaugaacuuucuc

SEQ ID NO: 839660 - RNA, 22 nt, Homo sapiens
cuguugaaaauuauuuuaaaca

SEQ ID NO: 839661 - RNA, 18 nt, Homo sapiens
cuuaaaaaaaacucuuua

SEQ ID NO: 839662 - RNA, 15 nt, Homo sapiens
cuuaagcacaauuaa

SEQ ID NO: 839663 - RNA, 13 nt, Homo sapiens
cuuagaaugccau

SEQ ID NO: 839664 - RNA, 17 nt, Homo sapiens
cuuauguguuacauuau

SEQ ID NO: 839665 - RNA, 18 nt, Homo sapiens
cuuauuauuuuauccuga

SEQ ID NO: 839666 - RNA, 21 nt, Homo sapiens
cuucaagagcaucuggaacaa

SEQ ID NO: 839667 - RNA, 14 nt, Homo sapiens
cuuccgacaccacu

SEQ ID NO: 839668 - RNA, 16 nt, Homo sapiens
cuuccgacaccacugg

SEQ ID NO: 839669 - RNA, 18 nt, Homo sapiens
cuuccgacaccacuggga

SEQ ID NO: 839670 - RNA, 14 nt, Homo sapiens
cuucugaucuugga

SEQ ID NO: 839671 - RNA, 16 nt, Homo sapiens
cuuguauaguguaaaa

SEQ ID NO: 839672 - RNA, 15 nt, Homo sapiens
gaaacaaaugaaaua

SEQ ID NO: 839673 - RNA, 18 nt, Homo sapiens
gaaacacuaaauuaguuu

SEQ ID NO: 839674 - RNA, 21 nt, Homo sapiens
gaaagagaaugaacuguggaa

SEQ ID NO: 839675 - RNA, 18 nt, Homo sapiens
gaaaguauagauggccaa

SEQ ID NO: 839676 - RNA, 20 nt, Homo sapiens
gaaaucaguaaacacugugu

SEQ ID NO: 839677 - RNA, 22 nt, Homo sapiens
gaaauguugacuggccaaaaau

SEQ ID NO: 839678 - RNA, 12 nt, Homo sapiens
gaacaaauacac

SEQ ID NO: 839679 - RNA, 22 nt, Homo sapiens
gaagugggcaggggcacccaag

SEQ ID NO: 839680 - RNA, 15 nt, Homo sapiens
guuuaaaugccaaaa

SEQ ID NO: 839681 - RNA, 18 nt, Homo sapiens
guuuacagaaugcuacaa

SEQ ID NO: 839682 - RNA, 12 nt, Homo sapiens
uaaaaaaacuga

SEQ ID NO: 839683 - RNA, 20 nt, Homo sapiens
uaaaaaggaaauuagucuuu

SEQ ID NO: 839684 - RNA, 13 nt, Homo sapiens
uaaaacagcagca

SEQ ID NO: 839685 - RNA, 17 nt, Homo sapiens
uaaaacuacacaucccu

SEQ ID NO: 839686 - RNA, 22 nt, Homo sapiens
uaaaagcaccauugugaagcag

SEQ ID NO: 839687 - RNA, 16 nt, Homo sapiens
uaaaagucacauaaaa

SEQ ID NO: 839688 - RNA, 15 nt, Homo sapiens
uaaaagugcauuuaa

SEQ ID NO: 839689 - RNA, 18 nt, Homo sapiens
uaaaauuaauuugugcau

SEQ ID NO: 839690 - RNA, 24 nt, Homo sapiens
uaaaauuaauuugugcaucagaaa

SEQ ID NO: 839691 - RNA, 13 nt, Homo sapiens
uaaacacugugua

SEQ ID NO: 839692 - RNA, 16 nt, Homo sapiens
uaaacagcaaagccau

SEQ ID NO: 839693 - RNA, 17 nt, Homo sapiens
uaaacccuuaacuggca

SEQ ID NO: 839694 - RNA, 17 nt, Homo sapiens
uaaagggagaaaugcca

SEQ ID NO: 839695 - RNA, 15 nt, Homo sapiens
uaaauguuugcaaug

SEQ ID NO: 839696 - RNA, 12 nt, Homo sapiens
uaaauucacugu

SEQ ID NO: 839697 - RNA, 19 nt, Homo sapiens
uaacaauaugauugcacua

SEQ ID NO: 839698 - RNA, 16 nt, Homo sapiens
uaagcaagccaggaga

SEQ ID NO: 839699 - RNA, 14 nt, Homo sapiens
uaagucuacauuaa

SEQ ID NO: 839700 - RNA, 19 nt, Homo sapiens
uaagugaauuuaugagauu

SEQ ID NO: 839701 - RNA, 16 nt, Homo sapiens
uaaguuuuauacauaa

SEQ ID NO: 839702 - RNA, 16 nt, Homo sapiens
uaauaauagauuguga

SEQ ID NO: 839703 - RNA, 13 nt, Homo sapiens
uaauaggaugaau

SEQ ID NO: 839704 - RNA, 14 nt, Homo sapiens
uaaucaugcucaug

SEQ ID NO: 839705 - RNA, 14 nt, Homo sapiens
uaaucccagcacuu

SEQ ID NO: 839706 - RNA, 17 nt, Homo sapiens
uaaucuauaacuacaua

SEQ ID NO: 839707 - RNA, 20 nt, Homo sapiens
uaaugaaccguuuacagugu

SEQ ID NO: 839708 - RNA, 15 nt, Homo sapiens
uaauuaaagccuuaa

SEQ ID NO: 839709 - RNA, 22 nt, Homo sapiens
uacaaaagcagcuuuuaguuca

SEQ ID NO: 839710 - RNA, 13 nt, Homo sapiens
uacaaguguauau

SEQ ID NO: 839711 - RNA, 23 nt, Homo sapiens
uacacuuuauuaauauaaccaua

SEQ ID NO: 839712 - RNA, 14 nt, Homo sapiens
uacaugcaauuuau

SEQ ID NO: 839713 - RNA, 14 nt, Homo sapiens
uacauguaccugac

SEQ ID NO: 839714 - RNA, 16 nt, Homo sapiens
uacccuauaucuauaa

SEQ ID NO: 839715 - RNA, 19 nt, Homo sapiens
uacggaggacgcuggggaa

SEQ ID NO: 839716 - RNA, 23 nt, Homo sapiens
uacuaagccacaagaaauuugau

SEQ ID NO: 839717 - RNA, 19 nt, Homo sapiens
uacuccugaggaugcuacu

SEQ ID NO: 839718 - RNA, 15 nt, Homo sapiens
uacuuagaaugccau

SEQ ID NO: 839719 - RNA, 19 nt, Homo sapiens
uagaaaucacaagaacaaa

SEQ ID NO: 839720 - RNA, 21 nt, Homo sapiens
uagaagcuguaguagcccuuu

SEQ ID NO: 839721 - RNA, 15 nt, Homo sapiens
uagaauuaagucaga

SEQ ID NO: 839722 - RNA, 17 nt, Homo sapiens
uagaauugcaaucuaua

SEQ ID NO: 839723 - RNA, 20 nt, Homo sapiens
uagcuaagcaagccaggaga

SEQ ID NO: 839724 - RNA, 20 nt, Homo sapiens
uagcuuguauaguguaaaau

SEQ ID NO: 839725 - RNA, 20 nt, Homo sapiens
uaggcaaaggcccuugggca

SEQ ID NO: 839726 - RNA, 16 nt, Homo sapiens
uagugcagaaucucau

SEQ ID NO: 839727 - RNA, 16 nt, Homo sapiens
uaguuaaaagccuuuc

SEQ ID NO: 839728 - RNA, 22 nt, Homo sapiens
uauagauuaaaucauacuccua

SEQ ID NO: 839729 - RNA, 16 nt, Homo sapiens
uauaguuaaucuauaa

SEQ ID NO: 839730 - RNA, 18 nt, Homo sapiens
uauaucucaaauuguaau

SEQ ID NO: 839731 - RNA, 14 nt, Homo sapiens
uaucuagcauuuau

SEQ ID NO: 839732 - RNA, 22 nt, Homo sapiens
uaucucaaauuguaauuaauaa

SEQ ID NO: 839733 - RNA, 21 nt, Homo sapiens
uaucuuuaugcaaaaacauau

SEQ ID NO: 839734 - RNA, 16 nt, Homo sapiens
uaugaaagccacacuu

SEQ ID NO: 839735 - RNA, 15 nt, Homo sapiens
uauguguuacauuau

SEQ ID NO: 839736 - RNA, 21 nt, Homo sapiens
uauguuuguacaagauuguca

SEQ ID NO: 839737 - RNA, 18 nt, Homo sapiens
uauuaauauaaccauaaa

SEQ ID NO: 839738 - RNA, 19 nt, Homo sapiens
uauuccucuugcauuucac

SEQ ID NO: 839739 - RNA, 15 nt, Homo sapiens
uauuuagugaacuac

SEQ ID NO: 839740 - RNA, 13 nt, Homo sapiens
uauuuucauuucu

SEQ ID NO: 839741 - RNA, 12 nt, Homo sapiens
ucaaaucuccag

SEQ ID NO: 839742 - RNA, 16 nt, Homo sapiens
ucaacgaugugacugc

SEQ ID NO: 839743 - RNA, 13 nt, Homo sapiens
ucaagaaaagcau

SEQ ID NO: 839744 - RNA, 23 nt, Homo sapiens
ucacaagaacaaauacacuuuau

SEQ ID NO: 839745 - RNA, 15 nt, Homo sapiens
ucacauccuugacuu

SEQ ID NO: 839746 - RNA, 18 nt, Homo sapiens
ucacuaaacucugaauaa

SEQ ID NO: 839747 - RNA, 17 nt, Homo sapiens
ucacucaggaacccugg

SEQ ID NO: 839748 - RNA, 12 nt, Homo sapiens
ucagaaaccaaa

SEQ ID NO: 839749 - RNA, 11 nt, Homo sapiens
ucagcacugcc

SEQ ID NO: 839750 - RNA, 12 nt, Homo sapiens
ucaggaccugcu

SEQ ID NO: 839751 - RNA, 14 nt, Homo sapiens
ucaguaaacacugu

SEQ ID NO: 839752 - RNA, 18 nt, Homo sapiens
ucaguauucccagccuug

SEQ ID NO: 839753 - RNA, 20 nt, Homo sapiens
ucauaaccacccuagcuuua

SEQ ID NO: 839754 - RNA, 14 nt, Homo sapiens
ucauaccagucagu

SEQ ID NO: 839755 - RNA, 15 nt, Homo sapiens
ucaucaucagucuua

SEQ ID NO: 839756 - RNA, 15 nt, Homo sapiens
ucaugcucauguaua

SEQ ID NO: 839757 - RNA, 18 nt, Homo sapiens
ucaugucuguaaucccag

SEQ ID NO: 839758 - RNA, 21 nt, Homo sapiens
ucauucagcgcaugcaccuuc

SEQ ID NO: 839759 - RNA, 18 nt, Homo sapiens
uccagugacuuucaggaa

SEQ ID NO: 839760 - RNA, 23 nt, Homo sapiens
ucccagaaauuagaaaccuuaau

SEQ ID NO: 839761 - RNA, 20 nt, Homo sapiens
ucccagagcacaagaaggcc

SEQ ID NO: 839762 - RNA, 17 nt, Homo sapiens
ucccagguaauuuaaau

SEQ ID NO: 839763 - RNA, 18 nt, Homo sapiens
ucccaucugucaccaauu

SEQ ID NO: 839764 - RNA, 24 nt, Homo sapiens
uccccgugucuguucaguuagcau

SEQ ID NO: 839765 - RNA, 22 nt, Homo sapiens
uccccucacuuaaccaccccau

SEQ ID NO: 839766 - RNA, 15 nt, Homo sapiens
uccuaggaguacaag

SEQ ID NO: 839767 - RNA, 20 nt, Homo sapiens
uccuauaucuguuuguauau

SEQ ID NO: 839768 - RNA, 12 nt, Homo sapiens
uccuaugcuuua

SEQ ID NO: 839769 - RNA, 20 nt, Homo sapiens
uccucacauauuauugguca

SEQ ID NO: 839770 - RNA, 14 nt, Homo sapiens
uccugcauguuaau

SEQ ID NO: 839771 - RNA, 14 nt, Homo sapiens
uccugugaauuucu

SEQ ID NO: 839772 - RNA, 22 nt, Homo sapiens
uccuuggagugcugcagcuuug

SEQ ID NO: 839773 - RNA, 13 nt, Homo sapiens
uccuuuugguucc

SEQ ID NO: 839774 - RNA, 12 nt, Homo sapiens
ucggcugugagg

SEQ ID NO: 839775 - RNA, 20 nt, Homo sapiens
ucugaacaaagagagcucau

SEQ ID NO: 839776 - RNA, 15 nt, Homo sapiens
ucugaaccucuucaa

SEQ ID NO: 839777 - RNA, 15 nt, Homo sapiens
ucugaauaagcacuu

SEQ ID NO: 839778 - RNA, 15 nt, Homo sapiens
ucugcaucagcuuuu

SEQ ID NO: 839779 - RNA, 12 nt, Homo sapiens
ucuggcuucccu

SEQ ID NO: 839780 - RNA, 14 nt, Homo sapiens
ucuguaaacucaaa

SEQ ID NO: 839781 - RNA, 15 nt, Homo sapiens
ucuguaaaugaacac

SEQ ID NO: 839782 - RNA, 17 nt, Homo sapiens
ucuguaaaugaacacau

SEQ ID NO: 839783 - RNA, 13 nt, Homo sapiens
ucuuaaaaacugu

SEQ ID NO: 839784 - RNA, 22 nt, Homo sapiens
ucuuacauaauuuuuuauucaa

SEQ ID NO: 839785 - RNA, 15 nt, Homo sapiens
ucuuggcuucuuaaa

SEQ ID NO: 839786 - RNA, 18 nt, Homo sapiens
ucuuuggggaaacuaaca

SEQ ID NO: 839787 - RNA, 15 nt, Homo sapiens
ucuuuuaggaucaga

SEQ ID NO: 839788 - RNA, 13 nt, Homo sapiens
ucuuuugugagaa

SEQ ID NO: 839789 - RNA, 15 nt, Homo sapiens
ugaaaaauauugcua

SEQ ID NO: 839790 - RNA, 14 nt, Homo sapiens
ugaaaaucuaauau

SEQ ID NO: 839791 - RNA, 16 nt, Homo sapiens
ugaaaguugcuuuuau

SEQ ID NO: 839792 - RNA, 16 nt, Homo sapiens
ugaaaucagcaugaca

SEQ ID NO: 839793 - RNA, 20 nt, Homo sapiens
ugaacauuuaguacccugca

SEQ ID NO: 839794 - RNA, 23 nt, Homo sapiens
ugaacuguuuggucgagucuuug

SEQ ID NO: 839795 - RNA, 19 nt, Homo sapiens
ugaauagggcuaggaauau

SEQ ID NO: 839796 - RNA, 14 nt, Homo sapiens
ugacagccucugac

SEQ ID NO: 839797 - RNA, 20 nt, Homo sapiens
caggaggcagagguugcaau

SEQ ID NO: 839798 - RNA, 19 nt, Homo sapiens
caggauuuccucuugaacc

SEQ ID NO: 839799 - RNA, 16 nt, Homo sapiens
cagguggacaaaguca

SEQ ID NO: 839800 - RNA, 12 nt, Homo sapiens
caguaaacacug

SEQ ID NO: 839801 - RNA, 18 nt, Homo sapiens
caguuagcauggauuuau

SEQ ID NO: 839802 - RNA, 22 nt, Homo sapiens
cauacuccuaugcuuuagcuua

SEQ ID NO: 839803 - RNA, 17 nt, Homo sapiens
cauauucuaaauucacu

SEQ ID NO: 839804 - RNA, 15 nt, Homo sapiens
caucaaaaacaaccu

SEQ ID NO: 839805 - RNA, 13 nt, Homo sapiens
caucaaguuccac

SEQ ID NO: 839806 - RNA, 19 nt, Homo sapiens
caucaucagucuuaauauu

SEQ ID NO: 839807 - RNA, 17 nt, Homo sapiens
cauccugagugugauga

SEQ ID NO: 839808 - RNA, 19 nt, Homo sapiens
caucucuacuaaaaauaca

SEQ ID NO: 839809 - RNA, 22 nt, Homo sapiens
caugaguggaaagucaccuaca

SEQ ID NO: 839810 - RNA, 23 nt, Homo sapiens
caugcaaacugcuuuauuuuccc

SEQ ID NO: 839811 - RNA, 16 nt, Homo sapiens
cauggaggccaagaac

SEQ ID NO: 839812 - RNA, 21 nt, Homo sapiens
cauggauuuauugagugccaa
